United States Patent 7,314,750 (ADDRESSABLE OLIGONUCLEOTIDE ARRAY OF THE RAT GENOME) - sequence listing, part 14

SEQ ID NO: 491107 - DNA, 25 bp, Rattus norvegicus
gtcagtctccagaggtaggcacctt

SEQ ID NO: 491108 - DNA, 25 bp, Rattus norvegicus
gtcagtctccagtggtaggcacctt

SEQ ID NO: 491109 - DNA, 25 bp, Rattus norvegicus
gtcagtctctgacatgcagaccagt

SEQ ID NO: 491110 - DNA, 25 bp, Rattus norvegicus
gtcagtctctgagatgcagaccagt

SEQ ID NO: 491111 - DNA, 25 bp, Rattus norvegicus
gtcagtctgatacatacttctttgt

SEQ ID NO: 491112 - DNA, 25 bp, Rattus norvegicus
gtcagtctgatagatacttctttgt

SEQ ID NO: 491113 - DNA, 25 bp, Rattus norvegicus
gtcagtctgctcataaacttgatac

SEQ ID NO: 491114 - DNA, 25 bp, Rattus norvegicus
gtcagtctgctcttaaacttgatac

SEQ ID NO: 491115 - DNA, 25 bp, Rattus norvegicus
gtcagtctggaaactgcaccggaca

SEQ ID NO: 491116 - DNA, 25 bp, Rattus norvegicus
gtcagtctggaatctgcaccggaca

SEQ ID NO: 491117 - DNA, 25 bp, Rattus norvegicus
gtcagtctggatatttctgccctgg

SEQ ID NO: 491118 - DNA, 25 bp, Rattus norvegicus
gtcagtctggatttttctgccctgg

SEQ ID NO: 491119 - DNA, 25 bp, Rattus norvegicus
gtcagtctgtctactttatgggcaa

SEQ ID NO: 491120 - DNA, 25 bp, Rattus norvegicus
gtcagtctgtcttctttatgggcaa

SEQ ID NO: 491121 - DNA, 25 bp, Rattus norvegicus
gtcagtctgttgagtactccatcag

SEQ ID NO: 491122 - DNA, 25 bp, Rattus norvegicus
gtcagtctgttgtgtactccatcag

SEQ ID NO: 491123 - DNA, 25 bp, Rattus norvegicus
gtcagtcttaggagttaccaagaac

SEQ ID NO: 491124 - DNA, 25 bp, Rattus norvegicus
gtcagtcttaggtgttaccaagaac

SEQ ID NO: 491125 - DNA, 25 bp, Rattus norvegicus
gtcagtcttcagcacctgtgtcaga

SEQ ID NO: 491126 - DNA, 25 bp, Rattus norvegicus
gtcagtcttcaggacctgtgtcaga

SEQ ID NO: 491127 - DNA, 25 bp, Rattus norvegicus
gtcagtcttctgatccattatttga

SEQ ID NO: 491128 - DNA, 25 bp, Rattus norvegicus
gtcagtcttctgttccattatttga

SEQ ID NO: 491129 - DNA, 25 bp, Rattus norvegicus
gtcagtcttgatctgcttgatgaga

SEQ ID NO: 491130 - DNA, 25 bp, Rattus norvegicus
gtcagtcttgatgtgcttgatgaga

SEQ ID NO: 491131 - DNA, 25 bp, Rattus norvegicus
gtcagtcttgcaaaatctttacgta

SEQ ID NO: 491132 - DNA, 25 bp, Rattus norvegicus
gtcagtcttgcataatctttacgta

SEQ ID NO: 491133 - DNA, 25 bp, Rattus norvegicus
gtcagtgaacgtccgcactcgagat

SEQ ID NO: 491134 - DNA, 25 bp, Rattus norvegicus
gtcagtgaacgtgcgcactcgagat

SEQ ID NO: 491135 - DNA, 25 bp, Rattus norvegicus
gtcagtgaaggcctcttgcttgtca

SEQ ID NO: 491136 - DNA, 25 bp, Rattus norvegicus
gtcagtgaaggcgtcttgcttgtca

SEQ ID NO: 491137 - DNA, 25 bp, Rattus norvegicus
gtcagtgacaagcagagctctgtca

SEQ ID NO: 491138 - DNA, 25 bp, Rattus norvegicus
gtcagtgacaaggagagctctgtca

SEQ ID NO: 491139 - DNA, 25 bp, Rattus norvegicus
gtcagtgaccatcccgagctgaata

SEQ ID NO: 491140 - DNA, 25 bp, Rattus norvegicus
gtcagtgaccatgccgagctgaata

SEQ ID NO: 491141 - DNA, 25 bp, Rattus norvegicus
gtcagtgaccgcacattcagacatg

SEQ ID NO: 491142 - DNA, 25 bp, Rattus norvegicus
gtcagtgaccgctcattcagacatg

SEQ ID NO: 491143 - DNA, 25 bp, Rattus norvegicus
gtcagtgacgctcgaacagtgctcc

SEQ ID NO: 491144 - DNA, 25 bp, Rattus norvegicus
gtcagtgacgctggaacagtgctcc

SEQ ID NO: 491145 - DNA, 25 bp, Rattus norvegicus
gtcagtgactaacctgcctaccgaa

SEQ ID NO: 491146 - DNA, 25 bp, Rattus norvegicus
gtcagtgactaagctgcctaccgaa

SEQ ID NO: 491147 - DNA, 25 bp, Rattus norvegicus
gtcagtgactttcttacctggtgga

SEQ ID NO: 491148 - DNA, 25 bp, Rattus norvegicus
gtcagtgactttgttacctggtgga

SEQ ID NO: 491149 - DNA, 25 bp, Rattus norvegicus
gtcagtgagctcatccacacagaag

SEQ ID NO: 491150 - DNA, 25 bp, Rattus norvegicus
gtcagtgagctcttccacacagaag

SEQ ID NO: 491151 - DNA, 25 bp, Rattus norvegicus
gtcagtgaggccaggcatgtgccat

SEQ ID NO: 491152 - DNA, 25 bp, Rattus norvegicus
gtcagtgaggcctggcatgtgccat

SEQ ID NO: 491153 - DNA, 25 bp, Rattus norvegicus
gtcagtgatcacaaactatcctggt

SEQ ID NO: 491154 - DNA, 25 bp, Rattus norvegicus
gtcagtgatcactaactatcctggt

SEQ ID NO: 491155 - DNA, 25 bp, Rattus norvegicus
gtcagtgatcagctgaccccttgtt

SEQ ID NO: 491156 - DNA, 25 bp, Rattus norvegicus
gtcagtgatcaggtgaccccttgtt

SEQ ID NO: 491157 - DNA, 25 bp, Rattus norvegicus
gtcagtgatctcacaccatgtggat

SEQ ID NO: 491158 - DNA, 25 bp, Rattus norvegicus
gtcagtgatctctcaccatgtggat

SEQ ID NO: 491159 - DNA, 25 bp, Rattus norvegicus
gtcagtgatgcccttcagatgattc

SEQ ID NO: 491160 - DNA, 25 bp, Rattus norvegicus
gtcagtgatgccgttcagatgattc

SEQ ID NO: 491161 - DNA, 25 bp, Rattus norvegicus
gtcagtgatggcaggagccctttac

SEQ ID NO: 491162 - DNA, 25 bp, Rattus norvegicus
gtcagtgatggctggagccctttac

SEQ ID NO: 491163 - DNA, 25 bp, Rattus norvegicus
gtcagtgattgtctgggtcctttcc

SEQ ID NO: 491164 - DNA, 25 bp, Rattus norvegicus
gtcagtgattgtgtgggtcctttcc

SEQ ID NO: 491165 - DNA, 25 bp, Rattus norvegicus
gtcagtgatttcaaacgcttccttc

SEQ ID NO: 491166 - DNA, 25 bp, Rattus norvegicus
gtcagtgatttctaacgcttccttc

SEQ ID NO: 491167 - DNA, 25 bp, Rattus norvegicus
gtcagtgcacacatagatggtcggc

SEQ ID NO: 491168 - DNA, 25 bp, Rattus norvegicus
gtcagtgcacacatgttaaatgttt

SEQ ID NO: 491169 - DNA, 25 bp, Rattus norvegicus
gtcagtgcacacttagatggtcggc

SEQ ID NO: 491170 - DNA, 25 bp, Rattus norvegicus
gtcagtgcacacttgttaaatgttt

SEQ ID NO: 491171 - DNA, 25 bp, Rattus norvegicus
gtcagtgcactaaccattatgtaca

SEQ ID NO: 491172 - DNA, 25 bp, Rattus norvegicus
gtcagtgcactatccattatgtaca

SEQ ID NO: 491173 - DNA, 25 bp, Rattus norvegicus
gtcagtgcactgaaaggagaatcgt

SEQ ID NO: 491174 - DNA, 25 bp, Rattus norvegicus
gtcagtgcactgtaaggagaatcgt

SEQ ID NO: 491175 - DNA, 25 bp, Rattus norvegicus
gtcagtgcacttcttgagttctggc

SEQ ID NO: 491176 - DNA, 25 bp, Rattus norvegicus
gtcagtgcacttgttgagttctggc

SEQ ID NO: 491177 - DNA, 25 bp, Rattus norvegicus
gtcagtgcagaaccttgcgtgctga

SEQ ID NO: 491178 - DNA, 25 bp, Rattus norvegicus
gtcagtgcagaagcttgcgtgctga

SEQ ID NO: 491179 - DNA, 25 bp, Rattus norvegicus
gtcagtgcagacctcatattctttt

SEQ ID NO: 491180 - DNA, 25 bp, Rattus norvegicus
gtcagtgcagacgtcatattctttt

SEQ ID NO: 491181 - DNA, 25 bp, Rattus norvegicus
gtcagtgcagtactctcatacagaa

SEQ ID NO: 491182 - DNA, 25 bp, Rattus norvegicus
gtcagtgcagtagtctcatacagaa

SEQ ID NO: 491183 - DNA, 25 bp, Rattus norvegicus
gtcagtgccaagaatccacatgcca

SEQ ID NO: 491184 - DNA, 25 bp, Rattus norvegicus
gtcagtgccaagtatccacatgcca

SEQ ID NO: 491185 - DNA, 25 bp, Rattus norvegicus
gtcagtgccgcaacctggagagaat

SEQ ID NO: 491186 - DNA, 25 bp, Rattus norvegicus
gtcagtgccgcatcctggagagaat

SEQ ID NO: 491187 - DNA, 25 bp, Rattus norvegicus
gtcagtgcgcttcacacagctggac

SEQ ID NO: 491188 - DNA, 25 bp, Rattus norvegicus
gtcagtgcgcttgacacagctggac

SEQ ID NO: 491189 - DNA, 25 bp, Rattus norvegicus
gtcagtgctacaacagagctctgca

SEQ ID NO: 491190 - DNA, 25 bp, Rattus norvegicus
gtcagtgctacatcagagctctgca

SEQ ID NO: 491191 - DNA, 25 bp, Rattus norvegicus
gtcagtgctctcatcacaggaattt

SEQ ID NO: 491192 - DNA, 25 bp, Rattus norvegicus
gtcagtgctctcttcacaggaattt

SEQ ID NO: 491193 - DNA, 25 bp, Rattus norvegicus
gtcagtgctgcaccttttgataatt

SEQ ID NO: 491194 - DNA, 25 bp, Rattus norvegicus
gtcagtgctgcagcttttgataatt

SEQ ID NO: 491195 - DNA, 25 bp, Rattus norvegicus
gtcagtgctggccacacaattgtga

SEQ ID NO: 491196 - DNA, 25 bp, Rattus norvegicus
gtcagtgctggcgacacaattgtga

SEQ ID NO: 491197 - DNA, 25 bp, Rattus norvegicus
gtcagtgctgtccttgtacacaaag

SEQ ID NO: 491198 - DNA, 25 bp, Rattus norvegicus
gtcagtgctgtcgttgtacacaaag

SEQ ID NO: 491199 - DNA, 25 bp, Rattus norvegicus
gtcagtgcttaacagcagtggctgc

SEQ ID NO: 491200 - DNA, 25 bp, Rattus norvegicus
gtcagtgcttaagagcagtggctgc

SEQ ID NO: 491201 - DNA, 25 bp, Rattus norvegicus
gtcagtgcttccagttccaatacat

SEQ ID NO: 491202 - DNA, 25 bp, Rattus norvegicus
gtcagtgcttcctgttccaatacat

SEQ ID NO: 491203 - DNA, 25 bp, Rattus norvegicus
gtcagtggcaccaagagggctgctt

SEQ ID NO: 491204 - DNA, 25 bp, Rattus norvegicus
gtcagtggcacctagagggctgctt

SEQ ID NO: 491205 - DNA, 25 bp, Rattus norvegicus
gtcagtggccagcttaatgtgcaca

SEQ ID NO: 491206 - DNA, 25 bp, Rattus norvegicus
gtcagtggccaggttaatgtgcaca

SEQ ID NO: 491207 - DNA, 25 bp, Rattus norvegicus
gtcagtgggatgcacactcgagtaa

SEQ ID NO: 491208 - DNA, 25 bp, Rattus norvegicus
gtcagtgggatggacactcgagtaa

SEQ ID NO: 491209 - DNA, 25 bp, Rattus norvegicus
gtcagtgggattctcaaccatgctc

SEQ ID NO: 491210 - DNA, 25 bp, Rattus norvegicus
gtcagtgggattgtcaaccatgctc

SEQ ID NO: 491211 - DNA, 25 bp, Rattus norvegicus
gtcagtgggcttcaccttcctgaaa

SEQ ID NO: 491212 - DNA, 25 bp, Rattus norvegicus
gtcagtgggcttgaccttcctgaaa

SEQ ID NO: 491213 - DNA, 25 bp, Rattus norvegicus
gtcagtgggtgacgtattccgtcta

SEQ ID NO: 491214 - DNA, 25 bp, Rattus norvegicus
gtcagtgggtgaggtattccgtcta

SEQ ID NO: 491215 - DNA, 25 bp, Rattus norvegicus
gtcagtgggtttactttccgttgca

SEQ ID NO: 491216 - DNA, 25 bp, Rattus norvegicus
gtcagtgggttttctttccgttgca

SEQ ID NO: 491217 - DNA, 25 bp, Rattus norvegicus
gtcagtggttagagcaatggttgct

SEQ ID NO: 491218 - DNA, 25 bp, Rattus norvegicus
gtcagtggttagtgcaatggttgct

SEQ ID NO: 491219 - DNA, 25 bp, Rattus norvegicus
gtcagtgtaccaagtagctacccag

SEQ ID NO: 491220 - DNA, 25 bp, Rattus norvegicus
gtcagtgtaccatgtagctacccag

SEQ ID NO: 491221 - DNA, 25 bp, Rattus norvegicus
gtcagtgtatgtctgtggtttttgt

SEQ ID NO: 491222 - DNA, 25 bp, Rattus norvegicus
gtcagtgtatgtgtgtggtttttgt

SEQ ID NO: 491223 - DNA, 25 bp, Rattus norvegicus
gtcagtgtcaaactcaagagcactc

SEQ ID NO: 491224 - DNA, 25 bp, Rattus norvegicus
gtcagtgtcaaagtcaagagcactc

SEQ ID NO: 491225 - DNA, 25 bp, Rattus norvegicus
gtcagtgtcacaaaaccatttatgt

SEQ ID NO: 491226 - DNA, 25 bp, Rattus norvegicus
gtcagtgtcacataaccatttatgt

SEQ ID NO: 491227 - DNA, 25 bp, Rattus norvegicus
gtcagtgtcctcaaggctccaccaa

SEQ ID NO: 491228 - DNA, 25 bp, Rattus norvegicus
gtcagtgtcctctaggctccaccaa

SEQ ID NO: 491229 - DNA, 25 bp, Rattus norvegicus
gtcagtgtccttcatgttgtttcta

SEQ ID NO: 491230 - DNA, 25 bp, Rattus norvegicus
gtcagtgtccttgatgttgtttcta

SEQ ID NO: 491231 - DNA, 25 bp, Rattus norvegicus
gtcagtgtcggaatcatgtgcttca

SEQ ID NO: 491232 - DNA, 25 bp, Rattus norvegicus
gtcagtgtcggattcatgtgcttca

SEQ ID NO: 491233 - DNA, 25 bp, Rattus norvegicus
gtcagtgtctatcgcctaattttca

SEQ ID NO: 491234 - DNA, 25 bp, Rattus norvegicus
gtcagtgtctatggcctaattttca

SEQ ID NO: 491235 - DNA, 25 bp, Rattus norvegicus
gtcagtgtctgtaagggagctttct

SEQ ID NO: 491236 - DNA, 25 bp, Rattus norvegicus
gtcagtgtctgttagggagctttct

SEQ ID NO: 491237 - DNA, 25 bp, Rattus norvegicus
gtcagtgtcttacagcacttgacaa

SEQ ID NO: 491238 - DNA, 25 bp, Rattus norvegicus
gtcagtgtcttagagcacttgacaa

SEQ ID NO: 491239 - DNA, 25 bp, Rattus norvegicus
gtcagtgtgaacattccatcagagt

SEQ ID NO: 491240 - DNA, 25 bp, Rattus norvegicus
gtcagtgtgaactttccatcagagt

SEQ ID NO: 491241 - DNA, 25 bp, Rattus norvegicus
gtcagtgtgcagagactttttccta

SEQ ID NO: 491242 - DNA, 25 bp, Rattus norvegicus
gtcagtgtgcagtgactttttccta

SEQ ID NO: 491243 - DNA, 25 bp, Rattus norvegicus
gtcagtgtgcgcctctatgctaaac

SEQ ID NO: 491244 - DNA, 25 bp, Rattus norvegicus
gtcagtgtgcgcgtctatgctaaac

SEQ ID NO: 491245 - DNA, 25 bp, Rattus norvegicus
gtcagtgtgggcacatgtctacaca

SEQ ID NO: 491246 - DNA, 25 bp, Rattus norvegicus
gtcagtgtgggctcatgtctacaca

SEQ ID NO: 491247 - DNA, 25 bp, Rattus norvegicus
gtcagtgtgtgaccgttcttaaatc

SEQ ID NO: 491248 - DNA, 25 bp, Rattus norvegicus
gtcagtgtgtgagcgttcttaaatc

SEQ ID NO: 491249 - DNA, 25 bp, Rattus norvegicus
gtcagtgtgtgcatgcgtgagtaca

SEQ ID NO: 491250 - DNA, 25 bp, Rattus norvegicus
gtcagtgtgtgcttgcgtgagtaca

SEQ ID NO: 491251 - DNA, 25 bp, Rattus norvegicus
gtcagtgtgttcatccccgaggagg

SEQ ID NO: 491252 - DNA, 25 bp, Rattus norvegicus
gtcagtgtgttcttccccgaggagg

SEQ ID NO: 491253 - DNA, 25 bp, Rattus norvegicus
gtcagtgttaagcttctggctatac

SEQ ID NO: 491254 - DNA, 25 bp, Rattus norvegicus
gtcagtgttaaggttctggctatac

SEQ ID NO: 491255 - DNA, 25 bp, Rattus norvegicus
gtcagtgttcaccagcttgtaaaaa

SEQ ID NO: 491256 - DNA, 25 bp, Rattus norvegicus
gtcagtgttcacgagcttgtaaaaa

SEQ ID NO: 491257 - DNA, 25 bp, Rattus norvegicus
gtcagtgttcctcgttaaccttagt

SEQ ID NO: 491258 - DNA, 25 bp, Rattus norvegicus
gtcagtgttcctggttaaccttagt

SEQ ID NO: 491259 - DNA, 25 bp, Rattus norvegicus
gtcagtgtttacacaatgtttctta

SEQ ID NO: 491260 - DNA, 25 bp, Rattus norvegicus
gtcagtgtttactcaatgtttctta

SEQ ID NO: 491261 - DNA, 25 bp, Rattus norvegicus
gtcagtgtttatatcctgaaccaat

SEQ ID NO: 491262 - DNA, 25 bp, Rattus norvegicus
gtcagtgtttatttcctgaaccaat

SEQ ID NO: 491263 - DNA, 25 bp, Rattus norvegicus
gtcagttaactcatgtaggctccct

SEQ ID NO: 491264 - DNA, 25 bp, Rattus norvegicus
gtcagttaactcttgtaggctccct

SEQ ID NO: 491265 - DNA, 25 bp, Rattus norvegicus
gtcagttatacacttacccagggaa

SEQ ID NO: 491266 - DNA, 25 bp, Rattus norvegicus
gtcagttatacagttacccagggaa

SEQ ID NO: 491267 - DNA, 25 bp, Rattus norvegicus
gtcagttatctgctttctccaaatt

SEQ ID NO: 491268 - DNA, 25 bp, Rattus norvegicus
gtcagttatctggtttctccaaatt

SEQ ID NO: 491269 - DNA, 25 bp, Rattus norvegicus
gtcagttatgttactacccttcaat

SEQ ID NO: 491270 - DNA, 25 bp, Rattus norvegicus
gtcagttatgtttctacccttcaat

SEQ ID NO: 491271 - DNA, 25 bp, Rattus norvegicus
gtcagttcagaaagcctcggttaca

SEQ ID NO: 491272 - DNA, 25 bp, Rattus norvegicus
gtcagttcagaacatagcagggtaa

SEQ ID NO: 491273 - DNA, 25 bp, Rattus norvegicus
gtcagttcagaagatagcagggtaa

SEQ ID NO: 491274 - DNA, 25 bp, Rattus norvegicus
gtcagttcagaatgcctcggttaca

SEQ ID NO: 491275 - DNA, 25 bp, Rattus norvegicus
gtcagttcaggcacaggtggctgca

SEQ ID NO: 491276 - DNA, 25 bp, Rattus norvegicus
gtcagttcaggctcaggtggctgca

SEQ ID NO: 491277 - DNA, 25 bp, Rattus norvegicus
gtcagttcagtgactgtctgtctaa

SEQ ID NO: 491278 - DNA, 25 bp, Rattus norvegicus
gtcagttcagtgtctgtctgtctaa

SEQ ID NO: 491279 - DNA, 25 bp, Rattus norvegicus
gtcagttcatggacatgctcttccc

SEQ ID NO: 491280 - DNA, 25 bp, Rattus norvegicus
gtcagttcatggtcatgctcttccc

SEQ ID NO: 491281 - DNA, 25 bp, Rattus norvegicus
gtcagttcatttccatctctgaaaa

SEQ ID NO: 491282 - DNA, 25 bp, Rattus norvegicus
gtcagttcatttgcatctctgaaaa

SEQ ID NO: 491283 - DNA, 25 bp, Rattus norvegicus
gtcagttccactcgtgcacgaagca

SEQ ID NO: 491284 - DNA, 25 bp, Rattus norvegicus
gtcagttccactggtgcacgaagca

SEQ ID NO: 491285 - DNA, 25 bp, Rattus norvegicus
gtcagttccaggcatctagggtcgc

SEQ ID NO: 491286 - DNA, 25 bp, Rattus norvegicus
gtcagttccagggatctagggtcgc

SEQ ID NO: 491287 - DNA, 25 bp, Rattus norvegicus
gtcagttccccaagaaatatgttac

SEQ ID NO: 491288 - DNA, 25 bp, Rattus norvegicus
gtcagttccccatgaaatatgttac

SEQ ID NO: 491289 - DNA, 25 bp, Rattus norvegicus
gtcagttccctgattagagagagct

SEQ ID NO: 491290 - DNA, 25 bp, Rattus norvegicus
gtcagttccctgtttagagagagct

SEQ ID NO: 491291 - DNA, 25 bp, Rattus norvegicus
gtcagttccggacaacattggccga

SEQ ID NO: 491292 - DNA, 25 bp, Rattus norvegicus
gtcagttccggagaacattggccga

SEQ ID NO: 491293 - DNA, 25 bp, Rattus norvegicus
gtcagttcctagaaattatctccca

SEQ ID NO: 491294 - DNA, 25 bp, Rattus norvegicus
gtcagttcctagtaattatctccca

SEQ ID NO: 491295 - DNA, 25 bp, Rattus norvegicus
gtcagttcctttctgccaaggcgaa

SEQ ID NO: 491296 - DNA, 25 bp, Rattus norvegicus
gtcagttcctttgtgccaaggcgaa

SEQ ID NO: 491297 - DNA, 25 bp, Rattus norvegicus
gtcagttctaggcaatggactcact

SEQ ID NO: 491298 - DNA, 25 bp, Rattus norvegicus
gtcagttctagggaatggactcact

SEQ ID NO: 491299 - DNA, 25 bp, Rattus norvegicus
gtcagttctcagcacacacacaaga

SEQ ID NO: 491300 - DNA, 25 bp, Rattus norvegicus
gtcagttctcaggacacacacaaga

SEQ ID NO: 491301 - DNA, 25 bp, Rattus norvegicus
gtcagttctctcactactgtagggt

SEQ ID NO: 491302 - DNA, 25 bp, Rattus norvegicus
gtcagttctctctctactgtagggt

SEQ ID NO: 491303 - DNA, 25 bp, Rattus norvegicus
gtcagttctctgcttgtgttaaatt

SEQ ID NO: 491304 - DNA, 25 bp, Rattus norvegicus
gtcagttctctggttgtgttaaatt

SEQ ID NO: 491305 - DNA, 25 bp, Rattus norvegicus
gtcagttctgccatggtggtacctt

SEQ ID NO: 491306 - DNA, 25 bp, Rattus norvegicus
gtcagttctgccttggtggtacctt

SEQ ID NO: 491307 - DNA, 25 bp, Rattus norvegicus
gtcagttctgtcacattaagggcaa

SEQ ID NO: 491308 - DNA, 25 bp, Rattus norvegicus
gtcagttctgtctcattaagggcaa

SEQ ID NO: 491309 - DNA, 25 bp, Rattus norvegicus
gtcagttcttagcatctcatttcac

SEQ ID NO: 491310 - DNA, 25 bp, Rattus norvegicus
gtcagttcttaggatctcatttcac

SEQ ID NO: 491311 - DNA, 25 bp, Rattus norvegicus
gtcagttcttgaattctaccttatg

SEQ ID NO: 491312 - DNA, 25 bp, Rattus norvegicus
gtcagttcttgatttctaccttatg

SEQ ID NO: 491313 - DNA, 25 bp, Rattus norvegicus
gtcagttgaaggcacgattgccctt

SEQ ID NO: 491314 - DNA, 25 bp, Rattus norvegicus
gtcagttgaagggacgattgccctt

SEQ ID NO: 491315 - DNA, 25 bp, Rattus norvegicus
gtcagttgactgatttctctttctt

SEQ ID NO: 491316 - DNA, 25 bp, Rattus norvegicus
gtcagttgactgttttctctttctt

SEQ ID NO: 491317 - DNA, 25 bp, Rattus norvegicus
gtcagttgacttccacacactataa

SEQ ID NO: 491318 - DNA, 25 bp, Rattus norvegicus
gtcagttgacttgcacacactataa

SEQ ID NO: 491319 - DNA, 25 bp, Rattus norvegicus
gtcagttgcagactatcttggaagc

SEQ ID NO: 491320 - DNA, 25 bp, Rattus norvegicus
gtcagttgcagagtatcttggaagc

SEQ ID NO: 491321 - DNA, 25 bp, Rattus norvegicus
gtcagttgcaggactggacatacat

SEQ ID NO: 491322 - DNA, 25 bp, Rattus norvegicus
gtcagttgcaggtctggacatacat

SEQ ID NO: 491323 - DNA, 25 bp, Rattus norvegicus
gtcagttggaatcagccccttaaga

SEQ ID NO: 491324 - DNA, 25 bp, Rattus norvegicus
gtcagttggaatgagccccttaaga

SEQ ID NO: 491325 - DNA, 25 bp, Rattus norvegicus
gtcagttgtcacactggctgccaaa

SEQ ID NO: 491326 - DNA, 25 bp, Rattus norvegicus
gtcagttgtcactctggctgccaaa

SEQ ID NO: 491327 - DNA, 25 bp, Rattus norvegicus
gtcagttgtcagatttcgcacacca

SEQ ID NO: 491328 - DNA, 25 bp, Rattus norvegicus
gtcagttgtcagttttcgcacacca

SEQ ID NO: 491329 - DNA, 25 bp, Rattus norvegicus
gtcagttgtccgatctgcatggatg

SEQ ID NO: 491330 - DNA, 25 bp, Rattus norvegicus
gtcagttgtccgttctgcatggatg

SEQ ID NO: 491331 - DNA, 25 bp, Rattus norvegicus
gtcagttgtgtgcagccctcaaaga

SEQ ID NO: 491332 - DNA, 25 bp, Rattus norvegicus
gtcagttgtgtgctttgcatttttc

SEQ ID NO: 491333 - DNA, 25 bp, Rattus norvegicus
gtcagttgtgtggagccctcaaaga

SEQ ID NO: 491334 - DNA, 25 bp, Rattus norvegicus
gtcagttgtgtggtttgcatttttc

SEQ ID NO: 491335 - DNA, 25 bp, Rattus norvegicus
gtcagttgttggacctggcacctac

SEQ ID NO: 491336 - DNA, 25 bp, Rattus norvegicus
gtcagttgttggtcctggcacctac

SEQ ID NO: 491337 - DNA, 25 bp, Rattus norvegicus
gtcagtttcaccaacatatcaatat

SEQ ID NO: 491338 - DNA, 25 bp, Rattus norvegicus
gtcagtttcacctacatatcaatat

SEQ ID NO: 491339 - DNA, 25 bp, Rattus norvegicus
gtcagtttccatcataatcctgaaa

SEQ ID NO: 491340 - DNA, 25 bp, Rattus norvegicus
gtcagtttccatgataatcctgaaa

SEQ ID NO: 491341 - DNA, 25 bp, Rattus norvegicus
gtcagtttcttaactactcagcaga

SEQ ID NO: 491342 - DNA, 25 bp, Rattus norvegicus
gtcagtttcttatctactcagcaga

SEQ ID NO: 491343 - DNA, 25 bp, Rattus norvegicus
gtcagtttgaccagcttgacctcag

SEQ ID NO: 491344 - DNA, 25 bp, Rattus norvegicus
gtcagtttgacctgcttgacctcag

SEQ ID NO: 491345 - DNA, 25 bp, Rattus norvegicus
gtcagtttgcggagctcccatggga

SEQ ID NO: 491346 - DNA, 25 bp, Rattus norvegicus
gtcagtttgcggtgctcccatggga

SEQ ID NO: 491347 - DNA, 25 bp, Rattus norvegicus
gtcagtttggtgcttcgatttttta

SEQ ID NO: 491348 - DNA, 25 bp, Rattus norvegicus
gtcagtttggtggttcgatttttta

SEQ ID NO: 491349 - DNA, 25 bp, Rattus norvegicus
gtcagtttgtagacgacagcccata

SEQ ID NO: 491350 - DNA, 25 bp, Rattus norvegicus
gtcagtttgtagtcgacagcccata

SEQ ID NO: 491351 - DNA, 25 bp, Rattus norvegicus
gtcagttttcatctggctaaggcta

SEQ ID NO: 491352 - DNA, 25 bp, Rattus norvegicus
gtcagttttcatgtggctaaggcta

SEQ ID NO: 491353 - DNA, 25 bp, Rattus norvegicus
gtcagttttctccactggaaccata

SEQ ID NO: 491354 - DNA, 25 bp, Rattus norvegicus
gtcagttttctcgactggaaccata

SEQ ID NO: 491355 - DNA, 25 bp, Rattus norvegicus
gtcataaactctctgtaaggcccca

SEQ ID NO: 491356 - DNA, 25 bp, Rattus norvegicus
gtcataaactctgtgtaaggcccca

SEQ ID NO: 491357 - DNA, 25 bp, Rattus norvegicus
gtcataaatatacctgttcctgtgt

SEQ ID NO: 491358 - DNA, 25 bp, Rattus norvegicus
gtcataaatatagctgttcctgtgt

SEQ ID NO: 491359 - DNA, 25 bp, Rattus norvegicus
gtcataaatgagctctgcaggcaca

SEQ ID NO: 491360 - DNA, 25 bp, Rattus norvegicus
gtcataaatgaggtctgcaggcaca

SEQ ID NO: 491361 - DNA, 25 bp, Rattus norvegicus
gtcataacatgacccattgtttttc

SEQ ID NO: 491362 - DNA, 25 bp, Rattus norvegicus
gtcataacatgagccattgtttttc

SEQ ID NO: 491363 - DNA, 25 bp, Rattus norvegicus
gtcataagtcacactagctgctcta

SEQ ID NO: 491364 - DNA, 25 bp, Rattus norvegicus
gtcataagtcactctagctgctcta

SEQ ID NO: 491365 - DNA, 25 bp, Rattus norvegicus
gtcataatactgctcttctggctgc

SEQ ID NO: 491366 - DNA, 25 bp, Rattus norvegicus
gtcataatactggtcttctggctgc

SEQ ID NO: 491367 - DNA, 25 bp, Rattus norvegicus
gtcataatgcttactcagatgctct

SEQ ID NO: 491368 - DNA, 25 bp, Rattus norvegicus
gtcataatgctttctcagatgctct

SEQ ID NO: 491369 - DNA, 25 bp, Rattus norvegicus
gtcataatggccactttagggcaca

SEQ ID NO: 491370 - DNA, 25 bp, Rattus norvegicus
gtcataatggcctctttagggcaca

SEQ ID NO: 491371 - DNA, 25 bp, Rattus norvegicus
gtcataatggctactggtcctgcta

SEQ ID NO: 491372 - DNA, 25 bp, Rattus norvegicus
gtcataatggcttctggtcctgcta

SEQ ID NO: 491373 - DNA, 25 bp, Rattus norvegicus
gtcatacacaggagtggctctcctg

SEQ ID NO: 491374 - DNA, 25 bp, Rattus norvegicus
gtcatacacaggtgtggctctcctg

SEQ ID NO: 491375 - DNA, 25 bp, Rattus norvegicus
gtcatacaccgacgtaattcgggat

SEQ ID NO: 491376 - DNA, 25 bp, Rattus norvegicus
gtcatacaccgaggtaattcgggat

SEQ ID NO: 491377 - DNA, 25 bp, Rattus norvegicus
gtcataccaaagacaggacagtcca

SEQ ID NO: 491378 - DNA, 25 bp, Rattus norvegicus
gtcataccaaagtcaggacagtcca

SEQ ID NO: 491379 - DNA, 25 bp, Rattus norvegicus
gtcataccagacagcacggagcagt

SEQ ID NO: 491380 - DNA, 25 bp, Rattus norvegicus
gtcataccagactgcacggagcagt

SEQ ID NO: 491381 - DNA, 25 bp, Rattus norvegicus
gtcataccgttcactttcaagttgg

SEQ ID NO: 491382 - DNA, 25 bp, Rattus norvegicus
gtcataccgttctctttcaagttgg

SEQ ID NO: 491383 - DNA, 25 bp, Rattus norvegicus
gtcataccttgaccgtgtacacatg

SEQ ID NO: 491384 - DNA, 25 bp, Rattus norvegicus
gtcataccttgagcgtgtacacatg

SEQ ID NO: 491385 - DNA, 25 bp, Rattus norvegicus
gtcatacgaaaccacaagcattgct

SEQ ID NO: 491386 - DNA, 25 bp, Rattus norvegicus
gtcatacgaaacgacaagcattgct

SEQ ID NO: 491387 - DNA, 25 bp, Rattus norvegicus
gtcatacttctgacaccagcggaag

SEQ ID NO: 491388 - DNA, 25 bp, Rattus norvegicus
gtcatacttctgtcaccagcggaag

SEQ ID NO: 491389 - DNA, 25 bp, Rattus norvegicus
gtcatacttgacctttgggcacctc

SEQ ID NO: 491390 - DNA, 25 bp, Rattus norvegicus
gtcatacttgacgtttgggcacctc

SEQ ID NO: 491391 - DNA, 25 bp, Rattus norvegicus
gtcatacttgtacttgcgagctaac

SEQ ID NO: 491392 - DNA, 25 bp, Rattus norvegicus
gtcatacttgtagttgcgagctaac

SEQ ID NO: 491393 - DNA, 25 bp, Rattus norvegicus
gtcatagacagcagcacttctgtat

SEQ ID NO: 491394 - DNA, 25 bp, Rattus norvegicus
gtcatagacagctgcacttctgtat

SEQ ID NO: 491395 - DNA, 25 bp, Rattus norvegicus
gtcatagaccagattgcatgcagtg

SEQ ID NO: 491396 - DNA, 25 bp, Rattus norvegicus
gtcatagaccagtttgcatgcagtg

SEQ ID NO: 491397 - DNA, 25 bp, Rattus norvegicus
gtcatagacgtcaaggtggcagcag

SEQ ID NO: 491398 - DNA, 25 bp, Rattus norvegicus
gtcatagacgtctaggtggcagcag

SEQ ID NO: 491399 - DNA, 25 bp, Rattus norvegicus
gtcatagactgtcctcaggcatgtt

SEQ ID NO: 491400 - DNA, 25 bp, Rattus norvegicus
gtcatagactgtgctcaggcatgtt

SEQ ID NO: 491401 - DNA, 25 bp, Rattus norvegicus
gtcatagcaaagactcaacctagga

SEQ ID NO: 491402 - DNA, 25 bp, Rattus norvegicus
gtcatagcaaagtctcaacctagga

SEQ ID NO: 491403 - DNA, 25 bp, Rattus norvegicus
gtcatagcacccagtgtctagacta

SEQ ID NO: 491404 - DNA, 25 bp, Rattus norvegicus
gtcatagcaccctgtgtctagacta

SEQ ID NO: 491405 - DNA, 25 bp, Rattus norvegicus
gtcatagcattcctcatcacattgg

SEQ ID NO: 491406 - DNA, 25 bp, Rattus norvegicus
gtcatagcattcgtcatcacattgg

SEQ ID NO: 491407 - DNA, 25 bp, Rattus norvegicus
gtcatagccagcctgaaggatgcat

SEQ ID NO: 491408 - DNA, 25 bp, Rattus norvegicus
gtcatagccagcgtgaaggatgcat

SEQ ID NO: 491409 - DNA, 25 bp, Rattus norvegicus
gtcatagccatgaagaaccagcaat

SEQ ID NO: 491410 - DNA, 25 bp, Rattus norvegicus
gtcatagccatgtagaaccagcaat

SEQ ID NO: 491411 - DNA, 25 bp, Rattus norvegicus
gtcatagctgatacgtactactcct

SEQ ID NO: 491412 - DNA, 25 bp, Rattus norvegicus
gtcatagctgattcgtactactcct

SEQ ID NO: 491413 - DNA, 25 bp, Rattus norvegicus
gtcataggcgagctgatcataccca

SEQ ID NO: 491414 - DNA, 25 bp, Rattus norvegicus
gtcataggcgaggtgatcataccca

SEQ ID NO: 491415 - DNA, 25 bp, Rattus norvegicus
gtcatagggttaatgccgtctctgt

SEQ ID NO: 491416 - DNA, 25 bp, Rattus norvegicus
gtcatagggttattgccgtctctgt

SEQ ID NO: 491417 - DNA, 25 bp, Rattus norvegicus
gtcataggtcataaggtcatagcat

SEQ ID NO: 491418 - DNA, 25 bp, Rattus norvegicus
gtcataggtcattaggtcatagcat

SEQ ID NO: 491419 - DNA, 25 bp, Rattus norvegicus
gtcataggtctgactcttaagggca

SEQ ID NO: 491420 - DNA, 25 bp, Rattus norvegicus
gtcataggtctgtctcttaagggca

SEQ ID NO: 491421 - DNA, 25 bp, Rattus norvegicus
gtcataggtgctcgcaatctgctgg

SEQ ID NO: 491422 - DNA, 25 bp, Rattus norvegicus
gtcataggtgctggcaatctgctgg

SEQ ID NO: 491423 - DNA, 25 bp, Rattus norvegicus
gtcataggtgtaccctgttgccgaa

SEQ ID NO: 491424 - DNA, 25 bp, Rattus norvegicus
gtcataggtgtagcctgttgccgaa

SEQ ID NO: 491425 - DNA, 25 bp, Rattus norvegicus
gtcatagtaagacacgccgcctagc

SEQ ID NO: 491426 - DNA, 25 bp, Rattus norvegicus
gtcatagtaagagacgccgcctagc

SEQ ID NO: 491427 - DNA, 25 bp, Rattus norvegicus
gtcatagtacttaacaggaggtctt

SEQ ID NO: 491428 - DNA, 25 bp, Rattus norvegicus
gtcatagtactttacaggaggtctt

SEQ ID NO: 491429 - DNA, 25 bp, Rattus norvegicus
gtcatagttgccaacacgatgccct

SEQ ID NO: 491430 - DNA, 25 bp, Rattus norvegicus
gtcatagttgcctacacgatgccct

SEQ ID NO: 491431 - DNA, 25 bp, Rattus norvegicus
gtcatagttgtgaccttggtattta

SEQ ID NO: 491432 - DNA, 25 bp, Rattus norvegicus
gtcatagttgtgtccttggtattta

SEQ ID NO: 491433 - DNA, 25 bp, Rattus norvegicus
gtcatataagtcaaacgccagccaa

SEQ ID NO: 491434 - DNA, 25 bp, Rattus norvegicus
gtcatataagtctaacgccagccaa

SEQ ID NO: 491435 - DNA, 25 bp, Rattus norvegicus
gtcatatccagtcagcaagagccct

SEQ ID NO: 491436 - DNA, 25 bp, Rattus norvegicus
gtcatatccagtgagcaagagccct

SEQ ID NO: 491437 - DNA, 25 bp, Rattus norvegicus
gtcatatcctagcaccccagaagaa

SEQ ID NO: 491438 - DNA, 25 bp, Rattus norvegicus
gtcatatcctaggaccccagaagaa

SEQ ID NO: 491439 - DNA, 25 bp, Rattus norvegicus
gtcatatccttaaattctacgccat

SEQ ID NO: 491440 - DNA, 25 bp, Rattus norvegicus
gtcatatccttatattctacgccat

SEQ ID NO: 491441 - DNA, 25 bp, Rattus norvegicus
gtcatatcgttgagagcgtggtcca

SEQ ID NO: 491442 - DNA, 25 bp, Rattus norvegicus
gtcatatcgttgtgagcgtggtcca

SEQ ID NO: 491443 - DNA, 25 bp, Rattus norvegicus
gtcatatctccccatttcaaaaatc

SEQ ID NO: 491444 - DNA, 25 bp, Rattus norvegicus
gtcatatctcccgatttcaaaaatc

SEQ ID NO: 491445 - DNA, 25 bp, Rattus norvegicus
gtcatatctgcaagttatatgaagg

SEQ ID NO: 491446 - DNA, 25 bp, Rattus norvegicus
gtcatatctgcatgttatatgaagg

SEQ ID NO: 491447 - DNA, 25 bp, Rattus norvegicus
gtcatatctgctagttgctcgagca

SEQ ID NO: 491448 - DNA, 25 bp, Rattus norvegicus
gtcatatctgcttgttgctcgagca

SEQ ID NO: 491449 - DNA, 25 bp, Rattus norvegicus
gtcatatgacatccctacttatcaa

SEQ ID NO: 491450 - DNA, 25 bp, Rattus norvegicus
gtcatatgacatgcctacttatcaa

SEQ ID NO: 491451 - DNA, 25 bp, Rattus norvegicus
gtcatatggccacgtctgagtccta

SEQ ID NO: 491452 - DNA, 25 bp, Rattus norvegicus
gtcatatggccaggtctgagtccta

SEQ ID NO: 491453 - DNA, 25 bp, Rattus norvegicus
gtcatatggcccagacggcaaacca

SEQ ID NO: 491454 - DNA, 25 bp, Rattus norvegicus
gtcatatggccctgacggcaaacca

SEQ ID NO: 491455 - DNA, 25 bp, Rattus norvegicus
gtcatattatctattaatggccttt

SEQ ID NO: 491456 - DNA, 25 bp, Rattus norvegicus
gtcatattatcttttaatggccttt

SEQ ID NO: 491457 - DNA, 25 bp, Rattus norvegicus
gtcatattatgtagccccgccttga

SEQ ID NO: 491458 - DNA, 25 bp, Rattus norvegicus
gtcatattatgttgccccgccttga

SEQ ID NO: 491459 - DNA, 25 bp, Rattus norvegicus
gtcatattcttgcaagtctctcctc

SEQ ID NO: 491460 - DNA, 25 bp, Rattus norvegicus
gtcatattcttggaagtctctcctc

SEQ ID NO: 491461 - DNA, 25 bp, Rattus norvegicus
gtcatattctttaatgtggtcgtca

SEQ ID NO: 491462 - DNA, 25 bp, Rattus norvegicus
gtcatattcttttatgtggtcgtca

SEQ ID NO: 491463 - DNA, 25 bp, Rattus norvegicus
gtcatatttattccagtcacccacc

SEQ ID NO: 491464 - DNA, 25 bp, Rattus norvegicus
gtcatatttattgcagtcacccacc

SEQ ID NO: 491465 - DNA, 25 bp, Rattus norvegicus
gtcatcaaagttaaggcttcccagg

SEQ ID NO: 491466 - DNA, 25 bp, Rattus norvegicus
gtcatcaaagtttaggcttcccagg

SEQ ID NO: 491467 - DNA, 25 bp, Rattus norvegicus
gtcatcaacaggctatgtgctggtt

SEQ ID NO: 491468 - DNA, 25 bp, Rattus norvegicus
gtcatcaacagggtatgtgctggtt

SEQ ID NO: 491469 - DNA, 25 bp, Rattus norvegicus
gtcatcaagaaaaggccacacggat

SEQ ID NO: 491470 - DNA, 25 bp, Rattus norvegicus
gtcatcaagaaatggccacacggat

SEQ ID NO: 491471 - DNA, 25 bp, Rattus norvegicus
gtcatcaagattaacatgtctgtat

SEQ ID NO: 491472 - DNA, 25 bp, Rattus norvegicus
gtcatcaagatttacatgtctgtat

SEQ ID NO: 491473 - DNA, 25 bp, Rattus norvegicus
gtcatcaatgacacctggacctgga

SEQ ID NO: 491474 - DNA, 25 bp, Rattus norvegicus
gtcatcaatgactcctggacctgga

SEQ ID NO: 491475 - DNA, 25 bp, Rattus norvegicus
gtcatcaatggcaatctctccggaa

SEQ ID NO: 491476 - DNA, 25 bp, Rattus norvegicus
gtcatcaatggctatctctccggaa

SEQ ID NO: 491477 - DNA, 25 bp, Rattus norvegicus
gtcatcacaagtccagttgtcattg

SEQ ID NO: 491478 - DNA, 25 bp, Rattus norvegicus
gtcatcacaagtgcagttgtcattg

SEQ ID NO: 491479 - DNA, 25 bp, Rattus norvegicus
gtcatcacactaaaacctccgggtt

SEQ ID NO: 491480 - DNA, 25 bp, Rattus norvegicus
gtcatcacactataacctccgggtt

SEQ ID NO: 491481 - DNA, 25 bp, Rattus norvegicus
gtcatcacagaactcctatttgttt

SEQ ID NO: 491482 - DNA, 25 bp, Rattus norvegicus
gtcatcacagaagtcctatttgttt

SEQ ID NO: 491483 - DNA, 25 bp, Rattus norvegicus
gtcatcacatttctagctgttcgat

SEQ ID NO: 491484 - DNA, 25 bp, Rattus norvegicus
gtcatcacatttgtagctgttcgat

SEQ ID NO: 491485 - DNA, 25 bp, Rattus norvegicus
gtcatcaccactcagcacagcagag

SEQ ID NO: 491486 - DNA, 25 bp, Rattus norvegicus
gtcatcaccactgagcacagcagag

SEQ ID NO: 491487 - DNA, 25 bp, Rattus norvegicus
gtcatcaccctcacggatgactgag

SEQ ID NO: 491488 - DNA, 25 bp, Rattus norvegicus
gtcatcaccctctcggatgactgag

SEQ ID NO: 491489 - DNA, 25 bp, Rattus norvegicus
gtcatcacccttatacttggtcaga

SEQ ID NO: 491490 - DNA, 25 bp, Rattus norvegicus
gtcatcacccttttacttggtcaga

SEQ ID NO: 491491 - DNA, 25 bp, Rattus norvegicus
gtcatcacctccagtttgatgggtt

SEQ ID NO: 491492 - DNA, 25 bp, Rattus norvegicus
gtcatcacctcctgtttgatgggtt

SEQ ID NO: 491493 - DNA, 25 bp, Rattus norvegicus
gtcatcacctgactaaatgctgagt

SEQ ID NO: 491494 - DNA, 25 bp, Rattus norvegicus
gtcatcacctgagtaaatgctgagt

SEQ ID NO: 491495 - DNA, 25 bp, Rattus norvegicus
gtcatcactgctaatagatctagga

SEQ ID NO: 491496 - DNA, 25 bp, Rattus norvegicus
gtcatcactgcttatagatctagga

SEQ ID NO: 491497 - DNA, 25 bp, Rattus norvegicus
gtcatcagacctatagaactcagag

SEQ ID NO: 491498 - DNA, 25 bp, Rattus norvegicus
gtcatcagacctttagaactcagag

SEQ ID NO: 491499 - DNA, 25 bp, Rattus norvegicus
gtcatcagactgcttagtaacttgg

SEQ ID NO: 491500 - DNA, 25 bp, Rattus norvegicus
gtcatcagactggttagtaacttgg

SEQ ID NO: 491501 - DNA, 25 bp, Rattus norvegicus
gtcatcagccctatgatgtacacta

SEQ ID NO: 491502 - DNA, 25 bp, Rattus norvegicus
gtcatcagccctttgatgtacacta

SEQ ID NO: 491503 - DNA, 25 bp, Rattus norvegicus
gtcatcagccttatgtgaatgtgca

SEQ ID NO: 491504 - DNA, 25 bp, Rattus norvegicus
gtcatcagccttttgtgaatgtgca

SEQ ID NO: 491505 - DNA, 25 bp, Rattus norvegicus
gtcatcagcgagctcacattacact

SEQ ID NO: 491506 - DNA, 25 bp, Rattus norvegicus
gtcatcagcgaggtcacattacact

SEQ ID NO: 491507 - DNA, 25 bp, Rattus norvegicus
gtcatcagctccaagggacctgcaa

SEQ ID NO: 491508 - DNA, 25 bp, Rattus norvegicus
gtcatcagctcctagggacctgcaa

SEQ ID NO: 491509 - DNA, 25 bp, Rattus norvegicus
gtcatcaggaacaggttccgagacc

SEQ ID NO: 491510 - DNA, 25 bp, Rattus norvegicus
gtcatcaggaactggttccgagacc

SEQ ID NO: 491511 - DNA, 25 bp, Rattus norvegicus
gtcatcaggtgaaatccaggctaat

SEQ ID NO: 491512 - DNA, 25 bp, Rattus norvegicus
gtcatcaggtgatatccaggctaat

SEQ ID NO: 491513 - DNA, 25 bp, Rattus norvegicus
gtcatcagtaatagtaaaacgcttt

SEQ ID NO: 491514 - DNA, 25 bp, Rattus norvegicus
gtcatcagtaattgtaaaacgcttt

SEQ ID NO: 491515 - DNA, 25 bp, Rattus norvegicus
gtcatcagtgacagtgacgactcag

SEQ ID NO: 491516 - DNA, 25 bp, Rattus norvegicus
gtcatcagtgactgtgacgactcag

SEQ ID NO: 491517 - DNA, 25 bp, Rattus norvegicus
gtcatcatcagtctttcgaatgcat

SEQ ID NO: 491518 - DNA, 25 bp, Rattus norvegicus
gtcatcatcagtgtttcgaatgcat

SEQ ID NO: 491519 - DNA, 25 bp, Rattus norvegicus
gtcatcatcatcagtaggtgaaaca

SEQ ID NO: 491520 - DNA, 25 bp, Rattus norvegicus
gtcatcatcatctgtaggtgaaaca

SEQ ID NO: 491521 - DNA, 25 bp, Rattus norvegicus
gtcatcatcccacaggtcctagaag

SEQ ID NO: 491522 - DNA, 25 bp, Rattus norvegicus
gtcatcatcccactgagaagtaaga

SEQ ID NO: 491523 - DNA, 25 bp, Rattus norvegicus
gtcatcatcccagaggtcctagaag

SEQ ID NO: 491524 - DNA, 25 bp, Rattus norvegicus
gtcatcatcccagtgagaagtaaga

SEQ ID NO: 491525 - DNA, 25 bp, Rattus norvegicus
gtcatcatcctcaacaacatctgag

SEQ ID NO: 491526 - DNA, 25 bp, Rattus norvegicus
gtcatcatcctcatcaggacagtca

SEQ ID NO: 491527 - DNA, 25 bp, Rattus norvegicus
gtcatcatcctctacaacatctgag

SEQ ID NO: 491528 - DNA, 25 bp, Rattus norvegicus
gtcatcatcctcttcaggacagtca

SEQ ID NO: 491529 - DNA, 25 bp, Rattus norvegicus
gtcatcatccttcttttcaatctta

SEQ ID NO: 491530 - DNA, 25 bp, Rattus norvegicus
gtcatcatccttgttttcaatctta

SEQ ID NO: 491531 - DNA, 25 bp, Rattus norvegicus
gtcatcatgaaaacccctgaacatc

SEQ ID NO: 491532 - DNA, 25 bp, Rattus norvegicus
gtcatcatgaaatcccctgaacatc

SEQ ID NO: 491533 - DNA, 25 bp, Rattus norvegicus
gtcatcatgactctgctggaaacaa

SEQ ID NO: 491534 - DNA, 25 bp, Rattus norvegicus
gtcatcatgactgtgctggaaacaa

SEQ ID NO: 491535 - DNA, 25 bp, Rattus norvegicus
gtcatcatgggaagtttgctccaga

SEQ ID NO: 491536 - DNA, 25 bp, Rattus norvegicus
gtcatcatgggatgtttgctccaga

SEQ ID NO: 491537 - DNA, 25 bp, Rattus norvegicus
gtcatcatgttcagcagtaaattga

SEQ ID NO: 491538 - DNA, 25 bp, Rattus norvegicus
gtcatcatgttctgcagtaaattga

SEQ ID NO: 491539 - DNA, 25 bp, Rattus norvegicus
gtcatcattttcatccaaagttagg

SEQ ID NO: 491540 - DNA, 25 bp, Rattus norvegicus
gtcatcattttcttccaaagttagg

SEQ ID NO: 491541 - DNA, 25 bp, Rattus norvegicus
gtcatccaaagaatgtccttctcac

SEQ ID NO: 491542 - DNA, 25 bp, Rattus norvegicus
gtcatccaaagattgtccttctcac

SEQ ID NO: 491543 - DNA, 25 bp, Rattus norvegicus
gtcatccacaggcaccgttatggga

SEQ ID NO: 491544 - DNA, 25 bp, Rattus norvegicus
gtcatccacagggaccgttatggga

SEQ ID NO: 491545 - DNA, 25 bp, Rattus norvegicus
gtcatccaccgacagttggaaccat

SEQ ID NO: 491546 - DNA, 25 bp, Rattus norvegicus
gtcatccaccgagagttggaaccat

SEQ ID NO: 491547 - DNA, 25 bp, Rattus norvegicus
gtcatccactaactattccatcgct

SEQ ID NO: 491548 - DNA, 25 bp, Rattus norvegicus
gtcatccactaagtattccatcgct

SEQ ID NO: 491549 - DNA, 25 bp, Rattus norvegicus
gtcatccacttcagtctgagggcaa

SEQ ID NO: 491550 - DNA, 25 bp, Rattus norvegicus
gtcatccacttctgtctgagggcaa

SEQ ID NO: 491551 - DNA, 25 bp, Rattus norvegicus
gtcatccagctgaccatgaggtgaa

SEQ ID NO: 491552 - DNA, 25 bp, Rattus norvegicus
gtcatccagctgtccatgaggtgaa

SEQ ID NO: 491553 - DNA, 25 bp, Rattus norvegicus
gtcatccatcttaccactgaaacag

SEQ ID NO: 491554 - DNA, 25 bp, Rattus norvegicus
gtcatccatctttccactgaaacag

SEQ ID NO: 491555 - DNA, 25 bp, Rattus norvegicus
gtcatccatttactatgccattgta

SEQ ID NO: 491556 - DNA, 25 bp, Rattus norvegicus
gtcatccatttagtatgccattgta

SEQ ID NO: 491557 - DNA, 25 bp, Rattus norvegicus
gtcatcccaaagagtgtcttttatt

SEQ ID NO: 491558 - DNA, 25 bp, Rattus norvegicus
gtcatcccaaagtgtgtcttttatt

SEQ ID NO: 491559 - DNA, 25 bp, Rattus norvegicus
gtcatcccacagcaactttacagat

SEQ ID NO: 491560 - DNA, 25 bp, Rattus norvegicus
gtcatcccacaggaactttacagat

SEQ ID NO: 491561 - DNA, 25 bp, Rattus norvegicus
gtcatcccaccactgtggaggcgga

SEQ ID NO: 491562 - DNA, 25 bp, Rattus norvegicus
gtcatcccaccagtgtggaggcgga

SEQ ID NO: 491563 - DNA, 25 bp, Rattus norvegicus
gtcatccccatgcactgagaaacag

SEQ ID NO: 491564 - DNA, 25 bp, Rattus norvegicus
gtcatccccatggactgagaaacag

SEQ ID NO: 491565 - DNA, 25 bp, Rattus norvegicus
gtcatcccctcacaatggttagtag

SEQ ID NO: 491566 - DNA, 25 bp, Rattus norvegicus
gtcatcccctcagaatggttagtag

SEQ ID NO: 491567 - DNA, 25 bp, Rattus norvegicus
gtcatcccctggcaggctaaagtga

SEQ ID NO: 491568 - DNA, 25 bp, Rattus norvegicus
gtcatcccctgggaggctaaagtga

SEQ ID NO: 491569 - DNA, 25 bp, Rattus norvegicus
gtcatccctttaatcacagagctta

SEQ ID NO: 491570 - DNA, 25 bp, Rattus norvegicus
gtcatccctttattcacagagctta

SEQ ID NO: 491571 - DNA, 25 bp, Rattus norvegicus
gtcatccgcgtgaggtttcagaaca

SEQ ID NO: 491572 - DNA, 25 bp, Rattus norvegicus
gtcatccgcgtgtggtttcagaaca

SEQ ID NO: 491573 - DNA, 25 bp, Rattus norvegicus
gtcatccggcagctggacgttgtaa

SEQ ID NO: 491574 - DNA, 25 bp, Rattus norvegicus
gtcatccggcaggtggacgttgtaa

SEQ ID NO: 491575 - DNA, 25 bp, Rattus norvegicus
gtcatcctagcactttaagagatag

SEQ ID NO: 491576 - DNA, 25 bp, Rattus norvegicus
gtcatcctagcagtttaagagatag

SEQ ID NO: 491577 - DNA, 25 bp, Rattus norvegicus
gtcatcctaggaacacttcagtaac

SEQ ID NO: 491578 - DNA, 25 bp, Rattus norvegicus
gtcatcctaggatcacttcagtaac

SEQ ID NO: 491579 - DNA, 25 bp, Rattus norvegicus
gtcatcctaggcatcatgtatggct

SEQ ID NO: 491580 - DNA, 25 bp, Rattus norvegicus
gtcatcctaggcttcatgtatggct

SEQ ID NO: 491581 - DNA, 25 bp, Rattus norvegicus
gtcatcctcccaacattttgtacta

SEQ ID NO: 491582 - DNA, 25 bp, Rattus norvegicus
gtcatcctcccatcattttgtacta

SEQ ID NO: 491583 - DNA, 25 bp, Rattus norvegicus
gtcatcctccctctagcttatatgt

SEQ ID NO: 491584 - DNA, 25 bp, Rattus norvegicus
gtcatcctccctgtagcttatatgt

SEQ ID NO: 491585 - DNA, 25 bp, Rattus norvegicus
gtcatcctcctgaagctgcttgaga

SEQ ID NO: 491586 - DNA, 25 bp, Rattus norvegicus
gtcatcctcctgtagctgcttgaga

SEQ ID NO: 491587 - DNA, 25 bp, Rattus norvegicus
gtcatcctgaacatagcctgcacaa

SEQ ID NO: 491588 - DNA, 25 bp, Rattus norvegicus
gtcatcctgaacttagcctgcacaa

SEQ ID NO: 491589 - DNA, 25 bp, Rattus norvegicus
gtcatcctgaagatgatctcgtgca

SEQ ID NO: 491590 - DNA, 25 bp, Rattus norvegicus
gtcatcctgaagttgatctcgtgca

SEQ ID NO: 491591 - DNA, 25 bp, Rattus norvegicus
gtcatcctgaggatcctgtgtcaga

SEQ ID NO: 491592 - DNA, 25 bp, Rattus norvegicus
gtcatcctgaggttcctgtgtcaga

SEQ ID NO: 491593 - DNA, 25 bp, Rattus norvegicus
gtcatcctgagtaactacttccggg

SEQ ID NO: 491594 - DNA, 25 bp, Rattus norvegicus
gtcatcctgagttactacttccggg

SEQ ID NO: 491595 - DNA, 25 bp, Rattus norvegicus
gtcatcctgggaatcattctaaaga

SEQ ID NO: 491596 - DNA, 25 bp, Rattus norvegicus
gtcatcctgggattcattctaaaga

SEQ ID NO: 491597 - DNA, 25 bp, Rattus norvegicus
gtcatccttcaaccggaccaatagg

SEQ ID NO: 491598 - DNA, 25 bp, Rattus norvegicus
gtcatccttcaagcggaccaatagg

SEQ ID NO: 491599 - DNA, 25 bp, Rattus norvegicus
gtcatccttgacaacttatacttag

SEQ ID NO: 491600 - DNA, 25 bp, Rattus norvegicus
gtcatccttgactacttatacttag

SEQ ID NO: 491601 - DNA, 25 bp, Rattus norvegicus
gtcatccttggaaatagccctggtt

SEQ ID NO: 491602 - DNA, 25 bp, Rattus norvegicus
gtcatccttggatatagccctggtt

SEQ ID NO: 491603 - DNA, 25 bp, Rattus norvegicus
gtcatccttgggagctgtctgaggc

SEQ ID NO: 491604 - DNA, 25 bp, Rattus norvegicus
gtcatccttgggtgctgtctgaggc

SEQ ID NO: 491605 - DNA, 25 bp, Rattus norvegicus
gtcatccttgtaaccagctgcttaa

SEQ ID NO: 491606 - DNA, 25 bp, Rattus norvegicus
gtcatccttgtatccagctgcttaa

SEQ ID NO: 491607 - DNA, 25 bp, Rattus norvegicus
gtcatcgaaccccagaggattcatg

SEQ ID NO: 491608 - DNA, 25 bp, Rattus norvegicus
gtcatcgaacccgagaggattcatg

SEQ ID NO: 491609 - DNA, 25 bp, Rattus norvegicus
gtcatcgaacttatcatagtttcta

SEQ ID NO: 491610 - DNA, 25 bp, Rattus norvegicus
gtcatcgaacttttcatagtttcta

SEQ ID NO: 491611 - DNA, 25 bp, Rattus norvegicus
gtcatcgacgacactcttcaagtaa

SEQ ID NO: 491612 - DNA, 25 bp, Rattus norvegicus
gtcatcgacgactctcttcaagtaa

SEQ ID NO: 491613 - DNA, 25 bp, Rattus norvegicus
gtcatcgagatccagagcaaacact

SEQ ID NO: 491614 - DNA, 25 bp, Rattus norvegicus
gtcatcgagatcgagagcaaacact

SEQ ID NO: 491615 - DNA, 25 bp, Rattus norvegicus
gtcatcgagctgatctatgtcttat

SEQ ID NO: 491616 - DNA, 25 bp, Rattus norvegicus
gtcatcgagctgttctatgtcttat

SEQ ID NO: 491617 - DNA, 25 bp, Rattus norvegicus
gtcatcgatcccaactgggtcggaa

SEQ ID NO: 491618 - DNA, 25 bp, Rattus norvegicus
gtcatcgatccctactgggtcggaa

SEQ ID NO: 491619 - DNA, 25 bp, Rattus norvegicus
gtcatcgatcctatcatcttcaata

SEQ ID NO: 491620 - DNA, 25 bp, Rattus norvegicus
gtcatcgatcctttcatcttcaata

SEQ ID NO: 491621 - DNA, 25 bp, Rattus norvegicus
gtcatcgattatatccctgtgtctc

SEQ ID NO: 491622 - DNA, 25 bp, Rattus norvegicus
gtcatcgattatttccctgtgtctc

SEQ ID NO: 491623 - DNA, 25 bp, Rattus norvegicus
gtcatcgcaaagatctgcgcgacaa

SEQ ID NO: 491624 - DNA, 25 bp, Rattus norvegicus
gtcatcgcaaagttctgcgcgacaa

SEQ ID NO: 491625 - DNA, 25 bp, Rattus norvegicus
gtcatcgcgttgagactctatcttt

SEQ ID NO: 491626 - DNA, 25 bp, Rattus norvegicus
gtcatcgcgttgtgactctatcttt

SEQ ID NO: 491627 - DNA, 25 bp, Rattus norvegicus
gtcatcgctgtacgctaagtgctat

SEQ ID NO: 491628 - DNA, 25 bp, Rattus norvegicus
gtcatcgctgtaggctaagtgctat

SEQ ID NO: 491629 - DNA, 25 bp, Rattus norvegicus
gtcatcgctgtgaatttcaacccat

SEQ ID NO: 491630 - DNA, 25 bp, Rattus norvegicus
gtcatcgctgtgtatttcaacccat

SEQ ID NO: 491631 - DNA, 25 bp, Rattus norvegicus
gtcatcggactcataaaccagtggt

SEQ ID NO: 491632 - DNA, 25 bp, Rattus norvegicus
gtcatcggactcttaaaccagtggt

SEQ ID NO: 491633 - DNA, 25 bp, Rattus norvegicus
gtcatcggatttctataccccgcat

SEQ ID NO: 491634 - DNA, 25 bp, Rattus norvegicus
gtcatcggatttgtataccccgcat

SEQ ID NO: 491635 - DNA, 25 bp, Rattus norvegicus
gtcatcgtaaccacatgtctagtag

SEQ ID NO: 491636 - DNA, 25 bp, Rattus norvegicus
gtcatcgtaacctcatgtctagtag

SEQ ID NO: 491637 - DNA, 25 bp, Rattus norvegicus
gtcatcgtacaccactttgttgacg

SEQ ID NO: 491638 - DNA, 25 bp, Rattus norvegicus
gtcatcgtacacgactttgttgacg

SEQ ID NO: 491639 - DNA, 25 bp, Rattus norvegicus
gtcatcgtcataccttggcttggac

SEQ ID NO: 491640 - DNA, 25 bp, Rattus norvegicus
gtcatcgtcatagcttggcttggac

SEQ ID NO: 491641 - DNA, 25 bp, Rattus norvegicus
gtcatcgtcctgagccattagagat

SEQ ID NO: 491642 - DNA, 25 bp, Rattus norvegicus
gtcatcgtcctgtgccattagagat

SEQ ID NO: 491643 - DNA, 25 bp, Rattus norvegicus
gtcatcgtgactatgtgtatcttaa

SEQ ID NO: 491644 - DNA, 25 bp, Rattus norvegicus
gtcatcgtgactttgtgtatcttaa

SEQ ID NO: 491645 - DNA, 25 bp, Rattus norvegicus
gtcatcgttaggcaagccactcgga

SEQ ID NO: 491646 - DNA, 25 bp, Rattus norvegicus
gtcatcgttagggaagccactcgga

SEQ ID NO: 491647 - DNA, 25 bp, Rattus norvegicus
gtcatcgtttatctcagtcttggcg

SEQ ID NO: 491648 - DNA, 25 bp, Rattus norvegicus
gtcatcgtttatgtcagtcttggcg

SEQ ID NO: 491649 - DNA, 25 bp, Rattus norvegicus
gtcatcgttttgaattcccactgag

SEQ ID NO: 491650 - DNA, 25 bp, Rattus norvegicus
gtcatcgttttgtattcccactgag

SEQ ID NO: 491651 - DNA, 25 bp, Rattus norvegicus
gtcatctaaacaatgtggaccttgc

SEQ ID NO: 491652 - DNA, 25 bp, Rattus norvegicus
gtcatctaaacattgtggaccttgc

SEQ ID NO: 491653 - DNA, 25 bp, Rattus norvegicus
gtcatctaatggacattggccactt

SEQ ID NO: 491654 - DNA, 25 bp, Rattus norvegicus
gtcatctaatggtcattggccactt

SEQ ID NO: 491655 - DNA, 25 bp, Rattus norvegicus
gtcatctacattcagcgagtccagc

SEQ ID NO: 491656 - DNA, 25 bp, Rattus norvegicus
gtcatctacattgagcgagtccagc

SEQ ID NO: 491657 - DNA, 25 bp, Rattus norvegicus
gtcatctatgcaacaactgtagctg

SEQ ID NO: 491658 - DNA, 25 bp, Rattus norvegicus
gtcatctatgcatcaactgtagctg

SEQ ID NO: 491659 - DNA, 25 bp, Rattus norvegicus
gtcatctcaacgaaacaggcacttc

SEQ ID NO: 491660 - DNA, 25 bp, Rattus norvegicus
gtcatctcaacgtaacaggcacttc

SEQ ID NO: 491661 - DNA, 25 bp, Rattus norvegicus
gtcatctcaaggatctccaagatat

SEQ ID NO: 491662 - DNA, 25 bp, Rattus norvegicus
gtcatctcaaggttctccaagatat

SEQ ID NO: 491663 - DNA, 25 bp, Rattus norvegicus
gtcatctcaggcattcttttctaaa

SEQ ID NO: 491664 - DNA, 25 bp, Rattus norvegicus
gtcatctcaggctttcttttctaaa

SEQ ID NO: 491665 - DNA, 25 bp, Rattus norvegicus
gtcatctcagttagttccattttct

SEQ ID NO: 491666 - DNA, 25 bp, Rattus norvegicus
gtcatctcagtttgttccattttct

SEQ ID NO: 491667 - DNA, 25 bp, Rattus norvegicus
gtcatctccacgagcgtcttatttt

SEQ ID NO: 491668 - DNA, 25 bp, Rattus norvegicus
gtcatctccacgtgcgtcttatttt

SEQ ID NO: 491669 - DNA, 25 bp, Rattus norvegicus
gtcatctccaggctagatttcaatg

SEQ ID NO: 491670 - DNA, 25 bp, Rattus norvegicus
gtcatctccagggtagatttcaatg

SEQ ID NO: 491671 - DNA, 25 bp, Rattus norvegicus
gtcatctccattccatttaaaacac

SEQ ID NO: 491672 - DNA, 25 bp, Rattus norvegicus
gtcatctccattgcatttaaaacac

SEQ ID NO: 491673 - DNA, 25 bp, Rattus norvegicus
gtcatctccctgataacctggcaga

SEQ ID NO: 491674 - DNA, 25 bp, Rattus norvegicus
gtcatctccctgttaacctggcaga

SEQ ID NO: 491675 - DNA, 25 bp, Rattus norvegicus
gtcatctcctgcatcatgtgcgtgt

SEQ ID NO: 491676 - DNA, 25 bp, Rattus norvegicus
gtcatctcctgcttcatgtgcgtgt

SEQ ID NO: 491677 - DNA, 25 bp, Rattus norvegicus
gtcatctcgcagacagacagtcaat

SEQ ID NO: 491678 - DNA, 25 bp, Rattus norvegicus
gtcatctcgcagtcagacagtcaat

SEQ ID NO: 491679 - DNA, 25 bp, Rattus norvegicus
gtcatctctatgaacgcctttttta

SEQ ID NO: 491680 - DNA, 25 bp, Rattus norvegicus
gtcatctctatgtacgcctttttta

SEQ ID NO: 491681 - DNA, 25 bp, Rattus norvegicus
gtcatctctccaacttgtcaatatg

SEQ ID NO: 491682 - DNA, 25 bp, Rattus norvegicus
gtcatctctccatcttgtcaatatg

SEQ ID NO: 491683 - DNA, 25 bp, Rattus norvegicus
gtcatctctcgacttgctttttaaa

SEQ ID NO: 491684 - DNA, 25 bp, Rattus norvegicus
gtcatctctcgagttgctttttaaa

SEQ ID NO: 491685 - DNA, 25 bp, Rattus norvegicus
gtcatctctgtgaggcttgttctgt

SEQ ID NO: 491686 - DNA, 25 bp, Rattus norvegicus
gtcatctctgtgtggcttgttctgt

SEQ ID NO: 491687 - DNA, 25 bp, Rattus norvegicus
gtcatctcttcacccgacatattga

SEQ ID NO: 491688 - DNA, 25 bp, Rattus norvegicus
gtcatctcttcagccgacatattga

SEQ ID NO: 491689 - DNA, 25 bp, Rattus norvegicus
gtcatctgaacccttcatacatggt

SEQ ID NO: 491690 - DNA, 25 bp, Rattus norvegicus
gtcatctgaaccgttcatacatggt

SEQ ID NO: 491691 - DNA, 25 bp, Rattus norvegicus
gtcatctgacagagcatggccctgc

SEQ ID NO: 491692 - DNA, 25 bp, Rattus norvegicus
gtcatctgacagtgcatggccctgc

SEQ ID NO: 491693 - DNA, 25 bp, Rattus norvegicus
gtcatctgacttatgagtgccgcaa

SEQ ID NO: 491694 - DNA, 25 bp, Rattus norvegicus
gtcatctgacttttgagtgccgcaa

SEQ ID NO: 491695 - DNA, 25 bp, Rattus norvegicus
gtcatctgcagcatcatgcatcttt

SEQ ID NO: 491696 - DNA, 25 bp, Rattus norvegicus
gtcatctgcagcttcatgcatcttt

SEQ ID NO: 491697 - DNA, 25 bp, Rattus norvegicus
gtcatctgccttcaactgtgcatga

SEQ ID NO: 491698 - DNA, 25 bp, Rattus norvegicus
gtcatctgccttgaactgtgcatga

SEQ ID NO: 491699 - DNA, 25 bp, Rattus norvegicus
gtcatctgctggaaagtcttgtgta

SEQ ID NO: 491700 - DNA, 25 bp, Rattus norvegicus
gtcatctgctggtaagtcttgtgta

SEQ ID NO: 491701 - DNA, 25 bp, Rattus norvegicus
gtcatctgcttactgagctagaaac

SEQ ID NO: 491702 - DNA, 25 bp, Rattus norvegicus
gtcatctgcttagtgagctagaaac

SEQ ID NO: 491703 - DNA, 25 bp, Rattus norvegicus
gtcatctggaatcaggtgcaccaca

SEQ ID NO: 491704 - DNA, 25 bp, Rattus norvegicus
gtcatctggaatgaggtgcaccaca

SEQ ID NO: 491705 - DNA, 25 bp, Rattus norvegicus
gtcatctgtaacaccattttctctt

SEQ ID NO: 491706 - DNA, 25 bp, Rattus norvegicus
gtcatctgtaactccattttctctt

SEQ ID NO: 491707 - DNA, 25 bp, Rattus norvegicus
gtcatctgtgacagtgtttcttaga

SEQ ID NO: 491708 - DNA, 25 bp, Rattus norvegicus
gtcatctgtgactgtgtttcttaga

SEQ ID NO: 491709 - DNA, 25 bp, Rattus norvegicus
gtcatctgtggaactcagtcaagtt

SEQ ID NO: 491710 - DNA, 25 bp, Rattus norvegicus
gtcatctgtggatctcagtcaagtt

SEQ ID NO: 491711 - DNA, 25 bp, Rattus norvegicus
gtcatctgtggtcgacatgtcgcta

SEQ ID NO: 491712 - DNA, 25 bp, Rattus norvegicus
gtcatctgtggtggacatgtcgcta

SEQ ID NO: 491713 - DNA, 25 bp, Rattus norvegicus
gtcatcttacccaaagcacttttca

SEQ ID NO: 491714 - DNA, 25 bp, Rattus norvegicus
gtcatcttaccctaagcacttttca

SEQ ID NO: 491715 - DNA, 25 bp, Rattus norvegicus
gtcatcttacttaaccttttagcca

SEQ ID NO: 491716 - DNA, 25 bp, Rattus norvegicus
gtcatcttactttaccttttagcca

SEQ ID NO: 491717 - DNA, 25 bp, Rattus norvegicus
gtcatcttatgaccactggttcctt

SEQ ID NO: 491718 - DNA, 25 bp, Rattus norvegicus
gtcatcttatgagcactggttcctt

SEQ ID NO: 491719 - DNA, 25 bp, Rattus norvegicus
gtcatcttcattctttctgttcaca

SEQ ID NO: 491720 - DNA, 25 bp, Rattus norvegicus
gtcatcttcattgtttctgttcaca

SEQ ID NO: 491721 - DNA, 25 bp, Rattus norvegicus
gtcatcttccccatagtccaggaag

SEQ ID NO: 491722 - DNA, 25 bp, Rattus norvegicus
gtcatcttccccttagtccaggaag

SEQ ID NO: 491723 - DNA, 25 bp, Rattus norvegicus
gtcatcttctgccacatggtttgaa

SEQ ID NO: 491724 - DNA, 25 bp, Rattus norvegicus
gtcatcttctgcgacatggtttgaa

SEQ ID NO: 491725 - DNA, 25 bp, Rattus norvegicus
gtcatcttgacacatgtgaaccttt

SEQ ID NO: 491726 - DNA, 25 bp, Rattus norvegicus
gtcatcttgacagatgtgaaccttt

SEQ ID NO: 491727 - DNA, 25 bp, Rattus norvegicus
gtcatcttgcctaaaacagacggaa

SEQ ID NO: 491728 - DNA, 25 bp, Rattus norvegicus
gtcatcttgccttaaacagacggaa

SEQ ID NO: 491729 - DNA, 25 bp, Rattus norvegicus
gtcatcttgggacaaacctagccta

SEQ ID NO: 491730 - DNA, 25 bp, Rattus norvegicus
gtcatcttgggagaaacctagccta

SEQ ID NO: 491731 - DNA, 25 bp, Rattus norvegicus
gtcatcttgtacaaggaggcccaca

SEQ ID NO: 491732 - DNA, 25 bp, Rattus norvegicus
gtcatcttgtacctgattctttgtg

SEQ ID NO: 491733 - DNA, 25 bp, Rattus norvegicus
gtcatcttgtacgtgattctttgtg

SEQ ID NO: 491734 - DNA, 25 bp, Rattus norvegicus
gtcatcttgtactaggaggcccaca

SEQ ID NO: 491735 - DNA, 25 bp, Rattus norvegicus
gtcatcttgtccaatccgaaagctg

SEQ ID NO: 491736 - DNA, 25 bp, Rattus norvegicus
gtcatcttgtcctatccgaaagctg

SEQ ID NO: 491737 - DNA, 25 bp, Rattus norvegicus
gtcatctttaatcagcctctgagct

SEQ ID NO: 491738 - DNA, 25 bp, Rattus norvegicus
gtcatctttaatgagcctctgagct

SEQ ID NO: 491739 - DNA, 25 bp, Rattus norvegicus
gtcatctttcttcaatttcttttca

SEQ ID NO: 491740 - DNA, 25 bp, Rattus norvegicus
gtcatctttcttgaatttcttttca

SEQ ID NO: 491741 - DNA, 25 bp, Rattus norvegicus
gtcatctttgttctcgaagactgac

SEQ ID NO: 491742 - DNA, 25 bp, Rattus norvegicus
gtcatctttgttgtcgaagactgac

SEQ ID NO: 491743 - DNA, 25 bp, Rattus norvegicus
gtcatcttttacaacttcgggaaca

SEQ ID NO: 491744 - DNA, 25 bp, Rattus norvegicus
gtcatcttttactacttcgggaaca

SEQ ID NO: 491745 - DNA, 25 bp, Rattus norvegicus
gtcatgaaattgctgtgtggtcaca

SEQ ID NO: 491746 - DNA, 25 bp, Rattus norvegicus
gtcatgaaattggtgtgtggtcaca

SEQ ID NO: 491747 - DNA, 25 bp, Rattus norvegicus
gtcatgaactgtcaacttggctcaa

SEQ ID NO: 491748 - DNA, 25 bp, Rattus norvegicus
gtcatgaactgtgaacttggctcaa

SEQ ID NO: 491749 - DNA, 25 bp, Rattus norvegicus
gtcatgaagaaactcaagcccttgt

SEQ ID NO: 491750 - DNA, 25 bp, Rattus norvegicus
gtcatgaagaaagtcaagcccttgt

SEQ ID NO: 491751 - DNA, 25 bp, Rattus norvegicus
gtcatgaagagcacctgtgcttcca

SEQ ID NO: 491752 - DNA, 25 bp, Rattus norvegicus
gtcatgaagagctcctgtgcttcca

SEQ ID NO: 491753 - DNA, 25 bp, Rattus norvegicus
gtcatgaatgataaggcaccggctt

SEQ ID NO: 491754 - DNA, 25 bp, Rattus norvegicus
gtcatgaatgattaggcaccggctt

SEQ ID NO: 491755 - DNA, 25 bp, Rattus norvegicus
gtcatgacccacaagttctagaatg

SEQ ID NO: 491756 - DNA, 25 bp, Rattus norvegicus
gtcatgacccactagttctagaatg

SEQ ID NO: 491757 - DNA, 25 bp, Rattus norvegicus
gtcatgaccccaatctttcaaagaa

SEQ ID NO: 491758 - DNA, 25 bp, Rattus norvegicus
gtcatgaccccattctttcaaagaa

SEQ ID NO: 491759 - DNA, 25 bp, Rattus norvegicus
gtcatgaccggtacgagcgactcac

SEQ ID NO: 491760 - DNA, 25 bp, Rattus norvegicus
gtcatgaccggttcgagcgactcac

SEQ ID NO: 491761 - DNA, 25 bp, Rattus norvegicus
gtcatgacctttactcaaagctgta

SEQ ID NO: 491762 - DNA, 25 bp, Rattus norvegicus
gtcatgaccttttctcaaagctgta

SEQ ID NO: 491763 - DNA, 25 bp, Rattus norvegicus
gtcatgactatcatgcactgatgca

SEQ ID NO: 491764 - DNA, 25 bp, Rattus norvegicus
gtcatgactatcttgcactgatgca

SEQ ID NO: 491765 - DNA, 25 bp, Rattus norvegicus
gtcatgataacgaaggacactgaga

SEQ ID NO: 491766 - DNA, 25 bp, Rattus norvegicus
gtcatgataacgtaggacactgaga

SEQ ID NO: 491767 - DNA, 25 bp, Rattus norvegicus
gtcatgatccgtccatggtctccat

SEQ ID NO: 491768 - DNA, 25 bp, Rattus norvegicus
gtcatgatccgtgcatggtctccat

SEQ ID NO: 491769 - DNA, 25 bp, Rattus norvegicus
gtcatgatgcagacttcaggatgtt

SEQ ID NO: 491770 - DNA, 25 bp, Rattus norvegicus
gtcatgatgcagtcttcaggatgtt

SEQ ID NO: 491771 - DNA, 25 bp, Rattus norvegicus
gtcatgatgtcaaggtcaccttata

SEQ ID NO: 491772 - DNA, 25 bp, Rattus norvegicus
gtcatgatgtcatggtcaccttata

SEQ ID NO: 491773 - DNA, 25 bp, Rattus norvegicus
gtcatgatgtctctgtgaatccctc

SEQ ID NO: 491774 - DNA, 25 bp, Rattus norvegicus
gtcatgatgtctgtgtgaatccctc

SEQ ID NO: 491775 - DNA, 25 bp, Rattus norvegicus
gtcatgattacaattgtctccctca

SEQ ID NO: 491776 - DNA, 25 bp, Rattus norvegicus
gtcatgattacatttgtctccctca

SEQ ID NO: 491777 - DNA, 25 bp, Rattus norvegicus
gtcatgattgcacactacagacctg

SEQ ID NO: 491778 - DNA, 25 bp, Rattus norvegicus
gtcatgattgcagactacagacctg

SEQ ID NO: 491779 - DNA, 25 bp, Rattus norvegicus
gtcatgcaagagcaccctaccaggg

SEQ ID NO: 491780 - DNA, 25 bp, Rattus norvegicus
gtcatgcaagaggaccctaccaggg

SEQ ID NO: 491781 - DNA, 25 bp, Rattus norvegicus
gtcatgcacggacataccaggtttg

SEQ ID NO: 491782 - DNA, 25 bp, Rattus norvegicus
gtcatgcacggagataccaggtttg

SEQ ID NO: 491783 - DNA, 25 bp, Rattus norvegicus
gtcatgcagaacagaacccaactag

SEQ ID NO: 491784 - DNA, 25 bp, Rattus norvegicus
gtcatgcagaactgaacccaactag

SEQ ID NO: 491785 - DNA, 25 bp, Rattus norvegicus
gtcatgcaggctatactttaagggt

SEQ ID NO: 491786 - DNA, 25 bp, Rattus norvegicus
gtcatgcaggctttactttaagggt

SEQ ID NO: 491787 - DNA, 25 bp, Rattus norvegicus
gtcatgcatagccttcagtcggaag

SEQ ID NO: 491788 - DNA, 25 bp, Rattus norvegicus
gtcatgcatagcgttcagtcggaag

SEQ ID NO: 491789 - DNA, 25 bp, Rattus norvegicus
gtcatgcatgggatgttcagcttgg

SEQ ID NO: 491790 - DNA, 25 bp, Rattus norvegicus
gtcatgcatgggttgttcagcttgg

SEQ ID NO: 491791 - DNA, 25 bp, Rattus norvegicus
gtcatgccaagcaggagctgacaca

SEQ ID NO: 491792 - DNA, 25 bp, Rattus norvegicus
gtcatgccaagctggagctgacaca

SEQ ID NO: 491793 - DNA, 25 bp, Rattus norvegicus
gtcatgccatgtcggaggcacatca

SEQ ID NO: 491794 - DNA, 25 bp, Rattus norvegicus
gtcatgccatgtgggaggcacatca

SEQ ID NO: 491795 - DNA, 25 bp, Rattus norvegicus
gtcatgcccatgcttccattatgaa

SEQ ID NO: 491796 - DNA, 25 bp, Rattus norvegicus
gtcatgcccatggttccattatgaa

SEQ ID NO: 491797 - DNA, 25 bp, Rattus norvegicus
gtcatgcctcaccagcagtgtgctc

SEQ ID NO: 491798 - DNA, 25 bp, Rattus norvegicus
gtcatgcctcacgagcagtgtgctc

SEQ ID NO: 491799 - DNA, 25 bp, Rattus norvegicus
gtcatgcctctgattggtggtaaag

SEQ ID NO: 491800 - DNA, 25 bp, Rattus norvegicus
gtcatgcctctgtttggtggtaaag

SEQ ID NO: 491801 - DNA, 25 bp, Rattus norvegicus
gtcatgcctcttcttcaaatttttc

SEQ ID NO: 491802 - DNA, 25 bp, Rattus norvegicus
gtcatgcctcttgttcaaatttttc

SEQ ID NO: 491803 - DNA, 25 bp, Rattus norvegicus
gtcatgcctggtacagtgtctactg

SEQ ID NO: 491804 - DNA, 25 bp, Rattus norvegicus
gtcatgcctggttcagtgtctactg

SEQ ID NO: 491805 - DNA, 25 bp, Rattus norvegicus
gtcatgcctgtcacagttaacttgt

SEQ ID NO: 491806 - DNA, 25 bp, Rattus norvegicus
gtcatgcctgtctcagttaacttgt

SEQ ID NO: 491807 - DNA, 25 bp, Rattus norvegicus
gtcatgcgcatgactctgagtttgt

SEQ ID NO: 491808 - DNA, 25 bp, Rattus norvegicus
gtcatgcgcatgtctctgagtttgt

SEQ ID NO: 491809 - DNA, 25 bp, Rattus norvegicus
gtcatgcgtgtgatggccttgcttc

SEQ ID NO: 491810 - DNA, 25 bp, Rattus norvegicus
gtcatgcgtgtgttggccttgcttc

SEQ ID NO: 491811 - DNA, 25 bp, Rattus norvegicus
gtcatgctagggaaaaatcttcagt

SEQ ID NO: 491812 - DNA, 25 bp, Rattus norvegicus
gtcatgctagggtaaaatcttcagt

SEQ ID NO: 491813 - DNA, 25 bp, Rattus norvegicus
gtcatgctagttcggtcagtcacag

SEQ ID NO: 491814 - DNA, 25 bp, Rattus norvegicus
gtcatgctagttgggtcagtcacag

SEQ ID NO: 491815 - DNA, 25 bp, Rattus norvegicus
gtcatgctcagcataggtgctcgct

SEQ ID NO: 491816 - DNA, 25 bp, Rattus norvegicus
gtcatgctcagcttaggtgctcgct

SEQ ID NO: 491817 - DNA, 25 bp, Rattus norvegicus
gtcatgctgaacattcctcagtttt

SEQ ID NO: 491818 - DNA, 25 bp, Rattus norvegicus
gtcatgctgaactttcctcagtttt

SEQ ID NO: 491819 - DNA, 25 bp, Rattus norvegicus
gtcatgctgcctcactttataaaaa

SEQ ID NO: 491820 - DNA, 25 bp, Rattus norvegicus
gtcatgctgcctgactttataaaaa

SEQ ID NO: 491821 - DNA, 25 bp, Rattus norvegicus
gtcatgctgctgactgtatttttat

SEQ ID NO: 491822 - DNA, 25 bp, Rattus norvegicus
gtcatgctgctgtctgtatttttat

SEQ ID NO: 491823 - DNA, 25 bp, Rattus norvegicus
gtcatgctgtgcacgagtaccaata

SEQ ID NO: 491824 - DNA, 25 bp, Rattus norvegicus
gtcatgctgtgctcgagtaccaata

SEQ ID NO: 491825 - DNA, 25 bp, Rattus norvegicus
gtcatgctttgacttgatgtcccag

SEQ ID NO: 491826 - DNA, 25 bp, Rattus norvegicus
gtcatgctttgagttgatgtcccag

SEQ ID NO: 491827 - DNA, 25 bp, Rattus norvegicus
gtcatggacagtcgctatttctgat

SEQ ID NO: 491828 - DNA, 25 bp, Rattus norvegicus
gtcatggacagtggctatttctgat

SEQ ID NO: 491829 - DNA, 25 bp, Rattus norvegicus
gtcatggaccacaccacacttaaaa

SEQ ID NO: 491830 - DNA, 25 bp, Rattus norvegicus
gtcatggaccactccacacttaaaa

SEQ ID NO: 491831 - DNA, 25 bp, Rattus norvegicus
gtcatggaccatacgtgtcaagaat

SEQ ID NO: 491832 - DNA, 25 bp, Rattus norvegicus
gtcatggaccattcgtgtcaagaat

SEQ ID NO: 491833 - DNA, 25 bp, Rattus norvegicus
gtcatggagacaccaggcctagact

SEQ ID NO: 491834 - DNA, 25 bp, Rattus norvegicus
gtcatggagacagcaggcctagact

SEQ ID NO: 491835 - DNA, 25 bp, Rattus norvegicus
gtcatggagaccatcgctgtgggtt

SEQ ID NO: 491836 - DNA, 25 bp, Rattus norvegicus
gtcatggagaccttcgctgtgggtt

SEQ ID NO: 491837 - DNA, 25 bp, Rattus norvegicus
gtcatggagattccagacacctctg

SEQ ID NO: 491838 - DNA, 25 bp, Rattus norvegicus
gtcatggagattgcagacacctctg

SEQ ID NO: 491839 - DNA, 25 bp, Rattus norvegicus
gtcatggaggctctaaccatcagct

SEQ ID NO: 491840 - DNA, 25 bp, Rattus norvegicus
gtcatggaggctgtaaccatcagct

SEQ ID NO: 491841 - DNA, 25 bp, Rattus norvegicus
gtcatggatgcactgggtcctatct

SEQ ID NO: 491842 - DNA, 25 bp, Rattus norvegicus
gtcatggatgcagtgggtcctatct

SEQ ID NO: 491843 - DNA, 25 bp, Rattus norvegicus
gtcatggctctaaaatttcctgttg

SEQ ID NO: 491844 - DNA, 25 bp, Rattus norvegicus
gtcatggctctataatttcctgttg

SEQ ID NO: 491845 - DNA, 25 bp, Rattus norvegicus
gtcatggctctccaacaaaggcatt

SEQ ID NO: 491846 - DNA, 25 bp, Rattus norvegicus
gtcatggctctcgaacaaaggcatt

SEQ ID NO: 491847 - DNA, 25 bp, Rattus norvegicus
gtcatggctgcccacgaaaaggata

SEQ ID NO: 491848 - DNA, 25 bp, Rattus norvegicus
gtcatggctgccgacgaaaaggata

SEQ ID NO: 491849 - DNA, 25 bp, Rattus norvegicus
gtcatggcttgacttcatctgaaaa

SEQ ID NO: 491850 - DNA, 25 bp, Rattus norvegicus
gtcatggcttgagttcatctgaaaa

SEQ ID NO: 491851 - DNA, 25 bp, Rattus norvegicus
gtcatggcttgcaaccagcggagat

SEQ ID NO: 491852 - DNA, 25 bp, Rattus norvegicus
gtcatggcttgctaccagcggagat

SEQ ID NO: 491853 - DNA, 25 bp, Rattus norvegicus
gtcatgggcgtgatcgtactgtgct

SEQ ID NO: 491854 - DNA, 25 bp, Rattus norvegicus
gtcatgggcgtgttcgtactgtgct

SEQ ID NO: 491855 - DNA, 25 bp, Rattus norvegicus
gtcatgggcttccatagcagcagca

SEQ ID NO: 491856 - DNA, 25 bp, Rattus norvegicus
gtcatgggcttcgatagcagcagca

SEQ ID NO: 491857 - DNA, 25 bp, Rattus norvegicus
gtcatgggtggtctggttacataca

SEQ ID NO: 491858 - DNA, 25 bp, Rattus norvegicus
gtcatgggtggtgtggttacataca

SEQ ID NO: 491859 - DNA, 25 bp, Rattus norvegicus
gtcatgggttgtattctttgaagct

SEQ ID NO: 491860 - DNA, 25 bp, Rattus norvegicus
gtcatgggttgttttctttgaagct

SEQ ID NO: 491861 - DNA, 25 bp, Rattus norvegicus
gtcatggtataactgtctctgagag

SEQ ID NO: 491862 - DNA, 25 bp, Rattus norvegicus
gtcatggtataagtgtctctgagag

SEQ ID NO: 491863 - DNA, 25 bp, Rattus norvegicus
gtcatggtatttcggctaaaggcct

SEQ ID NO: 491864 - DNA, 25 bp, Rattus norvegicus
gtcatggtatttgggctaaaggcct

SEQ ID NO: 491865 - DNA, 25 bp, Rattus norvegicus
gtcatggtcagtcaaacatctcctt

SEQ ID NO: 491866 - DNA, 25 bp, Rattus norvegicus
gtcatggtcagtgaaacatctcctt

SEQ ID NO: 491867 - DNA, 25 bp, Rattus norvegicus
gtcatggtgaacaggcttgtacatt

SEQ ID NO: 491868 - DNA, 25 bp, Rattus norvegicus
gtcatggtgaactggcttgtacatt

SEQ ID NO: 491869 - DNA, 25 bp, Rattus norvegicus
gtcatggtgagcagtcttcgtccgt

SEQ ID NO: 491870 - DNA, 25 bp, Rattus norvegicus
gtcatggtgagctgtcttcgtccgt

SEQ ID NO: 491871 - DNA, 25 bp, Rattus norvegicus
gtcatggttcatacttacttcaaag

SEQ ID NO: 491872 - DNA, 25 bp, Rattus norvegicus
gtcatggttcattcttacttcaaag

SEQ ID NO: 491873 - DNA, 25 bp, Rattus norvegicus
gtcatgtaaacaatcaactccaccc

SEQ ID NO: 491874 - DNA, 25 bp, Rattus norvegicus
gtcatgtaaacattcaactccaccc

SEQ ID NO: 491875 - DNA, 25 bp, Rattus norvegicus
gtcatgtaaactatgtgggctcctc

SEQ ID NO: 491876 - DNA, 25 bp, Rattus norvegicus
gtcatgtaaactttgtgggctcctc

SEQ ID NO: 491877 - DNA, 25 bp, Rattus norvegicus
gtcatgtaatcaattggcggcatac

SEQ ID NO: 491878 - DNA, 25 bp, Rattus norvegicus
gtcatgtaatcatttggcggcatac

SEQ ID NO: 491879 - DNA, 25 bp, Rattus norvegicus
gtcatgtacatgatctttgtattgt

SEQ ID NO: 491880 - DNA, 25 bp, Rattus norvegicus
gtcatgtacatgttctttgtattgt

SEQ ID NO: 491881 - DNA, 25 bp, Rattus norvegicus
gtcatgtatctaatgccttctctat

SEQ ID NO: 491882 - DNA, 25 bp, Rattus norvegicus
gtcatgtatctattgccttctctat

SEQ ID NO: 491883 - DNA, 25 bp, Rattus norvegicus
gtcatgtcatgtccagagttcctac

SEQ ID NO: 491884 - DNA, 25 bp, Rattus norvegicus
gtcatgtcatgtgcagagttcctac

SEQ ID NO: 491885 - DNA, 25 bp, Rattus norvegicus
gtcatgtcattgacctttaacgtgt

SEQ ID NO: 491886 - DNA, 25 bp, Rattus norvegicus
gtcatgtcattgtcctttaacgtgt

SEQ ID NO: 491887 - DNA, 25 bp, Rattus norvegicus
gtcatgtccaaaattcaattttcca

SEQ ID NO: 491888 - DNA, 25 bp, Rattus norvegicus
gtcatgtccaaatttcaattttcca

SEQ ID NO: 491889 - DNA, 25 bp, Rattus norvegicus
gtcatgtccattaactcaattcacg

SEQ ID NO: 491890 - DNA, 25 bp, Rattus norvegicus
gtcatgtccatttactcaattcacg

SEQ ID NO: 491891 - DNA, 25 bp, Rattus norvegicus
gtcatgtccccacaggaggagtctt

SEQ ID NO: 491892 - DNA, 25 bp, Rattus norvegicus
gtcatgtccccagaggaggagtctt

SEQ ID NO: 491893 - DNA, 25 bp, Rattus norvegicus
gtcatgtccgcgctgttctgcgatc

SEQ ID NO: 491894 - DNA, 25 bp, Rattus norvegicus
gtcatgtccgcggtgttctgcgatc

SEQ ID NO: 491895 - DNA, 25 bp, Rattus norvegicus
gtcatgtctcatctgctaaggcttt

SEQ ID NO: 491896 - DNA, 25 bp, Rattus norvegicus
gtcatgtctcatgtgctaaggcttt

SEQ ID NO: 491897 - DNA, 25 bp, Rattus norvegicus
gtcatgtctgtaaaggcaaccgttc

SEQ ID NO: 491898 - DNA, 25 bp, Rattus norvegicus
gtcatgtctgtataggcaaccgttc

SEQ ID NO: 491899 - DNA, 25 bp, Rattus norvegicus
gtcatgtgactaaatcctctacgta

SEQ ID NO: 491900 - DNA, 25 bp, Rattus norvegicus
gtcatgtgactatatcctctacgta

SEQ ID NO: 491901 - DNA, 25 bp, Rattus norvegicus
gtcatgtgatccactcatcagttac

SEQ ID NO: 491902 - DNA, 25 bp, Rattus norvegicus
gtcatgtgatcctctcatcagttac

SEQ ID NO: 491903 - DNA, 25 bp, Rattus norvegicus
gtcatgtgcataaagattctcagaa

SEQ ID NO: 491904 - DNA, 25 bp, Rattus norvegicus
gtcatgtgcatatagattctcagaa

SEQ ID NO: 491905 - DNA, 25 bp, Rattus norvegicus
gtcatgtgcgtacctaagacgactt

SEQ ID NO: 491906 - DNA, 25 bp, Rattus norvegicus
gtcatgtgcgtagctaagacgactt

SEQ ID NO: 491907 - DNA, 25 bp, Rattus norvegicus
gtcatgtggaaaagtcctcattttt

SEQ ID NO: 491908 - DNA, 25 bp, Rattus norvegicus
gtcatgtggaaatgtcctcattttt

SEQ ID NO: 491909 - DNA, 25 bp, Rattus norvegicus
gtcatgtggattcaatttctctgaa

SEQ ID NO: 491910 - DNA, 25 bp, Rattus norvegicus
gtcatgtggattgaatttctctgaa

SEQ ID NO: 491911 - DNA, 25 bp, Rattus norvegicus
gtcatgtggttgcttgccgcactgc

SEQ ID NO: 491912 - DNA, 25 bp, Rattus norvegicus
gtcatgtggttggttgccgcactgc

SEQ ID NO: 491913 - DNA, 25 bp, Rattus norvegicus
gtcatgtgtgccatgctttaccaaa

SEQ ID NO: 491914 - DNA, 25 bp, Rattus norvegicus
gtcatgtgtgccttgctttaccaaa

SEQ ID NO: 491915 - DNA, 25 bp, Rattus norvegicus
gtcatgttcatgagtgtccgtgccc

SEQ ID NO: 491916 - DNA, 25 bp, Rattus norvegicus
gtcatgttcatgtgtgtccgtgccc

SEQ ID NO: 491917 - DNA, 25 bp, Rattus norvegicus
gtcatgttcattcattaccaccaac

SEQ ID NO: 491918 - DNA, 25 bp, Rattus norvegicus
gtcatgttcattgattaccaccaac

SEQ ID NO: 491919 - DNA, 25 bp, Rattus norvegicus
gtcatgttctcaaagtattgcttat

SEQ ID NO: 491920 - DNA, 25 bp, Rattus norvegicus
gtcatgttctcatagtattgcttat

SEQ ID NO: 491921 - DNA, 25 bp, Rattus norvegicus
gtcatgttggcgagctatttcctta

SEQ ID NO: 491922 - DNA, 25 bp, Rattus norvegicus
gtcatgttggcgtgctatttcctta

SEQ ID NO: 491923 - DNA, 25 bp, Rattus norvegicus
gtcatgtttagacagccacacaggg

SEQ ID NO: 491924 - DNA, 25 bp, Rattus norvegicus
gtcatgtttagagagccacacaggg

SEQ ID NO: 491925 - DNA, 25 bp, Rattus norvegicus
gtcatgtttttcacagtttctatca

SEQ ID NO: 491926 - DNA, 25 bp, Rattus norvegicus
gtcatgtttttctcagtttctatca

SEQ ID NO: 491927 - DNA, 25 bp, Rattus norvegicus
gtcattaaacatccaccactggatg

SEQ ID NO: 491928 - DNA, 25 bp, Rattus norvegicus
gtcattaaacatgcaccactggatg

SEQ ID NO: 491929 - DNA, 25 bp, Rattus norvegicus
gtcattaaatggcacagtatctaat

SEQ ID NO: 491930 - DNA, 25 bp, Rattus norvegicus
gtcattaaatgggacagtatctaat

SEQ ID NO: 491931 - DNA, 25 bp, Rattus norvegicus
gtcattaaccacaaccgcatgaggg

SEQ ID NO: 491932 - DNA, 25 bp, Rattus norvegicus
gtcattaaccactaccgcatgaggg

SEQ ID NO: 491933 - DNA, 25 bp, Rattus norvegicus
gtcattaaggtaacgcagtccccac

SEQ ID NO: 491934 - DNA, 25 bp, Rattus norvegicus
gtcattaaggtatcgcagtccccac

SEQ ID NO: 491935 - DNA, 25 bp, Rattus norvegicus
gtcattacaagtccatgctcgtcta

SEQ ID NO: 491936 - DNA, 25 bp, Rattus norvegicus
gtcattacaagtgcatgctcgtcta

SEQ ID NO: 491937 - DNA, 25 bp, Rattus norvegicus
gtcattactctgactactgttggaa

SEQ ID NO: 491938 - DNA, 25 bp, Rattus norvegicus
gtcattactctgtctactgttggaa

SEQ ID NO: 491939 - DNA, 25 bp, Rattus norvegicus
gtcattactggtaacacgcaagccg

SEQ ID NO: 491940 - DNA, 25 bp, Rattus norvegicus
gtcattactggttacacgcaagccg

SEQ ID NO: 491941 - DNA, 25 bp, Rattus norvegicus
gtcattaggcaaaatccaaacagga

SEQ ID NO: 491942 - DNA, 25 bp, Rattus norvegicus
gtcattaggcaatatccaaacagga

SEQ ID NO: 491943 - DNA, 25 bp, Rattus norvegicus
gtcattatatgtacttcccttcatc

SEQ ID NO: 491944 - DNA, 25 bp, Rattus norvegicus
gtcattatatgttcttcccttcatc

SEQ ID NO: 491945 - DNA, 25 bp, Rattus norvegicus
gtcattatgtatatgcccagttcag

SEQ ID NO: 491946 - DNA, 25 bp, Rattus norvegicus
gtcattatgtatttgcccagttcag

SEQ ID NO: 491947 - DNA, 25 bp, Rattus norvegicus
gtcattatgtccacagtggtgtgaa

SEQ ID NO: 491948 - DNA, 25 bp, Rattus norvegicus
gtcattatgtcctcagtggtgtgaa

SEQ ID NO: 491949 - DNA, 25 bp, Rattus norvegicus
gtcattatttcacgaaagccctttg

SEQ ID NO: 491950 - DNA, 25 bp, Rattus norvegicus
gtcattatttcaggaaagccctttg

SEQ ID NO: 491951 - DNA, 25 bp, Rattus norvegicus
gtcattatttgcctttatctcccat

SEQ ID NO: 491952 - DNA, 25 bp, Rattus norvegicus
gtcattatttgcgtttatctcccat

SEQ ID NO: 491953 - DNA, 25 bp, Rattus norvegicus
gtcattcaaattatccctcttctgt

SEQ ID NO: 491954 - DNA, 25 bp, Rattus norvegicus
gtcattcaaattttccctcttctgt

SEQ ID NO: 491955 - DNA, 25 bp, Rattus norvegicus
gtcattcaagtgcatgtggccccat

SEQ ID NO: 491956 - DNA, 25 bp, Rattus norvegicus
gtcattcaagtggatgtggccccat

SEQ ID NO: 491957 - DNA, 25 bp, Rattus norvegicus
gtcattcaagttaccatctgcttta

SEQ ID NO: 491958 - DNA, 25 bp, Rattus norvegicus
gtcattcaagtttccatctgcttta

SEQ ID NO: 491959 - DNA, 25 bp, Rattus norvegicus
gtcattcaatgcatggcgtctcaaa

SEQ ID NO: 491960 - DNA, 25 bp, Rattus norvegicus
gtcattcaatgcttggcgtctcaaa

SEQ ID NO: 491961 - DNA, 25 bp, Rattus norvegicus
gtcattcacaccactgatgggaagt

SEQ ID NO: 491962 - DNA, 25 bp, Rattus norvegicus
gtcattcacacctctgatgggaagt

SEQ ID NO: 491963 - DNA, 25 bp, Rattus norvegicus
gtcattcacggaacattgttcttgt

SEQ ID NO: 491964 - DNA, 25 bp, Rattus norvegicus
gtcattcacggatcattgttcttgt

SEQ ID NO: 491965 - DNA, 25 bp, Rattus norvegicus
gtcattcagatgatagacccctggc

SEQ ID NO: 491966 - DNA, 25 bp, Rattus norvegicus
gtcattcagatgttagacccctggc

SEQ ID NO: 491967 - DNA, 25 bp, Rattus norvegicus
gtcattcagcttatagcagcagagc

SEQ ID NO: 491968 - DNA, 25 bp, Rattus norvegicus
gtcattcagcttcaaggcgaccaaa

SEQ ID NO: 491969 - DNA, 25 bp, Rattus norvegicus
gtcattcagcttgaaggcgaccaaa

SEQ ID NO: 491970 - DNA, 25 bp, Rattus norvegicus
gtcattcagcttttagcagcagagc

SEQ ID NO: 491971 - DNA, 25 bp, Rattus norvegicus
gtcattcaggaacagagaagctagt

SEQ ID NO: 491972 - DNA, 25 bp, Rattus norvegicus
gtcattcaggaagagagaagctagt

SEQ ID NO: 491973 - DNA, 25 bp, Rattus norvegicus
gtcattcaggttcacttcaatgtga

SEQ ID NO: 491974 - DNA, 25 bp, Rattus norvegicus
gtcattcaggttgacttcaatgtga

SEQ ID NO: 491975 - DNA, 25 bp, Rattus norvegicus
gtcattcagtgacattacctgccac

SEQ ID NO: 491976 - DNA, 25 bp, Rattus norvegicus
gtcattcagtgagattacctgccac

SEQ ID NO: 491977 - DNA, 25 bp, Rattus norvegicus
gtcattcatgcacacagcacgcctg

SEQ ID NO: 491978 - DNA, 25 bp, Rattus norvegicus
gtcattcatgcagacagcacgcctg

SEQ ID NO: 491979 - DNA, 25 bp, Rattus norvegicus
gtcattcatgctcttcctgaactga

SEQ ID NO: 491980 - DNA, 25 bp, Rattus norvegicus
gtcattcatgctgttcctgaactga

SEQ ID NO: 491981 - DNA, 25 bp, Rattus norvegicus
gtcattcatggaaggtgtcttactc

SEQ ID NO: 491982 - DNA, 25 bp, Rattus norvegicus
gtcattcatggatggtgtcttactc

SEQ ID NO: 491983 - DNA, 25 bp, Rattus norvegicus
gtcattcattctaggtgttgtctgc

SEQ ID NO: 491984 - DNA, 25 bp, Rattus norvegicus
gtcattcattcttggtgttgtctgc

SEQ ID NO: 491985 - DNA, 25 bp, Rattus norvegicus
gtcattccaagacagcagtgctcct

SEQ ID NO: 491986 - DNA, 25 bp, Rattus norvegicus
gtcattccaagagagcagtgctcct

SEQ ID NO: 491987 - DNA, 25 bp, Rattus norvegicus
gtcattcccaggagattctattaaa

SEQ ID NO: 491988 - DNA, 25 bp, Rattus norvegicus
gtcattcccaggtgattctattaaa

SEQ ID NO: 491989 - DNA, 25 bp, Rattus norvegicus
gtcattcccataagagcaaggctcc

SEQ ID NO: 491990 - DNA, 25 bp, Rattus norvegicus
gtcattcccatatgagcaaggctcc

SEQ ID NO: 491991 - DNA, 25 bp, Rattus norvegicus
gtcattcccatgagtcccaaaatca

SEQ ID NO: 491992 - DNA, 25 bp, Rattus norvegicus
gtcattcccatgtgtcccaaaatca

SEQ ID NO: 491993 - DNA, 25 bp, Rattus norvegicus
gtcattcccattcttttcgtttaga

SEQ ID NO: 491994 - DNA, 25 bp, Rattus norvegicus
gtcattcccattgttttcgtttaga

SEQ ID NO: 491995 - DNA, 25 bp, Rattus norvegicus
gtcattccccaaagtgcttttgtca

SEQ ID NO: 491996 - DNA, 25 bp, Rattus norvegicus
gtcattccccaatgtgcttttgtca

SEQ ID NO: 491997 - DNA, 25 bp, Rattus norvegicus
gtcattcccggactcacatgtacag

SEQ ID NO: 491998 - DNA, 25 bp, Rattus norvegicus
gtcattcccggagtcacatgtacag

SEQ ID NO: 491999 - DNA, 25 bp, Rattus norvegicus
gtcattccctgcagtggaaacagtt

SEQ ID NO: 492000 - DNA, 25 bp, Rattus norvegicus
gtcattccctgctgtggaaacagtt

SEQ ID NO: 492001 - DNA, 25 bp, Rattus norvegicus
gtcattccctggacagagacgttaa

SEQ ID NO: 492002 - DNA, 25 bp, Rattus norvegicus
gtcattccctggtcagagacgttaa

SEQ ID NO: 492003 - DNA, 25 bp, Rattus norvegicus
gtcattccgaacctaatgtgtttct

SEQ ID NO: 492004 - DNA, 25 bp, Rattus norvegicus
gtcattccgaacgtaatgtgtttct

SEQ ID NO: 492005 - DNA, 25 bp, Rattus norvegicus
gtcattccgccgcattgtggagtga

SEQ ID NO: 492006 - DNA, 25 bp, Rattus norvegicus
gtcattccgccggattgtggagtga

SEQ ID NO: 492007 - DNA, 25 bp, Rattus norvegicus
gtcattccgcttcacagcaggagaa

SEQ ID NO: 492008 - DNA, 25 bp, Rattus norvegicus
gtcattccgcttgacagcaggagaa

SEQ ID NO: 492009 - DNA, 25 bp, Rattus norvegicus
gtcattccgggacctattatttcac

SEQ ID NO: 492010 - DNA, 25 bp, Rattus norvegicus
gtcattccgggagctattatttcac

SEQ ID NO: 492011 - DNA, 25 bp, Rattus norvegicus
gtcattcctattctgatgtcctgag

SEQ ID NO: 492012 - DNA, 25 bp, Rattus norvegicus
gtcattcctattgtgatgtcctgag

SEQ ID NO: 492013 - DNA, 25 bp, Rattus norvegicus
gtcattcctctcacacctgtgtcga

SEQ ID NO: 492014 - DNA, 25 bp, Rattus norvegicus
gtcattcctctcagcagcatgggac

SEQ ID NO: 492015 - DNA, 25 bp, Rattus norvegicus
gtcattcctctctcacctgtgtcga

SEQ ID NO: 492016 - DNA, 25 bp, Rattus norvegicus
gtcattcctctctgcagcatgggac

SEQ ID NO: 492017 - DNA, 25 bp, Rattus norvegicus
gtcattcctgagactgtcattttat

SEQ ID NO: 492018 - DNA, 25 bp, Rattus norvegicus
gtcattcctgagtctgtcattttat

SEQ ID NO: 492019 - DNA, 25 bp, Rattus norvegicus
gtcattcctttgaaacatatgagca

SEQ ID NO: 492020 - DNA, 25 bp, Rattus norvegicus
gtcattcctttgtaacatatgagca

SEQ ID NO: 492021 - DNA, 25 bp, Rattus norvegicus
gtcattcgctgccagagagctagtg

SEQ ID NO: 492022 - DNA, 25 bp, Rattus norvegicus
gtcattcgctgcgagagagctagtg

SEQ ID NO: 492023 - DNA, 25 bp, Rattus norvegicus
gtcattctacacagaccttgtctta

SEQ ID NO: 492024 - DNA, 25 bp, Rattus norvegicus
gtcattctacactgaccttgtctta

SEQ ID NO: 492025 - DNA, 25 bp, Rattus norvegicus
gtcattctcagcctccaagatgaga

SEQ ID NO: 492026 - DNA, 25 bp, Rattus norvegicus
gtcattctcagcgtccaagatgaga

SEQ ID NO: 492027 - DNA, 25 bp, Rattus norvegicus
gtcattctctggctatggagtgttt

SEQ ID NO: 492028 - DNA, 25 bp, Rattus norvegicus
gtcattctctgggtatggagtgttt

SEQ ID NO: 492029 - DNA, 25 bp, Rattus norvegicus
gtcattctctttctgcccagaggga

SEQ ID NO: 492030 - DNA, 25 bp, Rattus norvegicus
gtcattctctttgtgcccagaggga

SEQ ID NO: 492031 - DNA, 25 bp, Rattus norvegicus
gtcattctgagcagttacttcctta

SEQ ID NO: 492032 - DNA, 25 bp, Rattus norvegicus
gtcattctgagctgttacttcctta

SEQ ID NO: 492033 - DNA, 25 bp, Rattus norvegicus
gtcattctgttcctgctgcaagtga

SEQ ID NO: 492034 - DNA, 25 bp, Rattus norvegicus
gtcattctgttcgtgctgcaagtga

SEQ ID NO: 492035 - DNA, 25 bp, Rattus norvegicus
gtcattcttaggaatgtgcctccca

SEQ ID NO: 492036 - DNA, 25 bp, Rattus norvegicus
gtcattcttaggtatgtgcctccca

SEQ ID NO: 492037 - DNA, 25 bp, Rattus norvegicus
gtcattcttctgagttatatctctg

SEQ ID NO: 492038 - DNA, 25 bp, Rattus norvegicus
gtcattcttctgtgttatatctctg

SEQ ID NO: 492039 - DNA, 25 bp, Rattus norvegicus
gtcattctttacaggaatccccact

SEQ ID NO: 492040 - DNA, 25 bp, Rattus norvegicus
gtcattctttactggaatccccact

SEQ ID NO: 492041 - DNA, 25 bp, Rattus norvegicus
gtcattgaactgaagccgctctgga

SEQ ID NO: 492042 - DNA, 25 bp, Rattus norvegicus
gtcattgaactgtagccgctctgga

SEQ ID NO: 492043 - DNA, 25 bp, Rattus norvegicus
gtcattgaataaattctattctggc

SEQ ID NO: 492044 - DNA, 25 bp, Rattus norvegicus
gtcattgaataatttctattctggc

SEQ ID NO: 492045 - DNA, 25 bp, Rattus norvegicus
gtcattgacacaaaattgagcctga

SEQ ID NO: 492046 - DNA, 25 bp, Rattus norvegicus
gtcattgacacataattgagcctga

SEQ ID NO: 492047 - DNA, 25 bp, Rattus norvegicus
gtcattgactggactcatggacctt

SEQ ID NO: 492048 - DNA, 25 bp, Rattus norvegicus
gtcattgactggtctcatggacctt

SEQ ID NO: 492049 - DNA, 25 bp, Rattus norvegicus
gtcattgagagaccgtgcagttcta

SEQ ID NO: 492050 - DNA, 25 bp, Rattus norvegicus
gtcattgagagagcgtgcagttcta

SEQ ID NO: 492051 - DNA, 25 bp, Rattus norvegicus
gtcattgagcatatgtcccaacggg

SEQ ID NO: 492052 - DNA, 25 bp, Rattus norvegicus
gtcattgagcatttgtcccaacggg

SEQ ID NO: 492053 - DNA, 25 bp, Rattus norvegicus
gtcattgagcctaaggagttccagt

SEQ ID NO: 492054 - DNA, 25 bp, Rattus norvegicus
gtcattgagccttaggagttccagt

SEQ ID NO: 492055 - DNA, 25 bp, Rattus norvegicus
gtcattgataacacttgctgatgga

SEQ ID NO: 492056 - DNA, 25 bp, Rattus norvegicus
gtcattgataactcttgctgatgga

SEQ ID NO: 492057 - DNA, 25 bp, Rattus norvegicus
gtcattgatcccaaaaatgtctttg

SEQ ID NO: 492058 - DNA, 25 bp, Rattus norvegicus
gtcattgatccctaaaatgtctttg

SEQ ID NO: 492059 - DNA, 25 bp, Rattus norvegicus
gtcattgatgtccttttttacctaa

SEQ ID NO: 492060 - DNA, 25 bp, Rattus norvegicus
gtcattgatgtcgttttttacctaa

SEQ ID NO: 492061 - DNA, 25 bp, Rattus norvegicus
gtcattgcagacaagtacgatccgt

SEQ ID NO: 492062 - DNA, 25 bp, Rattus norvegicus
gtcattgcagactagtacgatccgt

SEQ ID NO: 492063 - DNA, 25 bp, Rattus norvegicus
gtcattgcatcactggttgccacta

SEQ ID NO: 492064 - DNA, 25 bp, Rattus norvegicus
gtcattgcatcagtggttgccacta

SEQ ID NO: 492065 - DNA, 25 bp, Rattus norvegicus
gtcattgccaatactgccttacaag

SEQ ID NO: 492066 - DNA, 25 bp, Rattus norvegicus
gtcattgccaattctgccttacaag

SEQ ID NO: 492067 - DNA, 25 bp, Rattus norvegicus
gtcattgcctacaactgaacgtctt

SEQ ID NO: 492068 - DNA, 25 bp, Rattus norvegicus
gtcattgcctactactgaacgtctt

SEQ ID NO: 492069 - DNA, 25 bp, Rattus norvegicus
gtcattgcctctcatgtttgcagga

SEQ ID NO: 492070 - DNA, 25 bp, Rattus norvegicus
gtcattgcctctgatgtttgcagga

SEQ ID NO: 492071 - DNA, 25 bp, Rattus norvegicus
gtcattgcctggacaatcacggaaa

SEQ ID NO: 492072 - DNA, 25 bp, Rattus norvegicus
gtcattgcctggtcaatcacggaaa

SEQ ID NO: 492073 - DNA, 25 bp, Rattus norvegicus
gtcattgctagcagctgtggtactt

SEQ ID NO: 492074 - DNA, 25 bp, Rattus norvegicus
gtcattgctagctgctgtggtactt

SEQ ID NO: 492075 - DNA, 25 bp, Rattus norvegicus
gtcattgctgttctcttgggtgatg

SEQ ID NO: 492076 - DNA, 25 bp, Rattus norvegicus
gtcattgctgttgtcttgggtgatg

SEQ ID NO: 492077 - DNA, 25 bp, Rattus norvegicus
gtcattggaactacttcctggagta

SEQ ID NO: 492078 - DNA, 25 bp, Rattus norvegicus
gtcattggaacttcttcctggagta

SEQ ID NO: 492079 - DNA, 25 bp, Rattus norvegicus
gtcattggacaacatacatcgccgt

SEQ ID NO: 492080 - DNA, 25 bp, Rattus norvegicus
gtcattggacaagatacatcgccgt

SEQ ID NO: 492081 - DNA, 25 bp, Rattus norvegicus
gtcattggcattctggttgcccagg

SEQ ID NO: 492082 - DNA, 25 bp, Rattus norvegicus
gtcattggcattgtggttgcccagg

SEQ ID NO: 492083 - DNA, 25 bp, Rattus norvegicus
gtcattggctgcatgatttgtgcaa

SEQ ID NO: 492084 - DNA, 25 bp, Rattus norvegicus
gtcattggctgcttgatttgtgcaa

SEQ ID NO: 492085 - DNA, 25 bp, Rattus norvegicus
gtcattgggagcatattgtggactc

SEQ ID NO: 492086 - DNA, 25 bp, Rattus norvegicus
gtcattgggagcttattgtggactc

SEQ ID NO: 492087 - DNA, 25 bp, Rattus norvegicus
gtcattgggcacatctggtacagat

SEQ ID NO: 492088 - DNA, 25 bp, Rattus norvegicus
gtcattgggcacttctggtacagat

SEQ ID NO: 492089 - DNA, 25 bp, Rattus norvegicus
gtcattggtctgacattaagttgca

SEQ ID NO: 492090 - DNA, 25 bp, Rattus norvegicus
gtcattggtctgtcattaagttgca

SEQ ID NO: 492091 - DNA, 25 bp, Rattus norvegicus
gtcattggtggtcttcattgccttt

SEQ ID NO: 492092 - DNA, 25 bp, Rattus norvegicus
gtcattggtggtgttcattgccttt

SEQ ID NO: 492093 - DNA, 25 bp, Rattus norvegicus
gtcattgtagtgcattagcggccat

SEQ ID NO: 492094 - DNA, 25 bp, Rattus norvegicus
gtcattgtagtggattagcggccat

SEQ ID NO: 492095 - DNA, 25 bp, Rattus norvegicus
gtcattgtcaacagagaggcgcata

SEQ ID NO: 492096 - DNA, 25 bp, Rattus norvegicus
gtcattgtcaactgagaggcgcata

SEQ ID NO: 492097 - DNA, 25 bp, Rattus norvegicus
gtcattgtcggccttctgagagaag

SEQ ID NO: 492098 - DNA, 25 bp, Rattus norvegicus
gtcattgtcggcgttctgagagaag

SEQ ID NO: 492099 - DNA, 25 bp, Rattus norvegicus
gtcattgtcgttctatgtgctctga

SEQ ID NO: 492100 - DNA, 25 bp, Rattus norvegicus
gtcattgtcgttgtatgtgctctga

SEQ ID NO: 492101 - DNA, 25 bp, Rattus norvegicus
gtcattgtgaacacccgtattttct

SEQ ID NO: 492102 - DNA, 25 bp, Rattus norvegicus
gtcattgtgaactcccgtattttct

SEQ ID NO: 492103 - DNA, 25 bp, Rattus norvegicus
gtcattgtgaatctgccacccatgg

SEQ ID NO: 492104 - DNA, 25 bp, Rattus norvegicus
gtcattgtgaatgtgccacccatgg

SEQ ID NO: 492105 - DNA, 25 bp, Rattus norvegicus
gtcattgtggatcatctcctggcca

SEQ ID NO: 492106 - DNA, 25 bp, Rattus norvegicus
gtcattgtggatgatctcctggcca

SEQ ID NO: 492107 - DNA, 25 bp, Rattus norvegicus
gtcattgtgtgaccagcgattgtca

SEQ ID NO: 492108 - DNA, 25 bp, Rattus norvegicus
gtcattgtgtgagcagcgattgtca

SEQ ID NO: 492109 - DNA, 25 bp, Rattus norvegicus
gtcattgttattacataggcctagt

SEQ ID NO: 492110 - DNA, 25 bp, Rattus norvegicus
gtcattgttatttcataggcctagt

SEQ ID NO: 492111 - DNA, 25 bp, Rattus norvegicus
gtcattgttgacctgttaaacctta

SEQ ID NO: 492112 - DNA, 25 bp, Rattus norvegicus
gtcattgttgacgtgttaaacctta

SEQ ID NO: 492113 - DNA, 25 bp, Rattus norvegicus
gtcattgtttacatagcagtgctga

SEQ ID NO: 492114 - DNA, 25 bp, Rattus norvegicus
gtcattgtttacttagcagtgctga

SEQ ID NO: 492115 - DNA, 25 bp, Rattus norvegicus
gtcatttaaaaaatccggctggcta

SEQ ID NO: 492116 - DNA, 25 bp, Rattus norvegicus
gtcatttaaaaattccggctggcta

SEQ ID NO: 492117 - DNA, 25 bp, Rattus norvegicus
gtcatttaatctagtaagagcccat

SEQ ID NO: 492118 - DNA, 25 bp, Rattus norvegicus
gtcatttaatcttgtaagagcccat

SEQ ID NO: 492119 - DNA, 25 bp, Rattus norvegicus
gtcatttagaaaaacagtgcttgca

SEQ ID NO: 492120 - DNA, 25 bp, Rattus norvegicus
gtcatttagaaatacagtgcttgca

SEQ ID NO: 492121 - DNA, 25 bp, Rattus norvegicus
gtcatttagccaaaattcgggtact

SEQ ID NO: 492122 - DNA, 25 bp, Rattus norvegicus
gtcatttagccataattcgggtact

SEQ ID NO: 492123 - DNA, 25 bp, Rattus norvegicus
gtcatttatcagagggttgccaacc

SEQ ID NO: 492124 - DNA, 25 bp, Rattus norvegicus
gtcatttatcagtgggttgccaacc

SEQ ID NO: 492125 - DNA, 25 bp, Rattus norvegicus
gtcatttattacaagggcatcccag

SEQ ID NO: 492126 - DNA, 25 bp, Rattus norvegicus
gtcatttattactagggcatcccag

SEQ ID NO: 492127 - DNA, 25 bp, Rattus norvegicus
gtcatttatttcatgctatcatctt

SEQ ID NO: 492128 - DNA, 25 bp, Rattus norvegicus
gtcatttatttcttgctatcatctt

SEQ ID NO: 492129 - DNA, 25 bp, Rattus norvegicus
gtcatttcagaacccgtgtgtctcc

SEQ ID NO: 492130 - DNA, 25 bp, Rattus norvegicus
gtcatttcagaagccgtgtgtctcc

SEQ ID NO: 492131 - DNA, 25 bp, Rattus norvegicus
gtcatttcaggacaactggtctaaa

SEQ ID NO: 492132 - DNA, 25 bp, Rattus norvegicus
gtcatttcaggacctgtgagccagc

SEQ ID NO: 492133 - DNA, 25 bp, Rattus norvegicus
gtcatttcaggagaactggtctaaa

SEQ ID NO: 492134 - DNA, 25 bp, Rattus norvegicus
gtcatttcaggagctgtgagccagc

SEQ ID NO: 492135 - DNA, 25 bp, Rattus norvegicus
gtcatttccactcatactcaacgat

SEQ ID NO: 492136 - DNA, 25 bp, Rattus norvegicus
gtcatttccactgatactcaacgat

SEQ ID NO: 492137 - DNA, 25 bp, Rattus norvegicus
gtcatttccaggcacagcatccaat

SEQ ID NO: 492138 - DNA, 25 bp, Rattus norvegicus
gtcatttccagggacagcatccaat

SEQ ID NO: 492139 - DNA, 25 bp, Rattus norvegicus
gtcatttccattccaagttgcacta

SEQ ID NO: 492140 - DNA, 25 bp, Rattus norvegicus
gtcatttccattgcaagttgcacta

SEQ ID NO: 492141 - DNA, 25 bp, Rattus norvegicus
gtcatttccggcagctgtaagtgag

SEQ ID NO: 492142 - DNA, 25 bp, Rattus norvegicus
gtcatttccggctgctgtaagtgag

SEQ ID NO: 492143 - DNA, 25 bp, Rattus norvegicus
gtcatttcctacacaggcagagcag

SEQ ID NO: 492144 - DNA, 25 bp, Rattus norvegicus
gtcatttcctactcaggcagagcag

SEQ ID NO: 492145 - DNA, 25 bp, Rattus norvegicus
gtcatttcctgcagggaagtcggac

SEQ ID NO: 492146 - DNA, 25 bp, Rattus norvegicus
gtcatttcctgctgggaagtcggac

SEQ ID NO: 492147 - DNA, 25 bp, Rattus norvegicus
gtcatttctattcgtgggacaccct

SEQ ID NO: 492148 - DNA, 25 bp, Rattus norvegicus
gtcatttctattggtgggacaccct

SEQ ID NO: 492149 - DNA, 25 bp, Rattus norvegicus
gtcatttctcctaaagttccactaa

SEQ ID NO: 492150 - DNA, 25 bp, Rattus norvegicus
gtcatttctcctctgtatcttttaa

SEQ ID NO: 492151 - DNA, 25 bp, Rattus norvegicus
gtcatttctcctgtgtatcttttaa

SEQ ID NO: 492152 - DNA, 25 bp, Rattus norvegicus
gtcatttctccttaagttccactaa

SEQ ID NO: 492153 - DNA, 25 bp, Rattus norvegicus
gtcatttctgaacctgtagttggct

SEQ ID NO: 492154 - DNA, 25 bp, Rattus norvegicus
gtcatttctgaagctgtagttggct

SEQ ID NO: 492155 - DNA, 25 bp, Rattus norvegicus
gtcatttctggtatacactgcggaa

SEQ ID NO: 492156 - DNA, 25 bp, Rattus norvegicus
gtcatttctggtttacactgcggaa

SEQ ID NO: 492157 - DNA, 25 bp, Rattus norvegicus
gtcatttcttagacattcaaaccat

SEQ ID NO: 492158 - DNA, 25 bp, Rattus norvegicus
gtcatttcttagtcattcaaaccat

SEQ ID NO: 492159 - DNA, 25 bp, Rattus norvegicus
gtcatttcttttatgcatcttccag

SEQ ID NO: 492160 - DNA, 25 bp, Rattus norvegicus
gtcatttcttttttgcatcttccag

SEQ ID NO: 492161 - DNA, 25 bp, Rattus norvegicus
gtcatttgaaaccaactcctgttgt

SEQ ID NO: 492162 - DNA, 25 bp, Rattus norvegicus
gtcatttgaaacgaactcctgttgt

SEQ ID NO: 492163 - DNA, 25 bp, Rattus norvegicus
gtcatttgaagacataccacaccag

SEQ ID NO: 492164 - DNA, 25 bp, Rattus norvegicus
gtcatttgaagagataccacaccag

SEQ ID NO: 492165 - DNA, 25 bp, Rattus norvegicus
gtcatttgacatacaggctcgcatg

SEQ ID NO: 492166 - DNA, 25 bp, Rattus norvegicus
gtcatttgacatatagctgctgtta

SEQ ID NO: 492167 - DNA, 25 bp, Rattus norvegicus
gtcatttgacattcaggctcgcatg

SEQ ID NO: 492168 - DNA, 25 bp, Rattus norvegicus
gtcatttgacatttagctgctgtta

SEQ ID NO: 492169 - DNA, 25 bp, Rattus norvegicus
gtcatttgctatattgctttcctct

SEQ ID NO: 492170 - DNA, 25 bp, Rattus norvegicus
gtcatttgctattttgctttcctct

SEQ ID NO: 492171 - DNA, 25 bp, Rattus norvegicus
gtcatttgctgtctgttgacccagt

SEQ ID NO: 492172 - DNA, 25 bp, Rattus norvegicus
gtcatttgctgtgtgttgacccagt

SEQ ID NO: 492173 - DNA, 25 bp, Rattus norvegicus
gtcatttgcttacatttgccaaaca

SEQ ID NO: 492174 - DNA, 25 bp, Rattus norvegicus
gtcatttgcttagatttgccaaaca

SEQ ID NO: 492175 - DNA, 25 bp, Rattus norvegicus
gtcatttgcttgaacaaccccttga

SEQ ID NO: 492176 - DNA, 25 bp, Rattus norvegicus
gtcatttgcttgatgtctgttggaa

SEQ ID NO: 492177 - DNA, 25 bp, Rattus norvegicus
gtcatttgcttgtacaaccccttga

SEQ ID NO: 492178 - DNA, 25 bp, Rattus norvegicus
gtcatttgcttgttgtctgttggaa

SEQ ID NO: 492179 - DNA, 25 bp, Rattus norvegicus
gtcatttgctttctgcaagatcctt

SEQ ID NO: 492180 - DNA, 25 bp, Rattus norvegicus
gtcatttgctttgtgcaagatcctt

SEQ ID NO: 492181 - DNA, 25 bp, Rattus norvegicus
gtcatttggggcactctggcacttt

SEQ ID NO: 492182 - DNA, 25 bp, Rattus norvegicus
gtcatttggggctctctggcacttt

SEQ ID NO: 492183 - DNA, 25 bp, Rattus norvegicus
gtcatttgggttatactgcttgcat

SEQ ID NO: 492184 - DNA, 25 bp, Rattus norvegicus
gtcatttgggttttactgcttgcat

SEQ ID NO: 492185 - DNA, 25 bp, Rattus norvegicus
gtcatttggtccctttgatgtgcag

SEQ ID NO: 492186 - DNA, 25 bp, Rattus norvegicus
gtcatttggtccgtttgatgtgcag

SEQ ID NO: 492187 - DNA, 25 bp, Rattus norvegicus
gtcatttgtcaaactgctggccaac

SEQ ID NO: 492188 - DNA, 25 bp, Rattus norvegicus
gtcatttgtcaatctgctggccaac

SEQ ID NO: 492189 - DNA, 25 bp, Rattus norvegicus
gtcatttgttggcacttctggcatt

SEQ ID NO: 492190 - DNA, 25 bp, Rattus norvegicus
gtcatttgttgggacttctggcatt

SEQ ID NO: 492191 - DNA, 25 bp, Rattus norvegicus
gtcattttaagtcattttccttggg

SEQ ID NO: 492192 - DNA, 25 bp, Rattus norvegicus
gtcattttaagtgattttccttggg

SEQ ID NO: 492193 - DNA, 25 bp, Rattus norvegicus
gtcattttaattactccttcatacc

SEQ ID NO: 492194 - DNA, 25 bp, Rattus norvegicus
gtcattttaatttctccttcatacc

SEQ ID NO: 492195 - DNA, 25 bp, Rattus norvegicus
gtcattttcaaaaagttagctactg

SEQ ID NO: 492196 - DNA, 25 bp, Rattus norvegicus
gtcattttcaaatagttagctactg

SEQ ID NO: 492197 - DNA, 25 bp, Rattus norvegicus
gtcattttcaccataagttcctatt

SEQ ID NO: 492198 - DNA, 25 bp, Rattus norvegicus
gtcattttcaccttaagttcctatt

SEQ ID NO: 492199 - DNA, 25 bp, Rattus norvegicus
gtcattttcccaagtcccaaagaga

SEQ ID NO: 492200 - DNA, 25 bp, Rattus norvegicus
gtcattttcccatgtcccaaagaga

SEQ ID NO: 492201 - DNA, 25 bp, Rattus norvegicus
gtcattttctaactctatttgtcta

SEQ ID NO: 492202 - DNA, 25 bp, Rattus norvegicus
gtcattttctaagtctatttgtcta

SEQ ID NO: 492203 - DNA, 25 bp, Rattus norvegicus
gtcattttctagacagggcagccag

SEQ ID NO: 492204 - DNA, 25 bp, Rattus norvegicus
gtcattttctagtcagggcagccag

SEQ ID NO: 492205 - DNA, 25 bp, Rattus norvegicus
gtcattttctatacactggccacag

SEQ ID NO: 492206 - DNA, 25 bp, Rattus norvegicus
gtcattttctattcactggccacag

SEQ ID NO: 492207 - DNA, 25 bp, Rattus norvegicus
gtcattttgacaccactcttgtgca

SEQ ID NO: 492208 - DNA, 25 bp, Rattus norvegicus
gtcattttgacagcactcttgtgca

SEQ ID NO: 492209 - DNA, 25 bp, Rattus norvegicus
gtcattttgattaggcacacagcat

SEQ ID NO: 492210 - DNA, 25 bp, Rattus norvegicus
gtcattttgatttggcacacagcat

SEQ ID NO: 492211 - DNA, 25 bp, Rattus norvegicus
gtcattttgggcatatgcctgtgtc

SEQ ID NO: 492212 - DNA, 25 bp, Rattus norvegicus
gtcattttgggcttatgcctgtgtc

SEQ ID NO: 492213 - DNA, 25 bp, Rattus norvegicus
gtcattttgtgtaagactgtctaat

SEQ ID NO: 492214 - DNA, 25 bp, Rattus norvegicus
gtcattttgtgttagactgtctaat

SEQ ID NO: 492215 - DNA, 25 bp, Rattus norvegicus
gtcatttttatcatctacttaccaa

SEQ ID NO: 492216 - DNA, 25 bp, Rattus norvegicus
gtcatttttatcttctacttaccaa

SEQ ID NO: 492217 - DNA, 25 bp, Rattus norvegicus
gtcatttttctgaattcatctccca

SEQ ID NO: 492218 - DNA, 25 bp, Rattus norvegicus
gtcatttttctgtattcatctccca

SEQ ID NO: 492219 - DNA, 25 bp, Rattus norvegicus
gtcatttttgctcagacctgtacca

SEQ ID NO: 492220 - DNA, 25 bp, Rattus norvegicus
gtcatttttgctgagacctgtacca

SEQ ID NO: 492221 - DNA, 25 bp, Rattus norvegicus
gtcatttttgtactgcaggctctgc

SEQ ID NO: 492222 - DNA, 25 bp, Rattus norvegicus
gtcatttttgtagtgcaggctctgc

SEQ ID NO: 492223 - DNA, 25 bp, Rattus norvegicus
gtcattttttaacttgggcagcaaa

SEQ ID NO: 492224 - DNA, 25 bp, Rattus norvegicus
gtcattttttaagttgggcagcaaa

SEQ ID NO: 492225 - DNA, 25 bp, Rattus norvegicus
gtcattttttgcatcaactcatggt

SEQ ID NO: 492226 - DNA, 25 bp, Rattus norvegicus
gtcattttttgcttcaactcatggt

SEQ ID NO: 492227 - DNA, 25 bp, Rattus norvegicus
gtcatttttttgcgcgacccgctga

SEQ ID NO: 492228 - DNA, 25 bp, Rattus norvegicus
gtcatttttttgggcgacccgctga

SEQ ID NO: 492229 - DNA, 25 bp, Rattus norvegicus
gtccaaaactcacactcagatgcgt

SEQ ID NO: 492230 - DNA, 25 bp, Rattus norvegicus
gtccaaaactcagactcagatgcgt

SEQ ID NO: 492231 - DNA, 25 bp, Rattus norvegicus
gtccaaaatgttcatcttccactgc

SEQ ID NO: 492232 - DNA, 25 bp, Rattus norvegicus
gtccaaaatgttgatcttccactgc

SEQ ID NO: 492233 - DNA, 25 bp, Rattus norvegicus
gtccaaactttaattctgtacactg

SEQ ID NO: 492234 - DNA, 25 bp, Rattus norvegicus
gtccaaactttatttctgtacactg

SEQ ID NO: 492235 - DNA, 25 bp, Rattus norvegicus
gtccaaagactcctttcttgcttgt

SEQ ID NO: 492236 - DNA, 25 bp, Rattus norvegicus
gtccaaagactcgtttcttgcttgt

SEQ ID NO: 492237 - DNA, 25 bp, Rattus norvegicus
gtccaaagataaacaccgggctcgg

SEQ ID NO: 492238 - DNA, 25 bp, Rattus norvegicus
gtccaaagataatcaccgggctcgg

SEQ ID NO: 492239 - DNA, 25 bp, Rattus norvegicus
gtccaaagccagacttgacttgagg

SEQ ID NO: 492240 - DNA, 25 bp, Rattus norvegicus
gtccaaagccagtcttgacttgagg

SEQ ID NO: 492241 - DNA, 25 bp, Rattus norvegicus
gtccaaagcctgcagaaacgatgtt

SEQ ID NO: 492242 - DNA, 25 bp, Rattus norvegicus
gtccaaagcctggagaaacgatgtt

SEQ ID NO: 492243 - DNA, 25 bp, Rattus norvegicus
gtccaaagcttaaaccaggaggtgt

SEQ ID NO: 492244 - DNA, 25 bp, Rattus norvegicus
gtccaaagcttataccaggaggtgt

SEQ ID NO: 492245 - DNA, 25 bp, Rattus norvegicus
gtccaaaggcttctccaggaacagc

SEQ ID NO: 492246 - DNA, 25 bp, Rattus norvegicus
gtccaaaggcttgtccaggaacagc

SEQ ID NO: 492247 - DNA, 25 bp, Rattus norvegicus
gtccaaagtagtaatctagctgcct

SEQ ID NO: 492248 - DNA, 25 bp, Rattus norvegicus
gtccaaagtagttatctagctgcct

SEQ ID NO: 492249 - DNA, 25 bp, Rattus norvegicus
gtccaaagtgctagaggccttctga

SEQ ID NO: 492250 - DNA, 25 bp, Rattus norvegicus
gtccaaagtgcttgaggccttctga

SEQ ID NO: 492251 - DNA, 25 bp, Rattus norvegicus
gtccaaatccccagaaaccatgtaa

SEQ ID NO: 492252 - DNA, 25 bp, Rattus norvegicus
gtccaaatcccctgaaaccatgtaa

SEQ ID NO: 492253 - DNA, 25 bp, Rattus norvegicus
gtccaaatcctaacatcctgcaaac

SEQ ID NO: 492254 - DNA, 25 bp, Rattus norvegicus
gtccaaatcctatcatcctgcaaac

SEQ ID NO: 492255 - DNA, 25 bp, Rattus norvegicus
gtccaaatgagcatgaaaacccaga

SEQ ID NO: 492256 - DNA, 25 bp, Rattus norvegicus
gtccaaatgagcttgaaaacccaga

SEQ ID NO: 492257 - DNA, 25 bp, Rattus norvegicus
gtccaaatgttcatcaacacgtcct

SEQ ID NO: 492258 - DNA, 25 bp, Rattus norvegicus
gtccaaatgttcttcaacacgtcct

SEQ ID NO: 492259 - DNA, 25 bp, Rattus norvegicus
gtccaacaagttcatcatccacaat

SEQ ID NO: 492260 - DNA, 25 bp, Rattus norvegicus
gtccaacaagttgatcatccacaat

SEQ ID NO: 492261 - DNA, 25 bp, Rattus norvegicus
gtccaacagtggatactttatattt

SEQ ID NO: 492262 - DNA, 25 bp, Rattus norvegicus
gtccaacagtggttactttatattt

SEQ ID NO: 492263 - DNA, 25 bp, Rattus norvegicus
gtccaacattacagtgcttggcaga

SEQ ID NO: 492264 - DNA, 25 bp, Rattus norvegicus
gtccaacattactgtgcttggcaga

SEQ ID NO: 492265 - DNA, 25 bp, Rattus norvegicus
gtccaacccatgctcatacctgaga

SEQ ID NO: 492266 - DNA, 25 bp, Rattus norvegicus
gtccaacccatggtcatacctgaga

SEQ ID NO: 492267 - DNA, 25 bp, Rattus norvegicus
gtccaaccctaaagatccttgcctg

SEQ ID NO: 492268 - DNA, 25 bp, Rattus norvegicus
gtccaaccctaatgatccttgcctg

SEQ ID NO: 492269 - DNA, 25 bp, Rattus norvegicus
gtccaaccttttcccattacaacaa

SEQ ID NO: 492270 - DNA, 25 bp, Rattus norvegicus
gtccaaccttttgccattacaacaa

SEQ ID NO: 492271 - DNA, 25 bp, Rattus norvegicus
gtccaacgccatcagcgtaaccgga

SEQ ID NO: 492272 - DNA, 25 bp, Rattus norvegicus
gtccaacgccatgagcgtaaccgga

SEQ ID NO: 492273 - DNA, 25 bp, Rattus norvegicus
gtccaacgggccagcttagatgata

SEQ ID NO: 492274 - DNA, 25 bp, Rattus norvegicus
gtccaacgggcctgcttagatgata

SEQ ID NO: 492275 - DNA, 25 bp, Rattus norvegicus
gtccaacgtccacattcaggtctga

SEQ ID NO: 492276 - DNA, 25 bp, Rattus norvegicus
gtccaacgtccagattcaggtctga

SEQ ID NO: 492277 - DNA, 25 bp, Rattus norvegicus
gtccaactggagaatggcttgccgt

SEQ ID NO: 492278 - DNA, 25 bp, Rattus norvegicus
gtccaactggagtatggcttgccgt

SEQ ID NO: 492279 - DNA, 25 bp, Rattus norvegicus
gtccaactgggaatcatctcgaggg

SEQ ID NO: 492280 - DNA, 25 bp, Rattus norvegicus
gtccaactgggattcatctcgaggg

SEQ ID NO: 492281 - DNA, 25 bp, Rattus norvegicus
gtccaactgggcagtgctattttta

SEQ ID NO: 492282 - DNA, 25 bp, Rattus norvegicus
gtccaactgggctgtgctattttta

SEQ ID NO: 492283 - DNA, 25 bp, Rattus norvegicus
gtccaacttcggcagctgtgatgtt

SEQ ID NO: 492284 - DNA, 25 bp, Rattus norvegicus
gtccaacttcgggagctgtgatgtt

SEQ ID NO: 492285 - DNA, 25 bp, Rattus norvegicus
gtccaagaaacacaggccaccaatg

SEQ ID NO: 492286 - DNA, 25 bp, Rattus norvegicus
gtccaagaaacagaggccaccaatg

SEQ ID NO: 492287 - DNA, 25 bp, Rattus norvegicus
gtccaagaacaaacatgcaggcctc

SEQ ID NO: 492288 - DNA, 25 bp, Rattus norvegicus
gtccaagaacaatcatgcaggcctc

SEQ ID NO: 492289 - DNA, 25 bp, Rattus norvegicus
gtccaagaactcatacctcagtata

SEQ ID NO: 492290 - DNA, 25 bp, Rattus norvegicus
gtccaagaactcttacctcagtata

SEQ ID NO: 492291 - DNA, 25 bp, Rattus norvegicus
gtccaagaagatcggtcctcagcat

SEQ ID NO: 492292 - DNA, 25 bp, Rattus norvegicus
gtccaagaagatgggtcctcagcat

SEQ ID NO: 492293 - DNA, 25 bp, Rattus norvegicus
gtccaagaatccctttaaaatccag

SEQ ID NO: 492294 - DNA, 25 bp, Rattus norvegicus
gtccaagaatccgtttaaaatccag

SEQ ID NO: 492295 - DNA, 25 bp, Rattus norvegicus
gtccaagacgcacggcaagcagagc

SEQ ID NO: 492296 - DNA, 25 bp, Rattus norvegicus
gtccaagacgcagggcaagcagagc

SEQ ID NO: 492297 - DNA, 25 bp, Rattus norvegicus
gtccaagacttgattgagctatatg

SEQ ID NO: 492298 - DNA, 25 bp, Rattus norvegicus
gtccaagacttgtttgagctatatg

SEQ ID NO: 492299 - DNA, 25 bp, Rattus norvegicus
gtccaagagacaccagcatcagctt

SEQ ID NO: 492300 - DNA, 25 bp, Rattus norvegicus
gtccaagagacagcagcatcagctt

SEQ ID NO: 492301 - DNA, 25 bp, Rattus norvegicus
gtccaagagttcatccacatcgatc

SEQ ID NO: 492302 - DNA, 25 bp, Rattus norvegicus
gtccaagagttcttccacatcgatc

SEQ ID NO: 492303 - DNA, 25 bp, Rattus norvegicus
gtccaagcagtcatctctggcaaaa

SEQ ID NO: 492304 - DNA, 25 bp, Rattus norvegicus
gtccaagcagtcttctctggcaaaa

SEQ ID NO: 492305 - DNA, 25 bp, Rattus norvegicus
gtccaagcccacattgatatgttaa

SEQ ID NO: 492306 - DNA, 25 bp, Rattus norvegicus
gtccaagcccactttgatatgttaa

SEQ ID NO: 492307 - DNA, 25 bp, Rattus norvegicus
gtccaagctcttcactttgtaagta

SEQ ID NO: 492308 - DNA, 25 bp, Rattus norvegicus
gtccaagctcttgactttgtaagta

SEQ ID NO: 492309 - DNA, 25 bp, Rattus norvegicus
gtccaaggagagcacacggttccct

SEQ ID NO: 492310 - DNA, 25 bp, Rattus norvegicus
gtccaaggagaggacacggttccct

SEQ ID NO: 492311 - DNA, 25 bp, Rattus norvegicus
gtccaaggcactacagcgatctgta

SEQ ID NO: 492312 - DNA, 25 bp, Rattus norvegicus
gtccaaggcacttcagcgatctgta

SEQ ID NO: 492313 - DNA, 25 bp, Rattus norvegicus
gtccaaggcattcaaaaccagcatc

SEQ ID NO: 492314 - DNA, 25 bp, Rattus norvegicus
gtccaaggcattgaaaaccagcatc

SEQ ID NO: 492315 - DNA, 25 bp, Rattus norvegicus
gtccaaggctaaaactgtctttcat

SEQ ID NO: 492316 - DNA, 25 bp, Rattus norvegicus
gtccaaggctaatactgtctttcat

SEQ ID NO: 492317 - DNA, 25 bp, Rattus norvegicus
gtccaaggtcatacacaagtccttt

SEQ ID NO: 492318 - DNA, 25 bp, Rattus norvegicus
gtccaaggtcattcacaagtccttt

SEQ ID NO: 492319 - DNA, 25 bp, Rattus norvegicus
gtccaaggttttctctttcactgtc

SEQ ID NO: 492320 - DNA, 25 bp, Rattus norvegicus
gtccaaggttttgtctttcactgtc

SEQ ID NO: 492321 - DNA, 25 bp, Rattus norvegicus
gtccaagtacttccccagactaatg

SEQ ID NO: 492322 - DNA, 25 bp, Rattus norvegicus
gtccaagtacttgcccagactaatg

SEQ ID NO: 492323 - DNA, 25 bp, Rattus norvegicus
gtccaagtatacatcatcaccaagc

SEQ ID NO: 492324 - DNA, 25 bp, Rattus norvegicus
gtccaagtatacttcatcaccaagc

SEQ ID NO: 492325 - DNA, 25 bp, Rattus norvegicus
gtccaagtcaggattttacagagag

SEQ ID NO: 492326 - DNA, 25 bp, Rattus norvegicus
gtccaagtcaggtttttacagagag

SEQ ID NO: 492327 - DNA, 25 bp, Rattus norvegicus
gtccaagtctggctgtttaagcaaa

SEQ ID NO: 492328 - DNA, 25 bp, Rattus norvegicus
gtccaagtctgggtgtttaagcaaa

SEQ ID NO: 492329 - DNA, 25 bp, Rattus norvegicus
gtccaagtgcttcgcctacagcaag

SEQ ID NO: 492330 - DNA, 25 bp, Rattus norvegicus
gtccaagtgcttggcctacagcaag

SEQ ID NO: 492331 - DNA, 25 bp, Rattus norvegicus
gtccaagtgtaactgttcccggaag

SEQ ID NO: 492332 - DNA, 25 bp, Rattus norvegicus
gtccaagtgtaagtgttcccggaag

SEQ ID NO: 492333 - DNA, 25 bp, Rattus norvegicus
gtccaagttgatccttgacttcata

SEQ ID NO: 492334 - DNA, 25 bp, Rattus norvegicus
gtccaagttgatgcttgacttcata

SEQ ID NO: 492335 - DNA, 25 bp, Rattus norvegicus
gtccaatacagcagtttcacacttt

SEQ ID NO: 492336 - DNA, 25 bp, Rattus norvegicus
gtccaatacagctgtttcacacttt

SEQ ID NO: 492337 - DNA, 25 bp, Rattus norvegicus
gtccaatacggtactggcccaggga

SEQ ID NO: 492338 - DNA, 25 bp, Rattus norvegicus
gtccaatacggttctggcccaggga

SEQ ID NO: 492339 - DNA, 25 bp, Rattus norvegicus
gtccaatagagcctaactgtttctt

SEQ ID NO: 492340 - DNA, 25 bp, Rattus norvegicus
gtccaatagagcgtaactgtttctt

SEQ ID NO: 492341 - DNA, 25 bp, Rattus norvegicus
gtccaataggcacacccagcaactg

SEQ ID NO: 492342 - DNA, 25 bp, Rattus norvegicus
gtccaataggcagacccagcaactg

SEQ ID NO: 492343 - DNA, 25 bp, Rattus norvegicus
gtccaatcaaaaaccactaatagtg

SEQ ID NO: 492344 - DNA, 25 bp, Rattus norvegicus
gtccaatcaaaatccactaatagtg

SEQ ID NO: 492345 - DNA, 25 bp, Rattus norvegicus
gtccaatccccacaagcgcatatga

SEQ ID NO: 492346 - DNA, 25 bp, Rattus norvegicus
gtccaatccccagaagcgcatatga

SEQ ID NO: 492347 - DNA, 25 bp, Rattus norvegicus
gtccaatccggtacacagtgaagca

SEQ ID NO: 492348 - DNA, 25 bp, Rattus norvegicus
gtccaatccggttcacagtgaagca

SEQ ID NO: 492349 - DNA, 25 bp, Rattus norvegicus
gtccaatctagtcaacagagcgagt

SEQ ID NO: 492350 - DNA, 25 bp, Rattus norvegicus
gtccaatctagtgaacagagcgagt

SEQ ID NO: 492351 - DNA, 25 bp, Rattus norvegicus
gtccaatctggcaaaccaacgagtt

SEQ ID NO: 492352 - DNA, 25 bp, Rattus norvegicus
gtccaatctggcattgcagttcgga

SEQ ID NO: 492353 - DNA, 25 bp, Rattus norvegicus
gtccaatctggctaaccaacgagtt

SEQ ID NO: 492354 - DNA, 25 bp, Rattus norvegicus
gtccaatctggctttgcagttcgga

SEQ ID NO: 492355 - DNA, 25 bp, Rattus norvegicus
gtccaatgggaacttctttgccgca

SEQ ID NO: 492356 - DNA, 25 bp, Rattus norvegicus
gtccaatgggaagttctttgccgca

SEQ ID NO: 492357 - DNA, 25 bp, Rattus norvegicus
gtccaatgtctgaagaggtctcaaa

SEQ ID NO: 492358 - DNA, 25 bp, Rattus norvegicus
gtccaatgtctgtagaggtctcaaa

SEQ ID NO: 492359 - DNA, 25 bp, Rattus norvegicus
gtccaattatacagtggccaccggc

SEQ ID NO: 492360 - DNA, 25 bp, Rattus norvegicus
gtccaattatactgtggccaccggc

SEQ ID NO: 492361 - DNA, 25 bp, Rattus norvegicus
gtccaattccacaagcaagcagcag

SEQ ID NO: 492362 - DNA, 25 bp, Rattus norvegicus
gtccaattccactagcaagcagcag

SEQ ID NO: 492363 - DNA, 25 bp, Rattus norvegicus
gtccaattcctactgacgacattat

SEQ ID NO: 492364 - DNA, 25 bp, Rattus norvegicus
gtccaattcctagtgacgacattat

SEQ ID NO: 492365 - DNA, 25 bp, Rattus norvegicus
gtccaattggacagtgagccctggg

SEQ ID NO: 492366 - DNA, 25 bp, Rattus norvegicus
gtccaattggactgtgagccctggg

SEQ ID NO: 492367 - DNA, 25 bp, Rattus norvegicus
gtccacaaagtgatatgaactcctg

SEQ ID NO: 492368 - DNA, 25 bp, Rattus norvegicus
gtccacaaagtgttatgaactcctg

SEQ ID NO: 492369 - DNA, 25 bp, Rattus norvegicus
gtccacaagacgctagctagatagc

SEQ ID NO: 492370 - DNA, 25 bp, Rattus norvegicus
gtccacaagacggtagctagatagc

SEQ ID NO: 492371 - DNA, 25 bp, Rattus norvegicus
gtccacaagccccacataattgtgt

SEQ ID NO: 492372 - DNA, 25 bp, Rattus norvegicus
gtccacaagcccgacataattgtgt

SEQ ID NO: 492373 - DNA, 25 bp, Rattus norvegicus
gtccacaagcttatcataagcacgc

SEQ ID NO: 492374 - DNA, 25 bp, Rattus norvegicus
gtccacaagcttttcataagcacgc

SEQ ID NO: 492375 - DNA, 25 bp, Rattus norvegicus
gtccacaaggacatatttggaacaa

SEQ ID NO: 492376 - DNA, 25 bp, Rattus norvegicus
gtccacaaggacttatttggaacaa

SEQ ID NO: 492377 - DNA, 25 bp, Rattus norvegicus
gtccacaaggtgactgtaactcaga

SEQ ID NO: 492378 - DNA, 25 bp, Rattus norvegicus
gtccacaaggtgtctgtaactcaga

SEQ ID NO: 492379 - DNA, 25 bp, Rattus norvegicus
gtccacaaggttacactcaatatat

SEQ ID NO: 492380 - DNA, 25 bp, Rattus norvegicus
gtccacaaggtttcactcaatatat

SEQ ID NO: 492381 - DNA, 25 bp, Rattus norvegicus
gtccacaagtggaatactcccatga

SEQ ID NO: 492382 - DNA, 25 bp, Rattus norvegicus
gtccacaagtggtatactcccatga

SEQ ID NO: 492383 - DNA, 25 bp, Rattus norvegicus
gtccacaagtttctccagtaatcat

SEQ ID NO: 492384 - DNA, 25 bp, Rattus norvegicus
gtccacaagtttgtccagtaatcat

SEQ ID NO: 492385 - DNA, 25 bp, Rattus norvegicus
gtccacaatcagatggtcctggttt

SEQ ID NO: 492386 - DNA, 25 bp, Rattus norvegicus
gtccacaatcagttggtcctggttt

SEQ ID NO: 492387 - DNA, 25 bp, Rattus norvegicus
gtccacaatctgatagtgcctagaa

SEQ ID NO: 492388 - DNA, 25 bp, Rattus norvegicus
gtccacaatctgttagtgcctagaa

SEQ ID NO: 492389 - DNA, 25 bp, Rattus norvegicus
gtccacacagaccaaagcatttgaa

SEQ ID NO: 492390 - DNA, 25 bp, Rattus norvegicus
gtccacacagacgaaagcatttgaa

SEQ ID NO: 492391 - DNA, 25 bp, Rattus norvegicus
gtccacaccaggaccttgctgaagg

SEQ ID NO: 492392 - DNA, 25 bp, Rattus norvegicus
gtccacaccaggtccttgctgaagg

SEQ ID NO: 492393 - DNA, 25 bp, Rattus norvegicus
gtccacactatcactctttgagttg

SEQ ID NO: 492394 - DNA, 25 bp, Rattus norvegicus
gtccacactatctctctttgagttg

SEQ ID NO: 492395 - DNA, 25 bp, Rattus norvegicus
gtccacactccccacaaagggatgt

SEQ ID NO: 492396 - DNA, 25 bp, Rattus norvegicus
gtccacactcccgacaaagggatgt

SEQ ID NO: 492397 - DNA, 25 bp, Rattus norvegicus
gtccacactgatactgtgtacaaat

SEQ ID NO: 492398 - DNA, 25 bp, Rattus norvegicus
gtccacactgattctgtgtacaaat

SEQ ID NO: 492399 - DNA, 25 bp, Rattus norvegicus
gtccacacttagcatctcagtacag

SEQ ID NO: 492400 - DNA, 25 bp, Rattus norvegicus
gtccacacttaggatctcagtacag

SEQ ID NO: 492401 - DNA, 25 bp, Rattus norvegicus
gtccacagaacactggctctggtgt

SEQ ID NO: 492402 - DNA, 25 bp, Rattus norvegicus
gtccacagaacagtggctctggtgt

SEQ ID NO: 492403 - DNA, 25 bp, Rattus norvegicus
gtccacagaaggcaggcctgtcaca

SEQ ID NO: 492404 - DNA, 25 bp, Rattus norvegicus
gtccacagaagggaggcctgtcaca

SEQ ID NO: 492405 - DNA, 25 bp, Rattus norvegicus
gtccacagaggacatggtttaactg

SEQ ID NO: 492406 - DNA, 25 bp, Rattus norvegicus
gtccacagaggagatggtttaactg

SEQ ID NO: 492407 - DNA, 25 bp, Rattus norvegicus
gtccacagagtgaaaccctgcctta

SEQ ID NO: 492408 - DNA, 25 bp, Rattus norvegicus
gtccacagagtgtaaccctgcctta

SEQ ID NO: 492409 - DNA, 25 bp, Rattus norvegicus
gtccacagatttcagttccagggca

SEQ ID NO: 492410 - DNA, 25 bp, Rattus norvegicus
gtccacagatttgagttccagggca

SEQ ID NO: 492411 - DNA, 25 bp, Rattus norvegicus
gtccacagcaaaacggccaaaccgg

SEQ ID NO: 492412 - DNA, 25 bp, Rattus norvegicus
gtccacagcaaatcggccaaaccgg

SEQ ID NO: 492413 - DNA, 25 bp, Rattus norvegicus
gtccacagcacactccacatgaagg

SEQ ID NO: 492414 - DNA, 25 bp, Rattus norvegicus
gtccacagcacagtccacatgaagg

SEQ ID NO: 492415 - DNA, 25 bp, Rattus norvegicus
gtccacagcaggcagattctcgcag

SEQ ID NO: 492416 - DNA, 25 bp, Rattus norvegicus
gtccacagcagggagattctcgcag

SEQ ID NO: 492417 - DNA, 25 bp, Rattus norvegicus
gtccacagccacctggtatttgagg

SEQ ID NO: 492418 - DNA, 25 bp, Rattus norvegicus
gtccacagccacgtggtatttgagg

SEQ ID NO: 492419 - DNA, 25 bp, Rattus norvegicus
gtccacagccagagcacccttgttg

SEQ ID NO: 492420 - DNA, 25 bp, Rattus norvegicus
gtccacagccagtgcacccttgttg

SEQ ID NO: 492421 - DNA, 25 bp, Rattus norvegicus
gtccacaggagccacttgtgaacaa

SEQ ID NO: 492422 - DNA, 25 bp, Rattus norvegicus
gtccacaggagcgacttgtgaacaa

SEQ ID NO: 492423 - DNA, 25 bp, Rattus norvegicus
gtccacagggccattttgttgaggt

SEQ ID NO: 492424 - DNA, 25 bp, Rattus norvegicus
gtccacagggcctttttgttgaggt

SEQ ID NO: 492425 - DNA, 25 bp, Rattus norvegicus
gtccacagggtcacagctgaaggca

SEQ ID NO: 492426 - DNA, 25 bp, Rattus norvegicus
gtccacagggtctcagctgaaggca

SEQ ID NO: 492427 - DNA, 25 bp, Rattus norvegicus
gtccacagtaccatagcttcattag

SEQ ID NO: 492428 - DNA, 25 bp, Rattus norvegicus
gtccacagtaccttagcttcattag

SEQ ID NO: 492429 - DNA, 25 bp, Rattus norvegicus
gtccacagtgttatctgttctcact

SEQ ID NO: 492430 - DNA, 25 bp, Rattus norvegicus
gtccacagtgttttctgttctcact

SEQ ID NO: 492431 - DNA, 25 bp, Rattus norvegicus
gtccacagttagagagcacgctgca

SEQ ID NO: 492432 - DNA, 25 bp, Rattus norvegicus
gtccacagttagtgagcacgctgca

SEQ ID NO: 492433 - DNA, 25 bp, Rattus norvegicus
gtccacagtttcatgagaccacttc

SEQ ID NO: 492434 - DNA, 25 bp, Rattus norvegicus
gtccacagtttcttgagaccacttc

SEQ ID NO: 492435 - DNA, 25 bp, Rattus norvegicus
gtccacatagagacacactggtgtt

SEQ ID NO: 492436 - DNA, 25 bp, Rattus norvegicus
gtccacatagagtcacactggtgtt

SEQ ID NO: 492437 - DNA, 25 bp, Rattus norvegicus
gtccacatcataatctatacactgc

SEQ ID NO: 492438 - DNA, 25 bp, Rattus norvegicus
gtccacatcatattctatacactgc

SEQ ID NO: 492439 - DNA, 25 bp, Rattus norvegicus
gtccacattcccagatattttttag

SEQ ID NO: 492440 - DNA, 25 bp, Rattus norvegicus
gtccacattccctgatattttttag

SEQ ID NO: 492441 - DNA, 25 bp, Rattus norvegicus
gtccaccacattctcatagacatgt

SEQ ID NO: 492442 - DNA, 25 bp, Rattus norvegicus
gtccaccacattgtcatagacatgt

SEQ ID NO: 492443 - DNA, 25 bp, Rattus norvegicus
gtccaccagaggacaagccatcttt

SEQ ID NO: 492444 - DNA, 25 bp, Rattus norvegicus
gtccaccagaggtcaagccatcttt

SEQ ID NO: 492445 - DNA, 25 bp, Rattus norvegicus
gtccaccagtgtaatggtatcctga

SEQ ID NO: 492446 - DNA, 25 bp, Rattus norvegicus
gtccaccagtgttatggtatcctga

SEQ ID NO: 492447 - DNA, 25 bp, Rattus norvegicus
gtccaccatggaccgtagcgtgtgc

SEQ ID NO: 492448 - DNA, 25 bp, Rattus norvegicus
gtccaccatggagcgtagcgtgtgc

SEQ ID NO: 492449 - DNA, 25 bp, Rattus norvegicus
gtccacccaagccactggaaggaaa

SEQ ID NO: 492450 - DNA, 25 bp, Rattus norvegicus
gtccacccaagcgactggaaggaaa

SEQ ID NO: 492451 - DNA, 25 bp, Rattus norvegicus
gtccaccccgtacggcctgtgttgg

SEQ ID NO: 492452 - DNA, 25 bp, Rattus norvegicus
gtccaccccgtagggcctgtgttgg

SEQ ID NO: 492453 - DNA, 25 bp, Rattus norvegicus
gtccacccggagctgcggtaagatt

SEQ ID NO: 492454 - DNA, 25 bp, Rattus norvegicus
gtccacccggaggtgcggtaagatt

SEQ ID NO: 492455 - DNA, 25 bp, Rattus norvegicus
gtccaccctgtgacatgggaactga

SEQ ID NO: 492456 - DNA, 25 bp, Rattus norvegicus
gtccaccctgtgtcatgggaactga

SEQ ID NO: 492457 - DNA, 25 bp, Rattus norvegicus
gtccaccgtggccttaagtcacatt

SEQ ID NO: 492458 - DNA, 25 bp, Rattus norvegicus
gtccaccgtggcgttaagtcacatt

SEQ ID NO: 492459 - DNA, 25 bp, Rattus norvegicus
gtccaccgtggtaaaggctatttct

SEQ ID NO: 492460 - DNA, 25 bp, Rattus norvegicus
gtccaccgtggttaaggctatttct

SEQ ID NO: 492461 - DNA, 25 bp, Rattus norvegicus
gtccacctccaccatatcgtggaga

SEQ ID NO: 492462 - DNA, 25 bp, Rattus norvegicus
gtccacctccacgatatcgtggaga

SEQ ID NO: 492463 - DNA, 25 bp, Rattus norvegicus
gtccacctcttgacagctttgttag

SEQ ID NO: 492464 - DNA, 25 bp, Rattus norvegicus
gtccacctcttgtcagctttgttag

SEQ ID NO: 492465 - DNA, 25 bp, Rattus norvegicus
gtccaccttctaaagctttatctgg

SEQ ID NO: 492466 - DNA, 25 bp, Rattus norvegicus
gtccaccttctatagctttatctgg

SEQ ID NO: 492467 - DNA, 25 bp, Rattus norvegicus
gtccaccttggtctcaattttaatt

SEQ ID NO: 492468 - DNA, 25 bp, Rattus norvegicus
gtccaccttggtgtcaattttaatt

SEQ ID NO: 492469 - DNA, 25 bp, Rattus norvegicus
gtccacgacagcctctgcagagcta

SEQ ID NO: 492470 - DNA, 25 bp, Rattus norvegicus
gtccacgacagcgtctgcagagcta

SEQ ID NO: 492471 - DNA, 25 bp, Rattus norvegicus
gtccacgagactacctgactgttat

SEQ ID NO: 492472 - DNA, 25 bp, Rattus norvegicus
gtccacgagacttcctgactgttat

SEQ ID NO: 492473 - DNA, 25 bp, Rattus norvegicus
gtccacgagggtattgtatttcaca

SEQ ID NO: 492474 - DNA, 25 bp, Rattus norvegicus
gtccacgagggttttgtatttcaca

SEQ ID NO: 492475 - DNA, 25 bp, Rattus norvegicus
gtccacgattggcaggagccacttc

SEQ ID NO: 492476 - DNA, 25 bp, Rattus norvegicus
gtccacgattgggaggagccacttc

SEQ ID NO: 492477 - DNA, 25 bp, Rattus norvegicus
gtccacgattgtctacagaactttt

SEQ ID NO: 492478 - DNA, 25 bp, Rattus norvegicus
gtccacgattgtgtacagaactttt

SEQ ID NO: 492479 - DNA, 25 bp, Rattus norvegicus
gtccacgctgctcaaaaatctgctc

SEQ ID NO: 492480 - DNA, 25 bp, Rattus norvegicus
gtccacgctgctgaaaaatctgctc

SEQ ID NO: 492481 - DNA, 25 bp, Rattus norvegicus
gtccacggcatgacagagcccgagt

SEQ ID NO: 492482 - DNA, 25 bp, Rattus norvegicus
gtccacggcatgcatcccaaagaga

SEQ ID NO: 492483 - DNA, 25 bp, Rattus norvegicus
gtccacggcatggatcccaaagaga

SEQ ID NO: 492484 - DNA, 25 bp, Rattus norvegicus
gtccacggcatgtcagagcccgagt

SEQ ID NO: 492485 - DNA, 25 bp, Rattus norvegicus
gtccacggtggtatgatcaacaaga

SEQ ID NO: 492486 - DNA, 25 bp, Rattus norvegicus
gtccacggtggtttgatcaacaaga

SEQ ID NO: 492487 - DNA, 25 bp, Rattus norvegicus
gtccacgtaagaaactgtagatgtc

SEQ ID NO: 492488 - DNA, 25 bp, Rattus norvegicus
gtccacgtaagatactgtagatgtc

SEQ ID NO: 492489 - DNA, 25 bp, Rattus norvegicus
gtccacgtagctattgtaagcccat

SEQ ID NO: 492490 - DNA, 25 bp, Rattus norvegicus
gtccacgtagcttttgtaagcccat

SEQ ID NO: 492491 - DNA, 25 bp, Rattus norvegicus
gtccacgtgacaatccagcactgag

SEQ ID NO: 492492 - DNA, 25 bp, Rattus norvegicus
gtccacgtgacattccagcactgag

SEQ ID NO: 492493 - DNA, 25 bp, Rattus norvegicus
gtccacgtgctcctgagagtcagtt

SEQ ID NO: 492494 - DNA, 25 bp, Rattus norvegicus
gtccacgtgctcgtgagagtcagtt

SEQ ID NO: 492495 - DNA, 25 bp, Rattus norvegicus
gtccacgtggtgatcatgtgctcaa

SEQ ID NO: 492496 - DNA, 25 bp, Rattus norvegicus
gtccacgtggtgttcatgtgctcaa

SEQ ID NO: 492497 - DNA, 25 bp, Rattus norvegicus
gtccacgttcagctggttccatgaa

SEQ ID NO: 492498 - DNA, 25 bp, Rattus norvegicus
gtccacgttcaggtggttccatgaa

SEQ ID NO: 492499 - DNA, 25 bp, Rattus norvegicus
gtccacgttcatcgtgctgacccag

SEQ ID NO: 492500 - DNA, 25 bp, Rattus norvegicus
gtccacgttcatggtgctgacccag

SEQ ID NO: 492501 - DNA, 25 bp, Rattus norvegicus
gtccactaacctcctgaggactttt

SEQ ID NO: 492502 - DNA, 25 bp, Rattus norvegicus
gtccactaacctgctgaggactttt

SEQ ID NO: 492503 - DNA, 25 bp, Rattus norvegicus
gtccactaccccattgacaagtgtt

SEQ ID NO: 492504 - DNA, 25 bp, Rattus norvegicus
gtccactacccctttgacaagtgtt

SEQ ID NO: 492505 - DNA, 25 bp, Rattus norvegicus
gtccactagagtcctcactgttaga

SEQ ID NO: 492506 - DNA, 25 bp, Rattus norvegicus
gtccactagagtgctcactgttaga

SEQ ID NO: 492507 - DNA, 25 bp, Rattus norvegicus
gtccactaggaaaagactacgtgat

SEQ ID NO: 492508 - DNA, 25 bp, Rattus norvegicus
gtccactaggaatagactacgtgat

SEQ ID NO: 492509 - DNA, 25 bp, Rattus norvegicus
gtccactagtagctccagtgaggat

SEQ ID NO: 492510 - DNA, 25 bp, Rattus norvegicus
gtccactagtaggtccagtgaggat

SEQ ID NO: 492511 - DNA, 25 bp, Rattus norvegicus
gtccactagttactgaaatttccaa

SEQ ID NO: 492512 - DNA, 25 bp, Rattus norvegicus
gtccactagttagtgaaatttccaa

SEQ ID NO: 492513 - DNA, 25 bp, Rattus norvegicus
gtccactatctaaatacactttgag

SEQ ID NO: 492514 - DNA, 25 bp, Rattus norvegicus
gtccactatctatatacactttgag

SEQ ID NO: 492515 - DNA, 25 bp, Rattus norvegicus
gtccactcagtacccaaatttccag

SEQ ID NO: 492516 - DNA, 25 bp, Rattus norvegicus
gtccactcagtagccaaatttccag

SEQ ID NO: 492517 - DNA, 25 bp, Rattus norvegicus
gtccactcatcacacttcaatcatt

SEQ ID NO: 492518 - DNA, 25 bp, Rattus norvegicus
gtccactcatcagacttcaatcatt

SEQ ID NO: 492519 - DNA, 25 bp, Rattus norvegicus
gtccactcattcagatgccaactga

SEQ ID NO: 492520 - DNA, 25 bp, Rattus norvegicus
gtccactcattctgatgccaactga

SEQ ID NO: 492521 - DNA, 25 bp, Rattus norvegicus
gtccactcatttatcctgattctag

SEQ ID NO: 492522 - DNA, 25 bp, Rattus norvegicus
gtccactcatttttcctgattctag

SEQ ID NO: 492523 - DNA, 25 bp, Rattus norvegicus
gtccactccactacttacaagaaat

SEQ ID NO: 492524 - DNA, 25 bp, Rattus norvegicus
gtccactccacttcttacaagaaat

SEQ ID NO: 492525 - DNA, 25 bp, Rattus norvegicus
gtccactccagaatcgtgcttgtta

SEQ ID NO: 492526 - DNA, 25 bp, Rattus norvegicus
gtccactccagattcgtgcttgtta

SEQ ID NO: 492527 - DNA, 25 bp, Rattus norvegicus
gtccactcctgccaaggagaaccaa

SEQ ID NO: 492528 - DNA, 25 bp, Rattus norvegicus
gtccactcctgcgaaggagaaccaa

SEQ ID NO: 492529 - DNA, 25 bp, Rattus norvegicus
gtccactcggtgctgagacttatta

SEQ ID NO: 492530 - DNA, 25 bp, Rattus norvegicus
gtccactcggtggtgagacttatta

SEQ ID NO: 492531 - DNA, 25 bp, Rattus norvegicus
gtccactctattaatattgttcctt

SEQ ID NO: 492532 - DNA, 25 bp, Rattus norvegicus
gtccactctatttatattgttcctt

SEQ ID NO: 492533 - DNA, 25 bp, Rattus norvegicus
gtccactctccaactcgtgctgaga

SEQ ID NO: 492534 - DNA, 25 bp, Rattus norvegicus
gtccactctccatctcgtgctgaga

SEQ ID NO: 492535 - DNA, 25 bp, Rattus norvegicus
gtccactctgggaatttacaggttg

SEQ ID NO: 492536 - DNA, 25 bp, Rattus norvegicus
gtccactctgggtatttacaggttg

SEQ ID NO: 492537 - DNA, 25 bp, Rattus norvegicus
gtccactgaatgactgatgcgttcg

SEQ ID NO: 492538 - DNA, 25 bp, Rattus norvegicus
gtccactgaatgtctgatgcgttcg

SEQ ID NO: 492539 - DNA, 25 bp, Rattus norvegicus
gtccactgacatagatagcacactg

SEQ ID NO: 492540 - DNA, 25 bp, Rattus norvegicus
gtccactgacattgatagcacactg

SEQ ID NO: 492541 - DNA, 25 bp, Rattus norvegicus
gtccactggagaagcacataatata

SEQ ID NO: 492542 - DNA, 25 bp, Rattus norvegicus
gtccactggagatgcacataatata

SEQ ID NO: 492543 - DNA, 25 bp, Rattus norvegicus
gtccactggataatggccactcatt

SEQ ID NO: 492544 - DNA, 25 bp, Rattus norvegicus
gtccactggatattggccactcatt

SEQ ID NO: 492545 - DNA, 25 bp, Rattus norvegicus
gtccactgtaaactcattcttcctg

SEQ ID NO: 492546 - DNA, 25 bp, Rattus norvegicus
gtccactgtaaagtcattcttcctg

SEQ ID NO: 492547 - DNA, 25 bp, Rattus norvegicus
gtccactgtaacatgttccttgtac

SEQ ID NO: 492548 - DNA, 25 bp, Rattus norvegicus
gtccactgtaacttgttccttgtac

SEQ ID NO: 492549 - DNA, 25 bp, Rattus norvegicus
gtccactgtagcatgggtgacaact

SEQ ID NO: 492550 - DNA, 25 bp, Rattus norvegicus
gtccactgtagcttgggtgacaact

SEQ ID NO: 492551 - DNA, 25 bp, Rattus norvegicus
gtccactgtgctacttatgtattat

SEQ ID NO: 492552 - DNA, 25 bp, Rattus norvegicus
gtccactgtgcttcttatgtattat

SEQ ID NO: 492553 - DNA, 25 bp, Rattus norvegicus
gtccactgtgtgagagatcatacta

SEQ ID NO: 492554 - DNA, 25 bp, Rattus norvegicus
gtccactgtgtgtgagatcatacta

SEQ ID NO: 492555 - DNA, 25 bp, Rattus norvegicus
gtccactgttataccaacatgggct

SEQ ID NO: 492556 - DNA, 25 bp, Rattus norvegicus
gtccactgttattccaacatgggct

SEQ ID NO: 492557 - DNA, 25 bp, Rattus norvegicus
gtccacttacacctgcactgaaagg

SEQ ID NO: 492558 - DNA, 25 bp, Rattus norvegicus
gtccacttacacgtgcactgaaagg

SEQ ID NO: 492559 - DNA, 25 bp, Rattus norvegicus
gtccacttatgtaactatactttaa

SEQ ID NO: 492560 - DNA, 25 bp, Rattus norvegicus
gtccacttatgttactatactttaa

SEQ ID NO: 492561 - DNA, 25 bp, Rattus norvegicus
gtccacttcattcgcaggtgtccaa

SEQ ID NO: 492562 - DNA, 25 bp, Rattus norvegicus
gtccacttcattggcaggtgtccaa

SEQ ID NO: 492563 - DNA, 25 bp, Rattus norvegicus
gtccacttccataggccttgaacac

SEQ ID NO: 492564 - DNA, 25 bp, Rattus norvegicus
gtccacttccattggccttgaacac

SEQ ID NO: 492565 - DNA, 25 bp, Rattus norvegicus
gtccacttccgaagggagccggtct

SEQ ID NO: 492566 - DNA, 25 bp, Rattus norvegicus
gtccacttccgatgggagccggtct

SEQ ID NO: 492567 - DNA, 25 bp, Rattus norvegicus
gtccacttgatcatccgtttctaaa

SEQ ID NO: 492568 - DNA, 25 bp, Rattus norvegicus
gtccacttgatcttccgtttctaaa

SEQ ID NO: 492569 - DNA, 25 bp, Rattus norvegicus
gtccacttgcatcgtttactatttt

SEQ ID NO: 492570 - DNA, 25 bp, Rattus norvegicus
gtccacttgcatggtttactatttt

SEQ ID NO: 492571 - DNA, 25 bp, Rattus norvegicus
gtccacttggatacccatggtacaa

SEQ ID NO: 492572 - DNA, 25 bp, Rattus norvegicus
gtccacttggattcccatggtacaa

SEQ ID NO: 492573 - DNA, 25 bp, Rattus norvegicus
gtccacttgtggctgaagcgtattt

SEQ ID NO: 492574 - DNA, 25 bp, Rattus norvegicus
gtccacttgtgggtgaagcgtattt

SEQ ID NO: 492575 - DNA, 25 bp, Rattus norvegicus
gtccactttcatctcatgcggctaa

SEQ ID NO: 492576 - DNA, 25 bp, Rattus norvegicus
gtccactttcatgtcatgcggctaa

SEQ ID NO: 492577 - DNA, 25 bp, Rattus norvegicus
gtccactttctgctgtggcaagggc

SEQ ID NO: 492578 - DNA, 25 bp, Rattus norvegicus
gtccactttctggtgtggcaagggc

SEQ ID NO: 492579 - DNA, 25 bp, Rattus norvegicus
gtccactttgaccacgtgtttgaaa

SEQ ID NO: 492580 - DNA, 25 bp, Rattus norvegicus
gtccactttgacgacgtgtttgaaa

SEQ ID NO: 492581 - DNA, 25 bp, Rattus norvegicus
gtccacttttatctccccaagagta

SEQ ID NO: 492582 - DNA, 25 bp, Rattus norvegicus
gtccacttttatgtccccaagagta

SEQ ID NO: 492583 - DNA, 25 bp, Rattus norvegicus
gtccagaaaccaaagcgcgacatgt

SEQ ID NO: 492584 - DNA, 25 bp, Rattus norvegicus
gtccagaaaccatagcgcgacatgt

SEQ ID NO: 492585 - DNA, 25 bp, Rattus norvegicus
gtccagaaatcccaggtgtgcccac

SEQ ID NO: 492586 - DNA, 25 bp, Rattus norvegicus
gtccagaaatccgaggtgtgcccac

SEQ ID NO: 492587 - DNA, 25 bp, Rattus norvegicus
gtccagaaatgacttttctcatcaa

SEQ ID NO: 492588 - DNA, 25 bp, Rattus norvegicus
gtccagaaatgagttttctcatcaa

SEQ ID NO: 492589 - DNA, 25 bp, Rattus norvegicus
gtccagaagacaatttgcagcccct

SEQ ID NO: 492590 - DNA, 25 bp, Rattus norvegicus
gtccagaagacattttgcagcccct

SEQ ID NO: 492591 - DNA, 25 bp, Rattus norvegicus
gtccagaagacgatgcggtcatcct

SEQ ID NO: 492592 - DNA, 25 bp, Rattus norvegicus
gtccagaagacgttgcggtcatcct

SEQ ID NO: 492593 - DNA, 25 bp, Rattus norvegicus
gtccagaaggaccagatgctcctgg

SEQ ID NO: 492594 - DNA, 25 bp, Rattus norvegicus
gtccagaaggacgagatgctcctgg

SEQ ID NO: 492595 - DNA, 25 bp, Rattus norvegicus
gtccagaagtcaatcgaagacgttc

SEQ ID NO: 492596 - DNA, 25 bp, Rattus norvegicus
gtccagaagtcattcgaagacgttc

SEQ ID NO: 492597 - DNA, 25 bp, Rattus norvegicus
gtccagaatagtacctttgtctttt

SEQ ID NO: 492598 - DNA, 25 bp, Rattus norvegicus
gtccagaatagttcctttgtctttt

SEQ ID NO: 492599 - DNA, 25 bp, Rattus norvegicus
gtccagaatgccagtgaaatgctgt

SEQ ID NO: 492600 - DNA, 25 bp, Rattus norvegicus
gtccagaatgcctgtgaaatgctgt

SEQ ID NO: 492601 - DNA, 25 bp, Rattus norvegicus
gtccagaatgtgctgttcgcttcaa

SEQ ID NO: 492602 - DNA, 25 bp, Rattus norvegicus
gtccagaatgtggtgttcgcttcaa

SEQ ID NO: 492603 - DNA, 25 bp, Rattus norvegicus
gtccagaattttccattggtccatt

SEQ ID NO: 492604 - DNA, 25 bp, Rattus norvegicus
gtccagaattttgcattggtccatt

SEQ ID NO: 492605 - DNA, 25 bp, Rattus norvegicus
gtccagacacacattcagaacagtt

SEQ ID NO: 492606 - DNA, 25 bp, Rattus norvegicus
gtccagacacactttcagaacagtt

SEQ ID NO: 492607 - DNA, 25 bp, Rattus norvegicus
gtccagacagacattatacctcgtg

SEQ ID NO: 492608 - DNA, 25 bp, Rattus norvegicus
gtccagacagactttatacctcgtg

SEQ ID NO: 492609 - DNA, 25 bp, Rattus norvegicus
gtccagacagagaataccatccagg

SEQ ID NO: 492610 - DNA, 25 bp, Rattus norvegicus
gtccagacagagtataccatccagg

SEQ ID NO: 492611 - DNA, 25 bp, Rattus norvegicus
gtccagacatgcagaacagtacctt

SEQ ID NO: 492612 - DNA, 25 bp, Rattus norvegicus
gtccagacatgctgaacagtacctt

SEQ ID NO: 492613 - DNA, 25 bp, Rattus norvegicus
gtccagacatttcaggaggttgcct

SEQ ID NO: 492614 - DNA, 25 bp, Rattus norvegicus
gtccagacatttgaggaggttgcct

SEQ ID NO: 492615 - DNA, 25 bp, Rattus norvegicus
gtccagaccccactaaagggagttg

SEQ ID NO: 492616 - DNA, 25 bp, Rattus norvegicus
gtccagaccccagtaaagggagttg

SEQ ID NO: 492617 - DNA, 25 bp, Rattus norvegicus
gtccagaccctgatccttagaagat

SEQ ID NO: 492618 - DNA, 25 bp, Rattus norvegicus
gtccagaccctgttccttagaagat

SEQ ID NO: 492619 - DNA, 25 bp, Rattus norvegicus
gtccagactgtccttggcacggata

SEQ ID NO: 492620 - DNA, 25 bp, Rattus norvegicus
gtccagactgtcgttggcacggata

SEQ ID NO: 492621 - DNA, 25 bp, Rattus norvegicus
gtccagacttggcttttatgcacag

SEQ ID NO: 492622 - DNA, 25 bp, Rattus norvegicus
gtccagacttgggttttatgcacag

SEQ ID NO: 492623 - DNA, 25 bp, Rattus norvegicus
gtccagagacaaagcattttctaca

SEQ ID NO: 492624 - DNA, 25 bp, Rattus norvegicus
gtccagagacaatgcattttctaca

SEQ ID NO: 492625 - DNA, 25 bp, Rattus norvegicus
gtccagagactgatccaagtgccac

SEQ ID NO: 492626 - DNA, 25 bp, Rattus norvegicus
gtccagagactgttccaagtgccac

SEQ ID NO: 492627 - DNA, 25 bp, Rattus norvegicus
gtccagagcagcagcgatgtcgtaa

SEQ ID NO: 492628 - DNA, 25 bp, Rattus norvegicus
gtccagagcagctgcgatgtcgtaa

SEQ ID NO: 492629 - DNA, 25 bp, Rattus norvegicus
gtccagagcctgagcaggtgactca

SEQ ID NO: 492630 - DNA, 25 bp, Rattus norvegicus
gtccagagcctgtgcaggtgactca

SEQ ID NO: 492631 - DNA, 25 bp, Rattus norvegicus
gtccagagctgacctttatcacaga

SEQ ID NO: 492632 - DNA, 25 bp, Rattus norvegicus
gtccagagctgagctttatcacaga

SEQ ID NO: 492633 - DNA, 25 bp, Rattus norvegicus
gtccagaggtggcaactagcaacta

SEQ ID NO: 492634 - DNA, 25 bp, Rattus norvegicus
gtccagaggtgggaactagcaacta

SEQ ID NO: 492635 - DNA, 25 bp, Rattus norvegicus
gtccagagtagtcacatcagtttta

SEQ ID NO: 492636 - DNA, 25 bp, Rattus norvegicus
gtccagagtagtgacatcagtttta

SEQ ID NO: 492637 - DNA, 25 bp, Rattus norvegicus
gtccagagtctcctgaactttgtca

SEQ ID NO: 492638 - DNA, 25 bp, Rattus norvegicus
gtccagagtctcgtgaactttgtca

SEQ ID NO: 492639 - DNA, 25 bp, Rattus norvegicus
gtccagagttgacgcatcatgcttt

SEQ ID NO: 492640 - DNA, 25 bp, Rattus norvegicus
gtccagagttgaggcatcatgcttt

SEQ ID NO: 492641 - DNA, 25 bp, Rattus norvegicus
gtccagataggcaagtctcctgcag

SEQ ID NO: 492642 - DNA, 25 bp, Rattus norvegicus
gtccagataggctagtctcctgcag

SEQ ID NO: 492643 - DNA, 25 bp, Rattus norvegicus
gtccagatctgccactagttttaat

SEQ ID NO: 492644 - DNA, 25 bp, Rattus norvegicus
gtccagatctgcgactagttttaat

SEQ ID NO: 492645 - DNA, 25 bp, Rattus norvegicus
gtccagatgaagatgctctttccaa

SEQ ID NO: 492646 - DNA, 25 bp, Rattus norvegicus
gtccagatgaagttgctctttccaa

SEQ ID NO: 492647 - DNA, 25 bp, Rattus norvegicus
gtccagatgggactttgataccaga

SEQ ID NO: 492648 - DNA, 25 bp, Rattus norvegicus
gtccagatgggagtttgataccaga

SEQ ID NO: 492649 - DNA, 25 bp, Rattus norvegicus
gtccagatgggcacatgcagcacgc

SEQ ID NO: 492650 - DNA, 25 bp, Rattus norvegicus
gtccagatgggctcatgcagcacgc

SEQ ID NO: 492651 - DNA, 25 bp, Rattus norvegicus
gtccagatgtgaacgagggtttcct

SEQ ID NO: 492652 - DNA, 25 bp, Rattus norvegicus
gtccagatgtgatcgagggtttcct

SEQ ID NO: 492653 - DNA, 25 bp, Rattus norvegicus
gtccagattcctcactgttctagag

SEQ ID NO: 492654 - DNA, 25 bp, Rattus norvegicus
gtccagattcctgactgttctagag

SEQ ID NO: 492655 - DNA, 25 bp, Rattus norvegicus
gtccagcaagggatgctttgcccaa

SEQ ID NO: 492656 - DNA, 25 bp, Rattus norvegicus
gtccagcaagggttgctttgcccaa

SEQ ID NO: 492657 - DNA, 25 bp, Rattus norvegicus
gtccagcaatggctttctgctctac

SEQ ID NO: 492658 - DNA, 25 bp, Rattus norvegicus
gtccagcaatgggtttctgctctac

SEQ ID NO: 492659 - DNA, 25 bp, Rattus norvegicus
gtccagcacttcaatgtcattacac

SEQ ID NO: 492660 - DNA, 25 bp, Rattus norvegicus
gtccagcacttctatgtcattacac

SEQ ID NO: 492661 - DNA, 25 bp, Rattus norvegicus
gtccagcagaaacagcctcgctgtt

SEQ ID NO: 492662 - DNA, 25 bp, Rattus norvegicus
gtccagcagaaagagcctcgctgtt

SEQ ID NO: 492663 - DNA, 25 bp, Rattus norvegicus
gtccagcagcttatccaatgtgtga

SEQ ID NO: 492664 - DNA, 25 bp, Rattus norvegicus
gtccagcagcttttccaatgtgtga

SEQ ID NO: 492665 - DNA, 25 bp, Rattus norvegicus
gtccagcaggcgaccagtggatcat

SEQ ID NO: 492666 - DNA, 25 bp, Rattus norvegicus
gtccagcaggcgcatccgggtaaca

SEQ ID NO: 492667 - DNA, 25 bp, Rattus norvegicus
gtccagcaggcggatccgggtaaca

SEQ ID NO: 492668 - DNA, 25 bp, Rattus norvegicus
gtccagcaggcgtccagtggatcat

SEQ ID NO: 492669 - DNA, 25 bp, Rattus norvegicus
gtccagcatccgaattaggcagctt

SEQ ID NO: 492670 - DNA, 25 bp, Rattus norvegicus
gtccagcatccgtattaggcagctt

SEQ ID NO: 492671 - DNA, 25 bp, Rattus norvegicus
gtccagccaaaactgcaaactccag

SEQ ID NO: 492672 - DNA, 25 bp, Rattus norvegicus
gtccagccaaaagtgcaaactccag

SEQ ID NO: 492673 - DNA, 25 bp, Rattus norvegicus
gtccagccagacagtaattcctcag

SEQ ID NO: 492674 - DNA, 25 bp, Rattus norvegicus
gtccagccagactgtaattcctcag

SEQ ID NO: 492675 - DNA, 25 bp, Rattus norvegicus
gtccagccaggacccaatccaattg

SEQ ID NO: 492676 - DNA, 25 bp, Rattus norvegicus
gtccagccaggagccaatccaattg

SEQ ID NO: 492677 - DNA, 25 bp, Rattus norvegicus
gtccagcccaagatcaaaggagaaa

SEQ ID NO: 492678 - DNA, 25 bp, Rattus norvegicus
gtccagcccaagttcaaaggagaaa

SEQ ID NO: 492679 - DNA, 25 bp, Rattus norvegicus
gtccagcccataagcgcattaagtt

SEQ ID NO: 492680 - DNA, 25 bp, Rattus norvegicus
gtccagcccatatgcgcattaagtt

SEQ ID NO: 492681 - DNA, 25 bp, Rattus norvegicus
gtccagccgacacctttaaaaggag

SEQ ID NO: 492682 - DNA, 25 bp, Rattus norvegicus
gtccagccgacagctttaaaaggag

SEQ ID NO: 492683 - DNA, 25 bp, Rattus norvegicus
gtccagccgctgagtagataccaag

SEQ ID NO: 492684 - DNA, 25 bp, Rattus norvegicus
gtccagccgctgtgtagataccaag

SEQ ID NO: 492685 - DNA, 25 bp, Rattus norvegicus
gtccagcctaatctatgggcacttg

SEQ ID NO: 492686 - DNA, 25 bp, Rattus norvegicus
gtccagcctaatgtatgggcacttg

SEQ ID NO: 492687 - DNA, 25 bp, Rattus norvegicus
gtccagcctctgatggcagtagcta

SEQ ID NO: 492688 - DNA, 25 bp, Rattus norvegicus
gtccagcctctgttggcagtagcta

SEQ ID NO: 492689 - DNA, 25 bp, Rattus norvegicus
gtccagcctcttacacttaatataa

SEQ ID NO: 492690 - DNA, 25 bp, Rattus norvegicus
gtccagcctctttcacttaatataa

SEQ ID NO: 492691 - DNA, 25 bp, Rattus norvegicus
gtccagcctgggacgtagggcaaaa

SEQ ID NO: 492692 - DNA, 25 bp, Rattus norvegicus
gtccagcctgggtcgtagggcaaaa

SEQ ID NO: 492693 - DNA, 25 bp, Rattus norvegicus
gtccagcctggtcttgggttagctt

SEQ ID NO: 492694 - DNA, 25 bp, Rattus norvegicus
gtccagcctggtgttgggttagctt

SEQ ID NO: 492695 - DNA, 25 bp, Rattus norvegicus
gtccagccttggagcagagaacaat

SEQ ID NO: 492696 - DNA, 25 bp, Rattus norvegicus
gtccagccttggtgcagagaacaat

SEQ ID NO: 492697 - DNA, 25 bp, Rattus norvegicus
gtccagcgcagcaggcaggaacaga

SEQ ID NO: 492698 - DNA, 25 bp, Rattus norvegicus
gtccagcgcagctggcaggaacaga

SEQ ID NO: 492699 - DNA, 25 bp, Rattus norvegicus
gtccagctcaggactcaacatggag

SEQ ID NO: 492700 - DNA, 25 bp, Rattus norvegicus
gtccagctcaggtctcaacatggag

SEQ ID NO: 492701 - DNA, 25 bp, Rattus norvegicus
gtccagctgaagctccaaatttccc

SEQ ID NO: 492702 - DNA, 25 bp, Rattus norvegicus
gtccagctgaaggtccaaatttccc

SEQ ID NO: 492703 - DNA, 25 bp, Rattus norvegicus
gtccagctgaataaaacaccctcca

SEQ ID NO: 492704 - DNA, 25 bp, Rattus norvegicus
gtccagctgaattaaacaccctcca

SEQ ID NO: 492705 - DNA, 25 bp, Rattus norvegicus
gtccagctgggacctattttgccaa

SEQ ID NO: 492706 - DNA, 25 bp, Rattus norvegicus
gtccagctgggagctattttgccaa

SEQ ID NO: 492707 - DNA, 25 bp, Rattus norvegicus
gtccagcttcctagctaaggtttga

SEQ ID NO: 492708 - DNA, 25 bp, Rattus norvegicus
gtccagcttccttgctaaggtttga

SEQ ID NO: 492709 - DNA, 25 bp, Rattus norvegicus
gtccagcttgacacccggacttcag

SEQ ID NO: 492710 - DNA, 25 bp, Rattus norvegicus
gtccagcttgactcccggacttcag

SEQ ID NO: 492711 - DNA, 25 bp, Rattus norvegicus
gtccagcttggaacctaggccaggt

SEQ ID NO: 492712 - DNA, 25 bp, Rattus norvegicus
gtccagcttggatcctaggccaggt

SEQ ID NO: 492713 - DNA, 25 bp, Rattus norvegicus
gtccagcttggcctgggatttatat

SEQ ID NO: 492714 - DNA, 25 bp, Rattus norvegicus
gtccagcttggcgtgggatttatat

SEQ ID NO: 492715 - DNA, 25 bp, Rattus norvegicus
gtccagctttatatctaaaagattg

SEQ ID NO: 492716 - DNA, 25 bp, Rattus norvegicus
gtccagctttatttctaaaagattg

SEQ ID NO: 492717 - DNA, 25 bp, Rattus norvegicus
gtccaggaaaacacttctgtcttaa

SEQ ID NO: 492718 - DNA, 25 bp, Rattus norvegicus
gtccaggaaaactcttctgtcttaa

SEQ ID NO: 492719 - DNA, 25 bp, Rattus norvegicus
gtccaggaattccaagccacagcat

SEQ ID NO: 492720 - DNA, 25 bp, Rattus norvegicus
gtccaggaattcgaagccacagcat

SEQ ID NO: 492721 - DNA, 25 bp, Rattus norvegicus
gtccaggaccacaccatgagtttga

SEQ ID NO: 492722 - DNA, 25 bp, Rattus norvegicus
gtccaggaccactccatgagtttga

SEQ ID NO: 492723 - DNA, 25 bp, Rattus norvegicus
gtccaggacgccagctcaagtgagg

SEQ ID NO: 492724 - DNA, 25 bp, Rattus norvegicus
gtccaggacgcctgctcaagtgagg

SEQ ID NO: 492725 - DNA, 25 bp, Rattus norvegicus
gtccaggactagatttactttcaca

SEQ ID NO: 492726 - DNA, 25 bp, Rattus norvegicus
gtccaggactagttttactttcaca

SEQ ID NO: 492727 - DNA, 25 bp, Rattus norvegicus
gtccaggagacacatcagcccaggt

SEQ ID NO: 492728 - DNA, 25 bp, Rattus norvegicus
gtccaggagacagatcagcccaggt

SEQ ID NO: 492729 - DNA, 25 bp, Rattus norvegicus
gtccaggagggactgtctgacaccc

SEQ ID NO: 492730 - DNA, 25 bp, Rattus norvegicus
gtccaggagggagtgtctgacaccc

SEQ ID NO: 492731 - DNA, 25 bp, Rattus norvegicus
gtccaggaggtcagctacagggtct

SEQ ID NO: 492732 - DNA, 25 bp, Rattus norvegicus
gtccaggaggtctgctacagggtct

SEQ ID NO: 492733 - DNA, 25 bp, Rattus norvegicus
gtccaggcaactaggttttttatat

SEQ ID NO: 492734 - DNA, 25 bp, Rattus norvegicus
gtccaggcaacttggttttttatat

SEQ ID NO: 492735 - DNA, 25 bp, Rattus norvegicus
gtccaggcaatccagtatgagctct

SEQ ID NO: 492736 - DNA, 25 bp, Rattus norvegicus
gtccaggcaatcgagtatgagctct

SEQ ID NO: 492737 - DNA, 25 bp, Rattus norvegicus
gtccaggcagcccaaagatctgtgg

SEQ ID NO: 492738 - DNA, 25 bp, Rattus norvegicus
gtccaggcagccgaaagatctgtgg

SEQ ID NO: 492739 - DNA, 25 bp, Rattus norvegicus
gtccaggccattcattctttatatc

SEQ ID NO: 492740 - DNA, 25 bp, Rattus norvegicus
gtccaggccattgattctttatatc

SEQ ID NO: 492741 - DNA, 25 bp, Rattus norvegicus
gtccaggcctttcagtatacagatg

SEQ ID NO: 492742 - DNA, 25 bp, Rattus norvegicus
gtccaggcctttgagtatacagatg

SEQ ID NO: 492743 - DNA, 25 bp, Rattus norvegicus
gtccaggcgcggacacctgggaacc

SEQ ID NO: 492744 - DNA, 25 bp, Rattus norvegicus
gtccaggcgcggtcacctgggaacc

SEQ ID NO: 492745 - DNA, 25 bp, Rattus norvegicus
gtccaggctctaagcagttattcag

SEQ ID NO: 492746 - DNA, 25 bp, Rattus norvegicus
gtccaggctctatgcagttattcag

SEQ ID NO: 492747 - DNA, 25 bp, Rattus norvegicus
gtccaggctgatcccattcaagagg

SEQ ID NO: 492748 - DNA, 25 bp, Rattus norvegicus
gtccaggctgatgccattcaagagg

SEQ ID NO: 492749 - DNA, 25 bp, Rattus norvegicus
gtccagggagcacttgtacgattta

SEQ ID NO: 492750 - DNA, 25 bp, Rattus norvegicus
gtccagggagcagttgtacgattta

SEQ ID NO: 492751 - DNA, 25 bp, Rattus norvegicus
gtccagggatgacgcttaagatctt

SEQ ID NO: 492752 - DNA, 25 bp, Rattus norvegicus
gtccagggatgaggcttaagatctt

SEQ ID NO: 492753 - DNA, 25 bp, Rattus norvegicus
gtccagggcacacatgtcaatcatt

SEQ ID NO: 492754 - DNA, 25 bp, Rattus norvegicus
gtccagggcacagatgtcaatcatt

SEQ ID NO: 492755 - DNA, 25 bp, Rattus norvegicus
gtccagggcctaagcggagtatctc

SEQ ID NO: 492756 - DNA, 25 bp, Rattus norvegicus
gtccagggcctatgcggagtatctc

SEQ ID NO: 492757 - DNA, 25 bp, Rattus norvegicus
gtccagggctatcgctgtgactctg

SEQ ID NO: 492758 - DNA, 25 bp, Rattus norvegicus
gtccagggctatggctgtgactctg

SEQ ID NO: 492759 - DNA, 25 bp, Rattus norvegicus
gtccagggctctcatctgttgaaaa

SEQ ID NO: 492760 - DNA, 25 bp, Rattus norvegicus
gtccagggctctgatctgttgaaaa

SEQ ID NO: 492761 - DNA, 25 bp, Rattus norvegicus
gtccagggtggcactttgtgaaagt

SEQ ID NO: 492762 - DNA, 25 bp, Rattus norvegicus
gtccagggtggctctttgtgaaagt

SEQ ID NO: 492763 - DNA, 25 bp, Rattus norvegicus
gtccaggtactacgattggccttgg

SEQ ID NO: 492764 - DNA, 25 bp, Rattus norvegicus
gtccaggtactaggattggccttgg

SEQ ID NO: 492765 - DNA, 25 bp, Rattus norvegicus
gtccaggtagacacatttagctttt

SEQ ID NO: 492766 - DNA, 25 bp, Rattus norvegicus
gtccaggtagactcatttagctttt

SEQ ID NO: 492767 - DNA, 25 bp, Rattus norvegicus
gtccaggtccaacgcactacagcga

SEQ ID NO: 492768 - DNA, 25 bp, Rattus norvegicus
gtccaggtccaaggcactacagcga

SEQ ID NO: 492769 - DNA, 25 bp, Rattus norvegicus
gtccaggtccatagttttcaccaat

SEQ ID NO: 492770 - DNA, 25 bp, Rattus norvegicus
gtccaggtccattgttttcaccaat

SEQ ID NO: 492771 - DNA, 25 bp, Rattus norvegicus
gtccaggtctccagagcttaaagca

SEQ ID NO: 492772 - DNA, 25 bp, Rattus norvegicus
gtccaggtctcctgagcttaaagca

SEQ ID NO: 492773 - DNA, 25 bp, Rattus norvegicus
gtccaggtgcttactgctgtgtgtg

SEQ ID NO: 492774 - DNA, 25 bp, Rattus norvegicus
gtccaggtgctttctgctgtgtgtg

SEQ ID NO: 492775 - DNA, 25 bp, Rattus norvegicus
gtccaggtgtgaccagctcatggaa

SEQ ID NO: 492776 - DNA, 25 bp, Rattus norvegicus
gtccaggtgtgagcagctcatggaa

SEQ ID NO: 492777 - DNA, 25 bp, Rattus norvegicus
gtccaggtgtggcttggaaaggatg

SEQ ID NO: 492778 - DNA, 25 bp, Rattus norvegicus
gtccaggtgtgggttggaaaggatg

SEQ ID NO: 492779 - DNA, 25 bp, Rattus norvegicus
gtccaggtgttaactgtctctgtaa

SEQ ID NO: 492780 - DNA, 25 bp, Rattus norvegicus
gtccaggtgttatctgtctctgtaa

SEQ ID NO: 492781 - DNA, 25 bp, Rattus norvegicus
gtccaggtttgtagtctcgggtaag

SEQ ID NO: 492782 - DNA, 25 bp, Rattus norvegicus
gtccaggtttgttgtctcgggtaag

SEQ ID NO: 492783 - DNA, 25 bp, Rattus norvegicus
gtccaggttttcaggtcttcattaa

SEQ ID NO: 492784 - DNA, 25 bp, Rattus norvegicus
gtccaggttttctggtcttcattaa

SEQ ID NO: 492785 - DNA, 25 bp, Rattus norvegicus
gtccagtaacaaagaccttgaacta

SEQ ID NO: 492786 - DNA, 25 bp, Rattus norvegicus
gtccagtaacaatgaccttgaacta

SEQ ID NO: 492787 - DNA, 25 bp, Rattus norvegicus
gtccagtataaacttcaagttgtcg

SEQ ID NO: 492788 - DNA, 25 bp, Rattus norvegicus
gtccagtataaagttcaagttgtcg

SEQ ID NO: 492789 - DNA, 25 bp, Rattus norvegicus
gtccagtatcttcctgtgagtgact

SEQ ID NO: 492790 - DNA, 25 bp, Rattus norvegicus
gtccagtatcttgctgtgagtgact

SEQ ID NO: 492791 - DNA, 25 bp, Rattus norvegicus
gtccagtatggcagtatagggttaa

SEQ ID NO: 492792 - DNA, 25 bp, Rattus norvegicus
gtccagtatggctgtatagggttaa

SEQ ID NO: 492793 - DNA, 25 bp, Rattus norvegicus
gtccagtcagttacagattcatcat

SEQ ID NO: 492794 - DNA, 25 bp, Rattus norvegicus
gtccagtcagtttcagattcatcat

SEQ ID NO: 492795 - DNA, 25 bp, Rattus norvegicus
gtccagtccctcactgtgtttataa

SEQ ID NO: 492796 - DNA, 25 bp, Rattus norvegicus
gtccagtccctctctgtgtttataa

SEQ ID NO: 492797 - DNA, 25 bp, Rattus norvegicus
gtccagtcctgcctatgtgaaaagt

SEQ ID NO: 492798 - DNA, 25 bp, Rattus norvegicus
gtccagtcctgcgtatgtgaaaagt

SEQ ID NO: 492799 - DNA, 25 bp, Rattus norvegicus
gtccagtcctggctcaaacacgaga

SEQ ID NO: 492800 - DNA, 25 bp, Rattus norvegicus
gtccagtcctgggtcaaacacgaga

SEQ ID NO: 492801 - DNA, 25 bp, Rattus norvegicus
gtccagtccttgagatgtgtctgac

SEQ ID NO: 492802 - DNA, 25 bp, Rattus norvegicus
gtccagtccttgatgatgtccagaa

SEQ ID NO: 492803 - DNA, 25 bp, Rattus norvegicus
gtccagtccttgtgatgtgtctgac

SEQ ID NO: 492804 - DNA, 25 bp, Rattus norvegicus
gtccagtccttgttgatgtccagaa

SEQ ID NO: 492805 - DNA, 25 bp, Rattus norvegicus
gtccagtctgtgcaagtcatacaag

SEQ ID NO: 492806 - DNA, 25 bp, Rattus norvegicus
gtccagtctgtggaagtcatacaag

SEQ ID NO: 492807 - DNA, 25 bp, Rattus norvegicus
gtccagtcttagaaagcgctgcctg

SEQ ID NO: 492808 - DNA, 25 bp, Rattus norvegicus
gtccagtcttagtaagcgctgcctg

SEQ ID NO: 492809 - DNA, 25 bp, Rattus norvegicus
gtccagtcttcaaatcatattcacc

SEQ ID NO: 492810 - DNA, 25 bp, Rattus norvegicus
gtccagtcttcatatcatattcacc

SEQ ID NO: 492811 - DNA, 25 bp, Rattus norvegicus
gtccagtgagttcctcagtctggaa

SEQ ID NO: 492812 - DNA, 25 bp, Rattus norvegicus
gtccagtgagttgctcagtctggaa

SEQ ID NO: 492813 - DNA, 25 bp, Rattus norvegicus
gtccagtggatcatccagtgtgctc

SEQ ID NO: 492814 - DNA, 25 bp, Rattus norvegicus
gtccagtggatcttccagtgtgctc

SEQ ID NO: 492815 - DNA, 25 bp, Rattus norvegicus
gtccagtggccaccttatggtgtga

SEQ ID NO: 492816 - DNA, 25 bp, Rattus norvegicus
gtccagtggccagcttatggtgtga

SEQ ID NO: 492817 - DNA, 25 bp, Rattus norvegicus
gtccagtggtgtacaggctttctag

SEQ ID NO: 492818 - DNA, 25 bp, Rattus norvegicus
gtccagtggtgttcaggctttctag

SEQ ID NO: 492819 - DNA, 25 bp, Rattus norvegicus
gtccagtgtctcagggttactgaca

SEQ ID NO: 492820 - DNA, 25 bp, Rattus norvegicus
gtccagtgtctctgggttactgaca

SEQ ID NO: 492821 - DNA, 25 bp, Rattus norvegicus
gtccagtgtgctcatctgaggagcc

SEQ ID NO: 492822 - DNA, 25 bp, Rattus norvegicus
gtccagtgtgctgatctgaggagcc

SEQ ID NO: 492823 - DNA, 25 bp, Rattus norvegicus
gtccagtgtgtcataaacctcatag

SEQ ID NO: 492824 - DNA, 25 bp, Rattus norvegicus
gtccagtgtgtcttaaacctcatag

SEQ ID NO: 492825 - DNA, 25 bp, Rattus norvegicus
gtccagtgtttacacgacagtggca

SEQ ID NO: 492826 - DNA, 25 bp, Rattus norvegicus
gtccagtgtttagacgacagtggca

SEQ ID NO: 492827 - DNA, 25 bp, Rattus norvegicus
gtccagttacacatggcaggtccta

SEQ ID NO: 492828 - DNA, 25 bp, Rattus norvegicus
gtccagttacacttggcaggtccta

SEQ ID NO: 492829 - DNA, 25 bp, Rattus norvegicus
gtccagttcacaagggagcgagcca

SEQ ID NO: 492830 - DNA, 25 bp, Rattus norvegicus
gtccagttcacatgggagcgagcca

SEQ ID NO: 492831 - DNA, 25 bp, Rattus norvegicus
gtccagtttcataacagccttattg

SEQ ID NO: 492832 - DNA, 25 bp, Rattus norvegicus
gtccagtttcattacagccttattg

SEQ ID NO: 492833 - DNA, 25 bp, Rattus norvegicus
gtccagtttgtacagactattgtat

SEQ ID NO: 492834 - DNA, 25 bp, Rattus norvegicus
gtccagtttgtagagactattgtat

SEQ ID NO: 492835 - DNA, 25 bp, Rattus norvegicus
gtccagttttatagcattccttcat

SEQ ID NO: 492836 - DNA, 25 bp, Rattus norvegicus
gtccagttttattgcattccttcat

SEQ ID NO: 492837 - DNA, 25 bp, Rattus norvegicus
gtccagttttgacatgactcggtct

SEQ ID NO: 492838 - DNA, 25 bp, Rattus norvegicus
gtccagttttgagatgactcggtct

SEQ ID NO: 492839 - DNA, 25 bp, Rattus norvegicus
gtccagtttttcatgtagcagcagc

SEQ ID NO: 492840 - DNA, 25 bp, Rattus norvegicus
gtccagtttttcttgtagcagcagc

SEQ ID NO: 492841 - DNA, 25 bp, Rattus norvegicus
gtccataaacatacaagaagcctac

SEQ ID NO: 492842 - DNA, 25 bp, Rattus norvegicus
gtccataaacattcaagaagcctac

SEQ ID NO: 492843 - DNA, 25 bp, Rattus norvegicus
gtccatacagtgctctatcatttgc

SEQ ID NO: 492844 - DNA, 25 bp, Rattus norvegicus
gtccatacagtggtctatcatttgc

SEQ ID NO: 492845 - DNA, 25 bp, Rattus norvegicus
gtccatacccaacagcaaatgcgtt

SEQ ID NO: 492846 - DNA, 25 bp, Rattus norvegicus
gtccatacccaagagcaaatgcgtt

SEQ ID NO: 492847 - DNA, 25 bp, Rattus norvegicus
gtccatacttttccagaagcatcca

SEQ ID NO: 492848 - DNA, 25 bp, Rattus norvegicus
gtccatacttttgcagaagcatcca

SEQ ID NO: 492849 - DNA, 25 bp, Rattus norvegicus
gtccatagcagcacctttcatagaa

SEQ ID NO: 492850 - DNA, 25 bp, Rattus norvegicus
gtccatagcagctcctttcatagaa

SEQ ID NO: 492851 - DNA, 25 bp, Rattus norvegicus
gtccatagcatcactgactgacatg

SEQ ID NO: 492852 - DNA, 25 bp, Rattus norvegicus
gtccatagcatctctgactgacatg

SEQ ID NO: 492853 - DNA, 25 bp, Rattus norvegicus
gtccatagcattatattcagagcag

SEQ ID NO: 492854 - DNA, 25 bp, Rattus norvegicus
gtccatagcattttattcagagcag

SEQ ID NO: 492855 - DNA, 25 bp, Rattus norvegicus
gtccatatcagtataccttttgttt

SEQ ID NO: 492856 - DNA, 25 bp, Rattus norvegicus
gtccatatcagtttaccttttgttt

SEQ ID NO: 492857 - DNA, 25 bp, Rattus norvegicus
gtccatatgcgaaaccttctaaaga

SEQ ID NO: 492858 - DNA, 25 bp, Rattus norvegicus
gtccatatgcgataccttctaaaga

SEQ ID NO: 492859 - DNA, 25 bp, Rattus norvegicus
gtccatatgtatatcaacttctgag

SEQ ID NO: 492860 - DNA, 25 bp, Rattus norvegicus
gtccatatgtatttcaacttctgag

SEQ ID NO: 492861 - DNA, 25 bp, Rattus norvegicus
gtccatatgtttaaagcccttctgt

SEQ ID NO: 492862 - DNA, 25 bp, Rattus norvegicus
gtccatatgttttaagcccttctgt

SEQ ID NO: 492863 - DNA, 25 bp, Rattus norvegicus
gtccatattgtcacatctgtgatga

SEQ ID NO: 492864 - DNA, 25 bp, Rattus norvegicus
gtccatattgtctcatctgtgatga

SEQ ID NO: 492865 - DNA, 25 bp, Rattus norvegicus
gtccatcacataaagctcagctcag

SEQ ID NO: 492866 - DNA, 25 bp, Rattus norvegicus
gtccatcacatatagctcagctcag

SEQ ID NO: 492867 - DNA, 25 bp, Rattus norvegicus
gtccatcacattcttcgggcttcag

SEQ ID NO: 492868 - DNA, 25 bp, Rattus norvegicus
gtccatcacattgttcgggcttcag

SEQ ID NO: 492869 - DNA, 25 bp, Rattus norvegicus
gtccatcagtgtaaactccctgaga

SEQ ID NO: 492870 - DNA, 25 bp, Rattus norvegicus
gtccatcagtgttaactccctgaga

SEQ ID NO: 492871 - DNA, 25 bp, Rattus norvegicus
gtccatcatccacggaagtcagcag

SEQ ID NO: 492872 - DNA, 25 bp, Rattus norvegicus
gtccatcatccagggaagtcagcag

SEQ ID NO: 492873 - DNA, 25 bp, Rattus norvegicus
gtccatccaaacctcaagagctttg

SEQ ID NO: 492874 - DNA, 25 bp, Rattus norvegicus
gtccatccaaacgtcaagagctttg

SEQ ID NO: 492875 - DNA, 25 bp, Rattus norvegicus
gtccatccagatcccatgtgaagca

SEQ ID NO: 492876 - DNA, 25 bp, Rattus norvegicus
gtccatccagatgccatgtgaagca

SEQ ID NO: 492877 - DNA, 25 bp, Rattus norvegicus
gtccatcccagtccgaattctgaca

SEQ ID NO: 492878 - DNA, 25 bp, Rattus norvegicus
gtccatcccagtgcgaattctgaca

SEQ ID NO: 492879 - DNA, 25 bp, Rattus norvegicus
gtccatcccgtgcaaatggctgttt

SEQ ID NO: 492880 - DNA, 25 bp, Rattus norvegicus
gtccatcccgtggaaatggctgttt

SEQ ID NO: 492881 - DNA, 25 bp, Rattus norvegicus
gtccatcctgcaccattaatacaat

SEQ ID NO: 492882 - DNA, 25 bp, Rattus norvegicus
gtccatcctgcagcattaatacaat

SEQ ID NO: 492883 - DNA, 25 bp, Rattus norvegicus
gtccatcctggactttagtgtttgt

SEQ ID NO: 492884 - DNA, 25 bp, Rattus norvegicus
gtccatcctggagtttagtgtttgt

SEQ ID NO: 492885 - DNA, 25 bp, Rattus norvegicus
gtccatcctgtgatgcaaattctgt

SEQ ID NO: 492886 - DNA, 25 bp, Rattus norvegicus
gtccatcctgtgttgcaaattctgt

SEQ ID NO: 492887 - DNA, 25 bp, Rattus norvegicus
gtccatccttccagcagcggttgtg

SEQ ID NO: 492888 - DNA, 25 bp, Rattus norvegicus
gtccatccttcctgcagcggttgtg

SEQ ID NO: 492889 - DNA, 25 bp, Rattus norvegicus
gtccatcgagcacagctgggcgcca

SEQ ID NO: 492890 - DNA, 25 bp, Rattus norvegicus
gtccatcgagcagagctgggcgcca

SEQ ID NO: 492891 - DNA, 25 bp, Rattus norvegicus
gtccatcggactcccctgggatctg

SEQ ID NO: 492892 - DNA, 25 bp, Rattus norvegicus
gtccatcggactgccctgggatctg

SEQ ID NO: 492893 - DNA, 25 bp, Rattus norvegicus
gtccatcgtggacttgacatgtgcc

SEQ ID NO: 492894 - DNA, 25 bp, Rattus norvegicus
gtccatcgtggagttgacatgtgcc

SEQ ID NO: 492895 - DNA, 25 bp, Rattus norvegicus
gtccatctaaggagtccagggttta

SEQ ID NO: 492896 - DNA, 25 bp, Rattus norvegicus
gtccatctaaggtgtccagggttta

SEQ ID NO: 492897 - DNA, 25 bp, Rattus norvegicus
gtccatctacgtcggctgcgataaa

SEQ ID NO: 492898 - DNA, 25 bp, Rattus norvegicus
gtccatctacgtgggctgcgataaa

SEQ ID NO: 492899 - DNA, 25 bp, Rattus norvegicus
gtccatctactcacttctgtgggtt

SEQ ID NO: 492900 - DNA, 25 bp, Rattus norvegicus
gtccatctactctcttctgtgggtt

SEQ ID NO: 492901 - DNA, 25 bp, Rattus norvegicus
gtccatctagtgatagccatgacgc

SEQ ID NO: 492902 - DNA, 25 bp, Rattus norvegicus
gtccatctagtgttagccatgacgc

SEQ ID NO: 492903 - DNA, 25 bp, Rattus norvegicus
gtccatctgcacaggacagatttgt

SEQ ID NO: 492904 - DNA, 25 bp, Rattus norvegicus
gtccatctgcactggacagatttgt

SEQ ID NO: 492905 - DNA, 25 bp, Rattus norvegicus
gtccatctgcagcatgttacttacc

SEQ ID NO: 492906 - DNA, 25 bp, Rattus norvegicus
gtccatctgcaggatgttacttacc

SEQ ID NO: 492907 - DNA, 25 bp, Rattus norvegicus
gtccatctgctcatgctttacatta

SEQ ID NO: 492908 - DNA, 25 bp, Rattus norvegicus
gtccatctgctcttgctttacatta

SEQ ID NO: 492909 - DNA, 25 bp, Rattus norvegicus
gtccatctggaacacatgctagccc

SEQ ID NO: 492910 - DNA, 25 bp, Rattus norvegicus
gtccatctggaagacatgctagccc

SEQ ID NO: 492911 - DNA, 25 bp, Rattus norvegicus
gtccatcttaagagtctaacaaaag

SEQ ID NO: 492912 - DNA, 25 bp, Rattus norvegicus
gtccatcttaagtgtctaacaaaag

SEQ ID NO: 492913 - DNA, 25 bp, Rattus norvegicus
gtccatcttcaacttcttcgcggaa

SEQ ID NO: 492914 - DNA, 25 bp, Rattus norvegicus
gtccatcttcaagttcttcgcggaa

SEQ ID NO: 492915 - DNA, 25 bp, Rattus norvegicus
gtccatcttccaacaaactttatcg

SEQ ID NO: 492916 - DNA, 25 bp, Rattus norvegicus
gtccatcttccatcaaactttatcg

SEQ ID NO: 492917 - DNA, 25 bp, Rattus norvegicus
gtccatcttctcatcttattgtaaa

SEQ ID NO: 492918 - DNA, 25 bp, Rattus norvegicus
gtccatcttctcttcttattgtaaa

SEQ ID NO: 492919 - DNA, 25 bp, Rattus norvegicus
gtccatcttggaacgtacttaatac

SEQ ID NO: 492920 - DNA, 25 bp, Rattus norvegicus
gtccatcttggatcgtacttaatac

SEQ ID NO: 492921 - DNA, 25 bp, Rattus norvegicus
gtccatcttgttctcagcagggtga

SEQ ID NO: 492922 - DNA, 25 bp, Rattus norvegicus
gtccatcttgttgtcagcagggtga

SEQ ID NO: 492923 - DNA, 25 bp, Rattus norvegicus
gtccatctttctcgtgctatgtaat

SEQ ID NO: 492924 - DNA, 25 bp, Rattus norvegicus
gtccatctttctcgtttatgcaaag

SEQ ID NO: 492925 - DNA, 25 bp, Rattus norvegicus
gtccatctttctggtgctatgtaat

SEQ ID NO: 492926 - DNA, 25 bp, Rattus norvegicus
gtccatctttctggtttatgcaaag

SEQ ID NO: 492927 - DNA, 25 bp, Rattus norvegicus
gtccatcttttgatgaatcatcagg

SEQ ID NO: 492928 - DNA, 25 bp, Rattus norvegicus
gtccatcttttgttgaatcatcagg

SEQ ID NO: 492929 - DNA, 25 bp, Rattus norvegicus
gtccatgaacatatgtttctctgaa

SEQ ID NO: 492930 - DNA, 25 bp, Rattus norvegicus
gtccatgaacatttgtttctctgaa

SEQ ID NO: 492931 - DNA, 25 bp, Rattus norvegicus
gtccatgaacttaagctactcgtgt

SEQ ID NO: 492932 - DNA, 25 bp, Rattus norvegicus
gtccatgaactttagctactcgtgt

SEQ ID NO: 492933 - DNA, 25 bp, Rattus norvegicus
gtccatgaagtcactagcctcaagc

SEQ ID NO: 492934 - DNA, 25 bp, Rattus norvegicus
gtccatgaagtctctagcctcaagc

SEQ ID NO: 492935 - DNA, 25 bp, Rattus norvegicus
gtccatgacctacactacttgagaa

SEQ ID NO: 492936 - DNA, 25 bp, Rattus norvegicus
gtccatgacctagactacttgagaa

SEQ ID NO: 492937 - DNA, 25 bp, Rattus norvegicus
gtccatgactatcctggtgtaacca

SEQ ID NO: 492938 - DNA, 25 bp, Rattus norvegicus
gtccatgactatgctggtgtaacca

SEQ ID NO: 492939 - DNA, 25 bp, Rattus norvegicus
gtccatgactccagtttcaagggat

SEQ ID NO: 492940 - DNA, 25 bp, Rattus norvegicus
gtccatgactcctgtttcaagggat

SEQ ID NO: 492941 - DNA, 25 bp, Rattus norvegicus
gtccatgagcacagtgtcttctttg

SEQ ID NO: 492942 - DNA, 25 bp, Rattus norvegicus
gtccatgagcactgtgtcttctttg

SEQ ID NO: 492943 - DNA, 25 bp, Rattus norvegicus
gtccatgagcttctgaatattcaag

SEQ ID NO: 492944 - DNA, 25 bp, Rattus norvegicus
gtccatgagcttgtgaatattcaag

SEQ ID NO: 492945 - DNA, 25 bp, Rattus norvegicus
gtccatgcagctctgtgccagggca

SEQ ID NO: 492946 - DNA, 25 bp, Rattus norvegicus
gtccatgcagctgtgtgccagggca

SEQ ID NO: 492947 - DNA, 25 bp, Rattus norvegicus
gtccatgcatgtaaccccacaggga

SEQ ID NO: 492948 - DNA, 25 bp, Rattus norvegicus
gtccatgcatgttaccccacaggga

SEQ ID NO: 492949 - DNA, 25 bp, Rattus norvegicus
gtccatgctactcgaattaaagtta

SEQ ID NO: 492950 - DNA, 25 bp, Rattus norvegicus
gtccatgctactggaattaaagtta

SEQ ID NO: 492951 - DNA, 25 bp, Rattus norvegicus
gtccatggccttagtgttcttattg

SEQ ID NO: 492952 - DNA, 25 bp, Rattus norvegicus
gtccatggcctttgtgttcttattg

SEQ ID NO: 492953 - DNA, 25 bp, Rattus norvegicus
gtccatggcgacaggcaaaaacctt

SEQ ID NO: 492954 - DNA, 25 bp, Rattus norvegicus
gtccatggcgactggcaaaaacctt

SEQ ID NO: 492955 - DNA, 25 bp, Rattus norvegicus
gtccatggtaggattcccagagatc

SEQ ID NO: 492956 - DNA, 25 bp, Rattus norvegicus
gtccatggtaggtttcccagagatc

SEQ ID NO: 492957 - DNA, 25 bp, Rattus norvegicus
gtccatggtcatcagatattgctaa

SEQ ID NO: 492958 - DNA, 25 bp, Rattus norvegicus
gtccatggtcatgagatattgctaa

SEQ ID NO: 492959 - DNA, 25 bp, Rattus norvegicus
gtccatggtcggatagtggagctgt

SEQ ID NO: 492960 - DNA, 25 bp, Rattus norvegicus
gtccatggtcggttagtggagctgt

SEQ ID NO: 492961 - DNA, 25 bp, Rattus norvegicus
gtccatgtaaccactttgaattctt

SEQ ID NO: 492962 - DNA, 25 bp, Rattus norvegicus
gtccatgtaacctctttgaattctt

SEQ ID NO: 492963 - DNA, 25 bp, Rattus norvegicus
gtccatgtagttctgactgcagcag

SEQ ID NO: 492964 - DNA, 25 bp, Rattus norvegicus
gtccatgtagttgtgactgcagcag

SEQ ID NO: 492965 - DNA, 25 bp, Rattus norvegicus
gtccatgtatgtcagggtgttgaat

SEQ ID NO: 492966 - DNA, 25 bp, Rattus norvegicus
gtccatgtatgtgagggtgttgaat

SEQ ID NO: 492967 - DNA, 25 bp, Rattus norvegicus
gtccatgtcaggaaccattcagttg

SEQ ID NO: 492968 - DNA, 25 bp, Rattus norvegicus
gtccatgtcaggtaccattcagttg

SEQ ID NO: 492969 - DNA, 25 bp, Rattus norvegicus
gtccatgtcccaaggtgatagctat

SEQ ID NO: 492970 - DNA, 25 bp, Rattus norvegicus
gtccatgtcccatggtgatagctat

SEQ ID NO: 492971 - DNA, 25 bp, Rattus norvegicus
gtccatgtgacaacagaacctcctg

SEQ ID NO: 492972 - DNA, 25 bp, Rattus norvegicus
gtccatgtgacatcagaacctcctg

SEQ ID NO: 492973 - DNA, 25 bp, Rattus norvegicus
gtccatgtgtgtcttgctgtagtca

SEQ ID NO: 492974 - DNA, 25 bp, Rattus norvegicus
gtccatgtgtgtgttgctgtagtca

SEQ ID NO: 492975 - DNA, 25 bp, Rattus norvegicus
gtccatgttcacatcagttgagctg

SEQ ID NO: 492976 - DNA, 25 bp, Rattus norvegicus
gtccatgttcacttcagttgagctg

SEQ ID NO: 492977 - DNA, 25 bp, Rattus norvegicus
gtccatgttctccattctacttgaa

SEQ ID NO: 492978 - DNA, 25 bp, Rattus norvegicus
gtccatgttctcgattctacttgaa

SEQ ID NO: 492979 - DNA, 25 bp, Rattus norvegicus
gtccatgttctgcaactcacacaat

SEQ ID NO: 492980 - DNA, 25 bp, Rattus norvegicus
gtccatgttctggaactcacacaat

SEQ ID NO: 492981 - DNA, 25 bp, Rattus norvegicus
gtccatgttggaatcgatcagggta

SEQ ID NO: 492982 - DNA, 25 bp, Rattus norvegicus
gtccatgttggattcgatcagggta

SEQ ID NO: 492983 - DNA, 25 bp, Rattus norvegicus
gtccattatcatagcacgtttttaa

SEQ ID NO: 492984 - DNA, 25 bp, Rattus norvegicus
gtccattatcattgcacgtttttaa

SEQ ID NO: 492985 - DNA, 25 bp, Rattus norvegicus
gtccattcaaatcacttgtgcttac

SEQ ID NO: 492986 - DNA, 25 bp, Rattus norvegicus
gtccattcaaatgacttgtgcttac

SEQ ID NO: 492987 - DNA, 25 bp, Rattus norvegicus
gtccattcacgcagttttgtaacca

SEQ ID NO: 492988 - DNA, 25 bp, Rattus norvegicus
gtccattcacgctgttttgtaacca

SEQ ID NO: 492989 - DNA, 25 bp, Rattus norvegicus
gtccattcatctaattacgtcactg

SEQ ID NO: 492990 - DNA, 25 bp, Rattus norvegicus
gtccattcatcttattacgtcactg

SEQ ID NO: 492991 - DNA, 25 bp, Rattus norvegicus
gtccattcatgtactctgtcgaaga

SEQ ID NO: 492992 - DNA, 25 bp, Rattus norvegicus
gtccattcatgttctctgtcgaaga

SEQ ID NO: 492993 - DNA, 25 bp, Rattus norvegicus
gtccattcccagcactaaggcgact

SEQ ID NO: 492994 - DNA, 25 bp, Rattus norvegicus
gtccattcccaggactaaggcgact

SEQ ID NO: 492995 - DNA, 25 bp, Rattus norvegicus
gtccattcctagagtagacaccctg

SEQ ID NO: 492996 - DNA, 25 bp, Rattus norvegicus
gtccattcctagtgtagacaccctg

SEQ ID NO: 492997 - DNA, 25 bp, Rattus norvegicus
gtccattcctcaaaagtagcactgt

SEQ ID NO: 492998 - DNA, 25 bp, Rattus norvegicus
gtccattcctcataagtagcactgt

SEQ ID NO: 492999 - DNA, 25 bp, Rattus norvegicus
gtccattcttggcttctaactatag

SEQ ID NO: 493000 - DNA, 25 bp, Rattus norvegicus
gtccattcttgggttctaactatag

SEQ ID NO: 493001 - DNA, 25 bp, Rattus norvegicus
gtccattgccaaaggtcagccctga

SEQ ID NO: 493002 - DNA, 25 bp, Rattus norvegicus
gtccattgccaatggtcagccctga

SEQ ID NO: 493003 - DNA, 25 bp, Rattus norvegicus
gtccattgccagcttagacactcgc

SEQ ID NO: 493004 - DNA, 25 bp, Rattus norvegicus
gtccattgccaggttagacactcgc

SEQ ID NO: 493005 - DNA, 25 bp, Rattus norvegicus
gtccattggcttaagtattttcaca

SEQ ID NO: 493006 - DNA, 25 bp, Rattus norvegicus
gtccattggctttagtattttcaca

SEQ ID NO: 493007 - DNA, 25 bp, Rattus norvegicus
gtccattggtgcatctgcagatcta

SEQ ID NO: 493008 - DNA, 25 bp, Rattus norvegicus
gtccattggtgcttctgcagatcta

SEQ ID NO: 493009 - DNA, 25 bp, Rattus norvegicus
gtccattggttaattcctacctcaa

SEQ ID NO: 493010 - DNA, 25 bp, Rattus norvegicus
gtccattggttatttcctacctcaa

SEQ ID NO: 493011 - DNA, 25 bp, Rattus norvegicus
gtccattgtgatcgcccagatctat

SEQ ID NO: 493012 - DNA, 25 bp, Rattus norvegicus
gtccattgtgatggcccagatctat

SEQ ID NO: 493013 - DNA, 25 bp, Rattus norvegicus
gtccattgttcaccatactcattaa

SEQ ID NO: 493014 - DNA, 25 bp, Rattus norvegicus
gtccattgttcagcatactcattaa

SEQ ID NO: 493015 - DNA, 25 bp, Rattus norvegicus
gtccatttacatactattcctttca

SEQ ID NO: 493016 - DNA, 25 bp, Rattus norvegicus
gtccatttacattctattcctttca

SEQ ID NO: 493017 - DNA, 25 bp, Rattus norvegicus
gtccatttattcaagtgttctccag

SEQ ID NO: 493018 - DNA, 25 bp, Rattus norvegicus
gtccatttattctagtgttctccag

SEQ ID NO: 493019 - DNA, 25 bp, Rattus norvegicus
gtccatttcacaccctacttatcag

SEQ ID NO: 493020 - DNA, 25 bp, Rattus norvegicus
gtccatttcacagcctacttatcag

SEQ ID NO: 493021 - DNA, 25 bp, Rattus norvegicus
gtccatttccctaaaactctgagat

SEQ ID NO: 493022 - DNA, 25 bp, Rattus norvegicus
gtccatttcccttaaactctgagat

SEQ ID NO: 493023 - DNA, 25 bp, Rattus norvegicus
gtccatttgtgccactggtcaatgt

SEQ ID NO: 493024 - DNA, 25 bp, Rattus norvegicus
gtccatttgtgcgactggtcaatgt

SEQ ID NO: 493025 - DNA, 25 bp, Rattus norvegicus
gtccattttacaaactagctctccc

SEQ ID NO: 493026 - DNA, 25 bp, Rattus norvegicus
gtccattttacatactagctctccc

SEQ ID NO: 493027 - DNA, 25 bp, Rattus norvegicus
gtccattttagtagccattggcatt

SEQ ID NO: 493028 - DNA, 25 bp, Rattus norvegicus
gtccattttagttgccattggcatt

SEQ ID NO: 493029 - DNA, 25 bp, Rattus norvegicus
gtccattttcagatcttgaccattg

SEQ ID NO: 493030 - DNA, 25 bp, Rattus norvegicus
gtccattttcagttcttgaccattg

SEQ ID NO: 493031 - DNA, 25 bp, Rattus norvegicus
gtccattttcatatgctcatcaggg

SEQ ID NO: 493032 - DNA, 25 bp, Rattus norvegicus
gtccattttcatttgctcatcaggg

SEQ ID NO: 493033 - DNA, 25 bp, Rattus norvegicus
gtccattttctccagatttctgtgc

SEQ ID NO: 493034 - DNA, 25 bp, Rattus norvegicus
gtccattttctcgagatttctgtgc

SEQ ID NO: 493035 - DNA, 25 bp, Rattus norvegicus
gtccatttttgtcatgtctgcgaat

SEQ ID NO: 493036 - DNA, 25 bp, Rattus norvegicus
gtccatttttgtgatgtctgcgaat

SEQ ID NO: 493037 - DNA, 25 bp, Rattus norvegicus
gtcccaaaccgccaccaagaagagg

SEQ ID NO: 493038 - DNA, 25 bp, Rattus norvegicus
gtcccaaaccgcgaccaagaagagg

SEQ ID NO: 493039 - DNA, 25 bp, Rattus norvegicus
gtcccaaagtccatgttaaacctgt

SEQ ID NO: 493040 - DNA, 25 bp, Rattus norvegicus
gtcccaaagtccttgttaaacctgt

SEQ ID NO: 493041 - DNA, 25 bp, Rattus norvegicus
gtcccaaatgcaaggcctggtattg

SEQ ID NO: 493042 - DNA, 25 bp, Rattus norvegicus
gtcccaaatgcatggcctggtattg

SEQ ID NO: 493043 - DNA, 25 bp, Rattus norvegicus
gtcccaaattataccaaaggccaat

SEQ ID NO: 493044 - DNA, 25 bp, Rattus norvegicus
gtcccaaattattccaaaggccaat

SEQ ID NO: 493045 - DNA, 25 bp, Rattus norvegicus
gtcccaacttccacagaactctgat

SEQ ID NO: 493046 - DNA, 25 bp, Rattus norvegicus
gtcccaacttcctcagaactctgat

SEQ ID NO: 493047 - DNA, 25 bp, Rattus norvegicus
gtcccaacttctcaattaactcgtt

SEQ ID NO: 493048 - DNA, 25 bp, Rattus norvegicus
gtcccaacttctgaattaactcgtt

SEQ ID NO: 493049 - DNA, 25 bp, Rattus norvegicus
gtcccaagaaagatggcttgcccta

SEQ ID NO: 493050 - DNA, 25 bp, Rattus norvegicus
gtcccaagaaagttggcttgcccta

SEQ ID NO: 493051 - DNA, 25 bp, Rattus norvegicus
gtcccaagagatagcttcctgataa

SEQ ID NO: 493052 - DNA, 25 bp, Rattus norvegicus
gtcccaagagattgcttcctgataa

SEQ ID NO: 493053 - DNA, 25 bp, Rattus norvegicus
gtcccaagaggcattttactgtata

SEQ ID NO: 493054 - DNA, 25 bp, Rattus norvegicus
gtcccaagaggctttttactgtata

SEQ ID NO: 493055 - DNA, 25 bp, Rattus norvegicus
gtcccaagcagtacagacatgcctt

SEQ ID NO: 493056 - DNA, 25 bp, Rattus norvegicus
gtcccaagcagttcagacatgcctt

SEQ ID NO: 493057 - DNA, 25 bp, Rattus norvegicus
gtcccaagcctgcaagacggtttga

SEQ ID NO: 493058 - DNA, 25 bp, Rattus norvegicus
gtcccaagcctggaagacggtttga

SEQ ID NO: 493059 - DNA, 25 bp, Rattus norvegicus
gtcccaagctcacgatgctcagggt

SEQ ID NO: 493060 - DNA, 25 bp, Rattus norvegicus
gtcccaagctcaggatgctcagggt

SEQ ID NO: 493061 - DNA, 25 bp, Rattus norvegicus
gtcccaaggagaccccagtaacttt

SEQ ID NO: 493062 - DNA, 25 bp, Rattus norvegicus
gtcccaaggagagcccagtaacttt

SEQ ID NO: 493063 - DNA, 25 bp, Rattus norvegicus
gtcccaaggaggagctgtagccatt

SEQ ID NO: 493064 - DNA, 25 bp, Rattus norvegicus
gtcccaaggaggtgctgtagccatt

SEQ ID NO: 493065 - DNA, 25 bp, Rattus norvegicus
gtcccaagggatcaaatgccctctt

SEQ ID NO: 493066 - DNA, 25 bp, Rattus norvegicus
gtcccaagggatgaaatgccctctt

SEQ ID NO: 493067 - DNA, 25 bp, Rattus norvegicus
gtcccaagtagaaattcttccacaa

SEQ ID NO: 493068 - DNA, 25 bp, Rattus norvegicus
gtcccaagtagatattcttccacaa

SEQ ID NO: 493069 - DNA, 25 bp, Rattus norvegicus
gtcccaagtgttcctgtattatcat

SEQ ID NO: 493070 - DNA, 25 bp, Rattus norvegicus
gtcccaagtgttgctgtattatcat

SEQ ID NO: 493071 - DNA, 25 bp, Rattus norvegicus
gtcccaatggctaagcagcgcggcc

SEQ ID NO: 493072 - DNA, 25 bp, Rattus norvegicus
gtcccaatggcttagcagcgcggcc

SEQ ID NO: 493073 - DNA, 25 bp, Rattus norvegicus
gtcccacaagtgctgatagtcttcc

SEQ ID NO: 493074 - DNA, 25 bp, Rattus norvegicus
gtcccacaagtggtgatagtcttcc

SEQ ID NO: 493075 - DNA, 25 bp, Rattus norvegicus
gtcccacacagtctttaaggccttt

SEQ ID NO: 493076 - DNA, 25 bp, Rattus norvegicus
gtcccacacagtgtttaaggccttt

SEQ ID NO: 493077 - DNA, 25 bp, Rattus norvegicus
gtcccacaccctagtggagggccaa

SEQ ID NO: 493078 - DNA, 25 bp, Rattus norvegicus
gtcccacacccttgtggagggccaa

SEQ ID NO: 493079 - DNA, 25 bp, Rattus norvegicus
gtcccacagcccaaggttcaggcaa

SEQ ID NO: 493080 - DNA, 25 bp, Rattus norvegicus
gtcccacagccctaggttcaggcaa

SEQ ID NO: 493081 - DNA, 25 bp, Rattus norvegicus
gtcccacagctcaagtcgataggca

SEQ ID NO: 493082 - DNA, 25 bp, Rattus norvegicus
gtcccacagctctagtcgataggca

SEQ ID NO: 493083 - DNA, 25 bp, Rattus norvegicus
gtcccacaggatcgatacagatgga

SEQ ID NO: 493084 - DNA, 25 bp, Rattus norvegicus
gtcccacaggatggatacagatgga

SEQ ID NO: 493085 - DNA, 25 bp, Rattus norvegicus
gtcccacagtatattcttttgcatt

SEQ ID NO: 493086 - DNA, 25 bp, Rattus norvegicus
gtcccacagtattttcttttgcatt

SEQ ID NO: 493087 - DNA, 25 bp, Rattus norvegicus
gtcccaccaagcataccacggagta

SEQ ID NO: 493088 - DNA, 25 bp, Rattus norvegicus
gtcccaccaagcttaccacggagta

SEQ ID NO: 493089 - DNA, 25 bp, Rattus norvegicus
gtcccaccagctcaggtctgaggaa

SEQ ID NO: 493090 - DNA, 25 bp, Rattus norvegicus
gtcccaccagctgaggtctgaggaa

SEQ ID NO: 493091 - DNA, 25 bp, Rattus norvegicus
gtcccacccagtaatgtaagactgt

SEQ ID NO: 493092 - DNA, 25 bp, Rattus norvegicus
gtcccacccagttatgtaagactgt

SEQ ID NO: 493093 - DNA, 25 bp, Rattus norvegicus
gtcccacctaggattctttttagct

SEQ ID NO: 493094 - DNA, 25 bp, Rattus norvegicus
gtcccacctaggtttctttttagct

SEQ ID NO: 493095 - DNA, 25 bp, Rattus norvegicus
gtcccacctgaaccagtgcattgag

SEQ ID NO: 493096 - DNA, 25 bp, Rattus norvegicus
gtcccacctgaagcagtgcattgag

SEQ ID NO: 493097 - DNA, 25 bp, Rattus norvegicus
gtcccacggagaaaaccatcttcat

SEQ ID NO: 493098 - DNA, 25 bp, Rattus norvegicus
gtcccacggagataaccatcttcat

SEQ ID NO: 493099 - DNA, 25 bp, Rattus norvegicus
gtcccacgggagacagagcaacact

SEQ ID NO: 493100 - DNA, 25 bp, Rattus norvegicus
gtcccacgggagtcagagcaacact

SEQ ID NO: 493101 - DNA, 25 bp, Rattus norvegicus
gtcccacgggcaaatgtttctgttt

SEQ ID NO: 493102 - DNA, 25 bp, Rattus norvegicus
gtcccacgggcatatgtttctgttt

SEQ ID NO: 493103 - DNA, 25 bp, Rattus norvegicus
gtcccactaatacagagtccctgtc

SEQ ID NO: 493104 - DNA, 25 bp, Rattus norvegicus
gtcccactaatagagagtccctgtc

SEQ ID NO: 493105 - DNA, 25 bp, Rattus norvegicus
gtcccactcggtaactgatagcacg

SEQ ID NO: 493106 - DNA, 25 bp, Rattus norvegicus
gtcccactcggttactgatagcacg

SEQ ID NO: 493107 - DNA, 25 bp, Rattus norvegicus
gtcccactctataaatcagcagctg

SEQ ID NO: 493108 - DNA, 25 bp, Rattus norvegicus
gtcccactctattaatcagcagctg

SEQ ID NO: 493109 - DNA, 25 bp, Rattus norvegicus
gtcccactgcttatgattaaaacca

SEQ ID NO: 493110 - DNA, 25 bp, Rattus norvegicus
gtcccactgcttttgattaaaacca

SEQ ID NO: 493111 - DNA, 25 bp, Rattus norvegicus
gtcccactgggtctgcgaaatcgag

SEQ ID NO: 493112 - DNA, 25 bp, Rattus norvegicus
gtcccactgggtgtgcgaaatcgag

SEQ ID NO: 493113 - DNA, 25 bp, Rattus norvegicus
gtcccactgttgagagagctgcatg

SEQ ID NO: 493114 - DNA, 25 bp, Rattus norvegicus
gtcccactgttgtgagagctgcatg

SEQ ID NO: 493115 - DNA, 25 bp, Rattus norvegicus
gtcccacttcctataacaatcaaat

SEQ ID NO: 493116 - DNA, 25 bp, Rattus norvegicus
gtcccacttcctttaacaatcaaat

SEQ ID NO: 493117 - DNA, 25 bp, Rattus norvegicus
gtcccacttgttatgctagtactaa

SEQ ID NO: 493118 - DNA, 25 bp, Rattus norvegicus
gtcccacttgttttgctagtactaa

SEQ ID NO: 493119 - DNA, 25 bp, Rattus norvegicus
gtcccagaaattccaacagttccgt

SEQ ID NO: 493120 - DNA, 25 bp, Rattus norvegicus
gtcccagaaattcccatgaaatgta

SEQ ID NO: 493121 - DNA, 25 bp, Rattus norvegicus
gtcccagaaattgcaacagttccgt

SEQ ID NO: 493122 - DNA, 25 bp, Rattus norvegicus
gtcccagaaattgccatgaaatgta

SEQ ID NO: 493123 - DNA, 25 bp, Rattus norvegicus
gtcccagaactgatgaaacttgtta

SEQ ID NO: 493124 - DNA, 25 bp, Rattus norvegicus
gtcccagaactgttgaaacttgtta

SEQ ID NO: 493125 - DNA, 25 bp, Rattus norvegicus
gtcccagactgacgtggtgactcta

SEQ ID NO: 493126 - DNA, 25 bp, Rattus norvegicus
gtcccagactgaggtggtgactcta

SEQ ID NO: 493127 - DNA, 25 bp, Rattus norvegicus
gtcccagaggagacaaaagcccaag

SEQ ID NO: 493128 - DNA, 25 bp, Rattus norvegicus
gtcccagaggagtcaaaagcccaag

SEQ ID NO: 493129 - DNA, 25 bp, Rattus norvegicus
gtcccagatcggactggagttctag

SEQ ID NO: 493130 - DNA, 25 bp, Rattus norvegicus
gtcccagatcggtctggagttctag

SEQ ID NO: 493131 - DNA, 25 bp, Rattus norvegicus
gtcccagatggtagtcagaatcgaa

SEQ ID NO: 493132 - DNA, 25 bp, Rattus norvegicus
gtcccagatggttgtcagaatcgaa

SEQ ID NO: 493133 - DNA, 25 bp, Rattus norvegicus
gtcccagcaggacttcacagcacaa

SEQ ID NO: 493134 - DNA, 25 bp, Rattus norvegicus
gtcccagcaggagttcacagcacaa

SEQ ID NO: 493135 - DNA, 25 bp, Rattus norvegicus
gtcccagcaggcaatgacatgcatc

SEQ ID NO: 493136 - DNA, 25 bp, Rattus norvegicus
gtcccagcaggcagcgaaacgcatt

SEQ ID NO: 493137 - DNA, 25 bp, Rattus norvegicus
gtcccagcaggctatgacatgcatc

SEQ ID NO: 493138 - DNA, 25 bp, Rattus norvegicus
gtcccagcaggctgcgaaacgcatt

SEQ ID NO: 493139 - DNA, 25 bp, Rattus norvegicus
gtcccagcagtcagtccaggaataa

SEQ ID NO: 493140 - DNA, 25 bp, Rattus norvegicus
gtcccagcagtctgtccaggaataa

SEQ ID NO: 493141 - DNA, 25 bp, Rattus norvegicus
gtcccagcagtgataaacttgcaat

SEQ ID NO: 493142 - DNA, 25 bp, Rattus norvegicus
gtcccagcagtgttaaacttgcaat

SEQ ID NO: 493143 - DNA, 25 bp, Rattus norvegicus
gtcccagccatcagagccagagaaa

SEQ ID NO: 493144 - DNA, 25 bp, Rattus norvegicus
gtcccagccatctgagccagagaaa

SEQ ID NO: 493145 - DNA, 25 bp, Rattus norvegicus
gtcccagccctgcatgagtatgcta

SEQ ID NO: 493146 - DNA, 25 bp, Rattus norvegicus
gtcccagccctggatgagtatgcta

SEQ ID NO: 493147 - DNA, 25 bp, Rattus norvegicus
gtcccagccgctatcaatggaggag

SEQ ID NO: 493148 - DNA, 25 bp, Rattus norvegicus
gtcccagccgctttcaatggaggag

SEQ ID NO: 493149 - DNA, 25 bp, Rattus norvegicus
gtcccagcctgacgatcttactaga

SEQ ID NO: 493150 - DNA, 25 bp, Rattus norvegicus
gtcccagcctgaggatcttactaga

SEQ ID NO: 493151 - DNA, 25 bp, Rattus norvegicus
gtcccagcctgcatttttggtggaa

SEQ ID NO: 493152 - DNA, 25 bp, Rattus norvegicus
gtcccagcctgcttttttggtggaa

SEQ ID NO: 493153 - DNA, 25 bp, Rattus norvegicus
gtcccagcgggcattaatccggctg

SEQ ID NO: 493154 - DNA, 25 bp, Rattus norvegicus
gtcccagcgggctttaatccggctg

SEQ ID NO: 493155 - DNA, 25 bp, Rattus norvegicus
gtcccagctagtcgcgatatctcaa

SEQ ID NO: 493156 - DNA, 25 bp, Rattus norvegicus
gtcccagctagtggcgatatctcaa

SEQ ID NO: 493157 - DNA, 25 bp, Rattus norvegicus
gtcccagctgggaatgtggaagcct

SEQ ID NO: 493158 - DNA, 25 bp, Rattus norvegicus
gtcccagctgggagttcaaattcat

SEQ ID NO: 493159 - DNA, 25 bp, Rattus norvegicus
gtcccagctgggtatgtggaagcct

SEQ ID NO: 493160 - DNA, 25 bp, Rattus norvegicus
gtcccagctgggtgttcaaattcat

SEQ ID NO: 493161 - DNA, 25 bp, Rattus norvegicus
gtcccaggaaagactgaggccctta

SEQ ID NO: 493162 - DNA, 25 bp, Rattus norvegicus
gtcccaggaaagtctgaggccctta

SEQ ID NO: 493163 - DNA, 25 bp, Rattus norvegicus
gtcccaggaatgaccgtcagacaga

SEQ ID NO: 493164 - DNA, 25 bp, Rattus norvegicus
gtcccaggaatgtccgtcagacaga

SEQ ID NO: 493165 - DNA, 25 bp, Rattus norvegicus
gtcccaggacacaatatgaccacac

SEQ ID NO: 493166 - DNA, 25 bp, Rattus norvegicus
gtcccaggacactatatgaccacac

SEQ ID NO: 493167 - DNA, 25 bp, Rattus norvegicus
gtcccaggacccaacagaggagcaa

SEQ ID NO: 493168 - DNA, 25 bp, Rattus norvegicus
gtcccaggaccctacagaggagcaa

SEQ ID NO: 493169 - DNA, 25 bp, Rattus norvegicus
gtcccaggacttaggctacttatat

SEQ ID NO: 493170 - DNA, 25 bp, Rattus norvegicus
gtcccaggactttggctacttatat

SEQ ID NO: 493171 - DNA, 25 bp, Rattus norvegicus
gtcccaggagatctaacacacactt

SEQ ID NO: 493172 - DNA, 25 bp, Rattus norvegicus
gtcccaggagatgtaacacacactt

SEQ ID NO: 493173 - DNA, 25 bp, Rattus norvegicus
gtcccaggagcacacattagctagc

SEQ ID NO: 493174 - DNA, 25 bp, Rattus norvegicus
gtcccaggagcagacattagctagc

SEQ ID NO: 493175 - DNA, 25 bp, Rattus norvegicus
gtcccaggagcccatttctaatgat

SEQ ID NO: 493176 - DNA, 25 bp, Rattus norvegicus
gtcccaggagccgatttctaatgat

SEQ ID NO: 493177 - DNA, 25 bp, Rattus norvegicus
gtcccaggatttatgaccctgtgtg

SEQ ID NO: 493178 - DNA, 25 bp, Rattus norvegicus
gtcccaggatttttgaccctgtgtg

SEQ ID NO: 493179 - DNA, 25 bp, Rattus norvegicus
gtcccaggctgtcagcaattctgta

SEQ ID NO: 493180 - DNA, 25 bp, Rattus norvegicus
gtcccaggctgtgagcaattctgta

SEQ ID NO: 493181 - DNA, 25 bp, Rattus norvegicus
gtcccaggcttcagttctgcggtag

SEQ ID NO: 493182 - DNA, 25 bp, Rattus norvegicus
gtcccaggcttctgttctgcggtag

SEQ ID NO: 493183 - DNA, 25 bp, Rattus norvegicus
gtcccagggaacaatacaacatctt

SEQ ID NO: 493184 - DNA, 25 bp, Rattus norvegicus
gtcccagggaaccaggacatgttct

SEQ ID NO: 493185 - DNA, 25 bp, Rattus norvegicus
gtcccagggaacgaggacatgttct

SEQ ID NO: 493186 - DNA, 25 bp, Rattus norvegicus
gtcccagggaactatacaacatctt

SEQ ID NO: 493187 - DNA, 25 bp, Rattus norvegicus
gtcccagggactccacagatatttt

SEQ ID NO: 493188 - DNA, 25 bp, Rattus norvegicus
gtcccagggactgcacagatatttt

SEQ ID NO: 493189 - DNA, 25 bp, Rattus norvegicus
gtcccagggagaccacagcggatta

SEQ ID NO: 493190 - DNA, 25 bp, Rattus norvegicus
gtcccagggagagcacagcggatta

SEQ ID NO: 493191 - DNA, 25 bp, Rattus norvegicus
gtcccagggtacatcagaaatctga

SEQ ID NO: 493192 - DNA, 25 bp, Rattus norvegicus
gtcccagggtacttcagaaatctga

SEQ ID NO: 493193 - DNA, 25 bp, Rattus norvegicus
gtcccagggtttctctgaaaaggca

SEQ ID NO: 493194 - DNA, 25 bp, Rattus norvegicus
gtcccagggtttgtctgaaaaggca

SEQ ID NO: 493195 - DNA, 25 bp, Rattus norvegicus
gtcccaggtcagcatgactacatag

SEQ ID NO: 493196 - DNA, 25 bp, Rattus norvegicus
gtcccaggtcaggatgactacatag

SEQ ID NO: 493197 - DNA, 25 bp, Rattus norvegicus
gtcccaggtcctagtgaatcagata

SEQ ID NO: 493198 - DNA, 25 bp, Rattus norvegicus
gtcccaggtccttgtgaatcagata

SEQ ID NO: 493199 - DNA, 25 bp, Rattus norvegicus
gtcccaggtgggaacatgacttctt

SEQ ID NO: 493200 - DNA, 25 bp, Rattus norvegicus
gtcccaggtgggtacatgacttctt

SEQ ID NO: 493201 - DNA, 25 bp, Rattus norvegicus
gtcccaggttgaaactccatacaga

SEQ ID NO: 493202 - DNA, 25 bp, Rattus norvegicus
gtcccaggttgatactccatacaga

SEQ ID NO: 493203 - DNA, 25 bp, Rattus norvegicus
gtcccagtacaaatggctgccagtt

SEQ ID NO: 493204 - DNA, 25 bp, Rattus norvegicus
gtcccagtacaattggctgccagtt

SEQ ID NO: 493205 - DNA, 25 bp, Rattus norvegicus
gtcccagtaggactagaatttgtgt

SEQ ID NO: 493206 - DNA, 25 bp, Rattus norvegicus
gtcccagtaggagtagaatttgtgt

SEQ ID NO: 493207 - DNA, 25 bp, Rattus norvegicus
gtcccagtcaacatatagcttgttt

SEQ ID NO: 493208 - DNA, 25 bp, Rattus norvegicus
gtcccagtcaacttatagcttgttt

SEQ ID NO: 493209 - DNA, 25 bp, Rattus norvegicus
gtcccagtcccaccatgtgactgtt

SEQ ID NO: 493210 - DNA, 25 bp, Rattus norvegicus
gtcccagtcccagcatgtgactgtt

SEQ ID NO: 493211 - DNA, 25 bp, Rattus norvegicus
gtcccagtgctacacagcctgatgt

SEQ ID NO: 493212 - DNA, 25 bp, Rattus norvegicus
gtcccagtgctagacagcctgatgt

SEQ ID NO: 493213 - DNA, 25 bp, Rattus norvegicus
gtcccagtggcactctgagcttgta

SEQ ID NO: 493214 - DNA, 25 bp, Rattus norvegicus
gtcccagtggcagtctgagcttgta

SEQ ID NO: 493215 - DNA, 25 bp, Rattus norvegicus
gtcccagtggctcacaggcaaccaa

SEQ ID NO: 493216 - DNA, 25 bp, Rattus norvegicus
gtcccagtggctgacaggcaaccaa

SEQ ID NO: 493217 - DNA, 25 bp, Rattus norvegicus
gtcccagtggtcatgtccaatggat

SEQ ID NO: 493218 - DNA, 25 bp, Rattus norvegicus
gtcccagtggtcttgtccaatggat

SEQ ID NO: 493219 - DNA, 25 bp, Rattus norvegicus
gtcccagtgttgcagatgcttgccc

SEQ ID NO: 493220 - DNA, 25 bp, Rattus norvegicus
gtcccagtgttggagatgcttgccc

SEQ ID NO: 493221 - DNA, 25 bp, Rattus norvegicus
gtcccagttctcatcactagaaata

SEQ ID NO: 493222 - DNA, 25 bp, Rattus norvegicus
gtcccagttctcttcactagaaata

SEQ ID NO: 493223 - DNA, 25 bp, Rattus norvegicus
gtcccagttttaatttctctcaaga

SEQ ID NO: 493224 - DNA, 25 bp, Rattus norvegicus
gtcccagttttattttctctcaaga

SEQ ID NO: 493225 - DNA, 25 bp, Rattus norvegicus
gtcccataaggacgtgagttagctt

SEQ ID NO: 493226 - DNA, 25 bp, Rattus norvegicus
gtcccataaggaggtgagttagctt

SEQ ID NO: 493227 - DNA, 25 bp, Rattus norvegicus
gtcccatagtcgctctggcaattgt

SEQ ID NO: 493228 - DNA, 25 bp, Rattus norvegicus
gtcccatagtcggtctggcaattgt

SEQ ID NO: 493229 - DNA, 25 bp, Rattus norvegicus
gtcccatatccccagagagaacagt

SEQ ID NO: 493230 - DNA, 25 bp, Rattus norvegicus
gtcccatatcccgagagagaacagt

SEQ ID NO: 493231 - DNA, 25 bp, Rattus norvegicus
gtcccatatcctctagtggtggcaa

SEQ ID NO: 493232 - DNA, 25 bp, Rattus norvegicus
gtcccatatcctgtagtggtggcaa

SEQ ID NO: 493233 - DNA, 25 bp, Rattus norvegicus
gtcccatcagtgatctcattctgaa

SEQ ID NO: 493234 - DNA, 25 bp, Rattus norvegicus
gtcccatcagtgttctcattctgaa

SEQ ID NO: 493235 - DNA, 25 bp, Rattus norvegicus
gtcccatccacacttgtcagttgtg

SEQ ID NO: 493236 - DNA, 25 bp, Rattus norvegicus
gtcccatccacagttgtcagttgtg

SEQ ID NO: 493237 - DNA, 25 bp, Rattus norvegicus
gtcccatccagaaattggtagcctg

SEQ ID NO: 493238 - DNA, 25 bp, Rattus norvegicus
gtcccatccagatattggtagcctg

SEQ ID NO: 493239 - DNA, 25 bp, Rattus norvegicus
gtcccatccggacagaggagactga

SEQ ID NO: 493240 - DNA, 25 bp, Rattus norvegicus
gtcccatccggagagaggagactga

SEQ ID NO: 493241 - DNA, 25 bp, Rattus norvegicus
gtcccatccggtcagagtgcagaga

SEQ ID NO: 493242 - DNA, 25 bp, Rattus norvegicus
gtcccatccggtgagagtgcagaga

SEQ ID NO: 493243 - DNA, 25 bp, Rattus norvegicus
gtcccatcctcaccctttgaatgaa

SEQ ID NO: 493244 - DNA, 25 bp, Rattus norvegicus
gtcccatcctcagcctttgaatgaa

SEQ ID NO: 493245 - DNA, 25 bp, Rattus norvegicus
gtcccatctaaacagaccgagagtt

SEQ ID NO: 493246 - DNA, 25 bp, Rattus norvegicus
gtcccatctaaagagaccgagagtt

SEQ ID NO: 493247 - DNA, 25 bp, Rattus norvegicus
gtcccatctactcctggaagaatcc

SEQ ID NO: 493248 - DNA, 25 bp, Rattus norvegicus
gtcccatctactgctggaagaatcc

SEQ ID NO: 493249 - DNA, 25 bp, Rattus norvegicus
gtcccatctcagactgcattagttg

SEQ ID NO: 493250 - DNA, 25 bp, Rattus norvegicus
gtcccatctcagtctgcattagttg

SEQ ID NO: 493251 - DNA, 25 bp, Rattus norvegicus
gtcccatctgagctctgcaaaattg

SEQ ID NO: 493252 - DNA, 25 bp, Rattus norvegicus
gtcccatctgaggtctgcaaaattg

SEQ ID NO: 493253 - DNA, 25 bp, Rattus norvegicus
gtcccatcttccagaagcacgagtc

SEQ ID NO: 493254 - DNA, 25 bp, Rattus norvegicus
gtcccatcttcctgaagcacgagtc

SEQ ID NO: 493255 - DNA, 25 bp, Rattus norvegicus
gtcccatcttggaggtcatgtggca

SEQ ID NO: 493256 - DNA, 25 bp, Rattus norvegicus
gtcccatcttggtggtcatgtggca

SEQ ID NO: 493257 - DNA, 25 bp, Rattus norvegicus
gtcccatcttgtcctatcaaagtta

SEQ ID NO: 493258 - DNA, 25 bp, Rattus norvegicus
gtcccatcttgtgctatcaaagtta

SEQ ID NO: 493259 - DNA, 25 bp, Rattus norvegicus
gtcccatgagttaccagtcttactg

SEQ ID NO: 493260 - DNA, 25 bp, Rattus norvegicus
gtcccatgagtttccagtcttactg

SEQ ID NO: 493261 - DNA, 25 bp, Rattus norvegicus
gtcccatgatgcaagagtctgctcg

SEQ ID NO: 493262 - DNA, 25 bp, Rattus norvegicus
gtcccatgatgctagagtctgctcg

SEQ ID NO: 493263 - DNA, 25 bp, Rattus norvegicus
gtcccatgatggctggatctcccag

SEQ ID NO: 493264 - DNA, 25 bp, Rattus norvegicus
gtcccatgatgggtggatctcccag

SEQ ID NO: 493265 - DNA, 25 bp, Rattus norvegicus
gtcccatgcgaccatgtggacgatt

SEQ ID NO: 493266 - DNA, 25 bp, Rattus norvegicus
gtcccatgcgacgatgtggacgatt

SEQ ID NO: 493267 - DNA, 25 bp, Rattus norvegicus
gtcccattaaatagagtgccaacat

SEQ ID NO: 493268 - DNA, 25 bp, Rattus norvegicus
gtcccattaaattgagtgccaacat

SEQ ID NO: 493269 - DNA, 25 bp, Rattus norvegicus
gtcccattagacatcgcactgtttt

SEQ ID NO: 493270 - DNA, 25 bp, Rattus norvegicus
gtcccattagacttcgcactgtttt

SEQ ID NO: 493271 - DNA, 25 bp, Rattus norvegicus
gtcccattcattccgttttgtttga

SEQ ID NO: 493272 - DNA, 25 bp, Rattus norvegicus
gtcccattcattgcgttttgtttga

SEQ ID NO: 493273 - DNA, 25 bp, Rattus norvegicus
gtcccattcccacatatatgcactt

SEQ ID NO: 493274 - DNA, 25 bp, Rattus norvegicus
gtcccattcccagatatatgcactt

SEQ ID NO: 493275 - DNA, 25 bp, Rattus norvegicus
gtcccattgttcctcaataccttga

SEQ ID NO: 493276 - DNA, 25 bp, Rattus norvegicus
gtcccattgttcgtcaataccttga

SEQ ID NO: 493277 - DNA, 25 bp, Rattus norvegicus
gtcccatttgggagttccgcttgtg

SEQ ID NO: 493278 - DNA, 25 bp, Rattus norvegicus
gtcccatttgggtgttccgcttgtg

SEQ ID NO: 493279 - DNA, 25 bp, Rattus norvegicus
gtccccaaagccaagaacactaagt

SEQ ID NO: 493280 - DNA, 25 bp, Rattus norvegicus
gtccccaaagcctagaacactaagt

SEQ ID NO: 493281 - DNA, 25 bp, Rattus norvegicus
gtccccaaagctccttttgtggctg

SEQ ID NO: 493282 - DNA, 25 bp, Rattus norvegicus
gtccccaaagctgcttttgtggctg

SEQ ID NO: 493283 - DNA, 25 bp, Rattus norvegicus
gtccccaaaggtagtgttatcgaat

SEQ ID NO: 493284 - DNA, 25 bp, Rattus norvegicus
gtccccaaaggttgtgttatcgaat

SEQ ID NO: 493285 - DNA, 25 bp, Rattus norvegicus
gtccccaacacgcagagattcaacg

SEQ ID NO: 493286 - DNA, 25 bp, Rattus norvegicus
gtccccaacacggagagattcaacg

SEQ ID NO: 493287 - DNA, 25 bp, Rattus norvegicus
gtccccaacagtatctgtcacaaat

SEQ ID NO: 493288 - DNA, 25 bp, Rattus norvegicus
gtccccaacagtttctgtcacaaat

SEQ ID NO: 493289 - DNA, 25 bp, Rattus norvegicus
gtccccaacggactggataatgcac

SEQ ID NO: 493290 - DNA, 25 bp, Rattus norvegicus
gtccccaacggagtggataatgcac

SEQ ID NO: 493291 - DNA, 25 bp, Rattus norvegicus
gtccccaagagacactgcattgagt

SEQ ID NO: 493292 - DNA, 25 bp, Rattus norvegicus
gtccccaagagagactgcattgagt

SEQ ID NO: 493293 - DNA, 25 bp, Rattus norvegicus
gtccccaagaggattgtccttatat

SEQ ID NO: 493294 - DNA, 25 bp, Rattus norvegicus
gtccccaagaggtttgtccttatat

SEQ ID NO: 493295 - DNA, 25 bp, Rattus norvegicus
gtccccaaggacaagttacaacaga

SEQ ID NO: 493296 - DNA, 25 bp, Rattus norvegicus
gtccccaaggactagttacaacaga

SEQ ID NO: 493297 - DNA, 25 bp, Rattus norvegicus
gtccccaatcacaattgtccatgaa

SEQ ID NO: 493298 - DNA, 25 bp, Rattus norvegicus
gtccccaatcactattgtccatgaa

SEQ ID NO: 493299 - DNA, 25 bp, Rattus norvegicus
gtccccaatctcaggaatgctgtca

SEQ ID NO: 493300 - DNA, 25 bp, Rattus norvegicus
gtccccaatctctggaatgctgtca

SEQ ID NO: 493301 - DNA, 25 bp, Rattus norvegicus
gtccccaattggactctatttctac

SEQ ID NO: 493302 - DNA, 25 bp, Rattus norvegicus
gtccccaattggtctctatttctac

SEQ ID NO: 493303 - DNA, 25 bp, Rattus norvegicus
gtccccacaaagacttttgctctta

SEQ ID NO: 493304 - DNA, 25 bp, Rattus norvegicus
gtccccacaaagtcttttgctctta

SEQ ID NO: 493305 - DNA, 25 bp, Rattus norvegicus
gtccccacaacaccatttgagagac

SEQ ID NO: 493306 - DNA, 25 bp, Rattus norvegicus
gtccccacaacagcatttgagagac

SEQ ID NO: 493307 - DNA, 25 bp, Rattus norvegicus
gtccccacagaaagaagtcttacct

SEQ ID NO: 493308 - DNA, 25 bp, Rattus norvegicus
gtccccacagaatgaagtcttacct

SEQ ID NO: 493309 - DNA, 25 bp, Rattus norvegicus
gtccccacagcaagtgtcacttaaa

SEQ ID NO: 493310 - DNA, 25 bp, Rattus norvegicus
gtccccacagcatgtgtcacttaaa

SEQ ID NO: 493311 - DNA, 25 bp, Rattus norvegicus
gtccccaccctgaagtcatattata

SEQ ID NO: 493312 - DNA, 25 bp, Rattus norvegicus
gtccccaccctgtagtcatattata

SEQ ID NO: 493313 - DNA, 25 bp, Rattus norvegicus
gtccccactcaaaagtccagtagga

SEQ ID NO: 493314 - DNA, 25 bp, Rattus norvegicus
gtccccactcaatagtccagtagga

SEQ ID NO: 493315 - DNA, 25 bp, Rattus norvegicus
gtccccacttgaagctggttcaaag

SEQ ID NO: 493316 - DNA, 25 bp, Rattus norvegicus
gtccccacttgacgatttgacagca

SEQ ID NO: 493317 - DNA, 25 bp, Rattus norvegicus
gtccccacttgaggatttgacagca

SEQ ID NO: 493318 - DNA, 25 bp, Rattus norvegicus
gtccccacttgatgctggttcaaag

SEQ ID NO: 493319 - DNA, 25 bp, Rattus norvegicus
gtccccagaattataaatgccacag

SEQ ID NO: 493320 - DNA, 25 bp, Rattus norvegicus
gtccccagaattttaaatgccacag

SEQ ID NO: 493321 - DNA, 25 bp, Rattus norvegicus
gtccccagagtcaggctctggcaag

SEQ ID NO: 493322 - DNA, 25 bp, Rattus norvegicus
gtccccagagtctggctctggcaag

SEQ ID NO: 493323 - DNA, 25 bp, Rattus norvegicus
gtccccagcataaggagcagtcatt

SEQ ID NO: 493324 - DNA, 25 bp, Rattus norvegicus
gtccccagcataattgagtgagtca

SEQ ID NO: 493325 - DNA, 25 bp, Rattus norvegicus
gtccccagcatatggagcagtcatt

SEQ ID NO: 493326 - DNA, 25 bp, Rattus norvegicus
gtccccagcatatttgagtgagtca

SEQ ID NO: 493327 - DNA, 25 bp, Rattus norvegicus
gtccccagcctcagacattaatgat

SEQ ID NO: 493328 - DNA, 25 bp, Rattus norvegicus
gtccccagcctctgacattaatgat

SEQ ID NO: 493329 - DNA, 25 bp, Rattus norvegicus
gtccccaggcaaaaccacaggtggc

SEQ ID NO: 493330 - DNA, 25 bp, Rattus norvegicus
gtccccaggcaataccacaggtggc

SEQ ID NO: 493331 - DNA, 25 bp, Rattus norvegicus
gtccccagggaccattgatttaata

SEQ ID NO: 493332 - DNA, 25 bp, Rattus norvegicus
gtccccagggacgattgatttaata

SEQ ID NO: 493333 - DNA, 25 bp, Rattus norvegicus
gtccccaggtcacagttctttagca

SEQ ID NO: 493334 - DNA, 25 bp, Rattus norvegicus
gtccccaggtcagagttctttagca

SEQ ID NO: 493335 - DNA, 25 bp, Rattus norvegicus
gtccccaggtggacatccagatagt

SEQ ID NO: 493336 - DNA, 25 bp, Rattus norvegicus
gtccccaggtggtcatccagatagt

SEQ ID NO: 493337 - DNA, 25 bp, Rattus norvegicus
gtccccagtgcccagttatttatgg

SEQ ID NO: 493338 - DNA, 25 bp, Rattus norvegicus
gtccccagtgccgagttatttatgg

SEQ ID NO: 493339 - DNA, 25 bp, Rattus norvegicus
gtccccatattgaaacccttactct

SEQ ID NO: 493340 - DNA, 25 bp, Rattus norvegicus
gtccccatattgtaacccttactct

SEQ ID NO: 493341 - DNA, 25 bp, Rattus norvegicus
gtccccatcaaactgcaaactcagt

SEQ ID NO: 493342 - DNA, 25 bp, Rattus norvegicus
gtccccatcaaagtgcaaactcagt

SEQ ID NO: 493343 - DNA, 25 bp, Rattus norvegicus
gtccccatcctaagcagttttaaag

SEQ ID NO: 493344 - DNA, 25 bp, Rattus norvegicus
gtccccatcctatgcagttttaaag

SEQ ID NO: 493345 - DNA, 25 bp, Rattus norvegicus
gtccccatcttcatactattagaca

SEQ ID NO: 493346 - DNA, 25 bp, Rattus norvegicus
gtccccatcttcttactattagaca

SEQ ID NO: 493347 - DNA, 25 bp, Rattus norvegicus
gtccccatgagcaaatgagatgaga

SEQ ID NO: 493348 - DNA, 25 bp, Rattus norvegicus
gtccccatgagctaatgagatgaga

SEQ ID NO: 493349 - DNA, 25 bp, Rattus norvegicus
gtccccatgctgagactactgaatg

SEQ ID NO: 493350 - DNA, 25 bp, Rattus norvegicus
gtccccatgctgtgactactgaatg

SEQ ID NO: 493351 - DNA, 25 bp, Rattus norvegicus
gtccccatgcttaataaaccatctc

SEQ ID NO: 493352 - DNA, 25 bp, Rattus norvegicus
gtccccatgctttataaaccatctc

SEQ ID NO: 493353 - DNA, 25 bp, Rattus norvegicus
gtccccatggacaagttgtataaag

SEQ ID NO: 493354 - DNA, 25 bp, Rattus norvegicus
gtccccatggactagttgtataaag

SEQ ID NO: 493355 - DNA, 25 bp, Rattus norvegicus
gtccccatggctacgcgacagtcaa

SEQ ID NO: 493356 - DNA, 25 bp, Rattus norvegicus
gtccccatggcttcgcgacagtcaa

SEQ ID NO: 493357 - DNA, 25 bp, Rattus norvegicus
gtccccattatgaagctaccatgtg

SEQ ID NO: 493358 - DNA, 25 bp, Rattus norvegicus
gtccccattatgtagctaccatgtg

SEQ ID NO: 493359 - DNA, 25 bp, Rattus norvegicus
gtccccattcccagaacaaaacatg

SEQ ID NO: 493360 - DNA, 25 bp, Rattus norvegicus
gtccccattccctgaacaaaacatg

SEQ ID NO: 493361 - DNA, 25 bp, Rattus norvegicus
gtccccattggtctgatgtcatgta

SEQ ID NO: 493362 - DNA, 25 bp, Rattus norvegicus
gtccccattggtgtgatgtcatgta

SEQ ID NO: 493363 - DNA, 25 bp, Rattus norvegicus
gtccccattgtgcaaaacagcctgt

SEQ ID NO: 493364 - DNA, 25 bp, Rattus norvegicus
gtccccattgtggaaaacagcctgt

SEQ ID NO: 493365 - DNA, 25 bp, Rattus norvegicus
gtccccatttcaacttccttggaga

SEQ ID NO: 493366 - DNA, 25 bp, Rattus norvegicus
gtccccatttcatcttccttggaga

SEQ ID NO: 493367 - DNA, 25 bp, Rattus norvegicus
gtcccccatcagctgctcagggaga

SEQ ID NO: 493368 - DNA, 25 bp, Rattus norvegicus
gtcccccatcaggtgctcagggaga

SEQ ID NO: 493369 - DNA, 25 bp, Rattus norvegicus
gtccccgaggaacaaagtgtcttcg

SEQ ID NO: 493370 - DNA, 25 bp, Rattus norvegicus
gtccccgaggaagaaagtgtcttcg

SEQ ID NO: 493371 - DNA, 25 bp, Rattus norvegicus
gtccccgagtctcatttacagtgaa

SEQ ID NO: 493372 - DNA, 25 bp, Rattus norvegicus
gtccccgagtctgatttacagtgaa

SEQ ID NO: 493373 - DNA, 25 bp, Rattus norvegicus
gtccccgagtttactgtacaaggca

SEQ ID NO: 493374 - DNA, 25 bp, Rattus norvegicus
gtccccgagttttctgtacaaggca

SEQ ID NO: 493375 - DNA, 25 bp, Rattus norvegicus
gtccccgcaggacctgcttcgaaga

SEQ ID NO: 493376 - DNA, 25 bp, Rattus norvegicus
gtccccgcaggagctgcttcgaaga

SEQ ID NO: 493377 - DNA, 25 bp, Rattus norvegicus
gtccccgcggttcatgttacatgtt

SEQ ID NO: 493378 - DNA, 25 bp, Rattus norvegicus
gtccccgcggttgatgttacatgtt

SEQ ID NO: 493379 - DNA, 25 bp, Rattus norvegicus
gtccccggaggccttgccggtgcgt

SEQ ID NO: 493380 - DNA, 25 bp, Rattus norvegicus
gtccccggaggcgttgccggtgcgt

SEQ ID NO: 493381 - DNA, 25 bp, Rattus norvegicus
gtccccgggagacctggagaattat

SEQ ID NO: 493382 - DNA, 25 bp, Rattus norvegicus
gtccccgggagagctggagaattat

SEQ ID NO: 493383 - DNA, 25 bp, Rattus norvegicus
gtccccgtctcacctgttaaacagg

SEQ ID NO: 493384 - DNA, 25 bp, Rattus norvegicus
gtccccgtctcagctgttaaacagg

SEQ ID NO: 493385 - DNA, 25 bp, Rattus norvegicus
gtccccgtctggctcataggtgaca

SEQ ID NO: 493386 - DNA, 25 bp, Rattus norvegicus
gtccccgtctgggtcataggtgaca

SEQ ID NO: 493387 - DNA, 25 bp, Rattus norvegicus
gtccccgttgacaaatggtggctaa

SEQ ID NO: 493388 - DNA, 25 bp, Rattus norvegicus
gtccccgttgactaatggtggctaa

SEQ ID NO: 493389 - DNA, 25 bp, Rattus norvegicus
gtccccgtttcaacaatttgcatgg

SEQ ID NO: 493390 - DNA, 25 bp, Rattus norvegicus
gtccccgtttcatcaatttgcatgg

SEQ ID NO: 493391 - DNA, 25 bp, Rattus norvegicus
gtcccctactgtcgcatcttatatg

SEQ ID NO: 493392 - DNA, 25 bp, Rattus norvegicus
gtcccctactgtggcatcttatatg

SEQ ID NO: 493393 - DNA, 25 bp, Rattus norvegicus
gtcccctaggaaagaaactgctctc

SEQ ID NO: 493394 - DNA, 25 bp, Rattus norvegicus
gtcccctaggaatgaaactgctctc

SEQ ID NO: 493395 - DNA, 25 bp, Rattus norvegicus
gtcccctatggtaataacagagcta

SEQ ID NO: 493396 - DNA, 25 bp, Rattus norvegicus
gtcccctatggttataacagagcta

SEQ ID NO: 493397 - DNA, 25 bp, Rattus norvegicus
gtcccctcaatccaaaggccatttt

SEQ ID NO: 493398 - DNA, 25 bp, Rattus norvegicus
gtcccctcaatcgaaaggccatttt

SEQ ID NO: 493399 - DNA, 25 bp, Rattus norvegicus
gtcccctcagggaagcactgtctgg

SEQ ID NO: 493400 - DNA, 25 bp, Rattus norvegicus
gtcccctcagggtagcactgtctgg

SEQ ID NO: 493401 - DNA, 25 bp, Rattus norvegicus
gtcccctcctaaagtagttctggca

SEQ ID NO: 493402 - DNA, 25 bp, Rattus norvegicus
gtcccctcctaatgtagttctggca

SEQ ID NO: 493403 - DNA, 25 bp, Rattus norvegicus
gtcccctctatgcaggtgtatatag

SEQ ID NO: 493404 - DNA, 25 bp, Rattus norvegicus
gtcccctctatggaggtgtatatag

SEQ ID NO: 493405 - DNA, 25 bp, Rattus norvegicus
gtcccctctcagatgtctacgaaat

SEQ ID NO: 493406 - DNA, 25 bp, Rattus norvegicus
gtcccctctcagttgtctacgaaat

SEQ ID NO: 493407 - DNA, 25 bp, Rattus norvegicus
gtcccctctcctcgatttaaatgga

SEQ ID NO: 493408 - DNA, 25 bp, Rattus norvegicus
gtcccctctcctggatttaaatgga

SEQ ID NO: 493409 - DNA, 25 bp, Rattus norvegicus
gtcccctcttctagtggagacattt

SEQ ID NO: 493410 - DNA, 25 bp, Rattus norvegicus
gtcccctcttcttgtggagacattt

SEQ ID NO: 493411 - DNA, 25 bp, Rattus norvegicus
gtcccctgagagaaatctcttgcta

SEQ ID NO: 493412 - DNA, 25 bp, Rattus norvegicus
gtcccctgagagtaatctcttgcta

SEQ ID NO: 493413 - DNA, 25 bp, Rattus norvegicus
gtcccctgaggaagcaaatggccag

SEQ ID NO: 493414 - DNA, 25 bp, Rattus norvegicus
gtcccctgaggatgcaaatggccag

SEQ ID NO: 493415 - DNA, 25 bp, Rattus norvegicus
gtcccctgatccataagcagatgtg

SEQ ID NO: 493416 - DNA, 25 bp, Rattus norvegicus
gtcccctgatccttaagcagatgtg

SEQ ID NO: 493417 - DNA, 25 bp, Rattus norvegicus
gtcccctggtaccttggaagtgaca

SEQ ID NO: 493418 - DNA, 25 bp, Rattus norvegicus
gtcccctggtacgttggaagtgaca

SEQ ID NO: 493419 - DNA, 25 bp, Rattus norvegicus
gtcccctggtgtacggtggcatgaa

SEQ ID NO: 493420 - DNA, 25 bp, Rattus norvegicus
gtcccctggtgttcggtggcatgaa

SEQ ID NO: 493421 - DNA, 25 bp, Rattus norvegicus
gtcccctgtattacctatcatggag

SEQ ID NO: 493422 - DNA, 25 bp, Rattus norvegicus
gtcccctgtatttcctatcatggag

SEQ ID NO: 493423 - DNA, 25 bp, Rattus norvegicus
gtcccctgtcttatagcagcagata

SEQ ID NO: 493424 - DNA, 25 bp, Rattus norvegicus
gtcccctgtcttttagcagcagata

SEQ ID NO: 493425 - DNA, 25 bp, Rattus norvegicus
gtcccctgtgacaggttggttcaga

SEQ ID NO: 493426 - DNA, 25 bp, Rattus norvegicus
gtcccctgtgactggttggttcaga

SEQ ID NO: 493427 - DNA, 25 bp, Rattus norvegicus
gtcccctgtgtgaggtgtttcttca

SEQ ID NO: 493428 - DNA, 25 bp, Rattus norvegicus
gtcccctgtgtgtggtgtttcttca

SEQ ID NO: 493429 - DNA, 25 bp, Rattus norvegicus
gtcccctgttgcaaaagttctttgt

SEQ ID NO: 493430 - DNA, 25 bp, Rattus norvegicus
gtcccctgttgctaaagttctttgt

SEQ ID NO: 493431 - DNA, 25 bp, Rattus norvegicus
gtccccttaaaccttaggctcagag

SEQ ID NO: 493432 - DNA, 25 bp, Rattus norvegicus
gtccccttaaacgttaggctcagag

SEQ ID NO: 493433 - DNA, 25 bp, Rattus norvegicus
gtccccttagcaagtggcacataga

SEQ ID NO: 493434 - DNA, 25 bp, Rattus norvegicus
gtccccttagcatgtggcacataga

SEQ ID NO: 493435 - DNA, 25 bp, Rattus norvegicus
gtccccttcatcctggttcagaaga

SEQ ID NO: 493436 - DNA, 25 bp, Rattus norvegicus
gtccccttcatcgtggttcagaaga

SEQ ID NO: 493437 - DNA, 25 bp, Rattus norvegicus
gtccccttccatcaactgaatgatc

SEQ ID NO: 493438 - DNA, 25 bp, Rattus norvegicus
gtccccttccatgaactgaatgatc

SEQ ID NO: 493439 - DNA, 25 bp, Rattus norvegicus
gtccccttgaataggtttgtcacct

SEQ ID NO: 493440 - DNA, 25 bp, Rattus norvegicus
gtccccttgaattggtttgtcacct

SEQ ID NO: 493441 - DNA, 25 bp, Rattus norvegicus
gtccccttgggaagtgttgttacca

SEQ ID NO: 493442 - DNA, 25 bp, Rattus norvegicus
gtccccttgggatgtgttgttacca

SEQ ID NO: 493443 - DNA, 25 bp, Rattus norvegicus
gtccccttgggtagccagggaatgc

SEQ ID NO: 493444 - DNA, 25 bp, Rattus norvegicus
gtccccttgggttgccagggaatgc

SEQ ID NO: 493445 - DNA, 25 bp, Rattus norvegicus
gtccccttgttcaggtgaacgttgg

SEQ ID NO: 493446 - DNA, 25 bp, Rattus norvegicus
gtccccttgttctggtgaacgttgg

SEQ ID NO: 493447 - DNA, 25 bp, Rattus norvegicus
gtcccctttctgattcagcattttt

SEQ ID NO: 493448 - DNA, 25 bp, Rattus norvegicus
gtcccctttctgtttcagcattttt

SEQ ID NO: 493449 - DNA, 25 bp, Rattus norvegicus
gtcccctttgacctacgagatgtgt

SEQ ID NO: 493450 - DNA, 25 bp, Rattus norvegicus
gtcccctttgacgtacgagatgtgt

SEQ ID NO: 493451 - DNA, 25 bp, Rattus norvegicus
gtccccttttacactgtatcacaga

SEQ ID NO: 493452 - DNA, 25 bp, Rattus norvegicus
gtccccttttactctgtatcacaga

SEQ ID NO: 493453 - DNA, 25 bp, Rattus norvegicus
gtcccgaaatggagcagtttgccct

SEQ ID NO: 493454 - DNA, 25 bp, Rattus norvegicus
gtcccgaaatggtgcagtttgccct

SEQ ID NO: 493455 - DNA, 25 bp, Rattus norvegicus
gtcccgaaggccacgaagtggccgc

SEQ ID NO: 493456 - DNA, 25 bp, Rattus norvegicus
gtcccgaaggcctcgaagtggccgc

SEQ ID NO: 493457 - DNA, 25 bp, Rattus norvegicus
gtcccgaaggctccttgagtctgta

SEQ ID NO: 493458 - DNA, 25 bp, Rattus norvegicus
gtcccgaaggctgcttgagtctgta

SEQ ID NO: 493459 - DNA, 25 bp, Rattus norvegicus
gtcccgacggtgcaagatccccata

SEQ ID NO: 493460 - DNA, 25 bp, Rattus norvegicus
gtcccgacggtggaagatccccata

SEQ ID NO: 493461 - DNA, 25 bp, Rattus norvegicus
gtcccgacttgaatttcttgtcctt

SEQ ID NO: 493462 - DNA, 25 bp, Rattus norvegicus
gtcccgacttgattttcttgtcctt

SEQ ID NO: 493463 - DNA, 25 bp, Rattus norvegicus
gtcccgacttggatgaagtttttat

SEQ ID NO: 493464 - DNA, 25 bp, Rattus norvegicus
gtcccgacttggttgaagtttttat

SEQ ID NO: 493465 - DNA, 25 bp, Rattus norvegicus
gtcccgaggtgcctctgaacccaga

SEQ ID NO: 493466 - DNA, 25 bp, Rattus norvegicus
gtcccgaggtgcgtctgaacccaga

SEQ ID NO: 493467 - DNA, 25 bp, Rattus norvegicus
gtcccgagttgtcgtcgggtctcca

SEQ ID NO: 493468 - DNA, 25 bp, Rattus norvegicus
gtcccgagttgtggtcgggtctcca

SEQ ID NO: 493469 - DNA, 25 bp, Rattus norvegicus
gtcccgatcgtgcattgcagggcat

SEQ ID NO: 493470 - DNA, 25 bp, Rattus norvegicus
gtcccgatcgtggattgcagggcat

SEQ ID NO: 493471 - DNA, 25 bp, Rattus norvegicus
gtcccgcaaccccaggaggacattt

SEQ ID NO: 493472 - DNA, 25 bp, Rattus norvegicus
gtcccgcaacccgaggaggacattt

SEQ ID NO: 493473 - DNA, 25 bp, Rattus norvegicus
gtcccgcaggctctgttaggtgata

SEQ ID NO: 493474 - DNA, 25 bp, Rattus norvegicus
gtcccgcaggctgtgttaggtgata

SEQ ID NO: 493475 - DNA, 25 bp, Rattus norvegicus
gtcccgccagggaacaggcaagaaa

SEQ ID NO: 493476 - DNA, 25 bp, Rattus norvegicus
gtcccgccagggtacaggcaagaaa

SEQ ID NO: 493477 - DNA, 25 bp, Rattus norvegicus
gtcccgcccgaaacctgaaatgagc

SEQ ID NO: 493478 - DNA, 25 bp, Rattus norvegicus
gtcccgcccgaatcctgaaatgagc

SEQ ID NO: 493479 - DNA, 25 bp, Rattus norvegicus
gtcccgcgtactctacaagtttaca

SEQ ID NO: 493480 - DNA, 25 bp, Rattus norvegicus
gtcccgcgtactgtacaagtttaca

SEQ ID NO: 493481 - DNA, 25 bp, Rattus norvegicus
gtcccgctcggacaagagacagcaa

SEQ ID NO: 493482 - DNA, 25 bp, Rattus norvegicus
gtcccgctcggagaagagacagcaa

SEQ ID NO: 493483 - DNA, 25 bp, Rattus norvegicus
gtcccggatcgcactgattccgcga

SEQ ID NO: 493484 - DNA, 25 bp, Rattus norvegicus
gtcccggatcgctctgattccgcga

SEQ ID NO: 493485 - DNA, 25 bp, Rattus norvegicus
gtcccggccggccactgaggagagc

SEQ ID NO: 493486 - DNA, 25 bp, Rattus norvegicus
gtcccggccggcgactgaggagagc

SEQ ID NO: 493487 - DNA, 25 bp, Rattus norvegicus
gtcccggcctctatcatgttgagga

SEQ ID NO: 493488 - DNA, 25 bp, Rattus norvegicus
gtcccggcctctttcatgttgagga

SEQ ID NO: 493489 - DNA, 25 bp, Rattus norvegicus
gtcccggcttcaagtttgttgaaac

SEQ ID NO: 493490 - DNA, 25 bp, Rattus norvegicus
gtcccggcttcatgtttgttgaaac

SEQ ID NO: 493491 - DNA, 25 bp, Rattus norvegicus
gtcccgggaaccagacacccaagat

SEQ ID NO: 493492 - DNA, 25 bp, Rattus norvegicus
gtcccgggaacctgacacccaagat

SEQ ID NO: 493493 - DNA, 25 bp, Rattus norvegicus
gtcccgggatagataggcagcttgc

SEQ ID NO: 493494 - DNA, 25 bp, Rattus norvegicus
gtcccgggatagttaggcagcttgc

SEQ ID NO: 493495 - DNA, 25 bp, Rattus norvegicus
gtcccgggcacgcagcttcatgaag

SEQ ID NO: 493496 - DNA, 25 bp, Rattus norvegicus
gtcccgggcacggagcttcatgaag

SEQ ID NO: 493497 - DNA, 25 bp, Rattus norvegicus
gtcccgggcagtcaaaagctttaag

SEQ ID NO: 493498 - DNA, 25 bp, Rattus norvegicus
gtcccgggcagtgaaaagctttaag

SEQ ID NO: 493499 - DNA, 25 bp, Rattus norvegicus
gtcccggtgactctagtagctaatg

SEQ ID NO: 493500 - DNA, 25 bp, Rattus norvegicus
gtcccggtgactgtagtagctaatg

SEQ ID NO: 493501 - DNA, 25 bp, Rattus norvegicus
gtcccggtgattactaccaaattca

SEQ ID NO: 493502 - DNA, 25 bp, Rattus norvegicus
gtcccggtgatttctaccaaattca

SEQ ID NO: 493503 - DNA, 25 bp, Rattus norvegicus
gtcccgtatctgcatttccaagtag

SEQ ID NO: 493504 - DNA, 25 bp, Rattus norvegicus
gtcccgtatctggatttccaagtag

SEQ ID NO: 493505 - DNA, 25 bp, Rattus norvegicus
gtcccgtatttaccactaactagca

SEQ ID NO: 493506 - DNA, 25 bp, Rattus norvegicus
gtcccgtatttagcactaactagca

SEQ ID NO: 493507 - DNA, 25 bp, Rattus norvegicus
gtcccgtcatacagttccaggtggt

SEQ ID NO: 493508 - DNA, 25 bp, Rattus norvegicus
gtcccgtcatactgttccaggtggt

SEQ ID NO: 493509 - DNA, 25 bp, Rattus norvegicus
gtcccgtcattaatattgtacagtc

SEQ ID NO: 493510 - DNA, 25 bp, Rattus norvegicus
gtcccgtcattattattgtacagtc

SEQ ID NO: 493511 - DNA, 25 bp, Rattus norvegicus
gtcccgtctaagcaggccaatccat

SEQ ID NO: 493512 - DNA, 25 bp, Rattus norvegicus
gtcccgtctaaggaggccaatccat

SEQ ID NO: 493513 - DNA, 25 bp, Rattus norvegicus
gtcccgtgaagcacatccacaggaa

SEQ ID NO: 493514 - DNA, 25 bp, Rattus norvegicus
gtcccgtgaagctcatccacaggaa

SEQ ID NO: 493515 - DNA, 25 bp, Rattus norvegicus
gtcccgtgaccacagagatgctgga

SEQ ID NO: 493516 - DNA, 25 bp, Rattus norvegicus
gtcccgtgaccagagagatgctgga

SEQ ID NO: 493517 - DNA, 25 bp, Rattus norvegicus
gtcccgtgaggtatggtttgccata

SEQ ID NO: 493518 - DNA, 25 bp, Rattus norvegicus
gtcccgtgaggtttggtttgccata

SEQ ID NO: 493519 - DNA, 25 bp, Rattus norvegicus
gtcccgtgcctgacacacacaggat

SEQ ID NO: 493520 - DNA, 25 bp, Rattus norvegicus
gtcccgtgcctgtcacacacaggat

SEQ ID NO: 493521 - DNA, 25 bp, Rattus norvegicus
gtcccgtggactctatcacgaggga

SEQ ID NO: 493522 - DNA, 25 bp, Rattus norvegicus
gtcccgtggactgtatcacgaggga

SEQ ID NO: 493523 - DNA, 25 bp, Rattus norvegicus
gtcccgtgggacacagaccaaagta

SEQ ID NO: 493524 - DNA, 25 bp, Rattus norvegicus
gtcccgtgggactcagaccaaagta

SEQ ID NO: 493525 - DNA, 25 bp, Rattus norvegicus
gtcccgtgtcagagacaaggagagc

SEQ ID NO: 493526 - DNA, 25 bp, Rattus norvegicus
gtcccgtgtcagtgacaaggagagc

SEQ ID NO: 493527 - DNA, 25 bp, Rattus norvegicus
gtcccgttgagccagcattgcgtga

SEQ ID NO: 493528 - DNA, 25 bp, Rattus norvegicus
gtcccgttgagcgagcattgcgtga

SEQ ID NO: 493529 - DNA, 25 bp, Rattus norvegicus
gtcccgttgtctacattttgttata

SEQ ID NO: 493530 - DNA, 25 bp, Rattus norvegicus
gtcccgttgtcttcattttgttata

SEQ ID NO: 493531 - DNA, 25 bp, Rattus norvegicus
gtcccgtttctaagtgcttgtgctt

SEQ ID NO: 493532 - DNA, 25 bp, Rattus norvegicus
gtcccgtttctatgtgcttgtgctt

SEQ ID NO: 493533 - DNA, 25 bp, Rattus norvegicus
gtccctaaagaaacagtggcgccag

SEQ ID NO: 493534 - DNA, 25 bp, Rattus norvegicus
gtccctaaagaatcagtggcgccag

SEQ ID NO: 493535 - DNA, 25 bp, Rattus norvegicus
gtccctaaagacagtgagcacgtgt

SEQ ID NO: 493536 - DNA, 25 bp, Rattus norvegicus
gtccctaaagactgtgagcacgtgt

SEQ ID NO: 493537 - DNA, 25 bp, Rattus norvegicus
gtccctaaccatcaggatgacatca

SEQ ID NO: 493538 - DNA, 25 bp, Rattus norvegicus
gtccctaaccatgaggatgacatca

SEQ ID NO: 493539 - DNA, 25 bp, Rattus norvegicus
gtccctaaccccatgtttgtgggag

SEQ ID NO: 493540 - DNA, 25 bp, Rattus norvegicus
gtccctaaccccttgtttgtgggag

SEQ ID NO: 493541 - DNA, 25 bp, Rattus norvegicus
gtccctaagacgagaccatgatagt

SEQ ID NO: 493542 - DNA, 25 bp, Rattus norvegicus
gtccctaagacgtgaccatgatagt

SEQ ID NO: 493543 - DNA, 25 bp, Rattus norvegicus
gtccctaaggttctacagacttctg

SEQ ID NO: 493544 - DNA, 25 bp, Rattus norvegicus
gtccctaaggttgtacagacttctg

SEQ ID NO: 493545 - DNA, 25 bp, Rattus norvegicus
gtccctaatgtcagctgttagccaa

SEQ ID NO: 493546 - DNA, 25 bp, Rattus norvegicus
gtccctaatgtctgctgttagccaa

SEQ ID NO: 493547 - DNA, 25 bp, Rattus norvegicus
gtccctaatgtgacacccggataag

SEQ ID NO: 493548 - DNA, 25 bp, Rattus norvegicus
gtccctaatgtgtcacccggataag

SEQ ID NO: 493549 - DNA, 25 bp, Rattus norvegicus
gtccctacaagtcccaggtgtgcca

SEQ ID NO: 493550 - DNA, 25 bp, Rattus norvegicus
gtccctacaagtgccaggtgtgcca

SEQ ID NO: 493551 - DNA, 25 bp, Rattus norvegicus
gtccctacagaaaccatccatgata

SEQ ID NO: 493552 - DNA, 25 bp, Rattus norvegicus
gtccctacagaatccatccatgata

SEQ ID NO: 493553 - DNA, 25 bp, Rattus norvegicus
gtccctacatctaaatagcttgctt

SEQ ID NO: 493554 - DNA, 25 bp, Rattus norvegicus
gtccctacatcttaatagcttgctt

SEQ ID NO: 493555 - DNA, 25 bp, Rattus norvegicus
gtccctactctacctcaggatgagg

SEQ ID NO: 493556 - DNA, 25 bp, Rattus norvegicus
gtccctactctagctcaggatgagg

SEQ ID NO: 493557 - DNA, 25 bp, Rattus norvegicus
gtccctactctgctttgggatagta

SEQ ID NO: 493558 - DNA, 25 bp, Rattus norvegicus
gtccctactctggtttgggatagta

SEQ ID NO: 493559 - DNA, 25 bp, Rattus norvegicus
gtccctactgaaaattccttttcat

SEQ ID NO: 493560 - DNA, 25 bp, Rattus norvegicus
gtccctactgaatattccttttcat

SEQ ID NO: 493561 - DNA, 25 bp, Rattus norvegicus
gtccctagaatacttgggcaacata

SEQ ID NO: 493562 - DNA, 25 bp, Rattus norvegicus
gtccctagaatagttgggcaacata

SEQ ID NO: 493563 - DNA, 25 bp, Rattus norvegicus
gtccctaggacgcttggcagacaag

SEQ ID NO: 493564 - DNA, 25 bp, Rattus norvegicus
gtccctaggacggttggcagacaag

SEQ ID NO: 493565 - DNA, 25 bp, Rattus norvegicus
gtccctagggcaaagccttgtcaaa

SEQ ID NO: 493566 - DNA, 25 bp, Rattus norvegicus
gtccctagggcatagccttgtcaaa

SEQ ID NO: 493567 - DNA, 25 bp, Rattus norvegicus
gtccctaggtttaaatgcccatggt

SEQ ID NO: 493568 - DNA, 25 bp, Rattus norvegicus
gtccctaggttttaatgcccatggt

SEQ ID NO: 493569 - DNA, 25 bp, Rattus norvegicus
gtccctagtgcccatgtgcgaagaa

SEQ ID NO: 493570 - DNA, 25 bp, Rattus norvegicus
gtccctagtgccgatgtgcgaagaa

SEQ ID NO: 493571 - DNA, 25 bp, Rattus norvegicus
gtccctatacatcatgagcacacac

SEQ ID NO: 493572 - DNA, 25 bp, Rattus norvegicus
gtccctatacatgatgagcacacac

SEQ ID NO: 493573 - DNA, 25 bp, Rattus norvegicus
gtccctataggtagattttcctcct

SEQ ID NO: 493574 - DNA, 25 bp, Rattus norvegicus
gtccctataggttgattttcctcct

SEQ ID NO: 493575 - DNA, 25 bp, Rattus norvegicus
gtccctatctcaagcacagacagag

SEQ ID NO: 493576 - DNA, 25 bp, Rattus norvegicus
gtccctatctcatgcacagacagag

SEQ ID NO: 493577 - DNA, 25 bp, Rattus norvegicus
gtccctatctgtaaggtgggcagtt

SEQ ID NO: 493578 - DNA, 25 bp, Rattus norvegicus
gtccctatctgttaggtgggcagtt

SEQ ID NO: 493579 - DNA, 25 bp, Rattus norvegicus
gtccctatgactcacagcatgctgt

SEQ ID NO: 493580 - DNA, 25 bp, Rattus norvegicus
gtccctatgactgacagcatgctgt

SEQ ID NO: 493581 - DNA, 25 bp, Rattus norvegicus
gtccctattcagaaatcaacttgag

SEQ ID NO: 493582 - DNA, 25 bp, Rattus norvegicus
gtccctattcagtaatcaacttgag

SEQ ID NO: 493583 - DNA, 25 bp, Rattus norvegicus
gtccctattttgcagtggtgtgaat

SEQ ID NO: 493584 - DNA, 25 bp, Rattus norvegicus
gtccctattttggagtggtgtgaat

SEQ ID NO: 493585 - DNA, 25 bp, Rattus norvegicus
gtccctcaagcgctggaagccgaaa

SEQ ID NO: 493586 - DNA, 25 bp, Rattus norvegicus
gtccctcaagcggtggaagccgaaa

SEQ ID NO: 493587 - DNA, 25 bp, Rattus norvegicus
gtccctcacactaatgcggcaagca

SEQ ID NO: 493588 - DNA, 25 bp, Rattus norvegicus
gtccctcacacttatgcggcaagca

SEQ ID NO: 493589 - DNA, 25 bp, Rattus norvegicus
gtccctcactttccattactagttg

SEQ ID NO: 493590 - DNA, 25 bp, Rattus norvegicus
gtccctcactttgcattactagttg

SEQ ID NO: 493591 - DNA, 25 bp, Rattus norvegicus
gtccctcagccaattcaatgttgaa

SEQ ID NO: 493592 - DNA, 25 bp, Rattus norvegicus
gtccctcagccatttcaatgttgaa

SEQ ID NO: 493593 - DNA, 25 bp, Rattus norvegicus
gtccctcatccgcagactgaaaaca

SEQ ID NO: 493594 - DNA, 25 bp, Rattus norvegicus
gtccctcatccggagactgaaaaca

SEQ ID NO: 493595 - DNA, 25 bp, Rattus norvegicus
gtccctcatggtctgcagtgaataa

SEQ ID NO: 493596 - DNA, 25 bp, Rattus norvegicus
gtccctcatggtgtgcagtgaataa

SEQ ID NO: 493597 - DNA, 25 bp, Rattus norvegicus
gtccctcattacatagcaactggca

SEQ ID NO: 493598 - DNA, 25 bp, Rattus norvegicus
gtccctcattacttagcaactggca

SEQ ID NO: 493599 - DNA, 25 bp, Rattus norvegicus
gtccctccaatcctgttagttatta

SEQ ID NO: 493600 - DNA, 25 bp, Rattus norvegicus
gtccctccaatcgtgttagttatta

SEQ ID NO: 493601 - DNA, 25 bp, Rattus norvegicus
gtccctccagtcaaaagctttgtga

SEQ ID NO: 493602 - DNA, 25 bp, Rattus norvegicus
gtccctccagtctaaagctttgtga

SEQ ID NO: 493603 - DNA, 25 bp, Rattus norvegicus
gtccctccatgtagtagaccttgag

SEQ ID NO: 493604 - DNA, 25 bp, Rattus norvegicus
gtccctccatgttgtagaccttgag

SEQ ID NO: 493605 - DNA, 25 bp, Rattus norvegicus
gtccctcccgacagtacagatgtgt

SEQ ID NO: 493606 - DNA, 25 bp, Rattus norvegicus
gtccctcccgactgtacagatgtgt

SEQ ID NO: 493607 - DNA, 25 bp, Rattus norvegicus
gtccctcccttcactggacaaggaa

SEQ ID NO: 493608 - DNA, 25 bp, Rattus norvegicus
gtccctcccttctctggacaaggaa

SEQ ID NO: 493609 - DNA, 25 bp, Rattus norvegicus
gtccctccgcatcctgtaaatatgt

SEQ ID NO: 493610 - DNA, 25 bp, Rattus norvegicus
gtccctccgcatgctgtaaatatgt

SEQ ID NO: 493611 - DNA, 25 bp, Rattus norvegicus
gtccctccgttccaaggtggatgaa

SEQ ID NO: 493612 - DNA, 25 bp, Rattus norvegicus
gtccctccgttcgaaggtggatgaa

SEQ ID NO: 493613 - DNA, 25 bp, Rattus norvegicus
gtccctcctccaataaagcttaaga

SEQ ID NO: 493614 - DNA, 25 bp, Rattus norvegicus
gtccctcctccattaaagcttaaga

SEQ ID NO: 493615 - DNA, 25 bp, Rattus norvegicus
gtccctcctgacagacggttaaaca

SEQ ID NO: 493616 - DNA, 25 bp, Rattus norvegicus
gtccctcctgactgacggttaaaca

SEQ ID NO: 493617 - DNA, 25 bp, Rattus norvegicus
gtccctcctgatctatttttcttgg

SEQ ID NO: 493618 - DNA, 25 bp, Rattus norvegicus
gtccctcctgatgtatttttcttgg

SEQ ID NO: 493619 - DNA, 25 bp, Rattus norvegicus
gtccctcctgtgagcagtgtgcaaa

SEQ ID NO: 493620 - DNA, 25 bp, Rattus norvegicus
gtccctcctgtgtgcagtgtgcaaa

SEQ ID NO: 493621 - DNA, 25 bp, Rattus norvegicus
gtccctcctgttactgctggaatgt

SEQ ID NO: 493622 - DNA, 25 bp, Rattus norvegicus
gtccctcctgtttctgctggaatgt

SEQ ID NO: 493623 - DNA, 25 bp, Rattus norvegicus
gtccctcgtcatcatcaatatcaat

SEQ ID NO: 493624 - DNA, 25 bp, Rattus norvegicus
gtccctcgtcatgatcaatatcaat

SEQ ID NO: 493625 - DNA, 25 bp, Rattus norvegicus
gtccctctacatatactctttggtt

SEQ ID NO: 493626 - DNA, 25 bp, Rattus norvegicus
gtccctctacatttactctttggtt

SEQ ID NO: 493627 - DNA, 25 bp, Rattus norvegicus
gtccctctcaaacgttcagtcgata

SEQ ID NO: 493628 - DNA, 25 bp, Rattus norvegicus
gtccctctcaaaggttcagtcgata

SEQ ID NO: 493629 - DNA, 25 bp, Rattus norvegicus
gtccctctggaactggagctgttct

SEQ ID NO: 493630 - DNA, 25 bp, Rattus norvegicus
gtccctctggaagtggagctgttct

SEQ ID NO: 493631 - DNA, 25 bp, Rattus norvegicus
gtccctctgggtaacagctgagaca

SEQ ID NO: 493632 - DNA, 25 bp, Rattus norvegicus
gtccctctgggttacagctgagaca

SEQ ID NO: 493633 - DNA, 25 bp, Rattus norvegicus
gtccctctggtcaatgaaggtctca

SEQ ID NO: 493634 - DNA, 25 bp, Rattus norvegicus
gtccctctggtctatgaaggtctca

SEQ ID NO: 493635 - DNA, 25 bp, Rattus norvegicus
gtccctcttcagcaaaggcaggtga

SEQ ID NO: 493636 - DNA, 25 bp, Rattus norvegicus
gtccctcttcaggaaaggcaggtga

SEQ ID NO: 493637 - DNA, 25 bp, Rattus norvegicus
gtccctcttccgcaacatggagtat

SEQ ID NO: 493638 - DNA, 25 bp, Rattus norvegicus
gtccctcttccggaacatggagtat

SEQ ID NO: 493639 - DNA, 25 bp, Rattus norvegicus
gtccctcttcttaggtctggattac

SEQ ID NO: 493640 - DNA, 25 bp, Rattus norvegicus
gtccctcttctttggtctggattac

SEQ ID NO: 493641 - DNA, 25 bp, Rattus norvegicus
gtccctctttcaacagaatcatcaa

SEQ ID NO: 493642 - DNA, 25 bp, Rattus norvegicus
gtccctctttcatcagaatcatcaa

SEQ ID NO: 493643 - DNA, 25 bp, Rattus norvegicus
gtccctctttgacaatgctgaagct

SEQ ID NO: 493644 - DNA, 25 bp, Rattus norvegicus
gtccctctttgagaatgctgaagct

SEQ ID NO: 493645 - DNA, 25 bp, Rattus norvegicus
gtccctctttttcctggcaataagt

SEQ ID NO: 493646 - DNA, 25 bp, Rattus norvegicus
gtccctctttttgctggcaataagt

SEQ ID NO: 493647 - DNA, 25 bp, Rattus norvegicus
gtccctgaaaacatttacccacttg

SEQ ID NO: 493648 - DNA, 25 bp, Rattus norvegicus
gtccctgaaaacttttacccacttg

SEQ ID NO: 493649 - DNA, 25 bp, Rattus norvegicus
gtccctgaacttatattctgttgtt

SEQ ID NO: 493650 - DNA, 25 bp, Rattus norvegicus
gtccctgaacttttattctgttgtt

SEQ ID NO: 493651 - DNA, 25 bp, Rattus norvegicus
gtccctgaagttagtgaacacgtct

SEQ ID NO: 493652 - DNA, 25 bp, Rattus norvegicus
gtccctgaagttatgcatttatagc

SEQ ID NO: 493653 - DNA, 25 bp, Rattus norvegicus
gtccctgaagtttgtgaacacgtct

SEQ ID NO: 493654 - DNA, 25 bp, Rattus norvegicus
gtccctgaagttttgcatttatagc

SEQ ID NO: 493655 - DNA, 25 bp, Rattus norvegicus
gtccctgactatatacagcacatgt

SEQ ID NO: 493656 - DNA, 25 bp, Rattus norvegicus
gtccctgactatttacagcacatgt

SEQ ID NO: 493657 - DNA, 25 bp, Rattus norvegicus
gtccctgactcccattaacaatagc

SEQ ID NO: 493658 - DNA, 25 bp, Rattus norvegicus
gtccctgactccgattaacaatagc

SEQ ID NO: 493659 - DNA, 25 bp, Rattus norvegicus
gtccctgacttgagtaacttctatg

SEQ ID NO: 493660 - DNA, 25 bp, Rattus norvegicus
gtccctgacttgtgtaacttctatg

SEQ ID NO: 493661 - DNA, 25 bp, Rattus norvegicus
gtccctgagaccctcatggtgaatg

SEQ ID NO: 493662 - DNA, 25 bp, Rattus norvegicus
gtccctgagaccgtcatggtgaatg

SEQ ID NO: 493663 - DNA, 25 bp, Rattus norvegicus
gtccctgagggaccattgggcccaa

SEQ ID NO: 493664 - DNA, 25 bp, Rattus norvegicus
gtccctgagggagcattgggcccaa

SEQ ID NO: 493665 - DNA, 25 bp, Rattus norvegicus
gtccctgaggtactgctcaaactgc

SEQ ID NO: 493666 - DNA, 25 bp, Rattus norvegicus
gtccctgaggtagtgctcaaactgc

SEQ ID NO: 493667 - DNA, 25 bp, Rattus norvegicus
gtccctgatacccatacattgtgtt

SEQ ID NO: 493668 - DNA, 25 bp, Rattus norvegicus
gtccctgataccgatacattgtgtt

SEQ ID NO: 493669 - DNA, 25 bp, Rattus norvegicus
gtccctgatgataaccattgccttt

SEQ ID NO: 493670 - DNA, 25 bp, Rattus norvegicus
gtccctgatgattaccattgccttt

SEQ ID NO: 493671 - DNA, 25 bp, Rattus norvegicus
gtccctgatgtacgaagtctgcctc

SEQ ID NO: 493672 - DNA, 25 bp, Rattus norvegicus
gtccctgatgtaggaagtctgcctc

SEQ ID NO: 493673 - DNA, 25 bp, Rattus norvegicus
gtccctgcagtaattcaagtgttat

SEQ ID NO: 493674 - DNA, 25 bp, Rattus norvegicus
gtccctgcagtaatttgctgccaga

SEQ ID NO: 493675 - DNA, 25 bp, Rattus norvegicus
gtccctgcagtatttcaagtgttat

SEQ ID NO: 493676 - DNA, 25 bp, Rattus norvegicus
gtccctgcagtattttgctgccaga

SEQ ID NO: 493677 - DNA, 25 bp, Rattus norvegicus
gtccctgcatccagaagggtttcta

SEQ ID NO: 493678 - DNA, 25 bp, Rattus norvegicus
gtccctgcatcctgaagggtttcta

SEQ ID NO: 493679 - DNA, 25 bp, Rattus norvegicus
gtccctgcatctcacaagagagagg

SEQ ID NO: 493680 - DNA, 25 bp, Rattus norvegicus
gtccctgcatctgacaagagagagg

SEQ ID NO: 493681 - DNA, 25 bp, Rattus norvegicus
gtccctgcatgcatgtgtgctatgg

SEQ ID NO: 493682 - DNA, 25 bp, Rattus norvegicus
gtccctgcatgcttgtgtgctatgg

SEQ ID NO: 493683 - DNA, 25 bp, Rattus norvegicus
gtccctgcatttcaagactcttgcc

SEQ ID NO: 493684 - DNA, 25 bp, Rattus norvegicus
gtccctgcatttgaagactcttgcc

SEQ ID NO: 493685 - DNA, 25 bp, Rattus norvegicus
gtccctgccagtaattgtcacttta

SEQ ID NO: 493686 - DNA, 25 bp, Rattus norvegicus
gtccctgccagttattgtcacttta

SEQ ID NO: 493687 - DNA, 25 bp, Rattus norvegicus
gtccctgccggcagatgacgtgtga

SEQ ID NO: 493688 - DNA, 25 bp, Rattus norvegicus
gtccctgccggctgatgacgtgtga

SEQ ID NO: 493689 - DNA, 25 bp, Rattus norvegicus
gtccctgcgatcactggtgtttagt

SEQ ID NO: 493690 - DNA, 25 bp, Rattus norvegicus
gtccctgcgatctctggtgtttagt

SEQ ID NO: 493691 - DNA, 25 bp, Rattus norvegicus
gtccctgcgctgatgggaacattga

SEQ ID NO: 493692 - DNA, 25 bp, Rattus norvegicus
gtccctgcgctgttgggaacattga

SEQ ID NO: 493693 - DNA, 25 bp, Rattus norvegicus
gtccctgcgtgtcagtgaatgccat

SEQ ID NO: 493694 - DNA, 25 bp, Rattus norvegicus
gtccctgcgtgtgagtgaatgccat

SEQ ID NO: 493695 - DNA, 25 bp, Rattus norvegicus
gtccctgcgttcatacaactgagtg

SEQ ID NO: 493696 - DNA, 25 bp, Rattus norvegicus
gtccctgcgttcttacaactgagtg

SEQ ID NO: 493697 - DNA, 25 bp, Rattus norvegicus
gtccctgctctcagattttgtaaac

SEQ ID NO: 493698 - DNA, 25 bp, Rattus norvegicus
gtccctgctctctgattttgtaaac

SEQ ID NO: 493699 - DNA, 25 bp, Rattus norvegicus
gtccctgctgacagagtaactgttt

SEQ ID NO: 493700 - DNA, 25 bp, Rattus norvegicus
gtccctgctgactgagtaactgttt

SEQ ID NO: 493701 - DNA, 25 bp, Rattus norvegicus
gtccctgctgccacttaagaaaatg

SEQ ID NO: 493702 - DNA, 25 bp, Rattus norvegicus
gtccctgctgccataaatgtaaaaa

SEQ ID NO: 493703 - DNA, 25 bp, Rattus norvegicus
gtccctgctgcctcttaagaaaatg

SEQ ID NO: 493704 - DNA, 25 bp, Rattus norvegicus
gtccctgctgccttaaatgtaaaaa

SEQ ID NO: 493705 - DNA, 25 bp, Rattus norvegicus
gtccctgctgtgactagcctggaga

SEQ ID NO: 493706 - DNA, 25 bp, Rattus norvegicus
gtccctgctgtgtctagcctggaga

SEQ ID NO: 493707 - DNA, 25 bp, Rattus norvegicus
gtccctggaagtacagagtcactgg

SEQ ID NO: 493708 - DNA, 25 bp, Rattus norvegicus
gtccctggaagttcagagtcactgg

SEQ ID NO: 493709 - DNA, 25 bp, Rattus norvegicus
gtccctggacacatttagataattg

SEQ ID NO: 493710 - DNA, 25 bp, Rattus norvegicus
gtccctggacacttttagataattg

SEQ ID NO: 493711 - DNA, 25 bp, Rattus norvegicus
gtccctggagtccacatggcaggaa

SEQ ID NO: 493712 - DNA, 25 bp, Rattus norvegicus
gtccctggagtcgacatggcaggaa

SEQ ID NO: 493713 - DNA, 25 bp, Rattus norvegicus
gtccctggcaacattaatatgctgt

SEQ ID NO: 493714 - DNA, 25 bp, Rattus norvegicus
gtccctggcaactttaatatgctgt

SEQ ID NO: 493715 - DNA, 25 bp, Rattus norvegicus
gtccctggccaaagaaagaattcga

SEQ ID NO: 493716 - DNA, 25 bp, Rattus norvegicus
gtccctggccaatgaaagaattcga

SEQ ID NO: 493717 - DNA, 25 bp, Rattus norvegicus
gtccctggccagcaagactgagagt

SEQ ID NO: 493718 - DNA, 25 bp, Rattus norvegicus
gtccctggccagcagtggagtaaat

SEQ ID NO: 493719 - DNA, 25 bp, Rattus norvegicus
gtccctggccaggaagactgagagt

SEQ ID NO: 493720 - DNA, 25 bp, Rattus norvegicus
gtccctggccaggagtggagtaaat

SEQ ID NO: 493721 - DNA, 25 bp, Rattus norvegicus
gtccctggcctgagaagaagttcct

SEQ ID NO: 493722 - DNA, 25 bp, Rattus norvegicus
gtccctggcctgtgaagaagttcct

SEQ ID NO: 493723 - DNA, 25 bp, Rattus norvegicus
gtccctgggaagctgttatcttcaa

SEQ ID NO: 493724 - DNA, 25 bp, Rattus norvegicus
gtccctgggaaggtgttatcttcaa

SEQ ID NO: 493725 - DNA, 25 bp, Rattus norvegicus
gtccctgggaccacggagggccgag

SEQ ID NO: 493726 - DNA, 25 bp, Rattus norvegicus
gtccctgggacctcggagggccgag

SEQ ID NO: 493727 - DNA, 25 bp, Rattus norvegicus
gtccctgggatccacgtagagaagt

SEQ ID NO: 493728 - DNA, 25 bp, Rattus norvegicus
gtccctgggatcgacgtagagaagt

SEQ ID NO: 493729 - DNA, 25 bp, Rattus norvegicus
gtccctgggccaagagcctggctca

SEQ ID NO: 493730 - DNA, 25 bp, Rattus norvegicus
gtccctgggccatgagcctggctca

SEQ ID NO: 493731 - DNA, 25 bp, Rattus norvegicus
gtccctgggtagaggagcaaacctc

SEQ ID NO: 493732 - DNA, 25 bp, Rattus norvegicus
gtccctgggtagtggagcaaacctc

SEQ ID NO: 493733 - DNA, 25 bp, Rattus norvegicus
gtccctggtcacagtgctggttaaa

SEQ ID NO: 493734 - DNA, 25 bp, Rattus norvegicus
gtccctggtcacagttgaaggtttt

SEQ ID NO: 493735 - DNA, 25 bp, Rattus norvegicus
gtccctggtcactgtgctggttaaa

SEQ ID NO: 493736 - DNA, 25 bp, Rattus norvegicus
gtccctggtcactgttgaaggtttt

SEQ ID NO: 493737 - DNA, 25 bp, Rattus norvegicus
gtccctggtcagagtgagttcatcc

SEQ ID NO: 493738 - DNA, 25 bp, Rattus norvegicus
gtccctggtcagtgtgagttcatcc

SEQ ID NO: 493739 - DNA, 25 bp, Rattus norvegicus
gtccctggtcatcgtgatgcgcaga

SEQ ID NO: 493740 - DNA, 25 bp, Rattus norvegicus
gtccctggtcatggtgatgcgcaga

SEQ ID NO: 493741 - DNA, 25 bp, Rattus norvegicus
gtccctggtccaagtaaattagaat

SEQ ID NO: 493742 - DNA, 25 bp, Rattus norvegicus
gtccctggtccatgtaaattagaat

SEQ ID NO: 493743 - DNA, 25 bp, Rattus norvegicus
gtccctggtctaccaataaaagccc

SEQ ID NO: 493744 - DNA, 25 bp, Rattus norvegicus
gtccctggtctagcaataaaagccc

SEQ ID NO: 493745 - DNA, 25 bp, Rattus norvegicus
gtccctggtctgagtggtggctcat

SEQ ID NO: 493746 - DNA, 25 bp, Rattus norvegicus
gtccctggtctgtgtggtggctcat

SEQ ID NO: 493747 - DNA, 25 bp, Rattus norvegicus
gtccctggttaaatacttgccacaa

SEQ ID NO: 493748 - DNA, 25 bp, Rattus norvegicus
gtccctggttaattacttgccacaa

SEQ ID NO: 493749 - DNA, 25 bp, Rattus norvegicus
gtccctgtacgcctcaaaaatgatg

SEQ ID NO: 493750 - DNA, 25 bp, Rattus norvegicus
gtccctgtacgcgtcaaaaatgatg

SEQ ID NO: 493751 - DNA, 25 bp, Rattus norvegicus
gtccctgtactaagagttgccttgg

SEQ ID NO: 493752 - DNA, 25 bp, Rattus norvegicus
gtccctgtactatgagttgccttgg

SEQ ID NO: 493753 - DNA, 25 bp, Rattus norvegicus
gtccctgtagagagactgagcctca

SEQ ID NO: 493754 - DNA, 25 bp, Rattus norvegicus
gtccctgtagagtgactgagcctca

SEQ ID NO: 493755 - DNA, 25 bp, Rattus norvegicus
gtccctgtattaactgtccttgaag

SEQ ID NO: 493756 - DNA, 25 bp, Rattus norvegicus
gtccctgtattatctgtccttgaag

SEQ ID NO: 493757 - DNA, 25 bp, Rattus norvegicus
gtccctgtattcaagattctgccaa

SEQ ID NO: 493758 - DNA, 25 bp, Rattus norvegicus
gtccctgtattctagattctgccaa

SEQ ID NO: 493759 - DNA, 25 bp, Rattus norvegicus
gtccctgtcactatcagtcattcta

SEQ ID NO: 493760 - DNA, 25 bp, Rattus norvegicus
gtccctgtcactttcagtcattcta

SEQ ID NO: 493761 - DNA, 25 bp, Rattus norvegicus
gtccctgtcagcacgttgttactaa

SEQ ID NO: 493762 - DNA, 25 bp, Rattus norvegicus
gtccctgtcagctcgttgttactaa

SEQ ID NO: 493763 - DNA, 25 bp, Rattus norvegicus
gtccctgtctcactctagttgtgga

SEQ ID NO: 493764 - DNA, 25 bp, Rattus norvegicus
gtccctgtctcagtctagttgtgga

SEQ ID NO: 493765 - DNA, 25 bp, Rattus norvegicus
gtccctgtggagacagacctggtca

SEQ ID NO: 493766 - DNA, 25 bp, Rattus norvegicus
gtccctgtggagtcagacctggtca

SEQ ID NO: 493767 - DNA, 25 bp, Rattus norvegicus
gtccctgttcacatcaattcagcta

SEQ ID NO: 493768 - DNA, 25 bp, Rattus norvegicus
gtccctgttcacttcaattcagcta

SEQ ID NO: 493769 - DNA, 25 bp, Rattus norvegicus
gtccctgttgccagtacttatttag

SEQ ID NO: 493770 - DNA, 25 bp, Rattus norvegicus
gtccctgttgccagtatttggttgc

SEQ ID NO: 493771 - DNA, 25 bp, Rattus norvegicus
gtccctgttgcctgtacttatttag

SEQ ID NO: 493772 - DNA, 25 bp, Rattus norvegicus
gtccctgttgcctgtatttggttgc

SEQ ID NO: 493773 - DNA, 25 bp, Rattus norvegicus
gtccctgttgtactttgtgctgtaa

SEQ ID NO: 493774 - DNA, 25 bp, Rattus norvegicus
gtccctgttgtagtttgtgctgtaa

SEQ ID NO: 493775 - DNA, 25 bp, Rattus norvegicus
gtccctgttgttacattctagaaac

SEQ ID NO: 493776 - DNA, 25 bp, Rattus norvegicus
gtccctgttgtttcattctagaaac

SEQ ID NO: 493777 - DNA, 25 bp, Rattus norvegicus
gtcccttacatgactgctggtgtgt

SEQ ID NO: 493778 - DNA, 25 bp, Rattus norvegicus
gtcccttacatgtctgctggtgtgt

SEQ ID NO: 493779 - DNA, 25 bp, Rattus norvegicus
gtcccttacattatcatttcatctg

SEQ ID NO: 493780 - DNA, 25 bp, Rattus norvegicus
gtcccttacattttcatttcatctg

SEQ ID NO: 493781 - DNA, 25 bp, Rattus norvegicus
gtcccttacgtgagtcctggcatgg

SEQ ID NO: 493782 - DNA, 25 bp, Rattus norvegicus
gtcccttacgtgtgtcctggcatgg

SEQ ID NO: 493783 - DNA, 25 bp, Rattus norvegicus
gtcccttagtgacttcccagaggaa

SEQ ID NO: 493784 - DNA, 25 bp, Rattus norvegicus
gtcccttagtgagttcccagaggaa

SEQ ID NO: 493785 - DNA, 25 bp, Rattus norvegicus
gtcccttatttgattgctggcatcc

SEQ ID NO: 493786 - DNA, 25 bp, Rattus norvegicus
gtcccttatttgtttgctggcatcc

SEQ ID NO: 493787 - DNA, 25 bp, Rattus norvegicus
gtcccttcactgcagacaatcttag

SEQ ID NO: 493788 - DNA, 25 bp, Rattus norvegicus
gtcccttcactggagacaatcttag

SEQ ID NO: 493789 - DNA, 25 bp, Rattus norvegicus
gtcccttcagggacgtaattcagtt

SEQ ID NO: 493790 - DNA, 25 bp, Rattus norvegicus
gtcccttcagggtcgtaattcagtt

SEQ ID NO: 493791 - DNA, 25 bp, Rattus norvegicus
gtcccttcagttatctcttcttgag

SEQ ID NO: 493792 - DNA, 25 bp, Rattus norvegicus
gtcccttcagttttctcttcttgag

SEQ ID NO: 493793 - DNA, 25 bp, Rattus norvegicus
gtcccttcattcattcaactatcag

SEQ ID NO: 493794 - DNA, 25 bp, Rattus norvegicus
gtcccttcattctttcaactatcag

SEQ ID NO: 493795 - DNA, 25 bp, Rattus norvegicus
gtcccttccaagagtccatgtaaat

SEQ ID NO: 493796 - DNA, 25 bp, Rattus norvegicus
gtcccttccaagtgtccatgtaaat

SEQ ID NO: 493797 - DNA, 25 bp, Rattus norvegicus
gtcccttccgagatcccagaagatg

SEQ ID NO: 493798 - DNA, 25 bp, Rattus norvegicus
gtcccttccgagttcccagaagatg

SEQ ID NO: 493799 - DNA, 25 bp, Rattus norvegicus
gtcccttcctctctataaatggcta

SEQ ID NO: 493800 - DNA, 25 bp, Rattus norvegicus
gtcccttcctctgtataaatggcta

SEQ ID NO: 493801 - DNA, 25 bp, Rattus norvegicus
gtcccttcctgtacattttttcatg

SEQ ID NO: 493802 - DNA, 25 bp, Rattus norvegicus
gtcccttcctgttcattttttcatg

SEQ ID NO: 493803 - DNA, 25 bp, Rattus norvegicus
gtcccttcgcagaatttaattattt

SEQ ID NO: 493804 - DNA, 25 bp, Rattus norvegicus
gtcccttcgcagtatttaattattt

SEQ ID NO: 493805 - DNA, 25 bp, Rattus norvegicus
gtcccttcggtgagtgaatctgtca

SEQ ID NO: 493806 - DNA, 25 bp, Rattus norvegicus
gtcccttcggtgtgtgaatctgtca

SEQ ID NO: 493807 - DNA, 25 bp, Rattus norvegicus
gtcccttctaagagacgcataggtt

SEQ ID NO: 493808 - DNA, 25 bp, Rattus norvegicus
gtcccttctaagtgacgcataggtt

SEQ ID NO: 493809 - DNA, 25 bp, Rattus norvegicus
gtcccttctagcctgagttcaagtg

SEQ ID NO: 493810 - DNA, 25 bp, Rattus norvegicus
gtcccttctagcgtgagttcaagtg

SEQ ID NO: 493811 - DNA, 25 bp, Rattus norvegicus
gtcccttctcccatgatatttataa

SEQ ID NO: 493812 - DNA, 25 bp, Rattus norvegicus
gtcccttctcccttgatatttataa

SEQ ID NO: 493813 - DNA, 25 bp, Rattus norvegicus
gtcccttctcgcctagagtagagat

SEQ ID NO: 493814 - DNA, 25 bp, Rattus norvegicus
gtcccttctcgcgtagagtagagat

SEQ ID NO: 493815 - DNA, 25 bp, Rattus norvegicus
gtcccttctggccagtgtgtcagag

SEQ ID NO: 493816 - DNA, 25 bp, Rattus norvegicus
gtcccttctggcgagtgtgtcagag

SEQ ID NO: 493817 - DNA, 25 bp, Rattus norvegicus
gtcccttctgggattatctattcac

SEQ ID NO: 493818 - DNA, 25 bp, Rattus norvegicus
gtcccttctgggtttatctattcac

SEQ ID NO: 493819 - DNA, 25 bp, Rattus norvegicus
gtcccttctgtgaaccggataccga

SEQ ID NO: 493820 - DNA, 25 bp, Rattus norvegicus
gtcccttctgtgtaccggataccga

SEQ ID NO: 493821 - DNA, 25 bp, Rattus norvegicus
gtcccttgaagaaaatcccaacagt

SEQ ID NO: 493822 - DNA, 25 bp, Rattus norvegicus
gtcccttgaagataatcccaacagt

SEQ ID NO: 493823 - DNA, 25 bp, Rattus norvegicus
gtcccttgaggacatcagcgtgtga

SEQ ID NO: 493824 - DNA, 25 bp, Rattus norvegicus
gtcccttgaggagatcagcgtgtga

SEQ ID NO: 493825 - DNA, 25 bp, Rattus norvegicus
gtcccttgcaagcaccaaacctgag

SEQ ID NO: 493826 - DNA, 25 bp, Rattus norvegicus
gtcccttgcaaggaccaaacctgag

SEQ ID NO: 493827 - DNA, 25 bp, Rattus norvegicus
gtcccttggaccaattttctatgtt

SEQ ID NO: 493828 - DNA, 25 bp, Rattus norvegicus
gtcccttggacctattttctatgtt

SEQ ID NO: 493829 - DNA, 25 bp, Rattus norvegicus
gtcccttggccaagaagaccacaca

SEQ ID NO: 493830 - DNA, 25 bp, Rattus norvegicus
gtcccttggccatgaagaccacaca

SEQ ID NO: 493831 - DNA, 25 bp, Rattus norvegicus
gtcccttgggagattgcacgattca

SEQ ID NO: 493832 - DNA, 25 bp, Rattus norvegicus
gtcccttgggagtttgcacgattca

SEQ ID NO: 493833 - DNA, 25 bp, Rattus norvegicus
gtcccttgtaaaaaggcccgtgcct

SEQ ID NO: 493834 - DNA, 25 bp, Rattus norvegicus
gtcccttgtaaataggcccgtgcct

SEQ ID NO: 493835 - DNA, 25 bp, Rattus norvegicus
gtcccttgtagtactcttcgaaaga

SEQ ID NO: 493836 - DNA, 25 bp, Rattus norvegicus
gtcccttgtagttctcttcgaaaga

SEQ ID NO: 493837 - DNA, 25 bp, Rattus norvegicus
gtcccttgtcagagccgtaggcaaa

SEQ ID NO: 493838 - DNA, 25 bp, Rattus norvegicus
gtcccttgtcagtgccgtaggcaaa

SEQ ID NO: 493839 - DNA, 25 bp, Rattus norvegicus
gtccctttaacgagtttggctcctg

SEQ ID NO: 493840 - DNA, 25 bp, Rattus norvegicus
gtccctttaacgtgtttggctcctg

SEQ ID NO: 493841 - DNA, 25 bp, Rattus norvegicus
gtccctttaatcagaataatcagtg

SEQ ID NO: 493842 - DNA, 25 bp, Rattus norvegicus
gtccctttaatctgaataatcagtg

SEQ ID NO: 493843 - DNA, 25 bp, Rattus norvegicus
gtccctttattcatagtaccagccg

SEQ ID NO: 493844 - DNA, 25 bp, Rattus norvegicus
gtccctttattcttagtaccagccg

SEQ ID NO: 493845 - DNA, 25 bp, Rattus norvegicus
gtccctttccaaagcgtactaatat

SEQ ID NO: 493846 - DNA, 25 bp, Rattus norvegicus
gtccctttccaatgcgtactaatat

SEQ ID NO: 493847 - DNA, 25 bp, Rattus norvegicus
gtccctttcctgatatgcttttgta

SEQ ID NO: 493848 - DNA, 25 bp, Rattus norvegicus
gtccctttcctgttatgcttttgta

SEQ ID NO: 493849 - DNA, 25 bp, Rattus norvegicus
gtccctttctacattgcctaaggat

SEQ ID NO: 493850 - DNA, 25 bp, Rattus norvegicus
gtccctttctactttgcctaaggat

SEQ ID NO: 493851 - DNA, 25 bp, Rattus norvegicus
gtccctttcttcaatggcggagcgg

SEQ ID NO: 493852 - DNA, 25 bp, Rattus norvegicus
gtccctttcttctatggcggagcgg

SEQ ID NO: 493853 - DNA, 25 bp, Rattus norvegicus
gtccctttgcgaaaagttggtgcct

SEQ ID NO: 493854 - DNA, 25 bp, Rattus norvegicus
gtccctttgcgataagttggtgcct

SEQ ID NO: 493855 - DNA, 25 bp, Rattus norvegicus
gtccctttgcttatgtgggccacaa

SEQ ID NO: 493856 - DNA, 25 bp, Rattus norvegicus
gtccctttgcttttgtgggccacaa

SEQ ID NO: 493857 - DNA, 25 bp, Rattus norvegicus
gtccctttgtatattctctactctg

SEQ ID NO: 493858 - DNA, 25 bp, Rattus norvegicus
gtccctttgtattttctctactctg

SEQ ID NO: 493859 - DNA, 25 bp, Rattus norvegicus
gtcccttttccccagagatgggtgg

SEQ ID NO: 493860 - DNA, 25 bp, Rattus norvegicus
gtcccttttcccgagagatgggtgg

SEQ ID NO: 493861 - DNA, 25 bp, Rattus norvegicus
gtcccttttgtgcttagaacagtct

SEQ ID NO: 493862 - DNA, 25 bp, Rattus norvegicus
gtcccttttgtggttagaacagtct

SEQ ID NO: 493863 - DNA, 25 bp, Rattus norvegicus
gtccgaaactggcagaagatccatc

SEQ ID NO: 493864 - DNA, 25 bp, Rattus norvegicus
gtccgaaactgggagaagatccatc

SEQ ID NO: 493865 - DNA, 25 bp, Rattus norvegicus
gtccgaaagccaaatcgaacgtttt

SEQ ID NO: 493866 - DNA, 25 bp, Rattus norvegicus
gtccgaaagccatatcgaacgtttt

SEQ ID NO: 493867 - DNA, 25 bp, Rattus norvegicus
gtccgaaatggtcctggcccggaat

SEQ ID NO: 493868 - DNA, 25 bp, Rattus norvegicus
gtccgaaatggtgctggcccggaat

SEQ ID NO: 493869 - DNA, 25 bp, Rattus norvegicus
gtccgaacaagtcaatgctaacctg

SEQ ID NO: 493870 - DNA, 25 bp, Rattus norvegicus
gtccgaacaagtgaatgctaacctg

SEQ ID NO: 493871 - DNA, 25 bp, Rattus norvegicus
gtccgaacagcaccttcttactaaa

SEQ ID NO: 493872 - DNA, 25 bp, Rattus norvegicus
gtccgaacagcagcttcttactaaa

SEQ ID NO: 493873 - DNA, 25 bp, Rattus norvegicus
gtccgaagtcagacaccttggtttg

SEQ ID NO: 493874 - DNA, 25 bp, Rattus norvegicus
gtccgaagtcagtcaccttggtttg

SEQ ID NO: 493875 - DNA, 25 bp, Rattus norvegicus
gtccgacaccatcatgtgttcttaa

SEQ ID NO: 493876 - DNA, 25 bp, Rattus norvegicus
gtccgacaccatgatgtgttcttaa

SEQ ID NO: 493877 - DNA, 25 bp, Rattus norvegicus
gtccgacctggaagtcacacgttta

SEQ ID NO: 493878 - DNA, 25 bp, Rattus norvegicus
gtccgacctggatgtcacacgttta

SEQ ID NO: 493879 - DNA, 25 bp, Rattus norvegicus
gtccgactactaatggttatctggt

SEQ ID NO: 493880 - DNA, 25 bp, Rattus norvegicus
gtccgactactattggttatctggt

SEQ ID NO: 493881 - DNA, 25 bp, Rattus norvegicus
gtccgactcatcactgtttccttaa

SEQ ID NO: 493882 - DNA, 25 bp, Rattus norvegicus
gtccgactcatctctgtttccttaa

SEQ ID NO: 493883 - DNA, 25 bp, Rattus norvegicus
gtccgactccaacttcattgttctt

SEQ ID NO: 493884 - DNA, 25 bp, Rattus norvegicus
gtccgactccaagttcattgttctt

SEQ ID NO: 493885 - DNA, 25 bp, Rattus norvegicus
gtccgactctttcatcttgagccaa

SEQ ID NO: 493886 - DNA, 25 bp, Rattus norvegicus
gtccgactctttgatcttgagccaa

SEQ ID NO: 493887 - DNA, 25 bp, Rattus norvegicus
gtccgagacctgagcatacgtgtag

SEQ ID NO: 493888 - DNA, 25 bp, Rattus norvegicus
gtccgagacctgtgcatacgtgtag

SEQ ID NO: 493889 - DNA, 25 bp, Rattus norvegicus
gtccgagaggccatctccagtggag

SEQ ID NO: 493890 - DNA, 25 bp, Rattus norvegicus
gtccgagaggccttctccagtggag

SEQ ID NO: 493891 - DNA, 25 bp, Rattus norvegicus
gtccgagatttgaacacctgtgggt

SEQ ID NO: 493892 - DNA, 25 bp, Rattus norvegicus
gtccgagatttgtacacctgtgggt

SEQ ID NO: 493893 - DNA, 25 bp, Rattus norvegicus
gtccgagcccagcagtacctagaaa

SEQ ID NO: 493894 - DNA, 25 bp, Rattus norvegicus
gtccgagcccaggagtacctagaaa

SEQ ID NO: 493895 - DNA, 25 bp, Rattus norvegicus
gtccgagctgctcaagctatgtgaa

SEQ ID NO: 493896 - DNA, 25 bp, Rattus norvegicus
gtccgagctgctgaagctatgtgaa

SEQ ID NO: 493897 - DNA, 25 bp, Rattus norvegicus
gtccgaggaagtctaatgtctctga

SEQ ID NO: 493898 - DNA, 25 bp, Rattus norvegicus
gtccgaggaagtgtaatgtctctga

SEQ ID NO: 493899 - DNA, 25 bp, Rattus norvegicus
gtccgagggatcacaggtgtcagaa

SEQ ID NO: 493900 - DNA, 25 bp, Rattus norvegicus
gtccgagggatctcaggtgtcagaa

SEQ ID NO: 493901 - DNA, 25 bp, Rattus norvegicus
gtccgaggtcatccaggtagaacgt

SEQ ID NO: 493902 - DNA, 25 bp, Rattus norvegicus
gtccgaggtcatgcaggtagaacgt

SEQ ID NO: 493903 - DNA, 25 bp, Rattus norvegicus
gtccgaggtgtccacaggtcacaga

SEQ ID NO: 493904 - DNA, 25 bp, Rattus norvegicus
gtccgaggtgtcgacaggtcacaga

SEQ ID NO: 493905 - DNA, 25 bp, Rattus norvegicus
gtccgagtacaacgtgatggcaaca

SEQ ID NO: 493906 - DNA, 25 bp, Rattus norvegicus
gtccgagtacaaggtgatggcaaca

SEQ ID NO: 493907 - DNA, 25 bp, Rattus norvegicus
gtccgagtccgactgtgctcaaggc

SEQ ID NO: 493908 - DNA, 25 bp, Rattus norvegicus
gtccgagtccgagtgtgctcaaggc

SEQ ID NO: 493909 - DNA, 25 bp, Rattus norvegicus
gtccgagtctgcatcaactgcaata

SEQ ID NO: 493910 - DNA, 25 bp, Rattus norvegicus
gtccgagtctgcttcaactgcaata

SEQ ID NO: 493911 - DNA, 25 bp, Rattus norvegicus
gtccgagtgctgctacaatcacgag

SEQ ID NO: 493912 - DNA, 25 bp, Rattus norvegicus
gtccgagtgctggtacaatcacgag

SEQ ID NO: 493913 - DNA, 25 bp, Rattus norvegicus
gtccgagttactcacttgtacttta

SEQ ID NO: 493914 - DNA, 25 bp, Rattus norvegicus
gtccgagttactgacttgtacttta

SEQ ID NO: 493915 - DNA, 25 bp, Rattus norvegicus
gtccgagttcgccaagggaataaca

SEQ ID NO: 493916 - DNA, 25 bp, Rattus norvegicus
gtccgagttcgcgaagggaataaca

SEQ ID NO: 493917 - DNA, 25 bp, Rattus norvegicus
gtccgagtttgtcatgctacctatg

SEQ ID NO: 493918 - DNA, 25 bp, Rattus norvegicus
gtccgagtttgtgatgctacctatg

SEQ ID NO: 493919 - DNA, 25 bp, Rattus norvegicus
gtccgataactgaaaaccacctggt

SEQ ID NO: 493920 - DNA, 25 bp, Rattus norvegicus
gtccgataactgtaaaccacctggt

SEQ ID NO: 493921 - DNA, 25 bp, Rattus norvegicus
gtccgatcaattagtctagtgtgcg

SEQ ID NO: 493922 - DNA, 25 bp, Rattus norvegicus
gtccgatcaatttgtctagtgtgcg

SEQ ID NO: 493923 - DNA, 25 bp, Rattus norvegicus
gtccgatcactcacagcaagttgtt

SEQ ID NO: 493924 - DNA, 25 bp, Rattus norvegicus
gtccgatcactctcagcaagttgtt

SEQ ID NO: 493925 - DNA, 25 bp, Rattus norvegicus
gtccgatggaaaacaggagcctgtt

SEQ ID NO: 493926 - DNA, 25 bp, Rattus norvegicus
gtccgatggaaatcaggagcctgtt

SEQ ID NO: 493927 - DNA, 25 bp, Rattus norvegicus
gtccgatgtgacaccttggatcctt

SEQ ID NO: 493928 - DNA, 25 bp, Rattus norvegicus
gtccgatgtgactccttggatcctt

SEQ ID NO: 493929 - DNA, 25 bp, Rattus norvegicus
gtccgatttggtcgttgcgccgctt

SEQ ID NO: 493930 - DNA, 25 bp, Rattus norvegicus
gtccgatttggtggttgcgccgctt

SEQ ID NO: 493931 - DNA, 25 bp, Rattus norvegicus
gtccgcaagacgattgatcgctcca

SEQ ID NO: 493932 - DNA, 25 bp, Rattus norvegicus
gtccgcaagacgtttgatcgctcca

SEQ ID NO: 493933 - DNA, 25 bp, Rattus norvegicus
gtccgcacatccagtgtttctaaag

SEQ ID NO: 493934 - DNA, 25 bp, Rattus norvegicus
gtccgcacatcctgtgtttctaaag

SEQ ID NO: 493935 - DNA, 25 bp, Rattus norvegicus
gtccgcatgttactaccctgtaaat

SEQ ID NO: 493936 - DNA, 25 bp, Rattus norvegicus
gtccgcatgttagtaccctgtaaat

SEQ ID NO: 493937 - DNA, 25 bp, Rattus norvegicus
gtccgccacaccacagtggaagtag

SEQ ID NO: 493938 - DNA, 25 bp, Rattus norvegicus
gtccgccacacctcagtggaagtag

SEQ ID NO: 493939 - DNA, 25 bp, Rattus norvegicus
gtccgccatgtgcaaggccggcttc

SEQ ID NO: 493940 - DNA, 25 bp, Rattus norvegicus
gtccgccatgtggaaggccggcttc

SEQ ID NO: 493941 - DNA, 25 bp, Rattus norvegicus
gtccgcccaccaagaggaagatccg

SEQ ID NO: 493942 - DNA, 25 bp, Rattus norvegicus
gtccgcccaccatgaggaagatccg

SEQ ID NO: 493943 - DNA, 25 bp, Rattus norvegicus
gtccgcctgtcaaaggcttttatta

SEQ ID NO: 493944 - DNA, 25 bp, Rattus norvegicus
gtccgcctgtcataggcttttatta

SEQ ID NO: 493945 - DNA, 25 bp, Rattus norvegicus
gtccgcgacatcaatgaggccttta

SEQ ID NO: 493946 - DNA, 25 bp, Rattus norvegicus
gtccgcgacatctatgaggccttta

SEQ ID NO: 493947 - DNA, 25 bp, Rattus norvegicus
gtccgcgactccagtgtatacaaaa

SEQ ID NO: 493948 - DNA, 25 bp, Rattus norvegicus
gtccgcgactcctgtgtatacaaaa

SEQ ID NO: 493949 - DNA, 25 bp, Rattus norvegicus
gtccgcgagaagatgggctgggccc

SEQ ID NO: 493950 - DNA, 25 bp, Rattus norvegicus
gtccgcgagaagttgggctgggccc

SEQ ID NO: 493951 - DNA, 25 bp, Rattus norvegicus
gtccgcggtagactttggcctacgt

SEQ ID NO: 493952 - DNA, 25 bp, Rattus norvegicus
gtccgcggtagagtttggcctacgt

SEQ ID NO: 493953 - DNA, 25 bp, Rattus norvegicus
gtccgcgtccttccatcatggtatt

SEQ ID NO: 493954 - DNA, 25 bp, Rattus norvegicus
gtccgcgtccttgcatcatggtatt

SEQ ID NO: 493955 - DNA, 25 bp, Rattus norvegicus
gtccgctccaataacgtctgagaag

SEQ ID NO: 493956 - DNA, 25 bp, Rattus norvegicus
gtccgctccaattacgtctgagaag

SEQ ID NO: 493957 - DNA, 25 bp, Rattus norvegicus
gtccgctctctgcagtggagttaaa

SEQ ID NO: 493958 - DNA, 25 bp, Rattus norvegicus
gtccgctctctggagtggagttaaa

SEQ ID NO: 493959 - DNA, 25 bp, Rattus norvegicus
gtccgctgacatcgagagtgcacac

SEQ ID NO: 493960 - DNA, 25 bp, Rattus norvegicus
gtccgctgacatggagagtgcacac

SEQ ID NO: 493961 - DNA, 25 bp, Rattus norvegicus
gtccgcttctctctgaagagcgact

SEQ ID NO: 493962 - DNA, 25 bp, Rattus norvegicus
gtccgcttctctgtgaagagcgact

SEQ ID NO: 493963 - DNA, 25 bp, Rattus norvegicus
gtccggagtgagatgcgctttacgt

SEQ ID NO: 493964 - DNA, 25 bp, Rattus norvegicus
gtccggagtgagttgcgctttacgt

SEQ ID NO: 493965 - DNA, 25 bp, Rattus norvegicus
gtccggagtggaaaggctgcttcaa

SEQ ID NO: 493966 - DNA, 25 bp, Rattus norvegicus
gtccggagtggataggctgcttcaa

SEQ ID NO: 493967 - DNA, 25 bp, Rattus norvegicus
gtccggatcaagcaggatgtactct

SEQ ID NO: 493968 - DNA, 25 bp, Rattus norvegicus
gtccggatcaaggaggatgtactct

SEQ ID NO: 493969 - DNA, 25 bp, Rattus norvegicus
gtccggatcctgagagtgcgtctga

SEQ ID NO: 493970 - DNA, 25 bp, Rattus norvegicus
gtccggatcctgtgagtgcgtctga

SEQ ID NO: 493971 - DNA, 25 bp, Rattus norvegicus
gtccggatgcttaccagaagacagt

SEQ ID NO: 493972 - DNA, 25 bp, Rattus norvegicus
gtccggatgctttccagaagacagt

SEQ ID NO: 493973 - DNA, 25 bp, Rattus norvegicus
gtccggcaaccaccaaattgtcatc

SEQ ID NO: 493974 - DNA, 25 bp, Rattus norvegicus
gtccggcaaccagcaaattgtcatc

SEQ ID NO: 493975 - DNA, 25 bp, Rattus norvegicus
gtccggcaagccagaactttatact

SEQ ID NO: 493976 - DNA, 25 bp, Rattus norvegicus
gtccggcaagcctgaactttatact

SEQ ID NO: 493977 - DNA, 25 bp, Rattus norvegicus
gtccggcagcgacgagtcctagaac

SEQ ID NO: 493978 - DNA, 25 bp, Rattus norvegicus
gtccggcagcgaggagtcctagaac

SEQ ID NO: 493979 - DNA, 25 bp, Rattus norvegicus
gtccggctatgaagcctagtactgg

SEQ ID NO: 493980 - DNA, 25 bp, Rattus norvegicus
gtccggctatgatgcctagtactgg

SEQ ID NO: 493981 - DNA, 25 bp, Rattus norvegicus
gtccggctcactcaagtgtcaagtg

SEQ ID NO: 493982 - DNA, 25 bp, Rattus norvegicus
gtccggctcactgaagtgtcaagtg

SEQ ID NO: 493983 - DNA, 25 bp, Rattus norvegicus
gtccgggagccaatgtgtcgtacta

SEQ ID NO: 493984 - DNA, 25 bp, Rattus norvegicus
gtccgggagccattgtgtcgtacta

SEQ ID NO: 493985 - DNA, 25 bp, Rattus norvegicus
gtccgggcacgcctaaggcttctcg

SEQ ID NO: 493986 - DNA, 25 bp, Rattus norvegicus
gtccgggcacgcgtaaggcttctcg

SEQ ID NO: 493987 - DNA, 25 bp, Rattus norvegicus
gtccgggctcccataggtcgtggct

SEQ ID NO: 493988 - DNA, 25 bp, Rattus norvegicus
gtccgggctcccttaggtcgtggct

SEQ ID NO: 493989 - DNA, 25 bp, Rattus norvegicus
gtccgggtcatcatctttagctaaa

SEQ ID NO: 493990 - DNA, 25 bp, Rattus norvegicus
gtccgggtcatcttctttagctaaa

SEQ ID NO: 493991 - DNA, 25 bp, Rattus norvegicus
gtccgggtgcctatgagaatctcaa

SEQ ID NO: 493992 - DNA, 25 bp, Rattus norvegicus
gtccgggtgcctttgagaatctcaa

SEQ ID NO: 493993 - DNA, 25 bp, Rattus norvegicus
gtccgggttccaatcttttcaccag

SEQ ID NO: 493994 - DNA, 25 bp, Rattus norvegicus
gtccgggttccattcttttcaccag

SEQ ID NO: 493995 - DNA, 25 bp, Rattus norvegicus
gtccggtagaatatgccgctgaaat

SEQ ID NO: 493996 - DNA, 25 bp, Rattus norvegicus
gtccggtagaatttgccgctgaaat

SEQ ID NO: 493997 - DNA, 25 bp, Rattus norvegicus
gtccggtccctgaggtgttagtaca

SEQ ID NO: 493998 - DNA, 25 bp, Rattus norvegicus
gtccggtccctgtggtgttagtaca

SEQ ID NO: 493999 - DNA, 25 bp, Rattus norvegicus
gtccggtctctacatgtggaggcta

SEQ ID NO: 494000 - DNA, 25 bp, Rattus norvegicus
gtccggtctctagatgtggaggcta

SEQ ID NO: 494001 - DNA, 25 bp, Rattus norvegicus
gtccggtctgaactttctccgagta

SEQ ID NO: 494002 - DNA, 25 bp, Rattus norvegicus
gtccggtctgaagtttctccgagta

SEQ ID NO: 494003 - DNA, 25 bp, Rattus norvegicus
gtccggttacagagcttgcactgga

SEQ ID NO: 494004 - DNA, 25 bp, Rattus norvegicus
gtccggttacagtgcttgcactgga

SEQ ID NO: 494005 - DNA, 25 bp, Rattus norvegicus
gtccggttcagtcgaaagtctacgt

SEQ ID NO: 494006 - DNA, 25 bp, Rattus norvegicus
gtccggttcagtggaaagtctacgt

SEQ ID NO: 494007 - DNA, 25 bp, Rattus norvegicus
gtccggttgaatcagaccctttcat

SEQ ID NO: 494008 - DNA, 25 bp, Rattus norvegicus
gtccggttgaatgagaccctttcat

SEQ ID NO: 494009 - DNA, 25 bp, Rattus norvegicus
gtccgtaagactatttgaggcccat

SEQ ID NO: 494010 - DNA, 25 bp, Rattus norvegicus
gtccgtaagactttttgaggcccat

SEQ ID NO: 494011 - DNA, 25 bp, Rattus norvegicus
gtccgtaattccaatgggtgtagcc

SEQ ID NO: 494012 - DNA, 25 bp, Rattus norvegicus
gtccgtaattcctatgggtgtagcc

SEQ ID NO: 494013 - DNA, 25 bp, Rattus norvegicus
gtccgtagcagccttatattctgaa

SEQ ID NO: 494014 - DNA, 25 bp, Rattus norvegicus
gtccgtagcagcgttatattctgaa

SEQ ID NO: 494015 - DNA, 25 bp, Rattus norvegicus
gtccgtagccagacattttcttgtt

SEQ ID NO: 494016 - DNA, 25 bp, Rattus norvegicus
gtccgtagccagtcattttcttgtt

SEQ ID NO: 494017 - DNA, 25 bp, Rattus norvegicus
gtccgtatctttctgcagtatgtgg

SEQ ID NO: 494018 - DNA, 25 bp, Rattus norvegicus
gtccgtatctttgtgcagtatgtgg

SEQ ID NO: 494019 - DNA, 25 bp, Rattus norvegicus
gtccgtatgtccatctgggctctga

SEQ ID NO: 494020 - DNA, 25 bp, Rattus norvegicus
gtccgtatgtccttctgggctctga

SEQ ID NO: 494021 - DNA, 25 bp, Rattus norvegicus
gtccgtcaactgaagatagtgccta

SEQ ID NO: 494022 - DNA, 25 bp, Rattus norvegicus
gtccgtcaactgtagatagtgccta

SEQ ID NO: 494023 - DNA, 25 bp, Rattus norvegicus
gtccgtcagtgaaaggttttgctta

SEQ ID NO: 494024 - DNA, 25 bp, Rattus norvegicus
gtccgtcagtgataggttttgctta

SEQ ID NO: 494025 - DNA, 25 bp, Rattus norvegicus
gtccgtccgcggaggtctttctctt

SEQ ID NO: 494026 - DNA, 25 bp, Rattus norvegicus
gtccgtccgcggtggtctttctctt

SEQ ID NO: 494027 - DNA, 25 bp, Rattus norvegicus
gtccgtccgggaaggcagacaccaa

SEQ ID NO: 494028 - DNA, 25 bp, Rattus norvegicus
gtccgtccgggatggcagacaccaa

SEQ ID NO: 494029 - DNA, 25 bp, Rattus norvegicus
gtccgtcgctgtcccgtgtgaatca

SEQ ID NO: 494030 - DNA, 25 bp, Rattus norvegicus
gtccgtcgctgtgccgtgtgaatca

SEQ ID NO: 494031 - DNA, 25 bp, Rattus norvegicus
gtccgtcgtcggctgaaagtgataa

SEQ ID NO: 494032 - DNA, 25 bp, Rattus norvegicus
gtccgtcgtcgggtgaaagtgataa

SEQ ID NO: 494033 - DNA, 25 bp, Rattus norvegicus
gtccgtctaaatagcgttttgcatt

SEQ ID NO: 494034 - DNA, 25 bp, Rattus norvegicus
gtccgtctaaattgcgttttgcatt

SEQ ID NO: 494035 - DNA, 25 bp, Rattus norvegicus
gtccgtctcctcagcgcaggaagct

SEQ ID NO: 494036 - DNA, 25 bp, Rattus norvegicus
gtccgtctcctctgcgcaggaagct

SEQ ID NO: 494037 - DNA, 25 bp, Rattus norvegicus
gtccgtctctatctttctatgtttc

SEQ ID NO: 494038 - DNA, 25 bp, Rattus norvegicus
gtccgtctctatgtttctatgtttc

SEQ ID NO: 494039 - DNA, 25 bp, Rattus norvegicus
gtccgtctgactatagaactgtagg

SEQ ID NO: 494040 - DNA, 25 bp, Rattus norvegicus
gtccgtctgactttagaactgtagg

SEQ ID NO: 494041 - DNA, 25 bp, Rattus norvegicus
gtccgtcttagacctgacagtctgt

SEQ ID NO: 494042 - DNA, 25 bp, Rattus norvegicus
gtccgtcttagagctgacagtctgt

SEQ ID NO: 494043 - DNA, 25 bp, Rattus norvegicus
gtccgtgaaggcaaacccgatggca

SEQ ID NO: 494044 - DNA, 25 bp, Rattus norvegicus
gtccgtgaaggctaacccgatggca

SEQ ID NO: 494045 - DNA, 25 bp, Rattus norvegicus
gtccgtgacgacatgctgtgtgctg

SEQ ID NO: 494046 - DNA, 25 bp, Rattus norvegicus
gtccgtgacgacttgctgtgtgctg

SEQ ID NO: 494047 - DNA, 25 bp, Rattus norvegicus
gtccgtgagacgcagctcaggaccc

SEQ ID NO: 494048 - DNA, 25 bp, Rattus norvegicus
gtccgtgagacggagctcaggaccc

SEQ ID NO: 494049 - DNA, 25 bp, Rattus norvegicus
gtccgtgagtttccatgctgtcgat

SEQ ID NO: 494050 - DNA, 25 bp, Rattus norvegicus
gtccgtgagtttgcatgctgtcgat

SEQ ID NO: 494051 - DNA, 25 bp, Rattus norvegicus
gtccgtgatctgaactctagctgag

SEQ ID NO: 494052 - DNA, 25 bp, Rattus norvegicus
gtccgtgatctgtactctagctgag

SEQ ID NO: 494053 - DNA, 25 bp, Rattus norvegicus
gtccgtgattcgaggttgctgatca

SEQ ID NO: 494054 - DNA, 25 bp, Rattus norvegicus
gtccgtgattcgtggttgctgatca

SEQ ID NO: 494055 - DNA, 25 bp, Rattus norvegicus
gtccgtgcacggatgaccacagcta

SEQ ID NO: 494056 - DNA, 25 bp, Rattus norvegicus
gtccgtgcacggttgaccacagcta

SEQ ID NO: 494057 - DNA, 25 bp, Rattus norvegicus
gtccgtgctacaaggcaagcacttt

SEQ ID NO: 494058 - DNA, 25 bp, Rattus norvegicus
gtccgtgctacatggcaagcacttt

SEQ ID NO: 494059 - DNA, 25 bp, Rattus norvegicus
gtccgtgctgtgagacccaaagtcc

SEQ ID NO: 494060 - DNA, 25 bp, Rattus norvegicus
gtccgtgctgtgtgacccaaagtcc

SEQ ID NO: 494061 - DNA, 25 bp, Rattus norvegicus
gtccgtggcggtcaatccaagctga

SEQ ID NO: 494062 - DNA, 25 bp, Rattus norvegicus
gtccgtggcggtgaatccaagctga

SEQ ID NO: 494063 - DNA, 25 bp, Rattus norvegicus
gtccgtggtcaaaatctctgttcag

SEQ ID NO: 494064 - DNA, 25 bp, Rattus norvegicus
gtccgtggtcaatatctctgttcag

SEQ ID NO: 494065 - DNA, 25 bp, Rattus norvegicus
gtccgtggtttaaatctgttgctgt

SEQ ID NO: 494066 - DNA, 25 bp, Rattus norvegicus
gtccgtggtttatatctgttgctgt

SEQ ID NO: 494067 - DNA, 25 bp, Rattus norvegicus
gtccgtgtcaataaactcatttcca

SEQ ID NO: 494068 - DNA, 25 bp, Rattus norvegicus
gtccgtgtcaattaactcatttcca

SEQ ID NO: 494069 - DNA, 25 bp, Rattus norvegicus
gtccgttaagttctggcactgcaat

SEQ ID NO: 494070 - DNA, 25 bp, Rattus norvegicus
gtccgttaagttgtggcactgcaat

SEQ ID NO: 494071 - DNA, 25 bp, Rattus norvegicus
gtccgttaggatattctttcataga

SEQ ID NO: 494072 - DNA, 25 bp, Rattus norvegicus
gtccgttaggattttctttcataga

SEQ ID NO: 494073 - DNA, 25 bp, Rattus norvegicus
gtccgttatttaaatcaggtcttat

SEQ ID NO: 494074 - DNA, 25 bp, Rattus norvegicus
gtccgttatttatatcaggtcttat

SEQ ID NO: 494075 - DNA, 25 bp, Rattus norvegicus
gtccgttcatgtctacttgttggtt

SEQ ID NO: 494076 - DNA, 25 bp, Rattus norvegicus
gtccgttcatgtgtacttgttggtt

SEQ ID NO: 494077 - DNA, 25 bp, Rattus norvegicus
gtccgttccatcagtgagaaatcac

SEQ ID NO: 494078 - DNA, 25 bp, Rattus norvegicus
gtccgttccatctgtgagaaatcac

SEQ ID NO: 494079 - DNA, 25 bp, Rattus norvegicus
gtccgttcccacagaaggctttagg

SEQ ID NO: 494080 - DNA, 25 bp, Rattus norvegicus
gtccgttcccactgaaggctttagg

SEQ ID NO: 494081 - DNA, 25 bp, Rattus norvegicus
gtccgttcggagcaatggccattaa

SEQ ID NO: 494082 - DNA, 25 bp, Rattus norvegicus
gtccgttcggaggaatggccattaa

SEQ ID NO: 494083 - DNA, 25 bp, Rattus norvegicus
gtccgttctataaactgaaaccttg

SEQ ID NO: 494084 - DNA, 25 bp, Rattus norvegicus
gtccgttctatatactgaaaccttg

SEQ ID NO: 494085 - DNA, 25 bp, Rattus norvegicus
gtccgttctgtcatagccaatggaa

SEQ ID NO: 494086 - DNA, 25 bp, Rattus norvegicus
gtccgttctgtcttagccaatggaa

SEQ ID NO: 494087 - DNA, 25 bp, Rattus norvegicus
gtccgttcttggcaggagcagtaca

SEQ ID NO: 494088 - DNA, 25 bp, Rattus norvegicus
gtccgttcttgggaggagcagtaca

SEQ ID NO: 494089 - DNA, 25 bp, Rattus norvegicus
gtccgttgtgagcagcctttgtcag

SEQ ID NO: 494090 - DNA, 25 bp, Rattus norvegicus
gtccgttgtgaggagcctttgtcag

SEQ ID NO: 494091 - DNA, 25 bp, Rattus norvegicus
gtccgtttcattacagatactcgtt

SEQ ID NO: 494092 - DNA, 25 bp, Rattus norvegicus
gtccgtttcatttcagatactcgtt

SEQ ID NO: 494093 - DNA, 25 bp, Rattus norvegicus
gtccgttttgagaccagcaaaataa

SEQ ID NO: 494094 - DNA, 25 bp, Rattus norvegicus
gtccgttttgagtccagcaaaataa

SEQ ID NO: 494095 - DNA, 25 bp, Rattus norvegicus
gtcctaaaaggcaggcccacagatt

SEQ ID NO: 494096 - DNA, 25 bp, Rattus norvegicus
gtcctaaaaggctggcccacagatt

SEQ ID NO: 494097 - DNA, 25 bp, Rattus norvegicus
gtcctaaacgccattctgggtctta

SEQ ID NO: 494098 - DNA, 25 bp, Rattus norvegicus
gtcctaaacgcctttctgggtctta

SEQ ID NO: 494099 - DNA, 25 bp, Rattus norvegicus
gtcctaaagccactatctctcttga

SEQ ID NO: 494100 - DNA, 25 bp, Rattus norvegicus
gtcctaaagccagtatctctcttga

SEQ ID NO: 494101 - DNA, 25 bp, Rattus norvegicus
gtcctaaagtctaaatgtggtctga

SEQ ID NO: 494102 - DNA, 25 bp, Rattus norvegicus
gtcctaaagtctaattctggtccta

SEQ ID NO: 494103 - DNA, 25 bp, Rattus norvegicus
gtcctaaagtcttaatgtggtctga

SEQ ID NO: 494104 - DNA, 25 bp, Rattus norvegicus
gtcctaaagtcttattctggtccta

SEQ ID NO: 494105 - DNA, 25 bp, Rattus norvegicus
gtcctaaattacaatgccatgggct

SEQ ID NO: 494106 - DNA, 25 bp, Rattus norvegicus
gtcctaaattactatgccatgggct

SEQ ID NO: 494107 - DNA, 25 bp, Rattus norvegicus
gtcctaaccactccggtaacttagc

SEQ ID NO: 494108 - DNA, 25 bp, Rattus norvegicus
gtcctaaccactgcggtaacttagc

SEQ ID NO: 494109 - DNA, 25 bp, Rattus norvegicus
gtcctaaccctaattcagtgcatta

SEQ ID NO: 494110 - DNA, 25 bp, Rattus norvegicus
gtcctaaccctatttcagtgcatta

SEQ ID NO: 494111 - DNA, 25 bp, Rattus norvegicus
gtcctaactgatctgtgctctctac

SEQ ID NO: 494112 - DNA, 25 bp, Rattus norvegicus
gtcctaactgatgtgtgctctctac

SEQ ID NO: 494113 - DNA, 25 bp, Rattus norvegicus
gtcctaacttccattgatgatagtc

SEQ ID NO: 494114 - DNA, 25 bp, Rattus norvegicus
gtcctaacttcctttgatgatagtc

SEQ ID NO: 494115 - DNA, 25 bp, Rattus norvegicus
gtcctaagacttatcctagtcactg

SEQ ID NO: 494116 - DNA, 25 bp, Rattus norvegicus
gtcctaagacttttcctagtcactg

SEQ ID NO: 494117 - DNA, 25 bp, Rattus norvegicus
gtcctaagcctcaagtttgtctttg

SEQ ID NO: 494118 - DNA, 25 bp, Rattus norvegicus
gtcctaagcctctagtttgtctttg

SEQ ID NO: 494119 - DNA, 25 bp, Rattus norvegicus
gtcctaagcgcacagcgggctccag

SEQ ID NO: 494120 - DNA, 25 bp, Rattus norvegicus
gtcctaagcgcagagcgggctccag

SEQ ID NO: 494121 - DNA, 25 bp, Rattus norvegicus
gtcctaagtcaactgtccgagtcgc

SEQ ID NO: 494122 - DNA, 25 bp, Rattus norvegicus
gtcctaagtcaagtgtccgagtcgc

SEQ ID NO: 494123 - DNA, 25 bp, Rattus norvegicus
gtcctaagtctgctgcttttctgaa

SEQ ID NO: 494124 - DNA, 25 bp, Rattus norvegicus
gtcctaagtctggtgcttttctgaa

SEQ ID NO: 494125 - DNA, 25 bp, Rattus norvegicus
gtcctaagtggtattcaaatgtcct

SEQ ID NO: 494126 - DNA, 25 bp, Rattus norvegicus
gtcctaagtggttttcaaatgtcct

SEQ ID NO: 494127 - DNA, 25 bp, Rattus norvegicus
gtcctaatgatcacagacggccctg

SEQ ID NO: 494128 - DNA, 25 bp, Rattus norvegicus
gtcctaatgatctcagacggccctg

SEQ ID NO: 494129 - DNA, 25 bp, Rattus norvegicus
gtcctaattactacctctcagatgt

SEQ ID NO: 494130 - DNA, 25 bp, Rattus norvegicus
gtcctaattacttcctctcagatgt

SEQ ID NO: 494131 - DNA, 25 bp, Rattus norvegicus
gtcctaattggactcagcgagttct

SEQ ID NO: 494132 - DNA, 25 bp, Rattus norvegicus
gtcctaattggagtcagcgagttct

SEQ ID NO: 494133 - DNA, 25 bp, Rattus norvegicus
gtcctacaacgtcagagcctggttg

SEQ ID NO: 494134 - DNA, 25 bp, Rattus norvegicus
gtcctacaacgtgagagcctggttg

SEQ ID NO: 494135 - DNA, 25 bp, Rattus norvegicus
gtcctacacaagatccgctttgaag

SEQ ID NO: 494136 - DNA, 25 bp, Rattus norvegicus
gtcctacacaagttccgctttgaag

SEQ ID NO: 494137 - DNA, 25 bp, Rattus norvegicus
gtcctacaggcacctaggccaggga

SEQ ID NO: 494138 - DNA, 25 bp, Rattus norvegicus
gtcctacaggcagctaggccaggga

SEQ ID NO: 494139 - DNA, 25 bp, Rattus norvegicus
gtcctacagggcagcaccactaaga

SEQ ID NO: 494140 - DNA, 25 bp, Rattus norvegicus
gtcctacagggctgcaccactaaga

SEQ ID NO: 494141 - DNA, 25 bp, Rattus norvegicus
gtcctacattccaggcatggatgta

SEQ ID NO: 494142 - DNA, 25 bp, Rattus norvegicus
gtcctacattcctggcatggatgta

SEQ ID NO: 494143 - DNA, 25 bp, Rattus norvegicus
gtcctacattttataagaacctctc

SEQ ID NO: 494144 - DNA, 25 bp, Rattus norvegicus
gtcctacattttttaagaacctctc

SEQ ID NO: 494145 - DNA, 25 bp, Rattus norvegicus
gtcctaccacatagtctctttgtgt

SEQ ID NO: 494146 - DNA, 25 bp, Rattus norvegicus
gtcctaccacattgtctctttgtgt

SEQ ID NO: 494147 - DNA, 25 bp, Rattus norvegicus
gtcctacccggacgaggagctacag

SEQ ID NO: 494148 - DNA, 25 bp, Rattus norvegicus
gtcctacccggaggaggagctacag

SEQ ID NO: 494149 - DNA, 25 bp, Rattus norvegicus
gtcctacccttaatctggtacttag

SEQ ID NO: 494150 - DNA, 25 bp, Rattus norvegicus
gtcctacccttattctggtacttag

SEQ ID NO: 494151 - DNA, 25 bp, Rattus norvegicus
gtcctaccgcagaagcaactatctt

SEQ ID NO: 494152 - DNA, 25 bp, Rattus norvegicus
gtcctaccgcagtagcaactatctt

SEQ ID NO: 494153 - DNA, 25 bp, Rattus norvegicus
gtcctaccgggtcgagacgctgcta

SEQ ID NO: 494154 - DNA, 25 bp, Rattus norvegicus
gtcctaccgggtggagacgctgcta

SEQ ID NO: 494155 - DNA, 25 bp, Rattus norvegicus
gtcctaccttgtaatagtatcccat

SEQ ID NO: 494156 - DNA, 25 bp, Rattus norvegicus
gtcctaccttgttatagtatcccat

SEQ ID NO: 494157 - DNA, 25 bp, Rattus norvegicus
gtcctacgacatactgtggaggcct

SEQ ID NO: 494158 - DNA, 25 bp, Rattus norvegicus
gtcctacgacattctgtggaggcct

SEQ ID NO: 494159 - DNA, 25 bp, Rattus norvegicus
gtcctactaaatcctcattctctga

SEQ ID NO: 494160 - DNA, 25 bp, Rattus norvegicus
gtcctactaaatgctcattctctga

SEQ ID NO: 494161 - DNA, 25 bp, Rattus norvegicus
gtcctactaggaccagtgacagggt

SEQ ID NO: 494162 - DNA, 25 bp, Rattus norvegicus
gtcctactaggaccgcttgaaaact

SEQ ID NO: 494163 - DNA, 25 bp, Rattus norvegicus
gtcctactaggagcagtgacagggt

SEQ ID NO: 494164 - DNA, 25 bp, Rattus norvegicus
gtcctactaggagcgcttgaaaact

SEQ ID NO: 494165 - DNA, 25 bp, Rattus norvegicus
gtcctactatagagcaatatccttt

SEQ ID NO: 494166 - DNA, 25 bp, Rattus norvegicus
gtcctactatagtgcaatatccttt

SEQ ID NO: 494167 - DNA, 25 bp, Rattus norvegicus
gtcctactctttcttattgtttcct

SEQ ID NO: 494168 - DNA, 25 bp, Rattus norvegicus
gtcctactctttgttattgtttcct

SEQ ID NO: 494169 - DNA, 25 bp, Rattus norvegicus
gtcctactgtgtctcagcatcctta

SEQ ID NO: 494170 - DNA, 25 bp, Rattus norvegicus
gtcctactgtgtgtcagcatcctta

SEQ ID NO: 494171 - DNA, 25 bp, Rattus norvegicus
gtcctactttttagtaccatcagtg

SEQ ID NO: 494172 - DNA, 25 bp, Rattus norvegicus
gtcctacttttttgtaccatcagtg

SEQ ID NO: 494173 - DNA, 25 bp, Rattus norvegicus
gtcctagaactaagaaaccctgcca

SEQ ID NO: 494174 - DNA, 25 bp, Rattus norvegicus
gtcctagaactatgaaaccctgcca

SEQ ID NO: 494175 - DNA, 25 bp, Rattus norvegicus
gtcctagaacttcttctgtaagcca

SEQ ID NO: 494176 - DNA, 25 bp, Rattus norvegicus
gtcctagaacttgttctgtaagcca

SEQ ID NO: 494177 - DNA, 25 bp, Rattus norvegicus
gtcctagaagatagcacaacccacc

SEQ ID NO: 494178 - DNA, 25 bp, Rattus norvegicus
gtcctagaagattgcacaacccacc

SEQ ID NO: 494179 - DNA, 25 bp, Rattus norvegicus
gtcctagaccttagcactacagtag

SEQ ID NO: 494180 - DNA, 25 bp, Rattus norvegicus
gtcctagacctttgcactacagtag

SEQ ID NO: 494181 - DNA, 25 bp, Rattus norvegicus
gtcctagactgcagaagtgtcctct

SEQ ID NO: 494182 - DNA, 25 bp, Rattus norvegicus
gtcctagactgctgaagtgtcctct

SEQ ID NO: 494183 - DNA, 25 bp, Rattus norvegicus
gtcctagagaaaccgctgcactggc

SEQ ID NO: 494184 - DNA, 25 bp, Rattus norvegicus
gtcctagagaaagcgctgcactggc

SEQ ID NO: 494185 - DNA, 25 bp, Rattus norvegicus
gtcctagagaatctggtcttctttg

SEQ ID NO: 494186 - DNA, 25 bp, Rattus norvegicus
gtcctagagaatgtggtcttctttg

SEQ ID NO: 494187 - DNA, 25 bp, Rattus norvegicus
gtcctagagaccaaacacttgcaag

SEQ ID NO: 494188 - DNA, 25 bp, Rattus norvegicus
gtcctagagaccagctgagtgtaat

SEQ ID NO: 494189 - DNA, 25 bp, Rattus norvegicus
gtcctagagacctaacacttgcaag

SEQ ID NO: 494190 - DNA, 25 bp, Rattus norvegicus
gtcctagagacctgctgagtgtaat

SEQ ID NO: 494191 - DNA, 25 bp, Rattus norvegicus
gtcctagagctaaccattcatggtt

SEQ ID NO: 494192 - DNA, 25 bp, Rattus norvegicus
gtcctagagctatccattcatggtt

SEQ ID NO: 494193 - DNA, 25 bp, Rattus norvegicus
gtcctagagcttagtcagaaagaga

SEQ ID NO: 494194 - DNA, 25 bp, Rattus norvegicus
gtcctagagctttgtcagaaagaga

SEQ ID NO: 494195 - DNA, 25 bp, Rattus norvegicus
gtcctagaggctaaggtgggcccta

SEQ ID NO: 494196 - DNA, 25 bp, Rattus norvegicus
gtcctagaggcttaggtgggcccta

SEQ ID NO: 494197 - DNA, 25 bp, Rattus norvegicus
gtcctagcactactcaggagtcaca

SEQ ID NO: 494198 - DNA, 25 bp, Rattus norvegicus
gtcctagcactagtcaggagtcaca

SEQ ID NO: 494199 - DNA, 25 bp, Rattus norvegicus
gtcctagctcgtactgtatttctta

SEQ ID NO: 494200 - DNA, 25 bp, Rattus norvegicus
gtcctagctcgttctgtatttctta

SEQ ID NO: 494201 - DNA, 25 bp, Rattus norvegicus
gtcctagctgctcactcattataaa

SEQ ID NO: 494202 - DNA, 25 bp, Rattus norvegicus
gtcctagctgctgactcattataaa

SEQ ID NO: 494203 - DNA, 25 bp, Rattus norvegicus
gtcctaggaaatcccatgaactcca

SEQ ID NO: 494204 - DNA, 25 bp, Rattus norvegicus
gtcctaggaaatgccatgaactcca

SEQ ID NO: 494205 - DNA, 25 bp, Rattus norvegicus
gtcctaggatgcaggcttagcctca

SEQ ID NO: 494206 - DNA, 25 bp, Rattus norvegicus
gtcctaggatgctggcttagcctca

SEQ ID NO: 494207 - DNA, 25 bp, Rattus norvegicus
gtcctaggtgatcgctctggcagta

SEQ ID NO: 494208 - DNA, 25 bp, Rattus norvegicus
gtcctaggtgatggctctggcagta

SEQ ID NO: 494209 - DNA, 25 bp, Rattus norvegicus
gtcctagtaccacatcttaggtttt

SEQ ID NO: 494210 - DNA, 25 bp, Rattus norvegicus
gtcctagtaccagatcttaggtttt

SEQ ID NO: 494211 - DNA, 25 bp, Rattus norvegicus
gtcctagtgaagagagggcgccctt

SEQ ID NO: 494212 - DNA, 25 bp, Rattus norvegicus
gtcctagtgaagtgagggcgccctt

SEQ ID NO: 494213 - DNA, 25 bp, Rattus norvegicus
gtcctagtgctcaagactgaacgta

SEQ ID NO: 494214 - DNA, 25 bp, Rattus norvegicus
gtcctagtgctctagactgaacgta

SEQ ID NO: 494215 - DNA, 25 bp, Rattus norvegicus
gtcctagtgtaacccaaggagccct

SEQ ID NO: 494216 - DNA, 25 bp, Rattus norvegicus
gtcctagtgtaagccaaggagccct

SEQ ID NO: 494217 - DNA, 25 bp, Rattus norvegicus
gtcctagttattactgaggcagggt

SEQ ID NO: 494218 - DNA, 25 bp, Rattus norvegicus
gtcctagttatttctgaggcagggt

SEQ ID NO: 494219 - DNA, 25 bp, Rattus norvegicus
gtcctagtttgaccactaagcacat

SEQ ID NO: 494220 - DNA, 25 bp, Rattus norvegicus
gtcctagtttgagcactaagcacat

SEQ ID NO: 494221 - DNA, 25 bp, Rattus norvegicus
gtcctataaagaactcttgcccgtc

SEQ ID NO: 494222 - DNA, 25 bp, Rattus norvegicus
gtcctataaagatctcttgcccgtc

SEQ ID NO: 494223 - DNA, 25 bp, Rattus norvegicus
gtcctatatcaacacgtctgcagag

SEQ ID NO: 494224 - DNA, 25 bp, Rattus norvegicus
gtcctatatcaagacgtctgcagag

SEQ ID NO: 494225 - DNA, 25 bp, Rattus norvegicus
gtcctatattccctagatatggcca

SEQ ID NO: 494226 - DNA, 25 bp, Rattus norvegicus
gtcctatattccgtagatatggcca

SEQ ID NO: 494227 - DNA, 25 bp, Rattus norvegicus
gtcctatcattgagaaccttggatt

SEQ ID NO: 494228 - DNA, 25 bp, Rattus norvegicus
gtcctatcattgtgaaccttggatt

SEQ ID NO: 494229 - DNA, 25 bp, Rattus norvegicus
gtcctatcctggcatcgattctatt

SEQ ID NO: 494230 - DNA, 25 bp, Rattus norvegicus
gtcctatcctgggatcgattctatt

SEQ ID NO: 494231 - DNA, 25 bp, Rattus norvegicus
gtcctatctgtaccgtttcacatgt

SEQ ID NO: 494232 - DNA, 25 bp, Rattus norvegicus
gtcctatctgtagcgtttcacatgt

SEQ ID NO: 494233 - DNA, 25 bp, Rattus norvegicus
gtcctatgatgccaagttgctactt

SEQ ID NO: 494234 - DNA, 25 bp, Rattus norvegicus
gtcctatgatgcgaagttgctactt

SEQ ID NO: 494235 - DNA, 25 bp, Rattus norvegicus
gtcctatgcagacactatagtggat

SEQ ID NO: 494236 - DNA, 25 bp, Rattus norvegicus
gtcctatgcagagactatagtggat

SEQ ID NO: 494237 - DNA, 25 bp, Rattus norvegicus
gtcctatgctgcaacaattgcttcg

SEQ ID NO: 494238 - DNA, 25 bp, Rattus norvegicus
gtcctatgctgctacaattgcttcg

SEQ ID NO: 494239 - DNA, 25 bp, Rattus norvegicus
gtcctatgcttaaaccccggtggtg

SEQ ID NO: 494240 - DNA, 25 bp, Rattus norvegicus
gtcctatgcttataccccggtggtg

SEQ ID NO: 494241 - DNA, 25 bp, Rattus norvegicus
gtcctatgctttacctgtgggaaac

SEQ ID NO: 494242 - DNA, 25 bp, Rattus norvegicus
gtcctatgcttttcctgtgggaaac

SEQ ID NO: 494243 - DNA, 25 bp, Rattus norvegicus
gtcctatggatcaaattccttgcct

SEQ ID NO: 494244 - DNA, 25 bp, Rattus norvegicus
gtcctatggatctaattccttgcct

SEQ ID NO: 494245 - DNA, 25 bp, Rattus norvegicus
gtcctatgggctaagagaacactca

SEQ ID NO: 494246 - DNA, 25 bp, Rattus norvegicus
gtcctatgggcttagagaacactca

SEQ ID NO: 494247 - DNA, 25 bp, Rattus norvegicus
gtcctatggttgactataactctct

SEQ ID NO: 494248 - DNA, 25 bp, Rattus norvegicus
gtcctatggttgtctataactctct

SEQ ID NO: 494249 - DNA, 25 bp, Rattus norvegicus
gtcctatgtgtcagttgttttggca

SEQ ID NO: 494250 - DNA, 25 bp, Rattus norvegicus
gtcctatgtgtctgttgttttggca

SEQ ID NO: 494251 - DNA, 25 bp, Rattus norvegicus
gtcctattatgtatcattatgtcac

SEQ ID NO: 494252 - DNA, 25 bp, Rattus norvegicus
gtcctattatgtttcattatgtcac

SEQ ID NO: 494253 - DNA, 25 bp, Rattus norvegicus
gtcctattcaaaccagaaccctgtg

SEQ ID NO: 494254 - DNA, 25 bp, Rattus norvegicus
gtcctattcaaagcagaaccctgtg

SEQ ID NO: 494255 - DNA, 25 bp, Rattus norvegicus
gtcctattctggcaggtagtctact

SEQ ID NO: 494256 - DNA, 25 bp, Rattus norvegicus
gtcctattctgggaggtagtctact

SEQ ID NO: 494257 - DNA, 25 bp, Rattus norvegicus
gtcctcaaactcagggtagtctttc

SEQ ID NO: 494258 - DNA, 25 bp, Rattus norvegicus
gtcctcaaactctgggtagtctttc

SEQ ID NO: 494259 - DNA, 25 bp, Rattus norvegicus
gtcctcaaagctcacaaatttcacg

SEQ ID NO: 494260 - DNA, 25 bp, Rattus norvegicus
gtcctcaaagctgacaaatttcacg

SEQ ID NO: 494261 - DNA, 25 bp, Rattus norvegicus
gtcctcaaaggcctgtgtgtatttt

SEQ ID NO: 494262 - DNA, 25 bp, Rattus norvegicus
gtcctcaaaggcgtgtgtgtatttt

SEQ ID NO: 494263 - DNA, 25 bp, Rattus norvegicus
gtcctcaactggaccttgatagcca

SEQ ID NO: 494264 - DNA, 25 bp, Rattus norvegicus
gtcctcaactggtccttgatagcca

SEQ ID NO: 494265 - DNA, 25 bp, Rattus norvegicus
gtcctcaatgaaatgttaccgcagc

SEQ ID NO: 494266 - DNA, 25 bp, Rattus norvegicus
gtcctcaatgaattgttaccgcagc

SEQ ID NO: 494267 - DNA, 25 bp, Rattus norvegicus
gtcctcaatgagcttcaggctcaaa

SEQ ID NO: 494268 - DNA, 25 bp, Rattus norvegicus
gtcctcaatgaggttcaggctcaaa

SEQ ID NO: 494269 - DNA, 25 bp, Rattus norvegicus
gtcctcacaggaacactataaagtc

SEQ ID NO: 494270 - DNA, 25 bp, Rattus norvegicus
gtcctcacaggacatccttaggtgt

SEQ ID NO: 494271 - DNA, 25 bp, Rattus norvegicus
gtcctcacaggagatccttaggtgt

SEQ ID NO: 494272 - DNA, 25 bp, Rattus norvegicus
gtcctcacaggatcactataaagtc

SEQ ID NO: 494273 - DNA, 25 bp, Rattus norvegicus
gtcctcacaggtcttttgtaagaac

SEQ ID NO: 494274 - DNA, 25 bp, Rattus norvegicus
gtcctcacaggtgttttgtaagaac

SEQ ID NO: 494275 - DNA, 25 bp, Rattus norvegicus
gtcctcacagttacttgtgtggtaa

SEQ ID NO: 494276 - DNA, 25 bp, Rattus norvegicus
gtcctcacagtttcttgtgtggtaa

SEQ ID NO: 494277 - DNA, 25 bp, Rattus norvegicus
gtcctcaccattaggagactaccga

SEQ ID NO: 494278 - DNA, 25 bp, Rattus norvegicus
gtcctcaccatttggagactaccga

SEQ ID NO: 494279 - DNA, 25 bp, Rattus norvegicus
gtcctcacctggaggaggctctgta

SEQ ID NO: 494280 - DNA, 25 bp, Rattus norvegicus
gtcctcacctggtggaggctctgta

SEQ ID NO: 494281 - DNA, 25 bp, Rattus norvegicus
gtcctcactgcaagtgtagttccag

SEQ ID NO: 494282 - DNA, 25 bp, Rattus norvegicus
gtcctcactgcatgtgtagttccag

SEQ ID NO: 494283 - DNA, 25 bp, Rattus norvegicus
gtcctcacttatcacaagtactgtt

SEQ ID NO: 494284 - DNA, 25 bp, Rattus norvegicus
gtcctcacttatgacaagtactgtt

SEQ ID NO: 494285 - DNA, 25 bp, Rattus norvegicus
gtcctcagaagacctattctagcag

SEQ ID NO: 494286 - DNA, 25 bp, Rattus norvegicus
gtcctcagaagagctattctagcag

SEQ ID NO: 494287 - DNA, 25 bp, Rattus norvegicus
gtcctcagaggaagctgacaaccat

SEQ ID NO: 494288 - DNA, 25 bp, Rattus norvegicus
gtcctcagaggatgctgacaaccat

SEQ ID NO: 494289 - DNA, 25 bp, Rattus norvegicus
gtcctcagagtgagtgacagccact

SEQ ID NO: 494290 - DNA, 25 bp, Rattus norvegicus
gtcctcagagtgtgtgacagccact

SEQ ID NO: 494291 - DNA, 25 bp, Rattus norvegicus
gtcctcagcagaataccattgggtt

SEQ ID NO: 494292 - DNA, 25 bp, Rattus norvegicus
gtcctcagcagattaccattgggtt

SEQ ID NO: 494293 - DNA, 25 bp, Rattus norvegicus
gtcctcaggatgatatttgacacta

SEQ ID NO: 494294 - DNA, 25 bp, Rattus norvegicus
gtcctcaggatgttatttgacacta

SEQ ID NO: 494295 - DNA, 25 bp, Rattus norvegicus
gtcctcaggcgacagctgtatcttg

SEQ ID NO: 494296 - DNA, 25 bp, Rattus norvegicus
gtcctcaggcgagagctgtatcttg

SEQ ID NO: 494297 - DNA, 25 bp, Rattus norvegicus
gtcctcagggccaattttgatgact

SEQ ID NO: 494298 - DNA, 25 bp, Rattus norvegicus
gtcctcagggcctattttgatgact

SEQ ID NO: 494299 - DNA, 25 bp, Rattus norvegicus
gtcctcagtactagcctcatgataa

SEQ ID NO: 494300 - DNA, 25 bp, Rattus norvegicus
gtcctcagtacttgcctcatgataa

SEQ ID NO: 494301 - DNA, 25 bp, Rattus norvegicus
gtcctcagtcatatggacttcaaat

SEQ ID NO: 494302 - DNA, 25 bp, Rattus norvegicus
gtcctcagtcatttggacttcaaat

SEQ ID NO: 494303 - DNA, 25 bp, Rattus norvegicus
gtcctcagtcctctgaagactctat

SEQ ID NO: 494304 - DNA, 25 bp, Rattus norvegicus
gtcctcagtcctgtgaagactctat

SEQ ID NO: 494305 - DNA, 25 bp, Rattus norvegicus
gtcctcagtgtgctctgaatctgga

SEQ ID NO: 494306 - DNA, 25 bp, Rattus norvegicus
gtcctcagtgtggtctgaatctgga

SEQ ID NO: 494307 - DNA, 25 bp, Rattus norvegicus
gtcctcatactgagctgactgttat

SEQ ID NO: 494308 - DNA, 25 bp, Rattus norvegicus
gtcctcatactgtgctgactgttat

SEQ ID NO: 494309 - DNA, 25 bp, Rattus norvegicus
gtcctcatctacacgcacggaaagg

SEQ ID NO: 494310 - DNA, 25 bp, Rattus norvegicus
gtcctcatctactcgcacggaaagg

SEQ ID NO: 494311 - DNA, 25 bp, Rattus norvegicus
gtcctcatcttccactgtagatttt

SEQ ID NO: 494312 - DNA, 25 bp, Rattus norvegicus
gtcctcatcttcgactgtagatttt

SEQ ID NO: 494313 - DNA, 25 bp, Rattus norvegicus
gtcctcatggacagaaatccctagg

SEQ ID NO: 494314 - DNA, 25 bp, Rattus norvegicus
gtcctcatggactgaaatccctagg

SEQ ID NO: 494315 - DNA, 25 bp, Rattus norvegicus
gtcctcatggttacagtggtgacat

SEQ ID NO: 494316 - DNA, 25 bp, Rattus norvegicus
gtcctcatggtttcagtggtgacat

SEQ ID NO: 494317 - DNA, 25 bp, Rattus norvegicus
gtcctcatgtagctgtgattacctt

SEQ ID NO: 494318 - DNA, 25 bp, Rattus norvegicus
gtcctcatgtaggtgtgattacctt

SEQ ID NO: 494319 - DNA, 25 bp, Rattus norvegicus
gtcctcattaatcccgagtctgtta

SEQ ID NO: 494320 - DNA, 25 bp, Rattus norvegicus
gtcctcattaatctggactcatcca

SEQ ID NO: 494321 - DNA, 25 bp, Rattus norvegicus
gtcctcattaatgccgagtctgtta

SEQ ID NO: 494322 - DNA, 25 bp, Rattus norvegicus
gtcctcattaatgtggactcatcca

SEQ ID NO: 494323 - DNA, 25 bp, Rattus norvegicus
gtcctcatttttagctctgtaacac

SEQ ID NO: 494324 - DNA, 25 bp, Rattus norvegicus
gtcctcattttttgctctgtaacac

SEQ ID NO: 494325 - DNA, 25 bp, Rattus norvegicus
gtcctccaagcacataagccctgag

SEQ ID NO: 494326 - DNA, 25 bp, Rattus norvegicus
gtcctccaagcagataagccctgag

SEQ ID NO: 494327 - DNA, 25 bp, Rattus norvegicus
gtcctccaagccaagacctgtcgga

SEQ ID NO: 494328 - DNA, 25 bp, Rattus norvegicus
gtcctccaagcctagacctgtcgga

SEQ ID NO: 494329 - DNA, 25 bp, Rattus norvegicus
gtcctccaaggtcattctcaaagta

SEQ ID NO: 494330 - DNA, 25 bp, Rattus norvegicus
gtcctccaaggtgattctcaaagta

SEQ ID NO: 494331 - DNA, 25 bp, Rattus norvegicus
gtcctccaagttacctaccagtcgt

SEQ ID NO: 494332 - DNA, 25 bp, Rattus norvegicus
gtcctccaagtttcctaccagtcgt

SEQ ID NO: 494333 - DNA, 25 bp, Rattus norvegicus
gtcctccagacaagatgcccataat

SEQ ID NO: 494334 - DNA, 25 bp, Rattus norvegicus
gtcctccagacatgatgcccataat

SEQ ID NO: 494335 - DNA, 25 bp, Rattus norvegicus
gtcctccagggcacaagcttgaggg

SEQ ID NO: 494336 - DNA, 25 bp, Rattus norvegicus
gtcctccagggctcaagcttgaggg

SEQ ID NO: 494337 - DNA, 25 bp, Rattus norvegicus
gtcctccagggtcgcatgtttaaca

SEQ ID NO: 494338 - DNA, 25 bp, Rattus norvegicus
gtcctccagggtggcatgtttaaca

SEQ ID NO: 494339 - DNA, 25 bp, Rattus norvegicus
gtcctccagtatagcacctgtagca

SEQ ID NO: 494340 - DNA, 25 bp, Rattus norvegicus
gtcctccagtattgcacctgtagca

SEQ ID NO: 494341 - DNA, 25 bp, Rattus norvegicus
gtcctccagtgtctagtacacagat

SEQ ID NO: 494342 - DNA, 25 bp, Rattus norvegicus
gtcctccagtgtgtagtacacagat

SEQ ID NO: 494343 - DNA, 25 bp, Rattus norvegicus
gtcctccagttcaatgtattttcct

SEQ ID NO: 494344 - DNA, 25 bp, Rattus norvegicus
gtcctccagttctatgtattttcct

SEQ ID NO: 494345 - DNA, 25 bp, Rattus norvegicus
gtcctccatcacagtcctgatatag

SEQ ID NO: 494346 - DNA, 25 bp, Rattus norvegicus
gtcctccatcactgtcctgatatag

SEQ ID NO: 494347 - DNA, 25 bp, Rattus norvegicus
gtcctccatcagcacatatcttaaa

SEQ ID NO: 494348 - DNA, 25 bp, Rattus norvegicus
gtcctccatcaggacatatcttaaa

SEQ ID NO: 494349 - DNA, 25 bp, Rattus norvegicus
gtcctccatgacattttctgtgtta

SEQ ID NO: 494350 - DNA, 25 bp, Rattus norvegicus
gtcctccatgactttttctgtgtta

SEQ ID NO: 494351 - DNA, 25 bp, Rattus norvegicus
gtcctccatgctcatgatcgcgatg

SEQ ID NO: 494352 - DNA, 25 bp, Rattus norvegicus
gtcctccatgctgatgatcgcgatg

SEQ ID NO: 494353 - DNA, 25 bp, Rattus norvegicus
gtcctcccaactctatataagctca

SEQ ID NO: 494354 - DNA, 25 bp, Rattus norvegicus
gtcctcccaactgtatataagctca

SEQ ID NO: 494355 - DNA, 25 bp, Rattus norvegicus
gtcctcccacagatctgtgtaggaa

SEQ ID NO: 494356 - DNA, 25 bp, Rattus norvegicus
gtcctcccacagttctgtgtaggaa

SEQ ID NO: 494357 - DNA, 25 bp, Rattus norvegicus
gtcctcccagacaagatcataagca

SEQ ID NO: 494358 - DNA, 25 bp, Rattus norvegicus
gtcctcccagactagatcataagca

SEQ ID NO: 494359 - DNA, 25 bp, Rattus norvegicus
gtcctcccaggaattggttcatatg

SEQ ID NO: 494360 - DNA, 25 bp, Rattus norvegicus
gtcctcccaggacctttgaaaggtt

SEQ ID NO: 494361 - DNA, 25 bp, Rattus norvegicus
gtcctcccaggagctttgaaaggtt

SEQ ID NO: 494362 - DNA, 25 bp, Rattus norvegicus
gtcctcccaggatttggttcatatg

SEQ ID NO: 494363 - DNA, 25 bp, Rattus norvegicus
gtcctcccctctcagattatgttaa

SEQ ID NO: 494364 - DNA, 25 bp, Rattus norvegicus
gtcctcccctctgagattatgttaa

SEQ ID NO: 494365 - DNA, 25 bp, Rattus norvegicus
gtcctcccgctacctggactgtgag

SEQ ID NO: 494366 - DNA, 25 bp, Rattus norvegicus
gtcctcccgctagctggactgtgag

SEQ ID NO: 494367 - DNA, 25 bp, Rattus norvegicus
gtcctccctaagacgatttccatag

SEQ ID NO: 494368 - DNA, 25 bp, Rattus norvegicus
gtcctccctaagtcgatttccatag

SEQ ID NO: 494369 - DNA, 25 bp, Rattus norvegicus
gtcctccctcatcaagtttccatta

SEQ ID NO: 494370 - DNA, 25 bp, Rattus norvegicus
gtcctccctcatgaagtttccatta

SEQ ID NO: 494371 - DNA, 25 bp, Rattus norvegicus
gtcctccgaattctagggtgactga

SEQ ID NO: 494372 - DNA, 25 bp, Rattus norvegicus
gtcctccgaattgtagggtgactga

SEQ ID NO: 494373 - DNA, 25 bp, Rattus norvegicus
gtcctccgatttaggaaccaggtct

SEQ ID NO: 494374 - DNA, 25 bp, Rattus norvegicus
gtcctccgattttggaaccaggtct

SEQ ID NO: 494375 - DNA, 25 bp, Rattus norvegicus
gtcctccggagcattgatccaggat

SEQ ID NO: 494376 - DNA, 25 bp, Rattus norvegicus
gtcctccggagctttgatccaggat

SEQ ID NO: 494377 - DNA, 25 bp, Rattus norvegicus
gtcctccgtatcaggcgatgacaaa

SEQ ID NO: 494378 - DNA, 25 bp, Rattus norvegicus
gtcctccgtatctggcgatgacaaa

SEQ ID NO: 494379 - DNA, 25 bp, Rattus norvegicus
gtcctccgtcacagagatccaagaa

SEQ ID NO: 494380 - DNA, 25 bp, Rattus norvegicus
gtcctccgtcactgagatccaagaa

SEQ ID NO: 494381 - DNA, 25 bp, Rattus norvegicus
gtcctcctacttatgttctctataa

SEQ ID NO: 494382 - DNA, 25 bp, Rattus norvegicus
gtcctcctacttttgttctctataa

SEQ ID NO: 494383 - DNA, 25 bp, Rattus norvegicus
gtcctcctaggcattattttcttat

SEQ ID NO: 494384 - DNA, 25 bp, Rattus norvegicus
gtcctcctaggctttattttcttat

SEQ ID NO: 494385 - DNA, 25 bp, Rattus norvegicus
gtcctcctgaccctgattaaacaaa

SEQ ID NO: 494386 - DNA, 25 bp, Rattus norvegicus
gtcctcctgaccgtgattaaacaaa

SEQ ID NO: 494387 - DNA, 25 bp, Rattus norvegicus
gtcctcctggaactacaactttatg

SEQ ID NO: 494388 - DNA, 25 bp, Rattus norvegicus
gtcctcctggaagtacaactttatg

SEQ ID NO: 494389 - DNA, 25 bp, Rattus norvegicus
gtcctcctggtaacaaccttattgg

SEQ ID NO: 494390 - DNA, 25 bp, Rattus norvegicus
gtcctcctggtatcaaccttattgg

SEQ ID NO: 494391 - DNA, 25 bp, Rattus norvegicus
gtcctcctgtagattcttactgtgt

SEQ ID NO: 494392 - DNA, 25 bp, Rattus norvegicus
gtcctcctgtagtttcttactgtgt

SEQ ID NO: 494393 - DNA, 25 bp, Rattus norvegicus
gtcctcctttgaaatttttcccatt

SEQ ID NO: 494394 - DNA, 25 bp, Rattus norvegicus
gtcctcctttgatatttttcccatt

SEQ ID NO: 494395 - DNA, 25 bp, Rattus norvegicus
gtcctcctttttcacatgtatagtt

SEQ ID NO: 494396 - DNA, 25 bp, Rattus norvegicus
gtcctcctttttgacatgtatagtt

SEQ ID NO: 494397 - DNA, 25 bp, Rattus norvegicus
gtcctcgagataaacccgtgtgcgt

SEQ ID NO: 494398 - DNA, 25 bp, Rattus norvegicus
gtcctcgagatatacccgtgtgcgt

SEQ ID NO: 494399 - DNA, 25 bp, Rattus norvegicus
gtcctcgagctcatatttgccaaga

SEQ ID NO: 494400 - DNA, 25 bp, Rattus norvegicus
gtcctcgagctcttatttgccaaga

SEQ ID NO: 494401 - DNA, 25 bp, Rattus norvegicus
gtcctcgagtctccgtgaagctgaa

SEQ ID NO: 494402 - DNA, 25 bp, Rattus norvegicus
gtcctcgagtctgcgtgaagctgaa

SEQ ID NO: 494403 - DNA, 25 bp, Rattus norvegicus
gtcctcgataagaaactgctccaga

SEQ ID NO: 494404 - DNA, 25 bp, Rattus norvegicus
gtcctcgataagtaactgctccaga

SEQ ID NO: 494405 - DNA, 25 bp, Rattus norvegicus
gtcctcgatgcactcgaaggtgatc

SEQ ID NO: 494406 - DNA, 25 bp, Rattus norvegicus
gtcctcgatgcagtcgaaggtgatc

SEQ ID NO: 494407 - DNA, 25 bp, Rattus norvegicus
gtcctcgccgagagcagccaatgtt

SEQ ID NO: 494408 - DNA, 25 bp, Rattus norvegicus
gtcctcgccgagtgcagccaatgtt

SEQ ID NO: 494409 - DNA, 25 bp, Rattus norvegicus
gtcctcgccggcctgtggtttgtac

SEQ ID NO: 494410 - DNA, 25 bp, Rattus norvegicus
gtcctcgccggcgtgtggtttgtac

SEQ ID NO: 494411 - DNA, 25 bp, Rattus norvegicus
gtcctcgctgacatcctaattttgt

SEQ ID NO: 494412 - DNA, 25 bp, Rattus norvegicus
gtcctcgctgacttcctaattttgt

SEQ ID NO: 494413 - DNA, 25 bp, Rattus norvegicus
gtcctcggcttcagtagatcttgtc

SEQ ID NO: 494414 - DNA, 25 bp, Rattus norvegicus
gtcctcggcttcatagacacagaaa

SEQ ID NO: 494415 - DNA, 25 bp, Rattus norvegicus
gtcctcggcttctgtagatcttgtc

SEQ ID NO: 494416 - DNA, 25 bp, Rattus norvegicus
gtcctcggcttcttagacacagaaa

SEQ ID NO: 494417 - DNA, 25 bp, Rattus norvegicus
gtcctcgggcacatgtacatacata

SEQ ID NO: 494418 - DNA, 25 bp, Rattus norvegicus
gtcctcgggcacttgtacatacata

SEQ ID NO: 494419 - DNA, 25 bp, Rattus norvegicus
gtcctcgggcgactacaggtcatta

SEQ ID NO: 494420 - DNA, 25 bp, Rattus norvegicus
gtcctcgggcgagtacaggtcatta

SEQ ID NO: 494421 - DNA, 25 bp, Rattus norvegicus
gtcctcgggtagcactatgtccaat

SEQ ID NO: 494422 - DNA, 25 bp, Rattus norvegicus
gtcctcgggtaggactatgtccaat

SEQ ID NO: 494423 - DNA, 25 bp, Rattus norvegicus
gtcctcgtcatacccagcatgttca

SEQ ID NO: 494424 - DNA, 25 bp, Rattus norvegicus
gtcctcgtcatagccagcatgttca

SEQ ID NO: 494425 - DNA, 25 bp, Rattus norvegicus
gtcctcgtcgctagctaagaagtca

SEQ ID NO: 494426 - DNA, 25 bp, Rattus norvegicus
gtcctcgtcgcttgctaagaagtca

SEQ ID NO: 494427 - DNA, 25 bp, Rattus norvegicus
gtcctcgtctcgaatatagcgccct

SEQ ID NO: 494428 - DNA, 25 bp, Rattus norvegicus
gtcctcgtctcgtatatagcgccct

SEQ ID NO: 494429 - DNA, 25 bp, Rattus norvegicus
gtcctcgtggttatccagttacaat

SEQ ID NO: 494430 - DNA, 25 bp, Rattus norvegicus
gtcctcgtggttttccagttacaat

SEQ ID NO: 494431 - DNA, 25 bp, Rattus norvegicus
gtcctcgttcgccagatccgtgttt

SEQ ID NO: 494432 - DNA, 25 bp, Rattus norvegicus
gtcctcgttcgcgagatccgtgttt

SEQ ID NO: 494433 - DNA, 25 bp, Rattus norvegicus
gtcctctacaggatcttgatgaatt

SEQ ID NO: 494434 - DNA, 25 bp, Rattus norvegicus
gtcctctacaggttcttgatgaatt

SEQ ID NO: 494435 - DNA, 25 bp, Rattus norvegicus
gtcctctaccctaaactagttgtca

SEQ ID NO: 494436 - DNA, 25 bp, Rattus norvegicus
gtcctctacccttaactagttgtca

SEQ ID NO: 494437 - DNA, 25 bp, Rattus norvegicus
gtcctctagagactgctgcattgtt

SEQ ID NO: 494438 - DNA, 25 bp, Rattus norvegicus
gtcctctagagagtgctgcattgtt

SEQ ID NO: 494439 - DNA, 25 bp, Rattus norvegicus
gtcctctatcacaacgtggcagtaa

SEQ ID NO: 494440 - DNA, 25 bp, Rattus norvegicus
gtcctctatcactacgtggcagtaa

SEQ ID NO: 494441 - DNA, 25 bp, Rattus norvegicus
gtcctctcattacggtcctgttgga

SEQ ID NO: 494442 - DNA, 25 bp, Rattus norvegicus
gtcctctcattagggtcctgttgga

SEQ ID NO: 494443 - DNA, 25 bp, Rattus norvegicus
gtcctctccaggcttttgtactgaa

SEQ ID NO: 494444 - DNA, 25 bp, Rattus norvegicus
gtcctctccagggttttgtactgaa

SEQ ID NO: 494445 - DNA, 25 bp, Rattus norvegicus
gtcctctccatgatcgaaatagcaa

SEQ ID NO: 494446 - DNA, 25 bp, Rattus norvegicus
gtcctctccatgttcgaaatagcaa

SEQ ID NO: 494447 - DNA, 25 bp, Rattus norvegicus
gtcctctcccagatacataggtgtg

SEQ ID NO: 494448 - DNA, 25 bp, Rattus norvegicus
gtcctctcccagttacataggtgtg

SEQ ID NO: 494449 - DNA, 25 bp, Rattus norvegicus
gtcctctccctgaagactgaaaata

SEQ ID NO: 494450 - DNA, 25 bp, Rattus norvegicus
gtcctctccctgtagactgaaaata

SEQ ID NO: 494451 - DNA, 25 bp, Rattus norvegicus
gtcctctcctagattttctgtttga

SEQ ID NO: 494452 - DNA, 25 bp, Rattus norvegicus
gtcctctcctagtttttctgtttga

SEQ ID NO: 494453 - DNA, 25 bp, Rattus norvegicus
gtcctctcctgaccccgtaagaaag

SEQ ID NO: 494454 - DNA, 25 bp, Rattus norvegicus
gtcctctcctgagcccgtaagaaag

SEQ ID NO: 494455 - DNA, 25 bp, Rattus norvegicus
gtcctctcgccaatacactgagtaa

SEQ ID NO: 494456 - DNA, 25 bp, Rattus norvegicus
gtcctctcgccattacactgagtaa

SEQ ID NO: 494457 - DNA, 25 bp, Rattus norvegicus
gtcctctctcttatctgtttttaat

SEQ ID NO: 494458 - DNA, 25 bp, Rattus norvegicus
gtcctctctcttttctgtttttaat

SEQ ID NO: 494459 - DNA, 25 bp, Rattus norvegicus
gtcctctctgacaaccatgagtttg

SEQ ID NO: 494460 - DNA, 25 bp, Rattus norvegicus
gtcctctctgactaccatgagtttg

SEQ ID NO: 494461 - DNA, 25 bp, Rattus norvegicus
gtcctctctgctaggtgcttatggc

SEQ ID NO: 494462 - DNA, 25 bp, Rattus norvegicus
gtcctctctgcttggtgcttatggc

SEQ ID NO: 494463 - DNA, 25 bp, Rattus norvegicus
gtcctctctggtatatctgttgtct

SEQ ID NO: 494464 - DNA, 25 bp, Rattus norvegicus
gtcctctctggtcgtcctcgagtct

SEQ ID NO: 494465 - DNA, 25 bp, Rattus norvegicus
gtcctctctggtggtcctcgagtct

SEQ ID NO: 494466 - DNA, 25 bp, Rattus norvegicus
gtcctctctggtttatctgttgtct

SEQ ID NO: 494467 - DNA, 25 bp, Rattus norvegicus
gtcctctcttataacatatccactt

SEQ ID NO: 494468 - DNA, 25 bp, Rattus norvegicus
gtcctctcttattacatatccactt

SEQ ID NO: 494469 - DNA, 25 bp, Rattus norvegicus
gtcctctgaaagaaccactgagcta

SEQ ID NO: 494470 - DNA, 25 bp, Rattus norvegicus
gtcctctgaaagaccagtcagcgct

SEQ ID NO: 494471 - DNA, 25 bp, Rattus norvegicus
gtcctctgaaagtaccactgagcta

SEQ ID NO: 494472 - DNA, 25 bp, Rattus norvegicus
gtcctctgaaagtccagtcagcgct

SEQ ID NO: 494473 - DNA, 25 bp, Rattus norvegicus
gtcctctgaaccagtatatggctca

SEQ ID NO: 494474 - DNA, 25 bp, Rattus norvegicus
gtcctctgaaccctgacttttttat

SEQ ID NO: 494475 - DNA, 25 bp, Rattus norvegicus
gtcctctgaaccgtgacttttttat

SEQ ID NO: 494476 - DNA, 25 bp, Rattus norvegicus
gtcctctgaacctgtatatggctca

SEQ ID NO: 494477 - DNA, 25 bp, Rattus norvegicus
gtcctctgaagaccaaaccatacct

SEQ ID NO: 494478 - DNA, 25 bp, Rattus norvegicus
gtcctctgaagacttgtgcgtgctc

SEQ ID NO: 494479 - DNA, 25 bp, Rattus norvegicus
gtcctctgaagagcaaaccatacct

SEQ ID NO: 494480 - DNA, 25 bp, Rattus norvegicus
gtcctctgaagagttgtgcgtgctc

SEQ ID NO: 494481 - DNA, 25 bp, Rattus norvegicus
gtcctctgaagcctgtgtatacata

SEQ ID NO: 494482 - DNA, 25 bp, Rattus norvegicus
gtcctctgaagcgtgtgtatacata

SEQ ID NO: 494483 - DNA, 25 bp, Rattus norvegicus
gtcctctgacctacaaatgatcctt

SEQ ID NO: 494484 - DNA, 25 bp, Rattus norvegicus
gtcctctgaccttcaaatgatcctt

SEQ ID NO: 494485 - DNA, 25 bp, Rattus norvegicus
gtcctctgacttcgtttcattcgaa

SEQ ID NO: 494486 - DNA, 25 bp, Rattus norvegicus
gtcctctgacttggtttcattcgaa

SEQ ID NO: 494487 - DNA, 25 bp, Rattus norvegicus
gtcctctgagcactctagctgacaa

SEQ ID NO: 494488 - DNA, 25 bp, Rattus norvegicus
gtcctctgagcagtctagctgacaa

SEQ ID NO: 494489 - DNA, 25 bp, Rattus norvegicus
gtcctctgcatcagtgcactgtgaa

SEQ ID NO: 494490 - DNA, 25 bp, Rattus norvegicus
gtcctctgcatctgtgcactgtgaa

SEQ ID NO: 494491 - DNA, 25 bp, Rattus norvegicus
gtcctctgcctcatgataacttaat

SEQ ID NO: 494492 - DNA, 25 bp, Rattus norvegicus
gtcctctgcctcttgataacttaat

SEQ ID NO: 494493 - DNA, 25 bp, Rattus norvegicus
gtcctctgcttcagctatgctggaa

SEQ ID NO: 494494 - DNA, 25 bp, Rattus norvegicus
gtcctctgcttctgctatgctggaa

SEQ ID NO: 494495 - DNA, 25 bp, Rattus norvegicus
gtcctctgcttgctgaacctgtggg

SEQ ID NO: 494496 - DNA, 25 bp, Rattus norvegicus
gtcctctgcttggtgaacctgtggg

SEQ ID NO: 494497 - DNA, 25 bp, Rattus norvegicus
gtcctctggaatattggtgctccat

SEQ ID NO: 494498 - DNA, 25 bp, Rattus norvegicus
gtcctctggaattttggtgctccat

SEQ ID NO: 494499 - DNA, 25 bp, Rattus norvegicus
gtcctctggaggaggcggatcatca

SEQ ID NO: 494500 - DNA, 25 bp, Rattus norvegicus
gtcctctggaggtggcggatcatca

SEQ ID NO: 494501 - DNA, 25 bp, Rattus norvegicus
gtcctctggtaaatggcaggcttat

SEQ ID NO: 494502 - DNA, 25 bp, Rattus norvegicus
gtcctctggtaattggcaggcttat

SEQ ID NO: 494503 - DNA, 25 bp, Rattus norvegicus
gtcctctgtaaaaccaaggccttac

SEQ ID NO: 494504 - DNA, 25 bp, Rattus norvegicus
gtcctctgtaaatccaaggccttac

SEQ ID NO: 494505 - DNA, 25 bp, Rattus norvegicus
gtcctctgtgccctctgcagtgaca

SEQ ID NO: 494506 - DNA, 25 bp, Rattus norvegicus
gtcctctgtgccgtctgcagtgaca

SEQ ID NO: 494507 - DNA, 25 bp, Rattus norvegicus
gtcctctgtgggatgtaccacggta

SEQ ID NO: 494508 - DNA, 25 bp, Rattus norvegicus
gtcctctgtgggttgtaccacggta

SEQ ID NO: 494509 - DNA, 25 bp, Rattus norvegicus
gtcctctgttaaaatggtgcgctga

SEQ ID NO: 494510 - DNA, 25 bp, Rattus norvegicus
gtcctctgttaatatggtgcgctga

SEQ ID NO: 494511 - DNA, 25 bp, Rattus norvegicus
gtcctcttacatatccaaccaaaaa

SEQ ID NO: 494512 - DNA, 25 bp, Rattus norvegicus
gtcctcttacatttccaaccaaaaa

SEQ ID NO: 494513 - DNA, 25 bp, Rattus norvegicus
gtcctcttagtaatagtttagacat

SEQ ID NO: 494514 - DNA, 25 bp, Rattus norvegicus
gtcctcttagtattagtttagacat

SEQ ID NO: 494515 - DNA, 25 bp, Rattus norvegicus
gtcctcttatctagttccctgggaa

SEQ ID NO: 494516 - DNA, 25 bp, Rattus norvegicus
gtcctcttatcttgttccctgggaa

SEQ ID NO: 494517 - DNA, 25 bp, Rattus norvegicus
gtcctcttccaaagctgcaagcgaa

SEQ ID NO: 494518 - DNA, 25 bp, Rattus norvegicus
gtcctcttccaatgctgcaagcgaa

SEQ ID NO: 494519 - DNA, 25 bp, Rattus norvegicus
gtcctcttcctcacagaagtcagaa

SEQ ID NO: 494520 - DNA, 25 bp, Rattus norvegicus
gtcctcttcctctcagaagtcagaa

SEQ ID NO: 494521 - DNA, 25 bp, Rattus norvegicus
gtcctcttctctaggcaatgctata

SEQ ID NO: 494522 - DNA, 25 bp, Rattus norvegicus
gtcctcttctcttggcaatgctata

SEQ ID NO: 494523 - DNA, 25 bp, Rattus norvegicus
gtcctcttctgactgtcatgggcaa

SEQ ID NO: 494524 - DNA, 25 bp, Rattus norvegicus
gtcctcttctgagtgtcatgggcaa

SEQ ID NO: 494525 - DNA, 25 bp, Rattus norvegicus
gtcctcttgaccatcgtacattgaa

SEQ ID NO: 494526 - DNA, 25 bp, Rattus norvegicus
gtcctcttgaccttcgtacattgaa

SEQ ID NO: 494527 - DNA, 25 bp, Rattus norvegicus
gtcctcttgactcgatctgtcacaa

SEQ ID NO: 494528 - DNA, 25 bp, Rattus norvegicus
gtcctcttgactggatctgtcacaa

SEQ ID NO: 494529 - DNA, 25 bp, Rattus norvegicus
gtcctcttgctactcaaagttcata

SEQ ID NO: 494530 - DNA, 25 bp, Rattus norvegicus
gtcctcttgctagtcaaagttcata

SEQ ID NO: 494531 - DNA, 25 bp, Rattus norvegicus
gtcctcttgctgatggctgctagat

SEQ ID NO: 494532 - DNA, 25 bp, Rattus norvegicus
gtcctcttgctgttggctgctagat

SEQ ID NO: 494533 - DNA, 25 bp, Rattus norvegicus
gtcctcttgtttaatttgtcctcgt

SEQ ID NO: 494534 - DNA, 25 bp, Rattus norvegicus
gtcctcttgttttatttgtcctcgt

SEQ ID NO: 494535 - DNA, 25 bp, Rattus norvegicus
gtcctctttaatctgacgcgtgaga

SEQ ID NO: 494536 - DNA, 25 bp, Rattus norvegicus
gtcctctttaatgtgacgcgtgaga

SEQ ID NO: 494537 - DNA, 25 bp, Rattus norvegicus
gtcctctttgaacaacttgccattg

SEQ ID NO: 494538 - DNA, 25 bp, Rattus norvegicus
gtcctctttgaagaacttgccattg

SEQ ID NO: 494539 - DNA, 25 bp, Rattus norvegicus
gtcctctttgctcgatggatcgtaa

SEQ ID NO: 494540 - DNA, 25 bp, Rattus norvegicus
gtcctctttgctggatggatcgtaa

SEQ ID NO: 494541 - DNA, 25 bp, Rattus norvegicus
gtcctctttggccagataaaacgtt

SEQ ID NO: 494542 - DNA, 25 bp, Rattus norvegicus
gtcctctttggcgagataaaacgtt

SEQ ID NO: 494543 - DNA, 25 bp, Rattus norvegicus
gtcctctttgtaactggaagtttct

SEQ ID NO: 494544 - DNA, 25 bp, Rattus norvegicus
gtcctctttgtatctggaagtttct

SEQ ID NO: 494545 - DNA, 25 bp, Rattus norvegicus
gtcctcttttacagatggcccagaa

SEQ ID NO: 494546 - DNA, 25 bp, Rattus norvegicus
gtcctcttttactgatggcccagaa

SEQ ID NO: 494547 - DNA, 25 bp, Rattus norvegicus
gtcctcttttcgatattttgttctg

SEQ ID NO: 494548 - DNA, 25 bp, Rattus norvegicus
gtcctcttttcgttattttgttctg

SEQ ID NO: 494549 - DNA, 25 bp, Rattus norvegicus
gtcctgaaatgaaagatggcgcctc

SEQ ID NO: 494550 - DNA, 25 bp, Rattus norvegicus
gtcctgaaatgatagatggcgcctc

SEQ ID NO: 494551 - DNA, 25 bp, Rattus norvegicus
gtcctgaacacgacctgcaagaagt

SEQ ID NO: 494552 - DNA, 25 bp, Rattus norvegicus
gtcctgaacacgtcctgcaagaagt

SEQ ID NO: 494553 - DNA, 25 bp, Rattus norvegicus
gtcctgaacccacgaatgtaaagat

SEQ ID NO: 494554 - DNA, 25 bp, Rattus norvegicus
gtcctgaacccaggaatgtaaagat

SEQ ID NO: 494555 - DNA, 25 bp, Rattus norvegicus
gtcctgaacgagaagtcgcccgaag

SEQ ID NO: 494556 - DNA, 25 bp, Rattus norvegicus
gtcctgaacgagtagtcgcccgaag

SEQ ID NO: 494557 - DNA, 25 bp, Rattus norvegicus
gtcctgaaggccagcgcggagacta

SEQ ID NO: 494558 - DNA, 25 bp, Rattus norvegicus
gtcctgaaggcctgcgcggagacta

SEQ ID NO: 494559 - DNA, 25 bp, Rattus norvegicus
gtcctgaagttacgaccacggaagg

SEQ ID NO: 494560 - DNA, 25 bp, Rattus norvegicus
gtcctgaagttaggaccacggaagg

SEQ ID NO: 494561 - DNA, 25 bp, Rattus norvegicus
gtcctgacaggcataggatggctca

SEQ ID NO: 494562 - DNA, 25 bp, Rattus norvegicus
gtcctgacaggcttaggatggctca

SEQ ID NO: 494563 - DNA, 25 bp, Rattus norvegicus
gtcctgaccccacgcatggatgaaa

SEQ ID NO: 494564 - DNA, 25 bp, Rattus norvegicus
gtcctgaccccaggcatggatgaaa

SEQ ID NO: 494565 - DNA, 25 bp, Rattus norvegicus
gtcctgaccgctctgagagaacatg

SEQ ID NO: 494566 - DNA, 25 bp, Rattus norvegicus
gtcctgaccgctgtgagagaacatg

SEQ ID NO: 494567 - DNA, 25 bp, Rattus norvegicus
gtcctgaccgtgaactagcagagct

SEQ ID NO: 494568 - DNA, 25 bp, Rattus norvegicus
gtcctgaccgtgtactagcagagct

SEQ ID NO: 494569 - DNA, 25 bp, Rattus norvegicus
gtcctgagaacacctgtctggatga

SEQ ID NO: 494570 - DNA, 25 bp, Rattus norvegicus
gtcctgagaacagctgtctggatga

SEQ ID NO: 494571 - DNA, 25 bp, Rattus norvegicus
gtcctgagactcatgtgtgtgcaca

SEQ ID NO: 494572 - DNA, 25 bp, Rattus norvegicus
gtcctgagactcttgtgtgtgcaca

SEQ ID NO: 494573 - DNA, 25 bp, Rattus norvegicus
gtcctgagagctatactgaatgtac

SEQ ID NO: 494574 - DNA, 25 bp, Rattus norvegicus
gtcctgagagctttactgaatgtac

SEQ ID NO: 494575 - DNA, 25 bp, Rattus norvegicus
gtcctgagccttcacttaagacctt

SEQ ID NO: 494576 - DNA, 25 bp, Rattus norvegicus
gtcctgagccttgacttaagacctt

SEQ ID NO: 494577 - DNA, 25 bp, Rattus norvegicus
gtcctgagcgtcacctgtggtcacc

SEQ ID NO: 494578 - DNA, 25 bp, Rattus norvegicus
gtcctgagcgtctcctgtggtcacc

SEQ ID NO: 494579 - DNA, 25 bp, Rattus norvegicus
gtcctgagcgtgaaacggttcacca

SEQ ID NO: 494580 - DNA, 25 bp, Rattus norvegicus
gtcctgagcgtgtaacggttcacca

SEQ ID NO: 494581 - DNA, 25 bp, Rattus norvegicus
gtcctgagcgttctgtgtttgtttg

SEQ ID NO: 494582 - DNA, 25 bp, Rattus norvegicus
gtcctgagcgttgtgtgtttgtttg

SEQ ID NO: 494583 - DNA, 25 bp, Rattus norvegicus
gtcctgaggaatacttacttgcaca

SEQ ID NO: 494584 - DNA, 25 bp, Rattus norvegicus
gtcctgaggaattcttacttgcaca

SEQ ID NO: 494585 - DNA, 25 bp, Rattus norvegicus
gtcctgaggaggattgcaaccccat

SEQ ID NO: 494586 - DNA, 25 bp, Rattus norvegicus
gtcctgaggaggtttgcaaccccat

SEQ ID NO: 494587 - DNA, 25 bp, Rattus norvegicus
gtcctgagtcagaacatcctttaaa

SEQ ID NO: 494588 - DNA, 25 bp, Rattus norvegicus
gtcctgagtcagtacatcctttaaa

SEQ ID NO: 494589 - DNA, 25 bp, Rattus norvegicus
gtcctgagtcccactattgattacg

SEQ ID NO: 494590 - DNA, 25 bp, Rattus norvegicus
gtcctgagtccctctattgattacg

SEQ ID NO: 494591 - DNA, 25 bp, Rattus norvegicus
gtcctgagttctatacatggtgttt

SEQ ID NO: 494592 - DNA, 25 bp, Rattus norvegicus
gtcctgagttctttacatggtgttt

SEQ ID NO: 494593 - DNA, 25 bp, Rattus norvegicus
gtcctgataccaattctccttagaa

SEQ ID NO: 494594 - DNA, 25 bp, Rattus norvegicus
gtcctgataccatttctccttagaa

SEQ ID NO: 494595 - DNA, 25 bp, Rattus norvegicus
gtcctgatagacaagctgagatgct

SEQ ID NO: 494596 - DNA, 25 bp, Rattus norvegicus
gtcctgatagactagctgagatgct

SEQ ID NO: 494597 - DNA, 25 bp, Rattus norvegicus
gtcctgataggcactgaatatttcc

SEQ ID NO: 494598 - DNA, 25 bp, Rattus norvegicus
gtcctgataggctctgaatatttcc

SEQ ID NO: 494599 - DNA, 25 bp, Rattus norvegicus
gtcctgatcatcctgtggctgagtt

SEQ ID NO: 494600 - DNA, 25 bp, Rattus norvegicus
gtcctgatcatcgtgtggctgagtt

SEQ ID NO: 494601 - DNA, 25 bp, Rattus norvegicus
gtcctgatccccaattggttcttga

SEQ ID NO: 494602 - DNA, 25 bp, Rattus norvegicus
gtcctgatcccctattggttcttga

SEQ ID NO: 494603 - DNA, 25 bp, Rattus norvegicus
gtcctgatcctgaggccatttattg

SEQ ID NO: 494604 - DNA, 25 bp, Rattus norvegicus
gtcctgatcctgtggccatttattg

SEQ ID NO: 494605 - DNA, 25 bp, Rattus norvegicus
gtcctgatctatccagacagacgtt

SEQ ID NO: 494606 - DNA, 25 bp, Rattus norvegicus
gtcctgatctatgcagacagacgtt

SEQ ID NO: 494607 - DNA, 25 bp, Rattus norvegicus
gtcctgatgatcatgctgctaatta

SEQ ID NO: 494608 - DNA, 25 bp, Rattus norvegicus
gtcctgatgatcttgctgctaatta

SEQ ID NO: 494609 - DNA, 25 bp, Rattus norvegicus
gtcctgatgcttatcctatgctgga

SEQ ID NO: 494610 - DNA, 25 bp, Rattus norvegicus
gtcctgatgcttttcctatgctgga

SEQ ID NO: 494611 - DNA, 25 bp, Rattus norvegicus
gtcctgattctgagcttaattctgg

SEQ ID NO: 494612 - DNA, 25 bp, Rattus norvegicus
gtcctgattctgtgcttaattctgg

SEQ ID NO: 494613 - DNA, 25 bp, Rattus norvegicus
gtcctgattgaaaacctaccctctg

SEQ ID NO: 494614 - DNA, 25 bp, Rattus norvegicus
gtcctgattgaatacctaccctctg

SEQ ID NO: 494615 - DNA, 25 bp, Rattus norvegicus
gtcctgattgtcactcttttactta

SEQ ID NO: 494616 - DNA, 25 bp, Rattus norvegicus
gtcctgattgtctctcttttactta

SEQ ID NO: 494617 - DNA, 25 bp, Rattus norvegicus
gtcctgattgttactccatctttaa

SEQ ID NO: 494618 - DNA, 25 bp, Rattus norvegicus
gtcctgattgtttctccatctttaa

SEQ ID NO: 494619 - DNA, 25 bp, Rattus norvegicus
gtcctgatttttaaagttgttggca

SEQ ID NO: 494620 - DNA, 25 bp, Rattus norvegicus
gtcctgattttttaagttgttggca

SEQ ID NO: 494621 - DNA, 25 bp, Rattus norvegicus
gtcctgcaaaggaccaggctggtca

SEQ ID NO: 494622 - DNA, 25 bp, Rattus norvegicus
gtcctgcaaaggtccaggctggtca

SEQ ID NO: 494623 - DNA, 25 bp, Rattus norvegicus
gtcctgcaagacagggtcatcgatg

SEQ ID NO: 494624 - DNA, 25 bp, Rattus norvegicus
gtcctgcaagactgggtcatcgatg

SEQ ID NO: 494625 - DNA, 25 bp, Rattus norvegicus
gtcctgcaatcgactgtgtgttggg

SEQ ID NO: 494626 - DNA, 25 bp, Rattus norvegicus
gtcctgcaatcgtctgtgtgttggg

SEQ ID NO: 494627 - DNA, 25 bp, Rattus norvegicus
gtcctgcacggcatgtttttatcat

SEQ ID NO: 494628 - DNA, 25 bp, Rattus norvegicus
gtcctgcacggcttgtttttatcat

SEQ ID NO: 494629 - DNA, 25 bp, Rattus norvegicus
gtcctgcactctcctgtcaggtggg

SEQ ID NO: 494630 - DNA, 25 bp, Rattus norvegicus
gtcctgcactctgctgtcaggtggg

SEQ ID NO: 494631 - DNA, 25 bp, Rattus norvegicus
gtcctgcactttcttggaccagtac

SEQ ID NO: 494632 - DNA, 25 bp, Rattus norvegicus
gtcctgcactttgttggaccagtac

SEQ ID NO: 494633 - DNA, 25 bp, Rattus norvegicus
gtcctgcagcttacatgtcactgaa

SEQ ID NO: 494634 - DNA, 25 bp, Rattus norvegicus
gtcctgcagctttcatgtcactgaa

SEQ ID NO: 494635 - DNA, 25 bp, Rattus norvegicus
gtcctgcatcagcttggtgaggcca

SEQ ID NO: 494636 - DNA, 25 bp, Rattus norvegicus
gtcctgcatcagctttgtacatatg

SEQ ID NO: 494637 - DNA, 25 bp, Rattus norvegicus
gtcctgcatcaggttggtgaggcca

SEQ ID NO: 494638 - DNA, 25 bp, Rattus norvegicus
gtcctgcatcaggtttgtacatatg

SEQ ID NO: 494639 - DNA, 25 bp, Rattus norvegicus
gtcctgcatctaaagccactacaat

SEQ ID NO: 494640 - DNA, 25 bp, Rattus norvegicus
gtcctgcatctatagccactacaat

SEQ ID NO: 494641 - DNA, 25 bp, Rattus norvegicus
gtcctgcattgtatcattttctgta

SEQ ID NO: 494642 - DNA, 25 bp, Rattus norvegicus
gtcctgcattgtttcattttctgta

SEQ ID NO: 494643 - DNA, 25 bp, Rattus norvegicus
gtcctgccatgtcccagaaacaaga

SEQ ID NO: 494644 - DNA, 25 bp, Rattus norvegicus
gtcctgccatgtgccagaaacaaga

SEQ ID NO: 494645 - DNA, 25 bp, Rattus norvegicus
gtcctgcccaatcgcttaactataa

SEQ ID NO: 494646 - DNA, 25 bp, Rattus norvegicus
gtcctgcccaatggcttaactataa

SEQ ID NO: 494647 - DNA, 25 bp, Rattus norvegicus
gtcctgccccatacatagatcctga

SEQ ID NO: 494648 - DNA, 25 bp, Rattus norvegicus
gtcctgccccattcatagatcctga

SEQ ID NO: 494649 - DNA, 25 bp, Rattus norvegicus
gtcctgccctgactgaggttaatga

SEQ ID NO: 494650 - DNA, 25 bp, Rattus norvegicus
gtcctgccctgagtgaggttaatga

SEQ ID NO: 494651 - DNA, 25 bp, Rattus norvegicus
gtcctgccgattaccttttacagat

SEQ ID NO: 494652 - DNA, 25 bp, Rattus norvegicus
gtcctgccgatttccttttacagat

SEQ ID NO: 494653 - DNA, 25 bp, Rattus norvegicus
gtcctgcctccacttcagggtgtgt

SEQ ID NO: 494654 - DNA, 25 bp, Rattus norvegicus
gtcctgcctccagttcagggtgtgt

SEQ ID NO: 494655 - DNA, 25 bp, Rattus norvegicus
gtcctgcctgtaaatagcatgtcct

SEQ ID NO: 494656 - DNA, 25 bp, Rattus norvegicus
gtcctgcctgtatatagcatgtcct

SEQ ID NO: 494657 - DNA, 25 bp, Rattus norvegicus
gtcctgcctgtcagagtagggccgc

SEQ ID NO: 494658 - DNA, 25 bp, Rattus norvegicus
gtcctgcctgtctgagtagggccgc

SEQ ID NO: 494659 - DNA, 25 bp, Rattus norvegicus
gtcctgccttttctgcattttttag

SEQ ID NO: 494660 - DNA, 25 bp, Rattus norvegicus
gtcctgccttttgtgcattttttag

SEQ ID NO: 494661 - DNA, 25 bp, Rattus norvegicus
gtcctgcggagcatcaggccgaaag

SEQ ID NO: 494662 - DNA, 25 bp, Rattus norvegicus
gtcctgcggagcttcaggccgaaag

SEQ ID NO: 494663 - DNA, 25 bp, Rattus norvegicus
gtcctgcggcgtattcgacgttaaa

SEQ ID NO: 494664 - DNA, 25 bp, Rattus norvegicus
gtcctgcggcgttttcgacgttaaa

SEQ ID NO: 494665 - DNA, 25 bp, Rattus norvegicus
gtcctgcgtcgacatcaacgagtgt

SEQ ID NO: 494666 - DNA, 25 bp, Rattus norvegicus
gtcctgcgtcgagatcaacgagtgt

SEQ ID NO: 494667 - DNA, 25 bp, Rattus norvegicus
gtcctgctaattcgtactatgtcat

SEQ ID NO: 494668 - DNA, 25 bp, Rattus norvegicus
gtcctgctaattggtactatgtcat

SEQ ID NO: 494669 - DNA, 25 bp, Rattus norvegicus
gtcctgctcaaacctgaacatcatt

SEQ ID NO: 494670 - DNA, 25 bp, Rattus norvegicus
gtcctgctcaaagctgaacatcatt

SEQ ID NO: 494671 - DNA, 25 bp, Rattus norvegicus
gtcctgctcatgcatctatcttatt

SEQ ID NO: 494672 - DNA, 25 bp, Rattus norvegicus
gtcctgctcatggatctatcttatt

SEQ ID NO: 494673 - DNA, 25 bp, Rattus norvegicus
gtcctgctcctgaagaaacgtgcat

SEQ ID NO: 494674 - DNA, 25 bp, Rattus norvegicus
gtcctgctcctgcaaagctgctggt

SEQ ID NO: 494675 - DNA, 25 bp, Rattus norvegicus
gtcctgctcctggaaagctgctggt

SEQ ID NO: 494676 - DNA, 25 bp, Rattus norvegicus
gtcctgctcctgtagaaacgtgcat

SEQ ID NO: 494677 - DNA, 25 bp, Rattus norvegicus
gtcctgctctagacctttgtaattg

SEQ ID NO: 494678 - DNA, 25 bp, Rattus norvegicus
gtcctgctctagtcctttgtaattg

SEQ ID NO: 494679 - DNA, 25 bp, Rattus norvegicus
gtcctgctctttctactcgtgtaaa

SEQ ID NO: 494680 - DNA, 25 bp, Rattus norvegicus
gtcctgctctttgtactcgtgtaaa

SEQ ID NO: 494681 - DNA, 25 bp, Rattus norvegicus
gtcctgctgcaaagtcccgcttggg

SEQ ID NO: 494682 - DNA, 25 bp, Rattus norvegicus
gtcctgctgcaatgtcccgcttggg

SEQ ID NO: 494683 - DNA, 25 bp, Rattus norvegicus
gtcctgctgcagagacccaagtgca

SEQ ID NO: 494684 - DNA, 25 bp, Rattus norvegicus
gtcctgctgcagtgacccaagtgca

SEQ ID NO: 494685 - DNA, 25 bp, Rattus norvegicus
gtcctgctgctgagatgaccagctg

SEQ ID NO: 494686 - DNA, 25 bp, Rattus norvegicus
gtcctgctgctgtgatgaccagctg

SEQ ID NO: 494687 - DNA, 25 bp, Rattus norvegicus
gtcctgctgtccacagggagcaatg

SEQ ID NO: 494688 - DNA, 25 bp, Rattus norvegicus
gtcctgctgtcctcagggagcaatg

SEQ ID NO: 494689 - DNA, 25 bp, Rattus norvegicus
gtcctgcttaccacatttctgaatg

SEQ ID NO: 494690 - DNA, 25 bp, Rattus norvegicus
gtcctgcttacctcatttctgaatg

SEQ ID NO: 494691 - DNA, 25 bp, Rattus norvegicus
gtcctgcttcggaaacgattcttca

SEQ ID NO: 494692 - DNA, 25 bp, Rattus norvegicus
gtcctgcttcggtaacgattcttca

SEQ ID NO: 494693 - DNA, 25 bp, Rattus norvegicus
gtcctgcttgggattcatttgcata

SEQ ID NO: 494694 - DNA, 25 bp, Rattus norvegicus
gtcctgcttgggtttcatttgcata

SEQ ID NO: 494695 - DNA, 25 bp, Rattus norvegicus
gtcctgcttgtcatgagactaccac

SEQ ID NO: 494696 - DNA, 25 bp, Rattus norvegicus
gtcctgcttgtcttgagactaccac

SEQ ID NO: 494697 - DNA, 25 bp, Rattus norvegicus
gtcctgcttgtgctgatggtgtaac

SEQ ID NO: 494698 - DNA, 25 bp, Rattus norvegicus
gtcctgcttgtggtgatggtgtaac

SEQ ID NO: 494699 - DNA, 25 bp, Rattus norvegicus
gtcctggaaaacaagtcctcatatt

SEQ ID NO: 494700 - DNA, 25 bp, Rattus norvegicus
gtcctggaaaactagtcctcatatt

SEQ ID NO: 494701 - DNA, 25 bp, Rattus norvegicus
gtcctggaaactcttgtactgctca

SEQ ID NO: 494702 - DNA, 25 bp, Rattus norvegicus
gtcctggaaactgttgtactgctca

SEQ ID NO: 494703 - DNA, 25 bp, Rattus norvegicus
gtcctggaacacactctgaacagca

SEQ ID NO: 494704 - DNA, 25 bp, Rattus norvegicus
gtcctggaacactctctgaacagca

SEQ ID NO: 494705 - DNA, 25 bp, Rattus norvegicus
gtcctggaacgaacttaacctttct

SEQ ID NO: 494706 - DNA, 25 bp, Rattus norvegicus
gtcctggaacgatcttaacctttct

SEQ ID NO: 494707 - DNA, 25 bp, Rattus norvegicus
gtcctggaactacctaaattaaaca

SEQ ID NO: 494708 - DNA, 25 bp, Rattus norvegicus
gtcctggaactagctaaattaaaca

SEQ ID NO: 494709 - DNA, 25 bp, Rattus norvegicus
gtcctggaactcagtgtactcgctg

SEQ ID NO: 494710 - DNA, 25 bp, Rattus norvegicus
gtcctggaactctgtgtactcgctg

SEQ ID NO: 494711 - DNA, 25 bp, Rattus norvegicus
gtcctggaacttattgatgcaattg

SEQ ID NO: 494712 - DNA, 25 bp, Rattus norvegicus
gtcctggaactttttgatgcaattg

SEQ ID NO: 494713 - DNA, 25 bp, Rattus norvegicus
gtcctggaagagaagatgttttgtt

SEQ ID NO: 494714 - DNA, 25 bp, Rattus norvegicus
gtcctggaagagtagatgttttgtt

SEQ ID NO: 494715 - DNA, 25 bp, Rattus norvegicus
gtcctggaaggtccagcctattcta

SEQ ID NO: 494716 - DNA, 25 bp, Rattus norvegicus
gtcctggaaggtgcagcctattcta

SEQ ID NO: 494717 - DNA, 25 bp, Rattus norvegicus
gtcctggaatttcgtccacagagca

SEQ ID NO: 494718 - DNA, 25 bp, Rattus norvegicus
gtcctggaatttggtccacagagca

SEQ ID NO: 494719 - DNA, 25 bp, Rattus norvegicus
gtcctggacacaagttctgtcatca

SEQ ID NO: 494720 - DNA, 25 bp, Rattus norvegicus
gtcctggacacatgttctgtcatca

SEQ ID NO: 494721 - DNA, 25 bp, Rattus norvegicus
gtcctggacaccaaaggccacttgg

SEQ ID NO: 494722 - DNA, 25 bp, Rattus norvegicus
gtcctggacacctaaggccacttgg

SEQ ID NO: 494723 - DNA, 25 bp, Rattus norvegicus
gtcctggacctgagaatacctgagt

SEQ ID NO: 494724 - DNA, 25 bp, Rattus norvegicus
gtcctggacctgtgaatacctgagt

SEQ ID NO: 494725 - DNA, 25 bp, Rattus norvegicus
gtcctggaggccactcgggttaatc

SEQ ID NO: 494726 - DNA, 25 bp, Rattus norvegicus
gtcctggaggcctctcgggttaatc

SEQ ID NO: 494727 - DNA, 25 bp, Rattus norvegicus
gtcctggaggtgcactacaccatgt

SEQ ID NO: 494728 - DNA, 25 bp, Rattus norvegicus
gtcctggaggtggactacaccatgt

SEQ ID NO: 494729 - DNA, 25 bp, Rattus norvegicus
gtcctggatgagattgatgctgcct

SEQ ID NO: 494730 - DNA, 25 bp, Rattus norvegicus
gtcctggatgagtttgatgctgcct

SEQ ID NO: 494731 - DNA, 25 bp, Rattus norvegicus
gtcctggatggcctcagactcatag

SEQ ID NO: 494732 - DNA, 25 bp, Rattus norvegicus
gtcctggatggcgtcagactcatag

SEQ ID NO: 494733 - DNA, 25 bp, Rattus norvegicus
gtcctggatttgacccacaattatg

SEQ ID NO: 494734 - DNA, 25 bp, Rattus norvegicus
gtcctggatttgtcccacaattatg

SEQ ID NO: 494735 - DNA, 25 bp, Rattus norvegicus
gtcctggcaaccctaaggatgtgaa

SEQ ID NO: 494736 - DNA, 25 bp, Rattus norvegicus
gtcctggcaaccgtaaggatgtgaa

SEQ ID NO: 494737 - DNA, 25 bp, Rattus norvegicus
gtcctggcagttaacacgatgtgca

SEQ ID NO: 494738 - DNA, 25 bp, Rattus norvegicus
gtcctggcagtttacacgatgtgca

SEQ ID NO: 494739 - DNA, 25 bp, Rattus norvegicus
gtcctggcatctcaagggcagcagc

SEQ ID NO: 494740 - DNA, 25 bp, Rattus norvegicus
gtcctggcatctgaagggcagcagc

SEQ ID NO: 494741 - DNA, 25 bp, Rattus norvegicus
gtcctggcatgtcacaattttacta

SEQ ID NO: 494742 - DNA, 25 bp, Rattus norvegicus
gtcctggcatgtgacaattttacta

SEQ ID NO: 494743 - DNA, 25 bp, Rattus norvegicus
gtcctggccaccatcaagcagtgta

SEQ ID NO: 494744 - DNA, 25 bp, Rattus norvegicus
gtcctggccaccttcaagcagtgta

SEQ ID NO: 494745 - DNA, 25 bp, Rattus norvegicus
gtcctggcccagctgaagtttctgt

SEQ ID NO: 494746 - DNA, 25 bp, Rattus norvegicus
gtcctggcccaggtgaagtttctgt

SEQ ID NO: 494747 - DNA, 25 bp, Rattus norvegicus
gtcctggccctacttctatagggct

SEQ ID NO: 494748 - DNA, 25 bp, Rattus norvegicus
gtcctggccctagttctatagggct

SEQ ID NO: 494749 - DNA, 25 bp, Rattus norvegicus
gtcctggctacaccttcaaatgata

SEQ ID NO: 494750 - DNA, 25 bp, Rattus norvegicus
gtcctggctacagcttcaaatgata

SEQ ID NO: 494751 - DNA, 25 bp, Rattus norvegicus
gtcctggctcgtagttaatgaagcc

SEQ ID NO: 494752 - DNA, 25 bp, Rattus norvegicus
gtcctggctcgttgttaatgaagcc

SEQ ID NO: 494753 - DNA, 25 bp, Rattus norvegicus
gtcctggctctgatgttgctgtcgt

SEQ ID NO: 494754 - DNA, 25 bp, Rattus norvegicus
gtcctggctctgttgttgctgtcgt

SEQ ID NO: 494755 - DNA, 25 bp, Rattus norvegicus
gtcctggctggaatgttttatttac

SEQ ID NO: 494756 - DNA, 25 bp, Rattus norvegicus
gtcctggctggattgttttatttac

SEQ ID NO: 494757 - DNA, 25 bp, Rattus norvegicus
gtcctggctgtgatcataagatccc

SEQ ID NO: 494758 - DNA, 25 bp, Rattus norvegicus
gtcctggctgtgttcataagatccc

SEQ ID NO: 494759 - DNA, 25 bp, Rattus norvegicus
gtcctgggaagtcaacttgagccct

SEQ ID NO: 494760 - DNA, 25 bp, Rattus norvegicus
gtcctgggaagtgaacttgagccct

SEQ ID NO: 494761 - DNA, 25 bp, Rattus norvegicus
gtcctgggattaagggtgtgctcca

SEQ ID NO: 494762 - DNA, 25 bp, Rattus norvegicus
gtcctgggattatgggtgtgctcca

SEQ ID NO: 494763 - DNA, 25 bp, Rattus norvegicus
gtcctgggcagtaggtttacatcat

SEQ ID NO: 494764 - DNA, 25 bp, Rattus norvegicus
gtcctgggcagttggtttacatcat

SEQ ID NO: 494765 - DNA, 25 bp, Rattus norvegicus
gtcctgggccaaccccatatattta

SEQ ID NO: 494766 - DNA, 25 bp, Rattus norvegicus
gtcctgggccaagcccatatattta

SEQ ID NO: 494767 - DNA, 25 bp, Rattus norvegicus
gtcctggggccgagtatgcctgcat

SEQ ID NO: 494768 - DNA, 25 bp, Rattus norvegicus
gtcctggggccgtgtatgcctgcat

SEQ ID NO: 494769 - DNA, 25 bp, Rattus norvegicus
gtcctgggtatcacatgtgggccgc

SEQ ID NO: 494770 - DNA, 25 bp, Rattus norvegicus
gtcctgggtatcaggaagggccact

SEQ ID NO: 494771 - DNA, 25 bp, Rattus norvegicus
gtcctgggtatctcatgtgggccgc

SEQ ID NO: 494772 - DNA, 25 bp, Rattus norvegicus
gtcctgggtatctggaagggccact

SEQ ID NO: 494773 - DNA, 25 bp, Rattus norvegicus
gtcctgggttatcagcattttccat

SEQ ID NO: 494774 - DNA, 25 bp, Rattus norvegicus
gtcctgggttatgagcattttccat

SEQ ID NO: 494775 - DNA, 25 bp, Rattus norvegicus
gtcctgggtttaactgcatatttca

SEQ ID NO: 494776 - DNA, 25 bp, Rattus norvegicus
gtcctgggtttatctgcatatttca

SEQ ID NO: 494777 - DNA, 25 bp, Rattus norvegicus
gtcctggtaggcaaagaccggtcaa

SEQ ID NO: 494778 - DNA, 25 bp, Rattus norvegicus
gtcctggtaggccaacaggctcaaa

SEQ ID NO: 494779 - DNA, 25 bp, Rattus norvegicus
gtcctggtaggcgaacaggctcaaa

SEQ ID NO: 494780 - DNA, 25 bp, Rattus norvegicus
gtcctggtaggctaagaccggtcaa

SEQ ID NO: 494781 - DNA, 25 bp, Rattus norvegicus
gtcctggtagtactggtcagacctg

SEQ ID NO: 494782 - DNA, 25 bp, Rattus norvegicus
gtcctggtagtagtggtcagacctg

SEQ ID NO: 494783 - DNA, 25 bp, Rattus norvegicus
gtcctggtatttatgttcgagtagc

SEQ ID NO: 494784 - DNA, 25 bp, Rattus norvegicus
gtcctggtatttttgttcgagtagc

SEQ ID NO: 494785 - DNA, 25 bp, Rattus norvegicus
gtcctggtcaccatgtacgagagag

SEQ ID NO: 494786 - DNA, 25 bp, Rattus norvegicus
gtcctggtcaccttgtacgagagag

SEQ ID NO: 494787 - DNA, 25 bp, Rattus norvegicus
gtcctggtccatcactatttacaaa

SEQ ID NO: 494788 - DNA, 25 bp, Rattus norvegicus
gtcctggtccatgactatttacaaa

SEQ ID NO: 494789 - DNA, 25 bp, Rattus norvegicus
gtcctggtcctacattcgaacttgg

SEQ ID NO: 494790 - DNA, 25 bp, Rattus norvegicus
gtcctggtcctagattcgaacttgg

SEQ ID NO: 494791 - DNA, 25 bp, Rattus norvegicus
gtcctggtctacaacacttgcagtc

SEQ ID NO: 494792 - DNA, 25 bp, Rattus norvegicus
gtcctggtctactacacttgcagtc

SEQ ID NO: 494793 - DNA, 25 bp, Rattus norvegicus
gtcctggtctccatgacatttgtca

SEQ ID NO: 494794 - DNA, 25 bp, Rattus norvegicus
gtcctggtctccttgacatttgtca

SEQ ID NO: 494795 - DNA, 25 bp, Rattus norvegicus
gtcctggtgaagacctgctgtagct

SEQ ID NO: 494796 - DNA, 25 bp, Rattus norvegicus
gtcctggtgaagtcctgctgtagct

SEQ ID NO: 494797 - DNA, 25 bp, Rattus norvegicus
gtcctggtgtgacctaatggttcag

SEQ ID NO: 494798 - DNA, 25 bp, Rattus norvegicus
gtcctggtgtgagctaatggttcag

SEQ ID NO: 494799 - DNA, 25 bp, Rattus norvegicus
gtcctggtgttgattctcagtgtta

SEQ ID NO: 494800 - DNA, 25 bp, Rattus norvegicus
gtcctggtgttgtttctcagtgtta

SEQ ID NO: 494801 - DNA, 25 bp, Rattus norvegicus
gtcctggttcaacgattggacccaa

SEQ ID NO: 494802 - DNA, 25 bp, Rattus norvegicus
gtcctggttcaaggattggacccaa

SEQ ID NO: 494803 - DNA, 25 bp, Rattus norvegicus
gtcctggttcagattccagtaacca

SEQ ID NO: 494804 - DNA, 25 bp, Rattus norvegicus
gtcctggttcagtttccagtaacca

SEQ ID NO: 494805 - DNA, 25 bp, Rattus norvegicus
gtcctggttgctcttctgatattgc

SEQ ID NO: 494806 - DNA, 25 bp, Rattus norvegicus
gtcctggttgctgttctgatattgc

SEQ ID NO: 494807 - DNA, 25 bp, Rattus norvegicus
gtcctgtaaatgaacccactttggt

SEQ ID NO: 494808 - DNA, 25 bp, Rattus norvegicus
gtcctgtaaatgtacccactttggt

SEQ ID NO: 494809 - DNA, 25 bp, Rattus norvegicus
gtcctgtaactgaagtgtagtaatt

SEQ ID NO: 494810 - DNA, 25 bp, Rattus norvegicus
gtcctgtaactgtagtgtagtaatt

SEQ ID NO: 494811 - DNA, 25 bp, Rattus norvegicus
gtcctgtaaggtcaaaacttggctt

SEQ ID NO: 494812 - DNA, 25 bp, Rattus norvegicus
gtcctgtaaggtgaaaacttggctt

SEQ ID NO: 494813 - DNA, 25 bp, Rattus norvegicus
gtcctgtactttcatgacagctcca

SEQ ID NO: 494814 - DNA, 25 bp, Rattus norvegicus
gtcctgtactttgatgacagctcca

SEQ ID NO: 494815 - DNA, 25 bp, Rattus norvegicus
gtcctgtatgttcgatcctgatgga

SEQ ID NO: 494816 - DNA, 25 bp, Rattus norvegicus
gtcctgtatgttggatcctgatgga

SEQ ID NO: 494817 - DNA, 25 bp, Rattus norvegicus
gtcctgtcactgacattaggtaggg

SEQ ID NO: 494818 - DNA, 25 bp, Rattus norvegicus
gtcctgtcactgtcattaggtaggg

SEQ ID NO: 494819 - DNA, 25 bp, Rattus norvegicus
gtcctgtcagagcatgcatgcttat

SEQ ID NO: 494820 - DNA, 25 bp, Rattus norvegicus
gtcctgtcagaggatgcatgcttat

SEQ ID NO: 494821 - DNA, 25 bp, Rattus norvegicus
gtcctgtcattaacttgtaagccct

SEQ ID NO: 494822 - DNA, 25 bp, Rattus norvegicus
gtcctgtcattatcttgtaagccct

SEQ ID NO: 494823 - DNA, 25 bp, Rattus norvegicus
gtcctgtccaacacgttcaatgtat

SEQ ID NO: 494824 - DNA, 25 bp, Rattus norvegicus
gtcctgtccaactcgttcaatgtat

SEQ ID NO: 494825 - DNA, 25 bp, Rattus norvegicus
gtcctgtcccttatctgtacagaat

SEQ ID NO: 494826 - DNA, 25 bp, Rattus norvegicus
gtcctgtcccttttctgtacagaat

SEQ ID NO: 494827 - DNA, 25 bp, Rattus norvegicus
gtcctgtcctcaatttccgtagagg

SEQ ID NO: 494828 - DNA, 25 bp, Rattus norvegicus
gtcctgtcctcattttccgtagagg

SEQ ID NO: 494829 - DNA, 25 bp, Rattus norvegicus
gtcctgtcctgtaggagccacagtg

SEQ ID NO: 494830 - DNA, 25 bp, Rattus norvegicus
gtcctgtcctgttggagccacagtg

SEQ ID NO: 494831 - DNA, 25 bp, Rattus norvegicus
gtcctgtccttccagggattgtgta

SEQ ID NO: 494832 - DNA, 25 bp, Rattus norvegicus
gtcctgtccttcgagggattgtgta

SEQ ID NO: 494833 - DNA, 25 bp, Rattus norvegicus
gtcctgtccttgcaggcaggagaca

SEQ ID NO: 494834 - DNA, 25 bp, Rattus norvegicus
gtcctgtccttggaggcaggagaca

SEQ ID NO: 494835 - DNA, 25 bp, Rattus norvegicus
gtcctgtcctttacttgtgtgtgtg

SEQ ID NO: 494836 - DNA, 25 bp, Rattus norvegicus
gtcctgtccttttcttgtgtgtgtg

SEQ ID NO: 494837 - DNA, 25 bp, Rattus norvegicus
gtcctgtcgtctagttagcatgatt

SEQ ID NO: 494838 - DNA, 25 bp, Rattus norvegicus
gtcctgtcgtcttgttagcatgatt

SEQ ID NO: 494839 - DNA, 25 bp, Rattus norvegicus
gtcctgtctaacaggaaccggttgc

SEQ ID NO: 494840 - DNA, 25 bp, Rattus norvegicus
gtcctgtctaactggaaccggttgc

SEQ ID NO: 494841 - DNA, 25 bp, Rattus norvegicus
gtcctgtctatgaggcatacatttt

SEQ ID NO: 494842 - DNA, 25 bp, Rattus norvegicus
gtcctgtctatgtggcatacatttt

SEQ ID NO: 494843 - DNA, 25 bp, Rattus norvegicus
gtcctgtctctacctttgtctgtat

SEQ ID NO: 494844 - DNA, 25 bp, Rattus norvegicus
gtcctgtctctagctttgtctgtat

SEQ ID NO: 494845 - DNA, 25 bp, Rattus norvegicus
gtcctgtctcttctgtataacttgt

SEQ ID NO: 494846 - DNA, 25 bp, Rattus norvegicus
gtcctgtctcttgtgtataacttgt

SEQ ID NO: 494847 - DNA, 25 bp, Rattus norvegicus
gtcctgtcttagatgtacaccctaa

SEQ ID NO: 494848 - DNA, 25 bp, Rattus norvegicus
gtcctgtcttagttgtacaccctaa

SEQ ID NO: 494849 - DNA, 25 bp, Rattus norvegicus
gtcctgtcttctcgaggtcagcgtc

SEQ ID NO: 494850 - DNA, 25 bp, Rattus norvegicus
gtcctgtcttctggaggtcagcgtc

SEQ ID NO: 494851 - DNA, 25 bp, Rattus norvegicus
gtcctgtctttaattggtttagtct

SEQ ID NO: 494852 - DNA, 25 bp, Rattus norvegicus
gtcctgtctttatttggtttagtct

SEQ ID NO: 494853 - DNA, 25 bp, Rattus norvegicus
gtcctgtctttgctagatttaccgg

SEQ ID NO: 494854 - DNA, 25 bp, Rattus norvegicus
gtcctgtctttggtagatttaccgg

SEQ ID NO: 494855 - DNA, 25 bp, Rattus norvegicus
gtcctgtcttttagtcatggagaac

SEQ ID NO: 494856 - DNA, 25 bp, Rattus norvegicus
gtcctgtctttttgtcatggagaac

SEQ ID NO: 494857 - DNA, 25 bp, Rattus norvegicus
gtcctgtgacaaactggaacctgat

SEQ ID NO: 494858 - DNA, 25 bp, Rattus norvegicus
gtcctgtgacaatctggaacctgat

SEQ ID NO: 494859 - DNA, 25 bp, Rattus norvegicus
gtcctgtgattcagatagttgctca

SEQ ID NO: 494860 - DNA, 25 bp, Rattus norvegicus
gtcctgtgattctgatagttgctca

SEQ ID NO: 494861 - DNA, 25 bp, Rattus norvegicus
gtcctgtgccatagtatccatagag

SEQ ID NO: 494862 - DNA, 25 bp, Rattus norvegicus
gtcctgtgccattgtatccatagag

SEQ ID NO: 494863 - DNA, 25 bp, Rattus norvegicus
gtcctgtgcctaagcagttgtttca

SEQ ID NO: 494864 - DNA, 25 bp, Rattus norvegicus
gtcctgtgcctatgcagttgtttca

SEQ ID NO: 494865 - DNA, 25 bp, Rattus norvegicus
gtcctgtgctgtacaagcaatcctg

SEQ ID NO: 494866 - DNA, 25 bp, Rattus norvegicus
gtcctgtgctgttcaagcaatcctg

SEQ ID NO: 494867 - DNA, 25 bp, Rattus norvegicus
gtcctgtggcagaaggcactctgaa

SEQ ID NO: 494868 - DNA, 25 bp, Rattus norvegicus
gtcctgtggcagtaggcactctgaa

SEQ ID NO: 494869 - DNA, 25 bp, Rattus norvegicus
gtcctgtggccaactacttagtaaa

SEQ ID NO: 494870 - DNA, 25 bp, Rattus norvegicus
gtcctgtggccatctacttagtaaa

SEQ ID NO: 494871 - DNA, 25 bp, Rattus norvegicus
gtcctgtggctgcttgtctcagtaa

SEQ ID NO: 494872 - DNA, 25 bp, Rattus norvegicus
gtcctgtggctggttgtctcagtaa

SEQ ID NO: 494873 - DNA, 25 bp, Rattus norvegicus
gtcctgtggcttcgtcagatctgaa

SEQ ID NO: 494874 - DNA, 25 bp, Rattus norvegicus
gtcctgtggcttggtcagatctgaa

SEQ ID NO: 494875 - DNA, 25 bp, Rattus norvegicus
gtcctgtgggtgaacaggcctcaga

SEQ ID NO: 494876 - DNA, 25 bp, Rattus norvegicus
gtcctgtgggtgtacaggcctcaga

SEQ ID NO: 494877 - DNA, 25 bp, Rattus norvegicus
gtcctgtgtccaagtgagcacggtt

SEQ ID NO: 494878 - DNA, 25 bp, Rattus norvegicus
gtcctgtgtccatgtgagcacggtt

SEQ ID NO: 494879 - DNA, 25 bp, Rattus norvegicus
gtcctgtgttttctcacccttttga

SEQ ID NO: 494880 - DNA, 25 bp, Rattus norvegicus
gtcctgtgttttgtcacccttttga

SEQ ID NO: 494881 - DNA, 25 bp, Rattus norvegicus
gtcctgttacaccaagagcggcatg

SEQ ID NO: 494882 - DNA, 25 bp, Rattus norvegicus
gtcctgttacacgaagagcggcatg

SEQ ID NO: 494883 - DNA, 25 bp, Rattus norvegicus
gtcctgttatctacctgtcttagaa

SEQ ID NO: 494884 - DNA, 25 bp, Rattus norvegicus
gtcctgttatcttcctgtcttagaa

SEQ ID NO: 494885 - DNA, 25 bp, Rattus norvegicus
gtcctgttatgcatacagcagccaa

SEQ ID NO: 494886 - DNA, 25 bp, Rattus norvegicus
gtcctgttatgcttacagcagccaa

SEQ ID NO: 494887 - DNA, 25 bp, Rattus norvegicus
gtcctgttatgtacctcatggttta

SEQ ID NO: 494888 - DNA, 25 bp, Rattus norvegicus
gtcctgttatgttcctcatggttta

SEQ ID NO: 494889 - DNA, 25 bp, Rattus norvegicus
gtcctgttcattatgcgaccgttgc

SEQ ID NO: 494890 - DNA, 25 bp, Rattus norvegicus
gtcctgttcattttgcgaccgttgc

SEQ ID NO: 494891 - DNA, 25 bp, Rattus norvegicus
gtcctgttccaacgaatggctacat

SEQ ID NO: 494892 - DNA, 25 bp, Rattus norvegicus
gtcctgttccaaggaatggctacat

SEQ ID NO: 494893 - DNA, 25 bp, Rattus norvegicus
gtcctgttccatatctccatgtgga

SEQ ID NO: 494894 - DNA, 25 bp, Rattus norvegicus
gtcctgttccatttctccatgtgga

SEQ ID NO: 494895 - DNA, 25 bp, Rattus norvegicus
gtcctgttccgcagctctaaataaa

SEQ ID NO: 494896 - DNA, 25 bp, Rattus norvegicus
gtcctgttccgctgctctaaataaa

SEQ ID NO: 494897 - DNA, 25 bp, Rattus norvegicus
gtcctgttcctacttcataggtatt

SEQ ID NO: 494898 - DNA, 25 bp, Rattus norvegicus
gtcctgttcctagttcataggtatt

SEQ ID NO: 494899 - DNA, 25 bp, Rattus norvegicus
gtcctgttcctgcagagctgtagga

SEQ ID NO: 494900 - DNA, 25 bp, Rattus norvegicus
gtcctgttcctggagagctgtagga

SEQ ID NO: 494901 - DNA, 25 bp, Rattus norvegicus
gtcctgttctaaaaagttctgttca

SEQ ID NO: 494902 - DNA, 25 bp, Rattus norvegicus
gtcctgttctaataagttctgttca

SEQ ID NO: 494903 - DNA, 25 bp, Rattus norvegicus
gtcctgttgcacatcatccagagtt

SEQ ID NO: 494904 - DNA, 25 bp, Rattus norvegicus
gtcctgttgcacttcatccagagtt

SEQ ID NO: 494905 - DNA, 25 bp, Rattus norvegicus
gtcctgttgtatatattgcctttgt

SEQ ID NO: 494906 - DNA, 25 bp, Rattus norvegicus
gtcctgttgtatttattgcctttgt

SEQ ID NO: 494907 - DNA, 25 bp, Rattus norvegicus
gtcctgtttacccacaaggtatcca

SEQ ID NO: 494908 - DNA, 25 bp, Rattus norvegicus
gtcctgtttaccgacaaggtatcca

SEQ ID NO: 494909 - DNA, 25 bp, Rattus norvegicus
gtcctgttttgaccccttatgttga

SEQ ID NO: 494910 - DNA, 25 bp, Rattus norvegicus
gtcctgttttgagcccttatgttga

SEQ ID NO: 494911 - DNA, 25 bp, Rattus norvegicus
gtccttaaatccctagttcacagtt

SEQ ID NO: 494912 - DNA, 25 bp, Rattus norvegicus
gtccttaaatccgtagttcacagtt

SEQ ID NO: 494913 - DNA, 25 bp, Rattus norvegicus
gtccttaagaggatgtctgtcaaag

SEQ ID NO: 494914 - DNA, 25 bp, Rattus norvegicus
gtccttaagaggttgtctgtcaaag

SEQ ID NO: 494915 - DNA, 25 bp, Rattus norvegicus
gtccttaaggaacccctgggtgcca

SEQ ID NO: 494916 - DNA, 25 bp, Rattus norvegicus
gtccttaaggaagccctgggtgcca

SEQ ID NO: 494917 - DNA, 25 bp, Rattus norvegicus
gtccttaagttcattgttctctgtc

SEQ ID NO: 494918 - DNA, 25 bp, Rattus norvegicus
gtccttaagttctttgttctctgtc

SEQ ID NO: 494919 - DNA, 25 bp, Rattus norvegicus
gtccttacaagacagcaagtgccct

SEQ ID NO: 494920 - DNA, 25 bp, Rattus norvegicus
gtccttacaagagagcaagtgccct

SEQ ID NO: 494921 - DNA, 25 bp, Rattus norvegicus
gtccttacactgctatcatgccaat

SEQ ID NO: 494922 - DNA, 25 bp, Rattus norvegicus
gtccttacactggtatcatgccaat

SEQ ID NO: 494923 - DNA, 25 bp, Rattus norvegicus
gtccttacagtgagtgctatcctta

SEQ ID NO: 494924 - DNA, 25 bp, Rattus norvegicus
gtccttacagtgtgtgctatcctta

SEQ ID NO: 494925 - DNA, 25 bp, Rattus norvegicus
gtccttacagttcctttgtcgtgga

SEQ ID NO: 494926 - DNA, 25 bp, Rattus norvegicus
gtccttacagttgctttgtcgtgga

SEQ ID NO: 494927 - DNA, 25 bp, Rattus norvegicus
gtccttacataccaacagtctttat

SEQ ID NO: 494928 - DNA, 25 bp, Rattus norvegicus
gtccttacatacgaacagtctttat

SEQ ID NO: 494929 - DNA, 25 bp, Rattus norvegicus
gtccttacttggacctggagctgag

SEQ ID NO: 494930 - DNA, 25 bp, Rattus norvegicus
gtccttacttggtcctggagctgag

SEQ ID NO: 494931 - DNA, 25 bp, Rattus norvegicus
gtccttagcaaactgatccatagaa

SEQ ID NO: 494932 - DNA, 25 bp, Rattus norvegicus
gtccttagcaaagtgatccatagaa

SEQ ID NO: 494933 - DNA, 25 bp, Rattus norvegicus
gtccttagccacctcatattttgat

SEQ ID NO: 494934 - DNA, 25 bp, Rattus norvegicus
gtccttagccacgtcatattttgat

SEQ ID NO: 494935 - DNA, 25 bp, Rattus norvegicus
gtccttagccgtcaccaatgtagca

SEQ ID NO: 494936 - DNA, 25 bp, Rattus norvegicus
gtccttagccgtgaccaatgtagca

SEQ ID NO: 494937 - DNA, 25 bp, Rattus norvegicus
gtccttagctctcccagaaagaaga

SEQ ID NO: 494938 - DNA, 25 bp, Rattus norvegicus
gtccttagctctgccagaaagaaga

SEQ ID NO: 494939 - DNA, 25 bp, Rattus norvegicus
gtccttagtctaaccacatcgggag

SEQ ID NO: 494940 - DNA, 25 bp, Rattus norvegicus
gtccttagtctatccacatcgggag

SEQ ID NO: 494941 - DNA, 25 bp, Rattus norvegicus
gtccttagtctccaattcatgggca

SEQ ID NO: 494942 - DNA, 25 bp, Rattus norvegicus
gtccttagtctcgaattcatgggca

SEQ ID NO: 494943 - DNA, 25 bp, Rattus norvegicus
gtccttagtgacaacagccaaccac

SEQ ID NO: 494944 - DNA, 25 bp, Rattus norvegicus
gtccttagtgactacagccaaccac

SEQ ID NO: 494945 - DNA, 25 bp, Rattus norvegicus
gtccttatacatatcgatgccgtgt

SEQ ID NO: 494946 - DNA, 25 bp, Rattus norvegicus
gtccttatacatttcgatgccgtgt

SEQ ID NO: 494947 - DNA, 25 bp, Rattus norvegicus
gtccttatatatagacttccagcag

SEQ ID NO: 494948 - DNA, 25 bp, Rattus norvegicus
gtccttatatattgacttccagcag

SEQ ID NO: 494949 - DNA, 25 bp, Rattus norvegicus
gtccttatccgtcactctatgggta

SEQ ID NO: 494950 - DNA, 25 bp, Rattus norvegicus
gtccttatccgtgactctatgggta

SEQ ID NO: 494951 - DNA, 25 bp, Rattus norvegicus
gtccttatctgtactgaacattcac

SEQ ID NO: 494952 - DNA, 25 bp, Rattus norvegicus
gtccttatctgttctgaacattcac

SEQ ID NO: 494953 - DNA, 25 bp, Rattus norvegicus
gtccttatgcttacgtggtgagcac

SEQ ID NO: 494954 - DNA, 25 bp, Rattus norvegicus
gtccttatgctttcgtggtgagcac

SEQ ID NO: 494955 - DNA, 25 bp, Rattus norvegicus
gtccttatggacagtggatacctgt

SEQ ID NO: 494956 - DNA, 25 bp, Rattus norvegicus
gtccttatggactgtggatacctgt

SEQ ID NO: 494957 - DNA, 25 bp, Rattus norvegicus
gtccttatgtgcatgaaactgccaa

SEQ ID NO: 494958 - DNA, 25 bp, Rattus norvegicus
gtccttatgtgcttgaaactgccaa

SEQ ID NO: 494959 - DNA, 25 bp, Rattus norvegicus
gtccttattggccaactgtactcaa

SEQ ID NO: 494960 - DNA, 25 bp, Rattus norvegicus
gtccttattggcgaactgtactcaa

SEQ ID NO: 494961 - DNA, 25 bp, Rattus norvegicus
gtccttattttaagtcctgtaaatt

SEQ ID NO: 494962 - DNA, 25 bp, Rattus norvegicus
gtccttattttatgtcctgtaaatt

SEQ ID NO: 494963 - DNA, 25 bp, Rattus norvegicus
gtccttcaagaaatgtattagtgtt

SEQ ID NO: 494964 - DNA, 25 bp, Rattus norvegicus
gtccttcaagaattgtattagtgtt

SEQ ID NO: 494965 - DNA, 25 bp, Rattus norvegicus
gtccttcaagatacccttcttaaca

SEQ ID NO: 494966 - DNA, 25 bp, Rattus norvegicus
gtccttcaagattcccttcttaaca

SEQ ID NO: 494967 - DNA, 25 bp, Rattus norvegicus
gtccttcacatcagtcaaatctgca

SEQ ID NO: 494968 - DNA, 25 bp, Rattus norvegicus
gtccttcacatctgtcaaatctgca

SEQ ID NO: 494969 - DNA, 25 bp, Rattus norvegicus
gtccttcacttccttgagtattatg

SEQ ID NO: 494970 - DNA, 25 bp, Rattus norvegicus
gtccttcacttcgttgagtattatg

SEQ ID NO: 494971 - DNA, 25 bp, Rattus norvegicus
gtccttcagactcctttcatagttt

SEQ ID NO: 494972 - DNA, 25 bp, Rattus norvegicus
gtccttcagactgctttcatagttt

SEQ ID NO: 494973 - DNA, 25 bp, Rattus norvegicus
gtccttcagcctcaccaggaatcag

SEQ ID NO: 494974 - DNA, 25 bp, Rattus norvegicus
gtccttcagcctgaccaggaatcag

SEQ ID NO: 494975 - DNA, 25 bp, Rattus norvegicus
gtccttcaggctaattcctgtcatt

SEQ ID NO: 494976 - DNA, 25 bp, Rattus norvegicus
gtccttcaggcttattcctgtcatt

SEQ ID NO: 494977 - DNA, 25 bp, Rattus norvegicus
gtccttcagggcagcaggagtcaga

SEQ ID NO: 494978 - DNA, 25 bp, Rattus norvegicus
gtccttcagggctgcaggagtcaga

SEQ ID NO: 494979 - DNA, 25 bp, Rattus norvegicus
gtccttcagtgcagataaaccactc

SEQ ID NO: 494980 - DNA, 25 bp, Rattus norvegicus
gtccttcagtgctgataaaccactc

SEQ ID NO: 494981 - DNA, 25 bp, Rattus norvegicus
gtccttcatccccatgttattacca

SEQ ID NO: 494982 - DNA, 25 bp, Rattus norvegicus
gtccttcatcccgatgttattacca

SEQ ID NO: 494983 - DNA, 25 bp, Rattus norvegicus
gtccttcattccatcctgtatgtga

SEQ ID NO: 494984 - DNA, 25 bp, Rattus norvegicus
gtccttcattccttcctgtatgtga

SEQ ID NO: 494985 - DNA, 25 bp, Rattus norvegicus
gtccttccagatatggtgttagcac

SEQ ID NO: 494986 - DNA, 25 bp, Rattus norvegicus
gtccttccagatttggtgttagcac

SEQ ID NO: 494987 - DNA, 25 bp, Rattus norvegicus
gtccttcccatcagtgctgttttat

SEQ ID NO: 494988 - DNA, 25 bp, Rattus norvegicus
gtccttcccatctgtgctgttttat

SEQ ID NO: 494989 - DNA, 25 bp, Rattus norvegicus
gtccttccccagatggaattcgtag

SEQ ID NO: 494990 - DNA, 25 bp, Rattus norvegicus
gtccttccccagttggaattcgtag

SEQ ID NO: 494991 - DNA, 25 bp, Rattus norvegicus
gtccttcccgtgacgtttgtagata

SEQ ID NO: 494992 - DNA, 25 bp, Rattus norvegicus
gtccttcccgtgtcgtttgtagata

SEQ ID NO: 494993 - DNA, 25 bp, Rattus norvegicus
gtccttcccttcactcatggagaag

SEQ ID NO: 494994 - DNA, 25 bp, Rattus norvegicus
gtccttcccttcatgtgagttgttt

SEQ ID NO: 494995 - DNA, 25 bp, Rattus norvegicus
gtccttcccttctctcatggagaag

SEQ ID NO: 494996 - DNA, 25 bp, Rattus norvegicus
gtccttcccttcttgtgagttgttt

SEQ ID NO: 494997 - DNA, 25 bp, Rattus norvegicus
gtccttccggatcttgctatttaat

SEQ ID NO: 494998 - DNA, 25 bp, Rattus norvegicus
gtccttccggatgttgctatttaat

SEQ ID NO: 494999 - DNA, 25 bp, Rattus norvegicus
gtccttcctgaaactatattttgtc

SEQ ID NO: 495000 - DNA, 25 bp, Rattus norvegicus
gtccttcctgaatctatattttgtc

SEQ ID NO: 495001 - DNA, 25 bp, Rattus norvegicus
gtccttcctgagacttcattcaaaa

SEQ ID NO: 495002 - DNA, 25 bp, Rattus norvegicus
gtccttcctgagtcttcattcaaaa

SEQ ID NO: 495003 - DNA, 25 bp, Rattus norvegicus
gtccttccttccctatgtatttgaa

SEQ ID NO: 495004 - DNA, 25 bp, Rattus norvegicus
gtccttccttccgtatgtatttgaa

SEQ ID NO: 495005 - DNA, 25 bp, Rattus norvegicus
gtccttcctttcaaagtccaacact

SEQ ID NO: 495006 - DNA, 25 bp, Rattus norvegicus
gtccttcctttctaagtccaacact

SEQ ID NO: 495007 - DNA, 25 bp, Rattus norvegicus
gtccttcgcaggaatctgggattgc

SEQ ID NO: 495008 - DNA, 25 bp, Rattus norvegicus
gtccttcgcaggtatctgggattgc

SEQ ID NO: 495009 - DNA, 25 bp, Rattus norvegicus
gtccttcgcataaatgggagcttcc

SEQ ID NO: 495010 - DNA, 25 bp, Rattus norvegicus
gtccttcgcatatatgggagcttcc

SEQ ID NO: 495011 - DNA, 25 bp, Rattus norvegicus
gtccttcgcattacagattctttag

SEQ ID NO: 495012 - DNA, 25 bp, Rattus norvegicus
gtccttcgcatttcagattctttag

SEQ ID NO: 495013 - DNA, 25 bp, Rattus norvegicus
gtccttcgctctcaaatgcaaacag

SEQ ID NO: 495014 - DNA, 25 bp, Rattus norvegicus
gtccttcgctctgaaatgcaaacag

SEQ ID NO: 495015 - DNA, 25 bp, Rattus norvegicus
gtccttctacaaaatttgctctggt

SEQ ID NO: 495016 - DNA, 25 bp, Rattus norvegicus
gtccttctacaatatttgctctggt

SEQ ID NO: 495017 - DNA, 25 bp, Rattus norvegicus
gtccttctatttcgtgtatattatc

SEQ ID NO: 495018 - DNA, 25 bp, Rattus norvegicus
gtccttctatttggtgtatattatc

SEQ ID NO: 495019 - DNA, 25 bp, Rattus norvegicus
gtccttctgatgacacgctgttgga

SEQ ID NO: 495020 - DNA, 25 bp, Rattus norvegicus
gtccttctgatgtcacgctgttgga

SEQ ID NO: 495021 - DNA, 25 bp, Rattus norvegicus
gtccttctggacatcctgaattgga

SEQ ID NO: 495022 - DNA, 25 bp, Rattus norvegicus
gtccttctggacttcctgaattgga

SEQ ID NO: 495023 - DNA, 25 bp, Rattus norvegicus
gtccttctgggcactgacatctcaa

SEQ ID NO: 495024 - DNA, 25 bp, Rattus norvegicus
gtccttctgggctctgacatctcaa

SEQ ID NO: 495025 - DNA, 25 bp, Rattus norvegicus
gtccttctgtcaagttttgtgatgg

SEQ ID NO: 495026 - DNA, 25 bp, Rattus norvegicus
gtccttctgtcatgttttgtgatgg

SEQ ID NO: 495027 - DNA, 25 bp, Rattus norvegicus
gtccttctgtgcagatcctggatat

SEQ ID NO: 495028 - DNA, 25 bp, Rattus norvegicus
gtccttctgtgctgatcctggatat

SEQ ID NO: 495029 - DNA, 25 bp, Rattus norvegicus
gtccttcttcttcctgagacgagga

SEQ ID NO: 495030 - DNA, 25 bp, Rattus norvegicus
gtccttcttcttgctgagacgagga

SEQ ID NO: 495031 - DNA, 25 bp, Rattus norvegicus
gtccttctttacatgactttgggca

SEQ ID NO: 495032 - DNA, 25 bp, Rattus norvegicus
gtccttctttacttgactttgggca

SEQ ID NO: 495033 - DNA, 25 bp, Rattus norvegicus
gtccttctttctacatttcgttttg

SEQ ID NO: 495034 - DNA, 25 bp, Rattus norvegicus
gtccttctttcttcatttcgttttg

SEQ ID NO: 495035 - DNA, 25 bp, Rattus norvegicus
gtccttgaaataactgtggtgtaat

SEQ ID NO: 495036 - DNA, 25 bp, Rattus norvegicus
gtccttgaaatatctgtggtgtaat

SEQ ID NO: 495037 - DNA, 25 bp, Rattus norvegicus
gtccttgaaattagactgtcatcat

SEQ ID NO: 495038 - DNA, 25 bp, Rattus norvegicus
gtccttgaaatttgactgtcatcat

SEQ ID NO: 495039 - DNA, 25 bp, Rattus norvegicus
gtccttgaacgaactcggcgcggcg

SEQ ID NO: 495040 - DNA, 25 bp, Rattus norvegicus
gtccttgaacgatctcggcgcggcg

SEQ ID NO: 495041 - DNA, 25 bp, Rattus norvegicus
gtccttgaagtcacaggtgtttttc

SEQ ID NO: 495042 - DNA, 25 bp, Rattus norvegicus
gtccttgaagtctcaggtgtttttc

SEQ ID NO: 495043 - DNA, 25 bp, Rattus norvegicus
gtccttgaccagatgtgaccttata

SEQ ID NO: 495044 - DNA, 25 bp, Rattus norvegicus
gtccttgaccagttgtgaccttata

SEQ ID NO: 495045 - DNA, 25 bp, Rattus norvegicus
gtccttgacctgcaaacctatggga

SEQ ID NO: 495046 - DNA, 25 bp, Rattus norvegicus
gtccttgacctgcactatggcttag

SEQ ID NO: 495047 - DNA, 25 bp, Rattus norvegicus
gtccttgacctggaaacctatggga

SEQ ID NO: 495048 - DNA, 25 bp, Rattus norvegicus
gtccttgacctggactatggcttag

SEQ ID NO: 495049 - DNA, 25 bp, Rattus norvegicus
gtccttgagtttactctttctttat

SEQ ID NO: 495050 - DNA, 25 bp, Rattus norvegicus
gtccttgagttttctctttctttat

SEQ ID NO: 495051 - DNA, 25 bp, Rattus norvegicus
gtccttgataaacctatggccacag

SEQ ID NO: 495052 - DNA, 25 bp, Rattus norvegicus
gtccttgataaagctatggccacag

SEQ ID NO: 495053 - DNA, 25 bp, Rattus norvegicus
gtccttgatcaacaccgtatatttg

SEQ ID NO: 495054 - DNA, 25 bp, Rattus norvegicus
gtccttgatcaagaccgtatatttg

SEQ ID NO: 495055 - DNA, 25 bp, Rattus norvegicus
gtccttgatcctcagtcgcagagtt

SEQ ID NO: 495056 - DNA, 25 bp, Rattus norvegicus
gtccttgatcctgagtcgcagagtt

SEQ ID NO: 495057 - DNA, 25 bp, Rattus norvegicus
gtccttgattgtatactgcagtcca

SEQ ID NO: 495058 - DNA, 25 bp, Rattus norvegicus
gtccttgattgtttactgcagtcca

SEQ ID NO: 495059 - DNA, 25 bp, Rattus norvegicus
gtccttgcagagagcatgaccattt

SEQ ID NO: 495060 - DNA, 25 bp, Rattus norvegicus
gtccttgcagagtgcatgaccattt

SEQ ID NO: 495061 - DNA, 25 bp, Rattus norvegicus
gtccttgcagcaatatagttcttgg

SEQ ID NO: 495062 - DNA, 25 bp, Rattus norvegicus
gtccttgcagcaatttttacagaaa

SEQ ID NO: 495063 - DNA, 25 bp, Rattus norvegicus
gtccttgcagcattatagttcttgg

SEQ ID NO: 495064 - DNA, 25 bp, Rattus norvegicus
gtccttgcagcattttttacagaaa

SEQ ID NO: 495065 - DNA, 25 bp, Rattus norvegicus
gtccttgcaggcatctgaagaccaa

SEQ ID NO: 495066 - DNA, 25 bp, Rattus norvegicus
gtccttgcaggcttctgaagaccaa

SEQ ID NO: 495067 - DNA, 25 bp, Rattus norvegicus
gtccttgcatgcaggacatggccac

SEQ ID NO: 495068 - DNA, 25 bp, Rattus norvegicus
gtccttgcatgctggacatggccac

SEQ ID NO: 495069 - DNA, 25 bp, Rattus norvegicus
gtccttgccaaaatgtttctgtctt

SEQ ID NO: 495070 - DNA, 25 bp, Rattus norvegicus
gtccttgccaaattgtttctgtctt

SEQ ID NO: 495071 - DNA, 25 bp, Rattus norvegicus
gtccttgccactaccaaatgacaaa

SEQ ID NO: 495072 - DNA, 25 bp, Rattus norvegicus
gtccttgccacttccaaatgacaaa

SEQ ID NO: 495073 - DNA, 25 bp, Rattus norvegicus
gtccttgccctaaatggattctaat

SEQ ID NO: 495074 - DNA, 25 bp, Rattus norvegicus
gtccttgccctatatggattctaat

SEQ ID NO: 495075 - DNA, 25 bp, Rattus norvegicus
gtccttgctgggacctgcagaggaa

SEQ ID NO: 495076 - DNA, 25 bp, Rattus norvegicus
gtccttgctgggagatgtcactagg

SEQ ID NO: 495077 - DNA, 25 bp, Rattus norvegicus
gtccttgctgggtcctgcagaggaa

SEQ ID NO: 495078 - DNA, 25 bp, Rattus norvegicus
gtccttgctgggtgatgtcactagg

SEQ ID NO: 495079 - DNA, 25 bp, Rattus norvegicus
gtccttgctttgctcctggaaataa

SEQ ID NO: 495080 - DNA, 25 bp, Rattus norvegicus
gtccttgctttggtcctggaaataa

SEQ ID NO: 495081 - DNA, 25 bp, Rattus norvegicus
gtccttggaacccacttgcgaaagt

SEQ ID NO: 495082 - DNA, 25 bp, Rattus norvegicus
gtccttggaaccgacttgcgaaagt

SEQ ID NO: 495083 - DNA, 25 bp, Rattus norvegicus
gtccttggaacgcacagcattacag

SEQ ID NO: 495084 - DNA, 25 bp, Rattus norvegicus
gtccttggaacggacagcattacag

SEQ ID NO: 495085 - DNA, 25 bp, Rattus norvegicus
gtccttggaggcaggagacacccac

SEQ ID NO: 495086 - DNA, 25 bp, Rattus norvegicus
gtccttggaggctggagacacccac

SEQ ID NO: 495087 - DNA, 25 bp, Rattus norvegicus
gtccttggccagattctggtactaa

SEQ ID NO: 495088 - DNA, 25 bp, Rattus norvegicus
gtccttggccagtttctggtactaa

SEQ ID NO: 495089 - DNA, 25 bp, Rattus norvegicus
gtccttggccttcaaactgcagagg

SEQ ID NO: 495090 - DNA, 25 bp, Rattus norvegicus
gtccttggccttgaaactgcagagg

SEQ ID NO: 495091 - DNA, 25 bp, Rattus norvegicus
gtccttggcgtaattttccactcta

SEQ ID NO: 495092 - DNA, 25 bp, Rattus norvegicus
gtccttggcgtatttttccactcta

SEQ ID NO: 495093 - DNA, 25 bp, Rattus norvegicus
gtccttggcttgaagaggcaccagt

SEQ ID NO: 495094 - DNA, 25 bp, Rattus norvegicus
gtccttggcttgcatagatgtttcc

SEQ ID NO: 495095 - DNA, 25 bp, Rattus norvegicus
gtccttggcttggatagatgtttcc

SEQ ID NO: 495096 - DNA, 25 bp, Rattus norvegicus
gtccttggcttgtagaggcaccagt

SEQ ID NO: 495097 - DNA, 25 bp, Rattus norvegicus
gtccttgggcttaggaaccaagcct

SEQ ID NO: 495098 - DNA, 25 bp, Rattus norvegicus
gtccttgggctttggaaccaagcct

SEQ ID NO: 495099 - DNA, 25 bp, Rattus norvegicus
gtccttgggtgccacagttgaagac

SEQ ID NO: 495100 - DNA, 25 bp, Rattus norvegicus
gtccttgggtgcgacagttgaagac

SEQ ID NO: 495101 - DNA, 25 bp, Rattus norvegicus
gtccttgggttaacctgtttacaat

SEQ ID NO: 495102 - DNA, 25 bp, Rattus norvegicus
gtccttgggttatcctgtttacaat

SEQ ID NO: 495103 - DNA, 25 bp, Rattus norvegicus
gtccttggtcacactctatgggaaa

SEQ ID NO: 495104 - DNA, 25 bp, Rattus norvegicus
gtccttggtcactctctatgggaaa

SEQ ID NO: 495105 - DNA, 25 bp, Rattus norvegicus
gtccttggtgtcacagggctctcgg

SEQ ID NO: 495106 - DNA, 25 bp, Rattus norvegicus
gtccttggtgtctcagggctctcgg

SEQ ID NO: 495107 - DNA, 25 bp, Rattus norvegicus
gtccttgtaaagaaaatcctatcgg

SEQ ID NO: 495108 - DNA, 25 bp, Rattus norvegicus
gtccttgtaaagtaaatcctatcgg

SEQ ID NO: 495109 - DNA, 25 bp, Rattus norvegicus
gtccttgtaaatagcttcccagttg

SEQ ID NO: 495110 - DNA, 25 bp, Rattus norvegicus
gtccttgtaaattgcttcccagttg

SEQ ID NO: 495111 - DNA, 25 bp, Rattus norvegicus
gtccttgtacctcaagggcttaccg

SEQ ID NO: 495112 - DNA, 25 bp, Rattus norvegicus
gtccttgtacctcctggaattattg

SEQ ID NO: 495113 - DNA, 25 bp, Rattus norvegicus
gtccttgtacctgaagggcttaccg

SEQ ID NO: 495114 - DNA, 25 bp, Rattus norvegicus
gtccttgtacctgctggaattattg

SEQ ID NO: 495115 - DNA, 25 bp, Rattus norvegicus
gtccttgtacttacacaaacgtctc

SEQ ID NO: 495116 - DNA, 25 bp, Rattus norvegicus
gtccttgtacttcgaggtttctctt

SEQ ID NO: 495117 - DNA, 25 bp, Rattus norvegicus
gtccttgtacttggaggtttctctt

SEQ ID NO: 495118 - DNA, 25 bp, Rattus norvegicus
gtccttgtactttcacaaacgtctc

SEQ ID NO: 495119 - DNA, 25 bp, Rattus norvegicus
gtccttgtaggcactgttttaagaa

SEQ ID NO: 495120 - DNA, 25 bp, Rattus norvegicus
gtccttgtaggctctgttttaagaa

SEQ ID NO: 495121 - DNA, 25 bp, Rattus norvegicus
gtccttgtcaagctctgttttttga

SEQ ID NO: 495122 - DNA, 25 bp, Rattus norvegicus
gtccttgtcaaggtctgttttttga

SEQ ID NO: 495123 - DNA, 25 bp, Rattus norvegicus
gtccttgtcaatctttgttttttct

SEQ ID NO: 495124 - DNA, 25 bp, Rattus norvegicus
gtccttgtcaatgtttgttttttct

SEQ ID NO: 495125 - DNA, 25 bp, Rattus norvegicus
gtccttgtcaggaactggttgaacc

SEQ ID NO: 495126 - DNA, 25 bp, Rattus norvegicus
gtccttgtcaggtactggttgaacc

SEQ ID NO: 495127 - DNA, 25 bp, Rattus norvegicus
gtccttgtcatcagtgcgagtttat

SEQ ID NO: 495128 - DNA, 25 bp, Rattus norvegicus
gtccttgtcatctgtgcgagtttat

SEQ ID NO: 495129 - DNA, 25 bp, Rattus norvegicus
gtccttgtcattacattgttcactc

SEQ ID NO: 495130 - DNA, 25 bp, Rattus norvegicus
gtccttgtcatttcattgttcactc

SEQ ID NO: 495131 - DNA, 25 bp, Rattus norvegicus
gtccttgtccaaccctggtctatgt

SEQ ID NO: 495132 - DNA, 25 bp, Rattus norvegicus
gtccttgtccaagcctggtctatgt

SEQ ID NO: 495133 - DNA, 25 bp, Rattus norvegicus
gtccttgtcgggacttgtcggtcgt

SEQ ID NO: 495134 - DNA, 25 bp, Rattus norvegicus
gtccttgtcgggtcttgtcggtcgt

SEQ ID NO: 495135 - DNA, 25 bp, Rattus norvegicus
gtccttgtctcaaccctggggctgg

SEQ ID NO: 495136 - DNA, 25 bp, Rattus norvegicus
gtccttgtctcatccctggggctgg

SEQ ID NO: 495137 - DNA, 25 bp, Rattus norvegicus
gtccttgtgattaatcctcattgtc

SEQ ID NO: 495138 - DNA, 25 bp, Rattus norvegicus
gtccttgtgattattctgttcttag

SEQ ID NO: 495139 - DNA, 25 bp, Rattus norvegicus
gtccttgtgatttatcctcattgtc

SEQ ID NO: 495140 - DNA, 25 bp, Rattus norvegicus
gtccttgtgatttttctgttcttag

SEQ ID NO: 495141 - DNA, 25 bp, Rattus norvegicus
gtccttgtgcttactgcaggttgta

SEQ ID NO: 495142 - DNA, 25 bp, Rattus norvegicus
gtccttgtgctttctgcaggttgta

SEQ ID NO: 495143 - DNA, 25 bp, Rattus norvegicus
gtccttgtggacactaggcaccggt

SEQ ID NO: 495144 - DNA, 25 bp, Rattus norvegicus
gtccttgtggactctaggcaccggt

SEQ ID NO: 495145 - DNA, 25 bp, Rattus norvegicus
gtccttgtgtacatttccctgaaaa

SEQ ID NO: 495146 - DNA, 25 bp, Rattus norvegicus
gtccttgtgtacttttccctgaaaa

SEQ ID NO: 495147 - DNA, 25 bp, Rattus norvegicus
gtccttgttctcagttcttaggagg

SEQ ID NO: 495148 - DNA, 25 bp, Rattus norvegicus
gtccttgttctctgttcttaggagg

SEQ ID NO: 495149 - DNA, 25 bp, Rattus norvegicus
gtccttgttggaactactctgtagt

SEQ ID NO: 495150 - DNA, 25 bp, Rattus norvegicus
gtccttgttggatctactctgtagt

SEQ ID NO: 495151 - DNA, 25 bp, Rattus norvegicus
gtccttgtttagaagttaagcacct

SEQ ID NO: 495152 - DNA, 25 bp, Rattus norvegicus
gtccttgtttagtagttaagcacct

SEQ ID NO: 495153 - DNA, 25 bp, Rattus norvegicus
gtcctttaaacacaggaacccagtg

SEQ ID NO: 495154 - DNA, 25 bp, Rattus norvegicus
gtcctttaaacagaggaacccagtg

SEQ ID NO: 495155 - DNA, 25 bp, Rattus norvegicus
gtcctttacaaaagtgtgccatgct

SEQ ID NO: 495156 - DNA, 25 bp, Rattus norvegicus
gtcctttacaaatgtgtgccatgct

SEQ ID NO: 495157 - DNA, 25 bp, Rattus norvegicus
gtcctttaccgacgcttcaaaaatg

SEQ ID NO: 495158 - DNA, 25 bp, Rattus norvegicus
gtcctttaccgaggcttcaaaaatg

SEQ ID NO: 495159 - DNA, 25 bp, Rattus norvegicus
gtcctttactagaatgtgagctcct

SEQ ID NO: 495160 - DNA, 25 bp, Rattus norvegicus
gtcctttactagtatgtgagctcct

SEQ ID NO: 495161 - DNA, 25 bp, Rattus norvegicus
gtcctttagcttcagcttgccctga

SEQ ID NO: 495162 - DNA, 25 bp, Rattus norvegicus
gtcctttagcttgagcttgccctga

SEQ ID NO: 495163 - DNA, 25 bp, Rattus norvegicus
gtcctttatgttacagatagtacca

SEQ ID NO: 495164 - DNA, 25 bp, Rattus norvegicus
gtcctttatgtttcagatagtacca

SEQ ID NO: 495165 - DNA, 25 bp, Rattus norvegicus
gtcctttattccctctaacaatgat

SEQ ID NO: 495166 - DNA, 25 bp, Rattus norvegicus
gtcctttattccgtctaacaatgat

SEQ ID NO: 495167 - DNA, 25 bp, Rattus norvegicus
gtcctttcaaaacaggccatctaag

SEQ ID NO: 495168 - DNA, 25 bp, Rattus norvegicus
gtcctttcaaaagaggccatctaag

SEQ ID NO: 495169 - DNA, 25 bp, Rattus norvegicus
gtcctttcacacagcagtgctgaat

SEQ ID NO: 495170 - DNA, 25 bp, Rattus norvegicus
gtcctttcacactgcagtgctgaat

SEQ ID NO: 495171 - DNA, 25 bp, Rattus norvegicus
gtcctttccacaatccatcagtaaa

SEQ ID NO: 495172 - DNA, 25 bp, Rattus norvegicus
gtcctttccacattccatcagtaaa

SEQ ID NO: 495173 - DNA, 25 bp, Rattus norvegicus
gtcctttccatcagtggctgggcag

SEQ ID NO: 495174 - DNA, 25 bp, Rattus norvegicus
gtcctttccatctgtggctgggcag

SEQ ID NO: 495175 - DNA, 25 bp, Rattus norvegicus
gtcctttcccctcttgagttgaaat

SEQ ID NO: 495176 - DNA, 25 bp, Rattus norvegicus
gtcctttcccctgttgagttgaaat

SEQ ID NO: 495177 - DNA, 25 bp, Rattus norvegicus
gtcctttcctacagtatgtgagcca

SEQ ID NO: 495178 - DNA, 25 bp, Rattus norvegicus
gtcctttcctactgtatgtgagcca

SEQ ID NO: 495179 - DNA, 25 bp, Rattus norvegicus
gtcctttcctgcataagaaccatgt

SEQ ID NO: 495180 - DNA, 25 bp, Rattus norvegicus
gtcctttcctgcttaagaaccatgt

SEQ ID NO: 495181 - DNA, 25 bp, Rattus norvegicus
gtcctttcctgtactttatctggga

SEQ ID NO: 495182 - DNA, 25 bp, Rattus norvegicus
gtcctttcctgttctttatctggga

SEQ ID NO: 495183 - DNA, 25 bp, Rattus norvegicus
gtcctttccttgaaccacagtgaag

SEQ ID NO: 495184 - DNA, 25 bp, Rattus norvegicus
gtcctttccttgcagtgttgtttag

SEQ ID NO: 495185 - DNA, 25 bp, Rattus norvegicus
gtcctttccttggagtgttgtttag

SEQ ID NO: 495186 - DNA, 25 bp, Rattus norvegicus
gtcctttccttgtaccacagtgaag

SEQ ID NO: 495187 - DNA, 25 bp, Rattus norvegicus
gtcctttcgattctagctgctgagc

SEQ ID NO: 495188 - DNA, 25 bp, Rattus norvegicus
gtcctttcgattgtagctgctgagc

SEQ ID NO: 495189 - DNA, 25 bp, Rattus norvegicus
gtcctttctccaagttttcagctat

SEQ ID NO: 495190 - DNA, 25 bp, Rattus norvegicus
gtcctttctccatgttttcagctat

SEQ ID NO: 495191 - DNA, 25 bp, Rattus norvegicus
gtcctttctcgccagcacagggagc

SEQ ID NO: 495192 - DNA, 25 bp, Rattus norvegicus
gtcctttctcgcgagcacagggagc

SEQ ID NO: 495193 - DNA, 25 bp, Rattus norvegicus
gtcctttctgttcagttacttgtcg

SEQ ID NO: 495194 - DNA, 25 bp, Rattus norvegicus
gtcctttctgttgagttacttgtcg

SEQ ID NO: 495195 - DNA, 25 bp, Rattus norvegicus
gtcctttcttgcacgaatgtcatag

SEQ ID NO: 495196 - DNA, 25 bp, Rattus norvegicus
gtcctttcttgctcgaatgtcatag

SEQ ID NO: 495197 - DNA, 25 bp, Rattus norvegicus
gtcctttgaaccaggatggagccca

SEQ ID NO: 495198 - DNA, 25 bp, Rattus norvegicus
gtcctttgaacctggatggagccca

SEQ ID NO: 495199 - DNA, 25 bp, Rattus norvegicus
gtcctttgaccaccacacatagata

SEQ ID NO: 495200 - DNA, 25 bp, Rattus norvegicus
gtcctttgaccagcacacatagata

SEQ ID NO: 495201 - DNA, 25 bp, Rattus norvegicus
gtcctttgatgcctgacaagaccgt

SEQ ID NO: 495202 - DNA, 25 bp, Rattus norvegicus
gtcctttgatgcgtgacaagaccgt

SEQ ID NO: 495203 - DNA, 25 bp, Rattus norvegicus
gtcctttgcctcacttgcttattta

SEQ ID NO: 495204 - DNA, 25 bp, Rattus norvegicus
gtcctttgcctcattaataatgtgt

SEQ ID NO: 495205 - DNA, 25 bp, Rattus norvegicus
gtcctttgcctctcttgcttattta

SEQ ID NO: 495206 - DNA, 25 bp, Rattus norvegicus
gtcctttgcctctttaataatgtgt

SEQ ID NO: 495207 - DNA, 25 bp, Rattus norvegicus
gtcctttgctccatgccagtatgaa

SEQ ID NO: 495208 - DNA, 25 bp, Rattus norvegicus
gtcctttgctccttgccagtatgaa

SEQ ID NO: 495209 - DNA, 25 bp, Rattus norvegicus
gtcctttggcaactgagacatctaa

SEQ ID NO: 495210 - DNA, 25 bp, Rattus norvegicus
gtcctttggcaagtgagacatctaa

SEQ ID NO: 495211 - DNA, 25 bp, Rattus norvegicus
gtcctttggccgcactaactttaat

SEQ ID NO: 495212 - DNA, 25 bp, Rattus norvegicus
gtcctttggccggactaactttaat

SEQ ID NO: 495213 - DNA, 25 bp, Rattus norvegicus
gtcctttgggatctcattttgtcca

SEQ ID NO: 495214 - DNA, 25 bp, Rattus norvegicus
gtcctttgggatgtcattttgtcca

SEQ ID NO: 495215 - DNA, 25 bp, Rattus norvegicus
gtcctttggtctccattgagagttg

SEQ ID NO: 495216 - DNA, 25 bp, Rattus norvegicus
gtcctttggtctgcattgagagttg

SEQ ID NO: 495217 - DNA, 25 bp, Rattus norvegicus
gtcctttgtagcaattaaatgcatt

SEQ ID NO: 495218 - DNA, 25 bp, Rattus norvegicus
gtcctttgtagctattaaatgcatt

SEQ ID NO: 495219 - DNA, 25 bp, Rattus norvegicus
gtcctttgtggtaacatgaagttta

SEQ ID NO: 495220 - DNA, 25 bp, Rattus norvegicus
gtcctttgtggttacatgaagttta

SEQ ID NO: 495221 - DNA, 25 bp, Rattus norvegicus
gtcctttgttctatttattgcgttg

SEQ ID NO: 495222 - DNA, 25 bp, Rattus norvegicus
gtcctttgttctttttattgcgttg

SEQ ID NO: 495223 - DNA, 25 bp, Rattus norvegicus
gtccttttaggtaggcttatgatct

SEQ ID NO: 495224 - DNA, 25 bp, Rattus norvegicus
gtccttttaggttggcttatgatct

SEQ ID NO: 495225 - DNA, 25 bp, Rattus norvegicus
gtccttttagtcagtggccttcgtg

SEQ ID NO: 495226 - DNA, 25 bp, Rattus norvegicus
gtccttttagtctgtggccttcgtg

SEQ ID NO: 495227 - DNA, 25 bp, Rattus norvegicus
gtccttttatccacttgtgtattca

SEQ ID NO: 495228 - DNA, 25 bp, Rattus norvegicus
gtccttttatcctcttgtgtattca

SEQ ID NO: 495229 - DNA, 25 bp, Rattus norvegicus
gtccttttcgatctctccttctaaa

SEQ ID NO: 495230 - DNA, 25 bp, Rattus norvegicus
gtccttttcgatgtctccttctaaa

SEQ ID NO: 495231 - DNA, 25 bp, Rattus norvegicus
gtccttttgaatattgcacagccct

SEQ ID NO: 495232 - DNA, 25 bp, Rattus norvegicus
gtccttttgaattttgcacagccct

SEQ ID NO: 495233 - DNA, 25 bp, Rattus norvegicus
gtccttttgaccagtaacaatgacg

SEQ ID NO: 495234 - DNA, 25 bp, Rattus norvegicus
gtccttttgacctgtaacaatgacg

SEQ ID NO: 495235 - DNA, 25 bp, Rattus norvegicus
gtccttttgctgaggaggacagcct

SEQ ID NO: 495236 - DNA, 25 bp, Rattus norvegicus
gtccttttgctgtggaggacagcct

SEQ ID NO: 495237 - DNA, 25 bp, Rattus norvegicus
gtccttttgttcatagtgtgtgtct

SEQ ID NO: 495238 - DNA, 25 bp, Rattus norvegicus
gtccttttgttcttagtgtgtgtct

SEQ ID NO: 495239 - DNA, 25 bp, Rattus norvegicus
gtcctttttaagatcccagtgaata

SEQ ID NO: 495240 - DNA, 25 bp, Rattus norvegicus
gtcctttttaagttcccagtgaata

SEQ ID NO: 495241 - DNA, 25 bp, Rattus norvegicus
gtcctttttctaatgtattcagtcc

SEQ ID NO: 495242 - DNA, 25 bp, Rattus norvegicus
gtcctttttctactttgcttggcat

SEQ ID NO: 495243 - DNA, 25 bp, Rattus norvegicus
gtcctttttctagtttgcttggcat

SEQ ID NO: 495244 - DNA, 25 bp, Rattus norvegicus
gtcctttttctattgtattcagtcc

SEQ ID NO: 495245 - DNA, 25 bp, Rattus norvegicus
gtcctttttgacacagcaaactatt

SEQ ID NO: 495246 - DNA, 25 bp, Rattus norvegicus
gtcctttttgactcagcaaactatt

SEQ ID NO: 495247 - DNA, 25 bp, Rattus norvegicus
gtcgaaaaagctaggcccagcagcg

SEQ ID NO: 495248 - DNA, 25 bp, Rattus norvegicus
gtcgaaaaagcttggcccagcagcg

SEQ ID NO: 495249 - DNA, 25 bp, Rattus norvegicus
gtcgaaccccagacacaaggtaaag

SEQ ID NO: 495250 - DNA, 25 bp, Rattus norvegicus
gtcgaaccccagtcacaaggtaaag

SEQ ID NO: 495251 - DNA, 25 bp, Rattus norvegicus
gtcgaacctggaattgtcctttggt

SEQ ID NO: 495252 - DNA, 25 bp, Rattus norvegicus
gtcgaacctggatttgtcctttggt

SEQ ID NO: 495253 - DNA, 25 bp, Rattus norvegicus
gtcgaacgactgaagcggtggccca

SEQ ID NO: 495254 - DNA, 25 bp, Rattus norvegicus
gtcgaacgactgtagcggtggccca

SEQ ID NO: 495255 - DNA, 25 bp, Rattus norvegicus
gtcgaagaagaactcgtcgcggctc

SEQ ID NO: 495256 - DNA, 25 bp, Rattus norvegicus
gtcgaagaagaagtcgtcgcggctc

SEQ ID NO: 495257 - DNA, 25 bp, Rattus norvegicus
gtcgaagcatggaccttccagatga

SEQ ID NO: 495258 - DNA, 25 bp, Rattus norvegicus
gtcgaagcatggtccttccagatga

SEQ ID NO: 495259 - DNA, 25 bp, Rattus norvegicus
gtcgaaggcttgctcttgtcaaata

SEQ ID NO: 495260 - DNA, 25 bp, Rattus norvegicus
gtcgaaggcttggtcttgtcaaata

SEQ ID NO: 495261 - DNA, 25 bp, Rattus norvegicus
gtcgaagtacagactgtcccctggg

SEQ ID NO: 495262 - DNA, 25 bp, Rattus norvegicus
gtcgaagtacagtctgtcccctggg

SEQ ID NO: 495263 - DNA, 25 bp, Rattus norvegicus
gtcgaagtgcctcgtggattcctaa

SEQ ID NO: 495264 - DNA, 25 bp, Rattus norvegicus
gtcgaagtgcctggtggattcctaa

SEQ ID NO: 495265 - DNA, 25 bp, Rattus norvegicus
gtcgaatgccatatgtcacctgtgc

SEQ ID NO: 495266 - DNA, 25 bp, Rattus norvegicus
gtcgaatgccatttgtcacctgtgc

SEQ ID NO: 495267 - DNA, 25 bp, Rattus norvegicus
gtcgaatgtcagaacggcggcatct

SEQ ID NO: 495268 - DNA, 25 bp, Rattus norvegicus
gtcgaatgtcagtacggcggcatct

SEQ ID NO: 495269 - DNA, 25 bp, Rattus norvegicus
gtcgaattccatattgtgatcccaa

SEQ ID NO: 495270 - DNA, 25 bp, Rattus norvegicus
gtcgaattccattttgtgatcccaa

SEQ ID NO: 495271 - DNA, 25 bp, Rattus norvegicus
gtcgacactgtcctggcttccttgg

SEQ ID NO: 495272 - DNA, 25 bp, Rattus norvegicus
gtcgacactgtcgtggcttccttgg

SEQ ID NO: 495273 - DNA, 25 bp, Rattus norvegicus
gtcgacagatctcagtttgcgtgga

SEQ ID NO: 495274 - DNA, 25 bp, Rattus norvegicus
gtcgacagatctgagtttgcgtgga

SEQ ID NO: 495275 - DNA, 25 bp, Rattus norvegicus
gtcgacagccctcgagcacagagaa

SEQ ID NO: 495276 - DNA, 25 bp, Rattus norvegicus
gtcgacagccctggagcacagagaa

SEQ ID NO: 495277 - DNA, 25 bp, Rattus norvegicus
gtcgacaggagcatctcaatcaaaa

SEQ ID NO: 495278 - DNA, 25 bp, Rattus norvegicus
gtcgacaggagcttctcaatcaaaa

SEQ ID NO: 495279 - DNA, 25 bp, Rattus norvegicus
gtcgacagtctgattatcactaaat

SEQ ID NO: 495280 - DNA, 25 bp, Rattus norvegicus
gtcgacagtctgtttatcactaaat

SEQ ID NO: 495281 - DNA, 25 bp, Rattus norvegicus
gtcgacatgaagatttcctgttgca

SEQ ID NO: 495282 - DNA, 25 bp, Rattus norvegicus
gtcgacatgaagttttcctgttgca

SEQ ID NO: 495283 - DNA, 25 bp, Rattus norvegicus
gtcgaccaaagactagtaaccagct

SEQ ID NO: 495284 - DNA, 25 bp, Rattus norvegicus
gtcgaccaaagagtagtaaccagct

SEQ ID NO: 495285 - DNA, 25 bp, Rattus norvegicus
gtcgaccatccaattttatttctca

SEQ ID NO: 495286 - DNA, 25 bp, Rattus norvegicus
gtcgaccatccatttttatttctca

SEQ ID NO: 495287 - DNA, 25 bp, Rattus norvegicus
gtcgaccccaagattctgaggaaca

SEQ ID NO: 495288 - DNA, 25 bp, Rattus norvegicus
gtcgaccccaagtttctgaggaaca

SEQ ID NO: 495289 - DNA, 25 bp, Rattus norvegicus
gtcgaccctgacctgctgtaaaata

SEQ ID NO: 495290 - DNA, 25 bp, Rattus norvegicus
gtcgaccctgacgtgctgtaaaata

SEQ ID NO: 495291 - DNA, 25 bp, Rattus norvegicus
gtcgaccttggaccaaagttgcctt

SEQ ID NO: 495292 - DNA, 25 bp, Rattus norvegicus
gtcgaccttggagcaaagttgcctt

SEQ ID NO: 495293 - DNA, 25 bp, Rattus norvegicus
gtcgacgcttctattttatactgac

SEQ ID NO: 495294 - DNA, 25 bp, Rattus norvegicus
gtcgacgcttcttttttatactgac

SEQ ID NO: 495295 - DNA, 25 bp, Rattus norvegicus
gtcgacggtcctcgttctgccggtt

SEQ ID NO: 495296 - DNA, 25 bp, Rattus norvegicus
gtcgacggtcctggttctgccggtt

SEQ ID NO: 495297 - DNA, 25 bp, Rattus norvegicus
gtcgacgtcgaaagaaagagtatgt

SEQ ID NO: 495298 - DNA, 25 bp, Rattus norvegicus
gtcgacgtcgaatgaaagagtatgt

SEQ ID NO: 495299 - DNA, 25 bp, Rattus norvegicus
gtcgactcaagtccctcaaaagtac

SEQ ID NO: 495300 - DNA, 25 bp, Rattus norvegicus
gtcgactcaagtgcctcaaaagtac

SEQ ID NO: 495301 - DNA, 25 bp, Rattus norvegicus
gtcgactgccagatgacctgtgaga

SEQ ID NO: 495302 - DNA, 25 bp, Rattus norvegicus
gtcgactgccagttgacctgtgaga

SEQ ID NO: 495303 - DNA, 25 bp, Rattus norvegicus
gtcgactgttgcagctctttagaaa

SEQ ID NO: 495304 - DNA, 25 bp, Rattus norvegicus
gtcgactgttgctgctctttagaaa

SEQ ID NO: 495305 - DNA, 25 bp, Rattus norvegicus
gtcgactgttttctttagtaggcta

SEQ ID NO: 495306 - DNA, 25 bp, Rattus norvegicus
gtcgactgttttgtttagtaggcta

SEQ ID NO: 495307 - DNA, 25 bp, Rattus norvegicus
gtcgacttgaatattatccctatgt

SEQ ID NO: 495308 - DNA, 25 bp, Rattus norvegicus
gtcgacttgaattttatccctatgt

SEQ ID NO: 495309 - DNA, 25 bp, Rattus norvegicus
gtcgacttggcactcgaggcttgac

SEQ ID NO: 495310 - DNA, 25 bp, Rattus norvegicus
gtcgacttggcagtcgaggcttgac

SEQ ID NO: 495311 - DNA, 25 bp, Rattus norvegicus
gtcgacttgttaagggccagcactt

SEQ ID NO: 495312 - DNA, 25 bp, Rattus norvegicus
gtcgacttgttatgggccagcactt

SEQ ID NO: 495313 - DNA, 25 bp, Rattus norvegicus
gtcgagacagttactcaagcagcag

SEQ ID NO: 495314 - DNA, 25 bp, Rattus norvegicus
gtcgagacagtttctcaagcagcag

SEQ ID NO: 495315 - DNA, 25 bp, Rattus norvegicus
gtcgagaggagtatctggcttttct

SEQ ID NO: 495316 - DNA, 25 bp, Rattus norvegicus
gtcgagaggagtttctggcttttct

SEQ ID NO: 495317 - DNA, 25 bp, Rattus norvegicus
gtcgagatcagtcttttctggtatt

SEQ ID NO: 495318 - DNA, 25 bp, Rattus norvegicus
gtcgagatcagtgttttctggtatt

SEQ ID NO: 495319 - DNA, 25 bp, Rattus norvegicus
gtcgagatgactacgtggctttcct

SEQ ID NO: 495320 - DNA, 25 bp, Rattus norvegicus
gtcgagatgacttcgtggctttcct

SEQ ID NO: 495321 - DNA, 25 bp, Rattus norvegicus
gtcgagatgtcaagctgatcccacc

SEQ ID NO: 495322 - DNA, 25 bp, Rattus norvegicus
gtcgagatgtcatgctgatcccacc

SEQ ID NO: 495323 - DNA, 25 bp, Rattus norvegicus
gtcgagatgtctaggattgcacttt

SEQ ID NO: 495324 - DNA, 25 bp, Rattus norvegicus
gtcgagatgtcttggattgcacttt

SEQ ID NO: 495325 - DNA, 25 bp, Rattus norvegicus
gtcgagcagaacctgtggccgcatc

SEQ ID NO: 495326 - DNA, 25 bp, Rattus norvegicus
gtcgagcagaacgtgtggccgcatc

SEQ ID NO: 495327 - DNA, 25 bp, Rattus norvegicus
gtcgagcagactacttgtaacttgg

SEQ ID NO: 495328 - DNA, 25 bp, Rattus norvegicus
gtcgagcagacttcttgtaacttgg

SEQ ID NO: 495329 - DNA, 25 bp, Rattus norvegicus
gtcgagcatggtataattgcagttt

SEQ ID NO: 495330 - DNA, 25 bp, Rattus norvegicus
gtcgagcatggtttaattgcagttt

SEQ ID NO: 495331 - DNA, 25 bp, Rattus norvegicus
gtcgagcatgtgaacaaccttgaaa

SEQ ID NO: 495332 - DNA, 25 bp, Rattus norvegicus
gtcgagcatgtgtacaaccttgaaa

SEQ ID NO: 495333 - DNA, 25 bp, Rattus norvegicus
gtcgagcccaccaggcagaaggcaa

SEQ ID NO: 495334 - DNA, 25 bp, Rattus norvegicus
gtcgagcccacctggcagaaggcaa

SEQ ID NO: 495335 - DNA, 25 bp, Rattus norvegicus
gtcgagccccatcatttgaagtgtt

SEQ ID NO: 495336 - DNA, 25 bp, Rattus norvegicus
gtcgagccccatgatttgaagtgtt

SEQ ID NO: 495337 - DNA, 25 bp, Rattus norvegicus
gtcgagccgcgcactcagagtcggc

SEQ ID NO: 495338 - DNA, 25 bp, Rattus norvegicus
gtcgagccgcgctctcagagtcggc

SEQ ID NO: 495339 - DNA, 25 bp, Rattus norvegicus
gtcgagcctgcaatcttatttgatt

SEQ ID NO: 495340 - DNA, 25 bp, Rattus norvegicus
gtcgagcctgcattcttatttgatt

SEQ ID NO: 495341 - DNA, 25 bp, Rattus norvegicus
gtcgagccttccagatgtagagttt

SEQ ID NO: 495342 - DNA, 25 bp, Rattus norvegicus
gtcgagccttcctgatgtagagttt

SEQ ID NO: 495343 - DNA, 25 bp, Rattus norvegicus
gtcgagctatgaaatctgtgctgaa

SEQ ID NO: 495344 - DNA, 25 bp, Rattus norvegicus
gtcgagctatgatatctgtgctgaa

SEQ ID NO: 495345 - DNA, 25 bp, Rattus norvegicus
gtcgagctatgcatacacgtttact

SEQ ID NO: 495346 - DNA, 25 bp, Rattus norvegicus
gtcgagctatgcttacacgtttact

SEQ ID NO: 495347 - DNA, 25 bp, Rattus norvegicus
gtcgagggcaaaaaacccaaagctg

SEQ ID NO: 495348 - DNA, 25 bp, Rattus norvegicus
gtcgagggcaaataacccaaagctg

SEQ ID NO: 495349 - DNA, 25 bp, Rattus norvegicus
gtcgaggtccccaatgtacgatata

SEQ ID NO: 495350 - DNA, 25 bp, Rattus norvegicus
gtcgaggtcccctatgtacgatata

SEQ ID NO: 495351 - DNA, 25 bp, Rattus norvegicus
gtcgaggtgaacacgtcgctctcca

SEQ ID NO: 495352 - DNA, 25 bp, Rattus norvegicus
gtcgaggtgaactcgtcgctctcca

SEQ ID NO: 495353 - DNA, 25 bp, Rattus norvegicus
gtcgagtacaggcaaactctctaaa

SEQ ID NO: 495354 - DNA, 25 bp, Rattus norvegicus
gtcgagtacagggaaactctctaaa

SEQ ID NO: 495355 - DNA, 25 bp, Rattus norvegicus
gtcgagtccggtacacaatagttca

SEQ ID NO: 495356 - DNA, 25 bp, Rattus norvegicus
gtcgagtccggttcacaatagttca

SEQ ID NO: 495357 - DNA, 25 bp, Rattus norvegicus
gtcgagtcttgaaccactaccttac

SEQ ID NO: 495358 - DNA, 25 bp, Rattus norvegicus
gtcgagtcttgatccactaccttac

SEQ ID NO: 495359 - DNA, 25 bp, Rattus norvegicus
gtcgagtgacagcagctgccctcat

SEQ ID NO: 495360 - DNA, 25 bp, Rattus norvegicus
gtcgagtgacaggagctgccctcat

SEQ ID NO: 495361 - DNA, 25 bp, Rattus norvegicus
gtcgagtggagcatagtgtgcatcc

SEQ ID NO: 495362 - DNA, 25 bp, Rattus norvegicus
gtcgagtggagcttagtgtgcatcc

SEQ ID NO: 495363 - DNA, 25 bp, Rattus norvegicus
gtcgagttcagtcgcagacccagac

SEQ ID NO: 495364 - DNA, 25 bp, Rattus norvegicus
gtcgagttcagtggcagacccagac

SEQ ID NO: 495365 - DNA, 25 bp, Rattus norvegicus
gtcgagttccagctgcttgtgagca

SEQ ID NO: 495366 - DNA, 25 bp, Rattus norvegicus
gtcgagttccaggtgcttgtgagca

SEQ ID NO: 495367 - DNA, 25 bp, Rattus norvegicus
gtcgagttgggtcagttgatccttt

SEQ ID NO: 495368 - DNA, 25 bp, Rattus norvegicus
gtcgagttgggtgagttgatccttt

SEQ ID NO: 495369 - DNA, 25 bp, Rattus norvegicus
gtcgatacttaaccattccacaaac

SEQ ID NO: 495370 - DNA, 25 bp, Rattus norvegicus
gtcgatacttaagcattccacaaac

SEQ ID NO: 495371 - DNA, 25 bp, Rattus norvegicus
gtcgatagcctaccactgagtcttc

SEQ ID NO: 495372 - DNA, 25 bp, Rattus norvegicus
gtcgatagcctagcactgagtcttc

SEQ ID NO: 495373 - DNA, 25 bp, Rattus norvegicus
gtcgataggctgacacacatctgtt

SEQ ID NO: 495374 - DNA, 25 bp, Rattus norvegicus
gtcgataggctgtcacacatctgtt

SEQ ID NO: 495375 - DNA, 25 bp, Rattus norvegicus
gtcgatagtcaccttttctggtctc

SEQ ID NO: 495376 - DNA, 25 bp, Rattus norvegicus
gtcgatagtcacgttttctggtctc

SEQ ID NO: 495377 - DNA, 25 bp, Rattus norvegicus
gtcgatagtggtctctacctcgcat

SEQ ID NO: 495378 - DNA, 25 bp, Rattus norvegicus
gtcgatagtggtgtctacctcgcat

SEQ ID NO: 495379 - DNA, 25 bp, Rattus norvegicus
gtcgatataagcagctttaccctcc

SEQ ID NO: 495380 - DNA, 25 bp, Rattus norvegicus
gtcgatataagctgctttaccctcc

SEQ ID NO: 495381 - DNA, 25 bp, Rattus norvegicus
gtcgatatcttgaacatttagcaga

SEQ ID NO: 495382 - DNA, 25 bp, Rattus norvegicus
gtcgatatcttgtacatttagcaga

SEQ ID NO: 495383 - DNA, 25 bp, Rattus norvegicus
gtcgatatttgaacctcctgtgaat

SEQ ID NO: 495384 - DNA, 25 bp, Rattus norvegicus
gtcgatatttgatcctcctgtgaat

SEQ ID NO: 495385 - DNA, 25 bp, Rattus norvegicus
gtcgatctggatctcttttgaggtt

SEQ ID NO: 495386 - DNA, 25 bp, Rattus norvegicus
gtcgatctggatgtcttttgaggtt

SEQ ID NO: 495387 - DNA, 25 bp, Rattus norvegicus
gtcgatcttcaaagagcatctccac

SEQ ID NO: 495388 - DNA, 25 bp, Rattus norvegicus
gtcgatcttcaatgagcatctccac

SEQ ID NO: 495389 - DNA, 25 bp, Rattus norvegicus
gtcgatctttctatgctatgctttg

SEQ ID NO: 495390 - DNA, 25 bp, Rattus norvegicus
gtcgatctttctttgctatgctttg

SEQ ID NO: 495391 - DNA, 25 bp, Rattus norvegicus
gtcgatgagcttcgccagagcgtca

SEQ ID NO: 495392 - DNA, 25 bp, Rattus norvegicus
gtcgatgagcttggccagagcgtca

SEQ ID NO: 495393 - DNA, 25 bp, Rattus norvegicus
gtcgatgatgacctacccagctttc

SEQ ID NO: 495394 - DNA, 25 bp, Rattus norvegicus
gtcgatgatgacgtacccagctttc

SEQ ID NO: 495395 - DNA, 25 bp, Rattus norvegicus
gtcgatgatggtcacgactctgtcg

SEQ ID NO: 495396 - DNA, 25 bp, Rattus norvegicus
gtcgatgatggtgacgactctgtcg

SEQ ID NO: 495397 - DNA, 25 bp, Rattus norvegicus
gtcgatgatttccacaccaatgatg

SEQ ID NO: 495398 - DNA, 25 bp, Rattus norvegicus
gtcgatgatttcgacaccaatgatg

SEQ ID NO: 495399 - DNA, 25 bp, Rattus norvegicus
gtcgatgcagttcgccttgatggaa

SEQ ID NO: 495400 - DNA, 25 bp, Rattus norvegicus
gtcgatgcagttggccttgatggaa

SEQ ID NO: 495401 - DNA, 25 bp, Rattus norvegicus
gtcgatgccactaacactagctagg

SEQ ID NO: 495402 - DNA, 25 bp, Rattus norvegicus
gtcgatgccacttacactagctagg

SEQ ID NO: 495403 - DNA, 25 bp, Rattus norvegicus
gtcgatggcaccatcttgtgctaac

SEQ ID NO: 495404 - DNA, 25 bp, Rattus norvegicus
gtcgatggcaccttcttgtgctaac

SEQ ID NO: 495405 - DNA, 25 bp, Rattus norvegicus
gtcgatgtaaatctcactcctgaag

SEQ ID NO: 495406 - DNA, 25 bp, Rattus norvegicus
gtcgatgtaaatgtcactcctgaag

SEQ ID NO: 495407 - DNA, 25 bp, Rattus norvegicus
gtcgatgtcacgcaccctggttata

SEQ ID NO: 495408 - DNA, 25 bp, Rattus norvegicus
gtcgatgtcacggaccctggttata

SEQ ID NO: 495409 - DNA, 25 bp, Rattus norvegicus
gtcgatgtggccatatatgtgtcat

SEQ ID NO: 495410 - DNA, 25 bp, Rattus norvegicus
gtcgatgtggccttatatgtgtcat

SEQ ID NO: 495411 - DNA, 25 bp, Rattus norvegicus
gtcgatgttcaaaagcaccagttac

SEQ ID NO: 495412 - DNA, 25 bp, Rattus norvegicus
gtcgatgttcaatagcaccagttac

SEQ ID NO: 495413 - DNA, 25 bp, Rattus norvegicus
gtcgattatttccttagctagcttt

SEQ ID NO: 495414 - DNA, 25 bp, Rattus norvegicus
gtcgattatttcgttagctagcttt

SEQ ID NO: 495415 - DNA, 25 bp, Rattus norvegicus
gtcgattcaactatacccatttgag

SEQ ID NO: 495416 - DNA, 25 bp, Rattus norvegicus
gtcgattcaactttacccatttgag

SEQ ID NO: 495417 - DNA, 25 bp, Rattus norvegicus
gtcgattgcttacatttgttcctgt

SEQ ID NO: 495418 - DNA, 25 bp, Rattus norvegicus
gtcgattgcttagatttgttcctgt

SEQ ID NO: 495419 - DNA, 25 bp, Rattus norvegicus
gtcgattggatcactttttattaat

SEQ ID NO: 495420 - DNA, 25 bp, Rattus norvegicus
gtcgattggatctctttttattaat

SEQ ID NO: 495421 - DNA, 25 bp, Rattus norvegicus
gtcgcaaacaaacactacatactga

SEQ ID NO: 495422 - DNA, 25 bp, Rattus norvegicus
gtcgcaaacaaagactacatactga

SEQ ID NO: 495423 - DNA, 25 bp, Rattus norvegicus
gtcgcaacaactagagagcctccaa

SEQ ID NO: 495424 - DNA, 25 bp, Rattus norvegicus
gtcgcaacaacttgagagcctccaa

SEQ ID NO: 495425 - DNA, 25 bp, Rattus norvegicus
gtcgcaagaagcacgaactggagat

SEQ ID NO: 495426 - DNA, 25 bp, Rattus norvegicus
gtcgcaagaagctcgaactggagat

SEQ ID NO: 495427 - DNA, 25 bp, Rattus norvegicus
gtcgcaagcccaaggtggagcagtt

SEQ ID NO: 495428 - DNA, 25 bp, Rattus norvegicus
gtcgcaagcccatggtggagcagtt

SEQ ID NO: 495429 - DNA, 25 bp, Rattus norvegicus
gtcgcaagcgacacgcggcagagat

SEQ ID NO: 495430 - DNA, 25 bp, Rattus norvegicus
gtcgcaagcgactcgcggcagagat

SEQ ID NO: 495431 - DNA, 25 bp, Rattus norvegicus
gtcgcaaggcatccagcagctactg

SEQ ID NO: 495432 - DNA, 25 bp, Rattus norvegicus
gtcgcaaggcatgcagcagctactg

SEQ ID NO: 495433 - DNA, 25 bp, Rattus norvegicus
gtcgcacacacaatgatggctctgg

SEQ ID NO: 495434 - DNA, 25 bp, Rattus norvegicus
gtcgcacacacattgatggctctgg

SEQ ID NO: 495435 - DNA, 25 bp, Rattus norvegicus
gtcgcacatccactcctttatgaaa

SEQ ID NO: 495436 - DNA, 25 bp, Rattus norvegicus
gtcgcacatccagtcctttatgaaa

SEQ ID NO: 495437 - DNA, 25 bp, Rattus norvegicus
gtcgcacccagtcgtacctgaggat

SEQ ID NO: 495438 - DNA, 25 bp, Rattus norvegicus
gtcgcacccagtggtacctgaggat

SEQ ID NO: 495439 - DNA, 25 bp, Rattus norvegicus
gtcgcaccttaaaccatggatattt

SEQ ID NO: 495440 - DNA, 25 bp, Rattus norvegicus
gtcgcaccttaatccatggatattt

SEQ ID NO: 495441 - DNA, 25 bp, Rattus norvegicus
gtcgcacgagagagcaccgcgaccg

SEQ ID NO: 495442 - DNA, 25 bp, Rattus norvegicus
gtcgcacgagagtgcaccgcgaccg

SEQ ID NO: 495443 - DNA, 25 bp, Rattus norvegicus
gtcgcacggcgcatcatgatgacgt

SEQ ID NO: 495444 - DNA, 25 bp, Rattus norvegicus
gtcgcacggcgcttcatgatgacgt

SEQ ID NO: 495445 - DNA, 25 bp, Rattus norvegicus
gtcgcactagctagggagactcctt

SEQ ID NO: 495446 - DNA, 25 bp, Rattus norvegicus
gtcgcactagcttgggagactcctt

SEQ ID NO: 495447 - DNA, 25 bp, Rattus norvegicus
gtcgcactattgagaagcccatggt

SEQ ID NO: 495448 - DNA, 25 bp, Rattus norvegicus
gtcgcactattgtgaagcccatggt

SEQ ID NO: 495449 - DNA, 25 bp, Rattus norvegicus
gtcgcacttcgtaccggactcagct

SEQ ID NO: 495450 - DNA, 25 bp, Rattus norvegicus
gtcgcacttcgttccggactcagct

SEQ ID NO: 495451 - DNA, 25 bp, Rattus norvegicus
gtcgcagacataaaggattttcacg

SEQ ID NO: 495452 - DNA, 25 bp, Rattus norvegicus
gtcgcagacatataggattttcacg

SEQ ID NO: 495453 - DNA, 25 bp, Rattus norvegicus
gtcgcagaggccagaaaggccagaa

SEQ ID NO: 495454 - DNA, 25 bp, Rattus norvegicus
gtcgcagaggcctgaaaggccagaa

SEQ ID NO: 495455 - DNA, 25 bp, Rattus norvegicus
gtcgcagagggcatgctacccagct

SEQ ID NO: 495456 - DNA, 25 bp, Rattus norvegicus
gtcgcagagggcttgctacccagct

SEQ ID NO: 495457 - DNA, 25 bp, Rattus norvegicus
gtcgcagagtgaccccaagccaggt

SEQ ID NO: 495458 - DNA, 25 bp, Rattus norvegicus
gtcgcagagtgagcccaagccaggt

SEQ ID NO: 495459 - DNA, 25 bp, Rattus norvegicus
gtcgcagatgtacgtgaagccactt

SEQ ID NO: 495460 - DNA, 25 bp, Rattus norvegicus
gtcgcagatgtaggtgaagccactt

SEQ ID NO: 495461 - DNA, 25 bp, Rattus norvegicus
gtcgcagcctctcgtgtctgcaaaa

SEQ ID NO: 495462 - DNA, 25 bp, Rattus norvegicus
gtcgcagcctctggtgtctgcaaaa

SEQ ID NO: 495463 - DNA, 25 bp, Rattus norvegicus
gtcgcagctcctccctatgacagga

SEQ ID NO: 495464 - DNA, 25 bp, Rattus norvegicus
gtcgcagctcctgcctatgacagga

SEQ ID NO: 495465 - DNA, 25 bp, Rattus norvegicus
gtcgcaggagctcgattttcccaca

SEQ ID NO: 495466 - DNA, 25 bp, Rattus norvegicus
gtcgcaggagctggattttcccaca

SEQ ID NO: 495467 - DNA, 25 bp, Rattus norvegicus
gtcgcaggtctgcaactctgagaga

SEQ ID NO: 495468 - DNA, 25 bp, Rattus norvegicus
gtcgcaggtctggaactctgagaga

SEQ ID NO: 495469 - DNA, 25 bp, Rattus norvegicus
gtcgcagtcgcactcgtgataggaa

SEQ ID NO: 495470 - DNA, 25 bp, Rattus norvegicus
gtcgcagtcgcagtcgtgataggaa

SEQ ID NO: 495471 - DNA, 25 bp, Rattus norvegicus
gtcgcagtggtgaccagtccggctt

SEQ ID NO: 495472 - DNA, 25 bp, Rattus norvegicus
gtcgcagtggtgtccagtccggctt

SEQ ID NO: 495473 - DNA, 25 bp, Rattus norvegicus
gtcgcagttgatctcgctggaccca

SEQ ID NO: 495474 - DNA, 25 bp, Rattus norvegicus
gtcgcagttgatgtcgctggaccca

SEQ ID NO: 495475 - DNA, 25 bp, Rattus norvegicus
gtcgcatccatgctaaagatcaagg

SEQ ID NO: 495476 - DNA, 25 bp, Rattus norvegicus
gtcgcatccatggtaaagatcaagg

SEQ ID NO: 495477 - DNA, 25 bp, Rattus norvegicus
gtcgcatgcgccagacggtggtcac

SEQ ID NO: 495478 - DNA, 25 bp, Rattus norvegicus
gtcgcatgcgcctgacggtggtcac

SEQ ID NO: 495479 - DNA, 25 bp, Rattus norvegicus
gtcgcatgcggaagccggccaagac

SEQ ID NO: 495480 - DNA, 25 bp, Rattus norvegicus
gtcgcatgcggatgccggccaagac

SEQ ID NO: 495481 - DNA, 25 bp, Rattus norvegicus
gtcgcatggatgcaggagacaccca

SEQ ID NO: 495482 - DNA, 25 bp, Rattus norvegicus
gtcgcatggatggaggagacaccca

SEQ ID NO: 495483 - DNA, 25 bp, Rattus norvegicus
gtcgcattcactcacggtcattgga

SEQ ID NO: 495484 - DNA, 25 bp, Rattus norvegicus
gtcgcattcactgacggtcattgga

SEQ ID NO: 495485 - DNA, 25 bp, Rattus norvegicus
gtcgccaaagtcatagaccgtttct

SEQ ID NO: 495486 - DNA, 25 bp, Rattus norvegicus
gtcgccaaagtcttagaccgtttct

SEQ ID NO: 495487 - DNA, 25 bp, Rattus norvegicus
gtcgccaagagtattctgttcgttc

SEQ ID NO: 495488 - DNA, 25 bp, Rattus norvegicus
gtcgccaagagttttctgttcgttc

SEQ ID NO: 495489 - DNA, 25 bp, Rattus norvegicus
gtcgccactctgaggagttttgcat

SEQ ID NO: 495490 - DNA, 25 bp, Rattus norvegicus
gtcgccactctgtggagttttgcat

SEQ ID NO: 495491 - DNA, 25 bp, Rattus norvegicus
gtcgccagagctccttgaggccttg

SEQ ID NO: 495492 - DNA, 25 bp, Rattus norvegicus
gtcgccagagctgcttgaggccttg

SEQ ID NO: 495493 - DNA, 25 bp, Rattus norvegicus
gtcgccagctcccagcaaagcgtgg

SEQ ID NO: 495494 - DNA, 25 bp, Rattus norvegicus
gtcgccagctccgagcaaagcgtgg

SEQ ID NO: 495495 - DNA, 25 bp, Rattus norvegicus
gtcgccagctttccatgtgaatatg

SEQ ID NO: 495496 - DNA, 25 bp, Rattus norvegicus
gtcgccagctttgcatgtgaatatg

SEQ ID NO: 495497 - DNA, 25 bp, Rattus norvegicus
gtcgccaggtgaatggatgtgtcca

SEQ ID NO: 495498 - DNA, 25 bp, Rattus norvegicus
gtcgccaggtgattggatgtgtcca

SEQ ID NO: 495499 - DNA, 25 bp, Rattus norvegicus
gtcgccagtttaattcctacactaa

SEQ ID NO: 495500 - DNA, 25 bp, Rattus norvegicus
gtcgccagtttatttcctacactaa

SEQ ID NO: 495501 - DNA, 25 bp, Rattus norvegicus
gtcgccatcggtcttgaacattcag

SEQ ID NO: 495502 - DNA, 25 bp, Rattus norvegicus
gtcgccatcggtgttgaacattcag

SEQ ID NO: 495503 - DNA, 25 bp, Rattus norvegicus
gtcgccatgagcaaagcccaccctc

SEQ ID NO: 495504 - DNA, 25 bp, Rattus norvegicus
gtcgccatgagctaagcccaccctc

SEQ ID NO: 495505 - DNA, 25 bp, Rattus norvegicus
gtcgccatgtccagtaagccaaata

SEQ ID NO: 495506 - DNA, 25 bp, Rattus norvegicus
gtcgccatgtcctgtaagccaaata

SEQ ID NO: 495507 - DNA, 25 bp, Rattus norvegicus
gtcgccattcttatcttttgtcata

SEQ ID NO: 495508 - DNA, 25 bp, Rattus norvegicus
gtcgccattcttttcttttgtcata

SEQ ID NO: 495509 - DNA, 25 bp, Rattus norvegicus
gtcgcccaatctcgaatgcatgcaa

SEQ ID NO: 495510 - DNA, 25 bp, Rattus norvegicus
gtcgcccaatctggaatgcatgcaa

SEQ ID NO: 495511 - DNA, 25 bp, Rattus norvegicus
gtcgcccaccatagtgcaatacagg

SEQ ID NO: 495512 - DNA, 25 bp, Rattus norvegicus
gtcgcccaccattgtgcaatacagg

SEQ ID NO: 495513 - DNA, 25 bp, Rattus norvegicus
gtcgcccatttcatcatcatttgat

SEQ ID NO: 495514 - DNA, 25 bp, Rattus norvegicus
gtcgcccatttcttcatcatttgat

SEQ ID NO: 495515 - DNA, 25 bp, Rattus norvegicus
gtcgcccgagctctgcgtgtgcaca

SEQ ID NO: 495516 - DNA, 25 bp, Rattus norvegicus
gtcgcccgagctgtgcgtgtgcaca

SEQ ID NO: 495517 - DNA, 25 bp, Rattus norvegicus
gtcgccctcagtcagctttagctaa

SEQ ID NO: 495518 - DNA, 25 bp, Rattus norvegicus
gtcgccctcagtgagctttagctaa

SEQ ID NO: 495519 - DNA, 25 bp, Rattus norvegicus
gtcgccctccataattgtttggtca

SEQ ID NO: 495520 - DNA, 25 bp, Rattus norvegicus
gtcgccctccattattgtttggtca

SEQ ID NO: 495521 - DNA, 25 bp, Rattus norvegicus
gtcgccctcggacccagagaaatac

SEQ ID NO: 495522 - DNA, 25 bp, Rattus norvegicus
gtcgccctcggagccagagaaatac

SEQ ID NO: 495523 - DNA, 25 bp, Rattus norvegicus
gtcgccctctgtatttgtatttgga

SEQ ID NO: 495524 - DNA, 25 bp, Rattus norvegicus
gtcgccctctgtttttgtatttgga

SEQ ID NO: 495525 - DNA, 25 bp, Rattus norvegicus
gtcgccctttggcaaaagcactctg

SEQ ID NO: 495526 - DNA, 25 bp, Rattus norvegicus
gtcgccctttgggaaaagcactctg

SEQ ID NO: 495527 - DNA, 25 bp, Rattus norvegicus
gtcgcccttttcctggacagatcag

SEQ ID NO: 495528 - DNA, 25 bp, Rattus norvegicus
gtcgcccttttcgtggacagatcag

SEQ ID NO: 495529 - DNA, 25 bp, Rattus norvegicus
gtcgccgcaaggaaatgaatcgtcg

SEQ ID NO: 495530 - DNA, 25 bp, Rattus norvegicus
gtcgccgcaaggtaatgaatcgtcg

SEQ ID NO: 495531 - DNA, 25 bp, Rattus norvegicus
gtcgccgcagctctgagaatcttat

SEQ ID NO: 495532 - DNA, 25 bp, Rattus norvegicus
gtcgccgcagctgtgagaatcttat

SEQ ID NO: 495533 - DNA, 25 bp, Rattus norvegicus
gtcgccgcgggcctcattgtctgca

SEQ ID NO: 495534 - DNA, 25 bp, Rattus norvegicus
gtcgccgcgggcgtcattgtctgca

SEQ ID NO: 495535 - DNA, 25 bp, Rattus norvegicus
gtcgccgggacaactgtgtgtaata

SEQ ID NO: 495536 - DNA, 25 bp, Rattus norvegicus
gtcgccgggacatctgtgtgtaata

SEQ ID NO: 495537 - DNA, 25 bp, Rattus norvegicus
gtcgccggttacagatcggacttaa

SEQ ID NO: 495538 - DNA, 25 bp, Rattus norvegicus
gtcgccggttactgatcggacttaa

SEQ ID NO: 495539 - DNA, 25 bp, Rattus norvegicus
gtcgccgtagtaattggtgcaaaga

SEQ ID NO: 495540 - DNA, 25 bp, Rattus norvegicus
gtcgccgtagtatttggtgcaaaga

SEQ ID NO: 495541 - DNA, 25 bp, Rattus norvegicus
gtcgccgtgcacatctatattgaga

SEQ ID NO: 495542 - DNA, 25 bp, Rattus norvegicus
gtcgccgtgcacttctatattgaga

SEQ ID NO: 495543 - DNA, 25 bp, Rattus norvegicus
gtcgccgtggagaaactgtgtacct

SEQ ID NO: 495544 - DNA, 25 bp, Rattus norvegicus
gtcgccgtggagtaactgtgtacct

SEQ ID NO: 495545 - DNA, 25 bp, Rattus norvegicus
gtcgccgttgagacgcgcgaactcg

SEQ ID NO: 495546 - DNA, 25 bp, Rattus norvegicus
gtcgccgttgagtcgcgcgaactcg

SEQ ID NO: 495547 - DNA, 25 bp, Rattus norvegicus
gtcgcctcaagtatttaagttattg

SEQ ID NO: 495548 - DNA, 25 bp, Rattus norvegicus
gtcgcctcaagtttttaagttattg

SEQ ID NO: 495549 - DNA, 25 bp, Rattus norvegicus
gtcgcctcctctcggatcttgagca

SEQ ID NO: 495550 - DNA, 25 bp, Rattus norvegicus
gtcgcctcctctgggatcttgagca

SEQ ID NO: 495551 - DNA, 25 bp, Rattus norvegicus
gtcgcctgccatactgaaaacatct

SEQ ID NO: 495552 - DNA, 25 bp, Rattus norvegicus
gtcgcctgccattctgaaaacatct

SEQ ID NO: 495553 - DNA, 25 bp, Rattus norvegicus
gtcgcctggcacatggataacggag

SEQ ID NO: 495554 - DNA, 25 bp, Rattus norvegicus
gtcgcctggcacttggataacggag

SEQ ID NO: 495555 - DNA, 25 bp, Rattus norvegicus
gtcgcctggctcagttcatcgggaa

SEQ ID NO: 495556 - DNA, 25 bp, Rattus norvegicus
gtcgcctggctctgttcatcgggaa

SEQ ID NO: 495557 - DNA, 25 bp, Rattus norvegicus
gtcgcctgtaacagtattcttggtc

SEQ ID NO: 495558 - DNA, 25 bp, Rattus norvegicus
gtcgcctgtaactgtattcttggtc

SEQ ID NO: 495559 - DNA, 25 bp, Rattus norvegicus
gtcgcctgttagcttctggtacaca

SEQ ID NO: 495560 - DNA, 25 bp, Rattus norvegicus
gtcgcctgttaggttctggtacaca

SEQ ID NO: 495561 - DNA, 25 bp, Rattus norvegicus
gtcgccttcactatgacgcagaaac

SEQ ID NO: 495562 - DNA, 25 bp, Rattus norvegicus
gtcgccttcactttgacgcagaaac

SEQ ID NO: 495563 - DNA, 25 bp, Rattus norvegicus
gtcgccttcatgaaagtcactctat

SEQ ID NO: 495564 - DNA, 25 bp, Rattus norvegicus
gtcgccttcatgtaagtcactctat

SEQ ID NO: 495565 - DNA, 25 bp, Rattus norvegicus
gtcgccttgccgatgtatctcaaga

SEQ ID NO: 495566 - DNA, 25 bp, Rattus norvegicus
gtcgccttgccgttgtatctcaaga

SEQ ID NO: 495567 - DNA, 25 bp, Rattus norvegicus
gtcgcctttatgcaccacatacgga

SEQ ID NO: 495568 - DNA, 25 bp, Rattus norvegicus
gtcgcctttatggaccacatacgga

SEQ ID NO: 495569 - DNA, 25 bp, Rattus norvegicus
gtcgcctttgctactgctttaacag

SEQ ID NO: 495570 - DNA, 25 bp, Rattus norvegicus
gtcgcctttgcttctgctttaacag

SEQ ID NO: 495571 - DNA, 25 bp, Rattus norvegicus
gtcgcgaactcaaatcggcatttag

SEQ ID NO: 495572 - DNA, 25 bp, Rattus norvegicus
gtcgcgaactcatatcggcatttag

SEQ ID NO: 495573 - DNA, 25 bp, Rattus norvegicus
gtcgcgacctgcatctttggtccta

SEQ ID NO: 495574 - DNA, 25 bp, Rattus norvegicus
gtcgcgacctgcttctttggtccta

SEQ ID NO: 495575 - DNA, 25 bp, Rattus norvegicus
gtcgcgagtgttagccgcttggaat

SEQ ID NO: 495576 - DNA, 25 bp, Rattus norvegicus
gtcgcgagtgtttgccgcttggaat

SEQ ID NO: 495577 - DNA, 25 bp, Rattus norvegicus
gtcgcgcagagacagctgagcaaca

SEQ ID NO: 495578 - DNA, 25 bp, Rattus norvegicus
gtcgcgcagagagagctgagcaaca

SEQ ID NO: 495579 - DNA, 25 bp, Rattus norvegicus
gtcgcgcgggctactcaggccctga

SEQ ID NO: 495580 - DNA, 25 bp, Rattus norvegicus
gtcgcgcgggcttctcaggccctga

SEQ ID NO: 495581 - DNA, 25 bp, Rattus norvegicus
gtcgcgctcggaagcaggcatgctt

SEQ ID NO: 495582 - DNA, 25 bp, Rattus norvegicus
gtcgcgctcggatgcaggcatgctt

SEQ ID NO: 495583 - DNA, 25 bp, Rattus norvegicus
gtcgcggctcacctcgtagtcgtca

SEQ ID NO: 495584 - DNA, 25 bp, Rattus norvegicus
gtcgcggctcacgtcgtagtcgtca

SEQ ID NO: 495585 - DNA, 25 bp, Rattus norvegicus
gtcgcggctccaagcctgcctggag

SEQ ID NO: 495586 - DNA, 25 bp, Rattus norvegicus
gtcgcggctccatgcctgcctggag

SEQ ID NO: 495587 - DNA, 25 bp, Rattus norvegicus
gtcgcggctgtgacttcaagatcga

SEQ ID NO: 495588 - DNA, 25 bp, Rattus norvegicus
gtcgcggctgtgtcttcaagatcga

SEQ ID NO: 495589 - DNA, 25 bp, Rattus norvegicus
gtcgcggtccccagcaggtgaacca

SEQ ID NO: 495590 - DNA, 25 bp, Rattus norvegicus
gtcgcggtcccctgcaggtgaacca

SEQ ID NO: 495591 - DNA, 25 bp, Rattus norvegicus
gtcgcggtccgtctttcccgagtcg

SEQ ID NO: 495592 - DNA, 25 bp, Rattus norvegicus
gtcgcggtccgtgtttcccgagtcg

SEQ ID NO: 495593 - DNA, 25 bp, Rattus norvegicus
gtcgcgtcaactacctgggtatgta

SEQ ID NO: 495594 - DNA, 25 bp, Rattus norvegicus
gtcgcgtcaacttcctgggtatgta

SEQ ID NO: 495595 - DNA, 25 bp, Rattus norvegicus
gtcgcgtcccgaattcacaagtaga

SEQ ID NO: 495596 - DNA, 25 bp, Rattus norvegicus
gtcgcgtcccgatttcacaagtaga

SEQ ID NO: 495597 - DNA, 25 bp, Rattus norvegicus
gtcgcgtctccactgatgtcattga

SEQ ID NO: 495598 - DNA, 25 bp, Rattus norvegicus
gtcgcgtctccagtgatgtcattga

SEQ ID NO: 495599 - DNA, 25 bp, Rattus norvegicus
gtcgcgtgagctcttctaaaatcca

SEQ ID NO: 495600 - DNA, 25 bp, Rattus norvegicus
gtcgcgtgagctgttctaaaatcca

SEQ ID NO: 495601 - DNA, 25 bp, Rattus norvegicus
gtcgctaacgaaaactggtctagtc

SEQ ID NO: 495602 - DNA, 25 bp, Rattus norvegicus
gtcgctaacgaatactggtctagtc

SEQ ID NO: 495603 - DNA, 25 bp, Rattus norvegicus
gtcgctaattgtagactgttctgca

SEQ ID NO: 495604 - DNA, 25 bp, Rattus norvegicus
gtcgctaattgttgactgttctgca

SEQ ID NO: 495605 - DNA, 25 bp, Rattus norvegicus
gtcgctacactccacttactgaggg

SEQ ID NO: 495606 - DNA, 25 bp, Rattus norvegicus
gtcgctacactcgacttactgaggg

SEQ ID NO: 495607 - DNA, 25 bp, Rattus norvegicus
gtcgctacctcaatctcttaagagt

SEQ ID NO: 495608 - DNA, 25 bp, Rattus norvegicus
gtcgctacctcattctcttaagagt

SEQ ID NO: 495609 - DNA, 25 bp, Rattus norvegicus
gtcgctacgcttagtatgatgccag

SEQ ID NO: 495610 - DNA, 25 bp, Rattus norvegicus
gtcgctacgctttgtatgatgccag

SEQ ID NO: 495611 - DNA, 25 bp, Rattus norvegicus
gtcgctatcctcagacaaggtaggt

SEQ ID NO: 495612 - DNA, 25 bp, Rattus norvegicus
gtcgctatcctctgacaaggtaggt

SEQ ID NO: 495613 - DNA, 25 bp, Rattus norvegicus
gtcgctatggcgactatgaggatga

SEQ ID NO: 495614 - DNA, 25 bp, Rattus norvegicus
gtcgctatggcgtctatgaggatga

SEQ ID NO: 495615 - DNA, 25 bp, Rattus norvegicus
gtcgctcaaatacacttaacctttt

SEQ ID NO: 495616 - DNA, 25 bp, Rattus norvegicus
gtcgctcaaatagacttaacctttt

SEQ ID NO: 495617 - DNA, 25 bp, Rattus norvegicus
gtcgctcacttcacaatccaaagat

SEQ ID NO: 495618 - DNA, 25 bp, Rattus norvegicus
gtcgctcacttctcaatccaaagat

SEQ ID NO: 495619 - DNA, 25 bp, Rattus norvegicus
gtcgctcaggacatggcaggcatag

SEQ ID NO: 495620 - DNA, 25 bp, Rattus norvegicus
gtcgctcaggacttggcaggcatag

SEQ ID NO: 495621 - DNA, 25 bp, Rattus norvegicus
gtcgctcatatcactggacttgatt

SEQ ID NO: 495622 - DNA, 25 bp, Rattus norvegicus
gtcgctcatatctctggacttgatt

SEQ ID NO: 495623 - DNA, 25 bp, Rattus norvegicus
gtcgctcatgcgagcaacagggtat

SEQ ID NO: 495624 - DNA, 25 bp, Rattus norvegicus
gtcgctcatgcgtgcaacagggtat

SEQ ID NO: 495625 - DNA, 25 bp, Rattus norvegicus
gtcgctcattcaccagaaaagtata

SEQ ID NO: 495626 - DNA, 25 bp, Rattus norvegicus
gtcgctcattcagcagaaaagtata

SEQ ID NO: 495627 - DNA, 25 bp, Rattus norvegicus
gtcgctccaatactagcccaacaga

SEQ ID NO: 495628 - DNA, 25 bp, Rattus norvegicus
gtcgctccaatagtagcccaacaga

SEQ ID NO: 495629 - DNA, 25 bp, Rattus norvegicus
gtcgctccagtgagtctgactttga

SEQ ID NO: 495630 - DNA, 25 bp, Rattus norvegicus
gtcgctccagtgtgtctgactttga

SEQ ID NO: 495631 - DNA, 25 bp, Rattus norvegicus
gtcgctcgttgcctgcatgcttgca

SEQ ID NO: 495632 - DNA, 25 bp, Rattus norvegicus
gtcgctcgttgcgtgcatgcttgca

SEQ ID NO: 495633 - DNA, 25 bp, Rattus norvegicus
gtcgctctcaccatatataccaaga

SEQ ID NO: 495634 - DNA, 25 bp, Rattus norvegicus
gtcgctctcaccttatataccaaga

SEQ ID NO: 495635 - DNA, 25 bp, Rattus norvegicus
gtcgctctttctaatctcatgggat

SEQ ID NO: 495636 - DNA, 25 bp, Rattus norvegicus
gtcgctctttcttatctcatgggat

SEQ ID NO: 495637 - DNA, 25 bp, Rattus norvegicus
gtcgctgaattcctgtgatcattga

SEQ ID NO: 495638 - DNA, 25 bp, Rattus norvegicus
gtcgctgaattcgtgtgatcattga

SEQ ID NO: 495639 - DNA, 25 bp, Rattus norvegicus
gtcgctgaccccagtggagcagaca

SEQ ID NO: 495640 - DNA, 25 bp, Rattus norvegicus
gtcgctgacccctgtggagcagaca

SEQ ID NO: 495641 - DNA, 25 bp, Rattus norvegicus
gtcgctgatagccaatctgaattcc

SEQ ID NO: 495642 - DNA, 25 bp, Rattus norvegicus
gtcgctgatagcgaatctgaattcc

SEQ ID NO: 495643 - DNA, 25 bp, Rattus norvegicus
gtcgctgattttagatccagtcaca

SEQ ID NO: 495644 - DNA, 25 bp, Rattus norvegicus
gtcgctgatttttgatccagtcaca

SEQ ID NO: 495645 - DNA, 25 bp, Rattus norvegicus
gtcgctgccaacaaaaacgccttta

SEQ ID NO: 495646 - DNA, 25 bp, Rattus norvegicus
gtcgctgccaactaaaacgccttta

SEQ ID NO: 495647 - DNA, 25 bp, Rattus norvegicus
gtcgctgccggtactcagggctgcc

SEQ ID NO: 495648 - DNA, 25 bp, Rattus norvegicus
gtcgctgccggttctcagggctgcc

SEQ ID NO: 495649 - DNA, 25 bp, Rattus norvegicus
gtcgctggccgaaaactattttgat

SEQ ID NO: 495650 - DNA, 25 bp, Rattus norvegicus
gtcgctggccgataactattttgat

SEQ ID NO: 495651 - DNA, 25 bp, Rattus norvegicus
gtcgctggcctgatttatgactgca

SEQ ID NO: 495652 - DNA, 25 bp, Rattus norvegicus
gtcgctggcctgttttatgactgca

SEQ ID NO: 495653 - DNA, 25 bp, Rattus norvegicus
gtcgctgggctgacaacaagcaagt

SEQ ID NO: 495654 - DNA, 25 bp, Rattus norvegicus
gtcgctgggctgtcaacaagcaagt

SEQ ID NO: 495655 - DNA, 25 bp, Rattus norvegicus
gtcgctgggtaaactagcatggctc

SEQ ID NO: 495656 - DNA, 25 bp, Rattus norvegicus
gtcgctgggtaatctagcatggctc

SEQ ID NO: 495657 - DNA, 25 bp, Rattus norvegicus
gtcgctgtcactaatctgagggctt

SEQ ID NO: 495658 - DNA, 25 bp, Rattus norvegicus
gtcgctgtcacttatctgagggctt

SEQ ID NO: 495659 - DNA, 25 bp, Rattus norvegicus
gtcgctgtctttacagacgtataaa

SEQ ID NO: 495660 - DNA, 25 bp, Rattus norvegicus
gtcgctgtcttttcagacgtataaa

SEQ ID NO: 495661 - DNA, 25 bp, Rattus norvegicus
gtcgctgtgagtagttccagacctt

SEQ ID NO: 495662 - DNA, 25 bp, Rattus norvegicus
gtcgctgtgagttgttccagacctt

SEQ ID NO: 495663 - DNA, 25 bp, Rattus norvegicus
gtcgctgtgtcccatcatattggaa

SEQ ID NO: 495664 - DNA, 25 bp, Rattus norvegicus
gtcgctgtgtccgatcatattggaa

SEQ ID NO: 495665 - DNA, 25 bp, Rattus norvegicus
gtcgctgttatgagagagtggcctc

SEQ ID NO: 495666 - DNA, 25 bp, Rattus norvegicus
gtcgctgttatgtgagagtggcctc

SEQ ID NO: 495667 - DNA, 25 bp, Rattus norvegicus
gtcgctgttcctaaatgggtgcttt

SEQ ID NO: 495668 - DNA, 25 bp, Rattus norvegicus
gtcgctgttccttaatgggtgcttt

SEQ ID NO: 495669 - DNA, 25 bp, Rattus norvegicus
gtcgctgttctgattgtaggatttt

SEQ ID NO: 495670 - DNA, 25 bp, Rattus norvegicus
gtcgctgttctgtttgtaggatttt

SEQ ID NO: 495671 - DNA, 25 bp, Rattus norvegicus
gtcgctgttgtgcttcactgtggaa

SEQ ID NO: 495672 - DNA, 25 bp, Rattus norvegicus
gtcgctgttgtggttcactgtggaa

SEQ ID NO: 495673 - DNA, 25 bp, Rattus norvegicus
gtcgcttaatctctccctggagtta

SEQ ID NO: 495674 - DNA, 25 bp, Rattus norvegicus
gtcgcttaatctgtccctggagtta

SEQ ID NO: 495675 - DNA, 25 bp, Rattus norvegicus
gtcgcttactgtaacttatgtttca

SEQ ID NO: 495676 - DNA, 25 bp, Rattus norvegicus
gtcgcttactgttacttatgtttca

SEQ ID NO: 495677 - DNA, 25 bp, Rattus norvegicus
gtcgcttaggcgatacccatgaaga

SEQ ID NO: 495678 - DNA, 25 bp, Rattus norvegicus
gtcgcttaggcgttacccatgaaga

SEQ ID NO: 495679 - DNA, 25 bp, Rattus norvegicus
gtcgcttccttaactgaggccatgg

SEQ ID NO: 495680 - DNA, 25 bp, Rattus norvegicus
gtcgcttccttatctgaggccatgg

SEQ ID NO: 495681 - DNA, 25 bp, Rattus norvegicus
gtcgcttcgatgaatgggatcccag

SEQ ID NO: 495682 - DNA, 25 bp, Rattus norvegicus
gtcgcttcgatgtatgggatcccag

SEQ ID NO: 495683 - DNA, 25 bp, Rattus norvegicus
gtcgcttctcttacttggatgtggg

SEQ ID NO: 495684 - DNA, 25 bp, Rattus norvegicus
gtcgcttctctttcttggatgtggg

SEQ ID NO: 495685 - DNA, 25 bp, Rattus norvegicus
gtcgcttctgttagatacacgtctt

SEQ ID NO: 495686 - DNA, 25 bp, Rattus norvegicus
gtcgcttctgtttgatacacgtctt

SEQ ID NO: 495687 - DNA, 25 bp, Rattus norvegicus
gtcgcttgtattaactaccaccttt

SEQ ID NO: 495688 - DNA, 25 bp, Rattus norvegicus
gtcgcttgtatttactaccaccttt

SEQ ID NO: 495689 - DNA, 25 bp, Rattus norvegicus
gtcgcttgtcgacaacagctttttg

SEQ ID NO: 495690 - DNA, 25 bp, Rattus norvegicus
gtcgcttgtcgagaacagctttttg

SEQ ID NO: 495691 - DNA, 25 bp, Rattus norvegicus
gtcgcttgtgatccccttcaacatg

SEQ ID NO: 495692 - DNA, 25 bp, Rattus norvegicus
gtcgcttgtgatgcccttcaacatg

SEQ ID NO: 495693 - DNA, 25 bp, Rattus norvegicus
gtcgcttttcttacctaatcacagt

SEQ ID NO: 495694 - DNA, 25 bp, Rattus norvegicus
gtcgcttttctttcctaatcacagt

SEQ ID NO: 495695 - DNA, 25 bp, Rattus norvegicus
gtcgcttttgatattaacccattgg

SEQ ID NO: 495696 - DNA, 25 bp, Rattus norvegicus
gtcgcttttgattttaacccattgg

SEQ ID NO: 495697 - DNA, 25 bp, Rattus norvegicus
gtcgcttttggcatttctaatttgt

SEQ ID NO: 495698 - DNA, 25 bp, Rattus norvegicus
gtcgcttttggcttttctaatttgt

SEQ ID NO: 495699 - DNA, 25 bp, Rattus norvegicus
gtcggaaacaagatctcttcgagct

SEQ ID NO: 495700 - DNA, 25 bp, Rattus norvegicus
gtcggaaacaagttctcttcgagct

SEQ ID NO: 495701 - DNA, 25 bp, Rattus norvegicus
gtcggaacgcccagtttctatgaat

SEQ ID NO: 495702 - DNA, 25 bp, Rattus norvegicus
gtcggaacgccctgtttctatgaat

SEQ ID NO: 495703 - DNA, 25 bp, Rattus norvegicus
gtcggaacttctacaccaggtatga

SEQ ID NO: 495704 - DNA, 25 bp, Rattus norvegicus
gtcggaacttcttcaccaggtatga

SEQ ID NO: 495705 - DNA, 25 bp, Rattus norvegicus
gtcggaagacccaggaccttgaact

SEQ ID NO: 495706 - DNA, 25 bp, Rattus norvegicus
gtcggaagaccctggaccttgaact

SEQ ID NO: 495707 - DNA, 25 bp, Rattus norvegicus
gtcggaagactgacaacggtcacct

SEQ ID NO: 495708 - DNA, 25 bp, Rattus norvegicus
gtcggaagactgtcaacggtcacct

SEQ ID NO: 495709 - DNA, 25 bp, Rattus norvegicus
gtcggaagcgtgaacttgttgtttt

SEQ ID NO: 495710 - DNA, 25 bp, Rattus norvegicus
gtcggaagcgtgtacttgttgtttt

SEQ ID NO: 495711 - DNA, 25 bp, Rattus norvegicus
gtcggaaggactagactccacagaa

SEQ ID NO: 495712 - DNA, 25 bp, Rattus norvegicus
gtcggaaggacttgactccacagaa

SEQ ID NO: 495713 - DNA, 25 bp, Rattus norvegicus
gtcggaaggcttacctccactggta

SEQ ID NO: 495714 - DNA, 25 bp, Rattus norvegicus
gtcggaaggctttcctccactggta

SEQ ID NO: 495715 - DNA, 25 bp, Rattus norvegicus
gtcggaatctgcagaactcaacctc

SEQ ID NO: 495716 - DNA, 25 bp, Rattus norvegicus
gtcggaatctgctgaactcaacctc

SEQ ID NO: 495717 - DNA, 25 bp, Rattus norvegicus
gtcggacaaacaaacacgcatgatt

SEQ ID NO: 495718 - DNA, 25 bp, Rattus norvegicus
gtcggacaaacatacacgcatgatt

SEQ ID NO: 495719 - DNA, 25 bp, Rattus norvegicus
gtcggacaccctagaggacagccat

SEQ ID NO: 495720 - DNA, 25 bp, Rattus norvegicus
gtcggacacccttgaggacagccat

SEQ ID NO: 495721 - DNA, 25 bp, Rattus norvegicus
gtcggacatcttaatttcttcctga

SEQ ID NO: 495722 - DNA, 25 bp, Rattus norvegicus
gtcggacatcttagtgacctgtgaa

SEQ ID NO: 495723 - DNA, 25 bp, Rattus norvegicus
gtcggacatctttatttcttcctga

SEQ ID NO: 495724 - DNA, 25 bp, Rattus norvegicus
gtcggacatctttgtgacctgtgaa

SEQ ID NO: 495725 - DNA, 25 bp, Rattus norvegicus
gtcggacgactgaagcttgttgtac

SEQ ID NO: 495726 - DNA, 25 bp, Rattus norvegicus
gtcggacgactgtagcttgttgtac

SEQ ID NO: 495727 - DNA, 25 bp, Rattus norvegicus
gtcggagacacacaaccgtcagcat

SEQ ID NO: 495728 - DNA, 25 bp, Rattus norvegicus
gtcggagacacagaaccgtcagcat

SEQ ID NO: 495729 - DNA, 25 bp, Rattus norvegicus
gtcggagagcaacgtcactatgcag

SEQ ID NO: 495730 - DNA, 25 bp, Rattus norvegicus
gtcggagagcaaggtcactatgcag

SEQ ID NO: 495731 - DNA, 25 bp, Rattus norvegicus
gtcggagagctgctacaacctcctg

SEQ ID NO: 495732 - DNA, 25 bp, Rattus norvegicus
gtcggagagctggtacaacctcctg

SEQ ID NO: 495733 - DNA, 25 bp, Rattus norvegicus
gtcggagaggctaatcacactggtg

SEQ ID NO: 495734 - DNA, 25 bp, Rattus norvegicus
gtcggagaggcttatcacactggtg

SEQ ID NO: 495735 - DNA, 25 bp, Rattus norvegicus
gtcggagctcaacgacttcggacct

SEQ ID NO: 495736 - DNA, 25 bp, Rattus norvegicus
gtcggagctcaaggacttcggacct

SEQ ID NO: 495737 - DNA, 25 bp, Rattus norvegicus
gtcggaggaatgaaccgccgtccaa

SEQ ID NO: 495738 - DNA, 25 bp, Rattus norvegicus
gtcggaggaatgtaccgccgtccaa

SEQ ID NO: 495739 - DNA, 25 bp, Rattus norvegicus
gtcggataccagagtccctcagtaa

SEQ ID NO: 495740 - DNA, 25 bp, Rattus norvegicus
gtcggataccagtgtccctcagtaa

SEQ ID NO: 495741 - DNA, 25 bp, Rattus norvegicus
gtcggatagtggagctgtggtgact

SEQ ID NO: 495742 - DNA, 25 bp, Rattus norvegicus
gtcggatagtggtgctgtggtgact

SEQ ID NO: 495743 - DNA, 25 bp, Rattus norvegicus
gtcggatccacaaggttccttgaaa

SEQ ID NO: 495744 - DNA, 25 bp, Rattus norvegicus
gtcggatccacatggttccttgaaa

SEQ ID NO: 495745 - DNA, 25 bp, Rattus norvegicus
gtcggatgacttcctgaactggcac

SEQ ID NO: 495746 - DNA, 25 bp, Rattus norvegicus
gtcggatgacttgctgaactggcac

SEQ ID NO: 495747 - DNA, 25 bp, Rattus norvegicus
gtcggatgctacatttaaggcctta

SEQ ID NO: 495748 - DNA, 25 bp, Rattus norvegicus
gtcggatgctacttttaaggcctta

SEQ ID NO: 495749 - DNA, 25 bp, Rattus norvegicus
gtcggatgggagatgctgctcacaa

SEQ ID NO: 495750 - DNA, 25 bp, Rattus norvegicus
gtcggatgggagttgctgctcacaa

SEQ ID NO: 495751 - DNA, 25 bp, Rattus norvegicus
gtcggatgtacaccagagctgacaa

SEQ ID NO: 495752 - DNA, 25 bp, Rattus norvegicus
gtcggatgtacagcagagctgacaa

SEQ ID NO: 495753 - DNA, 25 bp, Rattus norvegicus
gtcggcaagctacagagtcatcaga

SEQ ID NO: 495754 - DNA, 25 bp, Rattus norvegicus
gtcggcaagctagagagtcatcaga

SEQ ID NO: 495755 - DNA, 25 bp, Rattus norvegicus
gtcggcaaggctctcagtattttga

SEQ ID NO: 495756 - DNA, 25 bp, Rattus norvegicus
gtcggcaaggctgtcagtattttga

SEQ ID NO: 495757 - DNA, 25 bp, Rattus norvegicus
gtcggcacacttctcaggacaatga

SEQ ID NO: 495758 - DNA, 25 bp, Rattus norvegicus
gtcggcacacttgtcaggacaatga

SEQ ID NO: 495759 - DNA, 25 bp, Rattus norvegicus
gtcggcagacttacttttgagtgat

SEQ ID NO: 495760 - DNA, 25 bp, Rattus norvegicus
gtcggcagactttcttttgagtgat

SEQ ID NO: 495761 - DNA, 25 bp, Rattus norvegicus
gtcggcagcatcattgtcgttgtta

SEQ ID NO: 495762 - DNA, 25 bp, Rattus norvegicus
gtcggcagcatctttgtcgttgtta

SEQ ID NO: 495763 - DNA, 25 bp, Rattus norvegicus
gtcggcagtagtcttgtgtacttac

SEQ ID NO: 495764 - DNA, 25 bp, Rattus norvegicus
gtcggcagtagtgttgtgtacttac

SEQ ID NO: 495765 - DNA, 25 bp, Rattus norvegicus
gtcggcagtttgaaaaggactcgat

SEQ ID NO: 495766 - DNA, 25 bp, Rattus norvegicus
gtcggcagtttgtaaaggactcgat

SEQ ID NO: 495767 - DNA, 25 bp, Rattus norvegicus
gtcggcatcatcattatcctcactg

SEQ ID NO: 495768 - DNA, 25 bp, Rattus norvegicus
gtcggcatcatctttatcctcactg

SEQ ID NO: 495769 - DNA, 25 bp, Rattus norvegicus
gtcggcatctcaagctatacgcaga

SEQ ID NO: 495770 - DNA, 25 bp, Rattus norvegicus
gtcggcatctcatgctatacgcaga

SEQ ID NO: 495771 - DNA, 25 bp, Rattus norvegicus
gtcggcattttgcacacgtatgtat

SEQ ID NO: 495772 - DNA, 25 bp, Rattus norvegicus
gtcggcattttggacacgtatgtat

SEQ ID NO: 495773 - DNA, 25 bp, Rattus norvegicus
gtcggccaagtcagtgctgttttat

SEQ ID NO: 495774 - DNA, 25 bp, Rattus norvegicus
gtcggccaagtctgtgctgttttat

SEQ ID NO: 495775 - DNA, 25 bp, Rattus norvegicus
gtcggccagccactgagcagacgat

SEQ ID NO: 495776 - DNA, 25 bp, Rattus norvegicus
gtcggccagccagtgagcagacgat

SEQ ID NO: 495777 - DNA, 25 bp, Rattus norvegicus
gtcggcccacagagtcggtgctcac

SEQ ID NO: 495778 - DNA, 25 bp, Rattus norvegicus
gtcggcccacagtgtcggtgctcac

SEQ ID NO: 495779 - DNA, 25 bp, Rattus norvegicus
gtcggcctaacactgatttaaaatt

SEQ ID NO: 495780 - DNA, 25 bp, Rattus norvegicus
gtcggcctaacagtgatttaaaatt

SEQ ID NO: 495781 - DNA, 25 bp, Rattus norvegicus
gtcggcctagatcctggttctgcag

SEQ ID NO: 495782 - DNA, 25 bp, Rattus norvegicus
gtcggcctagatgctggttctgcag

SEQ ID NO: 495783 - DNA, 25 bp, Rattus norvegicus
gtcggcctcgctcgcgcacaatgag

SEQ ID NO: 495784 - DNA, 25 bp, Rattus norvegicus
gtcggcctcgctggcgcacaatgag

SEQ ID NO: 495785 - DNA, 25 bp, Rattus norvegicus
gtcggcctctgtcaagattgcataa

SEQ ID NO: 495786 - DNA, 25 bp, Rattus norvegicus
gtcggcctctgtgaagattgcataa

SEQ ID NO: 495787 - DNA, 25 bp, Rattus norvegicus
gtcggcctgggaatctgatcttttc

SEQ ID NO: 495788 - DNA, 25 bp, Rattus norvegicus
gtcggcctgggattctgatcttttc

SEQ ID NO: 495789 - DNA, 25 bp, Rattus norvegicus
gtcggcgatataaaactgctgtcag

SEQ ID NO: 495790 - DNA, 25 bp, Rattus norvegicus
gtcggcgatatataactgctgtcag

SEQ ID NO: 495791 - DNA, 25 bp, Rattus norvegicus
gtcggcgatcaaagcatgcacctgt

SEQ ID NO: 495792 - DNA, 25 bp, Rattus norvegicus
gtcggcgatcaatgcatgcacctgt

SEQ ID NO: 495793 - DNA, 25 bp, Rattus norvegicus
gtcggcgcgcatacgggcacagata

SEQ ID NO: 495794 - DNA, 25 bp, Rattus norvegicus
gtcggcgcgcattcgggcacagata

SEQ ID NO: 495795 - DNA, 25 bp, Rattus norvegicus
gtcggcgtatagacattctgtcaga

SEQ ID NO: 495796 - DNA, 25 bp, Rattus norvegicus
gtcggcgtatagtcattctgtcaga

SEQ ID NO: 495797 - DNA, 25 bp, Rattus norvegicus
gtcggcgttaccataactgatcctt

SEQ ID NO: 495798 - DNA, 25 bp, Rattus norvegicus
gtcggcgttaccttaactgatcctt

SEQ ID NO: 495799 - DNA, 25 bp, Rattus norvegicus
gtcggctacaccaaagattaccctg

SEQ ID NO: 495800 - DNA, 25 bp, Rattus norvegicus
gtcggctacacctaagattaccctg

SEQ ID NO: 495801 - DNA, 25 bp, Rattus norvegicus
gtcggctcccgtaagttactgaact

SEQ ID NO: 495802 - DNA, 25 bp, Rattus norvegicus
gtcggctcccgttagttactgaact

SEQ ID NO: 495803 - DNA, 25 bp, Rattus norvegicus
gtcggctctggaacttgttgaagtc

SEQ ID NO: 495804 - DNA, 25 bp, Rattus norvegicus
gtcggctctggatcttgttgaagtc

SEQ ID NO: 495805 - DNA, 25 bp, Rattus norvegicus
gtcggctgaagcctgagcagatact

SEQ ID NO: 495806 - DNA, 25 bp, Rattus norvegicus
gtcggctgaagcgtgagcagatact

SEQ ID NO: 495807 - DNA, 25 bp, Rattus norvegicus
gtcggctgctgcagtacaccctgta

SEQ ID NO: 495808 - DNA, 25 bp, Rattus norvegicus
gtcggctgctgctgtacaccctgta

SEQ ID NO: 495809 - DNA, 25 bp, Rattus norvegicus
gtcggctgtcttctaaatatcttat

SEQ ID NO: 495810 - DNA, 25 bp, Rattus norvegicus
gtcggctgtcttgtaaatatcttat

SEQ ID NO: 495811 - DNA, 25 bp, Rattus norvegicus
gtcggcttcctgatggcactggcgc

SEQ ID NO: 495812 - DNA, 25 bp, Rattus norvegicus
gtcggcttcctgttggcactggcgc

SEQ ID NO: 495813 - DNA, 25 bp, Rattus norvegicus
gtcggcttcgttcctgtgttttata

SEQ ID NO: 495814 - DNA, 25 bp, Rattus norvegicus
gtcggcttcgttgctgtgttttata

SEQ ID NO: 495815 - DNA, 25 bp, Rattus norvegicus
gtcgggaaagcaccttcggccccaa

SEQ ID NO: 495816 - DNA, 25 bp, Rattus norvegicus
gtcgggaaagcagcttcggccccaa

SEQ ID NO: 495817 - DNA, 25 bp, Rattus norvegicus
gtcgggaaccttactatgtcatgga

SEQ ID NO: 495818 - DNA, 25 bp, Rattus norvegicus
gtcgggaacctttctatgtcatgga

SEQ ID NO: 495819 - DNA, 25 bp, Rattus norvegicus
gtcgggaactccatgctttttgctt

SEQ ID NO: 495820 - DNA, 25 bp, Rattus norvegicus
gtcgggaactccttgctttttgctt

SEQ ID NO: 495821 - DNA, 25 bp, Rattus norvegicus
gtcgggaagcctctcagttaattga

SEQ ID NO: 495822 - DNA, 25 bp, Rattus norvegicus
gtcgggaagcctgtcagttaattga

SEQ ID NO: 495823 - DNA, 25 bp, Rattus norvegicus
gtcgggaaggaaccccagcgccttt

SEQ ID NO: 495824 - DNA, 25 bp, Rattus norvegicus
gtcgggaaggaagcccagcgccttt

SEQ ID NO: 495825 - DNA, 25 bp, Rattus norvegicus
gtcgggacaagcaaggaagcccaca

SEQ ID NO: 495826 - DNA, 25 bp, Rattus norvegicus
gtcgggacaagctaggaagcccaca

SEQ ID NO: 495827 - DNA, 25 bp, Rattus norvegicus
gtcgggacatgtaacttcaaaccag

SEQ ID NO: 495828 - DNA, 25 bp, Rattus norvegicus
gtcgggacatgttacttcaaaccag

SEQ ID NO: 495829 - DNA, 25 bp, Rattus norvegicus
gtcgggacttaaatttcacactaga

SEQ ID NO: 495830 - DNA, 25 bp, Rattus norvegicus
gtcgggacttaattttcacactaga

SEQ ID NO: 495831 - DNA, 25 bp, Rattus norvegicus
gtcgggataaacacctgtcatccta

SEQ ID NO: 495832 - DNA, 25 bp, Rattus norvegicus
gtcgggataaactcctgtcatccta

SEQ ID NO: 495833 - DNA, 25 bp, Rattus norvegicus
gtcgggatatgcactgttaggatga

SEQ ID NO: 495834 - DNA, 25 bp, Rattus norvegicus
gtcgggatatgctctgttaggatga

SEQ ID NO: 495835 - DNA, 25 bp, Rattus norvegicus
gtcgggatgtgcaaagcctggtcct

SEQ ID NO: 495836 - DNA, 25 bp, Rattus norvegicus
gtcgggatgtgctaagcctggtcct

SEQ ID NO: 495837 - DNA, 25 bp, Rattus norvegicus
gtcgggattaagaccgatcacatgg

SEQ ID NO: 495838 - DNA, 25 bp, Rattus norvegicus
gtcgggattaagtccgatcacatgg

SEQ ID NO: 495839 - DNA, 25 bp, Rattus norvegicus
gtcgggatttagactgtcaggcacc

SEQ ID NO: 495840 - DNA, 25 bp, Rattus norvegicus
gtcgggatttagtctgtcaggcacc

SEQ ID NO: 495841 - DNA, 25 bp, Rattus norvegicus
gtcgggcaatgtcagccgcttgctc

SEQ ID NO: 495842 - DNA, 25 bp, Rattus norvegicus
gtcgggcaatgtgagccgcttgctc

SEQ ID NO: 495843 - DNA, 25 bp, Rattus norvegicus
gtcgggcacgacagggctgctctca

SEQ ID NO: 495844 - DNA, 25 bp, Rattus norvegicus
gtcgggcacgactgggctgctctca

SEQ ID NO: 495845 - DNA, 25 bp, Rattus norvegicus
gtcgggcagccgcacactatgagca

SEQ ID NO: 495846 - DNA, 25 bp, Rattus norvegicus
gtcgggcagccggacactatgagca

SEQ ID NO: 495847 - DNA, 25 bp, Rattus norvegicus
gtcgggccaacgagtattacttgtc

SEQ ID NO: 495848 - DNA, 25 bp, Rattus norvegicus
gtcgggccaacgtgtattacttgtc

SEQ ID NO: 495849 - DNA, 25 bp, Rattus norvegicus
gtcgggccaccaattcactgagtga

SEQ ID NO: 495850 - DNA, 25 bp, Rattus norvegicus
gtcgggccaccatttcactgagtga

SEQ ID NO: 495851 - DNA, 25 bp, Rattus norvegicus
gtcgggccagtaattctgctatgga

SEQ ID NO: 495852 - DNA, 25 bp, Rattus norvegicus
gtcgggccagtatttctgctatgga

SEQ ID NO: 495853 - DNA, 25 bp, Rattus norvegicus
gtcgggcctacaaacacaaagcaat

SEQ ID NO: 495854 - DNA, 25 bp, Rattus norvegicus
gtcgggcctacatacacaaagcaat

SEQ ID NO: 495855 - DNA, 25 bp, Rattus norvegicus
gtcgggcctggtaagtacttggatg

SEQ ID NO: 495856 - DNA, 25 bp, Rattus norvegicus
gtcgggcctggttagtacttggatg

SEQ ID NO: 495857 - DNA, 25 bp, Rattus norvegicus
gtcgggcgtctgacttgagaattaa

SEQ ID NO: 495858 - DNA, 25 bp, Rattus norvegicus
gtcgggcgtctgtcttgagaattaa

SEQ ID NO: 495859 - DNA, 25 bp, Rattus norvegicus
gtcgggcgtttacctttgaggctcc

SEQ ID NO: 495860 - DNA, 25 bp, Rattus norvegicus
gtcgggcgtttagctttgaggctcc

SEQ ID NO: 495861 - DNA, 25 bp, Rattus norvegicus
gtcgggctaacacacacacagacgg

SEQ ID NO: 495862 - DNA, 25 bp, Rattus norvegicus
gtcgggctaacagacacacagacgg

SEQ ID NO: 495863 - DNA, 25 bp, Rattus norvegicus
gtcgggctagagagatgcttttcca

SEQ ID NO: 495864 - DNA, 25 bp, Rattus norvegicus
gtcgggctagagtgatgcttttcca

SEQ ID NO: 495865 - DNA, 25 bp, Rattus norvegicus
gtcgggctctcgaaataatcgcagt

SEQ ID NO: 495866 - DNA, 25 bp, Rattus norvegicus
gtcgggctctcgtaataatcgcagt

SEQ ID NO: 495867 - DNA, 25 bp, Rattus norvegicus
gtcgggctgtatctccacagtaagc

SEQ ID NO: 495868 - DNA, 25 bp, Rattus norvegicus
gtcgggctgtatgtccacagtaagc

SEQ ID NO: 495869 - DNA, 25 bp, Rattus norvegicus
gtcgggctttctagagctccctgga

SEQ ID NO: 495870 - DNA, 25 bp, Rattus norvegicus
gtcgggctttcttgagctccctgga

SEQ ID NO: 495871 - DNA, 25 bp, Rattus norvegicus
gtcgggtaaaccacagtcacagtta

SEQ ID NO: 495872 - DNA, 25 bp, Rattus norvegicus
gtcgggtaaacctcagtcacagtta

SEQ ID NO: 495873 - DNA, 25 bp, Rattus norvegicus
gtcgggtaaggtctccacttgcaat

SEQ ID NO: 495874 - DNA, 25 bp, Rattus norvegicus
gtcgggtaaggtgtccacttgcaat

SEQ ID NO: 495875 - DNA, 25 bp, Rattus norvegicus
gtcgggtagtgtatgtgaatttctt

SEQ ID NO: 495876 - DNA, 25 bp, Rattus norvegicus
gtcgggtagtgtttgtgaatttctt

SEQ ID NO: 495877 - DNA, 25 bp, Rattus norvegicus
gtcgggtgcatacgctccgcagaac

SEQ ID NO: 495878 - DNA, 25 bp, Rattus norvegicus
gtcgggtgcataggctccgcagaac

SEQ ID NO: 495879 - DNA, 25 bp, Rattus norvegicus
gtcgggtgccagatccaggaagttt

SEQ ID NO: 495880 - DNA, 25 bp, Rattus norvegicus
gtcgggtgccagttccaggaagttt

SEQ ID NO: 495881 - DNA, 25 bp, Rattus norvegicus
gtcgggtggttgaaactggtcataa

SEQ ID NO: 495882 - DNA, 25 bp, Rattus norvegicus
gtcgggtggttgtaactggtcataa

SEQ ID NO: 495883 - DNA, 25 bp, Rattus norvegicus
gtcgggttcctcacaaatccatcat

SEQ ID NO: 495884 - DNA, 25 bp, Rattus norvegicus
gtcgggttcctctcaaatccatcat

SEQ ID NO: 495885 - DNA, 25 bp, Rattus norvegicus
gtcggtaaactcatctttgtgctgt

SEQ ID NO: 495886 - DNA, 25 bp, Rattus norvegicus
gtcggtaaactcttctttgtgctgt

SEQ ID NO: 495887 - DNA, 25 bp, Rattus norvegicus
gtcggtaagagaccctgagttaaag

SEQ ID NO: 495888 - DNA, 25 bp, Rattus norvegicus
gtcggtaagagagcctgagttaaag

SEQ ID NO: 495889 - DNA, 25 bp, Rattus norvegicus
gtcggtacaagccacatttcagttg

SEQ ID NO: 495890 - DNA, 25 bp, Rattus norvegicus
gtcggtacaagcgacatttcagttg

SEQ ID NO: 495891 - DNA, 25 bp, Rattus norvegicus
gtcggtagcgaaacgccacgccggc

SEQ ID NO: 495892 - DNA, 25 bp, Rattus norvegicus
gtcggtagcgaatcgccacgccggc

SEQ ID NO: 495893 - DNA, 25 bp, Rattus norvegicus
gtcggtagtgctaattacctccaaa

SEQ ID NO: 495894 - DNA, 25 bp, Rattus norvegicus
gtcggtagtgcttattacctccaaa

SEQ ID NO: 495895 - DNA, 25 bp, Rattus norvegicus
gtcggtatttatagtttcccactgt

SEQ ID NO: 495896 - DNA, 25 bp, Rattus norvegicus
gtcggtatttattgtttcccactgt

SEQ ID NO: 495897 - DNA, 25 bp, Rattus norvegicus
gtcggtcacctccttactgtaaata

SEQ ID NO: 495898 - DNA, 25 bp, Rattus norvegicus
gtcggtcacctcgttactgtaaata

SEQ ID NO: 495899 - DNA, 25 bp, Rattus norvegicus
gtcggtcactttaggcctttgagac

SEQ ID NO: 495900 - DNA, 25 bp, Rattus norvegicus
gtcggtcacttttggcctttgagac

SEQ ID NO: 495901 - DNA, 25 bp, Rattus norvegicus
gtcggtcctgacagttagaggtctt

SEQ ID NO: 495902 - DNA, 25 bp, Rattus norvegicus
gtcggtcctgactgttagaggtctt

SEQ ID NO: 495903 - DNA, 25 bp, Rattus norvegicus
gtcggtcctggaagcagcgaagcca

SEQ ID NO: 495904 - DNA, 25 bp, Rattus norvegicus
gtcggtcctggatgcagcgaagcca

SEQ ID NO: 495905 - DNA, 25 bp, Rattus norvegicus
gtcggtcggaagctattgcagtcat

SEQ ID NO: 495906 - DNA, 25 bp, Rattus norvegicus
gtcggtcggaaggtattgcagtcat

SEQ ID NO: 495907 - DNA, 25 bp, Rattus norvegicus
gtcggtctctcacagttttctaaat

SEQ ID NO: 495908 - DNA, 25 bp, Rattus norvegicus
gtcggtctctcagagttttctaaat

SEQ ID NO: 495909 - DNA, 25 bp, Rattus norvegicus
gtcggtctgcagagtgtcagttcca

SEQ ID NO: 495910 - DNA, 25 bp, Rattus norvegicus
gtcggtctgcagtgtgtcagttcca

SEQ ID NO: 495911 - DNA, 25 bp, Rattus norvegicus
gtcggtctggacatcgctttgcgcg

SEQ ID NO: 495912 - DNA, 25 bp, Rattus norvegicus
gtcggtctggacttcgctttgcgcg

SEQ ID NO: 495913 - DNA, 25 bp, Rattus norvegicus
gtcggtcttccactagtgagtcata

SEQ ID NO: 495914 - DNA, 25 bp, Rattus norvegicus
gtcggtcttccagtagtgagtcata

SEQ ID NO: 495915 - DNA, 25 bp, Rattus norvegicus
gtcggtcttcttagcggcgaagcca

SEQ ID NO: 495916 - DNA, 25 bp, Rattus norvegicus
gtcggtcttctttgcggcgaagcca

SEQ ID NO: 495917 - DNA, 25 bp, Rattus norvegicus
gtcggtcttgcgcttgaagtgtcac

SEQ ID NO: 495918 - DNA, 25 bp, Rattus norvegicus
gtcggtcttgcggttgaagtgtcac

SEQ ID NO: 495919 - DNA, 25 bp, Rattus norvegicus
gtcggtctttctaatgtagcttttt

SEQ ID NO: 495920 - DNA, 25 bp, Rattus norvegicus
gtcggtctttcttatgtagcttttt

SEQ ID NO: 495921 - DNA, 25 bp, Rattus norvegicus
gtcggtgaagacaaaccagacccgg

SEQ ID NO: 495922 - DNA, 25 bp, Rattus norvegicus
gtcggtgaagactaaccagacccgg

SEQ ID NO: 495923 - DNA, 25 bp, Rattus norvegicus
gtcggtgacattctggaccttggca

SEQ ID NO: 495924 - DNA, 25 bp, Rattus norvegicus
gtcggtgacattgtggaccttggca

SEQ ID NO: 495925 - DNA, 25 bp, Rattus norvegicus
gtcggtgatggcaaactgccgtgcc

SEQ ID NO: 495926 - DNA, 25 bp, Rattus norvegicus
gtcggtgatggctaactgccgtgcc

SEQ ID NO: 495927 - DNA, 25 bp, Rattus norvegicus
gtcggtgcatgtacctgccattttt

SEQ ID NO: 495928 - DNA, 25 bp, Rattus norvegicus
gtcggtgcatgttcctgccattttt

SEQ ID NO: 495929 - DNA, 25 bp, Rattus norvegicus
gtcggtgccattcaagaacattttt

SEQ ID NO: 495930 - DNA, 25 bp, Rattus norvegicus
gtcggtgccattgaagaacattttt

SEQ ID NO: 495931 - DNA, 25 bp, Rattus norvegicus
gtcggtgctgaacacccacatgagg

SEQ ID NO: 495932 - DNA, 25 bp, Rattus norvegicus
gtcggtgctgaagacccacatgagg

SEQ ID NO: 495933 - DNA, 25 bp, Rattus norvegicus
gtcggtgcttcccagaatgctcaga

SEQ ID NO: 495934 - DNA, 25 bp, Rattus norvegicus
gtcggtgcttccgagaatgctcaga

SEQ ID NO: 495935 - DNA, 25 bp, Rattus norvegicus
gtcggtggtcatcaactacaatcac

SEQ ID NO: 495936 - DNA, 25 bp, Rattus norvegicus
gtcggtggtcatgaactacaatcac

SEQ ID NO: 495937 - DNA, 25 bp, Rattus norvegicus
gtcggtggtggacacatctgcatcc

SEQ ID NO: 495938 - DNA, 25 bp, Rattus norvegicus
gtcggtggtggagacatctgcatcc

SEQ ID NO: 495939 - DNA, 25 bp, Rattus norvegicus
gtcggtgtcagcagtgtatgtacat

SEQ ID NO: 495940 - DNA, 25 bp, Rattus norvegicus
gtcggtgtcagctgtgtatgtacat

SEQ ID NO: 495941 - DNA, 25 bp, Rattus norvegicus
gtcggtgtcttaagtacttgttatc

SEQ ID NO: 495942 - DNA, 25 bp, Rattus norvegicus
gtcggtgtcttatgtacttgttatc

SEQ ID NO: 495943 - DNA, 25 bp, Rattus norvegicus
gtcggtgtcttcatggaggatgctt

SEQ ID NO: 495944 - DNA, 25 bp, Rattus norvegicus
gtcggtgtcttcttggaggatgctt

SEQ ID NO: 495945 - DNA, 25 bp, Rattus norvegicus
gtcggtgttgataccattccgtgga

SEQ ID NO: 495946 - DNA, 25 bp, Rattus norvegicus
gtcggtgttgattccattccgtgga

SEQ ID NO: 495947 - DNA, 25 bp, Rattus norvegicus
gtcggttagcaactagtacttcact

SEQ ID NO: 495948 - DNA, 25 bp, Rattus norvegicus
gtcggttagcaagtagtacttcact

SEQ ID NO: 495949 - DNA, 25 bp, Rattus norvegicus
gtcggtttacaactctcactttttg

SEQ ID NO: 495950 - DNA, 25 bp, Rattus norvegicus
gtcggtttacaagtctcactttttg

SEQ ID NO: 495951 - DNA, 25 bp, Rattus norvegicus
gtcggtttccctagaaatcactcaa

SEQ ID NO: 495952 - DNA, 25 bp, Rattus norvegicus
gtcggtttcccttgaaatcactcaa

SEQ ID NO: 495953 - DNA, 25 bp, Rattus norvegicus
gtcggtttctggattctgtcttaag

SEQ ID NO: 495954 - DNA, 25 bp, Rattus norvegicus
gtcggtttctggtttctgtcttaag

SEQ ID NO: 495955 - DNA, 25 bp, Rattus norvegicus
gtcggtttgcagctgttatctgact

SEQ ID NO: 495956 - DNA, 25 bp, Rattus norvegicus
gtcggtttgcaggtgttatctgact

SEQ ID NO: 495957 - DNA, 25 bp, Rattus norvegicus
gtcggttttgttacgcaacacgaag

SEQ ID NO: 495958 - DNA, 25 bp, Rattus norvegicus
gtcggttttgtttcgcaacacgaag

SEQ ID NO: 495959 - DNA, 25 bp, Rattus norvegicus
gtcgtaactctgaaggtccagcaac

SEQ ID NO: 495960 - DNA, 25 bp, Rattus norvegicus
gtcgtaactctgtaggtccagcaac

SEQ ID NO: 495961 - DNA, 25 bp, Rattus norvegicus
gtcgtaactggaccgattggcgtcc

SEQ ID NO: 495962 - DNA, 25 bp, Rattus norvegicus
gtcgtaactggagcgattggcgtcc

SEQ ID NO: 495963 - DNA, 25 bp, Rattus norvegicus
gtcgtaatataaactccccttttct

SEQ ID NO: 495964 - DNA, 25 bp, Rattus norvegicus
gtcgtaatataatctccccttttct

SEQ ID NO: 495965 - DNA, 25 bp, Rattus norvegicus
gtcgtagacgaactctgctttgggt

SEQ ID NO: 495966 - DNA, 25 bp, Rattus norvegicus
gtcgtagacgaagtctgctttgggt

SEQ ID NO: 495967 - DNA, 25 bp, Rattus norvegicus
gtcgtagactttctggctctgacat

SEQ ID NO: 495968 - DNA, 25 bp, Rattus norvegicus
gtcgtagactttgtggctctgacat

SEQ ID NO: 495969 - DNA, 25 bp, Rattus norvegicus
gtcgtagagtccattgtatctgtaa

SEQ ID NO: 495970 - DNA, 25 bp, Rattus norvegicus
gtcgtagagtcctttgtatctgtaa

SEQ ID NO: 495971 - DNA, 25 bp, Rattus norvegicus
gtcgtagccgaacatggtagtgcat

SEQ ID NO: 495972 - DNA, 25 bp, Rattus norvegicus
gtcgtagccgaagatggtagtgcat

SEQ ID NO: 495973 - DNA, 25 bp, Rattus norvegicus
gtcgtagtagacaaccacaatcagg

SEQ ID NO: 495974 - DNA, 25 bp, Rattus norvegicus
gtcgtagtagactaccacaatcagg

SEQ ID NO: 495975 - DNA, 25 bp, Rattus norvegicus
gtcgtatccaccagtgtatcagcat

SEQ ID NO: 495976 - DNA, 25 bp, Rattus norvegicus
gtcgtatccacctgtgtatcagcat

SEQ ID NO: 495977 - DNA, 25 bp, Rattus norvegicus
gtcgtatggcctcaacttagctgtt

SEQ ID NO: 495978 - DNA, 25 bp, Rattus norvegicus
gtcgtatggcctgaacttagctgtt

SEQ ID NO: 495979 - DNA, 25 bp, Rattus norvegicus
gtcgtatgtactcaggccatggcag

SEQ ID NO: 495980 - DNA, 25 bp, Rattus norvegicus
gtcgtatgtactgaggccatggcag

SEQ ID NO: 495981 - DNA, 25 bp, Rattus norvegicus
gtcgtatttgctctctgaactggga

SEQ ID NO: 495982 - DNA, 25 bp, Rattus norvegicus
gtcgtatttgctgtctgaactggga

SEQ ID NO: 495983 - DNA, 25 bp, Rattus norvegicus
gtcgtatttggtcacggcagaatta

SEQ ID NO: 495984 - DNA, 25 bp, Rattus norvegicus
gtcgtatttggtgacggcagaatta

SEQ ID NO: 495985 - DNA, 25 bp, Rattus norvegicus
gtcgtcaagatgctaccgttcagga

SEQ ID NO: 495986 - DNA, 25 bp, Rattus norvegicus
gtcgtcaaggttcagcttcacgtct

SEQ ID NO: 495987 - DNA, 25 bp, Rattus norvegicus
gtcgtcaaggttgagcttcacgtct

SEQ ID NO: 495988 - DNA, 25 bp, Rattus norvegicus
gtcgtcacgcggctacagctgcatg

SEQ ID NO: 495989 - DNA, 25 bp, Rattus norvegicus
gtcgtcacgcgggtacagctgcatg

SEQ ID NO: 495990 - DNA, 25 bp, Rattus norvegicus
gtcgtcacgtgtacctccaggtcct

SEQ ID NO: 495991 - DNA, 25 bp, Rattus norvegicus
gtcgtcacgtgttcctccaggtcct

SEQ ID NO: 495992 - DNA, 25 bp, Rattus norvegicus
gtcgtcagaaaactcaggccttcca

SEQ ID NO: 495993 - DNA, 25 bp, Rattus norvegicus
gtcgtcagaaaagtcaggccttcca

SEQ ID NO: 495994 - DNA, 25 bp, Rattus norvegicus
gtcgtcagacttatgggaacattta

SEQ ID NO: 495995 - DNA, 25 bp, Rattus norvegicus
gtcgtcagacttttgggaacattta

SEQ ID NO: 495996 - DNA, 25 bp, Rattus norvegicus
gtcgtcagccacaacatttatcatt

SEQ ID NO: 495997 - DNA, 25 bp, Rattus norvegicus
gtcgtcagccactacatttatcatt

SEQ ID NO: 495998 - DNA, 25 bp, Rattus norvegicus
gtcgtcatactcatttgggaagcct

SEQ ID NO: 495999 - DNA, 25 bp, Rattus norvegicus
gtcgtcatactcttttgggaagcct

SEQ ID NO: 496000 - DNA, 25 bp, Rattus norvegicus
gtcgtcatcctcatcggcctcaaag

SEQ ID NO: 496001 - DNA, 25 bp, Rattus norvegicus
gtcgtcatcctcttcggcctcaaag

SEQ ID NO: 496002 - DNA, 25 bp, Rattus norvegicus
gtcgtcatggacagggtgcccttct

SEQ ID NO: 496003 - DNA, 25 bp, Rattus norvegicus
gtcgtcatggactgggtgcccttct

SEQ ID NO: 496004 - DNA, 25 bp, Rattus norvegicus
gtcgtcatttacaactttgggttgt

SEQ ID NO: 496005 - DNA, 25 bp, Rattus norvegicus
gtcgtcatttactactttgggttgt

SEQ ID NO: 496006 - DNA, 25 bp, Rattus norvegicus
gtcgtcatttggaactggaggctta

SEQ ID NO: 496007 - DNA, 25 bp, Rattus norvegicus
gtcgtcatttggtactggaggctta

SEQ ID NO: 496008 - DNA, 25 bp, Rattus norvegicus
gtcgtccaccatcaaacacgttagg

SEQ ID NO: 496009 - DNA, 25 bp, Rattus norvegicus
gtcgtccaccatgaaacacgttagg

SEQ ID NO: 496010 - DNA, 25 bp, Rattus norvegicus
gtcgtccctggaccacatcagtgct

SEQ ID NO: 496011 - DNA, 25 bp, Rattus norvegicus
gtcgtccctggagcacatcagtgct

SEQ ID NO: 496012 - DNA, 25 bp, Rattus norvegicus
gtcgtcctcagccagggtgtgtcca

SEQ ID NO: 496013 - DNA, 25 bp, Rattus norvegicus
gtcgtcctcagcgagggtgtgtcca

SEQ ID NO: 496014 - DNA, 25 bp, Rattus norvegicus
gtcgtcctgtctcccgtgggcttca

SEQ ID NO: 496015 - DNA, 25 bp, Rattus norvegicus
gtcgtcctgtctgccgtgggcttca

SEQ ID NO: 496016 - DNA, 25 bp, Rattus norvegicus
gtcgtcctgtgcactttgagcttat

SEQ ID NO: 496017 - DNA, 25 bp, Rattus norvegicus
gtcgtcctgtgctctttgagcttat

SEQ ID NO: 496018 - DNA, 25 bp, Rattus norvegicus
gtcgtccttctaccaagagaatgtt

SEQ ID NO: 496019 - DNA, 25 bp, Rattus norvegicus
gtcgtccttctagcaagagaatgtt

SEQ ID NO: 496020 - DNA, 25 bp, Rattus norvegicus
gtcgtcgacgacacaattcttcaga

SEQ ID NO: 496021 - DNA, 25 bp, Rattus norvegicus
gtcgtcgacgactcaattcttcaga

SEQ ID NO: 496022 - DNA, 25 bp, Rattus norvegicus
gtcgtcggagcccaacttggcatcg

SEQ ID NO: 496023 - DNA, 25 bp, Rattus norvegicus
gtcgtcggagccgaacttggcatcg

SEQ ID NO: 496024 - DNA, 25 bp, Rattus norvegicus
gtcgtcgtcatacctgagtcagaag

SEQ ID NO: 496025 - DNA, 25 bp, Rattus norvegicus
gtcgtcgtcatagctgagtcagaag

SEQ ID NO: 496026 - DNA, 25 bp, Rattus norvegicus
gtcgtctaagtcatgctgttctggc

SEQ ID NO: 496027 - DNA, 25 bp, Rattus norvegicus
gtcgtctaagtcttgctgttctggc

SEQ ID NO: 496028 - DNA, 25 bp, Rattus norvegicus
gtcgtctacagcctgatgtcacaga

SEQ ID NO: 496029 - DNA, 25 bp, Rattus norvegicus
gtcgtctacagcgtgatgtcacaga

SEQ ID NO: 496030 - DNA, 25 bp, Rattus norvegicus
gtcgtctcacgcaggcagccatcta

SEQ ID NO: 496031 - DNA, 25 bp, Rattus norvegicus
gtcgtctcacgctggcagccatcta

SEQ ID NO: 496032 - DNA, 25 bp, Rattus norvegicus
gtcgtctccaagatcgaagcattca

SEQ ID NO: 496033 - DNA, 25 bp, Rattus norvegicus
gtcgtctccaagttcgaagcattca

SEQ ID NO: 496034 - DNA, 25 bp, Rattus norvegicus
gtcgtctccatgacaactgtaggct

SEQ ID NO: 496035 - DNA, 25 bp, Rattus norvegicus
gtcgtctccatgtcaactgtaggct

SEQ ID NO: 496036 - DNA, 25 bp, Rattus norvegicus
gtcgtctcttctagtctcagctgta

SEQ ID NO: 496037 - DNA, 25 bp, Rattus norvegicus
gtcgtctcttcttgtctcagctgta

SEQ ID NO: 496038 - DNA, 25 bp, Rattus norvegicus
gtcgtctgctggattgtccataaca

SEQ ID NO: 496039 - DNA, 25 bp, Rattus norvegicus
gtcgtctgctggtttgtccataaca

SEQ ID NO: 496040 - DNA, 25 bp, Rattus norvegicus
gtcgtctgtgatccctatgaatcca

SEQ ID NO: 496041 - DNA, 25 bp, Rattus norvegicus
gtcgtctgtgatgcctatgaatcca

SEQ ID NO: 496042 - DNA, 25 bp, Rattus norvegicus
gtcgtcttcaagaccagtggagacc

SEQ ID NO: 496043 - DNA, 25 bp, Rattus norvegicus
gtcgtcttcaagtccagtggagacc

SEQ ID NO: 496044 - DNA, 25 bp, Rattus norvegicus
gtcgtcttctgtctgtaattgccaa

SEQ ID NO: 496045 - DNA, 25 bp, Rattus norvegicus
gtcgtcttctgtgtgtaattgccaa

SEQ ID NO: 496046 - DNA, 25 bp, Rattus norvegicus
gtcgtcttgaccaaaactggtctca

SEQ ID NO: 496047 - DNA, 25 bp, Rattus norvegicus
gtcgtcttgacctaaactggtctca

SEQ ID NO: 496048 - DNA, 25 bp, Rattus norvegicus
gtcgtcttgcagaagaatgtgtcta

SEQ ID NO: 496049 - DNA, 25 bp, Rattus norvegicus
gtcgtcttgcagtagaatgtgtcta

SEQ ID NO: 496050 - DNA, 25 bp, Rattus norvegicus
gtcgtcttgctcctcttgtgcccaa

SEQ ID NO: 496051 - DNA, 25 bp, Rattus norvegicus
gtcgtcttgctcgtcttgtgcccaa

SEQ ID NO: 496052 - DNA, 25 bp, Rattus norvegicus
gtcgtctttcttcagagcgatgcgg

SEQ ID NO: 496053 - DNA, 25 bp, Rattus norvegicus
gtcgtctttcttgagagcgatgcgg

SEQ ID NO: 496054 - DNA, 25 bp, Rattus norvegicus
gtcgtgaacatcagccttgttaact

SEQ ID NO: 496055 - DNA, 25 bp, Rattus norvegicus
gtcgtgaacatctgccttgttaact

SEQ ID NO: 496056 - DNA, 25 bp, Rattus norvegicus
gtcgtgaagacccaccttagggaca

SEQ ID NO: 496057 - DNA, 25 bp, Rattus norvegicus
gtcgtgaagaccgaccttagggaca

SEQ ID NO: 496058 - DNA, 25 bp, Rattus norvegicus
gtcgtgaagctcatcctttctaaag

SEQ ID NO: 496059 - DNA, 25 bp, Rattus norvegicus
gtcgtgaagctcttcctttctaaag

SEQ ID NO: 496060 - DNA, 25 bp, Rattus norvegicus
gtcgtgagccaccaagtgattggtt

SEQ ID NO: 496061 - DNA, 25 bp, Rattus norvegicus
gtcgtgagccacgaagtgattggtt

SEQ ID NO: 496062 - DNA, 25 bp, Rattus norvegicus
gtcgtgatattgcaccccgtaaata

SEQ ID NO: 496063 - DNA, 25 bp, Rattus norvegicus
gtcgtgatattggaccccgtaaata

SEQ ID NO: 496064 - DNA, 25 bp, Rattus norvegicus
gtcgtgatcacaactgagcctgcag

SEQ ID NO: 496065 - DNA, 25 bp, Rattus norvegicus
gtcgtgatcacatctgagcctgcag

SEQ ID NO: 496066 - DNA, 25 bp, Rattus norvegicus
gtcgtgcacaagaggatctccatca

SEQ ID NO: 496067 - DNA, 25 bp, Rattus norvegicus
gtcgtgcacaagtggatctccatca

SEQ ID NO: 496068 - DNA, 25 bp, Rattus norvegicus
gtcgtgcatattcccagctgtggtg

SEQ ID NO: 496069 - DNA, 25 bp, Rattus norvegicus
gtcgtgcatattgccagctgtggtg

SEQ ID NO: 496070 - DNA, 25 bp, Rattus norvegicus
gtcgtgcattatatcctcatcaaaa

SEQ ID NO: 496071 - DNA, 25 bp, Rattus norvegicus
gtcgtgcattatttcctcatcaaaa

SEQ ID NO: 496072 - DNA, 25 bp, Rattus norvegicus
gtcgtgccaataaagagcccctgct

SEQ ID NO: 496073 - DNA, 25 bp, Rattus norvegicus
gtcgtgccaatatagagcccctgct

SEQ ID NO: 496074 - DNA, 25 bp, Rattus norvegicus
gtcgtgccgttaatgtaccactgga

SEQ ID NO: 496075 - DNA, 25 bp, Rattus norvegicus
gtcgtgccgttattgtaccactgga

SEQ ID NO: 496076 - DNA, 25 bp, Rattus norvegicus
gtcgtgcctggaccttaggctagaa

SEQ ID NO: 496077 - DNA, 25 bp, Rattus norvegicus
gtcgtgcctggagcttaggctagaa

SEQ ID NO: 496078 - DNA, 25 bp, Rattus norvegicus
gtcgtgctgccaattgggatgctag

SEQ ID NO: 496079 - DNA, 25 bp, Rattus norvegicus
gtcgtgctgccatttgggatgctag

SEQ ID NO: 496080 - DNA, 25 bp, Rattus norvegicus
gtcgtggacaccaggaagcttctga

SEQ ID NO: 496081 - DNA, 25 bp, Rattus norvegicus
gtcgtggacacctggaagcttctga

SEQ ID NO: 496082 - DNA, 25 bp, Rattus norvegicus
gtcgtggagcgcaaagctacctaat

SEQ ID NO: 496083 - DNA, 25 bp, Rattus norvegicus
gtcgtggagcgctaagctacctaat

SEQ ID NO: 496084 - DNA, 25 bp, Rattus norvegicus
gtcgtggaggacagggactcttttc

SEQ ID NO: 496085 - DNA, 25 bp, Rattus norvegicus
gtcgtggaggactgggactcttttc

SEQ ID NO: 496086 - DNA, 25 bp, Rattus norvegicus
gtcgtggcattgatgaaccgccttt

SEQ ID NO: 496087 - DNA, 25 bp, Rattus norvegicus
gtcgtggcattgttgaaccgccttt

SEQ ID NO: 496088 - DNA, 25 bp, Rattus norvegicus
gtcgtggctctgctataaagcctca

SEQ ID NO: 496089 - DNA, 25 bp, Rattus norvegicus
gtcgtggctctggtataaagcctca

SEQ ID NO: 496090 - DNA, 25 bp, Rattus norvegicus
gtcgtgggatcgcttagctagagta

SEQ ID NO: 496091 - DNA, 25 bp, Rattus norvegicus
gtcgtgggatcggttagctagagta

SEQ ID NO: 496092 - DNA, 25 bp, Rattus norvegicus
gtcgtgggtctgcagtctcactgcc

SEQ ID NO: 496093 - DNA, 25 bp, Rattus norvegicus
gtcgtgggtctggagtctcactgcc

SEQ ID NO: 496094 - DNA, 25 bp, Rattus norvegicus
gtcgtggtaatcaccatactgtcga

SEQ ID NO: 496095 - DNA, 25 bp, Rattus norvegicus
gtcgtggtaatctccatactgtcga

SEQ ID NO: 496096 - DNA, 25 bp, Rattus norvegicus
gtcgtggtagacatcggtgtcatcc

SEQ ID NO: 496097 - DNA, 25 bp, Rattus norvegicus
gtcgtggtagacttcggtgtcatcc

SEQ ID NO: 496098 - DNA, 25 bp, Rattus norvegicus
gtcgtggtctctatgactttgagcc

SEQ ID NO: 496099 - DNA, 25 bp, Rattus norvegicus
gtcgtggtctctttgactttgagcc

SEQ ID NO: 496100 - DNA, 25 bp, Rattus norvegicus
gtcgtgtaagcaaggcacattcttt

SEQ ID NO: 496101 - DNA, 25 bp, Rattus norvegicus
gtcgtgtaagcatggcacattcttt

SEQ ID NO: 496102 - DNA, 25 bp, Rattus norvegicus
gtcgtgtaccaaaccatctcataaa

SEQ ID NO: 496103 - DNA, 25 bp, Rattus norvegicus
gtcgtgtaccaatccatctcataaa

SEQ ID NO: 496104 - DNA, 25 bp, Rattus norvegicus
gtcgtgtacgtgaacgtttgtgcaa

SEQ ID NO: 496105 - DNA, 25 bp, Rattus norvegicus
gtcgtgtacgtgtacgtttgtgcaa

SEQ ID NO: 496106 - DNA, 25 bp, Rattus norvegicus
gtcgtgtagggacagccttcacttt

SEQ ID NO: 496107 - DNA, 25 bp, Rattus norvegicus
gtcgtgtagggagagccttcacttt

SEQ ID NO: 496108 - DNA, 25 bp, Rattus norvegicus
gtcgtgtcccagaacgataacctgg

SEQ ID NO: 496109 - DNA, 25 bp, Rattus norvegicus
gtcgtgtcccagtacgataacctgg

SEQ ID NO: 496110 - DNA, 25 bp, Rattus norvegicus
gtcgtgtctcctacaccatgatgac

SEQ ID NO: 496111 - DNA, 25 bp, Rattus norvegicus
gtcgtgtctccttcaccatgatgac

SEQ ID NO: 496112 - DNA, 25 bp, Rattus norvegicus
gtcgtgtctgaacaaggtgctgtct

SEQ ID NO: 496113 - DNA, 25 bp, Rattus norvegicus
gtcgtgtctgaagaaggtgctgtct

SEQ ID NO: 496114 - DNA, 25 bp, Rattus norvegicus
gtcgtgtgagcaccactaacaactc

SEQ ID NO: 496115 - DNA, 25 bp, Rattus norvegicus
gtcgtgtgagcagcactaacaactc

SEQ ID NO: 496116 - DNA, 25 bp, Rattus norvegicus
gtcgtgtgtttcctttagtgcagag

SEQ ID NO: 496117 - DNA, 25 bp, Rattus norvegicus
gtcgtgtgtttcgtttagtgcagag

SEQ ID NO: 496118 - DNA, 25 bp, Rattus norvegicus
gtcgtgtttgttcctgctcactgca

SEQ ID NO: 496119 - DNA, 25 bp, Rattus norvegicus
gtcgtgtttgttgctgctcactgca

SEQ ID NO: 496120 - DNA, 25 bp, Rattus norvegicus
gtcgttaatcagagtctgtctgccc

SEQ ID NO: 496121 - DNA, 25 bp, Rattus norvegicus
gtcgttaatcagtgtctgtctgccc

SEQ ID NO: 496122 - DNA, 25 bp, Rattus norvegicus
gtcgttaccacaatctgatgaagct

SEQ ID NO: 496123 - DNA, 25 bp, Rattus norvegicus
gtcgttaccacattctgatgaagct

SEQ ID NO: 496124 - DNA, 25 bp, Rattus norvegicus
gtcgttagctgaatcatgaccttca

SEQ ID NO: 496125 - DNA, 25 bp, Rattus norvegicus
gtcgttagctgattcatgaccttca

SEQ ID NO: 496126 - DNA, 25 bp, Rattus norvegicus
gtcgttcaggttaaggagctcctct

SEQ ID NO: 496127 - DNA, 25 bp, Rattus norvegicus
gtcgttcaggtttaggagctcctct

SEQ ID NO: 496128 - DNA, 25 bp, Rattus norvegicus
gtcgttcatctactacagttcattt

SEQ ID NO: 496129 - DNA, 25 bp, Rattus norvegicus
gtcgttcatctagtacagttcattt

SEQ ID NO: 496130 - DNA, 25 bp, Rattus norvegicus
gtcgttcattgacacatctgctcta

SEQ ID NO: 496131 - DNA, 25 bp, Rattus norvegicus
gtcgttcattgagacatctgctcta

SEQ ID NO: 496132 - DNA, 25 bp, Rattus norvegicus
gtcgttcctaagatgctcctcagag

SEQ ID NO: 496133 - DNA, 25 bp, Rattus norvegicus
gtcgttcctaagttgctcctcagag

SEQ ID NO: 496134 - DNA, 25 bp, Rattus norvegicus
gtcgttcggaacactgcactacaag

SEQ ID NO: 496135 - DNA, 25 bp, Rattus norvegicus
gtcgttcggaactctgcactacaag

SEQ ID NO: 496136 - DNA, 25 bp, Rattus norvegicus
gtcgttctctcgcaatcatttttac

SEQ ID NO: 496137 - DNA, 25 bp, Rattus norvegicus
gtcgttctctcggaatcatttttac

SEQ ID NO: 496138 - DNA, 25 bp, Rattus norvegicus
gtcgttcttcacaccgcgtagaaag

SEQ ID NO: 496139 - DNA, 25 bp, Rattus norvegicus
gtcgttcttcactccgcgtagaaag

SEQ ID NO: 496140 - DNA, 25 bp, Rattus norvegicus
gtcgttgacaatctatgaccttgca

SEQ ID NO: 496141 - DNA, 25 bp, Rattus norvegicus
gtcgttgacaatgtatgaccttgca

SEQ ID NO: 496142 - DNA, 25 bp, Rattus norvegicus
gtcgttgaggaaagcgctgtcctgc

SEQ ID NO: 496143 - DNA, 25 bp, Rattus norvegicus
gtcgttgaggaatgcgctgtcctgc

SEQ ID NO: 496144 - DNA, 25 bp, Rattus norvegicus
gtcgttgcctcaagtgtactttgca

SEQ ID NO: 496145 - DNA, 25 bp, Rattus norvegicus
gtcgttgcctcatgtgtactttgca

SEQ ID NO: 496146 - DNA, 25 bp, Rattus norvegicus
gtcgttgctgccagcgaagccaaag

SEQ ID NO: 496147 - DNA, 25 bp, Rattus norvegicus
gtcgttgctgcctgcgaagccaaag

SEQ ID NO: 496148 - DNA, 25 bp, Rattus norvegicus
gtcgttgctgttcgctgttatgaaa

SEQ ID NO: 496149 - DNA, 25 bp, Rattus norvegicus
gtcgttgctgttggctgttatgaaa

SEQ ID NO: 496150 - DNA, 25 bp, Rattus norvegicus
gtcgttggcaaacctgggatatttc

SEQ ID NO: 496151 - DNA, 25 bp, Rattus norvegicus
gtcgttggcaaagctgggatatttc

SEQ ID NO: 496152 - DNA, 25 bp, Rattus norvegicus
gtcgttggccaaaatttgtgctgta

SEQ ID NO: 496153 - DNA, 25 bp, Rattus norvegicus
gtcgttggccaatatttgtgctgta

SEQ ID NO: 496154 - DNA, 25 bp, Rattus norvegicus
gtcgttgggagcaaacacaggttct

SEQ ID NO: 496155 - DNA, 25 bp, Rattus norvegicus
gtcgttgggagctaacacaggttct

SEQ ID NO: 496156 - DNA, 25 bp, Rattus norvegicus
gtcgttggtgctctttcattttgat

SEQ ID NO: 496157 - DNA, 25 bp, Rattus norvegicus
gtcgttggtgctgtttcattttgat

SEQ ID NO: 496158 - DNA, 25 bp, Rattus norvegicus
gtcgttgtacagaatgccacagtcc

SEQ ID NO: 496159 - DNA, 25 bp, Rattus norvegicus
gtcgttgtacagtatgccacagtcc

SEQ ID NO: 496160 - DNA, 25 bp, Rattus norvegicus
gtcgttgtgtttatcttgagtagat

SEQ ID NO: 496161 - DNA, 25 bp, Rattus norvegicus
gtcgttgtgtttttcttgagtagat

SEQ ID NO: 496162 - DNA, 25 bp, Rattus norvegicus
gtcgtttcagaacaggacctgcctg

SEQ ID NO: 496163 - DNA, 25 bp, Rattus norvegicus
gtcgtttcagaagaggacctgcctg

SEQ ID NO: 496164 - DNA, 25 bp, Rattus norvegicus
gtcgtttcagacatggatcctacaa

SEQ ID NO: 496165 - DNA, 25 bp, Rattus norvegicus
gtcgtttcagacttggatcctacaa

SEQ ID NO: 496166 - DNA, 25 bp, Rattus norvegicus
gtcgtttcccaccaggaaggctgta

SEQ ID NO: 496167 - DNA, 25 bp, Rattus norvegicus
gtcgtttcccacgaggaaggctgta

SEQ ID NO: 496168 - DNA, 25 bp, Rattus norvegicus
gtcgtttcccagagacgtgaatcta

SEQ ID NO: 496169 - DNA, 25 bp, Rattus norvegicus
gtcgtttcccagtgacgtgaatcta

SEQ ID NO: 496170 - DNA, 25 bp, Rattus norvegicus
gtcgtttcctgccattacaattaat

SEQ ID NO: 496171 - DNA, 25 bp, Rattus norvegicus
gtcgtttcctgcgattacaattaat

SEQ ID NO: 496172 - DNA, 25 bp, Rattus norvegicus
gtcgtttcgaccaaccgagggtgag

SEQ ID NO: 496173 - DNA, 25 bp, Rattus norvegicus
gtcgtttcgacctaccgagggtgag

SEQ ID NO: 496174 - DNA, 25 bp, Rattus norvegicus
gtcgtttctcctcacaagtactaaa

SEQ ID NO: 496175 - DNA, 25 bp, Rattus norvegicus
gtcgtttctcctgacaagtactaaa

SEQ ID NO: 496176 - DNA, 25 bp, Rattus norvegicus
gtcgtttctcgtcgttgtgtgtgtt

SEQ ID NO: 496177 - DNA, 25 bp, Rattus norvegicus
gtcgtttctcgtggttgtgtgtgtt

SEQ ID NO: 496178 - DNA, 25 bp, Rattus norvegicus
gtcgtttctgttagtcccttctgta

SEQ ID NO: 496179 - DNA, 25 bp, Rattus norvegicus
gtcgtttctgtttgtcccttctgta

SEQ ID NO: 496180 - DNA, 25 bp, Rattus norvegicus
gtcgtttcttatactggcatctatc

SEQ ID NO: 496181 - DNA, 25 bp, Rattus norvegicus
gtcgtttcttattctggcatctatc

SEQ ID NO: 496182 - DNA, 25 bp, Rattus norvegicus
gtcgtttgacttcgtttgactcagt

SEQ ID NO: 496183 - DNA, 25 bp, Rattus norvegicus
gtcgtttgacttggtttgactcagt

SEQ ID NO: 496184 - DNA, 25 bp, Rattus norvegicus
gtcgtttgatgcagtttacccagga

SEQ ID NO: 496185 - DNA, 25 bp, Rattus norvegicus
gtcgtttgatgctgtttacccagga

SEQ ID NO: 496186 - DNA, 25 bp, Rattus norvegicus
gtcgttttgacactactaggcagtt

SEQ ID NO: 496187 - DNA, 25 bp, Rattus norvegicus
gtcgttttgacagtactaggcagtt

SEQ ID NO: 496188 - DNA, 25 bp, Rattus norvegicus
gtcgttttggcaatctagtctttac

SEQ ID NO: 496189 - DNA, 25 bp, Rattus norvegicus
gtcgttttggcattctagtctttac

SEQ ID NO: 496190 - DNA, 25 bp, Rattus norvegicus
gtctaaaaagttcccgttctgcgat

SEQ ID NO: 496191 - DNA, 25 bp, Rattus norvegicus
gtctaaaaagttgccgttctgcgat

SEQ ID NO: 496192 - DNA, 25 bp, Rattus norvegicus
gtctaaaacgcacttctctcctgaa

SEQ ID NO: 496193 - DNA, 25 bp, Rattus norvegicus
gtctaaaacgcagttctctcctgaa

SEQ ID NO: 496194 - DNA, 25 bp, Rattus norvegicus
gtctaaaacttactggcacctgggt

SEQ ID NO: 496195 - DNA, 25 bp, Rattus norvegicus
gtctaaaacttagtggcacctgggt

SEQ ID NO: 496196 - DNA, 25 bp, Rattus norvegicus
gtctaaaatctgcttccaacccagt

SEQ ID NO: 496197 - DNA, 25 bp, Rattus norvegicus
gtctaaaatctggttccaacccagt

SEQ ID NO: 496198 - DNA, 25 bp, Rattus norvegicus
gtctaaacagccaataagagccctt

SEQ ID NO: 496199 - DNA, 25 bp, Rattus norvegicus
gtctaaacagcctataagagccctt

SEQ ID NO: 496200 - DNA, 25 bp, Rattus norvegicus
gtctaaacagtactaccggtccgat

SEQ ID NO: 496201 - DNA, 25 bp, Rattus norvegicus
gtctaaacagtagtaccggtccgat

SEQ ID NO: 496202 - DNA, 25 bp, Rattus norvegicus
gtctaaaccgacaaagcccgtgtag

SEQ ID NO: 496203 - DNA, 25 bp, Rattus norvegicus
gtctaaaccgactaagcccgtgtag

SEQ ID NO: 496204 - DNA, 25 bp, Rattus norvegicus
gtctaaagttggctcaggctggcaa

SEQ ID NO: 496205 - DNA, 25 bp, Rattus norvegicus
gtctaaagttgggtcaggctggcaa

SEQ ID NO: 496206 - DNA, 25 bp, Rattus norvegicus
gtctaaatcgttctgccttttctta

SEQ ID NO: 496207 - DNA, 25 bp, Rattus norvegicus
gtctaaatcgttgtgccttttctta

SEQ ID NO: 496208 - DNA, 25 bp, Rattus norvegicus
gtctaaatggtgactgtatttccaa

SEQ ID NO: 496209 - DNA, 25 bp, Rattus norvegicus
gtctaaatggtgtctgtatttccaa

SEQ ID NO: 496210 - DNA, 25 bp, Rattus norvegicus
gtctaacagtgtctcctttagcgga

SEQ ID NO: 496211 - DNA, 25 bp, Rattus norvegicus
gtctaacagtgtgtcctttagcgga

SEQ ID NO: 496212 - DNA, 25 bp, Rattus norvegicus
gtctaaccagaaccccatgacatgg

SEQ ID NO: 496213 - DNA, 25 bp, Rattus norvegicus
gtctaaccagaagcccatgacatgg

SEQ ID NO: 496214 - DNA, 25 bp, Rattus norvegicus
gtctaaccagtgatcagcagtgtgt

SEQ ID NO: 496215 - DNA, 25 bp, Rattus norvegicus
gtctaaccagtgttcagcagtgtgt

SEQ ID NO: 496216 - DNA, 25 bp, Rattus norvegicus
gtctaaccagttctacgcatgctat

SEQ ID NO: 496217 - DNA, 25 bp, Rattus norvegicus
gtctaaccagttgtacgcatgctat

SEQ ID NO: 496218 - DNA, 25 bp, Rattus norvegicus
gtctaactacagctctagccagact

SEQ ID NO: 496219 - DNA, 25 bp, Rattus norvegicus
gtctaactacaggtctagccagact

SEQ ID NO: 496220 - DNA, 25 bp, Rattus norvegicus
gtctaactgctacggacgaggcctt

SEQ ID NO: 496221 - DNA, 25 bp, Rattus norvegicus
gtctaactgctagggacgaggcctt

SEQ ID NO: 496222 - DNA, 25 bp, Rattus norvegicus
gtctaactgttgacactagatgact

SEQ ID NO: 496223 - DNA, 25 bp, Rattus norvegicus
gtctaactgttgtcactagatgact

SEQ ID NO: 496224 - DNA, 25 bp, Rattus norvegicus
gtctaacttagtcttcacgtggcta

SEQ ID NO: 496225 - DNA, 25 bp, Rattus norvegicus
gtctaacttagtgttcacgtggcta

SEQ ID NO: 496226 - DNA, 25 bp, Rattus norvegicus
gtctaagaaacaatcccgtgtcctg

SEQ ID NO: 496227 - DNA, 25 bp, Rattus norvegicus
gtctaagaaacattcccgtgtcctg

SEQ ID NO: 496228 - DNA, 25 bp, Rattus norvegicus
gtctaagaacctacaggaccacgga

SEQ ID NO: 496229 - DNA, 25 bp, Rattus norvegicus
gtctaagaaccttcaggaccacgga

SEQ ID NO: 496230 - DNA, 25 bp, Rattus norvegicus
gtctaagacaacagtgcccagcctt

SEQ ID NO: 496231 - DNA, 25 bp, Rattus norvegicus
gtctaagacaactgtgcccagcctt

SEQ ID NO: 496232 - DNA, 25 bp, Rattus norvegicus
gtctaagacattaaccacagttgct

SEQ ID NO: 496233 - DNA, 25 bp, Rattus norvegicus
gtctaagacatttaccacagttgct

SEQ ID NO: 496234 - DNA, 25 bp, Rattus norvegicus
gtctaagacccaactactcctttag

SEQ ID NO: 496235 - DNA, 25 bp, Rattus norvegicus
gtctaagacccatctactcctttag

SEQ ID NO: 496236 - DNA, 25 bp, Rattus norvegicus
gtctaagagccactctggtggctga

SEQ ID NO: 496237 - DNA, 25 bp, Rattus norvegicus
gtctaagagccagtctggtggctga

SEQ ID NO: 496238 - DNA, 25 bp, Rattus norvegicus
gtctaagagtgcagtgagtgtgtac

SEQ ID NO: 496239 - DNA, 25 bp, Rattus norvegicus
gtctaagagtgctgtgagtgtgtac

SEQ ID NO: 496240 - DNA, 25 bp, Rattus norvegicus
gtctaagcacacaacagtctgttct

SEQ ID NO: 496241 - DNA, 25 bp, Rattus norvegicus
gtctaagcacactacagtctgttct

SEQ ID NO: 496242 - DNA, 25 bp, Rattus norvegicus
gtctaagcagctacctggtgattgg

SEQ ID NO: 496243 - DNA, 25 bp, Rattus norvegicus
gtctaagcagcttcctggtgattgg

SEQ ID NO: 496244 - DNA, 25 bp, Rattus norvegicus
gtctaagcagttcgtatgattcaca

SEQ ID NO: 496245 - DNA, 25 bp, Rattus norvegicus
gtctaagcagttggtatgattcaca

SEQ ID NO: 496246 - DNA, 25 bp, Rattus norvegicus
gtctaagccacaataaatcagtcct

SEQ ID NO: 496247 - DNA, 25 bp, Rattus norvegicus
gtctaagccacattaaatcagtcct

SEQ ID NO: 496248 - DNA, 25 bp, Rattus norvegicus
gtctaagccgtgagtctttttaaat

SEQ ID NO: 496249 - DNA, 25 bp, Rattus norvegicus
gtctaagccgtgtgtctttttaaat

SEQ ID NO: 496250 - DNA, 25 bp, Rattus norvegicus
gtctaagcggttcctggagtcctga

SEQ ID NO: 496251 - DNA, 25 bp, Rattus norvegicus
gtctaagcggttgctggagtcctga

SEQ ID NO: 496252 - DNA, 25 bp, Rattus norvegicus
gtctaagctcgtccaaattgattgt

SEQ ID NO: 496253 - DNA, 25 bp, Rattus norvegicus
gtctaagctcgtgcaaattgattgt

SEQ ID NO: 496254 - DNA, 25 bp, Rattus norvegicus
gtctaaggttgactcactcagctcc

SEQ ID NO: 496255 - DNA, 25 bp, Rattus norvegicus
gtctaaggttgagtcactcagctcc

SEQ ID NO: 496256 - DNA, 25 bp, Rattus norvegicus
gtctaagttcatcttttgactccag

SEQ ID NO: 496257 - DNA, 25 bp, Rattus norvegicus
gtctaagttcatgttttgactccag

SEQ ID NO: 496258 - DNA, 25 bp, Rattus norvegicus
gtctaagttctcaaagtactccgaa

SEQ ID NO: 496259 - DNA, 25 bp, Rattus norvegicus
gtctaagttctctaagtactccgaa

SEQ ID NO: 496260 - DNA, 25 bp, Rattus norvegicus
gtctaatagctaaatcccaagggat

SEQ ID NO: 496261 - DNA, 25 bp, Rattus norvegicus
gtctaatagctatatcccaagggat

SEQ ID NO: 496262 - DNA, 25 bp, Rattus norvegicus
gtctaatatttgacagcatccgcca

SEQ ID NO: 496263 - DNA, 25 bp, Rattus norvegicus
gtctaatatttgtcagcatccgcca

SEQ ID NO: 496264 - DNA, 25 bp, Rattus norvegicus
gtctaatcacttctaataataaggg

SEQ ID NO: 496265 - DNA, 25 bp, Rattus norvegicus
gtctaatcacttgtaataataaggg

SEQ ID NO: 496266 - DNA, 25 bp, Rattus norvegicus
gtctaatcaggcctgtgtctgcctc

SEQ ID NO: 496267 - DNA, 25 bp, Rattus norvegicus
gtctaatcaggcgtgtgtctgcctc

SEQ ID NO: 496268 - DNA, 25 bp, Rattus norvegicus
gtctaatccaggaagcttcctagtt

SEQ ID NO: 496269 - DNA, 25 bp, Rattus norvegicus
gtctaatccaggtagcttcctagtt

SEQ ID NO: 496270 - DNA, 25 bp, Rattus norvegicus
gtctaatctgggaagtttgcaaatc

SEQ ID NO: 496271 - DNA, 25 bp, Rattus norvegicus
gtctaatctgggtagtttgcaaatc

SEQ ID NO: 496272 - DNA, 25 bp, Rattus norvegicus
gtctaatgatttcaatatcccctct

SEQ ID NO: 496273 - DNA, 25 bp, Rattus norvegicus
gtctaatgatttgaatatcccctct

SEQ ID NO: 496274 - DNA, 25 bp, Rattus norvegicus
gtctaatgcactctagaaacttcat

SEQ ID NO: 496275 - DNA, 25 bp, Rattus norvegicus
gtctaatgcactgtagaaacttcat

SEQ ID NO: 496276 - DNA, 25 bp, Rattus norvegicus
gtctaatggtgacctgggtgtccac

SEQ ID NO: 496277 - DNA, 25 bp, Rattus norvegicus
gtctaatggtgagctgggtgtccac

SEQ ID NO: 496278 - DNA, 25 bp, Rattus norvegicus
gtctaatggttcatcgtcagccaag

SEQ ID NO: 496279 - DNA, 25 bp, Rattus norvegicus
gtctaatggttcttcgtcagccaag

SEQ ID NO: 496280 - DNA, 25 bp, Rattus norvegicus
gtctaatgttgaaagcgtgcccttt

SEQ ID NO: 496281 - DNA, 25 bp, Rattus norvegicus
gtctaatgttgatagcgtgcccttt

SEQ ID NO: 496282 - DNA, 25 bp, Rattus norvegicus
gtctaattctgaacactgggccttg

SEQ ID NO: 496283 - DNA, 25 bp, Rattus norvegicus
gtctaattctgatcactgggccttg

SEQ ID NO: 496284 - DNA, 25 bp, Rattus norvegicus
gtctaattgaccaacctggcaaacc

SEQ ID NO: 496285 - DNA, 25 bp, Rattus norvegicus
gtctaattgacctacctggcaaacc

SEQ ID NO: 496286 - DNA, 25 bp, Rattus norvegicus
gtctaatttatgagctgggccctcc

SEQ ID NO: 496287 - DNA, 25 bp, Rattus norvegicus
gtctaatttatgtgctgggccctcc

SEQ ID NO: 496288 - DNA, 25 bp, Rattus norvegicus
gtctaatttgtcatttcatctcatg

SEQ ID NO: 496289 - DNA, 25 bp, Rattus norvegicus
gtctaatttgtcttttcatctcatg

SEQ ID NO: 496290 - DNA, 25 bp, Rattus norvegicus
gtctaattttccaagcatcatgttg

SEQ ID NO: 496291 - DNA, 25 bp, Rattus norvegicus
gtctaattttcctagcatcatgttg

SEQ ID NO: 496292 - DNA, 25 bp, Rattus norvegicus
gtctacaaaatcaggagggctgcct

SEQ ID NO: 496293 - DNA, 25 bp, Rattus norvegicus
gtctacaaaatctggagggctgcct

SEQ ID NO: 496294 - DNA, 25 bp, Rattus norvegicus
gtctacaacatcaaggccattcggg

SEQ ID NO: 496295 - DNA, 25 bp, Rattus norvegicus
gtctacaacatctaggccattcggg

SEQ ID NO: 496296 - DNA, 25 bp, Rattus norvegicus
gtctacaacttgctctcccaacaaa

SEQ ID NO: 496297 - DNA, 25 bp, Rattus norvegicus
gtctacaacttggtctcccaacaaa

SEQ ID NO: 496298 - DNA, 25 bp, Rattus norvegicus
gtctacaagtgtctgtggtctctca

SEQ ID NO: 496299 - DNA, 25 bp, Rattus norvegicus
gtctacaagtgtgtgtggtctctca

SEQ ID NO: 496300 - DNA, 25 bp, Rattus norvegicus
gtctacaattgtagagctgggctcc

SEQ ID NO: 496301 - DNA, 25 bp, Rattus norvegicus
gtctacaattgttgagctgggctcc

SEQ ID NO: 496302 - DNA, 25 bp, Rattus norvegicus
gtctacaccaatccagagggcttca

SEQ ID NO: 496303 - DNA, 25 bp, Rattus norvegicus
gtctacaccaatgcagagggcttca

SEQ ID NO: 496304 - DNA, 25 bp, Rattus norvegicus
gtctacactagtcggaacaggctta

SEQ ID NO: 496305 - DNA, 25 bp, Rattus norvegicus
gtctacactagtgggaacaggctta

SEQ ID NO: 496306 - DNA, 25 bp, Rattus norvegicus
gtctacactgataacataacttgtt

SEQ ID NO: 496307 - DNA, 25 bp, Rattus norvegicus
gtctacactgattacataacttgtt

SEQ ID NO: 496308 - DNA, 25 bp, Rattus norvegicus
gtctacactgggagttctaaccggc

SEQ ID NO: 496309 - DNA, 25 bp, Rattus norvegicus
gtctacactgggtgttctaaccggc

SEQ ID NO: 496310 - DNA, 25 bp, Rattus norvegicus
gtctacactgtcagctttggaaatg

SEQ ID NO: 496311 - DNA, 25 bp, Rattus norvegicus
gtctacactgtctgctttggaaatg

SEQ ID NO: 496312 - DNA, 25 bp, Rattus norvegicus
gtctacagactgattaacccacttt

SEQ ID NO: 496313 - DNA, 25 bp, Rattus norvegicus
gtctacagactgtttaacccacttt

SEQ ID NO: 496314 - DNA, 25 bp, Rattus norvegicus
gtctacagacttcttactggccaag

SEQ ID NO: 496315 - DNA, 25 bp, Rattus norvegicus
gtctacagacttgttactggccaag

SEQ ID NO: 496316 - DNA, 25 bp, Rattus norvegicus
gtctacagattcatggatagccttc

SEQ ID NO: 496317 - DNA, 25 bp, Rattus norvegicus
gtctacagattcttggatagccttc

SEQ ID NO: 496318 - DNA, 25 bp, Rattus norvegicus
gtctacagcaggagatgagcattct

SEQ ID NO: 496319 - DNA, 25 bp, Rattus norvegicus
gtctacagcaggtgatgagcattct

SEQ ID NO: 496320 - DNA, 25 bp, Rattus norvegicus
gtctacagcataccatctgcagtgg

SEQ ID NO: 496321 - DNA, 25 bp, Rattus norvegicus
gtctacagcatagcatctgcagtgg

SEQ ID NO: 496322 - DNA, 25 bp, Rattus norvegicus
gtctacagccagcatagtgagcctt

SEQ ID NO: 496323 - DNA, 25 bp, Rattus norvegicus
gtctacagccaggatagtgagcctt

SEQ ID NO: 496324 - DNA, 25 bp, Rattus norvegicus
gtctacagccctcatttgatgtgat

SEQ ID NO: 496325 - DNA, 25 bp, Rattus norvegicus
gtctacagccctgatttgatgtgat

SEQ ID NO: 496326 - DNA, 25 bp, Rattus norvegicus
gtctacaggcgcagcaagtattcct

SEQ ID NO: 496327 - DNA, 25 bp, Rattus norvegicus
gtctacaggcgctgcaagtattcct

SEQ ID NO: 496328 - DNA, 25 bp, Rattus norvegicus
gtctacagtatgatcttgtcctttc

SEQ ID NO: 496329 - DNA, 25 bp, Rattus norvegicus
gtctacagtatgttcttgtcctttc

SEQ ID NO: 496330 - DNA, 25 bp, Rattus norvegicus
gtctacagtgctcctgggacaccca

SEQ ID NO: 496331 - DNA, 25 bp, Rattus norvegicus
gtctacagtgctgctgggacaccca

SEQ ID NO: 496332 - DNA, 25 bp, Rattus norvegicus
gtctacagtttgcacagcctgctgc

SEQ ID NO: 496333 - DNA, 25 bp, Rattus norvegicus
gtctacagtttggacagcctgctgc

SEQ ID NO: 496334 - DNA, 25 bp, Rattus norvegicus
gtctacatacaccaagcagatccgt

SEQ ID NO: 496335 - DNA, 25 bp, Rattus norvegicus
gtctacatacacgaagcagatccgt

SEQ ID NO: 496336 - DNA, 25 bp, Rattus norvegicus
gtctacatagtgagatgacccactc

SEQ ID NO: 496337 - DNA, 25 bp, Rattus norvegicus
gtctacatagtgagccaggcctgtg

SEQ ID NO: 496338 - DNA, 25 bp, Rattus norvegicus
gtctacatagtgtgatgacccactc

SEQ ID NO: 496339 - DNA, 25 bp, Rattus norvegicus
gtctacatagtgtgccaggcctgtg

SEQ ID NO: 496340 - DNA, 25 bp, Rattus norvegicus
gtctacatatcaagtatcaggtcag

SEQ ID NO: 496341 - DNA, 25 bp, Rattus norvegicus
gtctacatatcatgtatcaggtcag

SEQ ID NO: 496342 - DNA, 25 bp, Rattus norvegicus
gtctacatcaacatgcctgggagag

SEQ ID NO: 496343 - DNA, 25 bp, Rattus norvegicus
gtctacatcaacttgcctgggagag

SEQ ID NO: 496344 - DNA, 25 bp, Rattus norvegicus
gtctacatcatgcactttggcctag

SEQ ID NO: 496345 - DNA, 25 bp, Rattus norvegicus
gtctacatcatggactttggcctag

SEQ ID NO: 496346 - DNA, 25 bp, Rattus norvegicus
gtctacatcccaaaactcacagttg

SEQ ID NO: 496347 - DNA, 25 bp, Rattus norvegicus
gtctacatcccataactcacagttg

SEQ ID NO: 496348 - DNA, 25 bp, Rattus norvegicus
gtctacatcctgacactaggtggca

SEQ ID NO: 496349 - DNA, 25 bp, Rattus norvegicus
gtctacatcctgtcactaggtggca

SEQ ID NO: 496350 - DNA, 25 bp, Rattus norvegicus
gtctacatcgacatgaccatcaagc

SEQ ID NO: 496351 - DNA, 25 bp, Rattus norvegicus
gtctacatcgacttgaccatcaagc

SEQ ID NO: 496352 - DNA, 25 bp, Rattus norvegicus
gtctacatgagtatgtttaccctaa

SEQ ID NO: 496353 - DNA, 25 bp, Rattus norvegicus
gtctacatgagtttgtttaccctaa

SEQ ID NO: 496354 - DNA, 25 bp, Rattus norvegicus
gtctacatgtacactcgggcagaac

SEQ ID NO: 496355 - DNA, 25 bp, Rattus norvegicus
gtctacatgtactctcgggcagaac

SEQ ID NO: 496356 - DNA, 25 bp, Rattus norvegicus
gtctacattacaacaaggtcaggag

SEQ ID NO: 496357 - DNA, 25 bp, Rattus norvegicus
gtctacattacatcaaggtcaggag

SEQ ID NO: 496358 - DNA, 25 bp, Rattus norvegicus
gtctacattttaatacggcacgtta

SEQ ID NO: 496359 - DNA, 25 bp, Rattus norvegicus
gtctacattttattacggcacgtta

SEQ ID NO: 496360 - DNA, 25 bp, Rattus norvegicus
gtctaccacagtcaaattccctttt

SEQ ID NO: 496361 - DNA, 25 bp, Rattus norvegicus
gtctaccacagtgaaattccctttt

SEQ ID NO: 496362 - DNA, 25 bp, Rattus norvegicus
gtctaccacatgcaccgggagcgag

SEQ ID NO: 496363 - DNA, 25 bp, Rattus norvegicus
gtctaccacatggaccgggagcgag

SEQ ID NO: 496364 - DNA, 25 bp, Rattus norvegicus
gtctaccacgggatctgactggctt

SEQ ID NO: 496365 - DNA, 25 bp, Rattus norvegicus
gtctaccacgggttctgactggctt

SEQ ID NO: 496366 - DNA, 25 bp, Rattus norvegicus
gtctaccagagaaacggatgctata

SEQ ID NO: 496367 - DNA, 25 bp, Rattus norvegicus
gtctaccagagatacggatgctata

SEQ ID NO: 496368 - DNA, 25 bp, Rattus norvegicus
gtctaccagggcactggcaccggaa

SEQ ID NO: 496369 - DNA, 25 bp, Rattus norvegicus
gtctaccagggctctggcaccggaa

SEQ ID NO: 496370 - DNA, 25 bp, Rattus norvegicus
gtctaccatagtcttgagcagttgt

SEQ ID NO: 496371 - DNA, 25 bp, Rattus norvegicus
gtctaccatagtgttgagcagttgt

SEQ ID NO: 496372 - DNA, 25 bp, Rattus norvegicus
gtctaccatcggcagggaccaaaga

SEQ ID NO: 496373 - DNA, 25 bp, Rattus norvegicus
gtctaccatcgggagggaccaaaga

SEQ ID NO: 496374 - DNA, 25 bp, Rattus norvegicus
gtctaccatgaaacttccaaccaga

SEQ ID NO: 496375 - DNA, 25 bp, Rattus norvegicus
gtctaccatgaatcttccaaccaga

SEQ ID NO: 496376 - DNA, 25 bp, Rattus norvegicus
gtctaccatgggagtgtaccaccta

SEQ ID NO: 496377 - DNA, 25 bp, Rattus norvegicus
gtctaccatgggtgtgtaccaccta

SEQ ID NO: 496378 - DNA, 25 bp, Rattus norvegicus
gtctaccatgttataaatgtgctta

SEQ ID NO: 496379 - DNA, 25 bp, Rattus norvegicus
gtctaccatgttttaaatgtgctta

SEQ ID NO: 496380 - DNA, 25 bp, Rattus norvegicus
gtctacccaggtatagtgaccttgg

SEQ ID NO: 496381 - DNA, 25 bp, Rattus norvegicus
gtctacccaggtttagtgaccttgg

SEQ ID NO: 496382 - DNA, 25 bp, Rattus norvegicus
gtctacccatcgattaggtcgttga

SEQ ID NO: 496383 - DNA, 25 bp, Rattus norvegicus
gtctacccatcgtttaggtcgttga

SEQ ID NO: 496384 - DNA, 25 bp, Rattus norvegicus
gtctaccccgagcaagaacaggcca

SEQ ID NO: 496385 - DNA, 25 bp, Rattus norvegicus
gtctaccccgaggaagaacaggcca

SEQ ID NO: 496386 - DNA, 25 bp, Rattus norvegicus
gtctaccctgagatggaattccatg

SEQ ID NO: 496387 - DNA, 25 bp, Rattus norvegicus
gtctaccctgagttggaattccatg

SEQ ID NO: 496388 - DNA, 25 bp, Rattus norvegicus
gtctaccctggaaccttgtttaaat

SEQ ID NO: 496389 - DNA, 25 bp, Rattus norvegicus
gtctaccctggatccttgtttaaat

SEQ ID NO: 496390 - DNA, 25 bp, Rattus norvegicus
gtctaccctgggataatgtcaccag

SEQ ID NO: 496391 - DNA, 25 bp, Rattus norvegicus
gtctaccctgggttaatgtcaccag

SEQ ID NO: 496392 - DNA, 25 bp, Rattus norvegicus
gtctaccgctggctgtgttactaca

SEQ ID NO: 496393 - DNA, 25 bp, Rattus norvegicus
gtctaccgctgggtgtgttactaca

SEQ ID NO: 496394 - DNA, 25 bp, Rattus norvegicus
gtctacctaaagctgactggctcaa

SEQ ID NO: 496395 - DNA, 25 bp, Rattus norvegicus
gtctacctaaaggtgactggctcaa

SEQ ID NO: 496396 - DNA, 25 bp, Rattus norvegicus
gtctaccttaccatatactatttca

SEQ ID NO: 496397 - DNA, 25 bp, Rattus norvegicus
gtctaccttaccttatactatttca

SEQ ID NO: 496398 - DNA, 25 bp, Rattus norvegicus
gtctaccttaggctgatttacttaa

SEQ ID NO: 496399 - DNA, 25 bp, Rattus norvegicus
gtctaccttagggtgatttacttaa

SEQ ID NO: 496400 - DNA, 25 bp, Rattus norvegicus
gtctaccttatcatgacatcctttc

SEQ ID NO: 496401 - DNA, 25 bp, Rattus norvegicus
gtctaccttatcttgacatcctttc

SEQ ID NO: 496402 - DNA, 25 bp, Rattus norvegicus
gtctaccttcatctactcactgagg

SEQ ID NO: 496403 - DNA, 25 bp, Rattus norvegicus
gtctaccttcatgtactcactgagg

SEQ ID NO: 496404 - DNA, 25 bp, Rattus norvegicus
gtctaccttgttactagttcacaca

SEQ ID NO: 496405 - DNA, 25 bp, Rattus norvegicus
gtctaccttgtttctagttcacaca

SEQ ID NO: 496406 - DNA, 25 bp, Rattus norvegicus
gtctacgagagccattcctattcaa

SEQ ID NO: 496407 - DNA, 25 bp, Rattus norvegicus
gtctacgagagcgattcctattcaa

SEQ ID NO: 496408 - DNA, 25 bp, Rattus norvegicus
gtctacgggtgaacagagcttctcc

SEQ ID NO: 496409 - DNA, 25 bp, Rattus norvegicus
gtctacgggtgatcagagcttctcc

SEQ ID NO: 496410 - DNA, 25 bp, Rattus norvegicus
gtctacgtcatcatcatactggaga

SEQ ID NO: 496411 - DNA, 25 bp, Rattus norvegicus
gtctacgtcatcttcatactggaga

SEQ ID NO: 496412 - DNA, 25 bp, Rattus norvegicus
gtctacgtccgacagtgagtgccta

SEQ ID NO: 496413 - DNA, 25 bp, Rattus norvegicus
gtctacgtccgagagtgagtgccta

SEQ ID NO: 496414 - DNA, 25 bp, Rattus norvegicus
gtctacgtgaaacagcattggctag

SEQ ID NO: 496415 - DNA, 25 bp, Rattus norvegicus
gtctacgtgaaagagcattggctag

SEQ ID NO: 496416 - DNA, 25 bp, Rattus norvegicus
gtctacgtgacccacgttaaacttg

SEQ ID NO: 496417 - DNA, 25 bp, Rattus norvegicus
gtctacgtgaccgacgttaaacttg

SEQ ID NO: 496418 - DNA, 25 bp, Rattus norvegicus
gtctacgttcaactacctcatgggc

SEQ ID NO: 496419 - DNA, 25 bp, Rattus norvegicus
gtctacgttcaagtacctcatgggc

SEQ ID NO: 496420 - DNA, 25 bp, Rattus norvegicus
gtctactacattcggttctgtgtct

SEQ ID NO: 496421 - DNA, 25 bp, Rattus norvegicus
gtctactacattgggttctgtgtct

SEQ ID NO: 496422 - DNA, 25 bp, Rattus norvegicus
gtctactatgtcagaactgtggttt

SEQ ID NO: 496423 - DNA, 25 bp, Rattus norvegicus
gtctactatgtctgaactgtggttt

SEQ ID NO: 496424 - DNA, 25 bp, Rattus norvegicus
gtctactcagtccttaaaccagatt

SEQ ID NO: 496425 - DNA, 25 bp, Rattus norvegicus
gtctactcagtcgttaaaccagatt

SEQ ID NO: 496426 - DNA, 25 bp, Rattus norvegicus
gtctactcatgcatgtttgcattat

SEQ ID NO: 496427 - DNA, 25 bp, Rattus norvegicus
gtctactcatgcttgtttgcattat

SEQ ID NO: 496428 - DNA, 25 bp, Rattus norvegicus
gtctactcatttcacagttttccat

SEQ ID NO: 496429 - DNA, 25 bp, Rattus norvegicus
gtctactcatttgacagttttccat

SEQ ID NO: 496430 - DNA, 25 bp, Rattus norvegicus
gtctactccaggcatcatttcaaag

SEQ ID NO: 496431 - DNA, 25 bp, Rattus norvegicus
gtctactccagggatcatttcaaag

SEQ ID NO: 496432 - DNA, 25 bp, Rattus norvegicus
gtctactcgctacggaattcagtca

SEQ ID NO: 496433 - DNA, 25 bp, Rattus norvegicus
gtctactcgctagggaattcagtca

SEQ ID NO: 496434 - DNA, 25 bp, Rattus norvegicus
gtctactctaacaggatcttactcc

SEQ ID NO: 496435 - DNA, 25 bp, Rattus norvegicus
gtctactctaactggatcttactcc

SEQ ID NO: 496436 - DNA, 25 bp, Rattus norvegicus
gtctactctaatattgaatgtcacc

SEQ ID NO: 496437 - DNA, 25 bp, Rattus norvegicus
gtctactctaattttgaatgtcacc

SEQ ID NO: 496438 - DNA, 25 bp, Rattus norvegicus
gtctactctcctatactttggtaag

SEQ ID NO: 496439 - DNA, 25 bp, Rattus norvegicus
gtctactctcctttactttggtaag

SEQ ID NO: 496440 - DNA, 25 bp, Rattus norvegicus
gtctactcttccacatgcatagttc

SEQ ID NO: 496441 - DNA, 25 bp, Rattus norvegicus
gtctactcttcctcatgcatagttc

SEQ ID NO: 496442 - DNA, 25 bp, Rattus norvegicus
gtctactgagacactgtttctgttg

SEQ ID NO: 496443 - DNA, 25 bp, Rattus norvegicus
gtctactgagactctgtttctgttg

SEQ ID NO: 496444 - DNA, 25 bp, Rattus norvegicus
gtctactgccctctagtgttaagtg

SEQ ID NO: 496445 - DNA, 25 bp, Rattus norvegicus
gtctactgccctgtagtgttaagtg

SEQ ID NO: 496446 - DNA, 25 bp, Rattus norvegicus
gtctactggataatacctttacata

SEQ ID NO: 496447 - DNA, 25 bp, Rattus norvegicus
gtctactggatattacctttacata

SEQ ID NO: 496448 - DNA, 25 bp, Rattus norvegicus
gtctactgttaacaccacctgcacg

SEQ ID NO: 496449 - DNA, 25 bp, Rattus norvegicus
gtctactgttaagaccacctgcacg

SEQ ID NO: 496450 - DNA, 25 bp, Rattus norvegicus
gtctactgtttaattattgtactct

SEQ ID NO: 496451 - DNA, 25 bp, Rattus norvegicus
gtctactgtttatttattgtactct

SEQ ID NO: 496452 - DNA, 25 bp, Rattus norvegicus
gtctacttaaatatcactccctcta

SEQ ID NO: 496453 - DNA, 25 bp, Rattus norvegicus
gtctacttaaatttcactccctcta

SEQ ID NO: 496454 - DNA, 25 bp, Rattus norvegicus
gtctacttccatagcctgagatagc

SEQ ID NO: 496455 - DNA, 25 bp, Rattus norvegicus
gtctacttccattgcctgagatagc

SEQ ID NO: 496456 - DNA, 25 bp, Rattus norvegicus
gtctacttctgtacttgcagctagt

SEQ ID NO: 496457 - DNA, 25 bp, Rattus norvegicus
gtctacttctgttcttgcagctagt

SEQ ID NO: 496458 - DNA, 25 bp, Rattus norvegicus
gtctacttggccatgggacaatcta

SEQ ID NO: 496459 - DNA, 25 bp, Rattus norvegicus
gtctacttggccttgggacaatcta

SEQ ID NO: 496460 - DNA, 25 bp, Rattus norvegicus
gtctacttgttgactacctggcagt

SEQ ID NO: 496461 - DNA, 25 bp, Rattus norvegicus
gtctacttgttgtctacctggcagt

SEQ ID NO: 496462 - DNA, 25 bp, Rattus norvegicus
gtctacttttacctgttaactgcat

SEQ ID NO: 496463 - DNA, 25 bp, Rattus norvegicus
gtctacttttacgtgttaactgcat

SEQ ID NO: 496464 - DNA, 25 bp, Rattus norvegicus
gtctacttttgacatggttttgcat

SEQ ID NO: 496465 - DNA, 25 bp, Rattus norvegicus
gtctacttttgagatggttttgcat

SEQ ID NO: 496466 - DNA, 25 bp, Rattus norvegicus
gtctagaaagataccccagcagttt

SEQ ID NO: 496467 - DNA, 25 bp, Rattus norvegicus
gtctagaaagattccccagcagttt

SEQ ID NO: 496468 - DNA, 25 bp, Rattus norvegicus
gtctagaaagctctggtttcctgga

SEQ ID NO: 496469 - DNA, 25 bp, Rattus norvegicus
gtctagaaagctgtggtttcctgga

SEQ ID NO: 496470 - DNA, 25 bp, Rattus norvegicus
gtctagaaagttcatttcctcctcc

SEQ ID NO: 496471 - DNA, 25 bp, Rattus norvegicus
gtctagaaagttgatttcctcctcc

SEQ ID NO: 496472 - DNA, 25 bp, Rattus norvegicus
gtctagaaatccctatcctgtgtga

SEQ ID NO: 496473 - DNA, 25 bp, Rattus norvegicus
gtctagaaatccgtatcctgtgtga

SEQ ID NO: 496474 - DNA, 25 bp, Rattus norvegicus
gtctagaaccagagaagggctccat

SEQ ID NO: 496475 - DNA, 25 bp, Rattus norvegicus
gtctagaaccagtgaagggctccat

SEQ ID NO: 496476 - DNA, 25 bp, Rattus norvegicus
gtctagaatcagacagatttctcat

SEQ ID NO: 496477 - DNA, 25 bp, Rattus norvegicus
gtctagaatcagtcagatttctcat

SEQ ID NO: 496478 - DNA, 25 bp, Rattus norvegicus
gtctagacacacaggtaaatttttg

SEQ ID NO: 496479 - DNA, 25 bp, Rattus norvegicus
gtctagacacactggtaaatttttg

SEQ ID NO: 496480 - DNA, 25 bp, Rattus norvegicus
gtctagaccaaacgagatgcccgtt

SEQ ID NO: 496481 - DNA, 25 bp, Rattus norvegicus
gtctagaccaaaggagatgcccgtt

SEQ ID NO: 496482 - DNA, 25 bp, Rattus norvegicus
gtctagaccaagctcaccgtcagta

SEQ ID NO: 496483 - DNA, 25 bp, Rattus norvegicus
gtctagaccaaggtcaccgtcagta

SEQ ID NO: 496484 - DNA, 25 bp, Rattus norvegicus
gtctagacccctcagcagatagagt

SEQ ID NO: 496485 - DNA, 25 bp, Rattus norvegicus
gtctagacccctgagcagatagagt

SEQ ID NO: 496486 - DNA, 25 bp, Rattus norvegicus
gtctagacgccaattctgttaacga

SEQ ID NO: 496487 - DNA, 25 bp, Rattus norvegicus
gtctagacgccatttctgttaacga

SEQ ID NO: 496488 - DNA, 25 bp, Rattus norvegicus
gtctagaggacacatttattccact

SEQ ID NO: 496489 - DNA, 25 bp, Rattus norvegicus
gtctagaggacagatttattccact

SEQ ID NO: 496490 - DNA, 25 bp, Rattus norvegicus
gtctagaggcgtcacagagagcact

SEQ ID NO: 496491 - DNA, 25 bp, Rattus norvegicus
gtctagaggcgtgacagagagcact

SEQ ID NO: 496492 - DNA, 25 bp, Rattus norvegicus
gtctagatcacacgttcgctgctat

SEQ ID NO: 496493 - DNA, 25 bp, Rattus norvegicus
gtctagatcacaggttcgctgctat

SEQ ID NO: 496494 - DNA, 25 bp, Rattus norvegicus
gtctagatcagaaatccgcttgcct

SEQ ID NO: 496495 - DNA, 25 bp, Rattus norvegicus
gtctagatcagatatccgcttgcct

SEQ ID NO: 496496 - DNA, 25 bp, Rattus norvegicus
gtctagatctgcacttacatacaag

SEQ ID NO: 496497 - DNA, 25 bp, Rattus norvegicus
gtctagatctgctcttacatacaag

SEQ ID NO: 496498 - DNA, 25 bp, Rattus norvegicus
gtctagatgaggacactctgccaac

SEQ ID NO: 496499 - DNA, 25 bp, Rattus norvegicus
gtctagatgaggtcactctgccaac

SEQ ID NO: 496500 - DNA, 25 bp, Rattus norvegicus
gtctagcaacccattgttttataat

SEQ ID NO: 496501 - DNA, 25 bp, Rattus norvegicus
gtctagcaaccctttgttttataat

SEQ ID NO: 496502 - DNA, 25 bp, Rattus norvegicus
gtctagcaatcaaaagcccgctttg

SEQ ID NO: 496503 - DNA, 25 bp, Rattus norvegicus
gtctagcaatcataagcccgctttg

SEQ ID NO: 496504 - DNA, 25 bp, Rattus norvegicus
gtctagcacatacgatacccacagt

SEQ ID NO: 496505 - DNA, 25 bp, Rattus norvegicus
gtctagcacataggatacccacagt

SEQ ID NO: 496506 - DNA, 25 bp, Rattus norvegicus
gtctagcaccaaaagtctctacgat

SEQ ID NO: 496507 - DNA, 25 bp, Rattus norvegicus
gtctagcaccaatagtctctacgat

SEQ ID NO: 496508 - DNA, 25 bp, Rattus norvegicus
gtctagcagcccaaggagcttgtca

SEQ ID NO: 496509 - DNA, 25 bp, Rattus norvegicus
gtctagcagccctaggagcttgtca

SEQ ID NO: 496510 - DNA, 25 bp, Rattus norvegicus
gtctagcagggcagtgggcttacct

SEQ ID NO: 496511 - DNA, 25 bp, Rattus norvegicus
gtctagcagggctgtgggcttacct

SEQ ID NO: 496512 - DNA, 25 bp, Rattus norvegicus
gtctagcatgtcctttagttcacgg

SEQ ID NO: 496513 - DNA, 25 bp, Rattus norvegicus
gtctagcatgtcgtttagttcacgg

SEQ ID NO: 496514 - DNA, 25 bp, Rattus norvegicus
gtctagcattacagatactacaagg

SEQ ID NO: 496515 - DNA, 25 bp, Rattus norvegicus
gtctagcattactgatactacaagg

SEQ ID NO: 496516 - DNA, 25 bp, Rattus norvegicus
gtctagcattcaagaggccctgggt

SEQ ID NO: 496517 - DNA, 25 bp, Rattus norvegicus
gtctagcattcatgaggccctgggt

SEQ ID NO: 496518 - DNA, 25 bp, Rattus norvegicus
gtctagcatttcagctgcagtccaa

SEQ ID NO: 496519 - DNA, 25 bp, Rattus norvegicus
gtctagcatttctgctgcagtccaa

SEQ ID NO: 496520 - DNA, 25 bp, Rattus norvegicus
gtctagccagacaaccttgagaaga

SEQ ID NO: 496521 - DNA, 25 bp, Rattus norvegicus
gtctagccagactaccttgagaaga

SEQ ID NO: 496522 - DNA, 25 bp, Rattus norvegicus
gtctagccttagacaataaacctgt

SEQ ID NO: 496523 - DNA, 25 bp, Rattus norvegicus
gtctagccttagtcaataaacctgt

SEQ ID NO: 496524 - DNA, 25 bp, Rattus norvegicus
gtctagcgagacacacctgtaatcc

SEQ ID NO: 496525 - DNA, 25 bp, Rattus norvegicus
gtctagcgagactcacctgtaatcc

SEQ ID NO: 496526 - DNA, 25 bp, Rattus norvegicus
gtctagctatctcgcttccattgaa

SEQ ID NO: 496527 - DNA, 25 bp, Rattus norvegicus
gtctagctatctggcttccattgaa

SEQ ID NO: 496528 - DNA, 25 bp, Rattus norvegicus
gtctagctcattccaattcttgttt

SEQ ID NO: 496529 - DNA, 25 bp, Rattus norvegicus
gtctagctcattgcaattcttgttt

SEQ ID NO: 496530 - DNA, 25 bp, Rattus norvegicus
gtctagctctttagcttacagtgct

SEQ ID NO: 496531 - DNA, 25 bp, Rattus norvegicus
gtctagctcttttgcttacagtgct

SEQ ID NO: 496532 - DNA, 25 bp, Rattus norvegicus
gtctagctggtcagaggcaagtctt

SEQ ID NO: 496533 - DNA, 25 bp, Rattus norvegicus
gtctagctggtctgaggcaagtctt

SEQ ID NO: 496534 - DNA, 25 bp, Rattus norvegicus
gtctagcttatacccattactcagt

SEQ ID NO: 496535 - DNA, 25 bp, Rattus norvegicus
gtctagcttatagccattactcagt

SEQ ID NO: 496536 - DNA, 25 bp, Rattus norvegicus
gtctagcttcccctggatagttgaa

SEQ ID NO: 496537 - DNA, 25 bp, Rattus norvegicus
gtctagcttcccgtggatagttgaa

SEQ ID NO: 496538 - DNA, 25 bp, Rattus norvegicus
gtctagcttcgccgtcatggtctat

SEQ ID NO: 496539 - DNA, 25 bp, Rattus norvegicus
gtctagcttcgcggtcatggtctat

SEQ ID NO: 496540 - DNA, 25 bp, Rattus norvegicus
gtctaggaaaaaacgtcctcctact

SEQ ID NO: 496541 - DNA, 25 bp, Rattus norvegicus
gtctaggaaaaatcgtcctcctact

SEQ ID NO: 496542 - DNA, 25 bp, Rattus norvegicus
gtctaggagagtacttgcaggcagt

SEQ ID NO: 496543 - DNA, 25 bp, Rattus norvegicus
gtctaggagagttcttgcaggcagt

SEQ ID NO: 496544 - DNA, 25 bp, Rattus norvegicus
gtctaggcaactcagggcaactttc

SEQ ID NO: 496545 - DNA, 25 bp, Rattus norvegicus
gtctaggcaactgagggcaactttc

SEQ ID NO: 496546 - DNA, 25 bp, Rattus norvegicus
gtctaggcccacaaccaatttaaga

SEQ ID NO: 496547 - DNA, 25 bp, Rattus norvegicus
gtctaggcccactaccaatttaaga

SEQ ID NO: 496548 - DNA, 25 bp, Rattus norvegicus
gtctaggccgacaccaaggatagct

SEQ ID NO: 496549 - DNA, 25 bp, Rattus norvegicus
gtctaggccgactccaaggatagct

SEQ ID NO: 496550 - DNA, 25 bp, Rattus norvegicus
gtctaggctggcactacaggcacgt

SEQ ID NO: 496551 - DNA, 25 bp, Rattus norvegicus
gtctaggctggctctacaggcacgt

SEQ ID NO: 496552 - DNA, 25 bp, Rattus norvegicus
gtctaggctgtacggcccctcgctg

SEQ ID NO: 496553 - DNA, 25 bp, Rattus norvegicus
gtctaggctgtagggcccctcgctg

SEQ ID NO: 496554 - DNA, 25 bp, Rattus norvegicus
gtctagggaaccagctcgtggtcta

SEQ ID NO: 496555 - DNA, 25 bp, Rattus norvegicus
gtctagggaacctgctcgtggtcta

SEQ ID NO: 496556 - DNA, 25 bp, Rattus norvegicus
gtctagggcatacctacattatgaa

SEQ ID NO: 496557 - DNA, 25 bp, Rattus norvegicus
gtctagggcatagctacattatgaa

SEQ ID NO: 496558 - DNA, 25 bp, Rattus norvegicus
gtctagggcccaatgcagagtcagg

SEQ ID NO: 496559 - DNA, 25 bp, Rattus norvegicus
gtctagggcccattgcagagtcagg

SEQ ID NO: 496560 - DNA, 25 bp, Rattus norvegicus
gtctaggtggccatgtaggtgttcc

SEQ ID NO: 496561 - DNA, 25 bp, Rattus norvegicus
gtctaggtggccttgtaggtgttcc

SEQ ID NO: 496562 - DNA, 25 bp, Rattus norvegicus
gtctaggttgacagggttagctata

SEQ ID NO: 496563 - DNA, 25 bp, Rattus norvegicus
gtctaggttgactgggttagctata

SEQ ID NO: 496564 - DNA, 25 bp, Rattus norvegicus
gtctaggtttgaagccagaggttaa

SEQ ID NO: 496565 - DNA, 25 bp, Rattus norvegicus
gtctaggtttgatgccagaggttaa

SEQ ID NO: 496566 - DNA, 25 bp, Rattus norvegicus
gtctagtacatcagcttgaacgtat

SEQ ID NO: 496567 - DNA, 25 bp, Rattus norvegicus
gtctagtacatctgcttgaacgtat

SEQ ID NO: 496568 - DNA, 25 bp, Rattus norvegicus
gtctagtagtggcaattgggcatat

SEQ ID NO: 496569 - DNA, 25 bp, Rattus norvegicus
gtctagtagtgggaattgggcatat

SEQ ID NO: 496570 - DNA, 25 bp, Rattus norvegicus
gtctagtcaactatccttggttacg

SEQ ID NO: 496571 - DNA, 25 bp, Rattus norvegicus
gtctagtcaactttccttggttacg

SEQ ID NO: 496572 - DNA, 25 bp, Rattus norvegicus
gtctagtcccttaggtacatttcta

SEQ ID NO: 496573 - DNA, 25 bp, Rattus norvegicus
gtctagtccctttggtacatttcta

SEQ ID NO: 496574 - DNA, 25 bp, Rattus norvegicus
gtctagtcctagaccaatatgtcaa

SEQ ID NO: 496575 - DNA, 25 bp, Rattus norvegicus
gtctagtcctagtccaatatgtcaa

SEQ ID NO: 496576 - DNA, 25 bp, Rattus norvegicus
gtctagtctgtaccattgtccgaga

SEQ ID NO: 496577 - DNA, 25 bp, Rattus norvegicus
gtctagtctgtagcattgtccgaga

SEQ ID NO: 496578 - DNA, 25 bp, Rattus norvegicus
gtctagtcttggctgtatacgatta

SEQ ID NO: 496579 - DNA, 25 bp, Rattus norvegicus
gtctagtcttgggtgtatacgatta

SEQ ID NO: 496580 - DNA, 25 bp, Rattus norvegicus
gtctagtgacagaaattgcacccat

SEQ ID NO: 496581 - DNA, 25 bp, Rattus norvegicus
gtctagtgacagtaattgcacccat

SEQ ID NO: 496582 - DNA, 25 bp, Rattus norvegicus
gtctagtggacaagctctgttagca

SEQ ID NO: 496583 - DNA, 25 bp, Rattus norvegicus
gtctagtggacatgctctgttagca

SEQ ID NO: 496584 - DNA, 25 bp, Rattus norvegicus
gtctagtggcatccgcatgttgtcc

SEQ ID NO: 496585 - DNA, 25 bp, Rattus norvegicus
gtctagtggcatgcgcatgttgtcc

SEQ ID NO: 496586 - DNA, 25 bp, Rattus norvegicus
gtctagtgtactctgacttctgtag

SEQ ID NO: 496587 - DNA, 25 bp, Rattus norvegicus
gtctagtgtactgtgacttctgtag

SEQ ID NO: 496588 - DNA, 25 bp, Rattus norvegicus
gtctagtgtcatatcacagcggtgt

SEQ ID NO: 496589 - DNA, 25 bp, Rattus norvegicus
gtctagtgtcatttcacagcggtgt

SEQ ID NO: 496590 - DNA, 25 bp, Rattus norvegicus
gtctagtgtgtgatgttgtgctcta

SEQ ID NO: 496591 - DNA, 25 bp, Rattus norvegicus
gtctagtgtgtgttgttgtgctcta

SEQ ID NO: 496592 - DNA, 25 bp, Rattus norvegicus
gtctagttatttagatgcctaatta

SEQ ID NO: 496593 - DNA, 25 bp, Rattus norvegicus
gtctagttattttgatgcctaatta

SEQ ID NO: 496594 - DNA, 25 bp, Rattus norvegicus
gtctagttcagcatgcactcattta

SEQ ID NO: 496595 - DNA, 25 bp, Rattus norvegicus
gtctagttcagcttgcactcattta

SEQ ID NO: 496596 - DNA, 25 bp, Rattus norvegicus
gtctagttcctcattcctacaagga

SEQ ID NO: 496597 - DNA, 25 bp, Rattus norvegicus
gtctagttcctctttcctacaagga

SEQ ID NO: 496598 - DNA, 25 bp, Rattus norvegicus
gtctagttcttaccctggagctttt

SEQ ID NO: 496599 - DNA, 25 bp, Rattus norvegicus
gtctagttcttagcctggagctttt

SEQ ID NO: 496600 - DNA, 25 bp, Rattus norvegicus
gtctagttggccatgcagagtgaat

SEQ ID NO: 496601 - DNA, 25 bp, Rattus norvegicus
gtctagttggccttgcagagtgaat

SEQ ID NO: 496602 - DNA, 25 bp, Rattus norvegicus
gtctagtttcacctcacaaatgtat

SEQ ID NO: 496603 - DNA, 25 bp, Rattus norvegicus
gtctagtttcacgtcacaaatgtat

SEQ ID NO: 496604 - DNA, 25 bp, Rattus norvegicus
gtctagtttgttcatttcttccagt

SEQ ID NO: 496605 - DNA, 25 bp, Rattus norvegicus
gtctagtttgttgatttcttccagt

SEQ ID NO: 496606 - DNA, 25 bp, Rattus norvegicus
gtctagttttctccctcaagagagc

SEQ ID NO: 496607 - DNA, 25 bp, Rattus norvegicus
gtctagttttctgcctcaagagagc

SEQ ID NO: 496608 - DNA, 25 bp, Rattus norvegicus
gtctataacttcacccatctaggag

SEQ ID NO: 496609 - DNA, 25 bp, Rattus norvegicus
gtctataacttctcccatctaggag

SEQ ID NO: 496610 - DNA, 25 bp, Rattus norvegicus
gtctatacacccattgcagttaatt

SEQ ID NO: 496611 - DNA, 25 bp, Rattus norvegicus
gtctatacaccctttgcagttaatt

SEQ ID NO: 496612 - DNA, 25 bp, Rattus norvegicus
gtctataccagacggcaaggcagta

SEQ ID NO: 496613 - DNA, 25 bp, Rattus norvegicus
gtctataccagagggcaaggcagta

SEQ ID NO: 496614 - DNA, 25 bp, Rattus norvegicus
gtctatacggtgaaggcatgcccac

SEQ ID NO: 496615 - DNA, 25 bp, Rattus norvegicus
gtctatacggtgtaggcatgcccac

SEQ ID NO: 496616 - DNA, 25 bp, Rattus norvegicus
gtctatacttgaaacattcccactt

SEQ ID NO: 496617 - DNA, 25 bp, Rattus norvegicus
gtctatacttgatacattcccactt

SEQ ID NO: 496618 - DNA, 25 bp, Rattus norvegicus
gtctatagacatccatgcttccttt

SEQ ID NO: 496619 - DNA, 25 bp, Rattus norvegicus
gtctatagacatgcatgcttccttt

SEQ ID NO: 496620 - DNA, 25 bp, Rattus norvegicus
gtctatagacttacaatcgggtcgg

SEQ ID NO: 496621 - DNA, 25 bp, Rattus norvegicus
gtctatagactttcaatcgggtcgg

SEQ ID NO: 496622 - DNA, 25 bp, Rattus norvegicus
gtctatagcagacgctggtctctct

SEQ ID NO: 496623 - DNA, 25 bp, Rattus norvegicus
gtctatagcagaggctggtctctct

SEQ ID NO: 496624 - DNA, 25 bp, Rattus norvegicus
gtctatagctgtagatgggcatcac

SEQ ID NO: 496625 - DNA, 25 bp, Rattus norvegicus
gtctatagctgttgatgggcatcac

SEQ ID NO: 496626 - DNA, 25 bp, Rattus norvegicus
gtctatagtatacacgcctttcatt

SEQ ID NO: 496627 - DNA, 25 bp, Rattus norvegicus
gtctatagtatagacgcctttcatt

SEQ ID NO: 496628 - DNA, 25 bp, Rattus norvegicus
gtctatagtgtaccgttcagccctg

SEQ ID NO: 496629 - DNA, 25 bp, Rattus norvegicus
gtctatagtgtagcgttcagccctg

SEQ ID NO: 496630 - DNA, 25 bp, Rattus norvegicus
gtctatagttctctccgggagagct

SEQ ID NO: 496631 - DNA, 25 bp, Rattus norvegicus
gtctatagttctgtccgggagagct

SEQ ID NO: 496632 - DNA, 25 bp, Rattus norvegicus
gtctatagtttgaatgttctagcta

SEQ ID NO: 496633 - DNA, 25 bp, Rattus norvegicus
gtctatagtttgtatgttctagcta

SEQ ID NO: 496634 - DNA, 25 bp, Rattus norvegicus
gtctatataaacaatcctttcccta

SEQ ID NO: 496635 - DNA, 25 bp, Rattus norvegicus
gtctatataaactatcctttcccta

SEQ ID NO: 496636 - DNA, 25 bp, Rattus norvegicus
gtctatatcacaattgctttccgca

SEQ ID NO: 496637 - DNA, 25 bp, Rattus norvegicus
gtctatatcacatttgctttccgca

SEQ ID NO: 496638 - DNA, 25 bp, Rattus norvegicus
gtctatatgggcaacaaagggctca

SEQ ID NO: 496639 - DNA, 25 bp, Rattus norvegicus
gtctatatgggctacaaagggctca

SEQ ID NO: 496640 - DNA, 25 bp, Rattus norvegicus
gtctatcacaggctacaatatggcc

SEQ ID NO: 496641 - DNA, 25 bp, Rattus norvegicus
gtctatcacagggtacaatatggcc

SEQ ID NO: 496642 - DNA, 25 bp, Rattus norvegicus
gtctatcagtgtcttactaaaccag

SEQ ID NO: 496643 - DNA, 25 bp, Rattus norvegicus
gtctatcagtgtgttactaaaccag

SEQ ID NO: 496644 - DNA, 25 bp, Rattus norvegicus
gtctatcccagccattcaagaggaa

SEQ ID NO: 496645 - DNA, 25 bp, Rattus norvegicus
gtctatcccagcgattcaagaggaa

SEQ ID NO: 496646 - DNA, 25 bp, Rattus norvegicus
gtctatcccttaagatggttatttg

SEQ ID NO: 496647 - DNA, 25 bp, Rattus norvegicus
gtctatcccttatgatggttatttg

SEQ ID NO: 496648 - DNA, 25 bp, Rattus norvegicus
gtctatcctaggctttgccaggaga

SEQ ID NO: 496649 - DNA, 25 bp, Rattus norvegicus
gtctatcctagggtttgccaggaga

SEQ ID NO: 496650 - DNA, 25 bp, Rattus norvegicus
gtctatccttcgagtgccctgagaa

SEQ ID NO: 496651 - DNA, 25 bp, Rattus norvegicus
gtctatccttcgtgtgccctgagaa

SEQ ID NO: 496652 - DNA, 25 bp, Rattus norvegicus
gtctatcctttccagttcagcaagt

SEQ ID NO: 496653 - DNA, 25 bp, Rattus norvegicus
gtctatcctttcgagttcagcaagt

SEQ ID NO: 496654 - DNA, 25 bp, Rattus norvegicus
gtctatcgagccattttgagtccta

SEQ ID NO: 496655 - DNA, 25 bp, Rattus norvegicus
gtctatcgagcctttttgagtccta

SEQ ID NO: 496656 - DNA, 25 bp, Rattus norvegicus
gtctatcgagttctgatgtcctcat

SEQ ID NO: 496657 - DNA, 25 bp, Rattus norvegicus
gtctatcgagttgtgatgtcctcat

SEQ ID NO: 496658 - DNA, 25 bp, Rattus norvegicus
gtctatcgtggactgtctcttattt

SEQ ID NO: 496659 - DNA, 25 bp, Rattus norvegicus
gtctatcgtggagtgtctcttattt

SEQ ID NO: 496660 - DNA, 25 bp, Rattus norvegicus
gtctatctacttctaggaactattc

SEQ ID NO: 496661 - DNA, 25 bp, Rattus norvegicus
gtctatctacttgtaggaactattc

SEQ ID NO: 496662 - DNA, 25 bp, Rattus norvegicus
gtctatctagacacactcctggttt

SEQ ID NO: 496663 - DNA, 25 bp, Rattus norvegicus
gtctatctagactcactcctggttt

SEQ ID NO: 496664 - DNA, 25 bp, Rattus norvegicus
gtctatctcttgatcacggttgtaa

SEQ ID NO: 496665 - DNA, 25 bp, Rattus norvegicus
gtctatctcttgttcacggttgtaa

SEQ ID NO: 496666 - DNA, 25 bp, Rattus norvegicus
gtctatctgaccaagttactgtata

SEQ ID NO: 496667 - DNA, 25 bp, Rattus norvegicus
gtctatctgacctagttactgtata

SEQ ID NO: 496668 - DNA, 25 bp, Rattus norvegicus
gtctatcttagcatcctgtgaattt

SEQ ID NO: 496669 - DNA, 25 bp, Rattus norvegicus
gtctatcttagcttcctgtgaattt

SEQ ID NO: 496670 - DNA, 25 bp, Rattus norvegicus
gtctatcttttcaagctcatctgct

SEQ ID NO: 496671 - DNA, 25 bp, Rattus norvegicus
gtctatcttttctagctcatctgct

SEQ ID NO: 496672 - DNA, 25 bp, Rattus norvegicus
gtctatgaaaggctccctgactgtc

SEQ ID NO: 496673 - DNA, 25 bp, Rattus norvegicus
gtctatgaaagggtccctgactgtc

SEQ ID NO: 496674 - DNA, 25 bp, Rattus norvegicus
gtctatgaccaaagtaagctgccat

SEQ ID NO: 496675 - DNA, 25 bp, Rattus norvegicus
gtctatgaccaatgtaagctgccat

SEQ ID NO: 496676 - DNA, 25 bp, Rattus norvegicus
gtctatgacctgctgaaacagttct

SEQ ID NO: 496677 - DNA, 25 bp, Rattus norvegicus
gtctatgacctggtgaaacagttct

SEQ ID NO: 496678 - DNA, 25 bp, Rattus norvegicus
gtctatgactggcaagctagctgtt

SEQ ID NO: 496679 - DNA, 25 bp, Rattus norvegicus
gtctatgactgggaagctagctgtt

SEQ ID NO: 496680 - DNA, 25 bp, Rattus norvegicus
gtctatgagcaaatgggcctcctgc

SEQ ID NO: 496681 - DNA, 25 bp, Rattus norvegicus
gtctatgagcaattgggcctcctgc

SEQ ID NO: 496682 - DNA, 25 bp, Rattus norvegicus
gtctatgagtgtcccaacctgttcc

SEQ ID NO: 496683 - DNA, 25 bp, Rattus norvegicus
gtctatgagtgtgccaacctgttcc

SEQ ID NO: 496684 - DNA, 25 bp, Rattus norvegicus
gtctatgcaacaaacacggtggtct

SEQ ID NO: 496685 - DNA, 25 bp, Rattus norvegicus
gtctatgcaacatacacggtggtct

SEQ ID NO: 496686 - DNA, 25 bp, Rattus norvegicus
gtctatgcagataccctggacttca

SEQ ID NO: 496687 - DNA, 25 bp, Rattus norvegicus
gtctatgcagattccctggacttca

SEQ ID NO: 496688 - DNA, 25 bp, Rattus norvegicus
gtctatgcagcaactgacctgagga

SEQ ID NO: 496689 - DNA, 25 bp, Rattus norvegicus
gtctatgcagcatctgacctgagga

SEQ ID NO: 496690 - DNA, 25 bp, Rattus norvegicus
gtctatgcccctcctggaggctgta

SEQ ID NO: 496691 - DNA, 25 bp, Rattus norvegicus
gtctatgcccctgctggaggctgta

SEQ ID NO: 496692 - DNA, 25 bp, Rattus norvegicus
gtctatgctctgcaaatctgatcac

SEQ ID NO: 496693 - DNA, 25 bp, Rattus norvegicus
gtctatgctctggaaatctgatcac

SEQ ID NO: 496694 - DNA, 25 bp, Rattus norvegicus
gtctatgcttaacgagccacctcta

SEQ ID NO: 496695 - DNA, 25 bp, Rattus norvegicus
gtctatgcttaaggagccacctcta

SEQ ID NO: 496696 - DNA, 25 bp, Rattus norvegicus
gtctatggaaataggttcgctcctt

SEQ ID NO: 496697 - DNA, 25 bp, Rattus norvegicus
gtctatggaaattggttcgctcctt

SEQ ID NO: 496698 - DNA, 25 bp, Rattus norvegicus
gtctatggcctcatcaggactgaac

SEQ ID NO: 496699 - DNA, 25 bp, Rattus norvegicus
gtctatggcctcttcaggactgaac

SEQ ID NO: 496700 - DNA, 25 bp, Rattus norvegicus
gtctatggcgccaaagctgcacttt

SEQ ID NO: 496701 - DNA, 25 bp, Rattus norvegicus
gtctatggcgcctaagctgcacttt

SEQ ID NO: 496702 - DNA, 25 bp, Rattus norvegicus
gtctatggcgtcatgagcatcatca

SEQ ID NO: 496703 - DNA, 25 bp, Rattus norvegicus
gtctatggcgtcttgagcatcatca

SEQ ID NO: 496704 - DNA, 25 bp, Rattus norvegicus
gtctatggttccactgactgttgaa

SEQ ID NO: 496705 - DNA, 25 bp, Rattus norvegicus
gtctatggttcctctgactgttgaa

SEQ ID NO: 496706 - DNA, 25 bp, Rattus norvegicus
gtctatgtacatatggctgaaaagt

SEQ ID NO: 496707 - DNA, 25 bp, Rattus norvegicus
gtctatgtacatatgttcctttgaa

SEQ ID NO: 496708 - DNA, 25 bp, Rattus norvegicus
gtctatgtacatttggctgaaaagt

SEQ ID NO: 496709 - DNA, 25 bp, Rattus norvegicus
gtctatgtacatttgttcctttgaa

SEQ ID NO: 496710 - DNA, 25 bp, Rattus norvegicus
gtctatgtaggtactttctcatttt

SEQ ID NO: 496711 - DNA, 25 bp, Rattus norvegicus
gtctatgtaggttctttctcatttt

SEQ ID NO: 496712 - DNA, 25 bp, Rattus norvegicus
gtctatgtatcaagtagtgctcccc

SEQ ID NO: 496713 - DNA, 25 bp, Rattus norvegicus
gtctatgtatcatgtagtgctcccc

SEQ ID NO: 496714 - DNA, 25 bp, Rattus norvegicus
gtctatgtccatccagggttgaaga

SEQ ID NO: 496715 - DNA, 25 bp, Rattus norvegicus
gtctatgtccatgcagggttgaaga

SEQ ID NO: 496716 - DNA, 25 bp, Rattus norvegicus
gtctatgtgtgcaagttgctcggca

SEQ ID NO: 496717 - DNA, 25 bp, Rattus norvegicus
gtctatgtgtgctagttgctcggca

SEQ ID NO: 496718 - DNA, 25 bp, Rattus norvegicus
gtctatgttctaatggatgtacgta

SEQ ID NO: 496719 - DNA, 25 bp, Rattus norvegicus
gtctatgttctattggatgtacgta

SEQ ID NO: 496720 - DNA, 25 bp, Rattus norvegicus
gtctatgtttatctttggtcaatcc

SEQ ID NO: 496721 - DNA, 25 bp, Rattus norvegicus
gtctatgtttatgtttggtcaatcc

SEQ ID NO: 496722 - DNA, 25 bp, Rattus norvegicus
gtctattaaagtatgtctccggatt

SEQ ID NO: 496723 - DNA, 25 bp, Rattus norvegicus
gtctattaaagtttgtctccggatt

SEQ ID NO: 496724 - DNA, 25 bp, Rattus norvegicus
gtctattacaatccctcccacagtg

SEQ ID NO: 496725 - DNA, 25 bp, Rattus norvegicus
gtctattacaatgcctcccacagtg

SEQ ID NO: 496726 - DNA, 25 bp, Rattus norvegicus
gtctattatcaaatccagtcttcca

SEQ ID NO: 496727 - DNA, 25 bp, Rattus norvegicus
gtctattatcaattccagtcttcca

SEQ ID NO: 496728 - DNA, 25 bp, Rattus norvegicus
gtctattcacacctcctttaaatta

SEQ ID NO: 496729 - DNA, 25 bp, Rattus norvegicus
gtctattcacacgtcctttaaatta

SEQ ID NO: 496730 - DNA, 25 bp, Rattus norvegicus
gtctattcagtgctacttgagcagc

SEQ ID NO: 496731 - DNA, 25 bp, Rattus norvegicus
gtctattcagtggtacttgagcagc

SEQ ID NO: 496732 - DNA, 25 bp, Rattus norvegicus
gtctattcctgcctagagggtttac

SEQ ID NO: 496733 - DNA, 25 bp, Rattus norvegicus
gtctattcctgcgtagagggtttac

SEQ ID NO: 496734 - DNA, 25 bp, Rattus norvegicus
gtctattctgtcacctgttgctgaa

SEQ ID NO: 496735 - DNA, 25 bp, Rattus norvegicus
gtctattctgtccactaggcagcaa

SEQ ID NO: 496736 - DNA, 25 bp, Rattus norvegicus
gtctattctgtcgactaggcagcaa

SEQ ID NO: 496737 - DNA, 25 bp, Rattus norvegicus
gtctattctgtctcctgttgctgaa

SEQ ID NO: 496738 - DNA, 25 bp, Rattus norvegicus
gtctattgaagaaccacacacctat

SEQ ID NO: 496739 - DNA, 25 bp, Rattus norvegicus
gtctattgaagatccacacacctat

SEQ ID NO: 496740 - DNA, 25 bp, Rattus norvegicus
gtctattgcacgcttcatggagtca

SEQ ID NO: 496741 - DNA, 25 bp, Rattus norvegicus
gtctattgcacggttcatggagtca

SEQ ID NO: 496742 - DNA, 25 bp, Rattus norvegicus
gtctattgccctagattttgatatt

SEQ ID NO: 496743 - DNA, 25 bp, Rattus norvegicus
gtctattgcccttgattttgatatt

SEQ ID NO: 496744 - DNA, 25 bp, Rattus norvegicus
gtctattggcaaacactactcgtct

SEQ ID NO: 496745 - DNA, 25 bp, Rattus norvegicus
gtctattggcaatcactactcgtct

SEQ ID NO: 496746 - DNA, 25 bp, Rattus norvegicus
gtctatttaacccagtgaaacaaag

SEQ ID NO: 496747 - DNA, 25 bp, Rattus norvegicus
gtctatttaaccgagtgaaacaaag

SEQ ID NO: 496748 - DNA, 25 bp, Rattus norvegicus
gtctatttaatcagcttccttctga

SEQ ID NO: 496749 - DNA, 25 bp, Rattus norvegicus
gtctatttaatctgcttccttctga

SEQ ID NO: 496750 - DNA, 25 bp, Rattus norvegicus
gtctatttcaacaatgggccttttg

SEQ ID NO: 496751 - DNA, 25 bp, Rattus norvegicus
gtctatttcaactatgggccttttg

SEQ ID NO: 496752 - DNA, 25 bp, Rattus norvegicus
gtctatttcttaagctaacaaaaac

SEQ ID NO: 496753 - DNA, 25 bp, Rattus norvegicus
gtctatttcttatgctaacaaaaac

SEQ ID NO: 496754 - DNA, 25 bp, Rattus norvegicus
gtctatttgcctatagtgcctccaa

SEQ ID NO: 496755 - DNA, 25 bp, Rattus norvegicus
gtctatttgcctttagtgcctccaa

SEQ ID NO: 496756 - DNA, 25 bp, Rattus norvegicus
gtctatttggttatgctgccttgga

SEQ ID NO: 496757 - DNA, 25 bp, Rattus norvegicus
gtctatttggttttgctgccttgga

SEQ ID NO: 496758 - DNA, 25 bp, Rattus norvegicus
gtctatttgtgtcgtcaggctgtat

SEQ ID NO: 496759 - DNA, 25 bp, Rattus norvegicus
gtctatttgtgtggtcaggctgtat

SEQ ID NO: 496760 - DNA, 25 bp, Rattus norvegicus
gtctattttattactccacactcta

SEQ ID NO: 496761 - DNA, 25 bp, Rattus norvegicus
gtctattttatttctccacactcta

SEQ ID NO: 496762 - DNA, 25 bp, Rattus norvegicus
gtctattttcttctatgagtcagct

SEQ ID NO: 496763 - DNA, 25 bp, Rattus norvegicus
gtctattttcttgtatgagtcagct

SEQ ID NO: 496764 - DNA, 25 bp, Rattus norvegicus
gtctcaaaactaatccaccacttat

SEQ ID NO: 496765 - DNA, 25 bp, Rattus norvegicus
gtctcaaaactattccaccacttat

SEQ ID NO: 496766 - DNA, 25 bp, Rattus norvegicus
gtctcaaacactaataactccagct

SEQ ID NO: 496767 - DNA, 25 bp, Rattus norvegicus
gtctcaaacacttataactccagct

SEQ ID NO: 496768 - DNA, 25 bp, Rattus norvegicus
gtctcaaactctatctcagtagcgt

SEQ ID NO: 496769 - DNA, 25 bp, Rattus norvegicus
gtctcaaactctttctcagtagcgt

SEQ ID NO: 496770 - DNA, 25 bp, Rattus norvegicus
gtctcaaaggccaagcattacattt

SEQ ID NO: 496771 - DNA, 25 bp, Rattus norvegicus
gtctcaaaggcctagcattacattt

SEQ ID NO: 496772 - DNA, 25 bp, Rattus norvegicus
gtctcaaagtcacctgcacttctat

SEQ ID NO: 496773 - DNA, 25 bp, Rattus norvegicus
gtctcaaagtcagctgcacttctat

SEQ ID NO: 496774 - DNA, 25 bp, Rattus norvegicus
gtctcaaagtctaacagtgtctcct

SEQ ID NO: 496775 - DNA, 25 bp, Rattus norvegicus
gtctcaaagtcttacagtgtctcct

SEQ ID NO: 496776 - DNA, 25 bp, Rattus norvegicus
gtctcaaatccaatagttcacagct

SEQ ID NO: 496777 - DNA, 25 bp, Rattus norvegicus
gtctcaaatccattagttcacagct

SEQ ID NO: 496778 - DNA, 25 bp, Rattus norvegicus
gtctcaaattttcctgctactcaag

SEQ ID NO: 496779 - DNA, 25 bp, Rattus norvegicus
gtctcaaattttgctgctactcaag

SEQ ID NO: 496780 - DNA, 25 bp, Rattus norvegicus
gtctcaacacacaccattttaactt

SEQ ID NO: 496781 - DNA, 25 bp, Rattus norvegicus
gtctcaacacactccattttaactt

SEQ ID NO: 496782 - DNA, 25 bp, Rattus norvegicus
gtctcaacattgcaaaggtccggtg

SEQ ID NO: 496783 - DNA, 25 bp, Rattus norvegicus
gtctcaacattggaaaggtccggtg

SEQ ID NO: 496784 - DNA, 25 bp, Rattus norvegicus
gtctcaaccaacaagccgaaccttt

SEQ ID NO: 496785 - DNA, 25 bp, Rattus norvegicus
gtctcaaccaactagccgaaccttt

SEQ ID NO: 496786 - DNA, 25 bp, Rattus norvegicus
gtctcaaccactagatgattgcttt

SEQ ID NO: 496787 - DNA, 25 bp, Rattus norvegicus
gtctcaaccacttgatgattgcttt

SEQ ID NO: 496788 - DNA, 25 bp, Rattus norvegicus
gtctcaactggaaatgttttaccgg

SEQ ID NO: 496789 - DNA, 25 bp, Rattus norvegicus
gtctcaactggatatgttttaccgg

SEQ ID NO: 496790 - DNA, 25 bp, Rattus norvegicus
gtctcaactgtgaagctccggctgg

SEQ ID NO: 496791 - DNA, 25 bp, Rattus norvegicus
gtctcaactgtgtagctccggctgg

SEQ ID NO: 496792 - DNA, 25 bp, Rattus norvegicus
gtctcaacttcccagtgcttatata

SEQ ID NO: 496793 - DNA, 25 bp, Rattus norvegicus
gtctcaacttccgagtgcttatata

SEQ ID NO: 496794 - DNA, 25 bp, Rattus norvegicus
gtctcaacttcgacacacggaatgg

SEQ ID NO: 496795 - DNA, 25 bp, Rattus norvegicus
gtctcaacttcgtcacacggaatgg

SEQ ID NO: 496796 - DNA, 25 bp, Rattus norvegicus
gtctcaagacagatccttctaggaa

SEQ ID NO: 496797 - DNA, 25 bp, Rattus norvegicus
gtctcaagacagttccttctaggaa

SEQ ID NO: 496798 - DNA, 25 bp, Rattus norvegicus
gtctcaagatatctgtgttcctgtc

SEQ ID NO: 496799 - DNA, 25 bp, Rattus norvegicus
gtctcaagatatgtgtgttcctgtc

SEQ ID NO: 496800 - DNA, 25 bp, Rattus norvegicus
gtctcaagcgccatcatactggata

SEQ ID NO: 496801 - DNA, 25 bp, Rattus norvegicus
gtctcaagcgccttcatactggata

SEQ ID NO: 496802 - DNA, 25 bp, Rattus norvegicus
gtctcaagcggcatgggtcgatttt

SEQ ID NO: 496803 - DNA, 25 bp, Rattus norvegicus
gtctcaagcggcttgggtcgatttt

SEQ ID NO: 496804 - DNA, 25 bp, Rattus norvegicus
gtctcaaggcttaatactactattt

SEQ ID NO: 496805 - DNA, 25 bp, Rattus norvegicus
gtctcaaggctttatactactattt

SEQ ID NO: 496806 - DNA, 25 bp, Rattus norvegicus
gtctcaagtatgacatgctgcctgt

SEQ ID NO: 496807 - DNA, 25 bp, Rattus norvegicus
gtctcaagtatgtcatgctgcctgt

SEQ ID NO: 496808 - DNA, 25 bp, Rattus norvegicus
gtctcaagtgttaacaaccattttg

SEQ ID NO: 496809 - DNA, 25 bp, Rattus norvegicus
gtctcaagtgtttacaaccattttg

SEQ ID NO: 496810 - DNA, 25 bp, Rattus norvegicus
gtctcaagttggatgacctcattac

SEQ ID NO: 496811 - DNA, 25 bp, Rattus norvegicus
gtctcaagttggttgacctcattac

SEQ ID NO: 496812 - DNA, 25 bp, Rattus norvegicus
gtctcaattaatacttccccaaatc

SEQ ID NO: 496813 - DNA, 25 bp, Rattus norvegicus
gtctcaattaattcttccccaaatc

SEQ ID NO: 496814 - DNA, 25 bp, Rattus norvegicus
gtctcacactgacatctccaaagtg

SEQ ID NO: 496815 - DNA, 25 bp, Rattus norvegicus
gtctcacactgagatctccaaagtg

SEQ ID NO: 496816 - DNA, 25 bp, Rattus norvegicus
gtctcacactgcagagtgctacaaa

SEQ ID NO: 496817 - DNA, 25 bp, Rattus norvegicus
gtctcacactgctgagtgctacaaa

SEQ ID NO: 496818 - DNA, 25 bp, Rattus norvegicus
gtctcacagcaccatgtttacaggg

SEQ ID NO: 496819 - DNA, 25 bp, Rattus norvegicus
gtctcacagcacgatgtttacaggg

SEQ ID NO: 496820 - DNA, 25 bp, Rattus norvegicus
gtctcacagcatcactggcatagta

SEQ ID NO: 496821 - DNA, 25 bp, Rattus norvegicus
gtctcacagcatgactggcatagta

SEQ ID NO: 496822 - DNA, 25 bp, Rattus norvegicus
gtctcacagcgaaagggatcaggaa

SEQ ID NO: 496823 - DNA, 25 bp, Rattus norvegicus
gtctcacagcgatagggatcaggaa

SEQ ID NO: 496824 - DNA, 25 bp, Rattus norvegicus
gtctcacattaacagaggcctagac

SEQ ID NO: 496825 - DNA, 25 bp, Rattus norvegicus
gtctcacattaagagaggcctagac

SEQ ID NO: 496826 - DNA, 25 bp, Rattus norvegicus
gtctcacattccaatcttaaagagg

SEQ ID NO: 496827 - DNA, 25 bp, Rattus norvegicus
gtctcacattcctatcttaaagagg

SEQ ID NO: 496828 - DNA, 25 bp, Rattus norvegicus
gtctcaccagcacgagtgcgtgcaa

SEQ ID NO: 496829 - DNA, 25 bp, Rattus norvegicus
gtctcaccagcaggagtgcgtgcaa

SEQ ID NO: 496830 - DNA, 25 bp, Rattus norvegicus
gtctcaccagccagaaggattctgt

SEQ ID NO: 496831 - DNA, 25 bp, Rattus norvegicus
gtctcaccagcctgaaggattctgt

SEQ ID NO: 496832 - DNA, 25 bp, Rattus norvegicus
gtctcaccagtacgtctttatcccg

SEQ ID NO: 496833 - DNA, 25 bp, Rattus norvegicus
gtctcaccagtaggtctttatcccg

SEQ ID NO: 496834 - DNA, 25 bp, Rattus norvegicus
gtctcaccagtgagcatatgggcaa

SEQ ID NO: 496835 - DNA, 25 bp, Rattus norvegicus
gtctcaccagtgtgcatatgggcaa

SEQ ID NO: 496836 - DNA, 25 bp, Rattus norvegicus
gtctcacccctgactgtgaaggaat

SEQ ID NO: 496837 - DNA, 25 bp, Rattus norvegicus
gtctcacccctgtctgtgaaggaat

SEQ ID NO: 496838 - DNA, 25 bp, Rattus norvegicus
gtctcaccctaccagcaagtgattg

SEQ ID NO: 496839 - DNA, 25 bp, Rattus norvegicus
gtctcaccctacgagcaagtgattg

SEQ ID NO: 496840 - DNA, 25 bp, Rattus norvegicus
gtctcacctagcaacataaccataa

SEQ ID NO: 496841 - DNA, 25 bp, Rattus norvegicus
gtctcacctagctacataaccataa

SEQ ID NO: 496842 - DNA, 25 bp, Rattus norvegicus
gtctcacctagtcccattttacaga

SEQ ID NO: 496843 - DNA, 25 bp, Rattus norvegicus
gtctcacctagtgccattttacaga

SEQ ID NO: 496844 - DNA, 25 bp, Rattus norvegicus
gtctcacctcagagggaaaagaagc

SEQ ID NO: 496845 - DNA, 25 bp, Rattus norvegicus
gtctcacctcagtgggaaaagaagc

SEQ ID NO: 496846 - DNA, 25 bp, Rattus norvegicus
gtctcacctgcgcttttgaaagcag

SEQ ID NO: 496847 - DNA, 25 bp, Rattus norvegicus
gtctcacctgcggttttgaaagcag

SEQ ID NO: 496848 - DNA, 25 bp, Rattus norvegicus
gtctcacctggaaactgtatctgaa

SEQ ID NO: 496849 - DNA, 25 bp, Rattus norvegicus
gtctcacctggatactgtatctgaa

SEQ ID NO: 496850 - DNA, 25 bp, Rattus norvegicus
gtctcaccttatattctggttactt

SEQ ID NO: 496851 - DNA, 25 bp, Rattus norvegicus
gtctcaccttattttctggttactt

SEQ ID NO: 496852 - DNA, 25 bp, Rattus norvegicus
gtctcaccttttccgatgagtttga

SEQ ID NO: 496853 - DNA, 25 bp, Rattus norvegicus
gtctcaccttttgcgatgagtttga

SEQ ID NO: 496854 - DNA, 25 bp, Rattus norvegicus
gtctcacgcagcagttgtggttgct

SEQ ID NO: 496855 - DNA, 25 bp, Rattus norvegicus
gtctcacgcagctgttgtggttgct

SEQ ID NO: 496856 - DNA, 25 bp, Rattus norvegicus
gtctcacgctgcagaacatgtgtca

SEQ ID NO: 496857 - DNA, 25 bp, Rattus norvegicus
gtctcacgctgctgaacatgtgtca

SEQ ID NO: 496858 - DNA, 25 bp, Rattus norvegicus
gtctcactaactctggctggcttca

SEQ ID NO: 496859 - DNA, 25 bp, Rattus norvegicus
gtctcactaactgtggctggcttca

SEQ ID NO: 496860 - DNA, 25 bp, Rattus norvegicus
gtctcactagttattcaaggttgta

SEQ ID NO: 496861 - DNA, 25 bp, Rattus norvegicus
gtctcactagtttttcaaggttgta

SEQ ID NO: 496862 - DNA, 25 bp, Rattus norvegicus
gtctcactccaacaaatgtctctta

SEQ ID NO: 496863 - DNA, 25 bp, Rattus norvegicus
gtctcactccaagaaatgtctctta

SEQ ID NO: 496864 - DNA, 25 bp, Rattus norvegicus
gtctcactcccaaggagtcacctaa

SEQ ID NO: 496865 - DNA, 25 bp, Rattus norvegicus
gtctcactcccatggagtcacctaa

SEQ ID NO: 496866 - DNA, 25 bp, Rattus norvegicus
gtctcactcgttcaaattctatgta

SEQ ID NO: 496867 - DNA, 25 bp, Rattus norvegicus
gtctcactcgttgaaattctatgta

SEQ ID NO: 496868 - DNA, 25 bp, Rattus norvegicus
gtctcactgctcaaaaaccaaaatg

SEQ ID NO: 496869 - DNA, 25 bp, Rattus norvegicus
gtctcactgctctaaaaccaaaatg

SEQ ID NO: 496870 - DNA, 25 bp, Rattus norvegicus
gtctcactgctgctctccaaaggag

SEQ ID NO: 496871 - DNA, 25 bp, Rattus norvegicus
gtctcactgctggtctccaaaggag

SEQ ID NO: 496872 - DNA, 25 bp, Rattus norvegicus
gtctcactggaccactttagtctaa

SEQ ID NO: 496873 - DNA, 25 bp, Rattus norvegicus
gtctcactggacgactttagtctaa

SEQ ID NO: 496874 - DNA, 25 bp, Rattus norvegicus
gtctcacttgagacatgtctgccta

SEQ ID NO: 496875 - DNA, 25 bp, Rattus norvegicus
gtctcacttgagtcatgtctgccta

SEQ ID NO: 496876 - DNA, 25 bp, Rattus norvegicus
gtctcacttgctcctgtagctgtca

SEQ ID NO: 496877 - DNA, 25 bp, Rattus norvegicus
gtctcacttgctgctgtagctgtca

SEQ ID NO: 496878 - DNA, 25 bp, Rattus norvegicus
gtctcactttctaatgttcctaact

SEQ ID NO: 496879 - DNA, 25 bp, Rattus norvegicus
gtctcactttcttatgttcctaact

SEQ ID NO: 496880 - DNA, 25 bp, Rattus norvegicus
gtctcactttgtagtcttggagatc

SEQ ID NO: 496881 - DNA, 25 bp, Rattus norvegicus
gtctcactttgttgtcttggagatc

SEQ ID NO: 496882 - DNA, 25 bp, Rattus norvegicus
gtctcacttttcagcgagtctactt

SEQ ID NO: 496883 - DNA, 25 bp, Rattus norvegicus
gtctcacttttctgcgagtctactt

SEQ ID NO: 496884 - DNA, 25 bp, Rattus norvegicus
gtctcagaactaacaactaccacca

SEQ ID NO: 496885 - DNA, 25 bp, Rattus norvegicus
gtctcagaactatcaactaccacca

SEQ ID NO: 496886 - DNA, 25 bp, Rattus norvegicus
gtctcagaactcagggacccggagg

SEQ ID NO: 496887 - DNA, 25 bp, Rattus norvegicus
gtctcagaactctgggacccggagg

SEQ ID NO: 496888 - DNA, 25 bp, Rattus norvegicus
gtctcagaagatcgtttgtgttaaa

SEQ ID NO: 496889 - DNA, 25 bp, Rattus norvegicus
gtctcagaagatggtttgtgttaaa

SEQ ID NO: 496890 - DNA, 25 bp, Rattus norvegicus
gtctcagacacaccgcgtttctaga

SEQ ID NO: 496891 - DNA, 25 bp, Rattus norvegicus
gtctcagacacagcgcgtttctaga

SEQ ID NO: 496892 - DNA, 25 bp, Rattus norvegicus
gtctcagacagaatgggcccagcta

SEQ ID NO: 496893 - DNA, 25 bp, Rattus norvegicus
gtctcagacagattgggcccagcta

SEQ ID NO: 496894 - DNA, 25 bp, Rattus norvegicus
gtctcagacgccctgctggaaaaga

SEQ ID NO: 496895 - DNA, 25 bp, Rattus norvegicus
gtctcagacgccgtgctggaaaaga

SEQ ID NO: 496896 - DNA, 25 bp, Rattus norvegicus
gtctcagactcgatccgcagcggga

SEQ ID NO: 496897 - DNA, 25 bp, Rattus norvegicus
gtctcagactcgttccgcagcggga

SEQ ID NO: 496898 - DNA, 25 bp, Rattus norvegicus
gtctcagagatgatcagccagtcag

SEQ ID NO: 496899 - DNA, 25 bp, Rattus norvegicus
gtctcagagatgttcagccagtcag

SEQ ID NO: 496900 - DNA, 25 bp, Rattus norvegicus
gtctcagagctacacctcagagctt

SEQ ID NO: 496901 - DNA, 25 bp, Rattus norvegicus
gtctcagagctagacctcagagctt

SEQ ID NO: 496902 - DNA, 25 bp, Rattus norvegicus
gtctcagagctcattcagtgatgga

SEQ ID NO: 496903 - DNA, 25 bp, Rattus norvegicus
gtctcagagctctttcagtgatgga

SEQ ID NO: 496904 - DNA, 25 bp, Rattus norvegicus
gtctcagagctgaagtatttcctaa

SEQ ID NO: 496905 - DNA, 25 bp, Rattus norvegicus
gtctcagagctgaggtgatagttca

SEQ ID NO: 496906 - DNA, 25 bp, Rattus norvegicus
gtctcagagctgtagtatttcctaa

SEQ ID NO: 496907 - DNA, 25 bp, Rattus norvegicus
gtctcagagctgtggtgatagttca

SEQ ID NO: 496908 - DNA, 25 bp, Rattus norvegicus
gtctcagagggtcgccttgaccagt

SEQ ID NO: 496909 - DNA, 25 bp, Rattus norvegicus
gtctcagagggtggccttgaccagt

SEQ ID NO: 496910 - DNA, 25 bp, Rattus norvegicus
gtctcagaggtcacttttggttttg

SEQ ID NO: 496911 - DNA, 25 bp, Rattus norvegicus
gtctcagaggtctcttttggttttg

SEQ ID NO: 496912 - DNA, 25 bp, Rattus norvegicus
gtctcagataagctgctaggacctt

SEQ ID NO: 496913 - DNA, 25 bp, Rattus norvegicus
gtctcagataaggtgctaggacctt

SEQ ID NO: 496914 - DNA, 25 bp, Rattus norvegicus
gtctcagattttctaaggaccaaaa

SEQ ID NO: 496915 - DNA, 25 bp, Rattus norvegicus
gtctcagattttgtaaggaccaaaa

SEQ ID NO: 496916 - DNA, 25 bp, Rattus norvegicus
gtctcagcaatgcttgactcatctc

SEQ ID NO: 496917 - DNA, 25 bp, Rattus norvegicus
gtctcagcaatggttgactcatctc

SEQ ID NO: 496918 - DNA, 25 bp, Rattus norvegicus
gtctcagcagtacggtgctttccta

SEQ ID NO: 496919 - DNA, 25 bp, Rattus norvegicus
gtctcagcagtagggtgctttccta

SEQ ID NO: 496920 - DNA, 25 bp, Rattus norvegicus
gtctcagcctccctaagtagtggga

SEQ ID NO: 496921 - DNA, 25 bp, Rattus norvegicus
gtctcagcctccgtaagtagtggga

SEQ ID NO: 496922 - DNA, 25 bp, Rattus norvegicus
gtctcagccttgattctacatggaa

SEQ ID NO: 496923 - DNA, 25 bp, Rattus norvegicus
gtctcagccttgtttctacatggaa

SEQ ID NO: 496924 - DNA, 25 bp, Rattus norvegicus
gtctcagcctttattcatctgcaaa

SEQ ID NO: 496925 - DNA, 25 bp, Rattus norvegicus
gtctcagccttttttcatctgcaaa

SEQ ID NO: 496926 - DNA, 25 bp, Rattus norvegicus
gtctcagctgctagtgttgacggga

SEQ ID NO: 496927 - DNA, 25 bp, Rattus norvegicus
gtctcagctgcttgtgttgacggga

SEQ ID NO: 496928 - DNA, 25 bp, Rattus norvegicus
gtctcagctgttctgtggaagccat

SEQ ID NO: 496929 - DNA, 25 bp, Rattus norvegicus
gtctcagctgttgtgtggaagccat

SEQ ID NO: 496930 - DNA, 25 bp, Rattus norvegicus
gtctcaggaatcacaagtttgccat

SEQ ID NO: 496931 - DNA, 25 bp, Rattus norvegicus
gtctcaggaatctcaagtttgccat

SEQ ID NO: 496932 - DNA, 25 bp, Rattus norvegicus
gtctcaggccacaagaagtctcatc

SEQ ID NO: 496933 - DNA, 25 bp, Rattus norvegicus
gtctcaggccactagaagtctcatc

SEQ ID NO: 496934 - DNA, 25 bp, Rattus norvegicus
gtctcaggcgtcagcatatgcacat

SEQ ID NO: 496935 - DNA, 25 bp, Rattus norvegicus
gtctcaggcgtctgcatatgcacat

SEQ ID NO: 496936 - DNA, 25 bp, Rattus norvegicus
gtctcagggaacatggcagctcgga

SEQ ID NO: 496937 - DNA, 25 bp, Rattus norvegicus
gtctcagggaacttggcagctcgga

SEQ ID NO: 496938 - DNA, 25 bp, Rattus norvegicus
gtctcagggcaacgtggtcattctc

SEQ ID NO: 496939 - DNA, 25 bp, Rattus norvegicus
gtctcagggcaaggtggtcattctc

SEQ ID NO: 496940 - DNA, 25 bp, Rattus norvegicus
gtctcagggccccagaaatgggtca

SEQ ID NO: 496941 - DNA, 25 bp, Rattus norvegicus
gtctcagggcccgagaaatgggtca

SEQ ID NO: 496942 - DNA, 25 bp, Rattus norvegicus
gtctcagggctgaaacactctcagg

SEQ ID NO: 496943 - DNA, 25 bp, Rattus norvegicus
gtctcagggctgtaacactctcagg

SEQ ID NO: 496944 - DNA, 25 bp, Rattus norvegicus
gtctcagggcttccaccgttggaag

SEQ ID NO: 496945 - DNA, 25 bp, Rattus norvegicus
gtctcagggcttgcaccgttggaag

SEQ ID NO: 496946 - DNA, 25 bp, Rattus norvegicus
gtctcaggtaacctcatttactggt

SEQ ID NO: 496947 - DNA, 25 bp, Rattus norvegicus
gtctcaggtaacgtcatttactggt

SEQ ID NO: 496948 - DNA, 25 bp, Rattus norvegicus
gtctcaggtactccctcgatgaaga

SEQ ID NO: 496949 - DNA, 25 bp, Rattus norvegicus
gtctcaggtactgcctcgatgaaga

SEQ ID NO: 496950 - DNA, 25 bp, Rattus norvegicus
gtctcaggtgctccagtcagccaaa

SEQ ID NO: 496951 - DNA, 25 bp, Rattus norvegicus
gtctcaggtgctgcagtcagccaaa

SEQ ID NO: 496952 - DNA, 25 bp, Rattus norvegicus
gtctcaggtgtgagaggcccgactc

SEQ ID NO: 496953 - DNA, 25 bp, Rattus norvegicus
gtctcaggtgtgtgaggcccgactc

SEQ ID NO: 496954 - DNA, 25 bp, Rattus norvegicus
gtctcaggttttagccatgaagaat

SEQ ID NO: 496955 - DNA, 25 bp, Rattus norvegicus
gtctcaggtttttgccatgaagaat

SEQ ID NO: 496956 - DNA, 25 bp, Rattus norvegicus
gtctcagtacaaatgtccctgtggt

SEQ ID NO: 496957 - DNA, 25 bp, Rattus norvegicus
gtctcagtacaattgtccctgtggt

SEQ ID NO: 496958 - DNA, 25 bp, Rattus norvegicus
gtctcagtagatacaacttagcctt

SEQ ID NO: 496959 - DNA, 25 bp, Rattus norvegicus
gtctcagtagattcaacttagcctt

SEQ ID NO: 496960 - DNA, 25 bp, Rattus norvegicus
gtctcagtagccaaggagcgtccta

SEQ ID NO: 496961 - DNA, 25 bp, Rattus norvegicus
gtctcagtagcctaggagcgtccta

SEQ ID NO: 496962 - DNA, 25 bp, Rattus norvegicus
gtctcagtccaaacaacaggttttt

SEQ ID NO: 496963 - DNA, 25 bp, Rattus norvegicus
gtctcagtccaatcaacaggttttt

SEQ ID NO: 496964 - DNA, 25 bp, Rattus norvegicus
gtctcagtcttaccacattgaacta

SEQ ID NO: 496965 - DNA, 25 bp, Rattus norvegicus
gtctcagtcttagcacattgaacta

SEQ ID NO: 496966 - DNA, 25 bp, Rattus norvegicus
gtctcagtcttcagaatggcacacc

SEQ ID NO: 496967 - DNA, 25 bp, Rattus norvegicus
gtctcagtcttctgaatggcacacc

SEQ ID NO: 496968 - DNA, 25 bp, Rattus norvegicus
gtctcagtgctgcagtccagagtaa

SEQ ID NO: 496969 - DNA, 25 bp, Rattus norvegicus
gtctcagtgctggagtccagagtaa

SEQ ID NO: 496970 - DNA, 25 bp, Rattus norvegicus
gtctcagtggcccaaggacaaaatg

SEQ ID NO: 496971 - DNA, 25 bp, Rattus norvegicus
gtctcagtggccgaaggacaaaatg

SEQ ID NO: 496972 - DNA, 25 bp, Rattus norvegicus
gtctcagtgtatcctaaagagtact

SEQ ID NO: 496973 - DNA, 25 bp, Rattus norvegicus
gtctcagtgtatgctaaagagtact

SEQ ID NO: 496974 - DNA, 25 bp, Rattus norvegicus
gtctcagtgtggattctgtggacta

SEQ ID NO: 496975 - DNA, 25 bp, Rattus norvegicus
gtctcagtgtggtttctgtggacta

SEQ ID NO: 496976 - DNA, 25 bp, Rattus norvegicus
gtctcagttcgaagtctggagcact

SEQ ID NO: 496977 - DNA, 25 bp, Rattus norvegicus
gtctcagttcgatgtctggagcact

SEQ ID NO: 496978 - DNA, 25 bp, Rattus norvegicus
gtctcagttgacatcctacttaatc

SEQ ID NO: 496979 - DNA, 25 bp, Rattus norvegicus
gtctcagttgacttcctacttaatc

SEQ ID NO: 496980 - DNA, 25 bp, Rattus norvegicus
gtctcagttgtgacatgatgctcaa

SEQ ID NO: 496981 - DNA, 25 bp, Rattus norvegicus
gtctcagttgtgtcatgatgctcaa

SEQ ID NO: 496982 - DNA, 25 bp, Rattus norvegicus
gtctcagtttctagactctgatatg

SEQ ID NO: 496983 - DNA, 25 bp, Rattus norvegicus
gtctcagtttcttgactctgatatg

SEQ ID NO: 496984 - DNA, 25 bp, Rattus norvegicus
gtctcatatagacttggctgcccag

SEQ ID NO: 496985 - DNA, 25 bp, Rattus norvegicus
gtctcatatagagttggctgcccag

SEQ ID NO: 496986 - DNA, 25 bp, Rattus norvegicus
gtctcatcagtaccagcggcagttt

SEQ ID NO: 496987 - DNA, 25 bp, Rattus norvegicus
gtctcatcagtagcagcggcagttt

SEQ ID NO: 496988 - DNA, 25 bp, Rattus norvegicus
gtctcatcattcaattcagtctcta

SEQ ID NO: 496989 - DNA, 25 bp, Rattus norvegicus
gtctcatcattctattcagtctcta

SEQ ID NO: 496990 - DNA, 25 bp, Rattus norvegicus
gtctcatcccacagagtgctgagat

SEQ ID NO: 496991 - DNA, 25 bp, Rattus norvegicus
gtctcatcccactgagtgctgagat

SEQ ID NO: 496992 - DNA, 25 bp, Rattus norvegicus
gtctcatcctctatcatactcaaaa

SEQ ID NO: 496993 - DNA, 25 bp, Rattus norvegicus
gtctcatcctctttcatactcaaaa

SEQ ID NO: 496994 - DNA, 25 bp, Rattus norvegicus
gtctcatcctggaacgtgacgttga

SEQ ID NO: 496995 - DNA, 25 bp, Rattus norvegicus
gtctcatcctggtacgtgacgttga

SEQ ID NO: 496996 - DNA, 25 bp, Rattus norvegicus
gtctcatcgatgctacttgacttgt

SEQ ID NO: 496997 - DNA, 25 bp, Rattus norvegicus
gtctcatcgatggtacttgacttgt

SEQ ID NO: 496998 - DNA, 25 bp, Rattus norvegicus
gtctcatcggtcactagtggcactt

SEQ ID NO: 496999 - DNA, 25 bp, Rattus norvegicus
gtctcatcggtctctagtggcactt

SEQ ID NO: 497000 - DNA, 25 bp, Rattus norvegicus
gtctcatctcaactcagcaacattt

SEQ ID NO: 497001 - DNA, 25 bp, Rattus norvegicus
gtctcatctcaagtcagcaacattt

SEQ ID NO: 497002 - DNA, 25 bp, Rattus norvegicus
gtctcatctgacagtctatgggcca

SEQ ID NO: 497003 - DNA, 25 bp, Rattus norvegicus
gtctcatctgactgtctatgggcca

SEQ ID NO: 497004 - DNA, 25 bp, Rattus norvegicus
gtctcatctgtactgccggcgttaa

SEQ ID NO: 497005 - DNA, 25 bp, Rattus norvegicus
gtctcatctgtagtgccggcgttaa

SEQ ID NO: 497006 - DNA, 25 bp, Rattus norvegicus
gtctcatctgtgaaacctctttgta

SEQ ID NO: 497007 - DNA, 25 bp, Rattus norvegicus
gtctcatctgtgtaacctctttgta

SEQ ID NO: 497008 - DNA, 25 bp, Rattus norvegicus
gtctcatctttcagtgttagtccca

SEQ ID NO: 497009 - DNA, 25 bp, Rattus norvegicus
gtctcatctttctgtgttagtccca

SEQ ID NO: 497010 - DNA, 25 bp, Rattus norvegicus
gtctcatgaccgacagtcagtgtgt

SEQ ID NO: 497011 - DNA, 25 bp, Rattus norvegicus
gtctcatgaccgtcagtcagtgtgt

SEQ ID NO: 497012 - DNA, 25 bp, Rattus norvegicus
gtctcatgagctctggaaggtaccc

SEQ ID NO: 497013 - DNA, 25 bp, Rattus norvegicus
gtctcatgagctgtggaaggtaccc

SEQ ID NO: 497014 - DNA, 25 bp, Rattus norvegicus
gtctcatgagtgaaatgcaccgcat

SEQ ID NO: 497015 - DNA, 25 bp, Rattus norvegicus
gtctcatgagtgtaatgcaccgcat

SEQ ID NO: 497016 - DNA, 25 bp, Rattus norvegicus
gtctcatgggtcacagcctgggatg

SEQ ID NO: 497017 - DNA, 25 bp, Rattus norvegicus
gtctcatgggtctcagcctgggatg

SEQ ID NO: 497018 - DNA, 25 bp, Rattus norvegicus
gtctcatgtagtataggatgtcctt

SEQ ID NO: 497019 - DNA, 25 bp, Rattus norvegicus
gtctcatgtagtttaggatgtcctt

SEQ ID NO: 497020 - DNA, 25 bp, Rattus norvegicus
gtctcattctaaagctacctgtctg

SEQ ID NO: 497021 - DNA, 25 bp, Rattus norvegicus
gtctcattctaatgctacctgtctg

SEQ ID NO: 497022 - DNA, 25 bp, Rattus norvegicus
gtctcattctggcaccgaagtgaaa

SEQ ID NO: 497023 - DNA, 25 bp, Rattus norvegicus
gtctcattctgggaccgaagtgaaa

SEQ ID NO: 497024 - DNA, 25 bp, Rattus norvegicus
gtctcattctgtagtgtacctcgtg

SEQ ID NO: 497025 - DNA, 25 bp, Rattus norvegicus
gtctcattctgttgtgtacctcgtg

SEQ ID NO: 497026 - DNA, 25 bp, Rattus norvegicus
gtctcattgaggattattcccacag

SEQ ID NO: 497027 - DNA, 25 bp, Rattus norvegicus
gtctcattgaggtttattcccacag

SEQ ID NO: 497028 - DNA, 25 bp, Rattus norvegicus
gtctcattgttgatctgacacagtg

SEQ ID NO: 497029 - DNA, 25 bp, Rattus norvegicus
gtctcattgttgttctgacacagtg

SEQ ID NO: 497030 - DNA, 25 bp, Rattus norvegicus
gtctcatttcttaaccaagggatat

SEQ ID NO: 497031 - DNA, 25 bp, Rattus norvegicus
gtctcatttctttaccaagggatat

SEQ ID NO: 497032 - DNA, 25 bp, Rattus norvegicus
gtctcatttgccaaaaactcctgtt

SEQ ID NO: 497033 - DNA, 25 bp, Rattus norvegicus
gtctcatttgcctaaaactcctgtt

SEQ ID NO: 497034 - DNA, 25 bp, Rattus norvegicus
gtctcatttgtacaacatttagctg

SEQ ID NO: 497035 - DNA, 25 bp, Rattus norvegicus
gtctcatttgtagaacatttagctg

SEQ ID NO: 497036 - DNA, 25 bp, Rattus norvegicus
gtctcatttgtgacttgatgcgcca

SEQ ID NO: 497037 - DNA, 25 bp, Rattus norvegicus
gtctcatttgtgtcttgatgcgcca

SEQ ID NO: 497038 - DNA, 25 bp, Rattus norvegicus
gtctcattttatctatttttcccgt

SEQ ID NO: 497039 - DNA, 25 bp, Rattus norvegicus
gtctcattttatgtatttttcccgt

SEQ ID NO: 497040 - DNA, 25 bp, Rattus norvegicus
gtctcatttttactcctaattcact

SEQ ID NO: 497041 - DNA, 25 bp, Rattus norvegicus
gtctcatttttagtcctaattcact

SEQ ID NO: 497042 - DNA, 25 bp, Rattus norvegicus
gtctccaaactcacttgcgttttaa

SEQ ID NO: 497043 - DNA, 25 bp, Rattus norvegicus
gtctccaaactctcttgcgttttaa

SEQ ID NO: 497044 - DNA, 25 bp, Rattus norvegicus
gtctccaaagtgacttatgcagtat

SEQ ID NO: 497045 - DNA, 25 bp, Rattus norvegicus
gtctccaaagtgtcttatgcagtat

SEQ ID NO: 497046 - DNA, 25 bp, Rattus norvegicus
gtctccaaatgaaaccaaaactgaa

SEQ ID NO: 497047 - DNA, 25 bp, Rattus norvegicus
gtctccaaatgataccaaaactgaa

SEQ ID NO: 497048 - DNA, 25 bp, Rattus norvegicus
gtctccaacagcaatgtggctccag

SEQ ID NO: 497049 - DNA, 25 bp, Rattus norvegicus
gtctccaacagctatgtggctccag

SEQ ID NO: 497050 - DNA, 25 bp, Rattus norvegicus
gtctccaacattaagtgcagtgcct

SEQ ID NO: 497051 - DNA, 25 bp, Rattus norvegicus
gtctccaacatttagtgcagtgcct

SEQ ID NO: 497052 - DNA, 25 bp, Rattus norvegicus
gtctccaatcctctcagtttgcaga

SEQ ID NO: 497053 - DNA, 25 bp, Rattus norvegicus
gtctccaatcctgtcagtttgcaga

SEQ ID NO: 497054 - DNA, 25 bp, Rattus norvegicus
gtctccaatctgatgttggtcattg

SEQ ID NO: 497055 - DNA, 25 bp, Rattus norvegicus
gtctccaatctgttgttggtcattg

SEQ ID NO: 497056 - DNA, 25 bp, Rattus norvegicus
gtctccaattacaactctgcactgg

SEQ ID NO: 497057 - DNA, 25 bp, Rattus norvegicus
gtctccaattactactctgcactgg

SEQ ID NO: 497058 - DNA, 25 bp, Rattus norvegicus
gtctccaattccaacttactttgat

SEQ ID NO: 497059 - DNA, 25 bp, Rattus norvegicus
gtctccaattcctacttactttgat

SEQ ID NO: 497060 - DNA, 25 bp, Rattus norvegicus
gtctccacactgaaacggcagtgat

SEQ ID NO: 497061 - DNA, 25 bp, Rattus norvegicus
gtctccacactgtaacggcagtgat

SEQ ID NO: 497062 - DNA, 25 bp, Rattus norvegicus
gtctccacagaaaacaacatccctt

SEQ ID NO: 497063 - DNA, 25 bp, Rattus norvegicus
gtctccacagaatacaacatccctt

SEQ ID NO: 497064 - DNA, 25 bp, Rattus norvegicus
gtctccacagccagcacacatagga

SEQ ID NO: 497065 - DNA, 25 bp, Rattus norvegicus
gtctccacagcctgcacacatagga

SEQ ID NO: 497066 - DNA, 25 bp, Rattus norvegicus
gtctccacatggatcagtttcattc

SEQ ID NO: 497067 - DNA, 25 bp, Rattus norvegicus
gtctccacatggttcagtttcattc

SEQ ID NO: 497068 - DNA, 25 bp, Rattus norvegicus
gtctccacattcactctatgtatat

SEQ ID NO: 497069 - DNA, 25 bp, Rattus norvegicus
gtctccacattctctctatgtatat

SEQ ID NO: 497070 - DNA, 25 bp, Rattus norvegicus
gtctccaccccgctgctgtgaggtg

SEQ ID NO: 497071 - DNA, 25 bp, Rattus norvegicus
gtctccaccccggtgctgtgaggtg

SEQ ID NO: 497072 - DNA, 25 bp, Rattus norvegicus
gtctccacctccagaattaggtagg

SEQ ID NO: 497073 - DNA, 25 bp, Rattus norvegicus
gtctccacctcctgaattaggtagg

SEQ ID NO: 497074 - DNA, 25 bp, Rattus norvegicus
gtctccacgacgatcctcaaaggat

SEQ ID NO: 497075 - DNA, 25 bp, Rattus norvegicus
gtctccacgacgttcctcaaaggat

SEQ ID NO: 497076 - DNA, 25 bp, Rattus norvegicus
gtctccactcagatcttgaaggtac

SEQ ID NO: 497077 - DNA, 25 bp, Rattus norvegicus
gtctccactcagttcttgaaggtac

SEQ ID NO: 497078 - DNA, 25 bp, Rattus norvegicus
gtctccactcatatttcagaactga

SEQ ID NO: 497079 - DNA, 25 bp, Rattus norvegicus
gtctccactcatttttcagaactga

SEQ ID NO: 497080 - DNA, 25 bp, Rattus norvegicus
gtctccactctgagttttagagaag

SEQ ID NO: 497081 - DNA, 25 bp, Rattus norvegicus
gtctccactctgtgttttagagaag

SEQ ID NO: 497082 - DNA, 25 bp, Rattus norvegicus
gtctccagaaatagccttgaaccga

SEQ ID NO: 497083 - DNA, 25 bp, Rattus norvegicus
gtctccagaaattgccttgaaccga

SEQ ID NO: 497084 - DNA, 25 bp, Rattus norvegicus
gtctccagagcaagaattccaggtc

SEQ ID NO: 497085 - DNA, 25 bp, Rattus norvegicus
gtctccagagcaccgactcgatgta

SEQ ID NO: 497086 - DNA, 25 bp, Rattus norvegicus
gtctccagagcagcgactcgatgta

SEQ ID NO: 497087 - DNA, 25 bp, Rattus norvegicus
gtctccagagcatgaattccaggtc

SEQ ID NO: 497088 - DNA, 25 bp, Rattus norvegicus
gtctccagagttcagcatctagcag

SEQ ID NO: 497089 - DNA, 25 bp, Rattus norvegicus
gtctccagagttgagcatctagcag

SEQ ID NO: 497090 - DNA, 25 bp, Rattus norvegicus
gtctccagcctacactaagctttta

SEQ ID NO: 497091 - DNA, 25 bp, Rattus norvegicus
gtctccagcctagactaagctttta

SEQ ID NO: 497092 - DNA, 25 bp, Rattus norvegicus
gtctccagctacaactgttctcaaa

SEQ ID NO: 497093 - DNA, 25 bp, Rattus norvegicus
gtctccagctactactgttctcaaa

SEQ ID NO: 497094 - DNA, 25 bp, Rattus norvegicus
gtctccagctatagtgcattttatg

SEQ ID NO: 497095 - DNA, 25 bp, Rattus norvegicus
gtctccagctattgtgcattttatg

SEQ ID NO: 497096 - DNA, 25 bp, Rattus norvegicus
gtctccagctcaatcttgcgaagat

SEQ ID NO: 497097 - DNA, 25 bp, Rattus norvegicus
gtctccagctcattcttgcgaagat

SEQ ID NO: 497098 - DNA, 25 bp, Rattus norvegicus
gtctccaggagccatacttctcggg

SEQ ID NO: 497099 - DNA, 25 bp, Rattus norvegicus
gtctccaggagcgatacttctcggg

SEQ ID NO: 497100 - DNA, 25 bp, Rattus norvegicus
gtctccaggagtccgggttcaacag

SEQ ID NO: 497101 - DNA, 25 bp, Rattus norvegicus
gtctccaggagtgcgggttcaacag

SEQ ID NO: 497102 - DNA, 25 bp, Rattus norvegicus
gtctccaggcagctgagtgatgacc

SEQ ID NO: 497103 - DNA, 25 bp, Rattus norvegicus
gtctccaggcaggtgagtgatgacc

SEQ ID NO: 497104 - DNA, 25 bp, Rattus norvegicus
gtctccagtaccatgcaaactcaga

SEQ ID NO: 497105 - DNA, 25 bp, Rattus norvegicus
gtctccagtaccttgcaaactcaga

SEQ ID NO: 497106 - DNA, 25 bp, Rattus norvegicus
gtctccagtcaacgacaatatccaa

SEQ ID NO: 497107 - DNA, 25 bp, Rattus norvegicus
gtctccagtcaaggacaatatccaa

SEQ ID NO: 497108 - DNA, 25 bp, Rattus norvegicus
gtctccagtgctaccaagggtggct

SEQ ID NO: 497109 - DNA, 25 bp, Rattus norvegicus
gtctccagtgcttccaagggtggct

SEQ ID NO: 497110 - DNA, 25 bp, Rattus norvegicus
gtctccagttccacttgtatatgtt

SEQ ID NO: 497111 - DNA, 25 bp, Rattus norvegicus
gtctccagttcctcttgtatatgtt

SEQ ID NO: 497112 - DNA, 25 bp, Rattus norvegicus
gtctccagttttagaaacctccagg

SEQ ID NO: 497113 - DNA, 25 bp, Rattus norvegicus
gtctccagtttttgaaacctccagg

SEQ ID NO: 497114 - DNA, 25 bp, Rattus norvegicus
gtctccataaagaatcactgtcatg

SEQ ID NO: 497115 - DNA, 25 bp, Rattus norvegicus
gtctccataaagtatcactgtcatg

SEQ ID NO: 497116 - DNA, 25 bp, Rattus norvegicus
gtctccatagcaatgcctgagcttt

SEQ ID NO: 497117 - DNA, 25 bp, Rattus norvegicus
gtctccatagcattgcctgagcttt

SEQ ID NO: 497118 - DNA, 25 bp, Rattus norvegicus
gtctccatatctattccaaccgaat

SEQ ID NO: 497119 - DNA, 25 bp, Rattus norvegicus
gtctccatatcttttccaaccgaat

SEQ ID NO: 497120 - DNA, 25 bp, Rattus norvegicus
gtctccatatgtatattatttcctg

SEQ ID NO: 497121 - DNA, 25 bp, Rattus norvegicus
gtctccatatgtttattatttcctg

SEQ ID NO: 497122 - DNA, 25 bp, Rattus norvegicus
gtctccatcaacattgttgggacaa

SEQ ID NO: 497123 - DNA, 25 bp, Rattus norvegicus
gtctccatcaactttgttgggacaa

SEQ ID NO: 497124 - DNA, 25 bp, Rattus norvegicus
gtctccatccggcttgggaagcaaa

SEQ ID NO: 497125 - DNA, 25 bp, Rattus norvegicus
gtctccatccgggttgggaagcaaa

SEQ ID NO: 497126 - DNA, 25 bp, Rattus norvegicus
gtctccatcctaaccatacttttga

SEQ ID NO: 497127 - DNA, 25 bp, Rattus norvegicus
gtctccatcctatccatacttttga

SEQ ID NO: 497128 - DNA, 25 bp, Rattus norvegicus
gtctccatcttcaatgccagtgaaa

SEQ ID NO: 497129 - DNA, 25 bp, Rattus norvegicus
gtctccatcttccagaactctgaga

SEQ ID NO: 497130 - DNA, 25 bp, Rattus norvegicus
gtctccatcttcgagaactctgaga

SEQ ID NO: 497131 - DNA, 25 bp, Rattus norvegicus
gtctccatcttctatgccagtgaaa

SEQ ID NO: 497132 - DNA, 25 bp, Rattus norvegicus
gtctccatgagtaagagcaccagat

SEQ ID NO: 497133 - DNA, 25 bp, Rattus norvegicus
gtctccatgagttagagcaccagat

SEQ ID NO: 497134 - DNA, 25 bp, Rattus norvegicus
gtctccatgattaacagcaatatag

SEQ ID NO: 497135 - DNA, 25 bp, Rattus norvegicus
gtctccatgatttacagcaatatag

SEQ ID NO: 497136 - DNA, 25 bp, Rattus norvegicus
gtctccatggccactgtcagattaa

SEQ ID NO: 497137 - DNA, 25 bp, Rattus norvegicus
gtctccatggcctctgtcagattaa

SEQ ID NO: 497138 - DNA, 25 bp, Rattus norvegicus
gtctccatggctatctttacagcaa

SEQ ID NO: 497139 - DNA, 25 bp, Rattus norvegicus
gtctccatggctttctttacagcaa

SEQ ID NO: 497140 - DNA, 25 bp, Rattus norvegicus
gtctccatgtttccatggttgtttg

SEQ ID NO: 497141 - DNA, 25 bp, Rattus norvegicus
gtctccatgtttgcatggttgtttg

SEQ ID NO: 497142 - DNA, 25 bp, Rattus norvegicus
gtctccattagaacaggctgtaggc

SEQ ID NO: 497143 - DNA, 25 bp, Rattus norvegicus
gtctccattagatcaggctgtaggc

SEQ ID NO: 497144 - DNA, 25 bp, Rattus norvegicus
gtctccattaggacccacaaatagt

SEQ ID NO: 497145 - DNA, 25 bp, Rattus norvegicus
gtctccattaggtcccacaaatagt

SEQ ID NO: 497146 - DNA, 25 bp, Rattus norvegicus
gtctccattcgtactcaagtcatag

SEQ ID NO: 497147 - DNA, 25 bp, Rattus norvegicus
gtctccattcgttctcaagtcatag

SEQ ID NO: 497148 - DNA, 25 bp, Rattus norvegicus
gtctccattctgatagcgatcttga

SEQ ID NO: 497149 - DNA, 25 bp, Rattus norvegicus
gtctccattctgttagcgatcttga

SEQ ID NO: 497150 - DNA, 25 bp, Rattus norvegicus
gtctccattgagatcgctgcagtga

SEQ ID NO: 497151 - DNA, 25 bp, Rattus norvegicus
gtctccattgagttcgctgcagtga

SEQ ID NO: 497152 - DNA, 25 bp, Rattus norvegicus
gtctccatttacatcatgtgcttgc

SEQ ID NO: 497153 - DNA, 25 bp, Rattus norvegicus
gtctccatttacttcatgtgcttgc

SEQ ID NO: 497154 - DNA, 25 bp, Rattus norvegicus
gtctcccaaccaaggaaggagctca

SEQ ID NO: 497155 - DNA, 25 bp, Rattus norvegicus
gtctcccaaccatggaaggagctca

SEQ ID NO: 497156 - DNA, 25 bp, Rattus norvegicus
gtctcccagccgagtacagaaggtg

SEQ ID NO: 497157 - DNA, 25 bp, Rattus norvegicus
gtctcccagccgtgtacagaaggtg

SEQ ID NO: 497158 - DNA, 25 bp, Rattus norvegicus
gtctcccaggtgatttggccaggaa

SEQ ID NO: 497159 - DNA, 25 bp, Rattus norvegicus
gtctcccaggtgttttggccaggaa

SEQ ID NO: 497160 - DNA, 25 bp, Rattus norvegicus
gtctcccagtggaggtgagcatgca

SEQ ID NO: 497161 - DNA, 25 bp, Rattus norvegicus
gtctcccagtggcattagtagtgat

SEQ ID NO: 497162 - DNA, 25 bp, Rattus norvegicus
gtctcccagtgggattagtagtgat

SEQ ID NO: 497163 - DNA, 25 bp, Rattus norvegicus
gtctcccagtggtggtgagcatgca

SEQ ID NO: 497164 - DNA, 25 bp, Rattus norvegicus
gtctcccatcctcacaattcatata

SEQ ID NO: 497165 - DNA, 25 bp, Rattus norvegicus
gtctcccatcctgacaattcatata

SEQ ID NO: 497166 - DNA, 25 bp, Rattus norvegicus
gtctcccatcttcaacagttaacaa

SEQ ID NO: 497167 - DNA, 25 bp, Rattus norvegicus
gtctcccatcttgaacagttaacaa

SEQ ID NO: 497168 - DNA, 25 bp, Rattus norvegicus
gtctcccatgctcacagagctaaga

SEQ ID NO: 497169 - DNA, 25 bp, Rattus norvegicus
gtctcccatgctgacagagctaaga

SEQ ID NO: 497170 - DNA, 25 bp, Rattus norvegicus
gtctcccatggtcttttttctgtgt

SEQ ID NO: 497171 - DNA, 25 bp, Rattus norvegicus
gtctcccatggtgttttttctgtgt

SEQ ID NO: 497172 - DNA, 25 bp, Rattus norvegicus
gtctccccagttctcagattcaaaa

SEQ ID NO: 497173 - DNA, 25 bp, Rattus norvegicus
gtctccccagttgtcagattcaaaa

SEQ ID NO: 497174 - DNA, 25 bp, Rattus norvegicus
gtctccccatttcgttgtccatgta

SEQ ID NO: 497175 - DNA, 25 bp, Rattus norvegicus
gtctccccatttggttgtccatgta

SEQ ID NO: 497176 - DNA, 25 bp, Rattus norvegicus
gtctcccctcggcaatgtgtgataa

SEQ ID NO: 497177 - DNA, 25 bp, Rattus norvegicus
gtctcccctcgggaatgtgtgataa

SEQ ID NO: 497178 - DNA, 25 bp, Rattus norvegicus
gtctcccctctaactgctttaagga

SEQ ID NO: 497179 - DNA, 25 bp, Rattus norvegicus
gtctcccctctatctgctttaagga

SEQ ID NO: 497180 - DNA, 25 bp, Rattus norvegicus
gtctcccctgaaagtgctaattttg

SEQ ID NO: 497181 - DNA, 25 bp, Rattus norvegicus
gtctcccctgaatgtgctaattttg

SEQ ID NO: 497182 - DNA, 25 bp, Rattus norvegicus
gtctccccttgaaaagcaggacctg

SEQ ID NO: 497183 - DNA, 25 bp, Rattus norvegicus
gtctccccttgataagcaggacctg

SEQ ID NO: 497184 - DNA, 25 bp, Rattus norvegicus
gtctcccgaatcatggtagtgcctg

SEQ ID NO: 497185 - DNA, 25 bp, Rattus norvegicus
gtctcccgaatcttggtagtgcctg

SEQ ID NO: 497186 - DNA, 25 bp, Rattus norvegicus
gtctcccggataactcagtccagga

SEQ ID NO: 497187 - DNA, 25 bp, Rattus norvegicus
gtctcccggatatctcagtccagga

SEQ ID NO: 497188 - DNA, 25 bp, Rattus norvegicus
gtctcccgtgtcaggtgttgaataa

SEQ ID NO: 497189 - DNA, 25 bp, Rattus norvegicus
gtctcccgtgtctggtgttgaataa

SEQ ID NO: 497190 - DNA, 25 bp, Rattus norvegicus
gtctccctaagtcaatcatggtaca

SEQ ID NO: 497191 - DNA, 25 bp, Rattus norvegicus
gtctccctaagtgaatcatggtaca

SEQ ID NO: 497192 - DNA, 25 bp, Rattus norvegicus
gtctccctcaggactaagaattgcc

SEQ ID NO: 497193 - DNA, 25 bp, Rattus norvegicus
gtctccctcaggtctaagaattgcc

SEQ ID NO: 497194 - DNA, 25 bp, Rattus norvegicus
gtctccctcattactgaaggtgtct

SEQ ID NO: 497195 - DNA, 25 bp, Rattus norvegicus
gtctccctcatttctgaaggtgtct

SEQ ID NO: 497196 - DNA, 25 bp, Rattus norvegicus
gtctccctctgtctaggttttagca

SEQ ID NO: 497197 - DNA, 25 bp, Rattus norvegicus
gtctccctctgtgtaggttttagca

SEQ ID NO: 497198 - DNA, 25 bp, Rattus norvegicus
gtctccctgtcgaagctgaaaatgg

SEQ ID NO: 497199 - DNA, 25 bp, Rattus norvegicus
gtctccctgtcgtagctgaaaatgg

SEQ ID NO: 497200 - DNA, 25 bp, Rattus norvegicus
gtctccctgtgcctttataatataa

SEQ ID NO: 497201 - DNA, 25 bp, Rattus norvegicus
gtctccctgtgcgtttataatataa

SEQ ID NO: 497202 - DNA, 25 bp, Rattus norvegicus
gtctccctgtgtatttatgtctgtg

SEQ ID NO: 497203 - DNA, 25 bp, Rattus norvegicus
gtctccctgtgtttttatgtctgtg

SEQ ID NO: 497204 - DNA, 25 bp, Rattus norvegicus
gtctcccttccccaggcaagaagag

SEQ ID NO: 497205 - DNA, 25 bp, Rattus norvegicus
gtctcccttcccgaggcaagaagag

SEQ ID NO: 497206 - DNA, 25 bp, Rattus norvegicus
gtctcccttctcatgataatatcca

SEQ ID NO: 497207 - DNA, 25 bp, Rattus norvegicus
gtctcccttctcttgataatatcca

SEQ ID NO: 497208 - DNA, 25 bp, Rattus norvegicus
gtctcccttgaacaactgaggctca

SEQ ID NO: 497209 - DNA, 25 bp, Rattus norvegicus
gtctcccttgaagaactgaggctca

SEQ ID NO: 497210 - DNA, 25 bp, Rattus norvegicus
gtctcccttgggagcagcctggaag

SEQ ID NO: 497211 - DNA, 25 bp, Rattus norvegicus
gtctcccttgggtgcagcctggaag

SEQ ID NO: 497212 - DNA, 25 bp, Rattus norvegicus
gtctcccttgtcactaaggcacagg

SEQ ID NO: 497213 - DNA, 25 bp, Rattus norvegicus
gtctcccttgtctctaaggcacagg

SEQ ID NO: 497214 - DNA, 25 bp, Rattus norvegicus
gtctccctttggaacctaagcagaa

SEQ ID NO: 497215 - DNA, 25 bp, Rattus norvegicus
gtctccctttggtacctaagcagaa

SEQ ID NO: 497216 - DNA, 25 bp, Rattus norvegicus
gtctcccttttactgttagatcaaa

SEQ ID NO: 497217 - DNA, 25 bp, Rattus norvegicus
gtctcccttttagtgttagatcaaa

SEQ ID NO: 497218 - DNA, 25 bp, Rattus norvegicus
gtctccgaaaacataaagcaacaca

SEQ ID NO: 497219 - DNA, 25 bp, Rattus norvegicus
gtctccgaaaacttaaagcaacaca

SEQ ID NO: 497220 - DNA, 25 bp, Rattus norvegicus
gtctccgacatgatttgaaatccag

SEQ ID NO: 497221 - DNA, 25 bp, Rattus norvegicus
gtctccgacatgttttgaaatccag

SEQ ID NO: 497222 - DNA, 25 bp, Rattus norvegicus
gtctccgaccacaaaggaagccagg

SEQ ID NO: 497223 - DNA, 25 bp, Rattus norvegicus
gtctccgaccactaaggaagccagg

SEQ ID NO: 497224 - DNA, 25 bp, Rattus norvegicus
gtctccgacgagatgatgaagtatt

SEQ ID NO: 497225 - DNA, 25 bp, Rattus norvegicus
gtctccgacgagttgatgaagtatt

SEQ ID NO: 497226 - DNA, 25 bp, Rattus norvegicus
gtctccgagacccagaggactatgg

SEQ ID NO: 497227 - DNA, 25 bp, Rattus norvegicus
gtctccgagaccgagaggactatgg

SEQ ID NO: 497228 - DNA, 25 bp, Rattus norvegicus
gtctccgagagcagggctggccata

SEQ ID NO: 497229 - DNA, 25 bp, Rattus norvegicus
gtctccgagagctgggctggccata

SEQ ID NO: 497230 - DNA, 25 bp, Rattus norvegicus
gtctccgagatgaattccagctgta

SEQ ID NO: 497231 - DNA, 25 bp, Rattus norvegicus
gtctccgagatgtattccagctgta

SEQ ID NO: 497232 - DNA, 25 bp, Rattus norvegicus
gtctccgagtacaaggcctattagg

SEQ ID NO: 497233 - DNA, 25 bp, Rattus norvegicus
gtctccgagtactaggcctattagg

SEQ ID NO: 497234 - DNA, 25 bp, Rattus norvegicus
gtctccgataatatattgatatcta

SEQ ID NO: 497235 - DNA, 25 bp, Rattus norvegicus
gtctccgataatttattgatatcta

SEQ ID NO: 497236 - DNA, 25 bp, Rattus norvegicus
gtctccgattcgctgctggctaatg

SEQ ID NO: 497237 - DNA, 25 bp, Rattus norvegicus
gtctccgattcggtgctggctaatg

SEQ ID NO: 497238 - DNA, 25 bp, Rattus norvegicus
gtctccgcctttaatactgcaataa

SEQ ID NO: 497239 - DNA, 25 bp, Rattus norvegicus
gtctccgccttttatactgcaataa

SEQ ID NO: 497240 - DNA, 25 bp, Rattus norvegicus
gtctccgcggagacctttcccagcg

SEQ ID NO: 497241 - DNA, 25 bp, Rattus norvegicus
gtctccgcggagtcctttcccagcg

SEQ ID NO: 497242 - DNA, 25 bp, Rattus norvegicus
gtctccgctgtgcaaggcaaactga

SEQ ID NO: 497243 - DNA, 25 bp, Rattus norvegicus
gtctccgctgtggaaggcaaactga

SEQ ID NO: 497244 - DNA, 25 bp, Rattus norvegicus
gtctccggatgaagtatttgctgct

SEQ ID NO: 497245 - DNA, 25 bp, Rattus norvegicus
gtctccggatgatgtatttgctgct

SEQ ID NO: 497246 - DNA, 25 bp, Rattus norvegicus
gtctccggcagaacttcaatggcac

SEQ ID NO: 497247 - DNA, 25 bp, Rattus norvegicus
gtctccggcagatcttcaatggcac

SEQ ID NO: 497248 - DNA, 25 bp, Rattus norvegicus
gtctccggtttgatgatcccttgtt

SEQ ID NO: 497249 - DNA, 25 bp, Rattus norvegicus
gtctccggtttgttgatcccttgtt

SEQ ID NO: 497250 - DNA, 25 bp, Rattus norvegicus
gtctccgtaccacgtgatgcacaga

SEQ ID NO: 497251 - DNA, 25 bp, Rattus norvegicus
gtctccgtaccaggtgatgcacaga

SEQ ID NO: 497252 - DNA, 25 bp, Rattus norvegicus
gtctccgtagccactatggcagagt

SEQ ID NO: 497253 - DNA, 25 bp, Rattus norvegicus
gtctccgtagcctctatggcagagt

SEQ ID NO: 497254 - DNA, 25 bp, Rattus norvegicus
gtctccgtcactagtgctattaaga

SEQ ID NO: 497255 - DNA, 25 bp, Rattus norvegicus
gtctccgtcacttgtgctattaaga

SEQ ID NO: 497256 - DNA, 25 bp, Rattus norvegicus
gtctccgtgagtctgagcgcttcag

SEQ ID NO: 497257 - DNA, 25 bp, Rattus norvegicus
gtctccgtgagtgtgagcgcttcag

SEQ ID NO: 497258 - DNA, 25 bp, Rattus norvegicus
gtctccgtggaaccactgtagggtt

SEQ ID NO: 497259 - DNA, 25 bp, Rattus norvegicus
gtctccgtggaagcactgtagggtt

SEQ ID NO: 497260 - DNA, 25 bp, Rattus norvegicus
gtctccgtgtttctacactatgtgt

SEQ ID NO: 497261 - DNA, 25 bp, Rattus norvegicus
gtctccgtgtttgtacactatgtgt

SEQ ID NO: 497262 - DNA, 25 bp, Rattus norvegicus
gtctccgttttcatctctcatataa

SEQ ID NO: 497263 - DNA, 25 bp, Rattus norvegicus
gtctccgttttcttctctcatataa

SEQ ID NO: 497264 - DNA, 25 bp, Rattus norvegicus
gtctcctaaagacctttggcctcag

SEQ ID NO: 497265 - DNA, 25 bp, Rattus norvegicus
gtctcctaaagagctttggcctcag

SEQ ID NO: 497266 - DNA, 25 bp, Rattus norvegicus
gtctcctacaccatgatgacccatg

SEQ ID NO: 497267 - DNA, 25 bp, Rattus norvegicus
gtctcctacaccttgatgacccatg

SEQ ID NO: 497268 - DNA, 25 bp, Rattus norvegicus
gtctcctacactatattactttaga

SEQ ID NO: 497269 - DNA, 25 bp, Rattus norvegicus
gtctcctacactttattactttaga

SEQ ID NO: 497270 - DNA, 25 bp, Rattus norvegicus
gtctcctacagtcctgttggtgaca

SEQ ID NO: 497271 - DNA, 25 bp, Rattus norvegicus
gtctcctacagtgctgttggtgaca

SEQ ID NO: 497272 - DNA, 25 bp, Rattus norvegicus
gtctcctacctgagttttatacctg

SEQ ID NO: 497273 - DNA, 25 bp, Rattus norvegicus
gtctcctacctgtgttttatacctg

SEQ ID NO: 497274 - DNA, 25 bp, Rattus norvegicus
gtctcctagaggattcagttgtcag

SEQ ID NO: 497275 - DNA, 25 bp, Rattus norvegicus
gtctcctagaggtttcagttgtcag

SEQ ID NO: 497276 - DNA, 25 bp, Rattus norvegicus
gtctcctaggagaggctgccaataa

SEQ ID NO: 497277 - DNA, 25 bp, Rattus norvegicus
gtctcctaggagtggctgccaataa

SEQ ID NO: 497278 - DNA, 25 bp, Rattus norvegicus
gtctcctatcccagtttagaactca

SEQ ID NO: 497279 - DNA, 25 bp, Rattus norvegicus
gtctcctatccctgtttagaactca

SEQ ID NO: 497280 - DNA, 25 bp, Rattus norvegicus
gtctcctatggcattctgtactgca

SEQ ID NO: 497281 - DNA, 25 bp, Rattus norvegicus
gtctcctatggctttctgtactgca

SEQ ID NO: 497282 - DNA, 25 bp, Rattus norvegicus
gtctcctcaagtagcagaacgaacg

SEQ ID NO: 497283 - DNA, 25 bp, Rattus norvegicus
gtctcctcaagttgcagaacgaacg

SEQ ID NO: 497284 - DNA, 25 bp, Rattus norvegicus
gtctcctcacaaattatgttgctgt

SEQ ID NO: 497285 - DNA, 25 bp, Rattus norvegicus
gtctcctcacaatttatgttgctgt

SEQ ID NO: 497286 - DNA, 25 bp, Rattus norvegicus
gtctcctcacagcatccagagatag

SEQ ID NO: 497287 - DNA, 25 bp, Rattus norvegicus
gtctcctcacaggatccagagatag

SEQ ID NO: 497288 - DNA, 25 bp, Rattus norvegicus
gtctcctcacatattttggctttta

SEQ ID NO: 497289 - DNA, 25 bp, Rattus norvegicus
gtctcctcacattttttggctttta

SEQ ID NO: 497290 - DNA, 25 bp, Rattus norvegicus
gtctcctcactaagagaggtgtccc

SEQ ID NO: 497291 - DNA, 25 bp, Rattus norvegicus
gtctcctcactatgagaggtgtccc

SEQ ID NO: 497292 - DNA, 25 bp, Rattus norvegicus
gtctcctcagagatgagctttctca

SEQ ID NO: 497293 - DNA, 25 bp, Rattus norvegicus
gtctcctcagagttgagctttctca

SEQ ID NO: 497294 - DNA, 25 bp, Rattus norvegicus
gtctcctcagttccattatgaaatt

SEQ ID NO: 497295 - DNA, 25 bp, Rattus norvegicus
gtctcctcagttgcattatgaaatt

SEQ ID NO: 497296 - DNA, 25 bp, Rattus norvegicus
gtctcctccactaatggttacttta

SEQ ID NO: 497297 - DNA, 25 bp, Rattus norvegicus
gtctcctccactagagtagatgcga

SEQ ID NO: 497298 - DNA, 25 bp, Rattus norvegicus
gtctcctccacttatggttacttta

SEQ ID NO: 497299 - DNA, 25 bp, Rattus norvegicus
gtctcctccacttgagtagatgcga

SEQ ID NO: 497300 - DNA, 25 bp, Rattus norvegicus
gtctcctccattcctgcactagaat

SEQ ID NO: 497301 - DNA, 25 bp, Rattus norvegicus
gtctcctccattgctgcactagaat

SEQ ID NO: 497302 - DNA, 25 bp, Rattus norvegicus
gtctcctcccggcagaaaatggaga

SEQ ID NO: 497303 - DNA, 25 bp, Rattus norvegicus
gtctcctcccgggagaaaatggaga

SEQ ID NO: 497304 - DNA, 25 bp, Rattus norvegicus
gtctcctcctcactcatagagcaat

SEQ ID NO: 497305 - DNA, 25 bp, Rattus norvegicus
gtctcctcctcagtcatagagcaat

SEQ ID NO: 497306 - DNA, 25 bp, Rattus norvegicus
gtctcctcctttcagctataatggg

SEQ ID NO: 497307 - DNA, 25 bp, Rattus norvegicus
gtctcctcctttgagctataatggg

SEQ ID NO: 497308 - DNA, 25 bp, Rattus norvegicus
gtctcctcgaatcttcagatcattc

SEQ ID NO: 497309 - DNA, 25 bp, Rattus norvegicus
gtctcctcgaatgttcagatcattc

SEQ ID NO: 497310 - DNA, 25 bp, Rattus norvegicus
gtctcctcggagattgggattgtct

SEQ ID NO: 497311 - DNA, 25 bp, Rattus norvegicus
gtctcctcggagtttgggattgtct

SEQ ID NO: 497312 - DNA, 25 bp, Rattus norvegicus
gtctcctctcctaaagcagaaacat

SEQ ID NO: 497313 - DNA, 25 bp, Rattus norvegicus
gtctcctctccttaagcagaaacat

SEQ ID NO: 497314 - DNA, 25 bp, Rattus norvegicus
gtctcctctgcacgcttaagttatt

SEQ ID NO: 497315 - DNA, 25 bp, Rattus norvegicus
gtctcctctgcaggcttaagttatt

SEQ ID NO: 497316 - DNA, 25 bp, Rattus norvegicus
gtctcctctgttcatgattctcatg

SEQ ID NO: 497317 - DNA, 25 bp, Rattus norvegicus
gtctcctctgttgatgattctcatg

SEQ ID NO: 497318 - DNA, 25 bp, Rattus norvegicus
gtctcctcttctatgataattacga

SEQ ID NO: 497319 - DNA, 25 bp, Rattus norvegicus
gtctcctcttctttgataattacga

SEQ ID NO: 497320 - DNA, 25 bp, Rattus norvegicus
gtctcctgaaggcagtgacccgtgt

SEQ ID NO: 497321 - DNA, 25 bp, Rattus norvegicus
gtctcctgaagggagtgacccgtgt

SEQ ID NO: 497322 - DNA, 25 bp, Rattus norvegicus
gtctcctgacatcgcctggactgaa

SEQ ID NO: 497323 - DNA, 25 bp, Rattus norvegicus
gtctcctgacatggcctggactgaa

SEQ ID NO: 497324 - DNA, 25 bp, Rattus norvegicus
gtctcctgactcagctggaaggctg

SEQ ID NO: 497325 - DNA, 25 bp, Rattus norvegicus
gtctcctgactctgctggaaggctg

SEQ ID NO: 497326 - DNA, 25 bp, Rattus norvegicus
gtctcctgacttatatgtagcctca

SEQ ID NO: 497327 - DNA, 25 bp, Rattus norvegicus
gtctcctgacttttatgtagcctca

SEQ ID NO: 497328 - DNA, 25 bp, Rattus norvegicus
gtctcctgagagagctggacttctt

SEQ ID NO: 497329 - DNA, 25 bp, Rattus norvegicus
gtctcctgagagtgctggacttctt

SEQ ID NO: 497330 - DNA, 25 bp, Rattus norvegicus
gtctcctgaggcatagcatctgtca

SEQ ID NO: 497331 - DNA, 25 bp, Rattus norvegicus
gtctcctgaggcttagcatctgtca

SEQ ID NO: 497332 - DNA, 25 bp, Rattus norvegicus
gtctcctgagtaaagccgacttagg

SEQ ID NO: 497333 - DNA, 25 bp, Rattus norvegicus
gtctcctgagtatagccgacttagg

SEQ ID NO: 497334 - DNA, 25 bp, Rattus norvegicus
gtctcctgatgtatgctgtggcaca

SEQ ID NO: 497335 - DNA, 25 bp, Rattus norvegicus
gtctcctgatgtttgctgtggcaca

SEQ ID NO: 497336 - DNA, 25 bp, Rattus norvegicus
gtctcctgattgacagatcatccag

SEQ ID NO: 497337 - DNA, 25 bp, Rattus norvegicus
gtctcctgattgtcagatcatccag

SEQ ID NO: 497338 - DNA, 25 bp, Rattus norvegicus
gtctcctgcccacatgaagtttgta

SEQ ID NO: 497339 - DNA, 25 bp, Rattus norvegicus
gtctcctgcccagatgaagtttgta

SEQ ID NO: 497340 - DNA, 25 bp, Rattus norvegicus
gtctcctgctctcttgaagaagggc

SEQ ID NO: 497341 - DNA, 25 bp, Rattus norvegicus
gtctcctgctctgttgaagaagggc

SEQ ID NO: 497342 - DNA, 25 bp, Rattus norvegicus
gtctcctgctgcagaatgggctctg

SEQ ID NO: 497343 - DNA, 25 bp, Rattus norvegicus
gtctcctgctgcagcatttgacaag

SEQ ID NO: 497344 - DNA, 25 bp, Rattus norvegicus
gtctcctgctgctgaatgggctctg

SEQ ID NO: 497345 - DNA, 25 bp, Rattus norvegicus
gtctcctgctgctgcatttgacaag

SEQ ID NO: 497346 - DNA, 25 bp, Rattus norvegicus
gtctcctgcttgctttctgatttaa

SEQ ID NO: 497347 - DNA, 25 bp, Rattus norvegicus
gtctcctgcttggtttctgatttaa

SEQ ID NO: 497348 - DNA, 25 bp, Rattus norvegicus
gtctcctggagcacaaagccttgaa

SEQ ID NO: 497349 - DNA, 25 bp, Rattus norvegicus
gtctcctggagctcaaagccttgaa

SEQ ID NO: 497350 - DNA, 25 bp, Rattus norvegicus
gtctcctggaggcagaactgtgcta

SEQ ID NO: 497351 - DNA, 25 bp, Rattus norvegicus
gtctcctggagggagaactgtgcta

SEQ ID NO: 497352 - DNA, 25 bp, Rattus norvegicus
gtctcctggatgaagaaactgccgc

SEQ ID NO: 497353 - DNA, 25 bp, Rattus norvegicus
gtctcctggatgcatggtttgctcc

SEQ ID NO: 497354 - DNA, 25 bp, Rattus norvegicus
gtctcctggatggatggtttgctcc

SEQ ID NO: 497355 - DNA, 25 bp, Rattus norvegicus
gtctcctggatgtagaaactgccgc

SEQ ID NO: 497356 - DNA, 25 bp, Rattus norvegicus
gtctcctggcacataacaatgtcta

SEQ ID NO: 497357 - DNA, 25 bp, Rattus norvegicus
gtctcctggcacttaacaatgtcta

SEQ ID NO: 497358 - DNA, 25 bp, Rattus norvegicus
gtctcctggcatccaatcaatgtgt

SEQ ID NO: 497359 - DNA, 25 bp, Rattus norvegicus
gtctcctggcatgcaatcaatgtgt

SEQ ID NO: 497360 - DNA, 25 bp, Rattus norvegicus
gtctcctggcttaggagtttgggtt

SEQ ID NO: 497361 - DNA, 25 bp, Rattus norvegicus
gtctcctggctttggagtttgggtt

SEQ ID NO: 497362 - DNA, 25 bp, Rattus norvegicus
gtctcctgtaaactggacacacaga

SEQ ID NO: 497363 - DNA, 25 bp, Rattus norvegicus
gtctcctgtaaagtggacacacaga

SEQ ID NO: 497364 - DNA, 25 bp, Rattus norvegicus
gtctcctgtagacccagtggaatct

SEQ ID NO: 497365 - DNA, 25 bp, Rattus norvegicus
gtctcctgtagagccagtggaatct

SEQ ID NO: 497366 - DNA, 25 bp, Rattus norvegicus
gtctcctgtatcagtttggtctgaa

SEQ ID NO: 497367 - DNA, 25 bp, Rattus norvegicus
gtctcctgtatctgtttggtctgaa

SEQ ID NO: 497368 - DNA, 25 bp, Rattus norvegicus
gtctcctgtcctcattaagcttagc

SEQ ID NO: 497369 - DNA, 25 bp, Rattus norvegicus
gtctcctgtcctgattaagcttagc

SEQ ID NO: 497370 - DNA, 25 bp, Rattus norvegicus
gtctcctgtgatattctccagaaca

SEQ ID NO: 497371 - DNA, 25 bp, Rattus norvegicus
gtctcctgtgattttctccagaaca

SEQ ID NO: 497372 - DNA, 25 bp, Rattus norvegicus
gtctcctgtggccatgagttcacca

SEQ ID NO: 497373 - DNA, 25 bp, Rattus norvegicus
gtctcctgtggcgatgagttcacca

SEQ ID NO: 497374 - DNA, 25 bp, Rattus norvegicus
gtctcctgtgggaatttcatttgtc

SEQ ID NO: 497375 - DNA, 25 bp, Rattus norvegicus
gtctcctgtgggtatttcatttgtc

SEQ ID NO: 497376 - DNA, 25 bp, Rattus norvegicus
gtctcctgtgtacgtgaaccaagtc

SEQ ID NO: 497377 - DNA, 25 bp, Rattus norvegicus
gtctcctgtgtaggtgaaccaagtc

SEQ ID NO: 497378 - DNA, 25 bp, Rattus norvegicus
gtctcctgttctaatgatgtaccag

SEQ ID NO: 497379 - DNA, 25 bp, Rattus norvegicus
gtctcctgttcttatgatgtaccag

SEQ ID NO: 497380 - DNA, 25 bp, Rattus norvegicus
gtctcctgttgacacagccattgga

SEQ ID NO: 497381 - DNA, 25 bp, Rattus norvegicus
gtctcctgttgagacagccattgga

SEQ ID NO: 497382 - DNA, 25 bp, Rattus norvegicus
gtctccttaaccactgaacagttca

SEQ ID NO: 497383 - DNA, 25 bp, Rattus norvegicus
gtctccttaacctctgaacagttca

SEQ ID NO: 497384 - DNA, 25 bp, Rattus norvegicus
gtctccttacacatgctattatacc

SEQ ID NO: 497385 - DNA, 25 bp, Rattus norvegicus
gtctccttacacttgctattatacc

SEQ ID NO: 497386 - DNA, 25 bp, Rattus norvegicus
gtctccttacgtacagtttcaactt

SEQ ID NO: 497387 - DNA, 25 bp, Rattus norvegicus
gtctccttacgttcagtttcaactt

SEQ ID NO: 497388 - DNA, 25 bp, Rattus norvegicus
gtctccttactcaccaagaagcagg

SEQ ID NO: 497389 - DNA, 25 bp, Rattus norvegicus
gtctccttactctccaagaagcagg

SEQ ID NO: 497390 - DNA, 25 bp, Rattus norvegicus
gtctccttagctcacagtttccggg

SEQ ID NO: 497391 - DNA, 25 bp, Rattus norvegicus
gtctccttagctgacagtttccggg

SEQ ID NO: 497392 - DNA, 25 bp, Rattus norvegicus
gtctccttatgtatcttccactagt

SEQ ID NO: 497393 - DNA, 25 bp, Rattus norvegicus
gtctccttatgtttcttccactagt

SEQ ID NO: 497394 - DNA, 25 bp, Rattus norvegicus
gtctccttcactagattgacttcat

SEQ ID NO: 497395 - DNA, 25 bp, Rattus norvegicus
gtctccttcactagattgtaagcct

SEQ ID NO: 497396 - DNA, 25 bp, Rattus norvegicus
gtctccttcacttgattgacttcat

SEQ ID NO: 497397 - DNA, 25 bp, Rattus norvegicus
gtctccttcacttgattgtaagcct

SEQ ID NO: 497398 - DNA, 25 bp, Rattus norvegicus
gtctccttcggcagcggctatggtg

SEQ ID NO: 497399 - DNA, 25 bp, Rattus norvegicus
gtctccttcggctgcggctatggtg

SEQ ID NO: 497400 - DNA, 25 bp, Rattus norvegicus
gtctccttctggcttttaggcatac

SEQ ID NO: 497401 - DNA, 25 bp, Rattus norvegicus
gtctccttctgggttttaggcatac

SEQ ID NO: 497402 - DNA, 25 bp, Rattus norvegicus
gtctccttgctgcttgcataaagat

SEQ ID NO: 497403 - DNA, 25 bp, Rattus norvegicus
gtctccttgctggttgcataaagat

SEQ ID NO: 497404 - DNA, 25 bp, Rattus norvegicus
gtctccttggaccagggcgcgggct

SEQ ID NO: 497405 - DNA, 25 bp, Rattus norvegicus
gtctccttggacctggatttcagtt

SEQ ID NO: 497406 - DNA, 25 bp, Rattus norvegicus
gtctccttggacgagggcgcgggct

SEQ ID NO: 497407 - DNA, 25 bp, Rattus norvegicus
gtctccttggacgtggatttcagtt

SEQ ID NO: 497408 - DNA, 25 bp, Rattus norvegicus
gtctccttggctcacttgtagtttt

SEQ ID NO: 497409 - DNA, 25 bp, Rattus norvegicus
gtctccttggctgacttgtagtttt

SEQ ID NO: 497410 - DNA, 25 bp, Rattus norvegicus
gtctccttgggaagtaccttttcat

SEQ ID NO: 497411 - DNA, 25 bp, Rattus norvegicus
gtctccttgggatgtaccttttcat

SEQ ID NO: 497412 - DNA, 25 bp, Rattus norvegicus
gtctccttggttccttggtattcac

SEQ ID NO: 497413 - DNA, 25 bp, Rattus norvegicus
gtctccttggttgcttggtattcac

SEQ ID NO: 497414 - DNA, 25 bp, Rattus norvegicus
gtctccttgtcacagtttctctact

SEQ ID NO: 497415 - DNA, 25 bp, Rattus norvegicus
gtctccttgtcagagtttctctact

SEQ ID NO: 497416 - DNA, 25 bp, Rattus norvegicus
gtctccttgtctacagacttcataa

SEQ ID NO: 497417 - DNA, 25 bp, Rattus norvegicus
gtctccttgtcttcagacttcataa

SEQ ID NO: 497418 - DNA, 25 bp, Rattus norvegicus
gtctcctttaacattgcctttgttg

SEQ ID NO: 497419 - DNA, 25 bp, Rattus norvegicus
gtctcctttaactttgcctttgttg

SEQ ID NO: 497420 - DNA, 25 bp, Rattus norvegicus
gtctcctttaagattgtcctttctg

SEQ ID NO: 497421 - DNA, 25 bp, Rattus norvegicus
gtctcctttaagtttgtcctttctg

SEQ ID NO: 497422 - DNA, 25 bp, Rattus norvegicus
gtctcctttacgacctttgcaaaga

SEQ ID NO: 497423 - DNA, 25 bp, Rattus norvegicus
gtctcctttacgtcctttgcaaaga

SEQ ID NO: 497424 - DNA, 25 bp, Rattus norvegicus
gtctcctttcacatttcagctgaag

SEQ ID NO: 497425 - DNA, 25 bp, Rattus norvegicus
gtctcctttcacttttcagctgaag

SEQ ID NO: 497426 - DNA, 25 bp, Rattus norvegicus
gtctcctttgagattcctgattgac

SEQ ID NO: 497427 - DNA, 25 bp, Rattus norvegicus
gtctcctttgagtttcctgattgac

SEQ ID NO: 497428 - DNA, 25 bp, Rattus norvegicus
gtctcctttgcaaatcatgtacagt

SEQ ID NO: 497429 - DNA, 25 bp, Rattus norvegicus
gtctcctttgcatatcatgtacagt

SEQ ID NO: 497430 - DNA, 25 bp, Rattus norvegicus
gtctcctttgctcggtgtaatctga

SEQ ID NO: 497431 - DNA, 25 bp, Rattus norvegicus
gtctcctttgctcttgccaaaaaga

SEQ ID NO: 497432 - DNA, 25 bp, Rattus norvegicus
gtctcctttgctgggtgtaatctga

SEQ ID NO: 497433 - DNA, 25 bp, Rattus norvegicus
gtctcctttgctgttgccaaaaaga

SEQ ID NO: 497434 - DNA, 25 bp, Rattus norvegicus
gtctcctttgttaaattcttgtaca

SEQ ID NO: 497435 - DNA, 25 bp, Rattus norvegicus
gtctcctttgtttaattcttgtaca

SEQ ID NO: 497436 - DNA, 25 bp, Rattus norvegicus
gtctccttttccagttaagccagga

SEQ ID NO: 497437 - DNA, 25 bp, Rattus norvegicus
gtctccttttcctgttaagccagga

SEQ ID NO: 497438 - DNA, 25 bp, Rattus norvegicus
gtctcgaacactcaaatggcatata

SEQ ID NO: 497439 - DNA, 25 bp, Rattus norvegicus
gtctcgaacactgaaatggcatata

SEQ ID NO: 497440 - DNA, 25 bp, Rattus norvegicus
gtctcgaaggaaagcctgaggcatt

SEQ ID NO: 497441 - DNA, 25 bp, Rattus norvegicus
gtctcgaaggaatgcctgaggcatt

SEQ ID NO: 497442 - DNA, 25 bp, Rattus norvegicus
gtctcgaattctcctggccaatcga

SEQ ID NO: 497443 - DNA, 25 bp, Rattus norvegicus
gtctcgaattctgctggccaatcga

SEQ ID NO: 497444 - DNA, 25 bp, Rattus norvegicus
gtctcgactttcctatcatggataa

SEQ ID NO: 497445 - DNA, 25 bp, Rattus norvegicus
gtctcgactttcgtatcatggataa

SEQ ID NO: 497446 - DNA, 25 bp, Rattus norvegicus
gtctcgagacagagcactccgtagg

SEQ ID NO: 497447 - DNA, 25 bp, Rattus norvegicus
gtctcgagacagtgcactccgtagg

SEQ ID NO: 497448 - DNA, 25 bp, Rattus norvegicus
gtctcgagacttatgccactcagaa

SEQ ID NO: 497449 - DNA, 25 bp, Rattus norvegicus
gtctcgagacttttgccactcagaa

SEQ ID NO: 497450 - DNA, 25 bp, Rattus norvegicus
gtctcgaggatcaagtgtcattgca

SEQ ID NO: 497451 - DNA, 25 bp, Rattus norvegicus
gtctcgaggatctagtgtcattgca

SEQ ID NO: 497452 - DNA, 25 bp, Rattus norvegicus
gtctcgagggaaagtgtccactcca

SEQ ID NO: 497453 - DNA, 25 bp, Rattus norvegicus
gtctcgagggaatgtgtccactcca

SEQ ID NO: 497454 - DNA, 25 bp, Rattus norvegicus
gtctcgattgtacattccagttcca

SEQ ID NO: 497455 - DNA, 25 bp, Rattus norvegicus
gtctcgattgtagattccagttcca

SEQ ID NO: 497456 - DNA, 25 bp, Rattus norvegicus
gtctcgcagataacacaaggcccgg

SEQ ID NO: 497457 - DNA, 25 bp, Rattus norvegicus
gtctcgcagatatcacaaggcccgg

SEQ ID NO: 497458 - DNA, 25 bp, Rattus norvegicus
gtctcgccaacaagttcttactaga

SEQ ID NO: 497459 - DNA, 25 bp, Rattus norvegicus
gtctcgccaacatgttcttactaga

SEQ ID NO: 497460 - DNA, 25 bp, Rattus norvegicus
gtctcgctccttatgtctgcgcgga

SEQ ID NO: 497461 - DNA, 25 bp, Rattus norvegicus
gtctcgctccttttgtctgcgcgga

SEQ ID NO: 497462 - DNA, 25 bp, Rattus norvegicus
gtctcgctcttcattacagtcatgg

SEQ ID NO: 497463 - DNA, 25 bp, Rattus norvegicus
gtctcgctcttctttacagtcatgg

SEQ ID NO: 497464 - DNA, 25 bp, Rattus norvegicus
gtctcgctgcttcattgcagtacaa

SEQ ID NO: 497465 - DNA, 25 bp, Rattus norvegicus
gtctcgctgcttgattgcagtacaa

SEQ ID NO: 497466 - DNA, 25 bp, Rattus norvegicus
gtctcgcttgccagggcgcgctctg

SEQ ID NO: 497467 - DNA, 25 bp, Rattus norvegicus
gtctcgcttgcctgggcgcgctctg

SEQ ID NO: 497468 - DNA, 25 bp, Rattus norvegicus
gtctcgcttttcaacttactgaagg

SEQ ID NO: 497469 - DNA, 25 bp, Rattus norvegicus
gtctcgcttttctacttactgaagg

SEQ ID NO: 497470 - DNA, 25 bp, Rattus norvegicus
gtctcggaaactactgaaaaatgct

SEQ ID NO: 497471 - DNA, 25 bp, Rattus norvegicus
gtctcggaaacttctgaaaaatgct

SEQ ID NO: 497472 - DNA, 25 bp, Rattus norvegicus
gtctcggacaatcagctacgactat

SEQ ID NO: 497473 - DNA, 25 bp, Rattus norvegicus
gtctcggacaatgagctacgactat

SEQ ID NO: 497474 - DNA, 25 bp, Rattus norvegicus
gtctcggaccccatgatggagccaa

SEQ ID NO: 497475 - DNA, 25 bp, Rattus norvegicus
gtctcggaccccttgatggagccaa

SEQ ID NO: 497476 - DNA, 25 bp, Rattus norvegicus
gtctcggacctgattgtagatcaca

SEQ ID NO: 497477 - DNA, 25 bp, Rattus norvegicus
gtctcggacctgtttgtagatcaca

SEQ ID NO: 497478 - DNA, 25 bp, Rattus norvegicus
gtctcggacggtagttagctgacgt

SEQ ID NO: 497479 - DNA, 25 bp, Rattus norvegicus
gtctcggacggttgttagctgacgt

SEQ ID NO: 497480 - DNA, 25 bp, Rattus norvegicus
gtctcggcacccagcggacatggag

SEQ ID NO: 497481 - DNA, 25 bp, Rattus norvegicus
gtctcggcaccctgcggacatggag

SEQ ID NO: 497482 - DNA, 25 bp, Rattus norvegicus
gtctcggcactcagttcttggtaaa

SEQ ID NO: 497483 - DNA, 25 bp, Rattus norvegicus
gtctcggcactctgttcttggtaaa

SEQ ID NO: 497484 - DNA, 25 bp, Rattus norvegicus
gtctcggcgcccaccaatattcagt

SEQ ID NO: 497485 - DNA, 25 bp, Rattus norvegicus
gtctcggcgccctccaatattcagt

SEQ ID NO: 497486 - DNA, 25 bp, Rattus norvegicus
gtctcggctttgagttacagtccat

SEQ ID NO: 497487 - DNA, 25 bp, Rattus norvegicus
gtctcggctttgtgttacagtccat

SEQ ID NO: 497488 - DNA, 25 bp, Rattus norvegicus
gtctcgggagagagtcagatctctt

SEQ ID NO: 497489 - DNA, 25 bp, Rattus norvegicus
gtctcgggagagtgtcagatctctt

SEQ ID NO: 497490 - DNA, 25 bp, Rattus norvegicus
gtctcgggctaacttcctataggca

SEQ ID NO: 497491 - DNA, 25 bp, Rattus norvegicus
gtctcgggctaagttcctataggca

SEQ ID NO: 497492 - DNA, 25 bp, Rattus norvegicus
gtctcggtatgaacgcccgggtagc

SEQ ID NO: 497493 - DNA, 25 bp, Rattus norvegicus
gtctcggtatgatcgcccgggtagc

SEQ ID NO: 497494 - DNA, 25 bp, Rattus norvegicus
gtctcggtcagcagtggtgcacgca

SEQ ID NO: 497495 - DNA, 25 bp, Rattus norvegicus
gtctcggtcagcatggcgtgacaga

SEQ ID NO: 497496 - DNA, 25 bp, Rattus norvegicus
gtctcggtcagctgtggtgcacgca

SEQ ID NO: 497497 - DNA, 25 bp, Rattus norvegicus
gtctcggtcagcttggcgtgacaga

SEQ ID NO: 497498 - DNA, 25 bp, Rattus norvegicus
gtctcggtctgtctgcacttttata

SEQ ID NO: 497499 - DNA, 25 bp, Rattus norvegicus
gtctcggtctgtgtgcacttttata

SEQ ID NO: 497500 - DNA, 25 bp, Rattus norvegicus
gtctcggttcaaactttctttcttt

SEQ ID NO: 497501 - DNA, 25 bp, Rattus norvegicus
gtctcggttcaatctttctttcttt

SEQ ID NO: 497502 - DNA, 25 bp, Rattus norvegicus
gtctcggttctcatctcaacgagaa

SEQ ID NO: 497503 - DNA, 25 bp, Rattus norvegicus
gtctcggttctcttctcaacgagaa

SEQ ID NO: 497504 - DNA, 25 bp, Rattus norvegicus
gtctcggttggtacaactcttcaaa

SEQ ID NO: 497505 - DNA, 25 bp, Rattus norvegicus
gtctcggttggttcaactcttcaaa

SEQ ID NO: 497506 - DNA, 25 bp, Rattus norvegicus
gtctcgtaacttctgatgtagacgt

SEQ ID NO: 497507 - DNA, 25 bp, Rattus norvegicus
gtctcgtaacttgtgatgtagacgt

SEQ ID NO: 497508 - DNA, 25 bp, Rattus norvegicus
gtctcgtacgaaccttctgaagctt

SEQ ID NO: 497509 - DNA, 25 bp, Rattus norvegicus
gtctcgtacgaagcttctgaagctt

SEQ ID NO: 497510 - DNA, 25 bp, Rattus norvegicus
gtctcgtcgcatattcatgtttcat

SEQ ID NO: 497511 - DNA, 25 bp, Rattus norvegicus
gtctcgtcgcattttcatgtttcat

SEQ ID NO: 497512 - DNA, 25 bp, Rattus norvegicus
gtctcgtcgccgagcatgttaccca

SEQ ID NO: 497513 - DNA, 25 bp, Rattus norvegicus
gtctcgtcgccgtgcatgttaccca

SEQ ID NO: 497514 - DNA, 25 bp, Rattus norvegicus
gtctcgtctgccaatttgggtggaa

SEQ ID NO: 497515 - DNA, 25 bp, Rattus norvegicus
gtctcgtctgcctatttgggtggaa

SEQ ID NO: 497516 - DNA, 25 bp, Rattus norvegicus
gtctcgtcttggaatgagctggtgc

SEQ ID NO: 497517 - DNA, 25 bp, Rattus norvegicus
gtctcgtcttggtatgagctggtgc

SEQ ID NO: 497518 - DNA, 25 bp, Rattus norvegicus
gtctcgtgaccgaagtggactaata

SEQ ID NO: 497519 - DNA, 25 bp, Rattus norvegicus
gtctcgtgaccgtagtggactaata

SEQ ID NO: 497520 - DNA, 25 bp, Rattus norvegicus
gtctcgtgtgccatgatgtacacat

SEQ ID NO: 497521 - DNA, 25 bp, Rattus norvegicus
gtctcgtgtgccttgatgtacacat

SEQ ID NO: 497522 - DNA, 25 bp, Rattus norvegicus
gtctcgtgttatatattgtgcctca

SEQ ID NO: 497523 - DNA, 25 bp, Rattus norvegicus
gtctcgtgttatttattgtgcctca

SEQ ID NO: 497524 - DNA, 25 bp, Rattus norvegicus
gtctcgtgtttgaccaactttaatg

SEQ ID NO: 497525 - DNA, 25 bp, Rattus norvegicus
gtctcgtgtttgtccaactttaatg

SEQ ID NO: 497526 - DNA, 25 bp, Rattus norvegicus
gtctcgttctttctagtattgatga

SEQ ID NO: 497527 - DNA, 25 bp, Rattus norvegicus
gtctcgttctttgtagtattgatga

SEQ ID NO: 497528 - DNA, 25 bp, Rattus norvegicus
gtctcgtttcttaggaggctcctgg

SEQ ID NO: 497529 - DNA, 25 bp, Rattus norvegicus
gtctcgtttctttggaggctcctgg

SEQ ID NO: 497530 - DNA, 25 bp, Rattus norvegicus
gtctctaaatggactggagcacacc

SEQ ID NO: 497531 - DNA, 25 bp, Rattus norvegicus
gtctctaaatggtctggagcacacc

SEQ ID NO: 497532 - DNA, 25 bp, Rattus norvegicus
gtctctaaccacacctgggctaagg

SEQ ID NO: 497533 - DNA, 25 bp, Rattus norvegicus
gtctctaaccactcctgggctaagg

SEQ ID NO: 497534 - DNA, 25 bp, Rattus norvegicus
gtctctaacgtactaaaccgcacat

SEQ ID NO: 497535 - DNA, 25 bp, Rattus norvegicus
gtctctaacgtagtaaaccgcacat

SEQ ID NO: 497536 - DNA, 25 bp, Rattus norvegicus
gtctctaagaagatggaaccctgaa

SEQ ID NO: 497537 - DNA, 25 bp, Rattus norvegicus
gtctctaagaagttggaaccctgaa

SEQ ID NO: 497538 - DNA, 25 bp, Rattus norvegicus
gtctctaagcggaacttacccgaag

SEQ ID NO: 497539 - DNA, 25 bp, Rattus norvegicus
gtctctaagcggtacttacccgaag

SEQ ID NO: 497540 - DNA, 25 bp, Rattus norvegicus
gtctctaaggagactttgttaccag

SEQ ID NO: 497541 - DNA, 25 bp, Rattus norvegicus
gtctctaaggagtctttgttaccag

SEQ ID NO: 497542 - DNA, 25 bp, Rattus norvegicus
gtctctacataactccagctactgg

SEQ ID NO: 497543 - DNA, 25 bp, Rattus norvegicus
gtctctacataagtccagctactgg

SEQ ID NO: 497544 - DNA, 25 bp, Rattus norvegicus
gtctctacatctccgcgggctgcgg

SEQ ID NO: 497545 - DNA, 25 bp, Rattus norvegicus
gtctctacatctgcgcgggctgcgg

SEQ ID NO: 497546 - DNA, 25 bp, Rattus norvegicus
gtctctactaccacagaaacttcag

SEQ ID NO: 497547 - DNA, 25 bp, Rattus norvegicus
gtctctactacctcagaaacttcag

SEQ ID NO: 497548 - DNA, 25 bp, Rattus norvegicus
gtctctagaactacctggcacacag

SEQ ID NO: 497549 - DNA, 25 bp, Rattus norvegicus
gtctctagaacttcctggcacacag

SEQ ID NO: 497550 - DNA, 25 bp, Rattus norvegicus
gtctctagacagacattatggacag

SEQ ID NO: 497551 - DNA, 25 bp, Rattus norvegicus
gtctctagacagtcattatggacag

SEQ ID NO: 497552 - DNA, 25 bp, Rattus norvegicus
gtctctagagttaacggcgacctca

SEQ ID NO: 497553 - DNA, 25 bp, Rattus norvegicus
gtctctagagtttacggcgacctca

SEQ ID NO: 497554 - DNA, 25 bp, Rattus norvegicus
gtctctagatatcgaaatctgcttc

SEQ ID NO: 497555 - DNA, 25 bp, Rattus norvegicus
gtctctagatatggaaatctgcttc

SEQ ID NO: 497556 - DNA, 25 bp, Rattus norvegicus
gtctctagattgctcctgaggttcc

SEQ ID NO: 497557 - DNA, 25 bp, Rattus norvegicus
gtctctagattggtcctgaggttcc

SEQ ID NO: 497558 - DNA, 25 bp, Rattus norvegicus
gtctctaggcagaggatctccgatc

SEQ ID NO: 497559 - DNA, 25 bp, Rattus norvegicus
gtctctaggcagtggatctccgatc

SEQ ID NO: 497560 - DNA, 25 bp, Rattus norvegicus
gtctctagggacaaactggttcatt

SEQ ID NO: 497561 - DNA, 25 bp, Rattus norvegicus
gtctctagggactaactggttcatt

SEQ ID NO: 497562 - DNA, 25 bp, Rattus norvegicus
gtctctagtcctcttacaatgtcat

SEQ ID NO: 497563 - DNA, 25 bp, Rattus norvegicus
gtctctagtcctgttacaatgtcat

SEQ ID NO: 497564 - DNA, 25 bp, Rattus norvegicus
gtctctagtgtgaataatcctcgga

SEQ ID NO: 497565 - DNA, 25 bp, Rattus norvegicus
gtctctagtgtgtataatcctcgga

SEQ ID NO: 497566 - DNA, 25 bp, Rattus norvegicus
gtctctagttacactgcttgcaaga

SEQ ID NO: 497567 - DNA, 25 bp, Rattus norvegicus
gtctctagttactctgcttgcaaga

SEQ ID NO: 497568 - DNA, 25 bp, Rattus norvegicus
gtctctatgccaaaatcatgtcagt

SEQ ID NO: 497569 - DNA, 25 bp, Rattus norvegicus
gtctctatgccataatcatgtcagt

SEQ ID NO: 497570 - DNA, 25 bp, Rattus norvegicus
gtctctatggaaacagggccagctt

SEQ ID NO: 497571 - DNA, 25 bp, Rattus norvegicus
gtctctatggaatcagggccagctt

SEQ ID NO: 497572 - DNA, 25 bp, Rattus norvegicus
gtctctatgtgtattcaatctcccc

SEQ ID NO: 497573 - DNA, 25 bp, Rattus norvegicus
gtctctatgtgttttcaatctcccc

SEQ ID NO: 497574 - DNA, 25 bp, Rattus norvegicus
gtctctattcagactacattctcaa

SEQ ID NO: 497575 - DNA, 25 bp, Rattus norvegicus
gtctctattcagtctacattctcaa

SEQ ID NO: 497576 - DNA, 25 bp, Rattus norvegicus
gtctctcaaaagcacagcatacatg

SEQ ID NO: 497577 - DNA, 25 bp, Rattus norvegicus
gtctctcaaaaggacagcatacatg

SEQ ID NO: 497578 - DNA, 25 bp, Rattus norvegicus
gtctctcaaacaccttagatgcaag

SEQ ID NO: 497579 - DNA, 25 bp, Rattus norvegicus
gtctctcaaacagcttagatgcaag

SEQ ID NO: 497580 - DNA, 25 bp, Rattus norvegicus
gtctctcaacttacccaatgctggg

SEQ ID NO: 497581 - DNA, 25 bp, Rattus norvegicus
gtctctcaactttcccaatgctggg

SEQ ID NO: 497582 - DNA, 25 bp, Rattus norvegicus
gtctctcaagaccactcaagaatat

SEQ ID NO: 497583 - DNA, 25 bp, Rattus norvegicus
gtctctcaagacgactcaagaatat

SEQ ID NO: 497584 - DNA, 25 bp, Rattus norvegicus
gtctctcaatggagaggcccacagc

SEQ ID NO: 497585 - DNA, 25 bp, Rattus norvegicus
gtctctcaatggtgaggcccacagc

SEQ ID NO: 497586 - DNA, 25 bp, Rattus norvegicus
gtctctcacacaatctgtttgcagg

SEQ ID NO: 497587 - DNA, 25 bp, Rattus norvegicus
gtctctcacacacatggtcagcata

SEQ ID NO: 497588 - DNA, 25 bp, Rattus norvegicus
gtctctcacacagatggtcagcata

SEQ ID NO: 497589 - DNA, 25 bp, Rattus norvegicus
gtctctcacacattctgtttgcagg

SEQ ID NO: 497590 - DNA, 25 bp, Rattus norvegicus
gtctctcacagactggccagtatca

SEQ ID NO: 497591 - DNA, 25 bp, Rattus norvegicus
gtctctcacagagtggccagtatca

SEQ ID NO: 497592 - DNA, 25 bp, Rattus norvegicus
gtctctcacaggcacttaattcatt

SEQ ID NO: 497593 - DNA, 25 bp, Rattus norvegicus
gtctctcacagggacttaattcatt

SEQ ID NO: 497594 - DNA, 25 bp, Rattus norvegicus
gtctctcacatactggcagtatcat

SEQ ID NO: 497595 - DNA, 25 bp, Rattus norvegicus
gtctctcacatagtggcagtatcat

SEQ ID NO: 497596 - DNA, 25 bp, Rattus norvegicus
gtctctcacatgctcggtaaatgct

SEQ ID NO: 497597 - DNA, 25 bp, Rattus norvegicus
gtctctcacatggtcggtaaatgct

SEQ ID NO: 497598 - DNA, 25 bp, Rattus norvegicus
gtctctcactgactaattgccccat

SEQ ID NO: 497599 - DNA, 25 bp, Rattus norvegicus
gtctctcactgagtaattgccccat

SEQ ID NO: 497600 - DNA, 25 bp, Rattus norvegicus
gtctctcactgtccgtgttataagc

SEQ ID NO: 497601 - DNA, 25 bp, Rattus norvegicus
gtctctcactgtgcgtgttataagc

SEQ ID NO: 497602 - DNA, 25 bp, Rattus norvegicus
gtctctcagacaacacttgaccaag

SEQ ID NO: 497603 - DNA, 25 bp, Rattus norvegicus
gtctctcagacatcacttgaccaag

SEQ ID NO: 497604 - DNA, 25 bp, Rattus norvegicus
gtctctcagagcaaggaatggccca

SEQ ID NO: 497605 - DNA, 25 bp, Rattus norvegicus
gtctctcagagctaggaatggccca

SEQ ID NO: 497606 - DNA, 25 bp, Rattus norvegicus
gtctctcagataatgcacacacaca

SEQ ID NO: 497607 - DNA, 25 bp, Rattus norvegicus
gtctctcagatattgcacacacaca

SEQ ID NO: 497608 - DNA, 25 bp, Rattus norvegicus
gtctctcagcctctggatctatggg

SEQ ID NO: 497609 - DNA, 25 bp, Rattus norvegicus
gtctctcagcctgtggatctatggg

SEQ ID NO: 497610 - DNA, 25 bp, Rattus norvegicus
gtctctcagcttccatcagaggaaa

SEQ ID NO: 497611 - DNA, 25 bp, Rattus norvegicus
gtctctcagcttgcatcagaggaaa

SEQ ID NO: 497612 - DNA, 25 bp, Rattus norvegicus
gtctctcaggtaatcactaactagt

SEQ ID NO: 497613 - DNA, 25 bp, Rattus norvegicus
gtctctcaggtattcactaactagt

SEQ ID NO: 497614 - DNA, 25 bp, Rattus norvegicus
gtctctcagtcccaagcagaaggat

SEQ ID NO: 497615 - DNA, 25 bp, Rattus norvegicus
gtctctcagtccgaagcagaaggat

SEQ ID NO: 497616 - DNA, 25 bp, Rattus norvegicus
gtctctcagtgaagggctgcttgca

SEQ ID NO: 497617 - DNA, 25 bp, Rattus norvegicus
gtctctcagtgatgggctgcttgca

SEQ ID NO: 497618 - DNA, 25 bp, Rattus norvegicus
gtctctcatataatttcagtccgtt

SEQ ID NO: 497619 - DNA, 25 bp, Rattus norvegicus
gtctctcatatattttcagtccgtt

SEQ ID NO: 497620 - DNA, 25 bp, Rattus norvegicus
gtctctcatccgagcaatcaggaca

SEQ ID NO: 497621 - DNA, 25 bp, Rattus norvegicus
gtctctcatccgtgcaatcaggaca

SEQ ID NO: 497622 - DNA, 25 bp, Rattus norvegicus
gtctctcatcctcttaccatgataa

SEQ ID NO: 497623 - DNA, 25 bp, Rattus norvegicus
gtctctcatcctgttaccatgataa

SEQ ID NO: 497624 - DNA, 25 bp, Rattus norvegicus
gtctctcatcgcatatgctcttaga

SEQ ID NO: 497625 - DNA, 25 bp, Rattus norvegicus
gtctctcatcgcttatgctcttaga

SEQ ID NO: 497626 - DNA, 25 bp, Rattus norvegicus
gtctctcatgggagggtggcacaaa

SEQ ID NO: 497627 - DNA, 25 bp, Rattus norvegicus
gtctctcatgggtgggtggcacaaa

SEQ ID NO: 497628 - DNA, 25 bp, Rattus norvegicus
gtctctccaacacctgtgatgtcgt

SEQ ID NO: 497629 - DNA, 25 bp, Rattus norvegicus
gtctctccaacagctgtgatgtcgt

SEQ ID NO: 497630 - DNA, 25 bp, Rattus norvegicus
gtctctccacaaaacccaaggacta

SEQ ID NO: 497631 - DNA, 25 bp, Rattus norvegicus
gtctctccacaatacccaaggacta

SEQ ID NO: 497632 - DNA, 25 bp, Rattus norvegicus
gtctctccaccgcaaatctagtgta

SEQ ID NO: 497633 - DNA, 25 bp, Rattus norvegicus
gtctctccaccggaaatctagtgta

SEQ ID NO: 497634 - DNA, 25 bp, Rattus norvegicus
gtctctccagctactgtgcagttcg

SEQ ID NO: 497635 - DNA, 25 bp, Rattus norvegicus
gtctctccagcttctgtgcagttcg

SEQ ID NO: 497636 - DNA, 25 bp, Rattus norvegicus
gtctctccatctaacaatgaaaata

SEQ ID NO: 497637 - DNA, 25 bp, Rattus norvegicus
gtctctccatcttacaatgaaaata

SEQ ID NO: 497638 - DNA, 25 bp, Rattus norvegicus
gtctctcccaggaacagaagcttca

SEQ ID NO: 497639 - DNA, 25 bp, Rattus norvegicus
gtctctcccaggtacagaagcttca

SEQ ID NO: 497640 - DNA, 25 bp, Rattus norvegicus
gtctctccctccagtggtggtaaga

SEQ ID NO: 497641 - DNA, 25 bp, Rattus norvegicus
gtctctccctcctgtggtggtaaga

SEQ ID NO: 497642 - DNA, 25 bp, Rattus norvegicus
gtctctccctggaaaacgtggcaag

SEQ ID NO: 497643 - DNA, 25 bp, Rattus norvegicus
gtctctccctggtaaacgtggcaag

SEQ ID NO: 497644 - DNA, 25 bp, Rattus norvegicus
gtctctccgctcaaaggtcgatgaa

SEQ ID NO: 497645 - DNA, 25 bp, Rattus norvegicus
gtctctccgctctaaggtcgatgaa

SEQ ID NO: 497646 - DNA, 25 bp, Rattus norvegicus
gtctctccggccagacaagagtaga

SEQ ID NO: 497647 - DNA, 25 bp, Rattus norvegicus
gtctctccggcctgacaagagtaga

SEQ ID NO: 497648 - DNA, 25 bp, Rattus norvegicus
gtctctcctcaaaagaacctctttt

SEQ ID NO: 497649 - DNA, 25 bp, Rattus norvegicus
gtctctcctcaatagaacctctttt

SEQ ID NO: 497650 - DNA, 25 bp, Rattus norvegicus
gtctctcctctgctacaaaggtcag

SEQ ID NO: 497651 - DNA, 25 bp, Rattus norvegicus
gtctctcctctggtacaaaggtcag

SEQ ID NO: 497652 - DNA, 25 bp, Rattus norvegicus
gtctctcctggaaacagcatacact

SEQ ID NO: 497653 - DNA, 25 bp, Rattus norvegicus
gtctctcctggaaggttcgaagcct

SEQ ID NO: 497654 - DNA, 25 bp, Rattus norvegicus
gtctctcctggatacagcatacact

SEQ ID NO: 497655 - DNA, 25 bp, Rattus norvegicus
gtctctcctggatggttcgaagcct

SEQ ID NO: 497656 - DNA, 25 bp, Rattus norvegicus
gtctctcctgtgctagttctagcca

SEQ ID NO: 497657 - DNA, 25 bp, Rattus norvegicus
gtctctcctgtggtagttctagcca

SEQ ID NO: 497658 - DNA, 25 bp, Rattus norvegicus
gtctctccttatcctgtacatgtag

SEQ ID NO: 497659 - DNA, 25 bp, Rattus norvegicus
gtctctccttatgctgtacatgtag

SEQ ID NO: 497660 - DNA, 25 bp, Rattus norvegicus
gtctctccttggcacacacggaagg

SEQ ID NO: 497661 - DNA, 25 bp, Rattus norvegicus
gtctctccttgggacacacggaagg

SEQ ID NO: 497662 - DNA, 25 bp, Rattus norvegicus
gtctctcggaggcttctagaaatag

SEQ ID NO: 497663 - DNA, 25 bp, Rattus norvegicus
gtctctcggagggttctagaaatag

SEQ ID NO: 497664 - DNA, 25 bp, Rattus norvegicus
gtctctcggatcacaagttcacaag

SEQ ID NO: 497665 - DNA, 25 bp, Rattus norvegicus
gtctctcggatctcaagttcacaag

SEQ ID NO: 497666 - DNA, 25 bp, Rattus norvegicus
gtctctcgggaaatgaagggcctca

SEQ ID NO: 497667 - DNA, 25 bp, Rattus norvegicus
gtctctcgggaattgaagggcctca

SEQ ID NO: 497668 - DNA, 25 bp, Rattus norvegicus
gtctctcgtgtaatgaagaccactg

SEQ ID NO: 497669 - DNA, 25 bp, Rattus norvegicus
gtctctcgtgtattgaagaccactg

SEQ ID NO: 497670 - DNA, 25 bp, Rattus norvegicus
gtctctctacgcagggcagtgagca

SEQ ID NO: 497671 - DNA, 25 bp, Rattus norvegicus
gtctctctacgctgggcagtgagca

SEQ ID NO: 497672 - DNA, 25 bp, Rattus norvegicus
gtctctctagcacctggaatgtact

SEQ ID NO: 497673 - DNA, 25 bp, Rattus norvegicus
gtctctctagcagctggaatgtact

SEQ ID NO: 497674 - DNA, 25 bp, Rattus norvegicus
gtctctctatctaattccttcaaaa

SEQ ID NO: 497675 - DNA, 25 bp, Rattus norvegicus
gtctctctatcttattccttcaaaa

SEQ ID NO: 497676 - DNA, 25 bp, Rattus norvegicus
gtctctctcagaagatatccccgta

SEQ ID NO: 497677 - DNA, 25 bp, Rattus norvegicus
gtctctctcagatgatatccccgta

SEQ ID NO: 497678 - DNA, 25 bp, Rattus norvegicus
gtctctctcattattggcactggga

SEQ ID NO: 497679 - DNA, 25 bp, Rattus norvegicus
gtctctctcatttttggcactggga

SEQ ID NO: 497680 - DNA, 25 bp, Rattus norvegicus
gtctctctccgtacagacctcttaa

SEQ ID NO: 497681 - DNA, 25 bp, Rattus norvegicus
gtctctctccgttcagacctcttaa

SEQ ID NO: 497682 - DNA, 25 bp, Rattus norvegicus
gtctctctctaactctgcaaggaat

SEQ ID NO: 497683 - DNA, 25 bp, Rattus norvegicus
gtctctctctaagtctgcaaggaat

SEQ ID NO: 497684 - DNA, 25 bp, Rattus norvegicus
gtctctctctttatgaattcagccc

SEQ ID NO: 497685 - DNA, 25 bp, Rattus norvegicus
gtctctctctttttgaattcagccc

SEQ ID NO: 497686 - DNA, 25 bp, Rattus norvegicus
gtctctctgcctatataatctggtt

SEQ ID NO: 497687 - DNA, 25 bp, Rattus norvegicus
gtctctctgcctttataatctggtt

SEQ ID NO: 497688 - DNA, 25 bp, Rattus norvegicus
gtctctctgcgtcttattggttaaa

SEQ ID NO: 497689 - DNA, 25 bp, Rattus norvegicus
gtctctctgcgtgttattggttaaa

SEQ ID NO: 497690 - DNA, 25 bp, Rattus norvegicus
gtctctctgctaagttcattggtgt

SEQ ID NO: 497691 - DNA, 25 bp, Rattus norvegicus
gtctctctgctatgttcattggtgt

SEQ ID NO: 497692 - DNA, 25 bp, Rattus norvegicus
gtctctctgctcatctttggtcaga

SEQ ID NO: 497693 - DNA, 25 bp, Rattus norvegicus
gtctctctgctcttctttggtcaga

SEQ ID NO: 497694 - DNA, 25 bp, Rattus norvegicus
gtctctctggaacctacaggcttat

SEQ ID NO: 497695 - DNA, 25 bp, Rattus norvegicus
gtctctctggaagctacaggcttat

SEQ ID NO: 497696 - DNA, 25 bp, Rattus norvegicus
gtctctctggtcaataggactacct

SEQ ID NO: 497697 - DNA, 25 bp, Rattus norvegicus
gtctctctggtctataggactacct

SEQ ID NO: 497698 - DNA, 25 bp, Rattus norvegicus
gtctctctggtgagtatggtccaaa

SEQ ID NO: 497699 - DNA, 25 bp, Rattus norvegicus
gtctctctggtgtgtatggtccaaa

SEQ ID NO: 497700 - DNA, 25 bp, Rattus norvegicus
gtctctctggttagtcttctgaccc

SEQ ID NO: 497701 - DNA, 25 bp, Rattus norvegicus
gtctctctggtttgtcttctgaccc

SEQ ID NO: 497702 - DNA, 25 bp, Rattus norvegicus
gtctctcttcaaacagtgtgtcaat

SEQ ID NO: 497703 - DNA, 25 bp, Rattus norvegicus
gtctctcttcaactgctgagctgtg

SEQ ID NO: 497704 - DNA, 25 bp, Rattus norvegicus
gtctctcttcaagtgctgagctgtg

SEQ ID NO: 497705 - DNA, 25 bp, Rattus norvegicus
gtctctcttcaatcagtgtgtcaat

SEQ ID NO: 497706 - DNA, 25 bp, Rattus norvegicus
gtctctcttccaactgactgaaaag

SEQ ID NO: 497707 - DNA, 25 bp, Rattus norvegicus
gtctctcttccatctgactgaaaag

SEQ ID NO: 497708 - DNA, 25 bp, Rattus norvegicus
gtctctcttcttaagcagtgtctac

SEQ ID NO: 497709 - DNA, 25 bp, Rattus norvegicus
gtctctcttctttagcagtgtctac

SEQ ID NO: 497710 - DNA, 25 bp, Rattus norvegicus
gtctctcttgaaaccagggagccca

SEQ ID NO: 497711 - DNA, 25 bp, Rattus norvegicus
gtctctcttgaatccagggagccca

SEQ ID NO: 497712 - DNA, 25 bp, Rattus norvegicus
gtctctctttctctattatacttag

SEQ ID NO: 497713 - DNA, 25 bp, Rattus norvegicus
gtctctctttctgtattatacttag

SEQ ID NO: 497714 - DNA, 25 bp, Rattus norvegicus
gtctctctttgtaacccaggtggaa

SEQ ID NO: 497715 - DNA, 25 bp, Rattus norvegicus
gtctctctttgttacccaggtggaa

SEQ ID NO: 497716 - DNA, 25 bp, Rattus norvegicus
gtctctgaaagaccaaatagatttc

SEQ ID NO: 497717 - DNA, 25 bp, Rattus norvegicus
gtctctgaaagagcaaatagatttc

SEQ ID NO: 497718 - DNA, 25 bp, Rattus norvegicus
gtctctgaaatccaggaccttcaat

SEQ ID NO: 497719 - DNA, 25 bp, Rattus norvegicus
gtctctgaaatcgaggaccttcaat

SEQ ID NO: 497720 - DNA, 25 bp, Rattus norvegicus
gtctctgaagacaatgtcagccgat

SEQ ID NO: 497721 - DNA, 25 bp, Rattus norvegicus
gtctctgaagacacctaaccaaaga

SEQ ID NO: 497722 - DNA, 25 bp, Rattus norvegicus
gtctctgaagactatgtcagccgat

SEQ ID NO: 497723 - DNA, 25 bp, Rattus norvegicus
gtctctgaagactcctaaccaaaga

SEQ ID NO: 497724 - DNA, 25 bp, Rattus norvegicus
gtctctgaaggaccagctttgttaa

SEQ ID NO: 497725 - DNA, 25 bp, Rattus norvegicus
gtctctgaaggagcagctttgttaa

SEQ ID NO: 497726 - DNA, 25 bp, Rattus norvegicus
gtctctgacagacggtggacatcaa

SEQ ID NO: 497727 - DNA, 25 bp, Rattus norvegicus
gtctctgacagagggtggacatcaa

SEQ ID NO: 497728 - DNA, 25 bp, Rattus norvegicus
gtctctgacagtagagtcctgccaa

SEQ ID NO: 497729 - DNA, 25 bp, Rattus norvegicus
gtctctgacagttgagtcctgccaa

SEQ ID NO: 497730 - DNA, 25 bp, Rattus norvegicus
gtctctgacataacgagtcacactg

SEQ ID NO: 497731 - DNA, 25 bp, Rattus norvegicus
gtctctgacatatcgagtcacactg

SEQ ID NO: 497732 - DNA, 25 bp, Rattus norvegicus
gtctctgaccagctttgacagtgac

SEQ ID NO: 497733 - DNA, 25 bp, Rattus norvegicus
gtctctgaccaggtttgacagtgac

SEQ ID NO: 497734 - DNA, 25 bp, Rattus norvegicus
gtctctgacggacagctctgactga

SEQ ID NO: 497735 - DNA, 25 bp, Rattus norvegicus
gtctctgacggagagctctgactga

SEQ ID NO: 497736 - DNA, 25 bp, Rattus norvegicus
gtctctgactctatgcctacagtat

SEQ ID NO: 497737 - DNA, 25 bp, Rattus norvegicus
gtctctgactctttgcctacagtat

SEQ ID NO: 497738 - DNA, 25 bp, Rattus norvegicus
gtctctgactgcatagtcctaaggc

SEQ ID NO: 497739 - DNA, 25 bp, Rattus norvegicus
gtctctgactgcttagtcctaaggc

SEQ ID NO: 497740 - DNA, 25 bp, Rattus norvegicus
gtctctgacttactgggtgtggtta

SEQ ID NO: 497741 - DNA, 25 bp, Rattus norvegicus
gtctctgacttagtgggtgtggtta

SEQ ID NO: 497742 - DNA, 25 bp, Rattus norvegicus
gtctctgagaatcgtgtgacctgtg

SEQ ID NO: 497743 - DNA, 25 bp, Rattus norvegicus
gtctctgagaatggtgtgacctgtg

SEQ ID NO: 497744 - DNA, 25 bp, Rattus norvegicus
gtctctgagactcaaggcggacctt

SEQ ID NO: 497745 - DNA, 25 bp, Rattus norvegicus
gtctctgagactgaaggcggacctt

SEQ ID NO: 497746 - DNA, 25 bp, Rattus norvegicus
gtctctgagcctccagttaatgcta

SEQ ID NO: 497747 - DNA, 25 bp, Rattus norvegicus
gtctctgagcctgcagttaatgcta

SEQ ID NO: 497748 - DNA, 25 bp, Rattus norvegicus
gtctctgagcgaaacacttgtgttt

SEQ ID NO: 497749 - DNA, 25 bp, Rattus norvegicus
gtctctgagcgatacacttgtgttt

SEQ ID NO: 497750 - DNA, 25 bp, Rattus norvegicus
gtctctgaggacatagaacatgcag

SEQ ID NO: 497751 - DNA, 25 bp, Rattus norvegicus
gtctctgaggacttagaacatgcag

SEQ ID NO: 497752 - DNA, 25 bp, Rattus norvegicus
gtctctgagggaaaatgtgatttgc

SEQ ID NO: 497753 - DNA, 25 bp, Rattus norvegicus
gtctctgagggaacgcttgatctgc

SEQ ID NO: 497754 - DNA, 25 bp, Rattus norvegicus
gtctctgagggacgatacctgtaca

SEQ ID NO: 497755 - DNA, 25 bp, Rattus norvegicus
gtctctgagggaggatacctgtaca

SEQ ID NO: 497756 - DNA, 25 bp, Rattus norvegicus
gtctctgagggataatgtgatttgc

SEQ ID NO: 497757 - DNA, 25 bp, Rattus norvegicus
gtctctgagggatcgcttgatctgc

SEQ ID NO: 497758 - DNA, 25 bp, Rattus norvegicus
gtctctgagtagagttagattactt

SEQ ID NO: 497759 - DNA, 25 bp, Rattus norvegicus
gtctctgagtagtgttagattactt

SEQ ID NO: 497760 - DNA, 25 bp, Rattus norvegicus
gtctctgataatacgggtcttgcta

SEQ ID NO: 497761 - DNA, 25 bp, Rattus norvegicus
gtctctgataattcgggtcttgcta

SEQ ID NO: 497762 - DNA, 25 bp, Rattus norvegicus
gtctctgatgaaagtatccgcctcg

SEQ ID NO: 497763 - DNA, 25 bp, Rattus norvegicus
gtctctgatgaatgtatccgcctcg

SEQ ID NO: 497764 - DNA, 25 bp, Rattus norvegicus
gtctctgatgtcactcttcagcata

SEQ ID NO: 497765 - DNA, 25 bp, Rattus norvegicus
gtctctgatgtctctcttcagcata

SEQ ID NO: 497766 - DNA, 25 bp, Rattus norvegicus
gtctctgattcactccatcaactac

SEQ ID NO: 497767 - DNA, 25 bp, Rattus norvegicus
gtctctgattcagtccatcaactac

SEQ ID NO: 497768 - DNA, 25 bp, Rattus norvegicus
gtctctgattctccacagtgctgag

SEQ ID NO: 497769 - DNA, 25 bp, Rattus norvegicus
gtctctgattctcttgctggtgttg

SEQ ID NO: 497770 - DNA, 25 bp, Rattus norvegicus
gtctctgattctgcacagtgctgag

SEQ ID NO: 497771 - DNA, 25 bp, Rattus norvegicus
gtctctgattctgttgctggtgttg

SEQ ID NO: 497772 - DNA, 25 bp, Rattus norvegicus
gtctctgcaaatcaagatggtctaa

SEQ ID NO: 497773 - DNA, 25 bp, Rattus norvegicus
gtctctgcaaatgaagatggtctaa

SEQ ID NO: 497774 - DNA, 25 bp, Rattus norvegicus
gtctctgcacttacctgaggctggt

SEQ ID NO: 497775 - DNA, 25 bp, Rattus norvegicus
gtctctgcactttcctgaggctggt

SEQ ID NO: 497776 - DNA, 25 bp, Rattus norvegicus
gtctctgcaggcatgtatgtaggat

SEQ ID NO: 497777 - DNA, 25 bp, Rattus norvegicus
gtctctgcaggcttgtatgtaggat

SEQ ID NO: 497778 - DNA, 25 bp, Rattus norvegicus
gtctctgccaggcaaggaactcttg

SEQ ID NO: 497779 - DNA, 25 bp, Rattus norvegicus
gtctctgccagggaaggaactcttg

SEQ ID NO: 497780 - DNA, 25 bp, Rattus norvegicus
gtctctgcccaaagaatttatgctg

SEQ ID NO: 497781 - DNA, 25 bp, Rattus norvegicus
gtctctgcccaatgaatttatgctg

SEQ ID NO: 497782 - DNA, 25 bp, Rattus norvegicus
gtctctgccctcaacaaggcttggt

SEQ ID NO: 497783 - DNA, 25 bp, Rattus norvegicus
gtctctgccctctacaaggcttggt

SEQ ID NO: 497784 - DNA, 25 bp, Rattus norvegicus
gtctctgccgaccttaatacataag

SEQ ID NO: 497785 - DNA, 25 bp, Rattus norvegicus
gtctctgccgacgttaatacataag

SEQ ID NO: 497786 - DNA, 25 bp, Rattus norvegicus
gtctctgccgcacgaagacggtgta

SEQ ID NO: 497787 - DNA, 25 bp, Rattus norvegicus
gtctctgccgcaggaagacggtgta

SEQ ID NO: 497788 - DNA, 25 bp, Rattus norvegicus
gtctctgccttacaaatactggtga

SEQ ID NO: 497789 - DNA, 25 bp, Rattus norvegicus
gtctctgccttagaaatactggtga

SEQ ID NO: 497790 - DNA, 25 bp, Rattus norvegicus
gtctctgcggcaattgatgcttctc

SEQ ID NO: 497791 - DNA, 25 bp, Rattus norvegicus
gtctctgcggcacacctggagaagt

SEQ ID NO: 497792 - DNA, 25 bp, Rattus norvegicus
gtctctgcggcagacctggagaagt

SEQ ID NO: 497793 - DNA, 25 bp, Rattus norvegicus
gtctctgcggcatttgatgcttctc

SEQ ID NO: 497794 - DNA, 25 bp, Rattus norvegicus
gtctctgctaggacgagtcacccaa

SEQ ID NO: 497795 - DNA, 25 bp, Rattus norvegicus
gtctctgctaggtcgagtcacccaa

SEQ ID NO: 497796 - DNA, 25 bp, Rattus norvegicus
gtctctgctctacctagaagtctca

SEQ ID NO: 497797 - DNA, 25 bp, Rattus norvegicus
gtctctgctctagctagaagtctca

SEQ ID NO: 497798 - DNA, 25 bp, Rattus norvegicus
gtctctgctctcacattgactatga

SEQ ID NO: 497799 - DNA, 25 bp, Rattus norvegicus
gtctctgctctctcattgactatga

SEQ ID NO: 497800 - DNA, 25 bp, Rattus norvegicus
gtctctgctggactgccttatatga

SEQ ID NO: 497801 - DNA, 25 bp, Rattus norvegicus
gtctctgctggagtgccttatatga

SEQ ID NO: 497802 - DNA, 25 bp, Rattus norvegicus
gtctctgcttttcgaagatgtggca

SEQ ID NO: 497803 - DNA, 25 bp, Rattus norvegicus
gtctctgcttttggaagatgtggca

SEQ ID NO: 497804 - DNA, 25 bp, Rattus norvegicus
gtctctggacaactgggagcgtctc

SEQ ID NO: 497805 - DNA, 25 bp, Rattus norvegicus
gtctctggacaagtgggagcgtctc

SEQ ID NO: 497806 - DNA, 25 bp, Rattus norvegicus
gtctctggagtgacagtgtcctttc

SEQ ID NO: 497807 - DNA, 25 bp, Rattus norvegicus
gtctctggagtgtcagtgtcctttc

SEQ ID NO: 497808 - DNA, 25 bp, Rattus norvegicus
gtctctggcatcatctttatcctat

SEQ ID NO: 497809 - DNA, 25 bp, Rattus norvegicus
gtctctggcatcttctttatcctat

SEQ ID NO: 497810 - DNA, 25 bp, Rattus norvegicus
gtctctggctgtaaagacaccagct

SEQ ID NO: 497811 - DNA, 25 bp, Rattus norvegicus
gtctctggctgttaagacaccagct

SEQ ID NO: 497812 - DNA, 25 bp, Rattus norvegicus
gtctctgggagactatgagatccac

SEQ ID NO: 497813 - DNA, 25 bp, Rattus norvegicus
gtctctgggagactgtatcctttca

SEQ ID NO: 497814 - DNA, 25 bp, Rattus norvegicus
gtctctgggagagtatgagatccac

SEQ ID NO: 497815 - DNA, 25 bp, Rattus norvegicus
gtctctgggagagtgtatcctttca

SEQ ID NO: 497816 - DNA, 25 bp, Rattus norvegicus
gtctctggtcccattagatctagta

SEQ ID NO: 497817 - DNA, 25 bp, Rattus norvegicus
gtctctggtccctttagatctagta

SEQ ID NO: 497818 - DNA, 25 bp, Rattus norvegicus
gtctctggtgtacctgatgatccga

SEQ ID NO: 497819 - DNA, 25 bp, Rattus norvegicus
gtctctggtgtagctgatgatccga

SEQ ID NO: 497820 - DNA, 25 bp, Rattus norvegicus
gtctctgtaaaaatcaccactctca

SEQ ID NO: 497821 - DNA, 25 bp, Rattus norvegicus
gtctctgtaaaattcaccactctca

SEQ ID NO: 497822 - DNA, 25 bp, Rattus norvegicus
gtctctgtaactagcttctgaataa

SEQ ID NO: 497823 - DNA, 25 bp, Rattus norvegicus
gtctctgtaacttgcttctgaataa

SEQ ID NO: 497824 - DNA, 25 bp, Rattus norvegicus
gtctctgtaagccataattttccta

SEQ ID NO: 497825 - DNA, 25 bp, Rattus norvegicus
gtctctgtaagcgataattttccta

SEQ ID NO: 497826 - DNA, 25 bp, Rattus norvegicus
gtctctgtcatccaggcggctcaag

SEQ ID NO: 497827 - DNA, 25 bp, Rattus norvegicus
gtctctgtcatccttgagtttcatg

SEQ ID NO: 497828 - DNA, 25 bp, Rattus norvegicus
gtctctgtcatcgaggcggctcaag

SEQ ID NO: 497829 - DNA, 25 bp, Rattus norvegicus
gtctctgtcatcgttgagtttcatg

SEQ ID NO: 497830 - DNA, 25 bp, Rattus norvegicus
gtctctgtccttagatggtaagcta

SEQ ID NO: 497831 - DNA, 25 bp, Rattus norvegicus
gtctctgtcctttgatggtaagcta

SEQ ID NO: 497832 - DNA, 25 bp, Rattus norvegicus
gtctctgtctccaagtctggtaaca

SEQ ID NO: 497833 - DNA, 25 bp, Rattus norvegicus
gtctctgtctcctagtctggtaaca

SEQ ID NO: 497834 - DNA, 25 bp, Rattus norvegicus
gtctctgtctctcgttatcaagata

SEQ ID NO: 497835 - DNA, 25 bp, Rattus norvegicus
gtctctgtctctggttatcaagata

SEQ ID NO: 497836 - DNA, 25 bp, Rattus norvegicus
gtctctgtcttgaatcttagcctag

SEQ ID NO: 497837 - DNA, 25 bp, Rattus norvegicus
gtctctgtcttgcaaggaacacctg

SEQ ID NO: 497838 - DNA, 25 bp, Rattus norvegicus
gtctctgtcttggaaggaacacctg

SEQ ID NO: 497839 - DNA, 25 bp, Rattus norvegicus
gtctctgtcttgtatcttagcctag

SEQ ID NO: 497840 - DNA, 25 bp, Rattus norvegicus
gtctctgtctttcctgggatctaag

SEQ ID NO: 497841 - DNA, 25 bp, Rattus norvegicus
gtctctgtctttgctgggatctaag

SEQ ID NO: 497842 - DNA, 25 bp, Rattus norvegicus
gtctctgtgactatttccattttga

SEQ ID NO: 497843 - DNA, 25 bp, Rattus norvegicus
gtctctgtgactttttccattttga

SEQ ID NO: 497844 - DNA, 25 bp, Rattus norvegicus
gtctctgtgagtacgtatgtgcatc

SEQ ID NO: 497845 - DNA, 25 bp, Rattus norvegicus
gtctctgtgagttcgtatgtgcatc

SEQ ID NO: 497846 - DNA, 25 bp, Rattus norvegicus
gtctctgtgattaacatccaactcc

SEQ ID NO: 497847 - DNA, 25 bp, Rattus norvegicus
gtctctgtgattcgcttccccaaaa

SEQ ID NO: 497848 - DNA, 25 bp, Rattus norvegicus
gtctctgtgattggcttccccaaaa

SEQ ID NO: 497849 - DNA, 25 bp, Rattus norvegicus
gtctctgtgatttacatccaactcc

SEQ ID NO: 497850 - DNA, 25 bp, Rattus norvegicus
gtctctgtgcaccactgcttctgga

SEQ ID NO: 497851 - DNA, 25 bp, Rattus norvegicus
gtctctgtgcacgactgcttctgga

SEQ ID NO: 497852 - DNA, 25 bp, Rattus norvegicus
gtctctgtgccaactgcagaaagtc

SEQ ID NO: 497853 - DNA, 25 bp, Rattus norvegicus
gtctctgtgccatctgcagaaagtc

SEQ ID NO: 497854 - DNA, 25 bp, Rattus norvegicus
gtctctgtggagacgataccacgct

SEQ ID NO: 497855 - DNA, 25 bp, Rattus norvegicus
gtctctgtggagtcgataccacgct

SEQ ID NO: 497856 - DNA, 25 bp, Rattus norvegicus
gtctctgtggccaaattagctttag

SEQ ID NO: 497857 - DNA, 25 bp, Rattus norvegicus
gtctctgtggcctaattagctttag

SEQ ID NO: 497858 - DNA, 25 bp, Rattus norvegicus
gtctctgtgggcactgattccttct

SEQ ID NO: 497859 - DNA, 25 bp, Rattus norvegicus
gtctctgtgggctctgattccttct

SEQ ID NO: 497860 - DNA, 25 bp, Rattus norvegicus
gtctctgtgtctcagatccaagaaa

SEQ ID NO: 497861 - DNA, 25 bp, Rattus norvegicus
gtctctgtgtctctatgacagcatg

SEQ ID NO: 497862 - DNA, 25 bp, Rattus norvegicus
gtctctgtgtctgagatccaagaaa

SEQ ID NO: 497863 - DNA, 25 bp, Rattus norvegicus
gtctctgtgtctgtatgacagcatg

SEQ ID NO: 497864 - DNA, 25 bp, Rattus norvegicus
gtctctgtgtgcatacctgtaaaac

SEQ ID NO: 497865 - DNA, 25 bp, Rattus norvegicus
gtctctgtgtgcttacctgtaaaac

SEQ ID NO: 497866 - DNA, 25 bp, Rattus norvegicus
gtctctgtgtgtaggccaggcgcct

SEQ ID NO: 497867 - DNA, 25 bp, Rattus norvegicus
gtctctgtgtgttggccaggcgcct

SEQ ID NO: 497868 - DNA, 25 bp, Rattus norvegicus
gtctctgtgttaaagcctgtgctca

SEQ ID NO: 497869 - DNA, 25 bp, Rattus norvegicus
gtctctgtgttatagcctgtgctca

SEQ ID NO: 497870 - DNA, 25 bp, Rattus norvegicus
gtctctgttcccaatcgttaaagtt

SEQ ID NO: 497871 - DNA, 25 bp, Rattus norvegicus
gtctctgttccctatcgttaaagtt

SEQ ID NO: 497872 - DNA, 25 bp, Rattus norvegicus
gtctctgttctaaactgtgctggcc

SEQ ID NO: 497873 - DNA, 25 bp, Rattus norvegicus
gtctctgttctatactgtgctggcc

SEQ ID NO: 497874 - DNA, 25 bp, Rattus norvegicus
gtctctgttcttcccactataaagg

SEQ ID NO: 497875 - DNA, 25 bp, Rattus norvegicus
gtctctgttcttgccactataaagg

SEQ ID NO: 497876 - DNA, 25 bp, Rattus norvegicus
gtctctgttgacatcacctgcagca

SEQ ID NO: 497877 - DNA, 25 bp, Rattus norvegicus
gtctctgttgacttcacctgcagca

SEQ ID NO: 497878 - DNA, 25 bp, Rattus norvegicus
gtctcttaaactatctgggatccct

SEQ ID NO: 497879 - DNA, 25 bp, Rattus norvegicus
gtctcttaaactttctgggatccct

SEQ ID NO: 497880 - DNA, 25 bp, Rattus norvegicus
gtctcttaacctagctgagccttaa

SEQ ID NO: 497881 - DNA, 25 bp, Rattus norvegicus
gtctcttaaccttgctgagccttaa

SEQ ID NO: 497882 - DNA, 25 bp, Rattus norvegicus
gtctcttaagagctgctgccctgaa

SEQ ID NO: 497883 - DNA, 25 bp, Rattus norvegicus
gtctcttaagaggtgctgccctgaa

SEQ ID NO: 497884 - DNA, 25 bp, Rattus norvegicus
gtctcttagagaagcccacactcat

SEQ ID NO: 497885 - DNA, 25 bp, Rattus norvegicus
gtctcttagagatgcccacactcat

SEQ ID NO: 497886 - DNA, 25 bp, Rattus norvegicus
gtctcttatgtgagtcagcgctcat

SEQ ID NO: 497887 - DNA, 25 bp, Rattus norvegicus
gtctcttatgtgtgtcagcgctcat

SEQ ID NO: 497888 - DNA, 25 bp, Rattus norvegicus
gtctcttatttaactgcccaaacaa

SEQ ID NO: 497889 - DNA, 25 bp, Rattus norvegicus
gtctcttatttatctgcccaaacaa

SEQ ID NO: 497890 - DNA, 25 bp, Rattus norvegicus
gtctcttcagtgaacttcctagttt

SEQ ID NO: 497891 - DNA, 25 bp, Rattus norvegicus
gtctcttcagtgtacttcctagttt

SEQ ID NO: 497892 - DNA, 25 bp, Rattus norvegicus
gtctcttcatagcagtagaacccct

SEQ ID NO: 497893 - DNA, 25 bp, Rattus norvegicus
gtctcttcataggagtagaacccct

SEQ ID NO: 497894 - DNA, 25 bp, Rattus norvegicus
gtctcttccagcagttttcagggag

SEQ ID NO: 497895 - DNA, 25 bp, Rattus norvegicus
gtctcttccagctgttttcagggag

SEQ ID NO: 497896 - DNA, 25 bp, Rattus norvegicus
gtctcttcctttataactgctgagg

SEQ ID NO: 497897 - DNA, 25 bp, Rattus norvegicus
gtctcttcctttttaactgctgagg

SEQ ID NO: 497898 - DNA, 25 bp, Rattus norvegicus
gtctcttcggtcatgtattatatct

SEQ ID NO: 497899 - DNA, 25 bp, Rattus norvegicus
gtctcttcggtcttgtattatatct

SEQ ID NO: 497900 - DNA, 25 bp, Rattus norvegicus
gtctcttctctgcttattcaacagt

SEQ ID NO: 497901 - DNA, 25 bp, Rattus norvegicus
gtctcttctctggttattcaacagt

SEQ ID NO: 497902 - DNA, 25 bp, Rattus norvegicus
gtctcttctcttaaactgctatcat

SEQ ID NO: 497903 - DNA, 25 bp, Rattus norvegicus
gtctcttctctttaactgctatcat

SEQ ID NO: 497904 - DNA, 25 bp, Rattus norvegicus
gtctcttctgacatttacattcttt

SEQ ID NO: 497905 - DNA, 25 bp, Rattus norvegicus
gtctcttctgacttttacattcttt

SEQ ID NO: 497906 - DNA, 25 bp, Rattus norvegicus
gtctcttctgtaatactttgtaact

SEQ ID NO: 497907 - DNA, 25 bp, Rattus norvegicus
gtctcttctgtattactttgtaact

SEQ ID NO: 497908 - DNA, 25 bp, Rattus norvegicus
gtctcttcttgaatccatctgtaga

SEQ ID NO: 497909 - DNA, 25 bp, Rattus norvegicus
gtctcttcttgattccatctgtaga

SEQ ID NO: 497910 - DNA, 25 bp, Rattus norvegicus
gtctcttctttcattgctcttgaga

SEQ ID NO: 497911 - DNA, 25 bp, Rattus norvegicus
gtctcttctttctttgctcttgaga

SEQ ID NO: 497912 - DNA, 25 bp, Rattus norvegicus
gtctcttgacaaagagcatttgcct

SEQ ID NO: 497913 - DNA, 25 bp, Rattus norvegicus
gtctcttgacaatgagcatttgcct

SEQ ID NO: 497914 - DNA, 25 bp, Rattus norvegicus
gtctcttgactgcaggtttggctca

SEQ ID NO: 497915 - DNA, 25 bp, Rattus norvegicus
gtctcttgactggaggtttggctca

SEQ ID NO: 497916 - DNA, 25 bp, Rattus norvegicus
gtctcttgagacagtgcagccagaa

SEQ ID NO: 497917 - DNA, 25 bp, Rattus norvegicus
gtctcttgagactgtgcagccagaa

SEQ ID NO: 497918 - DNA, 25 bp, Rattus norvegicus
gtctcttgcaaactattgggccttg

SEQ ID NO: 497919 - DNA, 25 bp, Rattus norvegicus
gtctcttgcaaagtattgggccttg

SEQ ID NO: 497920 - DNA, 25 bp, Rattus norvegicus
gtctcttgccaactgcctagaaagg

SEQ ID NO: 497921 - DNA, 25 bp, Rattus norvegicus
gtctcttgccaagtgcctagaaagg

SEQ ID NO: 497922 - DNA, 25 bp, Rattus norvegicus
gtctcttgccttaggaccctagcaa

SEQ ID NO: 497923 - DNA, 25 bp, Rattus norvegicus
gtctcttgcctttggaccctagcaa

SEQ ID NO: 497924 - DNA, 25 bp, Rattus norvegicus
gtctcttgctagaccatcaggttta

SEQ ID NO: 497925 - DNA, 25 bp, Rattus norvegicus
gtctcttgctagtccatcaggttta

SEQ ID NO: 497926 - DNA, 25 bp, Rattus norvegicus
gtctcttgctccagaacttcaatag

SEQ ID NO: 497927 - DNA, 25 bp, Rattus norvegicus
gtctcttgctcctgaacttcaatag

SEQ ID NO: 497928 - DNA, 25 bp, Rattus norvegicus
gtctcttggaacagtgacacacaaa

SEQ ID NO: 497929 - DNA, 25 bp, Rattus norvegicus
gtctcttggaactgtgacacacaaa

SEQ ID NO: 497930 - DNA, 25 bp, Rattus norvegicus
gtctcttggactatcctgatagcat

SEQ ID NO: 497931 - DNA, 25 bp, Rattus norvegicus
gtctcttggactttcctgatagcat

SEQ ID NO: 497932 - DNA, 25 bp, Rattus norvegicus
gtctcttggccgcaagttaccagac

SEQ ID NO: 497933 - DNA, 25 bp, Rattus norvegicus
gtctcttggccggaagttaccagac

SEQ ID NO: 497934 - DNA, 25 bp, Rattus norvegicus
gtctcttggctgctcatgtgtttgg

SEQ ID NO: 497935 - DNA, 25 bp, Rattus norvegicus
gtctcttggctggtcatgtgtttgg

SEQ ID NO: 497936 - DNA, 25 bp, Rattus norvegicus
gtctcttgggacaactagggctaca

SEQ ID NO: 497937 - DNA, 25 bp, Rattus norvegicus
gtctcttgggactactagggctaca

SEQ ID NO: 497938 - DNA, 25 bp, Rattus norvegicus
gtctcttgggcaacagggcttgtaa

SEQ ID NO: 497939 - DNA, 25 bp, Rattus norvegicus
gtctcttgggcatcagggcttgtaa

SEQ ID NO: 497940 - DNA, 25 bp, Rattus norvegicus
gtctcttggtacagtgttgttgttc

SEQ ID NO: 497941 - DNA, 25 bp, Rattus norvegicus
gtctcttggtactgtgttgttgttc

SEQ ID NO: 497942 - DNA, 25 bp, Rattus norvegicus
gtctcttggtctctaattccaaaac

SEQ ID NO: 497943 - DNA, 25 bp, Rattus norvegicus
gtctcttggtctgtaattccaaaac

SEQ ID NO: 497944 - DNA, 25 bp, Rattus norvegicus
gtctcttgtagacactagcatttta

SEQ ID NO: 497945 - DNA, 25 bp, Rattus norvegicus
gtctcttgtagagactagcatttta

SEQ ID NO: 497946 - DNA, 25 bp, Rattus norvegicus
gtctcttgtagcaggtaaacacgtt

SEQ ID NO: 497947 - DNA, 25 bp, Rattus norvegicus
gtctcttgtagctggtaaacacgtt

SEQ ID NO: 497948 - DNA, 25 bp, Rattus norvegicus
gtctcttgtgctcatccactgtata

SEQ ID NO: 497949 - DNA, 25 bp, Rattus norvegicus
gtctcttgtgctgatccactgtata

SEQ ID NO: 497950 - DNA, 25 bp, Rattus norvegicus
gtctcttgttttcgattatttgtta

SEQ ID NO: 497951 - DNA, 25 bp, Rattus norvegicus
gtctcttgttttggattatttgtta

SEQ ID NO: 497952 - DNA, 25 bp, Rattus norvegicus
gtctctttaattcagtgccagcttg

SEQ ID NO: 497953 - DNA, 25 bp, Rattus norvegicus
gtctctttaattgagtgccagcttg

SEQ ID NO: 497954 - DNA, 25 bp, Rattus norvegicus
gtctctttagaccactcatttctat

SEQ ID NO: 497955 - DNA, 25 bp, Rattus norvegicus
gtctctttagacgactcatttctat

SEQ ID NO: 497956 - DNA, 25 bp, Rattus norvegicus
gtctctttagctactgtgacttgga

SEQ ID NO: 497957 - DNA, 25 bp, Rattus norvegicus
gtctctttagcttctgtgacttgga

SEQ ID NO: 497958 - DNA, 25 bp, Rattus norvegicus
gtctctttcatcatcatcaacacaa

SEQ ID NO: 497959 - DNA, 25 bp, Rattus norvegicus
gtctctttcatcttcatcaacacaa

SEQ ID NO: 497960 - DNA, 25 bp, Rattus norvegicus
gtctctttcatgagttgcttctaga

SEQ ID NO: 497961 - DNA, 25 bp, Rattus norvegicus
gtctctttcatgtgttgcttctaga

SEQ ID NO: 497962 - DNA, 25 bp, Rattus norvegicus
gtctctttcggaaggagttggaatc

SEQ ID NO: 497963 - DNA, 25 bp, Rattus norvegicus
gtctctttcggatggagttggaatc

SEQ ID NO: 497964 - DNA, 25 bp, Rattus norvegicus
gtctctttcttcatctagctctgaa

SEQ ID NO: 497965 - DNA, 25 bp, Rattus norvegicus
gtctctttcttcttctagctctgaa

SEQ ID NO: 497966 - DNA, 25 bp, Rattus norvegicus
gtctctttggctacagtcattcagt

SEQ ID NO: 497967 - DNA, 25 bp, Rattus norvegicus
gtctctttggcttcagtcattcagt

SEQ ID NO: 497968 - DNA, 25 bp, Rattus norvegicus
gtctcttttcctaacacgtatagca

SEQ ID NO: 497969 - DNA, 25 bp, Rattus norvegicus
gtctcttttccttacacgtatagca

SEQ ID NO: 497970 - DNA, 25 bp, Rattus norvegicus
gtctcttttcttattcattcactag

SEQ ID NO: 497971 - DNA, 25 bp, Rattus norvegicus
gtctcttttctttttcattcactag

SEQ ID NO: 497972 - DNA, 25 bp, Rattus norvegicus
gtctgaaaaaagaattccaggtcag

SEQ ID NO: 497973 - DNA, 25 bp, Rattus norvegicus
gtctgaaaaaagtattccaggtcag

SEQ ID NO: 497974 - DNA, 25 bp, Rattus norvegicus
gtctgaaacagactccatgaaatca

SEQ ID NO: 497975 - DNA, 25 bp, Rattus norvegicus
gtctgaaacagagtccatgaaatca

SEQ ID NO: 497976 - DNA, 25 bp, Rattus norvegicus
gtctgaaacgcacgtcccagaaggt

SEQ ID NO: 497977 - DNA, 25 bp, Rattus norvegicus
gtctgaaacgcaggtcccagaaggt

SEQ ID NO: 497978 - DNA, 25 bp, Rattus norvegicus
gtctgaaacgtcaccttggtatttt

SEQ ID NO: 497979 - DNA, 25 bp, Rattus norvegicus
gtctgaaacgtctccttggtatttt

SEQ ID NO: 497980 - DNA, 25 bp, Rattus norvegicus
gtctgaaagagaaaccctacccaca

SEQ ID NO: 497981 - DNA, 25 bp, Rattus norvegicus
gtctgaaagagataccctacccaca

SEQ ID NO: 497982 - DNA, 25 bp, Rattus norvegicus
gtctgaaaggtcaacatattccatg

SEQ ID NO: 497983 - DNA, 25 bp, Rattus norvegicus
gtctgaaaggtctacatattccatg

SEQ ID NO: 497984 - DNA, 25 bp, Rattus norvegicus
gtctgaaagtgtaggttctcttgga

SEQ ID NO: 497985 - DNA, 25 bp, Rattus norvegicus
gtctgaaagtgttggttctcttgga

SEQ ID NO: 497986 - DNA, 25 bp, Rattus norvegicus
gtctgaaatgcgaggctgtaatgcc

SEQ ID NO: 497987 - DNA, 25 bp, Rattus norvegicus
gtctgaaatgcgtggctgtaatgcc

SEQ ID NO: 497988 - DNA, 25 bp, Rattus norvegicus
gtctgaaattacagggcatctaata

SEQ ID NO: 497989 - DNA, 25 bp, Rattus norvegicus
gtctgaaattactgggcatctaata

SEQ ID NO: 497990 - DNA, 25 bp, Rattus norvegicus
gtctgaacactcctttgtgtgtccc

SEQ ID NO: 497991 - DNA, 25 bp, Rattus norvegicus
gtctgaacactcgtttgtgtgtccc

SEQ ID NO: 497992 - DNA, 25 bp, Rattus norvegicus
gtctgaacatagagtccaaggctca

SEQ ID NO: 497993 - DNA, 25 bp, Rattus norvegicus
gtctgaacatagtgtccaaggctca

SEQ ID NO: 497994 - DNA, 25 bp, Rattus norvegicus
gtctgaaccagacttggttgggttt

SEQ ID NO: 497995 - DNA, 25 bp, Rattus norvegicus
gtctgaaccagagttggttgggttt

SEQ ID NO: 497996 - DNA, 25 bp, Rattus norvegicus
gtctgaacgtggcaaagctccttaa

SEQ ID NO: 497997 - DNA, 25 bp, Rattus norvegicus
gtctgaacgtgggaaagctccttaa

SEQ ID NO: 497998 - DNA, 25 bp, Rattus norvegicus
gtctgaactctgactgaacctagat

SEQ ID NO: 497999 - DNA, 25 bp, Rattus norvegicus
gtctgaactctgatgtttttaacct

SEQ ID NO: 498000 - DNA, 25 bp, Rattus norvegicus
gtctgaactctgtctgaacctagat

SEQ ID NO: 498001 - DNA, 25 bp, Rattus norvegicus
gtctgaactctgttgtttttaacct

SEQ ID NO: 498002 - DNA, 25 bp, Rattus norvegicus
gtctgaactgacatgaatctgaatc

SEQ ID NO: 498003 - DNA, 25 bp, Rattus norvegicus
gtctgaactgacttgaatctgaatc

SEQ ID NO: 498004 - DNA, 25 bp, Rattus norvegicus
gtctgaactggaagctgcccaaatg

SEQ ID NO: 498005 - DNA, 25 bp, Rattus norvegicus
gtctgaactggatgctgcccaaatg

SEQ ID NO: 498006 - DNA, 25 bp, Rattus norvegicus
gtctgaagaactaaacggagcctgt

SEQ ID NO: 498007 - DNA, 25 bp, Rattus norvegicus
gtctgaagaacttaacggagcctgt

SEQ ID NO: 498008 - DNA, 25 bp, Rattus norvegicus
gtctgaagatccaacagtcctacaa

SEQ ID NO: 498009 - DNA, 25 bp, Rattus norvegicus
gtctgaagatcctacagtcctacaa

SEQ ID NO: 498010 - DNA, 25 bp, Rattus norvegicus
gtctgaagattccaccaaagccctg

SEQ ID NO: 498011 - DNA, 25 bp, Rattus norvegicus
gtctgaagattcgaccaaagccctg

SEQ ID NO: 498012 - DNA, 25 bp, Rattus norvegicus
gtctgaagcaacaatcggtctgcat

SEQ ID NO: 498013 - DNA, 25 bp, Rattus norvegicus
gtctgaagcaactatcggtctgcat

SEQ ID NO: 498014 - DNA, 25 bp, Rattus norvegicus
gtctgaagcagcacagggtccgcca

SEQ ID NO: 498015 - DNA, 25 bp, Rattus norvegicus
gtctgaagcagctcagggtccgcca

SEQ ID NO: 498016 - DNA, 25 bp, Rattus norvegicus
gtctgaagcatcatctgagcaactg

SEQ ID NO: 498017 - DNA, 25 bp, Rattus norvegicus
gtctgaagcatcttctgagcaactg

SEQ ID NO: 498018 - DNA, 25 bp, Rattus norvegicus
gtctgaagctcacgtttttcccaac

SEQ ID NO: 498019 - DNA, 25 bp, Rattus norvegicus
gtctgaagctcaggtttttcccaac

SEQ ID NO: 498020 - DNA, 25 bp, Rattus norvegicus
gtctgaagctgacggataacttcca

SEQ ID NO: 498021 - DNA, 25 bp, Rattus norvegicus
gtctgaagctgagggataacttcca

SEQ ID NO: 498022 - DNA, 25 bp, Rattus norvegicus
gtctgaagctggacacacggcggca

SEQ ID NO: 498023 - DNA, 25 bp, Rattus norvegicus
gtctgaagctggtcacacggcggca

SEQ ID NO: 498024 - DNA, 25 bp, Rattus norvegicus
gtctgaaggccaacaccaacgaagt

SEQ ID NO: 498025 - DNA, 25 bp, Rattus norvegicus
gtctgaaggccatcaccaacgaagt

SEQ ID NO: 498026 - DNA, 25 bp, Rattus norvegicus
gtctgaaggctccaacagcgacatg

SEQ ID NO: 498027 - DNA, 25 bp, Rattus norvegicus
gtctgaaggctcgaacagcgacatg

SEQ ID NO: 498028 - DNA, 25 bp, Rattus norvegicus
gtctgaagtgacactgatctggaaa

SEQ ID NO: 498029 - DNA, 25 bp, Rattus norvegicus
gtctgaagtgactctgatctggaaa

SEQ ID NO: 498030 - DNA, 25 bp, Rattus norvegicus
gtctgaatcatgatttcctggctgt

SEQ ID NO: 498031 - DNA, 25 bp, Rattus norvegicus
gtctgaatcatgttttcctggctgt

SEQ ID NO: 498032 - DNA, 25 bp, Rattus norvegicus
gtctgaatctcccacaaaacactag

SEQ ID NO: 498033 - DNA, 25 bp, Rattus norvegicus
gtctgaatctccgacaaaacactag

SEQ ID NO: 498034 - DNA, 25 bp, Rattus norvegicus
gtctgaatgaccctgcgtgccttgt

SEQ ID NO: 498035 - DNA, 25 bp, Rattus norvegicus
gtctgaatgaccgtgcgtgccttgt

SEQ ID NO: 498036 - DNA, 25 bp, Rattus norvegicus
gtctgaatgcagagcctacatcaca

SEQ ID NO: 498037 - DNA, 25 bp, Rattus norvegicus
gtctgaatgcagtgcctacatcaca

SEQ ID NO: 498038 - DNA, 25 bp, Rattus norvegicus
gtctgaattgaacatcccaatctca

SEQ ID NO: 498039 - DNA, 25 bp, Rattus norvegicus
gtctgaattgaagatcccaatctca

SEQ ID NO: 498040 - DNA, 25 bp, Rattus norvegicus
gtctgaattgttccagttgctgctg

SEQ ID NO: 498041 - DNA, 25 bp, Rattus norvegicus
gtctgaattgttgcagttgctgctg

SEQ ID NO: 498042 - DNA, 25 bp, Rattus norvegicus
gtctgaatttctaggatctagcaat

SEQ ID NO: 498043 - DNA, 25 bp, Rattus norvegicus
gtctgaatttcttggatctagcaat

SEQ ID NO: 498044 - DNA, 25 bp, Rattus norvegicus
gtctgacaatacctagtgaacccca

SEQ ID NO: 498045 - DNA, 25 bp, Rattus norvegicus
gtctgacaatacgtagtgaacccca

SEQ ID NO: 498046 - DNA, 25 bp, Rattus norvegicus
gtctgacacctcagtgggctgacta

SEQ ID NO: 498047 - DNA, 25 bp, Rattus norvegicus
gtctgacacctctgtgggctgacta

SEQ ID NO: 498048 - DNA, 25 bp, Rattus norvegicus
gtctgacaggaaagccacttcccta

SEQ ID NO: 498049 - DNA, 25 bp, Rattus norvegicus
gtctgacaggaatgccacttcccta

SEQ ID NO: 498050 - DNA, 25 bp, Rattus norvegicus
gtctgacatctaaaacatacctggc

SEQ ID NO: 498051 - DNA, 25 bp, Rattus norvegicus
gtctgacatctataacatacctggc

SEQ ID NO: 498052 - DNA, 25 bp, Rattus norvegicus
gtctgacatctgaggcagaagtttt

SEQ ID NO: 498053 - DNA, 25 bp, Rattus norvegicus
gtctgacatctgtggcagaagtttt

SEQ ID NO: 498054 - DNA, 25 bp, Rattus norvegicus
gtctgacatggccagtggctttcat

SEQ ID NO: 498055 - DNA, 25 bp, Rattus norvegicus
gtctgacatggcgagtggctttcat

SEQ ID NO: 498056 - DNA, 25 bp, Rattus norvegicus
gtctgacattgacttgtgtttgaca

SEQ ID NO: 498057 - DNA, 25 bp, Rattus norvegicus
gtctgacattgagttgtgtttgaca

SEQ ID NO: 498058 - DNA, 25 bp, Rattus norvegicus
gtctgacattttcactctgggaaga

SEQ ID NO: 498059 - DNA, 25 bp, Rattus norvegicus
gtctgacattttgactctgggaaga

SEQ ID NO: 498060 - DNA, 25 bp, Rattus norvegicus
gtctgaccagagcaaggagcaccct

SEQ ID NO: 498061 - DNA, 25 bp, Rattus norvegicus
gtctgaccagaggaaggagcaccct

SEQ ID NO: 498062 - DNA, 25 bp, Rattus norvegicus
gtctgaccggatactcattgggagg

SEQ ID NO: 498063 - DNA, 25 bp, Rattus norvegicus
gtctgaccggattctcattgggagg

SEQ ID NO: 498064 - DNA, 25 bp, Rattus norvegicus
gtctgacctcagaagctattaaata

SEQ ID NO: 498065 - DNA, 25 bp, Rattus norvegicus
gtctgacctcagtagctattaaata

SEQ ID NO: 498066 - DNA, 25 bp, Rattus norvegicus
gtctgacctctaactctctatatag

SEQ ID NO: 498067 - DNA, 25 bp, Rattus norvegicus
gtctgacctctatctctctatatag

SEQ ID NO: 498068 - DNA, 25 bp, Rattus norvegicus
gtctgacctggcataactcttaaac

SEQ ID NO: 498069 - DNA, 25 bp, Rattus norvegicus
gtctgacctggcttaactcttaaac

SEQ ID NO: 498070 - DNA, 25 bp, Rattus norvegicus
gtctgaccttaaccttatcatgata

SEQ ID NO: 498071 - DNA, 25 bp, Rattus norvegicus
gtctgaccttaagcttatcatgata

SEQ ID NO: 498072 - DNA, 25 bp, Rattus norvegicus
gtctgacggtctcggatttttaggt

SEQ ID NO: 498073 - DNA, 25 bp, Rattus norvegicus
gtctgacggtctgggatttttaggt

SEQ ID NO: 498074 - DNA, 25 bp, Rattus norvegicus
gtctgactcagcactttaatctgca

SEQ ID NO: 498075 - DNA, 25 bp, Rattus norvegicus
gtctgactcagctctttaatctgca

SEQ ID NO: 498076 - DNA, 25 bp, Rattus norvegicus
gtctgactccttcttgggactctac

SEQ ID NO: 498077 - DNA, 25 bp, Rattus norvegicus
gtctgactccttgttgggactctac

SEQ ID NO: 498078 - DNA, 25 bp, Rattus norvegicus
gtctgactctggctgcacaatgtta

SEQ ID NO: 498079 - DNA, 25 bp, Rattus norvegicus
gtctgactctgggtgcacaatgtta

SEQ ID NO: 498080 - DNA, 25 bp, Rattus norvegicus
gtctgactctttatgtatataccgg

SEQ ID NO: 498081 - DNA, 25 bp, Rattus norvegicus
gtctgactctttttgtatataccgg

SEQ ID NO: 498082 - DNA, 25 bp, Rattus norvegicus
gtctgactgcacagagcgcctctgt

SEQ ID NO: 498083 - DNA, 25 bp, Rattus norvegicus
gtctgactgcactgagcgcctctgt

SEQ ID NO: 498084 - DNA, 25 bp, Rattus norvegicus
gtctgactgtacatcgtggaaaagc

SEQ ID NO: 498085 - DNA, 25 bp, Rattus norvegicus
gtctgactgtacttcgtggaaaagc

SEQ ID NO: 498086 - DNA, 25 bp, Rattus norvegicus
gtctgactgtctcagtttgggcaaa

SEQ ID NO: 498087 - DNA, 25 bp, Rattus norvegicus
gtctgactgtctgagtttgggcaaa

SEQ ID NO: 498088 - DNA, 25 bp, Rattus norvegicus
gtctgacttcctactcagtcattat

SEQ ID NO: 498089 - DNA, 25 bp, Rattus norvegicus
gtctgacttccttctcagtcattat

SEQ ID NO: 498090 - DNA, 25 bp, Rattus norvegicus
gtctgacttgttcagtctgcttatt

SEQ ID NO: 498091 - DNA, 25 bp, Rattus norvegicus
gtctgacttgttgagtctgcttatt

SEQ ID NO: 498092 - DNA, 25 bp, Rattus norvegicus
gtctgactttaaacctctgtgctgt

SEQ ID NO: 498093 - DNA, 25 bp, Rattus norvegicus
gtctgactttaatcctctgtgctgt

SEQ ID NO: 498094 - DNA, 25 bp, Rattus norvegicus
gtctgagaaattccagcgcttcacg

SEQ ID NO: 498095 - DNA, 25 bp, Rattus norvegicus
gtctgagaaattgcagcgcttcacg

SEQ ID NO: 498096 - DNA, 25 bp, Rattus norvegicus
gtctgagaacaccaaggcttgcaca

SEQ ID NO: 498097 - DNA, 25 bp, Rattus norvegicus
gtctgagaacacctatcctgttgtt

SEQ ID NO: 498098 - DNA, 25 bp, Rattus norvegicus
gtctgagaacacgaaggcttgcaca

SEQ ID NO: 498099 - DNA, 25 bp, Rattus norvegicus
gtctgagaacacgtatcctgttgtt

SEQ ID NO: 498100 - DNA, 25 bp, Rattus norvegicus
gtctgagaacctacccccttctaat

SEQ ID NO: 498101 - DNA, 25 bp, Rattus norvegicus
gtctgagaaccttcccccttctaat

SEQ ID NO: 498102 - DNA, 25 bp, Rattus norvegicus
gtctgagaagctatcctgtagcaac

SEQ ID NO: 498103 - DNA, 25 bp, Rattus norvegicus
gtctgagaagctttcctgtagcaac

SEQ ID NO: 498104 - DNA, 25 bp, Rattus norvegicus
gtctgagacatcaggaagctttgaa

SEQ ID NO: 498105 - DNA, 25 bp, Rattus norvegicus
gtctgagacatctggaagctttgaa

SEQ ID NO: 498106 - DNA, 25 bp, Rattus norvegicus
gtctgagacctgctctacatggtga

SEQ ID NO: 498107 - DNA, 25 bp, Rattus norvegicus
gtctgagacctggtctacatggtga

SEQ ID NO: 498108 - DNA, 25 bp, Rattus norvegicus
gtctgagaccttatcctggagagaa

SEQ ID NO: 498109 - DNA, 25 bp, Rattus norvegicus
gtctgagaccttttcctggagagaa

SEQ ID NO: 498110 - DNA, 25 bp, Rattus norvegicus
gtctgagagaagcagtcctcccaag

SEQ ID NO: 498111 - DNA, 25 bp, Rattus norvegicus
gtctgagagaaggagtcctcccaag

SEQ ID NO: 498112 - DNA, 25 bp, Rattus norvegicus
gtctgagagatgagtccttgaacca

SEQ ID NO: 498113 - DNA, 25 bp, Rattus norvegicus
gtctgagagatgtgtccttgaacca

SEQ ID NO: 498114 - DNA, 25 bp, Rattus norvegicus
gtctgagagcctcagaacctacacc

SEQ ID NO: 498115 - DNA, 25 bp, Rattus norvegicus
gtctgagagcctgagaacctacacc

SEQ ID NO: 498116 - DNA, 25 bp, Rattus norvegicus
gtctgagatggaccccacgtgactc

SEQ ID NO: 498117 - DNA, 25 bp, Rattus norvegicus
gtctgagatggagcccacgtgactc

SEQ ID NO: 498118 - DNA, 25 bp, Rattus norvegicus
gtctgagatggcctgtgagacctca

SEQ ID NO: 498119 - DNA, 25 bp, Rattus norvegicus
gtctgagatggcgtgtgagacctca

SEQ ID NO: 498120 - DNA, 25 bp, Rattus norvegicus
gtctgagattctacgctttgttcac

SEQ ID NO: 498121 - DNA, 25 bp, Rattus norvegicus
gtctgagattcttcgctttgttcac

SEQ ID NO: 498122 - DNA, 25 bp, Rattus norvegicus
gtctgagcacagcaccacaggtgta

SEQ ID NO: 498123 - DNA, 25 bp, Rattus norvegicus
gtctgagcacaggaccacaggtgta

SEQ ID NO: 498124 - DNA, 25 bp, Rattus norvegicus
gtctgagccctgcaactgttttgga

SEQ ID NO: 498125 - DNA, 25 bp, Rattus norvegicus
gtctgagccctggaactgttttgga

SEQ ID NO: 498126 - DNA, 25 bp, Rattus norvegicus
gtctgagctgagatctcccaaggtt

SEQ ID NO: 498127 - DNA, 25 bp, Rattus norvegicus
gtctgagctgagttctcccaaggtt

SEQ ID NO: 498128 - DNA, 25 bp, Rattus norvegicus
gtctgagcttccagtcttccttggg

SEQ ID NO: 498129 - DNA, 25 bp, Rattus norvegicus
gtctgagcttcctgtcttccttggg

SEQ ID NO: 498130 - DNA, 25 bp, Rattus norvegicus
gtctgaggcccaaggatcaatttat

SEQ ID NO: 498131 - DNA, 25 bp, Rattus norvegicus
gtctgaggcccatggatcaatttat

SEQ ID NO: 498132 - DNA, 25 bp, Rattus norvegicus
gtctgaggccttaaatgtcatctgt

SEQ ID NO: 498133 - DNA, 25 bp, Rattus norvegicus
gtctgaggcctttaatgtcatctgt

SEQ ID NO: 498134 - DNA, 25 bp, Rattus norvegicus
gtctgagggcaacaactctgttaaa

SEQ ID NO: 498135 - DNA, 25 bp, Rattus norvegicus
gtctgagggcaagaactctgttaaa

SEQ ID NO: 498136 - DNA, 25 bp, Rattus norvegicus
gtctgaggtcacctgagtctaatga

SEQ ID NO: 498137 - DNA, 25 bp, Rattus norvegicus
gtctgaggtcacgtgagtctaatga

SEQ ID NO: 498138 - DNA, 25 bp, Rattus norvegicus
gtctgaggtctgcatgtgatgaaca

SEQ ID NO: 498139 - DNA, 25 bp, Rattus norvegicus
gtctgaggtctggatgtgatgaaca

SEQ ID NO: 498140 - DNA, 25 bp, Rattus norvegicus
gtctgaggtgtcaaattaccccttt

SEQ ID NO: 498141 - DNA, 25 bp, Rattus norvegicus
gtctgaggtgtctaattaccccttt

SEQ ID NO: 498142 - DNA, 25 bp, Rattus norvegicus
gtctgaggtttcatcacttgctttc

SEQ ID NO: 498143 - DNA, 25 bp, Rattus norvegicus
gtctgaggtttcttcacttgctttc

SEQ ID NO: 498144 - DNA, 25 bp, Rattus norvegicus
gtctgagtactcagtgggaatgtct

SEQ ID NO: 498145 - DNA, 25 bp, Rattus norvegicus
gtctgagtactctgtgggaatgtct

SEQ ID NO: 498146 - DNA, 25 bp, Rattus norvegicus
gtctgagtacttaagtgcagtgaaa

SEQ ID NO: 498147 - DNA, 25 bp, Rattus norvegicus
gtctgagtactttagtgcagtgaaa

SEQ ID NO: 498148 - DNA, 25 bp, Rattus norvegicus
gtctgagtagtcattctttttcctt

SEQ ID NO: 498149 - DNA, 25 bp, Rattus norvegicus
gtctgagtagtctttctttttcctt

SEQ ID NO: 498150 - DNA, 25 bp, Rattus norvegicus
gtctgagtcaccagtaccagtgaga

SEQ ID NO: 498151 - DNA, 25 bp, Rattus norvegicus
gtctgagtcacctgtaccagtgaga

SEQ ID NO: 498152 - DNA, 25 bp, Rattus norvegicus
gtctgagtccctactggaagcaaat

SEQ ID NO: 498153 - DNA, 25 bp, Rattus norvegicus
gtctgagtcccttctggaagcaaat

SEQ ID NO: 498154 - DNA, 25 bp, Rattus norvegicus
gtctgagtctcaattctttaccaag

SEQ ID NO: 498155 - DNA, 25 bp, Rattus norvegicus
gtctgagtctcatttctttaccaag

SEQ ID NO: 498156 - DNA, 25 bp, Rattus norvegicus
gtctgagtcttacttctgggagctt

SEQ ID NO: 498157 - DNA, 25 bp, Rattus norvegicus
gtctgagtcttagttctgggagctt

SEQ ID NO: 498158 - DNA, 25 bp, Rattus norvegicus
gtctgagtcttcagacatcatgtcc

SEQ ID NO: 498159 - DNA, 25 bp, Rattus norvegicus
gtctgagtcttctgacatcatgtcc

SEQ ID NO: 498160 - DNA, 25 bp, Rattus norvegicus
gtctgagtcttgcaaaacaccccaa

SEQ ID NO: 498161 - DNA, 25 bp, Rattus norvegicus
gtctgagtcttggaaaacaccccaa

SEQ ID NO: 498162 - DNA, 25 bp, Rattus norvegicus
gtctgagtgcacagctactggaata

SEQ ID NO: 498163 - DNA, 25 bp, Rattus norvegicus
gtctgagtgcactgctactggaata

SEQ ID NO: 498164 - DNA, 25 bp, Rattus norvegicus
gtctgagtgctaacccagctgatag

SEQ ID NO: 498165 - DNA, 25 bp, Rattus norvegicus
gtctgagtgctatcccagctgatag

SEQ ID NO: 498166 - DNA, 25 bp, Rattus norvegicus
gtctgagtggcactttacacatttt

SEQ ID NO: 498167 - DNA, 25 bp, Rattus norvegicus
gtctgagtggcagtttacacatttt

SEQ ID NO: 498168 - DNA, 25 bp, Rattus norvegicus
gtctgagtgtgtctgcggattcttc

SEQ ID NO: 498169 - DNA, 25 bp, Rattus norvegicus
gtctgagtgtgtgtgcggattcttc

SEQ ID NO: 498170 - DNA, 25 bp, Rattus norvegicus
gtctgagtgttaattggcccattta

SEQ ID NO: 498171 - DNA, 25 bp, Rattus norvegicus
gtctgagtgttatttggcccattta

SEQ ID NO: 498172 - DNA, 25 bp, Rattus norvegicus
gtctgagttcaaagcaagagtgcca

SEQ ID NO: 498173 - DNA, 25 bp, Rattus norvegicus
gtctgagttcaatgcaagagtgcca

SEQ ID NO: 498174 - DNA, 25 bp, Rattus norvegicus
gtctgagttccgaaagccaagcttg

SEQ ID NO: 498175 - DNA, 25 bp, Rattus norvegicus
gtctgagttccgtaagccaagcttg

SEQ ID NO: 498176 - DNA, 25 bp, Rattus norvegicus
gtctgagttcttcacattgtcttac

SEQ ID NO: 498177 - DNA, 25 bp, Rattus norvegicus
gtctgagttcttgacattgtcttac

SEQ ID NO: 498178 - DNA, 25 bp, Rattus norvegicus
gtctgataccaaatttacctaaagt

SEQ ID NO: 498179 - DNA, 25 bp, Rattus norvegicus
gtctgataccaattttacctaaagt

SEQ ID NO: 498180 - DNA, 25 bp, Rattus norvegicus
gtctgatagactagacctgtctcct

SEQ ID NO: 498181 - DNA, 25 bp, Rattus norvegicus
gtctgatagacttgacctgtctcct

SEQ ID NO: 498182 - DNA, 25 bp, Rattus norvegicus
gtctgatagtgtcctttcctaagct

SEQ ID NO: 498183 - DNA, 25 bp, Rattus norvegicus
gtctgatagtgtgctttcctaagct

SEQ ID NO: 498184 - DNA, 25 bp, Rattus norvegicus
gtctgatattatatattgcaccaat

SEQ ID NO: 498185 - DNA, 25 bp, Rattus norvegicus
gtctgatattatttattgcaccaat

SEQ ID NO: 498186 - DNA, 25 bp, Rattus norvegicus
gtctgatcataactaatccctccca

SEQ ID NO: 498187 - DNA, 25 bp, Rattus norvegicus
gtctgatcataagtaatccctccca

SEQ ID NO: 498188 - DNA, 25 bp, Rattus norvegicus
gtctgatcatctcaaagcctgtttc

SEQ ID NO: 498189 - DNA, 25 bp, Rattus norvegicus
gtctgatcatctgaaagcctgtttc

SEQ ID NO: 498190 - DNA, 25 bp, Rattus norvegicus
gtctgatcatttagtagtggcttcc

SEQ ID NO: 498191 - DNA, 25 bp, Rattus norvegicus
gtctgatcattttgtagtggcttcc

SEQ ID NO: 498192 - DNA, 25 bp, Rattus norvegicus
gtctgatccaatacttgcaggaccg

SEQ ID NO: 498193 - DNA, 25 bp, Rattus norvegicus
gtctgatccaattcttgcaggaccg

SEQ ID NO: 498194 - DNA, 25 bp, Rattus norvegicus
gtctgatcccaacagtcaacctgaa

SEQ ID NO: 498195 - DNA, 25 bp, Rattus norvegicus
gtctgatcccaagagtcaacctgaa

SEQ ID NO: 498196 - DNA, 25 bp, Rattus norvegicus
gtctgatccccaactgagtgctgtt

SEQ ID NO: 498197 - DNA, 25 bp, Rattus norvegicus
gtctgatccccatctgagtgctgtt

SEQ ID NO: 498198 - DNA, 25 bp, Rattus norvegicus
gtctgatctccacacaaggactgtg

SEQ ID NO: 498199 - DNA, 25 bp, Rattus norvegicus
gtctgatctccagacaaggactgtg

SEQ ID NO: 498200 - DNA, 25 bp, Rattus norvegicus
gtctgatctcggaagctaagcaggg

SEQ ID NO: 498201 - DNA, 25 bp, Rattus norvegicus
gtctgatctcggtagctaagcaggg

SEQ ID NO: 498202 - DNA, 25 bp, Rattus norvegicus
gtctgatctgcaaaagggctttcca

SEQ ID NO: 498203 - DNA, 25 bp, Rattus norvegicus
gtctgatctgcataagggctttcca

SEQ ID NO: 498204 - DNA, 25 bp, Rattus norvegicus
gtctgatgacatatctccctccagg

SEQ ID NO: 498205 - DNA, 25 bp, Rattus norvegicus
gtctgatgacatttctccctccagg

SEQ ID NO: 498206 - DNA, 25 bp, Rattus norvegicus
gtctgatgagtaaccagtgtgtcac

SEQ ID NO: 498207 - DNA, 25 bp, Rattus norvegicus
gtctgatgagtatccagtgtgtcac

SEQ ID NO: 498208 - DNA, 25 bp, Rattus norvegicus
gtctgatgcagtccgacctgagtga

SEQ ID NO: 498209 - DNA, 25 bp, Rattus norvegicus
gtctgatgcagtgcgacctgagtga

SEQ ID NO: 498210 - DNA, 25 bp, Rattus norvegicus
gtctgatgccagcactgaataaagt

SEQ ID NO: 498211 - DNA, 25 bp, Rattus norvegicus
gtctgatgccaggactgaataaagt

SEQ ID NO: 498212 - DNA, 25 bp, Rattus norvegicus
gtctgatgccatcaacgcttttgga

SEQ ID NO: 498213 - DNA, 25 bp, Rattus norvegicus
gtctgatgccatgaacgcttttgga

SEQ ID NO: 498214 - DNA, 25 bp, Rattus norvegicus
gtctgatgctacatacactatgctg

SEQ ID NO: 498215 - DNA, 25 bp, Rattus norvegicus
gtctgatgctacttacactatgctg

SEQ ID NO: 498216 - DNA, 25 bp, Rattus norvegicus
gtctgatggccaagagtccacacca

SEQ ID NO: 498217 - DNA, 25 bp, Rattus norvegicus
gtctgatggccatgagtccacacca

SEQ ID NO: 498218 - DNA, 25 bp, Rattus norvegicus
gtctgatggtaccagtcttagccaa

SEQ ID NO: 498219 - DNA, 25 bp, Rattus norvegicus
gtctgatggtacgagtcttagccaa

SEQ ID NO: 498220 - DNA, 25 bp, Rattus norvegicus
gtctgatgtctaacttcgacagcat

SEQ ID NO: 498221 - DNA, 25 bp, Rattus norvegicus
gtctgatgtctatcttcgacagcat

SEQ ID NO: 498222 - DNA, 25 bp, Rattus norvegicus
gtctgattaccaacttatttttatt

SEQ ID NO: 498223 - DNA, 25 bp, Rattus norvegicus
gtctgattaccatcttatttttatt

SEQ ID NO: 498224 - DNA, 25 bp, Rattus norvegicus
gtctgattatgtctcttcgtattct

SEQ ID NO: 498225 - DNA, 25 bp, Rattus norvegicus
gtctgattatgtgtcttcgtattct

SEQ ID NO: 498226 - DNA, 25 bp, Rattus norvegicus
gtctgattcacgatgctcagggaat

SEQ ID NO: 498227 - DNA, 25 bp, Rattus norvegicus
gtctgattcacgttgctcagggaat

SEQ ID NO: 498228 - DNA, 25 bp, Rattus norvegicus
gtctgattcagccaggcagttgctt

SEQ ID NO: 498229 - DNA, 25 bp, Rattus norvegicus
gtctgattcagcgaggcagttgctt

SEQ ID NO: 498230 - DNA, 25 bp, Rattus norvegicus
gtctgattccagaattgccctgaag

SEQ ID NO: 498231 - DNA, 25 bp, Rattus norvegicus
gtctgattccagtattgccctgaag

SEQ ID NO: 498232 - DNA, 25 bp, Rattus norvegicus
gtctgattcctgacatttgcgaaat

SEQ ID NO: 498233 - DNA, 25 bp, Rattus norvegicus
gtctgattcctgtcatttgcgaaat

SEQ ID NO: 498234 - DNA, 25 bp, Rattus norvegicus
gtctgattggaaacgtacccacttc

SEQ ID NO: 498235 - DNA, 25 bp, Rattus norvegicus
gtctgattggaatcgtacccacttc

SEQ ID NO: 498236 - DNA, 25 bp, Rattus norvegicus
gtctgattgtgcctgtgttttcacc

SEQ ID NO: 498237 - DNA, 25 bp, Rattus norvegicus
gtctgattgtgcgtgtgttttcacc

SEQ ID NO: 498238 - DNA, 25 bp, Rattus norvegicus
gtctgatttagcaggactttgcata

SEQ ID NO: 498239 - DNA, 25 bp, Rattus norvegicus
gtctgatttagctggactttgcata

SEQ ID NO: 498240 - DNA, 25 bp, Rattus norvegicus
gtctgcaaacagctccgggcaagag

SEQ ID NO: 498241 - DNA, 25 bp, Rattus norvegicus
gtctgcaaacaggtccgggcaagag

SEQ ID NO: 498242 - DNA, 25 bp, Rattus norvegicus
gtctgcaaagcaccggccattctct

SEQ ID NO: 498243 - DNA, 25 bp, Rattus norvegicus
gtctgcaaagcagcggccattctct

SEQ ID NO: 498244 - DNA, 25 bp, Rattus norvegicus
gtctgcaaaggtccctcggacaagt

SEQ ID NO: 498245 - DNA, 25 bp, Rattus norvegicus
gtctgcaaaggtgcctcggacaagt

SEQ ID NO: 498246 - DNA, 25 bp, Rattus norvegicus
gtctgcaactacagtcagcacgtaa

SEQ ID NO: 498247 - DNA, 25 bp, Rattus norvegicus
gtctgcaactactgtcagcacgtaa

SEQ ID NO: 498248 - DNA, 25 bp, Rattus norvegicus
gtctgcaagtgactgttggtcccct

SEQ ID NO: 498249 - DNA, 25 bp, Rattus norvegicus
gtctgcaagtgagtgttggtcccct

SEQ ID NO: 498250 - DNA, 25 bp, Rattus norvegicus
gtctgcaatgctcgccatgggtata

SEQ ID NO: 498251 - DNA, 25 bp, Rattus norvegicus
gtctgcaatgctggccatgggtata

SEQ ID NO: 498252 - DNA, 25 bp, Rattus norvegicus
gtctgcacaaccagcttggtcaaat

SEQ ID NO: 498253 - DNA, 25 bp, Rattus norvegicus
gtctgcacaacctgcttggtcaaat

SEQ ID NO: 498254 - DNA, 25 bp, Rattus norvegicus
gtctgcacaaggatcttctttgtat

SEQ ID NO: 498255 - DNA, 25 bp, Rattus norvegicus
gtctgcacaaggttcttctttgtat

SEQ ID NO: 498256 - DNA, 25 bp, Rattus norvegicus
gtctgcacaatcaccacgtggagaa

SEQ ID NO: 498257 - DNA, 25 bp, Rattus norvegicus
gtctgcacaatctccacgtggagaa

SEQ ID NO: 498258 - DNA, 25 bp, Rattus norvegicus
gtctgcacaattacttaagctttag

SEQ ID NO: 498259 - DNA, 25 bp, Rattus norvegicus
gtctgcacaatttcttaagctttag

SEQ ID NO: 498260 - DNA, 25 bp, Rattus norvegicus
gtctgcacacatcagctagttcttt

SEQ ID NO: 498261 - DNA, 25 bp, Rattus norvegicus
gtctgcacacatgagctagttcttt

SEQ ID NO: 498262 - DNA, 25 bp, Rattus norvegicus
gtctgcacatcacgagagggcatca

SEQ ID NO: 498263 - DNA, 25 bp, Rattus norvegicus
gtctgcacatcaggagagggcatca

SEQ ID NO: 498264 - DNA, 25 bp, Rattus norvegicus
gtctgcacccacataagctaagtag

SEQ ID NO: 498265 - DNA, 25 bp, Rattus norvegicus
gtctgcacccacttaagctaagtag

SEQ ID NO: 498266 - DNA, 25 bp, Rattus norvegicus
gtctgcaccgataatataagcttct

SEQ ID NO: 498267 - DNA, 25 bp, Rattus norvegicus
gtctgcaccgattatataagcttct

SEQ ID NO: 498268 - DNA, 25 bp, Rattus norvegicus
gtctgcacctttctagtgacagatg

SEQ ID NO: 498269 - DNA, 25 bp, Rattus norvegicus
gtctgcacctttgtagtgacagatg

SEQ ID NO: 498270 - DNA, 25 bp, Rattus norvegicus
gtctgcacgcaaattatccacaact

SEQ ID NO: 498271 - DNA, 25 bp, Rattus norvegicus
gtctgcacgcaatttatccacaact

SEQ ID NO: 498272 - DNA, 25 bp, Rattus norvegicus
gtctgcacgtgtatagcacagctca

SEQ ID NO: 498273 - DNA, 25 bp, Rattus norvegicus
gtctgcacgtgtttagcacagctca

SEQ ID NO: 498274 - DNA, 25 bp, Rattus norvegicus
gtctgcactcatctacttcactgta

SEQ ID NO: 498275 - DNA, 25 bp, Rattus norvegicus
gtctgcactcatgtacttcactgta

SEQ ID NO: 498276 - DNA, 25 bp, Rattus norvegicus
gtctgcacttgcaatgaactgataa

SEQ ID NO: 498277 - DNA, 25 bp, Rattus norvegicus
gtctgcacttgctatgaactgataa

SEQ ID NO: 498278 - DNA, 25 bp, Rattus norvegicus
gtctgcactttcatagcctattttt

SEQ ID NO: 498279 - DNA, 25 bp, Rattus norvegicus
gtctgcactttcttagcctattttt

SEQ ID NO: 498280 - DNA, 25 bp, Rattus norvegicus
gtctgcagaaacagttggagtgtct

SEQ ID NO: 498281 - DNA, 25 bp, Rattus norvegicus
gtctgcagaaactgttggagtgtct

SEQ ID NO: 498282 - DNA, 25 bp, Rattus norvegicus
gtctgcagaacaagctagatttgcc

SEQ ID NO: 498283 - DNA, 25 bp, Rattus norvegicus
gtctgcagaacatgctagatttgcc

SEQ ID NO: 498284 - DNA, 25 bp, Rattus norvegicus
gtctgcagaggaaagctgtccaccc

SEQ ID NO: 498285 - DNA, 25 bp, Rattus norvegicus
gtctgcagaggaactgagcaattgc

SEQ ID NO: 498286 - DNA, 25 bp, Rattus norvegicus
gtctgcagaggatagctgtccaccc

SEQ ID NO: 498287 - DNA, 25 bp, Rattus norvegicus
gtctgcagaggatctgagcaattgc

SEQ ID NO: 498288 - DNA, 25 bp, Rattus norvegicus
gtctgcagagtaaatggcttgtgcc

SEQ ID NO: 498289 - DNA, 25 bp, Rattus norvegicus
gtctgcagagtatatggcttgtgcc

SEQ ID NO: 498290 - DNA, 25 bp, Rattus norvegicus
gtctgcagatttcagagcggctgaa

SEQ ID NO: 498291 - DNA, 25 bp, Rattus norvegicus
gtctgcagatttgagagcggctgaa

SEQ ID NO: 498292 - DNA, 25 bp, Rattus norvegicus
gtctgcagcaagaacccttcaaggt

SEQ ID NO: 498293 - DNA, 25 bp, Rattus norvegicus
gtctgcagcaagtacccttcaaggt

SEQ ID NO: 498294 - DNA, 25 bp, Rattus norvegicus
gtctgcagcagtactgagctactgt

SEQ ID NO: 498295 - DNA, 25 bp, Rattus norvegicus
gtctgcagcagttctgagctactgt

SEQ ID NO: 498296 - DNA, 25 bp, Rattus norvegicus
gtctgcagcatcattccaaactgtg

SEQ ID NO: 498297 - DNA, 25 bp, Rattus norvegicus
gtctgcagcatctttccaaactgtg

SEQ ID NO: 498298 - DNA, 25 bp, Rattus norvegicus
gtctgcagcccactacttcagggaa

SEQ ID NO: 498299 - DNA, 25 bp, Rattus norvegicus
gtctgcagcccagtacttcagggaa

SEQ ID NO: 498300 - DNA, 25 bp, Rattus norvegicus
gtctgcagcctgacattagctagca

SEQ ID NO: 498301 - DNA, 25 bp, Rattus norvegicus
gtctgcagcctgaggactgactata

SEQ ID NO: 498302 - DNA, 25 bp, Rattus norvegicus
gtctgcagcctgtcattagctagca

SEQ ID NO: 498303 - DNA, 25 bp, Rattus norvegicus
gtctgcagcctgtggactgactata

SEQ ID NO: 498304 - DNA, 25 bp, Rattus norvegicus
gtctgcaggtgtacatatcagctca

SEQ ID NO: 498305 - DNA, 25 bp, Rattus norvegicus
gtctgcaggtgttcatatcagctca

SEQ ID NO: 498306 - DNA, 25 bp, Rattus norvegicus
gtctgcagtcttcataacgggcttc

SEQ ID NO: 498307 - DNA, 25 bp, Rattus norvegicus
gtctgcagtcttgataacgggcttc

SEQ ID NO: 498308 - DNA, 25 bp, Rattus norvegicus
gtctgcagttagctcttgatgtgaa

SEQ ID NO: 498309 - DNA, 25 bp, Rattus norvegicus
gtctgcagttaggtcttgatgtgaa

SEQ ID NO: 498310 - DNA, 25 bp, Rattus norvegicus
gtctgcagttggaagtttcagctgt

SEQ ID NO: 498311 - DNA, 25 bp, Rattus norvegicus
gtctgcagttggtagtttcagctgt

SEQ ID NO: 498312 - DNA, 25 bp, Rattus norvegicus
gtctgcagtttgaacacacttctgt

SEQ ID NO: 498313 - DNA, 25 bp, Rattus norvegicus
gtctgcagtttgtacacacttctgt

SEQ ID NO: 498314 - DNA, 25 bp, Rattus norvegicus
gtctgcatactcatgagcttttaag

SEQ ID NO: 498315 - DNA, 25 bp, Rattus norvegicus
gtctgcatactcttgagcttttaag

SEQ ID NO: 498316 - DNA, 25 bp, Rattus norvegicus
gtctgcatcagcctatttgtaaaat

SEQ ID NO: 498317 - DNA, 25 bp, Rattus norvegicus
gtctgcatcagcgtatttgtaaaat

SEQ ID NO: 498318 - DNA, 25 bp, Rattus norvegicus
gtctgcatcgagactgagcacagct

SEQ ID NO: 498319 - DNA, 25 bp, Rattus norvegicus
gtctgcatcgagtctgagcacagct

SEQ ID NO: 498320 - DNA, 25 bp, Rattus norvegicus
gtctgcatcttcagtaatggcctct

SEQ ID NO: 498321 - DNA, 25 bp, Rattus norvegicus
gtctgcatcttctgtaatggcctct

SEQ ID NO: 498322 - DNA, 25 bp, Rattus norvegicus
gtctgcatgacccatgtggcacgtt

SEQ ID NO: 498323 - DNA, 25 bp, Rattus norvegicus
gtctgcatgaccgatgtggcacgtt

SEQ ID NO: 498324 - DNA, 25 bp, Rattus norvegicus
gtctgcatgactagcttacctgatg

SEQ ID NO: 498325 - DNA, 25 bp, Rattus norvegicus
gtctgcatgacttgcttacctgatg

SEQ ID NO: 498326 - DNA, 25 bp, Rattus norvegicus
gtctgcatgcatactttagtagcta

SEQ ID NO: 498327 - DNA, 25 bp, Rattus norvegicus
gtctgcatgcattctttagtagcta

SEQ ID NO: 498328 - DNA, 25 bp, Rattus norvegicus
gtctgcatgcgaattcaagctcata

SEQ ID NO: 498329 - DNA, 25 bp, Rattus norvegicus
gtctgcatgcgatttcaagctcata

SEQ ID NO: 498330 - DNA, 25 bp, Rattus norvegicus
gtctgcatgctgacgactggcccag

SEQ ID NO: 498331 - DNA, 25 bp, Rattus norvegicus
gtctgcatgctgtcgactggcccag

SEQ ID NO: 498332 - DNA, 25 bp, Rattus norvegicus
gtctgcatggaaattgctgtcctgg

SEQ ID NO: 498333 - DNA, 25 bp, Rattus norvegicus
gtctgcatggaatttgctgtcctgg

SEQ ID NO: 498334 - DNA, 25 bp, Rattus norvegicus
gtctgcatgggaactgtccacacta

SEQ ID NO: 498335 - DNA, 25 bp, Rattus norvegicus
gtctgcatgggatctgtccacacta

SEQ ID NO: 498336 - DNA, 25 bp, Rattus norvegicus
gtctgcatggtcaaagttctgtgtc

SEQ ID NO: 498337 - DNA, 25 bp, Rattus norvegicus
gtctgcatggtctaagttctgtgtc

SEQ ID NO: 498338 - DNA, 25 bp, Rattus norvegicus
gtctgcatgtacacctgtgtgctac

SEQ ID NO: 498339 - DNA, 25 bp, Rattus norvegicus
gtctgcatgtactcctgtgtgctac

SEQ ID NO: 498340 - DNA, 25 bp, Rattus norvegicus
gtctgcatgtatccccaaaagccag

SEQ ID NO: 498341 - DNA, 25 bp, Rattus norvegicus
gtctgcatgtatccctacaggccac

SEQ ID NO: 498342 - DNA, 25 bp, Rattus norvegicus
gtctgcatgtatgcccaaaagccag

SEQ ID NO: 498343 - DNA, 25 bp, Rattus norvegicus
gtctgcatgtatgcctacaggccac

SEQ ID NO: 498344 - DNA, 25 bp, Rattus norvegicus
gtctgcattgtaactcatttacgat

SEQ ID NO: 498345 - DNA, 25 bp, Rattus norvegicus
gtctgcattgtatctcatttacgat

SEQ ID NO: 498346 - DNA, 25 bp, Rattus norvegicus
gtctgcatttgtaactgtgctaata

SEQ ID NO: 498347 - DNA, 25 bp, Rattus norvegicus
gtctgcatttgttactgtgctaata

SEQ ID NO: 498348 - DNA, 25 bp, Rattus norvegicus
gtctgcattttcatggagaaattta

SEQ ID NO: 498349 - DNA, 25 bp, Rattus norvegicus
gtctgcattttcttggagaaattta

SEQ ID NO: 498350 - DNA, 25 bp, Rattus norvegicus
gtctgccaagagctcaggacttttc

SEQ ID NO: 498351 - DNA, 25 bp, Rattus norvegicus
gtctgccaagaggtcaggacttttc

SEQ ID NO: 498352 - DNA, 25 bp, Rattus norvegicus
gtctgccaagatagctgatcctgtt

SEQ ID NO: 498353 - DNA, 25 bp, Rattus norvegicus
gtctgccaagattgctgatcctgtt

SEQ ID NO: 498354 - DNA, 25 bp, Rattus norvegicus
gtctgccacagcagggtcctgaagt

SEQ ID NO: 498355 - DNA, 25 bp, Rattus norvegicus
gtctgccacagctgggtcctgaagt

SEQ ID NO: 498356 - DNA, 25 bp, Rattus norvegicus
gtctgccacggcctgggacaaaaga

SEQ ID NO: 498357 - DNA, 25 bp, Rattus norvegicus
gtctgccacggcgtgggacaaaaga

SEQ ID NO: 498358 - DNA, 25 bp, Rattus norvegicus
gtctgccagataaagctcagtagtg

SEQ ID NO: 498359 - DNA, 25 bp, Rattus norvegicus
gtctgccagatatagctcagtagtg

SEQ ID NO: 498360 - DNA, 25 bp, Rattus norvegicus
gtctgccagcctatttgttacccga

SEQ ID NO: 498361 - DNA, 25 bp, Rattus norvegicus
gtctgccagcctttttgttacccga

SEQ ID NO: 498362 - DNA, 25 bp, Rattus norvegicus
gtctgccataaaatcttcctaagtt

SEQ ID NO: 498363 - DNA, 25 bp, Rattus norvegicus
gtctgccataaattcttcctaagtt

SEQ ID NO: 498364 - DNA, 25 bp, Rattus norvegicus
gtctgccatcccatgcaaggaggaa

SEQ ID NO: 498365 - DNA, 25 bp, Rattus norvegicus
gtctgccatcccttgcaaggaggaa

SEQ ID NO: 498366 - DNA, 25 bp, Rattus norvegicus
gtctgccatggtaaggtgacccaca

SEQ ID NO: 498367 - DNA, 25 bp, Rattus norvegicus
gtctgccatggttaggtgacccaca

SEQ ID NO: 498368 - DNA, 25 bp, Rattus norvegicus
gtctgccatgtaaatgtgtttagca

SEQ ID NO: 498369 - DNA, 25 bp, Rattus norvegicus
gtctgccatgtatatgtgtttagca

SEQ ID NO: 498370 - DNA, 25 bp, Rattus norvegicus
gtctgccattacaccagagtgactt

SEQ ID NO: 498371 - DNA, 25 bp, Rattus norvegicus
gtctgccattactccagagtgactt

SEQ ID NO: 498372 - DNA, 25 bp, Rattus norvegicus
gtctgccattccacagtaaactgtt

SEQ ID NO: 498373 - DNA, 25 bp, Rattus norvegicus
gtctgccattcctcagtaaactgtt

SEQ ID NO: 498374 - DNA, 25 bp, Rattus norvegicus
gtctgcccaacgagtcctcaaacaa

SEQ ID NO: 498375 - DNA, 25 bp, Rattus norvegicus
gtctgcccaacgtgtcctcaaacaa

SEQ ID NO: 498376 - DNA, 25 bp, Rattus norvegicus
gtctgcccaccaacagcgaaaagag

SEQ ID NO: 498377 - DNA, 25 bp, Rattus norvegicus
gtctgcccaccatcagcgaaaagag

SEQ ID NO: 498378 - DNA, 25 bp, Rattus norvegicus
gtctgcccacttcgaagagagccat

SEQ ID NO: 498379 - DNA, 25 bp, Rattus norvegicus
gtctgcccacttggaagagagccat

SEQ ID NO: 498380 - DNA, 25 bp, Rattus norvegicus
gtctgcccaggaatattatgttgat

SEQ ID NO: 498381 - DNA, 25 bp, Rattus norvegicus
gtctgcccaggattattatgttgat

SEQ ID NO: 498382 - DNA, 25 bp, Rattus norvegicus
gtctgcccagtgacaccagtttgag

SEQ ID NO: 498383 - DNA, 25 bp, Rattus norvegicus
gtctgcccagtgtcaccagtttgag

SEQ ID NO: 498384 - DNA, 25 bp, Rattus norvegicus
gtctgcccattgctttattcggttt

SEQ ID NO: 498385 - DNA, 25 bp, Rattus norvegicus
gtctgcccattggtttattcggttt

SEQ ID NO: 498386 - DNA, 25 bp, Rattus norvegicus
gtctgccccagcagatgtgatctag

SEQ ID NO: 498387 - DNA, 25 bp, Rattus norvegicus
gtctgccccagctgatgtgatctag

SEQ ID NO: 498388 - DNA, 25 bp, Rattus norvegicus
gtctgccccgggaaaggctgatgca

SEQ ID NO: 498389 - DNA, 25 bp, Rattus norvegicus
gtctgccccgggtaaggctgatgca

SEQ ID NO: 498390 - DNA, 25 bp, Rattus norvegicus
gtctgcccctttagaatctcaattt

SEQ ID NO: 498391 - DNA, 25 bp, Rattus norvegicus
gtctgccccttttgaatctcaattt

SEQ ID NO: 498392 - DNA, 25 bp, Rattus norvegicus
gtctgccctattcttttctttttct

SEQ ID NO: 498393 - DNA, 25 bp, Rattus norvegicus
gtctgccctattgttttctttttct

SEQ ID NO: 498394 - DNA, 25 bp, Rattus norvegicus
gtctgccctctgcacagaaggccaa

SEQ ID NO: 498395 - DNA, 25 bp, Rattus norvegicus
gtctgccctctggacagaaggccaa

SEQ ID NO: 498396 - DNA, 25 bp, Rattus norvegicus
gtctgccctgtgacatgaatggctt

SEQ ID NO: 498397 - DNA, 25 bp, Rattus norvegicus
gtctgccctgtgtcatgaatggctt

SEQ ID NO: 498398 - DNA, 25 bp, Rattus norvegicus
gtctgccgcacaccagagatgctgg

SEQ ID NO: 498399 - DNA, 25 bp, Rattus norvegicus
gtctgccgcacagcagagatgctgg

SEQ ID NO: 498400 - DNA, 25 bp, Rattus norvegicus
gtctgccgctacactgagagctaaa

SEQ ID NO: 498401 - DNA, 25 bp, Rattus norvegicus
gtctgccgctactctgagagctaaa

SEQ ID NO: 498402 - DNA, 25 bp, Rattus norvegicus
gtctgccggtcgctgatgaccacag

SEQ ID NO: 498403 - DNA, 25 bp, Rattus norvegicus
gtctgccggtcggtgatgaccacag

SEQ ID NO: 498404 - DNA, 25 bp, Rattus norvegicus
gtctgccgtaatacttggttctgag

SEQ ID NO: 498405 - DNA, 25 bp, Rattus norvegicus
gtctgccgtaattcttggttctgag

SEQ ID NO: 498406 - DNA, 25 bp, Rattus norvegicus
gtctgcctagataacatagaggtcc

SEQ ID NO: 498407 - DNA, 25 bp, Rattus norvegicus
gtctgcctagataagccctcaataa

SEQ ID NO: 498408 - DNA, 25 bp, Rattus norvegicus
gtctgcctagattacatagaggtcc

SEQ ID NO: 498409 - DNA, 25 bp, Rattus norvegicus
gtctgcctagattagccctcaataa

SEQ ID NO: 498410 - DNA, 25 bp, Rattus norvegicus
gtctgcctagcacctgggaagtgaa

SEQ ID NO: 498411 - DNA, 25 bp, Rattus norvegicus
gtctgcctagcagctgggaagtgaa

SEQ ID NO: 498412 - DNA, 25 bp, Rattus norvegicus
gtctgcctagttcccctgattggta

SEQ ID NO: 498413 - DNA, 25 bp, Rattus norvegicus
gtctgcctagttgccctgattggta

SEQ ID NO: 498414 - DNA, 25 bp, Rattus norvegicus
gtctgcctataaacggaccctggag

SEQ ID NO: 498415 - DNA, 25 bp, Rattus norvegicus
gtctgcctataatcggaccctggag

SEQ ID NO: 498416 - DNA, 25 bp, Rattus norvegicus
gtctgcctatctagtactactgact

SEQ ID NO: 498417 - DNA, 25 bp, Rattus norvegicus
gtctgcctatctagtgtacagttaa

SEQ ID NO: 498418 - DNA, 25 bp, Rattus norvegicus
gtctgcctatcttgtactactgact

SEQ ID NO: 498419 - DNA, 25 bp, Rattus norvegicus
gtctgcctatcttgtgtacagttaa

SEQ ID NO: 498420 - DNA, 25 bp, Rattus norvegicus
gtctgcctatgcattaattgtcgta

SEQ ID NO: 498421 - DNA, 25 bp, Rattus norvegicus
gtctgcctatgctttaattgtcgta

SEQ ID NO: 498422 - DNA, 25 bp, Rattus norvegicus
gtctgcctctgcacacctacaaaat

SEQ ID NO: 498423 - DNA, 25 bp, Rattus norvegicus
gtctgcctctgctcacctacaaaat

SEQ ID NO: 498424 - DNA, 25 bp, Rattus norvegicus
gtctgcctcttaactacttctataa

SEQ ID NO: 498425 - DNA, 25 bp, Rattus norvegicus
gtctgcctcttatctacttctataa

SEQ ID NO: 498426 - DNA, 25 bp, Rattus norvegicus
gtctgcctcttcacaaagcattggt

SEQ ID NO: 498427 - DNA, 25 bp, Rattus norvegicus
gtctgcctcttctcaaagcattggt

SEQ ID NO: 498428 - DNA, 25 bp, Rattus norvegicus
gtctgcctgacaccagcatttgagg

SEQ ID NO: 498429 - DNA, 25 bp, Rattus norvegicus
gtctgcctgacagcagcatttgagg

SEQ ID NO: 498430 - DNA, 25 bp, Rattus norvegicus
gtctgcctgcctagaagtcttcatc

SEQ ID NO: 498431 - DNA, 25 bp, Rattus norvegicus
gtctgcctgccttgaagtcttcatc

SEQ ID NO: 498432 - DNA, 25 bp, Rattus norvegicus
gtctgcctggagaacgctgaccatg

SEQ ID NO: 498433 - DNA, 25 bp, Rattus norvegicus
gtctgcctggagtacgctgaccatg

SEQ ID NO: 498434 - DNA, 25 bp, Rattus norvegicus
gtctgcctggatcggtctcaaaggt

SEQ ID NO: 498435 - DNA, 25 bp, Rattus norvegicus
gtctgcctggatgggtctcaaaggt

SEQ ID NO: 498436 - DNA, 25 bp, Rattus norvegicus
gtctgcctgggaagctacagaatgt

SEQ ID NO: 498437 - DNA, 25 bp, Rattus norvegicus
gtctgcctgggatgctacagaatgt

SEQ ID NO: 498438 - DNA, 25 bp, Rattus norvegicus
gtctgcctggttcgttgtctctaac

SEQ ID NO: 498439 - DNA, 25 bp, Rattus norvegicus
gtctgcctggttggttgtctctaac

SEQ ID NO: 498440 - DNA, 25 bp, Rattus norvegicus
gtctgcctgttgctaacttatgaag

SEQ ID NO: 498441 - DNA, 25 bp, Rattus norvegicus
gtctgcctgttggtaacttatgaag

SEQ ID NO: 498442 - DNA, 25 bp, Rattus norvegicus
gtctgccttattattaccatctttc

SEQ ID NO: 498443 - DNA, 25 bp, Rattus norvegicus
gtctgccttatttttaccatctttc

SEQ ID NO: 498444 - DNA, 25 bp, Rattus norvegicus
gtctgccttgcgagcaggaagttct

SEQ ID NO: 498445 - DNA, 25 bp, Rattus norvegicus
gtctgccttgcgtgcaggaagttct

SEQ ID NO: 498446 - DNA, 25 bp, Rattus norvegicus
gtctgccttgctctctaaaaatata

SEQ ID NO: 498447 - DNA, 25 bp, Rattus norvegicus
gtctgccttgctgtctaaaaatata

SEQ ID NO: 498448 - DNA, 25 bp, Rattus norvegicus
gtctgccttggcaaaatcaacttca

SEQ ID NO: 498449 - DNA, 25 bp, Rattus norvegicus
gtctgccttggctaaatcaacttca

SEQ ID NO: 498450 - DNA, 25 bp, Rattus norvegicus
gtctgcgaagctctcatctatggtt

SEQ ID NO: 498451 - DNA, 25 bp, Rattus norvegicus
gtctgcgaagctgtcatctatggtt

SEQ ID NO: 498452 - DNA, 25 bp, Rattus norvegicus
gtctgcgagtttctgtgtacatatg

SEQ ID NO: 498453 - DNA, 25 bp, Rattus norvegicus
gtctgcgagtttgtgtgtacatatg

SEQ ID NO: 498454 - DNA, 25 bp, Rattus norvegicus
gtctgcgccctcagtgtggctgcag

SEQ ID NO: 498455 - DNA, 25 bp, Rattus norvegicus
gtctgcgccctctgtgtggctgcag

SEQ ID NO: 498456 - DNA, 25 bp, Rattus norvegicus
gtctgcgcgcctctaaaagttccgg

SEQ ID NO: 498457 - DNA, 25 bp, Rattus norvegicus
gtctgcgcgcctgtaaaagttccgg

SEQ ID NO: 498458 - DNA, 25 bp, Rattus norvegicus
gtctgcgcgctgcaccttggcgtca

SEQ ID NO: 498459 - DNA, 25 bp, Rattus norvegicus
gtctgcgcgctggaccttggcgtca

SEQ ID NO: 498460 - DNA, 25 bp, Rattus norvegicus
gtctgcggctctcgttctgaaacat

SEQ ID NO: 498461 - DNA, 25 bp, Rattus norvegicus
gtctgcggctctggttctgaaacat

SEQ ID NO: 498462 - DNA, 25 bp, Rattus norvegicus
gtctgcgggattaagtgcctgacat

SEQ ID NO: 498463 - DNA, 25 bp, Rattus norvegicus
gtctgcgggatttagtgcctgacat

SEQ ID NO: 498464 - DNA, 25 bp, Rattus norvegicus
gtctgcgggccacccgggactttaa

SEQ ID NO: 498465 - DNA, 25 bp, Rattus norvegicus
gtctgcgggccagccgggactttaa

SEQ ID NO: 498466 - DNA, 25 bp, Rattus norvegicus
gtctgcgggtggagtatgcatacat

SEQ ID NO: 498467 - DNA, 25 bp, Rattus norvegicus
gtctgcgggtggtgtatgcatacat

SEQ ID NO: 498468 - DNA, 25 bp, Rattus norvegicus
gtctgcggtgtaccctaggtaacta

SEQ ID NO: 498469 - DNA, 25 bp, Rattus norvegicus
gtctgcggtgtagcctaggtaacta

SEQ ID NO: 498470 - DNA, 25 bp, Rattus norvegicus
gtctgcgtattgcataactgtgcct

SEQ ID NO: 498471 - DNA, 25 bp, Rattus norvegicus
gtctgcgtattggataactgtgcct

SEQ ID NO: 498472 - DNA, 25 bp, Rattus norvegicus
gtctgcgtgtgtccacctgtgccat

SEQ ID NO: 498473 - DNA, 25 bp, Rattus norvegicus
gtctgcgtgtgtgcacctgtgccat

SEQ ID NO: 498474 - DNA, 25 bp, Rattus norvegicus
gtctgcgtgttaattctgaagtctc

SEQ ID NO: 498475 - DNA, 25 bp, Rattus norvegicus
gtctgcgtgttatttctgaagtctc

SEQ ID NO: 498476 - DNA, 25 bp, Rattus norvegicus
gtctgctaacatatctcttttcttt

SEQ ID NO: 498477 - DNA, 25 bp, Rattus norvegicus
gtctgctaacatttctcttttcttt

SEQ ID NO: 498478 - DNA, 25 bp, Rattus norvegicus
gtctgctaagctagggatcttctcc

SEQ ID NO: 498479 - DNA, 25 bp, Rattus norvegicus
gtctgctaagcttgggatcttctcc

SEQ ID NO: 498480 - DNA, 25 bp, Rattus norvegicus
gtctgctaattccattcagtccagg

SEQ ID NO: 498481 - DNA, 25 bp, Rattus norvegicus
gtctgctaattcgattcagtccagg

SEQ ID NO: 498482 - DNA, 25 bp, Rattus norvegicus
gtctgctacacgatacgcacagcaa

SEQ ID NO: 498483 - DNA, 25 bp, Rattus norvegicus
gtctgctacacgttacgcacagcaa

SEQ ID NO: 498484 - DNA, 25 bp, Rattus norvegicus
gtctgctacgtgaccactaaagtgg

SEQ ID NO: 498485 - DNA, 25 bp, Rattus norvegicus
gtctgctacgtgtccactaaagtgg

SEQ ID NO: 498486 - DNA, 25 bp, Rattus norvegicus
gtctgctagtccctgaagcctttaa

SEQ ID NO: 498487 - DNA, 25 bp, Rattus norvegicus
gtctgctagtccgtgaagcctttaa

SEQ ID NO: 498488 - DNA, 25 bp, Rattus norvegicus
gtctgctatttgacgttttccataa

SEQ ID NO: 498489 - DNA, 25 bp, Rattus norvegicus
gtctgctatttgcaagttgtactat

SEQ ID NO: 498490 - DNA, 25 bp, Rattus norvegicus
gtctgctatttggaagttgtactat

SEQ ID NO: 498491 - DNA, 25 bp, Rattus norvegicus
gtctgctatttgtcgttttccataa

SEQ ID NO: 498492 - DNA, 25 bp, Rattus norvegicus
gtctgctcaaggaaatgacccacag

SEQ ID NO: 498493 - DNA, 25 bp, Rattus norvegicus
gtctgctcaaggtaatgacccacag

SEQ ID NO: 498494 - DNA, 25 bp, Rattus norvegicus
gtctgctcacgtagaagcttctcat

SEQ ID NO: 498495 - DNA, 25 bp, Rattus norvegicus
gtctgctcacgttgaagcttctcat

SEQ ID NO: 498496 - DNA, 25 bp, Rattus norvegicus
gtctgctcagcactgttactgttgg

SEQ ID NO: 498497 - DNA, 25 bp, Rattus norvegicus
gtctgctcagcagtgttactgttgg

SEQ ID NO: 498498 - DNA, 25 bp, Rattus norvegicus
gtctgctccgaaagggcagctactc

SEQ ID NO: 498499 - DNA, 25 bp, Rattus norvegicus
gtctgctccgaatgggcagctactc

SEQ ID NO: 498500 - DNA, 25 bp, Rattus norvegicus
gtctgctcctctaaggtgtatttgt

SEQ ID NO: 498501 - DNA, 25 bp, Rattus norvegicus
gtctgctcctctccaggatttatat

SEQ ID NO: 498502 - DNA, 25 bp, Rattus norvegicus
gtctgctcctctgcaggatttatat

SEQ ID NO: 498503 - DNA, 25 bp, Rattus norvegicus
gtctgctcctcttaggtgtatttgt

SEQ ID NO: 498504 - DNA, 25 bp, Rattus norvegicus
gtctgctccttaatattctgcatgg

SEQ ID NO: 498505 - DNA, 25 bp, Rattus norvegicus
gtctgctccttattattctgcatgg

SEQ ID NO: 498506 - DNA, 25 bp, Rattus norvegicus
gtctgctctactcatccaggtttta

SEQ ID NO: 498507 - DNA, 25 bp, Rattus norvegicus
gtctgctctactgatccaggtttta

SEQ ID NO: 498508 - DNA, 25 bp, Rattus norvegicus
gtctgctctcccatgataaacagtg

SEQ ID NO: 498509 - DNA, 25 bp, Rattus norvegicus
gtctgctctcccttgataaacagtg

SEQ ID NO: 498510 - DNA, 25 bp, Rattus norvegicus
gtctgctctgtgaatgtttctttgc

SEQ ID NO: 498511 - DNA, 25 bp, Rattus norvegicus
gtctgctctgtgtatgtttctttgc

SEQ ID NO: 498512 - DNA, 25 bp, Rattus norvegicus
gtctgctcttatatttgtaccatat

SEQ ID NO: 498513 - DNA, 25 bp, Rattus norvegicus
gtctgctcttatttttgtaccatat

SEQ ID NO: 498514 - DNA, 25 bp, Rattus norvegicus
gtctgctctttaatgggacaggcca

SEQ ID NO: 498515 - DNA, 25 bp, Rattus norvegicus
gtctgctctttattgggacaggcca

SEQ ID NO: 498516 - DNA, 25 bp, Rattus norvegicus
gtctgctgaactccctgaatgaaca

SEQ ID NO: 498517 - DNA, 25 bp, Rattus norvegicus
gtctgctgaactgcctgaatgaaca

SEQ ID NO: 498518 - DNA, 25 bp, Rattus norvegicus
gtctgctgaagacgtcttgcttctc

SEQ ID NO: 498519 - DNA, 25 bp, Rattus norvegicus
gtctgctgaagaggtcttgcttctc

SEQ ID NO: 498520 - DNA, 25 bp, Rattus norvegicus
gtctgctgagccaacagtgtctgaa

SEQ ID NO: 498521 - DNA, 25 bp, Rattus norvegicus
gtctgctgagcctacagtgtctgaa

SEQ ID NO: 498522 - DNA, 25 bp, Rattus norvegicus
gtctgctgagttatatgtgttctat

SEQ ID NO: 498523 - DNA, 25 bp, Rattus norvegicus
gtctgctgagttttatgtgttctat

SEQ ID NO: 498524 - DNA, 25 bp, Rattus norvegicus
gtctgctgcatgatggtgacatcat

SEQ ID NO: 498525 - DNA, 25 bp, Rattus norvegicus
gtctgctgcatgttggtgacatcat

SEQ ID NO: 498526 - DNA, 25 bp, Rattus norvegicus
gtctgctgcattctagtaacgtgtt

SEQ ID NO: 498527 - DNA, 25 bp, Rattus norvegicus
gtctgctgcattgtagtaacgtgtt

SEQ ID NO: 498528 - DNA, 25 bp, Rattus norvegicus
gtctgctgcgctaagtggttgaacc

SEQ ID NO: 498529 - DNA, 25 bp, Rattus norvegicus
gtctgctgcgcttagtggttgaacc

SEQ ID NO: 498530 - DNA, 25 bp, Rattus norvegicus
gtctgctgctatcgcctttagttaa

SEQ ID NO: 498531 - DNA, 25 bp, Rattus norvegicus
gtctgctgctatggcctttagttaa

SEQ ID NO: 498532 - DNA, 25 bp, Rattus norvegicus
gtctgctggcagatttgctggcctg

SEQ ID NO: 498533 - DNA, 25 bp, Rattus norvegicus
gtctgctggcagttttgctggcctg

SEQ ID NO: 498534 - DNA, 25 bp, Rattus norvegicus
gtctgctggtgtatctggcaatgca

SEQ ID NO: 498535 - DNA, 25 bp, Rattus norvegicus
gtctgctggtgtttctggcaatgca

SEQ ID NO: 498536 - DNA, 25 bp, Rattus norvegicus
gtctgctgtatgcttgttttctatt

SEQ ID NO: 498537 - DNA, 25 bp, Rattus norvegicus
gtctgctgtatggttgttttctatt

SEQ ID NO: 498538 - DNA, 25 bp, Rattus norvegicus
gtctgctgtcagatactccaagatt

SEQ ID NO: 498539 - DNA, 25 bp, Rattus norvegicus
gtctgctgtcagttactccaagatt

SEQ ID NO: 498540 - DNA, 25 bp, Rattus norvegicus
gtctgctgtgaaccacacgatgctc

SEQ ID NO: 498541 - DNA, 25 bp, Rattus norvegicus
gtctgctgtgaagcacacgatgctc

SEQ ID NO: 498542 - DNA, 25 bp, Rattus norvegicus
gtctgctgtgacaaagggttttctt

SEQ ID NO: 498543 - DNA, 25 bp, Rattus norvegicus
gtctgctgtgaccaaattgcctcca

SEQ ID NO: 498544 - DNA, 25 bp, Rattus norvegicus
gtctgctgtgacgaaattgcctcca

SEQ ID NO: 498545 - DNA, 25 bp, Rattus norvegicus
gtctgctgtgactaagggttttctt

SEQ ID NO: 498546 - DNA, 25 bp, Rattus norvegicus
gtctgctgtgtaagctacatgtcca

SEQ ID NO: 498547 - DNA, 25 bp, Rattus norvegicus
gtctgctgtgtatgctacatgtcca

SEQ ID NO: 498548 - DNA, 25 bp, Rattus norvegicus
gtctgcttacaacccagcaactagc

SEQ ID NO: 498549 - DNA, 25 bp, Rattus norvegicus
gtctgcttacaagccagcaactagc

SEQ ID NO: 498550 - DNA, 25 bp, Rattus norvegicus
gtctgcttagacatggtgctgggca

SEQ ID NO: 498551 - DNA, 25 bp, Rattus norvegicus
gtctgcttagacttggtgctgggca

SEQ ID NO: 498552 - DNA, 25 bp, Rattus norvegicus
gtctgcttagcaattccatatttat

SEQ ID NO: 498553 - DNA, 25 bp, Rattus norvegicus
gtctgcttagcatttccatatttat

SEQ ID NO: 498554 - DNA, 25 bp, Rattus norvegicus
gtctgcttataaactaccaacgtct

SEQ ID NO: 498555 - DNA, 25 bp, Rattus norvegicus
gtctgcttataatctaccaacgtct

SEQ ID NO: 498556 - DNA, 25 bp, Rattus norvegicus
gtctgcttatttatgcacccaggat

SEQ ID NO: 498557 - DNA, 25 bp, Rattus norvegicus
gtctgcttatttttgcacccaggat

SEQ ID NO: 498558 - DNA, 25 bp, Rattus norvegicus
gtctgcttcaaaacttcctttcata

SEQ ID NO: 498559 - DNA, 25 bp, Rattus norvegicus
gtctgcttcaaatcttcctttcata

SEQ ID NO: 498560 - DNA, 25 bp, Rattus norvegicus
gtctgcttcactcatgctggtagaa

SEQ ID NO: 498561 - DNA, 25 bp, Rattus norvegicus
gtctgcttcactgatgctggtagaa

SEQ ID NO: 498562 - DNA, 25 bp, Rattus norvegicus
gtctgcttcagtcccgtcggattta

SEQ ID NO: 498563 - DNA, 25 bp, Rattus norvegicus
gtctgcttcagtgccgtcggattta

SEQ ID NO: 498564 - DNA, 25 bp, Rattus norvegicus
gtctgcttcctaagccagtgaggtt

SEQ ID NO: 498565 - DNA, 25 bp, Rattus norvegicus
gtctgcttcctatgccagtgaggtt

SEQ ID NO: 498566 - DNA, 25 bp, Rattus norvegicus
gtctgcttcctcactgtaaatagta

SEQ ID NO: 498567 - DNA, 25 bp, Rattus norvegicus
gtctgcttcctctctgtaaatagta

SEQ ID NO: 498568 - DNA, 25 bp, Rattus norvegicus
gtctgcttctacacgatttgccaaa

SEQ ID NO: 498569 - DNA, 25 bp, Rattus norvegicus
gtctgcttctactcgatttgccaaa

SEQ ID NO: 498570 - DNA, 25 bp, Rattus norvegicus
gtctgcttctagagtttttcaaaca

SEQ ID NO: 498571 - DNA, 25 bp, Rattus norvegicus
gtctgcttctagtgtttttcaaaca

SEQ ID NO: 498572 - DNA, 25 bp, Rattus norvegicus
gtctgcttctctaggcatctgctga

SEQ ID NO: 498573 - DNA, 25 bp, Rattus norvegicus
gtctgcttctctagtgttgggacta

SEQ ID NO: 498574 - DNA, 25 bp, Rattus norvegicus
gtctgcttctcttggcatctgctga

SEQ ID NO: 498575 - DNA, 25 bp, Rattus norvegicus
gtctgcttctcttgtgttgggacta

SEQ ID NO: 498576 - DNA, 25 bp, Rattus norvegicus
gtctgcttctgtcgtctatgcatat

SEQ ID NO: 498577 - DNA, 25 bp, Rattus norvegicus
gtctgcttctgtggtctatgcatat

SEQ ID NO: 498578 - DNA, 25 bp, Rattus norvegicus
gtctgcttctttatactagtgtagg

SEQ ID NO: 498579 - DNA, 25 bp, Rattus norvegicus
gtctgcttctttttactagtgtagg

SEQ ID NO: 498580 - DNA, 25 bp, Rattus norvegicus
gtctgcttgcatagtgtctgtttta

SEQ ID NO: 498581 - DNA, 25 bp, Rattus norvegicus
gtctgcttgcattgtgtctgtttta

SEQ ID NO: 498582 - DNA, 25 bp, Rattus norvegicus
gtctgcttgtccaaaatgaaagttg

SEQ ID NO: 498583 - DNA, 25 bp, Rattus norvegicus
gtctgcttgtcctaaatgaaagttg

SEQ ID NO: 498584 - DNA, 25 bp, Rattus norvegicus
gtctgctttctgactaggtgcatat

SEQ ID NO: 498585 - DNA, 25 bp, Rattus norvegicus
gtctgctttctgtctaggtgcatat

SEQ ID NO: 498586 - DNA, 25 bp, Rattus norvegicus
gtctgctttgctctggactgagcga

SEQ ID NO: 498587 - DNA, 25 bp, Rattus norvegicus
gtctgctttgctgtggactgagcga

SEQ ID NO: 498588 - DNA, 25 bp, Rattus norvegicus
gtctgcttttctacctatgtcatgg

SEQ ID NO: 498589 - DNA, 25 bp, Rattus norvegicus
gtctgcttttcttcctatgtcatgg

SEQ ID NO: 498590 - DNA, 25 bp, Rattus norvegicus
gtctgcttttggaactacacgcatt

SEQ ID NO: 498591 - DNA, 25 bp, Rattus norvegicus
gtctgcttttggacaaaattttgaa

SEQ ID NO: 498592 - DNA, 25 bp, Rattus norvegicus
gtctgcttttggtactacacgcatt

SEQ ID NO: 498593 - DNA, 25 bp, Rattus norvegicus
gtctgcttttggtcaaaattttgaa

SEQ ID NO: 498594 - DNA, 25 bp, Rattus norvegicus
gtctggaaaagcactgagcattctc

SEQ ID NO: 498595 - DNA, 25 bp, Rattus norvegicus
gtctggaaaagctctgagcattctc

SEQ ID NO: 498596 - DNA, 25 bp, Rattus norvegicus
gtctggaaactaaaactgacctttg

SEQ ID NO: 498597 - DNA, 25 bp, Rattus norvegicus
gtctggaaactataactgacctttg

SEQ ID NO: 498598 - DNA, 25 bp, Rattus norvegicus
gtctggaacacacgccgctgggtca

SEQ ID NO: 498599 - DNA, 25 bp, Rattus norvegicus
gtctggaacacaggccgctgggtca

SEQ ID NO: 498600 - DNA, 25 bp, Rattus norvegicus
gtctggaaccagatcagcgtgcaaa

SEQ ID NO: 498601 - DNA, 25 bp, Rattus norvegicus
gtctggaaccagttcagcgtgcaaa

SEQ ID NO: 498602 - DNA, 25 bp, Rattus norvegicus
gtctggaacccgacaacctgaagga

SEQ ID NO: 498603 - DNA, 25 bp, Rattus norvegicus
gtctggaacccgtcaacctgaagga

SEQ ID NO: 498604 - DNA, 25 bp, Rattus norvegicus
gtctggaacctcagcatctggttaa

SEQ ID NO: 498605 - DNA, 25 bp, Rattus norvegicus
gtctggaacctctgcatctggttaa

SEQ ID NO: 498606 - DNA, 25 bp, Rattus norvegicus
gtctggaactctctgaggtccacgt

SEQ ID NO: 498607 - DNA, 25 bp, Rattus norvegicus
gtctggaactctgtgaggtccacgt

SEQ ID NO: 498608 - DNA, 25 bp, Rattus norvegicus
gtctggaagaacacctgtcttgttt

SEQ ID NO: 498609 - DNA, 25 bp, Rattus norvegicus
gtctggaagaactcctgtcttgttt

SEQ ID NO: 498610 - DNA, 25 bp, Rattus norvegicus
gtctggaagatcaccaaaatcaaca

SEQ ID NO: 498611 - DNA, 25 bp, Rattus norvegicus
gtctggaagatctccaaaatcaaca

SEQ ID NO: 498612 - DNA, 25 bp, Rattus norvegicus
gtctggaaggcccagttcacacatt

SEQ ID NO: 498613 - DNA, 25 bp, Rattus norvegicus
gtctggaaggccgagttcacacatt

SEQ ID NO: 498614 - DNA, 25 bp, Rattus norvegicus
gtctggaatacccacaccaagtttg

SEQ ID NO: 498615 - DNA, 25 bp, Rattus norvegicus
gtctggaataccgacaccaagtttg

SEQ ID NO: 498616 - DNA, 25 bp, Rattus norvegicus
gtctggaatttgagaacgggctgca

SEQ ID NO: 498617 - DNA, 25 bp, Rattus norvegicus
gtctggaatttgtgaacgggctgca

SEQ ID NO: 498618 - DNA, 25 bp, Rattus norvegicus
gtctggacaactcactatgatttct

SEQ ID NO: 498619 - DNA, 25 bp, Rattus norvegicus
gtctggacaactgactatgatttct

SEQ ID NO: 498620 - DNA, 25 bp, Rattus norvegicus
gtctggacaatgactgccatctgtt

SEQ ID NO: 498621 - DNA, 25 bp, Rattus norvegicus
gtctggacaatgtctgccatctgtt

SEQ ID NO: 498622 - DNA, 25 bp, Rattus norvegicus
gtctggacacttcttccagcacaat

SEQ ID NO: 498623 - DNA, 25 bp, Rattus norvegicus
gtctggacacttgttccagcacaat

SEQ ID NO: 498624 - DNA, 25 bp, Rattus norvegicus
gtctggacagacaataatagatccc

SEQ ID NO: 498625 - DNA, 25 bp, Rattus norvegicus
gtctggacagactataatagatccc

SEQ ID NO: 498626 - DNA, 25 bp, Rattus norvegicus
gtctggacagctcagtatgttcatt

SEQ ID NO: 498627 - DNA, 25 bp, Rattus norvegicus
gtctggacagctgagtatgttcatt

SEQ ID NO: 498628 - DNA, 25 bp, Rattus norvegicus
gtctggacaggtacccttccaaggg

SEQ ID NO: 498629 - DNA, 25 bp, Rattus norvegicus
gtctggacaggttcccttccaaggg

SEQ ID NO: 498630 - DNA, 25 bp, Rattus norvegicus
gtctggacagtaagtctctgtgttc

SEQ ID NO: 498631 - DNA, 25 bp, Rattus norvegicus
gtctggacagtatgtctctgtgttc

SEQ ID NO: 498632 - DNA, 25 bp, Rattus norvegicus
gtctggacatctcggtgaagttcta

SEQ ID NO: 498633 - DNA, 25 bp, Rattus norvegicus
gtctggacatctgggtgaagttcta

SEQ ID NO: 498634 - DNA, 25 bp, Rattus norvegicus
gtctggaccaggagtgcagcttgat

SEQ ID NO: 498635 - DNA, 25 bp, Rattus norvegicus
gtctggaccaggctgaaaacatatg

SEQ ID NO: 498636 - DNA, 25 bp, Rattus norvegicus
gtctggaccagggtgaaaacatatg

SEQ ID NO: 498637 - DNA, 25 bp, Rattus norvegicus
gtctggaccaggtgtgcagcttgat

SEQ ID NO: 498638 - DNA, 25 bp, Rattus norvegicus
gtctggaccatgctgatggctgcaa

SEQ ID NO: 498639 - DNA, 25 bp, Rattus norvegicus
gtctggaccatggtgatggctgcaa

SEQ ID NO: 498640 - DNA, 25 bp, Rattus norvegicus
gtctggactacacagggatatagtg

SEQ ID NO: 498641 - DNA, 25 bp, Rattus norvegicus
gtctggactacagagggatatagtg

SEQ ID NO: 498642 - DNA, 25 bp, Rattus norvegicus
gtctggacttcacccaacaggactc

SEQ ID NO: 498643 - DNA, 25 bp, Rattus norvegicus
gtctggacttcagccaacaggactc

SEQ ID NO: 498644 - DNA, 25 bp, Rattus norvegicus
gtctggagacgaagttttgaacctt

SEQ ID NO: 498645 - DNA, 25 bp, Rattus norvegicus
gtctggagacgatgttttgaacctt

SEQ ID NO: 498646 - DNA, 25 bp, Rattus norvegicus
gtctggagaggcaggagcccttact

SEQ ID NO: 498647 - DNA, 25 bp, Rattus norvegicus
gtctggagaggctggagcccttact

SEQ ID NO: 498648 - DNA, 25 bp, Rattus norvegicus
gtctggagatctacagagcacagaa

SEQ ID NO: 498649 - DNA, 25 bp, Rattus norvegicus
gtctggagatcttcagagcacagaa

SEQ ID NO: 498650 - DNA, 25 bp, Rattus norvegicus
gtctggagccaactagaagccttca

SEQ ID NO: 498651 - DNA, 25 bp, Rattus norvegicus
gtctggagccaagtagaagccttca

SEQ ID NO: 498652 - DNA, 25 bp, Rattus norvegicus
gtctggagccagcatgctagtgcct

SEQ ID NO: 498653 - DNA, 25 bp, Rattus norvegicus
gtctggagccaggatgctagtgcct

SEQ ID NO: 498654 - DNA, 25 bp, Rattus norvegicus
gtctggagcctcagctgcaaaaggt

SEQ ID NO: 498655 - DNA, 25 bp, Rattus norvegicus
gtctggagcctctgctgcaaaaggt

SEQ ID NO: 498656 - DNA, 25 bp, Rattus norvegicus
gtctggaggccaactgagatcatct

SEQ ID NO: 498657 - DNA, 25 bp, Rattus norvegicus
gtctggaggccatctgagatcatct

SEQ ID NO: 498658 - DNA, 25 bp, Rattus norvegicus
gtctggaggctgctctagcattgta

SEQ ID NO: 498659 - DNA, 25 bp, Rattus norvegicus
gtctggaggctggtctagcattgta

SEQ ID NO: 498660 - DNA, 25 bp, Rattus norvegicus
gtctggaggttcatatctgcatctt

SEQ ID NO: 498661 - DNA, 25 bp, Rattus norvegicus
gtctggaggttcttatctgcatctt

SEQ ID NO: 498662 - DNA, 25 bp, Rattus norvegicus
gtctggagtgtgcatgcacagcctt

SEQ ID NO: 498663 - DNA, 25 bp, Rattus norvegicus
gtctggagtgtggatgcacagcctt

SEQ ID NO: 498664 - DNA, 25 bp, Rattus norvegicus
gtctggataccaagctttcagtgta

SEQ ID NO: 498665 - DNA, 25 bp, Rattus norvegicus
gtctggataccatgctttcagtgta

SEQ ID NO: 498666 - DNA, 25 bp, Rattus norvegicus
gtctggatcagcctgacatcagcaa

SEQ ID NO: 498667 - DNA, 25 bp, Rattus norvegicus
gtctggatcagcgtgacatcagcaa

SEQ ID NO: 498668 - DNA, 25 bp, Rattus norvegicus
gtctggatccaacaccagggtggct

SEQ ID NO: 498669 - DNA, 25 bp, Rattus norvegicus
gtctggatccaagaccagggtggct

SEQ ID NO: 498670 - DNA, 25 bp, Rattus norvegicus
gtctggatccagcaaaggtccgtgt

SEQ ID NO: 498671 - DNA, 25 bp, Rattus norvegicus
gtctggatccaggaaaggtccgtgt

SEQ ID NO: 498672 - DNA, 25 bp, Rattus norvegicus
gtctggatcgacatcattctttcat

SEQ ID NO: 498673 - DNA, 25 bp, Rattus norvegicus
gtctggatcgacttcattctttcat

SEQ ID NO: 498674 - DNA, 25 bp, Rattus norvegicus
gtctggatgtctatcaaattagctt

SEQ ID NO: 498675 - DNA, 25 bp, Rattus norvegicus
gtctggatgtctttcaaattagctt

SEQ ID NO: 498676 - DNA, 25 bp, Rattus norvegicus
gtctggattaccaaaatcactcttc

SEQ ID NO: 498677 - DNA, 25 bp, Rattus norvegicus
gtctggattaccagaatgcaacgga

SEQ ID NO: 498678 - DNA, 25 bp, Rattus norvegicus
gtctggattacctaaatcactcttc

SEQ ID NO: 498679 - DNA, 25 bp, Rattus norvegicus
gtctggattacctgaatgcaacgga

SEQ ID NO: 498680 - DNA, 25 bp, Rattus norvegicus
gtctggattagtatacccgggatga

SEQ ID NO: 498681 - DNA, 25 bp, Rattus norvegicus
gtctggattagtttacccgggatga

SEQ ID NO: 498682 - DNA, 25 bp, Rattus norvegicus
gtctggattggtcatactgctttct

SEQ ID NO: 498683 - DNA, 25 bp, Rattus norvegicus
gtctggattggtgatactgctttct

SEQ ID NO: 498684 - DNA, 25 bp, Rattus norvegicus
gtctggcaactcaacagcgatcatt

SEQ ID NO: 498685 - DNA, 25 bp, Rattus norvegicus
gtctggcaactctacagcgatcatt

SEQ ID NO: 498686 - DNA, 25 bp, Rattus norvegicus
gtctggcaatgtactaaggctctaa

SEQ ID NO: 498687 - DNA, 25 bp, Rattus norvegicus
gtctggcaatgttctaaggctctaa

SEQ ID NO: 498688 - DNA, 25 bp, Rattus norvegicus
gtctggcacccacaagctcagagtg

SEQ ID NO: 498689 - DNA, 25 bp, Rattus norvegicus
gtctggcacccagaagctcagagtg

SEQ ID NO: 498690 - DNA, 25 bp, Rattus norvegicus
gtctggcagatccagtcctgctcag

SEQ ID NO: 498691 - DNA, 25 bp, Rattus norvegicus
gtctggcagatcgagtcctgctcag

SEQ ID NO: 498692 - DNA, 25 bp, Rattus norvegicus
gtctggcagcacattaccctgacaa

SEQ ID NO: 498693 - DNA, 25 bp, Rattus norvegicus
gtctggcagcactttaccctgacaa

SEQ ID NO: 498694 - DNA, 25 bp, Rattus norvegicus
gtctggcaggtaatcccatgattca

SEQ ID NO: 498695 - DNA, 25 bp, Rattus norvegicus
gtctggcaggtattcccatgattca

SEQ ID NO: 498696 - DNA, 25 bp, Rattus norvegicus
gtctggcaggttagcaaaggacagt

SEQ ID NO: 498697 - DNA, 25 bp, Rattus norvegicus
gtctggcaggtttgcaaaggacagt

SEQ ID NO: 498698 - DNA, 25 bp, Rattus norvegicus
gtctggcatggaactgttggtctca

SEQ ID NO: 498699 - DNA, 25 bp, Rattus norvegicus
gtctggcatggatctgttggtctca

SEQ ID NO: 498700 - DNA, 25 bp, Rattus norvegicus
gtctggcattaaaggcattgagtct

SEQ ID NO: 498701 - DNA, 25 bp, Rattus norvegicus
gtctggcattaatggcattgagtct

SEQ ID NO: 498702 - DNA, 25 bp, Rattus norvegicus
gtctggccaccgcactttgcctgga

SEQ ID NO: 498703 - DNA, 25 bp, Rattus norvegicus
gtctggccaccggactttgcctgga

SEQ ID NO: 498704 - DNA, 25 bp, Rattus norvegicus
gtctggccatcccaagtgtggcgtt

SEQ ID NO: 498705 - DNA, 25 bp, Rattus norvegicus
gtctggccatccgaagtgtggcgtt

SEQ ID NO: 498706 - DNA, 25 bp, Rattus norvegicus
gtctggccccagagaggaagctgtc

SEQ ID NO: 498707 - DNA, 25 bp, Rattus norvegicus
gtctggccccagtgaggaagctgtc

SEQ ID NO: 498708 - DNA, 25 bp, Rattus norvegicus
gtctggcccctacaggtgttgacca

SEQ ID NO: 498709 - DNA, 25 bp, Rattus norvegicus
gtctggcccctagaggtgttgacca

SEQ ID NO: 498710 - DNA, 25 bp, Rattus norvegicus
gtctggcccgccatttataaagcaa

SEQ ID NO: 498711 - DNA, 25 bp, Rattus norvegicus
gtctggcccgccttttataaagcaa

SEQ ID NO: 498712 - DNA, 25 bp, Rattus norvegicus
gtctggccggcaaagtcctgagtgt

SEQ ID NO: 498713 - DNA, 25 bp, Rattus norvegicus
gtctggccggcatagtcctgagtgt

SEQ ID NO: 498714 - DNA, 25 bp, Rattus norvegicus
gtctggcctcttagtgccattttta

SEQ ID NO: 498715 - DNA, 25 bp, Rattus norvegicus
gtctggcctctttgtgccattttta

SEQ ID NO: 498716 - DNA, 25 bp, Rattus norvegicus
gtctggcgttctactgctctgcaaa

SEQ ID NO: 498717 - DNA, 25 bp, Rattus norvegicus
gtctggcgttcttctgctctgcaaa

SEQ ID NO: 498718 - DNA, 25 bp, Rattus norvegicus
gtctggctaaagagcactggaccaa

SEQ ID NO: 498719 - DNA, 25 bp, Rattus norvegicus
gtctggctaaagtgcactggaccaa

SEQ ID NO: 498720 - DNA, 25 bp, Rattus norvegicus
gtctggctaattaaatatactcacc

SEQ ID NO: 498721 - DNA, 25 bp, Rattus norvegicus
gtctggctaatttaatatactcacc

SEQ ID NO: 498722 - DNA, 25 bp, Rattus norvegicus
gtctggctacttccgacaatgacgt

SEQ ID NO: 498723 - DNA, 25 bp, Rattus norvegicus
gtctggctacttgcgacaatgacgt

SEQ ID NO: 498724 - DNA, 25 bp, Rattus norvegicus
gtctggctatttagagctgccggaa

SEQ ID NO: 498725 - DNA, 25 bp, Rattus norvegicus
gtctggctattttgagctgccggaa

SEQ ID NO: 498726 - DNA, 25 bp, Rattus norvegicus
gtctggctcagaactttcgggtgga

SEQ ID NO: 498727 - DNA, 25 bp, Rattus norvegicus
gtctggctcagatctttcgggtgga

SEQ ID NO: 498728 - DNA, 25 bp, Rattus norvegicus
gtctggctcatcaggacatttttta

SEQ ID NO: 498729 - DNA, 25 bp, Rattus norvegicus
gtctggctcatctggacatttttta

SEQ ID NO: 498730 - DNA, 25 bp, Rattus norvegicus
gtctggctccagagtactagttgta

SEQ ID NO: 498731 - DNA, 25 bp, Rattus norvegicus
gtctggctccagtgtactagttgta

SEQ ID NO: 498732 - DNA, 25 bp, Rattus norvegicus
gtctggctctctagaagggcaaaag

SEQ ID NO: 498733 - DNA, 25 bp, Rattus norvegicus
gtctggctctcttgaagggcaaaag

SEQ ID NO: 498734 - DNA, 25 bp, Rattus norvegicus
gtctggctctgaagaacacacactg

SEQ ID NO: 498735 - DNA, 25 bp, Rattus norvegicus
gtctggctctgatgaacacacactg

SEQ ID NO: 498736 - DNA, 25 bp, Rattus norvegicus
gtctggctctggctagatttctatt

SEQ ID NO: 498737 - DNA, 25 bp, Rattus norvegicus
gtctggctctgggtagatttctatt

SEQ ID NO: 498738 - DNA, 25 bp, Rattus norvegicus
gtctggctgaataaaggtcttggca

SEQ ID NO: 498739 - DNA, 25 bp, Rattus norvegicus
gtctggctgaattaaggtcttggca

SEQ ID NO: 498740 - DNA, 25 bp, Rattus norvegicus
gtctggctggacacaccagtatcaa

SEQ ID NO: 498741 - DNA, 25 bp, Rattus norvegicus
gtctggctggactcaccagtatcaa

SEQ ID NO: 498742 - DNA, 25 bp, Rattus norvegicus
gtctggctggagatcaggtttgcac

SEQ ID NO: 498743 - DNA, 25 bp, Rattus norvegicus
gtctggctggagttcaggtttgcac

SEQ ID NO: 498744 - DNA, 25 bp, Rattus norvegicus
gtctggcttacaatggagtctgctt

SEQ ID NO: 498745 - DNA, 25 bp, Rattus norvegicus
gtctggcttacattggagtctgctt

SEQ ID NO: 498746 - DNA, 25 bp, Rattus norvegicus
gtctggcttattcagtgtgccacca

SEQ ID NO: 498747 - DNA, 25 bp, Rattus norvegicus
gtctggcttattgagtgtgccacca

SEQ ID NO: 498748 - DNA, 25 bp, Rattus norvegicus
gtctggcttcaacgctcgctcaagt

SEQ ID NO: 498749 - DNA, 25 bp, Rattus norvegicus
gtctggcttcaaggctcgctcaagt

SEQ ID NO: 498750 - DNA, 25 bp, Rattus norvegicus
gtctggctttgtcctggtttaagat

SEQ ID NO: 498751 - DNA, 25 bp, Rattus norvegicus
gtctggctttgtgctggtttaagat

SEQ ID NO: 498752 - DNA, 25 bp, Rattus norvegicus
gtctgggaaataaccacaccgccaa

SEQ ID NO: 498753 - DNA, 25 bp, Rattus norvegicus
gtctgggaaatatccacaccgccaa

SEQ ID NO: 498754 - DNA, 25 bp, Rattus norvegicus
gtctgggaactgctgctgacctcag

SEQ ID NO: 498755 - DNA, 25 bp, Rattus norvegicus
gtctgggaactggtgctgacctcag

SEQ ID NO: 498756 - DNA, 25 bp, Rattus norvegicus
gtctgggaagcaaaccttcaaccca

SEQ ID NO: 498757 - DNA, 25 bp, Rattus norvegicus
gtctgggaagcataccttcaaccca

SEQ ID NO: 498758 - DNA, 25 bp, Rattus norvegicus
gtctgggaatctctaatttgaggcc

SEQ ID NO: 498759 - DNA, 25 bp, Rattus norvegicus
gtctgggaatctcttcagttttgga

SEQ ID NO: 498760 - DNA, 25 bp, Rattus norvegicus
gtctgggaatctgtaatttgaggcc

SEQ ID NO: 498761 - DNA, 25 bp, Rattus norvegicus
gtctgggaatctgttcagttttgga

SEQ ID NO: 498762 - DNA, 25 bp, Rattus norvegicus
gtctgggaccaactcaaaaactgaa

SEQ ID NO: 498763 - DNA, 25 bp, Rattus norvegicus
gtctgggaccaagtcaaaaactgaa

SEQ ID NO: 498764 - DNA, 25 bp, Rattus norvegicus
gtctgggaccatcgaccgagagctc

SEQ ID NO: 498765 - DNA, 25 bp, Rattus norvegicus
gtctgggaccatggaccgagagctc

SEQ ID NO: 498766 - DNA, 25 bp, Rattus norvegicus
gtctgggaccgtattcagtgtatcc

SEQ ID NO: 498767 - DNA, 25 bp, Rattus norvegicus
gtctgggaccgttttcagtgtatcc

SEQ ID NO: 498768 - DNA, 25 bp, Rattus norvegicus
gtctgggaccttagtgatgggtcaa

SEQ ID NO: 498769 - DNA, 25 bp, Rattus norvegicus
gtctgggacctttgtgatgggtcaa

SEQ ID NO: 498770 - DNA, 25 bp, Rattus norvegicus
gtctgggacttcatccctgacaatt

SEQ ID NO: 498771 - DNA, 25 bp, Rattus norvegicus
gtctgggacttcctgattcctgtgt

SEQ ID NO: 498772 - DNA, 25 bp, Rattus norvegicus
gtctgggacttcgtgattcctgtgt

SEQ ID NO: 498773 - DNA, 25 bp, Rattus norvegicus
gtctgggacttcttccctgacaatt

SEQ ID NO: 498774 - DNA, 25 bp, Rattus norvegicus
gtctgggagcccatcaaaatgatgt

SEQ ID NO: 498775 - DNA, 25 bp, Rattus norvegicus
gtctgggagcccttcaaaatgatgt

SEQ ID NO: 498776 - DNA, 25 bp, Rattus norvegicus
gtctgggaggcacatttatgcactt

SEQ ID NO: 498777 - DNA, 25 bp, Rattus norvegicus
gtctgggaggcagatttatgcactt

SEQ ID NO: 498778 - DNA, 25 bp, Rattus norvegicus
gtctgggatagcctggcatcatgaa

SEQ ID NO: 498779 - DNA, 25 bp, Rattus norvegicus
gtctgggatagcgtggcatcatgaa

SEQ ID NO: 498780 - DNA, 25 bp, Rattus norvegicus
gtctgggatggccatgctcagtatc

SEQ ID NO: 498781 - DNA, 25 bp, Rattus norvegicus
gtctgggatggcgatgctcagtatc

SEQ ID NO: 498782 - DNA, 25 bp, Rattus norvegicus
gtctgggattatctggccttagcta

SEQ ID NO: 498783 - DNA, 25 bp, Rattus norvegicus
gtctgggattatgtggccttagcta

SEQ ID NO: 498784 - DNA, 25 bp, Rattus norvegicus
gtctgggattccaccaaccacatga

SEQ ID NO: 498785 - DNA, 25 bp, Rattus norvegicus
gtctgggattcctccaaccacatga

SEQ ID NO: 498786 - DNA, 25 bp, Rattus norvegicus
gtctgggatttaaaccctacgcaca

SEQ ID NO: 498787 - DNA, 25 bp, Rattus norvegicus
gtctgggatttataccctacgcaca

SEQ ID NO: 498788 - DNA, 25 bp, Rattus norvegicus
gtctgggcaaagaaaaccggcttct

SEQ ID NO: 498789 - DNA, 25 bp, Rattus norvegicus
gtctgggcaaagtaaaccggcttct

SEQ ID NO: 498790 - DNA, 25 bp, Rattus norvegicus
gtctgggcaccacttatccatgtga

SEQ ID NO: 498791 - DNA, 25 bp, Rattus norvegicus
gtctgggcaccagttatccatgtga

SEQ ID NO: 498792 - DNA, 25 bp, Rattus norvegicus
gtctgggcatgtctgcacaagcaat

SEQ ID NO: 498793 - DNA, 25 bp, Rattus norvegicus
gtctgggcatgtgtgcacaagcaat

SEQ ID NO: 498794 - DNA, 25 bp, Rattus norvegicus
gtctgggccgccacagagttgagat

SEQ ID NO: 498795 - DNA, 25 bp, Rattus norvegicus
gtctgggccgcctcagagttgagat

SEQ ID NO: 498796 - DNA, 25 bp, Rattus norvegicus
gtctgggcgtgcattagttcgtaat

SEQ ID NO: 498797 - DNA, 25 bp, Rattus norvegicus
gtctgggcgtgctttagttcgtaat

SEQ ID NO: 498798 - DNA, 25 bp, Rattus norvegicus
gtctgggctaaaagtttctgatcaa

SEQ ID NO: 498799 - DNA, 25 bp, Rattus norvegicus
gtctgggctaaatgtttctgatcaa

SEQ ID NO: 498800 - DNA, 25 bp, Rattus norvegicus
gtctgggctactatatttctggttt

SEQ ID NO: 498801 - DNA, 25 bp, Rattus norvegicus
gtctgggctactttatttctggttt

SEQ ID NO: 498802 - DNA, 25 bp, Rattus norvegicus
gtctgggctataattatggctggca

SEQ ID NO: 498803 - DNA, 25 bp, Rattus norvegicus
gtctgggctatatttatggctggca

SEQ ID NO: 498804 - DNA, 25 bp, Rattus norvegicus
gtctgggctcagctgtgagaccaca

SEQ ID NO: 498805 - DNA, 25 bp, Rattus norvegicus
gtctgggctcaggtgtgagaccaca

SEQ ID NO: 498806 - DNA, 25 bp, Rattus norvegicus
gtctgggctgctagacacctcgtga

SEQ ID NO: 498807 - DNA, 25 bp, Rattus norvegicus
gtctgggctgctctgacaatcagta

SEQ ID NO: 498808 - DNA, 25 bp, Rattus norvegicus
gtctgggctgctgtgacaatcagta

SEQ ID NO: 498809 - DNA, 25 bp, Rattus norvegicus
gtctgggctgcttgacacctcgtga

SEQ ID NO: 498810 - DNA, 25 bp, Rattus norvegicus
gtctgggcttctatatagtagtcct

SEQ ID NO: 498811 - DNA, 25 bp, Rattus norvegicus
gtctgggcttctttatagtagtcct

SEQ ID NO: 498812 - DNA, 25 bp, Rattus norvegicus
gtctgggcttgcagaagataggatt

SEQ ID NO: 498813 - DNA, 25 bp, Rattus norvegicus
gtctgggcttgctgaagataggatt

SEQ ID NO: 498814 - DNA, 25 bp, Rattus norvegicus
gtctgggtaaacctgctctactgag

SEQ ID NO: 498815 - DNA, 25 bp, Rattus norvegicus
gtctgggtaaacgtgctctactgag

SEQ ID NO: 498816 - DNA, 25 bp, Rattus norvegicus
gtctgggtacttatttcacgctaca

SEQ ID NO: 498817 - DNA, 25 bp, Rattus norvegicus
gtctgggtacttttttcacgctaca

SEQ ID NO: 498818 - DNA, 25 bp, Rattus norvegicus
gtctgggtagaaccacagcctggct

SEQ ID NO: 498819 - DNA, 25 bp, Rattus norvegicus
gtctgggtagaagcacagcctggct

SEQ ID NO: 498820 - DNA, 25 bp, Rattus norvegicus
gtctgggtagccaacttgtcatgta

SEQ ID NO: 498821 - DNA, 25 bp, Rattus norvegicus
gtctgggtagcctacttgtcatgta

SEQ ID NO: 498822 - DNA, 25 bp, Rattus norvegicus
gtctgggtcacgcagctcaataact

SEQ ID NO: 498823 - DNA, 25 bp, Rattus norvegicus
gtctgggtcacggagctcaataact

SEQ ID NO: 498824 - DNA, 25 bp, Rattus norvegicus
gtctgggtcagacacattccactga

SEQ ID NO: 498825 - DNA, 25 bp, Rattus norvegicus
gtctgggtcagagacattccactga

SEQ ID NO: 498826 - DNA, 25 bp, Rattus norvegicus
gtctgggtctcaatttattttctaa

SEQ ID NO: 498827 - DNA, 25 bp, Rattus norvegicus
gtctgggtctcattttattttctaa

SEQ ID NO: 498828 - DNA, 25 bp, Rattus norvegicus
gtctgggtctccagtacatatacgc

SEQ ID NO: 498829 - DNA, 25 bp, Rattus norvegicus
gtctgggtctcctgtacatatacgc

SEQ ID NO: 498830 - DNA, 25 bp, Rattus norvegicus
gtctgggtcttcatacatcattcaa

SEQ ID NO: 498831 - DNA, 25 bp, Rattus norvegicus
gtctgggtcttcttacatcattcaa

SEQ ID NO: 498832 - DNA, 25 bp, Rattus norvegicus
gtctgggtgtttactggatcctcca

SEQ ID NO: 498833 - DNA, 25 bp, Rattus norvegicus
gtctgggtgtttacttgaagcactg

SEQ ID NO: 498834 - DNA, 25 bp, Rattus norvegicus
gtctgggtgttttctggatcctcca

SEQ ID NO: 498835 - DNA, 25 bp, Rattus norvegicus
gtctgggtgttttcttgaagcactg

SEQ ID NO: 498836 - DNA, 25 bp, Rattus norvegicus
gtctgggttctcattagaagtacac

SEQ ID NO: 498837 - DNA, 25 bp, Rattus norvegicus
gtctgggttctccttaattattctt

SEQ ID NO: 498838 - DNA, 25 bp, Rattus norvegicus
gtctgggttctcgttaattattctt

SEQ ID NO: 498839 - DNA, 25 bp, Rattus norvegicus
gtctgggttctctttagaagtacac

SEQ ID NO: 498840 - DNA, 25 bp, Rattus norvegicus
gtctgggttctgctgtgaaactcat

SEQ ID NO: 498841 - DNA, 25 bp, Rattus norvegicus
gtctgggttctggtgtgaaactcat

SEQ ID NO: 498842 - DNA, 25 bp, Rattus norvegicus
gtctgggttgctctcttcaagaaca

SEQ ID NO: 498843 - DNA, 25 bp, Rattus norvegicus
gtctgggttgctgtcttcaagaaca

SEQ ID NO: 498844 - DNA, 25 bp, Rattus norvegicus
gtctggtaatcacaaggccctaagt

SEQ ID NO: 498845 - DNA, 25 bp, Rattus norvegicus
gtctggtaatcagaaggccctaagt

SEQ ID NO: 498846 - DNA, 25 bp, Rattus norvegicus
gtctggtaccttccctgtagtttaa

SEQ ID NO: 498847 - DNA, 25 bp, Rattus norvegicus
gtctggtaccttgcctgtagtttaa

SEQ ID NO: 498848 - DNA, 25 bp, Rattus norvegicus
gtctggtagcctatgcgtttaacaa

SEQ ID NO: 498849 - DNA, 25 bp, Rattus norvegicus
gtctggtagcctttgcgtttaacaa

SEQ ID NO: 498850 - DNA, 25 bp, Rattus norvegicus
gtctggtagctgctgaaacgcacaa

SEQ ID NO: 498851 - DNA, 25 bp, Rattus norvegicus
gtctggtagctggtgaaacgcacaa

SEQ ID NO: 498852 - DNA, 25 bp, Rattus norvegicus
gtctggtatacactaggtgctcata

SEQ ID NO: 498853 - DNA, 25 bp, Rattus norvegicus
gtctggtatacagtaggtgctcata

SEQ ID NO: 498854 - DNA, 25 bp, Rattus norvegicus
gtctggtcacttaactaaattccta

SEQ ID NO: 498855 - DNA, 25 bp, Rattus norvegicus
gtctggtcactttactaaattccta

SEQ ID NO: 498856 - DNA, 25 bp, Rattus norvegicus
gtctggtcagtaaagtaagccctcc

SEQ ID NO: 498857 - DNA, 25 bp, Rattus norvegicus
gtctggtcagtatagtaagccctcc

SEQ ID NO: 498858 - DNA, 25 bp, Rattus norvegicus
gtctggtcagtcaacatcgacatga

SEQ ID NO: 498859 - DNA, 25 bp, Rattus norvegicus
gtctggtcagtctacatcgacatga

SEQ ID NO: 498860 - DNA, 25 bp, Rattus norvegicus
gtctggtcatcaaaacgcgttcatt

SEQ ID NO: 498861 - DNA, 25 bp, Rattus norvegicus
gtctggtcatcataacgcgttcatt

SEQ ID NO: 498862 - DNA, 25 bp, Rattus norvegicus
gtctggtccaagattccgaagtggc

SEQ ID NO: 498863 - DNA, 25 bp, Rattus norvegicus
gtctggtccaagtttccgaagtggc

SEQ ID NO: 498864 - DNA, 25 bp, Rattus norvegicus
gtctggtccaggcataatggcatat

SEQ ID NO: 498865 - DNA, 25 bp, Rattus norvegicus
gtctggtccagggataatggcatat

SEQ ID NO: 498866 - DNA, 25 bp, Rattus norvegicus
gtctggtccctcatagtgacactta

SEQ ID NO: 498867 - DNA, 25 bp, Rattus norvegicus
gtctggtccctcttagtgacactta

SEQ ID NO: 498868 - DNA, 25 bp, Rattus norvegicus
gtctggtccctgctttgagtcctgt

SEQ ID NO: 498869 - DNA, 25 bp, Rattus norvegicus
gtctggtccctggtttgagtcctgt

SEQ ID NO: 498870 - DNA, 25 bp, Rattus norvegicus
gtctggtctaatagagcctggccaa

SEQ ID NO: 498871 - DNA, 25 bp, Rattus norvegicus
gtctggtctaattgagcctggccaa

SEQ ID NO: 498872 - DNA, 25 bp, Rattus norvegicus
gtctggtcttgtctttgtctttgtc

SEQ ID NO: 498873 - DNA, 25 bp, Rattus norvegicus
gtctggtcttgtgtttgtctttgtc

SEQ ID NO: 498874 - DNA, 25 bp, Rattus norvegicus
gtctggtgacacctgtttcacagca

SEQ ID NO: 498875 - DNA, 25 bp, Rattus norvegicus
gtctggtgacacgtgtttcacagca

SEQ ID NO: 498876 - DNA, 25 bp, Rattus norvegicus
gtctggtgcacgacccaagtaataa

SEQ ID NO: 498877 - DNA, 25 bp, Rattus norvegicus
gtctggtgcacgtcccaagtaataa

SEQ ID NO: 498878 - DNA, 25 bp, Rattus norvegicus
gtctggtggcacaagacctgccatt

SEQ ID NO: 498879 - DNA, 25 bp, Rattus norvegicus
gtctggtggcactagacctgccatt

SEQ ID NO: 498880 - DNA, 25 bp, Rattus norvegicus
gtctggtggtcaaagcttaccttat

SEQ ID NO: 498881 - DNA, 25 bp, Rattus norvegicus
gtctggtggtcacccacggagcaac

SEQ ID NO: 498882 - DNA, 25 bp, Rattus norvegicus
gtctggtggtcagccacggagcaac

SEQ ID NO: 498883 - DNA, 25 bp, Rattus norvegicus
gtctggtggtcatagcttaccttat

SEQ ID NO: 498884 - DNA, 25 bp, Rattus norvegicus
gtctggtgtgccacattaactgtgc

SEQ ID NO: 498885 - DNA, 25 bp, Rattus norvegicus
gtctggtgtgcctcattaactgtgc

SEQ ID NO: 498886 - DNA, 25 bp, Rattus norvegicus
gtctggtgtgctcctacagttgtaa

SEQ ID NO: 498887 - DNA, 25 bp, Rattus norvegicus
gtctggtgtgctgctacagttgtaa

SEQ ID NO: 498888 - DNA, 25 bp, Rattus norvegicus
gtctggttacacattggagcacaaa

SEQ ID NO: 498889 - DNA, 25 bp, Rattus norvegicus
gtctggttacactttggagcacaaa

SEQ ID NO: 498890 - DNA, 25 bp, Rattus norvegicus
gtctggttaggacactctggtctaa

SEQ ID NO: 498891 - DNA, 25 bp, Rattus norvegicus
gtctggttaggagactctggtctaa

SEQ ID NO: 498892 - DNA, 25 bp, Rattus norvegicus
gtctggttctacaagttgatcgtgt

SEQ ID NO: 498893 - DNA, 25 bp, Rattus norvegicus
gtctggttctactagttgatcgtgt

SEQ ID NO: 498894 - DNA, 25 bp, Rattus norvegicus
gtctggttctcaataaagcatcacg

SEQ ID NO: 498895 - DNA, 25 bp, Rattus norvegicus
gtctggttctcaattccaacagttt

SEQ ID NO: 498896 - DNA, 25 bp, Rattus norvegicus
gtctggttctcattaaagcatcacg

SEQ ID NO: 498897 - DNA, 25 bp, Rattus norvegicus
gtctggttctcatttccaacagttt

SEQ ID NO: 498898 - DNA, 25 bp, Rattus norvegicus
gtctggttctggaaccccttaggca

SEQ ID NO: 498899 - DNA, 25 bp, Rattus norvegicus
gtctggttctggtaccccttaggca

SEQ ID NO: 498900 - DNA, 25 bp, Rattus norvegicus
gtctggttcttacattggttctgtc

SEQ ID NO: 498901 - DNA, 25 bp, Rattus norvegicus
gtctggttcttagattggttctgtc

SEQ ID NO: 498902 - DNA, 25 bp, Rattus norvegicus
gtctggttgggcatgaacttcatcc

SEQ ID NO: 498903 - DNA, 25 bp, Rattus norvegicus
gtctggttgggcttgaacttcatcc

SEQ ID NO: 498904 - DNA, 25 bp, Rattus norvegicus
gtctggtttctaaaaagttcctggt

SEQ ID NO: 498905 - DNA, 25 bp, Rattus norvegicus
gtctggtttctataaagttcctggt

SEQ ID NO: 498906 - DNA, 25 bp, Rattus norvegicus
gtctggtttctgaggaatctgttac

SEQ ID NO: 498907 - DNA, 25 bp, Rattus norvegicus
gtctggtttctgtggaatctgttac

SEQ ID NO: 498908 - DNA, 25 bp, Rattus norvegicus
gtctggtttggtctgaagtgtcttt

SEQ ID NO: 498909 - DNA, 25 bp, Rattus norvegicus
gtctggtttggtgtgaagtgtcttt

SEQ ID NO: 498910 - DNA, 25 bp, Rattus norvegicus
gtctggtttgttaacttgtccttat

SEQ ID NO: 498911 - DNA, 25 bp, Rattus norvegicus
gtctggtttgtttacttgtccttat

SEQ ID NO: 498912 - DNA, 25 bp, Rattus norvegicus
gtctggttttaaccattagcctctc

SEQ ID NO: 498913 - DNA, 25 bp, Rattus norvegicus
gtctggttttaagcattagcctctc

SEQ ID NO: 498914 - DNA, 25 bp, Rattus norvegicus
gtctggttttggctcttttattgaa

SEQ ID NO: 498915 - DNA, 25 bp, Rattus norvegicus
gtctggttttgggtcttttattgaa

SEQ ID NO: 498916 - DNA, 25 bp, Rattus norvegicus
gtctgtaaaactctcctcacaattg

SEQ ID NO: 498917 - DNA, 25 bp, Rattus norvegicus
gtctgtaaaactgtcctcacaattg

SEQ ID NO: 498918 - DNA, 25 bp, Rattus norvegicus
gtctgtaaaatgatgctctcccttc

SEQ ID NO: 498919 - DNA, 25 bp, Rattus norvegicus
gtctgtaaaatgatggattccaccg

SEQ ID NO: 498920 - DNA, 25 bp, Rattus norvegicus
gtctgtaaaatgttgctctcccttc

SEQ ID NO: 498921 - DNA, 25 bp, Rattus norvegicus
gtctgtaaaatgttggattccaccg

SEQ ID NO: 498922 - DNA, 25 bp, Rattus norvegicus
gtctgtaaacagcaccaatttgatt

SEQ ID NO: 498923 - DNA, 25 bp, Rattus norvegicus
gtctgtaaacaggaccaatttgatt

SEQ ID NO: 498924 - DNA, 25 bp, Rattus norvegicus
gtctgtaaagctacccagctcttga

SEQ ID NO: 498925 - DNA, 25 bp, Rattus norvegicus
gtctgtaaagcttcccagctcttga

SEQ ID NO: 498926 - DNA, 25 bp, Rattus norvegicus
gtctgtaaatatacttcctcactga

SEQ ID NO: 498927 - DNA, 25 bp, Rattus norvegicus
gtctgtaaatattcttcctcactga

SEQ ID NO: 498928 - DNA, 25 bp, Rattus norvegicus
gtctgtaacccactctggcctggaa

SEQ ID NO: 498929 - DNA, 25 bp, Rattus norvegicus
gtctgtaacccagtctggcctggaa

SEQ ID NO: 498930 - DNA, 25 bp, Rattus norvegicus
gtctgtaacctactaagctgtgtct

SEQ ID NO: 498931 - DNA, 25 bp, Rattus norvegicus
gtctgtaacctagtaagctgtgtct

SEQ ID NO: 498932 - DNA, 25 bp, Rattus norvegicus
gtctgtaactatcgtcccagagggc

SEQ ID NO: 498933 - DNA, 25 bp, Rattus norvegicus
gtctgtaactatggtcccagagggc

SEQ ID NO: 498934 - DNA, 25 bp, Rattus norvegicus
gtctgtaagattcccagcagctgca

SEQ ID NO: 498935 - DNA, 25 bp, Rattus norvegicus
gtctgtaagattgccagcagctgca

SEQ ID NO: 498936 - DNA, 25 bp, Rattus norvegicus
gtctgtaagccacctccagttaagt

SEQ ID NO: 498937 - DNA, 25 bp, Rattus norvegicus
gtctgtaagccagctccagttaagt

SEQ ID NO: 498938 - DNA, 25 bp, Rattus norvegicus
gtctgtaatttcaaggccaagcctg

SEQ ID NO: 498939 - DNA, 25 bp, Rattus norvegicus
gtctgtaatttctaggccaagcctg

SEQ ID NO: 498940 - DNA, 25 bp, Rattus norvegicus
gtctgtaattttccaaattgttgtc

SEQ ID NO: 498941 - DNA, 25 bp, Rattus norvegicus
gtctgtaattttgcaaattgttgtc

SEQ ID NO: 498942 - DNA, 25 bp, Rattus norvegicus
gtctgtacagtaagcactttgccaa

SEQ ID NO: 498943 - DNA, 25 bp, Rattus norvegicus
gtctgtacagtatgcactttgccaa

SEQ ID NO: 498944 - DNA, 25 bp, Rattus norvegicus
gtctgtaccaggagatgactccttc

SEQ ID NO: 498945 - DNA, 25 bp, Rattus norvegicus
gtctgtaccaggtgatgactccttc

SEQ ID NO: 498946 - DNA, 25 bp, Rattus norvegicus
gtctgtacccaaacaatatcctcat

SEQ ID NO: 498947 - DNA, 25 bp, Rattus norvegicus
gtctgtacccaatcaatatcctcat

SEQ ID NO: 498948 - DNA, 25 bp, Rattus norvegicus
gtctgtaccgccctgaaagaggtct

SEQ ID NO: 498949 - DNA, 25 bp, Rattus norvegicus
gtctgtaccgccgtgaaagaggtct

SEQ ID NO: 498950 - DNA, 25 bp, Rattus norvegicus
gtctgtacctcgagtgtatctgaag

SEQ ID NO: 498951 - DNA, 25 bp, Rattus norvegicus
gtctgtacctcgtgtgtatctgaag

SEQ ID NO: 498952 - DNA, 25 bp, Rattus norvegicus
gtctgtacctgtccagtggatctgt

SEQ ID NO: 498953 - DNA, 25 bp, Rattus norvegicus
gtctgtacctgtgcagtggatctgt

SEQ ID NO: 498954 - DNA, 25 bp, Rattus norvegicus
gtctgtaccttgaaagctgctgctg

SEQ ID NO: 498955 - DNA, 25 bp, Rattus norvegicus
gtctgtaccttgtaagctgctgctg

SEQ ID NO: 498956 - DNA, 25 bp, Rattus norvegicus
gtctgtacgatgctggcttaccttt

SEQ ID NO: 498957 - DNA, 25 bp, Rattus norvegicus
gtctgtacgatggtggcttaccttt

SEQ ID NO: 498958 - DNA, 25 bp, Rattus norvegicus
gtctgtactcagcactcgggtgatt

SEQ ID NO: 498959 - DNA, 25 bp, Rattus norvegicus
gtctgtactcaggactcgggtgatt

SEQ ID NO: 498960 - DNA, 25 bp, Rattus norvegicus
gtctgtacttgcatgggttccattc

SEQ ID NO: 498961 - DNA, 25 bp, Rattus norvegicus
gtctgtacttgcttgggttccattc

SEQ ID NO: 498962 - DNA, 25 bp, Rattus norvegicus
gtctgtagaacacctcttctgcttt

SEQ ID NO: 498963 - DNA, 25 bp, Rattus norvegicus
gtctgtagaacagctcttctgcttt

SEQ ID NO: 498964 - DNA, 25 bp, Rattus norvegicus
gtctgtagacgcatcatcttgtgaa

SEQ ID NO: 498965 - DNA, 25 bp, Rattus norvegicus
gtctgtagacgcttcatcttgtgaa

SEQ ID NO: 498966 - DNA, 25 bp, Rattus norvegicus
gtctgtagatagactagcttcagct

SEQ ID NO: 498967 - DNA, 25 bp, Rattus norvegicus
gtctgtagatagtctagcttcagct

SEQ ID NO: 498968 - DNA, 25 bp, Rattus norvegicus
gtctgtagatgtaagccctatccta

SEQ ID NO: 498969 - DNA, 25 bp, Rattus norvegicus
gtctgtagatgtagactggccgcca

SEQ ID NO: 498970 - DNA, 25 bp, Rattus norvegicus
gtctgtagatgttagccctatccta

SEQ ID NO: 498971 - DNA, 25 bp, Rattus norvegicus
gtctgtagatgttgactggccgcca

SEQ ID NO: 498972 - DNA, 25 bp, Rattus norvegicus
gtctgtagccaaaagctgtttccaa

SEQ ID NO: 498973 - DNA, 25 bp, Rattus norvegicus
gtctgtagccaatagctgtttccaa

SEQ ID NO: 498974 - DNA, 25 bp, Rattus norvegicus
gtctgtagcctgaacacctgggaga

SEQ ID NO: 498975 - DNA, 25 bp, Rattus norvegicus
gtctgtagcctgtacacctgggaga

SEQ ID NO: 498976 - DNA, 25 bp, Rattus norvegicus
gtctgtagctgtcctccaggtctca

SEQ ID NO: 498977 - DNA, 25 bp, Rattus norvegicus
gtctgtagctgtcttcatcaagctt

SEQ ID NO: 498978 - DNA, 25 bp, Rattus norvegicus
gtctgtagctgtgctccaggtctca

SEQ ID NO: 498979 - DNA, 25 bp, Rattus norvegicus
gtctgtagctgtgttcatcaagctt

SEQ ID NO: 498980 - DNA, 25 bp, Rattus norvegicus
gtctgtagggctcccagaaggcctt

SEQ ID NO: 498981 - DNA, 25 bp, Rattus norvegicus
gtctgtagggctgccagaaggcctt

SEQ ID NO: 498982 - DNA, 25 bp, Rattus norvegicus
gtctgtagtatcatgattcccgcaa

SEQ ID NO: 498983 - DNA, 25 bp, Rattus norvegicus
gtctgtagtatcttgattcccgcaa

SEQ ID NO: 498984 - DNA, 25 bp, Rattus norvegicus
gtctgtataacacctactgtatata

SEQ ID NO: 498985 - DNA, 25 bp, Rattus norvegicus
gtctgtataacagctactgtatata

SEQ ID NO: 498986 - DNA, 25 bp, Rattus norvegicus
gtctgtatcctaagcgctggccttt

SEQ ID NO: 498987 - DNA, 25 bp, Rattus norvegicus
gtctgtatcctatgcgctggccttt

SEQ ID NO: 498988 - DNA, 25 bp, Rattus norvegicus
gtctgtatctgtaaaagggcttttc

SEQ ID NO: 498989 - DNA, 25 bp, Rattus norvegicus
gtctgtatctgttaaagggcttttc

SEQ ID NO: 498990 - DNA, 25 bp, Rattus norvegicus
gtctgtatgcacatgctgggtgact

SEQ ID NO: 498991 - DNA, 25 bp, Rattus norvegicus
gtctgtatgcacttgctgggtgact

SEQ ID NO: 498992 - DNA, 25 bp, Rattus norvegicus
gtctgtattatcaggcatatgcttc

SEQ ID NO: 498993 - DNA, 25 bp, Rattus norvegicus
gtctgtattatctggcatatgcttc

SEQ ID NO: 498994 - DNA, 25 bp, Rattus norvegicus
gtctgtattcttattctcacctgag

SEQ ID NO: 498995 - DNA, 25 bp, Rattus norvegicus
gtctgtattctttttctcacctgag

SEQ ID NO: 498996 - DNA, 25 bp, Rattus norvegicus
gtctgtatttaaacgttttcttctc

SEQ ID NO: 498997 - DNA, 25 bp, Rattus norvegicus
gtctgtatttaatcgttttcttctc

SEQ ID NO: 498998 - DNA, 25 bp, Rattus norvegicus
gtctgtcaaaagctcaaaccgttaa

SEQ ID NO: 498999 - DNA, 25 bp, Rattus norvegicus
gtctgtcaaaaggtcaaaccgttaa

SEQ ID NO: 499000 - DNA, 25 bp, Rattus norvegicus
gtctgtcaaagtaactctgcataca

SEQ ID NO: 499001 - DNA, 25 bp, Rattus norvegicus
gtctgtcaaagttactctgcataca

SEQ ID NO: 499002 - DNA, 25 bp, Rattus norvegicus
gtctgtcaacagcaagtcatccttg

SEQ ID NO: 499003 - DNA, 25 bp, Rattus norvegicus
gtctgtcaacaggaagtcatccttg

SEQ ID NO: 499004 - DNA, 25 bp, Rattus norvegicus
gtctgtcactgccagcatccaagcg

SEQ ID NO: 499005 - DNA, 25 bp, Rattus norvegicus
gtctgtcactgcgagcatccaagcg

SEQ ID NO: 499006 - DNA, 25 bp, Rattus norvegicus
gtctgtcacttacctacttgtcgaa

SEQ ID NO: 499007 - DNA, 25 bp, Rattus norvegicus
gtctgtcacttagctacttgtcgaa

SEQ ID NO: 499008 - DNA, 25 bp, Rattus norvegicus
gtctgtcagcccagcactctggagt

SEQ ID NO: 499009 - DNA, 25 bp, Rattus norvegicus
gtctgtcagccctgcactctggagt

SEQ ID NO: 499010 - DNA, 25 bp, Rattus norvegicus
gtctgtcagcctcctgtacagtaga

SEQ ID NO: 499011 - DNA, 25 bp, Rattus norvegicus
gtctgtcagcctgctgtacagtaga

SEQ ID NO: 499012 - DNA, 25 bp, Rattus norvegicus
gtctgtcagctgcaaggtcctggct

SEQ ID NO: 499013 - DNA, 25 bp, Rattus norvegicus
gtctgtcagctggaaggtcctggct

SEQ ID NO: 499014 - DNA, 25 bp, Rattus norvegicus
gtctgtcaggctatcctaggaaatg

SEQ ID NO: 499015 - DNA, 25 bp, Rattus norvegicus
gtctgtcaggctttcctaggaaatg

SEQ ID NO: 499016 - DNA, 25 bp, Rattus norvegicus
gtctgtcagggcaggataaccaaca

SEQ ID NO: 499017 - DNA, 25 bp, Rattus norvegicus
gtctgtcagggctggataaccaaca

SEQ ID NO: 499018 - DNA, 25 bp, Rattus norvegicus
gtctgtcagtagctggatccatccc

SEQ ID NO: 499019 - DNA, 25 bp, Rattus norvegicus
gtctgtcagtaggtggatccatccc

SEQ ID NO: 499020 - DNA, 25 bp, Rattus norvegicus
gtctgtcatccaataagtgttccca

SEQ ID NO: 499021 - DNA, 25 bp, Rattus norvegicus
gtctgtcatccattaagtgttccca

SEQ ID NO: 499022 - DNA, 25 bp, Rattus norvegicus
gtctgtccaggtacatacaagggtt

SEQ ID NO: 499023 - DNA, 25 bp, Rattus norvegicus
gtctgtccaggttcatacaagggtt

SEQ ID NO: 499024 - DNA, 25 bp, Rattus norvegicus
gtctgtccagtgacccatttataaa

SEQ ID NO: 499025 - DNA, 25 bp, Rattus norvegicus
gtctgtccagtgtcccatttataaa

SEQ ID NO: 499026 - DNA, 25 bp, Rattus norvegicus
gtctgtccatccatacaattcttag

SEQ ID NO: 499027 - DNA, 25 bp, Rattus norvegicus
gtctgtccatccttacaattcttag

SEQ ID NO: 499028 - DNA, 25 bp, Rattus norvegicus
gtctgtcccacaagatcgttataat

SEQ ID NO: 499029 - DNA, 25 bp, Rattus norvegicus
gtctgtcccacatgatcgttataat

SEQ ID NO: 499030 - DNA, 25 bp, Rattus norvegicus
gtctgtccgatccaaattttcaaaa

SEQ ID NO: 499031 - DNA, 25 bp, Rattus norvegicus
gtctgtccgatcgaaattttcaaaa

SEQ ID NO: 499032 - DNA, 25 bp, Rattus norvegicus
gtctgtcctatcagctactgaatgt

SEQ ID NO: 499033 - DNA, 25 bp, Rattus norvegicus
gtctgtcctatctgctactgaatgt

SEQ ID NO: 499034 - DNA, 25 bp, Rattus norvegicus
gtctgtcctcagaaatgctgtgggt

SEQ ID NO: 499035 - DNA, 25 bp, Rattus norvegicus
gtctgtcctcagtaatgctgtgggt

SEQ ID NO: 499036 - DNA, 25 bp, Rattus norvegicus
gtctgtcctcatagccaacatttta

SEQ ID NO: 499037 - DNA, 25 bp, Rattus norvegicus
gtctgtcctcattgccaacatttta

SEQ ID NO: 499038 - DNA, 25 bp, Rattus norvegicus
gtctgtcctgccacagaacagaagt

SEQ ID NO: 499039 - DNA, 25 bp, Rattus norvegicus
gtctgtcctgcctcagaacagaagt

SEQ ID NO: 499040 - DNA, 25 bp, Rattus norvegicus
gtctgtcctgtcctaggtatgccta

SEQ ID NO: 499041 - DNA, 25 bp, Rattus norvegicus
gtctgtcctgtcgtaggtatgccta

SEQ ID NO: 499042 - DNA, 25 bp, Rattus norvegicus
gtctgtccttacagagccgcaataa

SEQ ID NO: 499043 - DNA, 25 bp, Rattus norvegicus
gtctgtccttacctttatgtgcaat

SEQ ID NO: 499044 - DNA, 25 bp, Rattus norvegicus
gtctgtccttacgtttatgtgcaat

SEQ ID NO: 499045 - DNA, 25 bp, Rattus norvegicus
gtctgtccttactgagccgcaataa

SEQ ID NO: 499046 - DNA, 25 bp, Rattus norvegicus
gtctgtccttgtacctttgaaacta

SEQ ID NO: 499047 - DNA, 25 bp, Rattus norvegicus
gtctgtccttgttcctttgaaacta

SEQ ID NO: 499048 - DNA, 25 bp, Rattus norvegicus
gtctgtcggactattgttcctttca

SEQ ID NO: 499049 - DNA, 25 bp, Rattus norvegicus
gtctgtcggacttttgttcctttca

SEQ ID NO: 499050 - DNA, 25 bp, Rattus norvegicus
gtctgtcgtacaatcttggttaata

SEQ ID NO: 499051 - DNA, 25 bp, Rattus norvegicus
gtctgtcgtacattcttggttaata

SEQ ID NO: 499052 - DNA, 25 bp, Rattus norvegicus
gtctgtcgtataacgcaggcacatt

SEQ ID NO: 499053 - DNA, 25 bp, Rattus norvegicus
gtctgtcgtatatcgcaggcacatt

SEQ ID NO: 499054 - DNA, 25 bp, Rattus norvegicus
gtctgtcgtgcccaaagtaactcac

SEQ ID NO: 499055 - DNA, 25 bp, Rattus norvegicus
gtctgtcgtgccgaaagtaactcac

SEQ ID NO: 499056 - DNA, 25 bp, Rattus norvegicus
gtctgtcgtgttaaagggattttca

SEQ ID NO: 499057 - DNA, 25 bp, Rattus norvegicus
gtctgtcgtgtttaagggattttca

SEQ ID NO: 499058 - DNA, 25 bp, Rattus norvegicus
gtctgtctactgagctttcagacat

SEQ ID NO: 499059 - DNA, 25 bp, Rattus norvegicus
gtctgtctactgtgctttcagacat

SEQ ID NO: 499060 - DNA, 25 bp, Rattus norvegicus
gtctgtctatttaaccatgggatca

SEQ ID NO: 499061 - DNA, 25 bp, Rattus norvegicus
gtctgtctattttaccatgggatca

SEQ ID NO: 499062 - DNA, 25 bp, Rattus norvegicus
gtctgtctcaagaagctgtctgctg

SEQ ID NO: 499063 - DNA, 25 bp, Rattus norvegicus
gtctgtctcaagtagctgtctgctg

SEQ ID NO: 499064 - DNA, 25 bp, Rattus norvegicus
gtctgtctcacaagattcgtgtgac

SEQ ID NO: 499065 - DNA, 25 bp, Rattus norvegicus
gtctgtctcacatgattcgtgtgac

SEQ ID NO: 499066 - DNA, 25 bp, Rattus norvegicus
gtctgtctcattctctccaatgtat

SEQ ID NO: 499067 - DNA, 25 bp, Rattus norvegicus
gtctgtctcattgtctccaatgtat

SEQ ID NO: 499068 - DNA, 25 bp, Rattus norvegicus
gtctgtctccacatatgcatagaaa

SEQ ID NO: 499069 - DNA, 25 bp, Rattus norvegicus
gtctgtctccacttatgcatagaaa

SEQ ID NO: 499070 - DNA, 25 bp, Rattus norvegicus
gtctgtctccctctgcttgttttta

SEQ ID NO: 499071 - DNA, 25 bp, Rattus norvegicus
gtctgtctccctgtgcttgttttta

SEQ ID NO: 499072 - DNA, 25 bp, Rattus norvegicus
gtctgtctccttagaaggcccagaa

SEQ ID NO: 499073 - DNA, 25 bp, Rattus norvegicus
gtctgtctccttataaagatatgac

SEQ ID NO: 499074 - DNA, 25 bp, Rattus norvegicus
gtctgtctcctttgaaggcccagaa

SEQ ID NO: 499075 - DNA, 25 bp, Rattus norvegicus
gtctgtctccttttaaagatatgac

SEQ ID NO: 499076 - DNA, 25 bp, Rattus norvegicus
gtctgtctctatagcatggatatgt

SEQ ID NO: 499077 - DNA, 25 bp, Rattus norvegicus
gtctgtctctattgcatggatatgt

SEQ ID NO: 499078 - DNA, 25 bp, Rattus norvegicus
gtctgtctctgcactgttgtaataa

SEQ ID NO: 499079 - DNA, 25 bp, Rattus norvegicus
gtctgtctctgctctgttgtaataa

SEQ ID NO: 499080 - DNA, 25 bp, Rattus norvegicus
gtctgtctgactattgcctggtgta

SEQ ID NO: 499081 - DNA, 25 bp, Rattus norvegicus
gtctgtctgacttttgcctggtgta

SEQ ID NO: 499082 - DNA, 25 bp, Rattus norvegicus
gtctgtctgagaaaccaccagcgat

SEQ ID NO: 499083 - DNA, 25 bp, Rattus norvegicus
gtctgtctgagataccaccagcgat

SEQ ID NO: 499084 - DNA, 25 bp, Rattus norvegicus
gtctgtctgagtctcttgttgctaa

SEQ ID NO: 499085 - DNA, 25 bp, Rattus norvegicus
gtctgtctgagtgtcttgttgctaa

SEQ ID NO: 499086 - DNA, 25 bp, Rattus norvegicus
gtctgtctgcagattggctacccga

SEQ ID NO: 499087 - DNA, 25 bp, Rattus norvegicus
gtctgtctgcagtttggctacccga

SEQ ID NO: 499088 - DNA, 25 bp, Rattus norvegicus
gtctgtctgcctacagaagacattg

SEQ ID NO: 499089 - DNA, 25 bp, Rattus norvegicus
gtctgtctgccttcagaagacattg

SEQ ID NO: 499090 - DNA, 25 bp, Rattus norvegicus
gtctgtctggaaacttccctaacaa

SEQ ID NO: 499091 - DNA, 25 bp, Rattus norvegicus
gtctgtctggaatcttccctaacaa

SEQ ID NO: 499092 - DNA, 25 bp, Rattus norvegicus
gtctgtctggagctcagagcctgtt

SEQ ID NO: 499093 - DNA, 25 bp, Rattus norvegicus
gtctgtctggaggtcagagcctgtt

SEQ ID NO: 499094 - DNA, 25 bp, Rattus norvegicus
gtctgtctggtgaacgctggcttct

SEQ ID NO: 499095 - DNA, 25 bp, Rattus norvegicus
gtctgtctggtgtacgctggcttct

SEQ ID NO: 499096 - DNA, 25 bp, Rattus norvegicus
gtctgtctgtaaagcaaccaccttc

SEQ ID NO: 499097 - DNA, 25 bp, Rattus norvegicus
gtctgtctgtaatgcaaccaccttc

SEQ ID NO: 499098 - DNA, 25 bp, Rattus norvegicus
gtctgtctgtatacacatgcaccat

SEQ ID NO: 499099 - DNA, 25 bp, Rattus norvegicus
gtctgtctgtattcacatgcaccat

SEQ ID NO: 499100 - DNA, 25 bp, Rattus norvegicus
gtctgtctgtcaactccagagcatg

SEQ ID NO: 499101 - DNA, 25 bp, Rattus norvegicus
gtctgtctgtcatctccagagcatg

SEQ ID NO: 499102 - DNA, 25 bp, Rattus norvegicus
gtctgtctgttcctgagatacaaaa

SEQ ID NO: 499103 - DNA, 25 bp, Rattus norvegicus
gtctgtctgttcgtgagatacaaaa

SEQ ID NO: 499104 - DNA, 25 bp, Rattus norvegicus
gtctgtctgttgctatcgttttaaa

SEQ ID NO: 499105 - DNA, 25 bp, Rattus norvegicus
gtctgtctgttggtatcgttttaaa

SEQ ID NO: 499106 - DNA, 25 bp, Rattus norvegicus
gtctgtcttagtcgttggcagccct

SEQ ID NO: 499107 - DNA, 25 bp, Rattus norvegicus
gtctgtcttagtggttggcagccct

SEQ ID NO: 499108 - DNA, 25 bp, Rattus norvegicus
gtctgtcttcctcttcaaatattcc

SEQ ID NO: 499109 - DNA, 25 bp, Rattus norvegicus
gtctgtcttcctgttcaaatattcc

SEQ ID NO: 499110 - DNA, 25 bp, Rattus norvegicus
gtctgtcttctgagaatgcacactc

SEQ ID NO: 499111 - DNA, 25 bp, Rattus norvegicus
gtctgtcttctgtgaatgcacactc

SEQ ID NO: 499112 - DNA, 25 bp, Rattus norvegicus
gtctgtcttggcagtttatgtgcat

SEQ ID NO: 499113 - DNA, 25 bp, Rattus norvegicus
gtctgtcttggctgtttatgtgcat

SEQ ID NO: 499114 - DNA, 25 bp, Rattus norvegicus
gtctgtctttctataggatagctgt

SEQ ID NO: 499115 - DNA, 25 bp, Rattus norvegicus
gtctgtctttctctgtatatgtctg

SEQ ID NO: 499116 - DNA, 25 bp, Rattus norvegicus
gtctgtctttctgtgtatatgtctg

SEQ ID NO: 499117 - DNA, 25 bp, Rattus norvegicus
gtctgtctttctttaggatagctgt

SEQ ID NO: 499118 - DNA, 25 bp, Rattus norvegicus
gtctgtgaaatcaccagtggtctcc

SEQ ID NO: 499119 - DNA, 25 bp, Rattus norvegicus
gtctgtgaaatctccagtggtctcc

SEQ ID NO: 499120 - DNA, 25 bp, Rattus norvegicus
gtctgtgaagtgagcggagcttttt

SEQ ID NO: 499121 - DNA, 25 bp, Rattus norvegicus
gtctgtgaagtgtgcggagcttttt

SEQ ID NO: 499122 - DNA, 25 bp, Rattus norvegicus
gtctgtgaatccagacatgggtcct

SEQ ID NO: 499123 - DNA, 25 bp, Rattus norvegicus
gtctgtgaatcctgacatgggtcct

SEQ ID NO: 499124 - DNA, 25 bp, Rattus norvegicus
gtctgtgaatttataagcgcccatc

SEQ ID NO: 499125 - DNA, 25 bp, Rattus norvegicus
gtctgtgaatttttaagcgcccatc

SEQ ID NO: 499126 - DNA, 25 bp, Rattus norvegicus
gtctgtgacatcaggtgctgctcat

SEQ ID NO: 499127 - DNA, 25 bp, Rattus norvegicus
gtctgtgacatctggtgctgctcat

SEQ ID NO: 499128 - DNA, 25 bp, Rattus norvegicus
gtctgtgaccaaagagcttcatcat

SEQ ID NO: 499129 - DNA, 25 bp, Rattus norvegicus
gtctgtgaccaatgagcttcatcat

SEQ ID NO: 499130 - DNA, 25 bp, Rattus norvegicus
gtctgtgactccatttccacaggag

SEQ ID NO: 499131 - DNA, 25 bp, Rattus norvegicus
gtctgtgactccttttccacaggag

SEQ ID NO: 499132 - DNA, 25 bp, Rattus norvegicus
gtctgtgagactctcattgcctgaa

SEQ ID NO: 499133 - DNA, 25 bp, Rattus norvegicus
gtctgtgagactgtcattgcctgaa

SEQ ID NO: 499134 - DNA, 25 bp, Rattus norvegicus
gtctgtgagccccaagacttggaaa

SEQ ID NO: 499135 - DNA, 25 bp, Rattus norvegicus
gtctgtgagcccgaagacttggaaa

SEQ ID NO: 499136 - DNA, 25 bp, Rattus norvegicus
gtctgtgaggaactttttttggctg

SEQ ID NO: 499137 - DNA, 25 bp, Rattus norvegicus
gtctgtgaggaagtttttttggctg

SEQ ID NO: 499138 - DNA, 25 bp, Rattus norvegicus
gtctgtgaggctaggagcatccttt

SEQ ID NO: 499139 - DNA, 25 bp, Rattus norvegicus
gtctgtgaggcttggagcatccttt

SEQ ID NO: 499140 - DNA, 25 bp, Rattus norvegicus
gtctgtgagtatcttttgcaaattc

SEQ ID NO: 499141 - DNA, 25 bp, Rattus norvegicus
gtctgtgagtatgttttgcaaattc

SEQ ID NO: 499142 - DNA, 25 bp, Rattus norvegicus
gtctgtgagtttcagtcctgtctga

SEQ ID NO: 499143 - DNA, 25 bp, Rattus norvegicus
gtctgtgagtttgagtcctgtctga

SEQ ID NO: 499144 - DNA, 25 bp, Rattus norvegicus
gtctgtgatctaaaactgtatcttc

SEQ ID NO: 499145 - DNA, 25 bp, Rattus norvegicus
gtctgtgatctataactgtatcttc

SEQ ID NO: 499146 - DNA, 25 bp, Rattus norvegicus
gtctgtgatgtgactggagtctccg

SEQ ID NO: 499147 - DNA, 25 bp, Rattus norvegicus
gtctgtgatgtgtctggagtctccg

SEQ ID NO: 499148 - DNA, 25 bp, Rattus norvegicus
gtctgtgatttaaactcggtaccat

SEQ ID NO: 499149 - DNA, 25 bp, Rattus norvegicus
gtctgtgatttatactcggtaccat

SEQ ID NO: 499150 - DNA, 25 bp, Rattus norvegicus
gtctgtgcaattacgtgtatacccc

SEQ ID NO: 499151 - DNA, 25 bp, Rattus norvegicus
gtctgtgcaatttcgtgtatacccc

SEQ ID NO: 499152 - DNA, 25 bp, Rattus norvegicus
gtctgtgcacatcaatagtaaggga

SEQ ID NO: 499153 - DNA, 25 bp, Rattus norvegicus
gtctgtgcacatgaatagtaaggga

SEQ ID NO: 499154 - DNA, 25 bp, Rattus norvegicus
gtctgtgcaggacggttcttgttca

SEQ ID NO: 499155 - DNA, 25 bp, Rattus norvegicus
gtctgtgcaggagggttcttgttca

SEQ ID NO: 499156 - DNA, 25 bp, Rattus norvegicus
gtctgtgcagggaacctcagaatcc

SEQ ID NO: 499157 - DNA, 25 bp, Rattus norvegicus
gtctgtgcagggtacctcagaatcc

SEQ ID NO: 499158 - DNA, 25 bp, Rattus norvegicus
gtctgtgcatccacacggtacgtga

SEQ ID NO: 499159 - DNA, 25 bp, Rattus norvegicus
gtctgtgcatcctcacggtacgtga

SEQ ID NO: 499160 - DNA, 25 bp, Rattus norvegicus
gtctgtgcatgaatccagctgaaca

SEQ ID NO: 499161 - DNA, 25 bp, Rattus norvegicus
gtctgtgcatgattccagctgaaca

SEQ ID NO: 499162 - DNA, 25 bp, Rattus norvegicus
gtctgtgcatttaaattccctgttt

SEQ ID NO: 499163 - DNA, 25 bp, Rattus norvegicus
gtctgtgcattttaattccctgttt

SEQ ID NO: 499164 - DNA, 25 bp, Rattus norvegicus
gtctgtgccacacaccgtgtgggtc

SEQ ID NO: 499165 - DNA, 25 bp, Rattus norvegicus
gtctgtgccacagaccgtgtgggtc

SEQ ID NO: 499166 - DNA, 25 bp, Rattus norvegicus
gtctgtgccatgctctactagaaca

SEQ ID NO: 499167 - DNA, 25 bp, Rattus norvegicus
gtctgtgccatggtctactagaaca

SEQ ID NO: 499168 - DNA, 25 bp, Rattus norvegicus
gtctgtgccattatgtattttacta

SEQ ID NO: 499169 - DNA, 25 bp, Rattus norvegicus
gtctgtgccattttgtattttacta

SEQ ID NO: 499170 - DNA, 25 bp, Rattus norvegicus
gtctgtgcctctacagtatgcagaa

SEQ ID NO: 499171 - DNA, 25 bp, Rattus norvegicus
gtctgtgcctcttcagtatgcagaa

SEQ ID NO: 499172 - DNA, 25 bp, Rattus norvegicus
gtctgtgcggaccacatgtttaagg

SEQ ID NO: 499173 - DNA, 25 bp, Rattus norvegicus
gtctgtgcggacgacatgtttaagg

SEQ ID NO: 499174 - DNA, 25 bp, Rattus norvegicus
gtctgtgctattaacttgctgaaac

SEQ ID NO: 499175 - DNA, 25 bp, Rattus norvegicus
gtctgtgctatttacttgctgaaac

SEQ ID NO: 499176 - DNA, 25 bp, Rattus norvegicus
gtctgtgctcaacctaccgggaaat

SEQ ID NO: 499177 - DNA, 25 bp, Rattus norvegicus
gtctgtgctcaagctaccgggaaat

SEQ ID NO: 499178 - DNA, 25 bp, Rattus norvegicus
gtctgtgctcagctatggacttcca

SEQ ID NO: 499179 - DNA, 25 bp, Rattus norvegicus
gtctgtgctcaggtatggacttcca

SEQ ID NO: 499180 - DNA, 25 bp, Rattus norvegicus
gtctgtgctgccctgattagaaaac

SEQ ID NO: 499181 - DNA, 25 bp, Rattus norvegicus
gtctgtgctgccgtgattagaaaac

SEQ ID NO: 499182 - DNA, 25 bp, Rattus norvegicus
gtctgtgctggaatatgaagtccga

SEQ ID NO: 499183 - DNA, 25 bp, Rattus norvegicus
gtctgtgctggattatgaagtccga

SEQ ID NO: 499184 - DNA, 25 bp, Rattus norvegicus
gtctgtgctgtaactggagtttgtc

SEQ ID NO: 499185 - DNA, 25 bp, Rattus norvegicus
gtctgtgctgtacaacagtccaggt

SEQ ID NO: 499186 - DNA, 25 bp, Rattus norvegicus
gtctgtgctgtagaacagtccaggt

SEQ ID NO: 499187 - DNA, 25 bp, Rattus norvegicus
gtctgtgctgtatctggagtttgtc

SEQ ID NO: 499188 - DNA, 25 bp, Rattus norvegicus
gtctgtgctgtccttgcatttacat

SEQ ID NO: 499189 - DNA, 25 bp, Rattus norvegicus
gtctgtgctgtcgttgcatttacat

SEQ ID NO: 499190 - DNA, 25 bp, Rattus norvegicus
gtctgtggaactatggagccctgtt

SEQ ID NO: 499191 - DNA, 25 bp, Rattus norvegicus
gtctgtggaactttggagccctgtt

SEQ ID NO: 499192 - DNA, 25 bp, Rattus norvegicus
gtctgtggaatgacatctcctgcca

SEQ ID NO: 499193 - DNA, 25 bp, Rattus norvegicus
gtctgtggaatgtcatctcctgcca

SEQ ID NO: 499194 - DNA, 25 bp, Rattus norvegicus
gtctgtggactacagtgttccccag

SEQ ID NO: 499195 - DNA, 25 bp, Rattus norvegicus
gtctgtggactagagtgttccccag

SEQ ID NO: 499196 - DNA, 25 bp, Rattus norvegicus
gtctgtggagctagaggctcctgta

SEQ ID NO: 499197 - DNA, 25 bp, Rattus norvegicus
gtctgtggagcttgaggctcctgta

SEQ ID NO: 499198 - DNA, 25 bp, Rattus norvegicus
gtctgtggcaagctggagaattcct

SEQ ID NO: 499199 - DNA, 25 bp, Rattus norvegicus
gtctgtggcaaggtggagaattcct

SEQ ID NO: 499200 - DNA, 25 bp, Rattus norvegicus
gtctgtggcaatcaatggaactgtg

SEQ ID NO: 499201 - DNA, 25 bp, Rattus norvegicus
gtctgtggcaatgaatggaactgtg

SEQ ID NO: 499202 - DNA, 25 bp, Rattus norvegicus
gtctgtggcacaatagagtccttgt

SEQ ID NO: 499203 - DNA, 25 bp, Rattus norvegicus
gtctgtggcacattagagtccttgt

SEQ ID NO: 499204 - DNA, 25 bp, Rattus norvegicus
gtctgtggcaccagctcgctgcagg

SEQ ID NO: 499205 - DNA, 25 bp, Rattus norvegicus
gtctgtggcacctgctcgctgcagg

SEQ ID NO: 499206 - DNA, 25 bp, Rattus norvegicus
gtctgtggcagaaaggttttgtttt

SEQ ID NO: 499207 - DNA, 25 bp, Rattus norvegicus
gtctgtggcagataggttttgtttt

SEQ ID NO: 499208 - DNA, 25 bp, Rattus norvegicus
gtctgtggcagcaggcctcttgctg

SEQ ID NO: 499209 - DNA, 25 bp, Rattus norvegicus
gtctgtggcagctggcctcttgctg

SEQ ID NO: 499210 - DNA, 25 bp, Rattus norvegicus
gtctgtggccacatgattctagaga

SEQ ID NO: 499211 - DNA, 25 bp, Rattus norvegicus
gtctgtggccacttgattctagaga

SEQ ID NO: 499212 - DNA, 25 bp, Rattus norvegicus
gtctgtggccttcgaaagttcactg

SEQ ID NO: 499213 - DNA, 25 bp, Rattus norvegicus
gtctgtggccttggaaagttcactg

SEQ ID NO: 499214 - DNA, 25 bp, Rattus norvegicus
gtctgtgggatgcacacactggcct

SEQ ID NO: 499215 - DNA, 25 bp, Rattus norvegicus
gtctgtgggatggacacactggcct

SEQ ID NO: 499216 - DNA, 25 bp, Rattus norvegicus
gtctgtgggtgccttcctagccgcc

SEQ ID NO: 499217 - DNA, 25 bp, Rattus norvegicus
gtctgtgggtgcgttcctagccgcc

SEQ ID NO: 499218 - DNA, 25 bp, Rattus norvegicus
gtctgtgggtttaatgccaactcag

SEQ ID NO: 499219 - DNA, 25 bp, Rattus norvegicus
gtctgtgggttttatgccaactcag

SEQ ID NO: 499220 - DNA, 25 bp, Rattus norvegicus
gtctgtggtagactgctgctgaact

SEQ ID NO: 499221 - DNA, 25 bp, Rattus norvegicus
gtctgtggtagagtgctgctgaact

SEQ ID NO: 499222 - DNA, 25 bp, Rattus norvegicus
gtctgtggtcacaccgaaatccaag

SEQ ID NO: 499223 - DNA, 25 bp, Rattus norvegicus
gtctgtggtcacagaagctgcccat

SEQ ID NO: 499224 - DNA, 25 bp, Rattus norvegicus
gtctgtggtcactccgaaatccaag

SEQ ID NO: 499225 - DNA, 25 bp, Rattus norvegicus
gtctgtggtcactgaagctgcccat

SEQ ID NO: 499226 - DNA, 25 bp, Rattus norvegicus
gtctgtggtcttagttcactgtagt

SEQ ID NO: 499227 - DNA, 25 bp, Rattus norvegicus
gtctgtggtctttgttcactgtagt

SEQ ID NO: 499228 - DNA, 25 bp, Rattus norvegicus
gtctgtggttatatctgtctgtttt

SEQ ID NO: 499229 - DNA, 25 bp, Rattus norvegicus
gtctgtggttatctaggctgtgccc

SEQ ID NO: 499230 - DNA, 25 bp, Rattus norvegicus
gtctgtggttatgtaggctgtgccc

SEQ ID NO: 499231 - DNA, 25 bp, Rattus norvegicus
gtctgtggttatttctgtctgtttt

SEQ ID NO: 499232 - DNA, 25 bp, Rattus norvegicus
gtctgtgtaaagactgtgcttggct

SEQ ID NO: 499233 - DNA, 25 bp, Rattus norvegicus
gtctgtgtaaagtctgtgcttggct

SEQ ID NO: 499234 - DNA, 25 bp, Rattus norvegicus
gtctgtgtaagtctcttcccctggc

SEQ ID NO: 499235 - DNA, 25 bp, Rattus norvegicus
gtctgtgtaagtgtcttcccctggc

SEQ ID NO: 499236 - DNA, 25 bp, Rattus norvegicus
gtctgtgtaataaaagtactcagta

SEQ ID NO: 499237 - DNA, 25 bp, Rattus norvegicus
gtctgtgtaatataagtactcagta

SEQ ID NO: 499238 - DNA, 25 bp, Rattus norvegicus
gtctgtgtacaacgcctcgttgaac

SEQ ID NO: 499239 - DNA, 25 bp, Rattus norvegicus
gtctgtgtacaaggcctcgttgaac

SEQ ID NO: 499240 - DNA, 25 bp, Rattus norvegicus
gtctgtgtaccgaagtggaaactga

SEQ ID NO: 499241 - DNA, 25 bp, Rattus norvegicus
gtctgtgtaccgtagtggaaactga

SEQ ID NO: 499242 - DNA, 25 bp, Rattus norvegicus
gtctgtgtacctctgagactgccag

SEQ ID NO: 499243 - DNA, 25 bp, Rattus norvegicus
gtctgtgtacctgtgagactgccag

SEQ ID NO: 499244 - DNA, 25 bp, Rattus norvegicus
gtctgtgtatgtatgtcctcactgt

SEQ ID NO: 499245 - DNA, 25 bp, Rattus norvegicus
gtctgtgtatgtttgtcctcactgt

SEQ ID NO: 499246 - DNA, 25 bp, Rattus norvegicus
gtctgtgtattccttaatctctctg

SEQ ID NO: 499247 - DNA, 25 bp, Rattus norvegicus
gtctgtgtattcgttaatctctctg

SEQ ID NO: 499248 - DNA, 25 bp, Rattus norvegicus
gtctgtgtcactatgctacctggtg

SEQ ID NO: 499249 - DNA, 25 bp, Rattus norvegicus
gtctgtgtcactttgctacctggtg

SEQ ID NO: 499250 - DNA, 25 bp, Rattus norvegicus
gtctgtgtcctgatggcaacggtgc

SEQ ID NO: 499251 - DNA, 25 bp, Rattus norvegicus
gtctgtgtcctgttggcaacggtgc

SEQ ID NO: 499252 - DNA, 25 bp, Rattus norvegicus
gtctgtgtctttacttataccatgt

SEQ ID NO: 499253 - DNA, 25 bp, Rattus norvegicus
gtctgtgtcttttcttataccatgt

SEQ ID NO: 499254 - DNA, 25 bp, Rattus norvegicus
gtctgtgtgcaccttgcctctgagg

SEQ ID NO: 499255 - DNA, 25 bp, Rattus norvegicus
gtctgtgtgcacgttgcctctgagg

SEQ ID NO: 499256 - DNA, 25 bp, Rattus norvegicus
gtctgtgtgcagctgctataacaag

SEQ ID NO: 499257 - DNA, 25 bp, Rattus norvegicus
gtctgtgtgcaggtgctataacaag

SEQ ID NO: 499258 - DNA, 25 bp, Rattus norvegicus
gtctgtgtgcatctctgtgtctctc

SEQ ID NO: 499259 - DNA, 25 bp, Rattus norvegicus
gtctgtgtgcatgtctgtgtctctc

SEQ ID NO: 499260 - DNA, 25 bp, Rattus norvegicus
gtctgtgtggtcagatttggcgcca

SEQ ID NO: 499261 - DNA, 25 bp, Rattus norvegicus
gtctgtgtggtctgatttggcgcca

SEQ ID NO: 499262 - DNA, 25 bp, Rattus norvegicus
gtctgtgtgtctcactggagcacaa

SEQ ID NO: 499263 - DNA, 25 bp, Rattus norvegicus
gtctgtgtgtctgactggagcacaa

SEQ ID NO: 499264 - DNA, 25 bp, Rattus norvegicus
gtctgtgtgtgcaaaatgcgtccat

SEQ ID NO: 499265 - DNA, 25 bp, Rattus norvegicus
gtctgtgtgtgctaaatgcgtccat

SEQ ID NO: 499266 - DNA, 25 bp, Rattus norvegicus
gtctgtgtgtgtcgtcaagcacctc

SEQ ID NO: 499267 - DNA, 25 bp, Rattus norvegicus
gtctgtgtgtgtggtcaagcacctc

SEQ ID NO: 499268 - DNA, 25 bp, Rattus norvegicus
gtctgtgtgttgacttcatgcataa

SEQ ID NO: 499269 - DNA, 25 bp, Rattus norvegicus
gtctgtgtgttgtcttcatgcataa

SEQ ID NO: 499270 - DNA, 25 bp, Rattus norvegicus
gtctgtgttactcggtgtgcatatt

SEQ ID NO: 499271 - DNA, 25 bp, Rattus norvegicus
gtctgtgttactgggtgtgcatatt

SEQ ID NO: 499272 - DNA, 25 bp, Rattus norvegicus
gtctgtgttaggagagtccacctgg

SEQ ID NO: 499273 - DNA, 25 bp, Rattus norvegicus
gtctgtgttaggtgagtccacctgg

SEQ ID NO: 499274 - DNA, 25 bp, Rattus norvegicus
gtctgtgttcacagccgactatata

SEQ ID NO: 499275 - DNA, 25 bp, Rattus norvegicus
gtctgtgttcactgccgactatata

SEQ ID NO: 499276 - DNA, 25 bp, Rattus norvegicus
gtctgtgttctgatcaagctctcaa

SEQ ID NO: 499277 - DNA, 25 bp, Rattus norvegicus
gtctgtgttctgttcaagctctcaa

SEQ ID NO: 499278 - DNA, 25 bp, Rattus norvegicus
gtctgtgtttttcttttctacagtt

SEQ ID NO: 499279 - DNA, 25 bp, Rattus norvegicus
gtctgtgtttttgttttctacagtt

SEQ ID NO: 499280 - DNA, 25 bp, Rattus norvegicus
gtctgttaaagaactctccacctat

SEQ ID NO: 499281 - DNA, 25 bp, Rattus norvegicus
gtctgttaaagatctctccacctat

SEQ ID NO: 499282 - DNA, 25 bp, Rattus norvegicus
gtctgttaatacaccacaaattttg

SEQ ID NO: 499283 - DNA, 25 bp, Rattus norvegicus
gtctgttaatactccacaaattttg

SEQ ID NO: 499284 - DNA, 25 bp, Rattus norvegicus
gtctgttactgtcgagtttctctct

SEQ ID NO: 499285 - DNA, 25 bp, Rattus norvegicus
gtctgttactgtggagtttctctct

SEQ ID NO: 499286 - DNA, 25 bp, Rattus norvegicus
gtctgttagactagattgtaagctc

SEQ ID NO: 499287 - DNA, 25 bp, Rattus norvegicus
gtctgttagacttgattgtaagctc

SEQ ID NO: 499288 - DNA, 25 bp, Rattus norvegicus
gtctgttaggccacatactaagcaa

SEQ ID NO: 499289 - DNA, 25 bp, Rattus norvegicus
gtctgttaggcctcatactaagcaa

SEQ ID NO: 499290 - DNA, 25 bp, Rattus norvegicus
gtctgttagtctcgagtcatcaccc

SEQ ID NO: 499291 - DNA, 25 bp, Rattus norvegicus
gtctgttagtctggagtcatcaccc

SEQ ID NO: 499292 - DNA, 25 bp, Rattus norvegicus
gtctgttatcccacagctctgaaaa

SEQ ID NO: 499293 - DNA, 25 bp, Rattus norvegicus
gtctgttatccctcagctctgaaaa

SEQ ID NO: 499294 - DNA, 25 bp, Rattus norvegicus
gtctgttatgtaccaaaaatgtttc

SEQ ID NO: 499295 - DNA, 25 bp, Rattus norvegicus
gtctgttatgtagcaaaaatgtttc

SEQ ID NO: 499296 - DNA, 25 bp, Rattus norvegicus
gtctgttattcaagcaggctgtttt

SEQ ID NO: 499297 - DNA, 25 bp, Rattus norvegicus
gtctgttattcatgcaggctgtttt

SEQ ID NO: 499298 - DNA, 25 bp, Rattus norvegicus
gtctgttcacagctgtaattattat

SEQ ID NO: 499299 - DNA, 25 bp, Rattus norvegicus
gtctgttcacaggtgtaattattat

SEQ ID NO: 499300 - DNA, 25 bp, Rattus norvegicus
gtctgttcagcaccctgatttttat

SEQ ID NO: 499301 - DNA, 25 bp, Rattus norvegicus
gtctgttcagcagcctgatttttat

SEQ ID NO: 499302 - DNA, 25 bp, Rattus norvegicus
gtctgttcagggatatttatgcatt

SEQ ID NO: 499303 - DNA, 25 bp, Rattus norvegicus
gtctgttcagggttatttatgcatt

SEQ ID NO: 499304 - DNA, 25 bp, Rattus norvegicus
gtctgttcagtgcaggtgactgtca

SEQ ID NO: 499305 - DNA, 25 bp, Rattus norvegicus
gtctgttcagtggaggtgactgtca

SEQ ID NO: 499306 - DNA, 25 bp, Rattus norvegicus
gtctgttcatatataatgccctgta

SEQ ID NO: 499307 - DNA, 25 bp, Rattus norvegicus
gtctgttcatatttaatgccctgta

SEQ ID NO: 499308 - DNA, 25 bp, Rattus norvegicus
gtctgttccctgaagttgacaacca

SEQ ID NO: 499309 - DNA, 25 bp, Rattus norvegicus
gtctgttccctgtagttgacaacca

SEQ ID NO: 499310 - DNA, 25 bp, Rattus norvegicus
gtctgttctagaccgtacaaccgta

SEQ ID NO: 499311 - DNA, 25 bp, Rattus norvegicus
gtctgttctagagcgtacaaccgta

SEQ ID NO: 499312 - DNA, 25 bp, Rattus norvegicus
gtctgttctagcagggaagagcaaa

SEQ ID NO: 499313 - DNA, 25 bp, Rattus norvegicus
gtctgttctagctgggaagagcaaa

SEQ ID NO: 499314 - DNA, 25 bp, Rattus norvegicus
gtctgttctctaagcctggtaggca

SEQ ID NO: 499315 - DNA, 25 bp, Rattus norvegicus
gtctgttctctatgcctggtaggca

SEQ ID NO: 499316 - DNA, 25 bp, Rattus norvegicus
gtctgttctcttccttattaaaatt

SEQ ID NO: 499317 - DNA, 25 bp, Rattus norvegicus
gtctgttctcttgcttattaaaatt

SEQ ID NO: 499318 - DNA, 25 bp, Rattus norvegicus
gtctgttctggcatgcttctaataa

SEQ ID NO: 499319 - DNA, 25 bp, Rattus norvegicus
gtctgttctggcttgcttctaataa

SEQ ID NO: 499320 - DNA, 25 bp, Rattus norvegicus
gtctgttctgtacagccacttttaa

SEQ ID NO: 499321 - DNA, 25 bp, Rattus norvegicus
gtctgttctgtagagccacttttaa

SEQ ID NO: 499322 - DNA, 25 bp, Rattus norvegicus
gtctgttcttacactgtcactgaat

SEQ ID NO: 499323 - DNA, 25 bp, Rattus norvegicus
gtctgttcttaccaaatgtgcttct

SEQ ID NO: 499324 - DNA, 25 bp, Rattus norvegicus
gtctgttcttacgaaatgtgcttct

SEQ ID NO: 499325 - DNA, 25 bp, Rattus norvegicus
gtctgttcttactctgtcactgaat

SEQ ID NO: 499326 - DNA, 25 bp, Rattus norvegicus
gtctgttcttttcattgctgtaaat

SEQ ID NO: 499327 - DNA, 25 bp, Rattus norvegicus
gtctgttcttttgattgctgtaaat

SEQ ID NO: 499328 - DNA, 25 bp, Rattus norvegicus
gtctgttgatgtctctaagcatctc

SEQ ID NO: 499329 - DNA, 25 bp, Rattus norvegicus
gtctgttgatgtgtctaagcatctc

SEQ ID NO: 499330 - DNA, 25 bp, Rattus norvegicus
gtctgttgcaggctgctcaggacaa

SEQ ID NO: 499331 - DNA, 25 bp, Rattus norvegicus
gtctgttgcagggtgctcaggacaa

SEQ ID NO: 499332 - DNA, 25 bp, Rattus norvegicus
gtctgttgcagtattctatggacaa

SEQ ID NO: 499333 - DNA, 25 bp, Rattus norvegicus
gtctgttgcagttttctatggacaa

SEQ ID NO: 499334 - DNA, 25 bp, Rattus norvegicus
gtctgttgcattcattgacccgcaa

SEQ ID NO: 499335 - DNA, 25 bp, Rattus norvegicus
gtctgttgcattgattgacccgcaa

SEQ ID NO: 499336 - DNA, 25 bp, Rattus norvegicus
gtctgttgcgatagttgctgctgcg

SEQ ID NO: 499337 - DNA, 25 bp, Rattus norvegicus
gtctgttgcgattgttgctgctgcg

SEQ ID NO: 499338 - DNA, 25 bp, Rattus norvegicus
gtctgttgcgcaagggaaactactc

SEQ ID NO: 499339 - DNA, 25 bp, Rattus norvegicus
gtctgttgcgcatgggaaactactc

SEQ ID NO: 499340 - DNA, 25 bp, Rattus norvegicus
gtctgttgcttcctacagttatgat

SEQ ID NO: 499341 - DNA, 25 bp, Rattus norvegicus
gtctgttgcttcgtacagttatgat

SEQ ID NO: 499342 - DNA, 25 bp, Rattus norvegicus
gtctgttgtactcgtaatttaactc

SEQ ID NO: 499343 - DNA, 25 bp, Rattus norvegicus
gtctgttgtactggtaatttaactc

SEQ ID NO: 499344 - DNA, 25 bp, Rattus norvegicus
gtctgttgtggactgaggccaccat

SEQ ID NO: 499345 - DNA, 25 bp, Rattus norvegicus
gtctgttgtggagtgaggccaccat

SEQ ID NO: 499346 - DNA, 25 bp, Rattus norvegicus
gtctgttgtgttcacatgctgccca

SEQ ID NO: 499347 - DNA, 25 bp, Rattus norvegicus
gtctgttgtgttgacatgctgccca

SEQ ID NO: 499348 - DNA, 25 bp, Rattus norvegicus
gtctgtttacagatttgagctggat

SEQ ID NO: 499349 - DNA, 25 bp, Rattus norvegicus
gtctgtttacagttttgagctggat

SEQ ID NO: 499350 - DNA, 25 bp, Rattus norvegicus
gtctgtttacccaggctatatgtcc

SEQ ID NO: 499351 - DNA, 25 bp, Rattus norvegicus
gtctgtttaccctggctatatgtcc

SEQ ID NO: 499352 - DNA, 25 bp, Rattus norvegicus
gtctgtttatatatgcttttcctgt

SEQ ID NO: 499353 - DNA, 25 bp, Rattus norvegicus
gtctgtttatatttgcttttcctgt

SEQ ID NO: 499354 - DNA, 25 bp, Rattus norvegicus
gtctgtttatcaagagagggcccac

SEQ ID NO: 499355 - DNA, 25 bp, Rattus norvegicus
gtctgtttatcatgagagggcccac

SEQ ID NO: 499356 - DNA, 25 bp, Rattus norvegicus
gtctgtttatctcatttctatttcc

SEQ ID NO: 499357 - DNA, 25 bp, Rattus norvegicus
gtctgtttatctgatttctatttcc

SEQ ID NO: 499358 - DNA, 25 bp, Rattus norvegicus
gtctgtttcacgagaatgagtgtct

SEQ ID NO: 499359 - DNA, 25 bp, Rattus norvegicus
gtctgtttcacgtgaatgagtgtct

SEQ ID NO: 499360 - DNA, 25 bp, Rattus norvegicus
gtctgtttccttaactacgacacaa

SEQ ID NO: 499361 - DNA, 25 bp, Rattus norvegicus
gtctgtttcctttactacgacacaa

SEQ ID NO: 499362 - DNA, 25 bp, Rattus norvegicus
gtctgtttctccaaggccagcttag

SEQ ID NO: 499363 - DNA, 25 bp, Rattus norvegicus
gtctgtttctcctaggccagcttag

SEQ ID NO: 499364 - DNA, 25 bp, Rattus norvegicus
gtctgtttctctagcctttgaaagc

SEQ ID NO: 499365 - DNA, 25 bp, Rattus norvegicus
gtctgtttctctctgtgctcgttgg

SEQ ID NO: 499366 - DNA, 25 bp, Rattus norvegicus
gtctgtttctctgtgtgctcgttgg

SEQ ID NO: 499367 - DNA, 25 bp, Rattus norvegicus
gtctgtttctcttgcctttgaaagc

SEQ ID NO: 499368 - DNA, 25 bp, Rattus norvegicus
gtctgtttgccccacaagtatgtac

SEQ ID NO: 499369 - DNA, 25 bp, Rattus norvegicus
gtctgtttgcccgacaagtatgtac

SEQ ID NO: 499370 - DNA, 25 bp, Rattus norvegicus
gtctgtttgctgagttaagcctgca

SEQ ID NO: 499371 - DNA, 25 bp, Rattus norvegicus
gtctgtttgctgtgttaagcctgca

SEQ ID NO: 499372 - DNA, 25 bp, Rattus norvegicus
gtctgtttggccattactacacttt

SEQ ID NO: 499373 - DNA, 25 bp, Rattus norvegicus
gtctgtttggcctttactacacttt

SEQ ID NO: 499374 - DNA, 25 bp, Rattus norvegicus
gtctgttttctcaaaatctctgttt

SEQ ID NO: 499375 - DNA, 25 bp, Rattus norvegicus
gtctgttttctctaaatctctgttt

SEQ ID NO: 499376 - DNA, 25 bp, Rattus norvegicus
gtctgttttctgctaagggtgatca

SEQ ID NO: 499377 - DNA, 25 bp, Rattus norvegicus
gtctgttttctggtaagggtgatca

SEQ ID NO: 499378 - DNA, 25 bp, Rattus norvegicus
gtctgttttcttaatcatgctggtt

SEQ ID NO: 499379 - DNA, 25 bp, Rattus norvegicus
gtctgttttctttatcatgctggtt

SEQ ID NO: 499380 - DNA, 25 bp, Rattus norvegicus
gtctgttttgtcaagggagctgccc

SEQ ID NO: 499381 - DNA, 25 bp, Rattus norvegicus
gtctgttttgtctagggagctgccc

SEQ ID NO: 499382 - DNA, 25 bp, Rattus norvegicus
gtctgtttttcaaaattgctcttta

SEQ ID NO: 499383 - DNA, 25 bp, Rattus norvegicus
gtctgtttttcataattgctcttta

SEQ ID NO: 499384 - DNA, 25 bp, Rattus norvegicus
gtctgttttttcacttcatgtttta

SEQ ID NO: 499385 - DNA, 25 bp, Rattus norvegicus
gtctgttttttctcttcatgtttta

SEQ ID NO: 499386 - DNA, 25 bp, Rattus norvegicus
gtcttaaacaacagcctgggttgac

SEQ ID NO: 499387 - DNA, 25 bp, Rattus norvegicus
gtcttaaacaactgcctgggttgac

SEQ ID NO: 499388 - DNA, 25 bp, Rattus norvegicus
gtcttaaacctaccttcacaggaga

SEQ ID NO: 499389 - DNA, 25 bp, Rattus norvegicus
gtcttaaacctagcttcacaggaga

SEQ ID NO: 499390 - DNA, 25 bp, Rattus norvegicus
gtcttaaatctcacttcagtggtcc

SEQ ID NO: 499391 - DNA, 25 bp, Rattus norvegicus
gtcttaaatctctcttcagtggtcc

SEQ ID NO: 499392 - DNA, 25 bp, Rattus norvegicus
gtcttaacagttagagttcccaaca

SEQ ID NO: 499393 - DNA, 25 bp, Rattus norvegicus
gtcttaacagtttgagttcccaaca

SEQ ID NO: 499394 - DNA, 25 bp, Rattus norvegicus
gtcttaacttctagtcttggagcag

SEQ ID NO: 499395 - DNA, 25 bp, Rattus norvegicus
gtcttaacttcttgtcttggagcag

SEQ ID NO: 499396 - DNA, 25 bp, Rattus norvegicus
gtcttaagcttaatatacacatgtg

SEQ ID NO: 499397 - DNA, 25 bp, Rattus norvegicus
gtcttaagcttattatacacatgtg

SEQ ID NO: 499398 - DNA, 25 bp, Rattus norvegicus
gtcttaataatcctgtgtgctccac

SEQ ID NO: 499399 - DNA, 25 bp, Rattus norvegicus
gtcttaataatcgtgtgtgctccac

SEQ ID NO: 499400 - DNA, 25 bp, Rattus norvegicus
gtcttaatactcacattgctgcatg

SEQ ID NO: 499401 - DNA, 25 bp, Rattus norvegicus
gtcttaatactctcattgctgcatg

SEQ ID NO: 499402 - DNA, 25 bp, Rattus norvegicus
gtcttaatatttctattcctctccc

SEQ ID NO: 499403 - DNA, 25 bp, Rattus norvegicus
gtcttaatatttgtattcctctccc

SEQ ID NO: 499404 - DNA, 25 bp, Rattus norvegicus
gtcttaatcctcaactgactgcatc

SEQ ID NO: 499405 - DNA, 25 bp, Rattus norvegicus
gtcttaatcctctactgactgcatc

SEQ ID NO: 499406 - DNA, 25 bp, Rattus norvegicus
gtcttaatgcttcttttctacgtga

SEQ ID NO: 499407 - DNA, 25 bp, Rattus norvegicus
gtcttaatgcttgttttctacgtga

SEQ ID NO: 499408 - DNA, 25 bp, Rattus norvegicus
gtcttaatggctcaattgctgggca

SEQ ID NO: 499409 - DNA, 25 bp, Rattus norvegicus
gtcttaatggctgaattgctgggca

SEQ ID NO: 499410 - DNA, 25 bp, Rattus norvegicus
gtcttaatgtatctattcttccctc

SEQ ID NO: 499411 - DNA, 25 bp, Rattus norvegicus
gtcttaatgtatgtattcttccctc

SEQ ID NO: 499412 - DNA, 25 bp, Rattus norvegicus
gtcttaattgatctggttcgtccac

SEQ ID NO: 499413 - DNA, 25 bp, Rattus norvegicus
gtcttaattgatgtggttcgtccac

SEQ ID NO: 499414 - DNA, 25 bp, Rattus norvegicus
gtcttaattgtaattgcagatttgg

SEQ ID NO: 499415 - DNA, 25 bp, Rattus norvegicus
gtcttaattgtatttgcagatttgg

SEQ ID NO: 499416 - DNA, 25 bp, Rattus norvegicus
gtcttaattgtgacaggtcgtttcc

SEQ ID NO: 499417 - DNA, 25 bp, Rattus norvegicus
gtcttaattgtgtcaggtcgtttcc

SEQ ID NO: 499418 - DNA, 25 bp, Rattus norvegicus
gtcttaatttgcctttggtcaccac

SEQ ID NO: 499419 - DNA, 25 bp, Rattus norvegicus
gtcttaatttgcgtttggtcaccac

SEQ ID NO: 499420 - DNA, 25 bp, Rattus norvegicus
gtcttaattttgagatactaagcat

SEQ ID NO: 499421 - DNA, 25 bp, Rattus norvegicus
gtcttaattttgtgatactaagcat

SEQ ID NO: 499422 - DNA, 25 bp, Rattus norvegicus
gtcttacaacgcacggccatttgag

SEQ ID NO: 499423 - DNA, 25 bp, Rattus norvegicus
gtcttacaacgctcggccatttgag

SEQ ID NO: 499424 - DNA, 25 bp, Rattus norvegicus
gtcttacaagctctgtgacctagta

SEQ ID NO: 499425 - DNA, 25 bp, Rattus norvegicus
gtcttacaagctgtgtgacctagta

SEQ ID NO: 499426 - DNA, 25 bp, Rattus norvegicus
gtcttacacatgcattacacgggaa

SEQ ID NO: 499427 - DNA, 25 bp, Rattus norvegicus
gtcttacacatggattacacgggaa

SEQ ID NO: 499428 - DNA, 25 bp, Rattus norvegicus
gtcttacagttcagtccactagcta

SEQ ID NO: 499429 - DNA, 25 bp, Rattus norvegicus
gtcttacagttctgtccactagcta

SEQ ID NO: 499430 - DNA, 25 bp, Rattus norvegicus
gtcttacataacaagcttgaggcca

SEQ ID NO: 499431 - DNA, 25 bp, Rattus norvegicus
gtcttacataactagcttgaggcca

SEQ ID NO: 499432 - DNA, 25 bp, Rattus norvegicus
gtcttacatacacttaagccctgaa

SEQ ID NO: 499433 - DNA, 25 bp, Rattus norvegicus
gtcttacatacagttaagccctgaa

SEQ ID NO: 499434 - DNA, 25 bp, Rattus norvegicus
gtcttacatactcatacctcgggtg

SEQ ID NO: 499435 - DNA, 25 bp, Rattus norvegicus
gtcttacatactgatacctcgggtg

SEQ ID NO: 499436 - DNA, 25 bp, Rattus norvegicus
gtcttacatcacagaagagactgta

SEQ ID NO: 499437 - DNA, 25 bp, Rattus norvegicus
gtcttacatcactgaagagactgta

SEQ ID NO: 499438 - DNA, 25 bp, Rattus norvegicus
gtcttacatgagaatgtgtgaacca

SEQ ID NO: 499439 - DNA, 25 bp, Rattus norvegicus
gtcttacatgagtatgtgtgaacca

SEQ ID NO: 499440 - DNA, 25 bp, Rattus norvegicus
gtcttacattcacggtttatcattt

SEQ ID NO: 499441 - DNA, 25 bp, Rattus norvegicus
gtcttacattcagggtttatcattt

SEQ ID NO: 499442 - DNA, 25 bp, Rattus norvegicus
gtcttacattttctggctctctctt

SEQ ID NO: 499443 - DNA, 25 bp, Rattus norvegicus
gtcttacattttgtggctctctctt

SEQ ID NO: 499444 - DNA, 25 bp, Rattus norvegicus
gtcttaccactgagctcagcatgga

SEQ ID NO: 499445 - DNA, 25 bp, Rattus norvegicus
gtcttaccactgtgctcagcatgga

SEQ ID NO: 499446 - DNA, 25 bp, Rattus norvegicus
gtcttaccagtgcatccctatgaaa

SEQ ID NO: 499447 - DNA, 25 bp, Rattus norvegicus
gtcttaccagtggatccctatgaaa

SEQ ID NO: 499448 - DNA, 25 bp, Rattus norvegicus
gtcttacccattagcgcagttttca

SEQ ID NO: 499449 - DNA, 25 bp, Rattus norvegicus
gtcttacccattagttgacaagtgg

SEQ ID NO: 499450 - DNA, 25 bp, Rattus norvegicus
gtcttacccatttgcgcagttttca

SEQ ID NO: 499451 - DNA, 25 bp, Rattus norvegicus
gtcttacccatttgttgacaagtgg

SEQ ID NO: 499452 - DNA, 25 bp, Rattus norvegicus
gtcttacccctaagcaggtaaccat

SEQ ID NO: 499453 - DNA, 25 bp, Rattus norvegicus
gtcttacccctatgcaggtaaccat

SEQ ID NO: 499454 - DNA, 25 bp, Rattus norvegicus
gtcttaccctatcatgtgtttcctt

SEQ ID NO: 499455 - DNA, 25 bp, Rattus norvegicus
gtcttaccctatgatgtgtttcctt

SEQ ID NO: 499456 - DNA, 25 bp, Rattus norvegicus
gtcttacctctcagggcacaagaag

SEQ ID NO: 499457 - DNA, 25 bp, Rattus norvegicus
gtcttacctctctgggcacaagaag

SEQ ID NO: 499458 - DNA, 25 bp, Rattus norvegicus
gtcttaccttaacactgcatgcttt

SEQ ID NO: 499459 - DNA, 25 bp, Rattus norvegicus
gtcttaccttaagactgcatgcttt

SEQ ID NO: 499460 - DNA, 25 bp, Rattus norvegicus
gtcttaccttggcttctatgtggtt

SEQ ID NO: 499461 - DNA, 25 bp, Rattus norvegicus
gtcttaccttgggttctatgtggtt

SEQ ID NO: 499462 - DNA, 25 bp, Rattus norvegicus
gtcttaccttgtagaaaagcactat

SEQ ID NO: 499463 - DNA, 25 bp, Rattus norvegicus
gtcttaccttgttgaaaagcactat

SEQ ID NO: 499464 - DNA, 25 bp, Rattus norvegicus
gtcttacctttacgcctgacttcta

SEQ ID NO: 499465 - DNA, 25 bp, Rattus norvegicus
gtcttacctttaggcctgacttcta

SEQ ID NO: 499466 - DNA, 25 bp, Rattus norvegicus
gtcttacggtgcaaacttttcttgg

SEQ ID NO: 499467 - DNA, 25 bp, Rattus norvegicus
gtcttacggtgctaacttttcttgg

SEQ ID NO: 499468 - DNA, 25 bp, Rattus norvegicus
gtcttacgtattacatcatcctgcc

SEQ ID NO: 499469 - DNA, 25 bp, Rattus norvegicus
gtcttacgtatttcatcatcctgcc

SEQ ID NO: 499470 - DNA, 25 bp, Rattus norvegicus
gtcttactagtcatactgctctggg

SEQ ID NO: 499471 - DNA, 25 bp, Rattus norvegicus
gtcttactagtcttactgctctggg

SEQ ID NO: 499472 - DNA, 25 bp, Rattus norvegicus
gtcttactatgtaacattgggctca

SEQ ID NO: 499473 - DNA, 25 bp, Rattus norvegicus
gtcttactatgttacattgggctca

SEQ ID NO: 499474 - DNA, 25 bp, Rattus norvegicus
gtcttactcacacattgcttcatcc

SEQ ID NO: 499475 - DNA, 25 bp, Rattus norvegicus
gtcttactcacagattgcttcatcc

SEQ ID NO: 499476 - DNA, 25 bp, Rattus norvegicus
gtcttactcactatgggccagagag

SEQ ID NO: 499477 - DNA, 25 bp, Rattus norvegicus
gtcttactcactttgggccagagag

SEQ ID NO: 499478 - DNA, 25 bp, Rattus norvegicus
gtcttactctaacgtgttcttctgt

SEQ ID NO: 499479 - DNA, 25 bp, Rattus norvegicus
gtcttactctaaggtgttcttctgt

SEQ ID NO: 499480 - DNA, 25 bp, Rattus norvegicus
gtcttactctctcttcccatacata

SEQ ID NO: 499481 - DNA, 25 bp, Rattus norvegicus
gtcttactctctgttcccatacata

SEQ ID NO: 499482 - DNA, 25 bp, Rattus norvegicus
gtcttactctgtctcagtgtttgga

SEQ ID NO: 499483 - DNA, 25 bp, Rattus norvegicus
gtcttactctgtgtcagtgtttgga

SEQ ID NO: 499484 - DNA, 25 bp, Rattus norvegicus
gtcttactgagaagcatactttcac

SEQ ID NO: 499485 - DNA, 25 bp, Rattus norvegicus
gtcttactgagatgcatactttcac

SEQ ID NO: 499486 - DNA, 25 bp, Rattus norvegicus
gtcttactggagacagtgcgtccaa

SEQ ID NO: 499487 - DNA, 25 bp, Rattus norvegicus
gtcttactggagtcagtgcgtccaa

SEQ ID NO: 499488 - DNA, 25 bp, Rattus norvegicus
gtcttactgggcatatattgaataa

SEQ ID NO: 499489 - DNA, 25 bp, Rattus norvegicus
gtcttactgggcttatattgaataa

SEQ ID NO: 499490 - DNA, 25 bp, Rattus norvegicus
gtcttactggtgcttaaactgttct

SEQ ID NO: 499491 - DNA, 25 bp, Rattus norvegicus
gtcttactggtggttaaactgttct

SEQ ID NO: 499492 - DNA, 25 bp, Rattus norvegicus
gtcttactgtagatgcaaagccaaa

SEQ ID NO: 499493 - DNA, 25 bp, Rattus norvegicus
gtcttactgtagttgcaaagccaaa

SEQ ID NO: 499494 - DNA, 25 bp, Rattus norvegicus
gtcttacttgggatactgtgagcaa

SEQ ID NO: 499495 - DNA, 25 bp, Rattus norvegicus
gtcttacttgggttactgtgagcaa

SEQ ID NO: 499496 - DNA, 25 bp, Rattus norvegicus
gtcttactttctccttcttattgaa

SEQ ID NO: 499497 - DNA, 25 bp, Rattus norvegicus
gtcttactttctgcttcttattgaa

SEQ ID NO: 499498 - DNA, 25 bp, Rattus norvegicus
gtcttactttgtcagccatgggaat

SEQ ID NO: 499499 - DNA, 25 bp, Rattus norvegicus
gtcttactttgtgagccatgggaat

SEQ ID NO: 499500 - DNA, 25 bp, Rattus norvegicus
gtcttagaaaccagggctgtgccat

SEQ ID NO: 499501 - DNA, 25 bp, Rattus norvegicus
gtcttagaaacctgggctgtgccat

SEQ ID NO: 499502 - DNA, 25 bp, Rattus norvegicus
gtcttagacaccacttatgttgcat

SEQ ID NO: 499503 - DNA, 25 bp, Rattus norvegicus
gtcttagacacctcttatgttgcat

SEQ ID NO: 499504 - DNA, 25 bp, Rattus norvegicus
gtcttagacgcgatgggataattcc

SEQ ID NO: 499505 - DNA, 25 bp, Rattus norvegicus
gtcttagacgcgttgggataattcc

SEQ ID NO: 499506 - DNA, 25 bp, Rattus norvegicus
gtcttagagaagagactcccagggt

SEQ ID NO: 499507 - DNA, 25 bp, Rattus norvegicus
gtcttagagaagtgactcccagggt

SEQ ID NO: 499508 - DNA, 25 bp, Rattus norvegicus
gtcttagagcttagacaatctgata

SEQ ID NO: 499509 - DNA, 25 bp, Rattus norvegicus
gtcttagagctttgacaatctgata

SEQ ID NO: 499510 - DNA, 25 bp, Rattus norvegicus
gtcttagatcatacctttgagttct

SEQ ID NO: 499511 - DNA, 25 bp, Rattus norvegicus
gtcttagatcattcctttgagttct

SEQ ID NO: 499512 - DNA, 25 bp, Rattus norvegicus
gtcttagcactaagttccagggaac

SEQ ID NO: 499513 - DNA, 25 bp, Rattus norvegicus
gtcttagcactatgttccagggaac

SEQ ID NO: 499514 - DNA, 25 bp, Rattus norvegicus
gtcttagcatctcacttcctgaaaa

SEQ ID NO: 499515 - DNA, 25 bp, Rattus norvegicus
gtcttagcatctgacttcctgaaaa

SEQ ID NO: 499516 - DNA, 25 bp, Rattus norvegicus
gtcttagctgttccaaatgctgtca

SEQ ID NO: 499517 - DNA, 25 bp, Rattus norvegicus
gtcttagctgttgcaaatgctgtca

SEQ ID NO: 499518 - DNA, 25 bp, Rattus norvegicus
gtcttagcttctacatgaattcctt

SEQ ID NO: 499519 - DNA, 25 bp, Rattus norvegicus
gtcttagcttcttcatgaattcctt

SEQ ID NO: 499520 - DNA, 25 bp, Rattus norvegicus
gtcttaggatttatagccctcccat

SEQ ID NO: 499521 - DNA, 25 bp, Rattus norvegicus
gtcttaggatttttagccctcccat

SEQ ID NO: 499522 - DNA, 25 bp, Rattus norvegicus
gtcttaggccctatattcatgaata

SEQ ID NO: 499523 - DNA, 25 bp, Rattus norvegicus
gtcttaggccctttattcatgaata

SEQ ID NO: 499524 - DNA, 25 bp, Rattus norvegicus
gtcttagggatcacaatggcttgga

SEQ ID NO: 499525 - DNA, 25 bp, Rattus norvegicus
gtcttagggatctcaatggcttgga

SEQ ID NO: 499526 - DNA, 25 bp, Rattus norvegicus
gtcttaggtggactcagtggtacac

SEQ ID NO: 499527 - DNA, 25 bp, Rattus norvegicus
gtcttaggtggagtcagtggtacac

SEQ ID NO: 499528 - DNA, 25 bp, Rattus norvegicus
gtcttaggttgtcaccgtctagcaa

SEQ ID NO: 499529 - DNA, 25 bp, Rattus norvegicus
gtcttaggttgtgaccgtctagcaa

SEQ ID NO: 499530 - DNA, 25 bp, Rattus norvegicus
gtcttagtaccgacgctgttgtaaa

SEQ ID NO: 499531 - DNA, 25 bp, Rattus norvegicus
gtcttagtaccgtcgctgttgtaaa

SEQ ID NO: 499532 - DNA, 25 bp, Rattus norvegicus
gtcttagtagaaatcatcagcaaca

SEQ ID NO: 499533 - DNA, 25 bp, Rattus norvegicus
gtcttagtagaattcatcagcaaca

SEQ ID NO: 499534 - DNA, 25 bp, Rattus norvegicus
gtcttagtatacatcactatcctga

SEQ ID NO: 499535 - DNA, 25 bp, Rattus norvegicus
gtcttagtatacttcactatcctga

SEQ ID NO: 499536 - DNA, 25 bp, Rattus norvegicus
gtcttagtgactatcctgttgtaca

SEQ ID NO: 499537 - DNA, 25 bp, Rattus norvegicus
gtcttagtgactttcctgttgtaca

SEQ ID NO: 499538 - DNA, 25 bp, Rattus norvegicus
gtcttagtgatacgccagtgggtta

SEQ ID NO: 499539 - DNA, 25 bp, Rattus norvegicus
gtcttagtgataggccagtgggtta

SEQ ID NO: 499540 - DNA, 25 bp, Rattus norvegicus
gtcttagtgtctcttctggattgat

SEQ ID NO: 499541 - DNA, 25 bp, Rattus norvegicus
gtcttagtgtctgttctggattgat

SEQ ID NO: 499542 - DNA, 25 bp, Rattus norvegicus
gtcttagttccaagagatcccatct

SEQ ID NO: 499543 - DNA, 25 bp, Rattus norvegicus
gtcttagttccatgagatcccatct

SEQ ID NO: 499544 - DNA, 25 bp, Rattus norvegicus
gtcttagtttagcagtaactcccac

SEQ ID NO: 499545 - DNA, 25 bp, Rattus norvegicus
gtcttagtttaggagtaactcccac

SEQ ID NO: 499546 - DNA, 25 bp, Rattus norvegicus
gtcttataatacaagctaacggcaa

SEQ ID NO: 499547 - DNA, 25 bp, Rattus norvegicus
gtcttataatacagtccattgcttg

SEQ ID NO: 499548 - DNA, 25 bp, Rattus norvegicus
gtcttataatactagctaacggcaa

SEQ ID NO: 499549 - DNA, 25 bp, Rattus norvegicus
gtcttataatactgtccattgcttg

SEQ ID NO: 499550 - DNA, 25 bp, Rattus norvegicus
gtcttatacagactgctaaccccta

SEQ ID NO: 499551 - DNA, 25 bp, Rattus norvegicus
gtcttatacagagtgctaaccccta

SEQ ID NO: 499552 - DNA, 25 bp, Rattus norvegicus
gtcttatactggatgctttaattct

SEQ ID NO: 499553 - DNA, 25 bp, Rattus norvegicus
gtcttatactggttgctttaattct

SEQ ID NO: 499554 - DNA, 25 bp, Rattus norvegicus
gtcttatctcctagagtcagtggaa

SEQ ID NO: 499555 - DNA, 25 bp, Rattus norvegicus
gtcttatctccttgagtcagtggaa

SEQ ID NO: 499556 - DNA, 25 bp, Rattus norvegicus
gtcttatctcttattcaccacataa

SEQ ID NO: 499557 - DNA, 25 bp, Rattus norvegicus
gtcttatctctttttcaccacataa

SEQ ID NO: 499558 - DNA, 25 bp, Rattus norvegicus
gtcttatgaaccacagttttccctg

SEQ ID NO: 499559 - DNA, 25 bp, Rattus norvegicus
gtcttatgaacctcagttttccctg

SEQ ID NO: 499560 - DNA, 25 bp, Rattus norvegicus
gtcttatgaactcttctgacgtcag

SEQ ID NO: 499561 - DNA, 25 bp, Rattus norvegicus
gtcttatgaactgttctgacgtcag

SEQ ID NO: 499562 - DNA, 25 bp, Rattus norvegicus
gtcttatgacctcgtcttgtgacca

SEQ ID NO: 499563 - DNA, 25 bp, Rattus norvegicus
gtcttatgacctggtcttgtgacca

SEQ ID NO: 499564 - DNA, 25 bp, Rattus norvegicus
gtcttatgagataccagcacacttt

SEQ ID NO: 499565 - DNA, 25 bp, Rattus norvegicus
gtcttatgagattccagcacacttt

SEQ ID NO: 499566 - DNA, 25 bp, Rattus norvegicus
gtcttatgaggccaggctgacctta

SEQ ID NO: 499567 - DNA, 25 bp, Rattus norvegicus
gtcttatgaggcgaggctgacctta

SEQ ID NO: 499568 - DNA, 25 bp, Rattus norvegicus
gtcttatggagtcattcatttcaga

SEQ ID NO: 499569 - DNA, 25 bp, Rattus norvegicus
gtcttatggagtgattcatttcaga

SEQ ID NO: 499570 - DNA, 25 bp, Rattus norvegicus
gtcttatgggccattgtatacactg

SEQ ID NO: 499571 - DNA, 25 bp, Rattus norvegicus
gtcttatgggcctttgtatacactg

SEQ ID NO: 499572 - DNA, 25 bp, Rattus norvegicus
gtcttatgtcagaacttacctagat

SEQ ID NO: 499573 - DNA, 25 bp, Rattus norvegicus
gtcttatgtcagtacttacctagat

SEQ ID NO: 499574 - DNA, 25 bp, Rattus norvegicus
gtcttatgtgctagcttgttgggta

SEQ ID NO: 499575 - DNA, 25 bp, Rattus norvegicus
gtcttatgtgcttgcttgttgggta

SEQ ID NO: 499576 - DNA, 25 bp, Rattus norvegicus
gtcttatgttgtaagctcagggtca

SEQ ID NO: 499577 - DNA, 25 bp, Rattus norvegicus
gtcttatgttgttagctcagggtca

SEQ ID NO: 499578 - DNA, 25 bp, Rattus norvegicus
gtcttattcagactatatcacatca

SEQ ID NO: 499579 - DNA, 25 bp, Rattus norvegicus
gtcttattcagagtatatcacatca

SEQ ID NO: 499580 - DNA, 25 bp, Rattus norvegicus
gtcttattcccaagtttaccatctt

SEQ ID NO: 499581 - DNA, 25 bp, Rattus norvegicus
gtcttattcccatgtttaccatctt

SEQ ID NO: 499582 - DNA, 25 bp, Rattus norvegicus
gtcttattggctacctttgctgaaa

SEQ ID NO: 499583 - DNA, 25 bp, Rattus norvegicus
gtcttattggcttcctttgctgaaa

SEQ ID NO: 499584 - DNA, 25 bp, Rattus norvegicus
gtcttattgttcattccattggtca

SEQ ID NO: 499585 - DNA, 25 bp, Rattus norvegicus
gtcttattgttctttccattggtca

SEQ ID NO: 499586 - DNA, 25 bp, Rattus norvegicus
gtcttatttgccaacatcactggta

SEQ ID NO: 499587 - DNA, 25 bp, Rattus norvegicus
gtcttatttgcctacatcactggta

SEQ ID NO: 499588 - DNA, 25 bp, Rattus norvegicus
gtcttcaaactacaccaggcagcaa

SEQ ID NO: 499589 - DNA, 25 bp, Rattus norvegicus
gtcttcaaactagaccaggcagcaa

SEQ ID NO: 499590 - DNA, 25 bp, Rattus norvegicus
gtcttcaagcagcagcaggttaatt

SEQ ID NO: 499591 - DNA, 25 bp, Rattus norvegicus
gtcttcaagcaggagcaggttaatt

SEQ ID NO: 499592 - DNA, 25 bp, Rattus norvegicus
gtcttcaatgaacctgtgctaccag

SEQ ID NO: 499593 - DNA, 25 bp, Rattus norvegicus
gtcttcaatgaagctgtgctaccag

SEQ ID NO: 499594 - DNA, 25 bp, Rattus norvegicus
gtcttcaattgcagacttatatttg

SEQ ID NO: 499595 - DNA, 25 bp, Rattus norvegicus
gtcttcaattgctgacttatatttg

SEQ ID NO: 499596 - DNA, 25 bp, Rattus norvegicus
gtcttcacaaagaacgtaccgtcgt

SEQ ID NO: 499597 - DNA, 25 bp, Rattus norvegicus
gtcttcacaaagtacgtaccgtcgt

SEQ ID NO: 499598 - DNA, 25 bp, Rattus norvegicus
gtcttcacaagcattttgttttgtc

SEQ ID NO: 499599 - DNA, 25 bp, Rattus norvegicus
gtcttcacaagctttttgttttgtc

SEQ ID NO: 499600 - DNA, 25 bp, Rattus norvegicus
gtcttcacaagtatcaccatgcata

SEQ ID NO: 499601 - DNA, 25 bp, Rattus norvegicus
gtcttcacaagtttcaccatgcata

SEQ ID NO: 499602 - DNA, 25 bp, Rattus norvegicus
gtcttcacacacatcaaagtctctt

SEQ ID NO: 499603 - DNA, 25 bp, Rattus norvegicus
gtcttcacacacttcaaagtctctt

SEQ ID NO: 499604 - DNA, 25 bp, Rattus norvegicus
gtcttcacacagacatcagctagta

SEQ ID NO: 499605 - DNA, 25 bp, Rattus norvegicus
gtcttcacacagtcatcagctagta

SEQ ID NO: 499606 - DNA, 25 bp, Rattus norvegicus
gtcttcacacccagatttttctgtt

SEQ ID NO: 499607 - DNA, 25 bp, Rattus norvegicus
gtcttcacaccctgatttttctgtt

SEQ ID NO: 499608 - DNA, 25 bp, Rattus norvegicus
gtcttcacactgagaatggcgccta

SEQ ID NO: 499609 - DNA, 25 bp, Rattus norvegicus
gtcttcacactgtgaatggcgccta

SEQ ID NO: 499610 - DNA, 25 bp, Rattus norvegicus
gtcttcacagaaagcagtgtactat

SEQ ID NO: 499611 - DNA, 25 bp, Rattus norvegicus
gtcttcacagaatgcagtgtactat

SEQ ID NO: 499612 - DNA, 25 bp, Rattus norvegicus
gtcttcacataaccaagccattcag

SEQ ID NO: 499613 - DNA, 25 bp, Rattus norvegicus
gtcttcacataagcaagccattcag

SEQ ID NO: 499614 - DNA, 25 bp, Rattus norvegicus
gtcttcacatgaccttctcgtaatg

SEQ ID NO: 499615 - DNA, 25 bp, Rattus norvegicus
gtcttcacatgagcttctcgtaatg

SEQ ID NO: 499616 - DNA, 25 bp, Rattus norvegicus
gtcttcacatttataaattgcccgc

SEQ ID NO: 499617 - DNA, 25 bp, Rattus norvegicus
gtcttcacatttttaaattgcccgc

SEQ ID NO: 499618 - DNA, 25 bp, Rattus norvegicus
gtcttcaccattccccaacaatatt

SEQ ID NO: 499619 - DNA, 25 bp, Rattus norvegicus
gtcttcaccattgcccaacaatatt

SEQ ID NO: 499620 - DNA, 25 bp, Rattus norvegicus
gtcttcacctgtatcattccagcat

SEQ ID NO: 499621 - DNA, 25 bp, Rattus norvegicus
gtcttcacctgtttcattccagcat

SEQ ID NO: 499622 - DNA, 25 bp, Rattus norvegicus
gtcttcacggtgcttcagctgtcct

SEQ ID NO: 499623 - DNA, 25 bp, Rattus norvegicus
gtcttcacggtggttcagctgtcct

SEQ ID NO: 499624 - DNA, 25 bp, Rattus norvegicus
gtcttcagaaatcatggccactact

SEQ ID NO: 499625 - DNA, 25 bp, Rattus norvegicus
gtcttcagaaatgatggccactact

SEQ ID NO: 499626 - DNA, 25 bp, Rattus norvegicus
gtcttcagaatcctcaatcctaaca

SEQ ID NO: 499627 - DNA, 25 bp, Rattus norvegicus
gtcttcagaatcgtcaatcctaaca

SEQ ID NO: 499628 - DNA, 25 bp, Rattus norvegicus
gtcttcagagtaataaaatcatgca

SEQ ID NO: 499629 - DNA, 25 bp, Rattus norvegicus
gtcttcagagtattaaaatcatgca

SEQ ID NO: 499630 - DNA, 25 bp, Rattus norvegicus
gtcttcagattcaaagggcccaaat

SEQ ID NO: 499631 - DNA, 25 bp, Rattus norvegicus
gtcttcagattctaagggcccaaat

SEQ ID NO: 499632 - DNA, 25 bp, Rattus norvegicus
gtcttcagcccaagcttcttcagaa

SEQ ID NO: 499633 - DNA, 25 bp, Rattus norvegicus
gtcttcagcccatgcttcttcagaa

SEQ ID NO: 499634 - DNA, 25 bp, Rattus norvegicus
gtcttcagcgtcaactctaaggaga

SEQ ID NO: 499635 - DNA, 25 bp, Rattus norvegicus
gtcttcagcgtctactctaaggaga

SEQ ID NO: 499636 - DNA, 25 bp, Rattus norvegicus
gtcttcaggaatcatcactcacttg

SEQ ID NO: 499637 - DNA, 25 bp, Rattus norvegicus
gtcttcaggaatgatcactcacttg

SEQ ID NO: 499638 - DNA, 25 bp, Rattus norvegicus
gtcttcaggacaccagtaccacttt

SEQ ID NO: 499639 - DNA, 25 bp, Rattus norvegicus
gtcttcaggacagcagtaccacttt

SEQ ID NO: 499640 - DNA, 25 bp, Rattus norvegicus
gtcttcaggagcaccggtgccgcaa

SEQ ID NO: 499641 - DNA, 25 bp, Rattus norvegicus
gtcttcaggagctccggtgccgcaa

SEQ ID NO: 499642 - DNA, 25 bp, Rattus norvegicus
gtcttcagggcccaaacaagttcta

SEQ ID NO: 499643 - DNA, 25 bp, Rattus norvegicus
gtcttcagggccgaaacaagttcta

SEQ ID NO: 499644 - DNA, 25 bp, Rattus norvegicus
gtcttcagggcgagcccaggtgacc

SEQ ID NO: 499645 - DNA, 25 bp, Rattus norvegicus
gtcttcagggcgtgcccaggtgacc

SEQ ID NO: 499646 - DNA, 25 bp, Rattus norvegicus
gtcttcaggtctacaggccttcaca

SEQ ID NO: 499647 - DNA, 25 bp, Rattus norvegicus
gtcttcaggtcttcaggccttcaca

SEQ ID NO: 499648 - DNA, 25 bp, Rattus norvegicus
gtcttcaggttcatttgttggtttg

SEQ ID NO: 499649 - DNA, 25 bp, Rattus norvegicus
gtcttcaggttcttttgttggtttg

SEQ ID NO: 499650 - DNA, 25 bp, Rattus norvegicus
gtcttcagtagactatctttcacat

SEQ ID NO: 499651 - DNA, 25 bp, Rattus norvegicus
gtcttcagtagagtatctttcacat

SEQ ID NO: 499652 - DNA, 25 bp, Rattus norvegicus
gtcttcagtctgatcctaatggtgt

SEQ ID NO: 499653 - DNA, 25 bp, Rattus norvegicus
gtcttcagtctgttcctaatggtgt

SEQ ID NO: 499654 - DNA, 25 bp, Rattus norvegicus
gtcttcataacaagcatagccctcg

SEQ ID NO: 499655 - DNA, 25 bp, Rattus norvegicus
gtcttcataacatgcatagccctcg

SEQ ID NO: 499656 - DNA, 25 bp, Rattus norvegicus
gtcttcatatacagtcttgcctgag

SEQ ID NO: 499657 - DNA, 25 bp, Rattus norvegicus
gtcttcatatactgtcttgcctgag

SEQ ID NO: 499658 - DNA, 25 bp, Rattus norvegicus
gtcttcatcaccagcaaacaccagg

SEQ ID NO: 499659 - DNA, 25 bp, Rattus norvegicus
gtcttcatcacccacagagctgtag

SEQ ID NO: 499660 - DNA, 25 bp, Rattus norvegicus
gtcttcatcaccgacagagctgtag

SEQ ID NO: 499661 - DNA, 25 bp, Rattus norvegicus
gtcttcatcacctgcaaacaccagg

SEQ ID NO: 499662 - DNA, 25 bp, Rattus norvegicus
gtcttcatccatcagaggcctcaga

SEQ ID NO: 499663 - DNA, 25 bp, Rattus norvegicus
gtcttcatccatgagaggcctcaga

SEQ ID NO: 499664 - DNA, 25 bp, Rattus norvegicus
gtcttcatccccacttgaacaaaag

SEQ ID NO: 499665 - DNA, 25 bp, Rattus norvegicus
gtcttcatcccctcttgaacaaaag

SEQ ID NO: 499666 - DNA, 25 bp, Rattus norvegicus
gtcttcatctgcaaaaatccccagg

SEQ ID NO: 499667 - DNA, 25 bp, Rattus norvegicus
gtcttcatctgctaaaatccccagg

SEQ ID NO: 499668 - DNA, 25 bp, Rattus norvegicus
gtcttcatctgtcttgctatggcga

SEQ ID NO: 499669 - DNA, 25 bp, Rattus norvegicus
gtcttcatctgtgttgctatggcga

SEQ ID NO: 499670 - DNA, 25 bp, Rattus norvegicus
gtcttcatgaggcagttaggctgct

SEQ ID NO: 499671 - DNA, 25 bp, Rattus norvegicus
gtcttcatgagggagttaggctgct

SEQ ID NO: 499672 - DNA, 25 bp, Rattus norvegicus
gtcttcatggctcctgcagagtaaa

SEQ ID NO: 499673 - DNA, 25 bp, Rattus norvegicus
gtcttcatggctgctgcagagtaaa

SEQ ID NO: 499674 - DNA, 25 bp, Rattus norvegicus
gtcttcatgggccacgacttcaaaa

SEQ ID NO: 499675 - DNA, 25 bp, Rattus norvegicus
gtcttcatgggcgacgacttcaaaa

SEQ ID NO: 499676 - DNA, 25 bp, Rattus norvegicus
gtcttcatggttacacgtcatcacg

SEQ ID NO: 499677 - DNA, 25 bp, Rattus norvegicus
gtcttcatggtttcacgtcatcacg

SEQ ID NO: 499678 - DNA, 25 bp, Rattus norvegicus
gtcttcatgtgtacttgaccacaga

SEQ ID NO: 499679 - DNA, 25 bp, Rattus norvegicus
gtcttcatgtgttcttgaccacaga

SEQ ID NO: 499680 - DNA, 25 bp, Rattus norvegicus
gtcttcatgttcagtcatttttaat

SEQ ID NO: 499681 - DNA, 25 bp, Rattus norvegicus
gtcttcatgttctgtcatttttaat

SEQ ID NO: 499682 - DNA, 25 bp, Rattus norvegicus
gtcttcatgttgatagtggctcttt

SEQ ID NO: 499683 - DNA, 25 bp, Rattus norvegicus
gtcttcatgttgttagtggctcttt

SEQ ID NO: 499684 - DNA, 25 bp, Rattus norvegicus
gtcttcattcctatcaccagtggga

SEQ ID NO: 499685 - DNA, 25 bp, Rattus norvegicus
gtcttcattcctttcaccagtggga

SEQ ID NO: 499686 - DNA, 25 bp, Rattus norvegicus
gtcttcattgatctttgtcacgggt

SEQ ID NO: 499687 - DNA, 25 bp, Rattus norvegicus
gtcttcattgatgtttgtcacgggt

SEQ ID NO: 499688 - DNA, 25 bp, Rattus norvegicus
gtcttcatttctcggaccaatcaga

SEQ ID NO: 499689 - DNA, 25 bp, Rattus norvegicus
gtcttcatttctgggaccaatcaga

SEQ ID NO: 499690 - DNA, 25 bp, Rattus norvegicus
gtcttccaaagtacagggttatcca

SEQ ID NO: 499691 - DNA, 25 bp, Rattus norvegicus
gtcttccaaagttcagggttatcca

SEQ ID NO: 499692 - DNA, 25 bp, Rattus norvegicus
gtcttccaaattaatctctagatag

SEQ ID NO: 499693 - DNA, 25 bp, Rattus norvegicus
gtcttccaaatttatctctagatag

SEQ ID NO: 499694 - DNA, 25 bp, Rattus norvegicus
gtcttccaacggactgggcgttgcc

SEQ ID NO: 499695 - DNA, 25 bp, Rattus norvegicus
gtcttccaacggtctgggcgttgcc

SEQ ID NO: 499696 - DNA, 25 bp, Rattus norvegicus
gtcttccaagaaatccacatcttcc

SEQ ID NO: 499697 - DNA, 25 bp, Rattus norvegicus
gtcttccaagaaatctctgtacctg

SEQ ID NO: 499698 - DNA, 25 bp, Rattus norvegicus
gtcttccaagaattccacatcttcc

SEQ ID NO: 499699 - DNA, 25 bp, Rattus norvegicus
gtcttccaagaattctctgtacctg

SEQ ID NO: 499700 - DNA, 25 bp, Rattus norvegicus
gtcttccaagtccaggtagttcatg

SEQ ID NO: 499701 - DNA, 25 bp, Rattus norvegicus
gtcttccaagtcgaggtagttcatg

SEQ ID NO: 499702 - DNA, 25 bp, Rattus norvegicus
gtcttccacacacgcatgcatgagc

SEQ ID NO: 499703 - DNA, 25 bp, Rattus norvegicus
gtcttccacacaggcatgcatgagc

SEQ ID NO: 499704 - DNA, 25 bp, Rattus norvegicus
gtcttccacagaatcacttgcaata

SEQ ID NO: 499705 - DNA, 25 bp, Rattus norvegicus
gtcttccacagattcacttgcaata

SEQ ID NO: 499706 - DNA, 25 bp, Rattus norvegicus
gtcttccaccccattgattgagagg

SEQ ID NO: 499707 - DNA, 25 bp, Rattus norvegicus
gtcttccacccctttgattgagagg

SEQ ID NO: 499708 - DNA, 25 bp, Rattus norvegicus
gtcttccacctaaagcgtgctggaa

SEQ ID NO: 499709 - DNA, 25 bp, Rattus norvegicus
gtcttccacctatagcgtgctggaa

SEQ ID NO: 499710 - DNA, 25 bp, Rattus norvegicus
gtcttccactgaactaagacagaaa

SEQ ID NO: 499711 - DNA, 25 bp, Rattus norvegicus
gtcttccactgatctaagacagaaa

SEQ ID NO: 499712 - DNA, 25 bp, Rattus norvegicus
gtcttccagaatcagtctacgtctt

SEQ ID NO: 499713 - DNA, 25 bp, Rattus norvegicus
gtcttccagaatgagtctacgtctt

SEQ ID NO: 499714 - DNA, 25 bp, Rattus norvegicus
gtcttccaggaacggtggcatacag

SEQ ID NO: 499715 - DNA, 25 bp, Rattus norvegicus
gtcttccaggaagggtggcatacag

SEQ ID NO: 499716 - DNA, 25 bp, Rattus norvegicus
gtcttccaggccactcaggacattt

SEQ ID NO: 499717 - DNA, 25 bp, Rattus norvegicus
gtcttccaggcctctcaggacattt

SEQ ID NO: 499718 - DNA, 25 bp, Rattus norvegicus
gtcttccaggtactataaggcctca

SEQ ID NO: 499719 - DNA, 25 bp, Rattus norvegicus
gtcttccaggtagtataaggcctca

SEQ ID NO: 499720 - DNA, 25 bp, Rattus norvegicus
gtcttccagtcgctctactgctaaa

SEQ ID NO: 499721 - DNA, 25 bp, Rattus norvegicus
gtcttccagtcggtctactgctaaa

SEQ ID NO: 499722 - DNA, 25 bp, Rattus norvegicus
gtcttccagtgtaaaaggcatccct

SEQ ID NO: 499723 - DNA, 25 bp, Rattus norvegicus
gtcttccagtgttaaaggcatccct

SEQ ID NO: 499724 - DNA, 25 bp, Rattus norvegicus
gtcttccatattcacccatgaatgg

SEQ ID NO: 499725 - DNA, 25 bp, Rattus norvegicus
gtcttccatattgacccatgaatgg

SEQ ID NO: 499726 - DNA, 25 bp, Rattus norvegicus
gtcttccatgcactctccatgatcg

SEQ ID NO: 499727 - DNA, 25 bp, Rattus norvegicus
gtcttccatgcagtctccatgatcg

SEQ ID NO: 499728 - DNA, 25 bp, Rattus norvegicus
gtcttccattacatgagtctgtctt

SEQ ID NO: 499729 - DNA, 25 bp, Rattus norvegicus
gtcttccattacttgagtctgtctt

SEQ ID NO: 499730 - DNA, 25 bp, Rattus norvegicus
gtcttccattgcacatctagtagtt

SEQ ID NO: 499731 - DNA, 25 bp, Rattus norvegicus
gtcttccattgctcatctagtagtt

SEQ ID NO: 499732 - DNA, 25 bp, Rattus norvegicus
gtcttcccaaagaacttagcgtcct

SEQ ID NO: 499733 - DNA, 25 bp, Rattus norvegicus
gtcttcccaaagtacttagcgtcct

SEQ ID NO: 499734 - DNA, 25 bp, Rattus norvegicus
gtcttcccagctcagaatggagttc

SEQ ID NO: 499735 - DNA, 25 bp, Rattus norvegicus
gtcttcccagctgagaatggagttc

SEQ ID NO: 499736 - DNA, 25 bp, Rattus norvegicus
gtcttcccaggaacacggagtcaga

SEQ ID NO: 499737 - DNA, 25 bp, Rattus norvegicus
gtcttcccaggatcacggagtcaga

SEQ ID NO: 499738 - DNA, 25 bp, Rattus norvegicus
gtcttcccaggcatagggcagaggc

SEQ ID NO: 499739 - DNA, 25 bp, Rattus norvegicus
gtcttcccaggcttagggcagaggc

SEQ ID NO: 499740 - DNA, 25 bp, Rattus norvegicus
gtcttcccagtaacttcatgcagag

SEQ ID NO: 499741 - DNA, 25 bp, Rattus norvegicus
gtcttcccagtatcttcatgcagag

SEQ ID NO: 499742 - DNA, 25 bp, Rattus norvegicus
gtcttcccatgcactgagatatttg

SEQ ID NO: 499743 - DNA, 25 bp, Rattus norvegicus
gtcttcccatgctctgagatatttg

SEQ ID NO: 499744 - DNA, 25 bp, Rattus norvegicus
gtcttccccgagatggagatggctt

SEQ ID NO: 499745 - DNA, 25 bp, Rattus norvegicus
gtcttccccgagttggagatggctt

SEQ ID NO: 499746 - DNA, 25 bp, Rattus norvegicus
gtcttcccctcgattctgatgatga

SEQ ID NO: 499747 - DNA, 25 bp, Rattus norvegicus
gtcttcccctcgtttctgatgatga

SEQ ID NO: 499748 - DNA, 25 bp, Rattus norvegicus
gtcttccctaaaagcttgactgctg

SEQ ID NO: 499749 - DNA, 25 bp, Rattus norvegicus
gtcttccctaaatgcttgactgctg

SEQ ID NO: 499750 - DNA, 25 bp, Rattus norvegicus
gtcttccctaatcttactgatttct

SEQ ID NO: 499751 - DNA, 25 bp, Rattus norvegicus
gtcttccctaatgttactgatttct

SEQ ID NO: 499752 - DNA, 25 bp, Rattus norvegicus
gtcttccctccacactattaataga

SEQ ID NO: 499753 - DNA, 25 bp, Rattus norvegicus
gtcttccctccagactattaataga

SEQ ID NO: 499754 - DNA, 25 bp, Rattus norvegicus
gtcttccctggacaggacacttaca

SEQ ID NO: 499755 - DNA, 25 bp, Rattus norvegicus
gtcttccctggagaggacacttaca

SEQ ID NO: 499756 - DNA, 25 bp, Rattus norvegicus
gtcttccctgtgaagattctttttg

SEQ ID NO: 499757 - DNA, 25 bp, Rattus norvegicus
gtcttccctgtgtagattctttttg

SEQ ID NO: 499758 - DNA, 25 bp, Rattus norvegicus
gtcttcccttttctaggttgttgca

SEQ ID NO: 499759 - DNA, 25 bp, Rattus norvegicus
gtcttcccttttgtaggttgttgca

SEQ ID NO: 499760 - DNA, 25 bp, Rattus norvegicus
gtcttccgcagcatgagtggaggcc

SEQ ID NO: 499761 - DNA, 25 bp, Rattus norvegicus
gtcttccgcagcttgagtggaggcc

SEQ ID NO: 499762 - DNA, 25 bp, Rattus norvegicus
gtcttccgtgaccattaaactataa

SEQ ID NO: 499763 - DNA, 25 bp, Rattus norvegicus
gtcttccgtgacgattaaactataa

SEQ ID NO: 499764 - DNA, 25 bp, Rattus norvegicus
gtcttcctagcccagcgagctgtag

SEQ ID NO: 499765 - DNA, 25 bp, Rattus norvegicus
gtcttcctagccgagcgagctgtag

SEQ ID NO: 499766 - DNA, 25 bp, Rattus norvegicus
gtcttcctcatgatggtcatatctg

SEQ ID NO: 499767 - DNA, 25 bp, Rattus norvegicus
gtcttcctcatgttggtcatatctg

SEQ ID NO: 499768 - DNA, 25 bp, Rattus norvegicus
gtcttcctccaacccatactgaagg

SEQ ID NO: 499769 - DNA, 25 bp, Rattus norvegicus
gtcttcctccaagccatactgaagg

SEQ ID NO: 499770 - DNA, 25 bp, Rattus norvegicus
gtcttcctccgtaatatagattcag

SEQ ID NO: 499771 - DNA, 25 bp, Rattus norvegicus
gtcttcctccgttatatagattcag

SEQ ID NO: 499772 - DNA, 25 bp, Rattus norvegicus
gtcttcctcttcaacttactattag

SEQ ID NO: 499773 - DNA, 25 bp, Rattus norvegicus
gtcttcctcttctacttactattag

SEQ ID NO: 499774 - DNA, 25 bp, Rattus norvegicus
gtcttcctgaggcttccaaacaact

SEQ ID NO: 499775 - DNA, 25 bp, Rattus norvegicus
gtcttcctgagggttccaaacaact

SEQ ID NO: 499776 - DNA, 25 bp, Rattus norvegicus
gtcttcctgccaaggcggaatcatc

SEQ ID NO: 499777 - DNA, 25 bp, Rattus norvegicus
gtcttcctgccatggcggaatcatc

SEQ ID NO: 499778 - DNA, 25 bp, Rattus norvegicus
gtcttcctggataacttggtatata

SEQ ID NO: 499779 - DNA, 25 bp, Rattus norvegicus
gtcttcctggattacttggtatata

SEQ ID NO: 499780 - DNA, 25 bp, Rattus norvegicus
gtcttcctggttcagtgttctggaa

SEQ ID NO: 499781 - DNA, 25 bp, Rattus norvegicus
gtcttcctggttgagtgttctggaa

SEQ ID NO: 499782 - DNA, 25 bp, Rattus norvegicus
gtcttcctgtctcattccataggaa

SEQ ID NO: 499783 - DNA, 25 bp, Rattus norvegicus
gtcttcctgtctgattccataggaa

SEQ ID NO: 499784 - DNA, 25 bp, Rattus norvegicus
gtcttccttaataacatagacttga

SEQ ID NO: 499785 - DNA, 25 bp, Rattus norvegicus
gtcttccttaattacatagacttga

SEQ ID NO: 499786 - DNA, 25 bp, Rattus norvegicus
gtcttccttagacaatgagccttaa

SEQ ID NO: 499787 - DNA, 25 bp, Rattus norvegicus
gtcttccttagagaatgagccttaa

SEQ ID NO: 499788 - DNA, 25 bp, Rattus norvegicus
gtcttccttcagacattttgttttg

SEQ ID NO: 499789 - DNA, 25 bp, Rattus norvegicus
gtcttccttcagagactaagctatg

SEQ ID NO: 499790 - DNA, 25 bp, Rattus norvegicus
gtcttccttcagtcattttgttttg

SEQ ID NO: 499791 - DNA, 25 bp, Rattus norvegicus
gtcttccttcagtgactaagctatg

SEQ ID NO: 499792 - DNA, 25 bp, Rattus norvegicus
gtcttccttcatcctggtttgaaca

SEQ ID NO: 499793 - DNA, 25 bp, Rattus norvegicus
gtcttccttcatgctggtttgaaca

SEQ ID NO: 499794 - DNA, 25 bp, Rattus norvegicus
gtcttccttcccatctcatgtttgg

SEQ ID NO: 499795 - DNA, 25 bp, Rattus norvegicus
gtcttccttcccttctcatgtttgg

SEQ ID NO: 499796 - DNA, 25 bp, Rattus norvegicus
gtcttccttggtcattagtgctgca

SEQ ID NO: 499797 - DNA, 25 bp, Rattus norvegicus
gtcttccttggtgattagtgctgca

SEQ ID NO: 499798 - DNA, 25 bp, Rattus norvegicus
gtcttcctttgactcagaacttgtc

SEQ ID NO: 499799 - DNA, 25 bp, Rattus norvegicus
gtcttcctttgagtcagaacttgtc

SEQ ID NO: 499800 - DNA, 25 bp, Rattus norvegicus
gtcttccttttgcttttgaccattg

SEQ ID NO: 499801 - DNA, 25 bp, Rattus norvegicus
gtcttccttttggttttgaccattg

SEQ ID NO: 499802 - DNA, 25 bp, Rattus norvegicus
gtcttcgaagtacttggtcaccatc

SEQ ID NO: 499803 - DNA, 25 bp, Rattus norvegicus
gtcttcgaagtagttggtcaccatc

SEQ ID NO: 499804 - DNA, 25 bp, Rattus norvegicus
gtcttcgactatcagggcagcggct

SEQ ID NO: 499805 - DNA, 25 bp, Rattus norvegicus
gtcttcgactatgagggcagcggct

SEQ ID NO: 499806 - DNA, 25 bp, Rattus norvegicus
gtcttcgagcccagctgggaagagt

SEQ ID NO: 499807 - DNA, 25 bp, Rattus norvegicus
gtcttcgagccctgctgggaagagt

SEQ ID NO: 499808 - DNA, 25 bp, Rattus norvegicus
gtcttcgagtgacttattgctgctt

SEQ ID NO: 499809 - DNA, 25 bp, Rattus norvegicus
gtcttcgagtgagttattgctgctt

SEQ ID NO: 499810 - DNA, 25 bp, Rattus norvegicus
gtcttcgattgccaccctgagtcaa

SEQ ID NO: 499811 - DNA, 25 bp, Rattus norvegicus
gtcttcgattgcctgcattctagag

SEQ ID NO: 499812 - DNA, 25 bp, Rattus norvegicus
gtcttcgattgcgaccctgagtcaa

SEQ ID NO: 499813 - DNA, 25 bp, Rattus norvegicus
gtcttcgattgcgtgcattctagag

SEQ ID NO: 499814 - DNA, 25 bp, Rattus norvegicus
gtcttcgcagaacgcagtcttccaa

SEQ ID NO: 499815 - DNA, 25 bp, Rattus norvegicus
gtcttcgcagaaggcagtcttccaa

SEQ ID NO: 499816 - DNA, 25 bp, Rattus norvegicus
gtcttcgcatgtatctataatgcca

SEQ ID NO: 499817 - DNA, 25 bp, Rattus norvegicus
gtcttcgcatgtttctataatgcca

SEQ ID NO: 499818 - DNA, 25 bp, Rattus norvegicus
gtcttcgcctcacacttagcatttt

SEQ ID NO: 499819 - DNA, 25 bp, Rattus norvegicus
gtcttcgcctcagacttagcatttt

SEQ ID NO: 499820 - DNA, 25 bp, Rattus norvegicus
gtcttcgtaggactgtttgggctct

SEQ ID NO: 499821 - DNA, 25 bp, Rattus norvegicus
gtcttcgtaggagtgtttgggctct

SEQ ID NO: 499822 - DNA, 25 bp, Rattus norvegicus
gtcttcgtatgaatgacagcatgca

SEQ ID NO: 499823 - DNA, 25 bp, Rattus norvegicus
gtcttcgtatgattgacagcatgca

SEQ ID NO: 499824 - DNA, 25 bp, Rattus norvegicus
gtcttctaaactattgaattcctgc

SEQ ID NO: 499825 - DNA, 25 bp, Rattus norvegicus
gtcttctaaacttttgaattcctgc

SEQ ID NO: 499826 - DNA, 25 bp, Rattus norvegicus
gtcttctaaattagctgaggaacca

SEQ ID NO: 499827 - DNA, 25 bp, Rattus norvegicus
gtcttctaaatttgctgaggaacca

SEQ ID NO: 499828 - DNA, 25 bp, Rattus norvegicus
gtcttctacattcgcacatattcat

SEQ ID NO: 499829 - DNA, 25 bp, Rattus norvegicus
gtcttctacattctggttggcggcc

SEQ ID NO: 499830 - DNA, 25 bp, Rattus norvegicus
gtcttctacattggcacatattcat

SEQ ID NO: 499831 - DNA, 25 bp, Rattus norvegicus
gtcttctacattgtggttggcggcc

SEQ ID NO: 499832 - DNA, 25 bp, Rattus norvegicus
gtcttctacccaactgatgagcttt

SEQ ID NO: 499833 - DNA, 25 bp, Rattus norvegicus
gtcttctacccatctgatgagcttt

SEQ ID NO: 499834 - DNA, 25 bp, Rattus norvegicus
gtcttctaccctcccaaaggacagt

SEQ ID NO: 499835 - DNA, 25 bp, Rattus norvegicus
gtcttctaccctgccaaaggacagt

SEQ ID NO: 499836 - DNA, 25 bp, Rattus norvegicus
gtcttctacttcagacttcactgat

SEQ ID NO: 499837 - DNA, 25 bp, Rattus norvegicus
gtcttctacttctgacttcactgat

SEQ ID NO: 499838 - DNA, 25 bp, Rattus norvegicus
gtcttctagaagaaaccaggctcca

SEQ ID NO: 499839 - DNA, 25 bp, Rattus norvegicus
gtcttctagaagtaaccaggctcca

SEQ ID NO: 499840 - DNA, 25 bp, Rattus norvegicus
gtcttctagacccatttcatacaac

SEQ ID NO: 499841 - DNA, 25 bp, Rattus norvegicus
gtcttctagaccgatttcatacaac

SEQ ID NO: 499842 - DNA, 25 bp, Rattus norvegicus
gtcttctagactccagagggtgtca

SEQ ID NO: 499843 - DNA, 25 bp, Rattus norvegicus
gtcttctagactgcagagggtgtca

SEQ ID NO: 499844 - DNA, 25 bp, Rattus norvegicus
gtcttctagcccatatctttggcaa

SEQ ID NO: 499845 - DNA, 25 bp, Rattus norvegicus
gtcttctagcccttatctttggcaa

SEQ ID NO: 499846 - DNA, 25 bp, Rattus norvegicus
gtcttctagtgaatattgcccagtt

SEQ ID NO: 499847 - DNA, 25 bp, Rattus norvegicus
gtcttctagtgattattgcccagtt

SEQ ID NO: 499848 - DNA, 25 bp, Rattus norvegicus
gtcttctagttcagcctttttaagt

SEQ ID NO: 499849 - DNA, 25 bp, Rattus norvegicus
gtcttctagttctgcctttttaagt

SEQ ID NO: 499850 - DNA, 25 bp, Rattus norvegicus
gtcttctatccaatgatttacactg

SEQ ID NO: 499851 - DNA, 25 bp, Rattus norvegicus
gtcttctatccattgatttacactg

SEQ ID NO: 499852 - DNA, 25 bp, Rattus norvegicus
gtcttctcaaggatcctgtgtcaga

SEQ ID NO: 499853 - DNA, 25 bp, Rattus norvegicus
gtcttctcaaggttcctgtgtcaga

SEQ ID NO: 499854 - DNA, 25 bp, Rattus norvegicus
gtcttctcaagtcacgagtccagtg

SEQ ID NO: 499855 - DNA, 25 bp, Rattus norvegicus
gtcttctcaagtgacgagtccagtg

SEQ ID NO: 499856 - DNA, 25 bp, Rattus norvegicus
gtcttctcaatgaggttctattttt

SEQ ID NO: 499857 - DNA, 25 bp, Rattus norvegicus
gtcttctcaatgtggttctattttt

SEQ ID NO: 499858 - DNA, 25 bp, Rattus norvegicus
gtcttctcagaccttcttttgtaag

SEQ ID NO: 499859 - DNA, 25 bp, Rattus norvegicus
gtcttctcagacgttcttttgtaag

SEQ ID NO: 499860 - DNA, 25 bp, Rattus norvegicus
gtcttctcaggcaatgggctcacta

SEQ ID NO: 499861 - DNA, 25 bp, Rattus norvegicus
gtcttctcaggctatgggctcacta

SEQ ID NO: 499862 - DNA, 25 bp, Rattus norvegicus
gtcttctcatatcgaagagccccat

SEQ ID NO: 499863 - DNA, 25 bp, Rattus norvegicus
gtcttctcatatggaagagccccat

SEQ ID NO: 499864 - DNA, 25 bp, Rattus norvegicus
gtcttctcattaagttttagtgcct

SEQ ID NO: 499865 - DNA, 25 bp, Rattus norvegicus
gtcttctcattatgttttagtgcct

SEQ ID NO: 499866 - DNA, 25 bp, Rattus norvegicus
gtcttctccaagatgaaaggccgtg

SEQ ID NO: 499867 - DNA, 25 bp, Rattus norvegicus
gtcttctccaagttgaaaggccgtg

SEQ ID NO: 499868 - DNA, 25 bp, Rattus norvegicus
gtcttctcccataatgatgatgcct

SEQ ID NO: 499869 - DNA, 25 bp, Rattus norvegicus
gtcttctcccattatgatgatgcct

SEQ ID NO: 499870 - DNA, 25 bp, Rattus norvegicus
gtcttctcccgcaatgatcaagagt

SEQ ID NO: 499871 - DNA, 25 bp, Rattus norvegicus
gtcttctcccgctatgatcaagagt

SEQ ID NO: 499872 - DNA, 25 bp, Rattus norvegicus
gtcttctcccttagtggttctaaga

SEQ ID NO: 499873 - DNA, 25 bp, Rattus norvegicus
gtcttctcccttctgttgaatgtta

SEQ ID NO: 499874 - DNA, 25 bp, Rattus norvegicus
gtcttctcccttgtgttgaatgtta

SEQ ID NO: 499875 - DNA, 25 bp, Rattus norvegicus
gtcttctccctttgtggttctaaga

SEQ ID NO: 499876 - DNA, 25 bp, Rattus norvegicus
gtcttctcggtgaccctgagtgagg

SEQ ID NO: 499877 - DNA, 25 bp, Rattus norvegicus
gtcttctcggtgtccctgagtgagg

SEQ ID NO: 499878 - DNA, 25 bp, Rattus norvegicus
gtcttctctatgcaaaatgttcggg

SEQ ID NO: 499879 - DNA, 25 bp, Rattus norvegicus
gtcttctctatggaaaatgttcggg

SEQ ID NO: 499880 - DNA, 25 bp, Rattus norvegicus
gtcttctctcacatcaaactgacgt

SEQ ID NO: 499881 - DNA, 25 bp, Rattus norvegicus
gtcttctctcacttcaaactgacgt

SEQ ID NO: 499882 - DNA, 25 bp, Rattus norvegicus
gtcttctctcatacagtcagtagtg

SEQ ID NO: 499883 - DNA, 25 bp, Rattus norvegicus
gtcttctctcattcagtcagtagtg

SEQ ID NO: 499884 - DNA, 25 bp, Rattus norvegicus
gtcttctcttctcctttgttattta

SEQ ID NO: 499885 - DNA, 25 bp, Rattus norvegicus
gtcttctcttctgctttgttattta

SEQ ID NO: 499886 - DNA, 25 bp, Rattus norvegicus
gtcttctcttggctggagtttgcat

SEQ ID NO: 499887 - DNA, 25 bp, Rattus norvegicus
gtcttctcttgggtggagtttgcat

SEQ ID NO: 499888 - DNA, 25 bp, Rattus norvegicus
gtcttctgaactctggtggctctac

SEQ ID NO: 499889 - DNA, 25 bp, Rattus norvegicus
gtcttctgaactgtggtggctctac

SEQ ID NO: 499890 - DNA, 25 bp, Rattus norvegicus
gtcttctgacatcacccacagaaat

SEQ ID NO: 499891 - DNA, 25 bp, Rattus norvegicus
gtcttctgacatgacccacagaaat

SEQ ID NO: 499892 - DNA, 25 bp, Rattus norvegicus
gtcttctgagacacctgattttaac

SEQ ID NO: 499893 - DNA, 25 bp, Rattus norvegicus
gtcttctgagactcctgattttaac

SEQ ID NO: 499894 - DNA, 25 bp, Rattus norvegicus
gtcttctgagccagtgatggagcca

SEQ ID NO: 499895 - DNA, 25 bp, Rattus norvegicus
gtcttctgagcctgtgatggagcca

SEQ ID NO: 499896 - DNA, 25 bp, Rattus norvegicus
gtcttctggaagagctgctagcact

SEQ ID NO: 499897 - DNA, 25 bp, Rattus norvegicus
gtcttctggaagtgctgctagcact

SEQ ID NO: 499898 - DNA, 25 bp, Rattus norvegicus
gtcttctggacacccggatgtgtaa

SEQ ID NO: 499899 - DNA, 25 bp, Rattus norvegicus
gtcttctggacagccggatgtgtaa

SEQ ID NO: 499900 - DNA, 25 bp, Rattus norvegicus
gtcttctggccaaacgactgtgatt

SEQ ID NO: 499901 - DNA, 25 bp, Rattus norvegicus
gtcttctggccatacgactgtgatt

SEQ ID NO: 499902 - DNA, 25 bp, Rattus norvegicus
gtcttctggttcagaccacaactga

SEQ ID NO: 499903 - DNA, 25 bp, Rattus norvegicus
gtcttctggttctgaccacaactga

SEQ ID NO: 499904 - DNA, 25 bp, Rattus norvegicus
gtcttctgtagaaatctcccttgtc

SEQ ID NO: 499905 - DNA, 25 bp, Rattus norvegicus
gtcttctgtagatatctcccttgtc

SEQ ID NO: 499906 - DNA, 25 bp, Rattus norvegicus
gtcttctgtcctcactgagaagtac

SEQ ID NO: 499907 - DNA, 25 bp, Rattus norvegicus
gtcttctgtcctgactgagaagtac

SEQ ID NO: 499908 - DNA, 25 bp, Rattus norvegicus
gtcttctgtggccacaaacatcagt

SEQ ID NO: 499909 - DNA, 25 bp, Rattus norvegicus
gtcttctgtggcgacaaacatcagt

SEQ ID NO: 499910 - DNA, 25 bp, Rattus norvegicus
gtcttctgttctctgtacccaggca

SEQ ID NO: 499911 - DNA, 25 bp, Rattus norvegicus
gtcttctgttctgtgtacccaggca

SEQ ID NO: 499912 - DNA, 25 bp, Rattus norvegicus
gtcttctgttggacatagcttttca

SEQ ID NO: 499913 - DNA, 25 bp, Rattus norvegicus
gtcttctgttggtcatagcttttca

SEQ ID NO: 499914 - DNA, 25 bp, Rattus norvegicus
gtcttctgttttctgtataggccga

SEQ ID NO: 499915 - DNA, 25 bp, Rattus norvegicus
gtcttctgttttgtgtataggccga

SEQ ID NO: 499916 - DNA, 25 bp, Rattus norvegicus
gtcttcttagctaaaacaacccagg

SEQ ID NO: 499917 - DNA, 25 bp, Rattus norvegicus
gtcttcttagcttaaacaacccagg

SEQ ID NO: 499918 - DNA, 25 bp, Rattus norvegicus
gtcttcttaggcctcctagtgggca

SEQ ID NO: 499919 - DNA, 25 bp, Rattus norvegicus
gtcttcttaggcgtcctagtgggca

SEQ ID NO: 499920 - DNA, 25 bp, Rattus norvegicus
gtcttcttattcatggcattactcc

SEQ ID NO: 499921 - DNA, 25 bp, Rattus norvegicus
gtcttcttattcttggcattactcc

SEQ ID NO: 499922 - DNA, 25 bp, Rattus norvegicus
gtcttcttcaggagtaagtaccgat

SEQ ID NO: 499923 - DNA, 25 bp, Rattus norvegicus
gtcttcttcaggtgtaagtaccgat

SEQ ID NO: 499924 - DNA, 25 bp, Rattus norvegicus
gtcttcttccaaccatgggatgatt

SEQ ID NO: 499925 - DNA, 25 bp, Rattus norvegicus
gtcttcttccaagcatgggatgatt

SEQ ID NO: 499926 - DNA, 25 bp, Rattus norvegicus
gtcttcttcgtcagtgtgctcttca

SEQ ID NO: 499927 - DNA, 25 bp, Rattus norvegicus
gtcttcttcgtctgtgtgctcttca

SEQ ID NO: 499928 - DNA, 25 bp, Rattus norvegicus
gtcttcttctgaactcataaccatt

SEQ ID NO: 499929 - DNA, 25 bp, Rattus norvegicus
gtcttcttctgatctcataaccatt

SEQ ID NO: 499930 - DNA, 25 bp, Rattus norvegicus
gtcttcttgaggactttgctgtgag

SEQ ID NO: 499931 - DNA, 25 bp, Rattus norvegicus
gtcttcttgaggtctttgctgtgag

SEQ ID NO: 499932 - DNA, 25 bp, Rattus norvegicus
gtcttcttgcccattaacagctgta

SEQ ID NO: 499933 - DNA, 25 bp, Rattus norvegicus
gtcttcttgccctttaacagctgta

SEQ ID NO: 499934 - DNA, 25 bp, Rattus norvegicus
gtcttcttgcctaaaagaacatcaa

SEQ ID NO: 499935 - DNA, 25 bp, Rattus norvegicus
gtcttcttgccttaaagaacatcaa

SEQ ID NO: 499936 - DNA, 25 bp, Rattus norvegicus
gtcttctttcacaaacaactgctgg

SEQ ID NO: 499937 - DNA, 25 bp, Rattus norvegicus
gtcttctttcactaacaactgctgg

SEQ ID NO: 499938 - DNA, 25 bp, Rattus norvegicus
gtcttctttgaaacctggagtcctg

SEQ ID NO: 499939 - DNA, 25 bp, Rattus norvegicus
gtcttctttgaatcctggagtcctg

SEQ ID NO: 499940 - DNA, 25 bp, Rattus norvegicus
gtcttctttgacacctgacaaccta

SEQ ID NO: 499941 - DNA, 25 bp, Rattus norvegicus
gtcttctttgactcctgacaaccta

SEQ ID NO: 499942 - DNA, 25 bp, Rattus norvegicus
gtcttcttttccacagtattaaatg

SEQ ID NO: 499943 - DNA, 25 bp, Rattus norvegicus
gtcttcttttcctcagtattaaatg

SEQ ID NO: 499944 - DNA, 25 bp, Rattus norvegicus
gtcttgaaagacaaccaggccatca

SEQ ID NO: 499945 - DNA, 25 bp, Rattus norvegicus
gtcttgaaagactaccaggccatca

SEQ ID NO: 499946 - DNA, 25 bp, Rattus norvegicus
gtcttgaaagctaagctcactgtac

SEQ ID NO: 499947 - DNA, 25 bp, Rattus norvegicus
gtcttgaaagcttagctcactgtac

SEQ ID NO: 499948 - DNA, 25 bp, Rattus norvegicus
gtcttgaacagtccagtgagccttt

SEQ ID NO: 499949 - DNA, 25 bp, Rattus norvegicus
gtcttgaacagtgcagtgagccttt

SEQ ID NO: 499950 - DNA, 25 bp, Rattus norvegicus
gtcttgaaccccattatcagattat

SEQ ID NO: 499951 - DNA, 25 bp, Rattus norvegicus
gtcttgaacccctttatcagattat

SEQ ID NO: 499952 - DNA, 25 bp, Rattus norvegicus
gtcttgaactcacaatccctgcctt

SEQ ID NO: 499953 - DNA, 25 bp, Rattus norvegicus
gtcttgaactcacagtgacccatct

SEQ ID NO: 499954 - DNA, 25 bp, Rattus norvegicus
gtcttgaactcagaatccctgcctt

SEQ ID NO: 499955 - DNA, 25 bp, Rattus norvegicus
gtcttgaactcagagtgacccatct

SEQ ID NO: 499956 - DNA, 25 bp, Rattus norvegicus
gtcttgaagtcaatctccactctgg

SEQ ID NO: 499957 - DNA, 25 bp, Rattus norvegicus
gtcttgaagtcattctccactctgg

SEQ ID NO: 499958 - DNA, 25 bp, Rattus norvegicus
gtcttgaatttgctatgcctcagag

SEQ ID NO: 499959 - DNA, 25 bp, Rattus norvegicus
gtcttgaatttggtatgcctcagag

SEQ ID NO: 499960 - DNA, 25 bp, Rattus norvegicus
gtcttgacatcaactgttaacctta

SEQ ID NO: 499961 - DNA, 25 bp, Rattus norvegicus
gtcttgacatcatctgttaacctta

SEQ ID NO: 499962 - DNA, 25 bp, Rattus norvegicus
gtcttgacccctcgattatcttcag

SEQ ID NO: 499963 - DNA, 25 bp, Rattus norvegicus
gtcttgacccctggattatcttcag

SEQ ID NO: 499964 - DNA, 25 bp, Rattus norvegicus
gtcttgacctacatttccttcttgg

SEQ ID NO: 499965 - DNA, 25 bp, Rattus norvegicus
gtcttgacctacttttccttcttgg

SEQ ID NO: 499966 - DNA, 25 bp, Rattus norvegicus
gtcttgacctgtccgtccgtcatgc

SEQ ID NO: 499967 - DNA, 25 bp, Rattus norvegicus
gtcttgacctgtgcgtccgtcatgc

SEQ ID NO: 499968 - DNA, 25 bp, Rattus norvegicus
gtcttgaccttacaactgttctcta

SEQ ID NO: 499969 - DNA, 25 bp, Rattus norvegicus
gtcttgaccttagaactgttctcta

SEQ ID NO: 499970 - DNA, 25 bp, Rattus norvegicus
gtcttgactgctaactattccatga

SEQ ID NO: 499971 - DNA, 25 bp, Rattus norvegicus
gtcttgactgcttactattccatga

SEQ ID NO: 499972 - DNA, 25 bp, Rattus norvegicus
gtcttgactgtaagtgcaacccatt

SEQ ID NO: 499973 - DNA, 25 bp, Rattus norvegicus
gtcttgactgtatgtgcaacccatt

SEQ ID NO: 499974 - DNA, 25 bp, Rattus norvegicus
gtcttgactttgaaaactgtggcta

SEQ ID NO: 499975 - DNA, 25 bp, Rattus norvegicus
gtcttgactttgagcacctactagg

SEQ ID NO: 499976 - DNA, 25 bp, Rattus norvegicus
gtcttgactttgtaaactgtggcta

SEQ ID NO: 499977 - DNA, 25 bp, Rattus norvegicus
gtcttgactttgtgcacctactagg

SEQ ID NO: 499978 - DNA, 25 bp, Rattus norvegicus
gtcttgagaagcagcgggatgcctt

SEQ ID NO: 499979 - DNA, 25 bp, Rattus norvegicus
gtcttgagaagctgcgggatgcctt

SEQ ID NO: 499980 - DNA, 25 bp, Rattus norvegicus
gtcttgagagtcatgagcgcgtttc

SEQ ID NO: 499981 - DNA, 25 bp, Rattus norvegicus
gtcttgagagtcttgagcgcgtttc

SEQ ID NO: 499982 - DNA, 25 bp, Rattus norvegicus
gtcttgagagtgattacggtttctt

SEQ ID NO: 499983 - DNA, 25 bp, Rattus norvegicus
gtcttgagagtgtttacggtttctt

SEQ ID NO: 499984 - DNA, 25 bp, Rattus norvegicus
gtcttgagctatcttagcctcttaa

SEQ ID NO: 499985 - DNA, 25 bp, Rattus norvegicus
gtcttgagctatgttagcctcttaa

SEQ ID NO: 499986 - DNA, 25 bp, Rattus norvegicus
gtcttgaggtgcctgcatacacata

SEQ ID NO: 499987 - DNA, 25 bp, Rattus norvegicus
gtcttgaggtgcgtgcatacacata

SEQ ID NO: 499988 - DNA, 25 bp, Rattus norvegicus
gtcttgaggtttacagcggtacgta

SEQ ID NO: 499989 - DNA, 25 bp, Rattus norvegicus
gtcttgaggttttcagcggtacgta

SEQ ID NO: 499990 - DNA, 25 bp, Rattus norvegicus
gtcttgagtcacaacaacagtctag

SEQ ID NO: 499991 - DNA, 25 bp, Rattus norvegicus
gtcttgagtcactacaacagtctag

SEQ ID NO: 499992 - DNA, 25 bp, Rattus norvegicus
gtcttgagtgacagtcctgttcttt

SEQ ID NO: 499993 - DNA, 25 bp, Rattus norvegicus
gtcttgagtgactgtcctgttcttt

SEQ ID NO: 499994 - DNA, 25 bp, Rattus norvegicus
gtcttgagttctagcatgtgtttat

SEQ ID NO: 499995 - DNA, 25 bp, Rattus norvegicus
gtcttgagttcttgcatgtgtttat

SEQ ID NO: 499996 - DNA, 25 bp, Rattus norvegicus
gtcttgatatataagtctaacctgt

SEQ ID NO: 499997 - DNA, 25 bp, Rattus norvegicus
gtcttgatatattagtctaacctgt

SEQ ID NO: 499998 - DNA, 25 bp, Rattus norvegicus
gtcttgatcattagaactcctgttc

SEQ ID NO: 499999 - DNA, 25 bp, Rattus norvegicus
gtcttgatcatttgaactcctgttc

SEQ ID NO: 500000 - DNA, 25 bp, Rattus norvegicus
gtcttgatggacatgggtcggacat

SEQ ID NO: 500001 - DNA, 25 bp, Rattus norvegicus
gtcttgatggacttgggtcggacat

SEQ ID NO: 500002 - DNA, 25 bp, Rattus norvegicus
gtcttgattctgattgcaaagcaca

SEQ ID NO: 500003 - DNA, 25 bp, Rattus norvegicus
gtcttgattctgtttgcaaagcaca

SEQ ID NO: 500004 - DNA, 25 bp, Rattus norvegicus
gtcttgattttcctttgggactcag

SEQ ID NO: 500005 - DNA, 25 bp, Rattus norvegicus
gtcttgattttcgtttgggactcag

SEQ ID NO: 500006 - DNA, 25 bp, Rattus norvegicus
gtcttgcaaacacagcatttccttg

SEQ ID NO: 500007 - DNA, 25 bp, Rattus norvegicus
gtcttgcaaacagagcatttccttg

SEQ ID NO: 500008 - DNA, 25 bp, Rattus norvegicus
gtcttgcaaagaatagctacctctg

SEQ ID NO: 500009 - DNA, 25 bp, Rattus norvegicus
gtcttgcaaagattagctacctctg

SEQ ID NO: 500010 - DNA, 25 bp, Rattus norvegicus
gtcttgcaaagcatcatcaacttgg

SEQ ID NO: 500011 - DNA, 25 bp, Rattus norvegicus
gtcttgcaaagcttcatcaacttgg

SEQ ID NO: 500012 - DNA, 25 bp, Rattus norvegicus
gtcttgcacatgctaggcaatgctc

SEQ ID NO: 500013 - DNA, 25 bp, Rattus norvegicus
gtcttgcacatggtaggcaatgctc

SEQ ID NO: 500014 - DNA, 25 bp, Rattus norvegicus
gtcttgcaccagctagggtcgtccg

SEQ ID NO: 500015 - DNA, 25 bp, Rattus norvegicus
gtcttgcaccaggtagggtcgtccg

SEQ ID NO: 500016 - DNA, 25 bp, Rattus norvegicus
gtcttgcacctgcatgagcatcaca

SEQ ID NO: 500017 - DNA, 25 bp, Rattus norvegicus
gtcttgcacctggatgagcatcaca

SEQ ID NO: 500018 - DNA, 25 bp, Rattus norvegicus
gtcttgcactagactgtgttcagtg

SEQ ID NO: 500019 - DNA, 25 bp, Rattus norvegicus
gtcttgcactagtctgtgttcagtg

SEQ ID NO: 500020 - DNA, 25 bp, Rattus norvegicus
gtcttgcagaccacttcggaggcaa

SEQ ID NO: 500021 - DNA, 25 bp, Rattus norvegicus
gtcttgcagacctcttcggaggcaa

SEQ ID NO: 500022 - DNA, 25 bp, Rattus norvegicus
gtcttgcatcatacatggagcccat

SEQ ID NO: 500023 - DNA, 25 bp, Rattus norvegicus
gtcttgcatcattcatggagcccat

SEQ ID NO: 500024 - DNA, 25 bp, Rattus norvegicus
gtcttgcatctactttgactaccaa

SEQ ID NO: 500025 - DNA, 25 bp, Rattus norvegicus
gtcttgcatctagtttgactaccaa

SEQ ID NO: 500026 - DNA, 25 bp, Rattus norvegicus
gtcttgcatcttcagtgcttctgag

SEQ ID NO: 500027 - DNA, 25 bp, Rattus norvegicus
gtcttgcatcttgagtgcttctgag

SEQ ID NO: 500028 - DNA, 25 bp, Rattus norvegicus
gtcttgcatgtaacacaactcgagt

SEQ ID NO: 500029 - DNA, 25 bp, Rattus norvegicus
gtcttgcatgtatcacaactcgagt

SEQ ID NO: 500030 - DNA, 25 bp, Rattus norvegicus
gtcttgccaaatatatctccagatg

SEQ ID NO: 500031 - DNA, 25 bp, Rattus norvegicus
gtcttgccaaatttatctccagatg

SEQ ID NO: 500032 - DNA, 25 bp, Rattus norvegicus
gtcttgccacctagacatgtagaag

SEQ ID NO: 500033 - DNA, 25 bp, Rattus norvegicus
gtcttgccaccttgacatgtagaag

SEQ ID NO: 500034 - DNA, 25 bp, Rattus norvegicus
gtcttgccagctaagctatctgttt

SEQ ID NO: 500035 - DNA, 25 bp, Rattus norvegicus
gtcttgccagcttagctatctgttt

SEQ ID NO: 500036 - DNA, 25 bp, Rattus norvegicus
gtcttgcccagcaacctttcgaggg

SEQ ID NO: 500037 - DNA, 25 bp, Rattus norvegicus
gtcttgcccagctacctttcgaggg

SEQ ID NO: 500038 - DNA, 25 bp, Rattus norvegicus
gtcttgcccatcatcacatggagat

SEQ ID NO: 500039 - DNA, 25 bp, Rattus norvegicus
gtcttgcccatcttcacatggagat

SEQ ID NO: 500040 - DNA, 25 bp, Rattus norvegicus
gtcttgccgccaacatgtgatatga

SEQ ID NO: 500041 - DNA, 25 bp, Rattus norvegicus
gtcttgccgccatcatgtgatatga

SEQ ID NO: 500042 - DNA, 25 bp, Rattus norvegicus
gtcttgcctaacagctatccatgaa

SEQ ID NO: 500043 - DNA, 25 bp, Rattus norvegicus
gtcttgcctaactgctatccatgaa

SEQ ID NO: 500044 - DNA, 25 bp, Rattus norvegicus
gtcttgcctaccacctggtagacag

SEQ ID NO: 500045 - DNA, 25 bp, Rattus norvegicus
gtcttgcctacctcctggtagacag

SEQ ID NO: 500046 - DNA, 25 bp, Rattus norvegicus
gtcttgcctctcagtaaggactttg

SEQ ID NO: 500047 - DNA, 25 bp, Rattus norvegicus
gtcttgcctctctgtaaggactttg

SEQ ID NO: 500048 - DNA, 25 bp, Rattus norvegicus
gtcttgcctgagatggtaagtgata

SEQ ID NO: 500049 - DNA, 25 bp, Rattus norvegicus
gtcttgcctgagttggtaagtgata

SEQ ID NO: 500050 - DNA, 25 bp, Rattus norvegicus
gtcttgccttcacctgttactttct

SEQ ID NO: 500051 - DNA, 25 bp, Rattus norvegicus
gtcttgccttcagctgttactttct

SEQ ID NO: 500052 - DNA, 25 bp, Rattus norvegicus
gtcttgcgaagtaaactccccgtga

SEQ ID NO: 500053 - DNA, 25 bp, Rattus norvegicus
gtcttgcgaagttaactccccgtga

SEQ ID NO: 500054 - DNA, 25 bp, Rattus norvegicus
gtcttgcgggcacctaaactctgaa

SEQ ID NO: 500055 - DNA, 25 bp, Rattus norvegicus
gtcttgcgggcagctaaactctgaa

SEQ ID NO: 500056 - DNA, 25 bp, Rattus norvegicus
gtcttgcgttgaccatgctttgcag

SEQ ID NO: 500057 - DNA, 25 bp, Rattus norvegicus
gtcttgcgttgagcatgctttgcag

SEQ ID NO: 500058 - DNA, 25 bp, Rattus norvegicus
gtcttgctacagaacttaccacgtt

SEQ ID NO: 500059 - DNA, 25 bp, Rattus norvegicus
gtcttgctacagagtgaagccggca

SEQ ID NO: 500060 - DNA, 25 bp, Rattus norvegicus
gtcttgctacagtacttaccacgtt

SEQ ID NO: 500061 - DNA, 25 bp, Rattus norvegicus
gtcttgctacagtgtgaagccggca

SEQ ID NO: 500062 - DNA, 25 bp, Rattus norvegicus
gtcttgctactcacgggttcagcgt

SEQ ID NO: 500063 - DNA, 25 bp, Rattus norvegicus
gtcttgctactctcgggttcagcgt

SEQ ID NO: 500064 - DNA, 25 bp, Rattus norvegicus
gtcttgctccacaaaaggtgttttc

SEQ ID NO: 500065 - DNA, 25 bp, Rattus norvegicus
gtcttgctccactaaaggtgttttc

SEQ ID NO: 500066 - DNA, 25 bp, Rattus norvegicus
gtcttgctctcacagaattttacta

SEQ ID NO: 500067 - DNA, 25 bp, Rattus norvegicus
gtcttgctctcagagaattttacta

SEQ ID NO: 500068 - DNA, 25 bp, Rattus norvegicus
gtcttgctctctctaccaaagcaat

SEQ ID NO: 500069 - DNA, 25 bp, Rattus norvegicus
gtcttgctctctgtaccaaagcaat

SEQ ID NO: 500070 - DNA, 25 bp, Rattus norvegicus
gtcttgctgaacagcacctacagga

SEQ ID NO: 500071 - DNA, 25 bp, Rattus norvegicus
gtcttgctgaactgcacctacagga

SEQ ID NO: 500072 - DNA, 25 bp, Rattus norvegicus
gtcttgctgactagggcttgggcta

SEQ ID NO: 500073 - DNA, 25 bp, Rattus norvegicus
gtcttgctgacttgggcttgggcta

SEQ ID NO: 500074 - DNA, 25 bp, Rattus norvegicus
gtcttgctggcaaggcagttctcac

SEQ ID NO: 500075 - DNA, 25 bp, Rattus norvegicus
gtcttgctggcatggcagttctcac

SEQ ID NO: 500076 - DNA, 25 bp, Rattus norvegicus
gtcttgctgtatatgctgtctaaaa

SEQ ID NO: 500077 - DNA, 25 bp, Rattus norvegicus
gtcttgctgtatttgctgtctaaaa

SEQ ID NO: 500078 - DNA, 25 bp, Rattus norvegicus
gtcttgcttatcattcccagtttcc

SEQ ID NO: 500079 - DNA, 25 bp, Rattus norvegicus
gtcttgcttatctttcccagtttcc

SEQ ID NO: 500080 - DNA, 25 bp, Rattus norvegicus
gtcttgcttctgaattgttacccat

SEQ ID NO: 500081 - DNA, 25 bp, Rattus norvegicus
gtcttgcttctgtattgttacccat

SEQ ID NO: 500082 - DNA, 25 bp, Rattus norvegicus
gtcttgcttggactttacctttcta

SEQ ID NO: 500083 - DNA, 25 bp, Rattus norvegicus
gtcttgcttggagtttacctttcta

SEQ ID NO: 500084 - DNA, 25 bp, Rattus norvegicus
gtcttgctttaaatttccccacaag

SEQ ID NO: 500085 - DNA, 25 bp, Rattus norvegicus
gtcttgctttaattttccccacaag

SEQ ID NO: 500086 - DNA, 25 bp, Rattus norvegicus
gtcttgcttttgaaatggctccatc

SEQ ID NO: 500087 - DNA, 25 bp, Rattus norvegicus
gtcttgcttttgtaatggctccatc

SEQ ID NO: 500088 - DNA, 25 bp, Rattus norvegicus
gtcttggaacaaagggctatgcccc

SEQ ID NO: 500089 - DNA, 25 bp, Rattus norvegicus
gtcttggaacaatgggctatgcccc

SEQ ID NO: 500090 - DNA, 25 bp, Rattus norvegicus
gtcttggacaacagaacaacccaca

SEQ ID NO: 500091 - DNA, 25 bp, Rattus norvegicus
gtcttggacaactgaacaacccaca

SEQ ID NO: 500092 - DNA, 25 bp, Rattus norvegicus
gtcttggacaccatgagggaggcta

SEQ ID NO: 500093 - DNA, 25 bp, Rattus norvegicus
gtcttggacaccttgagggaggcta

SEQ ID NO: 500094 - DNA, 25 bp, Rattus norvegicus
gtcttggagacgatcctaaacactg

SEQ ID NO: 500095 - DNA, 25 bp, Rattus norvegicus
gtcttggagacgttcctaaacactg

SEQ ID NO: 500096 - DNA, 25 bp, Rattus norvegicus
gtcttggagcaacaacctcggacgg

SEQ ID NO: 500097 - DNA, 25 bp, Rattus norvegicus
gtcttggagcaagaacctcggacgg

SEQ ID NO: 500098 - DNA, 25 bp, Rattus norvegicus
gtcttggaggaacctcggctgccct

SEQ ID NO: 500099 - DNA, 25 bp, Rattus norvegicus
gtcttggaggaagctcggctgccct

SEQ ID NO: 500100 - DNA, 25 bp, Rattus norvegicus
gtcttggagtctaggcgtcttgcgt

SEQ ID NO: 500101 - DNA, 25 bp, Rattus norvegicus
gtcttggagtcttggcgtcttgcgt

SEQ ID NO: 500102 - DNA, 25 bp, Rattus norvegicus
gtcttggatcctcatttcctttatc

SEQ ID NO: 500103 - DNA, 25 bp, Rattus norvegicus
gtcttggatcctgatttcctttatc

SEQ ID NO: 500104 - DNA, 25 bp, Rattus norvegicus
gtcttggcaaagctcaactgtctac

SEQ ID NO: 500105 - DNA, 25 bp, Rattus norvegicus
gtcttggcaaaggtcaactgtctac

SEQ ID NO: 500106 - DNA, 25 bp, Rattus norvegicus
gtcttggcagcgattggtgttattt

SEQ ID NO: 500107 - DNA, 25 bp, Rattus norvegicus
gtcttggcagcgtttggtgttattt

SEQ ID NO: 500108 - DNA, 25 bp, Rattus norvegicus
gtcttggcattcatctagaaccttc

SEQ ID NO: 500109 - DNA, 25 bp, Rattus norvegicus
gtcttggcattcttctagaaccttc

SEQ ID NO: 500110 - DNA, 25 bp, Rattus norvegicus
gtcttggcccagcaagtcatttgtt

SEQ ID NO: 500111 - DNA, 25 bp, Rattus norvegicus
gtcttggcccagcttgataactatg

SEQ ID NO: 500112 - DNA, 25 bp, Rattus norvegicus
gtcttggcccaggaagtcatttgtt

SEQ ID NO: 500113 - DNA, 25 bp, Rattus norvegicus
gtcttggcccaggttgataactatg

SEQ ID NO: 500114 - DNA, 25 bp, Rattus norvegicus
gtcttggcgactccatgcatgtgaa

SEQ ID NO: 500115 - DNA, 25 bp, Rattus norvegicus
gtcttggcgactgcatgcatgtgaa

SEQ ID NO: 500116 - DNA, 25 bp, Rattus norvegicus
gtcttggcttctacagatggcgcaa

SEQ ID NO: 500117 - DNA, 25 bp, Rattus norvegicus
gtcttggcttcttcagatggcgcaa

SEQ ID NO: 500118 - DNA, 25 bp, Rattus norvegicus
gtcttgggacctctagttgctggcc

SEQ ID NO: 500119 - DNA, 25 bp, Rattus norvegicus
gtcttgggacctgtagttgctggcc

SEQ ID NO: 500120 - DNA, 25 bp, Rattus norvegicus
gtcttgggacggagaacctgttgcc

SEQ ID NO: 500121 - DNA, 25 bp, Rattus norvegicus
gtcttgggacggtgaacctgttgcc

SEQ ID NO: 500122 - DNA, 25 bp, Rattus norvegicus
gtcttgggactgcagcgatgactca

SEQ ID NO: 500123 - DNA, 25 bp, Rattus norvegicus
gtcttgggactggagcgatgactca

SEQ ID NO: 500124 - DNA, 25 bp, Rattus norvegicus
gtcttgggcaaaagcttcacacagg

SEQ ID NO: 500125 - DNA, 25 bp, Rattus norvegicus
gtcttgggcaaatgcttcacacagg

SEQ ID NO: 500126 - DNA, 25 bp, Rattus norvegicus
gtcttgggcatacaccagttttctc

SEQ ID NO: 500127 - DNA, 25 bp, Rattus norvegicus
gtcttgggcatagaccagttttctc

SEQ ID NO: 500128 - DNA, 25 bp, Rattus norvegicus
gtcttgggcattctgaggtaacctc

SEQ ID NO: 500129 - DNA, 25 bp, Rattus norvegicus
gtcttgggcattgtgaggtaacctc

SEQ ID NO: 500130 - DNA, 25 bp, Rattus norvegicus
gtcttgggccaacaacctttaagag

SEQ ID NO: 500131 - DNA, 25 bp, Rattus norvegicus
gtcttgggccaagaacctttaagag

SEQ ID NO: 500132 - DNA, 25 bp, Rattus norvegicus
gtcttgggctgcataagtttgaggc

SEQ ID NO: 500133 - DNA, 25 bp, Rattus norvegicus
gtcttgggctgcttaagtttgaggc

SEQ ID NO: 500134 - DNA, 25 bp, Rattus norvegicus
gtcttgggcttcaaaggttttcact

SEQ ID NO: 500135 - DNA, 25 bp, Rattus norvegicus
gtcttgggcttctaaggttttcact

SEQ ID NO: 500136 - DNA, 25 bp, Rattus norvegicus
gtcttgggctttaccattgcatcaa

SEQ ID NO: 500137 - DNA, 25 bp, Rattus norvegicus
gtcttgggcttttccattgcatcaa

SEQ ID NO: 500138 - DNA, 25 bp, Rattus norvegicus
gtcttgggtaacatcctgggttgca

SEQ ID NO: 500139 - DNA, 25 bp, Rattus norvegicus
gtcttgggtaacttcctgggttgca

SEQ ID NO: 500140 - DNA, 25 bp, Rattus norvegicus
gtcttggtcattccaaactatcaga

SEQ ID NO: 500141 - DNA, 25 bp, Rattus norvegicus
gtcttggtcattgcaaactatcaga

SEQ ID NO: 500142 - DNA, 25 bp, Rattus norvegicus
gtcttggtcctcagaagctgctgta

SEQ ID NO: 500143 - DNA, 25 bp, Rattus norvegicus
gtcttggtcctctgaagctgctgta

SEQ ID NO: 500144 - DNA, 25 bp, Rattus norvegicus
gtcttggtcttgattgtctggcttg

SEQ ID NO: 500145 - DNA, 25 bp, Rattus norvegicus
gtcttggtcttgtttgtctggcttg

SEQ ID NO: 500146 - DNA, 25 bp, Rattus norvegicus
gtcttggtgcctatgtgtgacacac

SEQ ID NO: 500147 - DNA, 25 bp, Rattus norvegicus
gtcttggtgcctattctgtgatgaa

SEQ ID NO: 500148 - DNA, 25 bp, Rattus norvegicus
gtcttggtgcctttgtgtgacacac

SEQ ID NO: 500149 - DNA, 25 bp, Rattus norvegicus
gtcttggtgccttttctgtgatgaa

SEQ ID NO: 500150 - DNA, 25 bp, Rattus norvegicus
gtcttggttggtattactgtcaaat

SEQ ID NO: 500151 - DNA, 25 bp, Rattus norvegicus
gtcttggttggttttactgtcaaat

SEQ ID NO: 500152 - DNA, 25 bp, Rattus norvegicus
gtcttgtaaacaatgcattgtgcac

SEQ ID NO: 500153 - DNA, 25 bp, Rattus norvegicus
gtcttgtaaacattgcattgtgcac

SEQ ID NO: 500154 - DNA, 25 bp, Rattus norvegicus
gtcttgtaaaccagtgtggaacaca

SEQ ID NO: 500155 - DNA, 25 bp, Rattus norvegicus
gtcttgtaaacctgtgtggaacaca

SEQ ID NO: 500156 - DNA, 25 bp, Rattus norvegicus
gtcttgtaaactcagaccctggcct

SEQ ID NO: 500157 - DNA, 25 bp, Rattus norvegicus
gtcttgtaaactgagaccctggcct

SEQ ID NO: 500158 - DNA, 25 bp, Rattus norvegicus
gtcttgtaacggaactgtggtgtct

SEQ ID NO: 500159 - DNA, 25 bp, Rattus norvegicus
gtcttgtaacggtactgtggtgtct

SEQ ID NO: 500160 - DNA, 25 bp, Rattus norvegicus
gtcttgtaccatacctggcatgatg

SEQ ID NO: 500161 - DNA, 25 bp, Rattus norvegicus
gtcttgtaccattcctggcatgatg

SEQ ID NO: 500162 - DNA, 25 bp, Rattus norvegicus
gtcttgtaggtgaaggttcccggat

SEQ ID NO: 500163 - DNA, 25 bp, Rattus norvegicus
gtcttgtaggtgtaggttcccggat

SEQ ID NO: 500164 - DNA, 25 bp, Rattus norvegicus
gtcttgtcaaagctagctctgtatc

SEQ ID NO: 500165 - DNA, 25 bp, Rattus norvegicus
gtcttgtcaaaggtagctctgtatc

SEQ ID NO: 500166 - DNA, 25 bp, Rattus norvegicus
gtcttgtcaaatccttgtgaataga

SEQ ID NO: 500167 - DNA, 25 bp, Rattus norvegicus
gtcttgtcaaatgcttgtgaataga

SEQ ID NO: 500168 - DNA, 25 bp, Rattus norvegicus
gtcttgtcagctagattcctggtgt

SEQ ID NO: 500169 - DNA, 25 bp, Rattus norvegicus
gtcttgtcagcttgattcctggtgt

SEQ ID NO: 500170 - DNA, 25 bp, Rattus norvegicus
gtcttgtcatacatcctttcagaga

SEQ ID NO: 500171 - DNA, 25 bp, Rattus norvegicus
gtcttgtcatacttcctttcagaga

SEQ ID NO: 500172 - DNA, 25 bp, Rattus norvegicus
gtcttgtccttcaggtactgtggtc

SEQ ID NO: 500173 - DNA, 25 bp, Rattus norvegicus
gtcttgtccttctggtactgtggtc

SEQ ID NO: 500174 - DNA, 25 bp, Rattus norvegicus
gtcttgtcggtcctgagtttcagaa

SEQ ID NO: 500175 - DNA, 25 bp, Rattus norvegicus
gtcttgtcggtcgtgagtttcagaa

SEQ ID NO: 500176 - DNA, 25 bp, Rattus norvegicus
gtcttgtctatcattagttccagga

SEQ ID NO: 500177 - DNA, 25 bp, Rattus norvegicus
gtcttgtctatctttagttccagga

SEQ ID NO: 500178 - DNA, 25 bp, Rattus norvegicus
gtcttgtctcacagggagcttggag

SEQ ID NO: 500179 - DNA, 25 bp, Rattus norvegicus
gtcttgtctcactgggagcttggag

SEQ ID NO: 500180 - DNA, 25 bp, Rattus norvegicus
gtcttgtctcatctctatcctgatg

SEQ ID NO: 500181 - DNA, 25 bp, Rattus norvegicus
gtcttgtctcatgtctatcctgatg

SEQ ID NO: 500182 - DNA, 25 bp, Rattus norvegicus
gtcttgtctccaaatgtggttgcca

SEQ ID NO: 500183 - DNA, 25 bp, Rattus norvegicus
gtcttgtctccatatgtggttgcca

SEQ ID NO: 500184 - DNA, 25 bp, Rattus norvegicus
gtcttgtctctaaaactcctgatct

SEQ ID NO: 500185 - DNA, 25 bp, Rattus norvegicus
gtcttgtctctataactcctgatct

SEQ ID NO: 500186 - DNA, 25 bp, Rattus norvegicus
gtcttgtctgacagtatgcagtttt

SEQ ID NO: 500187 - DNA, 25 bp, Rattus norvegicus
gtcttgtctgacagttaaaaatgga

SEQ ID NO: 500188 - DNA, 25 bp, Rattus norvegicus
gtcttgtctgactgtatgcagtttt

SEQ ID NO: 500189 - DNA, 25 bp, Rattus norvegicus
gtcttgtctgactgttaaaaatgga

SEQ ID NO: 500190 - DNA, 25 bp, Rattus norvegicus
gtcttgtctgtaaaaactgtttcca

SEQ ID NO: 500191 - DNA, 25 bp, Rattus norvegicus
gtcttgtctgtataaactgtttcca

SEQ ID NO: 500192 - DNA, 25 bp, Rattus norvegicus
gtcttgtgaaccacttgttctcggg

SEQ ID NO: 500193 - DNA, 25 bp, Rattus norvegicus
gtcttgtgaacctcttgttctcggg

SEQ ID NO: 500194 - DNA, 25 bp, Rattus norvegicus
gtcttgtgaagacatccagtgcggt

SEQ ID NO: 500195 - DNA, 25 bp, Rattus norvegicus
gtcttgtgaagagatccagtgcggt

SEQ ID NO: 500196 - DNA, 25 bp, Rattus norvegicus
gtcttgtgcaaaagcgtctcaccct

SEQ ID NO: 500197 - DNA, 25 bp, Rattus norvegicus
gtcttgtgcaaactttctccaacag

SEQ ID NO: 500198 - DNA, 25 bp, Rattus norvegicus
gtcttgtgcaaagtttctccaacag

SEQ ID NO: 500199 - DNA, 25 bp, Rattus norvegicus
gtcttgtgcaaatgcgtctcaccct

SEQ ID NO: 500200 - DNA, 25 bp, Rattus norvegicus
gtcttgtgccttagattgaattttt

SEQ ID NO: 500201 - DNA, 25 bp, Rattus norvegicus
gtcttgtgcctttgattgaattttt

SEQ ID NO: 500202 - DNA, 25 bp, Rattus norvegicus
gtcttgtgcgctattattgtgcttc

SEQ ID NO: 500203 - DNA, 25 bp, Rattus norvegicus
gtcttgtgcgcttttattgtgcttc

SEQ ID NO: 500204 - DNA, 25 bp, Rattus norvegicus
gtcttgtgtcccatggtggcagcaa

SEQ ID NO: 500205 - DNA, 25 bp, Rattus norvegicus
gtcttgtgtcccttggtggcagcaa

SEQ ID NO: 500206 - DNA, 25 bp, Rattus norvegicus
gtcttgtgtctcagggcttcacagc

SEQ ID NO: 500207 - DNA, 25 bp, Rattus norvegicus
gtcttgtgtctctgggcttcacagc

SEQ ID NO: 500208 - DNA, 25 bp, Rattus norvegicus
gtcttgtgttgtatctgcttttgaa

SEQ ID NO: 500209 - DNA, 25 bp, Rattus norvegicus
gtcttgtgttgtttctgcttttgaa

SEQ ID NO: 500210 - DNA, 25 bp, Rattus norvegicus
gtcttgttcactatatacccatctt

SEQ ID NO: 500211 - DNA, 25 bp, Rattus norvegicus
gtcttgttcactttatacccatctt

SEQ ID NO: 500212 - DNA, 25 bp, Rattus norvegicus
gtcttgttcccaccatctgaatgat

SEQ ID NO: 500213 - DNA, 25 bp, Rattus norvegicus
gtcttgttcccagcatctgaatgat

SEQ ID NO: 500214 - DNA, 25 bp, Rattus norvegicus
gtcttgttcctcagacttcttaaag

SEQ ID NO: 500215 - DNA, 25 bp, Rattus norvegicus
gtcttgttcctctgacttcttaaag

SEQ ID NO: 500216 - DNA, 25 bp, Rattus norvegicus
gtcttgttctctattctgcaggaga

SEQ ID NO: 500217 - DNA, 25 bp, Rattus norvegicus
gtcttgttctcttttctgcaggaga

SEQ ID NO: 500218 - DNA, 25 bp, Rattus norvegicus
gtcttgttctgcactgcgattgcgg

SEQ ID NO: 500219 - DNA, 25 bp, Rattus norvegicus
gtcttgttctgctctgcgattgcgg

SEQ ID NO: 500220 - DNA, 25 bp, Rattus norvegicus
gtcttgttgattcctgtctatccag

SEQ ID NO: 500221 - DNA, 25 bp, Rattus norvegicus
gtcttgttgattgctgtctatccag

SEQ ID NO: 500222 - DNA, 25 bp, Rattus norvegicus
gtcttgtttacccagctgatacaca

SEQ ID NO: 500223 - DNA, 25 bp, Rattus norvegicus
gtcttgtttacccagttagatcacc

SEQ ID NO: 500224 - DNA, 25 bp, Rattus norvegicus
gtcttgtttaccgagctgatacaca

SEQ ID NO: 500225 - DNA, 25 bp, Rattus norvegicus
gtcttgtttaccgagttagatcacc

SEQ ID NO: 500226 - DNA, 25 bp, Rattus norvegicus
gtcttgtttagaatgcatgggacat

SEQ ID NO: 500227 - DNA, 25 bp, Rattus norvegicus
gtcttgtttagattgcatgggacat

SEQ ID NO: 500228 - DNA, 25 bp, Rattus norvegicus
gtcttgtttagcacagcatttccga

SEQ ID NO: 500229 - DNA, 25 bp, Rattus norvegicus
gtcttgtttagctcagcatttccga

SEQ ID NO: 500230 - DNA, 25 bp, Rattus norvegicus
gtcttgttttacagatcatggctga

SEQ ID NO: 500231 - DNA, 25 bp, Rattus norvegicus
gtcttgttttactgatcatggctga

SEQ ID NO: 500232 - DNA, 25 bp, Rattus norvegicus
gtcttgttttccagttggacagcca

SEQ ID NO: 500233 - DNA, 25 bp, Rattus norvegicus
gtcttgttttcctgttggacagcca

SEQ ID NO: 500234 - DNA, 25 bp, Rattus norvegicus
gtcttgtttttaataggaacttcag

SEQ ID NO: 500235 - DNA, 25 bp, Rattus norvegicus
gtcttgtttttattaggaacttcag

SEQ ID NO: 500236 - DNA, 25 bp, Rattus norvegicus
gtcttgtttttgctttgtcttgtct

SEQ ID NO: 500237 - DNA, 25 bp, Rattus norvegicus
gtcttgtttttggtttgtcttgtct

SEQ ID NO: 500238 - DNA, 25 bp, Rattus norvegicus
gtctttaaagccatatccttcagga

SEQ ID NO: 500239 - DNA, 25 bp, Rattus norvegicus
gtctttaaagccttatccttcagga

SEQ ID NO: 500240 - DNA, 25 bp, Rattus norvegicus
gtctttaaccaccttcttttgtatg

SEQ ID NO: 500241 - DNA, 25 bp, Rattus norvegicus
gtctttaaccacgttcttttgtatg

SEQ ID NO: 500242 - DNA, 25 bp, Rattus norvegicus
gtctttaagcatccttcatctgcag

SEQ ID NO: 500243 - DNA, 25 bp, Rattus norvegicus
gtctttaagcatgcttcatctgcag

SEQ ID NO: 500244 - DNA, 25 bp, Rattus norvegicus
gtctttaatgcccttttgaatgaat

SEQ ID NO: 500245 - DNA, 25 bp, Rattus norvegicus
gtctttaatgccgttttgaatgaat

SEQ ID NO: 500246 - DNA, 25 bp, Rattus norvegicus
gtctttacagacatatttcacacgt

SEQ ID NO: 500247 - DNA, 25 bp, Rattus norvegicus
gtctttacagacttatttcacacgt

SEQ ID NO: 500248 - DNA, 25 bp, Rattus norvegicus
gtctttacaggcaaggctgcttcta

SEQ ID NO: 500249 - DNA, 25 bp, Rattus norvegicus
gtctttacaggctaggctgcttcta

SEQ ID NO: 500250 - DNA, 25 bp, Rattus norvegicus
gtctttaccatgatgaactttaatt

SEQ ID NO: 500251 - DNA, 25 bp, Rattus norvegicus
gtctttaccatgttgaactttaatt

SEQ ID NO: 500252 - DNA, 25 bp, Rattus norvegicus
gtctttactaatcgagaggttcatt

SEQ ID NO: 500253 - DNA, 25 bp, Rattus norvegicus
gtctttactaatggagaggttcatt

SEQ ID NO: 500254 - DNA, 25 bp, Rattus norvegicus
gtctttactatgcactttaacctat

SEQ ID NO: 500255 - DNA, 25 bp, Rattus norvegicus
gtctttactatggactttaacctat

SEQ ID NO: 500256 - DNA, 25 bp, Rattus norvegicus
gtctttacttccagaacgtgttctc

SEQ ID NO: 500257 - DNA, 25 bp, Rattus norvegicus
gtctttacttcctgaacgtgttctc

SEQ ID NO: 500258 - DNA, 25 bp, Rattus norvegicus
gtctttactttacttttcatacttg

SEQ ID NO: 500259 - DNA, 25 bp, Rattus norvegicus
gtctttactttagttttcatacttg

SEQ ID NO: 500260 - DNA, 25 bp, Rattus norvegicus
gtctttactttgaggctttcctatt

SEQ ID NO: 500261 - DNA, 25 bp, Rattus norvegicus
gtctttactttgtggctttcctatt

SEQ ID NO: 500262 - DNA, 25 bp, Rattus norvegicus
gtctttagaacccacaaacctgata

SEQ ID NO: 500263 - DNA, 25 bp, Rattus norvegicus
gtctttagaaccgacaaacctgata

SEQ ID NO: 500264 - DNA, 25 bp, Rattus norvegicus
gtctttagacgtagctattcctagc

SEQ ID NO: 500265 - DNA, 25 bp, Rattus norvegicus
gtctttagacgttgctattcctagc

SEQ ID NO: 500266 - DNA, 25 bp, Rattus norvegicus
gtctttagccctaaggcgagagcag

SEQ ID NO: 500267 - DNA, 25 bp, Rattus norvegicus
gtctttagcccttaggcgagagcag

SEQ ID NO: 500268 - DNA, 25 bp, Rattus norvegicus
gtctttaggcagacgctttcttaaa

SEQ ID NO: 500269 - DNA, 25 bp, Rattus norvegicus
gtctttaggcagtcgctttcttaaa

SEQ ID NO: 500270 - DNA, 25 bp, Rattus norvegicus
gtctttaggtggacatattctcact

SEQ ID NO: 500271 - DNA, 25 bp, Rattus norvegicus
gtctttaggtggtcatattctcact

SEQ ID NO: 500272 - DNA, 25 bp, Rattus norvegicus
gtctttagtagcataggaagtccct

SEQ ID NO: 500273 - DNA, 25 bp, Rattus norvegicus
gtctttagtagcttaggaagtccct

SEQ ID NO: 500274 - DNA, 25 bp, Rattus norvegicus
gtctttatacatccttacagctcca

SEQ ID NO: 500275 - DNA, 25 bp, Rattus norvegicus
gtctttatacatgcttacagctcca

SEQ ID NO: 500276 - DNA, 25 bp, Rattus norvegicus
gtctttatattaacgctgtacggta

SEQ ID NO: 500277 - DNA, 25 bp, Rattus norvegicus
gtctttatattatcgctgtacggta

SEQ ID NO: 500278 - DNA, 25 bp, Rattus norvegicus
gtctttatccagaagtcacgcctca

SEQ ID NO: 500279 - DNA, 25 bp, Rattus norvegicus
gtctttatccagtagtcacgcctca

SEQ ID NO: 500280 - DNA, 25 bp, Rattus norvegicus
gtctttatggccataggtctgataa

SEQ ID NO: 500281 - DNA, 25 bp, Rattus norvegicus
gtctttatggccttaggtctgataa

SEQ ID NO: 500282 - DNA, 25 bp, Rattus norvegicus
gtctttatgggacgctagcgctcga

SEQ ID NO: 500283 - DNA, 25 bp, Rattus norvegicus
gtctttatgggaggctagcgctcga

SEQ ID NO: 500284 - DNA, 25 bp, Rattus norvegicus
gtctttattaccatcatctttctac

SEQ ID NO: 500285 - DNA, 25 bp, Rattus norvegicus
gtctttattaccttcatctttctac

SEQ ID NO: 500286 - DNA, 25 bp, Rattus norvegicus
gtctttattcaaacttcatagggca

SEQ ID NO: 500287 - DNA, 25 bp, Rattus norvegicus
gtctttattcaatcttcatagggca

SEQ ID NO: 500288 - DNA, 25 bp, Rattus norvegicus
gtctttattggtcttttgcttgtta

SEQ ID NO: 500289 - DNA, 25 bp, Rattus norvegicus
gtctttattggtgttttgcttgtta

SEQ ID NO: 500290 - DNA, 25 bp, Rattus norvegicus
gtctttattgttagtttgccagaac

SEQ ID NO: 500291 - DNA, 25 bp, Rattus norvegicus
gtctttattgtttgtttgccagaac

SEQ ID NO: 500292 - DNA, 25 bp, Rattus norvegicus
gtctttatttcaagaatatggccat

SEQ ID NO: 500293 - DNA, 25 bp, Rattus norvegicus
gtctttatttcatgaatatggccat

SEQ ID NO: 500294 - DNA, 25 bp, Rattus norvegicus
gtctttatttctacctacacgtact

SEQ ID NO: 500295 - DNA, 25 bp, Rattus norvegicus
gtctttatttcttcctacacgtact

SEQ ID NO: 500296 - DNA, 25 bp, Rattus norvegicus
gtctttatttgaaacctgctcttaa

SEQ ID NO: 500297 - DNA, 25 bp, Rattus norvegicus
gtctttatttgatacctgctcttaa

SEQ ID NO: 500298 - DNA, 25 bp, Rattus norvegicus
gtctttcaagccaagaagccacaga

SEQ ID NO: 500299 - DNA, 25 bp, Rattus norvegicus
gtctttcaagcctagaagccacaga

SEQ ID NO: 500300 - DNA, 25 bp, Rattus norvegicus
gtctttcaaggcaaagccacttgac

SEQ ID NO: 500301 - DNA, 25 bp, Rattus norvegicus
gtctttcaaggctaagccacttgac

SEQ ID NO: 500302 - DNA, 25 bp, Rattus norvegicus
gtctttcacagaagcaccatggtac

SEQ ID NO: 500303 - DNA, 25 bp, Rattus norvegicus
gtctttcacagatgcaccatggtac

SEQ ID NO: 500304 - DNA, 25 bp, Rattus norvegicus
gtctttcaccttactcagagtcaca

SEQ ID NO: 500305 - DNA, 25 bp, Rattus norvegicus
gtctttcacctttctcagagtcaca

SEQ ID NO: 500306 - DNA, 25 bp, Rattus norvegicus
gtctttcactacagattgggctgct

SEQ ID NO: 500307 - DNA, 25 bp, Rattus norvegicus
gtctttcactaccactaatcacaat

SEQ ID NO: 500308 - DNA, 25 bp, Rattus norvegicus
gtctttcactacgactaatcacaat

SEQ ID NO: 500309 - DNA, 25 bp, Rattus norvegicus
gtctttcactactgattgggctgct

SEQ ID NO: 500310 - DNA, 25 bp, Rattus norvegicus
gtctttcactttatcaatgttctag

SEQ ID NO: 500311 - DNA, 25 bp, Rattus norvegicus
gtctttcactttttcaatgttctag

SEQ ID NO: 500312 - DNA, 25 bp, Rattus norvegicus
gtctttcagagtccgaagtgatttc

SEQ ID NO: 500313 - DNA, 25 bp, Rattus norvegicus
gtctttcagagtgcgaagtgatttc

SEQ ID NO: 500314 - DNA, 25 bp, Rattus norvegicus
gtctttcagtcactcagtcacacat

SEQ ID NO: 500315 - DNA, 25 bp, Rattus norvegicus
gtctttcagtcagtcagtcacacat

SEQ ID NO: 500316 - DNA, 25 bp, Rattus norvegicus
gtctttcatataagtgctgcaggtg

SEQ ID NO: 500317 - DNA, 25 bp, Rattus norvegicus
gtctttcatatatgtgctgcaggtg

SEQ ID NO: 500318 - DNA, 25 bp, Rattus norvegicus
gtctttcatcataacgggactcgtg

SEQ ID NO: 500319 - DNA, 25 bp, Rattus norvegicus
gtctttcatcattacgggactcgtg

SEQ ID NO: 500320 - DNA, 25 bp, Rattus norvegicus
gtctttcatcccatctttatgttag

SEQ ID NO: 500321 - DNA, 25 bp, Rattus norvegicus
gtctttcatcccttctttatgttag

SEQ ID NO: 500322 - DNA, 25 bp, Rattus norvegicus
gtctttccacatattatttctccta

SEQ ID NO: 500323 - DNA, 25 bp, Rattus norvegicus
gtctttccacattttatttctccta

SEQ ID NO: 500324 - DNA, 25 bp, Rattus norvegicus
gtctttccagaacttaccacatcca

SEQ ID NO: 500325 - DNA, 25 bp, Rattus norvegicus
gtctttccagaagttaccacatcca

SEQ ID NO: 500326 - DNA, 25 bp, Rattus norvegicus
gtctttcccaatccttttcttatga

SEQ ID NO: 500327 - DNA, 25 bp, Rattus norvegicus
gtctttcccaatgcttttcttatga

SEQ ID NO: 500328 - DNA, 25 bp, Rattus norvegicus
gtctttccctggacaagccaatagt

SEQ ID NO: 500329 - DNA, 25 bp, Rattus norvegicus
gtctttccctggtcaagccaatagt

SEQ ID NO: 500330 - DNA, 25 bp, Rattus norvegicus
gtctttccctgtcagatgttgagca

SEQ ID NO: 500331 - DNA, 25 bp, Rattus norvegicus
gtctttccctgtgagatgttgagca

SEQ ID NO: 500332 - DNA, 25 bp, Rattus norvegicus
gtctttccggaaccctgcgctggtt

SEQ ID NO: 500333 - DNA, 25 bp, Rattus norvegicus
gtctttccggaagcctgcgctggtt

SEQ ID NO: 500334 - DNA, 25 bp, Rattus norvegicus
gtctttccgttgattcattggctta

SEQ ID NO: 500335 - DNA, 25 bp, Rattus norvegicus
gtctttccgttgtttcattggctta

SEQ ID NO: 500336 - DNA, 25 bp, Rattus norvegicus
gtctttcctacccagggcaaatgaa

SEQ ID NO: 500337 - DNA, 25 bp, Rattus norvegicus
gtctttcctaccgagggcaaatgaa

SEQ ID NO: 500338 - DNA, 25 bp, Rattus norvegicus
gtctttcctgaaagattttgctgtg

SEQ ID NO: 500339 - DNA, 25 bp, Rattus norvegicus
gtctttcctgaatgattttgctgtg

SEQ ID NO: 500340 - DNA, 25 bp, Rattus norvegicus
gtctttcctgagaaagtgctggtga

SEQ ID NO: 500341 - DNA, 25 bp, Rattus norvegicus
gtctttcctgagtaagtgctggtga

SEQ ID NO: 500342 - DNA, 25 bp, Rattus norvegicus
gtctttcctggaatacacatagtgt

SEQ ID NO: 500343 - DNA, 25 bp, Rattus norvegicus
gtctttcctggattacacatagtgt

SEQ ID NO: 500344 - DNA, 25 bp, Rattus norvegicus
gtctttcctgtgagtaaccagaaga

SEQ ID NO: 500345 - DNA, 25 bp, Rattus norvegicus
gtctttcctgtgtgtaaccagaaga

SEQ ID NO: 500346 - DNA, 25 bp, Rattus norvegicus
gtctttccttccagctttatgtata

SEQ ID NO: 500347 - DNA, 25 bp, Rattus norvegicus
gtctttccttcctgctttatgtata

SEQ ID NO: 500348 - DNA, 25 bp, Rattus norvegicus
gtctttccttctctcgcatatgatt

SEQ ID NO: 500349 - DNA, 25 bp, Rattus norvegicus
gtctttccttctgtcgcatatgatt

SEQ ID NO: 500350 - DNA, 25 bp, Rattus norvegicus
gtctttccttgaaagtttactattt

SEQ ID NO: 500351 - DNA, 25 bp, Rattus norvegicus
gtctttccttgatagtttactattt

SEQ ID NO: 500352 - DNA, 25 bp, Rattus norvegicus
gtctttcgattcatactgtggctaa

SEQ ID NO: 500353 - DNA, 25 bp, Rattus norvegicus
gtctttcgattcttactgtggctaa

SEQ ID NO: 500354 - DNA, 25 bp, Rattus norvegicus
gtctttctaactctgggtgcatgta

SEQ ID NO: 500355 - DNA, 25 bp, Rattus norvegicus
gtctttctaactgtgggtgcatgta

SEQ ID NO: 500356 - DNA, 25 bp, Rattus norvegicus
gtctttctagccagaagcatcctgt

SEQ ID NO: 500357 - DNA, 25 bp, Rattus norvegicus
gtctttctagcctgaagcatcctgt

SEQ ID NO: 500358 - DNA, 25 bp, Rattus norvegicus
gtctttctatgtacgaacccacaaa

SEQ ID NO: 500359 - DNA, 25 bp, Rattus norvegicus
gtctttctatgttcgaacccacaaa

SEQ ID NO: 500360 - DNA, 25 bp, Rattus norvegicus
gtctttctcacaatttgattcttca

SEQ ID NO: 500361 - DNA, 25 bp, Rattus norvegicus
gtctttctcacattttgattcttca

SEQ ID NO: 500362 - DNA, 25 bp, Rattus norvegicus
gtctttctccacaggtagacttgga

SEQ ID NO: 500363 - DNA, 25 bp, Rattus norvegicus
gtctttctccactggtagacttgga

SEQ ID NO: 500364 - DNA, 25 bp, Rattus norvegicus
gtctttctcctgctaatttctgaag

SEQ ID NO: 500365 - DNA, 25 bp, Rattus norvegicus
gtctttctcctggtaatttctgaag

SEQ ID NO: 500366 - DNA, 25 bp, Rattus norvegicus
gtctttctccttcgaagatggtcag

SEQ ID NO: 500367 - DNA, 25 bp, Rattus norvegicus
gtctttctccttggaagatggtcag

SEQ ID NO: 500368 - DNA, 25 bp, Rattus norvegicus
gtctttctgaaaaacctgcccagag

SEQ ID NO: 500369 - DNA, 25 bp, Rattus norvegicus
gtctttctgaaacaaccttggcctt

SEQ ID NO: 500370 - DNA, 25 bp, Rattus norvegicus
gtctttctgaaagaaccttggcctt

SEQ ID NO: 500371 - DNA, 25 bp, Rattus norvegicus
gtctttctgaaatacctgcccagag

SEQ ID NO: 500372 - DNA, 25 bp, Rattus norvegicus
gtctttctgagtcctgtcatttcta

SEQ ID NO: 500373 - DNA, 25 bp, Rattus norvegicus
gtctttctgagtgctgtcatttcta

SEQ ID NO: 500374 - DNA, 25 bp, Rattus norvegicus
gtctttctgattaggtttaggctca

SEQ ID NO: 500375 - DNA, 25 bp, Rattus norvegicus
gtctttctgatttggtttaggctca

SEQ ID NO: 500376 - DNA, 25 bp, Rattus norvegicus
gtctttctgcacatcatggatgtat

SEQ ID NO: 500377 - DNA, 25 bp, Rattus norvegicus
gtctttctgcacttcatggatgtat

SEQ ID NO: 500378 - DNA, 25 bp, Rattus norvegicus
gtctttctgcctaataggaggtccc

SEQ ID NO: 500379 - DNA, 25 bp, Rattus norvegicus
gtctttctgccttataggaggtccc

SEQ ID NO: 500380 - DNA, 25 bp, Rattus norvegicus
gtctttctgtcaatatggcctgcaa

SEQ ID NO: 500381 - DNA, 25 bp, Rattus norvegicus
gtctttctgtcattatggcctgcaa

SEQ ID NO: 500382 - DNA, 25 bp, Rattus norvegicus
gtctttctgtttattgaagcttcct

SEQ ID NO: 500383 - DNA, 25 bp, Rattus norvegicus
gtctttctgttttttgaagcttcct

SEQ ID NO: 500384 - DNA, 25 bp, Rattus norvegicus
gtctttcttaaaagccttctgtggt

SEQ ID NO: 500385 - DNA, 25 bp, Rattus norvegicus
gtctttcttaaatgccttctgtggt

SEQ ID NO: 500386 - DNA, 25 bp, Rattus norvegicus
gtctttcttcagatacttacgtgaa

SEQ ID NO: 500387 - DNA, 25 bp, Rattus norvegicus
gtctttcttcagttacttacgtgaa

SEQ ID NO: 500388 - DNA, 25 bp, Rattus norvegicus
gtctttcttcataaagtatgatgtc

SEQ ID NO: 500389 - DNA, 25 bp, Rattus norvegicus
gtctttcttcattaagtatgatgtc

SEQ ID NO: 500390 - DNA, 25 bp, Rattus norvegicus
gtctttcttccacagtaccttgttt

SEQ ID NO: 500391 - DNA, 25 bp, Rattus norvegicus
gtctttcttccagagtaccttgttt

SEQ ID NO: 500392 - DNA, 25 bp, Rattus norvegicus
gtctttcttcctctagccagaactg

SEQ ID NO: 500393 - DNA, 25 bp, Rattus norvegicus
gtctttcttcctgtagccagaactg

SEQ ID NO: 500394 - DNA, 25 bp, Rattus norvegicus
gtctttcttggcagagagatgctcc

SEQ ID NO: 500395 - DNA, 25 bp, Rattus norvegicus
gtctttcttggctgagagatgctcc

SEQ ID NO: 500396 - DNA, 25 bp, Rattus norvegicus
gtctttgaaaaacccatctggctag

SEQ ID NO: 500397 - DNA, 25 bp, Rattus norvegicus
gtctttgaaaaagccatctggctag

SEQ ID NO: 500398 - DNA, 25 bp, Rattus norvegicus
gtctttgaactacactgcaagctag

SEQ ID NO: 500399 - DNA, 25 bp, Rattus norvegicus
gtctttgaactagactgcaagctag

SEQ ID NO: 500400 - DNA, 25 bp, Rattus norvegicus
gtctttgaagtaacctctttgggcg

SEQ ID NO: 500401 - DNA, 25 bp, Rattus norvegicus
gtctttgaagtatcctctttgggcg

SEQ ID NO: 500402 - DNA, 25 bp, Rattus norvegicus
gtctttgaattcactgaaccccgag

SEQ ID NO: 500403 - DNA, 25 bp, Rattus norvegicus
gtctttgaattctctgaaccccgag

SEQ ID NO: 500404 - DNA, 25 bp, Rattus norvegicus
gtctttgaccgacatgttgtcctca

SEQ ID NO: 500405 - DNA, 25 bp, Rattus norvegicus
gtctttgaccgagatgttgtcctca

SEQ ID NO: 500406 - DNA, 25 bp, Rattus norvegicus
gtctttgagagaccagcctcccgaa

SEQ ID NO: 500407 - DNA, 25 bp, Rattus norvegicus
gtctttgagagagcagcctcccgaa

SEQ ID NO: 500408 - DNA, 25 bp, Rattus norvegicus
gtctttgagccccttgatgaatgaa

SEQ ID NO: 500409 - DNA, 25 bp, Rattus norvegicus
gtctttgagcccgttgatgaatgaa

SEQ ID NO: 500410 - DNA, 25 bp, Rattus norvegicus
gtctttgaggtcatccttactgcaa

SEQ ID NO: 500411 - DNA, 25 bp, Rattus norvegicus
gtctttgaggtcttccttactgcaa

SEQ ID NO: 500412 - DNA, 25 bp, Rattus norvegicus
gtctttgagtccctttgactttcat

SEQ ID NO: 500413 - DNA, 25 bp, Rattus norvegicus
gtctttgagtccgtttgactttcat

SEQ ID NO: 500414 - DNA, 25 bp, Rattus norvegicus
gtctttgagtctcttgagcttcttc

SEQ ID NO: 500415 - DNA, 25 bp, Rattus norvegicus
gtctttgagtctgttgagcttcttc

SEQ ID NO: 500416 - DNA, 25 bp, Rattus norvegicus
gtctttgataccagggtcatcacga

SEQ ID NO: 500417 - DNA, 25 bp, Rattus norvegicus
gtctttgatacctgggtcatcacga

SEQ ID NO: 500418 - DNA, 25 bp, Rattus norvegicus
gtctttgatcttaacctgtggctaa

SEQ ID NO: 500419 - DNA, 25 bp, Rattus norvegicus
gtctttgatctttacctgtggctaa

SEQ ID NO: 500420 - DNA, 25 bp, Rattus norvegicus
gtctttgatgtgaccagagctgttt

SEQ ID NO: 500421 - DNA, 25 bp, Rattus norvegicus
gtctttgatgtgtccagagctgttt

SEQ ID NO: 500422 - DNA, 25 bp, Rattus norvegicus
gtctttgcacttatttaaacatggt

SEQ ID NO: 500423 - DNA, 25 bp, Rattus norvegicus
gtctttgcacttttttaaacatggt

SEQ ID NO: 500424 - DNA, 25 bp, Rattus norvegicus
gtctttgcagacaacgaagcctatg

SEQ ID NO: 500425 - DNA, 25 bp, Rattus norvegicus
gtctttgcagactacgaagcctatg

SEQ ID NO: 500426 - DNA, 25 bp, Rattus norvegicus
gtctttgcagttaagcctttcatgt

SEQ ID NO: 500427 - DNA, 25 bp, Rattus norvegicus
gtctttgcagtttagcctttcatgt

SEQ ID NO: 500428 - DNA, 25 bp, Rattus norvegicus
gtctttgccaagcttttacactttg

SEQ ID NO: 500429 - DNA, 25 bp, Rattus norvegicus
gtctttgccaaggttttacactttg

SEQ ID NO: 500430 - DNA, 25 bp, Rattus norvegicus
gtctttgcccaaattctaactgctt

SEQ ID NO: 500431 - DNA, 25 bp, Rattus norvegicus
gtctttgcccaatttctaactgctt

SEQ ID NO: 500432 - DNA, 25 bp, Rattus norvegicus
gtctttgcccttctactgctatctt

SEQ ID NO: 500433 - DNA, 25 bp, Rattus norvegicus
gtctttgcccttgtactgctatctt

SEQ ID NO: 500434 - DNA, 25 bp, Rattus norvegicus
gtctttgctgctagaatccgttcca

SEQ ID NO: 500435 - DNA, 25 bp, Rattus norvegicus
gtctttgctgcttgaatccgttcca

SEQ ID NO: 500436 - DNA, 25 bp, Rattus norvegicus
gtctttgctttaatgtcctcctcct

SEQ ID NO: 500437 - DNA, 25 bp, Rattus norvegicus
gtctttgctttattgtcctcctcct

SEQ ID NO: 500438 - DNA, 25 bp, Rattus norvegicus
gtctttggaaatcagctagtcgctt

SEQ ID NO: 500439 - DNA, 25 bp, Rattus norvegicus
gtctttggaaatgagctagtcgctt

SEQ ID NO: 500440 - DNA, 25 bp, Rattus norvegicus
gtctttggacccagattagagatag

SEQ ID NO: 500441 - DNA, 25 bp, Rattus norvegicus
gtctttggaccctgattagagatag

SEQ ID NO: 500442 - DNA, 25 bp, Rattus norvegicus
gtctttggagtcagggtctcactat

SEQ ID NO: 500443 - DNA, 25 bp, Rattus norvegicus
gtctttggagtctgggtctcactat

SEQ ID NO: 500444 - DNA, 25 bp, Rattus norvegicus
gtctttggcaaacctagcattagtt

SEQ ID NO: 500445 - DNA, 25 bp, Rattus norvegicus
gtctttggcaaagctagcattagtt

SEQ ID NO: 500446 - DNA, 25 bp, Rattus norvegicus
gtctttggcacacactggtcagtaa

SEQ ID NO: 500447 - DNA, 25 bp, Rattus norvegicus
gtctttggcacagactggtcagtaa

SEQ ID NO: 500448 - DNA, 25 bp, Rattus norvegicus
gtctttggcttcactccacaaatta

SEQ ID NO: 500449 - DNA, 25 bp, Rattus norvegicus
gtctttggcttcagtggtacactca

SEQ ID NO: 500450 - DNA, 25 bp, Rattus norvegicus
gtctttggcttctctccacaaatta

SEQ ID NO: 500451 - DNA, 25 bp, Rattus norvegicus
gtctttggcttctgtggtacactca

SEQ ID NO: 500452 - DNA, 25 bp, Rattus norvegicus
gtctttgggttgattctctatgcaa

SEQ ID NO: 500453 - DNA, 25 bp, Rattus norvegicus
gtctttgggttgtttctctatgcaa

SEQ ID NO: 500454 - DNA, 25 bp, Rattus norvegicus
gtctttggtcatactgtgctttcac

SEQ ID NO: 500455 - DNA, 25 bp, Rattus norvegicus
gtctttggtcattctgtgctttcac

SEQ ID NO: 500456 - DNA, 25 bp, Rattus norvegicus
gtctttggtcccagtttatttgcaa

SEQ ID NO: 500457 - DNA, 25 bp, Rattus norvegicus
gtctttggtccctgtttatttgcaa

SEQ ID NO: 500458 - DNA, 25 bp, Rattus norvegicus
gtctttggtggtacttggatcttaa

SEQ ID NO: 500459 - DNA, 25 bp, Rattus norvegicus
gtctttggtggttcttggatcttaa

SEQ ID NO: 500460 - DNA, 25 bp, Rattus norvegicus
gtctttggtgtcagcctgtgttaac

SEQ ID NO: 500461 - DNA, 25 bp, Rattus norvegicus
gtctttggtgtctgcctgtgttaac

SEQ ID NO: 500462 - DNA, 25 bp, Rattus norvegicus
gtctttgtaacccattcgtaggtct

SEQ ID NO: 500463 - DNA, 25 bp, Rattus norvegicus
gtctttgtaaccgattcgtaggtct

SEQ ID NO: 500464 - DNA, 25 bp, Rattus norvegicus
gtctttgtaagtagattatctctag

SEQ ID NO: 500465 - DNA, 25 bp, Rattus norvegicus
gtctttgtaagttgattatctctag

SEQ ID NO: 500466 - DNA, 25 bp, Rattus norvegicus
gtctttgtacctaaccatgttcgca

SEQ ID NO: 500467 - DNA, 25 bp, Rattus norvegicus
gtctttgtaccttaccatgttcgca

SEQ ID NO: 500468 - DNA, 25 bp, Rattus norvegicus
gtctttgtctctcacacaattctcc

SEQ ID NO: 500469 - DNA, 25 bp, Rattus norvegicus
gtctttgtctctcagtagtgttaga

SEQ ID NO: 500470 - DNA, 25 bp, Rattus norvegicus
gtctttgtctctgacacaattctcc

SEQ ID NO: 500471 - DNA, 25 bp, Rattus norvegicus
gtctttgtctctgagtagtgttaga

SEQ ID NO: 500472 - DNA, 25 bp, Rattus norvegicus
gtctttgtgcaaacagaggaagctt

SEQ ID NO: 500473 - DNA, 25 bp, Rattus norvegicus
gtctttgtgcaatcagaggaagctt

SEQ ID NO: 500474 - DNA, 25 bp, Rattus norvegicus
gtctttgtgccgagtacagagatag

SEQ ID NO: 500475 - DNA, 25 bp, Rattus norvegicus
gtctttgtgccgtgtacagagatag

SEQ ID NO: 500476 - DNA, 25 bp, Rattus norvegicus
gtctttgtgtgaccgttctccatgg

SEQ ID NO: 500477 - DNA, 25 bp, Rattus norvegicus
gtctttgtgtgagcgttctccatgg

SEQ ID NO: 500478 - DNA, 25 bp, Rattus norvegicus
gtctttgttctcatgtccagcttgg

SEQ ID NO: 500479 - DNA, 25 bp, Rattus norvegicus
gtctttgttctcttgtccagcttgg

SEQ ID NO: 500480 - DNA, 25 bp, Rattus norvegicus
gtctttgttcttagtagcagcatga

SEQ ID NO: 500481 - DNA, 25 bp, Rattus norvegicus
gtctttgttctttgtagcagcatga

SEQ ID NO: 500482 - DNA, 25 bp, Rattus norvegicus
gtcttttaaccacggatacatgtaa

SEQ ID NO: 500483 - DNA, 25 bp, Rattus norvegicus
gtcttttaaccagggatacatgtaa

SEQ ID NO: 500484 - DNA, 25 bp, Rattus norvegicus
gtcttttaactcaaggaatctttct

SEQ ID NO: 500485 - DNA, 25 bp, Rattus norvegicus
gtcttttaactctaggaatctttct

SEQ ID NO: 500486 - DNA, 25 bp, Rattus norvegicus
gtcttttaagttcccttacatgtgg

SEQ ID NO: 500487 - DNA, 25 bp, Rattus norvegicus
gtcttttaagttgccttacatgtgg

SEQ ID NO: 500488 - DNA, 25 bp, Rattus norvegicus
gtcttttaatcgctttattggcaat

SEQ ID NO: 500489 - DNA, 25 bp, Rattus norvegicus
gtcttttaatcggtttattggcaat

SEQ ID NO: 500490 - DNA, 25 bp, Rattus norvegicus
gtcttttataaactccgcaagcggc

SEQ ID NO: 500491 - DNA, 25 bp, Rattus norvegicus
gtcttttataaagtccgcaagcggc

SEQ ID NO: 500492 - DNA, 25 bp, Rattus norvegicus
gtcttttcagaaatccttaggtgcc

SEQ ID NO: 500493 - DNA, 25 bp, Rattus norvegicus
gtcttttcagaattccttaggtgcc

SEQ ID NO: 500494 - DNA, 25 bp, Rattus norvegicus
gtcttttcatttaatccttcagaac

SEQ ID NO: 500495 - DNA, 25 bp, Rattus norvegicus
gtcttttcattttatccttcagaac

SEQ ID NO: 500496 - DNA, 25 bp, Rattus norvegicus
gtcttttcctacacaagtcagattt

SEQ ID NO: 500497 - DNA, 25 bp, Rattus norvegicus
gtcttttcctactcaagtcagattt

SEQ ID NO: 500498 - DNA, 25 bp, Rattus norvegicus
gtcttttcctgtctaggtttgctcc

SEQ ID NO: 500499 - DNA, 25 bp, Rattus norvegicus
gtcttttcctgtgtaggtttgctcc

SEQ ID NO: 500500 - DNA, 25 bp, Rattus norvegicus
gtcttttcctttacttgatttcctg

SEQ ID NO: 500501 - DNA, 25 bp, Rattus norvegicus
gtcttttccttttcttgatttcctg

SEQ ID NO: 500502 - DNA, 25 bp, Rattus norvegicus
gtcttttctaagatctctaacattt

SEQ ID NO: 500503 - DNA, 25 bp, Rattus norvegicus
gtcttttctaagttctctaacattt

SEQ ID NO: 500504 - DNA, 25 bp, Rattus norvegicus
gtcttttctactctgctggtaacta

SEQ ID NO: 500505 - DNA, 25 bp, Rattus norvegicus
gtcttttctactgtgctggtaacta

SEQ ID NO: 500506 - DNA, 25 bp, Rattus norvegicus
gtcttttctattatacgcctgcatg

SEQ ID NO: 500507 - DNA, 25 bp, Rattus norvegicus
gtcttttctattttacgcctgcatg

SEQ ID NO: 500508 - DNA, 25 bp, Rattus norvegicus
gtcttttcttacaggcacacttgga

SEQ ID NO: 500509 - DNA, 25 bp, Rattus norvegicus
gtcttttcttactggcacacttgga

SEQ ID NO: 500510 - DNA, 25 bp, Rattus norvegicus
gtcttttcttccactgcagaattgt

SEQ ID NO: 500511 - DNA, 25 bp, Rattus norvegicus
gtcttttcttcctctgcagaattgt

SEQ ID NO: 500512 - DNA, 25 bp, Rattus norvegicus
gtcttttcttgcctataatgtattt

SEQ ID NO: 500513 - DNA, 25 bp, Rattus norvegicus
gtcttttcttgcgtataatgtattt

SEQ ID NO: 500514 - DNA, 25 bp, Rattus norvegicus
gtcttttcttgtacctgttaggtca

SEQ ID NO: 500515 - DNA, 25 bp, Rattus norvegicus
gtcttttcttgttcctgttaggtca

SEQ ID NO: 500516 - DNA, 25 bp, Rattus norvegicus
gtcttttctttcatagtgtgggtgc

SEQ ID NO: 500517 - DNA, 25 bp, Rattus norvegicus
gtcttttctttcttagtgtgggtgc

SEQ ID NO: 500518 - DNA, 25 bp, Rattus norvegicus
gtcttttgaagacgtcagctcactg

SEQ ID NO: 500519 - DNA, 25 bp, Rattus norvegicus
gtcttttgaagaggtcagctcactg

SEQ ID NO: 500520 - DNA, 25 bp, Rattus norvegicus
gtcttttgagcccacctttgaagag

SEQ ID NO: 500521 - DNA, 25 bp, Rattus norvegicus
gtcttttgagccgacctttgaagag

SEQ ID NO: 500522 - DNA, 25 bp, Rattus norvegicus
gtcttttgcctgatcaaagttccca

SEQ ID NO: 500523 - DNA, 25 bp, Rattus norvegicus
gtcttttgcctgttcaaagttccca

SEQ ID NO: 500524 - DNA, 25 bp, Rattus norvegicus
gtcttttgctgtacttgtgctgaaa

SEQ ID NO: 500525 - DNA, 25 bp, Rattus norvegicus
gtcttttgctgttcttgtgctgaaa

SEQ ID NO: 500526 - DNA, 25 bp, Rattus norvegicus
gtcttttggaggactgctcttctgt

SEQ ID NO: 500527 - DNA, 25 bp, Rattus norvegicus
gtcttttggaggtctgctcttctgt

SEQ ID NO: 500528 - DNA, 25 bp, Rattus norvegicus
gtcttttggccacctgaattcttac

SEQ ID NO: 500529 - DNA, 25 bp, Rattus norvegicus
gtcttttggccagctgaattcttac

SEQ ID NO: 500530 - DNA, 25 bp, Rattus norvegicus
gtcttttgtctcatgaaatgccatg

SEQ ID NO: 500531 - DNA, 25 bp, Rattus norvegicus
gtcttttgtctcctgcttaatttta

SEQ ID NO: 500532 - DNA, 25 bp, Rattus norvegicus
gtcttttgtctcctgtctttgtaat

SEQ ID NO: 500533 - DNA, 25 bp, Rattus norvegicus
gtcttttgtctcgtgcttaatttta

SEQ ID NO: 500534 - DNA, 25 bp, Rattus norvegicus
gtcttttgtctcgtgtctttgtaat

SEQ ID NO: 500535 - DNA, 25 bp, Rattus norvegicus
gtcttttgtctcttgaaatgccatg

SEQ ID NO: 500536 - DNA, 25 bp, Rattus norvegicus
gtcttttgtttacttgtctgtcaaa

SEQ ID NO: 500537 - DNA, 25 bp, Rattus norvegicus
gtcttttgtttagttgtctgtcaaa

SEQ ID NO: 500538 - DNA, 25 bp, Rattus norvegicus
gtctttttaagaaccagccatgtgc

SEQ ID NO: 500539 - DNA, 25 bp, Rattus norvegicus
gtctttttaagatccagccatgtgc

SEQ ID NO: 500540 - DNA, 25 bp, Rattus norvegicus
gtctttttacaccttttctcagtca

SEQ ID NO: 500541 - DNA, 25 bp, Rattus norvegicus
gtctttttacacgttttctcagtca

SEQ ID NO: 500542 - DNA, 25 bp, Rattus norvegicus
gtctttttataaactgctcgtggtc

SEQ ID NO: 500543 - DNA, 25 bp, Rattus norvegicus
gtctttttataatctgctcgtggtc

SEQ ID NO: 500544 - DNA, 25 bp, Rattus norvegicus
gtctttttatggaacactgcaggat

SEQ ID NO: 500545 - DNA, 25 bp, Rattus norvegicus
gtctttttatggtacactgcaggat

SEQ ID NO: 500546 - DNA, 25 bp, Rattus norvegicus
gtctttttcacaatcatgtactggg

SEQ ID NO: 500547 - DNA, 25 bp, Rattus norvegicus
gtctttttcacattcatgtactggg

SEQ ID NO: 500548 - DNA, 25 bp, Rattus norvegicus
gtctttttcaccattgtaccattca

SEQ ID NO: 500549 - DNA, 25 bp, Rattus norvegicus
gtctttttcacctttgtaccattca

SEQ ID NO: 500550 - DNA, 25 bp, Rattus norvegicus
gtctttttccctactatgttagcca

SEQ ID NO: 500551 - DNA, 25 bp, Rattus norvegicus
gtctttttccctccttgtatataag

SEQ ID NO: 500552 - DNA, 25 bp, Rattus norvegicus
gtctttttccctgcttgtatataag

SEQ ID NO: 500553 - DNA, 25 bp, Rattus norvegicus
gtctttttcccttctatgttagcca

SEQ ID NO: 500554 - DNA, 25 bp, Rattus norvegicus
gtctttttccttagaacgtgcttct

SEQ ID NO: 500555 - DNA, 25 bp, Rattus norvegicus
gtctttttcctttgaacgtgcttct

SEQ ID NO: 500556 - DNA, 25 bp, Rattus norvegicus
gtctttttcgtcacttctcttgcag

SEQ ID NO: 500557 - DNA, 25 bp, Rattus norvegicus
gtctttttcgtctcttctcttgcag

SEQ ID NO: 500558 - DNA, 25 bp, Rattus norvegicus
gtctttttgacacaattctcctttt

SEQ ID NO: 500559 - DNA, 25 bp, Rattus norvegicus
gtctttttgacagaattctcctttt

SEQ ID NO: 500560 - DNA, 25 bp, Rattus norvegicus
gtctttttgatgatccacatgttac

SEQ ID NO: 500561 - DNA, 25 bp, Rattus norvegicus
gtctttttgatgttccacatgttac

SEQ ID NO: 500562 - DNA, 25 bp, Rattus norvegicus
gtctttttgcacctgtgagggcttc

SEQ ID NO: 500563 - DNA, 25 bp, Rattus norvegicus
gtctttttgcacgtgtgagggcttc

SEQ ID NO: 500564 - DNA, 25 bp, Rattus norvegicus
gtctttttggacatcttgcaggtag

SEQ ID NO: 500565 - DNA, 25 bp, Rattus norvegicus
gtctttttggacttcttgcaggtag

SEQ ID NO: 500566 - DNA, 25 bp, Rattus norvegicus
gtctttttgtcactccttgtaaaat

SEQ ID NO: 500567 - DNA, 25 bp, Rattus norvegicus
gtctttttgtcagtccttgtaaaat

SEQ ID NO: 500568 - DNA, 25 bp, Rattus norvegicus
gtctttttgtctagtagcttttagc

SEQ ID NO: 500569 - DNA, 25 bp, Rattus norvegicus
gtctttttgtcttgtagcttttagc

SEQ ID NO: 500570 - DNA, 25 bp, Rattus norvegicus
gtcttttttatgcacaacagcctag

SEQ ID NO: 500571 - DNA, 25 bp, Rattus norvegicus
gtcttttttatggacaacagcctag

SEQ ID NO: 500572 - DNA, 25 bp, Rattus norvegicus
gtcttttttgttctatagccctgtt

SEQ ID NO: 500573 - DNA, 25 bp, Rattus norvegicus
gtcttttttgttgtatagccctgtt

SEQ ID NO: 500574 - DNA, 25 bp, Rattus norvegicus
gtgaaaaaacctctcttggctccag

SEQ ID NO: 500575 - DNA, 25 bp, Rattus norvegicus
gtgaaaaaacctgtcttggctccag

SEQ ID NO: 500576 - DNA, 25 bp, Rattus norvegicus
gtgaaaaaccctctacagccacgca

SEQ ID NO: 500577 - DNA, 25 bp, Rattus norvegicus
gtgaaaaaccctgtacagccacgca

SEQ ID NO: 500578 - DNA, 25 bp, Rattus norvegicus
gtgaaaaactatagcaacctccttg

SEQ ID NO: 500579 - DNA, 25 bp, Rattus norvegicus
gtgaaaaactattgcaacctccttg

SEQ ID NO: 500580 - DNA, 25 bp, Rattus norvegicus
gtgaaaaagccactccccacaagag

SEQ ID NO: 500581 - DNA, 25 bp, Rattus norvegicus
gtgaaaaagccagtccccacaagag

SEQ ID NO: 500582 - DNA, 25 bp, Rattus norvegicus
gtgaaaacaccaagcaaatgccaaa

SEQ ID NO: 500583 - DNA, 25 bp, Rattus norvegicus
gtgaaaacaccatgcaaatgccaaa

SEQ ID NO: 500584 - DNA, 25 bp, Rattus norvegicus
gtgaaaacagatccgtcctgccacg

SEQ ID NO: 500585 - DNA, 25 bp, Rattus norvegicus
gtgaaaacagatgcgtcctgccacg

SEQ ID NO: 500586 - DNA, 25 bp, Rattus norvegicus
gtgaaaaccacaagtcttccagaat

SEQ ID NO: 500587 - DNA, 25 bp, Rattus norvegicus
gtgaaaaccacatgtcttccagaat

SEQ ID NO: 500588 - DNA, 25 bp, Rattus norvegicus
gtgaaaacccaaccaggccacaatg

SEQ ID NO: 500589 - DNA, 25 bp, Rattus norvegicus
gtgaaaacccaagcaggccacaatg

SEQ ID NO: 500590 - DNA, 25 bp, Rattus norvegicus
gtgaaaacccacctagcatgttctg

SEQ ID NO: 500591 - DNA, 25 bp, Rattus norvegicus
gtgaaaacccacgtagcatgttctg

SEQ ID NO: 500592 - DNA, 25 bp, Rattus norvegicus
gtgaaaacccatacttccggaatga

SEQ ID NO: 500593 - DNA, 25 bp, Rattus norvegicus
gtgaaaacccattcttccggaatga

SEQ ID NO: 500594 - DNA, 25 bp, Rattus norvegicus
gtgaaaaccctgctagacgtcaact

SEQ ID NO: 500595 - DNA, 25 bp, Rattus norvegicus
gtgaaaaccctggtagacgtcaact

SEQ ID NO: 500596 - DNA, 25 bp, Rattus norvegicus
gtgaaaaccgtcctatcatggctgt

SEQ ID NO: 500597 - DNA, 25 bp, Rattus norvegicus
gtgaaaaccgtcgtatcatggctgt

SEQ ID NO: 500598 - DNA, 25 bp, Rattus norvegicus
gtgaaaacggccatccattggtttg

SEQ ID NO: 500599 - DNA, 25 bp, Rattus norvegicus
gtgaaaacggccttccattggtttg

SEQ ID NO: 500600 - DNA, 25 bp, Rattus norvegicus
gtgaaaactaggaggctggtcttgc

SEQ ID NO: 500601 - DNA, 25 bp, Rattus norvegicus
gtgaaaactaggtggctggtcttgc

SEQ ID NO: 500602 - DNA, 25 bp, Rattus norvegicus
gtgaaaactcctctcatcagcacat

SEQ ID NO: 500603 - DNA, 25 bp, Rattus norvegicus
gtgaaaactcctgtcatcagcacat

SEQ ID NO: 500604 - DNA, 25 bp, Rattus norvegicus
gtgaaaactcttagactgaccatgt

SEQ ID NO: 500605 - DNA, 25 bp, Rattus norvegicus
gtgaaaactctttgactgaccatgt

SEQ ID NO: 500606 - DNA, 25 bp, Rattus norvegicus
gtgaaaactgatcccatggttgtat

SEQ ID NO: 500607 - DNA, 25 bp, Rattus norvegicus
gtgaaaactgatgccatggttgtat

SEQ ID NO: 500608 - DNA, 25 bp, Rattus norvegicus
gtgaaaactgcaatagcaccgctaa

SEQ ID NO: 500609 - DNA, 25 bp, Rattus norvegicus
gtgaaaactgcattagcaccgctaa

SEQ ID NO: 500610 - DNA, 25 bp, Rattus norvegicus
gtgaaaagcacaccacaattctccc

SEQ ID NO: 500611 - DNA, 25 bp, Rattus norvegicus
gtgaaaagcacagcacaattctccc

SEQ ID NO: 500612 - DNA, 25 bp, Rattus norvegicus
gtgaaaagcatccagcccaaacttg

SEQ ID NO: 500613 - DNA, 25 bp, Rattus norvegicus
gtgaaaagcatcgagcccaaacttg

SEQ ID NO: 500614 - DNA, 25 bp, Rattus norvegicus
gtgaaaagccacagccctgaagtca

SEQ ID NO: 500615 - DNA, 25 bp, Rattus norvegicus
gtgaaaagccactgccctgaagtca

SEQ ID NO: 500616 - DNA, 25 bp, Rattus norvegicus
gtgaaaagctgcaatttcggtaact

SEQ ID NO: 500617 - DNA, 25 bp, Rattus norvegicus
gtgaaaagctgctatttcggtaact

SEQ ID NO: 500618 - DNA, 25 bp, Rattus norvegicus
gtgaaaatacaaaactgacagccga

SEQ ID NO: 500619 - DNA, 25 bp, Rattus norvegicus
gtgaaaatacaatactgacagccga

SEQ ID NO: 500620 - DNA, 25 bp, Rattus norvegicus
gtgaaaatcatgaacttagccagca

SEQ ID NO: 500621 - DNA, 25 bp, Rattus norvegicus
gtgaaaatcatgtacttagccagca

SEQ ID NO: 500622 - DNA, 25 bp, Rattus norvegicus
gtgaaaatgcctactctttacgaaa

SEQ ID NO: 500623 - DNA, 25 bp, Rattus norvegicus
gtgaaaatgcctacttaggtctgaa

SEQ ID NO: 500624 - DNA, 25 bp, Rattus norvegicus
gtgaaaatgcctattgttgcaacat

SEQ ID NO: 500625 - DNA, 25 bp, Rattus norvegicus
gtgaaaatgccttctctttacgaaa

SEQ ID NO: 500626 - DNA, 25 bp, Rattus norvegicus
gtgaaaatgccttcttaggtctgaa

SEQ ID NO: 500627 - DNA, 25 bp, Rattus norvegicus
gtgaaaatgccttttgttgcaacat

SEQ ID NO: 500628 - DNA, 25 bp, Rattus norvegicus
gtgaaaattcacacctaaccgcaac

SEQ ID NO: 500629 - DNA, 25 bp, Rattus norvegicus
gtgaaaattcactcctaaccgcaac

SEQ ID NO: 500630 - DNA, 25 bp, Rattus norvegicus
gtgaaaattggcctttgccctacaa

SEQ ID NO: 500631 - DNA, 25 bp, Rattus norvegicus
gtgaaaattggcgtttgccctacaa

SEQ ID NO: 500632 - DNA, 25 bp, Rattus norvegicus
gtgaaaattgtaccgcggtgctcct

SEQ ID NO: 500633 - DNA, 25 bp, Rattus norvegicus
gtgaaaattgtagcgcggtgctcct

SEQ ID NO: 500634 - DNA, 25 bp, Rattus norvegicus
gtgaaaattgttagccaggcttctg

SEQ ID NO: 500635 - DNA, 25 bp, Rattus norvegicus
gtgaaaattgtttgccaggcttctg

SEQ ID NO: 500636 - DNA, 25 bp, Rattus norvegicus
gtgaaacaaaagacccagccgaggt

SEQ ID NO: 500637 - DNA, 25 bp, Rattus norvegicus
gtgaaacaaaagtcccagccgaggt

SEQ ID NO: 500638 - DNA, 25 bp, Rattus norvegicus
gtgaaacaacttcgcatagatactt

SEQ ID NO: 500639 - DNA, 25 bp, Rattus norvegicus
gtgaaacaacttggcatagatactt

SEQ ID NO: 500640 - DNA, 25 bp, Rattus norvegicus
gtgaaacaagccaagctgaagctag

SEQ ID NO: 500641 - DNA, 25 bp, Rattus norvegicus
gtgaaacaagcctagctgaagctag

SEQ ID NO: 500642 - DNA, 25 bp, Rattus norvegicus
gtgaaacaatgccttatcccggatc

SEQ ID NO: 500643 - DNA, 25 bp, Rattus norvegicus
gtgaaacaatgcgttatcccggatc

SEQ ID NO: 500644 - DNA, 25 bp, Rattus norvegicus
gtgaaacacaccaactgaaagcaat

SEQ ID NO: 500645 - DNA, 25 bp, Rattus norvegicus
gtgaaacacacctactgaaagcaat

SEQ ID NO: 500646 - DNA, 25 bp, Rattus norvegicus
gtgaaacacagacacatcagccagc

SEQ ID NO: 500647 - DNA, 25 bp, Rattus norvegicus
gtgaaacacagagacatcagccagc

SEQ ID NO: 500648 - DNA, 25 bp, Rattus norvegicus
gtgaaacacctgaccaccgtggagc

SEQ ID NO: 500649 - DNA, 25 bp, Rattus norvegicus
gtgaaacacctgtccaccgtggagc

SEQ ID NO: 500650 - DNA, 25 bp, Rattus norvegicus
gtgaaacactacagggactgtccct

SEQ ID NO: 500651 - DNA, 25 bp, Rattus norvegicus
gtgaaacactactgggactgtccct

SEQ ID NO: 500652 - DNA, 25 bp, Rattus norvegicus
gtgaaacactccattgtctacaaaa

SEQ ID NO: 500653 - DNA, 25 bp, Rattus norvegicus
gtgaaacactcctttgtctacaaaa

SEQ ID NO: 500654 - DNA, 25 bp, Rattus norvegicus
gtgaaacactttctcagtcttctgt

SEQ ID NO: 500655 - DNA, 25 bp, Rattus norvegicus
gtgaaacactttgtcagtcttctgt

SEQ ID NO: 500656 - DNA, 25 bp, Rattus norvegicus
gtgaaacagaaaccgggagctacgc

SEQ ID NO: 500657 - DNA, 25 bp, Rattus norvegicus
gtgaaacagaaagcgggagctacgc

SEQ ID NO: 500658 - DNA, 25 bp, Rattus norvegicus
gtgaaacagacacaattagccctgt

SEQ ID NO: 500659 - DNA, 25 bp, Rattus norvegicus
gtgaaacagacagaattagccctgt

SEQ ID NO: 500660 - DNA, 25 bp, Rattus norvegicus
gtgaaacagcctatgtatccatgta

SEQ ID NO: 500661 - DNA, 25 bp, Rattus norvegicus
gtgaaacagcctttgtatccatgta

SEQ ID NO: 500662 - DNA, 25 bp, Rattus norvegicus
gtgaaacagctaaacctctggcctg

SEQ ID NO: 500663 - DNA, 25 bp, Rattus norvegicus
gtgaaacagctatacctctggcctg

SEQ ID NO: 500664 - DNA, 25 bp, Rattus norvegicus
gtgaaacagtatccagccttgggaa

SEQ ID NO: 500665 - DNA, 25 bp, Rattus norvegicus
gtgaaacagtatgcagccttgggaa

SEQ ID NO: 500666 - DNA, 25 bp, Rattus norvegicus
gtgaaacagtttaagtcctaataca

SEQ ID NO: 500667 - DNA, 25 bp, Rattus norvegicus
gtgaaacagttttagtcctaataca

SEQ ID NO: 500668 - DNA, 25 bp, Rattus norvegicus
gtgaaacatatactctgctccgaca

SEQ ID NO: 500669 - DNA, 25 bp, Rattus norvegicus
gtgaaacatatagtctgctccgaca

SEQ ID NO: 500670 - DNA, 25 bp, Rattus norvegicus
gtgaaacatgccctctaggaagcaa

SEQ ID NO: 500671 - DNA, 25 bp, Rattus norvegicus
gtgaaacatgccgtctaggaagcaa

SEQ ID NO: 500672 - DNA, 25 bp, Rattus norvegicus
gtgaaaccacttctttacagtattt

SEQ ID NO: 500673 - DNA, 25 bp, Rattus norvegicus
gtgaaaccacttgtttacagtattt

SEQ ID NO: 500674 - DNA, 25 bp, Rattus norvegicus
gtgaaaccagacactaccattttag

SEQ ID NO: 500675 - DNA, 25 bp, Rattus norvegicus
gtgaaaccagactctaccattttag

SEQ ID NO: 500676 - DNA, 25 bp, Rattus norvegicus
gtgaaaccaggtccattgtatgtga

SEQ ID NO: 500677 - DNA, 25 bp, Rattus norvegicus
gtgaaaccaggtgcattgtatgtga

SEQ ID NO: 500678 - DNA, 25 bp, Rattus norvegicus
gtgaaacccaaaccatttattgaga

SEQ ID NO: 500679 - DNA, 25 bp, Rattus norvegicus
gtgaaacccaaagcatttattgaga

SEQ ID NO: 500680 - DNA, 25 bp, Rattus norvegicus
gtgaaacccaacaccacatttttat

SEQ ID NO: 500681 - DNA, 25 bp, Rattus norvegicus
gtgaaacccaacagcttactataaa

SEQ ID NO: 500682 - DNA, 25 bp, Rattus norvegicus
gtgaaacccaactccacatttttat

SEQ ID NO: 500683 - DNA, 25 bp, Rattus norvegicus
gtgaaacccaactgcttactataaa

SEQ ID NO: 500684 - DNA, 25 bp, Rattus norvegicus
gtgaaacccatgattagctgtcctt

SEQ ID NO: 500685 - DNA, 25 bp, Rattus norvegicus
gtgaaacccatgtttagctgtcctt

SEQ ID NO: 500686 - DNA, 25 bp, Rattus norvegicus
gtgaaacccgtaatagcgagtacgt

SEQ ID NO: 500687 - DNA, 25 bp, Rattus norvegicus
gtgaaacccgtattagcgagtacgt

SEQ ID NO: 500688 - DNA, 25 bp, Rattus norvegicus
gtgaaaccctatctcgccaaaacca

SEQ ID NO: 500689 - DNA, 25 bp, Rattus norvegicus
gtgaaaccctatgtcgccaaaacca

SEQ ID NO: 500690 - DNA, 25 bp, Rattus norvegicus
gtgaaacctaggagtgtctccttaa

SEQ ID NO: 500691 - DNA, 25 bp, Rattus norvegicus
gtgaaacctaggtgtgtctccttaa

SEQ ID NO: 500692 - DNA, 25 bp, Rattus norvegicus
gtgaaacctcctccgattagtttgg

SEQ ID NO: 500693 - DNA, 25 bp, Rattus norvegicus
gtgaaacctcctgcgattagtttgg

SEQ ID NO: 500694 - DNA, 25 bp, Rattus norvegicus
gtgaaacctctgatgaccctaaagt

SEQ ID NO: 500695 - DNA, 25 bp, Rattus norvegicus
gtgaaacctctgttgaccctaaagt

SEQ ID NO: 500696 - DNA, 25 bp, Rattus norvegicus
gtgaaaccttacctgagaggacttt

SEQ ID NO: 500697 - DNA, 25 bp, Rattus norvegicus
gtgaaaccttacgtgagaggacttt

SEQ ID NO: 500698 - DNA, 25 bp, Rattus norvegicus
gtgaaaccttatcattgtaagcaat

SEQ ID NO: 500699 - DNA, 25 bp, Rattus norvegicus
gtgaaaccttatgattgtaagcaat

SEQ ID NO: 500700 - DNA, 25 bp, Rattus norvegicus
gtgaaaccttgtacccatccctgtt

SEQ ID NO: 500701 - DNA, 25 bp, Rattus norvegicus
gtgaaaccttgttcccatccctgtt

SEQ ID NO: 500702 - DNA, 25 bp, Rattus norvegicus
gtgaaacctttccaatgtaagcaat

SEQ ID NO: 500703 - DNA, 25 bp, Rattus norvegicus
gtgaaacctttcgaatgtaagcaat

SEQ ID NO: 500704 - DNA, 25 bp, Rattus norvegicus
gtgaaacgagtgatgctgctgttgc

SEQ ID NO: 500705 - DNA, 25 bp, Rattus norvegicus
gtgaaacgagtgttgctgctgttgc

SEQ ID NO: 500706 - DNA, 25 bp, Rattus norvegicus
gtgaaacgcacaagcctaagctagc

SEQ ID NO: 500707 - DNA, 25 bp, Rattus norvegicus
gtgaaacgcacatgcctaagctagc

SEQ ID NO: 500708 - DNA, 25 bp, Rattus norvegicus
gtgaaacgtgttattgtcatagtat

SEQ ID NO: 500709 - DNA, 25 bp, Rattus norvegicus
gtgaaacgtgtttttgtcatagtat

SEQ ID NO: 500710 - DNA, 25 bp, Rattus norvegicus
gtgaaactaatcatactctaacttt

SEQ ID NO: 500711 - DNA, 25 bp, Rattus norvegicus
gtgaaactaatcttactctaacttt

SEQ ID NO: 500712 - DNA, 25 bp, Rattus norvegicus
gtgaaactacacagcggtgcgtggt

SEQ ID NO: 500713 - DNA, 25 bp, Rattus norvegicus
gtgaaactacactgcggtgcgtggt

SEQ ID NO: 500714 - DNA, 25 bp, Rattus norvegicus
gtgaaactcaacagaaactatacag

SEQ ID NO: 500715 - DNA, 25 bp, Rattus norvegicus
gtgaaactcaactgaaactatacag

SEQ ID NO: 500716 - DNA, 25 bp, Rattus norvegicus
gtgaaactcaagagccctgtggaca

SEQ ID NO: 500717 - DNA, 25 bp, Rattus norvegicus
gtgaaactcaagtgccctgtggaca

SEQ ID NO: 500718 - DNA, 25 bp, Rattus norvegicus
gtgaaactcagaccccttttcttta

SEQ ID NO: 500719 - DNA, 25 bp, Rattus norvegicus
gtgaaactcagagcccttttcttta

SEQ ID NO: 500720 - DNA, 25 bp, Rattus norvegicus
gtgaaactcatgactatctacaata

SEQ ID NO: 500721 - DNA, 25 bp, Rattus norvegicus
gtgaaactcatgtctatctacaata

SEQ ID NO: 500722 - DNA, 25 bp, Rattus norvegicus
gtgaaactgcttccttcttcaagga

SEQ ID NO: 500723 - DNA, 25 bp, Rattus norvegicus
gtgaaactgcttgcttcttcaagga

SEQ ID NO: 500724 - DNA, 25 bp, Rattus norvegicus
gtgaaacttacaaggagcaactgga

SEQ ID NO: 500725 - DNA, 25 bp, Rattus norvegicus
gtgaaacttacatggagcaactgga

SEQ ID NO: 500726 - DNA, 25 bp, Rattus norvegicus
gtgaaacttaccacacagctgcctc

SEQ ID NO: 500727 - DNA, 25 bp, Rattus norvegicus
gtgaaacttacctcacagctgcctc

SEQ ID NO: 500728 - DNA, 25 bp, Rattus norvegicus
gtgaaacttgacatttcccagccag

SEQ ID NO: 500729 - DNA, 25 bp, Rattus norvegicus
gtgaaacttgacttttcccagccag

SEQ ID NO: 500730 - DNA, 25 bp, Rattus norvegicus
gtgaaacttggaatctttcctacaa

SEQ ID NO: 500731 - DNA, 25 bp, Rattus norvegicus
gtgaaacttggattctttcctacaa

SEQ ID NO: 500732 - DNA, 25 bp, Rattus norvegicus
gtgaaacttgtacatcctattccta

SEQ ID NO: 500733 - DNA, 25 bp, Rattus norvegicus
gtgaaacttgtagatcctattccta

SEQ ID NO: 500734 - DNA, 25 bp, Rattus norvegicus
gtgaaacttttgagttgctcttgct

SEQ ID NO: 500735 - DNA, 25 bp, Rattus norvegicus
gtgaaacttttgtgttgctcttgct

SEQ ID NO: 500736 - DNA, 25 bp, Rattus norvegicus
gtgaaagaccacctgtttggaataa

SEQ ID NO: 500737 - DNA, 25 bp, Rattus norvegicus
gtgaaagaccacgtgtttggaataa

SEQ ID NO: 500738 - DNA, 25 bp, Rattus norvegicus
gtgaaagacttgctatctcgcttct

SEQ ID NO: 500739 - DNA, 25 bp, Rattus norvegicus
gtgaaagacttggtatctcgcttct

SEQ ID NO: 500740 - DNA, 25 bp, Rattus norvegicus
gtgaaagagcttagcacgtgcaccc

SEQ ID NO: 500741 - DNA, 25 bp, Rattus norvegicus
gtgaaagagctttgcacgtgcaccc

SEQ ID NO: 500742 - DNA, 25 bp, Rattus norvegicus
gtgaaagagtcaaaccatcctattt

SEQ ID NO: 500743 - DNA, 25 bp, Rattus norvegicus
gtgaaagagtcataccatcctattt

SEQ ID NO: 500744 - DNA, 25 bp, Rattus norvegicus
gtgaaagatgctcccaggccggcct

SEQ ID NO: 500745 - DNA, 25 bp, Rattus norvegicus
gtgaaagatgctgccaggccggcct

SEQ ID NO: 500746 - DNA, 25 bp, Rattus norvegicus
gtgaaagcaggtctgtgcagcacat

SEQ ID NO: 500747 - DNA, 25 bp, Rattus norvegicus
gtgaaagcaggtgtgtgcagcacat

SEQ ID NO: 500748 - DNA, 25 bp, Rattus norvegicus
gtgaaagcccaacgtccactttgaa

SEQ ID NO: 500749 - DNA, 25 bp, Rattus norvegicus
gtgaaagcccaaggtccactttgaa

SEQ ID NO: 500750 - DNA, 25 bp, Rattus norvegicus
gtgaaagcccttcaagtgacccggg

SEQ ID NO: 500751 - DNA, 25 bp, Rattus norvegicus
gtgaaagcccttgaagtgacccggg

SEQ ID NO: 500752 - DNA, 25 bp, Rattus norvegicus
gtgaaagccgggagctagagcccct

SEQ ID NO: 500753 - DNA, 25 bp, Rattus norvegicus
gtgaaagccgggtgctagagcccct

SEQ ID NO: 500754 - DNA, 25 bp, Rattus norvegicus
gtgaaagcctctcacagagtcctga

SEQ ID NO: 500755 - DNA, 25 bp, Rattus norvegicus
gtgaaagcctctgacagagtcctga

SEQ ID NO: 500756 - DNA, 25 bp, Rattus norvegicus
gtgaaagcctttaacatctaattgt

SEQ ID NO: 500757 - DNA, 25 bp, Rattus norvegicus
gtgaaagccttttacatctaattgt

SEQ ID NO: 500758 - DNA, 25 bp, Rattus norvegicus
gtgaaagctaatattccagccagaa

SEQ ID NO: 500759 - DNA, 25 bp, Rattus norvegicus
gtgaaagctaattttccagccagaa

SEQ ID NO: 500760 - DNA, 25 bp, Rattus norvegicus
gtgaaagctactctggatatctcga

SEQ ID NO: 500761 - DNA, 25 bp, Rattus norvegicus
gtgaaagctactgtggatatctcga

SEQ ID NO: 500762 - DNA, 25 bp, Rattus norvegicus
gtgaaagctcaccatgtcttctttt

SEQ ID NO: 500763 - DNA, 25 bp, Rattus norvegicus
gtgaaagctcacgatgtcttctttt

SEQ ID NO: 500764 - DNA, 25 bp, Rattus norvegicus
gtgaaaggacacaccaaagcaccac

SEQ ID NO: 500765 - DNA, 25 bp, Rattus norvegicus
gtgaaaggacactccaaagcaccac

SEQ ID NO: 500766 - DNA, 25 bp, Rattus norvegicus
gtgaaaggcatcatctatcgcaaga

SEQ ID NO: 500767 - DNA, 25 bp, Rattus norvegicus
gtgaaaggcatcttctatcgcaaga

SEQ ID NO: 500768 - DNA, 25 bp, Rattus norvegicus
gtgaaaggccagacccatttctgaa

SEQ ID NO: 500769 - DNA, 25 bp, Rattus norvegicus
gtgaaaggccagtcccatttctgaa

SEQ ID NO: 500770 - DNA, 25 bp, Rattus norvegicus
gtgaaaggccttagtcctcagggtc

SEQ ID NO: 500771 - DNA, 25 bp, Rattus norvegicus
gtgaaaggcctttgtcctcagggtc

SEQ ID NO: 500772 - DNA, 25 bp, Rattus norvegicus
gtgaaaggtcatctattgcagtcta

SEQ ID NO: 500773 - DNA, 25 bp, Rattus norvegicus
gtgaaaggtcatgtattgcagtcta

SEQ ID NO: 500774 - DNA, 25 bp, Rattus norvegicus
gtgaaaggttcaattgctgccgctg

SEQ ID NO: 500775 - DNA, 25 bp, Rattus norvegicus
gtgaaaggttcatttgctgccgctg

SEQ ID NO: 500776 - DNA, 25 bp, Rattus norvegicus
gtgaaagtattccatggcccctata

SEQ ID NO: 500777 - DNA, 25 bp, Rattus norvegicus
gtgaaagtattcgatggcccctata

SEQ ID NO: 500778 - DNA, 25 bp, Rattus norvegicus
gtgaaagtcactcacccataggtgg

SEQ ID NO: 500779 - DNA, 25 bp, Rattus norvegicus
gtgaaagtcactgacccataggtgg

SEQ ID NO: 500780 - DNA, 25 bp, Rattus norvegicus
gtgaaagtcgacctgctccggcaaa

SEQ ID NO: 500781 - DNA, 25 bp, Rattus norvegicus
gtgaaagtcgacgtgctccggcaaa

SEQ ID NO: 500782 - DNA, 25 bp, Rattus norvegicus
gtgaaagtcttactcccactaatgg

SEQ ID NO: 500783 - DNA, 25 bp, Rattus norvegicus
gtgaaagtcttagtcccactaatgg

SEQ ID NO: 500784 - DNA, 25 bp, Rattus norvegicus
gtgaaagtgactcgccactgggcct

SEQ ID NO: 500785 - DNA, 25 bp, Rattus norvegicus
gtgaaagtgactggccactgggcct

SEQ ID NO: 500786 - DNA, 25 bp, Rattus norvegicus
gtgaaagtgagtcaggctcctccat

SEQ ID NO: 500787 - DNA, 25 bp, Rattus norvegicus
gtgaaagtgagtgaggctcctccat

SEQ ID NO: 500788 - DNA, 25 bp, Rattus norvegicus
gtgaaagtgccaagaattctcccca

SEQ ID NO: 500789 - DNA, 25 bp, Rattus norvegicus
gtgaaagtgccatgaattctcccca

SEQ ID NO: 500790 - DNA, 25 bp, Rattus norvegicus
gtgaaagtgttgactggctggccat

SEQ ID NO: 500791 - DNA, 25 bp, Rattus norvegicus
gtgaaagtgttgcaacccctggctt

SEQ ID NO: 500792 - DNA, 25 bp, Rattus norvegicus
gtgaaagtgttggaacccctggctt

SEQ ID NO: 500793 - DNA, 25 bp, Rattus norvegicus
gtgaaagtgttgtctggctggccat

SEQ ID NO: 500794 - DNA, 25 bp, Rattus norvegicus
gtgaaagttgcacccgtttcttcaa

SEQ ID NO: 500795 - DNA, 25 bp, Rattus norvegicus
gtgaaagttgcagccgtttcttcaa

SEQ ID NO: 500796 - DNA, 25 bp, Rattus norvegicus
gtgaaataaaccctgtttgcacctt

SEQ ID NO: 500797 - DNA, 25 bp, Rattus norvegicus
gtgaaataaaccgtgtttgcacctt

SEQ ID NO: 500798 - DNA, 25 bp, Rattus norvegicus
gtgaaatacgaccacattctgaagt

SEQ ID NO: 500799 - DNA, 25 bp, Rattus norvegicus
gtgaaatacgacgacattctgaagt

SEQ ID NO: 500800 - DNA, 25 bp, Rattus norvegicus
gtgaaatactatccttattgacacc

SEQ ID NO: 500801 - DNA, 25 bp, Rattus norvegicus
gtgaaatactatgcttattgacacc

SEQ ID NO: 500802 - DNA, 25 bp, Rattus norvegicus
gtgaaatactcaatgtgctctttta

SEQ ID NO: 500803 - DNA, 25 bp, Rattus norvegicus
gtgaaatactcattgtgctctttta

SEQ ID NO: 500804 - DNA, 25 bp, Rattus norvegicus
gtgaaatatgccactttactgttta

SEQ ID NO: 500805 - DNA, 25 bp, Rattus norvegicus
gtgaaatatgcctctttactgttta

SEQ ID NO: 500806 - DNA, 25 bp, Rattus norvegicus
gtgaaatatgtgatcccggagcccg

SEQ ID NO: 500807 - DNA, 25 bp, Rattus norvegicus
gtgaaatatgtgttcccggagcccg

SEQ ID NO: 500808 - DNA, 25 bp, Rattus norvegicus
gtgaaatcaacaacccgcccactcg

SEQ ID NO: 500809 - DNA, 25 bp, Rattus norvegicus
gtgaaatcaacatcccgcccactcg

SEQ ID NO: 500810 - DNA, 25 bp, Rattus norvegicus
gtgaaatcacacagagaatacataa

SEQ ID NO: 500811 - DNA, 25 bp, Rattus norvegicus
gtgaaatcacactgagaatacataa

SEQ ID NO: 500812 - DNA, 25 bp, Rattus norvegicus
gtgaaatcagctcctgctctccaat

SEQ ID NO: 500813 - DNA, 25 bp, Rattus norvegicus
gtgaaatcagctgctgctctccaat

SEQ ID NO: 500814 - DNA, 25 bp, Rattus norvegicus
gtgaaatcatgcacaagtctccttt

SEQ ID NO: 500815 - DNA, 25 bp, Rattus norvegicus
gtgaaatcatgctcaagtctccttt

SEQ ID NO: 500816 - DNA, 25 bp, Rattus norvegicus
gtgaaatccaggctaatgaaaccca

SEQ ID NO: 500817 - DNA, 25 bp, Rattus norvegicus
gtgaaatccagggtaatgaaaccca

SEQ ID NO: 500818 - DNA, 25 bp, Rattus norvegicus
gtgaaatccatccttctgacagaga

SEQ ID NO: 500819 - DNA, 25 bp, Rattus norvegicus
gtgaaatccatcgttctgacagaga

SEQ ID NO: 500820 - DNA, 25 bp, Rattus norvegicus
gtgaaatccatgaggcagtcctctg

SEQ ID NO: 500821 - DNA, 25 bp, Rattus norvegicus
gtgaaatccatgtggcagtcctctg

SEQ ID NO: 500822 - DNA, 25 bp, Rattus norvegicus
gtgaaatcctcacccagtattgtcc

SEQ ID NO: 500823 - DNA, 25 bp, Rattus norvegicus
gtgaaatcctcagccagtattgtcc

SEQ ID NO: 500824 - DNA, 25 bp, Rattus norvegicus
gtgaaatgacatatgtgagcctgtg

SEQ ID NO: 500825 - DNA, 25 bp, Rattus norvegicus
gtgaaatgacatttgtgagcctgtg

SEQ ID NO: 500826 - DNA, 25 bp, Rattus norvegicus
gtgaaatgaccacgatcctcccctt

SEQ ID NO: 500827 - DNA, 25 bp, Rattus norvegicus
gtgaaatgaccaggatcctcccctt

SEQ ID NO: 500828 - DNA, 25 bp, Rattus norvegicus
gtgaaatgactgaacacatgtgtga

SEQ ID NO: 500829 - DNA, 25 bp, Rattus norvegicus
gtgaaatgactgtacacatgtgtga

SEQ ID NO: 500830 - DNA, 25 bp, Rattus norvegicus
gtgaaatgatgtccctttccttgcc

SEQ ID NO: 500831 - DNA, 25 bp, Rattus norvegicus
gtgaaatgatgtgcctttccttgcc

SEQ ID NO: 500832 - DNA, 25 bp, Rattus norvegicus
gtgaaatgcagtcttaacccttacc

SEQ ID NO: 500833 - DNA, 25 bp, Rattus norvegicus
gtgaaatgcagtgttaacccttacc

SEQ ID NO: 500834 - DNA, 25 bp, Rattus norvegicus
gtgaaatgctagaactgccccacgg

SEQ ID NO: 500835 - DNA, 25 bp, Rattus norvegicus
gtgaaatgctagtactgccccacgg

SEQ ID NO: 500836 - DNA, 25 bp, Rattus norvegicus
gtgaaatgctgcacaacgttgcttt

SEQ ID NO: 500837 - DNA, 25 bp, Rattus norvegicus
gtgaaatgctgctcaacgttgcttt

SEQ ID NO: 500838 - DNA, 25 bp, Rattus norvegicus
gtgaaatgctgtcatgcccttacct

SEQ ID NO: 500839 - DNA, 25 bp, Rattus norvegicus
gtgaaatgctgtgatgcccttacct

SEQ ID NO: 500840 - DNA, 25 bp, Rattus norvegicus
gtgaaatgcttaacctgtttgagag

SEQ ID NO: 500841 - DNA, 25 bp, Rattus norvegicus
gtgaaatgcttatcctgtttgagag

SEQ ID NO: 500842 - DNA, 25 bp, Rattus norvegicus
gtgaaatggactaactttgcctaca

SEQ ID NO: 500843 - DNA, 25 bp, Rattus norvegicus
gtgaaatggacttactttgcctaca

SEQ ID NO: 500844 - DNA, 25 bp, Rattus norvegicus
gtgaaatggccaacccaggcgtgca

SEQ ID NO: 500845 - DNA, 25 bp, Rattus norvegicus
gtgaaatggccatcccaggcgtgca

SEQ ID NO: 500846 - DNA, 25 bp, Rattus norvegicus
gtgaaatgtcccacactttgaagca

SEQ ID NO: 500847 - DNA, 25 bp, Rattus norvegicus
gtgaaatgtccctcactttgaagca

SEQ ID NO: 500848 - DNA, 25 bp, Rattus norvegicus
gtgaaatgttgaactctgtgagttt

SEQ ID NO: 500849 - DNA, 25 bp, Rattus norvegicus
gtgaaatgttgatctctgtgagttt

SEQ ID NO: 500850 - DNA, 25 bp, Rattus norvegicus
gtgaaattaaccctgcagcatgtga

SEQ ID NO: 500851 - DNA, 25 bp, Rattus norvegicus
gtgaaattaaccgtgcagcatgtga

SEQ ID NO: 500852 - DNA, 25 bp, Rattus norvegicus
gtgaaattatcccagcagctgtaat

SEQ ID NO: 500853 - DNA, 25 bp, Rattus norvegicus
gtgaaattatccgagcagctgtaat

SEQ ID NO: 500854 - DNA, 25 bp, Rattus norvegicus
gtgaaattcaacacagtgcctccta

SEQ ID NO: 500855 - DNA, 25 bp, Rattus norvegicus
gtgaaattcaactcagtgcctccta

SEQ ID NO: 500856 - DNA, 25 bp, Rattus norvegicus
gtgaaattcaagagcagctcaacat

SEQ ID NO: 500857 - DNA, 25 bp, Rattus norvegicus
gtgaaattcaagtgcagctcaacat

SEQ ID NO: 500858 - DNA, 25 bp, Rattus norvegicus
gtgaaattcagcatgggcttgccct

SEQ ID NO: 500859 - DNA, 25 bp, Rattus norvegicus
gtgaaattcagcttgggcttgccct

SEQ ID NO: 500860 - DNA, 25 bp, Rattus norvegicus
gtgaaattcattatagaccctcttg

SEQ ID NO: 500861 - DNA, 25 bp, Rattus norvegicus
gtgaaattcattttagaccctcttg

SEQ ID NO: 500862 - DNA, 25 bp, Rattus norvegicus
gtgaaattcctgcaccaaagccttt

SEQ ID NO: 500863 - DNA, 25 bp, Rattus norvegicus
gtgaaattcctggaccaaagccttt

SEQ ID NO: 500864 - DNA, 25 bp, Rattus norvegicus
gtgaaattgcacacataacttgatt

SEQ ID NO: 500865 - DNA, 25 bp, Rattus norvegicus
gtgaaattgcactcataacttgatt

SEQ ID NO: 500866 - DNA, 25 bp, Rattus norvegicus
gtgaaattggcacttgcccctacgt

SEQ ID NO: 500867 - DNA, 25 bp, Rattus norvegicus
gtgaaattggcagttgcccctacgt

SEQ ID NO: 500868 - DNA, 25 bp, Rattus norvegicus
gtgaaattggtcagcatcagcctat

SEQ ID NO: 500869 - DNA, 25 bp, Rattus norvegicus
gtgaaattggtctgcatcagcctat

SEQ ID NO: 500870 - DNA, 25 bp, Rattus norvegicus
gtgaaattgttcaacggctgtcccc

SEQ ID NO: 500871 - DNA, 25 bp, Rattus norvegicus
gtgaaattgttctacggctgtcccc

SEQ ID NO: 500872 - DNA, 25 bp, Rattus norvegicus
gtgaaattgtttcccctgttcaagt

SEQ ID NO: 500873 - DNA, 25 bp, Rattus norvegicus
gtgaaattgtttgccctgttcaagt

SEQ ID NO: 500874 - DNA, 25 bp, Rattus norvegicus
gtgaaatttctcacttggtgcccca

SEQ ID NO: 500875 - DNA, 25 bp, Rattus norvegicus
gtgaaatttctctcttggtgcccca

SEQ ID NO: 500876 - DNA, 25 bp, Rattus norvegicus
gtgaacaaaacgacacacctcatag

SEQ ID NO: 500877 - DNA, 25 bp, Rattus norvegicus
gtgaacaaaacgtcacacctcatag

SEQ ID NO: 500878 - DNA, 25 bp, Rattus norvegicus
gtgaacaaaccaaggtaacaccagg

SEQ ID NO: 500879 - DNA, 25 bp, Rattus norvegicus
gtgaacaaaccatggtaacaccagg

SEQ ID NO: 500880 - DNA, 25 bp, Rattus norvegicus
gtgaacaacacccaggaacacttga

SEQ ID NO: 500881 - DNA, 25 bp, Rattus norvegicus
gtgaacaacaccgaggaacacttga

SEQ ID NO: 500882 - DNA, 25 bp, Rattus norvegicus
gtgaacaacatccagcccacaggag

SEQ ID NO: 500883 - DNA, 25 bp, Rattus norvegicus
gtgaacaacatcgagcccacaggag

SEQ ID NO: 500884 - DNA, 25 bp, Rattus norvegicus
gtgaacaaccgcatcatcgaggaga

SEQ ID NO: 500885 - DNA, 25 bp, Rattus norvegicus
gtgaacaaccgcttcatcgaggaga

SEQ ID NO: 500886 - DNA, 25 bp, Rattus norvegicus
gtgaacaacgcaagcttctgcaagc

SEQ ID NO: 500887 - DNA, 25 bp, Rattus norvegicus
gtgaacaacgcatgcttctgcaagc

SEQ ID NO: 500888 - DNA, 25 bp, Rattus norvegicus
gtgaacaactgaacagtggccagat

SEQ ID NO: 500889 - DNA, 25 bp, Rattus norvegicus
gtgaacaactgatcagtggccagat

SEQ ID NO: 500890 - DNA, 25 bp, Rattus norvegicus
gtgaacaagcacaccctggaaacaa

SEQ ID NO: 500891 - DNA, 25 bp, Rattus norvegicus
gtgaacaagcactccctggaaacaa

SEQ ID NO: 500892 - DNA, 25 bp, Rattus norvegicus
gtgaacaaggcaactccaagggcaa

SEQ ID NO: 500893 - DNA, 25 bp, Rattus norvegicus
gtgaacaaggcatctccaagggcaa

SEQ ID NO: 500894 - DNA, 25 bp, Rattus norvegicus
gtgaacaagtttatgcggcgccaga

SEQ ID NO: 500895 - DNA, 25 bp, Rattus norvegicus
gtgaacaagtttttgcggcgccaga

SEQ ID NO: 500896 - DNA, 25 bp, Rattus norvegicus
gtgaacaataccctcactgtccggt

SEQ ID NO: 500897 - DNA, 25 bp, Rattus norvegicus
gtgaacaataccgtcactgtccggt

SEQ ID NO: 500898 - DNA, 25 bp, Rattus norvegicus
gtgaacaatcacagttgggccacat

SEQ ID NO: 500899 - DNA, 25 bp, Rattus norvegicus
gtgaacaatcactgttgggccacat

SEQ ID NO: 500900 - DNA, 25 bp, Rattus norvegicus
gtgaacacaaacacatcttcttcct

SEQ ID NO: 500901 - DNA, 25 bp, Rattus norvegicus
gtgaacacaaactcatcttcttcct

SEQ ID NO: 500902 - DNA, 25 bp, Rattus norvegicus
gtgaacacaatcattagttaccctg

SEQ ID NO: 500903 - DNA, 25 bp, Rattus norvegicus
gtgaacacaatctttagttaccctg

SEQ ID NO: 500904 - DNA, 25 bp, Rattus norvegicus
gtgaacacacgaataaccagctagc

SEQ ID NO: 500905 - DNA, 25 bp, Rattus norvegicus
gtgaacacacgattaaccagctagc

SEQ ID NO: 500906 - DNA, 25 bp, Rattus norvegicus
gtgaacacacgtcggccagaacctt

SEQ ID NO: 500907 - DNA, 25 bp, Rattus norvegicus
gtgaacacacgtgggccagaacctt

SEQ ID NO: 500908 - DNA, 25 bp, Rattus norvegicus
gtgaacacagatcatggcctttgct

SEQ ID NO: 500909 - DNA, 25 bp, Rattus norvegicus
gtgaacacagatgatggcctttgct

SEQ ID NO: 500910 - DNA, 25 bp, Rattus norvegicus
gtgaacacagctctggccgcaaggt

SEQ ID NO: 500911 - DNA, 25 bp, Rattus norvegicus
gtgaacacagctgtggccgcaaggt

SEQ ID NO: 500912 - DNA, 25 bp, Rattus norvegicus
gtgaacacaggtccacacatccata

SEQ ID NO: 500913 - DNA, 25 bp, Rattus norvegicus
gtgaacacaggtgcacacatccata

SEQ ID NO: 500914 - DNA, 25 bp, Rattus norvegicus
gtgaacaccaaccacgttctaatct

SEQ ID NO: 500915 - DNA, 25 bp, Rattus norvegicus
gtgaacaccaacgacgttctaatct

SEQ ID NO: 500916 - DNA, 25 bp, Rattus norvegicus
gtgaacaccagacacatggagctga

SEQ ID NO: 500917 - DNA, 25 bp, Rattus norvegicus
gtgaacaccagagacatggagctga

SEQ ID NO: 500918 - DNA, 25 bp, Rattus norvegicus
gtgaacaccatcaggctttttcccc

SEQ ID NO: 500919 - DNA, 25 bp, Rattus norvegicus
gtgaacaccatctggctttttcccc

SEQ ID NO: 500920 - DNA, 25 bp, Rattus norvegicus
gtgaacaccctcactaatggaactg

SEQ ID NO: 500921 - DNA, 25 bp, Rattus norvegicus
gtgaacaccctctctaatggaactg

SEQ ID NO: 500922 - DNA, 25 bp, Rattus norvegicus
gtgaacaccgggagacctaggagat

SEQ ID NO: 500923 - DNA, 25 bp, Rattus norvegicus
gtgaacaccgggtgacctaggagat

SEQ ID NO: 500924 - DNA, 25 bp, Rattus norvegicus
gtgaacaccttcattccgtagagca

SEQ ID NO: 500925 - DNA, 25 bp, Rattus norvegicus
gtgaacaccttctttccgtagagca

SEQ ID NO: 500926 - DNA, 25 bp, Rattus norvegicus
gtgaacacgcggaccaccatcattt

SEQ ID NO: 500927 - DNA, 25 bp, Rattus norvegicus
gtgaacacgcggtccaccatcattt

SEQ ID NO: 500928 - DNA, 25 bp, Rattus norvegicus
gtgaacactccaagactggtgatca

SEQ ID NO: 500929 - DNA, 25 bp, Rattus norvegicus
gtgaacactccatgactggtgatca

SEQ ID NO: 500930 - DNA, 25 bp, Rattus norvegicus
gtgaacactcccctttgagcaagtc

SEQ ID NO: 500931 - DNA, 25 bp, Rattus norvegicus
gtgaacactcccgtttgagcaagtc

SEQ ID NO: 500932 - DNA, 25 bp, Rattus norvegicus
gtgaacactgaacttggcaatctta

SEQ ID NO: 500933 - DNA, 25 bp, Rattus norvegicus
gtgaacactgaagttggcaatctta

SEQ ID NO: 500934 - DNA, 25 bp, Rattus norvegicus
gtgaacacttcaagtattcttttct

SEQ ID NO: 500935 - DNA, 25 bp, Rattus norvegicus
gtgaacacttcatgtattcttttct

SEQ ID NO: 500936 - DNA, 25 bp, Rattus norvegicus
gtgaacacttgacaacctctcctga

SEQ ID NO: 500937 - DNA, 25 bp, Rattus norvegicus
gtgaacacttgacaaccttcttttg

SEQ ID NO: 500938 - DNA, 25 bp, Rattus norvegicus
gtgaacacttgagaacctctcctga

SEQ ID NO: 500939 - DNA, 25 bp, Rattus norvegicus
gtgaacacttgagaaccttcttttg

SEQ ID NO: 500940 - DNA, 25 bp, Rattus norvegicus
gtgaacactttccactttctgacac

SEQ ID NO: 500941 - DNA, 25 bp, Rattus norvegicus
gtgaacactttcgactttctgacac

SEQ ID NO: 500942 - DNA, 25 bp, Rattus norvegicus
gtgaacagaagccaccatctactcc

SEQ ID NO: 500943 - DNA, 25 bp, Rattus norvegicus
gtgaacagaagcgaccatctactcc

SEQ ID NO: 500944 - DNA, 25 bp, Rattus norvegicus
gtgaacagcacacattccagcactg

SEQ ID NO: 500945 - DNA, 25 bp, Rattus norvegicus
gtgaacagcacagattccagcactg

SEQ ID NO: 500946 - DNA, 25 bp, Rattus norvegicus
gtgaacagcatgactgagctgagaa

SEQ ID NO: 500947 - DNA, 25 bp, Rattus norvegicus
gtgaacagcatgtctgagctgagaa

SEQ ID NO: 500948 - DNA, 25 bp, Rattus norvegicus
gtgaacagcccaagactgtaccaga

SEQ ID NO: 500949 - DNA, 25 bp, Rattus norvegicus
gtgaacagcccatgactgtaccaga

SEQ ID NO: 500950 - DNA, 25 bp, Rattus norvegicus
gtgaacagctgtccttttatgtatg

SEQ ID NO: 500951 - DNA, 25 bp, Rattus norvegicus
gtgaacagctgtgcttttatgtatg

SEQ ID NO: 500952 - DNA, 25 bp, Rattus norvegicus
gtgaacaggagtaagccagagcaac

SEQ ID NO: 500953 - DNA, 25 bp, Rattus norvegicus
gtgaacaggagttagccagagcaac

SEQ ID NO: 500954 - DNA, 25 bp, Rattus norvegicus
gtgaacaggtttacccatttcagga

SEQ ID NO: 500955 - DNA, 25 bp, Rattus norvegicus
gtgaacaggttttcccatttcagga

SEQ ID NO: 500956 - DNA, 25 bp, Rattus norvegicus
gtgaacagtgccctgaatcctgtga

SEQ ID NO: 500957 - DNA, 25 bp, Rattus norvegicus
gtgaacagtgccgtgaatcctgtga

SEQ ID NO: 500958 - DNA, 25 bp, Rattus norvegicus
gtgaacagttatattaggtagtgaa

SEQ ID NO: 500959 - DNA, 25 bp, Rattus norvegicus
gtgaacagttattttaggtagtgaa

SEQ ID NO: 500960 - DNA, 25 bp, Rattus norvegicus
gtgaacagttgactcctggtgtctg

SEQ ID NO: 500961 - DNA, 25 bp, Rattus norvegicus
gtgaacagttgagtcctggtgtctg

SEQ ID NO: 500962 - DNA, 25 bp, Rattus norvegicus
gtgaacagttgcagtcactaaagtt

SEQ ID NO: 500963 - DNA, 25 bp, Rattus norvegicus
gtgaacagttgctgtcactaaagtt

SEQ ID NO: 500964 - DNA, 25 bp, Rattus norvegicus
gtgaacagttgtatacatgtatcat

SEQ ID NO: 500965 - DNA, 25 bp, Rattus norvegicus
gtgaacagttgtttacatgtatcat

SEQ ID NO: 500966 - DNA, 25 bp, Rattus norvegicus
gtgaacagtttacctaatgtactac

SEQ ID NO: 500967 - DNA, 25 bp, Rattus norvegicus
gtgaacagtttagctaatgtactac

SEQ ID NO: 500968 - DNA, 25 bp, Rattus norvegicus
gtgaacatcatcaccgtgtacaagc

SEQ ID NO: 500969 - DNA, 25 bp, Rattus norvegicus
gtgaacatcatctccgtgtacaagc

SEQ ID NO: 500970 - DNA, 25 bp, Rattus norvegicus
gtgaacatcgatattctgtatcctt

SEQ ID NO: 500971 - DNA, 25 bp, Rattus norvegicus
gtgaacatcgattttctgtatcctt

SEQ ID NO: 500972 - DNA, 25 bp, Rattus norvegicus
gtgaacatctaccttggattactag

SEQ ID NO: 500973 - DNA, 25 bp, Rattus norvegicus
gtgaacatctacgttggattactag

SEQ ID NO: 500974 - DNA, 25 bp, Rattus norvegicus
gtgaacatctgactgggtccaagca

SEQ ID NO: 500975 - DNA, 25 bp, Rattus norvegicus
gtgaacatctgagtgggtccaagca

SEQ ID NO: 500976 - DNA, 25 bp, Rattus norvegicus
gtgaacatctttattcctatattac

SEQ ID NO: 500977 - DNA, 25 bp, Rattus norvegicus
gtgaacatcttttttcctatattac

SEQ ID NO: 500978 - DNA, 25 bp, Rattus norvegicus
gtgaacatgattctttccttcctta

SEQ ID NO: 500979 - DNA, 25 bp, Rattus norvegicus
gtgaacatgattgtttccttcctta

SEQ ID NO: 500980 - DNA, 25 bp, Rattus norvegicus
gtgaacatgtgaatctttccccaag

SEQ ID NO: 500981 - DNA, 25 bp, Rattus norvegicus
gtgaacatgtgattctttccccaag

SEQ ID NO: 500982 - DNA, 25 bp, Rattus norvegicus
gtgaacatgtgcagggcagatcttt

SEQ ID NO: 500983 - DNA, 25 bp, Rattus norvegicus
gtgaacatgtgctgggcagatcttt

SEQ ID NO: 500984 - DNA, 25 bp, Rattus norvegicus
gtgaacattcaactgaccgggcttg

SEQ ID NO: 500985 - DNA, 25 bp, Rattus norvegicus
gtgaacattcaagtgaccgggcttg

SEQ ID NO: 500986 - DNA, 25 bp, Rattus norvegicus
gtgaacattcagcatcttggtcaat

SEQ ID NO: 500987 - DNA, 25 bp, Rattus norvegicus
gtgaacattcaggatcttggtcaat

SEQ ID NO: 500988 - DNA, 25 bp, Rattus norvegicus
gtgaacattcccagcgttggttcag

SEQ ID NO: 500989 - DNA, 25 bp, Rattus norvegicus
gtgaacattccctgcgttggttcag

SEQ ID NO: 500990 - DNA, 25 bp, Rattus norvegicus
gtgaacattcttatccatgcactgt

SEQ ID NO: 500991 - DNA, 25 bp, Rattus norvegicus
gtgaacattcttttccatgcactgt

SEQ ID NO: 500992 - DNA, 25 bp, Rattus norvegicus
gtgaacattgaccataaaaccgttt

SEQ ID NO: 500993 - DNA, 25 bp, Rattus norvegicus
gtgaacattgacgataaaaccgttt

SEQ ID NO: 500994 - DNA, 25 bp, Rattus norvegicus
gtgaacatttggcagaccgtgtgat

SEQ ID NO: 500995 - DNA, 25 bp, Rattus norvegicus
gtgaacatttgggagaccgtgtgat

SEQ ID NO: 500996 - DNA, 25 bp, Rattus norvegicus
gtgaacattttcaaactgccttgtg

SEQ ID NO: 500997 - DNA, 25 bp, Rattus norvegicus
gtgaacattttctaactgccttgtg

SEQ ID NO: 500998 - DNA, 25 bp, Rattus norvegicus
gtgaacattttgaagcacttctgtg

SEQ ID NO: 500999 - DNA, 25 bp, Rattus norvegicus
gtgaacattttgtagcacttctgtg

SEQ ID NO: 501000 - DNA, 25 bp, Rattus norvegicus
gtgaaccaaaccagagtgagtcctc

SEQ ID NO: 501001 - DNA, 25 bp, Rattus norvegicus
gtgaaccaaacctgagtgagtcctc

SEQ ID NO: 501002 - DNA, 25 bp, Rattus norvegicus
gtgaaccaaccgcagtgaaccaagc

SEQ ID NO: 501003 - DNA, 25 bp, Rattus norvegicus
gtgaaccaaccggagtgaaccaagc

SEQ ID NO: 501004 - DNA, 25 bp, Rattus norvegicus
gtgaaccaatagaagcacttgtcgt

SEQ ID NO: 501005 - DNA, 25 bp, Rattus norvegicus
gtgaaccaatagtagcacttgtcgt

SEQ ID NO: 501006 - DNA, 25 bp, Rattus norvegicus
gtgaaccacaacacagttctgcctt

SEQ ID NO: 501007 - DNA, 25 bp, Rattus norvegicus
gtgaaccacaactcagttctgcctt

SEQ ID NO: 501008 - DNA, 25 bp, Rattus norvegicus
gtgaaccacagccatatatgcattc

SEQ ID NO: 501009 - DNA, 25 bp, Rattus norvegicus
gtgaaccacagcgatatatgcattc

SEQ ID NO: 501010 - DNA, 25 bp, Rattus norvegicus
gtgaaccaccacatactggcagatg

SEQ ID NO: 501011 - DNA, 25 bp, Rattus norvegicus
gtgaaccaccacttactggcagatg

SEQ ID NO: 501012 - DNA, 25 bp, Rattus norvegicus
gtgaaccacctcagggtctatttta

SEQ ID NO: 501013 - DNA, 25 bp, Rattus norvegicus
gtgaaccacctctgggtctatttta

SEQ ID NO: 501014 - DNA, 25 bp, Rattus norvegicus
gtgaaccactcaattttatgcaagt

SEQ ID NO: 501015 - DNA, 25 bp, Rattus norvegicus
gtgaaccactcatttttatgcaagt

SEQ ID NO: 501016 - DNA, 25 bp, Rattus norvegicus
gtgaaccaggctcacacagactctt

SEQ ID NO: 501017 - DNA, 25 bp, Rattus norvegicus
gtgaaccaggctgacacagactctt

SEQ ID NO: 501018 - DNA, 25 bp, Rattus norvegicus
gtgaaccatgtacttggacccctga

SEQ ID NO: 501019 - DNA, 25 bp, Rattus norvegicus
gtgaaccatgtagttggacccctga

SEQ ID NO: 501020 - DNA, 25 bp, Rattus norvegicus
gtgaaccattctcatttcaacctgt

SEQ ID NO: 501021 - DNA, 25 bp, Rattus norvegicus
gtgaaccattctgatttcaacctgt

SEQ ID NO: 501022 - DNA, 25 bp, Rattus norvegicus
gtgaacccaaccaagagcagcttcc

SEQ ID NO: 501023 - DNA, 25 bp, Rattus norvegicus
gtgaacccaacctagagcagcttcc

SEQ ID NO: 501024 - DNA, 25 bp, Rattus norvegicus
gtgaacccaactatggtgcgacata

SEQ ID NO: 501025 - DNA, 25 bp, Rattus norvegicus
gtgaacccaactttggtgcgacata

SEQ ID NO: 501026 - DNA, 25 bp, Rattus norvegicus
gtgaacccagggaccagacctatgg

SEQ ID NO: 501027 - DNA, 25 bp, Rattus norvegicus
gtgaacccagggtccagacctatgg

SEQ ID NO: 501028 - DNA, 25 bp, Rattus norvegicus
gtgaaccccactcctgctgatagag

SEQ ID NO: 501029 - DNA, 25 bp, Rattus norvegicus
gtgaaccccactgctgctgatagag

SEQ ID NO: 501030 - DNA, 25 bp, Rattus norvegicus
gtgaaccccatccacatattgggaa

SEQ ID NO: 501031 - DNA, 25 bp, Rattus norvegicus
gtgaaccccatcgacatattgggaa

SEQ ID NO: 501032 - DNA, 25 bp, Rattus norvegicus
gtgaaccccgcaaaaagctattctg

SEQ ID NO: 501033 - DNA, 25 bp, Rattus norvegicus
gtgaaccccgcataaagctattctg

SEQ ID NO: 501034 - DNA, 25 bp, Rattus norvegicus
gtgaaccccggaaagttgcatgttt

SEQ ID NO: 501035 - DNA, 25 bp, Rattus norvegicus
gtgaaccccggatagttgcatgttt

SEQ ID NO: 501036 - DNA, 25 bp, Rattus norvegicus
gtgaacccggtgaccacagaaaact

SEQ ID NO: 501037 - DNA, 25 bp, Rattus norvegicus
gtgaacccggtgtccacagaaaact

SEQ ID NO: 501038 - DNA, 25 bp, Rattus norvegicus
gtgaaccctttgatgattcagtcct

SEQ ID NO: 501039 - DNA, 25 bp, Rattus norvegicus
gtgaaccctttgttgattcagtcct

SEQ ID NO: 501040 - DNA, 25 bp, Rattus norvegicus
gtgaaccgagagataacaccggcgg

SEQ ID NO: 501041 - DNA, 25 bp, Rattus norvegicus
gtgaaccgagagttaacaccggcgg

SEQ ID NO: 501042 - DNA, 25 bp, Rattus norvegicus
gtgaaccgcaaacagcagaccgctg

SEQ ID NO: 501043 - DNA, 25 bp, Rattus norvegicus
gtgaaccgcaaagagcagaccgctg

SEQ ID NO: 501044 - DNA, 25 bp, Rattus norvegicus
gtgaaccgggtcattatctaccaag

SEQ ID NO: 501045 - DNA, 25 bp, Rattus norvegicus
gtgaaccgggtctttatctaccaag

SEQ ID NO: 501046 - DNA, 25 bp, Rattus norvegicus
gtgaacctcacgcaggccagagtgc

SEQ ID NO: 501047 - DNA, 25 bp, Rattus norvegicus
gtgaacctcacggaggccagagtgc

SEQ ID NO: 501048 - DNA, 25 bp, Rattus norvegicus
gtgaacctcatcacgctgagaagta

SEQ ID NO: 501049 - DNA, 25 bp, Rattus norvegicus
gtgaacctcatctcgctgagaagta

SEQ ID NO: 501050 - DNA, 25 bp, Rattus norvegicus
gtgaacctccagctcaagtggccga

SEQ ID NO: 501051 - DNA, 25 bp, Rattus norvegicus
gtgaacctccaggtcaagtggccga

SEQ ID NO: 501052 - DNA, 25 bp, Rattus norvegicus
gtgaacctccatcgtagaaaccaac

SEQ ID NO: 501053 - DNA, 25 bp, Rattus norvegicus
gtgaacctccatggtagaaaccaac

SEQ ID NO: 501054 - DNA, 25 bp, Rattus norvegicus
gtgaacctggtgacttttactcaaa

SEQ ID NO: 501055 - DNA, 25 bp, Rattus norvegicus
gtgaacctggtgtcttttactcaaa

SEQ ID NO: 501056 - DNA, 25 bp, Rattus norvegicus
gtgaacctgtgcaaaaaacccatga

SEQ ID NO: 501057 - DNA, 25 bp, Rattus norvegicus
gtgaacctgtgctaaaaacccatga

SEQ ID NO: 501058 - DNA, 25 bp, Rattus norvegicus
gtgaacctgttgaaactcaacccaa

SEQ ID NO: 501059 - DNA, 25 bp, Rattus norvegicus
gtgaacctgttgtaactcaacccaa

SEQ ID NO: 501060 - DNA, 25 bp, Rattus norvegicus
gtgaaccttttcagtgcttagtaat

SEQ ID NO: 501061 - DNA, 25 bp, Rattus norvegicus
gtgaaccttttctgtgcttagtaat

SEQ ID NO: 501062 - DNA, 25 bp, Rattus norvegicus
gtgaacgaagatctggtggcctcca

SEQ ID NO: 501063 - DNA, 25 bp, Rattus norvegicus
gtgaacgaagatgtggtggcctcca

SEQ ID NO: 501064 - DNA, 25 bp, Rattus norvegicus
gtgaacgacatgaggcccggctctc

SEQ ID NO: 501065 - DNA, 25 bp, Rattus norvegicus
gtgaacgacatgtggcccggctctc

SEQ ID NO: 501066 - DNA, 25 bp, Rattus norvegicus
gtgaacgacctgaaagctatctgca

SEQ ID NO: 501067 - DNA, 25 bp, Rattus norvegicus
gtgaacgacctgtaagctatctgca

SEQ ID NO: 501068 - DNA, 25 bp, Rattus norvegicus
gtgaacgactcacgcactgctgtca

SEQ ID NO: 501069 - DNA, 25 bp, Rattus norvegicus
gtgaacgactcaggcactgctgtca

SEQ ID NO: 501070 - DNA, 25 bp, Rattus norvegicus
gtgaacgactgactccagcagggtt

SEQ ID NO: 501071 - DNA, 25 bp, Rattus norvegicus
gtgaacgactgagtccagcagggtt

SEQ ID NO: 501072 - DNA, 25 bp, Rattus norvegicus
gtgaacgactggctgtgctcatgaa

SEQ ID NO: 501073 - DNA, 25 bp, Rattus norvegicus
gtgaacgactgggtgtgctcatgaa

SEQ ID NO: 501074 - DNA, 25 bp, Rattus norvegicus
gtgaacgagcatccctgctggccag

SEQ ID NO: 501075 - DNA, 25 bp, Rattus norvegicus
gtgaacgagcatgcctgctggccag

SEQ ID NO: 501076 - DNA, 25 bp, Rattus norvegicus
gtgaacgccatcaacgacaatgccg

SEQ ID NO: 501077 - DNA, 25 bp, Rattus norvegicus
gtgaacgccatctacgacaatgccg

SEQ ID NO: 501078 - DNA, 25 bp, Rattus norvegicus
gtgaacgctttaccattagacctgc

SEQ ID NO: 501079 - DNA, 25 bp, Rattus norvegicus
gtgaacgctttagcattagacctgc

SEQ ID NO: 501080 - DNA, 25 bp, Rattus norvegicus
gtgaacggagctcctgacctaagag

SEQ ID NO: 501081 - DNA, 25 bp, Rattus norvegicus
gtgaacggagctgctgacctaagag

SEQ ID NO: 501082 - DNA, 25 bp, Rattus norvegicus
gtgaacggattcaggattcgtccaa

SEQ ID NO: 501083 - DNA, 25 bp, Rattus norvegicus
gtgaacggattctggattcgtccaa

SEQ ID NO: 501084 - DNA, 25 bp, Rattus norvegicus
gtgaacggccctactggaacatgac

SEQ ID NO: 501085 - DNA, 25 bp, Rattus norvegicus
gtgaacggcccttctggaacatgac

SEQ ID NO: 501086 - DNA, 25 bp, Rattus norvegicus
gtgaacggcgtcatcctggaggaaa

SEQ ID NO: 501087 - DNA, 25 bp, Rattus norvegicus
gtgaacggcgtcttcctggaggaaa

SEQ ID NO: 501088 - DNA, 25 bp, Rattus norvegicus
gtgaacgtcaccaaaactcgaaccg

SEQ ID NO: 501089 - DNA, 25 bp, Rattus norvegicus
gtgaacgtcacctaaactcgaaccg

SEQ ID NO: 501090 - DNA, 25 bp, Rattus norvegicus
gtgaacgtcttactctttggttatg

SEQ ID NO: 501091 - DNA, 25 bp, Rattus norvegicus
gtgaacgtcttagtctttggttatg

SEQ ID NO: 501092 - DNA, 25 bp, Rattus norvegicus
gtgaacgtgccccagcctggaagtt

SEQ ID NO: 501093 - DNA, 25 bp, Rattus norvegicus
gtgaacgtgcccgagcctggaagtt

SEQ ID NO: 501094 - DNA, 25 bp, Rattus norvegicus
gtgaacgtggacaacagcaaactga

SEQ ID NO: 501095 - DNA, 25 bp, Rattus norvegicus
gtgaacgtggactacagcaaactga

SEQ ID NO: 501096 - DNA, 25 bp, Rattus norvegicus
gtgaacgtgtctagccgaaatcagt

SEQ ID NO: 501097 - DNA, 25 bp, Rattus norvegicus
gtgaacgtgtcttgccgaaatcagt

SEQ ID NO: 501098 - DNA, 25 bp, Rattus norvegicus
gtgaacgttttcatcagccctccca

SEQ ID NO: 501099 - DNA, 25 bp, Rattus norvegicus
gtgaacgttttcctgcaggcagaca

SEQ ID NO: 501100 - DNA, 25 bp, Rattus norvegicus
gtgaacgttttcgtgcaggcagaca

SEQ ID NO: 501101 - DNA, 25 bp, Rattus norvegicus
gtgaacgttttcttcagccctccca

SEQ ID NO: 501102 - DNA, 25 bp, Rattus norvegicus
gtgaactaagaacccacagggccca

SEQ ID NO: 501103 - DNA, 25 bp, Rattus norvegicus
gtgaactaagaagccacagggccca

SEQ ID NO: 501104 - DNA, 25 bp, Rattus norvegicus
gtgaactaccatccaggtcctagga

SEQ ID NO: 501105 - DNA, 25 bp, Rattus norvegicus
gtgaactaccatgcaggtcctagga

SEQ ID NO: 501106 - DNA, 25 bp, Rattus norvegicus
gtgaactacggtacttgccatttcc

SEQ ID NO: 501107 - DNA, 25 bp, Rattus norvegicus
gtgaactacggttcttgccatttcc

SEQ ID NO: 501108 - DNA, 25 bp, Rattus norvegicus
gtgaactagaggaataccgccgaga

SEQ ID NO: 501109 - DNA, 25 bp, Rattus norvegicus
gtgaactagaggtataccgccgaga

SEQ ID NO: 501110 - DNA, 25 bp, Rattus norvegicus
gtgaactaggtcatttacttccacg

SEQ ID NO: 501111 - DNA, 25 bp, Rattus norvegicus
gtgaactaggtcttttacttccacg

SEQ ID NO: 501112 - DNA, 25 bp, Rattus norvegicus
gtgaactataccacagccacaatgg

SEQ ID NO: 501113 - DNA, 25 bp, Rattus norvegicus
gtgaactatacctcagccacaatgg

SEQ ID NO: 501114 - DNA, 25 bp, Rattus norvegicus
gtgaactatatcatcaagacactgt

SEQ ID NO: 501115 - DNA, 25 bp, Rattus norvegicus
gtgaactatatcttcaagacactgt

SEQ ID NO: 501116 - DNA, 25 bp, Rattus norvegicus
gtgaactcacatatctgctctgtat

SEQ ID NO: 501117 - DNA, 25 bp, Rattus norvegicus
gtgaactcacatttctgctctgtat

SEQ ID NO: 501118 - DNA, 25 bp, Rattus norvegicus
gtgaactcagctcacaaccatttgt

SEQ ID NO: 501119 - DNA, 25 bp, Rattus norvegicus
gtgaactcagctgacaaccatttgt

SEQ ID NO: 501120 - DNA, 25 bp, Rattus norvegicus
gtgaactcagttaccctgttatgtc

SEQ ID NO: 501121 - DNA, 25 bp, Rattus norvegicus
gtgaactcagtttccctgttatgtc

SEQ ID NO: 501122 - DNA, 25 bp, Rattus norvegicus
gtgaactcattgattaaatgcttca

SEQ ID NO: 501123 - DNA, 25 bp, Rattus norvegicus
gtgaactcattgtttaaatgcttca

SEQ ID NO: 501124 - DNA, 25 bp, Rattus norvegicus
gtgaactccacacttcagagtcttt

SEQ ID NO: 501125 - DNA, 25 bp, Rattus norvegicus
gtgaactccacagttcagagtcttt

SEQ ID NO: 501126 - DNA, 25 bp, Rattus norvegicus
gtgaactccaccaaaggcctgacat

SEQ ID NO: 501127 - DNA, 25 bp, Rattus norvegicus
gtgaactccacctaaggcctgacat

SEQ ID NO: 501128 - DNA, 25 bp, Rattus norvegicus
gtgaactccaggacaaccttggcta

SEQ ID NO: 501129 - DNA, 25 bp, Rattus norvegicus
gtgaactccaggtcaaccttggcta

SEQ ID NO: 501130 - DNA, 25 bp, Rattus norvegicus
gtgaactccagtactgcttgtcccc

SEQ ID NO: 501131 - DNA, 25 bp, Rattus norvegicus
gtgaactccagttctgcttgtcccc

SEQ ID NO: 501132 - DNA, 25 bp, Rattus norvegicus
gtgaactccattcaggacactagct

SEQ ID NO: 501133 - DNA, 25 bp, Rattus norvegicus
gtgaactccattgaggacactagct

SEQ ID NO: 501134 - DNA, 25 bp, Rattus norvegicus
gtgaactcccctaagtcactggtac

SEQ ID NO: 501135 - DNA, 25 bp, Rattus norvegicus
gtgaactccccttagtcactggtac

SEQ ID NO: 501136 - DNA, 25 bp, Rattus norvegicus
gtgaactccggccagacgccaagac

SEQ ID NO: 501137 - DNA, 25 bp, Rattus norvegicus
gtgaactccggcgagacgccaagac

SEQ ID NO: 501138 - DNA, 25 bp, Rattus norvegicus
gtgaactccgtgatcagactaggaa

SEQ ID NO: 501139 - DNA, 25 bp, Rattus norvegicus
gtgaactccgtgttcagactaggaa

SEQ ID NO: 501140 - DNA, 25 bp, Rattus norvegicus
gtgaactcctcaacaaaatacctgg

SEQ ID NO: 501141 - DNA, 25 bp, Rattus norvegicus
gtgaactcctcatcaaaatacctgg

SEQ ID NO: 501142 - DNA, 25 bp, Rattus norvegicus
gtgaactctaccctttttcataggt

SEQ ID NO: 501143 - DNA, 25 bp, Rattus norvegicus
gtgaactctaccgtttttcataggt

SEQ ID NO: 501144 - DNA, 25 bp, Rattus norvegicus
gtgaactctatcattggtatacctt

SEQ ID NO: 501145 - DNA, 25 bp, Rattus norvegicus
gtgaactctatctttggtatacctt

SEQ ID NO: 501146 - DNA, 25 bp, Rattus norvegicus
gtgaactctcatatagaatggctgc

SEQ ID NO: 501147 - DNA, 25 bp, Rattus norvegicus
gtgaactctcatttagaatggctgc

SEQ ID NO: 501148 - DNA, 25 bp, Rattus norvegicus
gtgaactctcctatcttaattcggg

SEQ ID NO: 501149 - DNA, 25 bp, Rattus norvegicus
gtgaactctcctttcttaattcggg

SEQ ID NO: 501150 - DNA, 25 bp, Rattus norvegicus
gtgaactctgccctccagttaagtt

SEQ ID NO: 501151 - DNA, 25 bp, Rattus norvegicus
gtgaactctgccgtccagttaagtt

SEQ ID NO: 501152 - DNA, 25 bp, Rattus norvegicus
gtgaactgaacgacaaggccttggt

SEQ ID NO: 501153 - DNA, 25 bp, Rattus norvegicus
gtgaactgaacgtcaaggccttggt

SEQ ID NO: 501154 - DNA, 25 bp, Rattus norvegicus
gtgaactgaatgctgatttccagac

SEQ ID NO: 501155 - DNA, 25 bp, Rattus norvegicus
gtgaactgaatggtgatttccagac

SEQ ID NO: 501156 - DNA, 25 bp, Rattus norvegicus
gtgaactgacatctctaacatttgt

SEQ ID NO: 501157 - DNA, 25 bp, Rattus norvegicus
gtgaactgacatgtctaacatttgt

SEQ ID NO: 501158 - DNA, 25 bp, Rattus norvegicus
gtgaactgacccagcccatgggtgc

SEQ ID NO: 501159 - DNA, 25 bp, Rattus norvegicus
gtgaactgaccctgcccatgggtgc

SEQ ID NO: 501160 - DNA, 25 bp, Rattus norvegicus
gtgaactgagccactcatatcaacc

SEQ ID NO: 501161 - DNA, 25 bp, Rattus norvegicus
gtgaactgagcctctcatatcaacc

SEQ ID NO: 501162 - DNA, 25 bp, Rattus norvegicus
gtgaactggaacattacgacattgt

SEQ ID NO: 501163 - DNA, 25 bp, Rattus norvegicus
gtgaactggaactttacgacattgt

SEQ ID NO: 501164 - DNA, 25 bp, Rattus norvegicus
gtgaactgtcaactgcaatttgcaa

SEQ ID NO: 501165 - DNA, 25 bp, Rattus norvegicus
gtgaactgtcaagtgcaatttgcaa

SEQ ID NO: 501166 - DNA, 25 bp, Rattus norvegicus
gtgaactgtgcgaaactcagcggag

SEQ ID NO: 501167 - DNA, 25 bp, Rattus norvegicus
gtgaactgtgcgtaactcagcggag

SEQ ID NO: 501168 - DNA, 25 bp, Rattus norvegicus
gtgaactgtttcatgcttccttagc

SEQ ID NO: 501169 - DNA, 25 bp, Rattus norvegicus
gtgaactgtttcttgcttccttagc

SEQ ID NO: 501170 - DNA, 25 bp, Rattus norvegicus
gtgaacttaatcagctgtcccaact

SEQ ID NO: 501171 - DNA, 25 bp, Rattus norvegicus
gtgaacttaatctgctgtcccaact

SEQ ID NO: 501172 - DNA, 25 bp, Rattus norvegicus
gtgaacttatatatacgcttgtgat

SEQ ID NO: 501173 - DNA, 25 bp, Rattus norvegicus
gtgaacttatatttacgcttgtgat

SEQ ID NO: 501174 - DNA, 25 bp, Rattus norvegicus
gtgaacttatgccttttatatagat

SEQ ID NO: 501175 - DNA, 25 bp, Rattus norvegicus
gtgaacttatgcgttttatatagat

SEQ ID NO: 501176 - DNA, 25 bp, Rattus norvegicus
gtgaacttcagcagagactccaaga

SEQ ID NO: 501177 - DNA, 25 bp, Rattus norvegicus
gtgaacttcagctgagactccaaga

SEQ ID NO: 501178 - DNA, 25 bp, Rattus norvegicus
gtgaacttccttccctaatctaaat

SEQ ID NO: 501179 - DNA, 25 bp, Rattus norvegicus
gtgaacttccttgcctaatctaaat

SEQ ID NO: 501180 - DNA, 25 bp, Rattus norvegicus
gtgaacttgacccataaatctgaag

SEQ ID NO: 501181 - DNA, 25 bp, Rattus norvegicus
gtgaacttgaccgataaatctgaag

SEQ ID NO: 501182 - DNA, 25 bp, Rattus norvegicus
gtgaacttggcccacttggactctg

SEQ ID NO: 501183 - DNA, 25 bp, Rattus norvegicus
gtgaacttggccgacttggactctg

SEQ ID NO: 501184 - DNA, 25 bp, Rattus norvegicus
gtgaactttagccagaggattatta

SEQ ID NO: 501185 - DNA, 25 bp, Rattus norvegicus
gtgaactttagcgagaggattatta

SEQ ID NO: 501186 - DNA, 25 bp, Rattus norvegicus
gtgaactttcacattttgatgagca

SEQ ID NO: 501187 - DNA, 25 bp, Rattus norvegicus
gtgaactttcactttttgatgagca

SEQ ID NO: 501188 - DNA, 25 bp, Rattus norvegicus
gtgaactttggcactttttcattgg

SEQ ID NO: 501189 - DNA, 25 bp, Rattus norvegicus
gtgaactttggcatcctgtcaagat

SEQ ID NO: 501190 - DNA, 25 bp, Rattus norvegicus
gtgaactttggcatcgatcgctcaa

SEQ ID NO: 501191 - DNA, 25 bp, Rattus norvegicus
gtgaactttggctctttttcattgg

SEQ ID NO: 501192 - DNA, 25 bp, Rattus norvegicus
gtgaactttggcttcctgtcaagat

SEQ ID NO: 501193 - DNA, 25 bp, Rattus norvegicus
gtgaactttggcttcgatcgctcaa

SEQ ID NO: 501194 - DNA, 25 bp, Rattus norvegicus
gtgaactttggtaaccagcctctga

SEQ ID NO: 501195 - DNA, 25 bp, Rattus norvegicus
gtgaactttggttaccagcctctga

SEQ ID NO: 501196 - DNA, 25 bp, Rattus norvegicus
gtgaactttgtacaaactttgtcat

SEQ ID NO: 501197 - DNA, 25 bp, Rattus norvegicus
gtgaactttgtacccgaacgtgtta

SEQ ID NO: 501198 - DNA, 25 bp, Rattus norvegicus
gtgaactttgtagaaactttgtcat

SEQ ID NO: 501199 - DNA, 25 bp, Rattus norvegicus
gtgaactttgtagccgaacgtgtta

SEQ ID NO: 501200 - DNA, 25 bp, Rattus norvegicus
gtgaactttgtgaaccgtgtcttga

SEQ ID NO: 501201 - DNA, 25 bp, Rattus norvegicus
gtgaactttgtgtaccgtgtcttga

SEQ ID NO: 501202 - DNA, 25 bp, Rattus norvegicus
gtgaagaaagcacagccagctcctg

SEQ ID NO: 501203 - DNA, 25 bp, Rattus norvegicus
gtgaagaaagcagagccagctcctg

SEQ ID NO: 501204 - DNA, 25 bp, Rattus norvegicus
gtgaagaacgacctgactgctaaga

SEQ ID NO: 501205 - DNA, 25 bp, Rattus norvegicus
gtgaagaacgacgtgactgctaaga

SEQ ID NO: 501206 - DNA, 25 bp, Rattus norvegicus
gtgaagaactcaacccatcatatct

SEQ ID NO: 501207 - DNA, 25 bp, Rattus norvegicus
gtgaagaactcaccgactttcccaa

SEQ ID NO: 501208 - DNA, 25 bp, Rattus norvegicus
gtgaagaactcagcgactttcccaa

SEQ ID NO: 501209 - DNA, 25 bp, Rattus norvegicus
gtgaagaactcatcccatcatatct

SEQ ID NO: 501210 - DNA, 25 bp, Rattus norvegicus
gtgaagaactccagtgtgcaaacct

SEQ ID NO: 501211 - DNA, 25 bp, Rattus norvegicus
gtgaagaactcctgtgtgcaaacct

SEQ ID NO: 501212 - DNA, 25 bp, Rattus norvegicus
gtgaagaagaccagcaatctccctc

SEQ ID NO: 501213 - DNA, 25 bp, Rattus norvegicus
gtgaagaagacctgcaatctccctc

SEQ ID NO: 501214 - DNA, 25 bp, Rattus norvegicus
gtgaagaagccactatcatgatttt

SEQ ID NO: 501215 - DNA, 25 bp, Rattus norvegicus
gtgaagaagccagtatcatgatttt

SEQ ID NO: 501216 - DNA, 25 bp, Rattus norvegicus
gtgaagaagtggagcaccagtgcca

SEQ ID NO: 501217 - DNA, 25 bp, Rattus norvegicus
gtgaagaagtggtgcaccagtgcca

SEQ ID NO: 501218 - DNA, 25 bp, Rattus norvegicus
gtgaagaattataatcggatcctaa

SEQ ID NO: 501219 - DNA, 25 bp, Rattus norvegicus
gtgaagaattattatcggatcctaa

SEQ ID NO: 501220 - DNA, 25 bp, Rattus norvegicus
gtgaagaattgaatttatgtaacct

SEQ ID NO: 501221 - DNA, 25 bp, Rattus norvegicus
gtgaagaattgattttatgtaacct

SEQ ID NO: 501222 - DNA, 25 bp, Rattus norvegicus
gtgaagacaaacaggctatacgcat

SEQ ID NO: 501223 - DNA, 25 bp, Rattus norvegicus
gtgaagacaaactggctatacgcat

SEQ ID NO: 501224 - DNA, 25 bp, Rattus norvegicus
gtgaagacacaacttttctccctat

SEQ ID NO: 501225 - DNA, 25 bp, Rattus norvegicus
gtgaagacacaagttttctccctat

SEQ ID NO: 501226 - DNA, 25 bp, Rattus norvegicus
gtgaagacactacgcaaacactggt

SEQ ID NO: 501227 - DNA, 25 bp, Rattus norvegicus
gtgaagacactaggcaaacactggt

SEQ ID NO: 501228 - DNA, 25 bp, Rattus norvegicus
gtgaagacagatccttcccctgaag

SEQ ID NO: 501229 - DNA, 25 bp, Rattus norvegicus
gtgaagacagatgcttcccctgaag

SEQ ID NO: 501230 - DNA, 25 bp, Rattus norvegicus
gtgaagacaggaacccgtgcttaaa

SEQ ID NO: 501231 - DNA, 25 bp, Rattus norvegicus
gtgaagacaggatcccgtgcttaaa

SEQ ID NO: 501232 - DNA, 25 bp, Rattus norvegicus
gtgaagaccaaacgcctcctccagt

SEQ ID NO: 501233 - DNA, 25 bp, Rattus norvegicus
gtgaagaccaaaggcctcctccagt

SEQ ID NO: 501234 - DNA, 25 bp, Rattus norvegicus
gtgaagaccattcccaatgaactct

SEQ ID NO: 501235 - DNA, 25 bp, Rattus norvegicus
gtgaagaccattgccaatgaactct

SEQ ID NO: 501236 - DNA, 25 bp, Rattus norvegicus
gtgaagaccctaactggtacacttg

SEQ ID NO: 501237 - DNA, 25 bp, Rattus norvegicus
gtgaagaccctatctggtacacttg

SEQ ID NO: 501238 - DNA, 25 bp, Rattus norvegicus
gtgaagacccttcaaaggacagtgg

SEQ ID NO: 501239 - DNA, 25 bp, Rattus norvegicus
gtgaagacccttgaaaggacagtgg

SEQ ID NO: 501240 - DNA, 25 bp, Rattus norvegicus
gtgaagacctatattagcactgaat

SEQ ID NO: 501241 - DNA, 25 bp, Rattus norvegicus
gtgaagacctattttagcactgaat

SEQ ID NO: 501242 - DNA, 25 bp, Rattus norvegicus
gtgaagactccaagatccagcagat

SEQ ID NO: 501243 - DNA, 25 bp, Rattus norvegicus
gtgaagactccatgatccagcagat

SEQ ID NO: 501244 - DNA, 25 bp, Rattus norvegicus
gtgaagactgagaccccactaggga

SEQ ID NO: 501245 - DNA, 25 bp, Rattus norvegicus
gtgaagactgagtccccactaggga

SEQ ID NO: 501246 - DNA, 25 bp, Rattus norvegicus
gtgaagacttcccacgcgtcgaatg

SEQ ID NO: 501247 - DNA, 25 bp, Rattus norvegicus
gtgaagacttccgacgcgtcgaatg

SEQ ID NO: 501248 - DNA, 25 bp, Rattus norvegicus
gtgaagacttgtatcttgtggcatt

SEQ ID NO: 501249 - DNA, 25 bp, Rattus norvegicus
gtgaagacttgtttcttgtggcatt

SEQ ID NO: 501250 - DNA, 25 bp, Rattus norvegicus
gtgaagagaagcctgacagagactt

SEQ ID NO: 501251 - DNA, 25 bp, Rattus norvegicus
gtgaagagaagcgtgacagagactt

SEQ ID NO: 501252 - DNA, 25 bp, Rattus norvegicus
gtgaagagccgcagtgctcacatga

SEQ ID NO: 501253 - DNA, 25 bp, Rattus norvegicus
gtgaagagccgctgtgctcacatga

SEQ ID NO: 501254 - DNA, 25 bp, Rattus norvegicus
gtgaagagcctgactgagatacgct

SEQ ID NO: 501255 - DNA, 25 bp, Rattus norvegicus
gtgaagagcctgtctgagatacgct

SEQ ID NO: 501256 - DNA, 25 bp, Rattus norvegicus
gtgaagagcgaccattacctgccgt

SEQ ID NO: 501257 - DNA, 25 bp, Rattus norvegicus
gtgaagagcgacgattacctgccgt

SEQ ID NO: 501258 - DNA, 25 bp, Rattus norvegicus
gtgaagagctgcagagccacgcctt

SEQ ID NO: 501259 - DNA, 25 bp, Rattus norvegicus
gtgaagagctgctgagccacgcctt

SEQ ID NO: 501260 - DNA, 25 bp, Rattus norvegicus
gtgaagagtcccaagaccgctgtgg

SEQ ID NO: 501261 - DNA, 25 bp, Rattus norvegicus
gtgaagagtcccagcttccagaaat

SEQ ID NO: 501262 - DNA, 25 bp, Rattus norvegicus
gtgaagagtccctagaccgctgtgg

SEQ ID NO: 501263 - DNA, 25 bp, Rattus norvegicus
gtgaagagtccctgcttccagaaat

SEQ ID NO: 501264 - DNA, 25 bp, Rattus norvegicus
gtgaagatatctcctgtagaagaga

SEQ ID NO: 501265 - DNA, 25 bp, Rattus norvegicus
gtgaagatatctgctgtagaagaga

SEQ ID NO: 501266 - DNA, 25 bp, Rattus norvegicus
gtgaagatcaaaaccctctcattct

SEQ ID NO: 501267 - DNA, 25 bp, Rattus norvegicus
gtgaagatcaaatccctctcattct

SEQ ID NO: 501268 - DNA, 25 bp, Rattus norvegicus
gtgaagatcactatccagtaatggg

SEQ ID NO: 501269 - DNA, 25 bp, Rattus norvegicus
gtgaagatcactttccagtaatggg

SEQ ID NO: 501270 - DNA, 25 bp, Rattus norvegicus
gtgaagatcgcccaactgcacagtt

SEQ ID NO: 501271 - DNA, 25 bp, Rattus norvegicus
gtgaagatcgccgaactgcacagtt

SEQ ID NO: 501272 - DNA, 25 bp, Rattus norvegicus
gtgaagatcgtcactgccaagaacc

SEQ ID NO: 501273 - DNA, 25 bp, Rattus norvegicus
gtgaagatcgtctctgccaagaacc

SEQ ID NO: 501274 - DNA, 25 bp, Rattus norvegicus
gtgaagatcttcaaagtctggctct

SEQ ID NO: 501275 - DNA, 25 bp, Rattus norvegicus
gtgaagatcttcataaaacaaacaa

SEQ ID NO: 501276 - DNA, 25 bp, Rattus norvegicus
gtgaagatcttctaagtctggctct

SEQ ID NO: 501277 - DNA, 25 bp, Rattus norvegicus
gtgaagatcttcttaaaacaaacaa

SEQ ID NO: 501278 - DNA, 25 bp, Rattus norvegicus
gtgaagatcttgcagaaacttataa

SEQ ID NO: 501279 - DNA, 25 bp, Rattus norvegicus
gtgaagatcttggagaaacttataa

SEQ ID NO: 501280 - DNA, 25 bp, Rattus norvegicus
gtgaagatggcaagactctgtctgg

SEQ ID NO: 501281 - DNA, 25 bp, Rattus norvegicus
gtgaagatggcatgactctgtctgg

SEQ ID NO: 501282 - DNA, 25 bp, Rattus norvegicus
gtgaagatggctacgggccccacga

SEQ ID NO: 501283 - DNA, 25 bp, Rattus norvegicus
gtgaagatggcttcgggccccacga

SEQ ID NO: 501284 - DNA, 25 bp, Rattus norvegicus
gtgaagatggtcagagcctctccca

SEQ ID NO: 501285 - DNA, 25 bp, Rattus norvegicus
gtgaagatggtctgagcctctccca

SEQ ID NO: 501286 - DNA, 25 bp, Rattus norvegicus
gtgaagattcctaacctgacttaat

SEQ ID NO: 501287 - DNA, 25 bp, Rattus norvegicus
gtgaagattccttacctgacttaat

SEQ ID NO: 501288 - DNA, 25 bp, Rattus norvegicus
gtgaagattcgaaagcatctgcttt

SEQ ID NO: 501289 - DNA, 25 bp, Rattus norvegicus
gtgaagattcgatagcatctgcttt

SEQ ID NO: 501290 - DNA, 25 bp, Rattus norvegicus
gtgaagattgttcgccttgtcaaga

SEQ ID NO: 501291 - DNA, 25 bp, Rattus norvegicus
gtgaagattgttggccttgtcaaga

SEQ ID NO: 501292 - DNA, 25 bp, Rattus norvegicus
gtgaagcaaaccagtagccatcttt

SEQ ID NO: 501293 - DNA, 25 bp, Rattus norvegicus
gtgaagcaaacctgtagccatcttt

SEQ ID NO: 501294 - DNA, 25 bp, Rattus norvegicus
gtgaagcaaagcaactcccactttt

SEQ ID NO: 501295 - DNA, 25 bp, Rattus norvegicus
gtgaagcaaagctactcccactttt

SEQ ID NO: 501296 - DNA, 25 bp, Rattus norvegicus
gtgaagcacaacagcaggtcctacg

SEQ ID NO: 501297 - DNA, 25 bp, Rattus norvegicus
gtgaagcacaactgcaggtcctacg

SEQ ID NO: 501298 - DNA, 25 bp, Rattus norvegicus
gtgaagcaccatctcttcagctggg

SEQ ID NO: 501299 - DNA, 25 bp, Rattus norvegicus
gtgaagcaccatgtcttcagctggg

SEQ ID NO: 501300 - DNA, 25 bp, Rattus norvegicus
gtgaagcaccgtctctcaaagtgtg

SEQ ID NO: 501301 - DNA, 25 bp, Rattus norvegicus
gtgaagcaccgtgtctcaaagtgtg

SEQ ID NO: 501302 - DNA, 25 bp, Rattus norvegicus
gtgaagcaccttacggatgctggaa

SEQ ID NO: 501303 - DNA, 25 bp, Rattus norvegicus
gtgaagcacctttcggatgctggaa

SEQ ID NO: 501304 - DNA, 25 bp, Rattus norvegicus
gtgaagcacggtcgttactccagtg

SEQ ID NO: 501305 - DNA, 25 bp, Rattus norvegicus
gtgaagcacggtggttactccagtg

SEQ ID NO: 501306 - DNA, 25 bp, Rattus norvegicus
gtgaagcactggacggtgttcccat

SEQ ID NO: 501307 - DNA, 25 bp, Rattus norvegicus
gtgaagcactggtcggtgttcccat

SEQ ID NO: 501308 - DNA, 25 bp, Rattus norvegicus
gtgaagcagagcatcgtctgcgacc

SEQ ID NO: 501309 - DNA, 25 bp, Rattus norvegicus
gtgaagcagagcttcgtctgcgacc

SEQ ID NO: 501310 - DNA, 25 bp, Rattus norvegicus
gtgaagcagctacactgtttccgtg

SEQ ID NO: 501311 - DNA, 25 bp, Rattus norvegicus
gtgaagcagctagactgtttccgtg

SEQ ID NO: 501312 - DNA, 25 bp, Rattus norvegicus
gtgaagcattctctttttacatttt

SEQ ID NO: 501313 - DNA, 25 bp, Rattus norvegicus
gtgaagcattctgtttttacatttt

SEQ ID NO: 501314 - DNA, 25 bp, Rattus norvegicus
gtgaagccaaagaaactgcgtacaa

SEQ ID NO: 501315 - DNA, 25 bp, Rattus norvegicus
gtgaagccaaagtaactgcgtacaa

SEQ ID NO: 501316 - DNA, 25 bp, Rattus norvegicus
gtgaagccaagccaaacagaagcag

SEQ ID NO: 501317 - DNA, 25 bp, Rattus norvegicus
gtgaagccaagcgaaacagaagcag

SEQ ID NO: 501318 - DNA, 25 bp, Rattus norvegicus
gtgaagccacagaacctcattttaa

SEQ ID NO: 501319 - DNA, 25 bp, Rattus norvegicus
gtgaagccacagtacctcattttaa

SEQ ID NO: 501320 - DNA, 25 bp, Rattus norvegicus
gtgaagccacatattccaacatgag

SEQ ID NO: 501321 - DNA, 25 bp, Rattus norvegicus
gtgaagccacattttccaacatgag

SEQ ID NO: 501322 - DNA, 25 bp, Rattus norvegicus
gtgaagcccatccaggacatccaag

SEQ ID NO: 501323 - DNA, 25 bp, Rattus norvegicus
gtgaagcccatcgaggacatccaag

SEQ ID NO: 501324 - DNA, 25 bp, Rattus norvegicus
gtgaagccgacacaggacaactgag

SEQ ID NO: 501325 - DNA, 25 bp, Rattus norvegicus
gtgaagccgacagaggacaactgag

SEQ ID NO: 501326 - DNA, 25 bp, Rattus norvegicus
gtgaagccgccaagagttgactcca

SEQ ID NO: 501327 - DNA, 25 bp, Rattus norvegicus
gtgaagccgccatgagttgactcca

SEQ ID NO: 501328 - DNA, 25 bp, Rattus norvegicus
gtgaagcctaagacccacacagtag

SEQ ID NO: 501329 - DNA, 25 bp, Rattus norvegicus
gtgaagcctaagtcccacacagtag

SEQ ID NO: 501330 - DNA, 25 bp, Rattus norvegicus
gtgaagcctatacatctgttgatgg

SEQ ID NO: 501331 - DNA, 25 bp, Rattus norvegicus
gtgaagcctatagatctgttgatgg

SEQ ID NO: 501332 - DNA, 25 bp, Rattus norvegicus
gtgaagcctgaacctgtgtccacac

SEQ ID NO: 501333 - DNA, 25 bp, Rattus norvegicus
gtgaagcctgaagctgtgtccacac

SEQ ID NO: 501334 - DNA, 25 bp, Rattus norvegicus
gtgaagcctgcccagggagaacaca

SEQ ID NO: 501335 - DNA, 25 bp, Rattus norvegicus
gtgaagcctgccgagggagaacaca

SEQ ID NO: 501336 - DNA, 25 bp, Rattus norvegicus
gtgaagcctgttacatacacgcttg

SEQ ID NO: 501337 - DNA, 25 bp, Rattus norvegicus
gtgaagcctgtttcatacacgcttg

SEQ ID NO: 501338 - DNA, 25 bp, Rattus norvegicus
gtgaagcgaactaaacgctcgggca

SEQ ID NO: 501339 - DNA, 25 bp, Rattus norvegicus
gtgaagcgaacttaacgctcgggca

SEQ ID NO: 501340 - DNA, 25 bp, Rattus norvegicus
gtgaagctaaccatttaccttgttt

SEQ ID NO: 501341 - DNA, 25 bp, Rattus norvegicus
gtgaagctaaccttttaccttgttt

SEQ ID NO: 501342 - DNA, 25 bp, Rattus norvegicus
gtgaagctaagtatgtccgcgtaag

SEQ ID NO: 501343 - DNA, 25 bp, Rattus norvegicus
gtgaagctaagtttgtccgcgtaag

SEQ ID NO: 501344 - DNA, 25 bp, Rattus norvegicus
gtgaagctactcctcgctggcttta

SEQ ID NO: 501345 - DNA, 25 bp, Rattus norvegicus
gtgaagctactcgtcgctggcttta

SEQ ID NO: 501346 - DNA, 25 bp, Rattus norvegicus
gtgaagctacttatttcttactttt

SEQ ID NO: 501347 - DNA, 25 bp, Rattus norvegicus
gtgaagctacttttttcttactttt

SEQ ID NO: 501348 - DNA, 25 bp, Rattus norvegicus
gtgaagctcaaacatgcttacgcta

SEQ ID NO: 501349 - DNA, 25 bp, Rattus norvegicus
gtgaagctcaaagatgcttacgcta

SEQ ID NO: 501350 - DNA, 25 bp, Rattus norvegicus
gtgaagctcaagcaggcccttctca

SEQ ID NO: 501351 - DNA, 25 bp, Rattus norvegicus
gtgaagctcaaggaggcccttctca

SEQ ID NO: 501352 - DNA, 25 bp, Rattus norvegicus
gtgaagctcccaaatcctcaggtat

SEQ ID NO: 501353 - DNA, 25 bp, Rattus norvegicus
gtgaagctcccatatcctcaggtat

SEQ ID NO: 501354 - DNA, 25 bp, Rattus norvegicus
gtgaagctcttcagtttccatacta

SEQ ID NO: 501355 - DNA, 25 bp, Rattus norvegicus
gtgaagctcttctgtttccatacta

SEQ ID NO: 501356 - DNA, 25 bp, Rattus norvegicus
gtgaagctgaccagaacacaagcaa

SEQ ID NO: 501357 - DNA, 25 bp, Rattus norvegicus
gtgaagctgacctgaacacaagcaa

SEQ ID NO: 501358 - DNA, 25 bp, Rattus norvegicus
gtgaagctgacgaggccaacagtgt

SEQ ID NO: 501359 - DNA, 25 bp, Rattus norvegicus
gtgaagctgacgtggccaacagtgt

SEQ ID NO: 501360 - DNA, 25 bp, Rattus norvegicus
gtgaagctgccacgtgagaactttt

SEQ ID NO: 501361 - DNA, 25 bp, Rattus norvegicus
gtgaagctgccaggtgagaactttt

SEQ ID NO: 501362 - DNA, 25 bp, Rattus norvegicus
gtgaagctgcctaaatagaagtcta

SEQ ID NO: 501363 - DNA, 25 bp, Rattus norvegicus
gtgaagctgcctccggtggattcct

SEQ ID NO: 501364 - DNA, 25 bp, Rattus norvegicus
gtgaagctgcctgcggtggattcct

SEQ ID NO: 501365 - DNA, 25 bp, Rattus norvegicus
gtgaagctgccttaatagaagtcta

SEQ ID NO: 501366 - DNA, 25 bp, Rattus norvegicus
gtgaagctggagagcaacttcgcct

SEQ ID NO: 501367 - DNA, 25 bp, Rattus norvegicus
gtgaagctggagtgcaacttcgcct

SEQ ID NO: 501368 - DNA, 25 bp, Rattus norvegicus
gtgaagctggcccagttcattgaaa

SEQ ID NO: 501369 - DNA, 25 bp, Rattus norvegicus
gtgaagctggccgagttcattgaaa

SEQ ID NO: 501370 - DNA, 25 bp, Rattus norvegicus
gtgaagctgggcacctagggccact

SEQ ID NO: 501371 - DNA, 25 bp, Rattus norvegicus
gtgaagctgggctcctagggccact

SEQ ID NO: 501372 - DNA, 25 bp, Rattus norvegicus
gtgaagctggtcaacttcatccgaa

SEQ ID NO: 501373 - DNA, 25 bp, Rattus norvegicus
gtgaagctggtctacttcatccgaa

SEQ ID NO: 501374 - DNA, 25 bp, Rattus norvegicus
gtgaagctgtccctgtacaacgagt

SEQ ID NO: 501375 - DNA, 25 bp, Rattus norvegicus
gtgaagctgtccgtgtacaacgagt

SEQ ID NO: 501376 - DNA, 25 bp, Rattus norvegicus
gtgaagctgtggagagcctgtctct

SEQ ID NO: 501377 - DNA, 25 bp, Rattus norvegicus
gtgaagctgtggtgagcctgtctct

SEQ ID NO: 501378 - DNA, 25 bp, Rattus norvegicus
gtgaagctgttcaccaaagacttgc

SEQ ID NO: 501379 - DNA, 25 bp, Rattus norvegicus
gtgaagctgttctccaaagacttgc

SEQ ID NO: 501380 - DNA, 25 bp, Rattus norvegicus
gtgaagctgtttcactctgacccca

SEQ ID NO: 501381 - DNA, 25 bp, Rattus norvegicus
gtgaagctgtttgactctgacccca

SEQ ID NO: 501382 - DNA, 25 bp, Rattus norvegicus
gtgaagcttataagtatctccaaac

SEQ ID NO: 501383 - DNA, 25 bp, Rattus norvegicus
gtgaagcttatatgtatctccaaac

SEQ ID NO: 501384 - DNA, 25 bp, Rattus norvegicus
gtgaagcttcttattgacctgccaa

SEQ ID NO: 501385 - DNA, 25 bp, Rattus norvegicus
gtgaagcttctttttgacctgccaa

SEQ ID NO: 501386 - DNA, 25 bp, Rattus norvegicus
gtgaagcttgttacctggtacgaca

SEQ ID NO: 501387 - DNA, 25 bp, Rattus norvegicus
gtgaagcttgtttcctggtacgaca

SEQ ID NO: 501388 - DNA, 25 bp, Rattus norvegicus
gtgaagctttctacgtacacttctt

SEQ ID NO: 501389 - DNA, 25 bp, Rattus norvegicus
gtgaagctttcttcgtacacttctt

SEQ ID NO: 501390 - DNA, 25 bp, Rattus norvegicus
gtgaaggaacccaacctgacagtaa

SEQ ID NO: 501391 - DNA, 25 bp, Rattus norvegicus
gtgaaggaaccctacctgacagtaa

SEQ ID NO: 501392 - DNA, 25 bp, Rattus norvegicus
gtgaaggacaccacatagcctgcat

SEQ ID NO: 501393 - DNA, 25 bp, Rattus norvegicus
gtgaaggacacctcatagcctgcat

SEQ ID NO: 501394 - DNA, 25 bp, Rattus norvegicus
gtgaaggaccaaaaccgtgtgataa

SEQ ID NO: 501395 - DNA, 25 bp, Rattus norvegicus
gtgaaggaccaataccgtgtgataa

SEQ ID NO: 501396 - DNA, 25 bp, Rattus norvegicus
gtgaaggagaggctcacctccccta

SEQ ID NO: 501397 - DNA, 25 bp, Rattus norvegicus
gtgaaggagagggtcacctccccta

SEQ ID NO: 501398 - DNA, 25 bp, Rattus norvegicus
gtgaaggagcttaactcgcgactgt

SEQ ID NO: 501399 - DNA, 25 bp, Rattus norvegicus
gtgaaggagctttactcgcgactgt

SEQ ID NO: 501400 - DNA, 25 bp, Rattus norvegicus
gtgaaggaggccactcagcatgaga

SEQ ID NO: 501401 - DNA, 25 bp, Rattus norvegicus
gtgaaggaggcctctcagcatgaga

SEQ ID NO: 501402 - DNA, 25 bp, Rattus norvegicus
gtgaaggagttcaactggacctcaa

SEQ ID NO: 501403 - DNA, 25 bp, Rattus norvegicus
gtgaaggagttctactggacctcaa

SEQ ID NO: 501404 - DNA, 25 bp, Rattus norvegicus
gtgaaggatgccactctgggtgttc

SEQ ID NO: 501405 - DNA, 25 bp, Rattus norvegicus
gtgaaggatgcctctctgggtgttc

SEQ ID NO: 501406 - DNA, 25 bp, Rattus norvegicus
gtgaaggatgtaactcagctttctg

SEQ ID NO: 501407 - DNA, 25 bp, Rattus norvegicus
gtgaaggatgtatctcagctttctg

SEQ ID NO: 501408 - DNA, 25 bp, Rattus norvegicus
gtgaaggcacagacctgagacccag

SEQ ID NO: 501409 - DNA, 25 bp, Rattus norvegicus
gtgaaggcacagtcctgagacccag

SEQ ID NO: 501410 - DNA, 25 bp, Rattus norvegicus
gtgaaggcaccacaacagtgtccct

SEQ ID NO: 501411 - DNA, 25 bp, Rattus norvegicus
gtgaaggcaccagaacagtgtccct

SEQ ID NO: 501412 - DNA, 25 bp, Rattus norvegicus
gtgaaggcacccagaaacctcggga

SEQ ID NO: 501413 - DNA, 25 bp, Rattus norvegicus
gtgaaggcacccatctgaaattaag

SEQ ID NO: 501414 - DNA, 25 bp, Rattus norvegicus
gtgaaggcaccctgaaacctcggga

SEQ ID NO: 501415 - DNA, 25 bp, Rattus norvegicus
gtgaaggcacccttctgaaattaag

SEQ ID NO: 501416 - DNA, 25 bp, Rattus norvegicus
gtgaaggccacactgtcactgggca

SEQ ID NO: 501417 - DNA, 25 bp, Rattus norvegicus
gtgaaggccacagtgtcactgggca

SEQ ID NO: 501418 - DNA, 25 bp, Rattus norvegicus
gtgaaggccaccaagcatggattat

SEQ ID NO: 501419 - DNA, 25 bp, Rattus norvegicus
gtgaaggccacccaccagtactgcg

SEQ ID NO: 501420 - DNA, 25 bp, Rattus norvegicus
gtgaaggccaccgaccagtactgcg

SEQ ID NO: 501421 - DNA, 25 bp, Rattus norvegicus
gtgaaggccacctagcatggattat

SEQ ID NO: 501422 - DNA, 25 bp, Rattus norvegicus
gtgaaggcccagactctcttagaaa

SEQ ID NO: 501423 - DNA, 25 bp, Rattus norvegicus
gtgaaggcccagtctctcttagaaa

SEQ ID NO: 501424 - DNA, 25 bp, Rattus norvegicus
gtgaaggcccatcttatctacatat

SEQ ID NO: 501425 - DNA, 25 bp, Rattus norvegicus
gtgaaggcccatgttatctacatat

SEQ ID NO: 501426 - DNA, 25 bp, Rattus norvegicus
gtgaaggcctatcatctcagcactc

SEQ ID NO: 501427 - DNA, 25 bp, Rattus norvegicus
gtgaaggcctatgatctcagcactc

SEQ ID NO: 501428 - DNA, 25 bp, Rattus norvegicus
gtgaaggcctttctaactgtctcga

SEQ ID NO: 501429 - DNA, 25 bp, Rattus norvegicus
gtgaaggcctttgtaactgtctcga

SEQ ID NO: 501430 - DNA, 25 bp, Rattus norvegicus
gtgaaggctctcagagacgctcgct

SEQ ID NO: 501431 - DNA, 25 bp, Rattus norvegicus
gtgaaggctctctgagacgctcgct

SEQ ID NO: 501432 - DNA, 25 bp, Rattus norvegicus
gtgaaggctgtcagcccagagaaat

SEQ ID NO: 501433 - DNA, 25 bp, Rattus norvegicus
gtgaaggctgtctgcccagagaaat

SEQ ID NO: 501434 - DNA, 25 bp, Rattus norvegicus
gtgaaggctgtgctggcctcttctc

SEQ ID NO: 501435 - DNA, 25 bp, Rattus norvegicus
gtgaaggctgtggtggcctcttctc

SEQ ID NO: 501436 - DNA, 25 bp, Rattus norvegicus
gtgaagggcaccctggtactaccaa

SEQ ID NO: 501437 - DNA, 25 bp, Rattus norvegicus
gtgaagggcaccgtggtactaccaa

SEQ ID NO: 501438 - DNA, 25 bp, Rattus norvegicus
gtgaagggtacgagtatcaatccat

SEQ ID NO: 501439 - DNA, 25 bp, Rattus norvegicus
gtgaagggtacgtgtatcaatccat

SEQ ID NO: 501440 - DNA, 25 bp, Rattus norvegicus
gtgaagggtggtcctttgacaaaca

SEQ ID NO: 501441 - DNA, 25 bp, Rattus norvegicus
gtgaagggtggtgctttgacaaaca

SEQ ID NO: 501442 - DNA, 25 bp, Rattus norvegicus
gtgaaggtcaagaaccccaaactca

SEQ ID NO: 501443 - DNA, 25 bp, Rattus norvegicus
gtgaaggtcaagtaccccaaactca

SEQ ID NO: 501444 - DNA, 25 bp, Rattus norvegicus
gtgaaggtccccaggagagcactag

SEQ ID NO: 501445 - DNA, 25 bp, Rattus norvegicus
gtgaaggtcccctggagagcactag

SEQ ID NO: 501446 - DNA, 25 bp, Rattus norvegicus
gtgaaggtcctgctgccctagaaaa

SEQ ID NO: 501447 - DNA, 25 bp, Rattus norvegicus
gtgaaggtcctggtgccctagaaaa

SEQ ID NO: 501448 - DNA, 25 bp, Rattus norvegicus
gtgaaggtcttactctcacagagga

SEQ ID NO: 501449 - DNA, 25 bp, Rattus norvegicus
gtgaaggtcttagtctcacagagga

SEQ ID NO: 501450 - DNA, 25 bp, Rattus norvegicus
gtgaaggttagaagacccgtgccct

SEQ ID NO: 501451 - DNA, 25 bp, Rattus norvegicus
gtgaaggttagatgacccgtgccct

SEQ ID NO: 501452 - DNA, 25 bp, Rattus norvegicus
gtgaaggttcctaactcaatgacaa

SEQ ID NO: 501453 - DNA, 25 bp, Rattus norvegicus
gtgaaggttccttactcaatgacaa

SEQ ID NO: 501454 - DNA, 25 bp, Rattus norvegicus
gtgaaggttttaatgtgcccggttg

SEQ ID NO: 501455 - DNA, 25 bp, Rattus norvegicus
gtgaaggttttattgtgcccggttg

SEQ ID NO: 501456 - DNA, 25 bp, Rattus norvegicus
gtgaaggttttcacccgtgcaaggg

SEQ ID NO: 501457 - DNA, 25 bp, Rattus norvegicus
gtgaaggttttctcccgtgcaaggg

SEQ ID NO: 501458 - DNA, 25 bp, Rattus norvegicus
gtgaagtaagttcttcctggccctt

SEQ ID NO: 501459 - DNA, 25 bp, Rattus norvegicus
gtgaagtaagttgttcctggccctt

SEQ ID NO: 501460 - DNA, 25 bp, Rattus norvegicus
gtgaagtaatttaccttgccaaaca

SEQ ID NO: 501461 - DNA, 25 bp, Rattus norvegicus
gtgaagtaattttccttgccaaaca

SEQ ID NO: 501462 - DNA, 25 bp, Rattus norvegicus
gtgaagtacaccatataccggacca

SEQ ID NO: 501463 - DNA, 25 bp, Rattus norvegicus
gtgaagtacaccttataccggacca

SEQ ID NO: 501464 - DNA, 25 bp, Rattus norvegicus
gtgaagtacataattctctttgcaa

SEQ ID NO: 501465 - DNA, 25 bp, Rattus norvegicus
gtgaagtacatatttctctttgcaa

SEQ ID NO: 501466 - DNA, 25 bp, Rattus norvegicus
gtgaagtactccaccgcgaagtcga

SEQ ID NO: 501467 - DNA, 25 bp, Rattus norvegicus
gtgaagtactcctccgcgaagtcga

SEQ ID NO: 501468 - DNA, 25 bp, Rattus norvegicus
gtgaagtacttcagtttcgttggaa

SEQ ID NO: 501469 - DNA, 25 bp, Rattus norvegicus
gtgaagtacttctgtttcgttggaa

SEQ ID NO: 501470 - DNA, 25 bp, Rattus norvegicus
gtgaagtagacaaggccatccctgc

SEQ ID NO: 501471 - DNA, 25 bp, Rattus norvegicus
gtgaagtagacatggccatccctgc

SEQ ID NO: 501472 - DNA, 25 bp, Rattus norvegicus
gtgaagtagccaccaaactgccgct

SEQ ID NO: 501473 - DNA, 25 bp, Rattus norvegicus
gtgaagtagccagcaaactgccgct

SEQ ID NO: 501474 - DNA, 25 bp, Rattus norvegicus
gtgaagtagcccataatcctaactt

SEQ ID NO: 501475 - DNA, 25 bp, Rattus norvegicus
gtgaagtagcccttaatcctaactt

SEQ ID NO: 501476 - DNA, 25 bp, Rattus norvegicus
gtgaagtattacattccacccactc

SEQ ID NO: 501477 - DNA, 25 bp, Rattus norvegicus
gtgaagtattactttccacccactc

SEQ ID NO: 501478 - DNA, 25 bp, Rattus norvegicus
gtgaagtcaaatccatgccgacctt

SEQ ID NO: 501479 - DNA, 25 bp, Rattus norvegicus
gtgaagtcaaatgcatgccgacctt

SEQ ID NO: 501480 - DNA, 25 bp, Rattus norvegicus
gtgaagtcactacttcttccagcca

SEQ ID NO: 501481 - DNA, 25 bp, Rattus norvegicus
gtgaagtcactagttcttccagcca

SEQ ID NO: 501482 - DNA, 25 bp, Rattus norvegicus
gtgaagtcagccacagagcacattt

SEQ ID NO: 501483 - DNA, 25 bp, Rattus norvegicus
gtgaagtcagcctcagagcacattt

SEQ ID NO: 501484 - DNA, 25 bp, Rattus norvegicus
gtgaagtccatcaccatggtcatta

SEQ ID NO: 501485 - DNA, 25 bp, Rattus norvegicus
gtgaagtccatctccatggtcatta

SEQ ID NO: 501486 - DNA, 25 bp, Rattus norvegicus
gtgaagtccttgaagcataaccatt

SEQ ID NO: 501487 - DNA, 25 bp, Rattus norvegicus
gtgaagtccttgagtgttagttgtc

SEQ ID NO: 501488 - DNA, 25 bp, Rattus norvegicus
gtgaagtccttgtagcataaccatt

SEQ ID NO: 501489 - DNA, 25 bp, Rattus norvegicus
gtgaagtccttgtgtgttagttgtc

SEQ ID NO: 501490 - DNA, 25 bp, Rattus norvegicus
gtgaagtcggagagacccagacctc

SEQ ID NO: 501491 - DNA, 25 bp, Rattus norvegicus
gtgaagtcggagtgacccagacctc

SEQ ID NO: 501492 - DNA, 25 bp, Rattus norvegicus
gtgaagtcggccaatatcataaagt

SEQ ID NO: 501493 - DNA, 25 bp, Rattus norvegicus
gtgaagtcggcctatatcataaagt

SEQ ID NO: 501494 - DNA, 25 bp, Rattus norvegicus
gtgaagtctgtacccaagtgcctga

SEQ ID NO: 501495 - DNA, 25 bp, Rattus norvegicus
gtgaagtctgtagccaagtgcctga

SEQ ID NO: 501496 - DNA, 25 bp, Rattus norvegicus
gtgaagtcttccatggacagcagct

SEQ ID NO: 501497 - DNA, 25 bp, Rattus norvegicus
gtgaagtcttccttggacagcagct

SEQ ID NO: 501498 - DNA, 25 bp, Rattus norvegicus
gtgaagtctttcaccgaactgtcct

SEQ ID NO: 501499 - DNA, 25 bp, Rattus norvegicus
gtgaagtctttctccgaactgtcct

SEQ ID NO: 501500 - DNA, 25 bp, Rattus norvegicus
gtgaagtgaaaccatttaaccagca

SEQ ID NO: 501501 - DNA, 25 bp, Rattus norvegicus
gtgaagtgaaacgatttaaccagca

SEQ ID NO: 501502 - DNA, 25 bp, Rattus norvegicus
gtgaagtgaagtagccctacgtctg

SEQ ID NO: 501503 - DNA, 25 bp, Rattus norvegicus
gtgaagtgaagttgccctacgtctg

SEQ ID NO: 501504 - DNA, 25 bp, Rattus norvegicus
gtgaagtggctgctctctgacagac

SEQ ID NO: 501505 - DNA, 25 bp, Rattus norvegicus
gtgaagtggctggtctctgacagac

SEQ ID NO: 501506 - DNA, 25 bp, Rattus norvegicus
gtgaagtggtccatgctacatcggt

SEQ ID NO: 501507 - DNA, 25 bp, Rattus norvegicus
gtgaagtggtccttgctacatcggt

SEQ ID NO: 501508 - DNA, 25 bp, Rattus norvegicus
gtgaagtgtcatcccagtcatgata

SEQ ID NO: 501509 - DNA, 25 bp, Rattus norvegicus
gtgaagtgtcatgccagtcatgata

SEQ ID NO: 501510 - DNA, 25 bp, Rattus norvegicus
gtgaagtgtcgaatgccatcaaatg

SEQ ID NO: 501511 - DNA, 25 bp, Rattus norvegicus
gtgaagtgtcgattgccatcaaatg

SEQ ID NO: 501512 - DNA, 25 bp, Rattus norvegicus
gtgaagttcagactcctagcaaatt

SEQ ID NO: 501513 - DNA, 25 bp, Rattus norvegicus
gtgaagttcagagtcctagcaaatt

SEQ ID NO: 501514 - DNA, 25 bp, Rattus norvegicus
gtgaagttcagccagtgtcttaaga

SEQ ID NO: 501515 - DNA, 25 bp, Rattus norvegicus
gtgaagttcagcgagtgtcttaaga

SEQ ID NO: 501516 - DNA, 25 bp, Rattus norvegicus
gtgaagttccttattggctacctct

SEQ ID NO: 501517 - DNA, 25 bp, Rattus norvegicus
gtgaagttcctttttggctacctct

SEQ ID NO: 501518 - DNA, 25 bp, Rattus norvegicus
gtgaagttctgactgtgctttctgt

SEQ ID NO: 501519 - DNA, 25 bp, Rattus norvegicus
gtgaagttctgagtgtgctttctgt

SEQ ID NO: 501520 - DNA, 25 bp, Rattus norvegicus
gtgaagttctggctttgagccctat

SEQ ID NO: 501521 - DNA, 25 bp, Rattus norvegicus
gtgaagttctgggtttgagccctat

SEQ ID NO: 501522 - DNA, 25 bp, Rattus norvegicus
gtgaagttctgtccggccagtccaa

SEQ ID NO: 501523 - DNA, 25 bp, Rattus norvegicus
gtgaagttctgtgcggccagtccaa

SEQ ID NO: 501524 - DNA, 25 bp, Rattus norvegicus
gtgaagttcttacactgatggccat

SEQ ID NO: 501525 - DNA, 25 bp, Rattus norvegicus
gtgaagttcttagactgatggccat

SEQ ID NO: 501526 - DNA, 25 bp, Rattus norvegicus
gtgaagttgtctcctgttacagtga

SEQ ID NO: 501527 - DNA, 25 bp, Rattus norvegicus
gtgaagttgtctgctgttacagtga

SEQ ID NO: 501528 - DNA, 25 bp, Rattus norvegicus
gtgaagtttcagacttctcacctgc

SEQ ID NO: 501529 - DNA, 25 bp, Rattus norvegicus
gtgaagtttcagtcttctcacctgc

SEQ ID NO: 501530 - DNA, 25 bp, Rattus norvegicus
gtgaagttttagaaagcctgtccct

SEQ ID NO: 501531 - DNA, 25 bp, Rattus norvegicus
gtgaagttttagtaagcctgtccct

SEQ ID NO: 501532 - DNA, 25 bp, Rattus norvegicus
gtgaagttttgcaaccttaggaatg

SEQ ID NO: 501533 - DNA, 25 bp, Rattus norvegicus
gtgaagttttgctaccttaggaatg

SEQ ID NO: 501534 - DNA, 25 bp, Rattus norvegicus
gtgaataaatcccatgcacagcatg

SEQ ID NO: 501535 - DNA, 25 bp, Rattus norvegicus
gtgaataaatccgatgcacagcatg

SEQ ID NO: 501536 - DNA, 25 bp, Rattus norvegicus
gtgaataagtccacactcgtgagca

SEQ ID NO: 501537 - DNA, 25 bp, Rattus norvegicus
gtgaataagtcctcactcgtgagca

SEQ ID NO: 501538 - DNA, 25 bp, Rattus norvegicus
gtgaatacatagactgtcagggcag

SEQ ID NO: 501539 - DNA, 25 bp, Rattus norvegicus
gtgaatacatagtctgtcagggcag

SEQ ID NO: 501540 - DNA, 25 bp, Rattus norvegicus
gtgaatacctcacagggttgacttt

SEQ ID NO: 501541 - DNA, 25 bp, Rattus norvegicus
gtgaatacctcagagggttgacttt

SEQ ID NO: 501542 - DNA, 25 bp, Rattus norvegicus
gtgaatacctttaagtacccagaat

SEQ ID NO: 501543 - DNA, 25 bp, Rattus norvegicus
gtgaataccttttagtacccagaat

SEQ ID NO: 501544 - DNA, 25 bp, Rattus norvegicus
gtgaatacgctgcatccgagatgac

SEQ ID NO: 501545 - DNA, 25 bp, Rattus norvegicus
gtgaatacgctggatccgagatgac

SEQ ID NO: 501546 - DNA, 25 bp, Rattus norvegicus
gtgaatacgtgaccttgggccacca

SEQ ID NO: 501547 - DNA, 25 bp, Rattus norvegicus
gtgaatacgtgagcttgggccacca

SEQ ID NO: 501548 - DNA, 25 bp, Rattus norvegicus
gtgaatactactacctaaggcagac

SEQ ID NO: 501549 - DNA, 25 bp, Rattus norvegicus
gtgaatactacttcctaaggcagac

SEQ ID NO: 501550 - DNA, 25 bp, Rattus norvegicus
gtgaatactataaaacccctactgt

SEQ ID NO: 501551 - DNA, 25 bp, Rattus norvegicus
gtgaatactatataacccctactgt

SEQ ID NO: 501552 - DNA, 25 bp, Rattus norvegicus
gtgaatactcagacctcggaggtga

SEQ ID NO: 501553 - DNA, 25 bp, Rattus norvegicus
gtgaatactcagtcctcggaggtga

SEQ ID NO: 501554 - DNA, 25 bp, Rattus norvegicus
gtgaatactcgcagatatgaatccc

SEQ ID NO: 501555 - DNA, 25 bp, Rattus norvegicus
gtgaatactcgcagtgttgtgccca

SEQ ID NO: 501556 - DNA, 25 bp, Rattus norvegicus
gtgaatactcgctgatatgaatccc

SEQ ID NO: 501557 - DNA, 25 bp, Rattus norvegicus
gtgaatactcgctgtgttgtgccca

SEQ ID NO: 501558 - DNA, 25 bp, Rattus norvegicus
gtgaatagacacagcgaccccatag

SEQ ID NO: 501559 - DNA, 25 bp, Rattus norvegicus
gtgaatagacactgcgaccccatag

SEQ ID NO: 501560 - DNA, 25 bp, Rattus norvegicus
gtgaatagcaacaccctatcgaggg

SEQ ID NO: 501561 - DNA, 25 bp, Rattus norvegicus
gtgaatagcaactccctatcgaggg

SEQ ID NO: 501562 - DNA, 25 bp, Rattus norvegicus
gtgaatagtagaatcctttaggaat

SEQ ID NO: 501563 - DNA, 25 bp, Rattus norvegicus
gtgaatagtagattcctttaggaat

SEQ ID NO: 501564 - DNA, 25 bp, Rattus norvegicus
gtgaatagtgctccgtgtccctggt

SEQ ID NO: 501565 - DNA, 25 bp, Rattus norvegicus
gtgaatagtgctgcgtgtccctggt

SEQ ID NO: 501566 - DNA, 25 bp, Rattus norvegicus
gtgaatagtgtcctatgcaatacaa

SEQ ID NO: 501567 - DNA, 25 bp, Rattus norvegicus
gtgaatagtgtcgtatgcaatacaa

SEQ ID NO: 501568 - DNA, 25 bp, Rattus norvegicus
gtgaatatgaacatactgctcatgt

SEQ ID NO: 501569 - DNA, 25 bp, Rattus norvegicus
gtgaatatgaacttactgctcatgt

SEQ ID NO: 501570 - DNA, 25 bp, Rattus norvegicus
gtgaatatgaagagagccctccagt

SEQ ID NO: 501571 - DNA, 25 bp, Rattus norvegicus
gtgaatatgaagtgagccctccagt

SEQ ID NO: 501572 - DNA, 25 bp, Rattus norvegicus
gtgaatatgcagagccagggctcca

SEQ ID NO: 501573 - DNA, 25 bp, Rattus norvegicus
gtgaatatgcagtgccagggctcca

SEQ ID NO: 501574 - DNA, 25 bp, Rattus norvegicus
gtgaatatggcgaggaggccctaca

SEQ ID NO: 501575 - DNA, 25 bp, Rattus norvegicus
gtgaatatggcgtggaggccctaca

SEQ ID NO: 501576 - DNA, 25 bp, Rattus norvegicus
gtgaatattcacagaccctctagaa

SEQ ID NO: 501577 - DNA, 25 bp, Rattus norvegicus
gtgaatattcactgaccctctagaa

SEQ ID NO: 501578 - DNA, 25 bp, Rattus norvegicus
gtgaatattggaccactgctgcttt

SEQ ID NO: 501579 - DNA, 25 bp, Rattus norvegicus
gtgaatattggagcactgctgcttt

SEQ ID NO: 501580 - DNA, 25 bp, Rattus norvegicus
gtgaatatttgccttcagtctccgc

SEQ ID NO: 501581 - DNA, 25 bp, Rattus norvegicus
gtgaatatttgcgttcagtctccgc

SEQ ID NO: 501582 - DNA, 25 bp, Rattus norvegicus
gtgaatcaacccatggagtacctgg

SEQ ID NO: 501583 - DNA, 25 bp, Rattus norvegicus
gtgaatcaacccttggagtacctgg

SEQ ID NO: 501584 - DNA, 25 bp, Rattus norvegicus
gtgaatcaacctcccatgggaatga

SEQ ID NO: 501585 - DNA, 25 bp, Rattus norvegicus
gtgaatcaacctgccatgggaatga

SEQ ID NO: 501586 - DNA, 25 bp, Rattus norvegicus
gtgaatcacacacagctctagcagc

SEQ ID NO: 501587 - DNA, 25 bp, Rattus norvegicus
gtgaatcacacagagctctagcagc

SEQ ID NO: 501588 - DNA, 25 bp, Rattus norvegicus
gtgaatcacggtactactccatgga

SEQ ID NO: 501589 - DNA, 25 bp, Rattus norvegicus
gtgaatcacggttctactccatgga

SEQ ID NO: 501590 - DNA, 25 bp, Rattus norvegicus
gtgaatcactgtctacagagccatc

SEQ ID NO: 501591 - DNA, 25 bp, Rattus norvegicus
gtgaatcactgtgtacagagccatc

SEQ ID NO: 501592 - DNA, 25 bp, Rattus norvegicus
gtgaatccatgtccaggacaaacct

SEQ ID NO: 501593 - DNA, 25 bp, Rattus norvegicus
gtgaatccatgtgcaggacaaacct

SEQ ID NO: 501594 - DNA, 25 bp, Rattus norvegicus
gtgaatcccatgcagtcctaccaga

SEQ ID NO: 501595 - DNA, 25 bp, Rattus norvegicus
gtgaatcccatggagtcctaccaga

SEQ ID NO: 501596 - DNA, 25 bp, Rattus norvegicus
gtgaatccccttcgaatggatgaat

SEQ ID NO: 501597 - DNA, 25 bp, Rattus norvegicus
gtgaatccccttggaatggatgaat

SEQ ID NO: 501598 - DNA, 25 bp, Rattus norvegicus
gtgaatcctggcaccttgcctgtgg

SEQ ID NO: 501599 - DNA, 25 bp, Rattus norvegicus
gtgaatcctggctccttgcctgtgg

SEQ ID NO: 501600 - DNA, 25 bp, Rattus norvegicus
gtgaatccttgtatcaaaaccacaa

SEQ ID NO: 501601 - DNA, 25 bp, Rattus norvegicus
gtgaatccttgtttcaaaaccacaa

SEQ ID NO: 501602 - DNA, 25 bp, Rattus norvegicus
gtgaatcctttgagaggctgccagt

SEQ ID NO: 501603 - DNA, 25 bp, Rattus norvegicus
gtgaatcctttgtgaggctgccagt

SEQ ID NO: 501604 - DNA, 25 bp, Rattus norvegicus
gtgaatcgcttgagcctggctttaa

SEQ ID NO: 501605 - DNA, 25 bp, Rattus norvegicus
gtgaatcgcttgtgcctggctttaa

SEQ ID NO: 501606 - DNA, 25 bp, Rattus norvegicus
gtgaatcggtttctgtggtctccac

SEQ ID NO: 501607 - DNA, 25 bp, Rattus norvegicus
gtgaatcggtttgtgtggtctccac

SEQ ID NO: 501608 - DNA, 25 bp, Rattus norvegicus
gtgaatcgtttaagtcatgccctaa

SEQ ID NO: 501609 - DNA, 25 bp, Rattus norvegicus
gtgaatcgtttatgtcatgccctaa

SEQ ID NO: 501610 - DNA, 25 bp, Rattus norvegicus
gtgaatctccacagtgtgaccatta

SEQ ID NO: 501611 - DNA, 25 bp, Rattus norvegicus
gtgaatctccactgtgtgaccatta

SEQ ID NO: 501612 - DNA, 25 bp, Rattus norvegicus
gtgaatctccgacttaaggccagcc

SEQ ID NO: 501613 - DNA, 25 bp, Rattus norvegicus
gtgaatctccgagttaaggccagcc

SEQ ID NO: 501614 - DNA, 25 bp, Rattus norvegicus
gtgaatctgcagaacaaaggagctt

SEQ ID NO: 501615 - DNA, 25 bp, Rattus norvegicus
gtgaatctgcagtacaaaggagctt

SEQ ID NO: 501616 - DNA, 25 bp, Rattus norvegicus
gtgaatctggttatctttgttgaaa

SEQ ID NO: 501617 - DNA, 25 bp, Rattus norvegicus
gtgaatctggttttctttgttgaaa

SEQ ID NO: 501618 - DNA, 25 bp, Rattus norvegicus
gtgaatctgtgcaggagtccaccga

SEQ ID NO: 501619 - DNA, 25 bp, Rattus norvegicus
gtgaatctgtgctggagtccaccga

SEQ ID NO: 501620 - DNA, 25 bp, Rattus norvegicus
gtgaatctgtggaatctggcactgt

SEQ ID NO: 501621 - DNA, 25 bp, Rattus norvegicus
gtgaatctgtggtatctggcactgt

SEQ ID NO: 501622 - DNA, 25 bp, Rattus norvegicus
gtgaatcttcacacttgctgctcag

SEQ ID NO: 501623 - DNA, 25 bp, Rattus norvegicus
gtgaatcttcactcttgctgctcag

SEQ ID NO: 501624 - DNA, 25 bp, Rattus norvegicus
gtgaatcttttaaggtgacgcccct

SEQ ID NO: 501625 - DNA, 25 bp, Rattus norvegicus
gtgaatcttttatggtgacgcccct

SEQ ID NO: 501626 - DNA, 25 bp, Rattus norvegicus
gtgaatgacttgatttcctctctga

SEQ ID NO: 501627 - DNA, 25 bp, Rattus norvegicus
gtgaatgacttgttttcctctctga

SEQ ID NO: 501628 - DNA, 25 bp, Rattus norvegicus
gtgaatgatcacactgtaaacacat

SEQ ID NO: 501629 - DNA, 25 bp, Rattus norvegicus
gtgaatgatcactctgtaaacacat

SEQ ID NO: 501630 - DNA, 25 bp, Rattus norvegicus
gtgaatgattctcacttagctgcat

SEQ ID NO: 501631 - DNA, 25 bp, Rattus norvegicus
gtgaatgattctgacttagctgcat

SEQ ID NO: 501632 - DNA, 25 bp, Rattus norvegicus
gtgaatgcaatgagttcatcttcct

SEQ ID NO: 501633 - DNA, 25 bp, Rattus norvegicus
gtgaatgcaatgtgttcatcttcct

SEQ ID NO: 501634 - DNA, 25 bp, Rattus norvegicus
gtgaatgcacacaatggaactttat

SEQ ID NO: 501635 - DNA, 25 bp, Rattus norvegicus
gtgaatgcacactatggaactttat

SEQ ID NO: 501636 - DNA, 25 bp, Rattus norvegicus
gtgaatgcagagaccagaggaccat

SEQ ID NO: 501637 - DNA, 25 bp, Rattus norvegicus
gtgaatgcagagtccagaggaccat

SEQ ID NO: 501638 - DNA, 25 bp, Rattus norvegicus
gtgaatgcagccacgctagcagtga

SEQ ID NO: 501639 - DNA, 25 bp, Rattus norvegicus
gtgaatgcagcctcgctagcagtga

SEQ ID NO: 501640 - DNA, 25 bp, Rattus norvegicus
gtgaatgcagctccatttgtctggc

SEQ ID NO: 501641 - DNA, 25 bp, Rattus norvegicus
gtgaatgcagctgcatttgtctggc

SEQ ID NO: 501642 - DNA, 25 bp, Rattus norvegicus
gtgaatgcagtcagtgctttgaaaa

SEQ ID NO: 501643 - DNA, 25 bp, Rattus norvegicus
gtgaatgcagtctgtgctttgaaaa

SEQ ID NO: 501644 - DNA, 25 bp, Rattus norvegicus
gtgaatgcatgtaaatacttttcgt

SEQ ID NO: 501645 - DNA, 25 bp, Rattus norvegicus
gtgaatgcatgttaatacttttcgt

SEQ ID NO: 501646 - DNA, 25 bp, Rattus norvegicus
gtgaatgccagacctcttagagcag

SEQ ID NO: 501647 - DNA, 25 bp, Rattus norvegicus
gtgaatgccagagctcttagagcag

SEQ ID NO: 501648 - DNA, 25 bp, Rattus norvegicus
gtgaatgccaggattcttagaaaac

SEQ ID NO: 501649 - DNA, 25 bp, Rattus norvegicus
gtgaatgccaggtttcttagaaaac

SEQ ID NO: 501650 - DNA, 25 bp, Rattus norvegicus
gtgaatgccataacgaactactgaa

SEQ ID NO: 501651 - DNA, 25 bp, Rattus norvegicus
gtgaatgccatatcgaactactgaa

SEQ ID NO: 501652 - DNA, 25 bp, Rattus norvegicus
gtgaatgcccgcacttacaatttta

SEQ ID NO: 501653 - DNA, 25 bp, Rattus norvegicus
gtgaatgcccgctcttacaatttta

SEQ ID NO: 501654 - DNA, 25 bp, Rattus norvegicus
gtgaatgcctctagagactgcaaat

SEQ ID NO: 501655 - DNA, 25 bp, Rattus norvegicus
gtgaatgcctcttgagactgcaaat

SEQ ID NO: 501656 - DNA, 25 bp, Rattus norvegicus
gtgaatgcgctgctaccttttggca

SEQ ID NO: 501657 - DNA, 25 bp, Rattus norvegicus
gtgaatgcgctggtaccttttggca

SEQ ID NO: 501658 - DNA, 25 bp, Rattus norvegicus
gtgaatgctaggaagccccgtacca

SEQ ID NO: 501659 - DNA, 25 bp, Rattus norvegicus
gtgaatgctaggtagccccgtacca

SEQ ID NO: 501660 - DNA, 25 bp, Rattus norvegicus
gtgaatgctcttaagaaaccaagtt

SEQ ID NO: 501661 - DNA, 25 bp, Rattus norvegicus
gtgaatgctctttagaaaccaagtt

SEQ ID NO: 501662 - DNA, 25 bp, Rattus norvegicus
gtgaatgctgatattgcttacgaaa

SEQ ID NO: 501663 - DNA, 25 bp, Rattus norvegicus
gtgaatgctgattttgcttacgaaa

SEQ ID NO: 501664 - DNA, 25 bp, Rattus norvegicus
gtgaatgctgctatggatgacctga

SEQ ID NO: 501665 - DNA, 25 bp, Rattus norvegicus
gtgaatgctgctttggatgacctga

SEQ ID NO: 501666 - DNA, 25 bp, Rattus norvegicus
gtgaatgcttggctacatacagtta

SEQ ID NO: 501667 - DNA, 25 bp, Rattus norvegicus
gtgaatgcttgggtacatacagtta

SEQ ID NO: 501668 - DNA, 25 bp, Rattus norvegicus
gtgaatggacacacccggcgttgag

SEQ ID NO: 501669 - DNA, 25 bp, Rattus norvegicus
gtgaatggacaccaactctgcagca

SEQ ID NO: 501670 - DNA, 25 bp, Rattus norvegicus
gtgaatggacacgaactctgcagca

SEQ ID NO: 501671 - DNA, 25 bp, Rattus norvegicus
gtgaatggacactcccggcgttgag

SEQ ID NO: 501672 - DNA, 25 bp, Rattus norvegicus
gtgaatggacccaatgaaaactctg

SEQ ID NO: 501673 - DNA, 25 bp, Rattus norvegicus
gtgaatggaccctatgaaaactctg

SEQ ID NO: 501674 - DNA, 25 bp, Rattus norvegicus
gtgaatggcaccagctgaatcttgt

SEQ ID NO: 501675 - DNA, 25 bp, Rattus norvegicus
gtgaatggcacctgctgaatcttgt

SEQ ID NO: 501676 - DNA, 25 bp, Rattus norvegicus
gtgaatggctttctgatgccctgat

SEQ ID NO: 501677 - DNA, 25 bp, Rattus norvegicus
gtgaatggctttgtgatgccctgat

SEQ ID NO: 501678 - DNA, 25 bp, Rattus norvegicus
gtgaatgggcttagactttgcactt

SEQ ID NO: 501679 - DNA, 25 bp, Rattus norvegicus
gtgaatgggctttgactttgcactt

SEQ ID NO: 501680 - DNA, 25 bp, Rattus norvegicus
gtgaatgggtcaattctccacagcc

SEQ ID NO: 501681 - DNA, 25 bp, Rattus norvegicus
gtgaatgggtcatttctccacagcc

SEQ ID NO: 501682 - DNA, 25 bp, Rattus norvegicus
gtgaatgggtccacacaccaaagta

SEQ ID NO: 501683 - DNA, 25 bp, Rattus norvegicus
gtgaatgggtcctcacaccaaagta

SEQ ID NO: 501684 - DNA, 25 bp, Rattus norvegicus
gtgaatgggtgtccacttctttttt

SEQ ID NO: 501685 - DNA, 25 bp, Rattus norvegicus
gtgaatgggtgtgcacttctttttt

SEQ ID NO: 501686 - DNA, 25 bp, Rattus norvegicus
gtgaatggtgaacccgcatcccaga

SEQ ID NO: 501687 - DNA, 25 bp, Rattus norvegicus
gtgaatggtgaagccgcatcccaga

SEQ ID NO: 501688 - DNA, 25 bp, Rattus norvegicus
gtgaatggtggcactagaaaggtaa

SEQ ID NO: 501689 - DNA, 25 bp, Rattus norvegicus
gtgaatggtggctctagaaaggtaa

SEQ ID NO: 501690 - DNA, 25 bp, Rattus norvegicus
gtgaatgtagcacaaccccaccagg

SEQ ID NO: 501691 - DNA, 25 bp, Rattus norvegicus
gtgaatgtagcagaaccccaccagg

SEQ ID NO: 501692 - DNA, 25 bp, Rattus norvegicus
gtgaatgtaggcatgcttccctctg

SEQ ID NO: 501693 - DNA, 25 bp, Rattus norvegicus
gtgaatgtaggcttgcttccctctg

SEQ ID NO: 501694 - DNA, 25 bp, Rattus norvegicus
gtgaatgtctgcaaagcaggcaaaa

SEQ ID NO: 501695 - DNA, 25 bp, Rattus norvegicus
gtgaatgtctgctaagcaggcaaaa

SEQ ID NO: 501696 - DNA, 25 bp, Rattus norvegicus
gtgaatgtcttcaactacctggctt

SEQ ID NO: 501697 - DNA, 25 bp, Rattus norvegicus
gtgaatgtcttctactacctggctt

SEQ ID NO: 501698 - DNA, 25 bp, Rattus norvegicus
gtgaatgtgagcaacacctggagaa

SEQ ID NO: 501699 - DNA, 25 bp, Rattus norvegicus
gtgaatgtgagctacacctggagaa

SEQ ID NO: 501700 - DNA, 25 bp, Rattus norvegicus
gtgaatgtgagtatgcccagcggaa

SEQ ID NO: 501701 - DNA, 25 bp, Rattus norvegicus
gtgaatgtgagtttgcccagcggaa

SEQ ID NO: 501702 - DNA, 25 bp, Rattus norvegicus
gtgaatgtgcttagtgccaccaaac

SEQ ID NO: 501703 - DNA, 25 bp, Rattus norvegicus
gtgaatgtgctttgtgccaccaaac

SEQ ID NO: 501704 - DNA, 25 bp, Rattus norvegicus
gtgaatgttattccggctctccaca

SEQ ID NO: 501705 - DNA, 25 bp, Rattus norvegicus
gtgaatgttattgcggctctccaca

SEQ ID NO: 501706 - DNA, 25 bp, Rattus norvegicus
gtgaatgttgttcttgcttattttc

SEQ ID NO: 501707 - DNA, 25 bp, Rattus norvegicus
gtgaatgttgttgttgcttattttc

SEQ ID NO: 501708 - DNA, 25 bp, Rattus norvegicus
gtgaattaataaaggcgtgggccaa

SEQ ID NO: 501709 - DNA, 25 bp, Rattus norvegicus
gtgaattaataatggcgtgggccaa

SEQ ID NO: 501710 - DNA, 25 bp, Rattus norvegicus
gtgaattacactcgattctcccaat

SEQ ID NO: 501711 - DNA, 25 bp, Rattus norvegicus
gtgaattacactggattctcccaat

SEQ ID NO: 501712 - DNA, 25 bp, Rattus norvegicus
gtgaattaccatcctcatgcagcca

SEQ ID NO: 501713 - DNA, 25 bp, Rattus norvegicus
gtgaattaccatgctcatgcagcca

SEQ ID NO: 501714 - DNA, 25 bp, Rattus norvegicus
gtgaattactaacttctaaaactgt

SEQ ID NO: 501715 - DNA, 25 bp, Rattus norvegicus
gtgaattactaagttctaaaactgt

SEQ ID NO: 501716 - DNA, 25 bp, Rattus norvegicus
gtgaattattttagtatcagctatt

SEQ ID NO: 501717 - DNA, 25 bp, Rattus norvegicus
gtgaattatttttgtatcagctatt

SEQ ID NO: 501718 - DNA, 25 bp, Rattus norvegicus
gtgaattcaagaaaagccctctgct

SEQ ID NO: 501719 - DNA, 25 bp, Rattus norvegicus
gtgaattcaagataagccctctgct

SEQ ID NO: 501720 - DNA, 25 bp, Rattus norvegicus
gtgaattcagagaccaacccttgac

SEQ ID NO: 501721 - DNA, 25 bp, Rattus norvegicus
gtgaattcagagtccaacccttgac

SEQ ID NO: 501722 - DNA, 25 bp, Rattus norvegicus
gtgaattcagctcccatgagaggtc

SEQ ID NO: 501723 - DNA, 25 bp, Rattus norvegicus
gtgaattcagctgccatgagaggtc

SEQ ID NO: 501724 - DNA, 25 bp, Rattus norvegicus
gtgaattcagtaatggccaagtcca

SEQ ID NO: 501725 - DNA, 25 bp, Rattus norvegicus
gtgaattcagtattggccaagtcca

SEQ ID NO: 501726 - DNA, 25 bp, Rattus norvegicus
gtgaattcatacaactgttacaagg

SEQ ID NO: 501727 - DNA, 25 bp, Rattus norvegicus
gtgaattcatactactgttacaagg

SEQ ID NO: 501728 - DNA, 25 bp, Rattus norvegicus
gtgaattcatccatcagtcagcagg

SEQ ID NO: 501729 - DNA, 25 bp, Rattus norvegicus
gtgaattcatccttcagtcagcagg

SEQ ID NO: 501730 - DNA, 25 bp, Rattus norvegicus
gtgaattccaaaatccctaaggcat

SEQ ID NO: 501731 - DNA, 25 bp, Rattus norvegicus
gtgaattccaaattccctaaggcat

SEQ ID NO: 501732 - DNA, 25 bp, Rattus norvegicus
gtgaattcccacctagatgcataag

SEQ ID NO: 501733 - DNA, 25 bp, Rattus norvegicus
gtgaattcccacgtagatgcataag

SEQ ID NO: 501734 - DNA, 25 bp, Rattus norvegicus
gtgaattcctacagtattctgtgaa

SEQ ID NO: 501735 - DNA, 25 bp, Rattus norvegicus
gtgaattcctactgtattctgtgaa

SEQ ID NO: 501736 - DNA, 25 bp, Rattus norvegicus
gtgaattcgagaccatgcgcagttc

SEQ ID NO: 501737 - DNA, 25 bp, Rattus norvegicus
gtgaattcgagagcatgcgcagttc

SEQ ID NO: 501738 - DNA, 25 bp, Rattus norvegicus
gtgaattcgctgaccgtacttgagc

SEQ ID NO: 501739 - DNA, 25 bp, Rattus norvegicus
gtgaattcgctgtccgtacttgagc

SEQ ID NO: 501740 - DNA, 25 bp, Rattus norvegicus
gtgaattcgtggcttctccaagcag

SEQ ID NO: 501741 - DNA, 25 bp, Rattus norvegicus
gtgaattcgtgggttctccaagcag

SEQ ID NO: 501742 - DNA, 25 bp, Rattus norvegicus
gtgaattctcatcattttgctgtta

SEQ ID NO: 501743 - DNA, 25 bp, Rattus norvegicus
gtgaattctcatgattttgctgtta

SEQ ID NO: 501744 - DNA, 25 bp, Rattus norvegicus
gtgaattctctaactgcacctgtca

SEQ ID NO: 501745 - DNA, 25 bp, Rattus norvegicus
gtgaattctctatctgcacctgtca

SEQ ID NO: 501746 - DNA, 25 bp, Rattus norvegicus
gtgaattctcttacctgcttaggat

SEQ ID NO: 501747 - DNA, 25 bp, Rattus norvegicus
gtgaattctctttcctgcttaggat

SEQ ID NO: 501748 - DNA, 25 bp, Rattus norvegicus
gtgaattctgagacagcctgggcta

SEQ ID NO: 501749 - DNA, 25 bp, Rattus norvegicus
gtgaattctgagtcagcctgggcta

SEQ ID NO: 501750 - DNA, 25 bp, Rattus norvegicus
gtgaattctgctcattgtgccctac

SEQ ID NO: 501751 - DNA, 25 bp, Rattus norvegicus
gtgaattctgctgattgtgccctac

SEQ ID NO: 501752 - DNA, 25 bp, Rattus norvegicus
gtgaattctgggatctatttactct

SEQ ID NO: 501753 - DNA, 25 bp, Rattus norvegicus
gtgaattctgggttctatttactct

SEQ ID NO: 501754 - DNA, 25 bp, Rattus norvegicus
gtgaattctgttccactgacaaaac

SEQ ID NO: 501755 - DNA, 25 bp, Rattus norvegicus
gtgaattctgttgcactgacaaaac

SEQ ID NO: 501756 - DNA, 25 bp, Rattus norvegicus
gtgaattcttgtctcagtttctgtt

SEQ ID NO: 501757 - DNA, 25 bp, Rattus norvegicus
gtgaattcttgtgtcagtttctgtt

SEQ ID NO: 501758 - DNA, 25 bp, Rattus norvegicus
gtgaattgtctccacagggcagaac

SEQ ID NO: 501759 - DNA, 25 bp, Rattus norvegicus
gtgaattgtctcgacagggcagaac

SEQ ID NO: 501760 - DNA, 25 bp, Rattus norvegicus
gtgaatttactgatatattgccaat

SEQ ID NO: 501761 - DNA, 25 bp, Rattus norvegicus
gtgaatttactgttatattgccaat

SEQ ID NO: 501762 - DNA, 25 bp, Rattus norvegicus
gtgaatttagccagccaaggttctg

SEQ ID NO: 501763 - DNA, 25 bp, Rattus norvegicus
gtgaatttagcctgccaaggttctg

SEQ ID NO: 501764 - DNA, 25 bp, Rattus norvegicus
gtgaatttagtcagtgcttcttcca

SEQ ID NO: 501765 - DNA, 25 bp, Rattus norvegicus
gtgaatttagtctgtgcttcttcca

SEQ ID NO: 501766 - DNA, 25 bp, Rattus norvegicus
gtgaatttatataagtcttggaaac

SEQ ID NO: 501767 - DNA, 25 bp, Rattus norvegicus
gtgaatttatattagtcttggaaac

SEQ ID NO: 501768 - DNA, 25 bp, Rattus norvegicus
gtgaatttattcctgctagtactta

SEQ ID NO: 501769 - DNA, 25 bp, Rattus norvegicus
gtgaatttattcgtgctagtactta

SEQ ID NO: 501770 - DNA, 25 bp, Rattus norvegicus
gtgaatttcactcactagtcagtct

SEQ ID NO: 501771 - DNA, 25 bp, Rattus norvegicus
gtgaatttcactgactagtcagtct

SEQ ID NO: 501772 - DNA, 25 bp, Rattus norvegicus
gtgaatttcagaatatcctgggcta

SEQ ID NO: 501773 - DNA, 25 bp, Rattus norvegicus
gtgaatttcagattatcctgggcta

SEQ ID NO: 501774 - DNA, 25 bp, Rattus norvegicus
gtgaatttcttcagtttgaatcccc

SEQ ID NO: 501775 - DNA, 25 bp, Rattus norvegicus
gtgaatttcttctgtttgaatcccc

SEQ ID NO: 501776 - DNA, 25 bp, Rattus norvegicus
gtgaatttgaacacaaggtcgtaaa

SEQ ID NO: 501777 - DNA, 25 bp, Rattus norvegicus
gtgaatttgaactcaaggtcgtaaa

SEQ ID NO: 501778 - DNA, 25 bp, Rattus norvegicus
gtgaatttgagactgtcgtgcctct

SEQ ID NO: 501779 - DNA, 25 bp, Rattus norvegicus
gtgaatttgagagtgtcgtgcctct

SEQ ID NO: 501780 - DNA, 25 bp, Rattus norvegicus
gtgaatttgaggcaaacccgaatgc

SEQ ID NO: 501781 - DNA, 25 bp, Rattus norvegicus
gtgaatttgagggaaacccgaatgc

SEQ ID NO: 501782 - DNA, 25 bp, Rattus norvegicus
gtgaatttgagtcaagcctgagcca

SEQ ID NO: 501783 - DNA, 25 bp, Rattus norvegicus
gtgaatttgagtgaagcctgagcca

SEQ ID NO: 501784 - DNA, 25 bp, Rattus norvegicus
gtgaatttgcaaatacttttcgtga

SEQ ID NO: 501785 - DNA, 25 bp, Rattus norvegicus
gtgaatttgcaattacttttcgtga

SEQ ID NO: 501786 - DNA, 25 bp, Rattus norvegicus
gtgaatttgcttcgtagcccatcag

SEQ ID NO: 501787 - DNA, 25 bp, Rattus norvegicus
gtgaatttgcttggtagcccatcag

SEQ ID NO: 501788 - DNA, 25 bp, Rattus norvegicus
gtgaatttgtgacagtggcaaccct

SEQ ID NO: 501789 - DNA, 25 bp, Rattus norvegicus
gtgaatttgtgagagtggcaaccct

SEQ ID NO: 501790 - DNA, 25 bp, Rattus norvegicus
gtgaattttaatcctatctctatct

SEQ ID NO: 501791 - DNA, 25 bp, Rattus norvegicus
gtgaattttaatgctatctctatct

SEQ ID NO: 501792 - DNA, 25 bp, Rattus norvegicus
gtgaattttacacataccgggctaa

SEQ ID NO: 501793 - DNA, 25 bp, Rattus norvegicus
gtgaattttacacctctggacctga

SEQ ID NO: 501794 - DNA, 25 bp, Rattus norvegicus
gtgaattttacagataccgggctaa

SEQ ID NO: 501795 - DNA, 25 bp, Rattus norvegicus
gtgaattttacagctctggacctga

SEQ ID NO: 501796 - DNA, 25 bp, Rattus norvegicus
gtgaattttcaaacactttagattt

SEQ ID NO: 501797 - DNA, 25 bp, Rattus norvegicus
gtgaattttcaatcactttagattt

SEQ ID NO: 501798 - DNA, 25 bp, Rattus norvegicus
gtgaattttcacatacaatggcgtt

SEQ ID NO: 501799 - DNA, 25 bp, Rattus norvegicus
gtgaattttcacttacaatggcgtt

SEQ ID NO: 501800 - DNA, 25 bp, Rattus norvegicus
gtgaattttctcattcccattatgc

SEQ ID NO: 501801 - DNA, 25 bp, Rattus norvegicus
gtgaattttctctttcccattatgc

SEQ ID NO: 501802 - DNA, 25 bp, Rattus norvegicus
gtgaattttgctcctttcggtaatg

SEQ ID NO: 501803 - DNA, 25 bp, Rattus norvegicus
gtgaattttgctgctttcggtaatg

SEQ ID NO: 501804 - DNA, 25 bp, Rattus norvegicus
gtgaattttgtaatctccctttgga

SEQ ID NO: 501805 - DNA, 25 bp, Rattus norvegicus
gtgaattttgtattctccctttgga

SEQ ID NO: 501806 - DNA, 25 bp, Rattus norvegicus
gtgaatttttccagagtctcagtcc

SEQ ID NO: 501807 - DNA, 25 bp, Rattus norvegicus
gtgaatttttcctgagtctcagtcc

SEQ ID NO: 501808 - DNA, 25 bp, Rattus norvegicus
gtgacaaaacataaaccttctgatt

SEQ ID NO: 501809 - DNA, 25 bp, Rattus norvegicus
gtgacaaaacattaaccttctgatt

SEQ ID NO: 501810 - DNA, 25 bp, Rattus norvegicus
gtgacaaaccctcaaacacgtgtgt

SEQ ID NO: 501811 - DNA, 25 bp, Rattus norvegicus
gtgacaaaccctgaaacacgtgtgt

SEQ ID NO: 501812 - DNA, 25 bp, Rattus norvegicus
gtgacaaacctgacttaggcctcag

SEQ ID NO: 501813 - DNA, 25 bp, Rattus norvegicus
gtgacaaacctgtcttaggcctcag

SEQ ID NO: 501814 - DNA, 25 bp, Rattus norvegicus
gtgacaaagcttacatccactgcac

SEQ ID NO: 501815 - DNA, 25 bp, Rattus norvegicus
gtgacaaagctttcatccactgcac

SEQ ID NO: 501816 - DNA, 25 bp, Rattus norvegicus
gtgacaaagtttatgaccctcagaa

SEQ ID NO: 501817 - DNA, 25 bp, Rattus norvegicus
gtgacaaagtttttgaccctcagaa

SEQ ID NO: 501818 - DNA, 25 bp, Rattus norvegicus
gtgacaaatccaatgatcctgatat

SEQ ID NO: 501819 - DNA, 25 bp, Rattus norvegicus
gtgacaaatccattgatcctgatat

SEQ ID NO: 501820 - DNA, 25 bp, Rattus norvegicus
gtgacaaattccagctacagatgat

SEQ ID NO: 501821 - DNA, 25 bp, Rattus norvegicus
gtgacaaattcctgctacagatgat

SEQ ID NO: 501822 - DNA, 25 bp, Rattus norvegicus
gtgacaaatttactggccatcccaa

SEQ ID NO: 501823 - DNA, 25 bp, Rattus norvegicus
gtgacaaatttagtggccatcccaa

SEQ ID NO: 501824 - DNA, 25 bp, Rattus norvegicus
gtgacaacagcccagaatcctgtgc

SEQ ID NO: 501825 - DNA, 25 bp, Rattus norvegicus
gtgacaacagccgagaatcctgtgc

SEQ ID NO: 501826 - DNA, 25 bp, Rattus norvegicus
gtgacaacatttatgtacattatgt

SEQ ID NO: 501827 - DNA, 25 bp, Rattus norvegicus
gtgacaacatttttgtacattatgt

SEQ ID NO: 501828 - DNA, 25 bp, Rattus norvegicus
gtgacaaccaagactcccgtggtaa

SEQ ID NO: 501829 - DNA, 25 bp, Rattus norvegicus
gtgacaaccaagtctcccgtggtaa

SEQ ID NO: 501830 - DNA, 25 bp, Rattus norvegicus
gtgacaacctacctttgatgtgctg

SEQ ID NO: 501831 - DNA, 25 bp, Rattus norvegicus
gtgacaacctacgtttgatgtgctg

SEQ ID NO: 501832 - DNA, 25 bp, Rattus norvegicus
gtgacaacctttccagaactctcaa

SEQ ID NO: 501833 - DNA, 25 bp, Rattus norvegicus
gtgacaacctttgcagaactctcaa

SEQ ID NO: 501834 - DNA, 25 bp, Rattus norvegicus
gtgacaacggtgataaaggccatgt

SEQ ID NO: 501835 - DNA, 25 bp, Rattus norvegicus
gtgacaacggtgttaaaggccatgt

SEQ ID NO: 501836 - DNA, 25 bp, Rattus norvegicus
gtgacaacgtccacattgtccgtga

SEQ ID NO: 501837 - DNA, 25 bp, Rattus norvegicus
gtgacaacgtcctcattgtccgtga

SEQ ID NO: 501838 - DNA, 25 bp, Rattus norvegicus
gtgacaactcagcagccaggaggta

SEQ ID NO: 501839 - DNA, 25 bp, Rattus norvegicus
gtgacaactcaggagccaggaggta

SEQ ID NO: 501840 - DNA, 25 bp, Rattus norvegicus
gtgacaactctcatctggacagata

SEQ ID NO: 501841 - DNA, 25 bp, Rattus norvegicus
gtgacaactctcttctggacagata

SEQ ID NO: 501842 - DNA, 25 bp, Rattus norvegicus
gtgacaactgctacgacgccaggaa

SEQ ID NO: 501843 - DNA, 25 bp, Rattus norvegicus
gtgacaactgcttcgacgccaggaa

SEQ ID NO: 501844 - DNA, 25 bp, Rattus norvegicus
gtgacaacttctaagagggccgaga

SEQ ID NO: 501845 - DNA, 25 bp, Rattus norvegicus
gtgacaacttcttagagggccgaga

SEQ ID NO: 501846 - DNA, 25 bp, Rattus norvegicus
gtgacaagaaccattacacctgctc

SEQ ID NO: 501847 - DNA, 25 bp, Rattus norvegicus
gtgacaagaacctttacacctgctc

SEQ ID NO: 501848 - DNA, 25 bp, Rattus norvegicus
gtgacaagaatccgcatttgtattt

SEQ ID NO: 501849 - DNA, 25 bp, Rattus norvegicus
gtgacaagaatcggcatttgtattt

SEQ ID NO: 501850 - DNA, 25 bp, Rattus norvegicus
gtgacaagatcaacagggtcctgga

SEQ ID NO: 501851 - DNA, 25 bp, Rattus norvegicus
gtgacaagatcatcagggtcctgga

SEQ ID NO: 501852 - DNA, 25 bp, Rattus norvegicus
gtgacaagctgcatttcggactcca

SEQ ID NO: 501853 - DNA, 25 bp, Rattus norvegicus
gtgacaagctgcttttcggactcca

SEQ ID NO: 501854 - DNA, 25 bp, Rattus norvegicus
gtgacaagctgtatatctgccctgc

SEQ ID NO: 501855 - DNA, 25 bp, Rattus norvegicus
gtgacaagctgtttatctgccctgc

SEQ ID NO: 501856 - DNA, 25 bp, Rattus norvegicus
gtgacaagcttcaggcctccccgga

SEQ ID NO: 501857 - DNA, 25 bp, Rattus norvegicus
gtgacaagcttcatttctagaataa

SEQ ID NO: 501858 - DNA, 25 bp, Rattus norvegicus
gtgacaagcttctggcctccccgga

SEQ ID NO: 501859 - DNA, 25 bp, Rattus norvegicus
gtgacaagcttcttttctagaataa

SEQ ID NO: 501860 - DNA, 25 bp, Rattus norvegicus
gtgacaaggaccacgtggacctgtg

SEQ ID NO: 501861 - DNA, 25 bp, Rattus norvegicus
gtgacaaggacctcgtggacctgtg

SEQ ID NO: 501862 - DNA, 25 bp, Rattus norvegicus
gtgacaaggcttacctagatgagtt

SEQ ID NO: 501863 - DNA, 25 bp, Rattus norvegicus
gtgacaaggctttcctagatgagtt

SEQ ID NO: 501864 - DNA, 25 bp, Rattus norvegicus
gtgacaaggttcctctggcccggaa

SEQ ID NO: 501865 - DNA, 25 bp, Rattus norvegicus
gtgacaaggttcgtctggcccggaa

SEQ ID NO: 501866 - DNA, 25 bp, Rattus norvegicus
gtgacaagtcacctaacgtggcact

SEQ ID NO: 501867 - DNA, 25 bp, Rattus norvegicus
gtgacaagtcacgtaacgtggcact

SEQ ID NO: 501868 - DNA, 25 bp, Rattus norvegicus
gtgacaagtgctattaatctctaaa

SEQ ID NO: 501869 - DNA, 25 bp, Rattus norvegicus
gtgacaagtgcttttaatctctaaa

SEQ ID NO: 501870 - DNA, 25 bp, Rattus norvegicus
gtgacaatacacaaaggcttactta

SEQ ID NO: 501871 - DNA, 25 bp, Rattus norvegicus
gtgacaatacactaaggcttactta

SEQ ID NO: 501872 - DNA, 25 bp, Rattus norvegicus
gtgacaatagacagtgaataccata

SEQ ID NO: 501873 - DNA, 25 bp, Rattus norvegicus
gtgacaatagactgtgaataccata

SEQ ID NO: 501874 - DNA, 25 bp, Rattus norvegicus
gtgacaatatgtctgtaaatctatc

SEQ ID NO: 501875 - DNA, 25 bp, Rattus norvegicus
gtgacaatatgtgtgtaaatctatc

SEQ ID NO: 501876 - DNA, 25 bp, Rattus norvegicus
gtgacaatcattaagccctgagccc

SEQ ID NO: 501877 - DNA, 25 bp, Rattus norvegicus
gtgacaatcatttagccctgagccc

SEQ ID NO: 501878 - DNA, 25 bp, Rattus norvegicus
gtgacaatgaacatctgtaatccca

SEQ ID NO: 501879 - DNA, 25 bp, Rattus norvegicus
gtgacaatgaacttctgtaatccca

SEQ ID NO: 501880 - DNA, 25 bp, Rattus norvegicus
gtgacaatgccaccagtctgagact

SEQ ID NO: 501881 - DNA, 25 bp, Rattus norvegicus
gtgacaatgccagcagtctgagact

SEQ ID NO: 501882 - DNA, 25 bp, Rattus norvegicus
gtgacaatggacatctttttctaac

SEQ ID NO: 501883 - DNA, 25 bp, Rattus norvegicus
gtgacaatggacttctttttctaac

SEQ ID NO: 501884 - DNA, 25 bp, Rattus norvegicus
gtgacaatggccacatcctttaaaa

SEQ ID NO: 501885 - DNA, 25 bp, Rattus norvegicus
gtgacaatggcctcatcctttaaaa

SEQ ID NO: 501886 - DNA, 25 bp, Rattus norvegicus
gtgacaatgtaaccacaccaagtgt

SEQ ID NO: 501887 - DNA, 25 bp, Rattus norvegicus
gtgacaatgtaagcacaccaagtgt

SEQ ID NO: 501888 - DNA, 25 bp, Rattus norvegicus
gtgacaatgtagagtccatccctct

SEQ ID NO: 501889 - DNA, 25 bp, Rattus norvegicus
gtgacaatgtagtgtccatccctct

SEQ ID NO: 501890 - DNA, 25 bp, Rattus norvegicus
gtgacaattatcagcacaattcaat

SEQ ID NO: 501891 - DNA, 25 bp, Rattus norvegicus
gtgacaattatctgcacaattcaat

SEQ ID NO: 501892 - DNA, 25 bp, Rattus norvegicus
gtgacaattccaatcctaagccgtt

SEQ ID NO: 501893 - DNA, 25 bp, Rattus norvegicus
gtgacaattccattcctaagccgtt

SEQ ID NO: 501894 - DNA, 25 bp, Rattus norvegicus
gtgacaattgcgatgcatacctaca

SEQ ID NO: 501895 - DNA, 25 bp, Rattus norvegicus
gtgacaattgcgttgcatacctaca

SEQ ID NO: 501896 - DNA, 25 bp, Rattus norvegicus
gtgacacaaacccttcttaagttgt

SEQ ID NO: 501897 - DNA, 25 bp, Rattus norvegicus
gtgacacaaaccgttcttaagttgt

SEQ ID NO: 501898 - DNA, 25 bp, Rattus norvegicus
gtgacacaaactcaccttttcttgt

SEQ ID NO: 501899 - DNA, 25 bp, Rattus norvegicus
gtgacacaaactgaccttttcttgt

SEQ ID NO: 501900 - DNA, 25 bp, Rattus norvegicus
gtgacacaaatacaatacccagact

SEQ ID NO: 501901 - DNA, 25 bp, Rattus norvegicus
gtgacacaaatagaatacccagact

SEQ ID NO: 501902 - DNA, 25 bp, Rattus norvegicus
gtgacacaacagctctttgactgtc

SEQ ID NO: 501903 - DNA, 25 bp, Rattus norvegicus
gtgacacaacaggtctttgactgtc

SEQ ID NO: 501904 - DNA, 25 bp, Rattus norvegicus
gtgacacaacccatcattcgagtcg

SEQ ID NO: 501905 - DNA, 25 bp, Rattus norvegicus
gtgacacaacccttcattcgagtcg

SEQ ID NO: 501906 - DNA, 25 bp, Rattus norvegicus
gtgacacaatccatgtctgcagcta

SEQ ID NO: 501907 - DNA, 25 bp, Rattus norvegicus
gtgacacaatccttgtctgcagcta

SEQ ID NO: 501908 - DNA, 25 bp, Rattus norvegicus
gtgacacaatcgatgcagtggcaga

SEQ ID NO: 501909 - DNA, 25 bp, Rattus norvegicus
gtgacacaatcgttgcagtggcaga

SEQ ID NO: 501910 - DNA, 25 bp, Rattus norvegicus
gtgacacaatgacagaagctcttct

SEQ ID NO: 501911 - DNA, 25 bp, Rattus norvegicus
gtgacacaatgagagaagctcttct

SEQ ID NO: 501912 - DNA, 25 bp, Rattus norvegicus
gtgacacacagaaacctgtccctga

SEQ ID NO: 501913 - DNA, 25 bp, Rattus norvegicus
gtgacacacagatacctgtccctga

SEQ ID NO: 501914 - DNA, 25 bp, Rattus norvegicus
gtgacacacagtccctgctgcatta

SEQ ID NO: 501915 - DNA, 25 bp, Rattus norvegicus
gtgacacacagtgcctgctgcatta

SEQ ID NO: 501916 - DNA, 25 bp, Rattus norvegicus
gtgacacaccttcccgatggctgga

SEQ ID NO: 501917 - DNA, 25 bp, Rattus norvegicus
gtgacacaccttgccgatggctgga

SEQ ID NO: 501918 - DNA, 25 bp, Rattus norvegicus
gtgacacactcaaaggataggcgct

SEQ ID NO: 501919 - DNA, 25 bp, Rattus norvegicus
gtgacacactcataggataggcgct

SEQ ID NO: 501920 - DNA, 25 bp, Rattus norvegicus
gtgacacactggctcctcactctgg

SEQ ID NO: 501921 - DNA, 25 bp, Rattus norvegicus
gtgacacactgggtcctcactctgg

SEQ ID NO: 501922 - DNA, 25 bp, Rattus norvegicus
gtgacacactgtagtcttgccaggc

SEQ ID NO: 501923 - DNA, 25 bp, Rattus norvegicus
gtgacacactgttgtcttgccaggc

SEQ ID NO: 501924 - DNA, 25 bp, Rattus norvegicus
gtgacacacttcatccagcaaaact

SEQ ID NO: 501925 - DNA, 25 bp, Rattus norvegicus
gtgacacacttcttccagcaaaact

SEQ ID NO: 501926 - DNA, 25 bp, Rattus norvegicus
gtgacacagaacaggtgaatgccat

SEQ ID NO: 501927 - DNA, 25 bp, Rattus norvegicus
gtgacacagaactggtgaatgccat

SEQ ID NO: 501928 - DNA, 25 bp, Rattus norvegicus
gtgacacaggaaatctcaatccaga

SEQ ID NO: 501929 - DNA, 25 bp, Rattus norvegicus
gtgacacaggaattctcaatccaga

SEQ ID NO: 501930 - DNA, 25 bp, Rattus norvegicus
gtgacacaggatagtcagggtccca

SEQ ID NO: 501931 - DNA, 25 bp, Rattus norvegicus
gtgacacaggattgtcagggtccca

SEQ ID NO: 501932 - DNA, 25 bp, Rattus norvegicus
gtgacacagggaacatctcaattta

SEQ ID NO: 501933 - DNA, 25 bp, Rattus norvegicus
gtgacacagggatcatctcaattta

SEQ ID NO: 501934 - DNA, 25 bp, Rattus norvegicus
gtgacacaggtgctcatccaattgt

SEQ ID NO: 501935 - DNA, 25 bp, Rattus norvegicus
gtgacacaggtggtcatccaattgt

SEQ ID NO: 501936 - DNA, 25 bp, Rattus norvegicus
gtgacacagtcacatggaacaaaag

SEQ ID NO: 501937 - DNA, 25 bp, Rattus norvegicus
gtgacacagtcagatggaacaaaag

SEQ ID NO: 501938 - DNA, 25 bp, Rattus norvegicus
gtgacacagtgcatgccaaactcta

SEQ ID NO: 501939 - DNA, 25 bp, Rattus norvegicus
gtgacacagtgcttgccaaactcta

SEQ ID NO: 501940 - DNA, 25 bp, Rattus norvegicus
gtgacacatcacatggtgaccatgc

SEQ ID NO: 501941 - DNA, 25 bp, Rattus norvegicus
gtgacacatcacttggtgaccatgc

SEQ ID NO: 501942 - DNA, 25 bp, Rattus norvegicus
gtgacacatcctcggtacctgaaga

SEQ ID NO: 501943 - DNA, 25 bp, Rattus norvegicus
gtgacacatcctgggtacctgaaga

SEQ ID NO: 501944 - DNA, 25 bp, Rattus norvegicus
gtgacacattgtatgttgctggctg

SEQ ID NO: 501945 - DNA, 25 bp, Rattus norvegicus
gtgacacattgtttgttgctggctg

SEQ ID NO: 501946 - DNA, 25 bp, Rattus norvegicus
gtgacacattttcatgccttcttga

SEQ ID NO: 501947 - DNA, 25 bp, Rattus norvegicus
gtgacacattttgatgccttcttga

SEQ ID NO: 501948 - DNA, 25 bp, Rattus norvegicus
gtgacaccaatacacagactcccag

SEQ ID NO: 501949 - DNA, 25 bp, Rattus norvegicus
gtgacaccaatagacagactcccag

SEQ ID NO: 501950 - DNA, 25 bp, Rattus norvegicus
gtgacaccagcacctgttctttaga

SEQ ID NO: 501951 - DNA, 25 bp, Rattus norvegicus
gtgacaccagcagctgttctttaga

SEQ ID NO: 501952 - DNA, 25 bp, Rattus norvegicus
gtgacaccatgactgttctttcggt

SEQ ID NO: 501953 - DNA, 25 bp, Rattus norvegicus
gtgacaccatgagtgttctttcggt

SEQ ID NO: 501954 - DNA, 25 bp, Rattus norvegicus
gtgacaccattgctgctgattcatg

SEQ ID NO: 501955 - DNA, 25 bp, Rattus norvegicus
gtgacaccattggtgctgattcatg

SEQ ID NO: 501956 - DNA, 25 bp, Rattus norvegicus
gtgacacccagacgttctcttagga

SEQ ID NO: 501957 - DNA, 25 bp, Rattus norvegicus
gtgacacccagaggttctcttagga

SEQ ID NO: 501958 - DNA, 25 bp, Rattus norvegicus
gtgacacccaggctaaaccaggctg

SEQ ID NO: 501959 - DNA, 25 bp, Rattus norvegicus
gtgacacccagggtaaaccaggctg

SEQ ID NO: 501960 - DNA, 25 bp, Rattus norvegicus
gtgacacccctgaatttggtatcat

SEQ ID NO: 501961 - DNA, 25 bp, Rattus norvegicus
gtgacacccctgtatttggtatcat

SEQ ID NO: 501962 - DNA, 25 bp, Rattus norvegicus
gtgacacccgtacctgtgggagtta

SEQ ID NO: 501963 - DNA, 25 bp, Rattus norvegicus
gtgacacccgtagctgtgggagtta

SEQ ID NO: 501964 - DNA, 25 bp, Rattus norvegicus
gtgacaccctgtaattttaactgat

SEQ ID NO: 501965 - DNA, 25 bp, Rattus norvegicus
gtgacaccctgttattttaactgat

SEQ ID NO: 501966 - DNA, 25 bp, Rattus norvegicus
gtgacaccggcgagacccaacgcga

SEQ ID NO: 501967 - DNA, 25 bp, Rattus norvegicus
gtgacaccggcgtgacccaacgcga

SEQ ID NO: 501968 - DNA, 25 bp, Rattus norvegicus
gtgacaccgtgcagaagacattttc

SEQ ID NO: 501969 - DNA, 25 bp, Rattus norvegicus
gtgacaccgtgctgaagacattttc

SEQ ID NO: 501970 - DNA, 25 bp, Rattus norvegicus
gtgacacctccacggactagcaaga

SEQ ID NO: 501971 - DNA, 25 bp, Rattus norvegicus
gtgacacctccagggactagcaaga

SEQ ID NO: 501972 - DNA, 25 bp, Rattus norvegicus
gtgacacctgggagttcattcacct

SEQ ID NO: 501973 - DNA, 25 bp, Rattus norvegicus
gtgacacctgggtgttcattcacct

SEQ ID NO: 501974 - DNA, 25 bp, Rattus norvegicus
gtgacaccttacattgctgccttaa

SEQ ID NO: 501975 - DNA, 25 bp, Rattus norvegicus
gtgacaccttactttgctgccttaa

SEQ ID NO: 501976 - DNA, 25 bp, Rattus norvegicus
gtgacacgtcacaggaaagtctcag

SEQ ID NO: 501977 - DNA, 25 bp, Rattus norvegicus
gtgacacgtcactggaaagtctcag

SEQ ID NO: 501978 - DNA, 25 bp, Rattus norvegicus
gtgacactatgcacgcagacttaat

SEQ ID NO: 501979 - DNA, 25 bp, Rattus norvegicus
gtgacactatgctcgcagacttaat

SEQ ID NO: 501980 - DNA, 25 bp, Rattus norvegicus
gtgacactcacgacagactgcattg

SEQ ID NO: 501981 - DNA, 25 bp, Rattus norvegicus
gtgacactcacgtcagactgcattg

SEQ ID NO: 501982 - DNA, 25 bp, Rattus norvegicus
gtgacactcagtcctctgaacgact

SEQ ID NO: 501983 - DNA, 25 bp, Rattus norvegicus
gtgacactcagtgctctgaacgact

SEQ ID NO: 501984 - DNA, 25 bp, Rattus norvegicus
gtgacactcatcattgggcaaccgg

SEQ ID NO: 501985 - DNA, 25 bp, Rattus norvegicus
gtgacactcatctttgggcaaccgg

SEQ ID NO: 501986 - DNA, 25 bp, Rattus norvegicus
gtgacactctcgctgctttgcatgt

SEQ ID NO: 501987 - DNA, 25 bp, Rattus norvegicus
gtgacactctcggtgctttgcatgt

SEQ ID NO: 501988 - DNA, 25 bp, Rattus norvegicus
gtgacactctttccattactcagtt

SEQ ID NO: 501989 - DNA, 25 bp, Rattus norvegicus
gtgacactctttgcattactcagtt

SEQ ID NO: 501990 - DNA, 25 bp, Rattus norvegicus
gtgacactgaaacacatgagccaga

SEQ ID NO: 501991 - DNA, 25 bp, Rattus norvegicus
gtgacactgaaagacatgagccaga

SEQ ID NO: 501992 - DNA, 25 bp, Rattus norvegicus
gtgacactgaagcaagatacccatg

SEQ ID NO: 501993 - DNA, 25 bp, Rattus norvegicus
gtgacactgaaggaagatacccatg

SEQ ID NO: 501994 - DNA, 25 bp, Rattus norvegicus
gtgacactgagtataccacactctg

SEQ ID NO: 501995 - DNA, 25 bp, Rattus norvegicus
gtgacactgagtttaccacactctg

SEQ ID NO: 501996 - DNA, 25 bp, Rattus norvegicus
gtgacactgcacaactactcgttgg

SEQ ID NO: 501997 - DNA, 25 bp, Rattus norvegicus
gtgacactgcactactactcgttgg

SEQ ID NO: 501998 - DNA, 25 bp, Rattus norvegicus
gtgacactgcctactttgtgctaag

SEQ ID NO: 501999 - DNA, 25 bp, Rattus norvegicus
gtgacactgccttctttgtgctaag

SEQ ID NO: 502000 - DNA, 25 bp, Rattus norvegicus
gtgacactgcgactagtggtccctg

SEQ ID NO: 502001 - DNA, 25 bp, Rattus norvegicus
gtgacactgcgagtagtggtccctg

SEQ ID NO: 502002 - DNA, 25 bp, Rattus norvegicus
gtgacactgctcattacggttctgt

SEQ ID NO: 502003 - DNA, 25 bp, Rattus norvegicus
gtgacactgctctttacggttctgt

SEQ ID NO: 502004 - DNA, 25 bp, Rattus norvegicus
gtgacactggaaatcagaccctggt

SEQ ID NO: 502005 - DNA, 25 bp, Rattus norvegicus
gtgacactggaattcagaccctggt

SEQ ID NO: 502006 - DNA, 25 bp, Rattus norvegicus
gtgacactggagctgagatctgaat

SEQ ID NO: 502007 - DNA, 25 bp, Rattus norvegicus
gtgacactggaggtgagatctgaat

SEQ ID NO: 502008 - DNA, 25 bp, Rattus norvegicus
gtgacactgtacatcagaacgcttt

SEQ ID NO: 502009 - DNA, 25 bp, Rattus norvegicus
gtgacactgtacttcagaacgcttt

SEQ ID NO: 502010 - DNA, 25 bp, Rattus norvegicus
gtgacactgtcaatggcactaatgt

SEQ ID NO: 502011 - DNA, 25 bp, Rattus norvegicus
gtgacactgtcattggcactaatgt

SEQ ID NO: 502012 - DNA, 25 bp, Rattus norvegicus
gtgacactgtctatcagtacgtcgg

SEQ ID NO: 502013 - DNA, 25 bp, Rattus norvegicus
gtgacactgtctttcagtacgtcgg

SEQ ID NO: 502014 - DNA, 25 bp, Rattus norvegicus
gtgacactgtgaattttcaaacact

SEQ ID NO: 502015 - DNA, 25 bp, Rattus norvegicus
gtgacactgtgatttttcaaacact

SEQ ID NO: 502016 - DNA, 25 bp, Rattus norvegicus
gtgacacttagcagcttagccaaac

SEQ ID NO: 502017 - DNA, 25 bp, Rattus norvegicus
gtgacacttagctgcttagccaaac

SEQ ID NO: 502018 - DNA, 25 bp, Rattus norvegicus
gtgacacttcacattttctatacat

SEQ ID NO: 502019 - DNA, 25 bp, Rattus norvegicus
gtgacacttcactttttctatacat

SEQ ID NO: 502020 - DNA, 25 bp, Rattus norvegicus
gtgacacttcagctgtccacggaga

SEQ ID NO: 502021 - DNA, 25 bp, Rattus norvegicus
gtgacacttcaggtgtccacggaga

SEQ ID NO: 502022 - DNA, 25 bp, Rattus norvegicus
gtgacacttgcaacaatgtgctact

SEQ ID NO: 502023 - DNA, 25 bp, Rattus norvegicus
gtgacacttgcatcaatgtgctact

SEQ ID NO: 502024 - DNA, 25 bp, Rattus norvegicus
gtgacacttgttacgagcatcataa

SEQ ID NO: 502025 - DNA, 25 bp, Rattus norvegicus
gtgacacttgtttcgagcatcataa

SEQ ID NO: 502026 - DNA, 25 bp, Rattus norvegicus
gtgacagaaatcagcagctctccca

SEQ ID NO: 502027 - DNA, 25 bp, Rattus norvegicus
gtgacagaaatctgcagctctccca

SEQ ID NO: 502028 - DNA, 25 bp, Rattus norvegicus
gtgacagaacgcatgccaaccccag

SEQ ID NO: 502029 - DNA, 25 bp, Rattus norvegicus
gtgacagaacgcttgccaaccccag

SEQ ID NO: 502030 - DNA, 25 bp, Rattus norvegicus
gtgacagaattcatacagaacactg

SEQ ID NO: 502031 - DNA, 25 bp, Rattus norvegicus
gtgacagaattcttacagaacactg

SEQ ID NO: 502032 - DNA, 25 bp, Rattus norvegicus
gtgacagacactcccttaccatgta

SEQ ID NO: 502033 - DNA, 25 bp, Rattus norvegicus
gtgacagacactgccttaccatgta

SEQ ID NO: 502034 - DNA, 25 bp, Rattus norvegicus
gtgacagacagcactcctgatggga

SEQ ID NO: 502035 - DNA, 25 bp, Rattus norvegicus
gtgacagacagctctcctgatggga

SEQ ID NO: 502036 - DNA, 25 bp, Rattus norvegicus
gtgacagaccaacctagccccttat

SEQ ID NO: 502037 - DNA, 25 bp, Rattus norvegicus
gtgacagaccaagctagccccttat

SEQ ID NO: 502038 - DNA, 25 bp, Rattus norvegicus
gtgacagacgagaccggtcctcctc

SEQ ID NO: 502039 - DNA, 25 bp, Rattus norvegicus
gtgacagacgagtccggtcctcctc

SEQ ID NO: 502040 - DNA, 25 bp, Rattus norvegicus
gtgacagagaacattcagtgtgctc

SEQ ID NO: 502041 - DNA, 25 bp, Rattus norvegicus
gtgacagagaactttcagtgtgctc

SEQ ID NO: 502042 - DNA, 25 bp, Rattus norvegicus
gtgacagagaatccaatgccctttt

SEQ ID NO: 502043 - DNA, 25 bp, Rattus norvegicus
gtgacagagaatgcaatgccctttt

SEQ ID NO: 502044 - DNA, 25 bp, Rattus norvegicus
gtgacagagaccacacataccactg

SEQ ID NO: 502045 - DNA, 25 bp, Rattus norvegicus
gtgacagagacctcacataccactg

SEQ ID NO: 502046 - DNA, 25 bp, Rattus norvegicus
gtgacagagcatcaagttcctaccc

SEQ ID NO: 502047 - DNA, 25 bp, Rattus norvegicus
gtgacagagcatgaagttcctaccc

SEQ ID NO: 502048 - DNA, 25 bp, Rattus norvegicus
gtgacagagcttatcttctttctca

SEQ ID NO: 502049 - DNA, 25 bp, Rattus norvegicus
gtgacagagcttttcttctttctca

SEQ ID NO: 502050 - DNA, 25 bp, Rattus norvegicus
gtgacagatctgatggccttggagt

SEQ ID NO: 502051 - DNA, 25 bp, Rattus norvegicus
gtgacagatctgttggccttggagt

SEQ ID NO: 502052 - DNA, 25 bp, Rattus norvegicus
gtgacagatgacaacagcagctggt

SEQ ID NO: 502053 - DNA, 25 bp, Rattus norvegicus
gtgacagatgactacagcagctggt

SEQ ID NO: 502054 - DNA, 25 bp, Rattus norvegicus
gtgacagcaccgactgcactgtaag

SEQ ID NO: 502055 - DNA, 25 bp, Rattus norvegicus
gtgacagcaccgtctgcactgtaag

SEQ ID NO: 502056 - DNA, 25 bp, Rattus norvegicus
gtgacagcactgaatatccttaaag

SEQ ID NO: 502057 - DNA, 25 bp, Rattus norvegicus
gtgacagcactgtatatccttaaag

SEQ ID NO: 502058 - DNA, 25 bp, Rattus norvegicus
gtgacagcacttcagttgccagaat

SEQ ID NO: 502059 - DNA, 25 bp, Rattus norvegicus
gtgacagcacttgagttgccagaat

SEQ ID NO: 502060 - DNA, 25 bp, Rattus norvegicus
gtgacagcagatatcatcaaccgag

SEQ ID NO: 502061 - DNA, 25 bp, Rattus norvegicus
gtgacagcagatttcatcaaccgag

SEQ ID NO: 502062 - DNA, 25 bp, Rattus norvegicus
gtgacagcagccattacaccgaatg

SEQ ID NO: 502063 - DNA, 25 bp, Rattus norvegicus
gtgacagcagcctttacaccgaatg

SEQ ID NO: 502064 - DNA, 25 bp, Rattus norvegicus
gtgacagcagcgattgtaacttgaa

SEQ ID NO: 502065 - DNA, 25 bp, Rattus norvegicus
gtgacagcagcgtttgtaacttgaa

SEQ ID NO: 502066 - DNA, 25 bp, Rattus norvegicus
gtgacagcagtaagggtgccaccga

SEQ ID NO: 502067 - DNA, 25 bp, Rattus norvegicus
gtgacagcagtatgggtgccaccga

SEQ ID NO: 502068 - DNA, 25 bp, Rattus norvegicus
gtgacagcatctctactgctttgta

SEQ ID NO: 502069 - DNA, 25 bp, Rattus norvegicus
gtgacagcatctgtactgctttgta

SEQ ID NO: 502070 - DNA, 25 bp, Rattus norvegicus
gtgacagcattaaactcttttgaag

SEQ ID NO: 502071 - DNA, 25 bp, Rattus norvegicus
gtgacagcattatactcttttgaag

SEQ ID NO: 502072 - DNA, 25 bp, Rattus norvegicus
gtgacagccaacagcattcctggag

SEQ ID NO: 502073 - DNA, 25 bp, Rattus norvegicus
gtgacagccaactgcattcctggag

SEQ ID NO: 502074 - DNA, 25 bp, Rattus norvegicus
gtgacagccaatactccattatcat

SEQ ID NO: 502075 - DNA, 25 bp, Rattus norvegicus
gtgacagccaatctattcagcacga

SEQ ID NO: 502076 - DNA, 25 bp, Rattus norvegicus
gtgacagccaatgtattcagcacga

SEQ ID NO: 502077 - DNA, 25 bp, Rattus norvegicus
gtgacagccaattctccattatcat

SEQ ID NO: 502078 - DNA, 25 bp, Rattus norvegicus
gtgacagccagcaagtcccagacaa

SEQ ID NO: 502079 - DNA, 25 bp, Rattus norvegicus
gtgacagccagctagtcccagacaa

SEQ ID NO: 502080 - DNA, 25 bp, Rattus norvegicus
gtgacagccataaggaagcccgttt

SEQ ID NO: 502081 - DNA, 25 bp, Rattus norvegicus
gtgacagccatatggaagcccgttt

SEQ ID NO: 502082 - DNA, 25 bp, Rattus norvegicus
gtgacagccccactactgttgaaag

SEQ ID NO: 502083 - DNA, 25 bp, Rattus norvegicus
gtgacagccccagtactgttgaaag

SEQ ID NO: 502084 - DNA, 25 bp, Rattus norvegicus
gtgacagccctgcatgcattctgca

SEQ ID NO: 502085 - DNA, 25 bp, Rattus norvegicus
gtgacagccctggatgcattctgca

SEQ ID NO: 502086 - DNA, 25 bp, Rattus norvegicus
gtgacagccgatcaaaacctcccat

SEQ ID NO: 502087 - DNA, 25 bp, Rattus norvegicus
gtgacagccgatgaaaacctcccat

SEQ ID NO: 502088 - DNA, 25 bp, Rattus norvegicus
gtgacagccgtgattgaagttacca

SEQ ID NO: 502089 - DNA, 25 bp, Rattus norvegicus
gtgacagccgtgtttgaagttacca

SEQ ID NO: 502090 - DNA, 25 bp, Rattus norvegicus
gtgacagccttcatctggaaccaga

SEQ ID NO: 502091 - DNA, 25 bp, Rattus norvegicus
gtgacagccttcttctggaaccaga

SEQ ID NO: 502092 - DNA, 25 bp, Rattus norvegicus
gtgacagccttgcaatctgcacaga

SEQ ID NO: 502093 - DNA, 25 bp, Rattus norvegicus
gtgacagccttggaatctgcacaga

SEQ ID NO: 502094 - DNA, 25 bp, Rattus norvegicus
gtgacagcgtgcagtgctagctctt

SEQ ID NO: 502095 - DNA, 25 bp, Rattus norvegicus
gtgacagcgtgctgtgctagctctt

SEQ ID NO: 502096 - DNA, 25 bp, Rattus norvegicus
gtgacagctaatcgtgcagttctaa

SEQ ID NO: 502097 - DNA, 25 bp, Rattus norvegicus
gtgacagctaatggtgcagttctaa

SEQ ID NO: 502098 - DNA, 25 bp, Rattus norvegicus
gtgacagctagacatctgcctacat

SEQ ID NO: 502099 - DNA, 25 bp, Rattus norvegicus
gtgacagctagagatctgcctacat

SEQ ID NO: 502100 - DNA, 25 bp, Rattus norvegicus
gtgacagctattccctaccagagaa

SEQ ID NO: 502101 - DNA, 25 bp, Rattus norvegicus
gtgacagctattgcctaccagagaa

SEQ ID NO: 502102 - DNA, 25 bp, Rattus norvegicus
gtgacagctcagcatatccaggtct

SEQ ID NO: 502103 - DNA, 25 bp, Rattus norvegicus
gtgacagctcagctttagtcgtctt

SEQ ID NO: 502104 - DNA, 25 bp, Rattus norvegicus
gtgacagctcaggatatccaggtct

SEQ ID NO: 502105 - DNA, 25 bp, Rattus norvegicus
gtgacagctcaggtttagtcgtctt

SEQ ID NO: 502106 - DNA, 25 bp, Rattus norvegicus
gtgacagctcatcacctgttaagtc

SEQ ID NO: 502107 - DNA, 25 bp, Rattus norvegicus
gtgacagctcatgacctgttaagtc

SEQ ID NO: 502108 - DNA, 25 bp, Rattus norvegicus
gtgacagctcgccttacgtctgata

SEQ ID NO: 502109 - DNA, 25 bp, Rattus norvegicus
gtgacagctcgcgttacgtctgata

SEQ ID NO: 502110 - DNA, 25 bp, Rattus norvegicus
gtgacagctggcattctagcttctc

SEQ ID NO: 502111 - DNA, 25 bp, Rattus norvegicus
gtgacagctggctttctagcttctc

SEQ ID NO: 502112 - DNA, 25 bp, Rattus norvegicus
gtgacagcttccattgtatgtccca

SEQ ID NO: 502113 - DNA, 25 bp, Rattus norvegicus
gtgacagcttcctttgtatgtccca

SEQ ID NO: 502114 - DNA, 25 bp, Rattus norvegicus
gtgacagcttgtcattcgacttcaa

SEQ ID NO: 502115 - DNA, 25 bp, Rattus norvegicus
gtgacagcttgtgattcgacttcaa

SEQ ID NO: 502116 - DNA, 25 bp, Rattus norvegicus
gtgacaggaaataatcccagctctg

SEQ ID NO: 502117 - DNA, 25 bp, Rattus norvegicus
gtgacaggaaattatcccagctctg

SEQ ID NO: 502118 - DNA, 25 bp, Rattus norvegicus
gtgacaggcgtcagtcccgggtctc

SEQ ID NO: 502119 - DNA, 25 bp, Rattus norvegicus
gtgacaggcgtctgtcccgggtctc

SEQ ID NO: 502120 - DNA, 25 bp, Rattus norvegicus
gtgacaggctcaatttctgcctaga

SEQ ID NO: 502121 - DNA, 25 bp, Rattus norvegicus
gtgacaggctcattttctgcctaga

SEQ ID NO: 502122 - DNA, 25 bp, Rattus norvegicus
gtgacagggcagaacaagatatttg

SEQ ID NO: 502123 - DNA, 25 bp, Rattus norvegicus
gtgacagggcagcacatccttgact

SEQ ID NO: 502124 - DNA, 25 bp, Rattus norvegicus
gtgacagggcaggacatccttgact

SEQ ID NO: 502125 - DNA, 25 bp, Rattus norvegicus
gtgacagggcagtacaagatatttg

SEQ ID NO: 502126 - DNA, 25 bp, Rattus norvegicus
gtgacagggcgcagatgctcaagat

SEQ ID NO: 502127 - DNA, 25 bp, Rattus norvegicus
gtgacagggcgctgatgctcaagat

SEQ ID NO: 502128 - DNA, 25 bp, Rattus norvegicus
gtgacagggctgcatttctgtgcca

SEQ ID NO: 502129 - DNA, 25 bp, Rattus norvegicus
gtgacagggctggatttctgtgcca

SEQ ID NO: 502130 - DNA, 25 bp, Rattus norvegicus
gtgacaggtaccacacacactgcat

SEQ ID NO: 502131 - DNA, 25 bp, Rattus norvegicus
gtgacaggtacctcacacactgcat

SEQ ID NO: 502132 - DNA, 25 bp, Rattus norvegicus
gtgacaggtataatttcgcatctaa

SEQ ID NO: 502133 - DNA, 25 bp, Rattus norvegicus
gtgacaggtatattttcgcatctaa

SEQ ID NO: 502134 - DNA, 25 bp, Rattus norvegicus
gtgacaggtcacatctactggaata

SEQ ID NO: 502135 - DNA, 25 bp, Rattus norvegicus
gtgacaggtcacttctactggaata

SEQ ID NO: 502136 - DNA, 25 bp, Rattus norvegicus
gtgacaggtcggaactcacaggcct

SEQ ID NO: 502137 - DNA, 25 bp, Rattus norvegicus
gtgacaggtcggtactcacaggcct

SEQ ID NO: 502138 - DNA, 25 bp, Rattus norvegicus
gtgacaggtggaatccccaagccat

SEQ ID NO: 502139 - DNA, 25 bp, Rattus norvegicus
gtgacaggtggattccccaagccat

SEQ ID NO: 502140 - DNA, 25 bp, Rattus norvegicus
gtgacagtaaccactcaaccagtga

SEQ ID NO: 502141 - DNA, 25 bp, Rattus norvegicus
gtgacagtaacctctcaaccagtga

SEQ ID NO: 502142 - DNA, 25 bp, Rattus norvegicus
gtgacagtagtcatgggttttcctc

SEQ ID NO: 502143 - DNA, 25 bp, Rattus norvegicus
gtgacagtagtcttgggttttcctc

SEQ ID NO: 502144 - DNA, 25 bp, Rattus norvegicus
gtgacagtcacaaactggacagggc

SEQ ID NO: 502145 - DNA, 25 bp, Rattus norvegicus
gtgacagtcacatactggacagggc

SEQ ID NO: 502146 - DNA, 25 bp, Rattus norvegicus
gtgacagtcactcgcacacacagca

SEQ ID NO: 502147 - DNA, 25 bp, Rattus norvegicus
gtgacagtcactggcacacacagca

SEQ ID NO: 502148 - DNA, 25 bp, Rattus norvegicus
gtgacagtcatgcttggctgtgaca

SEQ ID NO: 502149 - DNA, 25 bp, Rattus norvegicus
gtgacagtcatggttggctgtgaca

SEQ ID NO: 502150 - DNA, 25 bp, Rattus norvegicus
gtgacagtctcacaagtgaaagcat

SEQ ID NO: 502151 - DNA, 25 bp, Rattus norvegicus
gtgacagtctcagaagtgaaagcat

SEQ ID NO: 502152 - DNA, 25 bp, Rattus norvegicus
gtgacagtgactcagcctcaagacc

SEQ ID NO: 502153 - DNA, 25 bp, Rattus norvegicus
gtgacagtgactgagcctcaagacc

SEQ ID NO: 502154 - DNA, 25 bp, Rattus norvegicus
gtgacagtgagcctgcacatcgccg

SEQ ID NO: 502155 - DNA, 25 bp, Rattus norvegicus
gtgacagtgagcgtgcacatcgccg

SEQ ID NO: 502156 - DNA, 25 bp, Rattus norvegicus
gtgacagtgaggaccctgttctcat

SEQ ID NO: 502157 - DNA, 25 bp, Rattus norvegicus
gtgacagtgaggtccctgttctcat

SEQ ID NO: 502158 - DNA, 25 bp, Rattus norvegicus
gtgacagtgcccaggaaggttttca

SEQ ID NO: 502159 - DNA, 25 bp, Rattus norvegicus
gtgacagtgccctggaaggttttca

SEQ ID NO: 502160 - DNA, 25 bp, Rattus norvegicus
gtgacagtgcggaacatcccaacct

SEQ ID NO: 502161 - DNA, 25 bp, Rattus norvegicus
gtgacagtgcggtacatcccaacct

SEQ ID NO: 502162 - DNA, 25 bp, Rattus norvegicus
gtgacagtgctaatttcgtccagtc

SEQ ID NO: 502163 - DNA, 25 bp, Rattus norvegicus
gtgacagtgctattttcgtccagtc

SEQ ID NO: 502164 - DNA, 25 bp, Rattus norvegicus
gtgacagtgctcacttaactagatt

SEQ ID NO: 502165 - DNA, 25 bp, Rattus norvegicus
gtgacagtgctctcttaactagatt

SEQ ID NO: 502166 - DNA, 25 bp, Rattus norvegicus
gtgacagtgctgagtgttgttcccc

SEQ ID NO: 502167 - DNA, 25 bp, Rattus norvegicus
gtgacagtgctgtgtgttgttcccc

SEQ ID NO: 502168 - DNA, 25 bp, Rattus norvegicus
gtgacagtgcttcattcaagtgccc

SEQ ID NO: 502169 - DNA, 25 bp, Rattus norvegicus
gtgacagtgcttgattcaagtgccc

SEQ ID NO: 502170 - DNA, 25 bp, Rattus norvegicus
gtgacagtggccaagcttgatgctc

SEQ ID NO: 502171 - DNA, 25 bp, Rattus norvegicus
gtgacagtggcctagcttgatgctc

SEQ ID NO: 502172 - DNA, 25 bp, Rattus norvegicus
gtgacagtgtctacacgcctacttt

SEQ ID NO: 502173 - DNA, 25 bp, Rattus norvegicus
gtgacagtgtcttcacgcctacttt

SEQ ID NO: 502174 - DNA, 25 bp, Rattus norvegicus
gtgacagttacaagccaccgtgaag

SEQ ID NO: 502175 - DNA, 25 bp, Rattus norvegicus
gtgacagttacacagacccatggct

SEQ ID NO: 502176 - DNA, 25 bp, Rattus norvegicus
gtgacagttacaccatacactctaa

SEQ ID NO: 502177 - DNA, 25 bp, Rattus norvegicus
gtgacagttacagagacccatggct

SEQ ID NO: 502178 - DNA, 25 bp, Rattus norvegicus
gtgacagttacagcatacactctaa

SEQ ID NO: 502179 - DNA, 25 bp, Rattus norvegicus
gtgacagttacatgccaccgtgaag

SEQ ID NO: 502180 - DNA, 25 bp, Rattus norvegicus
gtgacagttcagctttcaccttgac

SEQ ID NO: 502181 - DNA, 25 bp, Rattus norvegicus
gtgacagttcaggtttcaccttgac

SEQ ID NO: 502182 - DNA, 25 bp, Rattus norvegicus
gtgacagttgatcaaaccttagtag

SEQ ID NO: 502183 - DNA, 25 bp, Rattus norvegicus
gtgacagttgatgaaaccttagtag

SEQ ID NO: 502184 - DNA, 25 bp, Rattus norvegicus
gtgacatactagctacatctgcgtt

SEQ ID NO: 502185 - DNA, 25 bp, Rattus norvegicus
gtgacatactaggtacatctgcgtt

SEQ ID NO: 502186 - DNA, 25 bp, Rattus norvegicus
gtgacataggtcatgcaaccagaga

SEQ ID NO: 502187 - DNA, 25 bp, Rattus norvegicus
gtgacataggtcttgcaaccagaga

SEQ ID NO: 502188 - DNA, 25 bp, Rattus norvegicus
gtgacatagtgtaccattgcctcat

SEQ ID NO: 502189 - DNA, 25 bp, Rattus norvegicus
gtgacatagtgttccattgcctcat

SEQ ID NO: 502190 - DNA, 25 bp, Rattus norvegicus
gtgacatatttcatcccgataatgc

SEQ ID NO: 502191 - DNA, 25 bp, Rattus norvegicus
gtgacatatttcttcccgataatgc

SEQ ID NO: 502192 - DNA, 25 bp, Rattus norvegicus
gtgacatcacataggtactcgaaca

SEQ ID NO: 502193 - DNA, 25 bp, Rattus norvegicus
gtgacatcacattggtactcgaaca

SEQ ID NO: 502194 - DNA, 25 bp, Rattus norvegicus
gtgacatcaccactccagtatggca

SEQ ID NO: 502195 - DNA, 25 bp, Rattus norvegicus
gtgacatcaccagtccagtatggca

SEQ ID NO: 502196 - DNA, 25 bp, Rattus norvegicus
gtgacatcaccccaaaccagtgtga

SEQ ID NO: 502197 - DNA, 25 bp, Rattus norvegicus
gtgacatcacccgaaaccagtgtga

SEQ ID NO: 502198 - DNA, 25 bp, Rattus norvegicus
gtgacatcagaacgccaatgcatca

SEQ ID NO: 502199 - DNA, 25 bp, Rattus norvegicus
gtgacatcagaaggccaatgcatca

SEQ ID NO: 502200 - DNA, 25 bp, Rattus norvegicus
gtgacatcaggcaggttgccgagaa

SEQ ID NO: 502201 - DNA, 25 bp, Rattus norvegicus
gtgacatcaggctggttgccgagaa

SEQ ID NO: 502202 - DNA, 25 bp, Rattus norvegicus
gtgacatcatgaagacaatacctct

SEQ ID NO: 502203 - DNA, 25 bp, Rattus norvegicus
gtgacatcatgatgacaatacctct

SEQ ID NO: 502204 - DNA, 25 bp, Rattus norvegicus
gtgacatcatgtcttatctaaatgt

SEQ ID NO: 502205 - DNA, 25 bp, Rattus norvegicus
gtgacatcatgtgttatctaaatgt

SEQ ID NO: 502206 - DNA, 25 bp, Rattus norvegicus
gtgacatccacgactactttaggct

SEQ ID NO: 502207 - DNA, 25 bp, Rattus norvegicus
gtgacatccacgtctactttaggct

SEQ ID NO: 502208 - DNA, 25 bp, Rattus norvegicus
gtgacatccccaagcagtattacgt

SEQ ID NO: 502209 - DNA, 25 bp, Rattus norvegicus
gtgacatccccatgcagtattacgt

SEQ ID NO: 502210 - DNA, 25 bp, Rattus norvegicus
gtgacatcctagactacttttctgt

SEQ ID NO: 502211 - DNA, 25 bp, Rattus norvegicus
gtgacatcctagtctacttttctgt

SEQ ID NO: 502212 - DNA, 25 bp, Rattus norvegicus
gtgacatcgagaactctaaagcccc

SEQ ID NO: 502213 - DNA, 25 bp, Rattus norvegicus
gtgacatcgagatctctaaagcccc

SEQ ID NO: 502214 - DNA, 25 bp, Rattus norvegicus
gtgacatcgagtattccatctgctt

SEQ ID NO: 502215 - DNA, 25 bp, Rattus norvegicus
gtgacatcgagttttccatctgctt

SEQ ID NO: 502216 - DNA, 25 bp, Rattus norvegicus
gtgacatcggctcagtacacacctt

SEQ ID NO: 502217 - DNA, 25 bp, Rattus norvegicus
gtgacatcggctgagtacacacctt

SEQ ID NO: 502218 - DNA, 25 bp, Rattus norvegicus
gtgacatcgggcagagtctttgctc

SEQ ID NO: 502219 - DNA, 25 bp, Rattus norvegicus
gtgacatcgggctgagtctttgctc

SEQ ID NO: 502220 - DNA, 25 bp, Rattus norvegicus
gtgacatctcgtagcactgaatggc

SEQ ID NO: 502221 - DNA, 25 bp, Rattus norvegicus
gtgacatctcgttgcactgaatggc

SEQ ID NO: 502222 - DNA, 25 bp, Rattus norvegicus
gtgacatctggaacatctagtattt

SEQ ID NO: 502223 - DNA, 25 bp, Rattus norvegicus
gtgacatctggatcatctagtattt

SEQ ID NO: 502224 - DNA, 25 bp, Rattus norvegicus
gtgacatctggcaggatgcgtacct

SEQ ID NO: 502225 - DNA, 25 bp, Rattus norvegicus
gtgacatctggctggatgcgtacct

SEQ ID NO: 502226 - DNA, 25 bp, Rattus norvegicus
gtgacatctgtaatgcaagcactga

SEQ ID NO: 502227 - DNA, 25 bp, Rattus norvegicus
gtgacatctgtattgcaagcactga

SEQ ID NO: 502228 - DNA, 25 bp, Rattus norvegicus
gtgacatcttggaaacatctggctt

SEQ ID NO: 502229 - DNA, 25 bp, Rattus norvegicus
gtgacatcttggtaacatctggctt

SEQ ID NO: 502230 - DNA, 25 bp, Rattus norvegicus
gtgacatgaagcctgggtccagcct

SEQ ID NO: 502231 - DNA, 25 bp, Rattus norvegicus
gtgacatgaagcgtgggtccagcct

SEQ ID NO: 502232 - DNA, 25 bp, Rattus norvegicus
gtgacatgagaccaagatgccctat

SEQ ID NO: 502233 - DNA, 25 bp, Rattus norvegicus
gtgacatgagacgaagatgccctat

SEQ ID NO: 502234 - DNA, 25 bp, Rattus norvegicus
gtgacatgagatcctctgtgtgtgt

SEQ ID NO: 502235 - DNA, 25 bp, Rattus norvegicus
gtgacatgagatgctctgtgtgtgt

SEQ ID NO: 502236 - DNA, 25 bp, Rattus norvegicus
gtgacatgagcacgcccaggagctt

SEQ ID NO: 502237 - DNA, 25 bp, Rattus norvegicus
gtgacatgagcaggcccaggagctt

SEQ ID NO: 502238 - DNA, 25 bp, Rattus norvegicus
gtgacatgccctctggatcaaagga

SEQ ID NO: 502239 - DNA, 25 bp, Rattus norvegicus
gtgacatgccctgtggatcaaagga

SEQ ID NO: 502240 - DNA, 25 bp, Rattus norvegicus
gtgacatgcgcacatggaccctgct

SEQ ID NO: 502241 - DNA, 25 bp, Rattus norvegicus
gtgacatgcgcagatggaccctgct

SEQ ID NO: 502242 - DNA, 25 bp, Rattus norvegicus
gtgacatggcataggtgtgccctat

SEQ ID NO: 502243 - DNA, 25 bp, Rattus norvegicus
gtgacatggcattggtgtgccctat

SEQ ID NO: 502244 - DNA, 25 bp, Rattus norvegicus
gtgacatggcgcctgttcttatcat

SEQ ID NO: 502245 - DNA, 25 bp, Rattus norvegicus
gtgacatggcgcgtgttcttatcat

SEQ ID NO: 502246 - DNA, 25 bp, Rattus norvegicus
gtgacatggtacaaatctacaactt

SEQ ID NO: 502247 - DNA, 25 bp, Rattus norvegicus
gtgacatggtactaatctacaactt

SEQ ID NO: 502248 - DNA, 25 bp, Rattus norvegicus
gtgacatgtagacagacacctgcca

SEQ ID NO: 502249 - DNA, 25 bp, Rattus norvegicus
gtgacatgtagagagacacctgcca

SEQ ID NO: 502250 - DNA, 25 bp, Rattus norvegicus
gtgacatgtattctgtccccacatc

SEQ ID NO: 502251 - DNA, 25 bp, Rattus norvegicus
gtgacatgtattgtgtccccacatc

SEQ ID NO: 502252 - DNA, 25 bp, Rattus norvegicus
gtgacatgtcgccagggaacccaag

SEQ ID NO: 502253 - DNA, 25 bp, Rattus norvegicus
gtgacatgtcgcgagggaacccaag

SEQ ID NO: 502254 - DNA, 25 bp, Rattus norvegicus
gtgacatgtgaaaccttttttaaga

SEQ ID NO: 502255 - DNA, 25 bp, Rattus norvegicus
gtgacatgtgaatccttttttaaga

SEQ ID NO: 502256 - DNA, 25 bp, Rattus norvegicus
gtgacatgttaacttttcgggataa

SEQ ID NO: 502257 - DNA, 25 bp, Rattus norvegicus
gtgacatgttaagttttcgggataa

SEQ ID NO: 502258 - DNA, 25 bp, Rattus norvegicus
gtgacatgttccagaacctgaccgg

SEQ ID NO: 502259 - DNA, 25 bp, Rattus norvegicus
gtgacatgttcctgaacctgaccgg

SEQ ID NO: 502260 - DNA, 25 bp, Rattus norvegicus
gtgacattaaatccttactctgtag

SEQ ID NO: 502261 - DNA, 25 bp, Rattus norvegicus
gtgacattaaatgcttactctgtag

SEQ ID NO: 502262 - DNA, 25 bp, Rattus norvegicus
gtgacattagctcgtacctacttgt

SEQ ID NO: 502263 - DNA, 25 bp, Rattus norvegicus
gtgacattagctggtacctacttgt

SEQ ID NO: 502264 - DNA, 25 bp, Rattus norvegicus
gtgacattcacgatctcatttacaa

SEQ ID NO: 502265 - DNA, 25 bp, Rattus norvegicus
gtgacattcacgttctcatttacaa

SEQ ID NO: 502266 - DNA, 25 bp, Rattus norvegicus
gtgacattcactacagtattcctta

SEQ ID NO: 502267 - DNA, 25 bp, Rattus norvegicus
gtgacattcacttcagtattcctta

SEQ ID NO: 502268 - DNA, 25 bp, Rattus norvegicus
gtgacattcatcaccatcttcacat

SEQ ID NO: 502269 - DNA, 25 bp, Rattus norvegicus
gtgacattcatctccatcttcacat

SEQ ID NO: 502270 - DNA, 25 bp, Rattus norvegicus
gtgacattcatgagatcccctttat

SEQ ID NO: 502271 - DNA, 25 bp, Rattus norvegicus
gtgacattcatgtgatcccctttat

SEQ ID NO: 502272 - DNA, 25 bp, Rattus norvegicus
gtgacattcccaagcagtacttaca

SEQ ID NO: 502273 - DNA, 25 bp, Rattus norvegicus
gtgacattcccatgcagtacttaca

SEQ ID NO: 502274 - DNA, 25 bp, Rattus norvegicus
gtgacattcctgcagtgctgagact

SEQ ID NO: 502275 - DNA, 25 bp, Rattus norvegicus
gtgacattcctggagtgctgagact

SEQ ID NO: 502276 - DNA, 25 bp, Rattus norvegicus
gtgacattcgctactgcactcagga

SEQ ID NO: 502277 - DNA, 25 bp, Rattus norvegicus
gtgacattcgcttctgcactcagga

SEQ ID NO: 502278 - DNA, 25 bp, Rattus norvegicus
gtgacattctctcacatgacttaga

SEQ ID NO: 502279 - DNA, 25 bp, Rattus norvegicus
gtgacattctctgacatgacttaga

SEQ ID NO: 502280 - DNA, 25 bp, Rattus norvegicus
gtgacattctgccatgtccttttgg

SEQ ID NO: 502281 - DNA, 25 bp, Rattus norvegicus
gtgacattctgcgatgtccttttgg

SEQ ID NO: 502282 - DNA, 25 bp, Rattus norvegicus
gtgacattgaaacctgctctctaat

SEQ ID NO: 502283 - DNA, 25 bp, Rattus norvegicus
gtgacattgaaagctgctctctaat

SEQ ID NO: 502284 - DNA, 25 bp, Rattus norvegicus
gtgacattgaacaggtgatggccca

SEQ ID NO: 502285 - DNA, 25 bp, Rattus norvegicus
gtgacattgaactggtgatggccca

SEQ ID NO: 502286 - DNA, 25 bp, Rattus norvegicus
gtgacattgacaaccgcaaggattt

SEQ ID NO: 502287 - DNA, 25 bp, Rattus norvegicus
gtgacattgacatccgcaaggattt

SEQ ID NO: 502288 - DNA, 25 bp, Rattus norvegicus
gtgacattgatgatttacctcttaa

SEQ ID NO: 502289 - DNA, 25 bp, Rattus norvegicus
gtgacattgatgttttacctcttaa

SEQ ID NO: 502290 - DNA, 25 bp, Rattus norvegicus
gtgacattgcaaaatactccgctct

SEQ ID NO: 502291 - DNA, 25 bp, Rattus norvegicus
gtgacattgcaatatactccgctct

SEQ ID NO: 502292 - DNA, 25 bp, Rattus norvegicus
gtgacattgcacacgcagagtagta

SEQ ID NO: 502293 - DNA, 25 bp, Rattus norvegicus
gtgacattgcactcgcagagtagta

SEQ ID NO: 502294 - DNA, 25 bp, Rattus norvegicus
gtgacattgctactgtgtgtgactc

SEQ ID NO: 502295 - DNA, 25 bp, Rattus norvegicus
gtgacattgctagtgtgtgtgactc

SEQ ID NO: 502296 - DNA, 25 bp, Rattus norvegicus
gtgacattgctcagctcaagctaaa

SEQ ID NO: 502297 - DNA, 25 bp, Rattus norvegicus
gtgacattgctctgctcaagctaaa

SEQ ID NO: 502298 - DNA, 25 bp, Rattus norvegicus
gtgacattgggtccctctgtctcac

SEQ ID NO: 502299 - DNA, 25 bp, Rattus norvegicus
gtgacattgggtgcctctgtctcac

SEQ ID NO: 502300 - DNA, 25 bp, Rattus norvegicus
gtgacattggttcactgttctcaga

SEQ ID NO: 502301 - DNA, 25 bp, Rattus norvegicus
gtgacattggttgactgttctcaga

SEQ ID NO: 502302 - DNA, 25 bp, Rattus norvegicus
gtgacatttactcagtgtatcgcac

SEQ ID NO: 502303 - DNA, 25 bp, Rattus norvegicus
gtgacatttactgagtgtatcgcac

SEQ ID NO: 502304 - DNA, 25 bp, Rattus norvegicus
gtgacatttgaccataggcagactt

SEQ ID NO: 502305 - DNA, 25 bp, Rattus norvegicus
gtgacatttgacgataggcagactt

SEQ ID NO: 502306 - DNA, 25 bp, Rattus norvegicus
gtgacatttgatacaaccgttgagc

SEQ ID NO: 502307 - DNA, 25 bp, Rattus norvegicus
gtgacatttgattcaaccgttgagc

SEQ ID NO: 502308 - DNA, 25 bp, Rattus norvegicus
gtgacattttgtcaggttcttcttc

SEQ ID NO: 502309 - DNA, 25 bp, Rattus norvegicus
gtgacattttgtgaggttcttcttc

SEQ ID NO: 502310 - DNA, 25 bp, Rattus norvegicus
gtgaccaaacacatttatgcctttt

SEQ ID NO: 502311 - DNA, 25 bp, Rattus norvegicus
gtgaccaaacacttttatgcctttt

SEQ ID NO: 502312 - DNA, 25 bp, Rattus norvegicus
gtgaccaaaccaatctgctgttagg

SEQ ID NO: 502313 - DNA, 25 bp, Rattus norvegicus
gtgaccaaaccattctgctgttagg

SEQ ID NO: 502314 - DNA, 25 bp, Rattus norvegicus
gtgaccaaactaaggccaatgggcc

SEQ ID NO: 502315 - DNA, 25 bp, Rattus norvegicus
gtgaccaaactatggccaatgggcc

SEQ ID NO: 502316 - DNA, 25 bp, Rattus norvegicus
gtgaccaaagaaacccatcatttat

SEQ ID NO: 502317 - DNA, 25 bp, Rattus norvegicus
gtgaccaaagaatcccatcatttat

SEQ ID NO: 502318 - DNA, 25 bp, Rattus norvegicus
gtgaccaacctgaatgcctaccgag

SEQ ID NO: 502319 - DNA, 25 bp, Rattus norvegicus
gtgaccaacctgtatgcctaccgag

SEQ ID NO: 502320 - DNA, 25 bp, Rattus norvegicus
gtgaccaacgacacagaaatccctt

SEQ ID NO: 502321 - DNA, 25 bp, Rattus norvegicus
gtgaccaacgactcagaaatccctt

SEQ ID NO: 502322 - DNA, 25 bp, Rattus norvegicus
gtgaccaacgtacaggacctgtctt

SEQ ID NO: 502323 - DNA, 25 bp, Rattus norvegicus
gtgaccaacgtagaggacctgtctt

SEQ ID NO: 502324 - DNA, 25 bp, Rattus norvegicus
gtgaccaatggtagcacagcccaaa

SEQ ID NO: 502325 - DNA, 25 bp, Rattus norvegicus
gtgaccaatggtctgctcagagcac

SEQ ID NO: 502326 - DNA, 25 bp, Rattus norvegicus
gtgaccaatggtgtgctcagagcac

SEQ ID NO: 502327 - DNA, 25 bp, Rattus norvegicus
gtgaccaatggttgcacagcccaaa

SEQ ID NO: 502328 - DNA, 25 bp, Rattus norvegicus
gtgaccacagagactatctgcagtt

SEQ ID NO: 502329 - DNA, 25 bp, Rattus norvegicus
gtgaccacagagtctatctgcagtt

SEQ ID NO: 502330 - DNA, 25 bp, Rattus norvegicus
gtgaccacagatagggcaattcagt

SEQ ID NO: 502331 - DNA, 25 bp, Rattus norvegicus
gtgaccacagattgggcaattcagt

SEQ ID NO: 502332 - DNA, 25 bp, Rattus norvegicus
gtgaccacccttaaaacttgtctgt

SEQ ID NO: 502333 - DNA, 25 bp, Rattus norvegicus
gtgaccaccctttaaacttgtctgt

SEQ ID NO: 502334 - DNA, 25 bp, Rattus norvegicus
gtgaccaccgtacgctggagtaagt

SEQ ID NO: 502335 - DNA, 25 bp, Rattus norvegicus
gtgaccaccgtaggctggagtaagt

SEQ ID NO: 502336 - DNA, 25 bp, Rattus norvegicus
gtgaccacctagcaagcgctaagca

SEQ ID NO: 502337 - DNA, 25 bp, Rattus norvegicus
gtgaccacctaggaagcgctaagca

SEQ ID NO: 502338 - DNA, 25 bp, Rattus norvegicus
gtgaccacctatcaggattcaacgt

SEQ ID NO: 502339 - DNA, 25 bp, Rattus norvegicus
gtgaccacctatgaggattcaacgt

SEQ ID NO: 502340 - DNA, 25 bp, Rattus norvegicus
gtgaccacgagaaaccttccaggga

SEQ ID NO: 502341 - DNA, 25 bp, Rattus norvegicus
gtgaccacgagataccttccaggga

SEQ ID NO: 502342 - DNA, 25 bp, Rattus norvegicus
gtgaccacggcacttgggaaaccaa

SEQ ID NO: 502343 - DNA, 25 bp, Rattus norvegicus
gtgaccacggcagttgggaaaccaa

SEQ ID NO: 502344 - DNA, 25 bp, Rattus norvegicus
gtgaccactattccagacaccaacg

SEQ ID NO: 502345 - DNA, 25 bp, Rattus norvegicus
gtgaccactattgcagacaccaacg

SEQ ID NO: 502346 - DNA, 25 bp, Rattus norvegicus
gtgaccactcttccgaggagacatg

SEQ ID NO: 502347 - DNA, 25 bp, Rattus norvegicus
gtgaccactcttgcgaggagacatg

SEQ ID NO: 502348 - DNA, 25 bp, Rattus norvegicus
gtgaccactggtaaggtgtccatct

SEQ ID NO: 502349 - DNA, 25 bp, Rattus norvegicus
gtgaccactggtatctgtatccaga

SEQ ID NO: 502350 - DNA, 25 bp, Rattus norvegicus
gtgaccactggttaggtgtccatct

SEQ ID NO: 502351 - DNA, 25 bp, Rattus norvegicus
gtgaccactggtttctgtatccaga

SEQ ID NO: 502352 - DNA, 25 bp, Rattus norvegicus
gtgaccacttccaagcacagtgttc

SEQ ID NO: 502353 - DNA, 25 bp, Rattus norvegicus
gtgaccacttccagttcactttttt

SEQ ID NO: 502354 - DNA, 25 bp, Rattus norvegicus
gtgaccacttcctagcacagtgttc

SEQ ID NO: 502355 - DNA, 25 bp, Rattus norvegicus
gtgaccacttcctgttcactttttt

SEQ ID NO: 502356 - DNA, 25 bp, Rattus norvegicus
gtgaccactttgcatactaccagtt

SEQ ID NO: 502357 - DNA, 25 bp, Rattus norvegicus
gtgaccactttggatactaccagtt

SEQ ID NO: 502358 - DNA, 25 bp, Rattus norvegicus
gtgaccagaattctattttctcgag

SEQ ID NO: 502359 - DNA, 25 bp, Rattus norvegicus
gtgaccagaattgtattttctcgag

SEQ ID NO: 502360 - DNA, 25 bp, Rattus norvegicus
gtgaccagacacctgatgagaatga

SEQ ID NO: 502361 - DNA, 25 bp, Rattus norvegicus
gtgaccagacacgtgatgagaatga

SEQ ID NO: 502362 - DNA, 25 bp, Rattus norvegicus
gtgaccagattcacggtgacacaca

SEQ ID NO: 502363 - DNA, 25 bp, Rattus norvegicus
gtgaccagattctcggtgacacaca

SEQ ID NO: 502364 - DNA, 25 bp, Rattus norvegicus
gtgaccagcagacccaggaacaaac

SEQ ID NO: 502365 - DNA, 25 bp, Rattus norvegicus
gtgaccagcagagccaggaacaaac

SEQ ID NO: 502366 - DNA, 25 bp, Rattus norvegicus
gtgaccagcagcattgcactaccaa

SEQ ID NO: 502367 - DNA, 25 bp, Rattus norvegicus
gtgaccagcagctttgcactaccaa

SEQ ID NO: 502368 - DNA, 25 bp, Rattus norvegicus
gtgaccagccatctagagcgtgctc

SEQ ID NO: 502369 - DNA, 25 bp, Rattus norvegicus
gtgaccagccatgtagagcgtgctc

SEQ ID NO: 502370 - DNA, 25 bp, Rattus norvegicus
gtgaccagcctcatttaagcacgtc

SEQ ID NO: 502371 - DNA, 25 bp, Rattus norvegicus
gtgaccagcctcttttaagcacgtc

SEQ ID NO: 502372 - DNA, 25 bp, Rattus norvegicus
gtgaccaggcatagagcagtgactc

SEQ ID NO: 502373 - DNA, 25 bp, Rattus norvegicus
gtgaccaggcattgagcagtgactc

SEQ ID NO: 502374 - DNA, 25 bp, Rattus norvegicus
gtgaccaggctgaacttcaacccga

SEQ ID NO: 502375 - DNA, 25 bp, Rattus norvegicus
gtgaccaggctgtacttcaacccga

SEQ ID NO: 502376 - DNA, 25 bp, Rattus norvegicus
gtgaccagggtcactttctttgttt

SEQ ID NO: 502377 - DNA, 25 bp, Rattus norvegicus
gtgaccagggtctctttctttgttt

SEQ ID NO: 502378 - DNA, 25 bp, Rattus norvegicus
gtgaccaggtgtcacacacttgatc

SEQ ID NO: 502379 - DNA, 25 bp, Rattus norvegicus
gtgaccaggtgtccaagctaaccag

SEQ ID NO: 502380 - DNA, 25 bp, Rattus norvegicus
gtgaccaggtgtgacacacttgatc

SEQ ID NO: 502381 - DNA, 25 bp, Rattus norvegicus
gtgaccaggtgtgcaagctaaccag

SEQ ID NO: 502382 - DNA, 25 bp, Rattus norvegicus
gtgaccagtcagaaagagtttctag

SEQ ID NO: 502383 - DNA, 25 bp, Rattus norvegicus
gtgaccagtcagtaagagtttctag

SEQ ID NO: 502384 - DNA, 25 bp, Rattus norvegicus
gtgaccagtgacaccgaactttgaa

SEQ ID NO: 502385 - DNA, 25 bp, Rattus norvegicus
gtgaccagtgacctgtacagaccat

SEQ ID NO: 502386 - DNA, 25 bp, Rattus norvegicus
gtgaccagtgacgtgtacagaccat

SEQ ID NO: 502387 - DNA, 25 bp, Rattus norvegicus
gtgaccagtgactccgaactttgaa

SEQ ID NO: 502388 - DNA, 25 bp, Rattus norvegicus
gtgaccagtgataagcgtcccgtgt

SEQ ID NO: 502389 - DNA, 25 bp, Rattus norvegicus
gtgaccagtgatacctttcagttac

SEQ ID NO: 502390 - DNA, 25 bp, Rattus norvegicus
gtgaccagtgattagcgtcccgtgt

SEQ ID NO: 502391 - DNA, 25 bp, Rattus norvegicus
gtgaccagtgattcctttcagttac

SEQ ID NO: 502392 - DNA, 25 bp, Rattus norvegicus
gtgaccagtggtagcaggatgcctt

SEQ ID NO: 502393 - DNA, 25 bp, Rattus norvegicus
gtgaccagtggttgcaggatgcctt

SEQ ID NO: 502394 - DNA, 25 bp, Rattus norvegicus
gtgaccagtgtacgcgttcaccagc

SEQ ID NO: 502395 - DNA, 25 bp, Rattus norvegicus
gtgaccagtgtaggcgttcaccagc

SEQ ID NO: 502396 - DNA, 25 bp, Rattus norvegicus
gtgaccagttcaactcccaagggtg

SEQ ID NO: 502397 - DNA, 25 bp, Rattus norvegicus
gtgaccagttcatctcccaagggtg

SEQ ID NO: 502398 - DNA, 25 bp, Rattus norvegicus
gtgaccagttctcttgtacaaactt

SEQ ID NO: 502399 - DNA, 25 bp, Rattus norvegicus
gtgaccagttctgttgtacaaactt

SEQ ID NO: 502400 - DNA, 25 bp, Rattus norvegicus
gtgaccatacacaatttctgatacc

SEQ ID NO: 502401 - DNA, 25 bp, Rattus norvegicus
gtgaccatacactatttctgatacc

SEQ ID NO: 502402 - DNA, 25 bp, Rattus norvegicus
gtgaccatacttaaattgaccttga

SEQ ID NO: 502403 - DNA, 25 bp, Rattus norvegicus
gtgaccatactttaattgaccttga

SEQ ID NO: 502404 - DNA, 25 bp, Rattus norvegicus
gtgaccatagagagttctccagatt

SEQ ID NO: 502405 - DNA, 25 bp, Rattus norvegicus
gtgaccatagagtgttctccagatt

SEQ ID NO: 502406 - DNA, 25 bp, Rattus norvegicus
gtgaccatcaagatccagcttcttc

SEQ ID NO: 502407 - DNA, 25 bp, Rattus norvegicus
gtgaccatcaagttccagcttcttc

SEQ ID NO: 502408 - DNA, 25 bp, Rattus norvegicus
gtgaccatcacgcaggagactacaa

SEQ ID NO: 502409 - DNA, 25 bp, Rattus norvegicus
gtgaccatcacggaggagactacaa

SEQ ID NO: 502410 - DNA, 25 bp, Rattus norvegicus
gtgaccatccatactgagttgctag

SEQ ID NO: 502411 - DNA, 25 bp, Rattus norvegicus
gtgaccatccattctgagttgctag

SEQ ID NO: 502412 - DNA, 25 bp, Rattus norvegicus
gtgaccatcccacaccagagaatgt

SEQ ID NO: 502413 - DNA, 25 bp, Rattus norvegicus
gtgaccatcccagaccagagaatgt

SEQ ID NO: 502414 - DNA, 25 bp, Rattus norvegicus
gtgaccatctcaactcagcacagaa

SEQ ID NO: 502415 - DNA, 25 bp, Rattus norvegicus
gtgaccatctcatctcagcacagaa

SEQ ID NO: 502416 - DNA, 25 bp, Rattus norvegicus
gtgaccatgaacaggctcggctgga

SEQ ID NO: 502417 - DNA, 25 bp, Rattus norvegicus
gtgaccatgaactggctcggctgga

SEQ ID NO: 502418 - DNA, 25 bp, Rattus norvegicus
gtgaccatggcgagtacaacgttaa

SEQ ID NO: 502419 - DNA, 25 bp, Rattus norvegicus
gtgaccatggcgtgtacaacgttaa

SEQ ID NO: 502420 - DNA, 25 bp, Rattus norvegicus
gtgaccatggctcacactaagctgt

SEQ ID NO: 502421 - DNA, 25 bp, Rattus norvegicus
gtgaccatggctgacactaagctgt

SEQ ID NO: 502422 - DNA, 25 bp, Rattus norvegicus
gtgaccatggtcagcaagatttaaa

SEQ ID NO: 502423 - DNA, 25 bp, Rattus norvegicus
gtgaccatggtctgcaagatttaaa

SEQ ID NO: 502424 - DNA, 25 bp, Rattus norvegicus
gtgaccattacactcttgggccaga

SEQ ID NO: 502425 - DNA, 25 bp, Rattus norvegicus
gtgaccattacagtcttgggccaga

SEQ ID NO: 502426 - DNA, 25 bp, Rattus norvegicus
gtgaccattatcataagggctcttt

SEQ ID NO: 502427 - DNA, 25 bp, Rattus norvegicus
gtgaccattatcttaagggctcttt

SEQ ID NO: 502428 - DNA, 25 bp, Rattus norvegicus
gtgaccattcgtcatccgagcagtg

SEQ ID NO: 502429 - DNA, 25 bp, Rattus norvegicus
gtgaccattcgtgatccgagcagtg

SEQ ID NO: 502430 - DNA, 25 bp, Rattus norvegicus
gtgaccattctcattaagacctagg

SEQ ID NO: 502431 - DNA, 25 bp, Rattus norvegicus
gtgaccattctctttaagacctagg

SEQ ID NO: 502432 - DNA, 25 bp, Rattus norvegicus
gtgaccattgatactcccaagttag

SEQ ID NO: 502433 - DNA, 25 bp, Rattus norvegicus
gtgaccattgatcttaacattgttt

SEQ ID NO: 502434 - DNA, 25 bp, Rattus norvegicus
gtgaccattgatgttaacattgttt

SEQ ID NO: 502435 - DNA, 25 bp, Rattus norvegicus
gtgaccattgattctcccaagttag

SEQ ID NO: 502436 - DNA, 25 bp, Rattus norvegicus
gtgaccattgtcagcttaacttgat

SEQ ID NO: 502437 - DNA, 25 bp, Rattus norvegicus
gtgaccattgtctgcttaacttgat

SEQ ID NO: 502438 - DNA, 25 bp, Rattus norvegicus
gtgacccaaaaaccaggcgcatcaa

SEQ ID NO: 502439 - DNA, 25 bp, Rattus norvegicus
gtgacccaaaaagcaggcgcatcaa

SEQ ID NO: 502440 - DNA, 25 bp, Rattus norvegicus
gtgacccaaacacgccattgaacca

SEQ ID NO: 502441 - DNA, 25 bp, Rattus norvegicus
gtgacccaaacaggccattgaacca

SEQ ID NO: 502442 - DNA, 25 bp, Rattus norvegicus
gtgacccaaatgaaaccatgccagt

SEQ ID NO: 502443 - DNA, 25 bp, Rattus norvegicus
gtgacccaaatgtaaccatgccagt

SEQ ID NO: 502444 - DNA, 25 bp, Rattus norvegicus
gtgacccaagatcgtggcctgcgaa

SEQ ID NO: 502445 - DNA, 25 bp, Rattus norvegicus
gtgacccaagatggtggcctgcgaa

SEQ ID NO: 502446 - DNA, 25 bp, Rattus norvegicus
gtgacccacatcaccatgatttaag

SEQ ID NO: 502447 - DNA, 25 bp, Rattus norvegicus
gtgacccacatcagagtcgtagtga

SEQ ID NO: 502448 - DNA, 25 bp, Rattus norvegicus
gtgacccacatctccatgatttaag

SEQ ID NO: 502449 - DNA, 25 bp, Rattus norvegicus
gtgacccacatctgagtcgtagtga

SEQ ID NO: 502450 - DNA, 25 bp, Rattus norvegicus
gtgacccacgagcagatagttccag

SEQ ID NO: 502451 - DNA, 25 bp, Rattus norvegicus
gtgacccacgaggagatagttccag

SEQ ID NO: 502452 - DNA, 25 bp, Rattus norvegicus
gtgacccactcacttatcttagtaa

SEQ ID NO: 502453 - DNA, 25 bp, Rattus norvegicus
gtgacccactcagttatcttagtaa

SEQ ID NO: 502454 - DNA, 25 bp, Rattus norvegicus
gtgacccagaaacctctgccatgat

SEQ ID NO: 502455 - DNA, 25 bp, Rattus norvegicus
gtgacccagaaagctctgccatgat

SEQ ID NO: 502456 - DNA, 25 bp, Rattus norvegicus
gtgacccagaacatgaccatgatag

SEQ ID NO: 502457 - DNA, 25 bp, Rattus norvegicus
gtgacccagaacttgaccatgatag

SEQ ID NO: 502458 - DNA, 25 bp, Rattus norvegicus
gtgacccagatgaggagcgctgcct

SEQ ID NO: 502459 - DNA, 25 bp, Rattus norvegicus
gtgacccagatgtggagcgctgcct

SEQ ID NO: 502460 - DNA, 25 bp, Rattus norvegicus
gtgacccagccaaggtctctgagga

SEQ ID NO: 502461 - DNA, 25 bp, Rattus norvegicus
gtgacccagccatggtctctgagga

SEQ ID NO: 502462 - DNA, 25 bp, Rattus norvegicus
gtgacccaggacaggaacatgaact

SEQ ID NO: 502463 - DNA, 25 bp, Rattus norvegicus
gtgacccaggactggaacatgaact

SEQ ID NO: 502464 - DNA, 25 bp, Rattus norvegicus
gtgacccaggagataatgaggtaaa

SEQ ID NO: 502465 - DNA, 25 bp, Rattus norvegicus
gtgacccaggagatgcatttctaag

SEQ ID NO: 502466 - DNA, 25 bp, Rattus norvegicus
gtgacccaggagttaatgaggtaaa

SEQ ID NO: 502467 - DNA, 25 bp, Rattus norvegicus
gtgacccaggagttgcatttctaag

SEQ ID NO: 502468 - DNA, 25 bp, Rattus norvegicus
gtgacccagtctcgaaatgccaaaa

SEQ ID NO: 502469 - DNA, 25 bp, Rattus norvegicus
gtgacccagtctggaaatgccaaaa

SEQ ID NO: 502470 - DNA, 25 bp, Rattus norvegicus
gtgacccatcctaatatatttccca

SEQ ID NO: 502471 - DNA, 25 bp, Rattus norvegicus
gtgacccatccttatatatttccca

SEQ ID NO: 502472 - DNA, 25 bp, Rattus norvegicus
gtgacccatgtactcggttgtagga

SEQ ID NO: 502473 - DNA, 25 bp, Rattus norvegicus
gtgacccatgtagtcggttgtagga

SEQ ID NO: 502474 - DNA, 25 bp, Rattus norvegicus
gtgacccatttacatggcgttctcg

SEQ ID NO: 502475 - DNA, 25 bp, Rattus norvegicus
gtgacccatttagatggcgttctcg

SEQ ID NO: 502476 - DNA, 25 bp, Rattus norvegicus
gtgaccccaagacctaggaggccat

SEQ ID NO: 502477 - DNA, 25 bp, Rattus norvegicus
gtgaccccaagagctaggaggccat

SEQ ID NO: 502478 - DNA, 25 bp, Rattus norvegicus
gtgaccccacagaaggccttgtaaa

SEQ ID NO: 502479 - DNA, 25 bp, Rattus norvegicus
gtgaccccacagtaggccttgtaaa

SEQ ID NO: 502480 - DNA, 25 bp, Rattus norvegicus
gtgaccccagcaccattgtctggaa

SEQ ID NO: 502481 - DNA, 25 bp, Rattus norvegicus
gtgaccccagcagcattgtctggaa

SEQ ID NO: 502482 - DNA, 25 bp, Rattus norvegicus
gtgaccccagccaggaggagcagaa

SEQ ID NO: 502483 - DNA, 25 bp, Rattus norvegicus
gtgaccccagcctggaggagcagaa

SEQ ID NO: 502484 - DNA, 25 bp, Rattus norvegicus
gtgaccccagctatgaagtgttcct

SEQ ID NO: 502485 - DNA, 25 bp, Rattus norvegicus
gtgaccccagctttgaagtgttcct

SEQ ID NO: 502486 - DNA, 25 bp, Rattus norvegicus
gtgaccccaggacaactacagaagc

SEQ ID NO: 502487 - DNA, 25 bp, Rattus norvegicus
gtgaccccaggagaactacagaagc

SEQ ID NO: 502488 - DNA, 25 bp, Rattus norvegicus
gtgaccccagtaattgtccatggag

SEQ ID NO: 502489 - DNA, 25 bp, Rattus norvegicus
gtgaccccagtatttgtccatggag

SEQ ID NO: 502490 - DNA, 25 bp, Rattus norvegicus
gtgaccccgactaccatctggtggg

SEQ ID NO: 502491 - DNA, 25 bp, Rattus norvegicus
gtgaccccgacttccatctggtggg

SEQ ID NO: 502492 - DNA, 25 bp, Rattus norvegicus
gtgacccctatcatgtgtacatcaa

SEQ ID NO: 502493 - DNA, 25 bp, Rattus norvegicus
gtgacccctatcttgtgtacatcaa

SEQ ID NO: 502494 - DNA, 25 bp, Rattus norvegicus
gtgacccggacaaggtgctgcgaat

SEQ ID NO: 502495 - DNA, 25 bp, Rattus norvegicus
gtgacccggacatggtgctgcgaat

SEQ ID NO: 502496 - DNA, 25 bp, Rattus norvegicus
gtgacccggcatctgtgtgaatgat

SEQ ID NO: 502497 - DNA, 25 bp, Rattus norvegicus
gtgacccggcatgtgtgtgaatgat

SEQ ID NO: 502498 - DNA, 25 bp, Rattus norvegicus
gtgacccggtcaatgaaaatcgcca

SEQ ID NO: 502499 - DNA, 25 bp, Rattus norvegicus
gtgacccggtcattgaaaatcgcca

SEQ ID NO: 502500 - DNA, 25 bp, Rattus norvegicus
gtgacccgtcgtcagtggacatgaa

SEQ ID NO: 502501 - DNA, 25 bp, Rattus norvegicus
gtgacccgtcgtgagtggacatgaa

SEQ ID NO: 502502 - DNA, 25 bp, Rattus norvegicus
gtgaccctaagaaacggagcctgta

SEQ ID NO: 502503 - DNA, 25 bp, Rattus norvegicus
gtgaccctaagatacggagcctgta

SEQ ID NO: 502504 - DNA, 25 bp, Rattus norvegicus
gtgaccctagtcagtatttttgctt

SEQ ID NO: 502505 - DNA, 25 bp, Rattus norvegicus
gtgaccctagtctgtatttttgctt

SEQ ID NO: 502506 - DNA, 25 bp, Rattus norvegicus
gtgaccctagttataggccaagcca

SEQ ID NO: 502507 - DNA, 25 bp, Rattus norvegicus
gtgaccctagttttaggccaagcca

SEQ ID NO: 502508 - DNA, 25 bp, Rattus norvegicus
gtgaccctataaatccatgattgag

SEQ ID NO: 502509 - DNA, 25 bp, Rattus norvegicus
gtgaccctataattccatgattgag

SEQ ID NO: 502510 - DNA, 25 bp, Rattus norvegicus
gtgaccctcaatacccgagtggcca

SEQ ID NO: 502511 - DNA, 25 bp, Rattus norvegicus
gtgaccctcaattcccgagtggcca

SEQ ID NO: 502512 - DNA, 25 bp, Rattus norvegicus
gtgaccctcagactacactgcacag

SEQ ID NO: 502513 - DNA, 25 bp, Rattus norvegicus
gtgaccctcagagtacactgcacag

SEQ ID NO: 502514 - DNA, 25 bp, Rattus norvegicus
gtgaccctcaggcatacagaccaaa

SEQ ID NO: 502515 - DNA, 25 bp, Rattus norvegicus
gtgaccctcagggatacagaccaaa

SEQ ID NO: 502516 - DNA, 25 bp, Rattus norvegicus
gtgaccctcagtcgatcgtttatgg

SEQ ID NO: 502517 - DNA, 25 bp, Rattus norvegicus
gtgaccctcagtggatcgtttatgg

SEQ ID NO: 502518 - DNA, 25 bp, Rattus norvegicus
gtgaccctcccgcagcacttggaga

SEQ ID NO: 502519 - DNA, 25 bp, Rattus norvegicus
gtgaccctcccggagcacttggaga

SEQ ID NO: 502520 - DNA, 25 bp, Rattus norvegicus
gtgaccctccctcaagcagtgagca

SEQ ID NO: 502521 - DNA, 25 bp, Rattus norvegicus
gtgaccctccctgaagcagtgagca

SEQ ID NO: 502522 - DNA, 25 bp, Rattus norvegicus
gtgaccctgactccatgaatatcct

SEQ ID NO: 502523 - DNA, 25 bp, Rattus norvegicus
gtgaccctgactgcatgaatatcct

SEQ ID NO: 502524 - DNA, 25 bp, Rattus norvegicus
gtgaccctgagcaatggcatgtttg

SEQ ID NO: 502525 - DNA, 25 bp, Rattus norvegicus
gtgaccctgagctatggcatgtttg

SEQ ID NO: 502526 - DNA, 25 bp, Rattus norvegicus
gtgaccctgattcacctgaaacttg

SEQ ID NO: 502527 - DNA, 25 bp, Rattus norvegicus
gtgaccctgattgacctgaaacttg

SEQ ID NO: 502528 - DNA, 25 bp, Rattus norvegicus
gtgaccctggaaagagtgatggttt

SEQ ID NO: 502529 - DNA, 25 bp, Rattus norvegicus
gtgaccctggaatgagtgatggttt

SEQ ID NO: 502530 - DNA, 25 bp, Rattus norvegicus
gtgaccctggcacacactgtgttca

SEQ ID NO: 502531 - DNA, 25 bp, Rattus norvegicus
gtgaccctggcagacactgtgttca

SEQ ID NO: 502532 - DNA, 25 bp, Rattus norvegicus
gtgaccctggcgaactggcagaaca

SEQ ID NO: 502533 - DNA, 25 bp, Rattus norvegicus
gtgaccctggcgtactggcagaaca

SEQ ID NO: 502534 - DNA, 25 bp, Rattus norvegicus
gtgaccctggctactctggtgagga

SEQ ID NO: 502535 - DNA, 25 bp, Rattus norvegicus
gtgaccctggcttctctggtgagga

SEQ ID NO: 502536 - DNA, 25 bp, Rattus norvegicus
gtgaccctggtgagagtaggcatca

SEQ ID NO: 502537 - DNA, 25 bp, Rattus norvegicus
gtgaccctggtgtgagtaggcatca

SEQ ID NO: 502538 - DNA, 25 bp, Rattus norvegicus
gtgaccctgtctatgcctttttatt

SEQ ID NO: 502539 - DNA, 25 bp, Rattus norvegicus
gtgaccctgtctttgcctttttatt

SEQ ID NO: 502540 - DNA, 25 bp, Rattus norvegicus
gtgaccctgtgtacattgttgtaaa

SEQ ID NO: 502541 - DNA, 25 bp, Rattus norvegicus
gtgaccctgtgttcattgttgtaaa

SEQ ID NO: 502542 - DNA, 25 bp, Rattus norvegicus
gtgacccttaaacctgttgcgggat

SEQ ID NO: 502543 - DNA, 25 bp, Rattus norvegicus
gtgacccttaaactctaacagctac

SEQ ID NO: 502544 - DNA, 25 bp, Rattus norvegicus
gtgacccttaaagctgttgcgggat

SEQ ID NO: 502545 - DNA, 25 bp, Rattus norvegicus
gtgacccttaaagtctaacagctac

SEQ ID NO: 502546 - DNA, 25 bp, Rattus norvegicus
gtgacccttctgagtgggcccaaag

SEQ ID NO: 502547 - DNA, 25 bp, Rattus norvegicus
gtgacccttctgtgtgggcccaaag

SEQ ID NO: 502548 - DNA, 25 bp, Rattus norvegicus
gtgacccttggaagcatggagttct

SEQ ID NO: 502549 - DNA, 25 bp, Rattus norvegicus
gtgacccttggatgcatggagttct

SEQ ID NO: 502550 - DNA, 25 bp, Rattus norvegicus
gtgacccttgtgatatttccatgtc

SEQ ID NO: 502551 - DNA, 25 bp, Rattus norvegicus
gtgacccttgtgttatttccatgtc

SEQ ID NO: 502552 - DNA, 25 bp, Rattus norvegicus
gtgaccctttcaagctttgttgatc

SEQ ID NO: 502553 - DNA, 25 bp, Rattus norvegicus
gtgaccctttcatgctttgttgatc

SEQ ID NO: 502554 - DNA, 25 bp, Rattus norvegicus
gtgaccgaattgagccagtggacat

SEQ ID NO: 502555 - DNA, 25 bp, Rattus norvegicus
gtgaccgaattgtgccagtggacat

SEQ ID NO: 502556 - DNA, 25 bp, Rattus norvegicus
gtgaccgacgacatatatctatagt

SEQ ID NO: 502557 - DNA, 25 bp, Rattus norvegicus
gtgaccgacgacttatatctatagt

SEQ ID NO: 502558 - DNA, 25 bp, Rattus norvegicus
gtgaccgacgttagcttaaggctac

SEQ ID NO: 502559 - DNA, 25 bp, Rattus norvegicus
gtgaccgacgtttgcttaaggctac

SEQ ID NO: 502560 - DNA, 25 bp, Rattus norvegicus
gtgaccgactgacatttctgggaaa

SEQ ID NO: 502561 - DNA, 25 bp, Rattus norvegicus
gtgaccgactgagatttctgggaaa

SEQ ID NO: 502562 - DNA, 25 bp, Rattus norvegicus
gtgaccgattgaaatcaaccgtgtt

SEQ ID NO: 502563 - DNA, 25 bp, Rattus norvegicus
gtgaccgattgatatcaaccgtgtt

SEQ ID NO: 502564 - DNA, 25 bp, Rattus norvegicus
gtgaccgattttccaattatccttt

SEQ ID NO: 502565 - DNA, 25 bp, Rattus norvegicus
gtgaccgattttgcaattatccttt

SEQ ID NO: 502566 - DNA, 25 bp, Rattus norvegicus
gtgaccgcacacatgccagtcaaat

SEQ ID NO: 502567 - DNA, 25 bp, Rattus norvegicus
gtgaccgcacacttgccagtcaaat

SEQ ID NO: 502568 - DNA, 25 bp, Rattus norvegicus
gtgaccgcaccgagattttctgaga

SEQ ID NO: 502569 - DNA, 25 bp, Rattus norvegicus
gtgaccgcaccgtgattttctgaga

SEQ ID NO: 502570 - DNA, 25 bp, Rattus norvegicus
gtgaccgcactgacaggtgatggcc

SEQ ID NO: 502571 - DNA, 25 bp, Rattus norvegicus
gtgaccgcactgtcaggtgatggcc

SEQ ID NO: 502572 - DNA, 25 bp, Rattus norvegicus
gtgaccgcagcgacagtgattctca

SEQ ID NO: 502573 - DNA, 25 bp, Rattus norvegicus
gtgaccgcagcgtcagtgattctca

SEQ ID NO: 502574 - DNA, 25 bp, Rattus norvegicus
gtgaccgcattcagatcttcgtgtg

SEQ ID NO: 502575 - DNA, 25 bp, Rattus norvegicus
gtgaccgcattctgatcttcgtgtg

SEQ ID NO: 502576 - DNA, 25 bp, Rattus norvegicus
gtgaccgccggcaagaactgtggca

SEQ ID NO: 502577 - DNA, 25 bp, Rattus norvegicus
gtgaccgccggctagaactgtggca

SEQ ID NO: 502578 - DNA, 25 bp, Rattus norvegicus
gtgaccgctgtgactctaaccgtga

SEQ ID NO: 502579 - DNA, 25 bp, Rattus norvegicus
gtgaccgctgtgtctctaaccgtga

SEQ ID NO: 502580 - DNA, 25 bp, Rattus norvegicus
gtgaccggaaccagaggccggcaaa

SEQ ID NO: 502581 - DNA, 25 bp, Rattus norvegicus
gtgaccggaacctgaggccggcaaa

SEQ ID NO: 502582 - DNA, 25 bp, Rattus norvegicus
gtgaccggaccacagaggcttttct

SEQ ID NO: 502583 - DNA, 25 bp, Rattus norvegicus
gtgaccggaccagagaggcttttct

SEQ ID NO: 502584 - DNA, 25 bp, Rattus norvegicus
gtgaccggcaccatcattgagaaat

SEQ ID NO: 502585 - DNA, 25 bp, Rattus norvegicus
gtgaccggcaccttcattgagaaat

SEQ ID NO: 502586 - DNA, 25 bp, Rattus norvegicus
gtgaccggcccacatgtatagttgt

SEQ ID NO: 502587 - DNA, 25 bp, Rattus norvegicus
gtgaccggcccagatgtatagttgt

SEQ ID NO: 502588 - DNA, 25 bp, Rattus norvegicus
gtgaccggcgttacagccgctcgga

SEQ ID NO: 502589 - DNA, 25 bp, Rattus norvegicus
gtgaccggcgtttcagccgctcgga

SEQ ID NO: 502590 - DNA, 25 bp, Rattus norvegicus
gtgaccgggcaacacactgttccat

SEQ ID NO: 502591 - DNA, 25 bp, Rattus norvegicus
gtgaccgggcaagacactgttccat

SEQ ID NO: 502592 - DNA, 25 bp, Rattus norvegicus
gtgaccgggtcaacgcgacgggcgg

SEQ ID NO: 502593 - DNA, 25 bp, Rattus norvegicus
gtgaccgggtcatcgcgacgggcgg

SEQ ID NO: 502594 - DNA, 25 bp, Rattus norvegicus
gtgaccggtactatgggacagatgc

SEQ ID NO: 502595 - DNA, 25 bp, Rattus norvegicus
gtgaccggtactttgggacagatgc

SEQ ID NO: 502596 - DNA, 25 bp, Rattus norvegicus
gtgaccgtaattcattttgtaaact

SEQ ID NO: 502597 - DNA, 25 bp, Rattus norvegicus
gtgaccgtaattgattttgtaaact

SEQ ID NO: 502598 - DNA, 25 bp, Rattus norvegicus
gtgaccgtcgtactgataattttga

SEQ ID NO: 502599 - DNA, 25 bp, Rattus norvegicus
gtgaccgtcgtagtgataattttga

SEQ ID NO: 502600 - DNA, 25 bp, Rattus norvegicus
gtgaccgtgacgaggtcgcaccaga

SEQ ID NO: 502601 - DNA, 25 bp, Rattus norvegicus
gtgaccgtgacgtggtcgcaccaga

SEQ ID NO: 502602 - DNA, 25 bp, Rattus norvegicus
gtgaccgtgaggactgtggacaacc

SEQ ID NO: 502603 - DNA, 25 bp, Rattus norvegicus
gtgaccgtgaggtctgtggacaacc

SEQ ID NO: 502604 - DNA, 25 bp, Rattus norvegicus
gtgaccgtggcaatctgtatgacta

SEQ ID NO: 502605 - DNA, 25 bp, Rattus norvegicus
gtgaccgtggcattctgtatgacta

SEQ ID NO: 502606 - DNA, 25 bp, Rattus norvegicus
gtgaccgtgtccctgaatcagtgag

SEQ ID NO: 502607 - DNA, 25 bp, Rattus norvegicus
gtgaccgtgtccgtgaatcagtgag

SEQ ID NO: 502608 - DNA, 25 bp, Rattus norvegicus
gtgaccgttaatcactgtgaggcca

SEQ ID NO: 502609 - DNA, 25 bp, Rattus norvegicus
gtgaccgttaatgactgtgaggcca

SEQ ID NO: 502610 - DNA, 25 bp, Rattus norvegicus
gtgaccgttacaccttcttgtgcaa

SEQ ID NO: 502611 - DNA, 25 bp, Rattus norvegicus
gtgaccgttacagcttcttgtgcaa

SEQ ID NO: 502612 - DNA, 25 bp, Rattus norvegicus
gtgacctaacccagtagactggatc

SEQ ID NO: 502613 - DNA, 25 bp, Rattus norvegicus
gtgacctaaccctgtagactggatc

SEQ ID NO: 502614 - DNA, 25 bp, Rattus norvegicus
gtgacctaagttagacccacctgta

SEQ ID NO: 502615 - DNA, 25 bp, Rattus norvegicus
gtgacctaagtttgacccacctgta

SEQ ID NO: 502616 - DNA, 25 bp, Rattus norvegicus
gtgacctacaagcaagggacatttc

SEQ ID NO: 502617 - DNA, 25 bp, Rattus norvegicus
gtgacctacaaggaagggacatttc

SEQ ID NO: 502618 - DNA, 25 bp, Rattus norvegicus
gtgacctacctaaagagctcggctg

SEQ ID NO: 502619 - DNA, 25 bp, Rattus norvegicus
gtgacctacctatagagctcggctg

SEQ ID NO: 502620 - DNA, 25 bp, Rattus norvegicus
gtgacctactgtctgagctgagacc

SEQ ID NO: 502621 - DNA, 25 bp, Rattus norvegicus
gtgacctactgtgtgagctgagacc

SEQ ID NO: 502622 - DNA, 25 bp, Rattus norvegicus
gtgacctagggcagaagagatcttg

SEQ ID NO: 502623 - DNA, 25 bp, Rattus norvegicus
gtgacctagggctgaagagatcttg

SEQ ID NO: 502624 - DNA, 25 bp, Rattus norvegicus
gtgacctagggtattctgcaagaac

SEQ ID NO: 502625 - DNA, 25 bp, Rattus norvegicus
gtgacctagggttttctgcaagaac

SEQ ID NO: 502626 - DNA, 25 bp, Rattus norvegicus
gtgacctagtctctagcttactctt

SEQ ID NO: 502627 - DNA, 25 bp, Rattus norvegicus
gtgacctagtctgtagcttactctt

SEQ ID NO: 502628 - DNA, 25 bp, Rattus norvegicus
gtgacctataagatagcctgtccaa

SEQ ID NO: 502629 - DNA, 25 bp, Rattus norvegicus
gtgacctataagttagcctgtccaa

SEQ ID NO: 502630 - DNA, 25 bp, Rattus norvegicus
gtgacctatgtcatttttactagag

SEQ ID NO: 502631 - DNA, 25 bp, Rattus norvegicus
gtgacctatgtcttttttactagag

SEQ ID NO: 502632 - DNA, 25 bp, Rattus norvegicus
gtgacctattacactgacataaatc

SEQ ID NO: 502633 - DNA, 25 bp, Rattus norvegicus
gtgacctattactctgacataaatc

SEQ ID NO: 502634 - DNA, 25 bp, Rattus norvegicus
gtgacctcacagatggtctggagca

SEQ ID NO: 502635 - DNA, 25 bp, Rattus norvegicus
gtgacctcacagttggtctggagca

SEQ ID NO: 502636 - DNA, 25 bp, Rattus norvegicus
gtgacctcacccagtttgggaatca

SEQ ID NO: 502637 - DNA, 25 bp, Rattus norvegicus
gtgacctcaccctgtttgggaatca

SEQ ID NO: 502638 - DNA, 25 bp, Rattus norvegicus
gtgacctcacggactcaagtttaat

SEQ ID NO: 502639 - DNA, 25 bp, Rattus norvegicus
gtgacctcacggtctcaagtttaat

SEQ ID NO: 502640 - DNA, 25 bp, Rattus norvegicus
gtgacctcactgcttggtgccctat

SEQ ID NO: 502641 - DNA, 25 bp, Rattus norvegicus
gtgacctcactggttggtgccctat

SEQ ID NO: 502642 - DNA, 25 bp, Rattus norvegicus
gtgacctcagagctttctaccgcaa

SEQ ID NO: 502643 - DNA, 25 bp, Rattus norvegicus
gtgacctcagaggtttctaccgcaa

SEQ ID NO: 502644 - DNA, 25 bp, Rattus norvegicus
gtgacctcagtgaagctcaacacag

SEQ ID NO: 502645 - DNA, 25 bp, Rattus norvegicus
gtgacctcagtgtagctcaacacag

SEQ ID NO: 502646 - DNA, 25 bp, Rattus norvegicus
gtgacctcagttatatccccagaac

SEQ ID NO: 502647 - DNA, 25 bp, Rattus norvegicus
gtgacctcagttttatccccagaac

SEQ ID NO: 502648 - DNA, 25 bp, Rattus norvegicus
gtgacctcatagacagcagcatgct

SEQ ID NO: 502649 - DNA, 25 bp, Rattus norvegicus
gtgacctcatagtcagcagcatgct

SEQ ID NO: 502650 - DNA, 25 bp, Rattus norvegicus
gtgacctcatcaacttggccaagaa

SEQ ID NO: 502651 - DNA, 25 bp, Rattus norvegicus
gtgacctcatcatcttggccaagaa

SEQ ID NO: 502652 - DNA, 25 bp, Rattus norvegicus
gtgacctcatgcacattcctcaatg

SEQ ID NO: 502653 - DNA, 25 bp, Rattus norvegicus
gtgacctcatgctcattcctcaatg

SEQ ID NO: 502654 - DNA, 25 bp, Rattus norvegicus
gtgacctcatggagactgacatctt

SEQ ID NO: 502655 - DNA, 25 bp, Rattus norvegicus
gtgacctcatggtgactgacatctt

SEQ ID NO: 502656 - DNA, 25 bp, Rattus norvegicus
gtgacctcatgtatctgaaaggcta

SEQ ID NO: 502657 - DNA, 25 bp, Rattus norvegicus
gtgacctcatgtttctgaaaggcta

SEQ ID NO: 502658 - DNA, 25 bp, Rattus norvegicus
gtgacctccacgagacactgaaaat

SEQ ID NO: 502659 - DNA, 25 bp, Rattus norvegicus
gtgacctccacgtgacactgaaaat

SEQ ID NO: 502660 - DNA, 25 bp, Rattus norvegicus
gtgacctccagtccatattagacca

SEQ ID NO: 502661 - DNA, 25 bp, Rattus norvegicus
gtgacctccagtgcatattagacca

SEQ ID NO: 502662 - DNA, 25 bp, Rattus norvegicus
gtgacctcctaacctatagctattg

SEQ ID NO: 502663 - DNA, 25 bp, Rattus norvegicus
gtgacctcctaagctatagctattg

SEQ ID NO: 502664 - DNA, 25 bp, Rattus norvegicus
gtgacctcctttcaaattaacatgt

SEQ ID NO: 502665 - DNA, 25 bp, Rattus norvegicus
gtgacctcctttgaaattaacatgt

SEQ ID NO: 502666 - DNA, 25 bp, Rattus norvegicus
gtgacctctaccacatcaatatgat

SEQ ID NO: 502667 - DNA, 25 bp, Rattus norvegicus
gtgacctctacctcatcaatatgat

SEQ ID NO: 502668 - DNA, 25 bp, Rattus norvegicus
gtgacctctcatcttgcagctgtag

SEQ ID NO: 502669 - DNA, 25 bp, Rattus norvegicus
gtgacctctcatgttgcagctgtag

SEQ ID NO: 502670 - DNA, 25 bp, Rattus norvegicus
gtgacctctccaacatcatgttgat

SEQ ID NO: 502671 - DNA, 25 bp, Rattus norvegicus
gtgacctctccatcatcatgttgat

SEQ ID NO: 502672 - DNA, 25 bp, Rattus norvegicus
gtgacctctgagatgtattccatga

SEQ ID NO: 502673 - DNA, 25 bp, Rattus norvegicus
gtgacctctgagttgtattccatga

SEQ ID NO: 502674 - DNA, 25 bp, Rattus norvegicus
gtgacctctgtcaaaaggcctttca

SEQ ID NO: 502675 - DNA, 25 bp, Rattus norvegicus
gtgacctctgtcagtgtaacttgac

SEQ ID NO: 502676 - DNA, 25 bp, Rattus norvegicus
gtgacctctgtctaaaggcctttca

SEQ ID NO: 502677 - DNA, 25 bp, Rattus norvegicus
gtgacctctgtctgtgtaacttgac

SEQ ID NO: 502678 - DNA, 25 bp, Rattus norvegicus
gtgacctctgttctaagatgactta

SEQ ID NO: 502679 - DNA, 25 bp, Rattus norvegicus
gtgacctctgttgtaagatgactta

SEQ ID NO: 502680 - DNA, 25 bp, Rattus norvegicus
gtgacctcttctaagctgaggtggt

SEQ ID NO: 502681 - DNA, 25 bp, Rattus norvegicus
gtgacctcttcttagctgaggtggt

SEQ ID NO: 502682 - DNA, 25 bp, Rattus norvegicus
gtgacctctttaacctatcagctga

SEQ ID NO: 502683 - DNA, 25 bp, Rattus norvegicus
gtgacctctttatcctatcagctga

SEQ ID NO: 502684 - DNA, 25 bp, Rattus norvegicus
gtgacctgaattatccataacttga

SEQ ID NO: 502685 - DNA, 25 bp, Rattus norvegicus
gtgacctgaattttccataacttga

SEQ ID NO: 502686 - DNA, 25 bp, Rattus norvegicus
gtgacctgacacatcacatatgtgt

SEQ ID NO: 502687 - DNA, 25 bp, Rattus norvegicus
gtgacctgacacttcacatatgtgt

SEQ ID NO: 502688 - DNA, 25 bp, Rattus norvegicus
gtgacctgagagatgacatggccaa

SEQ ID NO: 502689 - DNA, 25 bp, Rattus norvegicus
gtgacctgagagttgacatggccaa

SEQ ID NO: 502690 - DNA, 25 bp, Rattus norvegicus
gtgacctgaggaatgtcagccgttc

SEQ ID NO: 502691 - DNA, 25 bp, Rattus norvegicus
gtgacctgaggattgtcagccgttc

SEQ ID NO: 502692 - DNA, 25 bp, Rattus norvegicus
gtgacctgatcccatttaacttgag

SEQ ID NO: 502693 - DNA, 25 bp, Rattus norvegicus
gtgacctgatccgatttaacttgag

SEQ ID NO: 502694 - DNA, 25 bp, Rattus norvegicus
gtgacctgattcctttgctttaggg

SEQ ID NO: 502695 - DNA, 25 bp, Rattus norvegicus
gtgacctgattcgtttgctttaggg

SEQ ID NO: 502696 - DNA, 25 bp, Rattus norvegicus
gtgacctgctcaccggcgagtccat

SEQ ID NO: 502697 - DNA, 25 bp, Rattus norvegicus
gtgacctgctcagcggcgagtccat

SEQ ID NO: 502698 - DNA, 25 bp, Rattus norvegicus
gtgacctgctggcacagagaaccac

SEQ ID NO: 502699 - DNA, 25 bp, Rattus norvegicus
gtgacctgctgggacagagaaccac

SEQ ID NO: 502700 - DNA, 25 bp, Rattus norvegicus
gtgacctgcttacagttcaacaaga

SEQ ID NO: 502701 - DNA, 25 bp, Rattus norvegicus
gtgacctgcttagagttcaacaaga

SEQ ID NO: 502702 - DNA, 25 bp, Rattus norvegicus
gtgacctggaatcaactatgtaagt

SEQ ID NO: 502703 - DNA, 25 bp, Rattus norvegicus
gtgacctggaatgaactatgtaagt

SEQ ID NO: 502704 - DNA, 25 bp, Rattus norvegicus
gtgacctggagcaagctaggctgta

SEQ ID NO: 502705 - DNA, 25 bp, Rattus norvegicus
gtgacctggagctagctaggctgta

SEQ ID NO: 502706 - DNA, 25 bp, Rattus norvegicus
gtgacctgggccaatgtatgatacc

SEQ ID NO: 502707 - DNA, 25 bp, Rattus norvegicus
gtgacctgggcctatgtatgatacc

SEQ ID NO: 502708 - DNA, 25 bp, Rattus norvegicus
gtgacctgggtcacttaaaaaccat

SEQ ID NO: 502709 - DNA, 25 bp, Rattus norvegicus
gtgacctgggtctcttaaaaaccat

SEQ ID NO: 502710 - DNA, 25 bp, Rattus norvegicus
gtgacctgtcctagtctatgtttga

SEQ ID NO: 502711 - DNA, 25 bp, Rattus norvegicus
gtgacctgtccttgtctatgtttga

SEQ ID NO: 502712 - DNA, 25 bp, Rattus norvegicus
gtgacctgtgatcgccaaagacgtt

SEQ ID NO: 502713 - DNA, 25 bp, Rattus norvegicus
gtgacctgtgatggccaaagacgtt

SEQ ID NO: 502714 - DNA, 25 bp, Rattus norvegicus
gtgacctgtgcaaggattgtgcctt

SEQ ID NO: 502715 - DNA, 25 bp, Rattus norvegicus
gtgacctgtgcatggattgtgcctt

SEQ ID NO: 502716 - DNA, 25 bp, Rattus norvegicus
gtgacctgtgttatcgtgtgtatca

SEQ ID NO: 502717 - DNA, 25 bp, Rattus norvegicus
gtgacctgtgttttcgtgtgtatca

SEQ ID NO: 502718 - DNA, 25 bp, Rattus norvegicus
gtgaccttacctaatgtagttgcta

SEQ ID NO: 502719 - DNA, 25 bp, Rattus norvegicus
gtgaccttaccttatgtagttgcta

SEQ ID NO: 502720 - DNA, 25 bp, Rattus norvegicus
gtgaccttacttcctagtacgtgaa

SEQ ID NO: 502721 - DNA, 25 bp, Rattus norvegicus
gtgaccttacttgctagtacgtgaa

SEQ ID NO: 502722 - DNA, 25 bp, Rattus norvegicus
gtgaccttagcgattagttttctag

SEQ ID NO: 502723 - DNA, 25 bp, Rattus norvegicus
gtgaccttagcgtttagttttctag

SEQ ID NO: 502724 - DNA, 25 bp, Rattus norvegicus
gtgaccttatttccctagactacga

SEQ ID NO: 502725 - DNA, 25 bp, Rattus norvegicus
gtgaccttatttgcctagactacga

SEQ ID NO: 502726 - DNA, 25 bp, Rattus norvegicus
gtgaccttcaacagcagatcttaga

SEQ ID NO: 502727 - DNA, 25 bp, Rattus norvegicus
gtgaccttcaactgcagatcttaga

SEQ ID NO: 502728 - DNA, 25 bp, Rattus norvegicus
gtgaccttcacaaagctaccaagct

SEQ ID NO: 502729 - DNA, 25 bp, Rattus norvegicus
gtgaccttcacatagctaccaagct

SEQ ID NO: 502730 - DNA, 25 bp, Rattus norvegicus
gtgaccttcactcttgaacctgatt

SEQ ID NO: 502731 - DNA, 25 bp, Rattus norvegicus
gtgaccttcactgttgaacctgatt

SEQ ID NO: 502732 - DNA, 25 bp, Rattus norvegicus
gtgaccttccagagggtagcattct

SEQ ID NO: 502733 - DNA, 25 bp, Rattus norvegicus
gtgaccttccagtgggtagcattct

SEQ ID NO: 502734 - DNA, 25 bp, Rattus norvegicus
gtgaccttccatcgactgttcaaaa

SEQ ID NO: 502735 - DNA, 25 bp, Rattus norvegicus
gtgaccttccatggactgttcaaaa

SEQ ID NO: 502736 - DNA, 25 bp, Rattus norvegicus
gtgaccttccgccatggtgtctaag

SEQ ID NO: 502737 - DNA, 25 bp, Rattus norvegicus
gtgaccttccgcgatggtgtctaag

SEQ ID NO: 502738 - DNA, 25 bp, Rattus norvegicus
gtgaccttccggctctatgatgttc

SEQ ID NO: 502739 - DNA, 25 bp, Rattus norvegicus
gtgaccttccgggtctatgatgttc

SEQ ID NO: 502740 - DNA, 25 bp, Rattus norvegicus
gtgaccttcttcaagttatgaggaa

SEQ ID NO: 502741 - DNA, 25 bp, Rattus norvegicus
gtgaccttcttctagttatgaggaa

SEQ ID NO: 502742 - DNA, 25 bp, Rattus norvegicus
gtgaccttgaaacctcagagcctgt

SEQ ID NO: 502743 - DNA, 25 bp, Rattus norvegicus
gtgaccttgaaagctcagagcctgt

SEQ ID NO: 502744 - DNA, 25 bp, Rattus norvegicus
gtgaccttgcagaaagtctaactaa

SEQ ID NO: 502745 - DNA, 25 bp, Rattus norvegicus
gtgaccttgcagtaagtctaactaa

SEQ ID NO: 502746 - DNA, 25 bp, Rattus norvegicus
gtgaccttgcggcagccaatgaacc

SEQ ID NO: 502747 - DNA, 25 bp, Rattus norvegicus
gtgaccttgcgggagccaatgaacc

SEQ ID NO: 502748 - DNA, 25 bp, Rattus norvegicus
gtgaccttggagagagtagtttttc

SEQ ID NO: 502749 - DNA, 25 bp, Rattus norvegicus
gtgaccttggagtgagtagtttttc

SEQ ID NO: 502750 - DNA, 25 bp, Rattus norvegicus
gtgaccttggcgacagtggagagaa

SEQ ID NO: 502751 - DNA, 25 bp, Rattus norvegicus
gtgaccttggcgtcagtggagagaa

SEQ ID NO: 502752 - DNA, 25 bp, Rattus norvegicus
gtgaccttggttcataattctgttc

SEQ ID NO: 502753 - DNA, 25 bp, Rattus norvegicus
gtgaccttggttgataattctgttc

SEQ ID NO: 502754 - DNA, 25 bp, Rattus norvegicus
gtgaccttgtttcaggaggtgcatc

SEQ ID NO: 502755 - DNA, 25 bp, Rattus norvegicus
gtgaccttgtttgaggaggtgcatc

SEQ ID NO: 502756 - DNA, 25 bp, Rattus norvegicus
gtgacctttacgagttcttgttatg

SEQ ID NO: 502757 - DNA, 25 bp, Rattus norvegicus
gtgacctttacgtgttcttgttatg

SEQ ID NO: 502758 - DNA, 25 bp, Rattus norvegicus
gtgacctttcaaccatgtgtcccat

SEQ ID NO: 502759 - DNA, 25 bp, Rattus norvegicus
gtgacctttcaagcatgtgtcccat

SEQ ID NO: 502760 - DNA, 25 bp, Rattus norvegicus
gtgacctttcaccttttcagactgc

SEQ ID NO: 502761 - DNA, 25 bp, Rattus norvegicus
gtgacctttcacgttttcagactgc

SEQ ID NO: 502762 - DNA, 25 bp, Rattus norvegicus
gtgacctttccaatccaagaactat

SEQ ID NO: 502763 - DNA, 25 bp, Rattus norvegicus
gtgacctttccattccaagaactat

SEQ ID NO: 502764 - DNA, 25 bp, Rattus norvegicus
gtgacctttcttaaatgttgccaac

SEQ ID NO: 502765 - DNA, 25 bp, Rattus norvegicus
gtgacctttctttaatgttgccaac

SEQ ID NO: 502766 - DNA, 25 bp, Rattus norvegicus
gtgacctttgccagcaacctggcga

SEQ ID NO: 502767 - DNA, 25 bp, Rattus norvegicus
gtgacctttgcctgcaacctggcga

SEQ ID NO: 502768 - DNA, 25 bp, Rattus norvegicus
gtgacctttgctatctgtggagcca

SEQ ID NO: 502769 - DNA, 25 bp, Rattus norvegicus
gtgacctttgctttctgtggagcca

SEQ ID NO: 502770 - DNA, 25 bp, Rattus norvegicus
gtgaccttttcaatttagcttattt

SEQ ID NO: 502771 - DNA, 25 bp, Rattus norvegicus
gtgaccttttcattttagcttattt

SEQ ID NO: 502772 - DNA, 25 bp, Rattus norvegicus
gtgacgaaaacgcaccttgccttgg

SEQ ID NO: 502773 - DNA, 25 bp, Rattus norvegicus
gtgacgaaaacggaccttgccttgg

SEQ ID NO: 502774 - DNA, 25 bp, Rattus norvegicus
gtgacgaaaggaatcttccccgaag

SEQ ID NO: 502775 - DNA, 25 bp, Rattus norvegicus
gtgacgaaaggattcttccccgaag

SEQ ID NO: 502776 - DNA, 25 bp, Rattus norvegicus
gtgacgaacctgcatgtgtctggca

SEQ ID NO: 502777 - DNA, 25 bp, Rattus norvegicus
gtgacgaacctggatgtgtctggca

SEQ ID NO: 502778 - DNA, 25 bp, Rattus norvegicus
gtgacgaatgtcagtttatagtctt

SEQ ID NO: 502779 - DNA, 25 bp, Rattus norvegicus
gtgacgaatgtctgtttatagtctt

SEQ ID NO: 502780 - DNA, 25 bp, Rattus norvegicus
gtgacgacacgtctacaactatagt

SEQ ID NO: 502781 - DNA, 25 bp, Rattus norvegicus
gtgacgacacgtgtacaactatagt

SEQ ID NO: 502782 - DNA, 25 bp, Rattus norvegicus
gtgacgaccccaacagtggtggaga

SEQ ID NO: 502783 - DNA, 25 bp, Rattus norvegicus
gtgacgaccccatcagtggtggaga

SEQ ID NO: 502784 - DNA, 25 bp, Rattus norvegicus
gtgacgactaccaacacatggtgca

SEQ ID NO: 502785 - DNA, 25 bp, Rattus norvegicus
gtgacgactacctacacatggtgca

SEQ ID NO: 502786 - DNA, 25 bp, Rattus norvegicus
gtgacgagccacagaagttcttctt

SEQ ID NO: 502787 - DNA, 25 bp, Rattus norvegicus
gtgacgagccactgaagttcttctt

SEQ ID NO: 502788 - DNA, 25 bp, Rattus norvegicus
gtgacgagtagtatccagatggcca

SEQ ID NO: 502789 - DNA, 25 bp, Rattus norvegicus
gtgacgagtagtttccagatggcca

SEQ ID NO: 502790 - DNA, 25 bp, Rattus norvegicus
gtgacgatcacacaccttcgataaa

SEQ ID NO: 502791 - DNA, 25 bp, Rattus norvegicus
gtgacgatcacagaccttcgataaa

SEQ ID NO: 502792 - DNA, 25 bp, Rattus norvegicus
gtgacgatgacaacagtgacccggt

SEQ ID NO: 502793 - DNA, 25 bp, Rattus norvegicus
gtgacgatgacatcagtgacccggt

SEQ ID NO: 502794 - DNA, 25 bp, Rattus norvegicus
gtgacgatttgcagactgaccatga

SEQ ID NO: 502795 - DNA, 25 bp, Rattus norvegicus
gtgacgatttgctgactgaccatga

SEQ ID NO: 502796 - DNA, 25 bp, Rattus norvegicus
gtgacgcaaaatcaactactgactg

SEQ ID NO: 502797 - DNA, 25 bp, Rattus norvegicus
gtgacgcaaaatgaactactgactg

SEQ ID NO: 502798 - DNA, 25 bp, Rattus norvegicus
gtgacgcacaaacagtagagctggt

SEQ ID NO: 502799 - DNA, 25 bp, Rattus norvegicus
gtgacgcacaaagagtagagctggt

SEQ ID NO: 502800 - DNA, 25 bp, Rattus norvegicus
gtgacgcacagtcggtgacaatcat

SEQ ID NO: 502801 - DNA, 25 bp, Rattus norvegicus
gtgacgcacagtgggtgacaatcat

SEQ ID NO: 502802 - DNA, 25 bp, Rattus norvegicus
gtgacgcacgagattgaccgctaca

SEQ ID NO: 502803 - DNA, 25 bp, Rattus norvegicus
gtgacgcacgagtttgaccgctaca

SEQ ID NO: 502804 - DNA, 25 bp, Rattus norvegicus
gtgacgccaatgacctaaacagtta

SEQ ID NO: 502805 - DNA, 25 bp, Rattus norvegicus
gtgacgccaatgtcctaaacagtta

SEQ ID NO: 502806 - DNA, 25 bp, Rattus norvegicus
gtgacgccataaccaaaacctgtga

SEQ ID NO: 502807 - DNA, 25 bp, Rattus norvegicus
gtgacgccataagcaaaacctgtga

SEQ ID NO: 502808 - DNA, 25 bp, Rattus norvegicus
gtgacgcccattatgtccttttggt

SEQ ID NO: 502809 - DNA, 25 bp, Rattus norvegicus
gtgacgcccattttgtccttttggt

SEQ ID NO: 502810 - DNA, 25 bp, Rattus norvegicus
gtgacgccccgcaatgcagttcaga

SEQ ID NO: 502811 - DNA, 25 bp, Rattus norvegicus
gtgacgccccgctatgcagttcaga

SEQ ID NO: 502812 - DNA, 25 bp, Rattus norvegicus
gtgacgcctatgactatctcagcag

SEQ ID NO: 502813 - DNA, 25 bp, Rattus norvegicus
gtgacgcctatgtctatctcagcag

SEQ ID NO: 502814 - DNA, 25 bp, Rattus norvegicus
gtgacgctcaatactgtgttacagt

SEQ ID NO: 502815 - DNA, 25 bp, Rattus norvegicus
gtgacgctcaattctgtgttacagt

SEQ ID NO: 502816 - DNA, 25 bp, Rattus norvegicus
gtgacgctcattcaacagtttcaga

SEQ ID NO: 502817 - DNA, 25 bp, Rattus norvegicus
gtgacgctcattgaacagtttcaga

SEQ ID NO: 502818 - DNA, 25 bp, Rattus norvegicus
gtgacgctgagaactgtgacatcga

SEQ ID NO: 502819 - DNA, 25 bp, Rattus norvegicus
gtgacgctgagatctgtgacatcga

SEQ ID NO: 502820 - DNA, 25 bp, Rattus norvegicus
gtgacgctgagtatcatccattgcc

SEQ ID NO: 502821 - DNA, 25 bp, Rattus norvegicus
gtgacgctgagtttcatccattgcc

SEQ ID NO: 502822 - DNA, 25 bp, Rattus norvegicus
gtgacgctgcagacaaagccgtgtc

SEQ ID NO: 502823 - DNA, 25 bp, Rattus norvegicus
gtgacgctgcagtcaaagccgtgtc

SEQ ID NO: 502824 - DNA, 25 bp, Rattus norvegicus
gtgacgctgcctatttatatactgt

SEQ ID NO: 502825 - DNA, 25 bp, Rattus norvegicus
gtgacgctgcctttttatatactgt

SEQ ID NO: 502826 - DNA, 25 bp, Rattus norvegicus
gtgacgctgtctaagtgagttctga

SEQ ID NO: 502827 - DNA, 25 bp, Rattus norvegicus
gtgacgctgtcttagtgagttctga

SEQ ID NO: 502828 - DNA, 25 bp, Rattus norvegicus
gtgacgctttaactctgactttatg

SEQ ID NO: 502829 - DNA, 25 bp, Rattus norvegicus
gtgacgctttaagtctgactttatg

SEQ ID NO: 502830 - DNA, 25 bp, Rattus norvegicus
gtgacgctttgcagccttagactgt

SEQ ID NO: 502831 - DNA, 25 bp, Rattus norvegicus
gtgacgctttgctgccttagactgt

SEQ ID NO: 502832 - DNA, 25 bp, Rattus norvegicus
gtgacggaaccgcttcttgcaaact

SEQ ID NO: 502833 - DNA, 25 bp, Rattus norvegicus
gtgacggaaccggttcttgcaaact

SEQ ID NO: 502834 - DNA, 25 bp, Rattus norvegicus
gtgacggacttaaattgcctttgtt

SEQ ID NO: 502835 - DNA, 25 bp, Rattus norvegicus
gtgacggacttatattgcctttgtt

SEQ ID NO: 502836 - DNA, 25 bp, Rattus norvegicus
gtgacggagcagagcctaggcccta

SEQ ID NO: 502837 - DNA, 25 bp, Rattus norvegicus
gtgacggagcagtgcctaggcccta

SEQ ID NO: 502838 - DNA, 25 bp, Rattus norvegicus
gtgacggatcagaagggccattgac

SEQ ID NO: 502839 - DNA, 25 bp, Rattus norvegicus
gtgacggatcagtagggccattgac

SEQ ID NO: 502840 - DNA, 25 bp, Rattus norvegicus
gtgacggatctgagcagtacccaat

SEQ ID NO: 502841 - DNA, 25 bp, Rattus norvegicus
gtgacggatctgtgcagtacccaat

SEQ ID NO: 502842 - DNA, 25 bp, Rattus norvegicus
gtgacggcagtgacattgtcaacaa

SEQ ID NO: 502843 - DNA, 25 bp, Rattus norvegicus
gtgacggcagtgtcattgtcaacaa

SEQ ID NO: 502844 - DNA, 25 bp, Rattus norvegicus
gtgacggccaccagcaaggttatgc

SEQ ID NO: 502845 - DNA, 25 bp, Rattus norvegicus
gtgacggccacctgcaaggttatgc

SEQ ID NO: 502846 - DNA, 25 bp, Rattus norvegicus
gtgacgggcaacatcccttctacct

SEQ ID NO: 502847 - DNA, 25 bp, Rattus norvegicus
gtgacgggcaacttcccttctacct

SEQ ID NO: 502848 - DNA, 25 bp, Rattus norvegicus
gtgacggtagacaagaagactctgg

SEQ ID NO: 502849 - DNA, 25 bp, Rattus norvegicus
gtgacggtagactagaagactctgg

SEQ ID NO: 502850 - DNA, 25 bp, Rattus norvegicus
gtgacggtgactatgctgacttcca

SEQ ID NO: 502851 - DNA, 25 bp, Rattus norvegicus
gtgacggtgactttgctgacttcca

SEQ ID NO: 502852 - DNA, 25 bp, Rattus norvegicus
gtgacggtgcctaggaactgattct

SEQ ID NO: 502853 - DNA, 25 bp, Rattus norvegicus
gtgacggtgccttggaactgattct

SEQ ID NO: 502854 - DNA, 25 bp, Rattus norvegicus
gtgacggttgaaatttgcttggctc

SEQ ID NO: 502855 - DNA, 25 bp, Rattus norvegicus
gtgacggttgaattttgcttggctc

SEQ ID NO: 502856 - DNA, 25 bp, Rattus norvegicus
gtgacgtaacctacagtggattatc

SEQ ID NO: 502857 - DNA, 25 bp, Rattus norvegicus
gtgacgtaaccttcagtggattatc

SEQ ID NO: 502858 - DNA, 25 bp, Rattus norvegicus
gtgacgtacatcatcatgcatgcag

SEQ ID NO: 502859 - DNA, 25 bp, Rattus norvegicus
gtgacgtacatcttcatgcatgcag

SEQ ID NO: 502860 - DNA, 25 bp, Rattus norvegicus
gtgacgtacttcatccaaaaagctt

SEQ ID NO: 502861 - DNA, 25 bp, Rattus norvegicus
gtgacgtacttcttccaaaaagctt

SEQ ID NO: 502862 - DNA, 25 bp, Rattus norvegicus
gtgacgtagcctatgtactgagaca

SEQ ID NO: 502863 - DNA, 25 bp, Rattus norvegicus
gtgacgtagcctttgtactgagaca

SEQ ID NO: 502864 - DNA, 25 bp, Rattus norvegicus
gtgacgtatttaatgtgctctctcc

SEQ ID NO: 502865 - DNA, 25 bp, Rattus norvegicus
gtgacgtatttattgtgctctctcc

SEQ ID NO: 502866 - DNA, 25 bp, Rattus norvegicus
gtgacgtcaccccagtctaagtgaa

SEQ ID NO: 502867 - DNA, 25 bp, Rattus norvegicus
gtgacgtcacccgagtctaagtgaa

SEQ ID NO: 502868 - DNA, 25 bp, Rattus norvegicus
gtgacgtcccaactgcagaagctga

SEQ ID NO: 502869 - DNA, 25 bp, Rattus norvegicus
gtgacgtcccaagtgcagaagctga

SEQ ID NO: 502870 - DNA, 25 bp, Rattus norvegicus
gtgacgtcgtgacgagagctttaaa

SEQ ID NO: 502871 - DNA, 25 bp, Rattus norvegicus
gtgacgtcgtgaggagagctttaaa

SEQ ID NO: 502872 - DNA, 25 bp, Rattus norvegicus
gtgacgtctccaagagccaagggca

SEQ ID NO: 502873 - DNA, 25 bp, Rattus norvegicus
gtgacgtctccactagaaaccgatc

SEQ ID NO: 502874 - DNA, 25 bp, Rattus norvegicus
gtgacgtctccagtagaaaccgatc

SEQ ID NO: 502875 - DNA, 25 bp, Rattus norvegicus
gtgacgtctccatgagccaagggca

SEQ ID NO: 502876 - DNA, 25 bp, Rattus norvegicus
gtgacgtctcttagttaacctaagt

SEQ ID NO: 502877 - DNA, 25 bp, Rattus norvegicus
gtgacgtctctttgttaacctaagt

SEQ ID NO: 502878 - DNA, 25 bp, Rattus norvegicus
gtgacgtgatccacaatgctgggcc

SEQ ID NO: 502879 - DNA, 25 bp, Rattus norvegicus
gtgacgtgatcctcaatgctgggcc

SEQ ID NO: 502880 - DNA, 25 bp, Rattus norvegicus
gtgacgtgcttgagcttacagtggc

SEQ ID NO: 502881 - DNA, 25 bp, Rattus norvegicus
gtgacgtgcttgtgcttacagtggc

SEQ ID NO: 502882 - DNA, 25 bp, Rattus norvegicus
gtgacgtgtacaagtcctcagttcc

SEQ ID NO: 502883 - DNA, 25 bp, Rattus norvegicus
gtgacgtgtacatgtcctcagttcc

SEQ ID NO: 502884 - DNA, 25 bp, Rattus norvegicus
gtgacgtgtgttaatcctatagaga

SEQ ID NO: 502885 - DNA, 25 bp, Rattus norvegicus
gtgacgtgtgtttatcctatagaga

SEQ ID NO: 502886 - DNA, 25 bp, Rattus norvegicus
gtgacgttcaagagtttccctggca

SEQ ID NO: 502887 - DNA, 25 bp, Rattus norvegicus
gtgacgttcaagtgtttccctggca

SEQ ID NO: 502888 - DNA, 25 bp, Rattus norvegicus
gtgacgttccctatatcttgtgaca

SEQ ID NO: 502889 - DNA, 25 bp, Rattus norvegicus
gtgacgttccctttatcttgtgaca

SEQ ID NO: 502890 - DNA, 25 bp, Rattus norvegicus
gtgacgttctccatatttaatactg

SEQ ID NO: 502891 - DNA, 25 bp, Rattus norvegicus
gtgacgttctccttatttaatactg

SEQ ID NO: 502892 - DNA, 25 bp, Rattus norvegicus
gtgacgttctggagctgttggacaa

SEQ ID NO: 502893 - DNA, 25 bp, Rattus norvegicus
gtgacgttctggtgctgttggacaa

SEQ ID NO: 502894 - DNA, 25 bp, Rattus norvegicus
gtgacgttctttctctaaggttgag

SEQ ID NO: 502895 - DNA, 25 bp, Rattus norvegicus
gtgacgttctttgtctaaggttgag

SEQ ID NO: 502896 - DNA, 25 bp, Rattus norvegicus
gtgactaaaagaagtgtcgattgtt

SEQ ID NO: 502897 - DNA, 25 bp, Rattus norvegicus
gtgactaaaagatgtgtcgattgtt

SEQ ID NO: 502898 - DNA, 25 bp, Rattus norvegicus
gtgactaaagttatttatgaggcat

SEQ ID NO: 502899 - DNA, 25 bp, Rattus norvegicus
gtgactaaagttttttatgaggcat

SEQ ID NO: 502900 - DNA, 25 bp, Rattus norvegicus
gtgactaaatatcagatccttttct

SEQ ID NO: 502901 - DNA, 25 bp, Rattus norvegicus
gtgactaaatatgagatccttttct

SEQ ID NO: 502902 - DNA, 25 bp, Rattus norvegicus
gtgactaaccacagtgaccacttct

SEQ ID NO: 502903 - DNA, 25 bp, Rattus norvegicus
gtgactaaccactgtgaccacttct

SEQ ID NO: 502904 - DNA, 25 bp, Rattus norvegicus
gtgactaaccatattcactatgcat

SEQ ID NO: 502905 - DNA, 25 bp, Rattus norvegicus
gtgactaaccattttcactatgcat

SEQ ID NO: 502906 - DNA, 25 bp, Rattus norvegicus
gtgactaagcctagacacgggtctt

SEQ ID NO: 502907 - DNA, 25 bp, Rattus norvegicus
gtgactaagccttgacacgggtctt

SEQ ID NO: 502908 - DNA, 25 bp, Rattus norvegicus
gtgactaagtggctgattccctcac

SEQ ID NO: 502909 - DNA, 25 bp, Rattus norvegicus
gtgactaagtgggtgattccctcac

SEQ ID NO: 502910 - DNA, 25 bp, Rattus norvegicus
gtgactaatcatcgcacctccattt

SEQ ID NO: 502911 - DNA, 25 bp, Rattus norvegicus
gtgactaatcatggcacctccattt

SEQ ID NO: 502912 - DNA, 25 bp, Rattus norvegicus
gtgactaatttcagcttctagcact

SEQ ID NO: 502913 - DNA, 25 bp, Rattus norvegicus
gtgactaatttctgcttctagcact

SEQ ID NO: 502914 - DNA, 25 bp, Rattus norvegicus
gtgactacaaagacaatcgcctgct

SEQ ID NO: 502915 - DNA, 25 bp, Rattus norvegicus
gtgactacaaagtcaatcgcctgct

SEQ ID NO: 502916 - DNA, 25 bp, Rattus norvegicus
gtgactacaatgaattttgcatcct

SEQ ID NO: 502917 - DNA, 25 bp, Rattus norvegicus
gtgactacaatgtattttgcatcct

SEQ ID NO: 502918 - DNA, 25 bp, Rattus norvegicus
gtgactacactcagggaggctccta

SEQ ID NO: 502919 - DNA, 25 bp, Rattus norvegicus
gtgactacactctgggaggctccta

SEQ ID NO: 502920 - DNA, 25 bp, Rattus norvegicus
gtgactacagtcacttgtaagttct

SEQ ID NO: 502921 - DNA, 25 bp, Rattus norvegicus
gtgactacagtctcttgtaagttct

SEQ ID NO: 502922 - DNA, 25 bp, Rattus norvegicus
gtgactacatgtctagctgacttgc

SEQ ID NO: 502923 - DNA, 25 bp, Rattus norvegicus
gtgactacatgtgtagctgacttgc

SEQ ID NO: 502924 - DNA, 25 bp, Rattus norvegicus
gtgactacctccaaacttggttttg

SEQ ID NO: 502925 - DNA, 25 bp, Rattus norvegicus
gtgactacctcctaacttggttttg

SEQ ID NO: 502926 - DNA, 25 bp, Rattus norvegicus
gtgactacctctatctatgtttttt

SEQ ID NO: 502927 - DNA, 25 bp, Rattus norvegicus
gtgactacctctttctatgtttttt

SEQ ID NO: 502928 - DNA, 25 bp, Rattus norvegicus
gtgactactatgaacagactgattt

SEQ ID NO: 502929 - DNA, 25 bp, Rattus norvegicus
gtgactactatgtacagactgattt

SEQ ID NO: 502930 - DNA, 25 bp, Rattus norvegicus
gtgactactcagcttatgcccagac

SEQ ID NO: 502931 - DNA, 25 bp, Rattus norvegicus
gtgactactcaggttatgcccagac

SEQ ID NO: 502932 - DNA, 25 bp, Rattus norvegicus
gtgactactccactgattattctga

SEQ ID NO: 502933 - DNA, 25 bp, Rattus norvegicus
gtgactactccagtgattattctga

SEQ ID NO: 502934 - DNA, 25 bp, Rattus norvegicus
gtgactactcggatttccattctga

SEQ ID NO: 502935 - DNA, 25 bp, Rattus norvegicus
gtgactactcggttttccattctga

SEQ ID NO: 502936 - DNA, 25 bp, Rattus norvegicus
gtgactagaccaaccagtaaggcta

SEQ ID NO: 502937 - DNA, 25 bp, Rattus norvegicus
gtgactagaccatccagtaaggcta

SEQ ID NO: 502938 - DNA, 25 bp, Rattus norvegicus
gtgactagatttagtgcctggcatt

SEQ ID NO: 502939 - DNA, 25 bp, Rattus norvegicus
gtgactagattttgtgcctggcatt

SEQ ID NO: 502940 - DNA, 25 bp, Rattus norvegicus
gtgactagcttactacggaaccgaa

SEQ ID NO: 502941 - DNA, 25 bp, Rattus norvegicus
gtgactagcttagtacggaaccgaa

SEQ ID NO: 502942 - DNA, 25 bp, Rattus norvegicus
gtgactaggtggagcatctctcaat

SEQ ID NO: 502943 - DNA, 25 bp, Rattus norvegicus
gtgactaggtggtgcatctctcaat

SEQ ID NO: 502944 - DNA, 25 bp, Rattus norvegicus
gtgactagtcacattggcaggatga

SEQ ID NO: 502945 - DNA, 25 bp, Rattus norvegicus
gtgactagtcactttggcaggatga

SEQ ID NO: 502946 - DNA, 25 bp, Rattus norvegicus
gtgactagtcggctcagagttacta

SEQ ID NO: 502947 - DNA, 25 bp, Rattus norvegicus
gtgactagtcgggtcagagttacta

SEQ ID NO: 502948 - DNA, 25 bp, Rattus norvegicus
gtgactagttttcttgtttgttaag

SEQ ID NO: 502949 - DNA, 25 bp, Rattus norvegicus
gtgactagttttgttgtttgttaag

SEQ ID NO: 502950 - DNA, 25 bp, Rattus norvegicus
gtgactatcaatatgctgaaaccag

SEQ ID NO: 502951 - DNA, 25 bp, Rattus norvegicus
gtgactatcaatttgctgaaaccag

SEQ ID NO: 502952 - DNA, 25 bp, Rattus norvegicus
gtgactatcactcagcagctgcagg

SEQ ID NO: 502953 - DNA, 25 bp, Rattus norvegicus
gtgactatcactgagcagctgcagg

SEQ ID NO: 502954 - DNA, 25 bp, Rattus norvegicus
gtgactatccttagcacagtgaaca

SEQ ID NO: 502955 - DNA, 25 bp, Rattus norvegicus
gtgactatcctttgcacagtgaaca

SEQ ID NO: 502956 - DNA, 25 bp, Rattus norvegicus
gtgactatcttcataaggctgggct

SEQ ID NO: 502957 - DNA, 25 bp, Rattus norvegicus
gtgactatcttcttaaggctgggct

SEQ ID NO: 502958 - DNA, 25 bp, Rattus norvegicus
gtgactatgaacctgccccaagaga

SEQ ID NO: 502959 - DNA, 25 bp, Rattus norvegicus
gtgactatgaacgtgccccaagaga

SEQ ID NO: 502960 - DNA, 25 bp, Rattus norvegicus
gtgactatgaccagcaagtggctca

SEQ ID NO: 502961 - DNA, 25 bp, Rattus norvegicus
gtgactatgacctgcaagtggctca

SEQ ID NO: 502962 - DNA, 25 bp, Rattus norvegicus
gtgactatgggaatccaggttattt

SEQ ID NO: 502963 - DNA, 25 bp, Rattus norvegicus
gtgactatgggattccaggttattt

SEQ ID NO: 502964 - DNA, 25 bp, Rattus norvegicus
gtgactattaaactaccactgtaat

SEQ ID NO: 502965 - DNA, 25 bp, Rattus norvegicus
gtgactattaaagtaccactgtaat

SEQ ID NO: 502966 - DNA, 25 bp, Rattus norvegicus
gtgactattccaaattaacatgcct

SEQ ID NO: 502967 - DNA, 25 bp, Rattus norvegicus
gtgactattccatattaacatgcct

SEQ ID NO: 502968 - DNA, 25 bp, Rattus norvegicus
gtgactatttatcatcctagaatgt

SEQ ID NO: 502969 - DNA, 25 bp, Rattus norvegicus
gtgactatttatgatcctagaatgt

SEQ ID NO: 502970 - DNA, 25 bp, Rattus norvegicus
gtgactatttttaccactgaagctg

SEQ ID NO: 502971 - DNA, 25 bp, Rattus norvegicus
gtgactattttttccactgaagctg

SEQ ID NO: 502972 - DNA, 25 bp, Rattus norvegicus
gtgactcacaagcacaagtaactta

SEQ ID NO: 502973 - DNA, 25 bp, Rattus norvegicus
gtgactcacaaggacaagtaactta

SEQ ID NO: 502974 - DNA, 25 bp, Rattus norvegicus
gtgactcacacgaagaccagggaca

SEQ ID NO: 502975 - DNA, 25 bp, Rattus norvegicus
gtgactcacacgtagaccagggaca

SEQ ID NO: 502976 - DNA, 25 bp, Rattus norvegicus
gtgactcaccacaggctgtgtgaaa

SEQ ID NO: 502977 - DNA, 25 bp, Rattus norvegicus
gtgactcaccactggctgtgtgaaa

SEQ ID NO: 502978 - DNA, 25 bp, Rattus norvegicus
gtgactcacccgaatctccaaaaga

SEQ ID NO: 502979 - DNA, 25 bp, Rattus norvegicus
gtgactcacccgtatctccaaaaga

SEQ ID NO: 502980 - DNA, 25 bp, Rattus norvegicus
gtgactcacctacaggagtttgcca

SEQ ID NO: 502981 - DNA, 25 bp, Rattus norvegicus
gtgactcacctagaggagtttgcca

SEQ ID NO: 502982 - DNA, 25 bp, Rattus norvegicus
gtgactcactagaaccgcacttgtg

SEQ ID NO: 502983 - DNA, 25 bp, Rattus norvegicus
gtgactcactagtaccgcacttgtg

SEQ ID NO: 502984 - DNA, 25 bp, Rattus norvegicus
gtgactcactccatgataggtggaa

SEQ ID NO: 502985 - DNA, 25 bp, Rattus norvegicus
gtgactcactccttgataggtggaa

SEQ ID NO: 502986 - DNA, 25 bp, Rattus norvegicus
gtgactcagaccatcaacacggttg

SEQ ID NO: 502987 - DNA, 25 bp, Rattus norvegicus
gtgactcagaccttcaacacggttg

SEQ ID NO: 502988 - DNA, 25 bp, Rattus norvegicus
gtgactcagcataagttcttgcctg

SEQ ID NO: 502989 - DNA, 25 bp, Rattus norvegicus
gtgactcagcattagttcttgcctg

SEQ ID NO: 502990 - DNA, 25 bp, Rattus norvegicus
gtgactcagcgcacaacacatttgt

SEQ ID NO: 502991 - DNA, 25 bp, Rattus norvegicus
gtgactcagcgctcaacacatttgt

SEQ ID NO: 502992 - DNA, 25 bp, Rattus norvegicus
gtgactcagctaccaacggaaaccg

SEQ ID NO: 502993 - DNA, 25 bp, Rattus norvegicus
gtgactcagctagcaacggaaaccg

SEQ ID NO: 502994 - DNA, 25 bp, Rattus norvegicus
gtgactcaggttacactctaagctc

SEQ ID NO: 502995 - DNA, 25 bp, Rattus norvegicus
gtgactcaggtttcactctaagctc

SEQ ID NO: 502996 - DNA, 25 bp, Rattus norvegicus
gtgactcagtatactgtgagacatg

SEQ ID NO: 502997 - DNA, 25 bp, Rattus norvegicus
gtgactcagtattctgtgagacatg

SEQ ID NO: 502998 - DNA, 25 bp, Rattus norvegicus
gtgactcagtcccagtgaccaaatg

SEQ ID NO: 502999 - DNA, 25 bp, Rattus norvegicus
gtgactcagtccgagtgaccaaatg

SEQ ID NO: 503000 - DNA, 25 bp, Rattus norvegicus
gtgactcagtgtaagcaagtgactt

SEQ ID NO: 503001 - DNA, 25 bp, Rattus norvegicus
gtgactcagtgttagcaagtgactt

SEQ ID NO: 503002 - DNA, 25 bp, Rattus norvegicus
gtgactcatgtccaagcaaactgca

SEQ ID NO: 503003 - DNA, 25 bp, Rattus norvegicus
gtgactcatgtcgaagcaaactgca

SEQ ID NO: 503004 - DNA, 25 bp, Rattus norvegicus
gtgactcatttcaagaatgcatgct

SEQ ID NO: 503005 - DNA, 25 bp, Rattus norvegicus
gtgactcatttctagaatgcatgct

SEQ ID NO: 503006 - DNA, 25 bp, Rattus norvegicus
gtgactccaagcacagatgccggaa

SEQ ID NO: 503007 - DNA, 25 bp, Rattus norvegicus
gtgactccaagctcagatgccggaa

SEQ ID NO: 503008 - DNA, 25 bp, Rattus norvegicus
gtgactccacaacggcttttaggca

SEQ ID NO: 503009 - DNA, 25 bp, Rattus norvegicus
gtgactccacaagggcttttaggca

SEQ ID NO: 503010 - DNA, 25 bp, Rattus norvegicus
gtgactccactgaggcagttgttgt

SEQ ID NO: 503011 - DNA, 25 bp, Rattus norvegicus
gtgactccactgtggcagttgttgt

SEQ ID NO: 503012 - DNA, 25 bp, Rattus norvegicus
gtgactccagatctgacaccattta

SEQ ID NO: 503013 - DNA, 25 bp, Rattus norvegicus
gtgactccagatgtgacaccattta

SEQ ID NO: 503014 - DNA, 25 bp, Rattus norvegicus
gtgactccagcgagctttagttgag

SEQ ID NO: 503015 - DNA, 25 bp, Rattus norvegicus
gtgactccagcgtgctttagttgag

SEQ ID NO: 503016 - DNA, 25 bp, Rattus norvegicus
gtgactccagctcgccagtggcaga

SEQ ID NO: 503017 - DNA, 25 bp, Rattus norvegicus
gtgactccagctggccagtggcaga

SEQ ID NO: 503018 - DNA, 25 bp, Rattus norvegicus
gtgactccagtcatatgcatagcac

SEQ ID NO: 503019 - DNA, 25 bp, Rattus norvegicus
gtgactccagtcattgttgtataaa

SEQ ID NO: 503020 - DNA, 25 bp, Rattus norvegicus
gtgactccagtcctcagtgtgagct

SEQ ID NO: 503021 - DNA, 25 bp, Rattus norvegicus
gtgactccagtcgtcagtgtgagct

SEQ ID NO: 503022 - DNA, 25 bp, Rattus norvegicus
gtgactccagtcttatgcatagcac

SEQ ID NO: 503023 - DNA, 25 bp, Rattus norvegicus
gtgactccagtctttgttgtataaa

SEQ ID NO: 503024 - DNA, 25 bp, Rattus norvegicus
gtgactccattgatgaacctcaagc

SEQ ID NO: 503025 - DNA, 25 bp, Rattus norvegicus
gtgactccattgttgaacctcaagc

SEQ ID NO: 503026 - DNA, 25 bp, Rattus norvegicus
gtgactcccaaccaaaagtcctgaa

SEQ ID NO: 503027 - DNA, 25 bp, Rattus norvegicus
gtgactcccaacgaaaagtcctgaa

SEQ ID NO: 503028 - DNA, 25 bp, Rattus norvegicus
gtgactccccacacagtgagaggta

SEQ ID NO: 503029 - DNA, 25 bp, Rattus norvegicus
gtgactccccactcagtgagaggta

SEQ ID NO: 503030 - DNA, 25 bp, Rattus norvegicus
gtgactccccgaaacatgacataaa

SEQ ID NO: 503031 - DNA, 25 bp, Rattus norvegicus
gtgactccccgatacatgacataaa

SEQ ID NO: 503032 - DNA, 25 bp, Rattus norvegicus
gtgactcccttgaggcaaacgagct

SEQ ID NO: 503033 - DNA, 25 bp, Rattus norvegicus
gtgactcccttgtggcaaacgagct

SEQ ID NO: 503034 - DNA, 25 bp, Rattus norvegicus
gtgactcctctcaggaggcttgaaa

SEQ ID NO: 503035 - DNA, 25 bp, Rattus norvegicus
gtgactcctctctggaggcttgaaa

SEQ ID NO: 503036 - DNA, 25 bp, Rattus norvegicus
gtgactcctggcaggacagatcatc

SEQ ID NO: 503037 - DNA, 25 bp, Rattus norvegicus
gtgactcctggctggacagatcatc

SEQ ID NO: 503038 - DNA, 25 bp, Rattus norvegicus
gtgactcggacacgtttgcagtcga

SEQ ID NO: 503039 - DNA, 25 bp, Rattus norvegicus
gtgactcggacaggtttgcagtcga

SEQ ID NO: 503040 - DNA, 25 bp, Rattus norvegicus
gtgactcggtctccatcagtaacaa

SEQ ID NO: 503041 - DNA, 25 bp, Rattus norvegicus
gtgactcggtctgcatcagtaacaa

SEQ ID NO: 503042 - DNA, 25 bp, Rattus norvegicus
gtgactcgtgttatgggacatgttt

SEQ ID NO: 503043 - DNA, 25 bp, Rattus norvegicus
gtgactcgtgttttgggacatgttt

SEQ ID NO: 503044 - DNA, 25 bp, Rattus norvegicus
gtgactctaatgatgaacttatgct

SEQ ID NO: 503045 - DNA, 25 bp, Rattus norvegicus
gtgactctaatgttgaacttatgct

SEQ ID NO: 503046 - DNA, 25 bp, Rattus norvegicus
gtgactctatctaggttgggacctt

SEQ ID NO: 503047 - DNA, 25 bp, Rattus norvegicus
gtgactctatcttggttgggacctt

SEQ ID NO: 503048 - DNA, 25 bp, Rattus norvegicus
gtgactctcaaactttattacccaa

SEQ ID NO: 503049 - DNA, 25 bp, Rattus norvegicus
gtgactctcaaagtttattacccaa

SEQ ID NO: 503050 - DNA, 25 bp, Rattus norvegicus
gtgactctcaccactgtatgaaagc

SEQ ID NO: 503051 - DNA, 25 bp, Rattus norvegicus
gtgactctcacctctgtatgaaagc

SEQ ID NO: 503052 - DNA, 25 bp, Rattus norvegicus
gtgactctcactaagggtttcctca

SEQ ID NO: 503053 - DNA, 25 bp, Rattus norvegicus
gtgactctcacttagggtttcctca

SEQ ID NO: 503054 - DNA, 25 bp, Rattus norvegicus
gtgactctcagcaacatctcctgaa

SEQ ID NO: 503055 - DNA, 25 bp, Rattus norvegicus
gtgactctcagctacatctcctgaa

SEQ ID NO: 503056 - DNA, 25 bp, Rattus norvegicus
gtgactctgaccatgaagagccaag

SEQ ID NO: 503057 - DNA, 25 bp, Rattus norvegicus
gtgactctgaccttgaagagccaag

SEQ ID NO: 503058 - DNA, 25 bp, Rattus norvegicus
gtgactctgcacaaagcccaactgt

SEQ ID NO: 503059 - DNA, 25 bp, Rattus norvegicus
gtgactctgcacagtgatgacggct

SEQ ID NO: 503060 - DNA, 25 bp, Rattus norvegicus
gtgactctgcactaagcccaactgt

SEQ ID NO: 503061 - DNA, 25 bp, Rattus norvegicus
gtgactctgcactgtgatgacggct

SEQ ID NO: 503062 - DNA, 25 bp, Rattus norvegicus
gtgactctgcatatattagtaccta

SEQ ID NO: 503063 - DNA, 25 bp, Rattus norvegicus
gtgactctgcatcccaggtgtggtt

SEQ ID NO: 503064 - DNA, 25 bp, Rattus norvegicus
gtgactctgcatgccaggtgtggtt

SEQ ID NO: 503065 - DNA, 25 bp, Rattus norvegicus
gtgactctgcatttattagtaccta

SEQ ID NO: 503066 - DNA, 25 bp, Rattus norvegicus
gtgactctgctacctttggcatatg

SEQ ID NO: 503067 - DNA, 25 bp, Rattus norvegicus
gtgactctgctagctttggcatatg

SEQ ID NO: 503068 - DNA, 25 bp, Rattus norvegicus
gtgactctgggcacttcaggctcat

SEQ ID NO: 503069 - DNA, 25 bp, Rattus norvegicus
gtgactctgggctcttcaggctcat

SEQ ID NO: 503070 - DNA, 25 bp, Rattus norvegicus
gtgactctggttacgtgaggtcctc

SEQ ID NO: 503071 - DNA, 25 bp, Rattus norvegicus
gtgactctggttattatttctgaat

SEQ ID NO: 503072 - DNA, 25 bp, Rattus norvegicus
gtgactctggttatttctgttcaga

SEQ ID NO: 503073 - DNA, 25 bp, Rattus norvegicus
gtgactctggtttcgtgaggtcctc

SEQ ID NO: 503074 - DNA, 25 bp, Rattus norvegicus
gtgactctggtttttatttctgaat

SEQ ID NO: 503075 - DNA, 25 bp, Rattus norvegicus
gtgactctggttttttctgttcaga

SEQ ID NO: 503076 - DNA, 25 bp, Rattus norvegicus
gtgactctgtatatcttggcatgga

SEQ ID NO: 503077 - DNA, 25 bp, Rattus norvegicus
gtgactctgtatttcttggcatgga

SEQ ID NO: 503078 - DNA, 25 bp, Rattus norvegicus
gtgactctgtggaggctcagatgcc

SEQ ID NO: 503079 - DNA, 25 bp, Rattus norvegicus
gtgactctgtggtggctcagatgcc

SEQ ID NO: 503080 - DNA, 25 bp, Rattus norvegicus
gtgactcttatcctgaactcactgg

SEQ ID NO: 503081 - DNA, 25 bp, Rattus norvegicus
gtgactcttatcgtgaactcactgg

SEQ ID NO: 503082 - DNA, 25 bp, Rattus norvegicus
gtgactcttattacttttggtgcct

SEQ ID NO: 503083 - DNA, 25 bp, Rattus norvegicus
gtgactcttatttcttttggtgcct

SEQ ID NO: 503084 - DNA, 25 bp, Rattus norvegicus
gtgactcttcatataaccctttttt

SEQ ID NO: 503085 - DNA, 25 bp, Rattus norvegicus
gtgactcttcatttaaccctttttt

SEQ ID NO: 503086 - DNA, 25 bp, Rattus norvegicus
gtgactctttatatagcttttgaac

SEQ ID NO: 503087 - DNA, 25 bp, Rattus norvegicus
gtgactctttatttagcttttgaac

SEQ ID NO: 503088 - DNA, 25 bp, Rattus norvegicus
gtgactctttgaagactctaccacc

SEQ ID NO: 503089 - DNA, 25 bp, Rattus norvegicus
gtgactctttgatgactctaccacc

SEQ ID NO: 503090 - DNA, 25 bp, Rattus norvegicus
gtgactgaaaaaacggtccacgtgt

SEQ ID NO: 503091 - DNA, 25 bp, Rattus norvegicus
gtgactgaaaaatcggtccacgtgt

SEQ ID NO: 503092 - DNA, 25 bp, Rattus norvegicus
gtgactgaaaccattttcccatcat

SEQ ID NO: 503093 - DNA, 25 bp, Rattus norvegicus
gtgactgaaacctttttcccatcat

SEQ ID NO: 503094 - DNA, 25 bp, Rattus norvegicus
gtgactgaacctatgacaatacatg

SEQ ID NO: 503095 - DNA, 25 bp, Rattus norvegicus
gtgactgaacctttgacaatacatg

SEQ ID NO: 503096 - DNA, 25 bp, Rattus norvegicus
gtgactgaacgcaccacatacattg

SEQ ID NO: 503097 - DNA, 25 bp, Rattus norvegicus
gtgactgaacgctccacatacattg

SEQ ID NO: 503098 - DNA, 25 bp, Rattus norvegicus
gtgactgaacttctaaccatggata

SEQ ID NO: 503099 - DNA, 25 bp, Rattus norvegicus
gtgactgaacttgtaaccatggata

SEQ ID NO: 503100 - DNA, 25 bp, Rattus norvegicus
gtgactgaatgcatcagaccactgt

SEQ ID NO: 503101 - DNA, 25 bp, Rattus norvegicus
gtgactgaatgcttcagaccactgt

SEQ ID NO: 503102 - DNA, 25 bp, Rattus norvegicus
gtgactgacaaaaccagctagctgt

SEQ ID NO: 503103 - DNA, 25 bp, Rattus norvegicus
gtgactgacaaatccagctagctgt

SEQ ID NO: 503104 - DNA, 25 bp, Rattus norvegicus
gtgactgacaagaagttactcccaa

SEQ ID NO: 503105 - DNA, 25 bp, Rattus norvegicus
gtgactgacaagtagttactcccaa

SEQ ID NO: 503106 - DNA, 25 bp, Rattus norvegicus
gtgactgacacaagtccatcgccat

SEQ ID NO: 503107 - DNA, 25 bp, Rattus norvegicus
gtgactgacacatgtccatcgccat

SEQ ID NO: 503108 - DNA, 25 bp, Rattus norvegicus
gtgactgacactaggtgcttactga

SEQ ID NO: 503109 - DNA, 25 bp, Rattus norvegicus
gtgactgacacttggtgcttactga

SEQ ID NO: 503110 - DNA, 25 bp, Rattus norvegicus
gtgactgacagtcatccttacacag

SEQ ID NO: 503111 - DNA, 25 bp, Rattus norvegicus
gtgactgacagtgatccttacacag

SEQ ID NO: 503112 - DNA, 25 bp, Rattus norvegicus
gtgactgaccctagcagttgggcag

SEQ ID NO: 503113 - DNA, 25 bp, Rattus norvegicus
gtgactgacccttgcagttgggcag

SEQ ID NO: 503114 - DNA, 25 bp, Rattus norvegicus
gtgactgaccgtcatattgaccgtt

SEQ ID NO: 503115 - DNA, 25 bp, Rattus norvegicus
gtgactgaccgtgatattgaccgtt

SEQ ID NO: 503116 - DNA, 25 bp, Rattus norvegicus
gtgactgaccttcagatgtttccat

SEQ ID NO: 503117 - DNA, 25 bp, Rattus norvegicus
gtgactgaccttgagatgtttccat

SEQ ID NO: 503118 - DNA, 25 bp, Rattus norvegicus
gtgactgactgaaacgcagccctga

SEQ ID NO: 503119 - DNA, 25 bp, Rattus norvegicus
gtgactgactgatacgcagccctga

SEQ ID NO: 503120 - DNA, 25 bp, Rattus norvegicus
gtgactgactggaatcttggatgga

SEQ ID NO: 503121 - DNA, 25 bp, Rattus norvegicus
gtgactgactggtatcttggatgga

SEQ ID NO: 503122 - DNA, 25 bp, Rattus norvegicus
gtgactgactgtctaccaggaccag

SEQ ID NO: 503123 - DNA, 25 bp, Rattus norvegicus
gtgactgactgtgtaccaggaccag

SEQ ID NO: 503124 - DNA, 25 bp, Rattus norvegicus
gtgactgacttcatggttcatccta

SEQ ID NO: 503125 - DNA, 25 bp, Rattus norvegicus
gtgactgacttcttggttcatccta

SEQ ID NO: 503126 - DNA, 25 bp, Rattus norvegicus
gtgactgagaaccttctttaccttt

SEQ ID NO: 503127 - DNA, 25 bp, Rattus norvegicus
gtgactgagaacgttctttaccttt

SEQ ID NO: 503128 - DNA, 25 bp, Rattus norvegicus
gtgactgagaatactggccaccaaa

SEQ ID NO: 503129 - DNA, 25 bp, Rattus norvegicus
gtgactgagaattctggccaccaaa

SEQ ID NO: 503130 - DNA, 25 bp, Rattus norvegicus
gtgactgagcacagtgggtcctccc

SEQ ID NO: 503131 - DNA, 25 bp, Rattus norvegicus
gtgactgagcactgtgggtcctccc

SEQ ID NO: 503132 - DNA, 25 bp, Rattus norvegicus
gtgactgaggcgctgcatcaatcac

SEQ ID NO: 503133 - DNA, 25 bp, Rattus norvegicus
gtgactgaggcggtgcatcaatcac

SEQ ID NO: 503134 - DNA, 25 bp, Rattus norvegicus
gtgactgagggcaggactgttcccc

SEQ ID NO: 503135 - DNA, 25 bp, Rattus norvegicus
gtgactgagggctggactgttcccc

SEQ ID NO: 503136 - DNA, 25 bp, Rattus norvegicus
gtgactgagtaacatgccctgttcc

SEQ ID NO: 503137 - DNA, 25 bp, Rattus norvegicus
gtgactgagtaagatgccctgttcc

SEQ ID NO: 503138 - DNA, 25 bp, Rattus norvegicus
gtgactgatagaaggtgaatgcttc

SEQ ID NO: 503139 - DNA, 25 bp, Rattus norvegicus
gtgactgatagatggtgaatgcttc

SEQ ID NO: 503140 - DNA, 25 bp, Rattus norvegicus
gtgactgattacacgtgtacgctgc

SEQ ID NO: 503141 - DNA, 25 bp, Rattus norvegicus
gtgactgattactcgtgtacgctgc

SEQ ID NO: 503142 - DNA, 25 bp, Rattus norvegicus
gtgactgatttgatgcttactgctt

SEQ ID NO: 503143 - DNA, 25 bp, Rattus norvegicus
gtgactgatttgttgcttactgctt

SEQ ID NO: 503144 - DNA, 25 bp, Rattus norvegicus
gtgactgcacacaggattctgggaa

SEQ ID NO: 503145 - DNA, 25 bp, Rattus norvegicus
gtgactgcacactggattctgggaa

SEQ ID NO: 503146 - DNA, 25 bp, Rattus norvegicus
gtgactgcacatagaattctgtttg

SEQ ID NO: 503147 - DNA, 25 bp, Rattus norvegicus
gtgactgcacatccatcttcatgat

SEQ ID NO: 503148 - DNA, 25 bp, Rattus norvegicus
gtgactgcacatgcatcttcatgat

SEQ ID NO: 503149 - DNA, 25 bp, Rattus norvegicus
gtgactgcacattgaattctgtttg

SEQ ID NO: 503150 - DNA, 25 bp, Rattus norvegicus
gtgactgcactaatccgcattgtat

SEQ ID NO: 503151 - DNA, 25 bp, Rattus norvegicus
gtgactgcactattccgcattgtat

SEQ ID NO: 503152 - DNA, 25 bp, Rattus norvegicus
gtgactgcagcacaggcatctgagc

SEQ ID NO: 503153 - DNA, 25 bp, Rattus norvegicus
gtgactgcagcagaggcatctgagc

SEQ ID NO: 503154 - DNA, 25 bp, Rattus norvegicus
gtgactgcagtcagtgaaccaactc

SEQ ID NO: 503155 - DNA, 25 bp, Rattus norvegicus
gtgactgcagtctgtgaaccaactc

SEQ ID NO: 503156 - DNA, 25 bp, Rattus norvegicus
gtgactgcatttcctaagcgaacct

SEQ ID NO: 503157 - DNA, 25 bp, Rattus norvegicus
gtgactgcatttgctaagcgaacct

SEQ ID NO: 503158 - DNA, 25 bp, Rattus norvegicus
gtgactgccaatccgtgctgtctta

SEQ ID NO: 503159 - DNA, 25 bp, Rattus norvegicus
gtgactgccaatgcgtgctgtctta

SEQ ID NO: 503160 - DNA, 25 bp, Rattus norvegicus
gtgactgccagacttccacagatga

SEQ ID NO: 503161 - DNA, 25 bp, Rattus norvegicus
gtgactgccagagttccacagatga

SEQ ID NO: 503162 - DNA, 25 bp, Rattus norvegicus
gtgactgccagtcacattgggcaaa

SEQ ID NO: 503163 - DNA, 25 bp, Rattus norvegicus
gtgactgccagtgacattgggcaaa

SEQ ID NO: 503164 - DNA, 25 bp, Rattus norvegicus
gtgactgcccttcgtaatagatcct

SEQ ID NO: 503165 - DNA, 25 bp, Rattus norvegicus
gtgactgcccttggtaatagatcct

SEQ ID NO: 503166 - DNA, 25 bp, Rattus norvegicus
gtgactgcctctacgtagtgaccta

SEQ ID NO: 503167 - DNA, 25 bp, Rattus norvegicus
gtgactgcctcttcgtagtgaccta

SEQ ID NO: 503168 - DNA, 25 bp, Rattus norvegicus
gtgactgcggaacctgatccagtga

SEQ ID NO: 503169 - DNA, 25 bp, Rattus norvegicus
gtgactgcggaagctgatccagtga

SEQ ID NO: 503170 - DNA, 25 bp, Rattus norvegicus
gtgactgcggtgagtatgtactgca

SEQ ID NO: 503171 - DNA, 25 bp, Rattus norvegicus
gtgactgcggtgtgtatgtactgca

SEQ ID NO: 503172 - DNA, 25 bp, Rattus norvegicus
gtgactgcgtctactgcaaatccaa

SEQ ID NO: 503173 - DNA, 25 bp, Rattus norvegicus
gtgactgcgtcttctgcaaatccaa

SEQ ID NO: 503174 - DNA, 25 bp, Rattus norvegicus
gtgactgcgtggactctgggactta

SEQ ID NO: 503175 - DNA, 25 bp, Rattus norvegicus
gtgactgcgtggtctctgggactta

SEQ ID NO: 503176 - DNA, 25 bp, Rattus norvegicus
gtgactgctagacctgtatttggga

SEQ ID NO: 503177 - DNA, 25 bp, Rattus norvegicus
gtgactgctagagctgtatttggga

SEQ ID NO: 503178 - DNA, 25 bp, Rattus norvegicus
gtgactgctagccttgcatggtaaa

SEQ ID NO: 503179 - DNA, 25 bp, Rattus norvegicus
gtgactgctagcgttgcatggtaaa

SEQ ID NO: 503180 - DNA, 25 bp, Rattus norvegicus
gtgactgctatcacatctgatgcac

SEQ ID NO: 503181 - DNA, 25 bp, Rattus norvegicus
gtgactgctatctcatctgatgcac

SEQ ID NO: 503182 - DNA, 25 bp, Rattus norvegicus
gtgactgctcatacaatttgataac

SEQ ID NO: 503183 - DNA, 25 bp, Rattus norvegicus
gtgactgctcattcaatttgataac

SEQ ID NO: 503184 - DNA, 25 bp, Rattus norvegicus
gtgactgctcggatcctaagcaata

SEQ ID NO: 503185 - DNA, 25 bp, Rattus norvegicus
gtgactgctcggttcctaagcaata

SEQ ID NO: 503186 - DNA, 25 bp, Rattus norvegicus
gtgactgctctacccctatacctaa

SEQ ID NO: 503187 - DNA, 25 bp, Rattus norvegicus
gtgactgctctagccctatacctaa

SEQ ID NO: 503188 - DNA, 25 bp, Rattus norvegicus
gtgactgctctgaagacgcccaaga

SEQ ID NO: 503189 - DNA, 25 bp, Rattus norvegicus
gtgactgctctgcacgggaacttcc

SEQ ID NO: 503190 - DNA, 25 bp, Rattus norvegicus
gtgactgctctggacgggaacttcc

SEQ ID NO: 503191 - DNA, 25 bp, Rattus norvegicus
gtgactgctctgtagacgcccaaga

SEQ ID NO: 503192 - DNA, 25 bp, Rattus norvegicus
gtgactgctggaaaagaccctaaaa

SEQ ID NO: 503193 - DNA, 25 bp, Rattus norvegicus
gtgactgctggataagaccctaaaa

SEQ ID NO: 503194 - DNA, 25 bp, Rattus norvegicus
gtgactgctgtcatggcccatgaat

SEQ ID NO: 503195 - DNA, 25 bp, Rattus norvegicus
gtgactgctgtcttggcccatgaat

SEQ ID NO: 503196 - DNA, 25 bp, Rattus norvegicus
gtgactgcttcaagcgactcttgac

SEQ ID NO: 503197 - DNA, 25 bp, Rattus norvegicus
gtgactgcttcatgcgactcttgac

SEQ ID NO: 503198 - DNA, 25 bp, Rattus norvegicus
gtgactgcttgcatgtttcagaaac

SEQ ID NO: 503199 - DNA, 25 bp, Rattus norvegicus
gtgactgcttgcttgtttcagaaac

SEQ ID NO: 503200 - DNA, 25 bp, Rattus norvegicus
gtgactgctttcaagagcttttgat

SEQ ID NO: 503201 - DNA, 25 bp, Rattus norvegicus
gtgactgctttctagagcttttgat

SEQ ID NO: 503202 - DNA, 25 bp, Rattus norvegicus
gtgactgctttgaagtgaattttca

SEQ ID NO: 503203 - DNA, 25 bp, Rattus norvegicus
gtgactgctttgagttgagttacat

SEQ ID NO: 503204 - DNA, 25 bp, Rattus norvegicus
gtgactgctttgtagtgaattttca

SEQ ID NO: 503205 - DNA, 25 bp, Rattus norvegicus
gtgactgctttgtgttgagttacat

SEQ ID NO: 503206 - DNA, 25 bp, Rattus norvegicus
gtgactggacttatctaagccatgg

SEQ ID NO: 503207 - DNA, 25 bp, Rattus norvegicus
gtgactggacttttctaagccatgg

SEQ ID NO: 503208 - DNA, 25 bp, Rattus norvegicus
gtgactggatcaagccagcacagtt

SEQ ID NO: 503209 - DNA, 25 bp, Rattus norvegicus
gtgactggatcatgccagcacagtt

SEQ ID NO: 503210 - DNA, 25 bp, Rattus norvegicus
gtgactggatggctatcttcaattt

SEQ ID NO: 503211 - DNA, 25 bp, Rattus norvegicus
gtgactggatgggtatcttcaattt

SEQ ID NO: 503212 - DNA, 25 bp, Rattus norvegicus
gtgactggattaatgctgggcccca

SEQ ID NO: 503213 - DNA, 25 bp, Rattus norvegicus
gtgactggattattgctgggcccca

SEQ ID NO: 503214 - DNA, 25 bp, Rattus norvegicus
gtgactggcagcatattgtggagct

SEQ ID NO: 503215 - DNA, 25 bp, Rattus norvegicus
gtgactggcagcttattgtggagct

SEQ ID NO: 503216 - DNA, 25 bp, Rattus norvegicus
gtgactggcaggatctttaccaact

SEQ ID NO: 503217 - DNA, 25 bp, Rattus norvegicus
gtgactggcaggttctttaccaact

SEQ ID NO: 503218 - DNA, 25 bp, Rattus norvegicus
gtgactggcatcagcgaggacaccc

SEQ ID NO: 503219 - DNA, 25 bp, Rattus norvegicus
gtgactggcatccacttttcaagtg

SEQ ID NO: 503220 - DNA, 25 bp, Rattus norvegicus
gtgactggcatcgacttttcaagtg

SEQ ID NO: 503221 - DNA, 25 bp, Rattus norvegicus
gtgactggcatctgcgaggacaccc

SEQ ID NO: 503222 - DNA, 25 bp, Rattus norvegicus
gtgactggccagataaaagagcgct

SEQ ID NO: 503223 - DNA, 25 bp, Rattus norvegicus
gtgactggccagttaaaagagcgct

SEQ ID NO: 503224 - DNA, 25 bp, Rattus norvegicus
gtgactggcctcaaaatcactgtct

SEQ ID NO: 503225 - DNA, 25 bp, Rattus norvegicus
gtgactggcctctaaatcactgtct

SEQ ID NO: 503226 - DNA, 25 bp, Rattus norvegicus
gtgactggctgaattagactcctgc

SEQ ID NO: 503227 - DNA, 25 bp, Rattus norvegicus
gtgactggctgatttagactcctgc

SEQ ID NO: 503228 - DNA, 25 bp, Rattus norvegicus
gtgactggctgcaagccatgttcat

SEQ ID NO: 503229 - DNA, 25 bp, Rattus norvegicus
gtgactggctgcagagcttcaagct

SEQ ID NO: 503230 - DNA, 25 bp, Rattus norvegicus
gtgactggctgctagccatgttcat

SEQ ID NO: 503231 - DNA, 25 bp, Rattus norvegicus
gtgactggctgctgagcttcaagct

SEQ ID NO: 503232 - DNA, 25 bp, Rattus norvegicus
gtgactggctttatgtttctttctc

SEQ ID NO: 503233 - DNA, 25 bp, Rattus norvegicus
gtgactggctttttgtttctttctc

SEQ ID NO: 503234 - DNA, 25 bp, Rattus norvegicus
gtgactgggaacagatgctgtgcct

SEQ ID NO: 503235 - DNA, 25 bp, Rattus norvegicus
gtgactgggaactgatgctgtgcct

SEQ ID NO: 503236 - DNA, 25 bp, Rattus norvegicus
gtgactgggactcttgtgtgttaca

SEQ ID NO: 503237 - DNA, 25 bp, Rattus norvegicus
gtgactgggactgttgtgtgttaca

SEQ ID NO: 503238 - DNA, 25 bp, Rattus norvegicus
gtgactgggcatctgatcgccgatt

SEQ ID NO: 503239 - DNA, 25 bp, Rattus norvegicus
gtgactgggcatgtgatcgccgatt

SEQ ID NO: 503240 - DNA, 25 bp, Rattus norvegicus
gtgactgggtcactgacactcgtaa

SEQ ID NO: 503241 - DNA, 25 bp, Rattus norvegicus
gtgactgggtcagtgacactcgtaa

SEQ ID NO: 503242 - DNA, 25 bp, Rattus norvegicus
gtgactgggtgaccactgatatcca

SEQ ID NO: 503243 - DNA, 25 bp, Rattus norvegicus
gtgactgggtgagcactgatatcca

SEQ ID NO: 503244 - DNA, 25 bp, Rattus norvegicus
gtgactgggtgtatcgcacatcaaa

SEQ ID NO: 503245 - DNA, 25 bp, Rattus norvegicus
gtgactgggtgtttcgcacatcaaa

SEQ ID NO: 503246 - DNA, 25 bp, Rattus norvegicus
gtgactggtagtcactctgatcccc

SEQ ID NO: 503247 - DNA, 25 bp, Rattus norvegicus
gtgactggtagtgactctgatcccc

SEQ ID NO: 503248 - DNA, 25 bp, Rattus norvegicus
gtgactgtaaaaagttggtggccta

SEQ ID NO: 503249 - DNA, 25 bp, Rattus norvegicus
gtgactgtaaaatgttggtggccta

SEQ ID NO: 503250 - DNA, 25 bp, Rattus norvegicus
gtgactgtagtaatccttgtttggt

SEQ ID NO: 503251 - DNA, 25 bp, Rattus norvegicus
gtgactgtagtattccttgtttggt

SEQ ID NO: 503252 - DNA, 25 bp, Rattus norvegicus
gtgactgtccttccagaatgtacaa

SEQ ID NO: 503253 - DNA, 25 bp, Rattus norvegicus
gtgactgtccttgcagaatgtacaa

SEQ ID NO: 503254 - DNA, 25 bp, Rattus norvegicus
gtgactgtcgagaagacccttgttt

SEQ ID NO: 503255 - DNA, 25 bp, Rattus norvegicus
gtgactgtcgagtagacccttgttt

SEQ ID NO: 503256 - DNA, 25 bp, Rattus norvegicus
gtgactgtctcaaggtgagcgcctg

SEQ ID NO: 503257 - DNA, 25 bp, Rattus norvegicus
gtgactgtctcatggtgagcgcctg

SEQ ID NO: 503258 - DNA, 25 bp, Rattus norvegicus
gtgactgtgactacgaggaaacctt

SEQ ID NO: 503259 - DNA, 25 bp, Rattus norvegicus
gtgactgtgacttcgaggaaacctt

SEQ ID NO: 503260 - DNA, 25 bp, Rattus norvegicus
gtgactgtgagcacttggactctaa

SEQ ID NO: 503261 - DNA, 25 bp, Rattus norvegicus
gtgactgtgagctcttggactctaa

SEQ ID NO: 503262 - DNA, 25 bp, Rattus norvegicus
gtgactgtggtcaagtgctgtttta

SEQ ID NO: 503263 - DNA, 25 bp, Rattus norvegicus
gtgactgtggtcattgtgaagcctg

SEQ ID NO: 503264 - DNA, 25 bp, Rattus norvegicus
gtgactgtggtctagtgctgtttta

SEQ ID NO: 503265 - DNA, 25 bp, Rattus norvegicus
gtgactgtggtctttgtgaagcctg

SEQ ID NO: 503266 - DNA, 25 bp, Rattus norvegicus
gtgactgtgtgcctgtttttgtaaa

SEQ ID NO: 503267 - DNA, 25 bp, Rattus norvegicus
gtgactgtgtgcgtgtttttgtaaa

SEQ ID NO: 503268 - DNA, 25 bp, Rattus norvegicus
gtgactgttagaagcctctatggct

SEQ ID NO: 503269 - DNA, 25 bp, Rattus norvegicus
gtgactgttagatgcctctatggct

SEQ ID NO: 503270 - DNA, 25 bp, Rattus norvegicus
gtgactgttcacagacctcagtgat

SEQ ID NO: 503271 - DNA, 25 bp, Rattus norvegicus
gtgactgttcactgacctcagtgat

SEQ ID NO: 503272 - DNA, 25 bp, Rattus norvegicus
gtgactgttgagagacatccttccg

SEQ ID NO: 503273 - DNA, 25 bp, Rattus norvegicus
gtgactgttgagtgacatccttccg

SEQ ID NO: 503274 - DNA, 25 bp, Rattus norvegicus
gtgactgtttcactgtagtacacgt

SEQ ID NO: 503275 - DNA, 25 bp, Rattus norvegicus
gtgactgtttcagtgtagtacacgt

SEQ ID NO: 503276 - DNA, 25 bp, Rattus norvegicus
gtgactgtttccacgattgtaaagt

SEQ ID NO: 503277 - DNA, 25 bp, Rattus norvegicus
gtgactgtttccatgtgtaacgttt

SEQ ID NO: 503278 - DNA, 25 bp, Rattus norvegicus
gtgactgtttcctcgattgtaaagt

SEQ ID NO: 503279 - DNA, 25 bp, Rattus norvegicus
gtgactgtttccttgtgtaacgttt

SEQ ID NO: 503280 - DNA, 25 bp, Rattus norvegicus
gtgactgtttctcaggatgttcttt

SEQ ID NO: 503281 - DNA, 25 bp, Rattus norvegicus
gtgactgtttctgaggatgttcttt

SEQ ID NO: 503282 - DNA, 25 bp, Rattus norvegicus
gtgacttaacgccacggtggacgtt

SEQ ID NO: 503283 - DNA, 25 bp, Rattus norvegicus
gtgacttaacgcgacggtggacgtt

SEQ ID NO: 503284 - DNA, 25 bp, Rattus norvegicus
gtgacttaagtcactgggactcact

SEQ ID NO: 503285 - DNA, 25 bp, Rattus norvegicus
gtgacttaagtctctgggactcact

SEQ ID NO: 503286 - DNA, 25 bp, Rattus norvegicus
gtgacttaatgtatctttaccacca

SEQ ID NO: 503287 - DNA, 25 bp, Rattus norvegicus
gtgacttaatgtttctttaccacca

SEQ ID NO: 503288 - DNA, 25 bp, Rattus norvegicus
gtgacttaattcatgggtactttta

SEQ ID NO: 503289 - DNA, 25 bp, Rattus norvegicus
gtgacttaattcttgggtactttta

SEQ ID NO: 503290 - DNA, 25 bp, Rattus norvegicus
gtgacttaatttactgactgcctag

SEQ ID NO: 503291 - DNA, 25 bp, Rattus norvegicus
gtgacttaattttctgactgcctag

SEQ ID NO: 503292 - DNA, 25 bp, Rattus norvegicus
gtgacttagaagcaaccggatgtaa

SEQ ID NO: 503293 - DNA, 25 bp, Rattus norvegicus
gtgacttagaaggaaccggatgtaa

SEQ ID NO: 503294 - DNA, 25 bp, Rattus norvegicus
gtgacttagatactataatcccttg

SEQ ID NO: 503295 - DNA, 25 bp, Rattus norvegicus
gtgacttagatagtataatcccttg

SEQ ID NO: 503296 - DNA, 25 bp, Rattus norvegicus
gtgacttagcacacttactatccca

SEQ ID NO: 503297 - DNA, 25 bp, Rattus norvegicus
gtgacttagcactcttactatccca

SEQ ID NO: 503298 - DNA, 25 bp, Rattus norvegicus
gtgacttatcacagtgctggacttg

SEQ ID NO: 503299 - DNA, 25 bp, Rattus norvegicus
gtgacttatcactgtgctggacttg

SEQ ID NO: 503300 - DNA, 25 bp, Rattus norvegicus
gtgacttatcttcagattctgcatc

SEQ ID NO: 503301 - DNA, 25 bp, Rattus norvegicus
gtgacttatcttgagattctgcatc

SEQ ID NO: 503302 - DNA, 25 bp, Rattus norvegicus
gtgacttatgacatatctttggctt

SEQ ID NO: 503303 - DNA, 25 bp, Rattus norvegicus
gtgacttatgacttatctttggctt

SEQ ID NO: 503304 - DNA, 25 bp, Rattus norvegicus
gtgacttcaagtatggaccctggaa

SEQ ID NO: 503305 - DNA, 25 bp, Rattus norvegicus
gtgacttcaagtttggaccctggaa

SEQ ID NO: 503306 - DNA, 25 bp, Rattus norvegicus
gtgacttcacatcggcgtaatttaa

SEQ ID NO: 503307 - DNA, 25 bp, Rattus norvegicus
gtgacttcacatgggcgtaatttaa

SEQ ID NO: 503308 - DNA, 25 bp, Rattus norvegicus
gtgacttcactacaacctggtgtta

SEQ ID NO: 503309 - DNA, 25 bp, Rattus norvegicus
gtgacttcactagaacctggtgtta

SEQ ID NO: 503310 - DNA, 25 bp, Rattus norvegicus
gtgacttcactgaggttgtcatctc

SEQ ID NO: 503311 - DNA, 25 bp, Rattus norvegicus
gtgacttcactgtggttgtcatctc

SEQ ID NO: 503312 - DNA, 25 bp, Rattus norvegicus
gtgacttcagaacccacctcttgtt

SEQ ID NO: 503313 - DNA, 25 bp, Rattus norvegicus
gtgacttcagaagccacctcttgtt

SEQ ID NO: 503314 - DNA, 25 bp, Rattus norvegicus
gtgacttcagagatgttcaggtgac

SEQ ID NO: 503315 - DNA, 25 bp, Rattus norvegicus
gtgacttcagagttgttcaggtgac

SEQ ID NO: 503316 - DNA, 25 bp, Rattus norvegicus
gtgacttcaggtcctaacaacatgg

SEQ ID NO: 503317 - DNA, 25 bp, Rattus norvegicus
gtgacttcaggtgctaacaacatgg

SEQ ID NO: 503318 - DNA, 25 bp, Rattus norvegicus
gtgacttcattaatagccggagtgt

SEQ ID NO: 503319 - DNA, 25 bp, Rattus norvegicus
gtgacttcattattagccggagtgt

SEQ ID NO: 503320 - DNA, 25 bp, Rattus norvegicus
gtgacttccaaaagtggctctctaa

SEQ ID NO: 503321 - DNA, 25 bp, Rattus norvegicus
gtgacttccaaatgtggctctctaa

SEQ ID NO: 503322 - DNA, 25 bp, Rattus norvegicus
gtgacttccccaaagtagaatctag

SEQ ID NO: 503323 - DNA, 25 bp, Rattus norvegicus
gtgacttccccatagtagaatctag

SEQ ID NO: 503324 - DNA, 25 bp, Rattus norvegicus
gtgacttcccctactttttatgaat

SEQ ID NO: 503325 - DNA, 25 bp, Rattus norvegicus
gtgacttccccttctttttatgaat

SEQ ID NO: 503326 - DNA, 25 bp, Rattus norvegicus
gtgacttccgcacagtaatggatta

SEQ ID NO: 503327 - DNA, 25 bp, Rattus norvegicus
gtgacttccgcagagtaatggatta

SEQ ID NO: 503328 - DNA, 25 bp, Rattus norvegicus
gtgacttccgtaaccaccagaatgg

SEQ ID NO: 503329 - DNA, 25 bp, Rattus norvegicus
gtgacttccgtatccaccagaatgg

SEQ ID NO: 503330 - DNA, 25 bp, Rattus norvegicus
gtgacttccttcaacttgtgtctaa

SEQ ID NO: 503331 - DNA, 25 bp, Rattus norvegicus
gtgacttccttctacttgtgtctaa

SEQ ID NO: 503332 - DNA, 25 bp, Rattus norvegicus
gtgacttcgcagcactgagtggcat

SEQ ID NO: 503333 - DNA, 25 bp, Rattus norvegicus
gtgacttcgcaggactgagtggcat

SEQ ID NO: 503334 - DNA, 25 bp, Rattus norvegicus
gtgacttcggtaccttgcgagcgct

SEQ ID NO: 503335 - DNA, 25 bp, Rattus norvegicus
gtgacttcggtagcttgcgagcgct

SEQ ID NO: 503336 - DNA, 25 bp, Rattus norvegicus
gtgacttctagtaccaaagttacct

SEQ ID NO: 503337 - DNA, 25 bp, Rattus norvegicus
gtgacttctagttccaaagttacct

SEQ ID NO: 503338 - DNA, 25 bp, Rattus norvegicus
gtgacttctattctaccttgtgata

SEQ ID NO: 503339 - DNA, 25 bp, Rattus norvegicus
gtgacttctattgtaccttgtgata

SEQ ID NO: 503340 - DNA, 25 bp, Rattus norvegicus
gtgacttctcaccatctttttaaga

SEQ ID NO: 503341 - DNA, 25 bp, Rattus norvegicus
gtgacttctcacgatctttttaaga

SEQ ID NO: 503342 - DNA, 25 bp, Rattus norvegicus
gtgacttctcagctgtaggcagaat

SEQ ID NO: 503343 - DNA, 25 bp, Rattus norvegicus
gtgacttctcaggtgtaggcagaat

SEQ ID NO: 503344 - DNA, 25 bp, Rattus norvegicus
gtgacttctgccagggagactcaaa

SEQ ID NO: 503345 - DNA, 25 bp, Rattus norvegicus
gtgacttctgcctgggagactcaaa

SEQ ID NO: 503346 - DNA, 25 bp, Rattus norvegicus
gtgacttctggaaggtgtcctcttc

SEQ ID NO: 503347 - DNA, 25 bp, Rattus norvegicus
gtgacttctggatggtgtcctcttc

SEQ ID NO: 503348 - DNA, 25 bp, Rattus norvegicus
gtgacttctggcaaaattttacctt

SEQ ID NO: 503349 - DNA, 25 bp, Rattus norvegicus
gtgacttctggctaaattttacctt

SEQ ID NO: 503350 - DNA, 25 bp, Rattus norvegicus
gtgacttcttatatacacagttatg

SEQ ID NO: 503351 - DNA, 25 bp, Rattus norvegicus
gtgacttcttatttacacagttatg

SEQ ID NO: 503352 - DNA, 25 bp, Rattus norvegicus
gtgacttcttcaagggccctgccat

SEQ ID NO: 503353 - DNA, 25 bp, Rattus norvegicus
gtgacttcttcatgggccctgccat

SEQ ID NO: 503354 - DNA, 25 bp, Rattus norvegicus
gtgacttcttttccactaggcagag

SEQ ID NO: 503355 - DNA, 25 bp, Rattus norvegicus
gtgacttcttttgcactaggcagag

SEQ ID NO: 503356 - DNA, 25 bp, Rattus norvegicus
gtgacttgaaatatttccatgacat

SEQ ID NO: 503357 - DNA, 25 bp, Rattus norvegicus
gtgacttgaaatttttccatgacat

SEQ ID NO: 503358 - DNA, 25 bp, Rattus norvegicus
gtgacttgaagcattataccgttaa

SEQ ID NO: 503359 - DNA, 25 bp, Rattus norvegicus
gtgacttgaagctttataccgttaa

SEQ ID NO: 503360 - DNA, 25 bp, Rattus norvegicus
gtgacttgacaaccttccataatct

SEQ ID NO: 503361 - DNA, 25 bp, Rattus norvegicus
gtgacttgacaagcttccataatct

SEQ ID NO: 503362 - DNA, 25 bp, Rattus norvegicus
gtgacttgaccacagaaatggcagt

SEQ ID NO: 503363 - DNA, 25 bp, Rattus norvegicus
gtgacttgaccagagaaatggcagt

SEQ ID NO: 503364 - DNA, 25 bp, Rattus norvegicus
gtgacttgagagctactcggagcta

SEQ ID NO: 503365 - DNA, 25 bp, Rattus norvegicus
gtgacttgagaggtactcggagcta

SEQ ID NO: 503366 - DNA, 25 bp, Rattus norvegicus
gtgacttgagctcaagtcccgagct

SEQ ID NO: 503367 - DNA, 25 bp, Rattus norvegicus
gtgacttgagctgaagtcccgagct

SEQ ID NO: 503368 - DNA, 25 bp, Rattus norvegicus
gtgacttgcataagccattaggatc

SEQ ID NO: 503369 - DNA, 25 bp, Rattus norvegicus
gtgacttgcatatgccattaggatc

SEQ ID NO: 503370 - DNA, 25 bp, Rattus norvegicus
gtgacttgctatagctattgatcat

SEQ ID NO: 503371 - DNA, 25 bp, Rattus norvegicus
gtgacttgctattgctattgatcat

SEQ ID NO: 503372 - DNA, 25 bp, Rattus norvegicus
gtgacttgctgaacggcactgacgt

SEQ ID NO: 503373 - DNA, 25 bp, Rattus norvegicus
gtgacttgctgatcggcactgacgt

SEQ ID NO: 503374 - DNA, 25 bp, Rattus norvegicus
gtgacttgctggcaaagcccgcgaa

SEQ ID NO: 503375 - DNA, 25 bp, Rattus norvegicus
gtgacttgctgggaaagcccgcgaa

SEQ ID NO: 503376 - DNA, 25 bp, Rattus norvegicus
gtgacttggagcacctaacactaag

SEQ ID NO: 503377 - DNA, 25 bp, Rattus norvegicus
gtgacttggagctcctaacactaag

SEQ ID NO: 503378 - DNA, 25 bp, Rattus norvegicus
gtgacttggccaaatttatagctgt

SEQ ID NO: 503379 - DNA, 25 bp, Rattus norvegicus
gtgacttggccatatttatagctgt

SEQ ID NO: 503380 - DNA, 25 bp, Rattus norvegicus
gtgacttgggtccaccatcaaggaa

SEQ ID NO: 503381 - DNA, 25 bp, Rattus norvegicus
gtgacttgggtcgaccatcaaggaa

SEQ ID NO: 503382 - DNA, 25 bp, Rattus norvegicus
gtgacttggtctctttactgatctt

SEQ ID NO: 503383 - DNA, 25 bp, Rattus norvegicus
gtgacttggtctgtttactgatctt

SEQ ID NO: 503384 - DNA, 25 bp, Rattus norvegicus
gtgacttggtgaataacagctctac

SEQ ID NO: 503385 - DNA, 25 bp, Rattus norvegicus
gtgacttggtgattaacagctctac

SEQ ID NO: 503386 - DNA, 25 bp, Rattus norvegicus
gtgacttggtggagaagcatttaac

SEQ ID NO: 503387 - DNA, 25 bp, Rattus norvegicus
gtgacttggtggtgaagcatttaac

SEQ ID NO: 503388 - DNA, 25 bp, Rattus norvegicus
gtgacttggtttacagtcacccctt

SEQ ID NO: 503389 - DNA, 25 bp, Rattus norvegicus
gtgacttggttttcagtcacccctt

SEQ ID NO: 503390 - DNA, 25 bp, Rattus norvegicus
gtgacttgtaaaaaatcccgacttt

SEQ ID NO: 503391 - DNA, 25 bp, Rattus norvegicus
gtgacttgtaaataatcccgacttt

SEQ ID NO: 503392 - DNA, 25 bp, Rattus norvegicus
gtgacttgtaagacctgaatcttgc

SEQ ID NO: 503393 - DNA, 25 bp, Rattus norvegicus
gtgacttgtaagtcctgaatcttgc

SEQ ID NO: 503394 - DNA, 25 bp, Rattus norvegicus
gtgacttgtatgagccacttgaacg

SEQ ID NO: 503395 - DNA, 25 bp, Rattus norvegicus
gtgacttgtatgtgccacttgaacg

SEQ ID NO: 503396 - DNA, 25 bp, Rattus norvegicus
gtgacttgtcacatggaaactacag

SEQ ID NO: 503397 - DNA, 25 bp, Rattus norvegicus
gtgacttgtcacttggaaactacag

SEQ ID NO: 503398 - DNA, 25 bp, Rattus norvegicus
gtgacttgtcatacttttgcaaaaa

SEQ ID NO: 503399 - DNA, 25 bp, Rattus norvegicus
gtgacttgtcattcttttgcaaaaa

SEQ ID NO: 503400 - DNA, 25 bp, Rattus norvegicus
gtgacttgtcccatttcttagtagt

SEQ ID NO: 503401 - DNA, 25 bp, Rattus norvegicus
gtgacttgtcccttttcttagtagt

SEQ ID NO: 503402 - DNA, 25 bp, Rattus norvegicus
gtgacttgtccgatattcctttaag

SEQ ID NO: 503403 - DNA, 25 bp, Rattus norvegicus
gtgacttgtccgttattcctttaag

SEQ ID NO: 503404 - DNA, 25 bp, Rattus norvegicus
gtgacttgtggacttagcatatcaa

SEQ ID NO: 503405 - DNA, 25 bp, Rattus norvegicus
gtgacttgtggagttagcatatcaa

SEQ ID NO: 503406 - DNA, 25 bp, Rattus norvegicus
gtgacttgttacactcacgagtgcg

SEQ ID NO: 503407 - DNA, 25 bp, Rattus norvegicus
gtgacttgttactctcacgagtgcg

SEQ ID NO: 503408 - DNA, 25 bp, Rattus norvegicus
gtgacttgttcacgaccacatttta

SEQ ID NO: 503409 - DNA, 25 bp, Rattus norvegicus
gtgacttgttcaggaccacatttta

SEQ ID NO: 503410 - DNA, 25 bp, Rattus norvegicus
gtgactttaagtagggcatttttga

SEQ ID NO: 503411 - DNA, 25 bp, Rattus norvegicus
gtgactttaagttgggcatttttga

SEQ ID NO: 503412 - DNA, 25 bp, Rattus norvegicus
gtgactttaccaactagtttaatca

SEQ ID NO: 503413 - DNA, 25 bp, Rattus norvegicus
gtgactttaccatctagtttaatca

SEQ ID NO: 503414 - DNA, 25 bp, Rattus norvegicus
gtgactttacttaagatgtcctgta

SEQ ID NO: 503415 - DNA, 25 bp, Rattus norvegicus
gtgactttactttagatgtcctgta

SEQ ID NO: 503416 - DNA, 25 bp, Rattus norvegicus
gtgactttatttccagataatcttt

SEQ ID NO: 503417 - DNA, 25 bp, Rattus norvegicus
gtgactttatttgcagataatcttt

SEQ ID NO: 503418 - DNA, 25 bp, Rattus norvegicus
gtgactttcacacctttacttgggc

SEQ ID NO: 503419 - DNA, 25 bp, Rattus norvegicus
gtgactttcacagctttacttgggc

SEQ ID NO: 503420 - DNA, 25 bp, Rattus norvegicus
gtgactttcactaaatgtcctgtac

SEQ ID NO: 503421 - DNA, 25 bp, Rattus norvegicus
gtgactttcacttaatgtcctgtac

SEQ ID NO: 503422 - DNA, 25 bp, Rattus norvegicus
gtgactttcccgaaacagcacagga

SEQ ID NO: 503423 - DNA, 25 bp, Rattus norvegicus
gtgactttcccgtaacagcacagga

SEQ ID NO: 503424 - DNA, 25 bp, Rattus norvegicus
gtgactttcggcacctggacaacct

SEQ ID NO: 503425 - DNA, 25 bp, Rattus norvegicus
gtgactttcggctcctggacaacct

SEQ ID NO: 503426 - DNA, 25 bp, Rattus norvegicus
gtgactttcgtacgcgtccatcttg

SEQ ID NO: 503427 - DNA, 25 bp, Rattus norvegicus
gtgactttcgtaggcgtccatcttg

SEQ ID NO: 503428 - DNA, 25 bp, Rattus norvegicus
gtgactttctcaaactgttctctct

SEQ ID NO: 503429 - DNA, 25 bp, Rattus norvegicus
gtgactttctcatactgttctctct

SEQ ID NO: 503430 - DNA, 25 bp, Rattus norvegicus
gtgactttctctaactgaccactca

SEQ ID NO: 503431 - DNA, 25 bp, Rattus norvegicus
gtgactttctcttactgaccactca

SEQ ID NO: 503432 - DNA, 25 bp, Rattus norvegicus
gtgactttgagtattatggttatat

SEQ ID NO: 503433 - DNA, 25 bp, Rattus norvegicus
gtgactttgagttttatggttatat

SEQ ID NO: 503434 - DNA, 25 bp, Rattus norvegicus
gtgactttggccacatttcctggac

SEQ ID NO: 503435 - DNA, 25 bp, Rattus norvegicus
gtgactttggcctcatttcctggac

SEQ ID NO: 503436 - DNA, 25 bp, Rattus norvegicus
gtgactttggctctagactagcatt

SEQ ID NO: 503437 - DNA, 25 bp, Rattus norvegicus
gtgactttggctgtagactagcatt

SEQ ID NO: 503438 - DNA, 25 bp, Rattus norvegicus
gtgactttggtcaccaaggtcaagt

SEQ ID NO: 503439 - DNA, 25 bp, Rattus norvegicus
gtgactttggtcagcatagcttttg

SEQ ID NO: 503440 - DNA, 25 bp, Rattus norvegicus
gtgactttggtctccaaggtcaagt

SEQ ID NO: 503441 - DNA, 25 bp, Rattus norvegicus
gtgactttggtctgcatagcttttg

SEQ ID NO: 503442 - DNA, 25 bp, Rattus norvegicus
gtgactttgtacatgtttgcttttc

SEQ ID NO: 503443 - DNA, 25 bp, Rattus norvegicus
gtgactttgtacttgtttgcttttc

SEQ ID NO: 503444 - DNA, 25 bp, Rattus norvegicus
gtgactttgtcacctttgttttcaa

SEQ ID NO: 503445 - DNA, 25 bp, Rattus norvegicus
gtgactttgtcagctttgttttcaa

SEQ ID NO: 503446 - DNA, 25 bp, Rattus norvegicus
gtgactttgtccagttataaaccca

SEQ ID NO: 503447 - DNA, 25 bp, Rattus norvegicus
gtgactttgtcctgttataaaccca

SEQ ID NO: 503448 - DNA, 25 bp, Rattus norvegicus
gtgacttttacgatcaaacctccat

SEQ ID NO: 503449 - DNA, 25 bp, Rattus norvegicus
gtgacttttacgttcaaacctccat

SEQ ID NO: 503450 - DNA, 25 bp, Rattus norvegicus
gtgacttttctcaagtaggtggttt

SEQ ID NO: 503451 - DNA, 25 bp, Rattus norvegicus
gtgacttttctctagtaggtggttt

SEQ ID NO: 503452 - DNA, 25 bp, Rattus norvegicus
gtgacttttgaaccagcagctcccc

SEQ ID NO: 503453 - DNA, 25 bp, Rattus norvegicus
gtgacttttgaagcagcagctcccc

SEQ ID NO: 503454 - DNA, 25 bp, Rattus norvegicus
gtgacttttgtgaagcgtccaaggt

SEQ ID NO: 503455 - DNA, 25 bp, Rattus norvegicus
gtgacttttgtgtagcgtccaaggt

SEQ ID NO: 503456 - DNA, 25 bp, Rattus norvegicus
gtgactttttgacgaaagcctttct

SEQ ID NO: 503457 - DNA, 25 bp, Rattus norvegicus
gtgactttttgaggaaagcctttct

SEQ ID NO: 503458 - DNA, 25 bp, Rattus norvegicus
gtgactttttggatgtgtctcattt

SEQ ID NO: 503459 - DNA, 25 bp, Rattus norvegicus
gtgactttttggttgtgtctcattt

SEQ ID NO: 503460 - DNA, 25 bp, Rattus norvegicus
gtgagaaaacctccattgtggcgag

SEQ ID NO: 503461 - DNA, 25 bp, Rattus norvegicus
gtgagaaaacctgcattgtggcgag

SEQ ID NO: 503462 - DNA, 25 bp, Rattus norvegicus
gtgagaaacacaagccagctccgtt

SEQ ID NO: 503463 - DNA, 25 bp, Rattus norvegicus
gtgagaaacacatgccagctccgtt

SEQ ID NO: 503464 - DNA, 25 bp, Rattus norvegicus
gtgagaaacagtatccactcctgcc

SEQ ID NO: 503465 - DNA, 25 bp, Rattus norvegicus
gtgagaaacagtttccactcctgcc

SEQ ID NO: 503466 - DNA, 25 bp, Rattus norvegicus
gtgagaaacggccatagtctcccca

SEQ ID NO: 503467 - DNA, 25 bp, Rattus norvegicus
gtgagaaacggcgatagtctcccca

SEQ ID NO: 503468 - DNA, 25 bp, Rattus norvegicus
gtgagaaacgttcccctcagtaaag

SEQ ID NO: 503469 - DNA, 25 bp, Rattus norvegicus
gtgagaaacgttgccctcagtaaag

SEQ ID NO: 503470 - DNA, 25 bp, Rattus norvegicus
gtgagaaagcccatgtagaaatcca

SEQ ID NO: 503471 - DNA, 25 bp, Rattus norvegicus
gtgagaaagccccacaaatgtgatg

SEQ ID NO: 503472 - DNA, 25 bp, Rattus norvegicus
gtgagaaagcccgacaaatgtgatg

SEQ ID NO: 503473 - DNA, 25 bp, Rattus norvegicus
gtgagaaagcccttgtagaaatcca

SEQ ID NO: 503474 - DNA, 25 bp, Rattus norvegicus
gtgagaaagcgactgctctctttgc

SEQ ID NO: 503475 - DNA, 25 bp, Rattus norvegicus
gtgagaaagcgagtgctctctttgc

SEQ ID NO: 503476 - DNA, 25 bp, Rattus norvegicus
gtgagaaaggaccacaggatgccct

SEQ ID NO: 503477 - DNA, 25 bp, Rattus norvegicus
gtgagaaaggacgacaggatgccct

SEQ ID NO: 503478 - DNA, 25 bp, Rattus norvegicus
gtgagaaaggcactaccgctgtcct

SEQ ID NO: 503479 - DNA, 25 bp, Rattus norvegicus
gtgagaaaggcagtaccgctgtcct

SEQ ID NO: 503480 - DNA, 25 bp, Rattus norvegicus
gtgagaacactgaccagagcctttt

SEQ ID NO: 503481 - DNA, 25 bp, Rattus norvegicus
gtgagaacactgtccagagcctttt

SEQ ID NO: 503482 - DNA, 25 bp, Rattus norvegicus
gtgagaacaggactagactcttttt

SEQ ID NO: 503483 - DNA, 25 bp, Rattus norvegicus
gtgagaacaggagtagactcttttt

SEQ ID NO: 503484 - DNA, 25 bp, Rattus norvegicus
gtgagaacattgcaagaacctggaa

SEQ ID NO: 503485 - DNA, 25 bp, Rattus norvegicus
gtgagaacattggaagaacctggaa

SEQ ID NO: 503486 - DNA, 25 bp, Rattus norvegicus
gtgagaaccattacatccaatgcca

SEQ ID NO: 503487 - DNA, 25 bp, Rattus norvegicus
gtgagaaccatttcatccaatgcca

SEQ ID NO: 503488 - DNA, 25 bp, Rattus norvegicus
gtgagaacccggcacagacacactt

SEQ ID NO: 503489 - DNA, 25 bp, Rattus norvegicus
gtgagaacccgggacagacacactt

SEQ ID NO: 503490 - DNA, 25 bp, Rattus norvegicus
gtgagaaccgctacattgtcctggc

SEQ ID NO: 503491 - DNA, 25 bp, Rattus norvegicus
gtgagaaccgcttcattgtcctggc

SEQ ID NO: 503492 - DNA, 25 bp, Rattus norvegicus
gtgagaacctgacttgcatccctaa

SEQ ID NO: 503493 - DNA, 25 bp, Rattus norvegicus
gtgagaacctgagttgcatccctaa

SEQ ID NO: 503494 - DNA, 25 bp, Rattus norvegicus
gtgagaacctggacagttcgggtta

SEQ ID NO: 503495 - DNA, 25 bp, Rattus norvegicus
gtgagaacctggtcagttcgggtta

SEQ ID NO: 503496 - DNA, 25 bp, Rattus norvegicus
gtgagaacgatgcttacgcccctga

SEQ ID NO: 503497 - DNA, 25 bp, Rattus norvegicus
gtgagaacgatggttacgcccctga

SEQ ID NO: 503498 - DNA, 25 bp, Rattus norvegicus
gtgagaacgggtatctctgcccact

SEQ ID NO: 503499 - DNA, 25 bp, Rattus norvegicus
gtgagaacgggtttctctgcccact

SEQ ID NO: 503500 - DNA, 25 bp, Rattus norvegicus
gtgagaactcaactctttccacctt

SEQ ID NO: 503501 - DNA, 25 bp, Rattus norvegicus
gtgagaactcaagtctttccacctt

SEQ ID NO: 503502 - DNA, 25 bp, Rattus norvegicus
gtgagaactcatagcacagctgctc

SEQ ID NO: 503503 - DNA, 25 bp, Rattus norvegicus
gtgagaactcattgcacagctgctc

SEQ ID NO: 503504 - DNA, 25 bp, Rattus norvegicus
gtgagaacttccacctagattagtc

SEQ ID NO: 503505 - DNA, 25 bp, Rattus norvegicus
gtgagaacttcctcctagattagtc

SEQ ID NO: 503506 - DNA, 25 bp, Rattus norvegicus
gtgagaacttctcctgtcagggttt

SEQ ID NO: 503507 - DNA, 25 bp, Rattus norvegicus
gtgagaacttctgctgtcagggttt

SEQ ID NO: 503508 - DNA, 25 bp, Rattus norvegicus
gtgagaagaccaatcagcctcccta

SEQ ID NO: 503509 - DNA, 25 bp, Rattus norvegicus
gtgagaagaccattcagcctcccta

SEQ ID NO: 503510 - DNA, 25 bp, Rattus norvegicus
gtgagaagactgcaagcggcaccct

SEQ ID NO: 503511 - DNA, 25 bp, Rattus norvegicus
gtgagaagactggaagcggcaccct

SEQ ID NO: 503512 - DNA, 25 bp, Rattus norvegicus
gtgagaagagctagaccttgtcccc

SEQ ID NO: 503513 - DNA, 25 bp, Rattus norvegicus
gtgagaagagcttgaccttgtcccc

SEQ ID NO: 503514 - DNA, 25 bp, Rattus norvegicus
gtgagaagccccagagctgagagca

SEQ ID NO: 503515 - DNA, 25 bp, Rattus norvegicus
gtgagaagccccatttgatgtttaa

SEQ ID NO: 503516 - DNA, 25 bp, Rattus norvegicus
gtgagaagcccctgagctgagagca

SEQ ID NO: 503517 - DNA, 25 bp, Rattus norvegicus
gtgagaagccccttttgatgtttaa

SEQ ID NO: 503518 - DNA, 25 bp, Rattus norvegicus
gtgagaagctccaacttctgactgt

SEQ ID NO: 503519 - DNA, 25 bp, Rattus norvegicus
gtgagaagctcctacttctgactgt

SEQ ID NO: 503520 - DNA, 25 bp, Rattus norvegicus
gtgagaaggctaaccttgctttccc

SEQ ID NO: 503521 - DNA, 25 bp, Rattus norvegicus
gtgagaaggctatccttgctttccc

SEQ ID NO: 503522 - DNA, 25 bp, Rattus norvegicus
gtgagaagggtcagtctcctcagaa

SEQ ID NO: 503523 - DNA, 25 bp, Rattus norvegicus
gtgagaagggtctgtctcctcagaa

SEQ ID NO: 503524 - DNA, 25 bp, Rattus norvegicus
gtgagaagtaacaccaagtccttat

SEQ ID NO: 503525 - DNA, 25 bp, Rattus norvegicus
gtgagaagtaactccaagtccttat

SEQ ID NO: 503526 - DNA, 25 bp, Rattus norvegicus
gtgagaagtgccaacaaccagtctt

SEQ ID NO: 503527 - DNA, 25 bp, Rattus norvegicus
gtgagaagtgcctacaaccagtctt

SEQ ID NO: 503528 - DNA, 25 bp, Rattus norvegicus
gtgagaatacctcgactcctggttt

SEQ ID NO: 503529 - DNA, 25 bp, Rattus norvegicus
gtgagaatacctggactcctggttt

SEQ ID NO: 503530 - DNA, 25 bp, Rattus norvegicus
gtgagaatccagacacccagatcca

SEQ ID NO: 503531 - DNA, 25 bp, Rattus norvegicus
gtgagaatccagtcacccagatcca

SEQ ID NO: 503532 - DNA, 25 bp, Rattus norvegicus
gtgagaatccttcaactaaccgtcc

SEQ ID NO: 503533 - DNA, 25 bp, Rattus norvegicus
gtgagaatccttgaactaaccgtcc

SEQ ID NO: 503534 - DNA, 25 bp, Rattus norvegicus
gtgagaatctgcacgttgttcttta

SEQ ID NO: 503535 - DNA, 25 bp, Rattus norvegicus
gtgagaatctgctcgttgttcttta

SEQ ID NO: 503536 - DNA, 25 bp, Rattus norvegicus
gtgagaatgcagagccccgacatgg

SEQ ID NO: 503537 - DNA, 25 bp, Rattus norvegicus
gtgagaatgcagtgccccgacatgg

SEQ ID NO: 503538 - DNA, 25 bp, Rattus norvegicus
gtgagaatgctgatcctttccgtct

SEQ ID NO: 503539 - DNA, 25 bp, Rattus norvegicus
gtgagaatgctgatctcctgtcaat

SEQ ID NO: 503540 - DNA, 25 bp, Rattus norvegicus
gtgagaatgctgttcctttccgtct

SEQ ID NO: 503541 - DNA, 25 bp, Rattus norvegicus
gtgagaatgctgttctcctgtcaat

SEQ ID NO: 503542 - DNA, 25 bp, Rattus norvegicus
gtgagaatgcttagcggcttgctgc

SEQ ID NO: 503543 - DNA, 25 bp, Rattus norvegicus
gtgagaatgctttgcggcttgctgc

SEQ ID NO: 503544 - DNA, 25 bp, Rattus norvegicus
gtgagaatgggcatccatgtgcctc

SEQ ID NO: 503545 - DNA, 25 bp, Rattus norvegicus
gtgagaatgggcttccatgtgcctc

SEQ ID NO: 503546 - DNA, 25 bp, Rattus norvegicus
gtgagaatgtctccagccgacactt

SEQ ID NO: 503547 - DNA, 25 bp, Rattus norvegicus
gtgagaatgtctgcagccgacactt

SEQ ID NO: 503548 - DNA, 25 bp, Rattus norvegicus
gtgagaattgagagccccaggacag

SEQ ID NO: 503549 - DNA, 25 bp, Rattus norvegicus
gtgagaattgagtgccccaggacag

SEQ ID NO: 503550 - DNA, 25 bp, Rattus norvegicus
gtgagaatttatacaaaccgctatg

SEQ ID NO: 503551 - DNA, 25 bp, Rattus norvegicus
gtgagaatttattcaaaccgctatg

SEQ ID NO: 503552 - DNA, 25 bp, Rattus norvegicus
gtgagacaaacactcttaactatac

SEQ ID NO: 503553 - DNA, 25 bp, Rattus norvegicus
gtgagacaaacagtcttaactatac

SEQ ID NO: 503554 - DNA, 25 bp, Rattus norvegicus
gtgagacaaatccacgggcgagcct

SEQ ID NO: 503555 - DNA, 25 bp, Rattus norvegicus
gtgagacaaatcgacgggcgagcct

SEQ ID NO: 503556 - DNA, 25 bp, Rattus norvegicus
gtgagacaaccaaccctatgggtca

SEQ ID NO: 503557 - DNA, 25 bp, Rattus norvegicus
gtgagacaaccatccctatgggtca

SEQ ID NO: 503558 - DNA, 25 bp, Rattus norvegicus
gtgagacacgctcgtaatgggacaa

SEQ ID NO: 503559 - DNA, 25 bp, Rattus norvegicus
gtgagacacgctggtaatgggacaa

SEQ ID NO: 503560 - DNA, 25 bp, Rattus norvegicus
gtgagacagaagaacgcagcccaac

SEQ ID NO: 503561 - DNA, 25 bp, Rattus norvegicus
gtgagacagaagtacgcagcccaac

SEQ ID NO: 503562 - DNA, 25 bp, Rattus norvegicus
gtgagacagagacccctggatcatt

SEQ ID NO: 503563 - DNA, 25 bp, Rattus norvegicus
gtgagacagagagccctggatcatt

SEQ ID NO: 503564 - DNA, 25 bp, Rattus norvegicus
gtgagacagagccactgcaggactc

SEQ ID NO: 503565 - DNA, 25 bp, Rattus norvegicus
gtgagacagagcgactgcaggactc

SEQ ID NO: 503566 - DNA, 25 bp, Rattus norvegicus
gtgagacagctgctatggccctcag

SEQ ID NO: 503567 - DNA, 25 bp, Rattus norvegicus
gtgagacagctggtatggccctcag

SEQ ID NO: 503568 - DNA, 25 bp, Rattus norvegicus
gtgagacagtacactgtcccagcat

SEQ ID NO: 503569 - DNA, 25 bp, Rattus norvegicus
gtgagacagtactctgtcccagcat

SEQ ID NO: 503570 - DNA, 25 bp, Rattus norvegicus
gtgagacagtttcgtattgccttaa

SEQ ID NO: 503571 - DNA, 25 bp, Rattus norvegicus
gtgagacagtttggtattgccttaa

SEQ ID NO: 503572 - DNA, 25 bp, Rattus norvegicus
gtgagacatttcatgctgcacaagc

SEQ ID NO: 503573 - DNA, 25 bp, Rattus norvegicus
gtgagacatttcttgctgcacaagc

SEQ ID NO: 503574 - DNA, 25 bp, Rattus norvegicus
gtgagaccagctccttccagccaag

SEQ ID NO: 503575 - DNA, 25 bp, Rattus norvegicus
gtgagaccagctgcttccagccaag

SEQ ID NO: 503576 - DNA, 25 bp, Rattus norvegicus
gtgagaccatcaagtccccataatt

SEQ ID NO: 503577 - DNA, 25 bp, Rattus norvegicus
gtgagaccatcatgtccccataatt

SEQ ID NO: 503578 - DNA, 25 bp, Rattus norvegicus
gtgagaccatccagattgcagctta

SEQ ID NO: 503579 - DNA, 25 bp, Rattus norvegicus
gtgagaccatcctgattgcagctta

SEQ ID NO: 503580 - DNA, 25 bp, Rattus norvegicus
gtgagacccctgcaaatgggacagc

SEQ ID NO: 503581 - DNA, 25 bp, Rattus norvegicus
gtgagacccctggaaatgggacagc

SEQ ID NO: 503582 - DNA, 25 bp, Rattus norvegicus
gtgagaccctcaaataaggacagat

SEQ ID NO: 503583 - DNA, 25 bp, Rattus norvegicus
gtgagaccctcaccaattaacagtg

SEQ ID NO: 503584 - DNA, 25 bp, Rattus norvegicus
gtgagaccctcagcaattaacagtg

SEQ ID NO: 503585 - DNA, 25 bp, Rattus norvegicus
gtgagaccctcatataaggacagat

SEQ ID NO: 503586 - DNA, 25 bp, Rattus norvegicus
gtgagacctctacgttctgtggaac

SEQ ID NO: 503587 - DNA, 25 bp, Rattus norvegicus
gtgagacctctaggttctgtggaac

SEQ ID NO: 503588 - DNA, 25 bp, Rattus norvegicus
gtgagacctctgcagcttttaggca

SEQ ID NO: 503589 - DNA, 25 bp, Rattus norvegicus
gtgagacctctgcttgttcactgcc

SEQ ID NO: 503590 - DNA, 25 bp, Rattus norvegicus
gtgagacctctggagcttttaggca

SEQ ID NO: 503591 - DNA, 25 bp, Rattus norvegicus
gtgagacctctggttgttcactgcc

SEQ ID NO: 503592 - DNA, 25 bp, Rattus norvegicus
gtgagacctgagcacccaccagtca

SEQ ID NO: 503593 - DNA, 25 bp, Rattus norvegicus
gtgagacctgaggacccaccagtca

SEQ ID NO: 503594 - DNA, 25 bp, Rattus norvegicus
gtgagacctgggaacgccacagaaa

SEQ ID NO: 503595 - DNA, 25 bp, Rattus norvegicus
gtgagacctgggtacgccacagaaa

SEQ ID NO: 503596 - DNA, 25 bp, Rattus norvegicus
gtgagacgtcaacagcaggaaccaa

SEQ ID NO: 503597 - DNA, 25 bp, Rattus norvegicus
gtgagacgtcaagagcaggaaccaa

SEQ ID NO: 503598 - DNA, 25 bp, Rattus norvegicus
gtgagactaaaaactcgtcccagta

SEQ ID NO: 503599 - DNA, 25 bp, Rattus norvegicus
gtgagactaaaatctcgtcccagta

SEQ ID NO: 503600 - DNA, 25 bp, Rattus norvegicus
gtgagactactcagaggacagccat

SEQ ID NO: 503601 - DNA, 25 bp, Rattus norvegicus
gtgagactactctgaggacagccat

SEQ ID NO: 503602 - DNA, 25 bp, Rattus norvegicus
gtgagactcaacaacagacgcctgc

SEQ ID NO: 503603 - DNA, 25 bp, Rattus norvegicus
gtgagactcaactacagacgcctgc

SEQ ID NO: 503604 - DNA, 25 bp, Rattus norvegicus
gtgagactccaaaggtttcccaata

SEQ ID NO: 503605 - DNA, 25 bp, Rattus norvegicus
gtgagactccaaagttcatcagaag

SEQ ID NO: 503606 - DNA, 25 bp, Rattus norvegicus
gtgagactccaatggtttcccaata

SEQ ID NO: 503607 - DNA, 25 bp, Rattus norvegicus
gtgagactccaatgttcatcagaag

SEQ ID NO: 503608 - DNA, 25 bp, Rattus norvegicus
gtgagactctgtagtcccactttta

SEQ ID NO: 503609 - DNA, 25 bp, Rattus norvegicus
gtgagactctgttgtcccactttta

SEQ ID NO: 503610 - DNA, 25 bp, Rattus norvegicus
gtgagactcttgaccagactgttaa

SEQ ID NO: 503611 - DNA, 25 bp, Rattus norvegicus
gtgagactcttgtccagactgttaa

SEQ ID NO: 503612 - DNA, 25 bp, Rattus norvegicus
gtgagactgacacaaaccttaatgt

SEQ ID NO: 503613 - DNA, 25 bp, Rattus norvegicus
gtgagactgacagaaaccttaatgt

SEQ ID NO: 503614 - DNA, 25 bp, Rattus norvegicus
gtgagactgaccaatctggatctag

SEQ ID NO: 503615 - DNA, 25 bp, Rattus norvegicus
gtgagactgacctatctggatctag

SEQ ID NO: 503616 - DNA, 25 bp, Rattus norvegicus
gtgagactgctgaatgttctccatg

SEQ ID NO: 503617 - DNA, 25 bp, Rattus norvegicus
gtgagactgctgcatgcaagccccg

SEQ ID NO: 503618 - DNA, 25 bp, Rattus norvegicus
gtgagactgctggatgcaagccccg

SEQ ID NO: 503619 - DNA, 25 bp, Rattus norvegicus
gtgagactgctgtatgttctccatg

SEQ ID NO: 503620 - DNA, 25 bp, Rattus norvegicus
gtgagactggaaatcaagccatgtt

SEQ ID NO: 503621 - DNA, 25 bp, Rattus norvegicus
gtgagactggaattcaagccatgtt

SEQ ID NO: 503622 - DNA, 25 bp, Rattus norvegicus
gtgagactggcgctgcccaacaaga

SEQ ID NO: 503623 - DNA, 25 bp, Rattus norvegicus
gtgagactggcggtgcccaacaaga

SEQ ID NO: 503624 - DNA, 25 bp, Rattus norvegicus
gtgagactggtaccttagtggacat

SEQ ID NO: 503625 - DNA, 25 bp, Rattus norvegicus
gtgagactggtagcttagtggacat

SEQ ID NO: 503626 - DNA, 25 bp, Rattus norvegicus
gtgagacttcaccatgaattggaaa

SEQ ID NO: 503627 - DNA, 25 bp, Rattus norvegicus
gtgagacttcacgatgaattggaaa

SEQ ID NO: 503628 - DNA, 25 bp, Rattus norvegicus
gtgagacttctaactcggtttcaaa

SEQ ID NO: 503629 - DNA, 25 bp, Rattus norvegicus
gtgagacttctatctcggtttcaaa

SEQ ID NO: 503630 - DNA, 25 bp, Rattus norvegicus
gtgagactttgcaccattgtgtggt

SEQ ID NO: 503631 - DNA, 25 bp, Rattus norvegicus
gtgagactttgctccattgtgtggt

SEQ ID NO: 503632 - DNA, 25 bp, Rattus norvegicus
gtgagagaaaagcacttgcctgatt

SEQ ID NO: 503633 - DNA, 25 bp, Rattus norvegicus
gtgagagaaaaggacttgcctgatt

SEQ ID NO: 503634 - DNA, 25 bp, Rattus norvegicus
gtgagagaaagcatttgtcccctgc

SEQ ID NO: 503635 - DNA, 25 bp, Rattus norvegicus
gtgagagaaagcttttgtcccctgc

SEQ ID NO: 503636 - DNA, 25 bp, Rattus norvegicus
gtgagagaactgacttacttaccat

SEQ ID NO: 503637 - DNA, 25 bp, Rattus norvegicus
gtgagagaactgtcttacttaccat

SEQ ID NO: 503638 - DNA, 25 bp, Rattus norvegicus
gtgagagacaaccacggtcacgatg

SEQ ID NO: 503639 - DNA, 25 bp, Rattus norvegicus
gtgagagacaacgacggtcacgatg

SEQ ID NO: 503640 - DNA, 25 bp, Rattus norvegicus
gtgagagacaccattgttcccctgt

SEQ ID NO: 503641 - DNA, 25 bp, Rattus norvegicus
gtgagagacacctttgttcccctgt

SEQ ID NO: 503642 - DNA, 25 bp, Rattus norvegicus
gtgagagacagcatcccaaaccaga

SEQ ID NO: 503643 - DNA, 25 bp, Rattus norvegicus
gtgagagacagcttcccaaaccaga

SEQ ID NO: 503644 - DNA, 25 bp, Rattus norvegicus
gtgagagacctaccaccaatttgtc

SEQ ID NO: 503645 - DNA, 25 bp, Rattus norvegicus
gtgagagacctagcaccaatttgtc

SEQ ID NO: 503646 - DNA, 25 bp, Rattus norvegicus
gtgagagacgctctccgagctgtcc

SEQ ID NO: 503647 - DNA, 25 bp, Rattus norvegicus
gtgagagacgctgtccgagctgtcc

SEQ ID NO: 503648 - DNA, 25 bp, Rattus norvegicus
gtgagagactcaacgtgacccacga

SEQ ID NO: 503649 - DNA, 25 bp, Rattus norvegicus
gtgagagactcatcgtgacccacga

SEQ ID NO: 503650 - DNA, 25 bp, Rattus norvegicus
gtgagagaggtgaccctcctcagag

SEQ ID NO: 503651 - DNA, 25 bp, Rattus norvegicus
gtgagagaggtgtccctcctcagag

SEQ ID NO: 503652 - DNA, 25 bp, Rattus norvegicus
gtgagagattgccaaccaaacccct

SEQ ID NO: 503653 - DNA, 25 bp, Rattus norvegicus
gtgagagattgcgaaccaaacccct

SEQ ID NO: 503654 - DNA, 25 bp, Rattus norvegicus
gtgagagcaccaccatgtccggcag

SEQ ID NO: 503655 - DNA, 25 bp, Rattus norvegicus
gtgagagcaccagcatgtccggcag

SEQ ID NO: 503656 - DNA, 25 bp, Rattus norvegicus
gtgagagcagtcctcttagtattag

SEQ ID NO: 503657 - DNA, 25 bp, Rattus norvegicus
gtgagagcagtcgtcttagtattag

SEQ ID NO: 503658 - DNA, 25 bp, Rattus norvegicus
gtgagagccaaccatgaaattacct

SEQ ID NO: 503659 - DNA, 25 bp, Rattus norvegicus
gtgagagccaacgatgaaattacct

SEQ ID NO: 503660 - DNA, 25 bp, Rattus norvegicus
gtgagagcctcaaggacaccattgc

SEQ ID NO: 503661 - DNA, 25 bp, Rattus norvegicus
gtgagagcctcatggacaccattgc

SEQ ID NO: 503662 - DNA, 25 bp, Rattus norvegicus
gtgagagcgcctagctaggatgaac

SEQ ID NO: 503663 - DNA, 25 bp, Rattus norvegicus
gtgagagcgccttgctaggatgaac

SEQ ID NO: 503664 - DNA, 25 bp, Rattus norvegicus
gtgagagctactcgagccgcgacta

SEQ ID NO: 503665 - DNA, 25 bp, Rattus norvegicus
gtgagagctactggagccgcgacta

SEQ ID NO: 503666 - DNA, 25 bp, Rattus norvegicus
gtgagagctcagaccacagctgtct

SEQ ID NO: 503667 - DNA, 25 bp, Rattus norvegicus
gtgagagctcagtccacagctgtct

SEQ ID NO: 503668 - DNA, 25 bp, Rattus norvegicus
gtgagagctgctatgccacacagtc

SEQ ID NO: 503669 - DNA, 25 bp, Rattus norvegicus
gtgagagctgctcacaattgttttc

SEQ ID NO: 503670 - DNA, 25 bp, Rattus norvegicus
gtgagagctgctgacaattgttttc

SEQ ID NO: 503671 - DNA, 25 bp, Rattus norvegicus
gtgagagctgctttgccacacagtc

SEQ ID NO: 503672 - DNA, 25 bp, Rattus norvegicus
gtgagagctgtcatttccacaaagg

SEQ ID NO: 503673 - DNA, 25 bp, Rattus norvegicus
gtgagagctgtcttttccacaaagg

SEQ ID NO: 503674 - DNA, 25 bp, Rattus norvegicus
gtgagagcttaacctgtctgtatct

SEQ ID NO: 503675 - DNA, 25 bp, Rattus norvegicus
gtgagagcttaagctgtctgtatct

SEQ ID NO: 503676 - DNA, 25 bp, Rattus norvegicus
gtgagaggaccacctagatgcttga

SEQ ID NO: 503677 - DNA, 25 bp, Rattus norvegicus
gtgagaggaccagctagatgcttga

SEQ ID NO: 503678 - DNA, 25 bp, Rattus norvegicus
gtgagaggacctccatgccctgcct

SEQ ID NO: 503679 - DNA, 25 bp, Rattus norvegicus
gtgagaggacctgcatgccctgcct

SEQ ID NO: 503680 - DNA, 25 bp, Rattus norvegicus
gtgagaggcccactagcctgcactg

SEQ ID NO: 503681 - DNA, 25 bp, Rattus norvegicus
gtgagaggcccagtagcctgcactg

SEQ ID NO: 503682 - DNA, 25 bp, Rattus norvegicus
gtgagaggccctcgaacacgcctgt

SEQ ID NO: 503683 - DNA, 25 bp, Rattus norvegicus
gtgagaggccctggaacacgcctgt

SEQ ID NO: 503684 - DNA, 25 bp, Rattus norvegicus
gtgagaggccttcgtaaccagccca

SEQ ID NO: 503685 - DNA, 25 bp, Rattus norvegicus
gtgagaggccttggtaaccagccca

SEQ ID NO: 503686 - DNA, 25 bp, Rattus norvegicus
gtgagaggctatcacctacataaca

SEQ ID NO: 503687 - DNA, 25 bp, Rattus norvegicus
gtgagaggctatgacctacataaca

SEQ ID NO: 503688 - DNA, 25 bp, Rattus norvegicus
gtgagaggtacgagtcagccctgac

SEQ ID NO: 503689 - DNA, 25 bp, Rattus norvegicus
gtgagaggtacgtgtcagccctgac

SEQ ID NO: 503690 - DNA, 25 bp, Rattus norvegicus
gtgagaggtcctctatcttctttgc

SEQ ID NO: 503691 - DNA, 25 bp, Rattus norvegicus
gtgagaggtcctgtatcttctttgc

SEQ ID NO: 503692 - DNA, 25 bp, Rattus norvegicus
gtgagaggtgctcagctccaagcca

SEQ ID NO: 503693 - DNA, 25 bp, Rattus norvegicus
gtgagaggtgctgagctccaagcca

SEQ ID NO: 503694 - DNA, 25 bp, Rattus norvegicus
gtgagagtagcgatctgaccagcac

SEQ ID NO: 503695 - DNA, 25 bp, Rattus norvegicus
gtgagagtagcgttctgaccagcac

SEQ ID NO: 503696 - DNA, 25 bp, Rattus norvegicus
gtgagagtctctccttggtatctaa

SEQ ID NO: 503697 - DNA, 25 bp, Rattus norvegicus
gtgagagtctctgcttggtatctaa

SEQ ID NO: 503698 - DNA, 25 bp, Rattus norvegicus
gtgagagtgagtctcccctgtgtat

SEQ ID NO: 503699 - DNA, 25 bp, Rattus norvegicus
gtgagagtgagtgtcccctgtgtat

SEQ ID NO: 503700 - DNA, 25 bp, Rattus norvegicus
gtgagagtggctaagctgcccacaa

SEQ ID NO: 503701 - DNA, 25 bp, Rattus norvegicus
gtgagagtggctacttccggatccg

SEQ ID NO: 503702 - DNA, 25 bp, Rattus norvegicus
gtgagagtggcttagctgcccacaa

SEQ ID NO: 503703 - DNA, 25 bp, Rattus norvegicus
gtgagagtggcttcttccggatccg

SEQ ID NO: 503704 - DNA, 25 bp, Rattus norvegicus
gtgagagttattaaggccctgcaag

SEQ ID NO: 503705 - DNA, 25 bp, Rattus norvegicus
gtgagagttatttaggccctgcaag

SEQ ID NO: 503706 - DNA, 25 bp, Rattus norvegicus
gtgagagttctgctttttgtacata

SEQ ID NO: 503707 - DNA, 25 bp, Rattus norvegicus
gtgagagttctggtttttgtacata

SEQ ID NO: 503708 - DNA, 25 bp, Rattus norvegicus
gtgagataagaacccgccgtctcct

SEQ ID NO: 503709 - DNA, 25 bp, Rattus norvegicus
gtgagataagaagccgccgtctcct

SEQ ID NO: 503710 - DNA, 25 bp, Rattus norvegicus
gtgagataccaaatgccagtcccga

SEQ ID NO: 503711 - DNA, 25 bp, Rattus norvegicus
gtgagataccaattgccagtcccga

SEQ ID NO: 503712 - DNA, 25 bp, Rattus norvegicus
gtgagatacgtgacagcccgagatc

SEQ ID NO: 503713 - DNA, 25 bp, Rattus norvegicus
gtgagatacgtgtcagcccgagatc

SEQ ID NO: 503714 - DNA, 25 bp, Rattus norvegicus
gtgagatagagtcgcctcttctccc

SEQ ID NO: 503715 - DNA, 25 bp, Rattus norvegicus
gtgagatagagtggcctcttctccc

SEQ ID NO: 503716 - DNA, 25 bp, Rattus norvegicus
gtgagatagctcagtcttaaaaatg

SEQ ID NO: 503717 - DNA, 25 bp, Rattus norvegicus
gtgagatagctctgtcttaaaaatg

SEQ ID NO: 503718 - DNA, 25 bp, Rattus norvegicus
gtgagatatctgaaaattgttcgtg

SEQ ID NO: 503719 - DNA, 25 bp, Rattus norvegicus
gtgagatatctgtaaattgttcgtg

SEQ ID NO: 503720 - DNA, 25 bp, Rattus norvegicus
gtgagatatgccaggactgcctttt

SEQ ID NO: 503721 - DNA, 25 bp, Rattus norvegicus
gtgagatatgcctggactgcctttt

SEQ ID NO: 503722 - DNA, 25 bp, Rattus norvegicus
gtgagatcacttctgactaaacggt

SEQ ID NO: 503723 - DNA, 25 bp, Rattus norvegicus
gtgagatcacttgtgactaaacggt

SEQ ID NO: 503724 - DNA, 25 bp, Rattus norvegicus
gtgagatcagctcgcatcctgttaa

SEQ ID NO: 503725 - DNA, 25 bp, Rattus norvegicus
gtgagatcagctggcatcctgttaa

SEQ ID NO: 503726 - DNA, 25 bp, Rattus norvegicus
gtgagatccagaaggactccccaat

SEQ ID NO: 503727 - DNA, 25 bp, Rattus norvegicus
gtgagatccagatggactccccaat

SEQ ID NO: 503728 - DNA, 25 bp, Rattus norvegicus
gtgagatcctttatgctgttttacc

SEQ ID NO: 503729 - DNA, 25 bp, Rattus norvegicus
gtgagatcctttttgctgttttacc

SEQ ID NO: 503730 - DNA, 25 bp, Rattus norvegicus
gtgagatcgagtcctgctcagtgca

SEQ ID NO: 503731 - DNA, 25 bp, Rattus norvegicus
gtgagatcgagtgctgctcagtgca

SEQ ID NO: 503732 - DNA, 25 bp, Rattus norvegicus
gtgagatctcccaagcatgtactat

SEQ ID NO: 503733 - DNA, 25 bp, Rattus norvegicus
gtgagatctccctagcatgtactat

SEQ ID NO: 503734 - DNA, 25 bp, Rattus norvegicus
gtgagatctgagctctgaggcaaca

SEQ ID NO: 503735 - DNA, 25 bp, Rattus norvegicus
gtgagatctgaggtctgaggcaaca

SEQ ID NO: 503736 - DNA, 25 bp, Rattus norvegicus
gtgagatgacatccactaccttgtc

SEQ ID NO: 503737 - DNA, 25 bp, Rattus norvegicus
gtgagatgacatgcactaccttgtc

SEQ ID NO: 503738 - DNA, 25 bp, Rattus norvegicus
gtgagatgcacgcaagagcccgcac

SEQ ID NO: 503739 - DNA, 25 bp, Rattus norvegicus
gtgagatgcacggaagagcccgcac

SEQ ID NO: 503740 - DNA, 25 bp, Rattus norvegicus
gtgagatggaccacccctggaactg

SEQ ID NO: 503741 - DNA, 25 bp, Rattus norvegicus
gtgagatggacctcccctggaactg

SEQ ID NO: 503742 - DNA, 25 bp, Rattus norvegicus
gtgagatggctgcactgctcctgac

SEQ ID NO: 503743 - DNA, 25 bp, Rattus norvegicus
gtgagatggctggactgctcctgac

SEQ ID NO: 503744 - DNA, 25 bp, Rattus norvegicus
gtgagatgtacactgccaggagcat

SEQ ID NO: 503745 - DNA, 25 bp, Rattus norvegicus
gtgagatgtacagtgccaggagcat

SEQ ID NO: 503746 - DNA, 25 bp, Rattus norvegicus
gtgagatgtagaccagcaactgctt

SEQ ID NO: 503747 - DNA, 25 bp, Rattus norvegicus
gtgagatgtagagcagcaactgctt

SEQ ID NO: 503748 - DNA, 25 bp, Rattus norvegicus
gtgagatgtagcatttcctccatcc

SEQ ID NO: 503749 - DNA, 25 bp, Rattus norvegicus
gtgagatgtagcttttcctccatcc

SEQ ID NO: 503750 - DNA, 25 bp, Rattus norvegicus
gtgagatgttgcatgctccaccacc

SEQ ID NO: 503751 - DNA, 25 bp, Rattus norvegicus
gtgagatgttgcttgctccaccacc

SEQ ID NO: 503752 - DNA, 25 bp, Rattus norvegicus
gtgagatgttttcaatgtgcccttt

SEQ ID NO: 503753 - DNA, 25 bp, Rattus norvegicus
gtgagatgttttgaatgtgcccttt

SEQ ID NO: 503754 - DNA, 25 bp, Rattus norvegicus
gtgagattacttaccagtgcatcaa

SEQ ID NO: 503755 - DNA, 25 bp, Rattus norvegicus
gtgagattactttccagtgcatcaa

SEQ ID NO: 503756 - DNA, 25 bp, Rattus norvegicus
gtgagattcctaagccattgctcca

SEQ ID NO: 503757 - DNA, 25 bp, Rattus norvegicus
gtgagattcctatgccattgctcca

SEQ ID NO: 503758 - DNA, 25 bp, Rattus norvegicus
gtgagattcctcctctgtaagcttc

SEQ ID NO: 503759 - DNA, 25 bp, Rattus norvegicus
gtgagattcctcgtctgtaagcttc

SEQ ID NO: 503760 - DNA, 25 bp, Rattus norvegicus
gtgagattcctgaactctcaggcat

SEQ ID NO: 503761 - DNA, 25 bp, Rattus norvegicus
gtgagattcctgtactctcaggcat

SEQ ID NO: 503762 - DNA, 25 bp, Rattus norvegicus
gtgagattctctatcatacaccttc

SEQ ID NO: 503763 - DNA, 25 bp, Rattus norvegicus
gtgagattctctttcatacaccttc

SEQ ID NO: 503764 - DNA, 25 bp, Rattus norvegicus
gtgagatttcagaaccagcctcttt

SEQ ID NO: 503765 - DNA, 25 bp, Rattus norvegicus
gtgagatttcagtaccagcctcttt

SEQ ID NO: 503766 - DNA, 25 bp, Rattus norvegicus
gtgagatttcttctgtagctattct

SEQ ID NO: 503767 - DNA, 25 bp, Rattus norvegicus
gtgagatttcttgtgtagctattct

SEQ ID NO: 503768 - DNA, 25 bp, Rattus norvegicus
gtgagcaaacaaagacttagcaact

SEQ ID NO: 503769 - DNA, 25 bp, Rattus norvegicus
gtgagcaaacaatgacttagcaact

SEQ ID NO: 503770 - DNA, 25 bp, Rattus norvegicus
gtgagcaaacagaacatctctgttc

SEQ ID NO: 503771 - DNA, 25 bp, Rattus norvegicus
gtgagcaaacagtacatctctgttc

SEQ ID NO: 503772 - DNA, 25 bp, Rattus norvegicus
gtgagcaaagaaccttagtgatctg

SEQ ID NO: 503773 - DNA, 25 bp, Rattus norvegicus
gtgagcaaagaagcttagtgatctg

SEQ ID NO: 503774 - DNA, 25 bp, Rattus norvegicus
gtgagcaaagcacggcacacagcac

SEQ ID NO: 503775 - DNA, 25 bp, Rattus norvegicus
gtgagcaaagcagggcacacagcac

SEQ ID NO: 503776 - DNA, 25 bp, Rattus norvegicus
gtgagcaaaggcacaacacctctgg

SEQ ID NO: 503777 - DNA, 25 bp, Rattus norvegicus
gtgagcaaaggctcaacacctctgg

SEQ ID NO: 503778 - DNA, 25 bp, Rattus norvegicus
gtgagcaaatcacacctttaactta

SEQ ID NO: 503779 - DNA, 25 bp, Rattus norvegicus
gtgagcaaatcagacctttaactta

SEQ ID NO: 503780 - DNA, 25 bp, Rattus norvegicus
gtgagcaaatgcagatacgtttcca

SEQ ID NO: 503781 - DNA, 25 bp, Rattus norvegicus
gtgagcaaatgctgatacgtttcca

SEQ ID NO: 503782 - DNA, 25 bp, Rattus norvegicus
gtgagcaacagccattctctggttt

SEQ ID NO: 503783 - DNA, 25 bp, Rattus norvegicus
gtgagcaacagcgattctctggttt

SEQ ID NO: 503784 - DNA, 25 bp, Rattus norvegicus
gtgagcaacatcagcaaaacgccaa

SEQ ID NO: 503785 - DNA, 25 bp, Rattus norvegicus
gtgagcaacatctgcaaaacgccaa

SEQ ID NO: 503786 - DNA, 25 bp, Rattus norvegicus
gtgagcaacgggacctacctggaac

SEQ ID NO: 503787 - DNA, 25 bp, Rattus norvegicus
gtgagcaacgggtcctacctggaac

SEQ ID NO: 503788 - DNA, 25 bp, Rattus norvegicus
gtgagcaacttgcaccatctgtggc

SEQ ID NO: 503789 - DNA, 25 bp, Rattus norvegicus
gtgagcaacttggaccatctgtggc

SEQ ID NO: 503790 - DNA, 25 bp, Rattus norvegicus
gtgagcaataccactgccattttag

SEQ ID NO: 503791 - DNA, 25 bp, Rattus norvegicus
gtgagcaatacctctgccattttag

SEQ ID NO: 503792 - DNA, 25 bp, Rattus norvegicus
gtgagcaatccccaagttttaaggt

SEQ ID NO: 503793 - DNA, 25 bp, Rattus norvegicus
gtgagcaatcccgaagttttaaggt

SEQ ID NO: 503794 - DNA, 25 bp, Rattus norvegicus
gtgagcaattgtctccacttttcaa

SEQ ID NO: 503795 - DNA, 25 bp, Rattus norvegicus
gtgagcaattgtgtccacttttcaa

SEQ ID NO: 503796 - DNA, 25 bp, Rattus norvegicus
gtgagcacaagtacttgccgtcctg

SEQ ID NO: 503797 - DNA, 25 bp, Rattus norvegicus
gtgagcacaagttcttgccgtcctg

SEQ ID NO: 503798 - DNA, 25 bp, Rattus norvegicus
gtgagcacacagaatgcatatagat

SEQ ID NO: 503799 - DNA, 25 bp, Rattus norvegicus
gtgagcacacagtatgcatatagat

SEQ ID NO: 503800 - DNA, 25 bp, Rattus norvegicus
gtgagcacagagaaactgcagagga

SEQ ID NO: 503801 - DNA, 25 bp, Rattus norvegicus
gtgagcacagagaccctgtatctgc

SEQ ID NO: 503802 - DNA, 25 bp, Rattus norvegicus
gtgagcacagagtaactgcagagga

SEQ ID NO: 503803 - DNA, 25 bp, Rattus norvegicus
gtgagcacagagtccctgtatctgc

SEQ ID NO: 503804 - DNA, 25 bp, Rattus norvegicus
gtgagcacagtgatagcaacctgaa

SEQ ID NO: 503805 - DNA, 25 bp, Rattus norvegicus
gtgagcacagtgttagcaacctgaa

SEQ ID NO: 503806 - DNA, 25 bp, Rattus norvegicus
gtgagcacatgactgtacgtctgaa

SEQ ID NO: 503807 - DNA, 25 bp, Rattus norvegicus
gtgagcacatgagtgtacgtctgaa

SEQ ID NO: 503808 - DNA, 25 bp, Rattus norvegicus
gtgagcaccaccaaaggccagactg

SEQ ID NO: 503809 - DNA, 25 bp, Rattus norvegicus
gtgagcaccacctaaggccagactg

SEQ ID NO: 503810 - DNA, 25 bp, Rattus norvegicus
gtgagcaccattagacaccagcagg

SEQ ID NO: 503811 - DNA, 25 bp, Rattus norvegicus
gtgagcaccatttgacaccagcagg

SEQ ID NO: 503812 - DNA, 25 bp, Rattus norvegicus
gtgagcacccctactttggataacg

SEQ ID NO: 503813 - DNA, 25 bp, Rattus norvegicus
gtgagcacccctcggaggtcatgcc

SEQ ID NO: 503814 - DNA, 25 bp, Rattus norvegicus
gtgagcacccctgggaggtcatgcc

SEQ ID NO: 503815 - DNA, 25 bp, Rattus norvegicus
gtgagcaccccttctttggataacg

SEQ ID NO: 503816 - DNA, 25 bp, Rattus norvegicus
gtgagcaccggcaggcgctaaagaa

SEQ ID NO: 503817 - DNA, 25 bp, Rattus norvegicus
gtgagcaccggctggcgctaaagaa

SEQ ID NO: 503818 - DNA, 25 bp, Rattus norvegicus
gtgagcaccttacatcagcctgact

SEQ ID NO: 503819 - DNA, 25 bp, Rattus norvegicus
gtgagcaccttagatcagcctgact

SEQ ID NO: 503820 - DNA, 25 bp, Rattus norvegicus
gtgagcacctttaaatcaacctttt

SEQ ID NO: 503821 - DNA, 25 bp, Rattus norvegicus
gtgagcaccttttaatcaacctttt

SEQ ID NO: 503822 - DNA, 25 bp, Rattus norvegicus
gtgagcacgaataaaaaaccaggac

SEQ ID NO: 503823 - DNA, 25 bp, Rattus norvegicus
gtgagcacgaattaaaaaccaggac

SEQ ID NO: 503824 - DNA, 25 bp, Rattus norvegicus
gtgagcacggcacagatgtatcttc

SEQ ID NO: 503825 - DNA, 25 bp, Rattus norvegicus
gtgagcacggcagagatgtatcttc

SEQ ID NO: 503826 - DNA, 25 bp, Rattus norvegicus
gtgagcactacaatagcttggtgtc

SEQ ID NO: 503827 - DNA, 25 bp, Rattus norvegicus
gtgagcactacattagcttggtgtc

SEQ ID NO: 503828 - DNA, 25 bp, Rattus norvegicus
gtgagcactgctattaagtctatga

SEQ ID NO: 503829 - DNA, 25 bp, Rattus norvegicus
gtgagcactgcttttaagtctatga

SEQ ID NO: 503830 - DNA, 25 bp, Rattus norvegicus
gtgagcactggcatctcgtgggatc

SEQ ID NO: 503831 - DNA, 25 bp, Rattus norvegicus
gtgagcactggcttctcgtgggatc

SEQ ID NO: 503832 - DNA, 25 bp, Rattus norvegicus
gtgagcactgtgatcagcgagctgc

SEQ ID NO: 503833 - DNA, 25 bp, Rattus norvegicus
gtgagcactgtgatgacttccaagt

SEQ ID NO: 503834 - DNA, 25 bp, Rattus norvegicus
gtgagcactgtgttcagcgagctgc

SEQ ID NO: 503835 - DNA, 25 bp, Rattus norvegicus
gtgagcactgtgttgacttccaagt

SEQ ID NO: 503836 - DNA, 25 bp, Rattus norvegicus
gtgagcactttactaactgagccat

SEQ ID NO: 503837 - DNA, 25 bp, Rattus norvegicus
gtgagcactttagtaactgagccat

SEQ ID NO: 503838 - DNA, 25 bp, Rattus norvegicus
gtgagcagaccaccaaagggcctta

SEQ ID NO: 503839 - DNA, 25 bp, Rattus norvegicus
gtgagcagaccaccactgacagtgc

SEQ ID NO: 503840 - DNA, 25 bp, Rattus norvegicus
gtgagcagaccagcaaagggcctta

SEQ ID NO: 503841 - DNA, 25 bp, Rattus norvegicus
gtgagcagaccagcactgacagtgc

SEQ ID NO: 503842 - DNA, 25 bp, Rattus norvegicus
gtgagcagagagaaccctagtcagt

SEQ ID NO: 503843 - DNA, 25 bp, Rattus norvegicus
gtgagcagagagtaccctagtcagt

SEQ ID NO: 503844 - DNA, 25 bp, Rattus norvegicus
gtgagcagcaagaccatcgaaatga

SEQ ID NO: 503845 - DNA, 25 bp, Rattus norvegicus
gtgagcagcaagtccatcgaaatga

SEQ ID NO: 503846 - DNA, 25 bp, Rattus norvegicus
gtgagcagcacacgagtcccacttg

SEQ ID NO: 503847 - DNA, 25 bp, Rattus norvegicus
gtgagcagcacaggagtcccacttg

SEQ ID NO: 503848 - DNA, 25 bp, Rattus norvegicus
gtgagcagccgaagcctctgcagaa

SEQ ID NO: 503849 - DNA, 25 bp, Rattus norvegicus
gtgagcagccgatgcctctgcagaa

SEQ ID NO: 503850 - DNA, 25 bp, Rattus norvegicus
gtgagcaggacactctgaccatagt

SEQ ID NO: 503851 - DNA, 25 bp, Rattus norvegicus
gtgagcaggacagtctgaccatagt

SEQ ID NO: 503852 - DNA, 25 bp, Rattus norvegicus
gtgagcaggcagattgccagaattt

SEQ ID NO: 503853 - DNA, 25 bp, Rattus norvegicus
gtgagcaggcagtttgccagaattt

SEQ ID NO: 503854 - DNA, 25 bp, Rattus norvegicus
gtgagcagggttcatctattttaaa

SEQ ID NO: 503855 - DNA, 25 bp, Rattus norvegicus
gtgagcagggttgatctattttaaa

SEQ ID NO: 503856 - DNA, 25 bp, Rattus norvegicus
gtgagcagtaagatccgcatccatc

SEQ ID NO: 503857 - DNA, 25 bp, Rattus norvegicus
gtgagcagtaagttccgcatccatc

SEQ ID NO: 503858 - DNA, 25 bp, Rattus norvegicus
gtgagcagtcatctcccggatgaat

SEQ ID NO: 503859 - DNA, 25 bp, Rattus norvegicus
gtgagcagtcatgtcccggatgaat

SEQ ID NO: 503860 - DNA, 25 bp, Rattus norvegicus
gtgagcagtcttccaaagccatggt

SEQ ID NO: 503861 - DNA, 25 bp, Rattus norvegicus
gtgagcagtcttgcaaagccatggt

SEQ ID NO: 503862 - DNA, 25 bp, Rattus norvegicus
gtgagcagtgacatctagagacaga

SEQ ID NO: 503863 - DNA, 25 bp, Rattus norvegicus
gtgagcagtgacttctagagacaga

SEQ ID NO: 503864 - DNA, 25 bp, Rattus norvegicus
gtgagcagttctcgacacttacaac

SEQ ID NO: 503865 - DNA, 25 bp, Rattus norvegicus
gtgagcagttctggacacttacaac

SEQ ID NO: 503866 - DNA, 25 bp, Rattus norvegicus
gtgagcatcagtaaccttgaccttt

SEQ ID NO: 503867 - DNA, 25 bp, Rattus norvegicus
gtgagcatcagttaccttgaccttt

SEQ ID NO: 503868 - DNA, 25 bp, Rattus norvegicus
gtgagcatcatgcagcccaaaccca

SEQ ID NO: 503869 - DNA, 25 bp, Rattus norvegicus
gtgagcatcatggagcccaaaccca

SEQ ID NO: 503870 - DNA, 25 bp, Rattus norvegicus
gtgagcatccacctgtgtatttgtc

SEQ ID NO: 503871 - DNA, 25 bp, Rattus norvegicus
gtgagcatccacgtgtgtatttgtc

SEQ ID NO: 503872 - DNA, 25 bp, Rattus norvegicus
gtgagcatcctacccagatccgtag

SEQ ID NO: 503873 - DNA, 25 bp, Rattus norvegicus
gtgagcatcctagccagatccgtag

SEQ ID NO: 503874 - DNA, 25 bp, Rattus norvegicus
gtgagcatcgatacctttacttata

SEQ ID NO: 503875 - DNA, 25 bp, Rattus norvegicus
gtgagcatcgattcctttacttata

SEQ ID NO: 503876 - DNA, 25 bp, Rattus norvegicus
gtgagcatcggaagtctccagctgc

SEQ ID NO: 503877 - DNA, 25 bp, Rattus norvegicus
gtgagcatcggatgtctccagctgc

SEQ ID NO: 503878 - DNA, 25 bp, Rattus norvegicus
gtgagcatctccataccctactgtt

SEQ ID NO: 503879 - DNA, 25 bp, Rattus norvegicus
gtgagcatctccttaccctactgtt

SEQ ID NO: 503880 - DNA, 25 bp, Rattus norvegicus
gtgagcatctctagaacctcttcat

SEQ ID NO: 503881 - DNA, 25 bp, Rattus norvegicus
gtgagcatctcttgaacctcttcat

SEQ ID NO: 503882 - DNA, 25 bp, Rattus norvegicus
gtgagcatgaccattcaagtgaacg

SEQ ID NO: 503883 - DNA, 25 bp, Rattus norvegicus
gtgagcatgacctttcaagtgaacg

SEQ ID NO: 503884 - DNA, 25 bp, Rattus norvegicus
gtgagcattaccattgaacagttgt

SEQ ID NO: 503885 - DNA, 25 bp, Rattus norvegicus
gtgagcattacctttgaacagttgt

SEQ ID NO: 503886 - DNA, 25 bp, Rattus norvegicus
gtgagcattctcatgtgctgtccta

SEQ ID NO: 503887 - DNA, 25 bp, Rattus norvegicus
gtgagcattctcttgtgctgtccta

SEQ ID NO: 503888 - DNA, 25 bp, Rattus norvegicus
gtgagcattgaaatcctaacctgtg

SEQ ID NO: 503889 - DNA, 25 bp, Rattus norvegicus
gtgagcattgaattcctaacctgtg

SEQ ID NO: 503890 - DNA, 25 bp, Rattus norvegicus
gtgagcattttaaccgctgagccat

SEQ ID NO: 503891 - DNA, 25 bp, Rattus norvegicus
gtgagcattttatccgctgagccat

SEQ ID NO: 503892 - DNA, 25 bp, Rattus norvegicus
gtgagcattttgaacaacattcaaa

SEQ ID NO: 503893 - DNA, 25 bp, Rattus norvegicus
gtgagcattttgtacaacattcaaa

SEQ ID NO: 503894 - DNA, 25 bp, Rattus norvegicus
gtgagccaacacatacagcttgact

SEQ ID NO: 503895 - DNA, 25 bp, Rattus norvegicus
gtgagccaacacatgtacagaacaa

SEQ ID NO: 503896 - DNA, 25 bp, Rattus norvegicus
gtgagccaacacttacagcttgact

SEQ ID NO: 503897 - DNA, 25 bp, Rattus norvegicus
gtgagccaacacttgtacagaacaa

SEQ ID NO: 503898 - DNA, 25 bp, Rattus norvegicus
gtgagccaactcctgaaagtcgttc

SEQ ID NO: 503899 - DNA, 25 bp, Rattus norvegicus
gtgagccaactcgtgaaagtcgttc

SEQ ID NO: 503900 - DNA, 25 bp, Rattus norvegicus
gtgagccaagtgacacatccagttt

SEQ ID NO: 503901 - DNA, 25 bp, Rattus norvegicus
gtgagccaagtgtcacatccagttt

SEQ ID NO: 503902 - DNA, 25 bp, Rattus norvegicus
gtgagccacatgacttcgaagacat

SEQ ID NO: 503903 - DNA, 25 bp, Rattus norvegicus
gtgagccacatgtcttcgaagacat

SEQ ID NO: 503904 - DNA, 25 bp, Rattus norvegicus
gtgagccacctcaagacaggataag

SEQ ID NO: 503905 - DNA, 25 bp, Rattus norvegicus
gtgagccacctctagacaggataag

SEQ ID NO: 503906 - DNA, 25 bp, Rattus norvegicus
gtgagccacctgagattcatgagaa

SEQ ID NO: 503907 - DNA, 25 bp, Rattus norvegicus
gtgagccacctgtgattcatgagaa

SEQ ID NO: 503908 - DNA, 25 bp, Rattus norvegicus
gtgagccactcaaaactgggaccct

SEQ ID NO: 503909 - DNA, 25 bp, Rattus norvegicus
gtgagccactcataactgggaccct

SEQ ID NO: 503910 - DNA, 25 bp, Rattus norvegicus
gtgagccactggaaacttccctgag

SEQ ID NO: 503911 - DNA, 25 bp, Rattus norvegicus
gtgagccactggtaacttccctgag

SEQ ID NO: 503912 - DNA, 25 bp, Rattus norvegicus
gtgagccaggcactgcaatgcacac

SEQ ID NO: 503913 - DNA, 25 bp, Rattus norvegicus
gtgagccaggcagtgcaatgcacac

SEQ ID NO: 503914 - DNA, 25 bp, Rattus norvegicus
gtgagccagtcaagtagtttctatt

SEQ ID NO: 503915 - DNA, 25 bp, Rattus norvegicus
gtgagccagtcatgtagtttctatt

SEQ ID NO: 503916 - DNA, 25 bp, Rattus norvegicus
gtgagccagtggatgacatttcaga

SEQ ID NO: 503917 - DNA, 25 bp, Rattus norvegicus
gtgagccagtggttgacatttcaga

SEQ ID NO: 503918 - DNA, 25 bp, Rattus norvegicus
gtgagccatcagcacggtgtgaact

SEQ ID NO: 503919 - DNA, 25 bp, Rattus norvegicus
gtgagccatcaggacggtgtgaact

SEQ ID NO: 503920 - DNA, 25 bp, Rattus norvegicus
gtgagccattgtagtacgtctagta

SEQ ID NO: 503921 - DNA, 25 bp, Rattus norvegicus
gtgagccattgttgtacgtctagta

SEQ ID NO: 503922 - DNA, 25 bp, Rattus norvegicus
gtgagcccaagccaggtttggctat

SEQ ID NO: 503923 - DNA, 25 bp, Rattus norvegicus
gtgagcccaagcgaggtttggctat

SEQ ID NO: 503924 - DNA, 25 bp, Rattus norvegicus
gtgagcccactgagactggaggcta

SEQ ID NO: 503925 - DNA, 25 bp, Rattus norvegicus
gtgagcccactgtgactggaggcta

SEQ ID NO: 503926 - DNA, 25 bp, Rattus norvegicus
gtgagcccagagagcctgtaagcca

SEQ ID NO: 503927 - DNA, 25 bp, Rattus norvegicus
gtgagcccagagtgcctgtaagcca

SEQ ID NO: 503928 - DNA, 25 bp, Rattus norvegicus
gtgagccccataacccaggcatcta

SEQ ID NO: 503929 - DNA, 25 bp, Rattus norvegicus
gtgagccccatatcccaggcatcta

SEQ ID NO: 503930 - DNA, 25 bp, Rattus norvegicus
gtgagccccatgctgatgcttgata

SEQ ID NO: 503931 - DNA, 25 bp, Rattus norvegicus
gtgagccccatggtgatgcttgata

SEQ ID NO: 503932 - DNA, 25 bp, Rattus norvegicus
gtgagccccgagatgctggcacagc

SEQ ID NO: 503933 - DNA, 25 bp, Rattus norvegicus
gtgagccccgagttgctggcacagc

SEQ ID NO: 503934 - DNA, 25 bp, Rattus norvegicus
gtgagcccctctcagctagaaatgc

SEQ ID NO: 503935 - DNA, 25 bp, Rattus norvegicus
gtgagcccctctgagctagaaatgc

SEQ ID NO: 503936 - DNA, 25 bp, Rattus norvegicus
gtgagccctaaaaacttctttccat

SEQ ID NO: 503937 - DNA, 25 bp, Rattus norvegicus
gtgagccctaaatacttctttccat

SEQ ID NO: 503938 - DNA, 25 bp, Rattus norvegicus
gtgagccctgttatactcttaacta

SEQ ID NO: 503939 - DNA, 25 bp, Rattus norvegicus
gtgagccctgttttactcttaacta

SEQ ID NO: 503940 - DNA, 25 bp, Rattus norvegicus
gtgagcccttacaaacatgatacat

SEQ ID NO: 503941 - DNA, 25 bp, Rattus norvegicus
gtgagcccttactaacatgatacat

SEQ ID NO: 503942 - DNA, 25 bp, Rattus norvegicus
gtgagcccttccaaaattgtgtgta

SEQ ID NO: 503943 - DNA, 25 bp, Rattus norvegicus
gtgagcccttcctaaattgtgtgta

SEQ ID NO: 503944 - DNA, 25 bp, Rattus norvegicus
gtgagcccttggagtaaacctgttc

SEQ ID NO: 503945 - DNA, 25 bp, Rattus norvegicus
gtgagcccttggtgtaaacctgttc

SEQ ID NO: 503946 - DNA, 25 bp, Rattus norvegicus
gtgagccggccacgtgcaactgact

SEQ ID NO: 503947 - DNA, 25 bp, Rattus norvegicus
gtgagccggccaggtgcaactgact

SEQ ID NO: 503948 - DNA, 25 bp, Rattus norvegicus
gtgagccgttatcttgtcttattga

SEQ ID NO: 503949 - DNA, 25 bp, Rattus norvegicus
gtgagccgttatgttgtcttattga

SEQ ID NO: 503950 - DNA, 25 bp, Rattus norvegicus
gtgagcctacctaagtactgggtga

SEQ ID NO: 503951 - DNA, 25 bp, Rattus norvegicus
gtgagcctaccttagtactgggtga

SEQ ID NO: 503952 - DNA, 25 bp, Rattus norvegicus
gtgagcctagccacttagggccgag

SEQ ID NO: 503953 - DNA, 25 bp, Rattus norvegicus
gtgagcctagcctcttagggccgag

SEQ ID NO: 503954 - DNA, 25 bp, Rattus norvegicus
gtgagcctcaagaagtgctatccta

SEQ ID NO: 503955 - DNA, 25 bp, Rattus norvegicus
gtgagcctcaagtagtgctatccta

SEQ ID NO: 503956 - DNA, 25 bp, Rattus norvegicus
gtgagcctccttagactttttagaa

SEQ ID NO: 503957 - DNA, 25 bp, Rattus norvegicus
gtgagcctcctttgactttttagaa

SEQ ID NO: 503958 - DNA, 25 bp, Rattus norvegicus
gtgagcctgataagagttctgggaa

SEQ ID NO: 503959 - DNA, 25 bp, Rattus norvegicus
gtgagcctgatatgagttctgggaa

SEQ ID NO: 503960 - DNA, 25 bp, Rattus norvegicus
gtgagcctgctacaacacaccatag

SEQ ID NO: 503961 - DNA, 25 bp, Rattus norvegicus
gtgagcctgctagaacacaccatag

SEQ ID NO: 503962 - DNA, 25 bp, Rattus norvegicus
gtgagcctggccaacggacgcacgc

SEQ ID NO: 503963 - DNA, 25 bp, Rattus norvegicus
gtgagcctggcctacggacgcacgc

SEQ ID NO: 503964 - DNA, 25 bp, Rattus norvegicus
gtgagcctgggcaatctcagaagaa

SEQ ID NO: 503965 - DNA, 25 bp, Rattus norvegicus
gtgagcctgggcatgctaaaggaaa

SEQ ID NO: 503966 - DNA, 25 bp, Rattus norvegicus
gtgagcctgggctatctcagaagaa

SEQ ID NO: 503967 - DNA, 25 bp, Rattus norvegicus
gtgagcctgggcttgctaaaggaaa

SEQ ID NO: 503968 - DNA, 25 bp, Rattus norvegicus
gtgagcctgggtattatgattgttg

SEQ ID NO: 503969 - DNA, 25 bp, Rattus norvegicus
gtgagcctgggttttatgattgttg

SEQ ID NO: 503970 - DNA, 25 bp, Rattus norvegicus
gtgagcctggttatgttactgtttt

SEQ ID NO: 503971 - DNA, 25 bp, Rattus norvegicus
gtgagcctggttttgttactgtttt

SEQ ID NO: 503972 - DNA, 25 bp, Rattus norvegicus
gtgagcctgtagagtctctgtagaa

SEQ ID NO: 503973 - DNA, 25 bp, Rattus norvegicus
gtgagcctgtagtgtctctgtagaa

SEQ ID NO: 503974 - DNA, 25 bp, Rattus norvegicus
gtgagcctgtcgacagatctggaat

SEQ ID NO: 503975 - DNA, 25 bp, Rattus norvegicus
gtgagcctgtcgtcagatctggaat

SEQ ID NO: 503976 - DNA, 25 bp, Rattus norvegicus
gtgagccttcacatgtacaagcaca

SEQ ID NO: 503977 - DNA, 25 bp, Rattus norvegicus
gtgagccttcacttgtacaagcaca

SEQ ID NO: 503978 - DNA, 25 bp, Rattus norvegicus
gtgagccttcttaggttagtgcttc

SEQ ID NO: 503979 - DNA, 25 bp, Rattus norvegicus
gtgagccttctttggttagtgcttc

SEQ ID NO: 503980 - DNA, 25 bp, Rattus norvegicus
gtgagccttgatccctgtaacacca

SEQ ID NO: 503981 - DNA, 25 bp, Rattus norvegicus
gtgagccttgatgcctgtaacacca

SEQ ID NO: 503982 - DNA, 25 bp, Rattus norvegicus
gtgagccttgctcaacctggataga

SEQ ID NO: 503983 - DNA, 25 bp, Rattus norvegicus
gtgagccttgctgaacctggataga

SEQ ID NO: 503984 - DNA, 25 bp, Rattus norvegicus
gtgagccttgtcaagtttactacca

SEQ ID NO: 503985 - DNA, 25 bp, Rattus norvegicus
gtgagccttgtcagtgggagatcaa

SEQ ID NO: 503986 - DNA, 25 bp, Rattus norvegicus
gtgagccttgtctagtttactacca

SEQ ID NO: 503987 - DNA, 25 bp, Rattus norvegicus
gtgagccttgtctgtgggagatcaa

SEQ ID NO: 503988 - DNA, 25 bp, Rattus norvegicus
gtgagcctttcaaggaatccccgaa

SEQ ID NO: 503989 - DNA, 25 bp, Rattus norvegicus
gtgagcctttcatggaatccccgaa

SEQ ID NO: 503990 - DNA, 25 bp, Rattus norvegicus
gtgagccttttgaaggaatacttta

SEQ ID NO: 503991 - DNA, 25 bp, Rattus norvegicus
gtgagccttttgtaggaatacttta

SEQ ID NO: 503992 - DNA, 25 bp, Rattus norvegicus
gtgagcgaaaaactacatccttcct

SEQ ID NO: 503993 - DNA, 25 bp, Rattus norvegicus
gtgagcgaaaaagtacatccttcct

SEQ ID NO: 503994 - DNA, 25 bp, Rattus norvegicus
gtgagcgaaacaccccacgtgatga

SEQ ID NO: 503995 - DNA, 25 bp, Rattus norvegicus
gtgagcgaaacagcccacgtgatga

SEQ ID NO: 503996 - DNA, 25 bp, Rattus norvegicus
gtgagcgaccgcaagctcgtgagcc

SEQ ID NO: 503997 - DNA, 25 bp, Rattus norvegicus
gtgagcgaccgctagctcgtgagcc

SEQ ID NO: 503998 - DNA, 25 bp, Rattus norvegicus
gtgagcgagacaatttcagcggctt

SEQ ID NO: 503999 - DNA, 25 bp, Rattus norvegicus
gtgagcgagacattttcagcggctt

SEQ ID NO: 504000 - DNA, 25 bp, Rattus norvegicus
gtgagcgagccaatcaggttctgaa

SEQ ID NO: 504001 - DNA, 25 bp, Rattus norvegicus
gtgagcgagccattcaggttctgaa

SEQ ID NO: 504002 - DNA, 25 bp, Rattus norvegicus
gtgagcgccaatatagcccatgtca

SEQ ID NO: 504003 - DNA, 25 bp, Rattus norvegicus
gtgagcgccaatttagcccatgtca

SEQ ID NO: 504004 - DNA, 25 bp, Rattus norvegicus
gtgagcgcccttactggtggtaatc

SEQ ID NO: 504005 - DNA, 25 bp, Rattus norvegicus
gtgagcgccctttctggtggtaatc

SEQ ID NO: 504006 - DNA, 25 bp, Rattus norvegicus
gtgagcgcttcgagatgttccgaga

SEQ ID NO: 504007 - DNA, 25 bp, Rattus norvegicus
gtgagcgcttcgtgatgttccgaga

SEQ ID NO: 504008 - DNA, 25 bp, Rattus norvegicus
gtgagcgcttgccttgccatgagaa

SEQ ID NO: 504009 - DNA, 25 bp, Rattus norvegicus
gtgagcgcttgcgttgccatgagaa

SEQ ID NO: 504010 - DNA, 25 bp, Rattus norvegicus
gtgagcgcttgtctttggagcacaa

SEQ ID NO: 504011 - DNA, 25 bp, Rattus norvegicus
gtgagcgcttgtgtttggagcacaa

SEQ ID NO: 504012 - DNA, 25 bp, Rattus norvegicus
gtgagcggattcattatccagactt

SEQ ID NO: 504013 - DNA, 25 bp, Rattus norvegicus
gtgagcggattctttatccagactt

SEQ ID NO: 504014 - DNA, 25 bp, Rattus norvegicus
gtgagcggctgaactactctgcttg

SEQ ID NO: 504015 - DNA, 25 bp, Rattus norvegicus
gtgagcggctgatctactctgcttg

SEQ ID NO: 504016 - DNA, 25 bp, Rattus norvegicus
gtgagcggctgtatgaatctttgtt

SEQ ID NO: 504017 - DNA, 25 bp, Rattus norvegicus
gtgagcggctgtttgaatctttgtt

SEQ ID NO: 504018 - DNA, 25 bp, Rattus norvegicus
gtgagcggcttgagctgcagattat

SEQ ID NO: 504019 - DNA, 25 bp, Rattus norvegicus
gtgagcggcttgtgctgcagattat

SEQ ID NO: 504020 - DNA, 25 bp, Rattus norvegicus
gtgagcgggtgcatctcagcacatt

SEQ ID NO: 504021 - DNA, 25 bp, Rattus norvegicus
gtgagcgggtgcttctcagcacatt

SEQ ID NO: 504022 - DNA, 25 bp, Rattus norvegicus
gtgagcgtaatcagcacctggtcca

SEQ ID NO: 504023 - DNA, 25 bp, Rattus norvegicus
gtgagcgtaatctgcacctggtcca

SEQ ID NO: 504024 - DNA, 25 bp, Rattus norvegicus
gtgagcgtataaacccaagatcagt

SEQ ID NO: 504025 - DNA, 25 bp, Rattus norvegicus
gtgagcgtataatcccaagatcagt

SEQ ID NO: 504026 - DNA, 25 bp, Rattus norvegicus
gtgagcgtcaagctggcatgccatc

SEQ ID NO: 504027 - DNA, 25 bp, Rattus norvegicus
gtgagcgtcaaggtggcatgccatc

SEQ ID NO: 504028 - DNA, 25 bp, Rattus norvegicus
gtgagcgtcgatccaacagtgcagt

SEQ ID NO: 504029 - DNA, 25 bp, Rattus norvegicus
gtgagcgtcgatgcaacagtgcagt

SEQ ID NO: 504030 - DNA, 25 bp, Rattus norvegicus
gtgagcgtgagtatcactcctgatg

SEQ ID NO: 504031 - DNA, 25 bp, Rattus norvegicus
gtgagcgtgagtttcactcctgatg

SEQ ID NO: 504032 - DNA, 25 bp, Rattus norvegicus
gtgagctaacatatgtacttttcaa

SEQ ID NO: 504033 - DNA, 25 bp, Rattus norvegicus
gtgagctaacatttgtacttttcaa

SEQ ID NO: 504034 - DNA, 25 bp, Rattus norvegicus
gtgagctaacgaagtgcggcttctt

SEQ ID NO: 504035 - DNA, 25 bp, Rattus norvegicus
gtgagctaacgatgtgcggcttctt

SEQ ID NO: 504036 - DNA, 25 bp, Rattus norvegicus
gtgagctacacacagacctacttga

SEQ ID NO: 504037 - DNA, 25 bp, Rattus norvegicus
gtgagctacacagagacctacttga

SEQ ID NO: 504038 - DNA, 25 bp, Rattus norvegicus
gtgagctacctgacccaattgtaaa

SEQ ID NO: 504039 - DNA, 25 bp, Rattus norvegicus
gtgagctacctgtcccaattgtaaa

SEQ ID NO: 504040 - DNA, 25 bp, Rattus norvegicus
gtgagctacgccattgattctttaa

SEQ ID NO: 504041 - DNA, 25 bp, Rattus norvegicus
gtgagctacgcctttgattctttaa

SEQ ID NO: 504042 - DNA, 25 bp, Rattus norvegicus
gtgagctagaggatttctcccagtc

SEQ ID NO: 504043 - DNA, 25 bp, Rattus norvegicus
gtgagctagaggttttctcccagtc

SEQ ID NO: 504044 - DNA, 25 bp, Rattus norvegicus
gtgagctagtcccaccggcttagtg

SEQ ID NO: 504045 - DNA, 25 bp, Rattus norvegicus
gtgagctagtccgaccggcttagtg

SEQ ID NO: 504046 - DNA, 25 bp, Rattus norvegicus
gtgagctagtgcagttacctgctgg

SEQ ID NO: 504047 - DNA, 25 bp, Rattus norvegicus
gtgagctagtgctgttacctgctgg

SEQ ID NO: 504048 - DNA, 25 bp, Rattus norvegicus
gtgagctagttcagactatttggga

SEQ ID NO: 504049 - DNA, 25 bp, Rattus norvegicus
gtgagctagttctgactatttggga

SEQ ID NO: 504050 - DNA, 25 bp, Rattus norvegicus
gtgagctataaaaccctcatcccag

SEQ ID NO: 504051 - DNA, 25 bp, Rattus norvegicus
gtgagctataaatccctcatcccag

SEQ ID NO: 504052 - DNA, 25 bp, Rattus norvegicus
gtgagctatcacagagtccttttgc

SEQ ID NO: 504053 - DNA, 25 bp, Rattus norvegicus
gtgagctatcactgagtccttttgc

SEQ ID NO: 504054 - DNA, 25 bp, Rattus norvegicus
gtgagctatgatacccagtctttat

SEQ ID NO: 504055 - DNA, 25 bp, Rattus norvegicus
gtgagctatgattcccagtctttat

SEQ ID NO: 504056 - DNA, 25 bp, Rattus norvegicus
gtgagctatgcgcatgtaccatgaa

SEQ ID NO: 504057 - DNA, 25 bp, Rattus norvegicus
gtgagctatgcggatgtaccatgaa

SEQ ID NO: 504058 - DNA, 25 bp, Rattus norvegicus
gtgagctcaaccactgtgcatgttc

SEQ ID NO: 504059 - DNA, 25 bp, Rattus norvegicus
gtgagctcaacctctgtgcatgttc

SEQ ID NO: 504060 - DNA, 25 bp, Rattus norvegicus
gtgagctcaactatctttggcagca

SEQ ID NO: 504061 - DNA, 25 bp, Rattus norvegicus
gtgagctcaactttctttggcagca

SEQ ID NO: 504062 - DNA, 25 bp, Rattus norvegicus
gtgagctcacctagcaggatgtcag

SEQ ID NO: 504063 - DNA, 25 bp, Rattus norvegicus
gtgagctcacctcaagcttactcag

SEQ ID NO: 504064 - DNA, 25 bp, Rattus norvegicus
gtgagctcacctgaagcttactcag

SEQ ID NO: 504065 - DNA, 25 bp, Rattus norvegicus
gtgagctcaccttgcaggatgtcag

SEQ ID NO: 504066 - DNA, 25 bp, Rattus norvegicus
gtgagctcactcagtttctgtcgga

SEQ ID NO: 504067 - DNA, 25 bp, Rattus norvegicus
gtgagctcactctgtttctgtcgga

SEQ ID NO: 504068 - DNA, 25 bp, Rattus norvegicus
gtgagctcactgatggcttgtagat

SEQ ID NO: 504069 - DNA, 25 bp, Rattus norvegicus
gtgagctcactgttggcttgtagat

SEQ ID NO: 504070 - DNA, 25 bp, Rattus norvegicus
gtgagctcagctactttgggcaaga

SEQ ID NO: 504071 - DNA, 25 bp, Rattus norvegicus
gtgagctcagcttctttgggcaaga

SEQ ID NO: 504072 - DNA, 25 bp, Rattus norvegicus
gtgagctcatagcaaactcctgatc

SEQ ID NO: 504073 - DNA, 25 bp, Rattus norvegicus
gtgagctcataggaaactcctgatc

SEQ ID NO: 504074 - DNA, 25 bp, Rattus norvegicus
gtgagctccagaattccagctatgg

SEQ ID NO: 504075 - DNA, 25 bp, Rattus norvegicus
gtgagctccagatttccagctatgg

SEQ ID NO: 504076 - DNA, 25 bp, Rattus norvegicus
gtgagctccagtcgcagctgccgca

SEQ ID NO: 504077 - DNA, 25 bp, Rattus norvegicus
gtgagctccagtggcagctgccgca

SEQ ID NO: 504078 - DNA, 25 bp, Rattus norvegicus
gtgagctccatgcatgtcttagaag

SEQ ID NO: 504079 - DNA, 25 bp, Rattus norvegicus
gtgagctccatggatgtcttagaag

SEQ ID NO: 504080 - DNA, 25 bp, Rattus norvegicus
gtgagctcccagcagccatatatgg

SEQ ID NO: 504081 - DNA, 25 bp, Rattus norvegicus
gtgagctcccaggagccatatatgg

SEQ ID NO: 504082 - DNA, 25 bp, Rattus norvegicus
gtgagctccctaactactagactga

SEQ ID NO: 504083 - DNA, 25 bp, Rattus norvegicus
gtgagctccctatctactagactga

SEQ ID NO: 504084 - DNA, 25 bp, Rattus norvegicus
gtgagctccgtgattccagctatga

SEQ ID NO: 504085 - DNA, 25 bp, Rattus norvegicus
gtgagctccgtgtttccagctatga

SEQ ID NO: 504086 - DNA, 25 bp, Rattus norvegicus
gtgagctcctgtaggcagccctcca

SEQ ID NO: 504087 - DNA, 25 bp, Rattus norvegicus
gtgagctcctgttggcagccctcca

SEQ ID NO: 504088 - DNA, 25 bp, Rattus norvegicus
gtgagctccttaaactgacagtccc

SEQ ID NO: 504089 - DNA, 25 bp, Rattus norvegicus
gtgagctccttatactgacagtccc

SEQ ID NO: 504090 - DNA, 25 bp, Rattus norvegicus
gtgagctccttcagcatcgatactg

SEQ ID NO: 504091 - DNA, 25 bp, Rattus norvegicus
gtgagctccttctgcatcgatactg

SEQ ID NO: 504092 - DNA, 25 bp, Rattus norvegicus
gtgagctcgggcagtgttatcacat

SEQ ID NO: 504093 - DNA, 25 bp, Rattus norvegicus
gtgagctcgggctgtgttatcacat

SEQ ID NO: 504094 - DNA, 25 bp, Rattus norvegicus
gtgagctcggtactccagaaacact

SEQ ID NO: 504095 - DNA, 25 bp, Rattus norvegicus
gtgagctcggtagtccagaaacact

SEQ ID NO: 504096 - DNA, 25 bp, Rattus norvegicus
gtgagctctcaaatttattggcatt

SEQ ID NO: 504097 - DNA, 25 bp, Rattus norvegicus
gtgagctctcaattttattggcatt

SEQ ID NO: 504098 - DNA, 25 bp, Rattus norvegicus
gtgagctctcagatgggaccaccag

SEQ ID NO: 504099 - DNA, 25 bp, Rattus norvegicus
gtgagctctcagttgggaccaccag

SEQ ID NO: 504100 - DNA, 25 bp, Rattus norvegicus
gtgagctctgtaatcaatggagata

SEQ ID NO: 504101 - DNA, 25 bp, Rattus norvegicus
gtgagctctgtattcaatggagata

SEQ ID NO: 504102 - DNA, 25 bp, Rattus norvegicus
gtgagctctgttaaagatatccaat

SEQ ID NO: 504103 - DNA, 25 bp, Rattus norvegicus
gtgagctctgtttaagatatccaat

SEQ ID NO: 504104 - DNA, 25 bp, Rattus norvegicus
gtgagctgaagcattcctatgcggc

SEQ ID NO: 504105 - DNA, 25 bp, Rattus norvegicus
gtgagctgaagctttcctatgcggc

SEQ ID NO: 504106 - DNA, 25 bp, Rattus norvegicus
gtgagctgacggaactactggccca

SEQ ID NO: 504107 - DNA, 25 bp, Rattus norvegicus
gtgagctgacggtactactggccca

SEQ ID NO: 504108 - DNA, 25 bp, Rattus norvegicus
gtgagctgagacacacctctccagt

SEQ ID NO: 504109 - DNA, 25 bp, Rattus norvegicus
gtgagctgagactcacctctccagt

SEQ ID NO: 504110 - DNA, 25 bp, Rattus norvegicus
gtgagctgccctacatgggtgcaaa

SEQ ID NO: 504111 - DNA, 25 bp, Rattus norvegicus
gtgagctgccctagggatcccaata

SEQ ID NO: 504112 - DNA, 25 bp, Rattus norvegicus
gtgagctgcccttcatgggtgcaaa

SEQ ID NO: 504113 - DNA, 25 bp, Rattus norvegicus
gtgagctgcccttgggatcccaata

SEQ ID NO: 504114 - DNA, 25 bp, Rattus norvegicus
gtgagctgccggattcaccgttggc

SEQ ID NO: 504115 - DNA, 25 bp, Rattus norvegicus
gtgagctgccggtttcaccgttggc

SEQ ID NO: 504116 - DNA, 25 bp, Rattus norvegicus
gtgagctgcctaacttgggttctgg

SEQ ID NO: 504117 - DNA, 25 bp, Rattus norvegicus
gtgagctgcctatcttgggttctgg

SEQ ID NO: 504118 - DNA, 25 bp, Rattus norvegicus
gtgagctgctccacacgctgatgca

SEQ ID NO: 504119 - DNA, 25 bp, Rattus norvegicus
gtgagctgctcctcacgctgatgca

SEQ ID NO: 504120 - DNA, 25 bp, Rattus norvegicus
gtgagctgctggagtaacacttaca

SEQ ID NO: 504121 - DNA, 25 bp, Rattus norvegicus
gtgagctgctggtgtaacacttaca

SEQ ID NO: 504122 - DNA, 25 bp, Rattus norvegicus
gtgagctgcttcacagccctaggaa

SEQ ID NO: 504123 - DNA, 25 bp, Rattus norvegicus
gtgagctgcttcacttaagcctaga

SEQ ID NO: 504124 - DNA, 25 bp, Rattus norvegicus
gtgagctgcttctcagccctaggaa

SEQ ID NO: 504125 - DNA, 25 bp, Rattus norvegicus
gtgagctgcttctcttaagcctaga

SEQ ID NO: 504126 - DNA, 25 bp, Rattus norvegicus
gtgagctggacaaaatacttccatt

SEQ ID NO: 504127 - DNA, 25 bp, Rattus norvegicus
gtgagctggacataatacttccatt

SEQ ID NO: 504128 - DNA, 25 bp, Rattus norvegicus
gtgagctggcctagatgttagaatt

SEQ ID NO: 504129 - DNA, 25 bp, Rattus norvegicus
gtgagctggccttgatgttagaatt

SEQ ID NO: 504130 - DNA, 25 bp, Rattus norvegicus
gtgagctgggaaatccgtccattaa

SEQ ID NO: 504131 - DNA, 25 bp, Rattus norvegicus
gtgagctgggaattccgtccattaa

SEQ ID NO: 504132 - DNA, 25 bp, Rattus norvegicus
gtgagctgggctacagtttttccca

SEQ ID NO: 504133 - DNA, 25 bp, Rattus norvegicus
gtgagctgggcttcagtttttccca

SEQ ID NO: 504134 - DNA, 25 bp, Rattus norvegicus
gtgagctgtaagagaccaattttta

SEQ ID NO: 504135 - DNA, 25 bp, Rattus norvegicus
gtgagctgtaagtgaccaattttta

SEQ ID NO: 504136 - DNA, 25 bp, Rattus norvegicus
gtgagctgtcatcgctatgctggaa

SEQ ID NO: 504137 - DNA, 25 bp, Rattus norvegicus
gtgagctgtcatggctatgctggaa

SEQ ID NO: 504138 - DNA, 25 bp, Rattus norvegicus
gtgagctgtctgagctaagtgtcca

SEQ ID NO: 504139 - DNA, 25 bp, Rattus norvegicus
gtgagctgtctgtgctaagtgtcca

SEQ ID NO: 504140 - DNA, 25 bp, Rattus norvegicus
gtgagctgtcttcggcaatgcatag

SEQ ID NO: 504141 - DNA, 25 bp, Rattus norvegicus
gtgagctgtcttgggcaatgcatag

SEQ ID NO: 504142 - DNA, 25 bp, Rattus norvegicus
gtgagctgtgagcatctgtcatctc

SEQ ID NO: 504143 - DNA, 25 bp, Rattus norvegicus
gtgagctgtgaggatctgtcatctc

SEQ ID NO: 504144 - DNA, 25 bp, Rattus norvegicus
gtgagctgtgatcagagccccattt

SEQ ID NO: 504145 - DNA, 25 bp, Rattus norvegicus
gtgagctgtgatgagagccccattt

SEQ ID NO: 504146 - DNA, 25 bp, Rattus norvegicus
gtgagctgtgcaatctcgcacatat

SEQ ID NO: 504147 - DNA, 25 bp, Rattus norvegicus
gtgagctgtgcattctcgcacatat

SEQ ID NO: 504148 - DNA, 25 bp, Rattus norvegicus
gtgagctgtgtcattgattctacct

SEQ ID NO: 504149 - DNA, 25 bp, Rattus norvegicus
gtgagctgtgtctttgattctacct

SEQ ID NO: 504150 - DNA, 25 bp, Rattus norvegicus
gtgagctgttgcctactgtatcata

SEQ ID NO: 504151 - DNA, 25 bp, Rattus norvegicus
gtgagctgttgcgtactgtatcata

SEQ ID NO: 504152 - DNA, 25 bp, Rattus norvegicus
gtgagcttaagaacccagcggctgc

SEQ ID NO: 504153 - DNA, 25 bp, Rattus norvegicus
gtgagcttaagatcccagcggctgc

SEQ ID NO: 504154 - DNA, 25 bp, Rattus norvegicus
gtgagcttaccgctgttgttgcagc

SEQ ID NO: 504155 - DNA, 25 bp, Rattus norvegicus
gtgagcttaccggtgttgttgcagc

SEQ ID NO: 504156 - DNA, 25 bp, Rattus norvegicus
gtgagcttatgtattcgctctgcta

SEQ ID NO: 504157 - DNA, 25 bp, Rattus norvegicus
gtgagcttatgttttcgctctgcta

SEQ ID NO: 504158 - DNA, 25 bp, Rattus norvegicus
gtgagcttcctcaatttacctgtga

SEQ ID NO: 504159 - DNA, 25 bp, Rattus norvegicus
gtgagcttcctctatttacctgtga

SEQ ID NO: 504160 - DNA, 25 bp, Rattus norvegicus
gtgagcttcctgacgaatgtaaaat

SEQ ID NO: 504161 - DNA, 25 bp, Rattus norvegicus
gtgagcttcctgagcctgagcaaga

SEQ ID NO: 504162 - DNA, 25 bp, Rattus norvegicus
gtgagcttcctgtcgaatgtaaaat

SEQ ID NO: 504163 - DNA, 25 bp, Rattus norvegicus
gtgagcttcctgtgcctgagcaaga

SEQ ID NO: 504164 - DNA, 25 bp, Rattus norvegicus
gtgagcttctctatctactgtagca

SEQ ID NO: 504165 - DNA, 25 bp, Rattus norvegicus
gtgagcttctctttctactgtagca

SEQ ID NO: 504166 - DNA, 25 bp, Rattus norvegicus
gtgagcttgaccactgtagccaggg

SEQ ID NO: 504167 - DNA, 25 bp, Rattus norvegicus
gtgagcttgacctctgtagccaggg

SEQ ID NO: 504168 - DNA, 25 bp, Rattus norvegicus
gtgagcttgctgaagcacagtctct

SEQ ID NO: 504169 - DNA, 25 bp, Rattus norvegicus
gtgagcttgctgaggcctatgcaga

SEQ ID NO: 504170 - DNA, 25 bp, Rattus norvegicus
gtgagcttgctgtagcacagtctct

SEQ ID NO: 504171 - DNA, 25 bp, Rattus norvegicus
gtgagcttgctgtggcctatgcaga

SEQ ID NO: 504172 - DNA, 25 bp, Rattus norvegicus
gtgagcttggagagatctttctgtc

SEQ ID NO: 504173 - DNA, 25 bp, Rattus norvegicus
gtgagcttggagtgatctttctgtc

SEQ ID NO: 504174 - DNA, 25 bp, Rattus norvegicus
gtgagcttggcgacctgaattcagt

SEQ ID NO: 504175 - DNA, 25 bp, Rattus norvegicus
gtgagcttggcgtcctgaattcagt

SEQ ID NO: 504176 - DNA, 25 bp, Rattus norvegicus
gtgagctttacacgctgagacgtta

SEQ ID NO: 504177 - DNA, 25 bp, Rattus norvegicus
gtgagctttacaggctgagacgtta

SEQ ID NO: 504178 - DNA, 25 bp, Rattus norvegicus
gtgagctttcctcttagcactgctt

SEQ ID NO: 504179 - DNA, 25 bp, Rattus norvegicus
gtgagctttcctgttagcactgctt

SEQ ID NO: 504180 - DNA, 25 bp, Rattus norvegicus
gtgagctttgataaattccccaggc

SEQ ID NO: 504181 - DNA, 25 bp, Rattus norvegicus
gtgagctttgattaattccccaggc

SEQ ID NO: 504182 - DNA, 25 bp, Rattus norvegicus
gtgagctttgctatgttctaaccag

SEQ ID NO: 504183 - DNA, 25 bp, Rattus norvegicus
gtgagctttgctcgaaaatcgccat

SEQ ID NO: 504184 - DNA, 25 bp, Rattus norvegicus
gtgagctttgctggaaaatcgccat

SEQ ID NO: 504185 - DNA, 25 bp, Rattus norvegicus
gtgagctttgctttgttctaaccag

SEQ ID NO: 504186 - DNA, 25 bp, Rattus norvegicus
gtgagctttgtcaccggcaaccagt

SEQ ID NO: 504187 - DNA, 25 bp, Rattus norvegicus
gtgagctttgtctccggcaaccagt

SEQ ID NO: 504188 - DNA, 25 bp, Rattus norvegicus
gtgagcttttcaatgtgtttggtct

SEQ ID NO: 504189 - DNA, 25 bp, Rattus norvegicus
gtgagcttttcattgtgtttggtct

SEQ ID NO: 504190 - DNA, 25 bp, Rattus norvegicus
gtgaggaacagcactgtccacctgt

SEQ ID NO: 504191 - DNA, 25 bp, Rattus norvegicus
gtgaggaacagctctgtccacctgt

SEQ ID NO: 504192 - DNA, 25 bp, Rattus norvegicus
gtgaggaaccaacatttaaagctta

SEQ ID NO: 504193 - DNA, 25 bp, Rattus norvegicus
gtgaggaaccaagatttaaagctta

SEQ ID NO: 504194 - DNA, 25 bp, Rattus norvegicus
gtgaggaacggtctcagcttccttc

SEQ ID NO: 504195 - DNA, 25 bp, Rattus norvegicus
gtgaggaacggtgtcagcttccttc

SEQ ID NO: 504196 - DNA, 25 bp, Rattus norvegicus
gtgaggaactgtaccaccgttgtcg

SEQ ID NO: 504197 - DNA, 25 bp, Rattus norvegicus
gtgaggaactgttccaccgttgtcg

SEQ ID NO: 504198 - DNA, 25 bp, Rattus norvegicus
gtgaggaagaacatccagccttaat

SEQ ID NO: 504199 - DNA, 25 bp, Rattus norvegicus
gtgaggaagaacttccagccttaat

SEQ ID NO: 504200 - DNA, 25 bp, Rattus norvegicus
gtgaggaagagtaccgcttgccctt

SEQ ID NO: 504201 - DNA, 25 bp, Rattus norvegicus
gtgaggaagagttccgcttgccctt

SEQ ID NO: 504202 - DNA, 25 bp, Rattus norvegicus
gtgaggaagcccactagtccaggtt

SEQ ID NO: 504203 - DNA, 25 bp, Rattus norvegicus
gtgaggaagccctctagtccaggtt

SEQ ID NO: 504204 - DNA, 25 bp, Rattus norvegicus
gtgaggaagtccaaaccagccagcc

SEQ ID NO: 504205 - DNA, 25 bp, Rattus norvegicus
gtgaggaagtcctaaccagccagcc

SEQ ID NO: 504206 - DNA, 25 bp, Rattus norvegicus
gtgaggaagttcagcctggccgcaa

SEQ ID NO: 504207 - DNA, 25 bp, Rattus norvegicus
gtgaggaagttctgcctggccgcaa

SEQ ID NO: 504208 - DNA, 25 bp, Rattus norvegicus
gtgaggaatcaacggcatttcaatt

SEQ ID NO: 504209 - DNA, 25 bp, Rattus norvegicus
gtgaggaatcaagggcatttcaatt

SEQ ID NO: 504210 - DNA, 25 bp, Rattus norvegicus
gtgaggaatcctaacaccatggtca

SEQ ID NO: 504211 - DNA, 25 bp, Rattus norvegicus
gtgaggaatccttacaccatggtca

SEQ ID NO: 504212 - DNA, 25 bp, Rattus norvegicus
gtgaggacaagtaccagtggctagc

SEQ ID NO: 504213 - DNA, 25 bp, Rattus norvegicus
gtgaggacaagtccacctcccaaaa

SEQ ID NO: 504214 - DNA, 25 bp, Rattus norvegicus
gtgaggacaagtgcacctcccaaaa

SEQ ID NO: 504215 - DNA, 25 bp, Rattus norvegicus
gtgaggacaagttccagtggctagc

SEQ ID NO: 504216 - DNA, 25 bp, Rattus norvegicus
gtgaggacacccaaccaattggcca

SEQ ID NO: 504217 - DNA, 25 bp, Rattus norvegicus
gtgaggacaccctaccaattggcca

SEQ ID NO: 504218 - DNA, 25 bp, Rattus norvegicus
gtgaggacacctagccatcaggaat

SEQ ID NO: 504219 - DNA, 25 bp, Rattus norvegicus
gtgaggacaccttgccatcaggaat

SEQ ID NO: 504220 - DNA, 25 bp, Rattus norvegicus
gtgaggaccacaataatgacatcat

SEQ ID NO: 504221 - DNA, 25 bp, Rattus norvegicus
gtgaggaccacattaatgacatcat

SEQ ID NO: 504222 - DNA, 25 bp, Rattus norvegicus
gtgaggaccagactccaaatcccca

SEQ ID NO: 504223 - DNA, 25 bp, Rattus norvegicus
gtgaggaccagagtccaaatcccca

SEQ ID NO: 504224 - DNA, 25 bp, Rattus norvegicus
gtgaggaccaggcaactcgaactcc

SEQ ID NO: 504225 - DNA, 25 bp, Rattus norvegicus
gtgaggaccagggaactcgaactcc

SEQ ID NO: 504226 - DNA, 25 bp, Rattus norvegicus
gtgaggacctcaccagaaccttaaa

SEQ ID NO: 504227 - DNA, 25 bp, Rattus norvegicus
gtgaggacctcagcagaaccttaaa

SEQ ID NO: 504228 - DNA, 25 bp, Rattus norvegicus
gtgaggacctccatctagaagagca

SEQ ID NO: 504229 - DNA, 25 bp, Rattus norvegicus
gtgaggacctccttctagaagagca

SEQ ID NO: 504230 - DNA, 25 bp, Rattus norvegicus
gtgaggaccttcagggacacagtgt

SEQ ID NO: 504231 - DNA, 25 bp, Rattus norvegicus
gtgaggaccttctgggacacagtgt

SEQ ID NO: 504232 - DNA, 25 bp, Rattus norvegicus
gtgaggaccttgactgttctgtaac

SEQ ID NO: 504233 - DNA, 25 bp, Rattus norvegicus
gtgaggaccttgtctgttctgtaac

SEQ ID NO: 504234 - DNA, 25 bp, Rattus norvegicus
gtgaggactgttagaaggacttctg

SEQ ID NO: 504235 - DNA, 25 bp, Rattus norvegicus
gtgaggactgttagtacctctccag

SEQ ID NO: 504236 - DNA, 25 bp, Rattus norvegicus
gtgaggactgtttgaaggacttctg

SEQ ID NO: 504237 - DNA, 25 bp, Rattus norvegicus
gtgaggactgtttgtacctctccag

SEQ ID NO: 504238 - DNA, 25 bp, Rattus norvegicus
gtgaggagactcctctgttttcgtc

SEQ ID NO: 504239 - DNA, 25 bp, Rattus norvegicus
gtgaggagactcgtctgttttcgtc

SEQ ID NO: 504240 - DNA, 25 bp, Rattus norvegicus
gtgaggagcaccctatttctatgtc

SEQ ID NO: 504241 - DNA, 25 bp, Rattus norvegicus
gtgaggagcaccgtatttctatgtc

SEQ ID NO: 504242 - DNA, 25 bp, Rattus norvegicus
gtgaggagccggagcgctgcgacgc

SEQ ID NO: 504243 - DNA, 25 bp, Rattus norvegicus
gtgaggagccggtgcgctgcgacgc

SEQ ID NO: 504244 - DNA, 25 bp, Rattus norvegicus
gtgaggagctctaagcagcctggaa

SEQ ID NO: 504245 - DNA, 25 bp, Rattus norvegicus
gtgaggagctcttagcagcctggaa

SEQ ID NO: 504246 - DNA, 25 bp, Rattus norvegicus
gtgaggaggacccattctcccagaa

SEQ ID NO: 504247 - DNA, 25 bp, Rattus norvegicus
gtgaggaggaccgattctcccagaa

SEQ ID NO: 504248 - DNA, 25 bp, Rattus norvegicus
gtgaggataattagcccgagggcca

SEQ ID NO: 504249 - DNA, 25 bp, Rattus norvegicus
gtgaggataatttgcccgagggcca

SEQ ID NO: 504250 - DNA, 25 bp, Rattus norvegicus
gtgaggatatacagttcctcccttc

SEQ ID NO: 504251 - DNA, 25 bp, Rattus norvegicus
gtgaggatatactgttcctcccttc

SEQ ID NO: 504252 - DNA, 25 bp, Rattus norvegicus
gtgaggatcccacaatccctgtgaa

SEQ ID NO: 504253 - DNA, 25 bp, Rattus norvegicus
gtgaggatcccagaatccctgtgaa

SEQ ID NO: 504254 - DNA, 25 bp, Rattus norvegicus
gtgaggatgacaacagtactctgtg

SEQ ID NO: 504255 - DNA, 25 bp, Rattus norvegicus
gtgaggatgacatcagtactctgtg

SEQ ID NO: 504256 - DNA, 25 bp, Rattus norvegicus
gtgaggattccgagagtttataacc

SEQ ID NO: 504257 - DNA, 25 bp, Rattus norvegicus
gtgaggattccgtgagtttataacc

SEQ ID NO: 504258 - DNA, 25 bp, Rattus norvegicus
gtgaggattcttctggaaaggaccc

SEQ ID NO: 504259 - DNA, 25 bp, Rattus norvegicus
gtgaggattcttgtggaaaggaccc

SEQ ID NO: 504260 - DNA, 25 bp, Rattus norvegicus
gtgaggatttccatgcaatgagtag

SEQ ID NO: 504261 - DNA, 25 bp, Rattus norvegicus
gtgaggatttccttgcaatgagtag

SEQ ID NO: 504262 - DNA, 25 bp, Rattus norvegicus
gtgaggcaaaacacctcctgtagag

SEQ ID NO: 504263 - DNA, 25 bp, Rattus norvegicus
gtgaggcaaaactcctcctgtagag

SEQ ID NO: 504264 - DNA, 25 bp, Rattus norvegicus
gtgaggcacagcacctatgtaggca

SEQ ID NO: 504265 - DNA, 25 bp, Rattus norvegicus
gtgaggcacagctcctatgtaggca

SEQ ID NO: 504266 - DNA, 25 bp, Rattus norvegicus
gtgaggcacttcatgagaactcatt

SEQ ID NO: 504267 - DNA, 25 bp, Rattus norvegicus
gtgaggcacttcttgagaactcatt

SEQ ID NO: 504268 - DNA, 25 bp, Rattus norvegicus
gtgaggcagagtaccaacagcagca

SEQ ID NO: 504269 - DNA, 25 bp, Rattus norvegicus
gtgaggcagagttccaacagcagca

SEQ ID NO: 504270 - DNA, 25 bp, Rattus norvegicus
gtgaggcaggcacgaacagcttccc

SEQ ID NO: 504271 - DNA, 25 bp, Rattus norvegicus
gtgaggcaggcaggaacagcttccc

SEQ ID NO: 504272 - DNA, 25 bp, Rattus norvegicus
gtgaggcaggcgagagtctccttca

SEQ ID NO: 504273 - DNA, 25 bp, Rattus norvegicus
gtgaggcaggcgtgagtctccttca

SEQ ID NO: 504274 - DNA, 25 bp, Rattus norvegicus
gtgaggcagtgtaaaccggtttgaa

SEQ ID NO: 504275 - DNA, 25 bp, Rattus norvegicus
gtgaggcagtgttaaccggtttgaa

SEQ ID NO: 504276 - DNA, 25 bp, Rattus norvegicus
gtgaggcagttgacatcagatttgg

SEQ ID NO: 504277 - DNA, 25 bp, Rattus norvegicus
gtgaggcagttgtcatcagatttgg

SEQ ID NO: 504278 - DNA, 25 bp, Rattus norvegicus
gtgaggcatgtgatcacatctgtaa

SEQ ID NO: 504279 - DNA, 25 bp, Rattus norvegicus
gtgaggcatgtgttcacatctgtaa

SEQ ID NO: 504280 - DNA, 25 bp, Rattus norvegicus
gtgaggccacacaccgcaagtacta

SEQ ID NO: 504281 - DNA, 25 bp, Rattus norvegicus
gtgaggccacacctagaacattctt

SEQ ID NO: 504282 - DNA, 25 bp, Rattus norvegicus
gtgaggccacacgtagaacattctt

SEQ ID NO: 504283 - DNA, 25 bp, Rattus norvegicus
gtgaggccacactccgcaagtacta

SEQ ID NO: 504284 - DNA, 25 bp, Rattus norvegicus
gtgaggccagttaccatagtctaat

SEQ ID NO: 504285 - DNA, 25 bp, Rattus norvegicus
gtgaggccagtttccatagtctaat

SEQ ID NO: 504286 - DNA, 25 bp, Rattus norvegicus
gtgaggccatggactttcaaacaga

SEQ ID NO: 504287 - DNA, 25 bp, Rattus norvegicus
gtgaggccatggtctttcaaacaga

SEQ ID NO: 504288 - DNA, 25 bp, Rattus norvegicus
gtgaggcccaagaaaccctgtctgt

SEQ ID NO: 504289 - DNA, 25 bp, Rattus norvegicus
gtgaggcccaagtaaccctgtctgt

SEQ ID NO: 504290 - DNA, 25 bp, Rattus norvegicus
gtgaggcccaataactaaactctgt

SEQ ID NO: 504291 - DNA, 25 bp, Rattus norvegicus
gtgaggcccaattactaaactctgt

SEQ ID NO: 504292 - DNA, 25 bp, Rattus norvegicus
gtgaggcccatgataatgtctgtaa

SEQ ID NO: 504293 - DNA, 25 bp, Rattus norvegicus
gtgaggcccatgttaatgtctgtaa

SEQ ID NO: 504294 - DNA, 25 bp, Rattus norvegicus
gtgaggccccagaggtttctgaaaa

SEQ ID NO: 504295 - DNA, 25 bp, Rattus norvegicus
gtgaggccccagtggtttctgaaaa

SEQ ID NO: 504296 - DNA, 25 bp, Rattus norvegicus
gtgaggcccctgaggctgttgaaaa

SEQ ID NO: 504297 - DNA, 25 bp, Rattus norvegicus
gtgaggcccctgtggctgttgaaaa

SEQ ID NO: 504298 - DNA, 25 bp, Rattus norvegicus
gtgaggcccttgaccacagagtcgg

SEQ ID NO: 504299 - DNA, 25 bp, Rattus norvegicus
gtgaggcccttgtccacagagtcgg

SEQ ID NO: 504300 - DNA, 25 bp, Rattus norvegicus
gtgaggccgtaaccatgactccaat

SEQ ID NO: 504301 - DNA, 25 bp, Rattus norvegicus
gtgaggccgtaagcatgactccaat

SEQ ID NO: 504302 - DNA, 25 bp, Rattus norvegicus
gtgaggccgtgtcaaaaacttactt

SEQ ID NO: 504303 - DNA, 25 bp, Rattus norvegicus
gtgaggccgtgtgaaaaacttactt

SEQ ID NO: 504304 - DNA, 25 bp, Rattus norvegicus
gtgaggcctcctcttggtaaccgag

SEQ ID NO: 504305 - DNA, 25 bp, Rattus norvegicus
gtgaggcctcctgttggtaaccgag

SEQ ID NO: 504306 - DNA, 25 bp, Rattus norvegicus
gtgaggcgcagcacccacagcggtc

SEQ ID NO: 504307 - DNA, 25 bp, Rattus norvegicus
gtgaggcgcagctcccacagcggtc

SEQ ID NO: 504308 - DNA, 25 bp, Rattus norvegicus
gtgaggcgctcactcaaccaataag

SEQ ID NO: 504309 - DNA, 25 bp, Rattus norvegicus
gtgaggcgctcagtcaaccaataag

SEQ ID NO: 504310 - DNA, 25 bp, Rattus norvegicus
gtgaggcggcagacgcttacaggaa

SEQ ID NO: 504311 - DNA, 25 bp, Rattus norvegicus
gtgaggcggcagtcgcttacaggaa

SEQ ID NO: 504312 - DNA, 25 bp, Rattus norvegicus
gtgaggcgtctcagactgcttagtc

SEQ ID NO: 504313 - DNA, 25 bp, Rattus norvegicus
gtgaggcgtctctgactgcttagtc

SEQ ID NO: 504314 - DNA, 25 bp, Rattus norvegicus
gtgaggctagccagtaaaaggacag

SEQ ID NO: 504315 - DNA, 25 bp, Rattus norvegicus
gtgaggctagcctgtaaaaggacag

SEQ ID NO: 504316 - DNA, 25 bp, Rattus norvegicus
gtgaggctcaccatacagtagatga

SEQ ID NO: 504317 - DNA, 25 bp, Rattus norvegicus
gtgaggctcaccttacagtagatga

SEQ ID NO: 504318 - DNA, 25 bp, Rattus norvegicus
gtgaggctcgctagggaattgttcc

SEQ ID NO: 504319 - DNA, 25 bp, Rattus norvegicus
gtgaggctcgcttgggaattgttcc

SEQ ID NO: 504320 - DNA, 25 bp, Rattus norvegicus
gtgaggctgagaaccgcttgctgat

SEQ ID NO: 504321 - DNA, 25 bp, Rattus norvegicus
gtgaggctgagatccgcttgctgat

SEQ ID NO: 504322 - DNA, 25 bp, Rattus norvegicus
gtgaggctgcccaaaaagccgtcag

SEQ ID NO: 504323 - DNA, 25 bp, Rattus norvegicus
gtgaggctgccctaaaagccgtcag

SEQ ID NO: 504324 - DNA, 25 bp, Rattus norvegicus
gtgaggctgttgaccaagttgacaa

SEQ ID NO: 504325 - DNA, 25 bp, Rattus norvegicus
gtgaggctgttgtccaagttgacaa

SEQ ID NO: 504326 - DNA, 25 bp, Rattus norvegicus
gtgaggcttagcaagatctcgctgt

SEQ ID NO: 504327 - DNA, 25 bp, Rattus norvegicus
gtgaggcttagctagatctcgctgt

SEQ ID NO: 504328 - DNA, 25 bp, Rattus norvegicus
gtgaggcttcgtcgcgtctttccag

SEQ ID NO: 504329 - DNA, 25 bp, Rattus norvegicus
gtgaggcttcgtggcgtctttccag

SEQ ID NO: 504330 - DNA, 25 bp, Rattus norvegicus
gtgaggctttagaccccaaatacat

SEQ ID NO: 504331 - DNA, 25 bp, Rattus norvegicus
gtgaggctttagtccccaaatacat

SEQ ID NO: 504332 - DNA, 25 bp, Rattus norvegicus
gtgagggaaataaatgtctccgcaa

SEQ ID NO: 504333 - DNA, 25 bp, Rattus norvegicus
gtgagggaaatatatgtctccgcaa

SEQ ID NO: 504334 - DNA, 25 bp, Rattus norvegicus
gtgagggaacctctattcttggata

SEQ ID NO: 504335 - DNA, 25 bp, Rattus norvegicus
gtgagggaacctgtattcttggata

SEQ ID NO: 504336 - DNA, 25 bp, Rattus norvegicus
gtgagggaaggcacctgccacatat

SEQ ID NO: 504337 - DNA, 25 bp, Rattus norvegicus
gtgagggaaggctcctgccacatat

SEQ ID NO: 504338 - DNA, 25 bp, Rattus norvegicus
gtgagggacactcccatttgtgccc

SEQ ID NO: 504339 - DNA, 25 bp, Rattus norvegicus
gtgagggacactgccatttgtgccc

SEQ ID NO: 504340 - DNA, 25 bp, Rattus norvegicus
gtgagggactacagcttcagcgatg

SEQ ID NO: 504341 - DNA, 25 bp, Rattus norvegicus
gtgagggactactgcttcagcgatg

SEQ ID NO: 504342 - DNA, 25 bp, Rattus norvegicus
gtgagggagactacaggctccagaa

SEQ ID NO: 504343 - DNA, 25 bp, Rattus norvegicus
gtgagggagacttcaggctccagaa

SEQ ID NO: 504344 - DNA, 25 bp, Rattus norvegicus
gtgagggattctagatgctggactt

SEQ ID NO: 504345 - DNA, 25 bp, Rattus norvegicus
gtgagggattcttgatgctggactt

SEQ ID NO: 504346 - DNA, 25 bp, Rattus norvegicus
gtgagggattttcattgctcttgaa

SEQ ID NO: 504347 - DNA, 25 bp, Rattus norvegicus
gtgagggattttgattgctcttgaa

SEQ ID NO: 504348 - DNA, 25 bp, Rattus norvegicus
gtgagggcacatcacaaatctgtgt

SEQ ID NO: 504349 - DNA, 25 bp, Rattus norvegicus
gtgagggcacatgacaaatctgtgt

SEQ ID NO: 504350 - DNA, 25 bp, Rattus norvegicus
gtgagggcataactcattcccgagt

SEQ ID NO: 504351 - DNA, 25 bp, Rattus norvegicus
gtgagggcataagtcattcccgagt

SEQ ID NO: 504352 - DNA, 25 bp, Rattus norvegicus
gtgagggcatgtattcttgatttat

SEQ ID NO: 504353 - DNA, 25 bp, Rattus norvegicus
gtgagggcatgttttcttgatttat

SEQ ID NO: 504354 - DNA, 25 bp, Rattus norvegicus
gtgagggcccttacctatggagaaa

SEQ ID NO: 504355 - DNA, 25 bp, Rattus norvegicus
gtgagggccctttcctatggagaaa

SEQ ID NO: 504356 - DNA, 25 bp, Rattus norvegicus
gtgagggcctaaattgtacagaaat

SEQ ID NO: 504357 - DNA, 25 bp, Rattus norvegicus
gtgagggcctaatttgtacagaaat

SEQ ID NO: 504358 - DNA, 25 bp, Rattus norvegicus
gtgagggcgtttcccaccaagttta

SEQ ID NO: 504359 - DNA, 25 bp, Rattus norvegicus
gtgagggcgtttgccaccaagttta

SEQ ID NO: 504360 - DNA, 25 bp, Rattus norvegicus
gtgagggggacaagctgccttctct

SEQ ID NO: 504361 - DNA, 25 bp, Rattus norvegicus
gtgagggggacatgctgccttctct

SEQ ID NO: 504362 - DNA, 25 bp, Rattus norvegicus
gtgagggtagttctcagccacacac

SEQ ID NO: 504363 - DNA, 25 bp, Rattus norvegicus
gtgagggtagttgtcagccacacac

SEQ ID NO: 504364 - DNA, 25 bp, Rattus norvegicus
gtgagggtcactattctaatacttt

SEQ ID NO: 504365 - DNA, 25 bp, Rattus norvegicus
gtgagggtcacttttctaatacttt

SEQ ID NO: 504366 - DNA, 25 bp, Rattus norvegicus
gtgagggtcataagggctccagttt

SEQ ID NO: 504367 - DNA, 25 bp, Rattus norvegicus
gtgagggtcatatgggctccagttt

SEQ ID NO: 504368 - DNA, 25 bp, Rattus norvegicus
gtgagggtctcacgaccggtttcca

SEQ ID NO: 504369 - DNA, 25 bp, Rattus norvegicus
gtgagggtctcaggaccggtttcca

SEQ ID NO: 504370 - DNA, 25 bp, Rattus norvegicus
gtgagggtgaaccacatccttgagc

SEQ ID NO: 504371 - DNA, 25 bp, Rattus norvegicus
gtgagggtgaacgacatccttgagc

SEQ ID NO: 504372 - DNA, 25 bp, Rattus norvegicus
gtgagggtgagtccccaagccacat

SEQ ID NO: 504373 - DNA, 25 bp, Rattus norvegicus
gtgagggtgagtgcccaagccacat

SEQ ID NO: 504374 - DNA, 25 bp, Rattus norvegicus
gtgagggttgatcgctatttctgta

SEQ ID NO: 504375 - DNA, 25 bp, Rattus norvegicus
gtgagggttgatggctatttctgta

SEQ ID NO: 504376 - DNA, 25 bp, Rattus norvegicus
gtgaggtaaattctctgtttgtctt

SEQ ID NO: 504377 - DNA, 25 bp, Rattus norvegicus
gtgaggtaaattgtctgtttgtctt

SEQ ID NO: 504378 - DNA, 25 bp, Rattus norvegicus
gtgaggtaaccaagacctttttcct

SEQ ID NO: 504379 - DNA, 25 bp, Rattus norvegicus
gtgaggtaaccatgacctttttcct

SEQ ID NO: 504380 - DNA, 25 bp, Rattus norvegicus
gtgaggtaacttcaccccatagcat

SEQ ID NO: 504381 - DNA, 25 bp, Rattus norvegicus
gtgaggtaacttgaccccatagcat

SEQ ID NO: 504382 - DNA, 25 bp, Rattus norvegicus
gtgaggtaatgcactttctacttta

SEQ ID NO: 504383 - DNA, 25 bp, Rattus norvegicus
gtgaggtaatgctctttctacttta

SEQ ID NO: 504384 - DNA, 25 bp, Rattus norvegicus
gtgaggtacgagagacccttgccgc

SEQ ID NO: 504385 - DNA, 25 bp, Rattus norvegicus
gtgaggtacgagtgacccttgccgc

SEQ ID NO: 504386 - DNA, 25 bp, Rattus norvegicus
gtgaggtactgccagccacagcaaa

SEQ ID NO: 504387 - DNA, 25 bp, Rattus norvegicus
gtgaggtactgcgagccacagcaaa

SEQ ID NO: 504388 - DNA, 25 bp, Rattus norvegicus
gtgaggtagaaaaccctcaacccat

SEQ ID NO: 504389 - DNA, 25 bp, Rattus norvegicus
gtgaggtagaaatccctcaacccat

SEQ ID NO: 504390 - DNA, 25 bp, Rattus norvegicus
gtgaggtagtctcccatagatcaat

SEQ ID NO: 504391 - DNA, 25 bp, Rattus norvegicus
gtgaggtagtctgccatagatcaat

SEQ ID NO: 504392 - DNA, 25 bp, Rattus norvegicus
gtgaggtattgaaccctagaactaa

SEQ ID NO: 504393 - DNA, 25 bp, Rattus norvegicus
gtgaggtattgatccctagaactaa

SEQ ID NO: 504394 - DNA, 25 bp, Rattus norvegicus
gtgaggtcaatcaccgtggaacatt

SEQ ID NO: 504395 - DNA, 25 bp, Rattus norvegicus
gtgaggtcaatctccgtggaacatt

SEQ ID NO: 504396 - DNA, 25 bp, Rattus norvegicus
gtgaggtcacgtatttatctttgga

SEQ ID NO: 504397 - DNA, 25 bp, Rattus norvegicus
gtgaggtcacgtttttatctttgga

SEQ ID NO: 504398 - DNA, 25 bp, Rattus norvegicus
gtgaggtcagagcagttccacttcc

SEQ ID NO: 504399 - DNA, 25 bp, Rattus norvegicus
gtgaggtcagaggagttccacttcc

SEQ ID NO: 504400 - DNA, 25 bp, Rattus norvegicus
gtgaggtccacaatggacaccgtga

SEQ ID NO: 504401 - DNA, 25 bp, Rattus norvegicus
gtgaggtccacattggacaccgtga

SEQ ID NO: 504402 - DNA, 25 bp, Rattus norvegicus
gtgaggtcccaccaccatgtcacat

SEQ ID NO: 504403 - DNA, 25 bp, Rattus norvegicus
gtgaggtcccacgaccatgtcacat

SEQ ID NO: 504404 - DNA, 25 bp, Rattus norvegicus
gtgaggtcctgcatcaaacagagaa

SEQ ID NO: 504405 - DNA, 25 bp, Rattus norvegicus
gtgaggtcctgcttcaaacagagaa

SEQ ID NO: 504406 - DNA, 25 bp, Rattus norvegicus
gtgaggtcctgtctctaaacaactg

SEQ ID NO: 504407 - DNA, 25 bp, Rattus norvegicus
gtgaggtcctgtgtctaaacaactg

SEQ ID NO: 504408 - DNA, 25 bp, Rattus norvegicus
gtgaggtcgcctctaccttataaaa

SEQ ID NO: 504409 - DNA, 25 bp, Rattus norvegicus
gtgaggtcgcctgtaccttataaaa

SEQ ID NO: 504410 - DNA, 25 bp, Rattus norvegicus
gtgaggtctcaactcagtcaatccc

SEQ ID NO: 504411 - DNA, 25 bp, Rattus norvegicus
gtgaggtctcaagtcagtcaatccc

SEQ ID NO: 504412 - DNA, 25 bp, Rattus norvegicus
gtgaggtctcctagaagtgtcgtga

SEQ ID NO: 504413 - DNA, 25 bp, Rattus norvegicus
gtgaggtctccttgaagtgtcgtga

SEQ ID NO: 504414 - DNA, 25 bp, Rattus norvegicus
gtgaggtctgagattttgccttttt

SEQ ID NO: 504415 - DNA, 25 bp, Rattus norvegicus
gtgaggtctgagtttttgccttttt

SEQ ID NO: 504416 - DNA, 25 bp, Rattus norvegicus
gtgaggtgaacaacaatcccaattt

SEQ ID NO: 504417 - DNA, 25 bp, Rattus norvegicus
gtgaggtgaacatcaatcccaattt

SEQ ID NO: 504418 - DNA, 25 bp, Rattus norvegicus
gtgaggtgagcccagcacatcagta

SEQ ID NO: 504419 - DNA, 25 bp, Rattus norvegicus
gtgaggtgagccgagcacatcagta

SEQ ID NO: 504420 - DNA, 25 bp, Rattus norvegicus
gtgaggtgagtcattccgaggacct

SEQ ID NO: 504421 - DNA, 25 bp, Rattus norvegicus
gtgaggtgagtctttccgaggacct

SEQ ID NO: 504422 - DNA, 25 bp, Rattus norvegicus
gtgaggtgcattcagcaccctgatc

SEQ ID NO: 504423 - DNA, 25 bp, Rattus norvegicus
gtgaggtgcattgagcaccctgatc

SEQ ID NO: 504424 - DNA, 25 bp, Rattus norvegicus
gtgaggtgctgactttgaatcccca

SEQ ID NO: 504425 - DNA, 25 bp, Rattus norvegicus
gtgaggtgctgagtttgaatcccca

SEQ ID NO: 504426 - DNA, 25 bp, Rattus norvegicus
gtgaggtgcttcattcaccaggaat

SEQ ID NO: 504427 - DNA, 25 bp, Rattus norvegicus
gtgaggtgcttctttcaccaggaat

SEQ ID NO: 504428 - DNA, 25 bp, Rattus norvegicus
gtgaggtgggcgcagccctgctttg

SEQ ID NO: 504429 - DNA, 25 bp, Rattus norvegicus
gtgaggtgggcggagccctgctttg

SEQ ID NO: 504430 - DNA, 25 bp, Rattus norvegicus
gtgaggtgtcagcagttcactcttt

SEQ ID NO: 504431 - DNA, 25 bp, Rattus norvegicus
gtgaggtgtcaggagttcactcttt

SEQ ID NO: 504432 - DNA, 25 bp, Rattus norvegicus
gtgaggttcaccaagaacaggactc

SEQ ID NO: 504433 - DNA, 25 bp, Rattus norvegicus
gtgaggttcacctagaacaggactc

SEQ ID NO: 504434 - DNA, 25 bp, Rattus norvegicus
gtgaggttcctgagttagctgaccc

SEQ ID NO: 504435 - DNA, 25 bp, Rattus norvegicus
gtgaggttcctgtgttagctgaccc

SEQ ID NO: 504436 - DNA, 25 bp, Rattus norvegicus
gtgaggttctagagctcggcctaaa

SEQ ID NO: 504437 - DNA, 25 bp, Rattus norvegicus
gtgaggttctagtgctcggcctaaa

SEQ ID NO: 504438 - DNA, 25 bp, Rattus norvegicus
gtgaggttgaatccatagagctgcc

SEQ ID NO: 504439 - DNA, 25 bp, Rattus norvegicus
gtgaggttgaatgcatagagctgcc

SEQ ID NO: 504440 - DNA, 25 bp, Rattus norvegicus
gtgaggtttaacaactttctggtgt

SEQ ID NO: 504441 - DNA, 25 bp, Rattus norvegicus
gtgaggtttaactactttctggtgt

SEQ ID NO: 504442 - DNA, 25 bp, Rattus norvegicus
gtgaggtttcctactacaatgtgac

SEQ ID NO: 504443 - DNA, 25 bp, Rattus norvegicus
gtgaggtttccttctacaatgtgac

SEQ ID NO: 504444 - DNA, 25 bp, Rattus norvegicus
gtgaggtttcttatgtgtttgtatg

SEQ ID NO: 504445 - DNA, 25 bp, Rattus norvegicus
gtgaggtttcttttgtgtttgtatg

SEQ ID NO: 504446 - DNA, 25 bp, Rattus norvegicus
gtgagtaacattaaccttcgcaaga

SEQ ID NO: 504447 - DNA, 25 bp, Rattus norvegicus
gtgagtaacatttaccttcgcaaga

SEQ ID NO: 504448 - DNA, 25 bp, Rattus norvegicus
gtgagtaagaagatctctccctcct

SEQ ID NO: 504449 - DNA, 25 bp, Rattus norvegicus
gtgagtaagaagttctctccctcct

SEQ ID NO: 504450 - DNA, 25 bp, Rattus norvegicus
gtgagtaagtgtattcctccatctt

SEQ ID NO: 504451 - DNA, 25 bp, Rattus norvegicus
gtgagtaagtgttttcctccatctt

SEQ ID NO: 504452 - DNA, 25 bp, Rattus norvegicus
gtgagtacacacagctggtgacagc

SEQ ID NO: 504453 - DNA, 25 bp, Rattus norvegicus
gtgagtacacactgctggtgacagc

SEQ ID NO: 504454 - DNA, 25 bp, Rattus norvegicus
gtgagtacagcactgtcaccagcac

SEQ ID NO: 504455 - DNA, 25 bp, Rattus norvegicus
gtgagtacagcagtgtcaccagcac

SEQ ID NO: 504456 - DNA, 25 bp, Rattus norvegicus
gtgagtacccaacgccagaagctga

SEQ ID NO: 504457 - DNA, 25 bp, Rattus norvegicus
gtgagtacccaaggccagaagctga

SEQ ID NO: 504458 - DNA, 25 bp, Rattus norvegicus
gtgagtacccagacagagatgccaa

SEQ ID NO: 504459 - DNA, 25 bp, Rattus norvegicus
gtgagtacccagtcagagatgccaa

SEQ ID NO: 504460 - DNA, 25 bp, Rattus norvegicus
gtgagtacgggacctggacctccta

SEQ ID NO: 504461 - DNA, 25 bp, Rattus norvegicus
gtgagtacgggagctggacctccta

SEQ ID NO: 504462 - DNA, 25 bp, Rattus norvegicus
gtgagtactacgctcctggaggcaa

SEQ ID NO: 504463 - DNA, 25 bp, Rattus norvegicus
gtgagtactacggtcctggaggcaa

SEQ ID NO: 504464 - DNA, 25 bp, Rattus norvegicus
gtgagtactgcactcgaagtcctcg

SEQ ID NO: 504465 - DNA, 25 bp, Rattus norvegicus
gtgagtactgcagtcgaagtcctcg

SEQ ID NO: 504466 - DNA, 25 bp, Rattus norvegicus
gtgagtactggcatgtctgtgatga

SEQ ID NO: 504467 - DNA, 25 bp, Rattus norvegicus
gtgagtactggcttgtctgtgatga

SEQ ID NO: 504468 - DNA, 25 bp, Rattus norvegicus
gtgagtactttccagatgttagccg

SEQ ID NO: 504469 - DNA, 25 bp, Rattus norvegicus
gtgagtactttcgagatgttagccg

SEQ ID NO: 504470 - DNA, 25 bp, Rattus norvegicus
gtgagtagcaccatccttttaagaa

SEQ ID NO: 504471 - DNA, 25 bp, Rattus norvegicus
gtgagtagcaccttccttttaagaa

SEQ ID NO: 504472 - DNA, 25 bp, Rattus norvegicus
gtgagtaggtccattgcagccatca

SEQ ID NO: 504473 - DNA, 25 bp, Rattus norvegicus
gtgagtaggtcctttgcagccatca

SEQ ID NO: 504474 - DNA, 25 bp, Rattus norvegicus
gtgagtatctcgatcttgaagacca

SEQ ID NO: 504475 - DNA, 25 bp, Rattus norvegicus
gtgagtatctcgttcttgaagacca

SEQ ID NO: 504476 - DNA, 25 bp, Rattus norvegicus
gtgagtatgttgacagctgctccct

SEQ ID NO: 504477 - DNA, 25 bp, Rattus norvegicus
gtgagtatgttgtcagctgctccct

SEQ ID NO: 504478 - DNA, 25 bp, Rattus norvegicus
gtgagtcaacacacagtgctgctgt

SEQ ID NO: 504479 - DNA, 25 bp, Rattus norvegicus
gtgagtcaacactcagtgctgctgt

SEQ ID NO: 504480 - DNA, 25 bp, Rattus norvegicus
gtgagtcaagacaacttctccctgt

SEQ ID NO: 504481 - DNA, 25 bp, Rattus norvegicus
gtgagtcaagactacttctccctgt

SEQ ID NO: 504482 - DNA, 25 bp, Rattus norvegicus
gtgagtcaagcccatgagatgcccc

SEQ ID NO: 504483 - DNA, 25 bp, Rattus norvegicus
gtgagtcaagccgatgagatgcccc

SEQ ID NO: 504484 - DNA, 25 bp, Rattus norvegicus
gtgagtcacatcattgaggatcatg

SEQ ID NO: 504485 - DNA, 25 bp, Rattus norvegicus
gtgagtcacatctttgaggatcatg

SEQ ID NO: 504486 - DNA, 25 bp, Rattus norvegicus
gtgagtcacccaattatatcttaag

SEQ ID NO: 504487 - DNA, 25 bp, Rattus norvegicus
gtgagtcacccatttatatcttaag

SEQ ID NO: 504488 - DNA, 25 bp, Rattus norvegicus
gtgagtcacctaccaaactcaggtc

SEQ ID NO: 504489 - DNA, 25 bp, Rattus norvegicus
gtgagtcacctagcaaactcaggtc

SEQ ID NO: 504490 - DNA, 25 bp, Rattus norvegicus
gtgagtcacgacagcatcagatgca

SEQ ID NO: 504491 - DNA, 25 bp, Rattus norvegicus
gtgagtcacgactgcatcagatgca

SEQ ID NO: 504492 - DNA, 25 bp, Rattus norvegicus
gtgagtcacgagagcacaggcaaag

SEQ ID NO: 504493 - DNA, 25 bp, Rattus norvegicus
gtgagtcacgagtgcacaggcaaag

SEQ ID NO: 504494 - DNA, 25 bp, Rattus norvegicus
gtgagtcactacacttggttctcta

SEQ ID NO: 504495 - DNA, 25 bp, Rattus norvegicus
gtgagtcactactcttggttctcta

SEQ ID NO: 504496 - DNA, 25 bp, Rattus norvegicus
gtgagtcactctctgttcggtgctc

SEQ ID NO: 504497 - DNA, 25 bp, Rattus norvegicus
gtgagtcactctgtgttcggtgctc

SEQ ID NO: 504498 - DNA, 25 bp, Rattus norvegicus
gtgagtcagacgacccatcatggaa

SEQ ID NO: 504499 - DNA, 25 bp, Rattus norvegicus
gtgagtcagacgtcccatcatggaa

SEQ ID NO: 504500 - DNA, 25 bp, Rattus norvegicus
gtgagtcagagtattttcccagagc

SEQ ID NO: 504501 - DNA, 25 bp, Rattus norvegicus
gtgagtcagagttttttcccagagc

SEQ ID NO: 504502 - DNA, 25 bp, Rattus norvegicus
gtgagtcagatcactacttctacta

SEQ ID NO: 504503 - DNA, 25 bp, Rattus norvegicus
gtgagtcagatctctacttctacta

SEQ ID NO: 504504 - DNA, 25 bp, Rattus norvegicus
gtgagtcagggaattcccgaacttg

SEQ ID NO: 504505 - DNA, 25 bp, Rattus norvegicus
gtgagtcagggatttcccgaacttg

SEQ ID NO: 504506 - DNA, 25 bp, Rattus norvegicus
gtgagtcaggtgaccagatggtccc

SEQ ID NO: 504507 - DNA, 25 bp, Rattus norvegicus
gtgagtcaggtgtccagatggtccc

SEQ ID NO: 504508 - DNA, 25 bp, Rattus norvegicus
gtgagtcatagcacgacacctccag

SEQ ID NO: 504509 - DNA, 25 bp, Rattus norvegicus
gtgagtcatagctcgacacctccag

SEQ ID NO: 504510 - DNA, 25 bp, Rattus norvegicus
gtgagtcatagtcagctccgcatca

SEQ ID NO: 504511 - DNA, 25 bp, Rattus norvegicus
gtgagtcatagtgagctccgcatca

SEQ ID NO: 504512 - DNA, 25 bp, Rattus norvegicus
gtgagtcatgcgcattatccactcg

SEQ ID NO: 504513 - DNA, 25 bp, Rattus norvegicus
gtgagtcatgcggattatccactcg

SEQ ID NO: 504514 - DNA, 25 bp, Rattus norvegicus
gtgagtcattatctagccgtcgtac

SEQ ID NO: 504515 - DNA, 25 bp, Rattus norvegicus
gtgagtcattatgtagccgtcgtac

SEQ ID NO: 504516 - DNA, 25 bp, Rattus norvegicus
gtgagtccaacactcatgaccggaa

SEQ ID NO: 504517 - DNA, 25 bp, Rattus norvegicus
gtgagtccaacagtcatgaccggaa

SEQ ID NO: 504518 - DNA, 25 bp, Rattus norvegicus
gtgagtccacaaagtttcctgtttg

SEQ ID NO: 504519 - DNA, 25 bp, Rattus norvegicus
gtgagtccacaatgtttcctgtttg

SEQ ID NO: 504520 - DNA, 25 bp, Rattus norvegicus
gtgagtccagatccagtcaagatga

SEQ ID NO: 504521 - DNA, 25 bp, Rattus norvegicus
gtgagtccagatgcagtcaagatga

SEQ ID NO: 504522 - DNA, 25 bp, Rattus norvegicus
gtgagtccagcacttcaatgtcatt

SEQ ID NO: 504523 - DNA, 25 bp, Rattus norvegicus
gtgagtccagcagttcaatgtcatt

SEQ ID NO: 504524 - DNA, 25 bp, Rattus norvegicus
gtgagtccataaacagacgcctgac

SEQ ID NO: 504525 - DNA, 25 bp, Rattus norvegicus
gtgagtccataatcagacgcctgac

SEQ ID NO: 504526 - DNA, 25 bp, Rattus norvegicus
gtgagtccatgtcgccgatcgaagc

SEQ ID NO: 504527 - DNA, 25 bp, Rattus norvegicus
gtgagtccatgtggccgatcgaagc

SEQ ID NO: 504528 - DNA, 25 bp, Rattus norvegicus
gtgagtcccatgaaaaacttgtaca

SEQ ID NO: 504529 - DNA, 25 bp, Rattus norvegicus
gtgagtcccatgtaaaacttgtaca

SEQ ID NO: 504530 - DNA, 25 bp, Rattus norvegicus
gtgagtcccggcacctggactgaca

SEQ ID NO: 504531 - DNA, 25 bp, Rattus norvegicus
gtgagtcccggctcctggactgaca

SEQ ID NO: 504532 - DNA, 25 bp, Rattus norvegicus
gtgagtcctcacagcagggcacact

SEQ ID NO: 504533 - DNA, 25 bp, Rattus norvegicus
gtgagtcctcactgcagggcacact

SEQ ID NO: 504534 - DNA, 25 bp, Rattus norvegicus
gtgagtcctcgcagggaagccttgc

SEQ ID NO: 504535 - DNA, 25 bp, Rattus norvegicus
gtgagtcctcgctgggaagccttgc

SEQ ID NO: 504536 - DNA, 25 bp, Rattus norvegicus
gtgagtcggaagcagtccaacaaat

SEQ ID NO: 504537 - DNA, 25 bp, Rattus norvegicus
gtgagtcggaaggagtccaacaaat

SEQ ID NO: 504538 - DNA, 25 bp, Rattus norvegicus
gtgagtctaagccacaccacagaga

SEQ ID NO: 504539 - DNA, 25 bp, Rattus norvegicus
gtgagtctaagcgacaccacagaga

SEQ ID NO: 504540 - DNA, 25 bp, Rattus norvegicus
gtgagtctaatccccgttggtctgt

SEQ ID NO: 504541 - DNA, 25 bp, Rattus norvegicus
gtgagtctaatcgccgttggtctgt

SEQ ID NO: 504542 - DNA, 25 bp, Rattus norvegicus
gtgagtctactaagggtctccattc

SEQ ID NO: 504543 - DNA, 25 bp, Rattus norvegicus
gtgagtctactatgggtctccattc

SEQ ID NO: 504544 - DNA, 25 bp, Rattus norvegicus
gtgagtctactcattcaaagtctac

SEQ ID NO: 504545 - DNA, 25 bp, Rattus norvegicus
gtgagtctactctttcaaagtctac

SEQ ID NO: 504546 - DNA, 25 bp, Rattus norvegicus
gtgagtctcagcaccatagtgagtt

SEQ ID NO: 504547 - DNA, 25 bp, Rattus norvegicus
gtgagtctcagctccatagtgagtt

SEQ ID NO: 504548 - DNA, 25 bp, Rattus norvegicus
gtgagtctctcaaaccactttagat

SEQ ID NO: 504549 - DNA, 25 bp, Rattus norvegicus
gtgagtctctcataccactttagat

SEQ ID NO: 504550 - DNA, 25 bp, Rattus norvegicus
gtgagtctcttaaatggtgctgttt

SEQ ID NO: 504551 - DNA, 25 bp, Rattus norvegicus
gtgagtctcttatatggtgctgttt

SEQ ID NO: 504552 - DNA, 25 bp, Rattus norvegicus
gtgagtctgaacacagctgccttac

SEQ ID NO: 504553 - DNA, 25 bp, Rattus norvegicus
gtgagtctgaacagtttccctaact

SEQ ID NO: 504554 - DNA, 25 bp, Rattus norvegicus
gtgagtctgaactcagctgccttac

SEQ ID NO: 504555 - DNA, 25 bp, Rattus norvegicus
gtgagtctgaactgtttccctaact

SEQ ID NO: 504556 - DNA, 25 bp, Rattus norvegicus
gtgagtctgacaaattccactgtga

SEQ ID NO: 504557 - DNA, 25 bp, Rattus norvegicus
gtgagtctgacatattccactgtga

SEQ ID NO: 504558 - DNA, 25 bp, Rattus norvegicus
gtgagtctgactatttccatcatgt

SEQ ID NO: 504559 - DNA, 25 bp, Rattus norvegicus
gtgagtctgactttttccatcatgt

SEQ ID NO: 504560 - DNA, 25 bp, Rattus norvegicus
gtgagtctgatacacctgccgagcc

SEQ ID NO: 504561 - DNA, 25 bp, Rattus norvegicus
gtgagtctgatagacctgccgagcc

SEQ ID NO: 504562 - DNA, 25 bp, Rattus norvegicus
gtgagtctgcacaccaagctgagga

SEQ ID NO: 504563 - DNA, 25 bp, Rattus norvegicus
gtgagtctgcacctagctctaacag

SEQ ID NO: 504564 - DNA, 25 bp, Rattus norvegicus
gtgagtctgcacgtagctctaacag

SEQ ID NO: 504565 - DNA, 25 bp, Rattus norvegicus
gtgagtctgcactccaagctgagga

SEQ ID NO: 504566 - DNA, 25 bp, Rattus norvegicus
gtgagtctggctactgcataaactt

SEQ ID NO: 504567 - DNA, 25 bp, Rattus norvegicus
gtgagtctggctcaagaccgacatt

SEQ ID NO: 504568 - DNA, 25 bp, Rattus norvegicus
gtgagtctggctgaagaccgacatt

SEQ ID NO: 504569 - DNA, 25 bp, Rattus norvegicus
gtgagtctggcttctgcataaactt

SEQ ID NO: 504570 - DNA, 25 bp, Rattus norvegicus
gtgagtctgggcagacttctcatct

SEQ ID NO: 504571 - DNA, 25 bp, Rattus norvegicus
gtgagtctgggctgacttctcatct

SEQ ID NO: 504572 - DNA, 25 bp, Rattus norvegicus
gtgagtctgtccctgtgtgttgcct

SEQ ID NO: 504573 - DNA, 25 bp, Rattus norvegicus
gtgagtctgtccgtgtgtgttgcct

SEQ ID NO: 504574 - DNA, 25 bp, Rattus norvegicus
gtgagtcttagtacaatcagttcta

SEQ ID NO: 504575 - DNA, 25 bp, Rattus norvegicus
gtgagtcttagttcaatcagttcta

SEQ ID NO: 504576 - DNA, 25 bp, Rattus norvegicus
gtgagtctttatagcaaccctgtcc

SEQ ID NO: 504577 - DNA, 25 bp, Rattus norvegicus
gtgagtctttattgcaaccctgtcc

SEQ ID NO: 504578 - DNA, 25 bp, Rattus norvegicus
gtgagtctttcccaggacctgtgcc

SEQ ID NO: 504579 - DNA, 25 bp, Rattus norvegicus
gtgagtctttccgaggacctgtgcc

SEQ ID NO: 504580 - DNA, 25 bp, Rattus norvegicus
gtgagtgaattcagttccctaccaa

SEQ ID NO: 504581 - DNA, 25 bp, Rattus norvegicus
gtgagtgaattctgttccctaccaa

SEQ ID NO: 504582 - DNA, 25 bp, Rattus norvegicus
gtgagtgacacgaccttggatgcca

SEQ ID NO: 504583 - DNA, 25 bp, Rattus norvegicus
gtgagtgacacgtccttggatgcca

SEQ ID NO: 504584 - DNA, 25 bp, Rattus norvegicus
gtgagtgacactccacacttcttac

SEQ ID NO: 504585 - DNA, 25 bp, Rattus norvegicus
gtgagtgacactcccgtgctttacc

SEQ ID NO: 504586 - DNA, 25 bp, Rattus norvegicus
gtgagtgacactcccttgcaaatgt

SEQ ID NO: 504587 - DNA, 25 bp, Rattus norvegicus
gtgagtgacactgcacacttcttac

SEQ ID NO: 504588 - DNA, 25 bp, Rattus norvegicus
gtgagtgacactgccgtgctttacc

SEQ ID NO: 504589 - DNA, 25 bp, Rattus norvegicus
gtgagtgacactgccttgcaaatgt

SEQ ID NO: 504590 - DNA, 25 bp, Rattus norvegicus
gtgagtgacagcaggcacctccaat

SEQ ID NO: 504591 - DNA, 25 bp, Rattus norvegicus
gtgagtgacagctggcacctccaat

SEQ ID NO: 504592 - DNA, 25 bp, Rattus norvegicus
gtgagtgacccacggctttctgttc

SEQ ID NO: 504593 - DNA, 25 bp, Rattus norvegicus
gtgagtgacccagggctttctgttc

SEQ ID NO: 504594 - DNA, 25 bp, Rattus norvegicus
gtgagtgagtttccctcattctggc

SEQ ID NO: 504595 - DNA, 25 bp, Rattus norvegicus
gtgagtgagtttgcctcattctggc

SEQ ID NO: 504596 - DNA, 25 bp, Rattus norvegicus
gtgagtgatccaagtagtctattat

SEQ ID NO: 504597 - DNA, 25 bp, Rattus norvegicus
gtgagtgatccatgtagtctattat

SEQ ID NO: 504598 - DNA, 25 bp, Rattus norvegicus
gtgagtgattcaactgcccaacagc

SEQ ID NO: 504599 - DNA, 25 bp, Rattus norvegicus
gtgagtgattcatctgcccaacagc

SEQ ID NO: 504600 - DNA, 25 bp, Rattus norvegicus
gtgagtgcaaatcaggacgtgatct

SEQ ID NO: 504601 - DNA, 25 bp, Rattus norvegicus
gtgagtgcaaatgaggacgtgatct

SEQ ID NO: 504602 - DNA, 25 bp, Rattus norvegicus
gtgagtgcaagccaccaggttcctc

SEQ ID NO: 504603 - DNA, 25 bp, Rattus norvegicus
gtgagtgcaagcgaccaggttcctc

SEQ ID NO: 504604 - DNA, 25 bp, Rattus norvegicus
gtgagtgcacgaccagaggccatca

SEQ ID NO: 504605 - DNA, 25 bp, Rattus norvegicus
gtgagtgcacgagcagaggccatca

SEQ ID NO: 504606 - DNA, 25 bp, Rattus norvegicus
gtgagtgcagtactgagtccccttg

SEQ ID NO: 504607 - DNA, 25 bp, Rattus norvegicus
gtgagtgcagtagtgagtccccttg

SEQ ID NO: 504608 - DNA, 25 bp, Rattus norvegicus
gtgagtgcatacacacttacacatg

SEQ ID NO: 504609 - DNA, 25 bp, Rattus norvegicus
gtgagtgcatactcacttacacatg

SEQ ID NO: 504610 - DNA, 25 bp, Rattus norvegicus
gtgagtgcatttacttaaatccctt

SEQ ID NO: 504611 - DNA, 25 bp, Rattus norvegicus
gtgagtgcattttcttaaatccctt

SEQ ID NO: 504612 - DNA, 25 bp, Rattus norvegicus
gtgagtgccaatctgctgcaaatga

SEQ ID NO: 504613 - DNA, 25 bp, Rattus norvegicus
gtgagtgccaatgtgctgcaaatga

SEQ ID NO: 504614 - DNA, 25 bp, Rattus norvegicus
gtgagtgcctaacccactgtgaccg

SEQ ID NO: 504615 - DNA, 25 bp, Rattus norvegicus
gtgagtgcctaagccactgtgaccg

SEQ ID NO: 504616 - DNA, 25 bp, Rattus norvegicus
gtgagtgcctctcctaggtagctgt

SEQ ID NO: 504617 - DNA, 25 bp, Rattus norvegicus
gtgagtgcctctgctaggtagctgt

SEQ ID NO: 504618 - DNA, 25 bp, Rattus norvegicus
gtgagtgcctgcattggactcagag

SEQ ID NO: 504619 - DNA, 25 bp, Rattus norvegicus
gtgagtgcctgcctgtatacatgtc

SEQ ID NO: 504620 - DNA, 25 bp, Rattus norvegicus
gtgagtgcctgcgtgtatacatgtc

SEQ ID NO: 504621 - DNA, 25 bp, Rattus norvegicus
gtgagtgcctgctttggactcagag

SEQ ID NO: 504622 - DNA, 25 bp, Rattus norvegicus
gtgagtgctattaagggtccctggt

SEQ ID NO: 504623 - DNA, 25 bp, Rattus norvegicus
gtgagtgctatttagggtccctggt

SEQ ID NO: 504624 - DNA, 25 bp, Rattus norvegicus
gtgagtgctcccattatacatgcag

SEQ ID NO: 504625 - DNA, 25 bp, Rattus norvegicus
gtgagtgctccctttatacatgcag

SEQ ID NO: 504626 - DNA, 25 bp, Rattus norvegicus
gtgagtgctctacgaaatgctttta

SEQ ID NO: 504627 - DNA, 25 bp, Rattus norvegicus
gtgagtgctctaggaaatgctttta

SEQ ID NO: 504628 - DNA, 25 bp, Rattus norvegicus
gtgagtgctctgcaaccatacacga

SEQ ID NO: 504629 - DNA, 25 bp, Rattus norvegicus
gtgagtgctctggaaccatacacga

SEQ ID NO: 504630 - DNA, 25 bp, Rattus norvegicus
gtgagtgctgtgcaccctgtactga

SEQ ID NO: 504631 - DNA, 25 bp, Rattus norvegicus
gtgagtgctgtggaccctgtactga

SEQ ID NO: 504632 - DNA, 25 bp, Rattus norvegicus
gtgagtgcttctcatactattttta

SEQ ID NO: 504633 - DNA, 25 bp, Rattus norvegicus
gtgagtgcttctgatactattttta

SEQ ID NO: 504634 - DNA, 25 bp, Rattus norvegicus
gtgagtggacatactgtacaaggta

SEQ ID NO: 504635 - DNA, 25 bp, Rattus norvegicus
gtgagtggacatcattacctacctg

SEQ ID NO: 504636 - DNA, 25 bp, Rattus norvegicus
gtgagtggacatgattacctacctg

SEQ ID NO: 504637 - DNA, 25 bp, Rattus norvegicus
gtgagtggacattctgtacaaggta

SEQ ID NO: 504638 - DNA, 25 bp, Rattus norvegicus
gtgagtggacccaacagagctctct

SEQ ID NO: 504639 - DNA, 25 bp, Rattus norvegicus
gtgagtggaccctacagagctctct

SEQ ID NO: 504640 - DNA, 25 bp, Rattus norvegicus
gtgagtggagaacccatgtcccgtc

SEQ ID NO: 504641 - DNA, 25 bp, Rattus norvegicus
gtgagtggagaagccatgtcccgtc

SEQ ID NO: 504642 - DNA, 25 bp, Rattus norvegicus
gtgagtggatataccaactccctgc

SEQ ID NO: 504643 - DNA, 25 bp, Rattus norvegicus
gtgagtggatattccaactccctgc

SEQ ID NO: 504644 - DNA, 25 bp, Rattus norvegicus
gtgagtggctcaccctgaataaggc

SEQ ID NO: 504645 - DNA, 25 bp, Rattus norvegicus
gtgagtggctcagcctgaataaggc

SEQ ID NO: 504646 - DNA, 25 bp, Rattus norvegicus
gtgagtggctgactactgtctgtct

SEQ ID NO: 504647 - DNA, 25 bp, Rattus norvegicus
gtgagtggctgagtactgtctgtct

SEQ ID NO: 504648 - DNA, 25 bp, Rattus norvegicus
gtgagtgggcacacagcaggctgtg

SEQ ID NO: 504649 - DNA, 25 bp, Rattus norvegicus
gtgagtgggcactcagcaggctgtg

SEQ ID NO: 504650 - DNA, 25 bp, Rattus norvegicus
gtgagtgggtaacctatcatcgcag

SEQ ID NO: 504651 - DNA, 25 bp, Rattus norvegicus
gtgagtgggtaagctatcatcgcag

SEQ ID NO: 504652 - DNA, 25 bp, Rattus norvegicus
gtgagtgtcatgaagttgtcacgca

SEQ ID NO: 504653 - DNA, 25 bp, Rattus norvegicus
gtgagtgtcatgtagttgtcacgca

SEQ ID NO: 504654 - DNA, 25 bp, Rattus norvegicus
gtgagtgtcccgagcgtgttcttgc

SEQ ID NO: 504655 - DNA, 25 bp, Rattus norvegicus
gtgagtgtcccgtgcgtgttcttgc

SEQ ID NO: 504656 - DNA, 25 bp, Rattus norvegicus
gtgagtgtgaacatggcctcatcca

SEQ ID NO: 504657 - DNA, 25 bp, Rattus norvegicus
gtgagtgtgaacttggcctcatcca

SEQ ID NO: 504658 - DNA, 25 bp, Rattus norvegicus
gtgagtgtgcaaagtgcttcggcca

SEQ ID NO: 504659 - DNA, 25 bp, Rattus norvegicus
gtgagtgtgcaatgtgcttcggcca

SEQ ID NO: 504660 - DNA, 25 bp, Rattus norvegicus
gtgagtgtgctcaagaactagtctt

SEQ ID NO: 504661 - DNA, 25 bp, Rattus norvegicus
gtgagtgtgctctagaactagtctt

SEQ ID NO: 504662 - DNA, 25 bp, Rattus norvegicus
gtgagtgtgtcacactaccgtaatt

SEQ ID NO: 504663 - DNA, 25 bp, Rattus norvegicus
gtgagtgtgtcagactaccgtaatt

SEQ ID NO: 504664 - DNA, 25 bp, Rattus norvegicus
gtgagtgtgtgcatgtgctgtacac

SEQ ID NO: 504665 - DNA, 25 bp, Rattus norvegicus
gtgagtgtgtgcttgtgctgtacac

SEQ ID NO: 504666 - DNA, 25 bp, Rattus norvegicus
gtgagtgttcagcacaccacacagg

SEQ ID NO: 504667 - DNA, 25 bp, Rattus norvegicus
gtgagtgttcaggacaccacacagg

SEQ ID NO: 504668 - DNA, 25 bp, Rattus norvegicus
gtgagtgttttccatgtccaataga

SEQ ID NO: 504669 - DNA, 25 bp, Rattus norvegicus
gtgagtgttttcgatgtccaataga

SEQ ID NO: 504670 - DNA, 25 bp, Rattus norvegicus
gtgagttaccctcggtttgcactgc

SEQ ID NO: 504671 - DNA, 25 bp, Rattus norvegicus
gtgagttaccctgggtttgcactgc

SEQ ID NO: 504672 - DNA, 25 bp, Rattus norvegicus
gtgagttaccgtaactgtatttgtt

SEQ ID NO: 504673 - DNA, 25 bp, Rattus norvegicus
gtgagttaccgttactgtatttgtt

SEQ ID NO: 504674 - DNA, 25 bp, Rattus norvegicus
gtgagttaccttaccttaatgtgca

SEQ ID NO: 504675 - DNA, 25 bp, Rattus norvegicus
gtgagttacctttccttaatgtgca

SEQ ID NO: 504676 - DNA, 25 bp, Rattus norvegicus
gtgagttacttcagggaacacagca

SEQ ID NO: 504677 - DNA, 25 bp, Rattus norvegicus
gtgagttacttctgggaacacagca

SEQ ID NO: 504678 - DNA, 25 bp, Rattus norvegicus
gtgagttcaagcacttggacccacc

SEQ ID NO: 504679 - DNA, 25 bp, Rattus norvegicus
gtgagttcaagccaaggaccgccgt

SEQ ID NO: 504680 - DNA, 25 bp, Rattus norvegicus
gtgagttcaagcgaaggaccgccgt

SEQ ID NO: 504681 - DNA, 25 bp, Rattus norvegicus
gtgagttcaagctcttggacccacc

SEQ ID NO: 504682 - DNA, 25 bp, Rattus norvegicus
gtgagttcacagatttaactactat

SEQ ID NO: 504683 - DNA, 25 bp, Rattus norvegicus
gtgagttcacagttttaactactat

SEQ ID NO: 504684 - DNA, 25 bp, Rattus norvegicus
gtgagttcaggcaatcccgaaatat

SEQ ID NO: 504685 - DNA, 25 bp, Rattus norvegicus
gtgagttcaggctatcccgaaatat

SEQ ID NO: 504686 - DNA, 25 bp, Rattus norvegicus
gtgagttccacaaatttcgctttag

SEQ ID NO: 504687 - DNA, 25 bp, Rattus norvegicus
gtgagttccacatatttcgctttag

SEQ ID NO: 504688 - DNA, 25 bp, Rattus norvegicus
gtgagttccagaatccatgagacca

SEQ ID NO: 504689 - DNA, 25 bp, Rattus norvegicus
gtgagttccagattccatgagacca

SEQ ID NO: 504690 - DNA, 25 bp, Rattus norvegicus
gtgagttccagtaccaaggacttga

SEQ ID NO: 504691 - DNA, 25 bp, Rattus norvegicus
gtgagttccagttccaaggacttga

SEQ ID NO: 504692 - DNA, 25 bp, Rattus norvegicus
gtgagttccctaaattacatgctgt

SEQ ID NO: 504693 - DNA, 25 bp, Rattus norvegicus
gtgagttccctatattacatgctgt

SEQ ID NO: 504694 - DNA, 25 bp, Rattus norvegicus
gtgagttcctcactctggaacacag

SEQ ID NO: 504695 - DNA, 25 bp, Rattus norvegicus
gtgagttcctcagtctggaacacag

SEQ ID NO: 504696 - DNA, 25 bp, Rattus norvegicus
gtgagttcgaccagttgagcaaaga

SEQ ID NO: 504697 - DNA, 25 bp, Rattus norvegicus
gtgagttcgacctgttgagcaaaga

SEQ ID NO: 504698 - DNA, 25 bp, Rattus norvegicus
gtgagttcgagaccgtcgtgcacaa

SEQ ID NO: 504699 - DNA, 25 bp, Rattus norvegicus
gtgagttcgagagcgtcgtgcacaa

SEQ ID NO: 504700 - DNA, 25 bp, Rattus norvegicus
gtgagttctcagctgacccttttgt

SEQ ID NO: 504701 - DNA, 25 bp, Rattus norvegicus
gtgagttctcaggtgacccttttgt

SEQ ID NO: 504702 - DNA, 25 bp, Rattus norvegicus
gtgagttctctgaagtcctagggaa

SEQ ID NO: 504703 - DNA, 25 bp, Rattus norvegicus
gtgagttctctgtagtcctagggaa

SEQ ID NO: 504704 - DNA, 25 bp, Rattus norvegicus
gtgagttctgcaaccagagtccagg

SEQ ID NO: 504705 - DNA, 25 bp, Rattus norvegicus
gtgagttctgcatccagagtccagg

SEQ ID NO: 504706 - DNA, 25 bp, Rattus norvegicus
gtgagttctgggacagccaagacta

SEQ ID NO: 504707 - DNA, 25 bp, Rattus norvegicus
gtgagttctgggtcagccaagacta

SEQ ID NO: 504708 - DNA, 25 bp, Rattus norvegicus
gtgagttcttttagctactcctcca

SEQ ID NO: 504709 - DNA, 25 bp, Rattus norvegicus
gtgagttctttttgctactcctcca

SEQ ID NO: 504710 - DNA, 25 bp, Rattus norvegicus
gtgagttgaagaccagccaggccaa

SEQ ID NO: 504711 - DNA, 25 bp, Rattus norvegicus
gtgagttgaagagcagccaggccaa

SEQ ID NO: 504712 - DNA, 25 bp, Rattus norvegicus
gtgagttgtcctagatggcagcatt

SEQ ID NO: 504713 - DNA, 25 bp, Rattus norvegicus
gtgagttgtccttgatggcagcatt

SEQ ID NO: 504714 - DNA, 25 bp, Rattus norvegicus
gtgagttgtcttattcttcattcca

SEQ ID NO: 504715 - DNA, 25 bp, Rattus norvegicus
gtgagttgtctttttcttcattcca

SEQ ID NO: 504716 - DNA, 25 bp, Rattus norvegicus
gtgagtttcaagacaaccaaagcta

SEQ ID NO: 504717 - DNA, 25 bp, Rattus norvegicus
gtgagtttcaagtcaaccaaagcta

SEQ ID NO: 504718 - DNA, 25 bp, Rattus norvegicus
gtgagtttcacaatatgcatcccaa

SEQ ID NO: 504719 - DNA, 25 bp, Rattus norvegicus
gtgagtttcacattatgcatcccaa

SEQ ID NO: 504720 - DNA, 25 bp, Rattus norvegicus
gtgagtttgaggataccctgccagg

SEQ ID NO: 504721 - DNA, 25 bp, Rattus norvegicus
gtgagtttgaggttaccctgccagg

SEQ ID NO: 504722 - DNA, 25 bp, Rattus norvegicus
gtgagtttgtgtacaacaaccccaa

SEQ ID NO: 504723 - DNA, 25 bp, Rattus norvegicus
gtgagtttgtgttcaacaaccccaa

SEQ ID NO: 504724 - DNA, 25 bp, Rattus norvegicus
gtgagttttactccaaatccagcct

SEQ ID NO: 504725 - DNA, 25 bp, Rattus norvegicus
gtgagttttactgcaaatccagcct

SEQ ID NO: 504726 - DNA, 25 bp, Rattus norvegicus
gtgagttttaggacctccaaggctc

SEQ ID NO: 504727 - DNA, 25 bp, Rattus norvegicus
gtgagttttaggtcctccaaggctc

SEQ ID NO: 504728 - DNA, 25 bp, Rattus norvegicus
gtgataaaaagacccctcccgctgg

SEQ ID NO: 504729 - DNA, 25 bp, Rattus norvegicus
gtgataaaaagagccctcccgctgg

SEQ ID NO: 504730 - DNA, 25 bp, Rattus norvegicus
gtgataaactcccagagacccctgt

SEQ ID NO: 504731 - DNA, 25 bp, Rattus norvegicus
gtgataaactccgagagacccctgt

SEQ ID NO: 504732 - DNA, 25 bp, Rattus norvegicus
gtgataaagttgcaaactgctgtct

SEQ ID NO: 504733 - DNA, 25 bp, Rattus norvegicus
gtgataaagttggaaactgctgtct

SEQ ID NO: 504734 - DNA, 25 bp, Rattus norvegicus
gtgataaattttccaatctcaggaa

SEQ ID NO: 504735 - DNA, 25 bp, Rattus norvegicus
gtgataaattttgcaatctcaggaa

SEQ ID NO: 504736 - DNA, 25 bp, Rattus norvegicus
gtgataacagcaacccggcaacagg

SEQ ID NO: 504737 - DNA, 25 bp, Rattus norvegicus
gtgataacagcacagggaacttcat

SEQ ID NO: 504738 - DNA, 25 bp, Rattus norvegicus
gtgataacagcagagggaacttcat

SEQ ID NO: 504739 - DNA, 25 bp, Rattus norvegicus
gtgataacagcatcccggcaacagg

SEQ ID NO: 504740 - DNA, 25 bp, Rattus norvegicus
gtgataacagctcgccacagaccac

SEQ ID NO: 504741 - DNA, 25 bp, Rattus norvegicus
gtgataacagctggccacagaccac

SEQ ID NO: 504742 - DNA, 25 bp, Rattus norvegicus
gtgataacagttctcttttgagtca

SEQ ID NO: 504743 - DNA, 25 bp, Rattus norvegicus
gtgataacagttgtcttttgagtca

SEQ ID NO: 504744 - DNA, 25 bp, Rattus norvegicus
gtgataacattgacacccgtactgt

SEQ ID NO: 504745 - DNA, 25 bp, Rattus norvegicus
gtgataacattgtcacccgtactgt

SEQ ID NO: 504746 - DNA, 25 bp, Rattus norvegicus
gtgataaccaacaagctgctgctct

SEQ ID NO: 504747 - DNA, 25 bp, Rattus norvegicus
gtgataaccaacctaccataatgat

SEQ ID NO: 504748 - DNA, 25 bp, Rattus norvegicus
gtgataaccaacgtaccataatgat

SEQ ID NO: 504749 - DNA, 25 bp, Rattus norvegicus
gtgataaccaactagctgctgctct

SEQ ID NO: 504750 - DNA, 25 bp, Rattus norvegicus
gtgataaccccacaagctcattcat

SEQ ID NO: 504751 - DNA, 25 bp, Rattus norvegicus
gtgataaccccagaagctcattcat

SEQ ID NO: 504752 - DNA, 25 bp, Rattus norvegicus
gtgataacgcttattcacaacccag

SEQ ID NO: 504753 - DNA, 25 bp, Rattus norvegicus
gtgataacgctttttcacaacccag

SEQ ID NO: 504754 - DNA, 25 bp, Rattus norvegicus
gtgataactttgaagctgcttcttt

SEQ ID NO: 504755 - DNA, 25 bp, Rattus norvegicus
gtgataactttgtagctgcttcttt

SEQ ID NO: 504756 - DNA, 25 bp, Rattus norvegicus
gtgataagatccaccactatggcta

SEQ ID NO: 504757 - DNA, 25 bp, Rattus norvegicus
gtgataagatcctccactatggcta

SEQ ID NO: 504758 - DNA, 25 bp, Rattus norvegicus
gtgataagctgccttgtgggcccaa

SEQ ID NO: 504759 - DNA, 25 bp, Rattus norvegicus
gtgataagctgcgttgtgggcccaa

SEQ ID NO: 504760 - DNA, 25 bp, Rattus norvegicus
gtgataagctgtcatgctgccgcgt

SEQ ID NO: 504761 - DNA, 25 bp, Rattus norvegicus
gtgataagctgtgatgctgccgcgt

SEQ ID NO: 504762 - DNA, 25 bp, Rattus norvegicus
gtgataaggaggaagcctgcctatt

SEQ ID NO: 504763 - DNA, 25 bp, Rattus norvegicus
gtgataaggaggtagcctgcctatt

SEQ ID NO: 504764 - DNA, 25 bp, Rattus norvegicus
gtgataataataacccccatctgcc

SEQ ID NO: 504765 - DNA, 25 bp, Rattus norvegicus
gtgataataatatcccccatctgcc

SEQ ID NO: 504766 - DNA, 25 bp, Rattus norvegicus
gtgataattaagacaggccctcatt

SEQ ID NO: 504767 - DNA, 25 bp, Rattus norvegicus
gtgataattaagtcaggccctcatt

SEQ ID NO: 504768 - DNA, 25 bp, Rattus norvegicus
gtgataatttcaccatcttcccttc

SEQ ID NO: 504769 - DNA, 25 bp, Rattus norvegicus
gtgataatttcagcatcttcccttc

SEQ ID NO: 504770 - DNA, 25 bp, Rattus norvegicus
gtgatacacagcacctctggacatt

SEQ ID NO: 504771 - DNA, 25 bp, Rattus norvegicus
gtgatacacagctcctctggacatt

SEQ ID NO: 504772 - DNA, 25 bp, Rattus norvegicus
gtgatacacatgcacttttcctgtc

SEQ ID NO: 504773 - DNA, 25 bp, Rattus norvegicus
gtgatacacatggacttttcctgtc

SEQ ID NO: 504774 - DNA, 25 bp, Rattus norvegicus
gtgatacaccccacagagatctatg

SEQ ID NO: 504775 - DNA, 25 bp, Rattus norvegicus
gtgatacacccctcagagatctatg

SEQ ID NO: 504776 - DNA, 25 bp, Rattus norvegicus
gtgatacactccacgggcagcagac

SEQ ID NO: 504777 - DNA, 25 bp, Rattus norvegicus
gtgatacactcctcgggcagcagac

SEQ ID NO: 504778 - DNA, 25 bp, Rattus norvegicus
gtgatacagactctgtggaaccgat

SEQ ID NO: 504779 - DNA, 25 bp, Rattus norvegicus
gtgatacagactgtgtggaaccgat

SEQ ID NO: 504780 - DNA, 25 bp, Rattus norvegicus
gtgatacagagacgccagcaggcat

SEQ ID NO: 504781 - DNA, 25 bp, Rattus norvegicus
gtgatacagagaggccagcaggcat

SEQ ID NO: 504782 - DNA, 25 bp, Rattus norvegicus
gtgatacatatcattgagctctttc

SEQ ID NO: 504783 - DNA, 25 bp, Rattus norvegicus
gtgatacatatctttgagctctttc

SEQ ID NO: 504784 - DNA, 25 bp, Rattus norvegicus
gtgatacatggcagtttcatcccgt

SEQ ID NO: 504785 - DNA, 25 bp, Rattus norvegicus
gtgatacatggctgtttcatcccgt

SEQ ID NO: 504786 - DNA, 25 bp, Rattus norvegicus
gtgataccaccgcagcccagaaggg

SEQ ID NO: 504787 - DNA, 25 bp, Rattus norvegicus
gtgataccaccggagcccagaaggg

SEQ ID NO: 504788 - DNA, 25 bp, Rattus norvegicus
gtgataccactcacagtgggccggg

SEQ ID NO: 504789 - DNA, 25 bp, Rattus norvegicus
gtgataccactctcagtgggccggg

SEQ ID NO: 504790 - DNA, 25 bp, Rattus norvegicus
gtgataccagcacgccagaggctga

SEQ ID NO: 504791 - DNA, 25 bp, Rattus norvegicus
gtgataccagcaggccagaggctga

SEQ ID NO: 504792 - DNA, 25 bp, Rattus norvegicus
gtgataccagttccttttaaggaat

SEQ ID NO: 504793 - DNA, 25 bp, Rattus norvegicus
gtgataccagttgcttttaaggaat

SEQ ID NO: 504794 - DNA, 25 bp, Rattus norvegicus
gtgataccatgcaagctgggcattg

SEQ ID NO: 504795 - DNA, 25 bp, Rattus norvegicus
gtgataccatgctagctgggcattg

SEQ ID NO: 504796 - DNA, 25 bp, Rattus norvegicus
gtgataccatggaggcacacatgct

SEQ ID NO: 504797 - DNA, 25 bp, Rattus norvegicus
gtgataccatggtggcacacatgct

SEQ ID NO: 504798 - DNA, 25 bp, Rattus norvegicus
gtgatacccataccggtttcccgag

SEQ ID NO: 504799 - DNA, 25 bp, Rattus norvegicus
gtgatacccatagcggtttcccgag

SEQ ID NO: 504800 - DNA, 25 bp, Rattus norvegicus
gtgataccccagaaataatgcattg

SEQ ID NO: 504801 - DNA, 25 bp, Rattus norvegicus
gtgataccccagtaataatgcattg

SEQ ID NO: 504802 - DNA, 25 bp, Rattus norvegicus
gtgataccctaaccaaggcagcttc

SEQ ID NO: 504803 - DNA, 25 bp, Rattus norvegicus
gtgataccctaagcaaggcagcttc

SEQ ID NO: 504804 - DNA, 25 bp, Rattus norvegicus
gtgataccctacctgatccgaagag

SEQ ID NO: 504805 - DNA, 25 bp, Rattus norvegicus
gtgataccctacgtgatccgaagag

SEQ ID NO: 504806 - DNA, 25 bp, Rattus norvegicus
gtgatacctgttcctcacacagaga

SEQ ID NO: 504807 - DNA, 25 bp, Rattus norvegicus
gtgatacctgttgctcacacagaga

SEQ ID NO: 504808 - DNA, 25 bp, Rattus norvegicus
gtgataccttaaatttctcctctga

SEQ ID NO: 504809 - DNA, 25 bp, Rattus norvegicus
gtgataccttaattttctcctctga

SEQ ID NO: 504810 - DNA, 25 bp, Rattus norvegicus
gtgataccttcaactctggagaact

SEQ ID NO: 504811 - DNA, 25 bp, Rattus norvegicus
gtgataccttcatctctggagaact

SEQ ID NO: 504812 - DNA, 25 bp, Rattus norvegicus
gtgatactaaaaatccctttacgtg

SEQ ID NO: 504813 - DNA, 25 bp, Rattus norvegicus
gtgatactaaaattccctttacgtg

SEQ ID NO: 504814 - DNA, 25 bp, Rattus norvegicus
gtgatactctatattctttgcaaat

SEQ ID NO: 504815 - DNA, 25 bp, Rattus norvegicus
gtgatactctattttctttgcaaat

SEQ ID NO: 504816 - DNA, 25 bp, Rattus norvegicus
gtgatactctggagtctggccacta

SEQ ID NO: 504817 - DNA, 25 bp, Rattus norvegicus
gtgatactctggtgtctggccacta

SEQ ID NO: 504818 - DNA, 25 bp, Rattus norvegicus
gtgatactgccaatatcccatgcaa

SEQ ID NO: 504819 - DNA, 25 bp, Rattus norvegicus
gtgatactgccattatcccatgcaa

SEQ ID NO: 504820 - DNA, 25 bp, Rattus norvegicus
gtgatactgcttagaccgacttagg

SEQ ID NO: 504821 - DNA, 25 bp, Rattus norvegicus
gtgatactgctttgaccgacttagg

SEQ ID NO: 504822 - DNA, 25 bp, Rattus norvegicus
gtgatacttaacagccatcaggaca

SEQ ID NO: 504823 - DNA, 25 bp, Rattus norvegicus
gtgatacttaactgccatcaggaca

SEQ ID NO: 504824 - DNA, 25 bp, Rattus norvegicus
gtgatacttatcaggcgcattttta

SEQ ID NO: 504825 - DNA, 25 bp, Rattus norvegicus
gtgatacttatctggcgcattttta

SEQ ID NO: 504826 - DNA, 25 bp, Rattus norvegicus
gtgatacttctgaaccctgagcaat

SEQ ID NO: 504827 - DNA, 25 bp, Rattus norvegicus
gtgatacttctgtaccctgagcaat

SEQ ID NO: 504828 - DNA, 25 bp, Rattus norvegicus
gtgatactttaacccaagccctact

SEQ ID NO: 504829 - DNA, 25 bp, Rattus norvegicus
gtgatactttaagccaagccctact

SEQ ID NO: 504830 - DNA, 25 bp, Rattus norvegicus
gtgatagaataaagaggcgctccgc

SEQ ID NO: 504831 - DNA, 25 bp, Rattus norvegicus
gtgatagaataatgaggcgctccgc

SEQ ID NO: 504832 - DNA, 25 bp, Rattus norvegicus
gtgatagacactaccccaaactgtg

SEQ ID NO: 504833 - DNA, 25 bp, Rattus norvegicus
gtgatagacacttccccaaactgtg

SEQ ID NO: 504834 - DNA, 25 bp, Rattus norvegicus
gtgatagacaggctctcccagtgta

SEQ ID NO: 504835 - DNA, 25 bp, Rattus norvegicus
gtgatagacagggtctcccagtgta

SEQ ID NO: 504836 - DNA, 25 bp, Rattus norvegicus
gtgatagcaatcagctggcctggtt

SEQ ID NO: 504837 - DNA, 25 bp, Rattus norvegicus
gtgatagcaatcctttctgcagagg

SEQ ID NO: 504838 - DNA, 25 bp, Rattus norvegicus
gtgatagcaatcgtttctgcagagg

SEQ ID NO: 504839 - DNA, 25 bp, Rattus norvegicus
gtgatagcaatctgctggcctggtt

SEQ ID NO: 504840 - DNA, 25 bp, Rattus norvegicus
gtgatagcacaaccctgtcatcctg

SEQ ID NO: 504841 - DNA, 25 bp, Rattus norvegicus
gtgatagcacaagcctgtcatcctg

SEQ ID NO: 504842 - DNA, 25 bp, Rattus norvegicus
gtgatagcagagatgccgccgagct

SEQ ID NO: 504843 - DNA, 25 bp, Rattus norvegicus
gtgatagcagagttgccgccgagct

SEQ ID NO: 504844 - DNA, 25 bp, Rattus norvegicus
gtgatagcagctacatcctgaatgt

SEQ ID NO: 504845 - DNA, 25 bp, Rattus norvegicus
gtgatagcagcttcatcctgaatgt

SEQ ID NO: 504846 - DNA, 25 bp, Rattus norvegicus
gtgatagcattcatacagccaccct

SEQ ID NO: 504847 - DNA, 25 bp, Rattus norvegicus
gtgatagcattcttacagccaccct

SEQ ID NO: 504848 - DNA, 25 bp, Rattus norvegicus
gtgatagcatttcggcctttagcaa

SEQ ID NO: 504849 - DNA, 25 bp, Rattus norvegicus
gtgatagcatttgggcctttagcaa

SEQ ID NO: 504850 - DNA, 25 bp, Rattus norvegicus
gtgatagcccttcagtgtatttctc

SEQ ID NO: 504851 - DNA, 25 bp, Rattus norvegicus
gtgatagcccttgagtgtatttctc

SEQ ID NO: 504852 - DNA, 25 bp, Rattus norvegicus
gtgatagcgattaccccagatactg

SEQ ID NO: 504853 - DNA, 25 bp, Rattus norvegicus
gtgatagcgatttccccagatactg

SEQ ID NO: 504854 - DNA, 25 bp, Rattus norvegicus
gtgatagctcttccagtgataaaca

SEQ ID NO: 504855 - DNA, 25 bp, Rattus norvegicus
gtgatagctcttgcagtgataaaca

SEQ ID NO: 504856 - DNA, 25 bp, Rattus norvegicus
gtgatagctgcaagcatcttgcata

SEQ ID NO: 504857 - DNA, 25 bp, Rattus norvegicus
gtgatagctgcatgcatcttgcata

SEQ ID NO: 504858 - DNA, 25 bp, Rattus norvegicus
gtgataggacatatcatcctaaaaa

SEQ ID NO: 504859 - DNA, 25 bp, Rattus norvegicus
gtgataggacatttcatcctaaaaa

SEQ ID NO: 504860 - DNA, 25 bp, Rattus norvegicus
gtgataggcggccagcgaaactctc

SEQ ID NO: 504861 - DNA, 25 bp, Rattus norvegicus
gtgataggcggcgagcgaaactctc

SEQ ID NO: 504862 - DNA, 25 bp, Rattus norvegicus
gtgatagggtgtatagcatctgcat

SEQ ID NO: 504863 - DNA, 25 bp, Rattus norvegicus
gtgatagggtgtttagcatctgcat

SEQ ID NO: 504864 - DNA, 25 bp, Rattus norvegicus
gtgatagtacatatctggaaactgc

SEQ ID NO: 504865 - DNA, 25 bp, Rattus norvegicus
gtgatagtacatttctggaaactgc

SEQ ID NO: 504866 - DNA, 25 bp, Rattus norvegicus
gtgatagtatgtaagtccacactta

SEQ ID NO: 504867 - DNA, 25 bp, Rattus norvegicus
gtgatagtatgttagtccacactta

SEQ ID NO: 504868 - DNA, 25 bp, Rattus norvegicus
gtgatagtcaccagctttaagcgga

SEQ ID NO: 504869 - DNA, 25 bp, Rattus norvegicus
gtgatagtcacctgctttaagcgga

SEQ ID NO: 504870 - DNA, 25 bp, Rattus norvegicus
gtgatagtcctgaggctactagcac

SEQ ID NO: 504871 - DNA, 25 bp, Rattus norvegicus
gtgatagtcctgtggctactagcac

SEQ ID NO: 504872 - DNA, 25 bp, Rattus norvegicus
gtgatagtggcgcttacctaccatt

SEQ ID NO: 504873 - DNA, 25 bp, Rattus norvegicus
gtgatagtggcggttacctaccatt

SEQ ID NO: 504874 - DNA, 25 bp, Rattus norvegicus
gtgatagtggtgctttctgcccagc

SEQ ID NO: 504875 - DNA, 25 bp, Rattus norvegicus
gtgatagtggtggtttctgcccagc

SEQ ID NO: 504876 - DNA, 25 bp, Rattus norvegicus
gtgatagtgttaatgccgattggca

SEQ ID NO: 504877 - DNA, 25 bp, Rattus norvegicus
gtgatagtgttattgccgattggca

SEQ ID NO: 504878 - DNA, 25 bp, Rattus norvegicus
gtgatagttcatccgattccagaag

SEQ ID NO: 504879 - DNA, 25 bp, Rattus norvegicus
gtgatagttcatgcgattccagaag

SEQ ID NO: 504880 - DNA, 25 bp, Rattus norvegicus
gtgatagtttaccagcttgctcatt

SEQ ID NO: 504881 - DNA, 25 bp, Rattus norvegicus
gtgatagtttacgagcttgctcatt

SEQ ID NO: 504882 - DNA, 25 bp, Rattus norvegicus
gtgatatactcaccctgtgcttctc

SEQ ID NO: 504883 - DNA, 25 bp, Rattus norvegicus
gtgatatactcagcctgtgcttctc

SEQ ID NO: 504884 - DNA, 25 bp, Rattus norvegicus
gtgatatcccagagaccaggagttt

SEQ ID NO: 504885 - DNA, 25 bp, Rattus norvegicus
gtgatatcccagtgaccaggagttt

SEQ ID NO: 504886 - DNA, 25 bp, Rattus norvegicus
gtgatatcctcaagctgtttaagta

SEQ ID NO: 504887 - DNA, 25 bp, Rattus norvegicus
gtgatatcctcatgctgtttaagta

SEQ ID NO: 504888 - DNA, 25 bp, Rattus norvegicus
gtgatatctatcattctgtgtgtgt

SEQ ID NO: 504889 - DNA, 25 bp, Rattus norvegicus
gtgatatctatctttctgtgtgtgt

SEQ ID NO: 504890 - DNA, 25 bp, Rattus norvegicus
gtgatatctgagacttactgggcaa

SEQ ID NO: 504891 - DNA, 25 bp, Rattus norvegicus
gtgatatctgagtcttactgggcaa

SEQ ID NO: 504892 - DNA, 25 bp, Rattus norvegicus
gtgatatgcacccagtgaccatagg

SEQ ID NO: 504893 - DNA, 25 bp, Rattus norvegicus
gtgatatgcaccgagtgaccatagg

SEQ ID NO: 504894 - DNA, 25 bp, Rattus norvegicus
gtgatatgtaaactccctcaggata

SEQ ID NO: 504895 - DNA, 25 bp, Rattus norvegicus
gtgatatgtaaagtccctcaggata

SEQ ID NO: 504896 - DNA, 25 bp, Rattus norvegicus
gtgatatgtcacatccacaaatggc

SEQ ID NO: 504897 - DNA, 25 bp, Rattus norvegicus
gtgatatgtcacttccacaaatggc

SEQ ID NO: 504898 - DNA, 25 bp, Rattus norvegicus
gtgatattcaaacgtatggtggtta

SEQ ID NO: 504899 - DNA, 25 bp, Rattus norvegicus
gtgatattcaaaggtatggtggtta

SEQ ID NO: 504900 - DNA, 25 bp, Rattus norvegicus
gtgatattccccacaggcacgttaa

SEQ ID NO: 504901 - DNA, 25 bp, Rattus norvegicus
gtgatattcccctcaggcacgttaa

SEQ ID NO: 504902 - DNA, 25 bp, Rattus norvegicus
gtgatattcctgcagtccgctttaa

SEQ ID NO: 504903 - DNA, 25 bp, Rattus norvegicus
gtgatattcctggagtccgctttaa

SEQ ID NO: 504904 - DNA, 25 bp, Rattus norvegicus
gtgatattcgttattcaaaagtcat

SEQ ID NO: 504905 - DNA, 25 bp, Rattus norvegicus
gtgatattcgtttttcaaaagtcat

SEQ ID NO: 504906 - DNA, 25 bp, Rattus norvegicus
gtgatattctctagtgtccttctaa

SEQ ID NO: 504907 - DNA, 25 bp, Rattus norvegicus
gtgatattctctcttgtgtttccaa

SEQ ID NO: 504908 - DNA, 25 bp, Rattus norvegicus
gtgatattctctgttgtgtttccaa

SEQ ID NO: 504909 - DNA, 25 bp, Rattus norvegicus
gtgatattctcttgtgtccttctaa

SEQ ID NO: 504910 - DNA, 25 bp, Rattus norvegicus
gtgatatttaaccacgctacatact

SEQ ID NO: 504911 - DNA, 25 bp, Rattus norvegicus
gtgatatttaacgacgctacatact

SEQ ID NO: 504912 - DNA, 25 bp, Rattus norvegicus
gtgatcaaacttcaggcccttcagg

SEQ ID NO: 504913 - DNA, 25 bp, Rattus norvegicus
gtgatcaaacttgaggcccttcagg

SEQ ID NO: 504914 - DNA, 25 bp, Rattus norvegicus
gtgatcaaagatactgagtccctgt

SEQ ID NO: 504915 - DNA, 25 bp, Rattus norvegicus
gtgatcaaagattctgagtccctgt

SEQ ID NO: 504916 - DNA, 25 bp, Rattus norvegicus
gtgatcaaatttaccagcagtctgg

SEQ ID NO: 504917 - DNA, 25 bp, Rattus norvegicus
gtgatcaaattttccagcagtctgg

SEQ ID NO: 504918 - DNA, 25 bp, Rattus norvegicus
gtgatcaacaagcagaccccaaaca

SEQ ID NO: 504919 - DNA, 25 bp, Rattus norvegicus
gtgatcaacaaggagaccccaaaca

SEQ ID NO: 504920 - DNA, 25 bp, Rattus norvegicus
gtgatcaacatccaggacctgacag

SEQ ID NO: 504921 - DNA, 25 bp, Rattus norvegicus
gtgatcaacatcgaggacctgacag

SEQ ID NO: 504922 - DNA, 25 bp, Rattus norvegicus
gtgatcaactaaaagctctcctagt

SEQ ID NO: 504923 - DNA, 25 bp, Rattus norvegicus
gtgatcaactaatagctctcctagt

SEQ ID NO: 504924 - DNA, 25 bp, Rattus norvegicus
gtgatcaagagtcgctctgagccca

SEQ ID NO: 504925 - DNA, 25 bp, Rattus norvegicus
gtgatcaagagtggctctgagccca

SEQ ID NO: 504926 - DNA, 25 bp, Rattus norvegicus
gtgatcaaggacacccatctgagag

SEQ ID NO: 504927 - DNA, 25 bp, Rattus norvegicus
gtgatcaaggactcccatctgagag

SEQ ID NO: 504928 - DNA, 25 bp, Rattus norvegicus
gtgatcaaggatctagtccctgact

SEQ ID NO: 504929 - DNA, 25 bp, Rattus norvegicus
gtgatcaaggatgtagtccctgact

SEQ ID NO: 504930 - DNA, 25 bp, Rattus norvegicus
gtgatcacactgacttggaattaca

SEQ ID NO: 504931 - DNA, 25 bp, Rattus norvegicus
gtgatcacactgctgtttccaagaa

SEQ ID NO: 504932 - DNA, 25 bp, Rattus norvegicus
gtgatcacactggtgtttccaagaa

SEQ ID NO: 504933 - DNA, 25 bp, Rattus norvegicus
gtgatcacactgtcttggaattaca

SEQ ID NO: 504934 - DNA, 25 bp, Rattus norvegicus
gtgatcacagtgctcctaagattgg

SEQ ID NO: 504935 - DNA, 25 bp, Rattus norvegicus
gtgatcacagtggtcctaagattgg

SEQ ID NO: 504936 - DNA, 25 bp, Rattus norvegicus
gtgatcaccattcatgacatccagg

SEQ ID NO: 504937 - DNA, 25 bp, Rattus norvegicus
gtgatcaccattgatgacatccagg

SEQ ID NO: 504938 - DNA, 25 bp, Rattus norvegicus
gtgatcacctagacttccatcatat

SEQ ID NO: 504939 - DNA, 25 bp, Rattus norvegicus
gtgatcacctagtcttccatcatat

SEQ ID NO: 504940 - DNA, 25 bp, Rattus norvegicus
gtgatcacctgacatcatgcagctg

SEQ ID NO: 504941 - DNA, 25 bp, Rattus norvegicus
gtgatcacctgagatcatgcagctg

SEQ ID NO: 504942 - DNA, 25 bp, Rattus norvegicus
gtgatcacgcgcctaatgatgtcag

SEQ ID NO: 504943 - DNA, 25 bp, Rattus norvegicus
gtgatcacgcgcgtaatgatgtcag

SEQ ID NO: 504944 - DNA, 25 bp, Rattus norvegicus
gtgatcacgtgaagcctcatttgca

SEQ ID NO: 504945 - DNA, 25 bp, Rattus norvegicus
gtgatcacgtgatgcctcatttgca

SEQ ID NO: 504946 - DNA, 25 bp, Rattus norvegicus
gtgatcactaaacgcacacagtccc

SEQ ID NO: 504947 - DNA, 25 bp, Rattus norvegicus
gtgatcactaaaggcacacagtccc

SEQ ID NO: 504948 - DNA, 25 bp, Rattus norvegicus
gtgatcactgtcattctgtctctca

SEQ ID NO: 504949 - DNA, 25 bp, Rattus norvegicus
gtgatcactgtctttctgtctctca

SEQ ID NO: 504950 - DNA, 25 bp, Rattus norvegicus
gtgatcacttgacacagttcatctt

SEQ ID NO: 504951 - DNA, 25 bp, Rattus norvegicus
gtgatcacttgagacagttcatctt

SEQ ID NO: 504952 - DNA, 25 bp, Rattus norvegicus
gtgatcagagttccctcgctgggaa

SEQ ID NO: 504953 - DNA, 25 bp, Rattus norvegicus
gtgatcagagttgcctcgctgggaa

SEQ ID NO: 504954 - DNA, 25 bp, Rattus norvegicus
gtgatcagatacattaccatagcag

SEQ ID NO: 504955 - DNA, 25 bp, Rattus norvegicus
gtgatcagatactttaccatagcag

SEQ ID NO: 504956 - DNA, 25 bp, Rattus norvegicus
gtgatcagcaaactcctgaccttcg

SEQ ID NO: 504957 - DNA, 25 bp, Rattus norvegicus
gtgatcagcaaagtcctgaccttcg

SEQ ID NO: 504958 - DNA, 25 bp, Rattus norvegicus
gtgatcagcaagacattaccaatgg

SEQ ID NO: 504959 - DNA, 25 bp, Rattus norvegicus
gtgatcagcaagtcattaccaatgg

SEQ ID NO: 504960 - DNA, 25 bp, Rattus norvegicus
gtgatcagctggcttgcggacattt

SEQ ID NO: 504961 - DNA, 25 bp, Rattus norvegicus
gtgatcagctgggttgcggacattt

SEQ ID NO: 504962 - DNA, 25 bp, Rattus norvegicus
gtgatcagtcttatttccacttggt

SEQ ID NO: 504963 - DNA, 25 bp, Rattus norvegicus
gtgatcagtcttttttccacttggt

SEQ ID NO: 504964 - DNA, 25 bp, Rattus norvegicus
gtgatcataaatagtgctgaaccag

SEQ ID NO: 504965 - DNA, 25 bp, Rattus norvegicus
gtgatcataaattgtgctgaaccag

SEQ ID NO: 504966 - DNA, 25 bp, Rattus norvegicus
gtgatcataactctttgttgaacta

SEQ ID NO: 504967 - DNA, 25 bp, Rattus norvegicus
gtgatcataactgtttgttgaacta

SEQ ID NO: 504968 - DNA, 25 bp, Rattus norvegicus
gtgatcatacctcgtcctgatggac

SEQ ID NO: 504969 - DNA, 25 bp, Rattus norvegicus
gtgatcatacctggtcctgatggac

SEQ ID NO: 504970 - DNA, 25 bp, Rattus norvegicus
gtgatcatcacaccgctggactata

SEQ ID NO: 504971 - DNA, 25 bp, Rattus norvegicus
gtgatcatcacagcgctggactata

SEQ ID NO: 504972 - DNA, 25 bp, Rattus norvegicus
gtgatcatcctgacacttgatagaa

SEQ ID NO: 504973 - DNA, 25 bp, Rattus norvegicus
gtgatcatcctgctggtgtggaact

SEQ ID NO: 504974 - DNA, 25 bp, Rattus norvegicus
gtgatcatcctggtggtgtggaact

SEQ ID NO: 504975 - DNA, 25 bp, Rattus norvegicus
gtgatcatcctgtcacttgatagaa

SEQ ID NO: 504976 - DNA, 25 bp, Rattus norvegicus
gtgatcatcgatctcctaacagcat

SEQ ID NO: 504977 - DNA, 25 bp, Rattus norvegicus
gtgatcatcgatgtcctaacagcat

SEQ ID NO: 504978 - DNA, 25 bp, Rattus norvegicus
gtgatcatcggcaggatcttgtaaa

SEQ ID NO: 504979 - DNA, 25 bp, Rattus norvegicus
gtgatcatcggctggatcttgtaaa

SEQ ID NO: 504980 - DNA, 25 bp, Rattus norvegicus
gtgatcatctaaaatcctacagtct

SEQ ID NO: 504981 - DNA, 25 bp, Rattus norvegicus
gtgatcatctaatatcctacagtct

SEQ ID NO: 504982 - DNA, 25 bp, Rattus norvegicus
gtgatcatctgacctgtgaactcct

SEQ ID NO: 504983 - DNA, 25 bp, Rattus norvegicus
gtgatcatctgagctgtgaactcct

SEQ ID NO: 504984 - DNA, 25 bp, Rattus norvegicus
gtgatcatcttcaatgcagccagta

SEQ ID NO: 504985 - DNA, 25 bp, Rattus norvegicus
gtgatcatcttctatgcagccagta

SEQ ID NO: 504986 - DNA, 25 bp, Rattus norvegicus
gtgatcatgaacatactgcgccatt

SEQ ID NO: 504987 - DNA, 25 bp, Rattus norvegicus
gtgatcatgaacttactgcgccatt

SEQ ID NO: 504988 - DNA, 25 bp, Rattus norvegicus
gtgatcatgtagatgtgccttattt

SEQ ID NO: 504989 - DNA, 25 bp, Rattus norvegicus
gtgatcatgtagttgtgccttattt

SEQ ID NO: 504990 - DNA, 25 bp, Rattus norvegicus
gtgatcattggcataggtcctgccc

SEQ ID NO: 504991 - DNA, 25 bp, Rattus norvegicus
gtgatcattggcttaggtcctgccc

SEQ ID NO: 504992 - DNA, 25 bp, Rattus norvegicus
gtgatcatttcaaccagaaacccga

SEQ ID NO: 504993 - DNA, 25 bp, Rattus norvegicus
gtgatcatttcatccagaaacccga

SEQ ID NO: 504994 - DNA, 25 bp, Rattus norvegicus
gtgatcatttttacccttaagcaag

SEQ ID NO: 504995 - DNA, 25 bp, Rattus norvegicus
gtgatcattttttcccttaagcaag

SEQ ID NO: 504996 - DNA, 25 bp, Rattus norvegicus
gtgatccaaacacgtcgtcctctga

SEQ ID NO: 504997 - DNA, 25 bp, Rattus norvegicus
gtgatccaaacaggtcgtcctctga

SEQ ID NO: 504998 - DNA, 25 bp, Rattus norvegicus
gtgatccaaagtagtggtctcaggg

SEQ ID NO: 504999 - DNA, 25 bp, Rattus norvegicus
gtgatccaaagttgtggtctcaggg

SEQ ID NO: 505000 - DNA, 25 bp, Rattus norvegicus
gtgatccaataaagcttctccgaga

SEQ ID NO: 505001 - DNA, 25 bp, Rattus norvegicus
gtgatccaataatgcttctccgaga

SEQ ID NO: 505002 - DNA, 25 bp, Rattus norvegicus
gtgatccacaccagagtaacagtta

SEQ ID NO: 505003 - DNA, 25 bp, Rattus norvegicus
gtgatccacacctgagtaacagtta

SEQ ID NO: 505004 - DNA, 25 bp, Rattus norvegicus
gtgatccacactaaggtgactattt

SEQ ID NO: 505005 - DNA, 25 bp, Rattus norvegicus
gtgatccacacttaggtgactattt

SEQ ID NO: 505006 - DNA, 25 bp, Rattus norvegicus
gtgatccacggaattggcttctcat

SEQ ID NO: 505007 - DNA, 25 bp, Rattus norvegicus
gtgatccacggatttggcttctcat

SEQ ID NO: 505008 - DNA, 25 bp, Rattus norvegicus
gtgatccagacccatcccgtggtgg

SEQ ID NO: 505009 - DNA, 25 bp, Rattus norvegicus
gtgatccagaccgatcccgtggtgg

SEQ ID NO: 505010 - DNA, 25 bp, Rattus norvegicus
gtgatccagagaagtcgcccaacaa

SEQ ID NO: 505011 - DNA, 25 bp, Rattus norvegicus
gtgatccagagatgtcgcccaacaa

SEQ ID NO: 505012 - DNA, 25 bp, Rattus norvegicus
gtgatccagcgcaacagtgggagtt

SEQ ID NO: 505013 - DNA, 25 bp, Rattus norvegicus
gtgatccagcgctacagtgggagtt

SEQ ID NO: 505014 - DNA, 25 bp, Rattus norvegicus
gtgatccaggagctggctttttcaa

SEQ ID NO: 505015 - DNA, 25 bp, Rattus norvegicus
gtgatccaggaggtggctttttcaa

SEQ ID NO: 505016 - DNA, 25 bp, Rattus norvegicus
gtgatccagttcaaaaacttgtgtt

SEQ ID NO: 505017 - DNA, 25 bp, Rattus norvegicus
gtgatccagttcaaagctgattttg

SEQ ID NO: 505018 - DNA, 25 bp, Rattus norvegicus
gtgatccagttctaaaacttgtgtt

SEQ ID NO: 505019 - DNA, 25 bp, Rattus norvegicus
gtgatccagttctaagctgattttg

SEQ ID NO: 505020 - DNA, 25 bp, Rattus norvegicus
gtgatccatcccacattttcaatgt

SEQ ID NO: 505021 - DNA, 25 bp, Rattus norvegicus
gtgatccatccctcattttcaatgt

SEQ ID NO: 505022 - DNA, 25 bp, Rattus norvegicus
gtgatccatcttaaggacctgcagc

SEQ ID NO: 505023 - DNA, 25 bp, Rattus norvegicus
gtgatccatctttaggacctgcagc

SEQ ID NO: 505024 - DNA, 25 bp, Rattus norvegicus
gtgatccatttgatgcttccagaaa

SEQ ID NO: 505025 - DNA, 25 bp, Rattus norvegicus
gtgatccatttgttgcttccagaaa

SEQ ID NO: 505026 - DNA, 25 bp, Rattus norvegicus
gtgatcccaataaacccatgagctc

SEQ ID NO: 505027 - DNA, 25 bp, Rattus norvegicus
gtgatcccaatatacccatgagctc

SEQ ID NO: 505028 - DNA, 25 bp, Rattus norvegicus
gtgatcccagcgcttagaggttttg

SEQ ID NO: 505029 - DNA, 25 bp, Rattus norvegicus
gtgatcccagcggttagaggttttg

SEQ ID NO: 505030 - DNA, 25 bp, Rattus norvegicus
gtgatcccagttctgcctatgaaga

SEQ ID NO: 505031 - DNA, 25 bp, Rattus norvegicus
gtgatcccagttgtgcctatgaaga

SEQ ID NO: 505032 - DNA, 25 bp, Rattus norvegicus
gtgatccccaaaagaagtggcccta

SEQ ID NO: 505033 - DNA, 25 bp, Rattus norvegicus
gtgatccccaaatgaagtggcccta

SEQ ID NO: 505034 - DNA, 25 bp, Rattus norvegicus
gtgatccccaatcgttttcaagtta

SEQ ID NO: 505035 - DNA, 25 bp, Rattus norvegicus
gtgatccccaatggttttcaagtta

SEQ ID NO: 505036 - DNA, 25 bp, Rattus norvegicus
gtgatcccgagtccctgtggtgata

SEQ ID NO: 505037 - DNA, 25 bp, Rattus norvegicus
gtgatcccgagtgcctgtggtgata

SEQ ID NO: 505038 - DNA, 25 bp, Rattus norvegicus
gtgatcccgtgaacctgtgatcctg

SEQ ID NO: 505039 - DNA, 25 bp, Rattus norvegicus
gtgatcccgtgatcctgtgatcctg

SEQ ID NO: 505040 - DNA, 25 bp, Rattus norvegicus
gtgatccctaaacgcatttcacctt

SEQ ID NO: 505041 - DNA, 25 bp, Rattus norvegicus
gtgatccctaaaggcatttcacctt

SEQ ID NO: 505042 - DNA, 25 bp, Rattus norvegicus
gtgatccctaccagatgtaccatga

SEQ ID NO: 505043 - DNA, 25 bp, Rattus norvegicus
gtgatccctacctgatgtaccatga

SEQ ID NO: 505044 - DNA, 25 bp, Rattus norvegicus
gtgatccctgaccataaagccattt

SEQ ID NO: 505045 - DNA, 25 bp, Rattus norvegicus
gtgatccctgacgataaagccattt

SEQ ID NO: 505046 - DNA, 25 bp, Rattus norvegicus
gtgatcccttgtcatgtcaactgaa

SEQ ID NO: 505047 - DNA, 25 bp, Rattus norvegicus
gtgatcccttgtgatgtcaactgaa

SEQ ID NO: 505048 - DNA, 25 bp, Rattus norvegicus
gtgatccgggatcctcaaatgaagc

SEQ ID NO: 505049 - DNA, 25 bp, Rattus norvegicus
gtgatccgggatgctcaaatgaagc

SEQ ID NO: 505050 - DNA, 25 bp, Rattus norvegicus
gtgatcctatgacccactggaggta

SEQ ID NO: 505051 - DNA, 25 bp, Rattus norvegicus
gtgatcctatgagccactggaggta

SEQ ID NO: 505052 - DNA, 25 bp, Rattus norvegicus
gtgatcctcagaccttgcaggctct

SEQ ID NO: 505053 - DNA, 25 bp, Rattus norvegicus
gtgatcctcagagcttgcaggctct

SEQ ID NO: 505054 - DNA, 25 bp, Rattus norvegicus
gtgatcctcccaaaagtgtgccaag

SEQ ID NO: 505055 - DNA, 25 bp, Rattus norvegicus
gtgatcctcccataagtgtgccaag

SEQ ID NO: 505056 - DNA, 25 bp, Rattus norvegicus
gtgatcctcttgctaagttggtttt

SEQ ID NO: 505057 - DNA, 25 bp, Rattus norvegicus
gtgatcctcttggtaagttggtttt

SEQ ID NO: 505058 - DNA, 25 bp, Rattus norvegicus
gtgatcctgatgcagccaaagccat

SEQ ID NO: 505059 - DNA, 25 bp, Rattus norvegicus
gtgatcctgatggagccaaagccat

SEQ ID NO: 505060 - DNA, 25 bp, Rattus norvegicus
gtgatcctggagataatgctggcga

SEQ ID NO: 505061 - DNA, 25 bp, Rattus norvegicus
gtgatcctggagttaatgctggcga

SEQ ID NO: 505062 - DNA, 25 bp, Rattus norvegicus
gtgatcctgggccagccgtaaccgc

SEQ ID NO: 505063 - DNA, 25 bp, Rattus norvegicus
gtgatcctgggcgagccgtaaccgc

SEQ ID NO: 505064 - DNA, 25 bp, Rattus norvegicus
gtgatccttaatcagcgcactggga

SEQ ID NO: 505065 - DNA, 25 bp, Rattus norvegicus
gtgatccttaatgagcgcactggga

SEQ ID NO: 505066 - DNA, 25 bp, Rattus norvegicus
gtgatccttcatactttacttatta

SEQ ID NO: 505067 - DNA, 25 bp, Rattus norvegicus
gtgatccttcattctttacttatta

SEQ ID NO: 505068 - DNA, 25 bp, Rattus norvegicus
gtgatccttctacagggtcctgaat

SEQ ID NO: 505069 - DNA, 25 bp, Rattus norvegicus
gtgatccttctagagggtcctgaat

SEQ ID NO: 505070 - DNA, 25 bp, Rattus norvegicus
gtgatccttctgattcaactaccaa

SEQ ID NO: 505071 - DNA, 25 bp, Rattus norvegicus
gtgatccttctgtttcaactaccaa

SEQ ID NO: 505072 - DNA, 25 bp, Rattus norvegicus
gtgatcctttgcctgttgagttaca

SEQ ID NO: 505073 - DNA, 25 bp, Rattus norvegicus
gtgatcctttgcgtgttgagttaca

SEQ ID NO: 505074 - DNA, 25 bp, Rattus norvegicus
gtgatcgaattcctattcttggtat

SEQ ID NO: 505075 - DNA, 25 bp, Rattus norvegicus
gtgatcgaattcgtattcttggtat

SEQ ID NO: 505076 - DNA, 25 bp, Rattus norvegicus
gtgatcgactcacgaattcaggact

SEQ ID NO: 505077 - DNA, 25 bp, Rattus norvegicus
gtgatcgactcaggaattcaggact

SEQ ID NO: 505078 - DNA, 25 bp, Rattus norvegicus
gtgatcgagacaccacgccagctga

SEQ ID NO: 505079 - DNA, 25 bp, Rattus norvegicus
gtgatcgagacagcacgccagctga

SEQ ID NO: 505080 - DNA, 25 bp, Rattus norvegicus
gtgatcgattttataccatttagaa

SEQ ID NO: 505081 - DNA, 25 bp, Rattus norvegicus
gtgatcgattttttaccatttagaa

SEQ ID NO: 505082 - DNA, 25 bp, Rattus norvegicus
gtgatcgccccactacgggcttgat

SEQ ID NO: 505083 - DNA, 25 bp, Rattus norvegicus
gtgatcgccccagtacgggcttgat

SEQ ID NO: 505084 - DNA, 25 bp, Rattus norvegicus
gtgatcgccgatacttaaagttcca

SEQ ID NO: 505085 - DNA, 25 bp, Rattus norvegicus
gtgatcgccgattcttaaagttcca

SEQ ID NO: 505086 - DNA, 25 bp, Rattus norvegicus
gtgatcggaagtaccacactggcct

SEQ ID NO: 505087 - DNA, 25 bp, Rattus norvegicus
gtgatcggaagttccacactggcct

SEQ ID NO: 505088 - DNA, 25 bp, Rattus norvegicus
gtgatcggagaactgaacttgctaa

SEQ ID NO: 505089 - DNA, 25 bp, Rattus norvegicus
gtgatcggagaagtgaacttgctaa

SEQ ID NO: 505090 - DNA, 25 bp, Rattus norvegicus
gtgatcggcatcatagctttggcct

SEQ ID NO: 505091 - DNA, 25 bp, Rattus norvegicus
gtgatcggcatcttagctttggcct

SEQ ID NO: 505092 - DNA, 25 bp, Rattus norvegicus
gtgatcggcctgcatgaggatgacg

SEQ ID NO: 505093 - DNA, 25 bp, Rattus norvegicus
gtgatcggcctggatgaggatgacg

SEQ ID NO: 505094 - DNA, 25 bp, Rattus norvegicus
gtgatcggcggaatttcaaactctt

SEQ ID NO: 505095 - DNA, 25 bp, Rattus norvegicus
gtgatcggcggattttcaaactctt

SEQ ID NO: 505096 - DNA, 25 bp, Rattus norvegicus
gtgatcgtacttcaaaaccagccca

SEQ ID NO: 505097 - DNA, 25 bp, Rattus norvegicus
gtgatcgtacttgaaaaccagccca

SEQ ID NO: 505098 - DNA, 25 bp, Rattus norvegicus
gtgatcgtcagtaccgtgtgttatg

SEQ ID NO: 505099 - DNA, 25 bp, Rattus norvegicus
gtgatcgtcagttccgtgtgttatg

SEQ ID NO: 505100 - DNA, 25 bp, Rattus norvegicus
gtgatcgtggcacatgggtcttcat

SEQ ID NO: 505101 - DNA, 25 bp, Rattus norvegicus
gtgatcgtggcagatgggtcttcat

SEQ ID NO: 505102 - DNA, 25 bp, Rattus norvegicus
gtgatctaagctattctgtggctgt

SEQ ID NO: 505103 - DNA, 25 bp, Rattus norvegicus
gtgatctaagcttttctgtggctgt

SEQ ID NO: 505104 - DNA, 25 bp, Rattus norvegicus
gtgatctaccttacagcagttgtct

SEQ ID NO: 505105 - DNA, 25 bp, Rattus norvegicus
gtgatctacctttcagcagttgtct

SEQ ID NO: 505106 - DNA, 25 bp, Rattus norvegicus
gtgatctactacctagctttcagtg

SEQ ID NO: 505107 - DNA, 25 bp, Rattus norvegicus
gtgatctactacgtagctttcagtg

SEQ ID NO: 505108 - DNA, 25 bp, Rattus norvegicus
gtgatctactctccatgcaacagaa

SEQ ID NO: 505109 - DNA, 25 bp, Rattus norvegicus
gtgatctactctgcatgcaacagaa

SEQ ID NO: 505110 - DNA, 25 bp, Rattus norvegicus
gtgatctagatcactggctgctttc

SEQ ID NO: 505111 - DNA, 25 bp, Rattus norvegicus
gtgatctagatctctggctgctttc

SEQ ID NO: 505112 - DNA, 25 bp, Rattus norvegicus
gtgatctatttgctatttcgtgtac

SEQ ID NO: 505113 - DNA, 25 bp, Rattus norvegicus
gtgatctatttggtatttcgtgtac

SEQ ID NO: 505114 - DNA, 25 bp, Rattus norvegicus
gtgatctcaagtcctcgagactgta

SEQ ID NO: 505115 - DNA, 25 bp, Rattus norvegicus
gtgatctcaagtgctcgagactgta

SEQ ID NO: 505116 - DNA, 25 bp, Rattus norvegicus
gtgatctcacacaagcttgggacaa

SEQ ID NO: 505117 - DNA, 25 bp, Rattus norvegicus
gtgatctcacactagcttgggacaa

SEQ ID NO: 505118 - DNA, 25 bp, Rattus norvegicus
gtgatctcacggcaactgctaacag

SEQ ID NO: 505119 - DNA, 25 bp, Rattus norvegicus
gtgatctcacgggaactgctaacag

SEQ ID NO: 505120 - DNA, 25 bp, Rattus norvegicus
gtgatctcaggaacaaccacatgat

SEQ ID NO: 505121 - DNA, 25 bp, Rattus norvegicus
gtgatctcaggatcaaccacatgat

SEQ ID NO: 505122 - DNA, 25 bp, Rattus norvegicus
gtgatctcatctatttatgtcgctt

SEQ ID NO: 505123 - DNA, 25 bp, Rattus norvegicus
gtgatctcatctttttatgtcgctt

SEQ ID NO: 505124 - DNA, 25 bp, Rattus norvegicus
gtgatctccacgcatgtgactcagt

SEQ ID NO: 505125 - DNA, 25 bp, Rattus norvegicus
gtgatctccacggatgtgactcagt

SEQ ID NO: 505126 - DNA, 25 bp, Rattus norvegicus
gtgatctccagcaatcaaccaattg

SEQ ID NO: 505127 - DNA, 25 bp, Rattus norvegicus
gtgatctccagctatcaaccaattg

SEQ ID NO: 505128 - DNA, 25 bp, Rattus norvegicus
gtgatctcggcccagggttttctca

SEQ ID NO: 505129 - DNA, 25 bp, Rattus norvegicus
gtgatctcggccgagggttttctca

SEQ ID NO: 505130 - DNA, 25 bp, Rattus norvegicus
gtgatctctacaccacctttatcta

SEQ ID NO: 505131 - DNA, 25 bp, Rattus norvegicus
gtgatctctacagcacctttatcta

SEQ ID NO: 505132 - DNA, 25 bp, Rattus norvegicus
gtgatctctcacaaaacaaggcaat

SEQ ID NO: 505133 - DNA, 25 bp, Rattus norvegicus
gtgatctctcactaaacaaggcaat

SEQ ID NO: 505134 - DNA, 25 bp, Rattus norvegicus
gtgatctgatccagtattcagccca

SEQ ID NO: 505135 - DNA, 25 bp, Rattus norvegicus
gtgatctgatcctgtattcagccca

SEQ ID NO: 505136 - DNA, 25 bp, Rattus norvegicus
gtgatctgcacacgtgcaaacgcag

SEQ ID NO: 505137 - DNA, 25 bp, Rattus norvegicus
gtgatctgcacaggtgcaaacgcag

SEQ ID NO: 505138 - DNA, 25 bp, Rattus norvegicus
gtgatctgccaaagaaccaagaact

SEQ ID NO: 505139 - DNA, 25 bp, Rattus norvegicus
gtgatctgccaatgaaccaagaact

SEQ ID NO: 505140 - DNA, 25 bp, Rattus norvegicus
gtgatctgccccatacttataatgg

SEQ ID NO: 505141 - DNA, 25 bp, Rattus norvegicus
gtgatctgccccttacttataatgg

SEQ ID NO: 505142 - DNA, 25 bp, Rattus norvegicus
gtgatctgctctccctgaaggaatg

SEQ ID NO: 505143 - DNA, 25 bp, Rattus norvegicus
gtgatctgctctgcctgaaggaatg

SEQ ID NO: 505144 - DNA, 25 bp, Rattus norvegicus
gtgatctggacccagtcaaggcaaa

SEQ ID NO: 505145 - DNA, 25 bp, Rattus norvegicus
gtgatctggaccgagtcaaggcaaa

SEQ ID NO: 505146 - DNA, 25 bp, Rattus norvegicus
gtgatctggcctaagtattactgtt

SEQ ID NO: 505147 - DNA, 25 bp, Rattus norvegicus
gtgatctggccttagtattactgtt

SEQ ID NO: 505148 - DNA, 25 bp, Rattus norvegicus
gtgatctgtagcaccccagttcttg

SEQ ID NO: 505149 - DNA, 25 bp, Rattus norvegicus
gtgatctgtagctccccagttcttg

SEQ ID NO: 505150 - DNA, 25 bp, Rattus norvegicus
gtgatctgtaggaagcacccagcca

SEQ ID NO: 505151 - DNA, 25 bp, Rattus norvegicus
gtgatctgtaggtagcacccagcca

SEQ ID NO: 505152 - DNA, 25 bp, Rattus norvegicus
gtgatctgtcagcttgggaacttct

SEQ ID NO: 505153 - DNA, 25 bp, Rattus norvegicus
gtgatctgtcaggttgggaacttct

SEQ ID NO: 505154 - DNA, 25 bp, Rattus norvegicus
gtgatctgtttcaccagtatcttca

SEQ ID NO: 505155 - DNA, 25 bp, Rattus norvegicus
gtgatctgtttctccagtatcttca

SEQ ID NO: 505156 - DNA, 25 bp, Rattus norvegicus
gtgatcttaataccagagttcccca

SEQ ID NO: 505157 - DNA, 25 bp, Rattus norvegicus
gtgatcttaatagcagagttcccca

SEQ ID NO: 505158 - DNA, 25 bp, Rattus norvegicus
gtgatcttattgctgctcgtggcta

SEQ ID NO: 505159 - DNA, 25 bp, Rattus norvegicus
gtgatcttattggtgctcgtggcta

SEQ ID NO: 505160 - DNA, 25 bp, Rattus norvegicus
gtgatcttccctatatggccaggtg

SEQ ID NO: 505161 - DNA, 25 bp, Rattus norvegicus
gtgatcttccctttatggccaggtg

SEQ ID NO: 505162 - DNA, 25 bp, Rattus norvegicus
gtgatcttgaatactgtctccaaag

SEQ ID NO: 505163 - DNA, 25 bp, Rattus norvegicus
gtgatcttgaattctgtctccaaag

SEQ ID NO: 505164 - DNA, 25 bp, Rattus norvegicus
gtgatcttgtagattgaagccagca

SEQ ID NO: 505165 - DNA, 25 bp, Rattus norvegicus
gtgatcttgtagcaactgtaactgt

SEQ ID NO: 505166 - DNA, 25 bp, Rattus norvegicus
gtgatcttgtaggaactgtaactgt

SEQ ID NO: 505167 - DNA, 25 bp, Rattus norvegicus
gtgatcttgtagtttgaagccagca

SEQ ID NO: 505168 - DNA, 25 bp, Rattus norvegicus
gtgatgaaacatcgagtgcccctga

SEQ ID NO: 505169 - DNA, 25 bp, Rattus norvegicus
gtgatgaaacatggagtgcccctga

SEQ ID NO: 505170 - DNA, 25 bp, Rattus norvegicus
gtgatgaaccacatgcaccatgaag

SEQ ID NO: 505171 - DNA, 25 bp, Rattus norvegicus
gtgatgaaccacttgcaccatgaag

SEQ ID NO: 505172 - DNA, 25 bp, Rattus norvegicus
gtgatgaacggcacagtctaagtta

SEQ ID NO: 505173 - DNA, 25 bp, Rattus norvegicus
gtgatgaacggctcagtctaagtta

SEQ ID NO: 505174 - DNA, 25 bp, Rattus norvegicus
gtgatgaactttctggtccgctacc

SEQ ID NO: 505175 - DNA, 25 bp, Rattus norvegicus
gtgatgaactttgtggtccgctacc

SEQ ID NO: 505176 - DNA, 25 bp, Rattus norvegicus
gtgatgaaggtaactccctcgctta

SEQ ID NO: 505177 - DNA, 25 bp, Rattus norvegicus
gtgatgaaggtatctccctcgctta

SEQ ID NO: 505178 - DNA, 25 bp, Rattus norvegicus
gtgatgacacacacctgtatttcca

SEQ ID NO: 505179 - DNA, 25 bp, Rattus norvegicus
gtgatgacacactcctgtatttcca

SEQ ID NO: 505180 - DNA, 25 bp, Rattus norvegicus
gtgatgacacagcaacactttctgt

SEQ ID NO: 505181 - DNA, 25 bp, Rattus norvegicus
gtgatgacacaggaacactttctgt

SEQ ID NO: 505182 - DNA, 25 bp, Rattus norvegicus
gtgatgacacatcctatatgccaga

SEQ ID NO: 505183 - DNA, 25 bp, Rattus norvegicus
gtgatgacacatgctatatgccaga

SEQ ID NO: 505184 - DNA, 25 bp, Rattus norvegicus
gtgatgacagttcgtcgcttgccac

SEQ ID NO: 505185 - DNA, 25 bp, Rattus norvegicus
gtgatgacagttggtcgcttgccac

SEQ ID NO: 505186 - DNA, 25 bp, Rattus norvegicus
gtgatgaccacaccctcctcgatgt

SEQ ID NO: 505187 - DNA, 25 bp, Rattus norvegicus
gtgatgaccacagcctcctcgatgt

SEQ ID NO: 505188 - DNA, 25 bp, Rattus norvegicus
gtgatgaccagtccccggaagttgt

SEQ ID NO: 505189 - DNA, 25 bp, Rattus norvegicus
gtgatgaccagtgcccggaagttgt

SEQ ID NO: 505190 - DNA, 25 bp, Rattus norvegicus
gtgatgacctttaacttcctgtttt

SEQ ID NO: 505191 - DNA, 25 bp, Rattus norvegicus
gtgatgaccttttacttcctgtttt

SEQ ID NO: 505192 - DNA, 25 bp, Rattus norvegicus
gtgatgacgcataccgagtcagctt

SEQ ID NO: 505193 - DNA, 25 bp, Rattus norvegicus
gtgatgacgcattccgagtcagctt

SEQ ID NO: 505194 - DNA, 25 bp, Rattus norvegicus
gtgatgacgccacttgttactattg

SEQ ID NO: 505195 - DNA, 25 bp, Rattus norvegicus
gtgatgacgccagttgttactattg

SEQ ID NO: 505196 - DNA, 25 bp, Rattus norvegicus
gtgatgacgttaagcttacctcatt

SEQ ID NO: 505197 - DNA, 25 bp, Rattus norvegicus
gtgatgacgttatgcttacctcatt

SEQ ID NO: 505198 - DNA, 25 bp, Rattus norvegicus
gtgatgactccccaagaacctctgg

SEQ ID NO: 505199 - DNA, 25 bp, Rattus norvegicus
gtgatgactcccgaagaacctctgg

SEQ ID NO: 505200 - DNA, 25 bp, Rattus norvegicus
gtgatgactgacctctacattctag

SEQ ID NO: 505201 - DNA, 25 bp, Rattus norvegicus
gtgatgactgacgtctacattctag

SEQ ID NO: 505202 - DNA, 25 bp, Rattus norvegicus
gtgatgactgtgatgacttcaattt

SEQ ID NO: 505203 - DNA, 25 bp, Rattus norvegicus
gtgatgactgtgttgacttcaattt

SEQ ID NO: 505204 - DNA, 25 bp, Rattus norvegicus
gtgatgacttacaaaatctaccctt

SEQ ID NO: 505205 - DNA, 25 bp, Rattus norvegicus
gtgatgacttactaaatctaccctt

SEQ ID NO: 505206 - DNA, 25 bp, Rattus norvegicus
gtgatgacttctaccagctgtggca

SEQ ID NO: 505207 - DNA, 25 bp, Rattus norvegicus
gtgatgacttcttccagctgtggca

SEQ ID NO: 505208 - DNA, 25 bp, Rattus norvegicus
gtgatgagacacacttctcacctat

SEQ ID NO: 505209 - DNA, 25 bp, Rattus norvegicus
gtgatgagacactcttctcacctat

SEQ ID NO: 505210 - DNA, 25 bp, Rattus norvegicus
gtgatgagagtgacgacagctccag

SEQ ID NO: 505211 - DNA, 25 bp, Rattus norvegicus
gtgatgagagtgtcgacagctccag

SEQ ID NO: 505212 - DNA, 25 bp, Rattus norvegicus
gtgatgagatcaaacttgccagagt

SEQ ID NO: 505213 - DNA, 25 bp, Rattus norvegicus
gtgatgagatcatacttgccagagt

SEQ ID NO: 505214 - DNA, 25 bp, Rattus norvegicus
gtgatgagccttacagtgcatgctg

SEQ ID NO: 505215 - DNA, 25 bp, Rattus norvegicus
gtgatgagcctttcagtgcatgctg

SEQ ID NO: 505216 - DNA, 25 bp, Rattus norvegicus
gtgatgagctgacctgtactcccta

SEQ ID NO: 505217 - DNA, 25 bp, Rattus norvegicus
gtgatgagctgagctgtactcccta

SEQ ID NO: 505218 - DNA, 25 bp, Rattus norvegicus
gtgatgaggatcagccatctggcca

SEQ ID NO: 505219 - DNA, 25 bp, Rattus norvegicus
gtgatgaggatctgccatctggcca

SEQ ID NO: 505220 - DNA, 25 bp, Rattus norvegicus
gtgatgaggttacaggcctgcttca

SEQ ID NO: 505221 - DNA, 25 bp, Rattus norvegicus
gtgatgaggttagaggcctgcttca

SEQ ID NO: 505222 - DNA, 25 bp, Rattus norvegicus
gtgatgatcattaagttgcctcctt

SEQ ID NO: 505223 - DNA, 25 bp, Rattus norvegicus
gtgatgatcatttagttgcctcctt

SEQ ID NO: 505224 - DNA, 25 bp, Rattus norvegicus
gtgatgatcgtacctggcacgctca

SEQ ID NO: 505225 - DNA, 25 bp, Rattus norvegicus
gtgatgatcgtagctggcacgctca

SEQ ID NO: 505226 - DNA, 25 bp, Rattus norvegicus
gtgatgatgacacacacactccagt

SEQ ID NO: 505227 - DNA, 25 bp, Rattus norvegicus
gtgatgatgacagacacactccagt

SEQ ID NO: 505228 - DNA, 25 bp, Rattus norvegicus
gtgatgatgcggcttctgaccctga

SEQ ID NO: 505229 - DNA, 25 bp, Rattus norvegicus
gtgatgatgcgggttctgaccctga

SEQ ID NO: 505230 - DNA, 25 bp, Rattus norvegicus
gtgatgatgtctactgggcctttgc

SEQ ID NO: 505231 - DNA, 25 bp, Rattus norvegicus
gtgatgatgtcttctgggcctttgc

SEQ ID NO: 505232 - DNA, 25 bp, Rattus norvegicus
gtgatgattcagctgcaagtttgca

SEQ ID NO: 505233 - DNA, 25 bp, Rattus norvegicus
gtgatgattcaggtgcaagtttgca

SEQ ID NO: 505234 - DNA, 25 bp, Rattus norvegicus
gtgatgattccacttagtcctaaag

SEQ ID NO: 505235 - DNA, 25 bp, Rattus norvegicus
gtgatgattccagttagtcctaaag

SEQ ID NO: 505236 - DNA, 25 bp, Rattus norvegicus
gtgatgattgcccacccattggtac

SEQ ID NO: 505237 - DNA, 25 bp, Rattus norvegicus
gtgatgattgccgacccattggtac

SEQ ID NO: 505238 - DNA, 25 bp, Rattus norvegicus
gtgatgcaagttctccaaccagcaa

SEQ ID NO: 505239 - DNA, 25 bp, Rattus norvegicus
gtgatgcaagttgtccaaccagcaa

SEQ ID NO: 505240 - DNA, 25 bp, Rattus norvegicus
gtgatgcagagaagcctagcctaat

SEQ ID NO: 505241 - DNA, 25 bp, Rattus norvegicus
gtgatgcagagatgcctagcctaat

SEQ ID NO: 505242 - DNA, 25 bp, Rattus norvegicus
gtgatgcagcaccaagtcttgatga

SEQ ID NO: 505243 - DNA, 25 bp, Rattus norvegicus
gtgatgcagcacgaagtcttgatga

SEQ ID NO: 505244 - DNA, 25 bp, Rattus norvegicus
gtgatgcagctaccaagattccaaa

SEQ ID NO: 505245 - DNA, 25 bp, Rattus norvegicus
gtgatgcagctagcaagattccaaa

SEQ ID NO: 505246 - DNA, 25 bp, Rattus norvegicus
gtgatgcagttaatcctgttccttt

SEQ ID NO: 505247 - DNA, 25 bp, Rattus norvegicus
gtgatgcagttattcctgttccttt

SEQ ID NO: 505248 - DNA, 25 bp, Rattus norvegicus
gtgatgcatgaaccaagcacagtgc

SEQ ID NO: 505249 - DNA, 25 bp, Rattus norvegicus
gtgatgcatgaagcaagcacagtgc

SEQ ID NO: 505250 - DNA, 25 bp, Rattus norvegicus
gtgatgcatttgattgcctcagtag

SEQ ID NO: 505251 - DNA, 25 bp, Rattus norvegicus
gtgatgcatttgtttgcctcagtag

SEQ ID NO: 505252 - DNA, 25 bp, Rattus norvegicus
gtgatgcattttacttctagtcttt

SEQ ID NO: 505253 - DNA, 25 bp, Rattus norvegicus
gtgatgcatttttcttctagtcttt

SEQ ID NO: 505254 - DNA, 25 bp, Rattus norvegicus
gtgatgccacagctgatgacctcat

SEQ ID NO: 505255 - DNA, 25 bp, Rattus norvegicus
gtgatgccacaggtgatgacctcat

SEQ ID NO: 505256 - DNA, 25 bp, Rattus norvegicus
gtgatgccaccgaggaagctttgtt

SEQ ID NO: 505257 - DNA, 25 bp, Rattus norvegicus
gtgatgccaccgtggaagctttgtt

SEQ ID NO: 505258 - DNA, 25 bp, Rattus norvegicus
gtgatgccagtgatgatagcttttc

SEQ ID NO: 505259 - DNA, 25 bp, Rattus norvegicus
gtgatgccagtgttgatagcttttc

SEQ ID NO: 505260 - DNA, 25 bp, Rattus norvegicus
gtgatgccatgcaaagcaggccctg

SEQ ID NO: 505261 - DNA, 25 bp, Rattus norvegicus
gtgatgccatgctaagcaggccctg

SEQ ID NO: 505262 - DNA, 25 bp, Rattus norvegicus
gtgatgcccatgactggaaccagaa

SEQ ID NO: 505263 - DNA, 25 bp, Rattus norvegicus
gtgatgcccatgtctggaaccagaa

SEQ ID NO: 505264 - DNA, 25 bp, Rattus norvegicus
gtgatgccccctcagaggacaattt

SEQ ID NO: 505265 - DNA, 25 bp, Rattus norvegicus
gtgatgccccctgagaggacaattt

SEQ ID NO: 505266 - DNA, 25 bp, Rattus norvegicus
gtgatgccctcacatatcaactatt

SEQ ID NO: 505267 - DNA, 25 bp, Rattus norvegicus
gtgatgccctcagatatcaactatt

SEQ ID NO: 505268 - DNA, 25 bp, Rattus norvegicus
gtgatgccgcagacgtcgccgtaga

SEQ ID NO: 505269 - DNA, 25 bp, Rattus norvegicus
gtgatgccgcagtcgtcgccgtaga

SEQ ID NO: 505270 - DNA, 25 bp, Rattus norvegicus
gtgatgcctcctctgtagccatgga

SEQ ID NO: 505271 - DNA, 25 bp, Rattus norvegicus
gtgatgcctcctgtgtagccatgga

SEQ ID NO: 505272 - DNA, 25 bp, Rattus norvegicus
gtgatgcctggccagattctgtgaa

SEQ ID NO: 505273 - DNA, 25 bp, Rattus norvegicus
gtgatgcctggcgagattctgtgaa

SEQ ID NO: 505274 - DNA, 25 bp, Rattus norvegicus
gtgatgcctgttcagtcagatgctt

SEQ ID NO: 505275 - DNA, 25 bp, Rattus norvegicus
gtgatgcctgttgagtcagatgctt

SEQ ID NO: 505276 - DNA, 25 bp, Rattus norvegicus
gtgatgcgaagccactgccattccc

SEQ ID NO: 505277 - DNA, 25 bp, Rattus norvegicus
gtgatgcgaagcgactgccattccc

SEQ ID NO: 505278 - DNA, 25 bp, Rattus norvegicus
gtgatgcggaacaagaggcctctgt

SEQ ID NO: 505279 - DNA, 25 bp, Rattus norvegicus
gtgatgcggaactagaggcctctgt

SEQ ID NO: 505280 - DNA, 25 bp, Rattus norvegicus
gtgatgctaaatcctggccctggtt

SEQ ID NO: 505281 - DNA, 25 bp, Rattus norvegicus
gtgatgctaaatgctggccctggtt

SEQ ID NO: 505282 - DNA, 25 bp, Rattus norvegicus
gtgatgctagtgaggtgccgacctt

SEQ ID NO: 505283 - DNA, 25 bp, Rattus norvegicus
gtgatgctagtgtggtgccgacctt

SEQ ID NO: 505284 - DNA, 25 bp, Rattus norvegicus
gtgatgctcagaacaagtgtgctct

SEQ ID NO: 505285 - DNA, 25 bp, Rattus norvegicus
gtgatgctcagatcaagtgtgctct

SEQ ID NO: 505286 - DNA, 25 bp, Rattus norvegicus
gtgatgctcagtaaaagtattttta

SEQ ID NO: 505287 - DNA, 25 bp, Rattus norvegicus
gtgatgctcagttaaagtattttta

SEQ ID NO: 505288 - DNA, 25 bp, Rattus norvegicus
gtgatgctcctgctgtgagaaccat

SEQ ID NO: 505289 - DNA, 25 bp, Rattus norvegicus
gtgatgctcctggtgtgagaaccat

SEQ ID NO: 505290 - DNA, 25 bp, Rattus norvegicus
gtgatgctcgatcctgcaacactta

SEQ ID NO: 505291 - DNA, 25 bp, Rattus norvegicus
gtgatgctcgatgctgcaacactta

SEQ ID NO: 505292 - DNA, 25 bp, Rattus norvegicus
gtgatgctgcatctatttcttgggt

SEQ ID NO: 505293 - DNA, 25 bp, Rattus norvegicus
gtgatgctgcatgtatttcttgggt

SEQ ID NO: 505294 - DNA, 25 bp, Rattus norvegicus
gtgatgctggttagactggccgaaa

SEQ ID NO: 505295 - DNA, 25 bp, Rattus norvegicus
gtgatgctggtttgactggccgaaa

SEQ ID NO: 505296 - DNA, 25 bp, Rattus norvegicus
gtgatgctgtatcctggcacaccca

SEQ ID NO: 505297 - DNA, 25 bp, Rattus norvegicus
gtgatgctgtatgctggcacaccca

SEQ ID NO: 505298 - DNA, 25 bp, Rattus norvegicus
gtgatgctgtgtctgtatattctat

SEQ ID NO: 505299 - DNA, 25 bp, Rattus norvegicus
gtgatgctgtgtgtgtatattctat

SEQ ID NO: 505300 - DNA, 25 bp, Rattus norvegicus
gtgatgcttccgacgggagctgcct

SEQ ID NO: 505301 - DNA, 25 bp, Rattus norvegicus
gtgatgcttccgtcgggagctgcct

SEQ ID NO: 505302 - DNA, 25 bp, Rattus norvegicus
gtgatgcttgtgacctgactctgtc

SEQ ID NO: 505303 - DNA, 25 bp, Rattus norvegicus
gtgatgcttgtgtcctgactctgtc

SEQ ID NO: 505304 - DNA, 25 bp, Rattus norvegicus
gtgatgcttttcaacaaagtccact

SEQ ID NO: 505305 - DNA, 25 bp, Rattus norvegicus
gtgatgcttttctacaaagtccact

SEQ ID NO: 505306 - DNA, 25 bp, Rattus norvegicus
gtgatgctttttacacagccaggaa

SEQ ID NO: 505307 - DNA, 25 bp, Rattus norvegicus
gtgatgcttttttcacagccaggaa

SEQ ID NO: 505308 - DNA, 25 bp, Rattus norvegicus
gtgatggaaagactcccgctccaaa

SEQ ID NO: 505309 - DNA, 25 bp, Rattus norvegicus
gtgatggaaagagtcccgctccaaa

SEQ ID NO: 505310 - DNA, 25 bp, Rattus norvegicus
gtgatggacaatacttcccagagta

SEQ ID NO: 505311 - DNA, 25 bp, Rattus norvegicus
gtgatggacaattcttcccagagta

SEQ ID NO: 505312 - DNA, 25 bp, Rattus norvegicus
gtgatggaccttcgtatcaatatcc

SEQ ID NO: 505313 - DNA, 25 bp, Rattus norvegicus
gtgatggaccttggtatcaatatcc

SEQ ID NO: 505314 - DNA, 25 bp, Rattus norvegicus
gtgatggactttcttcccaacactt

SEQ ID NO: 505315 - DNA, 25 bp, Rattus norvegicus
gtgatggactttgttcccaacactt

SEQ ID NO: 505316 - DNA, 25 bp, Rattus norvegicus
gtgatggagaccctcattcttcaag

SEQ ID NO: 505317 - DNA, 25 bp, Rattus norvegicus
gtgatggagaccgtcattcttcaag

SEQ ID NO: 505318 - DNA, 25 bp, Rattus norvegicus
gtgatggagagaagcccctgtactg

SEQ ID NO: 505319 - DNA, 25 bp, Rattus norvegicus
gtgatggagagatgcccctgtactg

SEQ ID NO: 505320 - DNA, 25 bp, Rattus norvegicus
gtgatggagcaccagaccaatcagt

SEQ ID NO: 505321 - DNA, 25 bp, Rattus norvegicus
gtgatggagcacgagaccaatcagt

SEQ ID NO: 505322 - DNA, 25 bp, Rattus norvegicus
gtgatggagcctctgctgtaaagca

SEQ ID NO: 505323 - DNA, 25 bp, Rattus norvegicus
gtgatggagcctgtgctgtaaagca

SEQ ID NO: 505324 - DNA, 25 bp, Rattus norvegicus
gtgatggagtccaggcctacaaagt

SEQ ID NO: 505325 - DNA, 25 bp, Rattus norvegicus
gtgatggagtcctggcctacaaagt

SEQ ID NO: 505326 - DNA, 25 bp, Rattus norvegicus
gtgatggcaaacagccgtgccgctc

SEQ ID NO: 505327 - DNA, 25 bp, Rattus norvegicus
gtgatggcaaactgccgtgccgctc

SEQ ID NO: 505328 - DNA, 25 bp, Rattus norvegicus
gtgatggcaccacaaaagagttttt

SEQ ID NO: 505329 - DNA, 25 bp, Rattus norvegicus
gtgatggcaccagaaaagagttttt

SEQ ID NO: 505330 - DNA, 25 bp, Rattus norvegicus
gtgatggcacggatgctcaggaaac

SEQ ID NO: 505331 - DNA, 25 bp, Rattus norvegicus
gtgatggcacggttgctcaggaaac

SEQ ID NO: 505332 - DNA, 25 bp, Rattus norvegicus
gtgatggcaggacccctttacccct

SEQ ID NO: 505333 - DNA, 25 bp, Rattus norvegicus
gtgatggcaggagccctttacccct

SEQ ID NO: 505334 - DNA, 25 bp, Rattus norvegicus
gtgatggccaaaaagtacttgactt

SEQ ID NO: 505335 - DNA, 25 bp, Rattus norvegicus
gtgatggccaaatagtacttgactt

SEQ ID NO: 505336 - DNA, 25 bp, Rattus norvegicus
gtgatggccaagagcatccctgtgc

SEQ ID NO: 505337 - DNA, 25 bp, Rattus norvegicus
gtgatggccaagtgcatccctgtgc

SEQ ID NO: 505338 - DNA, 25 bp, Rattus norvegicus
gtgatggcctccattgataggtttc

SEQ ID NO: 505339 - DNA, 25 bp, Rattus norvegicus
gtgatggcctcctttgataggtttc

SEQ ID NO: 505340 - DNA, 25 bp, Rattus norvegicus
gtgatggcgacacaggatcctacga

SEQ ID NO: 505341 - DNA, 25 bp, Rattus norvegicus
gtgatggcgacagaggatcctacga

SEQ ID NO: 505342 - DNA, 25 bp, Rattus norvegicus
gtgatggctaggctgaagacaaaca

SEQ ID NO: 505343 - DNA, 25 bp, Rattus norvegicus
gtgatggctagggtgaagacaaaca

SEQ ID NO: 505344 - DNA, 25 bp, Rattus norvegicus
gtgatggctgcaaactccaggctag

SEQ ID NO: 505345 - DNA, 25 bp, Rattus norvegicus
gtgatggctgcatactccaggctag

SEQ ID NO: 505346 - DNA, 25 bp, Rattus norvegicus
gtgatggctggcatagcactgaact

SEQ ID NO: 505347 - DNA, 25 bp, Rattus norvegicus
gtgatggctggcttagcactgaact

SEQ ID NO: 505348 - DNA, 25 bp, Rattus norvegicus
gtgatgggagccctgacagcccttt

SEQ ID NO: 505349 - DNA, 25 bp, Rattus norvegicus
gtgatgggagccgtgacagcccttt

SEQ ID NO: 505350 - DNA, 25 bp, Rattus norvegicus
gtgatgggatatcaacctgtgtctc

SEQ ID NO: 505351 - DNA, 25 bp, Rattus norvegicus
gtgatgggatatgaacctgtgtctc

SEQ ID NO: 505352 - DNA, 25 bp, Rattus norvegicus
gtgatgggcattcaaccccttcagg

SEQ ID NO: 505353 - DNA, 25 bp, Rattus norvegicus
gtgatgggcattgaaccccttcagg

SEQ ID NO: 505354 - DNA, 25 bp, Rattus norvegicus
gtgatgggtccaagctatgtatgtg

SEQ ID NO: 505355 - DNA, 25 bp, Rattus norvegicus
gtgatgggtccatgctatgtatgtg

SEQ ID NO: 505356 - DNA, 25 bp, Rattus norvegicus
gtgatggtcatcctagctggcagac

SEQ ID NO: 505357 - DNA, 25 bp, Rattus norvegicus
gtgatggtcatcgtagctggcagac

SEQ ID NO: 505358 - DNA, 25 bp, Rattus norvegicus
gtgatggtccagctcagttgataat

SEQ ID NO: 505359 - DNA, 25 bp, Rattus norvegicus
gtgatggtccaggtcagttgataat

SEQ ID NO: 505360 - DNA, 25 bp, Rattus norvegicus
gtgatggtcccaccaagtaaagaaa

SEQ ID NO: 505361 - DNA, 25 bp, Rattus norvegicus
gtgatggtcccaccagcactgagaa

SEQ ID NO: 505362 - DNA, 25 bp, Rattus norvegicus
gtgatggtcccagcaagtaaagaaa

SEQ ID NO: 505363 - DNA, 25 bp, Rattus norvegicus
gtgatggtcccagcagcactgagaa

SEQ ID NO: 505364 - DNA, 25 bp, Rattus norvegicus
gtgatggtccccaatgtcattggct

SEQ ID NO: 505365 - DNA, 25 bp, Rattus norvegicus
gtgatggtcccctatgtcattggct

SEQ ID NO: 505366 - DNA, 25 bp, Rattus norvegicus
gtgatggtccttacctaggacacat

SEQ ID NO: 505367 - DNA, 25 bp, Rattus norvegicus
gtgatggtcctttcctaggacacat

SEQ ID NO: 505368 - DNA, 25 bp, Rattus norvegicus
gtgatggtgtgcagctcccgttcga

SEQ ID NO: 505369 - DNA, 25 bp, Rattus norvegicus
gtgatggtgtgctgctcccgttcga

SEQ ID NO: 505370 - DNA, 25 bp, Rattus norvegicus
gtgatgtaatctaaaccctctgtaa

SEQ ID NO: 505371 - DNA, 25 bp, Rattus norvegicus
gtgatgtaatcttaaccctctgtaa

SEQ ID NO: 505372 - DNA, 25 bp, Rattus norvegicus
gtgatgtacaagcagatgactccag

SEQ ID NO: 505373 - DNA, 25 bp, Rattus norvegicus
gtgatgtacaaggagatgactccag

SEQ ID NO: 505374 - DNA, 25 bp, Rattus norvegicus
gtgatgtacagtctaaacctcctta

SEQ ID NO: 505375 - DNA, 25 bp, Rattus norvegicus
gtgatgtacagtgtaaacctcctta

SEQ ID NO: 505376 - DNA, 25 bp, Rattus norvegicus
gtgatgtaccctacctatcaaggag

SEQ ID NO: 505377 - DNA, 25 bp, Rattus norvegicus
gtgatgtacccttcctatcaaggag

SEQ ID NO: 505378 - DNA, 25 bp, Rattus norvegicus
gtgatgtacgcacacatgctcatgt

SEQ ID NO: 505379 - DNA, 25 bp, Rattus norvegicus
gtgatgtacgcagacatgctcatgt

SEQ ID NO: 505380 - DNA, 25 bp, Rattus norvegicus
gtgatgtagccaagtttgctgacat

SEQ ID NO: 505381 - DNA, 25 bp, Rattus norvegicus
gtgatgtagccatgtttgctgacat

SEQ ID NO: 505382 - DNA, 25 bp, Rattus norvegicus
gtgatgtagctgaaactggtcccct

SEQ ID NO: 505383 - DNA, 25 bp, Rattus norvegicus
gtgatgtagctgtaactggtcccct

SEQ ID NO: 505384 - DNA, 25 bp, Rattus norvegicus
gtgatgtagtcactgttgtccctca

SEQ ID NO: 505385 - DNA, 25 bp, Rattus norvegicus
gtgatgtagtcagtgttgtccctca

SEQ ID NO: 505386 - DNA, 25 bp, Rattus norvegicus
gtgatgtatgatagccaaggccgcc

SEQ ID NO: 505387 - DNA, 25 bp, Rattus norvegicus
gtgatgtatgattgccaaggccgcc

SEQ ID NO: 505388 - DNA, 25 bp, Rattus norvegicus
gtgatgtatgcactggtgaccccaa

SEQ ID NO: 505389 - DNA, 25 bp, Rattus norvegicus
gtgatgtatgcagtggtgaccccaa

SEQ ID NO: 505390 - DNA, 25 bp, Rattus norvegicus
gtgatgtcaactacaagcagcaggc

SEQ ID NO: 505391 - DNA, 25 bp, Rattus norvegicus
gtgatgtcaacttcaagcagcaggc

SEQ ID NO: 505392 - DNA, 25 bp, Rattus norvegicus
gtgatgtcactaaggcaaccagcgt

SEQ ID NO: 505393 - DNA, 25 bp, Rattus norvegicus
gtgatgtcactatggcaaccagcgt

SEQ ID NO: 505394 - DNA, 25 bp, Rattus norvegicus
gtgatgtcatatctttataaggaga

SEQ ID NO: 505395 - DNA, 25 bp, Rattus norvegicus
gtgatgtcatatgtttataaggaga

SEQ ID NO: 505396 - DNA, 25 bp, Rattus norvegicus
gtgatgtcatccctccaggaacagg

SEQ ID NO: 505397 - DNA, 25 bp, Rattus norvegicus
gtgatgtcatccgtccaggaacagg

SEQ ID NO: 505398 - DNA, 25 bp, Rattus norvegicus
gtgatgtccacaccttgtgtcagtg

SEQ ID NO: 505399 - DNA, 25 bp, Rattus norvegicus
gtgatgtccacagcttgtgtcagtg

SEQ ID NO: 505400 - DNA, 25 bp, Rattus norvegicus
gtgatgtccagcatgtgtttagtaa

SEQ ID NO: 505401 - DNA, 25 bp, Rattus norvegicus
gtgatgtccagcttgtgtttagtaa

SEQ ID NO: 505402 - DNA, 25 bp, Rattus norvegicus
gtgatgtcccgactaactgtgccat

SEQ ID NO: 505403 - DNA, 25 bp, Rattus norvegicus
gtgatgtcccgagtaactgtgccat

SEQ ID NO: 505404 - DNA, 25 bp, Rattus norvegicus
gtgatgtcctgtcagtaagagccca

SEQ ID NO: 505405 - DNA, 25 bp, Rattus norvegicus
gtgatgtcctgtgagtaagagccca

SEQ ID NO: 505406 - DNA, 25 bp, Rattus norvegicus
gtgatgtctcatatttagccatgtt

SEQ ID NO: 505407 - DNA, 25 bp, Rattus norvegicus
gtgatgtctcatttttagccatgtt

SEQ ID NO: 505408 - DNA, 25 bp, Rattus norvegicus
gtgatgtctctcacatatgcaaaga

SEQ ID NO: 505409 - DNA, 25 bp, Rattus norvegicus
gtgatgtctctctcatatgcaaaga

SEQ ID NO: 505410 - DNA, 25 bp, Rattus norvegicus
gtgatgtctggcatgtttgggatat

SEQ ID NO: 505411 - DNA, 25 bp, Rattus norvegicus
gtgatgtctggcttgtttgggatat

SEQ ID NO: 505412 - DNA, 25 bp, Rattus norvegicus
gtgatgtcttcaaggttctttctcc

SEQ ID NO: 505413 - DNA, 25 bp, Rattus norvegicus
gtgatgtcttcatggttctttctcc

SEQ ID NO: 505414 - DNA, 25 bp, Rattus norvegicus
gtgatgtgaactaacttctgttgct

SEQ ID NO: 505415 - DNA, 25 bp, Rattus norvegicus
gtgatgtgaacttacttctgttgct

SEQ ID NO: 505416 - DNA, 25 bp, Rattus norvegicus
gtgatgtgacatatcccaggtggtg

SEQ ID NO: 505417 - DNA, 25 bp, Rattus norvegicus
gtgatgtgacatttcccaggtggtg

SEQ ID NO: 505418 - DNA, 25 bp, Rattus norvegicus
gtgatgtgactcagcacagtcatga

SEQ ID NO: 505419 - DNA, 25 bp, Rattus norvegicus
gtgatgtgactctgcacagtcatga

SEQ ID NO: 505420 - DNA, 25 bp, Rattus norvegicus
gtgatgtgacttatttctttgtaca

SEQ ID NO: 505421 - DNA, 25 bp, Rattus norvegicus
gtgatgtgacttttttctttgtaca

SEQ ID NO: 505422 - DNA, 25 bp, Rattus norvegicus
gtgatgtgatgtatcgttccaagtt

SEQ ID NO: 505423 - DNA, 25 bp, Rattus norvegicus
gtgatgtgatgtttcgttccaagtt

SEQ ID NO: 505424 - DNA, 25 bp, Rattus norvegicus
gtgatgtgatttaaccgtactgtgg

SEQ ID NO: 505425 - DNA, 25 bp, Rattus norvegicus
gtgatgtgattttaccgtactgtgg

SEQ ID NO: 505426 - DNA, 25 bp, Rattus norvegicus
gtgatgtgccctcaaggttcccaga

SEQ ID NO: 505427 - DNA, 25 bp, Rattus norvegicus
gtgatgtgccctgaaggttcccaga

SEQ ID NO: 505428 - DNA, 25 bp, Rattus norvegicus
gtgatgtgctaactcgtgcgagctt

SEQ ID NO: 505429 - DNA, 25 bp, Rattus norvegicus
gtgatgtgctaagtcgtgcgagctt

SEQ ID NO: 505430 - DNA, 25 bp, Rattus norvegicus
gtgatgtggactacaacactctgtt

SEQ ID NO: 505431 - DNA, 25 bp, Rattus norvegicus
gtgatgtggacttcaacactctgtt

SEQ ID NO: 505432 - DNA, 25 bp, Rattus norvegicus
gtgatgtggagcacgatgacctaga

SEQ ID NO: 505433 - DNA, 25 bp, Rattus norvegicus
gtgatgtggagctcgatgacctaga

SEQ ID NO: 505434 - DNA, 25 bp, Rattus norvegicus
gtgatgtggcttctgaccataccct

SEQ ID NO: 505435 - DNA, 25 bp, Rattus norvegicus
gtgatgtggcttgtgaccataccct

SEQ ID NO: 505436 - DNA, 25 bp, Rattus norvegicus
gtgatgtgggtcaatagcggtcccc

SEQ ID NO: 505437 - DNA, 25 bp, Rattus norvegicus
gtgatgtgggtctatagcggtcccc

SEQ ID NO: 505438 - DNA, 25 bp, Rattus norvegicus
gtgatgtggttgatgttgcttttat

SEQ ID NO: 505439 - DNA, 25 bp, Rattus norvegicus
gtgatgtggttgttgttgcttttat

SEQ ID NO: 505440 - DNA, 25 bp, Rattus norvegicus
gtgatgttgacaatttggcttttat

SEQ ID NO: 505441 - DNA, 25 bp, Rattus norvegicus
gtgatgttgacattttggcttttat

SEQ ID NO: 505442 - DNA, 25 bp, Rattus norvegicus
gtgatgttgaccacagcagcgttgc

SEQ ID NO: 505443 - DNA, 25 bp, Rattus norvegicus
gtgatgttgacctcagcagcgttgc

SEQ ID NO: 505444 - DNA, 25 bp, Rattus norvegicus
gtgatgttggcgatcaaacccttgt

SEQ ID NO: 505445 - DNA, 25 bp, Rattus norvegicus
gtgatgttggcgttcaaacccttgt

SEQ ID NO: 505446 - DNA, 25 bp, Rattus norvegicus
gtgatgttgtggaccaatcctggaa

SEQ ID NO: 505447 - DNA, 25 bp, Rattus norvegicus
gtgatgttgtggtccaatcctggaa

SEQ ID NO: 505448 - DNA, 25 bp, Rattus norvegicus
gtgatgttttatatgatgcccctga

SEQ ID NO: 505449 - DNA, 25 bp, Rattus norvegicus
gtgatgttttatttgatgcccctga

SEQ ID NO: 505450 - DNA, 25 bp, Rattus norvegicus
gtgatgttttcaacctgaggcttct

SEQ ID NO: 505451 - DNA, 25 bp, Rattus norvegicus
gtgatgttttcatcctgaggcttct

SEQ ID NO: 505452 - DNA, 25 bp, Rattus norvegicus
gtgatgtttttcatgccatttggaa

SEQ ID NO: 505453 - DNA, 25 bp, Rattus norvegicus
gtgatgtttttcttgccatttggaa

SEQ ID NO: 505454 - DNA, 25 bp, Rattus norvegicus
gtgattacacacaacagaccaacag

SEQ ID NO: 505455 - DNA, 25 bp, Rattus norvegicus
gtgattacacactacagaccaacag

SEQ ID NO: 505456 - DNA, 25 bp, Rattus norvegicus
gtgattacaggaagaccaggcccaa

SEQ ID NO: 505457 - DNA, 25 bp, Rattus norvegicus
gtgattacaggatgaccaggcccaa

SEQ ID NO: 505458 - DNA, 25 bp, Rattus norvegicus
gtgattacaggcagtttcgaaccaa

SEQ ID NO: 505459 - DNA, 25 bp, Rattus norvegicus
gtgattacaggctgtttcgaaccaa

SEQ ID NO: 505460 - DNA, 25 bp, Rattus norvegicus
gtgattacatatccacactagctgt

SEQ ID NO: 505461 - DNA, 25 bp, Rattus norvegicus
gtgattacatatgcacactagctgt

SEQ ID NO: 505462 - DNA, 25 bp, Rattus norvegicus
gtgattaccacgcttcaatgtttcc

SEQ ID NO: 505463 - DNA, 25 bp, Rattus norvegicus
gtgattaccacggttcaatgtttcc

SEQ ID NO: 505464 - DNA, 25 bp, Rattus norvegicus
gtgattacccacaggtgttgctgtg

SEQ ID NO: 505465 - DNA, 25 bp, Rattus norvegicus
gtgattacccactggtgttgctgtg

SEQ ID NO: 505466 - DNA, 25 bp, Rattus norvegicus
gtgattacctcgacttaagggccaa

SEQ ID NO: 505467 - DNA, 25 bp, Rattus norvegicus
gtgattacctcgtcttaagggccaa

SEQ ID NO: 505468 - DNA, 25 bp, Rattus norvegicus
gtgattaccttactgaagcctatgt

SEQ ID NO: 505469 - DNA, 25 bp, Rattus norvegicus
gtgattaccttagtgaagcctatgt

SEQ ID NO: 505470 - DNA, 25 bp, Rattus norvegicus
gtgattacctttcacaactggcgct

SEQ ID NO: 505471 - DNA, 25 bp, Rattus norvegicus
gtgattacctttgacaactggcgct

SEQ ID NO: 505472 - DNA, 25 bp, Rattus norvegicus
gtgattactactcttcatgagctac

SEQ ID NO: 505473 - DNA, 25 bp, Rattus norvegicus
gtgattactactgttcatgagctac

SEQ ID NO: 505474 - DNA, 25 bp, Rattus norvegicus
gtgattactattactactttacaaa

SEQ ID NO: 505475 - DNA, 25 bp, Rattus norvegicus
gtgattactatttctactttacaaa

SEQ ID NO: 505476 - DNA, 25 bp, Rattus norvegicus
gtgattactccacatctgcctattt

SEQ ID NO: 505477 - DNA, 25 bp, Rattus norvegicus
gtgattactccagatctgcctattt

SEQ ID NO: 505478 - DNA, 25 bp, Rattus norvegicus
gtgattacttaactctctacctaca

SEQ ID NO: 505479 - DNA, 25 bp, Rattus norvegicus
gtgattacttaagtctctacctaca

SEQ ID NO: 505480 - DNA, 25 bp, Rattus norvegicus
gtgattacttatctgtcatccacct

SEQ ID NO: 505481 - DNA, 25 bp, Rattus norvegicus
gtgattacttatgtgtcatccacct

SEQ ID NO: 505482 - DNA, 25 bp, Rattus norvegicus
gtgattagcacgctgtccaagtgaa

SEQ ID NO: 505483 - DNA, 25 bp, Rattus norvegicus
gtgattagcacggtgtccaagtgaa

SEQ ID NO: 505484 - DNA, 25 bp, Rattus norvegicus
gtgattagtgtgcagttaaatcccc

SEQ ID NO: 505485 - DNA, 25 bp, Rattus norvegicus
gtgattagtgtggagttaaatcccc

SEQ ID NO: 505486 - DNA, 25 bp, Rattus norvegicus
gtgattagttctcatcctagcactg

SEQ ID NO: 505487 - DNA, 25 bp, Rattus norvegicus
gtgattagttctgatcctagcactg

SEQ ID NO: 505488 - DNA, 25 bp, Rattus norvegicus
gtgattatatgtctcccaatgtgaa

SEQ ID NO: 505489 - DNA, 25 bp, Rattus norvegicus
gtgattatatgtgtcccaatgtgaa

SEQ ID NO: 505490 - DNA, 25 bp, Rattus norvegicus
gtgattatgaagaggctcctcctga

SEQ ID NO: 505491 - DNA, 25 bp, Rattus norvegicus
gtgattatgaagtggctcctcctga

SEQ ID NO: 505492 - DNA, 25 bp, Rattus norvegicus
gtgattatgattcccttttctttaa

SEQ ID NO: 505493 - DNA, 25 bp, Rattus norvegicus
gtgattatgattgccttttctttaa

SEQ ID NO: 505494 - DNA, 25 bp, Rattus norvegicus
gtgattattgacctctgttgcattt

SEQ ID NO: 505495 - DNA, 25 bp, Rattus norvegicus
gtgattattgacgtctgttgcattt

SEQ ID NO: 505496 - DNA, 25 bp, Rattus norvegicus
gtgattatttgcatgaccagactgg

SEQ ID NO: 505497 - DNA, 25 bp, Rattus norvegicus
gtgattatttgcttgaccagactgg

SEQ ID NO: 505498 - DNA, 25 bp, Rattus norvegicus
gtgattattttacccgctcaccagt

SEQ ID NO: 505499 - DNA, 25 bp, Rattus norvegicus
gtgattattttagccgctcaccagt

SEQ ID NO: 505500 - DNA, 25 bp, Rattus norvegicus
gtgattatttttcctgtaccctggg

SEQ ID NO: 505501 - DNA, 25 bp, Rattus norvegicus
gtgattatttttgctgtaccctggg

SEQ ID NO: 505502 - DNA, 25 bp, Rattus norvegicus
gtgattcaaggaagcttcatgtcta

SEQ ID NO: 505503 - DNA, 25 bp, Rattus norvegicus
gtgattcaaggatgcttcatgtcta

SEQ ID NO: 505504 - DNA, 25 bp, Rattus norvegicus
gtgattcaccccaactcaaacgact

SEQ ID NO: 505505 - DNA, 25 bp, Rattus norvegicus
gtgattcacccctactcaaacgact

SEQ ID NO: 505506 - DNA, 25 bp, Rattus norvegicus
gtgattcaccttatatcctgggcac

SEQ ID NO: 505507 - DNA, 25 bp, Rattus norvegicus
gtgattcaccttttatcctgggcac

SEQ ID NO: 505508 - DNA, 25 bp, Rattus norvegicus
gtgattcactgtaatgaacattcgt

SEQ ID NO: 505509 - DNA, 25 bp, Rattus norvegicus
gtgattcactgttatgaacattcgt

SEQ ID NO: 505510 - DNA, 25 bp, Rattus norvegicus
gtgattcagtatctcaaccctgcct

SEQ ID NO: 505511 - DNA, 25 bp, Rattus norvegicus
gtgattcagtatgtcaaccctgcct

SEQ ID NO: 505512 - DNA, 25 bp, Rattus norvegicus
gtgattcagtgcatgcctctagcag

SEQ ID NO: 505513 - DNA, 25 bp, Rattus norvegicus
gtgattcagtgcttgcctctagcag

SEQ ID NO: 505514 - DNA, 25 bp, Rattus norvegicus
gtgattcataaacacctggctgcta

SEQ ID NO: 505515 - DNA, 25 bp, Rattus norvegicus
gtgattcataaagacctggctgcta

SEQ ID NO: 505516 - DNA, 25 bp, Rattus norvegicus
gtgattcatacgagaccggtcagtg

SEQ ID NO: 505517 - DNA, 25 bp, Rattus norvegicus
gtgattcatacgtgaccggtcagtg

SEQ ID NO: 505518 - DNA, 25 bp, Rattus norvegicus
gtgattcatgcacgatgctccactt

SEQ ID NO: 505519 - DNA, 25 bp, Rattus norvegicus
gtgattcatgcaggatgctccactt

SEQ ID NO: 505520 - DNA, 25 bp, Rattus norvegicus
gtgattcattgccttaagactttct

SEQ ID NO: 505521 - DNA, 25 bp, Rattus norvegicus
gtgattcattgcgttaagactttct

SEQ ID NO: 505522 - DNA, 25 bp, Rattus norvegicus
gtgattcatttcagcaatcccagca

SEQ ID NO: 505523 - DNA, 25 bp, Rattus norvegicus
gtgattcatttctgcaatcccagca

SEQ ID NO: 505524 - DNA, 25 bp, Rattus norvegicus
gtgattccaaacacctgctacaggg

SEQ ID NO: 505525 - DNA, 25 bp, Rattus norvegicus
gtgattccaaactcctgctacaggg

SEQ ID NO: 505526 - DNA, 25 bp, Rattus norvegicus
gtgattccaattacctatgcaaccc

SEQ ID NO: 505527 - DNA, 25 bp, Rattus norvegicus
gtgattccaattctttgtaactgtc

SEQ ID NO: 505528 - DNA, 25 bp, Rattus norvegicus
gtgattccaattgtttgtaactgtc

SEQ ID NO: 505529 - DNA, 25 bp, Rattus norvegicus
gtgattccaatttcctatgcaaccc

SEQ ID NO: 505530 - DNA, 25 bp, Rattus norvegicus
gtgattccagagctcctggattccc

SEQ ID NO: 505531 - DNA, 25 bp, Rattus norvegicus
gtgattccagaggtcctggattccc

SEQ ID NO: 505532 - DNA, 25 bp, Rattus norvegicus
gtgattccagtgcactttattgctt

SEQ ID NO: 505533 - DNA, 25 bp, Rattus norvegicus
gtgattccagtggactttattgctt

SEQ ID NO: 505534 - DNA, 25 bp, Rattus norvegicus
gtgattccatagcttttgcatcctt

SEQ ID NO: 505535 - DNA, 25 bp, Rattus norvegicus
gtgattccataggttttgcatcctt

SEQ ID NO: 505536 - DNA, 25 bp, Rattus norvegicus
gtgattccgtaacagctgattgaga

SEQ ID NO: 505537 - DNA, 25 bp, Rattus norvegicus
gtgattccgtaagagctgattgaga

SEQ ID NO: 505538 - DNA, 25 bp, Rattus norvegicus
gtgattcctaaaccccgtatctctt

SEQ ID NO: 505539 - DNA, 25 bp, Rattus norvegicus
gtgattcctaaagcccgtatctctt

SEQ ID NO: 505540 - DNA, 25 bp, Rattus norvegicus
gtgattcctacaccagttcaagccg

SEQ ID NO: 505541 - DNA, 25 bp, Rattus norvegicus
gtgattcctacagcagttcaagccg

SEQ ID NO: 505542 - DNA, 25 bp, Rattus norvegicus
gtgattcctcgtcaaaaatgccaat

SEQ ID NO: 505543 - DNA, 25 bp, Rattus norvegicus
gtgattcctcgtgaaaaatgccaat

SEQ ID NO: 505544 - DNA, 25 bp, Rattus norvegicus
gtgattcctttgatttacgacacag

SEQ ID NO: 505545 - DNA, 25 bp, Rattus norvegicus
gtgattcctttgttttacgacacag

SEQ ID NO: 505546 - DNA, 25 bp, Rattus norvegicus
gtgattcgtttcataaaagtctgac

SEQ ID NO: 505547 - DNA, 25 bp, Rattus norvegicus
gtgattcgtttcttaaaagtctgac

SEQ ID NO: 505548 - DNA, 25 bp, Rattus norvegicus
gtgattctacatctcattcctacca

SEQ ID NO: 505549 - DNA, 25 bp, Rattus norvegicus
gtgattctacatgtcattcctacca

SEQ ID NO: 505550 - DNA, 25 bp, Rattus norvegicus
gtgattctcaggaagcagccttcat

SEQ ID NO: 505551 - DNA, 25 bp, Rattus norvegicus
gtgattctcaggagaccactggttt

SEQ ID NO: 505552 - DNA, 25 bp, Rattus norvegicus
gtgattctcaggtagcagccttcat

SEQ ID NO: 505553 - DNA, 25 bp, Rattus norvegicus
gtgattctcaggtgaccactggttt

SEQ ID NO: 505554 - DNA, 25 bp, Rattus norvegicus
gtgattctcatcctttacctgttat

SEQ ID NO: 505555 - DNA, 25 bp, Rattus norvegicus
gtgattctcatcgtttacctgttat

SEQ ID NO: 505556 - DNA, 25 bp, Rattus norvegicus
gtgattctcgatctggtccgcgcct

SEQ ID NO: 505557 - DNA, 25 bp, Rattus norvegicus
gtgattctcgatgtggtccgcgcct

SEQ ID NO: 505558 - DNA, 25 bp, Rattus norvegicus
gtgattctcgtaactgttttcttga

SEQ ID NO: 505559 - DNA, 25 bp, Rattus norvegicus
gtgattctcgtatctgttttcttga

SEQ ID NO: 505560 - DNA, 25 bp, Rattus norvegicus
gtgattctctgcaaggcctaagatt

SEQ ID NO: 505561 - DNA, 25 bp, Rattus norvegicus
gtgattctctgctaggcctaagatt

SEQ ID NO: 505562 - DNA, 25 bp, Rattus norvegicus
gtgattctcttgaacagctcaatgt

SEQ ID NO: 505563 - DNA, 25 bp, Rattus norvegicus
gtgattctcttgtacagctcaatgt

SEQ ID NO: 505564 - DNA, 25 bp, Rattus norvegicus
gtgattctctttaaattgccctgac

SEQ ID NO: 505565 - DNA, 25 bp, Rattus norvegicus
gtgattctcttttaattgccctgac

SEQ ID NO: 505566 - DNA, 25 bp, Rattus norvegicus
gtgattctgaacacctgggcagggt

SEQ ID NO: 505567 - DNA, 25 bp, Rattus norvegicus
gtgattctgaactcctgggcagggt

SEQ ID NO: 505568 - DNA, 25 bp, Rattus norvegicus
gtgattctgacactactcctatgaa

SEQ ID NO: 505569 - DNA, 25 bp, Rattus norvegicus
gtgattctgacagtactcctatgaa

SEQ ID NO: 505570 - DNA, 25 bp, Rattus norvegicus
gtgattctggaaatctgctgctgaa

SEQ ID NO: 505571 - DNA, 25 bp, Rattus norvegicus
gtgattctggaattctgctgctgaa

SEQ ID NO: 505572 - DNA, 25 bp, Rattus norvegicus
gtgattctgtgtacgagtcacacta

SEQ ID NO: 505573 - DNA, 25 bp, Rattus norvegicus
gtgattctgtgttcgagtcacacta

SEQ ID NO: 505574 - DNA, 25 bp, Rattus norvegicus
gtgattcttaataccttatctgcta

SEQ ID NO: 505575 - DNA, 25 bp, Rattus norvegicus
gtgattcttaattccttatctgcta

SEQ ID NO: 505576 - DNA, 25 bp, Rattus norvegicus
gtgattcttatcaatactatatact

SEQ ID NO: 505577 - DNA, 25 bp, Rattus norvegicus
gtgattcttatctatactatatact

SEQ ID NO: 505578 - DNA, 25 bp, Rattus norvegicus
gtgattcttcttactctatctttgt

SEQ ID NO: 505579 - DNA, 25 bp, Rattus norvegicus
gtgattcttcttcggcacgagagct

SEQ ID NO: 505580 - DNA, 25 bp, Rattus norvegicus
gtgattcttcttgggcacgagagct

SEQ ID NO: 505581 - DNA, 25 bp, Rattus norvegicus
gtgattcttctttctctatctttgt

SEQ ID NO: 505582 - DNA, 25 bp, Rattus norvegicus
gtgattcttggcataagctacaatg

SEQ ID NO: 505583 - DNA, 25 bp, Rattus norvegicus
gtgattcttggcttaagctacaatg

SEQ ID NO: 505584 - DNA, 25 bp, Rattus norvegicus
gtgattctttgcattgctcccccac

SEQ ID NO: 505585 - DNA, 25 bp, Rattus norvegicus
gtgattctttgctttgctcccccac

SEQ ID NO: 505586 - DNA, 25 bp, Rattus norvegicus
gtgattctttggatgtgacacttat

SEQ ID NO: 505587 - DNA, 25 bp, Rattus norvegicus
gtgattctttggttgtgacacttat

SEQ ID NO: 505588 - DNA, 25 bp, Rattus norvegicus
gtgattcttttgcacttactcaaaa

SEQ ID NO: 505589 - DNA, 25 bp, Rattus norvegicus
gtgattcttttggacttactcaaaa

SEQ ID NO: 505590 - DNA, 25 bp, Rattus norvegicus
gtgattgacagtatccccagtgagt

SEQ ID NO: 505591 - DNA, 25 bp, Rattus norvegicus
gtgattgacagtttccccagtgagt

SEQ ID NO: 505592 - DNA, 25 bp, Rattus norvegicus
gtgattgacatgattccccgagcca

SEQ ID NO: 505593 - DNA, 25 bp, Rattus norvegicus
gtgattgacatgtttccccgagcca

SEQ ID NO: 505594 - DNA, 25 bp, Rattus norvegicus
gtgattgactccacagactggcaaa

SEQ ID NO: 505595 - DNA, 25 bp, Rattus norvegicus
gtgattgactcctcagactggcaaa

SEQ ID NO: 505596 - DNA, 25 bp, Rattus norvegicus
gtgattgatgcgctaaaacttggtt

SEQ ID NO: 505597 - DNA, 25 bp, Rattus norvegicus
gtgattgatgcggtaaaacttggtt

SEQ ID NO: 505598 - DNA, 25 bp, Rattus norvegicus
gtgattgcaagcactagctgccatg

SEQ ID NO: 505599 - DNA, 25 bp, Rattus norvegicus
gtgattgcaagctctagctgccatg

SEQ ID NO: 505600 - DNA, 25 bp, Rattus norvegicus
gtgattgcacatcacacataggcaa

SEQ ID NO: 505601 - DNA, 25 bp, Rattus norvegicus
gtgattgcacatgacacataggcaa

SEQ ID NO: 505602 - DNA, 25 bp, Rattus norvegicus
gtgattgccacaatgccagtgttgt

SEQ ID NO: 505603 - DNA, 25 bp, Rattus norvegicus
gtgattgccacattgccagtgttgt

SEQ ID NO: 505604 - DNA, 25 bp, Rattus norvegicus
gtgattgcccatcatgtagacccca

SEQ ID NO: 505605 - DNA, 25 bp, Rattus norvegicus
gtgattgcccatgatgtagacccca

SEQ ID NO: 505606 - DNA, 25 bp, Rattus norvegicus
gtgattgccttgagggtgtgataca

SEQ ID NO: 505607 - DNA, 25 bp, Rattus norvegicus
gtgattgccttgtgggtgtgataca

SEQ ID NO: 505608 - DNA, 25 bp, Rattus norvegicus
gtgattgcgcctagagaacccggta

SEQ ID NO: 505609 - DNA, 25 bp, Rattus norvegicus
gtgattgcgccttgagaacccggta

SEQ ID NO: 505610 - DNA, 25 bp, Rattus norvegicus
gtgattgcggaaccacaacgactct

SEQ ID NO: 505611 - DNA, 25 bp, Rattus norvegicus
gtgattgcggaagcacaacgactct

SEQ ID NO: 505612 - DNA, 25 bp, Rattus norvegicus
gtgattgcgtatccaccagcagtgc

SEQ ID NO: 505613 - DNA, 25 bp, Rattus norvegicus
gtgattgcgtatgcaccagcagtgc

SEQ ID NO: 505614 - DNA, 25 bp, Rattus norvegicus
gtgattgctagacgacagtcccctg

SEQ ID NO: 505615 - DNA, 25 bp, Rattus norvegicus
gtgattgctagaggacagtcccctg

SEQ ID NO: 505616 - DNA, 25 bp, Rattus norvegicus
gtgattgcttatctcatgacttgtg

SEQ ID NO: 505617 - DNA, 25 bp, Rattus norvegicus
gtgattgcttatgtcatgacttgtg

SEQ ID NO: 505618 - DNA, 25 bp, Rattus norvegicus
gtgattgcttgaccttggtgcacaa

SEQ ID NO: 505619 - DNA, 25 bp, Rattus norvegicus
gtgattgcttgagcttggtgcacaa

SEQ ID NO: 505620 - DNA, 25 bp, Rattus norvegicus
gtgattgcttggctattgtctgaat

SEQ ID NO: 505621 - DNA, 25 bp, Rattus norvegicus
gtgattgcttgggtattgtctgaat

SEQ ID NO: 505622 - DNA, 25 bp, Rattus norvegicus
gtgattggatagatggctcccaaca

SEQ ID NO: 505623 - DNA, 25 bp, Rattus norvegicus
gtgattggatagttggctcccaaca

SEQ ID NO: 505624 - DNA, 25 bp, Rattus norvegicus
gtgattggcaacacaacatctggaa

SEQ ID NO: 505625 - DNA, 25 bp, Rattus norvegicus
gtgattggcaactcaacatctggaa

SEQ ID NO: 505626 - DNA, 25 bp, Rattus norvegicus
gtgattggtagcacatctgaacaat

SEQ ID NO: 505627 - DNA, 25 bp, Rattus norvegicus
gtgattggtagctcatctgaacaat

SEQ ID NO: 505628 - DNA, 25 bp, Rattus norvegicus
gtgattggtcataagctccaacaga

SEQ ID NO: 505629 - DNA, 25 bp, Rattus norvegicus
gtgattggtcattagctccaacaga

SEQ ID NO: 505630 - DNA, 25 bp, Rattus norvegicus
gtgattggtctcatcttttgtacat

SEQ ID NO: 505631 - DNA, 25 bp, Rattus norvegicus
gtgattggtctcctttgaacttaaa

SEQ ID NO: 505632 - DNA, 25 bp, Rattus norvegicus
gtgattggtctcgtttgaacttaaa

SEQ ID NO: 505633 - DNA, 25 bp, Rattus norvegicus
gtgattggtctcttcttttgtacat

SEQ ID NO: 505634 - DNA, 25 bp, Rattus norvegicus
gtgattggtcttccacagacaccca

SEQ ID NO: 505635 - DNA, 25 bp, Rattus norvegicus
gtgattggtcttgcacagacaccca

SEQ ID NO: 505636 - DNA, 25 bp, Rattus norvegicus
gtgattgtcatcagtttggcactaa

SEQ ID NO: 505637 - DNA, 25 bp, Rattus norvegicus
gtgattgtcatctgtttggcactaa

SEQ ID NO: 505638 - DNA, 25 bp, Rattus norvegicus
gtgattgtccaaactatcccaagaa

SEQ ID NO: 505639 - DNA, 25 bp, Rattus norvegicus
gtgattgtccaatctatcccaagaa

SEQ ID NO: 505640 - DNA, 25 bp, Rattus norvegicus
gtgattgtccttatcattctcatcc

SEQ ID NO: 505641 - DNA, 25 bp, Rattus norvegicus
gtgattgtccttttcattctcatcc

SEQ ID NO: 505642 - DNA, 25 bp, Rattus norvegicus
gtgattgtgaacagtggcttccttc

SEQ ID NO: 505643 - DNA, 25 bp, Rattus norvegicus
gtgattgtgaactgtggcttccttc

SEQ ID NO: 505644 - DNA, 25 bp, Rattus norvegicus
gtgattgtgactctatggatgtaaa

SEQ ID NO: 505645 - DNA, 25 bp, Rattus norvegicus
gtgattgtgactgtatggatgtaaa

SEQ ID NO: 505646 - DNA, 25 bp, Rattus norvegicus
gtgattgtgctcactattgttttaa

SEQ ID NO: 505647 - DNA, 25 bp, Rattus norvegicus
gtgattgtgctctctattgttttaa

SEQ ID NO: 505648 - DNA, 25 bp, Rattus norvegicus
gtgattgtggtcacaccctgacaac

SEQ ID NO: 505649 - DNA, 25 bp, Rattus norvegicus
gtgattgtggtctcaccctgacaac

SEQ ID NO: 505650 - DNA, 25 bp, Rattus norvegicus
gtgattgtgtttatctacctcttcg

SEQ ID NO: 505651 - DNA, 25 bp, Rattus norvegicus
gtgattgtgtttttctacctcttcg

SEQ ID NO: 505652 - DNA, 25 bp, Rattus norvegicus
gtgattgttctcaccacctggatca

SEQ ID NO: 505653 - DNA, 25 bp, Rattus norvegicus
gtgattgttctctccacctggatca

SEQ ID NO: 505654 - DNA, 25 bp, Rattus norvegicus
gtgattgttctgcacacttttcaaa

SEQ ID NO: 505655 - DNA, 25 bp, Rattus norvegicus
gtgattgttctggacacttttcaaa

SEQ ID NO: 505656 - DNA, 25 bp, Rattus norvegicus
gtgattgttgcacatctataatccc

SEQ ID NO: 505657 - DNA, 25 bp, Rattus norvegicus
gtgattgttgcagatctataatccc

SEQ ID NO: 505658 - DNA, 25 bp, Rattus norvegicus
gtgatttaattgattccacatcaat

SEQ ID NO: 505659 - DNA, 25 bp, Rattus norvegicus
gtgatttaattgtttccacatcaat

SEQ ID NO: 505660 - DNA, 25 bp, Rattus norvegicus
gtgatttacctgcacacatggcatc

SEQ ID NO: 505661 - DNA, 25 bp, Rattus norvegicus
gtgatttacctggacacatggcatc

SEQ ID NO: 505662 - DNA, 25 bp, Rattus norvegicus
gtgatttactgaaactgttttgata

SEQ ID NO: 505663 - DNA, 25 bp, Rattus norvegicus
gtgatttactgatactgttttgata

SEQ ID NO: 505664 - DNA, 25 bp, Rattus norvegicus
gtgatttaggtaactttctagtcaa

SEQ ID NO: 505665 - DNA, 25 bp, Rattus norvegicus
gtgatttaggtatctttctagtcaa

SEQ ID NO: 505666 - DNA, 25 bp, Rattus norvegicus
gtgatttaggtcattctccctttct

SEQ ID NO: 505667 - DNA, 25 bp, Rattus norvegicus
gtgatttaggtctttctccctttct

SEQ ID NO: 505668 - DNA, 25 bp, Rattus norvegicus
gtgatttatccaagactagtctctc

SEQ ID NO: 505669 - DNA, 25 bp, Rattus norvegicus
gtgatttatccaattctttgtatac

SEQ ID NO: 505670 - DNA, 25 bp, Rattus norvegicus
gtgatttatccatgactagtctctc

SEQ ID NO: 505671 - DNA, 25 bp, Rattus norvegicus
gtgatttatccatttctttgtatac

SEQ ID NO: 505672 - DNA, 25 bp, Rattus norvegicus
gtgatttatctgctaggtgaggcaa

SEQ ID NO: 505673 - DNA, 25 bp, Rattus norvegicus
gtgatttatctggtaggtgaggcaa

SEQ ID NO: 505674 - DNA, 25 bp, Rattus norvegicus
gtgatttcaacacaggcttagcctt

SEQ ID NO: 505675 - DNA, 25 bp, Rattus norvegicus
gtgatttcaacagaggcttagcctt

SEQ ID NO: 505676 - DNA, 25 bp, Rattus norvegicus
gtgatttcaattccaggtcaactgt

SEQ ID NO: 505677 - DNA, 25 bp, Rattus norvegicus
gtgatttcaattgcaggtcaactgt

SEQ ID NO: 505678 - DNA, 25 bp, Rattus norvegicus
gtgatttcacctcctgaactgatac

SEQ ID NO: 505679 - DNA, 25 bp, Rattus norvegicus
gtgatttcacctgctgaactgatac

SEQ ID NO: 505680 - DNA, 25 bp, Rattus norvegicus
gtgatttcacttattatccccagag

SEQ ID NO: 505681 - DNA, 25 bp, Rattus norvegicus
gtgatttcactttttatccccagag

SEQ ID NO: 505682 - DNA, 25 bp, Rattus norvegicus
gtgatttcatatcctgtattcttca

SEQ ID NO: 505683 - DNA, 25 bp, Rattus norvegicus
gtgatttcatatgctgtattcttca

SEQ ID NO: 505684 - DNA, 25 bp, Rattus norvegicus
gtgatttccaaaattctgtcccgat

SEQ ID NO: 505685 - DNA, 25 bp, Rattus norvegicus
gtgatttccaaatttctgtcccgat

SEQ ID NO: 505686 - DNA, 25 bp, Rattus norvegicus
gtgatttccctcctgccaaaaataa

SEQ ID NO: 505687 - DNA, 25 bp, Rattus norvegicus
gtgatttccctcgtgccaaaaataa

SEQ ID NO: 505688 - DNA, 25 bp, Rattus norvegicus
gtgatttctataaccctctttatcc

SEQ ID NO: 505689 - DNA, 25 bp, Rattus norvegicus
gtgatttctatatccctctttatcc

SEQ ID NO: 505690 - DNA, 25 bp, Rattus norvegicus
gtgatttctccaaggctctaaatta

SEQ ID NO: 505691 - DNA, 25 bp, Rattus norvegicus
gtgatttctccatggctctaaatta

SEQ ID NO: 505692 - DNA, 25 bp, Rattus norvegicus
gtgatttctcttcgttttgacttga

SEQ ID NO: 505693 - DNA, 25 bp, Rattus norvegicus
gtgatttctcttggttttgacttga

SEQ ID NO: 505694 - DNA, 25 bp, Rattus norvegicus
gtgatttctgaaagtacctatgaac

SEQ ID NO: 505695 - DNA, 25 bp, Rattus norvegicus
gtgatttctgaactgtacccgtgta

SEQ ID NO: 505696 - DNA, 25 bp, Rattus norvegicus
gtgatttctgaagtgtacccgtgta

SEQ ID NO: 505697 - DNA, 25 bp, Rattus norvegicus
gtgatttctgaatgtacctatgaac

SEQ ID NO: 505698 - DNA, 25 bp, Rattus norvegicus
gtgatttctggcacagagaaacctc

SEQ ID NO: 505699 - DNA, 25 bp, Rattus norvegicus
gtgatttctggctcagagaaacctc

SEQ ID NO: 505700 - DNA, 25 bp, Rattus norvegicus
gtgatttcttaaccattgatgtttg

SEQ ID NO: 505701 - DNA, 25 bp, Rattus norvegicus
gtgatttcttaagcattgatgtttg

SEQ ID NO: 505702 - DNA, 25 bp, Rattus norvegicus
gtgatttgactgattttacccatat

SEQ ID NO: 505703 - DNA, 25 bp, Rattus norvegicus
gtgatttgactgtttttacccatat

SEQ ID NO: 505704 - DNA, 25 bp, Rattus norvegicus
gtgatttgctctattgaactgttta

SEQ ID NO: 505705 - DNA, 25 bp, Rattus norvegicus
gtgatttgctcttttgaactgttta

SEQ ID NO: 505706 - DNA, 25 bp, Rattus norvegicus
gtgatttggttcacggtgcccacct

SEQ ID NO: 505707 - DNA, 25 bp, Rattus norvegicus
gtgatttggttctcggtgcccacct

SEQ ID NO: 505708 - DNA, 25 bp, Rattus norvegicus
gtgatttgtaccacagacctttttt

SEQ ID NO: 505709 - DNA, 25 bp, Rattus norvegicus
gtgatttgtacctcagacctttttt

SEQ ID NO: 505710 - DNA, 25 bp, Rattus norvegicus
gtgatttgtcatctctcgtgtgcca

SEQ ID NO: 505711 - DNA, 25 bp, Rattus norvegicus
gtgatttgtcatgtctcgtgtgcca

SEQ ID NO: 505712 - DNA, 25 bp, Rattus norvegicus
gtgattttacctaacttgtgggaat

SEQ ID NO: 505713 - DNA, 25 bp, Rattus norvegicus
gtgattttaccttacttgtgggaat

SEQ ID NO: 505714 - DNA, 25 bp, Rattus norvegicus
gtgattttcaccaagccaaggtttc

SEQ ID NO: 505715 - DNA, 25 bp, Rattus norvegicus
gtgattttcacctagccaaggtttc

SEQ ID NO: 505716 - DNA, 25 bp, Rattus norvegicus
gtgattttcatgaagttaaccatcc

SEQ ID NO: 505717 - DNA, 25 bp, Rattus norvegicus
gtgattttcatgtagttaaccatcc

SEQ ID NO: 505718 - DNA, 25 bp, Rattus norvegicus
gtgattttccctagcatacatgagt

SEQ ID NO: 505719 - DNA, 25 bp, Rattus norvegicus
gtgattttcccttgcatacatgagt

SEQ ID NO: 505720 - DNA, 25 bp, Rattus norvegicus
gtgattttctttcctgactttgaca

SEQ ID NO: 505721 - DNA, 25 bp, Rattus norvegicus
gtgattttctttgctgactttgaca

SEQ ID NO: 505722 - DNA, 25 bp, Rattus norvegicus
gtgattttgcagaacagcactccaa

SEQ ID NO: 505723 - DNA, 25 bp, Rattus norvegicus
gtgattttgcagtacagcactccaa

SEQ ID NO: 505724 - DNA, 25 bp, Rattus norvegicus
gtgatttttcaactgagctctctgt

SEQ ID NO: 505725 - DNA, 25 bp, Rattus norvegicus
gtgatttttcaagtgagctctctgt

SEQ ID NO: 505726 - DNA, 25 bp, Rattus norvegicus
gtgatttttctgacagtcaagctca

SEQ ID NO: 505727 - DNA, 25 bp, Rattus norvegicus
gtgatttttctgtcagtcaagctca

SEQ ID NO: 505728 - DNA, 25 bp, Rattus norvegicus
gtgatttttcttacagaggaactat

SEQ ID NO: 505729 - DNA, 25 bp, Rattus norvegicus
gtgatttttctttcagaggaactat

SEQ ID NO: 505730 - DNA, 25 bp, Rattus norvegicus
gtgatttttgcaagcctgtttttca

SEQ ID NO: 505731 - DNA, 25 bp, Rattus norvegicus
gtgatttttgcatgcctgtttttca

SEQ ID NO: 505732 - DNA, 25 bp, Rattus norvegicus
gtgatttttgctctcaacctgtact

SEQ ID NO: 505733 - DNA, 25 bp, Rattus norvegicus
gtgatttttgctgtcaacctgtact

SEQ ID NO: 505734 - DNA, 25 bp, Rattus norvegicus
gtgatttttgtacatccttgtcttg

SEQ ID NO: 505735 - DNA, 25 bp, Rattus norvegicus
gtgatttttgtagatccttgtcttg

SEQ ID NO: 505736 - DNA, 25 bp, Rattus norvegicus
gtgattttttcacctcattctatga

SEQ ID NO: 505737 - DNA, 25 bp, Rattus norvegicus
gtgattttttcagctcattctatga

SEQ ID NO: 505738 - DNA, 25 bp, Rattus norvegicus
gtgcaaaaacagacatttctaacat

SEQ ID NO: 505739 - DNA, 25 bp, Rattus norvegicus
gtgcaaaaacagtcatttctaacat

SEQ ID NO: 505740 - DNA, 25 bp, Rattus norvegicus
gtgcaaaagggaacctgaccccaat

SEQ ID NO: 505741 - DNA, 25 bp, Rattus norvegicus
gtgcaaaagggatcctgaccccaat

SEQ ID NO: 505742 - DNA, 25 bp, Rattus norvegicus
gtgcaaaagttgaaagagagctcaa

SEQ ID NO: 505743 - DNA, 25 bp, Rattus norvegicus
gtgcaaaagttgtaagagagctcaa

SEQ ID NO: 505744 - DNA, 25 bp, Rattus norvegicus
gtgcaaaatcaacggctacgccaag

SEQ ID NO: 505745 - DNA, 25 bp, Rattus norvegicus
gtgcaaaatcaagggctacgccaag

SEQ ID NO: 505746 - DNA, 25 bp, Rattus norvegicus
gtgcaaaatctacaggcaccctttt

SEQ ID NO: 505747 - DNA, 25 bp, Rattus norvegicus
gtgcaaaatctagaggcaccctttt

SEQ ID NO: 505748 - DNA, 25 bp, Rattus norvegicus
gtgcaaaatgagcttgctggcccca

SEQ ID NO: 505749 - DNA, 25 bp, Rattus norvegicus
gtgcaaaatgaggttgctggcccca

SEQ ID NO: 505750 - DNA, 25 bp, Rattus norvegicus
gtgcaaacaaccagatgtgggcctt

SEQ ID NO: 505751 - DNA, 25 bp, Rattus norvegicus
gtgcaaacaacctgatgtgggcctt

SEQ ID NO: 505752 - DNA, 25 bp, Rattus norvegicus
gtgcaaacacggacttcgtttctga

SEQ ID NO: 505753 - DNA, 25 bp, Rattus norvegicus
gtgcaaacacggtcttcgtttctga

SEQ ID NO: 505754 - DNA, 25 bp, Rattus norvegicus
gtgcaaacagccacttaaagcattt

SEQ ID NO: 505755 - DNA, 25 bp, Rattus norvegicus
gtgcaaacagcctcttaaagcattt

SEQ ID NO: 505756 - DNA, 25 bp, Rattus norvegicus
gtgcaaacatcacttttctcagaat

SEQ ID NO: 505757 - DNA, 25 bp, Rattus norvegicus
gtgcaaacatcagttttctcagaat

SEQ ID NO: 505758 - DNA, 25 bp, Rattus norvegicus
gtgcaaacccagaattaatcagctc

SEQ ID NO: 505759 - DNA, 25 bp, Rattus norvegicus
gtgcaaacccagtattaatcagctc

SEQ ID NO: 505760 - DNA, 25 bp, Rattus norvegicus
gtgcaaaccctcagctgtagtccag

SEQ ID NO: 505761 - DNA, 25 bp, Rattus norvegicus
gtgcaaaccctctgctgtagtccag

SEQ ID NO: 505762 - DNA, 25 bp, Rattus norvegicus
gtgcaaacccttcaaagattactgg

SEQ ID NO: 505763 - DNA, 25 bp, Rattus norvegicus
gtgcaaacccttgaaagattactgg

SEQ ID NO: 505764 - DNA, 25 bp, Rattus norvegicus
gtgcaaacctgtacagtcactgtgg

SEQ ID NO: 505765 - DNA, 25 bp, Rattus norvegicus
gtgcaaacctgttcagtcactgtgg

SEQ ID NO: 505766 - DNA, 25 bp, Rattus norvegicus
gtgcaaaccttgattaaaacgattg

SEQ ID NO: 505767 - DNA, 25 bp, Rattus norvegicus
gtgcaaaccttgtttaaaacgattg

SEQ ID NO: 505768 - DNA, 25 bp, Rattus norvegicus
gtgcaaacgatcacttccaggttaa

SEQ ID NO: 505769 - DNA, 25 bp, Rattus norvegicus
gtgcaaacgatctcttccaggttaa

SEQ ID NO: 505770 - DNA, 25 bp, Rattus norvegicus
gtgcaaactcagaatagatcctgtc

SEQ ID NO: 505771 - DNA, 25 bp, Rattus norvegicus
gtgcaaactcagtatagatcctgtc

SEQ ID NO: 505772 - DNA, 25 bp, Rattus norvegicus
gtgcaaactgctatccaatggtgtc

SEQ ID NO: 505773 - DNA, 25 bp, Rattus norvegicus
gtgcaaactgctttccaatggtgtc

SEQ ID NO: 505774 - DNA, 25 bp, Rattus norvegicus
gtgcaaactgtaatcaacctggtga

SEQ ID NO: 505775 - DNA, 25 bp, Rattus norvegicus
gtgcaaactgtattcaacctggtga

SEQ ID NO: 505776 - DNA, 25 bp, Rattus norvegicus
gtgcaaacttttagtcagccgcttt

SEQ ID NO: 505777 - DNA, 25 bp, Rattus norvegicus
gtgcaaactttttgtcagccgcttt

SEQ ID NO: 505778 - DNA, 25 bp, Rattus norvegicus
gtgcaaagagatcagcgggctacct

SEQ ID NO: 505779 - DNA, 25 bp, Rattus norvegicus
gtgcaaagagatgagcgggctacct

SEQ ID NO: 505780 - DNA, 25 bp, Rattus norvegicus
gtgcaaagaggactcccacctggaa

SEQ ID NO: 505781 - DNA, 25 bp, Rattus norvegicus
gtgcaaagaggagtcccacctggaa

SEQ ID NO: 505782 - DNA, 25 bp, Rattus norvegicus
gtgcaaagatgccaacagcctactg

SEQ ID NO: 505783 - DNA, 25 bp, Rattus norvegicus
gtgcaaagatgcgaacagcctactg

SEQ ID NO: 505784 - DNA, 25 bp, Rattus norvegicus
gtgcaaagattcagtgccaccattt

SEQ ID NO: 505785 - DNA, 25 bp, Rattus norvegicus
gtgcaaagattctgtgccaccattt

SEQ ID NO: 505786 - DNA, 25 bp, Rattus norvegicus
gtgcaaagcggtacatgccctggat

SEQ ID NO: 505787 - DNA, 25 bp, Rattus norvegicus
gtgcaaagcggttcatgccctggat

SEQ ID NO: 505788 - DNA, 25 bp, Rattus norvegicus
gtgcaaaggcatcaaactactcgtt

SEQ ID NO: 505789 - DNA, 25 bp, Rattus norvegicus
gtgcaaaggcatgaaactactcgtt

SEQ ID NO: 505790 - DNA, 25 bp, Rattus norvegicus
gtgcaaaggtttatatactctggga

SEQ ID NO: 505791 - DNA, 25 bp, Rattus norvegicus
gtgcaaaggtttttatactctggga

SEQ ID NO: 505792 - DNA, 25 bp, Rattus norvegicus
gtgcaaagtaaaaccgcttcgtctg

SEQ ID NO: 505793 - DNA, 25 bp, Rattus norvegicus
gtgcaaagtaaatccgcttcgtctg

SEQ ID NO: 505794 - DNA, 25 bp, Rattus norvegicus
gtgcaaagtcccactaacctgtatt

SEQ ID NO: 505795 - DNA, 25 bp, Rattus norvegicus
gtgcaaagtccctctaacctgtatt

SEQ ID NO: 505796 - DNA, 25 bp, Rattus norvegicus
gtgcaaagtgacagttgagccgcca

SEQ ID NO: 505797 - DNA, 25 bp, Rattus norvegicus
gtgcaaagtgactgttgagccgcca

SEQ ID NO: 505798 - DNA, 25 bp, Rattus norvegicus
gtgcaaagtgccatacgctacgaga

SEQ ID NO: 505799 - DNA, 25 bp, Rattus norvegicus
gtgcaaagtgccttacgctacgaga

SEQ ID NO: 505800 - DNA, 25 bp, Rattus norvegicus
gtgcaaagtgctacaggtttcccag

SEQ ID NO: 505801 - DNA, 25 bp, Rattus norvegicus
gtgcaaagtgcttcaggtttcccag

SEQ ID NO: 505802 - DNA, 25 bp, Rattus norvegicus
gtgcaaatatcccaaactcctaact

SEQ ID NO: 505803 - DNA, 25 bp, Rattus norvegicus
gtgcaaatatccgaaactcctaact

SEQ ID NO: 505804 - DNA, 25 bp, Rattus norvegicus
gtgcaaatcataatagctccagtgt

SEQ ID NO: 505805 - DNA, 25 bp, Rattus norvegicus
gtgcaaatcatattagctccagtgt

SEQ ID NO: 505806 - DNA, 25 bp, Rattus norvegicus
gtgcaaatgtcaccccatttaggct

SEQ ID NO: 505807 - DNA, 25 bp, Rattus norvegicus
gtgcaaatgtcagcccatttaggct

SEQ ID NO: 505808 - DNA, 25 bp, Rattus norvegicus
gtgcaaattaccattggcctatccc

SEQ ID NO: 505809 - DNA, 25 bp, Rattus norvegicus
gtgcaaattacctttggcctatccc

SEQ ID NO: 505810 - DNA, 25 bp, Rattus norvegicus
gtgcaaattgccattagatcttaca

SEQ ID NO: 505811 - DNA, 25 bp, Rattus norvegicus
gtgcaaattgcctttagatcttaca

SEQ ID NO: 505812 - DNA, 25 bp, Rattus norvegicus
gtgcaaattgggaacataagcagtt

SEQ ID NO: 505813 - DNA, 25 bp, Rattus norvegicus
gtgcaaattgggtacataagcagtt

SEQ ID NO: 505814 - DNA, 25 bp, Rattus norvegicus
gtgcaacaaccaccaggctggacga

SEQ ID NO: 505815 - DNA, 25 bp, Rattus norvegicus
gtgcaacaaccagcaggctggacga

SEQ ID NO: 505816 - DNA, 25 bp, Rattus norvegicus
gtgcaacaagagagcctggcattcc

SEQ ID NO: 505817 - DNA, 25 bp, Rattus norvegicus
gtgcaacaagagtgcctggcattcc

SEQ ID NO: 505818 - DNA, 25 bp, Rattus norvegicus
gtgcaacacgcacactcactggaga

SEQ ID NO: 505819 - DNA, 25 bp, Rattus norvegicus
gtgcaacacgcagactcactggaga

SEQ ID NO: 505820 - DNA, 25 bp, Rattus norvegicus
gtgcaacactttacagatggctctc

SEQ ID NO: 505821 - DNA, 25 bp, Rattus norvegicus
gtgcaacacttttcagatggctctc

SEQ ID NO: 505822 - DNA, 25 bp, Rattus norvegicus
gtgcaacagctaatcttctttgtga

SEQ ID NO: 505823 - DNA, 25 bp, Rattus norvegicus
gtgcaacagctattcttctttgtga

SEQ ID NO: 505824 - DNA, 25 bp, Rattus norvegicus
gtgcaacagctgcttgtccatactt

SEQ ID NO: 505825 - DNA, 25 bp, Rattus norvegicus
gtgcaacagctggttgtccatactt

SEQ ID NO: 505826 - DNA, 25 bp, Rattus norvegicus
gtgcaacagtagctatttgtaatct

SEQ ID NO: 505827 - DNA, 25 bp, Rattus norvegicus
gtgcaacagtaggtatttgtaatct

SEQ ID NO: 505828 - DNA, 25 bp, Rattus norvegicus
gtgcaaccaattcgctgcacgaact

SEQ ID NO: 505829 - DNA, 25 bp, Rattus norvegicus
gtgcaaccaattggctgcacgaact

SEQ ID NO: 505830 - DNA, 25 bp, Rattus norvegicus
gtgcaacccagaatctctgtggtat

SEQ ID NO: 505831 - DNA, 25 bp, Rattus norvegicus
gtgcaacccagattctctgtggtat

SEQ ID NO: 505832 - DNA, 25 bp, Rattus norvegicus
gtgcaaccctagacccagtcactga

SEQ ID NO: 505833 - DNA, 25 bp, Rattus norvegicus
gtgcaaccctagtcccagtcactga

SEQ ID NO: 505834 - DNA, 25 bp, Rattus norvegicus
gtgcaacctcatcaagcagttttgg

SEQ ID NO: 505835 - DNA, 25 bp, Rattus norvegicus
gtgcaacctcatgaagcagttttgg

SEQ ID NO: 505836 - DNA, 25 bp, Rattus norvegicus
gtgcaacctgcgcaatcagtcattt

SEQ ID NO: 505837 - DNA, 25 bp, Rattus norvegicus
gtgcaacctgcggaatcagtcattt

SEQ ID NO: 505838 - DNA, 25 bp, Rattus norvegicus
gtgcaacctttcagtatactgtaaa

SEQ ID NO: 505839 - DNA, 25 bp, Rattus norvegicus
gtgcaacctttctgtatactgtaaa

SEQ ID NO: 505840 - DNA, 25 bp, Rattus norvegicus
gtgcaacctttgaatactttactct

SEQ ID NO: 505841 - DNA, 25 bp, Rattus norvegicus
gtgcaacctttgtatactttactct

SEQ ID NO: 505842 - DNA, 25 bp, Rattus norvegicus
gtgcaacgacatatacttactgtat

SEQ ID NO: 505843 - DNA, 25 bp, Rattus norvegicus
gtgcaacgacatttacttactgtat

SEQ ID NO: 505844 - DNA, 25 bp, Rattus norvegicus
gtgcaactcaacaacaggattcagt

SEQ ID NO: 505845 - DNA, 25 bp, Rattus norvegicus
gtgcaactcaactacaggattcagt

SEQ ID NO: 505846 - DNA, 25 bp, Rattus norvegicus
gtgcaactcagactatattactata

SEQ ID NO: 505847 - DNA, 25 bp, Rattus norvegicus
gtgcaactcagagtatattactata

SEQ ID NO: 505848 - DNA, 25 bp, Rattus norvegicus
gtgcaactgactcgcagccgcttta

SEQ ID NO: 505849 - DNA, 25 bp, Rattus norvegicus
gtgcaactgactggcagccgcttta

SEQ ID NO: 505850 - DNA, 25 bp, Rattus norvegicus
gtgcaactgccacgctaccagaaga

SEQ ID NO: 505851 - DNA, 25 bp, Rattus norvegicus
gtgcaactgccaggctaccagaaga

SEQ ID NO: 505852 - DNA, 25 bp, Rattus norvegicus
gtgcaactgtcgacaatgccaatcg

SEQ ID NO: 505853 - DNA, 25 bp, Rattus norvegicus
gtgcaactgtcgtcaatgccaatcg

SEQ ID NO: 505854 - DNA, 25 bp, Rattus norvegicus
gtgcaacttactccgggcatctgcc

SEQ ID NO: 505855 - DNA, 25 bp, Rattus norvegicus
gtgcaacttactgcgggcatctgcc

SEQ ID NO: 505856 - DNA, 25 bp, Rattus norvegicus
gtgcaacttttcacttctgttgatg

SEQ ID NO: 505857 - DNA, 25 bp, Rattus norvegicus
gtgcaacttttctcttctgttgatg

SEQ ID NO: 505858 - DNA, 25 bp, Rattus norvegicus
gtgcaagaagcacgcgcatgccatc

SEQ ID NO: 505859 - DNA, 25 bp, Rattus norvegicus
gtgcaagaagcaggcgcatgccatc

SEQ ID NO: 505860 - DNA, 25 bp, Rattus norvegicus
gtgcaagacagtcctgctgagacca

SEQ ID NO: 505861 - DNA, 25 bp, Rattus norvegicus
gtgcaagacagtgctgctgagacca

SEQ ID NO: 505862 - DNA, 25 bp, Rattus norvegicus
gtgcaagaccatcgtgtccaagtat

SEQ ID NO: 505863 - DNA, 25 bp, Rattus norvegicus
gtgcaagaccatggtgtccaagtat

SEQ ID NO: 505864 - DNA, 25 bp, Rattus norvegicus
gtgcaagagctcactgcatttctga

SEQ ID NO: 505865 - DNA, 25 bp, Rattus norvegicus
gtgcaagagctctctgcatttctga

SEQ ID NO: 505866 - DNA, 25 bp, Rattus norvegicus
gtgcaagatagcacggtccagccta

SEQ ID NO: 505867 - DNA, 25 bp, Rattus norvegicus
gtgcaagatagctcggtccagccta

SEQ ID NO: 505868 - DNA, 25 bp, Rattus norvegicus
gtgcaagatgtcagaggtcttccat

SEQ ID NO: 505869 - DNA, 25 bp, Rattus norvegicus
gtgcaagatgtctgaggtcttccat

SEQ ID NO: 505870 - DNA, 25 bp, Rattus norvegicus
gtgcaagcacgaagacctgagttcc

SEQ ID NO: 505871 - DNA, 25 bp, Rattus norvegicus
gtgcaagcacgatgacctgagttcc

SEQ ID NO: 505872 - DNA, 25 bp, Rattus norvegicus
gtgcaagcatatagcctgcttcaaa

SEQ ID NO: 505873 - DNA, 25 bp, Rattus norvegicus
gtgcaagcatattgcctgcttcaaa

SEQ ID NO: 505874 - DNA, 25 bp, Rattus norvegicus
gtgcaagcatctctcacagttctca

SEQ ID NO: 505875 - DNA, 25 bp, Rattus norvegicus
gtgcaagcatctgtcacagttctca

SEQ ID NO: 505876 - DNA, 25 bp, Rattus norvegicus
gtgcaagcattcagctgaggccatc

SEQ ID NO: 505877 - DNA, 25 bp, Rattus norvegicus
gtgcaagcattctgctgaggccatc

SEQ ID NO: 505878 - DNA, 25 bp, Rattus norvegicus
gtgcaagccacgaactcttaactga

SEQ ID NO: 505879 - DNA, 25 bp, Rattus norvegicus
gtgcaagccacgtactcttaactga

SEQ ID NO: 505880 - DNA, 25 bp, Rattus norvegicus
gtgcaagccgataaccccagcacat

SEQ ID NO: 505881 - DNA, 25 bp, Rattus norvegicus
gtgcaagccgattaccccagcacat

SEQ ID NO: 505882 - DNA, 25 bp, Rattus norvegicus
gtgcaagcctgtagtcatagtgaat

SEQ ID NO: 505883 - DNA, 25 bp, Rattus norvegicus
gtgcaagcctgttgtcatagtgaat

SEQ ID NO: 505884 - DNA, 25 bp, Rattus norvegicus
gtgcaagcctttctaagtggctgtg

SEQ ID NO: 505885 - DNA, 25 bp, Rattus norvegicus
gtgcaagcctttgtaagtggctgtg

SEQ ID NO: 505886 - DNA, 25 bp, Rattus norvegicus
gtgcaagctgccatttttaaattac

SEQ ID NO: 505887 - DNA, 25 bp, Rattus norvegicus
gtgcaagctgccttttttaaattac

SEQ ID NO: 505888 - DNA, 25 bp, Rattus norvegicus
gtgcaagcttcgcttctttggtaac

SEQ ID NO: 505889 - DNA, 25 bp, Rattus norvegicus
gtgcaagcttcggttctttggtaac

SEQ ID NO: 505890 - DNA, 25 bp, Rattus norvegicus
gtgcaaggatggcagccagctcaca

SEQ ID NO: 505891 - DNA, 25 bp, Rattus norvegicus
gtgcaaggatgggagccagctcaca

SEQ ID NO: 505892 - DNA, 25 bp, Rattus norvegicus
gtgcaaggattcaaaagtggattac

SEQ ID NO: 505893 - DNA, 25 bp, Rattus norvegicus
gtgcaaggattctaaagtggattac

SEQ ID NO: 505894 - DNA, 25 bp, Rattus norvegicus
gtgcaaggcatcagctacatcctgg

SEQ ID NO: 505895 - DNA, 25 bp, Rattus norvegicus
gtgcaaggcatctgctacatcctgg

SEQ ID NO: 505896 - DNA, 25 bp, Rattus norvegicus
gtgcaaggcgctactggaaaacttc

SEQ ID NO: 505897 - DNA, 25 bp, Rattus norvegicus
gtgcaaggcgcttctggaaaacttc

SEQ ID NO: 505898 - DNA, 25 bp, Rattus norvegicus
gtgcaagggccacctacagaaggat

SEQ ID NO: 505899 - DNA, 25 bp, Rattus norvegicus
gtgcaagggccagctacagaaggat

SEQ ID NO: 505900 - DNA, 25 bp, Rattus norvegicus
gtgcaagggcgtccatgccagccta

SEQ ID NO: 505901 - DNA, 25 bp, Rattus norvegicus
gtgcaagggcgtgcatgccagccta

SEQ ID NO: 505902 - DNA, 25 bp, Rattus norvegicus
gtgcaagggcttccgacatgtcaag

SEQ ID NO: 505903 - DNA, 25 bp, Rattus norvegicus
gtgcaagggcttgcgacatgtcaag

SEQ ID NO: 505904 - DNA, 25 bp, Rattus norvegicus
gtgcaaggtttcaagctactgctta

SEQ ID NO: 505905 - DNA, 25 bp, Rattus norvegicus
gtgcaaggtttctagctactgctta

SEQ ID NO: 505906 - DNA, 25 bp, Rattus norvegicus
gtgcaagtaaagaccccgggctgca

SEQ ID NO: 505907 - DNA, 25 bp, Rattus norvegicus
gtgcaagtaaagtccccgggctgca

SEQ ID NO: 505908 - DNA, 25 bp, Rattus norvegicus
gtgcaagtcagaaatggcatttagc

SEQ ID NO: 505909 - DNA, 25 bp, Rattus norvegicus
gtgcaagtcagatatggcatttagc

SEQ ID NO: 505910 - DNA, 25 bp, Rattus norvegicus
gtgcaagtcattcaaagctgcccca

SEQ ID NO: 505911 - DNA, 25 bp, Rattus norvegicus
gtgcaagtcattgaaagctgcccca

SEQ ID NO: 505912 - DNA, 25 bp, Rattus norvegicus
gtgcaagtgcccaaatgagtttact

SEQ ID NO: 505913 - DNA, 25 bp, Rattus norvegicus
gtgcaagtgccctaatgagtttact

SEQ ID NO: 505914 - DNA, 25 bp, Rattus norvegicus
gtgcaagttgttacatatctcccgg

SEQ ID NO: 505915 - DNA, 25 bp, Rattus norvegicus
gtgcaagttgttatctgtggaacca

SEQ ID NO: 505916 - DNA, 25 bp, Rattus norvegicus
gtgcaagttgtttcatatctcccgg

SEQ ID NO: 505917 - DNA, 25 bp, Rattus norvegicus
gtgcaagttgttttctgtggaacca

SEQ ID NO: 505918 - DNA, 25 bp, Rattus norvegicus
gtgcaagtttgtcaacaccacagac

SEQ ID NO: 505919 - DNA, 25 bp, Rattus norvegicus
gtgcaagtttgtgaacaccacagac

SEQ ID NO: 505920 - DNA, 25 bp, Rattus norvegicus
gtgcaatactgacttcttactgatt

SEQ ID NO: 505921 - DNA, 25 bp, Rattus norvegicus
gtgcaatactgagttcttactgatt

SEQ ID NO: 505922 - DNA, 25 bp, Rattus norvegicus
gtgcaatactggctgtgcctcacta

SEQ ID NO: 505923 - DNA, 25 bp, Rattus norvegicus
gtgcaatactgggtgtgcctcacta

SEQ ID NO: 505924 - DNA, 25 bp, Rattus norvegicus
gtgcaatacttaactcacactttgg

SEQ ID NO: 505925 - DNA, 25 bp, Rattus norvegicus
gtgcaatacttatctcacactttgg

SEQ ID NO: 505926 - DNA, 25 bp, Rattus norvegicus
gtgcaatagcatatcttccttggat

SEQ ID NO: 505927 - DNA, 25 bp, Rattus norvegicus
gtgcaatagcatttcttccttggat

SEQ ID NO: 505928 - DNA, 25 bp, Rattus norvegicus
gtgcaatattaaacccagccttctt

SEQ ID NO: 505929 - DNA, 25 bp, Rattus norvegicus
gtgcaatattaatcccagccttctt

SEQ ID NO: 505930 - DNA, 25 bp, Rattus norvegicus
gtgcaatattatacctgagagctaa

SEQ ID NO: 505931 - DNA, 25 bp, Rattus norvegicus
gtgcaatattattcctgagagctaa

SEQ ID NO: 505932 - DNA, 25 bp, Rattus norvegicus
gtgcaatatttcatactgtgccgag

SEQ ID NO: 505933 - DNA, 25 bp, Rattus norvegicus
gtgcaatatttcttactgtgccgag

SEQ ID NO: 505934 - DNA, 25 bp, Rattus norvegicus
gtgcaatcagccagacatatgtcct

SEQ ID NO: 505935 - DNA, 25 bp, Rattus norvegicus
gtgcaatcagcctgacatatgtcct

SEQ ID NO: 505936 - DNA, 25 bp, Rattus norvegicus
gtgcaatcagtgattctacgctcgt

SEQ ID NO: 505937 - DNA, 25 bp, Rattus norvegicus
gtgcaatcagtgtttctacgctcgt

SEQ ID NO: 505938 - DNA, 25 bp, Rattus norvegicus
gtgcaatcagttcattttgtgtcac

SEQ ID NO: 505939 - DNA, 25 bp, Rattus norvegicus
gtgcaatcagttgattttgtgtcac

SEQ ID NO: 505940 - DNA, 25 bp, Rattus norvegicus
gtgcaatcatgaacttttgaccaat

SEQ ID NO: 505941 - DNA, 25 bp, Rattus norvegicus
gtgcaatcatgatcttttgaccaat

SEQ ID NO: 505942 - DNA, 25 bp, Rattus norvegicus
gtgcaatcgctcacctctcagggag

SEQ ID NO: 505943 - DNA, 25 bp, Rattus norvegicus
gtgcaatcgctctcctctcagggag

SEQ ID NO: 505944 - DNA, 25 bp, Rattus norvegicus
gtgcaatctattaaaggactccctc

SEQ ID NO: 505945 - DNA, 25 bp, Rattus norvegicus
gtgcaatctatttaaggactccctc

SEQ ID NO: 505946 - DNA, 25 bp, Rattus norvegicus
gtgcaatctcagagctgtgccagat

SEQ ID NO: 505947 - DNA, 25 bp, Rattus norvegicus
gtgcaatctcagtgctgtgccagat

SEQ ID NO: 505948 - DNA, 25 bp, Rattus norvegicus
gtgcaatctggacattcaaagacct

SEQ ID NO: 505949 - DNA, 25 bp, Rattus norvegicus
gtgcaatctggagattcaaagacct

SEQ ID NO: 505950 - DNA, 25 bp, Rattus norvegicus
gtgcaatgctgactgcaggccacca

SEQ ID NO: 505951 - DNA, 25 bp, Rattus norvegicus
gtgcaatgctgagtgcaggccacca

SEQ ID NO: 505952 - DNA, 25 bp, Rattus norvegicus
gtgcaatgctgtccattctatcatt

SEQ ID NO: 505953 - DNA, 25 bp, Rattus norvegicus
gtgcaatgctgtgcattctatcatt

SEQ ID NO: 505954 - DNA, 25 bp, Rattus norvegicus
gtgcaatgtcaaaggagctctcaac

SEQ ID NO: 505955 - DNA, 25 bp, Rattus norvegicus
gtgcaatgtcaatggagctctcaac

SEQ ID NO: 505956 - DNA, 25 bp, Rattus norvegicus
gtgcaatgtcacagcccgcgtggtc

SEQ ID NO: 505957 - DNA, 25 bp, Rattus norvegicus
gtgcaatgtcactgcccgcgtggtc

SEQ ID NO: 505958 - DNA, 25 bp, Rattus norvegicus
gtgcaatgtcagagtgcgcgtctat

SEQ ID NO: 505959 - DNA, 25 bp, Rattus norvegicus
gtgcaatgtcagtgtgcgcgtctat

SEQ ID NO: 505960 - DNA, 25 bp, Rattus norvegicus
gtgcaatgttatcacagagctctct

SEQ ID NO: 505961 - DNA, 25 bp, Rattus norvegicus
gtgcaatgttatgacagagctctct

SEQ ID NO: 505962 - DNA, 25 bp, Rattus norvegicus
gtgcaatgtttacccaacccaaatt

SEQ ID NO: 505963 - DNA, 25 bp, Rattus norvegicus
gtgcaatgtttagccaacccaaatt

SEQ ID NO: 505964 - DNA, 25 bp, Rattus norvegicus
gtgcaatgtttgacaaatccttcaa

SEQ ID NO: 505965 - DNA, 25 bp, Rattus norvegicus
gtgcaatgtttgtcaaatccttcaa

SEQ ID NO: 505966 - DNA, 25 bp, Rattus norvegicus
gtgcaattactacgcgaatgcttac

SEQ ID NO: 505967 - DNA, 25 bp, Rattus norvegicus
gtgcaattactaggcgaatgcttac

SEQ ID NO: 505968 - DNA, 25 bp, Rattus norvegicus
gtgcaattccaccttgtaaatggga

SEQ ID NO: 505969 - DNA, 25 bp, Rattus norvegicus
gtgcaattccacgttgtaaatggga

SEQ ID NO: 505970 - DNA, 25 bp, Rattus norvegicus
gtgcaattcttaatcctgtgtttca

SEQ ID NO: 505971 - DNA, 25 bp, Rattus norvegicus
gtgcaattcttattcctgtgtttca

SEQ ID NO: 505972 - DNA, 25 bp, Rattus norvegicus
gtgcaattcttgagccagtggacac

SEQ ID NO: 505973 - DNA, 25 bp, Rattus norvegicus
gtgcaattcttgtgccagtggacac

SEQ ID NO: 505974 - DNA, 25 bp, Rattus norvegicus
gtgcaattgcttcattagcccagta

SEQ ID NO: 505975 - DNA, 25 bp, Rattus norvegicus
gtgcaattgcttgattagcccagta

SEQ ID NO: 505976 - DNA, 25 bp, Rattus norvegicus
gtgcaattggtgatcctggtcaaac

SEQ ID NO: 505977 - DNA, 25 bp, Rattus norvegicus
gtgcaattggtgttcctggtcaaac

SEQ ID NO: 505978 - DNA, 25 bp, Rattus norvegicus
gtgcaatttagtagactcccagcct

SEQ ID NO: 505979 - DNA, 25 bp, Rattus norvegicus
gtgcaatttagttgactcccagcct

SEQ ID NO: 505980 - DNA, 25 bp, Rattus norvegicus
gtgcaatttcatcacttttcttagt

SEQ ID NO: 505981 - DNA, 25 bp, Rattus norvegicus
gtgcaatttcatgacttttcttagt

SEQ ID NO: 505982 - DNA, 25 bp, Rattus norvegicus
gtgcaatttgaactgtattctggat

SEQ ID NO: 505983 - DNA, 25 bp, Rattus norvegicus
gtgcaatttgaagtgtattctggat

SEQ ID NO: 505984 - DNA, 25 bp, Rattus norvegicus
gtgcaatttgtgcttcgggtatatt

SEQ ID NO: 505985 - DNA, 25 bp, Rattus norvegicus
gtgcaatttgtggttcgggtatatt

SEQ ID NO: 505986 - DNA, 25 bp, Rattus norvegicus
gtgcacaaaccaatgtacagctcag

SEQ ID NO: 505987 - DNA, 25 bp, Rattus norvegicus
gtgcacaaaccattgtacagctcag

SEQ ID NO: 505988 - DNA, 25 bp, Rattus norvegicus
gtgcacaaagacatacacacttggc

SEQ ID NO: 505989 - DNA, 25 bp, Rattus norvegicus
gtgcacaaagacttacacacttggc

SEQ ID NO: 505990 - DNA, 25 bp, Rattus norvegicus
gtgcacaaagtgatccctggtttct

SEQ ID NO: 505991 - DNA, 25 bp, Rattus norvegicus
gtgcacaaagtgttccctggtttct

SEQ ID NO: 505992 - DNA, 25 bp, Rattus norvegicus
gtgcacaaatgtagcccaagagtaa

SEQ ID NO: 505993 - DNA, 25 bp, Rattus norvegicus
gtgcacaaatgttgcccaagagtaa

SEQ ID NO: 505994 - DNA, 25 bp, Rattus norvegicus
gtgcacaacctgaaagctgtcctag

SEQ ID NO: 505995 - DNA, 25 bp, Rattus norvegicus
gtgcacaacctgtaagctgtcctag

SEQ ID NO: 505996 - DNA, 25 bp, Rattus norvegicus
gtgcacaagcgcaactactgcgcct

SEQ ID NO: 505997 - DNA, 25 bp, Rattus norvegicus
gtgcacaagcgctactactgcgcct

SEQ ID NO: 505998 - DNA, 25 bp, Rattus norvegicus
gtgcacaaggccctgagcgccatcg

SEQ ID NO: 505999 - DNA, 25 bp, Rattus norvegicus
gtgcacaaggccgtgagcgccatcg

SEQ ID NO: 506000 - DNA, 25 bp, Rattus norvegicus
gtgcacaatcacatccacagagact

SEQ ID NO: 506001 - DNA, 25 bp, Rattus norvegicus
gtgcacaatcacttccacagagact

SEQ ID NO: 506002 - DNA, 25 bp, Rattus norvegicus
gtgcacaatgcgctagcgcctgcta

SEQ ID NO: 506003 - DNA, 25 bp, Rattus norvegicus
gtgcacaatgcggtagcgcctgcta

SEQ ID NO: 506004 - DNA, 25 bp, Rattus norvegicus
gtgcacacaaagcaaggtcttgcct

SEQ ID NO: 506005 - DNA, 25 bp, Rattus norvegicus
gtgcacacaaaggaaggtcttgcct

SEQ ID NO: 506006 - DNA, 25 bp, Rattus norvegicus
gtgcacacacacagaggatgatgaa

SEQ ID NO: 506007 - DNA, 25 bp, Rattus norvegicus
gtgcacacacactgaggatgatgaa

SEQ ID NO: 506008 - DNA, 25 bp, Rattus norvegicus
gtgcacacacctaacctgtgtagat

SEQ ID NO: 506009 - DNA, 25 bp, Rattus norvegicus
gtgcacacaccttacctgtgtagat

SEQ ID NO: 506010 - DNA, 25 bp, Rattus norvegicus
gtgcacacagccagagacaagagat

SEQ ID NO: 506011 - DNA, 25 bp, Rattus norvegicus
gtgcacacagcctgagacaagagat

SEQ ID NO: 506012 - DNA, 25 bp, Rattus norvegicus
gtgcacacagtccaacctgatgggt

SEQ ID NO: 506013 - DNA, 25 bp, Rattus norvegicus
gtgcacacagtcgaacctgatgggt

SEQ ID NO: 506014 - DNA, 25 bp, Rattus norvegicus
gtgcacacccacagagagaacccag

SEQ ID NO: 506015 - DNA, 25 bp, Rattus norvegicus
gtgcacacccactgagagaacccag

SEQ ID NO: 506016 - DNA, 25 bp, Rattus norvegicus
gtgcacacctgtatactgtatgccc

SEQ ID NO: 506017 - DNA, 25 bp, Rattus norvegicus
gtgcacacctgtttactgtatgccc

SEQ ID NO: 506018 - DNA, 25 bp, Rattus norvegicus
gtgcacacggtcctggccaacatca

SEQ ID NO: 506019 - DNA, 25 bp, Rattus norvegicus
gtgcacacggtcgtggccaacatca

SEQ ID NO: 506020 - DNA, 25 bp, Rattus norvegicus
gtgcacactaatcctatcctttaag

SEQ ID NO: 506021 - DNA, 25 bp, Rattus norvegicus
gtgcacactaatgctatcctttaag

SEQ ID NO: 506022 - DNA, 25 bp, Rattus norvegicus
gtgcacactgaaaccttacttgaac

SEQ ID NO: 506023 - DNA, 25 bp, Rattus norvegicus
gtgcacactgaatccttacttgaac

SEQ ID NO: 506024 - DNA, 25 bp, Rattus norvegicus
gtgcacactgggactaagttggcat

SEQ ID NO: 506025 - DNA, 25 bp, Rattus norvegicus
gtgcacactgggtctaagttggcat

SEQ ID NO: 506026 - DNA, 25 bp, Rattus norvegicus
gtgcacactgtgatattttcccacc

SEQ ID NO: 506027 - DNA, 25 bp, Rattus norvegicus
gtgcacactgtgttattttcccacc

SEQ ID NO: 506028 - DNA, 25 bp, Rattus norvegicus
gtgcacacttgcaatcaagactcat

SEQ ID NO: 506029 - DNA, 25 bp, Rattus norvegicus
gtgcacacttgctatcaagactcat

SEQ ID NO: 506030 - DNA, 25 bp, Rattus norvegicus
gtgcacagacacacctaaacgcata

SEQ ID NO: 506031 - DNA, 25 bp, Rattus norvegicus
gtgcacagacactcctaaacgcata

SEQ ID NO: 506032 - DNA, 25 bp, Rattus norvegicus
gtgcacagacataatccagacagaa

SEQ ID NO: 506033 - DNA, 25 bp, Rattus norvegicus
gtgcacagacattatccagacagaa

SEQ ID NO: 506034 - DNA, 25 bp, Rattus norvegicus
gtgcacagagggacttttccttatc

SEQ ID NO: 506035 - DNA, 25 bp, Rattus norvegicus
gtgcacagagggtcttttccttatc

SEQ ID NO: 506036 - DNA, 25 bp, Rattus norvegicus
gtgcacagcagcactctggaggcgt

SEQ ID NO: 506037 - DNA, 25 bp, Rattus norvegicus
gtgcacagcagctctctggaggcgt

SEQ ID NO: 506038 - DNA, 25 bp, Rattus norvegicus
gtgcacagccacatgaggaggacca

SEQ ID NO: 506039 - DNA, 25 bp, Rattus norvegicus
gtgcacagccacttgaggaggacca

SEQ ID NO: 506040 - DNA, 25 bp, Rattus norvegicus
gtgcacagccagaacagtctcctga

SEQ ID NO: 506041 - DNA, 25 bp, Rattus norvegicus
gtgcacagccagtacagtctcctga

SEQ ID NO: 506042 - DNA, 25 bp, Rattus norvegicus
gtgcacagctgacaaatcgaatcct

SEQ ID NO: 506043 - DNA, 25 bp, Rattus norvegicus
gtgcacagctgagaaatcgaatcct

SEQ ID NO: 506044 - DNA, 25 bp, Rattus norvegicus
gtgcacagctgtattttccatgaag

SEQ ID NO: 506045 - DNA, 25 bp, Rattus norvegicus
gtgcacagctgttttttccatgaag

SEQ ID NO: 506046 - DNA, 25 bp, Rattus norvegicus
gtgcacagcttgcttatggacgcag

SEQ ID NO: 506047 - DNA, 25 bp, Rattus norvegicus
gtgcacagcttggttatggacgcag

SEQ ID NO: 506048 - DNA, 25 bp, Rattus norvegicus
gtgcacagctttcaggatgttccct

SEQ ID NO: 506049 - DNA, 25 bp, Rattus norvegicus
gtgcacagctttgaggatgttccct

SEQ ID NO: 506050 - DNA, 25 bp, Rattus norvegicus
gtgcacaggaatctactaaatctaa

SEQ ID NO: 506051 - DNA, 25 bp, Rattus norvegicus
gtgcacaggaatgtactaaatctaa

SEQ ID NO: 506052 - DNA, 25 bp, Rattus norvegicus
gtgcacaggtctaaggagcggcctc

SEQ ID NO: 506053 - DNA, 25 bp, Rattus norvegicus
gtgcacaggtcttaggagcggcctc

SEQ ID NO: 506054 - DNA, 25 bp, Rattus norvegicus
gtgcacagtgaaccttctcatcaga

SEQ ID NO: 506055 - DNA, 25 bp, Rattus norvegicus
gtgcacagtgaagcttctcatcaga

SEQ ID NO: 506056 - DNA, 25 bp, Rattus norvegicus
gtgcacagttctattcactgctgat

SEQ ID NO: 506057 - DNA, 25 bp, Rattus norvegicus
gtgcacagttcttttcactgctgat

SEQ ID NO: 506058 - DNA, 25 bp, Rattus norvegicus
gtgcacagtttgctgtatgaagtaa

SEQ ID NO: 506059 - DNA, 25 bp, Rattus norvegicus
gtgcacagtttggtgtatgaagtaa

SEQ ID NO: 506060 - DNA, 25 bp, Rattus norvegicus
gtgcacataactcgctactagatag

SEQ ID NO: 506061 - DNA, 25 bp, Rattus norvegicus
gtgcacataactggctactagatag

SEQ ID NO: 506062 - DNA, 25 bp, Rattus norvegicus
gtgcacatacatacatggacgcaaa

SEQ ID NO: 506063 - DNA, 25 bp, Rattus norvegicus
gtgcacatacattcatggacgcaaa

SEQ ID NO: 506064 - DNA, 25 bp, Rattus norvegicus
gtgcacatactacacttcttgggaa

SEQ ID NO: 506065 - DNA, 25 bp, Rattus norvegicus
gtgcacatactagacttcttgggaa

SEQ ID NO: 506066 - DNA, 25 bp, Rattus norvegicus
gtgcacatagtcattctacacgcag

SEQ ID NO: 506067 - DNA, 25 bp, Rattus norvegicus
gtgcacatagtctttctacacgcag

SEQ ID NO: 506068 - DNA, 25 bp, Rattus norvegicus
gtgcacatatttagcctgggtaagc

SEQ ID NO: 506069 - DNA, 25 bp, Rattus norvegicus
gtgcacatattttgcctgggtaagc

SEQ ID NO: 506070 - DNA, 25 bp, Rattus norvegicus
gtgcacatcagtaacggctgtcttc

SEQ ID NO: 506071 - DNA, 25 bp, Rattus norvegicus
gtgcacatcagttacggctgtcttc

SEQ ID NO: 506072 - DNA, 25 bp, Rattus norvegicus
gtgcacatccgtctcaagactgcta

SEQ ID NO: 506073 - DNA, 25 bp, Rattus norvegicus
gtgcacatccgtgtcaagactgcta

SEQ ID NO: 506074 - DNA, 25 bp, Rattus norvegicus
gtgcacatgctcatcagttttcatt

SEQ ID NO: 506075 - DNA, 25 bp, Rattus norvegicus
gtgcacatgctcttcagttttcatt

SEQ ID NO: 506076 - DNA, 25 bp, Rattus norvegicus
gtgcacatgcttccctgcacagaga

SEQ ID NO: 506077 - DNA, 25 bp, Rattus norvegicus
gtgcacatgcttgcctgcacagaga

SEQ ID NO: 506078 - DNA, 25 bp, Rattus norvegicus
gtgcacatggatacacatgccttca

SEQ ID NO: 506079 - DNA, 25 bp, Rattus norvegicus
gtgcacatggattcacatgccttca

SEQ ID NO: 506080 - DNA, 25 bp, Rattus norvegicus
gtgcacatggcccaaggtgacctcc

SEQ ID NO: 506081 - DNA, 25 bp, Rattus norvegicus
gtgcacatggccgaaggtgacctcc

SEQ ID NO: 506082 - DNA, 25 bp, Rattus norvegicus
gtgcacatgtaaacttcatagtcca

SEQ ID NO: 506083 - DNA, 25 bp, Rattus norvegicus
gtgcacatgtaatcttcatagtcca

SEQ ID NO: 506084 - DNA, 25 bp, Rattus norvegicus
gtgcacatgtacattgttattctca

SEQ ID NO: 506085 - DNA, 25 bp, Rattus norvegicus
gtgcacatgtacctactccagagat

SEQ ID NO: 506086 - DNA, 25 bp, Rattus norvegicus
gtgcacatgtacgtactccagagat

SEQ ID NO: 506087 - DNA, 25 bp, Rattus norvegicus
gtgcacatgtactttgttattctca

SEQ ID NO: 506088 - DNA, 25 bp, Rattus norvegicus
gtgcacatgtgcacacggtgcttta

SEQ ID NO: 506089 - DNA, 25 bp, Rattus norvegicus
gtgcacatgtgctcacggtgcttta

SEQ ID NO: 506090 - DNA, 25 bp, Rattus norvegicus
gtgcacatgttaatagcccttgaat

SEQ ID NO: 506091 - DNA, 25 bp, Rattus norvegicus
gtgcacatgttattagcccttgaat

SEQ ID NO: 506092 - DNA, 25 bp, Rattus norvegicus
gtgcacatgtttacctgacacagca

SEQ ID NO: 506093 - DNA, 25 bp, Rattus norvegicus
gtgcacatgttttcctgacacagca

SEQ ID NO: 506094 - DNA, 25 bp, Rattus norvegicus
gtgcacattcccacacacagacata

SEQ ID NO: 506095 - DNA, 25 bp, Rattus norvegicus
gtgcacattccctcacacagacata

SEQ ID NO: 506096 - DNA, 25 bp, Rattus norvegicus
gtgcacattcgacatgacggacgtc

SEQ ID NO: 506097 - DNA, 25 bp, Rattus norvegicus
gtgcacattcgagatgacggacgtc

SEQ ID NO: 506098 - DNA, 25 bp, Rattus norvegicus
gtgcacattggaccagacattctgc

SEQ ID NO: 506099 - DNA, 25 bp, Rattus norvegicus
gtgcacattggagcagacattctgc

SEQ ID NO: 506100 - DNA, 25 bp, Rattus norvegicus
gtgcaccaaacaccagttgtcccat

SEQ ID NO: 506101 - DNA, 25 bp, Rattus norvegicus
gtgcaccaaacagcagttgtcccat

SEQ ID NO: 506102 - DNA, 25 bp, Rattus norvegicus
gtgcaccaaagacgagcatctctgt

SEQ ID NO: 506103 - DNA, 25 bp, Rattus norvegicus
gtgcaccaaagaggagcatctctgt

SEQ ID NO: 506104 - DNA, 25 bp, Rattus norvegicus
gtgcaccaacatcacgagctttaag

SEQ ID NO: 506105 - DNA, 25 bp, Rattus norvegicus
gtgcaccaacatgacgagctttaag

SEQ ID NO: 506106 - DNA, 25 bp, Rattus norvegicus
gtgcaccaagggagctctgtttgta

SEQ ID NO: 506107 - DNA, 25 bp, Rattus norvegicus
gtgcaccaagggtgctctgtttgta

SEQ ID NO: 506108 - DNA, 25 bp, Rattus norvegicus
gtgcaccacacaactgaattctcat

SEQ ID NO: 506109 - DNA, 25 bp, Rattus norvegicus
gtgcaccacacatctgaattctcat

SEQ ID NO: 506110 - DNA, 25 bp, Rattus norvegicus
gtgcaccaccacacatggctttctt

SEQ ID NO: 506111 - DNA, 25 bp, Rattus norvegicus
gtgcaccaccactcatggctttctt

SEQ ID NO: 506112 - DNA, 25 bp, Rattus norvegicus
gtgcaccaccgcagtatggctaaaa

SEQ ID NO: 506113 - DNA, 25 bp, Rattus norvegicus
gtgcaccaccgctgtatggctaaaa

SEQ ID NO: 506114 - DNA, 25 bp, Rattus norvegicus
gtgcaccacgatagatcagctagct

SEQ ID NO: 506115 - DNA, 25 bp, Rattus norvegicus
gtgcaccacgattgatcagctagct

SEQ ID NO: 506116 - DNA, 25 bp, Rattus norvegicus
gtgcaccacgtacaagggacatctt

SEQ ID NO: 506117 - DNA, 25 bp, Rattus norvegicus
gtgcaccacgtagaagggacatctt

SEQ ID NO: 506118 - DNA, 25 bp, Rattus norvegicus
gtgcaccacgtcaacctggaaggag

SEQ ID NO: 506119 - DNA, 25 bp, Rattus norvegicus
gtgcaccacgtctacctggaaggag

SEQ ID NO: 506120 - DNA, 25 bp, Rattus norvegicus
gtgcaccactggctggctcaaaaag

SEQ ID NO: 506121 - DNA, 25 bp, Rattus norvegicus
gtgcaccactgggtggctcaaaaag

SEQ ID NO: 506122 - DNA, 25 bp, Rattus norvegicus
gtgcaccagcaaaattctccagcat

SEQ ID NO: 506123 - DNA, 25 bp, Rattus norvegicus
gtgcaccagcaatattctccagcat

SEQ ID NO: 506124 - DNA, 25 bp, Rattus norvegicus
gtgcaccagggacatgctgccaaga

SEQ ID NO: 506125 - DNA, 25 bp, Rattus norvegicus
gtgcaccagggagatgctgccaaga

SEQ ID NO: 506126 - DNA, 25 bp, Rattus norvegicus
gtgcacccaaggactccaatttgtt

SEQ ID NO: 506127 - DNA, 25 bp, Rattus norvegicus
gtgcacccaaggtctccaatttgtt

SEQ ID NO: 506128 - DNA, 25 bp, Rattus norvegicus
gtgcacccaggacaaacaagcttga

SEQ ID NO: 506129 - DNA, 25 bp, Rattus norvegicus
gtgcacccaggagaaacaagcttga

SEQ ID NO: 506130 - DNA, 25 bp, Rattus norvegicus
gtgcacccagttcaaaatggcccag

SEQ ID NO: 506131 - DNA, 25 bp, Rattus norvegicus
gtgcacccagttgaaaatggcccag

SEQ ID NO: 506132 - DNA, 25 bp, Rattus norvegicus
gtgcaccccgtcaagagttttcagc

SEQ ID NO: 506133 - DNA, 25 bp, Rattus norvegicus
gtgcaccccgtctagagttttcagc

SEQ ID NO: 506134 - DNA, 25 bp, Rattus norvegicus
gtgcacccgtgcacttacacttggc

SEQ ID NO: 506135 - DNA, 25 bp, Rattus norvegicus
gtgcacccgtgctcttacacttggc

SEQ ID NO: 506136 - DNA, 25 bp, Rattus norvegicus
gtgcaccctaagcatgctgaaggca

SEQ ID NO: 506137 - DNA, 25 bp, Rattus norvegicus
gtgcaccctaaggatgctgaaggca

SEQ ID NO: 506138 - DNA, 25 bp, Rattus norvegicus
gtgcaccctgtaactgtctaaatta

SEQ ID NO: 506139 - DNA, 25 bp, Rattus norvegicus
gtgcaccctgtatctgtctaaatta

SEQ ID NO: 506140 - DNA, 25 bp, Rattus norvegicus
gtgcacccttttaatcttcactagt

SEQ ID NO: 506141 - DNA, 25 bp, Rattus norvegicus
gtgcacccttttcagctggatgaga

SEQ ID NO: 506142 - DNA, 25 bp, Rattus norvegicus
gtgcacccttttgagctggatgaga

SEQ ID NO: 506143 - DNA, 25 bp, Rattus norvegicus
gtgcaccctttttatcttcactagt

SEQ ID NO: 506144 - DNA, 25 bp, Rattus norvegicus
gtgcaccgaacaagtacagttacct

SEQ ID NO: 506145 - DNA, 25 bp, Rattus norvegicus
gtgcaccgaacatgtacagttacct

SEQ ID NO: 506146 - DNA, 25 bp, Rattus norvegicus
gtgcaccgaggtccctgtcttaagg

SEQ ID NO: 506147 - DNA, 25 bp, Rattus norvegicus
gtgcaccgaggtgcctgtcttaagg

SEQ ID NO: 506148 - DNA, 25 bp, Rattus norvegicus
gtgcaccgagtgaggctacaagttc

SEQ ID NO: 506149 - DNA, 25 bp, Rattus norvegicus
gtgcaccgagtgtggctacaagttc

SEQ ID NO: 506150 - DNA, 25 bp, Rattus norvegicus
gtgcaccgccagaagcaacagtata

SEQ ID NO: 506151 - DNA, 25 bp, Rattus norvegicus
gtgcaccgccagtagcaacagtata

SEQ ID NO: 506152 - DNA, 25 bp, Rattus norvegicus
gtgcaccgtctgatgcgcaagggaa

SEQ ID NO: 506153 - DNA, 25 bp, Rattus norvegicus
gtgcaccgtctgctccgaaagggca

SEQ ID NO: 506154 - DNA, 25 bp, Rattus norvegicus
gtgcaccgtctgctttacaagggca

SEQ ID NO: 506155 - DNA, 25 bp, Rattus norvegicus
gtgcaccgtctggtccgaaagggca

SEQ ID NO: 506156 - DNA, 25 bp, Rattus norvegicus
gtgcaccgtctggtttacaagggca

SEQ ID NO: 506157 - DNA, 25 bp, Rattus norvegicus
gtgcaccgtctgttgcgcaagggaa

SEQ ID NO: 506158 - DNA, 25 bp, Rattus norvegicus
gtgcaccgtgtgctgttgaatttgt

SEQ ID NO: 506159 - DNA, 25 bp, Rattus norvegicus
gtgcaccgtgtggtgttgaatttgt

SEQ ID NO: 506160 - DNA, 25 bp, Rattus norvegicus
gtgcacctagagctttttataacag

SEQ ID NO: 506161 - DNA, 25 bp, Rattus norvegicus
gtgcacctagaggtttttataacag

SEQ ID NO: 506162 - DNA, 25 bp, Rattus norvegicus
gtgcacctcatacactactttggta

SEQ ID NO: 506163 - DNA, 25 bp, Rattus norvegicus
gtgcacctcatagactactttggta

SEQ ID NO: 506164 - DNA, 25 bp, Rattus norvegicus
gtgcacctgattattgctctcaaag

SEQ ID NO: 506165 - DNA, 25 bp, Rattus norvegicus
gtgcacctgatttttgctctcaaag

SEQ ID NO: 506166 - DNA, 25 bp, Rattus norvegicus
gtgcacctgccaacagaagcttttg

SEQ ID NO: 506167 - DNA, 25 bp, Rattus norvegicus
gtgcacctgccatcagaagcttttg

SEQ ID NO: 506168 - DNA, 25 bp, Rattus norvegicus
gtgcacctggaccattaggactgtg

SEQ ID NO: 506169 - DNA, 25 bp, Rattus norvegicus
gtgcacctggacgattaggactgtg

SEQ ID NO: 506170 - DNA, 25 bp, Rattus norvegicus
gtgcacctgtagatctgtttattgg

SEQ ID NO: 506171 - DNA, 25 bp, Rattus norvegicus
gtgcacctgtagttctgtttattgg

SEQ ID NO: 506172 - DNA, 25 bp, Rattus norvegicus
gtgcacctgtgtctggtgtctcaca

SEQ ID NO: 506173 - DNA, 25 bp, Rattus norvegicus
gtgcacctgtgtgtggtgtctcaca

SEQ ID NO: 506174 - DNA, 25 bp, Rattus norvegicus
gtgcaccttcaacgaggcccagaga

SEQ ID NO: 506175 - DNA, 25 bp, Rattus norvegicus
gtgcaccttcaaggaggcccagaga

SEQ ID NO: 506176 - DNA, 25 bp, Rattus norvegicus
gtgcaccttgcacattcttttatat

SEQ ID NO: 506177 - DNA, 25 bp, Rattus norvegicus
gtgcaccttgcagattcttttatat

SEQ ID NO: 506178 - DNA, 25 bp, Rattus norvegicus
gtgcacctttgtcaccgcagaagag

SEQ ID NO: 506179 - DNA, 25 bp, Rattus norvegicus
gtgcacctttgtgaccgcagaagag

SEQ ID NO: 506180 - DNA, 25 bp, Rattus norvegicus
gtgcacgactgcatctggacgcatg

SEQ ID NO: 506181 - DNA, 25 bp, Rattus norvegicus
gtgcacgactgcttctggacgcatg

SEQ ID NO: 506182 - DNA, 25 bp, Rattus norvegicus
gtgcacgactgtacctgcaattgat

SEQ ID NO: 506183 - DNA, 25 bp, Rattus norvegicus
gtgcacgactgttcctgcaattgat

SEQ ID NO: 506184 - DNA, 25 bp, Rattus norvegicus
gtgcacgagctgattgcctgtagaa

SEQ ID NO: 506185 - DNA, 25 bp, Rattus norvegicus
gtgcacgagctgtttgcctgtagaa

SEQ ID NO: 506186 - DNA, 25 bp, Rattus norvegicus
gtgcacgagcttagcggttttcagt

SEQ ID NO: 506187 - DNA, 25 bp, Rattus norvegicus
gtgcacgagctttgcggttttcagt

SEQ ID NO: 506188 - DNA, 25 bp, Rattus norvegicus
gtgcacgaggtcatccgcttaaatt

SEQ ID NO: 506189 - DNA, 25 bp, Rattus norvegicus
gtgcacgaggtcttccgcttaaatt

SEQ ID NO: 506190 - DNA, 25 bp, Rattus norvegicus
gtgcacgatattatttcctcttaaa

SEQ ID NO: 506191 - DNA, 25 bp, Rattus norvegicus
gtgcacgatattttttcctcttaaa

SEQ ID NO: 506192 - DNA, 25 bp, Rattus norvegicus
gtgcacgcacatcaccagtttgtaa

SEQ ID NO: 506193 - DNA, 25 bp, Rattus norvegicus
gtgcacgcacatgaccagtttgtaa

SEQ ID NO: 506194 - DNA, 25 bp, Rattus norvegicus
gtgcacgcccagatgccgagaaaaa

SEQ ID NO: 506195 - DNA, 25 bp, Rattus norvegicus
gtgcacgcccagttgccgagaaaaa

SEQ ID NO: 506196 - DNA, 25 bp, Rattus norvegicus
gtgcacgccgggaggtctctgaggg

SEQ ID NO: 506197 - DNA, 25 bp, Rattus norvegicus
gtgcacgccgggtggtctctgaggg

SEQ ID NO: 506198 - DNA, 25 bp, Rattus norvegicus
gtgcacgcctttaatgcatcagtgg

SEQ ID NO: 506199 - DNA, 25 bp, Rattus norvegicus
gtgcacgccttttatgcatcagtgg

SEQ ID NO: 506200 - DNA, 25 bp, Rattus norvegicus
gtgcacgcttatattagggccagca

SEQ ID NO: 506201 - DNA, 25 bp, Rattus norvegicus
gtgcacgcttattttagggccagca

SEQ ID NO: 506202 - DNA, 25 bp, Rattus norvegicus
gtgcacggacttcgaaggccttaac

SEQ ID NO: 506203 - DNA, 25 bp, Rattus norvegicus
gtgcacggacttggaaggccttaac

SEQ ID NO: 506204 - DNA, 25 bp, Rattus norvegicus
gtgcacggatttaactaccttggct

SEQ ID NO: 506205 - DNA, 25 bp, Rattus norvegicus
gtgcacggattttactaccttggct

SEQ ID NO: 506206 - DNA, 25 bp, Rattus norvegicus
gtgcacggcaccctcactagtgatg

SEQ ID NO: 506207 - DNA, 25 bp, Rattus norvegicus
gtgcacggcaccgtcactagtgatg

SEQ ID NO: 506208 - DNA, 25 bp, Rattus norvegicus
gtgcacgggcagcaggacaaaatct

SEQ ID NO: 506209 - DNA, 25 bp, Rattus norvegicus
gtgcacgggcaggaggacaaaatct

SEQ ID NO: 506210 - DNA, 25 bp, Rattus norvegicus
gtgcacgtaagtcagattattttta

SEQ ID NO: 506211 - DNA, 25 bp, Rattus norvegicus
gtgcacgtaagtgagattattttta

SEQ ID NO: 506212 - DNA, 25 bp, Rattus norvegicus
gtgcacgtctgaaatcccagcgctc

SEQ ID NO: 506213 - DNA, 25 bp, Rattus norvegicus
gtgcacgtctgatatcccagcgctc

SEQ ID NO: 506214 - DNA, 25 bp, Rattus norvegicus
gtgcacgtgcagctgaatgactatc

SEQ ID NO: 506215 - DNA, 25 bp, Rattus norvegicus
gtgcacgtgcaggtgaatgactatc

SEQ ID NO: 506216 - DNA, 25 bp, Rattus norvegicus
gtgcacgtggcgcacatacatgcat

SEQ ID NO: 506217 - DNA, 25 bp, Rattus norvegicus
gtgcacgtggcggacatacatgcat

SEQ ID NO: 506218 - DNA, 25 bp, Rattus norvegicus
gtgcacgtgtccactatttcagtga

SEQ ID NO: 506219 - DNA, 25 bp, Rattus norvegicus
gtgcacgtgtcctctatttcagtga

SEQ ID NO: 506220 - DNA, 25 bp, Rattus norvegicus
gtgcactaacacatttgctccagaa

SEQ ID NO: 506221 - DNA, 25 bp, Rattus norvegicus
gtgcactaacacttttgctccagaa

SEQ ID NO: 506222 - DNA, 25 bp, Rattus norvegicus
gtgcactaacgccttttacattaaa

SEQ ID NO: 506223 - DNA, 25 bp, Rattus norvegicus
gtgcactaacgcgttttacattaaa

SEQ ID NO: 506224 - DNA, 25 bp, Rattus norvegicus
gtgcactaacttagctaccaacttt

SEQ ID NO: 506225 - DNA, 25 bp, Rattus norvegicus
gtgcactaactttgctaccaacttt

SEQ ID NO: 506226 - DNA, 25 bp, Rattus norvegicus
gtgcactaatagatccttttctgtt

SEQ ID NO: 506227 - DNA, 25 bp, Rattus norvegicus
gtgcactaatagttccttttctgtt

SEQ ID NO: 506228 - DNA, 25 bp, Rattus norvegicus
gtgcactacacacggatgctccaga

SEQ ID NO: 506229 - DNA, 25 bp, Rattus norvegicus
gtgcactacacagggatgctccaga

SEQ ID NO: 506230 - DNA, 25 bp, Rattus norvegicus
gtgcactaccatccaatcttgatgt

SEQ ID NO: 506231 - DNA, 25 bp, Rattus norvegicus
gtgcactaccatgcaatcttgatgt

SEQ ID NO: 506232 - DNA, 25 bp, Rattus norvegicus
gtgcactactctctcatatgattct

SEQ ID NO: 506233 - DNA, 25 bp, Rattus norvegicus
gtgcactactctgtcatatgattct

SEQ ID NO: 506234 - DNA, 25 bp, Rattus norvegicus
gtgcactagcacacctggcaggaag

SEQ ID NO: 506235 - DNA, 25 bp, Rattus norvegicus
gtgcactagcactcctggcaggaag

SEQ ID NO: 506236 - DNA, 25 bp, Rattus norvegicus
gtgcactagggcagccatacttgaa

SEQ ID NO: 506237 - DNA, 25 bp, Rattus norvegicus
gtgcactagggctgccatacttgaa

SEQ ID NO: 506238 - DNA, 25 bp, Rattus norvegicus
gtgcactcactgactaaacccttga

SEQ ID NO: 506239 - DNA, 25 bp, Rattus norvegicus
gtgcactcactgtctaaacccttga

SEQ ID NO: 506240 - DNA, 25 bp, Rattus norvegicus
gtgcactcattgaatcgcatgtttt

SEQ ID NO: 506241 - DNA, 25 bp, Rattus norvegicus
gtgcactcattgtatcgcatgtttt

SEQ ID NO: 506242 - DNA, 25 bp, Rattus norvegicus
gtgcactccagaaaaacgccaatgt

SEQ ID NO: 506243 - DNA, 25 bp, Rattus norvegicus
gtgcactccagataaacgccaatgt

SEQ ID NO: 506244 - DNA, 25 bp, Rattus norvegicus
gtgcactccggtaaggtaattctca

SEQ ID NO: 506245 - DNA, 25 bp, Rattus norvegicus
gtgcactccggttaggtaattctca

SEQ ID NO: 506246 - DNA, 25 bp, Rattus norvegicus
gtgcactctagcctggttatactag

SEQ ID NO: 506247 - DNA, 25 bp, Rattus norvegicus
gtgcactctagcgtggttatactag

SEQ ID NO: 506248 - DNA, 25 bp, Rattus norvegicus
gtgcactctcatactgtaggcaata

SEQ ID NO: 506249 - DNA, 25 bp, Rattus norvegicus
gtgcactctcattctgtaggcaata

SEQ ID NO: 506250 - DNA, 25 bp, Rattus norvegicus
gtgcactctcgtctatgtatcctca

SEQ ID NO: 506251 - DNA, 25 bp, Rattus norvegicus
gtgcactctcgtgtatgtatcctca

SEQ ID NO: 506252 - DNA, 25 bp, Rattus norvegicus
gtgcactcttgtaactgggtcaaaa

SEQ ID NO: 506253 - DNA, 25 bp, Rattus norvegicus
gtgcactcttgttactgggtcaaaa

SEQ ID NO: 506254 - DNA, 25 bp, Rattus norvegicus
gtgcactgaacccacaagttgacca

SEQ ID NO: 506255 - DNA, 25 bp, Rattus norvegicus
gtgcactgaaccgacaagttgacca

SEQ ID NO: 506256 - DNA, 25 bp, Rattus norvegicus
gtgcactgaagcaattcatgtgtct

SEQ ID NO: 506257 - DNA, 25 bp, Rattus norvegicus
gtgcactgaagctattcatgtgtct

SEQ ID NO: 506258 - DNA, 25 bp, Rattus norvegicus
gtgcactgaatcaaacctttaaggt

SEQ ID NO: 506259 - DNA, 25 bp, Rattus norvegicus
gtgcactgaatctaacctttaaggt

SEQ ID NO: 506260 - DNA, 25 bp, Rattus norvegicus
gtgcactgagcaccaccagcgtctg

SEQ ID NO: 506261 - DNA, 25 bp, Rattus norvegicus
gtgcactgagcagcaccagcgtctg

SEQ ID NO: 506262 - DNA, 25 bp, Rattus norvegicus
gtgcactgaggtcatccttggtcat

SEQ ID NO: 506263 - DNA, 25 bp, Rattus norvegicus
gtgcactgaggtgatccttggtcat

SEQ ID NO: 506264 - DNA, 25 bp, Rattus norvegicus
gtgcactgcactaggttttactgac

SEQ ID NO: 506265 - DNA, 25 bp, Rattus norvegicus
gtgcactgcacttggttttactgac

SEQ ID NO: 506266 - DNA, 25 bp, Rattus norvegicus
gtgcactgcctcacagacttgtttt

SEQ ID NO: 506267 - DNA, 25 bp, Rattus norvegicus
gtgcactgcctctcagacttgtttt

SEQ ID NO: 506268 - DNA, 25 bp, Rattus norvegicus
gtgcactgctctccctgactgcaga

SEQ ID NO: 506269 - DNA, 25 bp, Rattus norvegicus
gtgcactgctctgcctgactgcaga

SEQ ID NO: 506270 - DNA, 25 bp, Rattus norvegicus
gtgcactggagaccaattcctgggt

SEQ ID NO: 506271 - DNA, 25 bp, Rattus norvegicus
gtgcactggagagcaattcctgggt

SEQ ID NO: 506272 - DNA, 25 bp, Rattus norvegicus
gtgcactggattacacaactgccac

SEQ ID NO: 506273 - DNA, 25 bp, Rattus norvegicus
gtgcactggatttcacaactgccac

SEQ ID NO: 506274 - DNA, 25 bp, Rattus norvegicus
gtgcactgggagagccaaccaccat

SEQ ID NO: 506275 - DNA, 25 bp, Rattus norvegicus
gtgcactgggagtgccaaccaccat

SEQ ID NO: 506276 - DNA, 25 bp, Rattus norvegicus
gtgcactgtagcatacctgaaccag

SEQ ID NO: 506277 - DNA, 25 bp, Rattus norvegicus
gtgcactgtagcttacctgaaccag

SEQ ID NO: 506278 - DNA, 25 bp, Rattus norvegicus
gtgcactgtcagaatagtatccctg

SEQ ID NO: 506279 - DNA, 25 bp, Rattus norvegicus
gtgcactgtcagctgtaatagacca

SEQ ID NO: 506280 - DNA, 25 bp, Rattus norvegicus
gtgcactgtcaggtgtaatagacca

SEQ ID NO: 506281 - DNA, 25 bp, Rattus norvegicus
gtgcactgtcagtatagtatccctg

SEQ ID NO: 506282 - DNA, 25 bp, Rattus norvegicus
gtgcactgtgaactctgcaacctgt

SEQ ID NO: 506283 - DNA, 25 bp, Rattus norvegicus
gtgcactgtgaagtctgcaacctgt

SEQ ID NO: 506284 - DNA, 25 bp, Rattus norvegicus
gtgcactgtgctcggtactgtaatc

SEQ ID NO: 506285 - DNA, 25 bp, Rattus norvegicus
gtgcactgtgctgggtactgtaatc

SEQ ID NO: 506286 - DNA, 25 bp, Rattus norvegicus
gtgcactgtgggaaacattgtccga

SEQ ID NO: 506287 - DNA, 25 bp, Rattus norvegicus
gtgcactgtgggtaacattgtccga

SEQ ID NO: 506288 - DNA, 25 bp, Rattus norvegicus
gtgcactgtttacatttcctggaca

SEQ ID NO: 506289 - DNA, 25 bp, Rattus norvegicus
gtgcactgtttagatttcctggaca

SEQ ID NO: 506290 - DNA, 25 bp, Rattus norvegicus
gtgcacttaacaatggaacccaaac

SEQ ID NO: 506291 - DNA, 25 bp, Rattus norvegicus
gtgcacttaacattggaacccaaac

SEQ ID NO: 506292 - DNA, 25 bp, Rattus norvegicus
gtgcacttacacatggccttatgta

SEQ ID NO: 506293 - DNA, 25 bp, Rattus norvegicus
gtgcacttacacttggccttatgta

SEQ ID NO: 506294 - DNA, 25 bp, Rattus norvegicus
gtgcacttacccagtgatgagtcac

SEQ ID NO: 506295 - DNA, 25 bp, Rattus norvegicus
gtgcacttaccctgtgatgagtcac

SEQ ID NO: 506296 - DNA, 25 bp, Rattus norvegicus
gtgcacttattcaccaagacgctga

SEQ ID NO: 506297 - DNA, 25 bp, Rattus norvegicus
gtgcacttattctccaagacgctga

SEQ ID NO: 506298 - DNA, 25 bp, Rattus norvegicus
gtgcacttcgcgctggtgatgtcct

SEQ ID NO: 506299 - DNA, 25 bp, Rattus norvegicus
gtgcacttcgcggtggtgatgtcct

SEQ ID NO: 506300 - DNA, 25 bp, Rattus norvegicus
gtgcacttcttcagaggttctcaga

SEQ ID NO: 506301 - DNA, 25 bp, Rattus norvegicus
gtgcacttcttctgaggttctcaga

SEQ ID NO: 506302 - DNA, 25 bp, Rattus norvegicus
gtgcacttgacacgcttgataactt

SEQ ID NO: 506303 - DNA, 25 bp, Rattus norvegicus
gtgcacttgacaggcttgataactt

SEQ ID NO: 506304 - DNA, 25 bp, Rattus norvegicus
gtgcactttatacgtgtcacactgt

SEQ ID NO: 506305 - DNA, 25 bp, Rattus norvegicus
gtgcactttataggtgtcacactgt

SEQ ID NO: 506306 - DNA, 25 bp, Rattus norvegicus
gtgcactttgcacaagtctcacctt

SEQ ID NO: 506307 - DNA, 25 bp, Rattus norvegicus
gtgcactttgcagaagtctcacctt

SEQ ID NO: 506308 - DNA, 25 bp, Rattus norvegicus
gtgcactttggtcacagagattaaa

SEQ ID NO: 506309 - DNA, 25 bp, Rattus norvegicus
gtgcactttggtgacagagattaaa

SEQ ID NO: 506310 - DNA, 25 bp, Rattus norvegicus
gtgcacttttgtctgtcctaactga

SEQ ID NO: 506311 - DNA, 25 bp, Rattus norvegicus
gtgcacttttgtgtgtcctaactga

SEQ ID NO: 506312 - DNA, 25 bp, Rattus norvegicus
gtgcactttttaagtttctttggaa

SEQ ID NO: 506313 - DNA, 25 bp, Rattus norvegicus
gtgcactttttatgtttctttggaa

SEQ ID NO: 506314 - DNA, 25 bp, Rattus norvegicus
gtgcagaaacaacctgctctctgtg

SEQ ID NO: 506315 - DNA, 25 bp, Rattus norvegicus
gtgcagaaacaagctgctctctgtg

SEQ ID NO: 506316 - DNA, 25 bp, Rattus norvegicus
gtgcagaaagctcagaccaaagaac

SEQ ID NO: 506317 - DNA, 25 bp, Rattus norvegicus
gtgcagaaagctgagaccaaagaac

SEQ ID NO: 506318 - DNA, 25 bp, Rattus norvegicus
gtgcagaacaccaactccgaaatga

SEQ ID NO: 506319 - DNA, 25 bp, Rattus norvegicus
gtgcagaacacctactccgaaatga

SEQ ID NO: 506320 - DNA, 25 bp, Rattus norvegicus
gtgcagaaccagaaaccacatagga

SEQ ID NO: 506321 - DNA, 25 bp, Rattus norvegicus
gtgcagaaccagtaaccacatagga

SEQ ID NO: 506322 - DNA, 25 bp, Rattus norvegicus
gtgcagaagtctcggagcatcctta

SEQ ID NO: 506323 - DNA, 25 bp, Rattus norvegicus
gtgcagaagtctgggagcatcctta

SEQ ID NO: 506324 - DNA, 25 bp, Rattus norvegicus
gtgcagaatctgctgttcgtcaatg

SEQ ID NO: 506325 - DNA, 25 bp, Rattus norvegicus
gtgcagaatctggtgttcgtcaatg

SEQ ID NO: 506326 - DNA, 25 bp, Rattus norvegicus
gtgcagaatcttacatgaacctcct

SEQ ID NO: 506327 - DNA, 25 bp, Rattus norvegicus
gtgcagaatctttcatgaacctcct

SEQ ID NO: 506328 - DNA, 25 bp, Rattus norvegicus
gtgcagacaagacgaagccccgttt

SEQ ID NO: 506329 - DNA, 25 bp, Rattus norvegicus
gtgcagacaagaggaagccccgttt

SEQ ID NO: 506330 - DNA, 25 bp, Rattus norvegicus
gtgcagacaatcagtgaaacccgat

SEQ ID NO: 506331 - DNA, 25 bp, Rattus norvegicus
gtgcagacaatctgtgaaacccgat

SEQ ID NO: 506332 - DNA, 25 bp, Rattus norvegicus
gtgcagacacttccagcacttggga

SEQ ID NO: 506333 - DNA, 25 bp, Rattus norvegicus
gtgcagacacttgcagcacttggga

SEQ ID NO: 506334 - DNA, 25 bp, Rattus norvegicus
gtgcagacagtactctcctcactga

SEQ ID NO: 506335 - DNA, 25 bp, Rattus norvegicus
gtgcagacagtagtctcctcactga

SEQ ID NO: 506336 - DNA, 25 bp, Rattus norvegicus
gtgcagacatttaatctcagctttt

SEQ ID NO: 506337 - DNA, 25 bp, Rattus norvegicus
gtgcagacattttatctcagctttt

SEQ ID NO: 506338 - DNA, 25 bp, Rattus norvegicus
gtgcagacccagcaggcttctggaa

SEQ ID NO: 506339 - DNA, 25 bp, Rattus norvegicus
gtgcagacccaggaggcttctggaa

SEQ ID NO: 506340 - DNA, 25 bp, Rattus norvegicus
gtgcagactttaccctcacaaacca

SEQ ID NO: 506341 - DNA, 25 bp, Rattus norvegicus
gtgcagactttagcctcacaaacca

SEQ ID NO: 506342 - DNA, 25 bp, Rattus norvegicus
gtgcagagaacgagtcaccacagaa

SEQ ID NO: 506343 - DNA, 25 bp, Rattus norvegicus
gtgcagagaacgtgtcaccacagaa

SEQ ID NO: 506344 - DNA, 25 bp, Rattus norvegicus
gtgcagagaattcccaggctgcttt

SEQ ID NO: 506345 - DNA, 25 bp, Rattus norvegicus
gtgcagagaattgccaggctgcttt

SEQ ID NO: 506346 - DNA, 25 bp, Rattus norvegicus
gtgcagagagccctcagtctgtctc

SEQ ID NO: 506347 - DNA, 25 bp, Rattus norvegicus
gtgcagagagccgtcagtctgtctc

SEQ ID NO: 506348 - DNA, 25 bp, Rattus norvegicus
gtgcagagatctcgcctcaatctaa

SEQ ID NO: 506349 - DNA, 25 bp, Rattus norvegicus
gtgcagagatctggcctcaatctaa

SEQ ID NO: 506350 - DNA, 25 bp, Rattus norvegicus
gtgcagagcagaattcagtttcctt

SEQ ID NO: 506351 - DNA, 25 bp, Rattus norvegicus
gtgcagagcagatttcagtttcctt

SEQ ID NO: 506352 - DNA, 25 bp, Rattus norvegicus
gtgcagagcatccaatactcagagt

SEQ ID NO: 506353 - DNA, 25 bp, Rattus norvegicus
gtgcagagcatcgaatactcagagt

SEQ ID NO: 506354 - DNA, 25 bp, Rattus norvegicus
gtgcagagcccgaaccgtgaactca

SEQ ID NO: 506355 - DNA, 25 bp, Rattus norvegicus
gtgcagagcccgtaccgtgaactca

SEQ ID NO: 506356 - DNA, 25 bp, Rattus norvegicus
gtgcagagcctcaggaacctatgca

SEQ ID NO: 506357 - DNA, 25 bp, Rattus norvegicus
gtgcagagcctctggaacctatgca

SEQ ID NO: 506358 - DNA, 25 bp, Rattus norvegicus
gtgcagagctcacaacctacttggg

SEQ ID NO: 506359 - DNA, 25 bp, Rattus norvegicus
gtgcagagctcagaacctacttggg

SEQ ID NO: 506360 - DNA, 25 bp, Rattus norvegicus
gtgcagaggacacacaaaccctgaa

SEQ ID NO: 506361 - DNA, 25 bp, Rattus norvegicus
gtgcagaggacagacaaaccctgaa

SEQ ID NO: 506362 - DNA, 25 bp, Rattus norvegicus
gtgcagagtagcagctccagcgagt

SEQ ID NO: 506363 - DNA, 25 bp, Rattus norvegicus
gtgcagagtagctgctccagcgagt

SEQ ID NO: 506364 - DNA, 25 bp, Rattus norvegicus
gtgcagagtccaaaaatttcagttt

SEQ ID NO: 506365 - DNA, 25 bp, Rattus norvegicus
gtgcagagtccataaatttcagttt

SEQ ID NO: 506366 - DNA, 25 bp, Rattus norvegicus
gtgcagagtcttctccttggagcag

SEQ ID NO: 506367 - DNA, 25 bp, Rattus norvegicus
gtgcagagtcttgtccttggagcag

SEQ ID NO: 506368 - DNA, 25 bp, Rattus norvegicus
gtgcagagtgaacgctgtacccctc

SEQ ID NO: 506369 - DNA, 25 bp, Rattus norvegicus
gtgcagagtgaaggctgtacccctc

SEQ ID NO: 506370 - DNA, 25 bp, Rattus norvegicus
gtgcagataaatcccgggaccacat

SEQ ID NO: 506371 - DNA, 25 bp, Rattus norvegicus
gtgcagataaatgccgggaccacat

SEQ ID NO: 506372 - DNA, 25 bp, Rattus norvegicus
gtgcagatacatacatgccctttaa

SEQ ID NO: 506373 - DNA, 25 bp, Rattus norvegicus
gtgcagatacattcatgccctttaa

SEQ ID NO: 506374 - DNA, 25 bp, Rattus norvegicus
gtgcagatagcactcacttataaat

SEQ ID NO: 506375 - DNA, 25 bp, Rattus norvegicus
gtgcagatagcagtcacttataaat

SEQ ID NO: 506376 - DNA, 25 bp, Rattus norvegicus
gtgcagatagtgacaccctcgatgt

SEQ ID NO: 506377 - DNA, 25 bp, Rattus norvegicus
gtgcagatagtgtcaccctcgatgt

SEQ ID NO: 506378 - DNA, 25 bp, Rattus norvegicus
gtgcagatcatacactttgctctta

SEQ ID NO: 506379 - DNA, 25 bp, Rattus norvegicus
gtgcagatcatagactttgctctta

SEQ ID NO: 506380 - DNA, 25 bp, Rattus norvegicus
gtgcagatcctgaggtcatgcgcat

SEQ ID NO: 506381 - DNA, 25 bp, Rattus norvegicus
gtgcagatcctgtggtcatgcgcat

SEQ ID NO: 506382 - DNA, 25 bp, Rattus norvegicus
gtgcagatcttgatacttcatgaga

SEQ ID NO: 506383 - DNA, 25 bp, Rattus norvegicus
gtgcagatcttgttacttcatgaga

SEQ ID NO: 506384 - DNA, 25 bp, Rattus norvegicus
gtgcagatgaatcccacagattaca

SEQ ID NO: 506385 - DNA, 25 bp, Rattus norvegicus
gtgcagatgaatgccacagattaca

SEQ ID NO: 506386 - DNA, 25 bp, Rattus norvegicus
gtgcagatgactaaaccggttgaca

SEQ ID NO: 506387 - DNA, 25 bp, Rattus norvegicus
gtgcagatgacttaaccggttgaca

SEQ ID NO: 506388 - DNA, 25 bp, Rattus norvegicus
gtgcagatgctcacatccagccttt

SEQ ID NO: 506389 - DNA, 25 bp, Rattus norvegicus
gtgcagatgctctcatccagccttt

SEQ ID NO: 506390 - DNA, 25 bp, Rattus norvegicus
gtgcagatggtcaccggcatcagta

SEQ ID NO: 506391 - DNA, 25 bp, Rattus norvegicus
gtgcagatggtctccggcatcagta

SEQ ID NO: 506392 - DNA, 25 bp, Rattus norvegicus
gtgcagattcacattaccaggaaca

SEQ ID NO: 506393 - DNA, 25 bp, Rattus norvegicus
gtgcagattcactttaccaggaaca

SEQ ID NO: 506394 - DNA, 25 bp, Rattus norvegicus
gtgcagattttcattgttgaaactc

SEQ ID NO: 506395 - DNA, 25 bp, Rattus norvegicus
gtgcagattttctttgttgaaactc

SEQ ID NO: 506396 - DNA, 25 bp, Rattus norvegicus
gtgcagcaaacaacgaagccggcat

SEQ ID NO: 506397 - DNA, 25 bp, Rattus norvegicus
gtgcagcaaacaattaacacacgtt

SEQ ID NO: 506398 - DNA, 25 bp, Rattus norvegicus
gtgcagcaaacatcgaagccggcat

SEQ ID NO: 506399 - DNA, 25 bp, Rattus norvegicus
gtgcagcaaacatttaacacacgtt

SEQ ID NO: 506400 - DNA, 25 bp, Rattus norvegicus
gtgcagcaactgatgccagactcga

SEQ ID NO: 506401 - DNA, 25 bp, Rattus norvegicus
gtgcagcaactgttgccagactcga

SEQ ID NO: 506402 - DNA, 25 bp, Rattus norvegicus
gtgcagcacacgagtcctggagagc

SEQ ID NO: 506403 - DNA, 25 bp, Rattus norvegicus
gtgcagcacacgtgtcctggagagc

SEQ ID NO: 506404 - DNA, 25 bp, Rattus norvegicus
gtgcagcacggtccctgagaacagt

SEQ ID NO: 506405 - DNA, 25 bp, Rattus norvegicus
gtgcagcacggtgcctgagaacagt

SEQ ID NO: 506406 - DNA, 25 bp, Rattus norvegicus
gtgcagcacgtacctagcaggccat

SEQ ID NO: 506407 - DNA, 25 bp, Rattus norvegicus
gtgcagcacgtagctagcaggccat

SEQ ID NO: 506408 - DNA, 25 bp, Rattus norvegicus
gtgcagcactacacctgttttcaaa

SEQ ID NO: 506409 - DNA, 25 bp, Rattus norvegicus
gtgcagcactactcctgttttcaaa

SEQ ID NO: 506410 - DNA, 25 bp, Rattus norvegicus
gtgcagcagcccacaggcaaatagt

SEQ ID NO: 506411 - DNA, 25 bp, Rattus norvegicus
gtgcagcagcccatggagctattgc

SEQ ID NO: 506412 - DNA, 25 bp, Rattus norvegicus
gtgcagcagccctcaggcaaatagt

SEQ ID NO: 506413 - DNA, 25 bp, Rattus norvegicus
gtgcagcagcccttggagctattgc

SEQ ID NO: 506414 - DNA, 25 bp, Rattus norvegicus
gtgcagcaggttacaggaatactta

SEQ ID NO: 506415 - DNA, 25 bp, Rattus norvegicus
gtgcagcaggtttcaggaatactta

SEQ ID NO: 506416 - DNA, 25 bp, Rattus norvegicus
gtgcagcatcaacaagcccaggtct

SEQ ID NO: 506417 - DNA, 25 bp, Rattus norvegicus
gtgcagcatcaagaagcccaggtct

SEQ ID NO: 506418 - DNA, 25 bp, Rattus norvegicus
gtgcagcatgaaatgtctcactagt

SEQ ID NO: 506419 - DNA, 25 bp, Rattus norvegicus
gtgcagcatgaattgtctcactagt

SEQ ID NO: 506420 - DNA, 25 bp, Rattus norvegicus
gtgcagcatgggagccactcaggaa

SEQ ID NO: 506421 - DNA, 25 bp, Rattus norvegicus
gtgcagcatgggtgccactcaggaa

SEQ ID NO: 506422 - DNA, 25 bp, Rattus norvegicus
gtgcagccaaggagcgtgtacttaa

SEQ ID NO: 506423 - DNA, 25 bp, Rattus norvegicus
gtgcagccaaggtgcgtgtacttaa

SEQ ID NO: 506424 - DNA, 25 bp, Rattus norvegicus
gtgcagcccaggagagaagcgctct

SEQ ID NO: 506425 - DNA, 25 bp, Rattus norvegicus
gtgcagcccaggtgagaagcgctct

SEQ ID NO: 506426 - DNA, 25 bp, Rattus norvegicus
gtgcagcccattctcaagctggtct

SEQ ID NO: 506427 - DNA, 25 bp, Rattus norvegicus
gtgcagcccattgtcaagctggtct

SEQ ID NO: 506428 - DNA, 25 bp, Rattus norvegicus
gtgcagcccgagcatgctcttaaga

SEQ ID NO: 506429 - DNA, 25 bp, Rattus norvegicus
gtgcagcccgaggatgctcttaaga

SEQ ID NO: 506430 - DNA, 25 bp, Rattus norvegicus
gtgcagccctggagcatccacagaa

SEQ ID NO: 506431 - DNA, 25 bp, Rattus norvegicus
gtgcagccctggtgcatccacagaa

SEQ ID NO: 506432 - DNA, 25 bp, Rattus norvegicus
gtgcagcccttgaccgaaagcttaa

SEQ ID NO: 506433 - DNA, 25 bp, Rattus norvegicus
gtgcagcccttgtccgaaagcttaa

SEQ ID NO: 506434 - DNA, 25 bp, Rattus norvegicus
gtgcagcctggtcagaatttccaca

SEQ ID NO: 506435 - DNA, 25 bp, Rattus norvegicus
gtgcagcctggtgagaatttccaca

SEQ ID NO: 506436 - DNA, 25 bp, Rattus norvegicus
gtgcagccttgtaagaagtatgtcg

SEQ ID NO: 506437 - DNA, 25 bp, Rattus norvegicus
gtgcagccttgttagaagtatgtcg

SEQ ID NO: 506438 - DNA, 25 bp, Rattus norvegicus
gtgcagcgacgtctttgtgatttac

SEQ ID NO: 506439 - DNA, 25 bp, Rattus norvegicus
gtgcagcgacgtgtttgtgatttac

SEQ ID NO: 506440 - DNA, 25 bp, Rattus norvegicus
gtgcagcgatggcacctcgtttgct

SEQ ID NO: 506441 - DNA, 25 bp, Rattus norvegicus
gtgcagcgatgggacctcgtttgct

SEQ ID NO: 506442 - DNA, 25 bp, Rattus norvegicus
gtgcagcgcaccagcctgggtcttc

SEQ ID NO: 506443 - DNA, 25 bp, Rattus norvegicus
gtgcagcgcacctgcctgggtcttc

SEQ ID NO: 506444 - DNA, 25 bp, Rattus norvegicus
gtgcagcgctgtcttcagaggctct

SEQ ID NO: 506445 - DNA, 25 bp, Rattus norvegicus
gtgcagcgctgtgttcagaggctct

SEQ ID NO: 506446 - DNA, 25 bp, Rattus norvegicus
gtgcagcgggaccatgacactcaaa

SEQ ID NO: 506447 - DNA, 25 bp, Rattus norvegicus
gtgcagcgggacgatgacactcaaa

SEQ ID NO: 506448 - DNA, 25 bp, Rattus norvegicus
gtgcagcgtgagagtcttgtcagat

SEQ ID NO: 506449 - DNA, 25 bp, Rattus norvegicus
gtgcagcgtgagtgtcttgtcagat

SEQ ID NO: 506450 - DNA, 25 bp, Rattus norvegicus
gtgcagctcaacattagcttcagta

SEQ ID NO: 506451 - DNA, 25 bp, Rattus norvegicus
gtgcagctcaactttagcttcagta

SEQ ID NO: 506452 - DNA, 25 bp, Rattus norvegicus
gtgcagctcaccagtcttcagggag

SEQ ID NO: 506453 - DNA, 25 bp, Rattus norvegicus
gtgcagctcacctgtcttcagggag

SEQ ID NO: 506454 - DNA, 25 bp, Rattus norvegicus
gtgcagctcctccagaatttacagg

SEQ ID NO: 506455 - DNA, 25 bp, Rattus norvegicus
gtgcagctcctcgagaatttacagg

SEQ ID NO: 506456 - DNA, 25 bp, Rattus norvegicus
gtgcagctgacgagggagttcattc

SEQ ID NO: 506457 - DNA, 25 bp, Rattus norvegicus
gtgcagctgacgtgggagttcattc

SEQ ID NO: 506458 - DNA, 25 bp, Rattus norvegicus
gtgcagctgagaacttttggaatgg

SEQ ID NO: 506459 - DNA, 25 bp, Rattus norvegicus
gtgcagctgagatcttttggaatgg

SEQ ID NO: 506460 - DNA, 25 bp, Rattus norvegicus
gtgcagctggcaagataactagacc

SEQ ID NO: 506461 - DNA, 25 bp, Rattus norvegicus
gtgcagctggcatgataactagacc

SEQ ID NO: 506462 - DNA, 25 bp, Rattus norvegicus
gtgcagctgtgacttcagactccta

SEQ ID NO: 506463 - DNA, 25 bp, Rattus norvegicus
gtgcagctgtgagttcagactccta

SEQ ID NO: 506464 - DNA, 25 bp, Rattus norvegicus
gtgcagcttaataacaacccagata

SEQ ID NO: 506465 - DNA, 25 bp, Rattus norvegicus
gtgcagcttaattacaacccagata

SEQ ID NO: 506466 - DNA, 25 bp, Rattus norvegicus
gtgcagcttactacgcgtacctgct

SEQ ID NO: 506467 - DNA, 25 bp, Rattus norvegicus
gtgcagcttacttcgcgtacctgct

SEQ ID NO: 506468 - DNA, 25 bp, Rattus norvegicus
gtgcagcttcccactggtatgttgg

SEQ ID NO: 506469 - DNA, 25 bp, Rattus norvegicus
gtgcagcttccctctggtatgttgg

SEQ ID NO: 506470 - DNA, 25 bp, Rattus norvegicus
gtgcagcttggaacatcttctgata

SEQ ID NO: 506471 - DNA, 25 bp, Rattus norvegicus
gtgcagcttggatcatcttctgata

SEQ ID NO: 506472 - DNA, 25 bp, Rattus norvegicus
gtgcagcttggtcccacaaagcgaa

SEQ ID NO: 506473 - DNA, 25 bp, Rattus norvegicus
gtgcagcttggtgccacaaagcgaa

SEQ ID NO: 506474 - DNA, 25 bp, Rattus norvegicus
gtgcagctttaaaacctttctcatt

SEQ ID NO: 506475 - DNA, 25 bp, Rattus norvegicus
gtgcagctttaatacctttctcatt

SEQ ID NO: 506476 - DNA, 25 bp, Rattus norvegicus
gtgcagctttgtacagaaacctttt

SEQ ID NO: 506477 - DNA, 25 bp, Rattus norvegicus
gtgcagctttgttcagaaacctttt

SEQ ID NO: 506478 - DNA, 25 bp, Rattus norvegicus
gtgcaggaacagctcagaccttgaa

SEQ ID NO: 506479 - DNA, 25 bp, Rattus norvegicus
gtgcaggaacaggtcagaccttgaa

SEQ ID NO: 506480 - DNA, 25 bp, Rattus norvegicus
gtgcaggaagaaagttcgcccgttt

SEQ ID NO: 506481 - DNA, 25 bp, Rattus norvegicus
gtgcaggaagaatgttcgcccgttt

SEQ ID NO: 506482 - DNA, 25 bp, Rattus norvegicus
gtgcaggacttcaatgcatcactct

SEQ ID NO: 506483 - DNA, 25 bp, Rattus norvegicus
gtgcaggacttctatgcatcactct

SEQ ID NO: 506484 - DNA, 25 bp, Rattus norvegicus
gtgcaggaggcgctgcttccccttc

SEQ ID NO: 506485 - DNA, 25 bp, Rattus norvegicus
gtgcaggaggcggtgcttccccttc

SEQ ID NO: 506486 - DNA, 25 bp, Rattus norvegicus
gtgcaggcacttaggacccttggga

SEQ ID NO: 506487 - DNA, 25 bp, Rattus norvegicus
gtgcaggcactttggacccttggga

SEQ ID NO: 506488 - DNA, 25 bp, Rattus norvegicus
gtgcaggcagagctcaacacgctca

SEQ ID NO: 506489 - DNA, 25 bp, Rattus norvegicus
gtgcaggcagaggtcaacacgctca

SEQ ID NO: 506490 - DNA, 25 bp, Rattus norvegicus
gtgcaggcagcgaggactaagcttt

SEQ ID NO: 506491 - DNA, 25 bp, Rattus norvegicus
gtgcaggcagcgtggactaagcttt

SEQ ID NO: 506492 - DNA, 25 bp, Rattus norvegicus
gtgcaggcagttcttgccttcttta

SEQ ID NO: 506493 - DNA, 25 bp, Rattus norvegicus
gtgcaggcagttgttgccttcttta

SEQ ID NO: 506494 - DNA, 25 bp, Rattus norvegicus
gtgcaggcatttatatctccaacgc

SEQ ID NO: 506495 - DNA, 25 bp, Rattus norvegicus
gtgcaggcatttttatctccaacgc

SEQ ID NO: 506496 - DNA, 25 bp, Rattus norvegicus
gtgcaggccaaaatctaacttctta

SEQ ID NO: 506497 - DNA, 25 bp, Rattus norvegicus
gtgcaggccaaattctaacttctta

SEQ ID NO: 506498 - DNA, 25 bp, Rattus norvegicus
gtgcaggccatgatttacgacgacg

SEQ ID NO: 506499 - DNA, 25 bp, Rattus norvegicus
gtgcaggccatgttttacgacgacg

SEQ ID NO: 506500 - DNA, 25 bp, Rattus norvegicus
gtgcaggcccacagaaggccaatta

SEQ ID NO: 506501 - DNA, 25 bp, Rattus norvegicus
gtgcaggcccactgaaggccaatta

SEQ ID NO: 506502 - DNA, 25 bp, Rattus norvegicus
gtgcaggcccctaacaatctattag

SEQ ID NO: 506503 - DNA, 25 bp, Rattus norvegicus
gtgcaggccccttacaatctattag

SEQ ID NO: 506504 - DNA, 25 bp, Rattus norvegicus
gtgcaggcctacagggagaccggaa

SEQ ID NO: 506505 - DNA, 25 bp, Rattus norvegicus
gtgcaggcctactgggagaccggaa

SEQ ID NO: 506506 - DNA, 25 bp, Rattus norvegicus
gtgcaggcctcccttggcacactgg

SEQ ID NO: 506507 - DNA, 25 bp, Rattus norvegicus
gtgcaggcctccgttggcacactgg

SEQ ID NO: 506508 - DNA, 25 bp, Rattus norvegicus
gtgcaggcctgcaagcccagcagag

SEQ ID NO: 506509 - DNA, 25 bp, Rattus norvegicus
gtgcaggcctgctagcccagcagag

SEQ ID NO: 506510 - DNA, 25 bp, Rattus norvegicus
gtgcaggcggtaccatgtctccagc

SEQ ID NO: 506511 - DNA, 25 bp, Rattus norvegicus
gtgcaggcggtagcatgtctccagc

SEQ ID NO: 506512 - DNA, 25 bp, Rattus norvegicus
gtgcaggcttccacttgtgtcaagt

SEQ ID NO: 506513 - DNA, 25 bp, Rattus norvegicus
gtgcaggcttcctcttgtgtcaagt

SEQ ID NO: 506514 - DNA, 25 bp, Rattus norvegicus
gtgcaggctttactttcttcattag

SEQ ID NO: 506515 - DNA, 25 bp, Rattus norvegicus
gtgcaggctttagtttcttcattag

SEQ ID NO: 506516 - DNA, 25 bp, Rattus norvegicus
gtgcagggacctctgtggtatacat

SEQ ID NO: 506517 - DNA, 25 bp, Rattus norvegicus
gtgcagggacctgtgtggtatacat

SEQ ID NO: 506518 - DNA, 25 bp, Rattus norvegicus
gtgcagggcattatcatctaccgtg

SEQ ID NO: 506519 - DNA, 25 bp, Rattus norvegicus
gtgcagggcattttcatctaccgtg

SEQ ID NO: 506520 - DNA, 25 bp, Rattus norvegicus
gtgcagggcccgctacatagtcagc

SEQ ID NO: 506521 - DNA, 25 bp, Rattus norvegicus
gtgcagggcccggtacatagtcagc

SEQ ID NO: 506522 - DNA, 25 bp, Rattus norvegicus
gtgcagggcttcatggatcgctgtc

SEQ ID NO: 506523 - DNA, 25 bp, Rattus norvegicus
gtgcagggcttcttggatcgctgtc

SEQ ID NO: 506524 - DNA, 25 bp, Rattus norvegicus
gtgcagggtcacattcttctaatcc

SEQ ID NO: 506525 - DNA, 25 bp, Rattus norvegicus
gtgcagggtcactttcttctaatcc

SEQ ID NO: 506526 - DNA, 25 bp, Rattus norvegicus
gtgcaggtcactcatgtatccctaa

SEQ ID NO: 506527 - DNA, 25 bp, Rattus norvegicus
gtgcaggtcactgatgtatccctaa

SEQ ID NO: 506528 - DNA, 25 bp, Rattus norvegicus
gtgcaggtccagaattttcagccat

SEQ ID NO: 506529 - DNA, 25 bp, Rattus norvegicus
gtgcaggtccagtattttcagccat

SEQ ID NO: 506530 - DNA, 25 bp, Rattus norvegicus
gtgcaggtctgcctagcgtttacca

SEQ ID NO: 506531 - DNA, 25 bp, Rattus norvegicus
gtgcaggtctgcgtagcgtttacca

SEQ ID NO: 506532 - DNA, 25 bp, Rattus norvegicus
gtgcaggtgcctctaagttgaccaa

SEQ ID NO: 506533 - DNA, 25 bp, Rattus norvegicus
gtgcaggtgcctgtaagttgaccaa

SEQ ID NO: 506534 - DNA, 25 bp, Rattus norvegicus
gtgcaggtgtataggctcacgccgc

SEQ ID NO: 506535 - DNA, 25 bp, Rattus norvegicus
gtgcaggtgtattggctcacgccgc

SEQ ID NO: 506536 - DNA, 25 bp, Rattus norvegicus
gtgcaggtgtgcaccatcaggttga

SEQ ID NO: 506537 - DNA, 25 bp, Rattus norvegicus
gtgcaggtgtgctccatcaggttga

SEQ ID NO: 506538 - DNA, 25 bp, Rattus norvegicus
gtgcaggttactactccacagttgc

SEQ ID NO: 506539 - DNA, 25 bp, Rattus norvegicus
gtgcaggttacttctccacagttgc

SEQ ID NO: 506540 - DNA, 25 bp, Rattus norvegicus
gtgcagtaaaaacaccttcacatac

SEQ ID NO: 506541 - DNA, 25 bp, Rattus norvegicus
gtgcagtaaaaagaccttcacatac

SEQ ID NO: 506542 - DNA, 25 bp, Rattus norvegicus
gtgcagtaaaccacagccagtcggt

SEQ ID NO: 506543 - DNA, 25 bp, Rattus norvegicus
gtgcagtaaacctcagccagtcggt

SEQ ID NO: 506544 - DNA, 25 bp, Rattus norvegicus
gtgcagtacaaaaatcgtcaggcca

SEQ ID NO: 506545 - DNA, 25 bp, Rattus norvegicus
gtgcagtacaaaactgactcgtgac

SEQ ID NO: 506546 - DNA, 25 bp, Rattus norvegicus
gtgcagtacaaatatcgtcaggcca

SEQ ID NO: 506547 - DNA, 25 bp, Rattus norvegicus
gtgcagtacaaatctgactcgtgac

SEQ ID NO: 506548 - DNA, 25 bp, Rattus norvegicus
gtgcagtacctgacatgagccagct

SEQ ID NO: 506549 - DNA, 25 bp, Rattus norvegicus
gtgcagtacctgtcatgagccagct

SEQ ID NO: 506550 - DNA, 25 bp, Rattus norvegicus
gtgcagtacgacctttactgtcaga

SEQ ID NO: 506551 - DNA, 25 bp, Rattus norvegicus
gtgcagtacgacgtttactgtcaga

SEQ ID NO: 506552 - DNA, 25 bp, Rattus norvegicus
gtgcagtacggaccgagtcaccctc

SEQ ID NO: 506553 - DNA, 25 bp, Rattus norvegicus
gtgcagtacggagcgagtcaccctc

SEQ ID NO: 506554 - DNA, 25 bp, Rattus norvegicus
gtgcagtagtccaggatttggttcc

SEQ ID NO: 506555 - DNA, 25 bp, Rattus norvegicus
gtgcagtagtcctggatttggttcc

SEQ ID NO: 506556 - DNA, 25 bp, Rattus norvegicus
gtgcagtagtgccaaaaggcccctt

SEQ ID NO: 506557 - DNA, 25 bp, Rattus norvegicus
gtgcagtagtgcgaaaaggcccctt

SEQ ID NO: 506558 - DNA, 25 bp, Rattus norvegicus
gtgcagtatcccagctttggaactt

SEQ ID NO: 506559 - DNA, 25 bp, Rattus norvegicus
gtgcagtatccctgctttggaactt

SEQ ID NO: 506560 - DNA, 25 bp, Rattus norvegicus
gtgcagtatgccagacttatttctt

SEQ ID NO: 506561 - DNA, 25 bp, Rattus norvegicus
gtgcagtatgcctgacttatttctt

SEQ ID NO: 506562 - DNA, 25 bp, Rattus norvegicus
gtgcagtatgtcactagttctgttg

SEQ ID NO: 506563 - DNA, 25 bp, Rattus norvegicus
gtgcagtatgtctctagttctgttg

SEQ ID NO: 506564 - DNA, 25 bp, Rattus norvegicus
gtgcagtcaactcccgcaagaagaa

SEQ ID NO: 506565 - DNA, 25 bp, Rattus norvegicus
gtgcagtcaactgccgcaagaagaa

SEQ ID NO: 506566 - DNA, 25 bp, Rattus norvegicus
gtgcagtcagtcaccaagagcagtc

SEQ ID NO: 506567 - DNA, 25 bp, Rattus norvegicus
gtgcagtcagtctccaagagcagtc

SEQ ID NO: 506568 - DNA, 25 bp, Rattus norvegicus
gtgcagtcatcccagtaccgtgcgc

SEQ ID NO: 506569 - DNA, 25 bp, Rattus norvegicus
gtgcagtcatccgagtaccgtgcgc

SEQ ID NO: 506570 - DNA, 25 bp, Rattus norvegicus
gtgcagtccatgaatcagccacaag

SEQ ID NO: 506571 - DNA, 25 bp, Rattus norvegicus
gtgcagtccatgtatcagccacaag

SEQ ID NO: 506572 - DNA, 25 bp, Rattus norvegicus
gtgcagtcccaaaacacatagcttt

SEQ ID NO: 506573 - DNA, 25 bp, Rattus norvegicus
gtgcagtcccaatacacatagcttt

SEQ ID NO: 506574 - DNA, 25 bp, Rattus norvegicus
gtgcagtccctaccaacacacagag

SEQ ID NO: 506575 - DNA, 25 bp, Rattus norvegicus
gtgcagtccctagcaacacacagag

SEQ ID NO: 506576 - DNA, 25 bp, Rattus norvegicus
gtgcagtcctacaacacggaaactc

SEQ ID NO: 506577 - DNA, 25 bp, Rattus norvegicus
gtgcagtcctacacagtgccaacat

SEQ ID NO: 506578 - DNA, 25 bp, Rattus norvegicus
gtgcagtcctactacacggaaactc

SEQ ID NO: 506579 - DNA, 25 bp, Rattus norvegicus
gtgcagtcctactcagtgccaacat

SEQ ID NO: 506580 - DNA, 25 bp, Rattus norvegicus
gtgcagtctgtgatgagggcagcct

SEQ ID NO: 506581 - DNA, 25 bp, Rattus norvegicus
gtgcagtctgtgttgagggcagcct

SEQ ID NO: 506582 - DNA, 25 bp, Rattus norvegicus
gtgcagtgacccctgctttgaaaaa

SEQ ID NO: 506583 - DNA, 25 bp, Rattus norvegicus
gtgcagtgacccgtgctttgaaaaa

SEQ ID NO: 506584 - DNA, 25 bp, Rattus norvegicus
gtgcagtgacgtcgtttccgatgat

SEQ ID NO: 506585 - DNA, 25 bp, Rattus norvegicus
gtgcagtgacgtggtttccgatgat

SEQ ID NO: 506586 - DNA, 25 bp, Rattus norvegicus
gtgcagtgagccaaagggacttact

SEQ ID NO: 506587 - DNA, 25 bp, Rattus norvegicus
gtgcagtgagcctaagggacttact

SEQ ID NO: 506588 - DNA, 25 bp, Rattus norvegicus
gtgcagtgcagtagacgtcaggcat

SEQ ID NO: 506589 - DNA, 25 bp, Rattus norvegicus
gtgcagtgcagttgacgtcaggcat

SEQ ID NO: 506590 - DNA, 25 bp, Rattus norvegicus
gtgcagtgcggcacttccacaatac

SEQ ID NO: 506591 - DNA, 25 bp, Rattus norvegicus
gtgcagtgcggctcttccacaatac

SEQ ID NO: 506592 - DNA, 25 bp, Rattus norvegicus
gtgcagtgctcgacgtccggcttca

SEQ ID NO: 506593 - DNA, 25 bp, Rattus norvegicus
gtgcagtgctcgtcgtccggcttca

SEQ ID NO: 506594 - DNA, 25 bp, Rattus norvegicus
gtgcagtgctttacagtgcttcaaa

SEQ ID NO: 506595 - DNA, 25 bp, Rattus norvegicus
gtgcagtgcttttcagtgcttcaaa

SEQ ID NO: 506596 - DNA, 25 bp, Rattus norvegicus
gtgcagtgggaaacctctgaaagca

SEQ ID NO: 506597 - DNA, 25 bp, Rattus norvegicus
gtgcagtgggaatcctctgaaagca

SEQ ID NO: 506598 - DNA, 25 bp, Rattus norvegicus
gtgcagtgggacagttatgagcccc

SEQ ID NO: 506599 - DNA, 25 bp, Rattus norvegicus
gtgcagtgggactgttatgagcccc

SEQ ID NO: 506600 - DNA, 25 bp, Rattus norvegicus
gtgcagtgtctcacaggattcgaat

SEQ ID NO: 506601 - DNA, 25 bp, Rattus norvegicus
gtgcagtgtctcatggtgtggctac

SEQ ID NO: 506602 - DNA, 25 bp, Rattus norvegicus
gtgcagtgtctctcaggattcgaat

SEQ ID NO: 506603 - DNA, 25 bp, Rattus norvegicus
gtgcagtgtctcttggtgtggctac

SEQ ID NO: 506604 - DNA, 25 bp, Rattus norvegicus
gtgcagtgtgatacccgccggcttg

SEQ ID NO: 506605 - DNA, 25 bp, Rattus norvegicus
gtgcagtgtgattcccgccggcttg

SEQ ID NO: 506606 - DNA, 25 bp, Rattus norvegicus
gtgcagtgtgctaacctgcagcctg

SEQ ID NO: 506607 - DNA, 25 bp, Rattus norvegicus
gtgcagtgtgcttacctgcagcctg

SEQ ID NO: 506608 - DNA, 25 bp, Rattus norvegicus
gtgcagttaatactcggcgcttgac

SEQ ID NO: 506609 - DNA, 25 bp, Rattus norvegicus
gtgcagttaatagtcggcgcttgac

SEQ ID NO: 506610 - DNA, 25 bp, Rattus norvegicus
gtgcagttacgccacacagtgtgcc

SEQ ID NO: 506611 - DNA, 25 bp, Rattus norvegicus
gtgcagttacgcgacacagtgtgcc

SEQ ID NO: 506612 - DNA, 25 bp, Rattus norvegicus
gtgcagttcattactaagactttca

SEQ ID NO: 506613 - DNA, 25 bp, Rattus norvegicus
gtgcagttcatttctaagactttca

SEQ ID NO: 506614 - DNA, 25 bp, Rattus norvegicus
gtgcagttctagacaggcgtcacgg

SEQ ID NO: 506615 - DNA, 25 bp, Rattus norvegicus
gtgcagttctagtcaggcgtcacgg

SEQ ID NO: 506616 - DNA, 25 bp, Rattus norvegicus
gtgcagttcttgctgtggtcctagc

SEQ ID NO: 506617 - DNA, 25 bp, Rattus norvegicus
gtgcagttcttggtgtggtcctagc

SEQ ID NO: 506618 - DNA, 25 bp, Rattus norvegicus
gtgcagttgggcctgttgtaatacc

SEQ ID NO: 506619 - DNA, 25 bp, Rattus norvegicus
gtgcagttgggcgtgttgtaatacc

SEQ ID NO: 506620 - DNA, 25 bp, Rattus norvegicus
gtgcagtttaacctctacattttat

SEQ ID NO: 506621 - DNA, 25 bp, Rattus norvegicus
gtgcagtttaacgtctacattttat

SEQ ID NO: 506622 - DNA, 25 bp, Rattus norvegicus
gtgcagtttggtcttcatgtgaatc

SEQ ID NO: 506623 - DNA, 25 bp, Rattus norvegicus
gtgcagtttggtgttcatgtgaatc

SEQ ID NO: 506624 - DNA, 25 bp, Rattus norvegicus
gtgcagttttagagggtacaagatc

SEQ ID NO: 506625 - DNA, 25 bp, Rattus norvegicus
gtgcagttttagtgggtacaagatc

SEQ ID NO: 506626 - DNA, 25 bp, Rattus norvegicus
gtgcagttttatacctatgtccact

SEQ ID NO: 506627 - DNA, 25 bp, Rattus norvegicus
gtgcagttttattcctatgtccact

SEQ ID NO: 506628 - DNA, 25 bp, Rattus norvegicus
gtgcataaaacccttaaattcatct

SEQ ID NO: 506629 - DNA, 25 bp, Rattus norvegicus
gtgcataaaaccgttaaattcatct

SEQ ID NO: 506630 - DNA, 25 bp, Rattus norvegicus
gtgcataagtggatcctttaaggat

SEQ ID NO: 506631 - DNA, 25 bp, Rattus norvegicus
gtgcataagtggttcctttaaggat

SEQ ID NO: 506632 - DNA, 25 bp, Rattus norvegicus
gtgcataatgtacctgccaatttcc

SEQ ID NO: 506633 - DNA, 25 bp, Rattus norvegicus
gtgcataatgtagctgccaatttcc

SEQ ID NO: 506634 - DNA, 25 bp, Rattus norvegicus
gtgcatacaaacacaataaccctca

SEQ ID NO: 506635 - DNA, 25 bp, Rattus norvegicus
gtgcatacaaactcaataaccctca

SEQ ID NO: 506636 - DNA, 25 bp, Rattus norvegicus
gtgcatacatgtcaccttgatcctt

SEQ ID NO: 506637 - DNA, 25 bp, Rattus norvegicus
gtgcatacatgtgaccttgatcctt

SEQ ID NO: 506638 - DNA, 25 bp, Rattus norvegicus
gtgcatacctagcactcataaactg

SEQ ID NO: 506639 - DNA, 25 bp, Rattus norvegicus
gtgcatacctaggactcataaactg

SEQ ID NO: 506640 - DNA, 25 bp, Rattus norvegicus
gtgcatacctgcatgaactagggat

SEQ ID NO: 506641 - DNA, 25 bp, Rattus norvegicus
gtgcatacctgcttgaactagggat

SEQ ID NO: 506642 - DNA, 25 bp, Rattus norvegicus
gtgcatacgtttctgtatactgtgc

SEQ ID NO: 506643 - DNA, 25 bp, Rattus norvegicus
gtgcatacgtttgtgtatactgtgc

SEQ ID NO: 506644 - DNA, 25 bp, Rattus norvegicus
gtgcatactgtgatcatagccatta

SEQ ID NO: 506645 - DNA, 25 bp, Rattus norvegicus
gtgcatactgtgttcatagccatta

SEQ ID NO: 506646 - DNA, 25 bp, Rattus norvegicus
gtgcatagaacaaacctgcttctca

SEQ ID NO: 506647 - DNA, 25 bp, Rattus norvegicus
gtgcatagaacatacctgcttctca

SEQ ID NO: 506648 - DNA, 25 bp, Rattus norvegicus
gtgcatagaatgagagcctccttct

SEQ ID NO: 506649 - DNA, 25 bp, Rattus norvegicus
gtgcatagaatgtgagcctccttct

SEQ ID NO: 506650 - DNA, 25 bp, Rattus norvegicus
gtgcatagcctgaaaccctggaata

SEQ ID NO: 506651 - DNA, 25 bp, Rattus norvegicus
gtgcatagcctgtaaccctggaata

SEQ ID NO: 506652 - DNA, 25 bp, Rattus norvegicus
gtgcatagctgcaactccattgttt

SEQ ID NO: 506653 - DNA, 25 bp, Rattus norvegicus
gtgcatagctgctactccattgttt

SEQ ID NO: 506654 - DNA, 25 bp, Rattus norvegicus
gtgcatagctgtccaggccaagcaa

SEQ ID NO: 506655 - DNA, 25 bp, Rattus norvegicus
gtgcatagctgtgcaggccaagcaa

SEQ ID NO: 506656 - DNA, 25 bp, Rattus norvegicus
gtgcatagctttctaagtgtcttaa

SEQ ID NO: 506657 - DNA, 25 bp, Rattus norvegicus
gtgcatagctttgtaagtgtcttaa

SEQ ID NO: 506658 - DNA, 25 bp, Rattus norvegicus
gtgcatagggttctttttactcttc

SEQ ID NO: 506659 - DNA, 25 bp, Rattus norvegicus
gtgcatagggttgtttttactcttc

SEQ ID NO: 506660 - DNA, 25 bp, Rattus norvegicus
gtgcatatatacattagctctggaa

SEQ ID NO: 506661 - DNA, 25 bp, Rattus norvegicus
gtgcatatatactttagctctggaa

SEQ ID NO: 506662 - DNA, 25 bp, Rattus norvegicus
gtgcatatcatgctaggctgcctgg

SEQ ID NO: 506663 - DNA, 25 bp, Rattus norvegicus
gtgcatatcatggtaggctgcctgg

SEQ ID NO: 506664 - DNA, 25 bp, Rattus norvegicus
gtgcatatcttaatgtttccttaaa

SEQ ID NO: 506665 - DNA, 25 bp, Rattus norvegicus
gtgcatatcttattgtttccttaaa

SEQ ID NO: 506666 - DNA, 25 bp, Rattus norvegicus
gtgcatatgatgacccgcgtaacct

SEQ ID NO: 506667 - DNA, 25 bp, Rattus norvegicus
gtgcatatgatgtcccgcgtaacct

SEQ ID NO: 506668 - DNA, 25 bp, Rattus norvegicus
gtgcatatgggcaagggagctgatg

SEQ ID NO: 506669 - DNA, 25 bp, Rattus norvegicus
gtgcatatgggctagggagctgatg

SEQ ID NO: 506670 - DNA, 25 bp, Rattus norvegicus
gtgcatatggtgctggagtattcct

SEQ ID NO: 506671 - DNA, 25 bp, Rattus norvegicus
gtgcatatggtggtggagtattcct

SEQ ID NO: 506672 - DNA, 25 bp, Rattus norvegicus
gtgcatatgtctatgtctatctgtg

SEQ ID NO: 506673 - DNA, 25 bp, Rattus norvegicus
gtgcatatgtctcttactctcgaat

SEQ ID NO: 506674 - DNA, 25 bp, Rattus norvegicus
gtgcatatgtctgttactctcgaat

SEQ ID NO: 506675 - DNA, 25 bp, Rattus norvegicus
gtgcatatgtctttgtctatctgtg

SEQ ID NO: 506676 - DNA, 25 bp, Rattus norvegicus
gtgcatattcagcttaccacctttt

SEQ ID NO: 506677 - DNA, 25 bp, Rattus norvegicus
gtgcatattcaggttaccacctttt

SEQ ID NO: 506678 - DNA, 25 bp, Rattus norvegicus
gtgcatattgcacctagatcataga

SEQ ID NO: 506679 - DNA, 25 bp, Rattus norvegicus
gtgcatattgcagctagatcataga

SEQ ID NO: 506680 - DNA, 25 bp, Rattus norvegicus
gtgcatatttctcttacactttctg

SEQ ID NO: 506681 - DNA, 25 bp, Rattus norvegicus
gtgcatatttctgttacactttctg

SEQ ID NO: 506682 - DNA, 25 bp, Rattus norvegicus
gtgcatcaacgcaatcatgagcttt

SEQ ID NO: 506683 - DNA, 25 bp, Rattus norvegicus
gtgcatcaacgctatcatgagcttt

SEQ ID NO: 506684 - DNA, 25 bp, Rattus norvegicus
gtgcatcaattaagggtcagctcaa

SEQ ID NO: 506685 - DNA, 25 bp, Rattus norvegicus
gtgcatcaattatgggtcagctcaa

SEQ ID NO: 506686 - DNA, 25 bp, Rattus norvegicus
gtgcatcacaagcacttccaggctt

SEQ ID NO: 506687 - DNA, 25 bp, Rattus norvegicus
gtgcatcacaaggacttccaggctt

SEQ ID NO: 506688 - DNA, 25 bp, Rattus norvegicus
gtgcatcacagtaacgtgtccacca

SEQ ID NO: 506689 - DNA, 25 bp, Rattus norvegicus
gtgcatcacagttacgtgtccacca

SEQ ID NO: 506690 - DNA, 25 bp, Rattus norvegicus
gtgcatcacatccagctcagtgggt

SEQ ID NO: 506691 - DNA, 25 bp, Rattus norvegicus
gtgcatcacatcgagctcagtgggt

SEQ ID NO: 506692 - DNA, 25 bp, Rattus norvegicus
gtgcatcacctacatagctactgag

SEQ ID NO: 506693 - DNA, 25 bp, Rattus norvegicus
gtgcatcacctagatagctactgag

SEQ ID NO: 506694 - DNA, 25 bp, Rattus norvegicus
gtgcatcacgccagctgtttccgta

SEQ ID NO: 506695 - DNA, 25 bp, Rattus norvegicus
gtgcatcacgcctgctgtttccgta

SEQ ID NO: 506696 - DNA, 25 bp, Rattus norvegicus
gtgcatcactccattcatggcatga

SEQ ID NO: 506697 - DNA, 25 bp, Rattus norvegicus
gtgcatcactcctttcatggcatga

SEQ ID NO: 506698 - DNA, 25 bp, Rattus norvegicus
gtgcatcactgcagcagagcttgag

SEQ ID NO: 506699 - DNA, 25 bp, Rattus norvegicus
gtgcatcactgctgcagagcttgag

SEQ ID NO: 506700 - DNA, 25 bp, Rattus norvegicus
gtgcatcaggtgcagagcctcttga

SEQ ID NO: 506701 - DNA, 25 bp, Rattus norvegicus
gtgcatcaggtggagagcctcttga

SEQ ID NO: 506702 - DNA, 25 bp, Rattus norvegicus
gtgcatcagtgcatacctacagaga

SEQ ID NO: 506703 - DNA, 25 bp, Rattus norvegicus
gtgcatcagtgcttacctacagaga

SEQ ID NO: 506704 - DNA, 25 bp, Rattus norvegicus
gtgcatcatcatatgcttcaagccc

SEQ ID NO: 506705 - DNA, 25 bp, Rattus norvegicus
gtgcatcatcatttgcttcaagccc

SEQ ID NO: 506706 - DNA, 25 bp, Rattus norvegicus
gtgcatcattaccaggagatacctt

SEQ ID NO: 506707 - DNA, 25 bp, Rattus norvegicus
gtgcatcattacgaggagatacctt

SEQ ID NO: 506708 - DNA, 25 bp, Rattus norvegicus
gtgcatcattccaggtctagtggga

SEQ ID NO: 506709 - DNA, 25 bp, Rattus norvegicus
gtgcatcattcctggtctagtggga

SEQ ID NO: 506710 - DNA, 25 bp, Rattus norvegicus
gtgcatccaactacctatgagcatg

SEQ ID NO: 506711 - DNA, 25 bp, Rattus norvegicus
gtgcatccaacttcctatgagcatg

SEQ ID NO: 506712 - DNA, 25 bp, Rattus norvegicus
gtgcatccaagtactatctgggcaa

SEQ ID NO: 506713 - DNA, 25 bp, Rattus norvegicus
gtgcatccaagttctatctgggcaa

SEQ ID NO: 506714 - DNA, 25 bp, Rattus norvegicus
gtgcatccaccgcaagatccgggag

SEQ ID NO: 506715 - DNA, 25 bp, Rattus norvegicus
gtgcatccaccggaagatccgggag

SEQ ID NO: 506716 - DNA, 25 bp, Rattus norvegicus
gtgcatccagagagaatttcccata

SEQ ID NO: 506717 - DNA, 25 bp, Rattus norvegicus
gtgcatccagagtgaatttcccata

SEQ ID NO: 506718 - DNA, 25 bp, Rattus norvegicus
gtgcatccccttctaactaaaattt

SEQ ID NO: 506719 - DNA, 25 bp, Rattus norvegicus
gtgcatccccttgtaactaaaattt

SEQ ID NO: 506720 - DNA, 25 bp, Rattus norvegicus
gtgcatcctcttagtagctgagcca

SEQ ID NO: 506721 - DNA, 25 bp, Rattus norvegicus
gtgcatcctctttgtagctgagcca

SEQ ID NO: 506722 - DNA, 25 bp, Rattus norvegicus
gtgcatcctgaaacagttaccacat

SEQ ID NO: 506723 - DNA, 25 bp, Rattus norvegicus
gtgcatcctgaatcagttaccacat

SEQ ID NO: 506724 - DNA, 25 bp, Rattus norvegicus
gtgcatcctgagaggacctgatgat

SEQ ID NO: 506725 - DNA, 25 bp, Rattus norvegicus
gtgcatcctgagcaaggctgtttgt

SEQ ID NO: 506726 - DNA, 25 bp, Rattus norvegicus
gtgcatcctgaggaaggctgtttgt

SEQ ID NO: 506727 - DNA, 25 bp, Rattus norvegicus
gtgcatcctgagtggacctgatgat

SEQ ID NO: 506728 - DNA, 25 bp, Rattus norvegicus
gtgcatcgaatgatattctgccaac

SEQ ID NO: 506729 - DNA, 25 bp, Rattus norvegicus
gtgcatcgaatgttattctgccaac

SEQ ID NO: 506730 - DNA, 25 bp, Rattus norvegicus
gtgcatcgctggaattgccatggcc

SEQ ID NO: 506731 - DNA, 25 bp, Rattus norvegicus
gtgcatcgctggtattgccatggcc

SEQ ID NO: 506732 - DNA, 25 bp, Rattus norvegicus
gtgcatcggtaccactgttgagcat

SEQ ID NO: 506733 - DNA, 25 bp, Rattus norvegicus
gtgcatcggtacgactgttgagcat

SEQ ID NO: 506734 - DNA, 25 bp, Rattus norvegicus
gtgcatctcattacacagcataccg

SEQ ID NO: 506735 - DNA, 25 bp, Rattus norvegicus
gtgcatctcatttcacagcataccg

SEQ ID NO: 506736 - DNA, 25 bp, Rattus norvegicus
gtgcatctctgccaaaaaccacatg

SEQ ID NO: 506737 - DNA, 25 bp, Rattus norvegicus
gtgcatctctgcgaaaaaccacatg

SEQ ID NO: 506738 - DNA, 25 bp, Rattus norvegicus
gtgcatctgacaagaacccaacgct

SEQ ID NO: 506739 - DNA, 25 bp, Rattus norvegicus
gtgcatctgacatgaacccaacgct

SEQ ID NO: 506740 - DNA, 25 bp, Rattus norvegicus
gtgcatctgactaaagatcatttat

SEQ ID NO: 506741 - DNA, 25 bp, Rattus norvegicus
gtgcatctgacttaagatcatttat

SEQ ID NO: 506742 - DNA, 25 bp, Rattus norvegicus
gtgcatctgagccaaagcttgtttc

SEQ ID NO: 506743 - DNA, 25 bp, Rattus norvegicus
gtgcatctgagcgaaagcttgtttc

SEQ ID NO: 506744 - DNA, 25 bp, Rattus norvegicus
gtgcatctgcttacctcatgctgct

SEQ ID NO: 506745 - DNA, 25 bp, Rattus norvegicus
gtgcatctgctttcctcatgctgct

SEQ ID NO: 506746 - DNA, 25 bp, Rattus norvegicus
gtgcatctggagacatctgcaggag

SEQ ID NO: 506747 - DNA, 25 bp, Rattus norvegicus
gtgcatctggagtcatctgcaggag

SEQ ID NO: 506748 - DNA, 25 bp, Rattus norvegicus
gtgcatctgttgcatacccactgca

SEQ ID NO: 506749 - DNA, 25 bp, Rattus norvegicus
gtgcatctgttggatacccactgca

SEQ ID NO: 506750 - DNA, 25 bp, Rattus norvegicus
gtgcatcttaacactctaacttcag

SEQ ID NO: 506751 - DNA, 25 bp, Rattus norvegicus
gtgcatcttaactctctaacttcag

SEQ ID NO: 506752 - DNA, 25 bp, Rattus norvegicus
gtgcatcttcgacagggacagcttc

SEQ ID NO: 506753 - DNA, 25 bp, Rattus norvegicus
gtgcatcttcgagagggacagcttc

SEQ ID NO: 506754 - DNA, 25 bp, Rattus norvegicus
gtgcatcttgagatccctccagaag

SEQ ID NO: 506755 - DNA, 25 bp, Rattus norvegicus
gtgcatcttgagttccctccagaag

SEQ ID NO: 506756 - DNA, 25 bp, Rattus norvegicus
gtgcatgaaccgatattgatccgaa

SEQ ID NO: 506757 - DNA, 25 bp, Rattus norvegicus
gtgcatgaaccgttattgatccgaa

SEQ ID NO: 506758 - DNA, 25 bp, Rattus norvegicus
gtgcatgaccatatatccttgaatt

SEQ ID NO: 506759 - DNA, 25 bp, Rattus norvegicus
gtgcatgaccatttatccttgaatt

SEQ ID NO: 506760 - DNA, 25 bp, Rattus norvegicus
gtgcatgacctgattaccattggca

SEQ ID NO: 506761 - DNA, 25 bp, Rattus norvegicus
gtgcatgacctgtttaccattggca

SEQ ID NO: 506762 - DNA, 25 bp, Rattus norvegicus
gtgcatgactaaacagtgccatcta

SEQ ID NO: 506763 - DNA, 25 bp, Rattus norvegicus
gtgcatgactaatcagtgccatcta

SEQ ID NO: 506764 - DNA, 25 bp, Rattus norvegicus
gtgcatgactctcgccgctggagat

SEQ ID NO: 506765 - DNA, 25 bp, Rattus norvegicus
gtgcatgactctggccgctggagat

SEQ ID NO: 506766 - DNA, 25 bp, Rattus norvegicus
gtgcatgaggaccagctccaggccc

SEQ ID NO: 506767 - DNA, 25 bp, Rattus norvegicus
gtgcatgaggacgagctccaggccc

SEQ ID NO: 506768 - DNA, 25 bp, Rattus norvegicus
gtgcatgaggtgagtcactgccttc

SEQ ID NO: 506769 - DNA, 25 bp, Rattus norvegicus
gtgcatgaggtgtgtcactgccttc

SEQ ID NO: 506770 - DNA, 25 bp, Rattus norvegicus
gtgcatgatctcactttgtacaaaa

SEQ ID NO: 506771 - DNA, 25 bp, Rattus norvegicus
gtgcatgatctctctttgtacaaaa

SEQ ID NO: 506772 - DNA, 25 bp, Rattus norvegicus
gtgcatgatctgacactttgtataa

SEQ ID NO: 506773 - DNA, 25 bp, Rattus norvegicus
gtgcatgatctgtcactttgtataa

SEQ ID NO: 506774 - DNA, 25 bp, Rattus norvegicus
gtgcatgatgccagtgactcattta

SEQ ID NO: 506775 - DNA, 25 bp, Rattus norvegicus
gtgcatgatgcctgtgactcattta

SEQ ID NO: 506776 - DNA, 25 bp, Rattus norvegicus
gtgcatgattttagatttgttcgtt

SEQ ID NO: 506777 - DNA, 25 bp, Rattus norvegicus
gtgcatgatttttgatttgttcgtt

SEQ ID NO: 506778 - DNA, 25 bp, Rattus norvegicus
gtgcatgcacagacaactagataag

SEQ ID NO: 506779 - DNA, 25 bp, Rattus norvegicus
gtgcatgcacagtcaactagataag

SEQ ID NO: 506780 - DNA, 25 bp, Rattus norvegicus
gtgcatgcatacctcatcagtgatg

SEQ ID NO: 506781 - DNA, 25 bp, Rattus norvegicus
gtgcatgcatacgtcatcagtgatg

SEQ ID NO: 506782 - DNA, 25 bp, Rattus norvegicus
gtgcatgccaggcatttgaactcgg

SEQ ID NO: 506783 - DNA, 25 bp, Rattus norvegicus
gtgcatgccagggatttgaactcgg

SEQ ID NO: 506784 - DNA, 25 bp, Rattus norvegicus
gtgcatgccccaatgcaaatcaatt

SEQ ID NO: 506785 - DNA, 25 bp, Rattus norvegicus
gtgcatgccccattgcaaatcaatt

SEQ ID NO: 506786 - DNA, 25 bp, Rattus norvegicus
gtgcatgccccgaatggatttcaac

SEQ ID NO: 506787 - DNA, 25 bp, Rattus norvegicus
gtgcatgccccgtatggatttcaac

SEQ ID NO: 506788 - DNA, 25 bp, Rattus norvegicus
gtgcatgccctgagcaaggattaaa

SEQ ID NO: 506789 - DNA, 25 bp, Rattus norvegicus
gtgcatgccctgtgcaaggattaaa

SEQ ID NO: 506790 - DNA, 25 bp, Rattus norvegicus
gtgcatgcgtgtactggttagttga

SEQ ID NO: 506791 - DNA, 25 bp, Rattus norvegicus
gtgcatgcgtgttctggttagttga

SEQ ID NO: 506792 - DNA, 25 bp, Rattus norvegicus
gtgcatgctatcatttacagtcagg

SEQ ID NO: 506793 - DNA, 25 bp, Rattus norvegicus
gtgcatgctatcttttacagtcagg

SEQ ID NO: 506794 - DNA, 25 bp, Rattus norvegicus
gtgcatgctatgagctcttctgaag

SEQ ID NO: 506795 - DNA, 25 bp, Rattus norvegicus
gtgcatgctatgtgctcttctgaag

SEQ ID NO: 506796 - DNA, 25 bp, Rattus norvegicus
gtgcatgctctaccttgtgggttta

SEQ ID NO: 506797 - DNA, 25 bp, Rattus norvegicus
gtgcatgctctagcttgtgggttta

SEQ ID NO: 506798 - DNA, 25 bp, Rattus norvegicus
gtgcatgctcttaggtggcgatcgc

SEQ ID NO: 506799 - DNA, 25 bp, Rattus norvegicus
gtgcatgctctttggtggcgatcgc

SEQ ID NO: 506800 - DNA, 25 bp, Rattus norvegicus
gtgcatgctgctacagtttctgtga

SEQ ID NO: 506801 - DNA, 25 bp, Rattus norvegicus
gtgcatgctgcttcagtttctgtga

SEQ ID NO: 506802 - DNA, 25 bp, Rattus norvegicus
gtgcatgctggtcttgtatttctat

SEQ ID NO: 506803 - DNA, 25 bp, Rattus norvegicus
gtgcatgctggtgttgtatttctat

SEQ ID NO: 506804 - DNA, 25 bp, Rattus norvegicus
gtgcatgcttgaacccagttgtgat

SEQ ID NO: 506805 - DNA, 25 bp, Rattus norvegicus
gtgcatgcttgatcccagttgtgat

SEQ ID NO: 506806 - DNA, 25 bp, Rattus norvegicus
gtgcatgctttaaacccagagctct

SEQ ID NO: 506807 - DNA, 25 bp, Rattus norvegicus
gtgcatgctttatacccagagctct

SEQ ID NO: 506808 - DNA, 25 bp, Rattus norvegicus
gtgcatgcttttatgctcttcagaa

SEQ ID NO: 506809 - DNA, 25 bp, Rattus norvegicus
gtgcatgcttttttgctcttcagaa

SEQ ID NO: 506810 - DNA, 25 bp, Rattus norvegicus
gtgcatggaaacagacttcacacat

SEQ ID NO: 506811 - DNA, 25 bp, Rattus norvegicus
gtgcatggaaacctaactgctagct

SEQ ID NO: 506812 - DNA, 25 bp, Rattus norvegicus
gtgcatggaaacgtaactgctagct

SEQ ID NO: 506813 - DNA, 25 bp, Rattus norvegicus
gtgcatggaaactgacttcacacat

SEQ ID NO: 506814 - DNA, 25 bp, Rattus norvegicus
gtgcatggacacacacttgacttta

SEQ ID NO: 506815 - DNA, 25 bp, Rattus norvegicus
gtgcatggacacacttttcctcaaa

SEQ ID NO: 506816 - DNA, 25 bp, Rattus norvegicus
gtgcatggacactcacttgacttta

SEQ ID NO: 506817 - DNA, 25 bp, Rattus norvegicus
gtgcatggacactcttttcctcaaa

SEQ ID NO: 506818 - DNA, 25 bp, Rattus norvegicus
gtgcatggacctcagagccaacctg

SEQ ID NO: 506819 - DNA, 25 bp, Rattus norvegicus
gtgcatggacctgagagccaacctg

SEQ ID NO: 506820 - DNA, 25 bp, Rattus norvegicus
gtgcatggatgtattacttgcccgt

SEQ ID NO: 506821 - DNA, 25 bp, Rattus norvegicus
gtgcatggatgttttacttgcccgt

SEQ ID NO: 506822 - DNA, 25 bp, Rattus norvegicus
gtgcatggcatgaacggaatctgac

SEQ ID NO: 506823 - DNA, 25 bp, Rattus norvegicus
gtgcatggcatgtacggaatctgac

SEQ ID NO: 506824 - DNA, 25 bp, Rattus norvegicus
gtgcatgggacactggctgacacct

SEQ ID NO: 506825 - DNA, 25 bp, Rattus norvegicus
gtgcatgggacagtggctgacacct

SEQ ID NO: 506826 - DNA, 25 bp, Rattus norvegicus
gtgcatgggcaacggctgtctatat

SEQ ID NO: 506827 - DNA, 25 bp, Rattus norvegicus
gtgcatgggcaagggctgtctatat

SEQ ID NO: 506828 - DNA, 25 bp, Rattus norvegicus
gtgcatgggcatctaccgcatgatt

SEQ ID NO: 506829 - DNA, 25 bp, Rattus norvegicus
gtgcatgggcatgtaccgcatgatt

SEQ ID NO: 506830 - DNA, 25 bp, Rattus norvegicus
gtgcatgggctcacagaagctccta

SEQ ID NO: 506831 - DNA, 25 bp, Rattus norvegicus
gtgcatgggctctcagaagctccta

SEQ ID NO: 506832 - DNA, 25 bp, Rattus norvegicus
gtgcatggtattctcaagctaggtt

SEQ ID NO: 506833 - DNA, 25 bp, Rattus norvegicus
gtgcatggtattgtcaagctaggtt

SEQ ID NO: 506834 - DNA, 25 bp, Rattus norvegicus
gtgcatggtcctctgccatatggaa

SEQ ID NO: 506835 - DNA, 25 bp, Rattus norvegicus
gtgcatggtcctgtgccatatggaa

SEQ ID NO: 506836 - DNA, 25 bp, Rattus norvegicus
gtgcatgtagttcagaccagtgtct

SEQ ID NO: 506837 - DNA, 25 bp, Rattus norvegicus
gtgcatgtagttgagaccagtgtct

SEQ ID NO: 506838 - DNA, 25 bp, Rattus norvegicus
gtgcatgtctgccttttagcattga

SEQ ID NO: 506839 - DNA, 25 bp, Rattus norvegicus
gtgcatgtctgcgttttagcattga

SEQ ID NO: 506840 - DNA, 25 bp, Rattus norvegicus
gtgcatgtcttaatgctgggaagca

SEQ ID NO: 506841 - DNA, 25 bp, Rattus norvegicus
gtgcatgtcttattgctgggaagca

SEQ ID NO: 506842 - DNA, 25 bp, Rattus norvegicus
gtgcatgtgacaagccatggctgct

SEQ ID NO: 506843 - DNA, 25 bp, Rattus norvegicus
gtgcatgtgacatgccatggctgct

SEQ ID NO: 506844 - DNA, 25 bp, Rattus norvegicus
gtgcatgtggaaacttagcgactgt

SEQ ID NO: 506845 - DNA, 25 bp, Rattus norvegicus
gtgcatgtggaatcttagcgactgt

SEQ ID NO: 506846 - DNA, 25 bp, Rattus norvegicus
gtgcatgtggctaacaataactcaa

SEQ ID NO: 506847 - DNA, 25 bp, Rattus norvegicus
gtgcatgtggcttacaataactcaa

SEQ ID NO: 506848 - DNA, 25 bp, Rattus norvegicus
gtgcatgtggtcctagggctaactc

SEQ ID NO: 506849 - DNA, 25 bp, Rattus norvegicus
gtgcatgtggtcgtagggctaactc

SEQ ID NO: 506850 - DNA, 25 bp, Rattus norvegicus
gtgcatgtggttctcgttagtttat

SEQ ID NO: 506851 - DNA, 25 bp, Rattus norvegicus
gtgcatgtggttgtcgttagtttat

SEQ ID NO: 506852 - DNA, 25 bp, Rattus norvegicus
gtgcatgtgtacaactgaggctcat

SEQ ID NO: 506853 - DNA, 25 bp, Rattus norvegicus
gtgcatgtgtactactgaggctcat

SEQ ID NO: 506854 - DNA, 25 bp, Rattus norvegicus
gtgcatgtgtcaaaactcctaatct

SEQ ID NO: 506855 - DNA, 25 bp, Rattus norvegicus
gtgcatgtgtcataactcctaatct

SEQ ID NO: 506856 - DNA, 25 bp, Rattus norvegicus
gtgcatgttactaagcgggcatctg

SEQ ID NO: 506857 - DNA, 25 bp, Rattus norvegicus
gtgcatgttacttagcgggcatctg

SEQ ID NO: 506858 - DNA, 25 bp, Rattus norvegicus
gtgcatgttcatatctactcacaac

SEQ ID NO: 506859 - DNA, 25 bp, Rattus norvegicus
gtgcatgttcatttctactcacaac

SEQ ID NO: 506860 - DNA, 25 bp, Rattus norvegicus
gtgcatgttctgaggagcagccctg

SEQ ID NO: 506861 - DNA, 25 bp, Rattus norvegicus
gtgcatgttctgtggagcagccctg

SEQ ID NO: 506862 - DNA, 25 bp, Rattus norvegicus
gtgcatgttgcaagcagtccttaag

SEQ ID NO: 506863 - DNA, 25 bp, Rattus norvegicus
gtgcatgttgcatgcagtccttaag

SEQ ID NO: 506864 - DNA, 25 bp, Rattus norvegicus
gtgcatgtttcactccaggcaagtt

SEQ ID NO: 506865 - DNA, 25 bp, Rattus norvegicus
gtgcatgtttcagtccaggcaagtt

SEQ ID NO: 506866 - DNA, 25 bp, Rattus norvegicus
gtgcatgtttttcgaaattacctct

SEQ ID NO: 506867 - DNA, 25 bp, Rattus norvegicus
gtgcatgtttttggaaattacctct

SEQ ID NO: 506868 - DNA, 25 bp, Rattus norvegicus
gtgcattaaacgatcccagagctgg

SEQ ID NO: 506869 - DNA, 25 bp, Rattus norvegicus
gtgcattaaacgttcccagagctgg

SEQ ID NO: 506870 - DNA, 25 bp, Rattus norvegicus
gtgcattaactgcttttgtgtgcca

SEQ ID NO: 506871 - DNA, 25 bp, Rattus norvegicus
gtgcattaactggttttgtgtgcca

SEQ ID NO: 506872 - DNA, 25 bp, Rattus norvegicus
gtgcattacattaactcagccgtct

SEQ ID NO: 506873 - DNA, 25 bp, Rattus norvegicus
gtgcattacatttactcagccgtct

SEQ ID NO: 506874 - DNA, 25 bp, Rattus norvegicus
gtgcattagaagcagcagtcagcct

SEQ ID NO: 506875 - DNA, 25 bp, Rattus norvegicus
gtgcattagaaggagcagtcagcct

SEQ ID NO: 506876 - DNA, 25 bp, Rattus norvegicus
gtgcattatggtcttttgatcttga

SEQ ID NO: 506877 - DNA, 25 bp, Rattus norvegicus
gtgcattatggtgttttgatcttga

SEQ ID NO: 506878 - DNA, 25 bp, Rattus norvegicus
gtgcattatttactttgagctccgt

SEQ ID NO: 506879 - DNA, 25 bp, Rattus norvegicus
gtgcattatttagtttgagctccgt

SEQ ID NO: 506880 - DNA, 25 bp, Rattus norvegicus
gtgcattcaaataacgtccgagtcg

SEQ ID NO: 506881 - DNA, 25 bp, Rattus norvegicus
gtgcattcaaattacgtccgagtcg

SEQ ID NO: 506882 - DNA, 25 bp, Rattus norvegicus
gtgcattcaagaccacataattagg

SEQ ID NO: 506883 - DNA, 25 bp, Rattus norvegicus
gtgcattcaagagcacataattagg

SEQ ID NO: 506884 - DNA, 25 bp, Rattus norvegicus
gtgcattcacagctcacatgttttt

SEQ ID NO: 506885 - DNA, 25 bp, Rattus norvegicus
gtgcattcacaggtcacatgttttt

SEQ ID NO: 506886 - DNA, 25 bp, Rattus norvegicus
gtgcattcacgccagcttctgaact

SEQ ID NO: 506887 - DNA, 25 bp, Rattus norvegicus
gtgcattcacgcgagcttctgaact

SEQ ID NO: 506888 - DNA, 25 bp, Rattus norvegicus
gtgcattcagccacctaaggaactt

SEQ ID NO: 506889 - DNA, 25 bp, Rattus norvegicus
gtgcattcagcctcctaaggaactt

SEQ ID NO: 506890 - DNA, 25 bp, Rattus norvegicus
gtgcattcaggaacccactggacgt

SEQ ID NO: 506891 - DNA, 25 bp, Rattus norvegicus
gtgcattcaggatcccactggacgt

SEQ ID NO: 506892 - DNA, 25 bp, Rattus norvegicus
gtgcattcaggtattccaagaggta

SEQ ID NO: 506893 - DNA, 25 bp, Rattus norvegicus
gtgcattcaggttttccaagaggta

SEQ ID NO: 506894 - DNA, 25 bp, Rattus norvegicus
gtgcattcatatacatgtcacttgc

SEQ ID NO: 506895 - DNA, 25 bp, Rattus norvegicus
gtgcattcatattcatgtcacttgc

SEQ ID NO: 506896 - DNA, 25 bp, Rattus norvegicus
gtgcattcatgccttaacttgggtt

SEQ ID NO: 506897 - DNA, 25 bp, Rattus norvegicus
gtgcattcatgcgttaacttgggtt

SEQ ID NO: 506898 - DNA, 25 bp, Rattus norvegicus
gtgcattcccagctactgatttctg

SEQ ID NO: 506899 - DNA, 25 bp, Rattus norvegicus
gtgcattcccaggtactgatttctg

SEQ ID NO: 506900 - DNA, 25 bp, Rattus norvegicus
gtgcattctagaccagcagagctac

SEQ ID NO: 506901 - DNA, 25 bp, Rattus norvegicus
gtgcattctagagcagcagagctac

SEQ ID NO: 506902 - DNA, 25 bp, Rattus norvegicus
gtgcattctcagactcgtatatgat

SEQ ID NO: 506903 - DNA, 25 bp, Rattus norvegicus
gtgcattctcagtctcgtatatgat

SEQ ID NO: 506904 - DNA, 25 bp, Rattus norvegicus
gtgcattctgaactcaactaacttg

SEQ ID NO: 506905 - DNA, 25 bp, Rattus norvegicus
gtgcattctgaagtcaactaacttg

SEQ ID NO: 506906 - DNA, 25 bp, Rattus norvegicus
gtgcattctgtccagtgcagagcca

SEQ ID NO: 506907 - DNA, 25 bp, Rattus norvegicus
gtgcattctgtcgagtgcagagcca

SEQ ID NO: 506908 - DNA, 25 bp, Rattus norvegicus
gtgcattctgttctgcctttggtgc

SEQ ID NO: 506909 - DNA, 25 bp, Rattus norvegicus
gtgcattctgttgtgcctttggtgc

SEQ ID NO: 506910 - DNA, 25 bp, Rattus norvegicus
gtgcattgacagagatatttcagca

SEQ ID NO: 506911 - DNA, 25 bp, Rattus norvegicus
gtgcattgacagtgatatttcagca

SEQ ID NO: 506912 - DNA, 25 bp, Rattus norvegicus
gtgcattgacatacagcagagcaat

SEQ ID NO: 506913 - DNA, 25 bp, Rattus norvegicus
gtgcattgacattcagcagagcaat

SEQ ID NO: 506914 - DNA, 25 bp, Rattus norvegicus
gtgcattgagaacacaccaagtttc

SEQ ID NO: 506915 - DNA, 25 bp, Rattus norvegicus
gtgcattgagaagacaccaagtttc

SEQ ID NO: 506916 - DNA, 25 bp, Rattus norvegicus
gtgcattgagcactaccgacgacta

SEQ ID NO: 506917 - DNA, 25 bp, Rattus norvegicus
gtgcattgagcagtaccgacgacta

SEQ ID NO: 506918 - DNA, 25 bp, Rattus norvegicus
gtgcattgcaatatccttttgtgta

SEQ ID NO: 506919 - DNA, 25 bp, Rattus norvegicus
gtgcattgcaatttccttttgtgta

SEQ ID NO: 506920 - DNA, 25 bp, Rattus norvegicus
gtgcattgtaccaagctctgggagg

SEQ ID NO: 506921 - DNA, 25 bp, Rattus norvegicus
gtgcattgtacctagctctgggagg

SEQ ID NO: 506922 - DNA, 25 bp, Rattus norvegicus
gtgcattgtactctttgcgtcttca

SEQ ID NO: 506923 - DNA, 25 bp, Rattus norvegicus
gtgcattgtactgtttgcgtcttca

SEQ ID NO: 506924 - DNA, 25 bp, Rattus norvegicus
gtgcatttaacaatcatagcctaca

SEQ ID NO: 506925 - DNA, 25 bp, Rattus norvegicus
gtgcatttaacattcatagcctaca

SEQ ID NO: 506926 - DNA, 25 bp, Rattus norvegicus
gtgcatttaaccaagcagttccaaa

SEQ ID NO: 506927 - DNA, 25 bp, Rattus norvegicus
gtgcatttaacctagcagttccaaa

SEQ ID NO: 506928 - DNA, 25 bp, Rattus norvegicus
gtgcatttaggcaaagacctggcat

SEQ ID NO: 506929 - DNA, 25 bp, Rattus norvegicus
gtgcatttaggctaagacctggcat

SEQ ID NO: 506930 - DNA, 25 bp, Rattus norvegicus
gtgcatttcagtatatctttaaaat

SEQ ID NO: 506931 - DNA, 25 bp, Rattus norvegicus
gtgcatttcagtttatctttaaaat

SEQ ID NO: 506932 - DNA, 25 bp, Rattus norvegicus
gtgcatttccatctagtcagggaga

SEQ ID NO: 506933 - DNA, 25 bp, Rattus norvegicus
gtgcatttccatgtagtcagggaga

SEQ ID NO: 506934 - DNA, 25 bp, Rattus norvegicus
gtgcatttctcccttcttagaatga

SEQ ID NO: 506935 - DNA, 25 bp, Rattus norvegicus
gtgcatttctccgttcttagaatga

SEQ ID NO: 506936 - DNA, 25 bp, Rattus norvegicus
gtgcatttctcgcactgcatttcat

SEQ ID NO: 506937 - DNA, 25 bp, Rattus norvegicus
gtgcatttctcggactgcatttcat

SEQ ID NO: 506938 - DNA, 25 bp, Rattus norvegicus
gtgcatttgcaaaccttttcacaag

SEQ ID NO: 506939 - DNA, 25 bp, Rattus norvegicus
gtgcatttgcaatccttttcacaag

SEQ ID NO: 506940 - DNA, 25 bp, Rattus norvegicus
gtgcatttgctgatagaacggtttc

SEQ ID NO: 506941 - DNA, 25 bp, Rattus norvegicus
gtgcatttgctgctagaatcctggc

SEQ ID NO: 506942 - DNA, 25 bp, Rattus norvegicus
gtgcatttgctggtagaatcctggc

SEQ ID NO: 506943 - DNA, 25 bp, Rattus norvegicus
gtgcatttgctgttagaacggtttc

SEQ ID NO: 506944 - DNA, 25 bp, Rattus norvegicus
gtgcatttgtttcttctcagttcaa

SEQ ID NO: 506945 - DNA, 25 bp, Rattus norvegicus
gtgcatttgtttgttctcagttcaa

SEQ ID NO: 506946 - DNA, 25 bp, Rattus norvegicus
gtgcattttcacacacgaaagactt

SEQ ID NO: 506947 - DNA, 25 bp, Rattus norvegicus
gtgcattttcactcacgaaagactt

SEQ ID NO: 506948 - DNA, 25 bp, Rattus norvegicus
gtgcattttcttcaggaaagccctg

SEQ ID NO: 506949 - DNA, 25 bp, Rattus norvegicus
gtgcattttcttgaggaaagccctg

SEQ ID NO: 506950 - DNA, 25 bp, Rattus norvegicus
gtgcattttgtcatctttttcaagt

SEQ ID NO: 506951 - DNA, 25 bp, Rattus norvegicus
gtgcattttgtcttctttttcaagt

SEQ ID NO: 506952 - DNA, 25 bp, Rattus norvegicus
gtgcatttttaaaccattacaatca

SEQ ID NO: 506953 - DNA, 25 bp, Rattus norvegicus
gtgcatttttaatccattacaatca

SEQ ID NO: 506954 - DNA, 25 bp, Rattus norvegicus
gtgccaaaatgcatgttttcccact

SEQ ID NO: 506955 - DNA, 25 bp, Rattus norvegicus
gtgccaaaatgcttgttttcccact

SEQ ID NO: 506956 - DNA, 25 bp, Rattus norvegicus
gtgccaaacatgcaacaagccctca

SEQ ID NO: 506957 - DNA, 25 bp, Rattus norvegicus
gtgccaaacatggaacaagccctca

SEQ ID NO: 506958 - DNA, 25 bp, Rattus norvegicus
gtgccaaagctcatggtgttcctga

SEQ ID NO: 506959 - DNA, 25 bp, Rattus norvegicus
gtgccaaagctcttggtgttcctga

SEQ ID NO: 506960 - DNA, 25 bp, Rattus norvegicus
gtgccaaaggaccaatctgcctgta

SEQ ID NO: 506961 - DNA, 25 bp, Rattus norvegicus
gtgccaaaggacgaatctgcctgta

SEQ ID NO: 506962 - DNA, 25 bp, Rattus norvegicus
gtgccaaagggcactgagtcccatg

SEQ ID NO: 506963 - DNA, 25 bp, Rattus norvegicus
gtgccaaagggctctgagtcccatg

SEQ ID NO: 506964 - DNA, 25 bp, Rattus norvegicus
gtgccaaaggttcaacttactgtat

SEQ ID NO: 506965 - DNA, 25 bp, Rattus norvegicus
gtgccaaaggttgaacttactgtat

SEQ ID NO: 506966 - DNA, 25 bp, Rattus norvegicus
gtgccaaagtggctctcatcattaa

SEQ ID NO: 506967 - DNA, 25 bp, Rattus norvegicus
gtgccaaagtgggtctcatcattaa

SEQ ID NO: 506968 - DNA, 25 bp, Rattus norvegicus
gtgccaaatatgacccagttgcaaa

SEQ ID NO: 506969 - DNA, 25 bp, Rattus norvegicus
gtgccaaatatgtcccagttgcaaa

SEQ ID NO: 506970 - DNA, 25 bp, Rattus norvegicus
gtgccaaatattacccaaagctttt

SEQ ID NO: 506971 - DNA, 25 bp, Rattus norvegicus
gtgccaaatatttcccaaagctttt

SEQ ID NO: 506972 - DNA, 25 bp, Rattus norvegicus
gtgccaaatttgacagtattgcatg

SEQ ID NO: 506973 - DNA, 25 bp, Rattus norvegicus
gtgccaaatttgctgatcagagatt

SEQ ID NO: 506974 - DNA, 25 bp, Rattus norvegicus
gtgccaaatttggtgatcagagatt

SEQ ID NO: 506975 - DNA, 25 bp, Rattus norvegicus
gtgccaaatttgtcagtattgcatg

SEQ ID NO: 506976 - DNA, 25 bp, Rattus norvegicus
gtgccaacagccctgtcaggaggaa

SEQ ID NO: 506977 - DNA, 25 bp, Rattus norvegicus
gtgccaacagccgtgtcaggaggaa

SEQ ID NO: 506978 - DNA, 25 bp, Rattus norvegicus
gtgccaacatatcttcatctacctt

SEQ ID NO: 506979 - DNA, 25 bp, Rattus norvegicus
gtgccaacatatgttcatctacctt

SEQ ID NO: 506980 - DNA, 25 bp, Rattus norvegicus
gtgccaaccagtagaagccaagagt

SEQ ID NO: 506981 - DNA, 25 bp, Rattus norvegicus
gtgccaaccagttgaagccaagagt

SEQ ID NO: 506982 - DNA, 25 bp, Rattus norvegicus
gtgccaacccgactgatcagagagt

SEQ ID NO: 506983 - DNA, 25 bp, Rattus norvegicus
gtgccaacccgagtgatcagagagt

SEQ ID NO: 506984 - DNA, 25 bp, Rattus norvegicus
gtgccaaccggcaaattcatcaaac

SEQ ID NO: 506985 - DNA, 25 bp, Rattus norvegicus
gtgccaaccggctaattcatcaaac

SEQ ID NO: 506986 - DNA, 25 bp, Rattus norvegicus
gtgccaacgagacttcaggctttgc

SEQ ID NO: 506987 - DNA, 25 bp, Rattus norvegicus
gtgccaacgagagttcaggctttgc

SEQ ID NO: 506988 - DNA, 25 bp, Rattus norvegicus
gtgccaacgcctattaattttgtcg

SEQ ID NO: 506989 - DNA, 25 bp, Rattus norvegicus
gtgccaacgccttttaattttgtcg

SEQ ID NO: 506990 - DNA, 25 bp, Rattus norvegicus
gtgccaacggccacattatgacttt

SEQ ID NO: 506991 - DNA, 25 bp, Rattus norvegicus
gtgccaacggcctcattatgacttt

SEQ ID NO: 506992 - DNA, 25 bp, Rattus norvegicus
gtgccaactcataccaagtggtcat

SEQ ID NO: 506993 - DNA, 25 bp, Rattus norvegicus
gtgccaactcattccaagtggtcat

SEQ ID NO: 506994 - DNA, 25 bp, Rattus norvegicus
gtgccaactgctctgaagacaacca

SEQ ID NO: 506995 - DNA, 25 bp, Rattus norvegicus
gtgccaactgctgtgaagacaacca

SEQ ID NO: 506996 - DNA, 25 bp, Rattus norvegicus
gtgccaagaaccaagagccaatcga

SEQ ID NO: 506997 - DNA, 25 bp, Rattus norvegicus
gtgccaagaacctagagccaatcga

SEQ ID NO: 506998 - DNA, 25 bp, Rattus norvegicus
gtgccaagacatctccgaagactac

SEQ ID NO: 506999 - DNA, 25 bp, Rattus norvegicus
gtgccaagacatgtccgaagactac

SEQ ID NO: 507000 - DNA, 25 bp, Rattus norvegicus
gtgccaagacccacctggtgagaag

SEQ ID NO: 507001 - DNA, 25 bp, Rattus norvegicus
gtgccaagaccctcctggtgagaag

SEQ ID NO: 507002 - DNA, 25 bp, Rattus norvegicus
gtgccaagacctctgctgtttggta

SEQ ID NO: 507003 - DNA, 25 bp, Rattus norvegicus
gtgccaagacctgtgctgtttggta

SEQ ID NO: 507004 - DNA, 25 bp, Rattus norvegicus
gtgccaagagctaaacccaagtcag

SEQ ID NO: 507005 - DNA, 25 bp, Rattus norvegicus
gtgccaagagcttaacccaagtcag

SEQ ID NO: 507006 - DNA, 25 bp, Rattus norvegicus
gtgccaagatcaagagcatcagcct

SEQ ID NO: 507007 - DNA, 25 bp, Rattus norvegicus
gtgccaagatcatgagcatcagcct

SEQ ID NO: 507008 - DNA, 25 bp, Rattus norvegicus
gtgccaagatgcacatgttcgtgaa

SEQ ID NO: 507009 - DNA, 25 bp, Rattus norvegicus
gtgccaagatgctcatgttcgtgaa

SEQ ID NO: 507010 - DNA, 25 bp, Rattus norvegicus
gtgccaagcacacaaagccgctaaa

SEQ ID NO: 507011 - DNA, 25 bp, Rattus norvegicus
gtgccaagcacagaaagccgctaaa

SEQ ID NO: 507012 - DNA, 25 bp, Rattus norvegicus
gtgccaagcactcgtagctaactag

SEQ ID NO: 507013 - DNA, 25 bp, Rattus norvegicus
gtgccaagcactggtagctaactag

SEQ ID NO: 507014 - DNA, 25 bp, Rattus norvegicus
gtgccaagccagctcctcaaatgaa

SEQ ID NO: 507015 - DNA, 25 bp, Rattus norvegicus
gtgccaagccaggtcctcaaatgaa

SEQ ID NO: 507016 - DNA, 25 bp, Rattus norvegicus
gtgccaagcctgacgatctgagttt

SEQ ID NO: 507017 - DNA, 25 bp, Rattus norvegicus
gtgccaagcctgtcgatctgagttt

SEQ ID NO: 507018 - DNA, 25 bp, Rattus norvegicus
gtgccaaggaacatcctgaccactt

SEQ ID NO: 507019 - DNA, 25 bp, Rattus norvegicus
gtgccaaggaacttcctgaccactt

SEQ ID NO: 507020 - DNA, 25 bp, Rattus norvegicus
gtgccaaggatgacttcttccgtta

SEQ ID NO: 507021 - DNA, 25 bp, Rattus norvegicus
gtgccaaggatgtcttcttccgtta

SEQ ID NO: 507022 - DNA, 25 bp, Rattus norvegicus
gtgccaaggccaagtcccgctcttt

SEQ ID NO: 507023 - DNA, 25 bp, Rattus norvegicus
gtgccaaggccatgtcccgctcttt

SEQ ID NO: 507024 - DNA, 25 bp, Rattus norvegicus
gtgccaaggtttcatgtttgcagca

SEQ ID NO: 507025 - DNA, 25 bp, Rattus norvegicus
gtgccaaggtttcattttagcccaa

SEQ ID NO: 507026 - DNA, 25 bp, Rattus norvegicus
gtgccaaggtttgatgtttgcagca

SEQ ID NO: 507027 - DNA, 25 bp, Rattus norvegicus
gtgccaaggtttgattttagcccaa

SEQ ID NO: 507028 - DNA, 25 bp, Rattus norvegicus
gtgccaagtcggagcgtgaatttct

SEQ ID NO: 507029 - DNA, 25 bp, Rattus norvegicus
gtgccaagtcggtgcgtgaatttct

SEQ ID NO: 507030 - DNA, 25 bp, Rattus norvegicus
gtgccaagtgagattcatctcctct

SEQ ID NO: 507031 - DNA, 25 bp, Rattus norvegicus
gtgccaagtgagtttcatctcctct

SEQ ID NO: 507032 - DNA, 25 bp, Rattus norvegicus
gtgccaagtgtgagcatcactgtga

SEQ ID NO: 507033 - DNA, 25 bp, Rattus norvegicus
gtgccaagtgtgtgcatcactgtga

SEQ ID NO: 507034 - DNA, 25 bp, Rattus norvegicus
gtgccaagtgttacacggttgtcta

SEQ ID NO: 507035 - DNA, 25 bp, Rattus norvegicus
gtgccaagtgtttcacggttgtcta

SEQ ID NO: 507036 - DNA, 25 bp, Rattus norvegicus
gtgccaagttacaaactccttgcct

SEQ ID NO: 507037 - DNA, 25 bp, Rattus norvegicus
gtgccaagttactaactccttgcct

SEQ ID NO: 507038 - DNA, 25 bp, Rattus norvegicus
gtgccaagtttaatcttcctctgaa

SEQ ID NO: 507039 - DNA, 25 bp, Rattus norvegicus
gtgccaagtttattcttcctctgaa

SEQ ID NO: 507040 - DNA, 25 bp, Rattus norvegicus
gtgccaagtttgacatcgatatgct

SEQ ID NO: 507041 - DNA, 25 bp, Rattus norvegicus
gtgccaagtttgtcatcgatatgct

SEQ ID NO: 507042 - DNA, 25 bp, Rattus norvegicus
gtgccaataaacctcaggtccactt

SEQ ID NO: 507043 - DNA, 25 bp, Rattus norvegicus
gtgccaataaacgtcaggtccactt

SEQ ID NO: 507044 - DNA, 25 bp, Rattus norvegicus
gtgccaataataccactatgtgcca

SEQ ID NO: 507045 - DNA, 25 bp, Rattus norvegicus
gtgccaataatagcactatgtgcca

SEQ ID NO: 507046 - DNA, 25 bp, Rattus norvegicus
gtgccaatcagaaattccctctgga

SEQ ID NO: 507047 - DNA, 25 bp, Rattus norvegicus
gtgccaatcagatattccctctgga

SEQ ID NO: 507048 - DNA, 25 bp, Rattus norvegicus
gtgccaatccgtacagactctgtgc

SEQ ID NO: 507049 - DNA, 25 bp, Rattus norvegicus
gtgccaatccgttcagactctgtgc

SEQ ID NO: 507050 - DNA, 25 bp, Rattus norvegicus
gtgccaatctctctagtttctgtta

SEQ ID NO: 507051 - DNA, 25 bp, Rattus norvegicus
gtgccaatctctgtagtttctgtta

SEQ ID NO: 507052 - DNA, 25 bp, Rattus norvegicus
gtgccaatggctagccttttctaca

SEQ ID NO: 507053 - DNA, 25 bp, Rattus norvegicus
gtgccaatggcttgccttttctaca

SEQ ID NO: 507054 - DNA, 25 bp, Rattus norvegicus
gtgccaatgtagcttatcttcggaa

SEQ ID NO: 507055 - DNA, 25 bp, Rattus norvegicus
gtgccaatgtaggttatcttcggaa

SEQ ID NO: 507056 - DNA, 25 bp, Rattus norvegicus
gtgccaatgtcaagctgaaccagaa

SEQ ID NO: 507057 - DNA, 25 bp, Rattus norvegicus
gtgccaatgtcatgctgaaccagaa

SEQ ID NO: 507058 - DNA, 25 bp, Rattus norvegicus
gtgccaattacactttctctttttg

SEQ ID NO: 507059 - DNA, 25 bp, Rattus norvegicus
gtgccaattacagtttctctttttg

SEQ ID NO: 507060 - DNA, 25 bp, Rattus norvegicus
gtgccacaaaacagccagacatatt

SEQ ID NO: 507061 - DNA, 25 bp, Rattus norvegicus
gtgccacaaaactgccagacatatt

SEQ ID NO: 507062 - DNA, 25 bp, Rattus norvegicus
gtgccacaaatgagccgccagcacg

SEQ ID NO: 507063 - DNA, 25 bp, Rattus norvegicus
gtgccacaaatgtgccgccagcacg

SEQ ID NO: 507064 - DNA, 25 bp, Rattus norvegicus
gtgccacaccttcgtcctgaatgag

SEQ ID NO: 507065 - DNA, 25 bp, Rattus norvegicus
gtgccacaccttggtcctgaatgag

SEQ ID NO: 507066 - DNA, 25 bp, Rattus norvegicus
gtgccacaggcaaccatcaggctgg

SEQ ID NO: 507067 - DNA, 25 bp, Rattus norvegicus
gtgccacaggcatccatcaggctgg

SEQ ID NO: 507068 - DNA, 25 bp, Rattus norvegicus
gtgccacaggtgacttagtctgcat

SEQ ID NO: 507069 - DNA, 25 bp, Rattus norvegicus
gtgccacaggtgtcttagtctgcat

SEQ ID NO: 507070 - DNA, 25 bp, Rattus norvegicus
gtgccacagtggagtgctcctttaa

SEQ ID NO: 507071 - DNA, 25 bp, Rattus norvegicus
gtgccacagtggtgtgctcctttaa

SEQ ID NO: 507072 - DNA, 25 bp, Rattus norvegicus
gtgccacagtttccactactcgtaa

SEQ ID NO: 507073 - DNA, 25 bp, Rattus norvegicus
gtgccacagtttgcactactcgtaa

SEQ ID NO: 507074 - DNA, 25 bp, Rattus norvegicus
gtgccacatacaatttttatagcct

SEQ ID NO: 507075 - DNA, 25 bp, Rattus norvegicus
gtgccacatacattttttatagcct

SEQ ID NO: 507076 - DNA, 25 bp, Rattus norvegicus
gtgccacattgtaaatttctgcgta

SEQ ID NO: 507077 - DNA, 25 bp, Rattus norvegicus
gtgccacattgttaatttctgcgta

SEQ ID NO: 507078 - DNA, 25 bp, Rattus norvegicus
gtgccaccaactataactgactatc

SEQ ID NO: 507079 - DNA, 25 bp, Rattus norvegicus
gtgccaccaactttaactgactatc

SEQ ID NO: 507080 - DNA, 25 bp, Rattus norvegicus
gtgccaccaagactggatccagaaa

SEQ ID NO: 507081 - DNA, 25 bp, Rattus norvegicus
gtgccaccaagagtggatccagaaa

SEQ ID NO: 507082 - DNA, 25 bp, Rattus norvegicus
gtgccaccaattagctgaacctgta

SEQ ID NO: 507083 - DNA, 25 bp, Rattus norvegicus
gtgccaccaatttgctgaacctgta

SEQ ID NO: 507084 - DNA, 25 bp, Rattus norvegicus
gtgccaccactgaaaggaaatgcct

SEQ ID NO: 507085 - DNA, 25 bp, Rattus norvegicus
gtgccaccactgtaaggaaatgcct

SEQ ID NO: 507086 - DNA, 25 bp, Rattus norvegicus
gtgccaccagttatatacccaaata

SEQ ID NO: 507087 - DNA, 25 bp, Rattus norvegicus
gtgccaccagttttatacccaaata

SEQ ID NO: 507088 - DNA, 25 bp, Rattus norvegicus
gtgccacccaaccttgttgaggaga

SEQ ID NO: 507089 - DNA, 25 bp, Rattus norvegicus
gtgccacccaacgttgttgaggaga

SEQ ID NO: 507090 - DNA, 25 bp, Rattus norvegicus
gtgccacccagcatgaaagttcttt

SEQ ID NO: 507091 - DNA, 25 bp, Rattus norvegicus
gtgccacccagcttgaaagttcttt

SEQ ID NO: 507092 - DNA, 25 bp, Rattus norvegicus
gtgccacccatgcaattccactaat

SEQ ID NO: 507093 - DNA, 25 bp, Rattus norvegicus
gtgccacccatggaattccactaat

SEQ ID NO: 507094 - DNA, 25 bp, Rattus norvegicus
gtgccaccccaaaactcatatgttg

SEQ ID NO: 507095 - DNA, 25 bp, Rattus norvegicus
gtgccaccccaatactcatatgttg

SEQ ID NO: 507096 - DNA, 25 bp, Rattus norvegicus
gtgccaccgtcacctgataaacaaa

SEQ ID NO: 507097 - DNA, 25 bp, Rattus norvegicus
gtgccaccgtcagctgataaacaaa

SEQ ID NO: 507098 - DNA, 25 bp, Rattus norvegicus
gtgccacctgatagagtccaacatc

SEQ ID NO: 507099 - DNA, 25 bp, Rattus norvegicus
gtgccacctgattgagtccaacatc

SEQ ID NO: 507100 - DNA, 25 bp, Rattus norvegicus
gtgccacctggaagcgatgaccgga

SEQ ID NO: 507101 - DNA, 25 bp, Rattus norvegicus
gtgccacctggatgcgatgaccgga

SEQ ID NO: 507102 - DNA, 25 bp, Rattus norvegicus
gtgccaccttcacatcaggataaga

SEQ ID NO: 507103 - DNA, 25 bp, Rattus norvegicus
gtgccaccttcagatcaggataaga

SEQ ID NO: 507104 - DNA, 25 bp, Rattus norvegicus
gtgccaccttctaagcgacgacaga

SEQ ID NO: 507105 - DNA, 25 bp, Rattus norvegicus
gtgccaccttcttagcgacgacaga

SEQ ID NO: 507106 - DNA, 25 bp, Rattus norvegicus
gtgccaccttggatgagtcactcaa

SEQ ID NO: 507107 - DNA, 25 bp, Rattus norvegicus
gtgccaccttggttgagtcactcaa

SEQ ID NO: 507108 - DNA, 25 bp, Rattus norvegicus
gtgccacgcagcaggttggtgaaca

SEQ ID NO: 507109 - DNA, 25 bp, Rattus norvegicus
gtgccacgcagctggttggtgaaca

SEQ ID NO: 507110 - DNA, 25 bp, Rattus norvegicus
gtgccacggatactctctgtcacaa

SEQ ID NO: 507111 - DNA, 25 bp, Rattus norvegicus
gtgccacggatagtctctgtcacaa

SEQ ID NO: 507112 - DNA, 25 bp, Rattus norvegicus
gtgccacgggttataaggattctgc

SEQ ID NO: 507113 - DNA, 25 bp, Rattus norvegicus
gtgccacgggttttaaggattctgc

SEQ ID NO: 507114 - DNA, 25 bp, Rattus norvegicus
gtgccacgttacagcttaaggtttt

SEQ ID NO: 507115 - DNA, 25 bp, Rattus norvegicus
gtgccacgttactgcttaaggtttt

SEQ ID NO: 507116 - DNA, 25 bp, Rattus norvegicus
gtgccactaaggctcctgagttacc

SEQ ID NO: 507117 - DNA, 25 bp, Rattus norvegicus
gtgccactaagggtcctgagttacc

SEQ ID NO: 507118 - DNA, 25 bp, Rattus norvegicus
gtgccactaatccaagaccttcttg

SEQ ID NO: 507119 - DNA, 25 bp, Rattus norvegicus
gtgccactaatcgaagaccttcttg

SEQ ID NO: 507120 - DNA, 25 bp, Rattus norvegicus
gtgccactcagtacagctagaggat

SEQ ID NO: 507121 - DNA, 25 bp, Rattus norvegicus
gtgccactcagttcagctagaggat

SEQ ID NO: 507122 - DNA, 25 bp, Rattus norvegicus
gtgccactccatataagttatagat

SEQ ID NO: 507123 - DNA, 25 bp, Rattus norvegicus
gtgccactccatttaagttatagat

SEQ ID NO: 507124 - DNA, 25 bp, Rattus norvegicus
gtgccactccgaaaggtgtgcctgg

SEQ ID NO: 507125 - DNA, 25 bp, Rattus norvegicus
gtgccactccgataggtgtgcctgg

SEQ ID NO: 507126 - DNA, 25 bp, Rattus norvegicus
gtgccactcgagctggtactgtaat

SEQ ID NO: 507127 - DNA, 25 bp, Rattus norvegicus
gtgccactcgaggtggtactgtaat

SEQ ID NO: 507128 - DNA, 25 bp, Rattus norvegicus
gtgccactgaagaagcttcctaagt

SEQ ID NO: 507129 - DNA, 25 bp, Rattus norvegicus
gtgccactgaagtagcttcctaagt

SEQ ID NO: 507130 - DNA, 25 bp, Rattus norvegicus
gtgccactgacaacaaccgatttca

SEQ ID NO: 507131 - DNA, 25 bp, Rattus norvegicus
gtgccactgacatcaaccgatttca

SEQ ID NO: 507132 - DNA, 25 bp, Rattus norvegicus
gtgccactgtacctgactttttaca

SEQ ID NO: 507133 - DNA, 25 bp, Rattus norvegicus
gtgccactgtacgtgactttttaca

SEQ ID NO: 507134 - DNA, 25 bp, Rattus norvegicus
gtgccactgtggacgtgggcttcaa

SEQ ID NO: 507135 - DNA, 25 bp, Rattus norvegicus
gtgccactgtggctacatgagttaa

SEQ ID NO: 507136 - DNA, 25 bp, Rattus norvegicus
gtgccactgtgggtacatgagttaa

SEQ ID NO: 507137 - DNA, 25 bp, Rattus norvegicus
gtgccactgtggtcgtgggcttcaa

SEQ ID NO: 507138 - DNA, 25 bp, Rattus norvegicus
gtgccactgtgtagtgatcaccttt

SEQ ID NO: 507139 - DNA, 25 bp, Rattus norvegicus
gtgccactgtgttgtgatcaccttt

SEQ ID NO: 507140 - DNA, 25 bp, Rattus norvegicus
gtgccactgttacactgatttgtga

SEQ ID NO: 507141 - DNA, 25 bp, Rattus norvegicus
gtgccactgttagactgatttgtga

SEQ ID NO: 507142 - DNA, 25 bp, Rattus norvegicus
gtgccacttaagagtgtctgctcta

SEQ ID NO: 507143 - DNA, 25 bp, Rattus norvegicus
gtgccacttaagtgtgtctgctcta

SEQ ID NO: 507144 - DNA, 25 bp, Rattus norvegicus
gtgccacttcacatggagttccaat

SEQ ID NO: 507145 - DNA, 25 bp, Rattus norvegicus
gtgccacttcacttggagttccaat

SEQ ID NO: 507146 - DNA, 25 bp, Rattus norvegicus
gtgccacttctgagaatactgacga

SEQ ID NO: 507147 - DNA, 25 bp, Rattus norvegicus
gtgccacttctgtgaatactgacga

SEQ ID NO: 507148 - DNA, 25 bp, Rattus norvegicus
gtgccacttggcaaataatgtgttt

SEQ ID NO: 507149 - DNA, 25 bp, Rattus norvegicus
gtgccacttggctaataatgtgttt

SEQ ID NO: 507150 - DNA, 25 bp, Rattus norvegicus
gtgccactttccatcctgtgttaaa

SEQ ID NO: 507151 - DNA, 25 bp, Rattus norvegicus
gtgccactttccttcctgtgttaaa

SEQ ID NO: 507152 - DNA, 25 bp, Rattus norvegicus
gtgccactttctatggaagtcatat

SEQ ID NO: 507153 - DNA, 25 bp, Rattus norvegicus
gtgccactttctttggaagtcatat

SEQ ID NO: 507154 - DNA, 25 bp, Rattus norvegicus
gtgccacttttgactgacttttgtg

SEQ ID NO: 507155 - DNA, 25 bp, Rattus norvegicus
gtgccacttttgtctgacttttgtg

SEQ ID NO: 507156 - DNA, 25 bp, Rattus norvegicus
gtgccagaacctcgtattatcatgt

SEQ ID NO: 507157 - DNA, 25 bp, Rattus norvegicus
gtgccagaacctggtattatcatgt

SEQ ID NO: 507158 - DNA, 25 bp, Rattus norvegicus
gtgccagaagtccactgagatcaga

SEQ ID NO: 507159 - DNA, 25 bp, Rattus norvegicus
gtgccagaagtcgactgagatcaga

SEQ ID NO: 507160 - DNA, 25 bp, Rattus norvegicus
gtgccagaatctcaggtgccatgtt

SEQ ID NO: 507161 - DNA, 25 bp, Rattus norvegicus
gtgccagaatctgaggtgccatgtt

SEQ ID NO: 507162 - DNA, 25 bp, Rattus norvegicus
gtgccagacactcttttgtgctttt

SEQ ID NO: 507163 - DNA, 25 bp, Rattus norvegicus
gtgccagacactgttttgtgctttt

SEQ ID NO: 507164 - DNA, 25 bp, Rattus norvegicus
gtgccagactcactcagctatgtca

SEQ ID NO: 507165 - DNA, 25 bp, Rattus norvegicus
gtgccagactcagtcagctatgtca

SEQ ID NO: 507166 - DNA, 25 bp, Rattus norvegicus
gtgccagagacccagtgtgctccta

SEQ ID NO: 507167 - DNA, 25 bp, Rattus norvegicus
gtgccagagaccgagtgtgctccta

SEQ ID NO: 507168 - DNA, 25 bp, Rattus norvegicus
gtgccagagcctaaattctcctttg

SEQ ID NO: 507169 - DNA, 25 bp, Rattus norvegicus
gtgccagagccttaattctcctttg

SEQ ID NO: 507170 - DNA, 25 bp, Rattus norvegicus
gtgccagagcgcatattcgcagctg

SEQ ID NO: 507171 - DNA, 25 bp, Rattus norvegicus
gtgccagagcgcttattcgcagctg

SEQ ID NO: 507172 - DNA, 25 bp, Rattus norvegicus
gtgccagaggccaggtaactccaga

SEQ ID NO: 507173 - DNA, 25 bp, Rattus norvegicus
gtgccagaggcctggtaactccaga

SEQ ID NO: 507174 - DNA, 25 bp, Rattus norvegicus
gtgccagaggtcagacaggctctaa

SEQ ID NO: 507175 - DNA, 25 bp, Rattus norvegicus
gtgccagaggtctgacaggctctaa

SEQ ID NO: 507176 - DNA, 25 bp, Rattus norvegicus
gtgccagatactaaactaactccag

SEQ ID NO: 507177 - DNA, 25 bp, Rattus norvegicus
gtgccagatacttaactaactccag

SEQ ID NO: 507178 - DNA, 25 bp, Rattus norvegicus
gtgccagatagactacgacttcgtg

SEQ ID NO: 507179 - DNA, 25 bp, Rattus norvegicus
gtgccagatagagtacgacttcgtg

SEQ ID NO: 507180 - DNA, 25 bp, Rattus norvegicus
gtgccagatataactgtcttgtttc

SEQ ID NO: 507181 - DNA, 25 bp, Rattus norvegicus
gtgccagatatatctgtcttgtttc

SEQ ID NO: 507182 - DNA, 25 bp, Rattus norvegicus
gtgccagatatcactgctctagatt

SEQ ID NO: 507183 - DNA, 25 bp, Rattus norvegicus
gtgccagatatctctgctctagatt

SEQ ID NO: 507184 - DNA, 25 bp, Rattus norvegicus
gtgccagatcggctaggaatcctca

SEQ ID NO: 507185 - DNA, 25 bp, Rattus norvegicus
gtgccagatcgggtaggaatcctca

SEQ ID NO: 507186 - DNA, 25 bp, Rattus norvegicus
gtgccagatggacagccagtgttct

SEQ ID NO: 507187 - DNA, 25 bp, Rattus norvegicus
gtgccagatggagagccagtgttct

SEQ ID NO: 507188 - DNA, 25 bp, Rattus norvegicus
gtgccagatttaatagtgccaagtt

SEQ ID NO: 507189 - DNA, 25 bp, Rattus norvegicus
gtgccagatttattagtgccaagtt

SEQ ID NO: 507190 - DNA, 25 bp, Rattus norvegicus
gtgccagcaacaattggcaagttta

SEQ ID NO: 507191 - DNA, 25 bp, Rattus norvegicus
gtgccagcaacatttggcaagttta

SEQ ID NO: 507192 - DNA, 25 bp, Rattus norvegicus
gtgccagcacagaggtcttctgcag

SEQ ID NO: 507193 - DNA, 25 bp, Rattus norvegicus
gtgccagcacagtggtcttctgcag

SEQ ID NO: 507194 - DNA, 25 bp, Rattus norvegicus
gtgccagcagacaagaggccaccat

SEQ ID NO: 507195 - DNA, 25 bp, Rattus norvegicus
gtgccagcagactagaggccaccat

SEQ ID NO: 507196 - DNA, 25 bp, Rattus norvegicus
gtgccagcatgtagactttattacg

SEQ ID NO: 507197 - DNA, 25 bp, Rattus norvegicus
gtgccagcatgttgactttattacg

SEQ ID NO: 507198 - DNA, 25 bp, Rattus norvegicus
gtgccagccaatcagcagtcatgag

SEQ ID NO: 507199 - DNA, 25 bp, Rattus norvegicus
gtgccagccaatgagcagtcatgag

SEQ ID NO: 507200 - DNA, 25 bp, Rattus norvegicus
gtgccagccacaagggaaaccttca

SEQ ID NO: 507201 - DNA, 25 bp, Rattus norvegicus
gtgccagccacatgggaaaccttca

SEQ ID NO: 507202 - DNA, 25 bp, Rattus norvegicus
gtgccagcctgtagtaaggcctgat

SEQ ID NO: 507203 - DNA, 25 bp, Rattus norvegicus
gtgccagcctgttgtaaggcctgat

SEQ ID NO: 507204 - DNA, 25 bp, Rattus norvegicus
gtgccagcgctgagggaagtttcta

SEQ ID NO: 507205 - DNA, 25 bp, Rattus norvegicus
gtgccagcgctgtgggaagtttcta

SEQ ID NO: 507206 - DNA, 25 bp, Rattus norvegicus
gtgccagctcgaacacaaggcttaa

SEQ ID NO: 507207 - DNA, 25 bp, Rattus norvegicus
gtgccagctcgatcacaaggcttaa

SEQ ID NO: 507208 - DNA, 25 bp, Rattus norvegicus
gtgccaggacagctttgttttccag

SEQ ID NO: 507209 - DNA, 25 bp, Rattus norvegicus
gtgccaggacaggtttgttttccag

SEQ ID NO: 507210 - DNA, 25 bp, Rattus norvegicus
gtgccaggacgcatgatgctgactt

SEQ ID NO: 507211 - DNA, 25 bp, Rattus norvegicus
gtgccaggacgcttgatgctgactt

SEQ ID NO: 507212 - DNA, 25 bp, Rattus norvegicus
gtgccaggccacatgaaatttctct

SEQ ID NO: 507213 - DNA, 25 bp, Rattus norvegicus
gtgccaggccacttgaaatttctct

SEQ ID NO: 507214 - DNA, 25 bp, Rattus norvegicus
gtgccaggcgttccatgcgtgtaaa

SEQ ID NO: 507215 - DNA, 25 bp, Rattus norvegicus
gtgccaggcgttgcatgcgtgtaaa

SEQ ID NO: 507216 - DNA, 25 bp, Rattus norvegicus
gtgccaggcttgagcgagatcctat

SEQ ID NO: 507217 - DNA, 25 bp, Rattus norvegicus
gtgccaggcttgtgcgagatcctat

SEQ ID NO: 507218 - DNA, 25 bp, Rattus norvegicus
gtgccaggctttccagtgaggacat

SEQ ID NO: 507219 - DNA, 25 bp, Rattus norvegicus
gtgccaggctttgcagtgaggacat

SEQ ID NO: 507220 - DNA, 25 bp, Rattus norvegicus
gtgccagggcctccgttagatctgc

SEQ ID NO: 507221 - DNA, 25 bp, Rattus norvegicus
gtgccagggcctgcgttagatctgc

SEQ ID NO: 507222 - DNA, 25 bp, Rattus norvegicus
gtgccaggtactacagaacagccgt

SEQ ID NO: 507223 - DNA, 25 bp, Rattus norvegicus
gtgccaggtacttcagaacagccgt

SEQ ID NO: 507224 - DNA, 25 bp, Rattus norvegicus
gtgccaggtgggacacagccatcat

SEQ ID NO: 507225 - DNA, 25 bp, Rattus norvegicus
gtgccaggtgggtcacagccatcat

SEQ ID NO: 507226 - DNA, 25 bp, Rattus norvegicus
gtgccaggttttaagactgcccaga

SEQ ID NO: 507227 - DNA, 25 bp, Rattus norvegicus
gtgccaggtttttagactgcccaga

SEQ ID NO: 507228 - DNA, 25 bp, Rattus norvegicus
gtgccagtaagtatgcctaccgtat

SEQ ID NO: 507229 - DNA, 25 bp, Rattus norvegicus
gtgccagtaagtttgcctaccgtat

SEQ ID NO: 507230 - DNA, 25 bp, Rattus norvegicus
gtgccagtaccacatagtttctgtt

SEQ ID NO: 507231 - DNA, 25 bp, Rattus norvegicus
gtgccagtaccagatagtttctgtt

SEQ ID NO: 507232 - DNA, 25 bp, Rattus norvegicus
gtgccagtagctatgaggagcccat

SEQ ID NO: 507233 - DNA, 25 bp, Rattus norvegicus
gtgccagtagctttgaggagcccat

SEQ ID NO: 507234 - DNA, 25 bp, Rattus norvegicus
gtgccagtcaaacacaagtcagtgt

SEQ ID NO: 507235 - DNA, 25 bp, Rattus norvegicus
gtgccagtcaaagacaagtcagtgt

SEQ ID NO: 507236 - DNA, 25 bp, Rattus norvegicus
gtgccagtcacaatcaggagtattt

SEQ ID NO: 507237 - DNA, 25 bp, Rattus norvegicus
gtgccagtcacattcaggagtattt

SEQ ID NO: 507238 - DNA, 25 bp, Rattus norvegicus
gtgccagtcatcagacacctgtttg

SEQ ID NO: 507239 - DNA, 25 bp, Rattus norvegicus
gtgccagtcatctgacacctgtttg

SEQ ID NO: 507240 - DNA, 25 bp, Rattus norvegicus
gtgccagtccctcacatatcatgaa

SEQ ID NO: 507241 - DNA, 25 bp, Rattus norvegicus
gtgccagtccctgacatatcatgaa

SEQ ID NO: 507242 - DNA, 25 bp, Rattus norvegicus
gtgccagtccgtctgatctttatgt

SEQ ID NO: 507243 - DNA, 25 bp, Rattus norvegicus
gtgccagtccgtgtgatctttatgt

SEQ ID NO: 507244 - DNA, 25 bp, Rattus norvegicus
gtgccagtgccaacctgacagagag

SEQ ID NO: 507245 - DNA, 25 bp, Rattus norvegicus
gtgccagtgccacagctagagccag

SEQ ID NO: 507246 - DNA, 25 bp, Rattus norvegicus
gtgccagtgccagagctagagccag

SEQ ID NO: 507247 - DNA, 25 bp, Rattus norvegicus
gtgccagtgccatcctgacagagag

SEQ ID NO: 507248 - DNA, 25 bp, Rattus norvegicus
gtgccagtgcttccttgtgtggaac

SEQ ID NO: 507249 - DNA, 25 bp, Rattus norvegicus
gtgccagtgcttgcttgtgtggaac

SEQ ID NO: 507250 - DNA, 25 bp, Rattus norvegicus
gtgccagtgttgagctgtttgtcaa

SEQ ID NO: 507251 - DNA, 25 bp, Rattus norvegicus
gtgccagtgttgtgctgtttgtcaa

SEQ ID NO: 507252 - DNA, 25 bp, Rattus norvegicus
gtgccagttacacactagtcagtca

SEQ ID NO: 507253 - DNA, 25 bp, Rattus norvegicus
gtgccagttacagactagtcagtca

SEQ ID NO: 507254 - DNA, 25 bp, Rattus norvegicus
gtgccagttcgtctctgattaacaa

SEQ ID NO: 507255 - DNA, 25 bp, Rattus norvegicus
gtgccagttcgtgtctgattaacaa

SEQ ID NO: 507256 - DNA, 25 bp, Rattus norvegicus
gtgccagttgcaaaatttgtagcat

SEQ ID NO: 507257 - DNA, 25 bp, Rattus norvegicus
gtgccagttgcataatttgtagcat

SEQ ID NO: 507258 - DNA, 25 bp, Rattus norvegicus
gtgccagtttgaacagtacccttat

SEQ ID NO: 507259 - DNA, 25 bp, Rattus norvegicus
gtgccagtttgatcagtacccttat

SEQ ID NO: 507260 - DNA, 25 bp, Rattus norvegicus
gtgccagtttttcctagaggtgaca

SEQ ID NO: 507261 - DNA, 25 bp, Rattus norvegicus
gtgccagtttttgctagaggtgaca

SEQ ID NO: 507262 - DNA, 25 bp, Rattus norvegicus
gtgccataatatacaaacttctact

SEQ ID NO: 507263 - DNA, 25 bp, Rattus norvegicus
gtgccataatattcaaacttctact

SEQ ID NO: 507264 - DNA, 25 bp, Rattus norvegicus
gtgccatacacaaaatcttctactc

SEQ ID NO: 507265 - DNA, 25 bp, Rattus norvegicus
gtgccatacacataatcttctactc

SEQ ID NO: 507266 - DNA, 25 bp, Rattus norvegicus
gtgccatacatacccgtttttgtct

SEQ ID NO: 507267 - DNA, 25 bp, Rattus norvegicus
gtgccatacatagccgtttttgtct

SEQ ID NO: 507268 - DNA, 25 bp, Rattus norvegicus
gtgccataccagctgaggacctgtt

SEQ ID NO: 507269 - DNA, 25 bp, Rattus norvegicus
gtgccataccaggtgaggacctgtt

SEQ ID NO: 507270 - DNA, 25 bp, Rattus norvegicus
gtgccataccatcctgaagtctcaa

SEQ ID NO: 507271 - DNA, 25 bp, Rattus norvegicus
gtgccataccatgctgaagtctcaa

SEQ ID NO: 507272 - DNA, 25 bp, Rattus norvegicus
gtgccatacggaaccctgtatttta

SEQ ID NO: 507273 - DNA, 25 bp, Rattus norvegicus
gtgccatacggatccctgtatttta

SEQ ID NO: 507274 - DNA, 25 bp, Rattus norvegicus
gtgccatactcgactgggtcagatt

SEQ ID NO: 507275 - DNA, 25 bp, Rattus norvegicus
gtgccatactcgtctgggtcagatt

SEQ ID NO: 507276 - DNA, 25 bp, Rattus norvegicus
gtgccatagcacctcacaatgtttg

SEQ ID NO: 507277 - DNA, 25 bp, Rattus norvegicus
gtgccatagcacgtcacaatgtttg

SEQ ID NO: 507278 - DNA, 25 bp, Rattus norvegicus
gtgccataggacacatcactgcttc

SEQ ID NO: 507279 - DNA, 25 bp, Rattus norvegicus
gtgccataggactcatcactgcttc

SEQ ID NO: 507280 - DNA, 25 bp, Rattus norvegicus
gtgccatatctaattccagagccat

SEQ ID NO: 507281 - DNA, 25 bp, Rattus norvegicus
gtgccatatctatttccagagccat

SEQ ID NO: 507282 - DNA, 25 bp, Rattus norvegicus
gtgccatcaactacaggtccaaaga

SEQ ID NO: 507283 - DNA, 25 bp, Rattus norvegicus
gtgccatcaacttcaggtccaaaga

SEQ ID NO: 507284 - DNA, 25 bp, Rattus norvegicus
gtgccatcatacagggctgcgtagg

SEQ ID NO: 507285 - DNA, 25 bp, Rattus norvegicus
gtgccatcatactgggctgcgtagg

SEQ ID NO: 507286 - DNA, 25 bp, Rattus norvegicus
gtgccatccagtagtcactgttcag

SEQ ID NO: 507287 - DNA, 25 bp, Rattus norvegicus
gtgccatccagttgtcactgttcag

SEQ ID NO: 507288 - DNA, 25 bp, Rattus norvegicus
gtgccatcccaaatcgtcctggtat

SEQ ID NO: 507289 - DNA, 25 bp, Rattus norvegicus
gtgccatcccaattcgtcctggtat

SEQ ID NO: 507290 - DNA, 25 bp, Rattus norvegicus
gtgccatctcttctacaacgagcag

SEQ ID NO: 507291 - DNA, 25 bp, Rattus norvegicus
gtgccatctcttgtacaacgagcag

SEQ ID NO: 507292 - DNA, 25 bp, Rattus norvegicus
gtgccatctgagaaactgctcttgg

SEQ ID NO: 507293 - DNA, 25 bp, Rattus norvegicus
gtgccatctgagtaactgctcttgg

SEQ ID NO: 507294 - DNA, 25 bp, Rattus norvegicus
gtgccatctgatagacttgcagcag

SEQ ID NO: 507295 - DNA, 25 bp, Rattus norvegicus
gtgccatctgattgacttgcagcag

SEQ ID NO: 507296 - DNA, 25 bp, Rattus norvegicus
gtgccatctgtcatcaagccatgta

SEQ ID NO: 507297 - DNA, 25 bp, Rattus norvegicus
gtgccatctgtcttcaagccatgta

SEQ ID NO: 507298 - DNA, 25 bp, Rattus norvegicus
gtgccatgagctattgtttcttcaa

SEQ ID NO: 507299 - DNA, 25 bp, Rattus norvegicus
gtgccatgagcttttgtttcttcaa

SEQ ID NO: 507300 - DNA, 25 bp, Rattus norvegicus
gtgccatgcaagctgccacaggaaa

SEQ ID NO: 507301 - DNA, 25 bp, Rattus norvegicus
gtgccatgcaaggtgccacaggaaa

SEQ ID NO: 507302 - DNA, 25 bp, Rattus norvegicus
gtgccatgcggaccagatttctgaa

SEQ ID NO: 507303 - DNA, 25 bp, Rattus norvegicus
gtgccatgcggagcagatttctgaa

SEQ ID NO: 507304 - DNA, 25 bp, Rattus norvegicus
gtgccatgctttcggttcatagttt

SEQ ID NO: 507305 - DNA, 25 bp, Rattus norvegicus
gtgccatgctttgggttcatagttt

SEQ ID NO: 507306 - DNA, 25 bp, Rattus norvegicus
gtgccatggagaagatgtttttcac

SEQ ID NO: 507307 - DNA, 25 bp, Rattus norvegicus
gtgccatggagatgatgtttttcac

SEQ ID NO: 507308 - DNA, 25 bp, Rattus norvegicus
gtgccatggcttatgttaccatttc

SEQ ID NO: 507309 - DNA, 25 bp, Rattus norvegicus
gtgccatggcttttgttaccatttc

SEQ ID NO: 507310 - DNA, 25 bp, Rattus norvegicus
gtgccatgggctcttctacaaatcc

SEQ ID NO: 507311 - DNA, 25 bp, Rattus norvegicus
gtgccatgggctgttctacaaatcc

SEQ ID NO: 507312 - DNA, 25 bp, Rattus norvegicus
gtgccatgggttccagatcctgaaa

SEQ ID NO: 507313 - DNA, 25 bp, Rattus norvegicus
gtgccatgggttgcagatcctgaaa

SEQ ID NO: 507314 - DNA, 25 bp, Rattus norvegicus
gtgccatgtataattctgtcctgtc

SEQ ID NO: 507315 - DNA, 25 bp, Rattus norvegicus
gtgccatgtatatttctgtcctgtc

SEQ ID NO: 507316 - DNA, 25 bp, Rattus norvegicus
gtgccatgtcacatctcaagtattc

SEQ ID NO: 507317 - DNA, 25 bp, Rattus norvegicus
gtgccatgtcacttctcaagtattc

SEQ ID NO: 507318 - DNA, 25 bp, Rattus norvegicus
gtgccatgtgtgatctatttgcatt

SEQ ID NO: 507319 - DNA, 25 bp, Rattus norvegicus
gtgccatgtgtgttctatttgcatt

SEQ ID NO: 507320 - DNA, 25 bp, Rattus norvegicus
gtgccatgttctatcgggattgaaa

SEQ ID NO: 507321 - DNA, 25 bp, Rattus norvegicus
gtgccatgttctttcgggattgaaa

SEQ ID NO: 507322 - DNA, 25 bp, Rattus norvegicus
gtgccatgttgaagtacagtttctg

SEQ ID NO: 507323 - DNA, 25 bp, Rattus norvegicus
gtgccatgttgatgtacagtttctg

SEQ ID NO: 507324 - DNA, 25 bp, Rattus norvegicus
gtgccatgttggcttatctcgctgc

SEQ ID NO: 507325 - DNA, 25 bp, Rattus norvegicus
gtgccatgttgggttatctcgctgc

SEQ ID NO: 507326 - DNA, 25 bp, Rattus norvegicus
gtgccattaaagcagttctagctgg

SEQ ID NO: 507327 - DNA, 25 bp, Rattus norvegicus
gtgccattaaaggagttctagctgg

SEQ ID NO: 507328 - DNA, 25 bp, Rattus norvegicus
gtgccattaagcctaggattttatc

SEQ ID NO: 507329 - DNA, 25 bp, Rattus norvegicus
gtgccattaagcgtaggattttatc

SEQ ID NO: 507330 - DNA, 25 bp, Rattus norvegicus
gtgccattatgtcagccctgtcaga

SEQ ID NO: 507331 - DNA, 25 bp, Rattus norvegicus
gtgccattatgtgagccctgtcaga

SEQ ID NO: 507332 - DNA, 25 bp, Rattus norvegicus
gtgccattattccaaactgctgtca

SEQ ID NO: 507333 - DNA, 25 bp, Rattus norvegicus
gtgccattattcgaaactgctgtca

SEQ ID NO: 507334 - DNA, 25 bp, Rattus norvegicus
gtgccattcaatactgtcattccga

SEQ ID NO: 507335 - DNA, 25 bp, Rattus norvegicus
gtgccattcaatcactactaacatg

SEQ ID NO: 507336 - DNA, 25 bp, Rattus norvegicus
gtgccattcaatgactactaacatg

SEQ ID NO: 507337 - DNA, 25 bp, Rattus norvegicus
gtgccattcaattctgtcattccga

SEQ ID NO: 507338 - DNA, 25 bp, Rattus norvegicus
gtgccattcagcagtgagactggaa

SEQ ID NO: 507339 - DNA, 25 bp, Rattus norvegicus
gtgccattcagctgtgagactggaa

SEQ ID NO: 507340 - DNA, 25 bp, Rattus norvegicus
gtgccattcctgatgattctgttca

SEQ ID NO: 507341 - DNA, 25 bp, Rattus norvegicus
gtgccattcctgttgattctgttca

SEQ ID NO: 507342 - DNA, 25 bp, Rattus norvegicus
gtgccattgagtatatgttattctt

SEQ ID NO: 507343 - DNA, 25 bp, Rattus norvegicus
gtgccattgagtttatgttattctt

SEQ ID NO: 507344 - DNA, 25 bp, Rattus norvegicus
gtgccattgtgcctggctcagaaaa

SEQ ID NO: 507345 - DNA, 25 bp, Rattus norvegicus
gtgccattgtgcgtggctcagaaaa

SEQ ID NO: 507346 - DNA, 25 bp, Rattus norvegicus
gtgccattgttcatggtaattgata

SEQ ID NO: 507347 - DNA, 25 bp, Rattus norvegicus
gtgccattgttcttggtaattgata

SEQ ID NO: 507348 - DNA, 25 bp, Rattus norvegicus
gtgccatttacacttctaactgtgt

SEQ ID NO: 507349 - DNA, 25 bp, Rattus norvegicus
gtgccatttacagttctaactgtgt

SEQ ID NO: 507350 - DNA, 25 bp, Rattus norvegicus
gtgccatttctcacttggatgcaag

SEQ ID NO: 507351 - DNA, 25 bp, Rattus norvegicus
gtgccatttctctcttggatgcaag

SEQ ID NO: 507352 - DNA, 25 bp, Rattus norvegicus
gtgccatttgaccatcttgggaaat

SEQ ID NO: 507353 - DNA, 25 bp, Rattus norvegicus
gtgccatttgacgatcttgggaaat

SEQ ID NO: 507354 - DNA, 25 bp, Rattus norvegicus
gtgccatttgccagagaagcttcag

SEQ ID NO: 507355 - DNA, 25 bp, Rattus norvegicus
gtgccatttgcctgagaagcttcag

SEQ ID NO: 507356 - DNA, 25 bp, Rattus norvegicus
gtgcccaaacttctgttttgcagca

SEQ ID NO: 507357 - DNA, 25 bp, Rattus norvegicus
gtgcccaaacttgtgttttgcagca

SEQ ID NO: 507358 - DNA, 25 bp, Rattus norvegicus
gtgcccaaatgtagtaggatgctct

SEQ ID NO: 507359 - DNA, 25 bp, Rattus norvegicus
gtgcccaaatgttgtaggatgctct

SEQ ID NO: 507360 - DNA, 25 bp, Rattus norvegicus
gtgcccaacatcagtgaggtttctg

SEQ ID NO: 507361 - DNA, 25 bp, Rattus norvegicus
gtgcccaacatctgtgaggtttctg

SEQ ID NO: 507362 - DNA, 25 bp, Rattus norvegicus
gtgcccaactaaagtcctttggcca

SEQ ID NO: 507363 - DNA, 25 bp, Rattus norvegicus
gtgcccaactaatgtcctttggcca

SEQ ID NO: 507364 - DNA, 25 bp, Rattus norvegicus
gtgcccaactggaaatcatgctgaa

SEQ ID NO: 507365 - DNA, 25 bp, Rattus norvegicus
gtgcccaactggtaatcatgctgaa

SEQ ID NO: 507366 - DNA, 25 bp, Rattus norvegicus
gtgcccaaggaaaaccactccagag

SEQ ID NO: 507367 - DNA, 25 bp, Rattus norvegicus
gtgcccaaggaaaattacattgatc

SEQ ID NO: 507368 - DNA, 25 bp, Rattus norvegicus
gtgcccaaggaataccactccagag

SEQ ID NO: 507369 - DNA, 25 bp, Rattus norvegicus
gtgcccaaggaatattacattgatc

SEQ ID NO: 507370 - DNA, 25 bp, Rattus norvegicus
gtgcccaataaacatttccatgcgg

SEQ ID NO: 507371 - DNA, 25 bp, Rattus norvegicus
gtgcccaataaagatttccatgcgg

SEQ ID NO: 507372 - DNA, 25 bp, Rattus norvegicus
gtgcccaatgcaagtatcatcgtct

SEQ ID NO: 507373 - DNA, 25 bp, Rattus norvegicus
gtgcccaatgcatgtatcatcgtct

SEQ ID NO: 507374 - DNA, 25 bp, Rattus norvegicus
gtgcccacaactaacccaggaaaat

SEQ ID NO: 507375 - DNA, 25 bp, Rattus norvegicus
gtgcccacaacttacccaggaaaat

SEQ ID NO: 507376 - DNA, 25 bp, Rattus norvegicus
gtgcccacagaactttttcttccag

SEQ ID NO: 507377 - DNA, 25 bp, Rattus norvegicus
gtgcccacagaagtttttcttccag

SEQ ID NO: 507378 - DNA, 25 bp, Rattus norvegicus
gtgcccacatggagactttgctttg

SEQ ID NO: 507379 - DNA, 25 bp, Rattus norvegicus
gtgcccacatggtgactttgctttg

SEQ ID NO: 507380 - DNA, 25 bp, Rattus norvegicus
gtgcccaccagactaacctctgaag

SEQ ID NO: 507381 - DNA, 25 bp, Rattus norvegicus
gtgcccaccagagtaacctctgaag

SEQ ID NO: 507382 - DNA, 25 bp, Rattus norvegicus
gtgcccaccatgctagctctgtgac

SEQ ID NO: 507383 - DNA, 25 bp, Rattus norvegicus
gtgcccaccatggtagctctgtgac

SEQ ID NO: 507384 - DNA, 25 bp, Rattus norvegicus
gtgcccaccgatcctatgcatacag

SEQ ID NO: 507385 - DNA, 25 bp, Rattus norvegicus
gtgcccaccgatgctatgcatacag

SEQ ID NO: 507386 - DNA, 25 bp, Rattus norvegicus
gtgcccacgaccaactggaggtgat

SEQ ID NO: 507387 - DNA, 25 bp, Rattus norvegicus
gtgcccacgacctactggaggtgat

SEQ ID NO: 507388 - DNA, 25 bp, Rattus norvegicus
gtgcccacgcaccagaaagtctctg

SEQ ID NO: 507389 - DNA, 25 bp, Rattus norvegicus
gtgcccacgcacgagaaagtctctg

SEQ ID NO: 507390 - DNA, 25 bp, Rattus norvegicus
gtgcccactaataactcactggata

SEQ ID NO: 507391 - DNA, 25 bp, Rattus norvegicus
gtgcccactaattactcactggata

SEQ ID NO: 507392 - DNA, 25 bp, Rattus norvegicus
gtgcccactgggaaagtagatcttt

SEQ ID NO: 507393 - DNA, 25 bp, Rattus norvegicus
gtgcccactgggtaagtagatcttt

SEQ ID NO: 507394 - DNA, 25 bp, Rattus norvegicus
gtgcccactggtcactggttacaac

SEQ ID NO: 507395 - DNA, 25 bp, Rattus norvegicus
gtgcccactggtgactggttacaac

SEQ ID NO: 507396 - DNA, 25 bp, Rattus norvegicus
gtgcccacttcccattttagtgtga

SEQ ID NO: 507397 - DNA, 25 bp, Rattus norvegicus
gtgcccacttccgattttagtgtga

SEQ ID NO: 507398 - DNA, 25 bp, Rattus norvegicus
gtgcccagaaccacaatcagtctga

SEQ ID NO: 507399 - DNA, 25 bp, Rattus norvegicus
gtgcccagaacctcaatcagtctga

SEQ ID NO: 507400 - DNA, 25 bp, Rattus norvegicus
gtgcccagacccaatgatgattcag

SEQ ID NO: 507401 - DNA, 25 bp, Rattus norvegicus
gtgcccagaccctatgatgattcag

SEQ ID NO: 507402 - DNA, 25 bp, Rattus norvegicus
gtgcccagactcacgggacaatata

SEQ ID NO: 507403 - DNA, 25 bp, Rattus norvegicus
gtgcccagactctcgggacaatata

SEQ ID NO: 507404 - DNA, 25 bp, Rattus norvegicus
gtgcccagactgaaagtttcagcca

SEQ ID NO: 507405 - DNA, 25 bp, Rattus norvegicus
gtgcccagactgtaagtttcagcca

SEQ ID NO: 507406 - DNA, 25 bp, Rattus norvegicus
gtgcccagagaccttggtacgtgtc

SEQ ID NO: 507407 - DNA, 25 bp, Rattus norvegicus
gtgcccagagacgttggtacgtgtc

SEQ ID NO: 507408 - DNA, 25 bp, Rattus norvegicus
gtgcccagagatcagaacgacccag

SEQ ID NO: 507409 - DNA, 25 bp, Rattus norvegicus
gtgcccagagatgagaacgacccag

SEQ ID NO: 507410 - DNA, 25 bp, Rattus norvegicus
gtgcccagatttcagggcttctgaa

SEQ ID NO: 507411 - DNA, 25 bp, Rattus norvegicus
gtgcccagatttgagggcttctgaa

SEQ ID NO: 507412 - DNA, 25 bp, Rattus norvegicus
gtgcccagcataatacctacaactt

SEQ ID NO: 507413 - DNA, 25 bp, Rattus norvegicus
gtgcccagcatattacctacaactt

SEQ ID NO: 507414 - DNA, 25 bp, Rattus norvegicus
gtgcccagctttctttttagcagaa

SEQ ID NO: 507415 - DNA, 25 bp, Rattus norvegicus
gtgcccagctttgtttttagcagaa

SEQ ID NO: 507416 - DNA, 25 bp, Rattus norvegicus
gtgcccaggagcatttgaggccata

SEQ ID NO: 507417 - DNA, 25 bp, Rattus norvegicus
gtgcccaggagcttttgaggccata

SEQ ID NO: 507418 - DNA, 25 bp, Rattus norvegicus
gtgcccaggcagatgtaggaagtca

SEQ ID NO: 507419 - DNA, 25 bp, Rattus norvegicus
gtgcccaggcagttgtaggaagtca

SEQ ID NO: 507420 - DNA, 25 bp, Rattus norvegicus
gtgcccaggtcaccagcaacagtgg

SEQ ID NO: 507421 - DNA, 25 bp, Rattus norvegicus
gtgcccaggtcagcagcaacagtgg

SEQ ID NO: 507422 - DNA, 25 bp, Rattus norvegicus
gtgcccagtggactcagagttatct

SEQ ID NO: 507423 - DNA, 25 bp, Rattus norvegicus
gtgcccagtggagtcagagttatct

SEQ ID NO: 507424 - DNA, 25 bp, Rattus norvegicus
gtgcccataggacagggtagtcaaa

SEQ ID NO: 507425 - DNA, 25 bp, Rattus norvegicus
gtgcccataggagagggtagtcaaa

SEQ ID NO: 507426 - DNA, 25 bp, Rattus norvegicus
gtgcccatatttacaggacatgttt

SEQ ID NO: 507427 - DNA, 25 bp, Rattus norvegicus
gtgcccatattttcaggacatgttt

SEQ ID NO: 507428 - DNA, 25 bp, Rattus norvegicus
gtgcccatcaaacggagaagccggt

SEQ ID NO: 507429 - DNA, 25 bp, Rattus norvegicus
gtgcccatcaaagggagaagccggt

SEQ ID NO: 507430 - DNA, 25 bp, Rattus norvegicus
gtgcccatcacacgtagggctacct

SEQ ID NO: 507431 - DNA, 25 bp, Rattus norvegicus
gtgcccatcacaggtagggctacct

SEQ ID NO: 507432 - DNA, 25 bp, Rattus norvegicus
gtgcccatcacgcacgtgacggaga

SEQ ID NO: 507433 - DNA, 25 bp, Rattus norvegicus
gtgcccatcacggacgtgacggaga

SEQ ID NO: 507434 - DNA, 25 bp, Rattus norvegicus
gtgcccatcagtcgctacagttgga

SEQ ID NO: 507435 - DNA, 25 bp, Rattus norvegicus
gtgcccatcagtggctacagttgga

SEQ ID NO: 507436 - DNA, 25 bp, Rattus norvegicus
gtgcccatcctgacattgtatgcca

SEQ ID NO: 507437 - DNA, 25 bp, Rattus norvegicus
gtgcccatcctgtcattgtatgcca

SEQ ID NO: 507438 - DNA, 25 bp, Rattus norvegicus
gtgcccatcttccacagagttaaag

SEQ ID NO: 507439 - DNA, 25 bp, Rattus norvegicus
gtgcccatcttcgacagagttaaag

SEQ ID NO: 507440 - DNA, 25 bp, Rattus norvegicus
gtgcccatgaacattaaggacctca

SEQ ID NO: 507441 - DNA, 25 bp, Rattus norvegicus
gtgcccatgaactttaaggacctca

SEQ ID NO: 507442 - DNA, 25 bp, Rattus norvegicus
gtgcccatgcagagagaacctctct

SEQ ID NO: 507443 - DNA, 25 bp, Rattus norvegicus
gtgcccatgcagtgagaacctctct

SEQ ID NO: 507444 - DNA, 25 bp, Rattus norvegicus
gtgcccatgcatcctggcatactta

SEQ ID NO: 507445 - DNA, 25 bp, Rattus norvegicus
gtgcccatgcatgctggcatactta

SEQ ID NO: 507446 - DNA, 25 bp, Rattus norvegicus
gtgcccatggacagagatccctaag

SEQ ID NO: 507447 - DNA, 25 bp, Rattus norvegicus
gtgcccatggactgagatccctaag

SEQ ID NO: 507448 - DNA, 25 bp, Rattus norvegicus
gtgcccattcccaggtgatgcaaag

SEQ ID NO: 507449 - DNA, 25 bp, Rattus norvegicus
gtgcccattccctggtgatgcaaag

SEQ ID NO: 507450 - DNA, 25 bp, Rattus norvegicus
gtgcccattctaagcctaaggagtg

SEQ ID NO: 507451 - DNA, 25 bp, Rattus norvegicus
gtgcccattctatgcctaaggagtg

SEQ ID NO: 507452 - DNA, 25 bp, Rattus norvegicus
gtgcccattgcccacagaatggtgg

SEQ ID NO: 507453 - DNA, 25 bp, Rattus norvegicus
gtgcccattgccgacagaatggtgg

SEQ ID NO: 507454 - DNA, 25 bp, Rattus norvegicus
gtgcccattgctctcgagctgagag

SEQ ID NO: 507455 - DNA, 25 bp, Rattus norvegicus
gtgcccattgctgtcgagctgagag

SEQ ID NO: 507456 - DNA, 25 bp, Rattus norvegicus
gtgccccaaaagagctttaccatgc

SEQ ID NO: 507457 - DNA, 25 bp, Rattus norvegicus
gtgccccaaaagtgctttaccatgc

SEQ ID NO: 507458 - DNA, 25 bp, Rattus norvegicus
gtgccccaaatccagctatttacat

SEQ ID NO: 507459 - DNA, 25 bp, Rattus norvegicus
gtgccccaaatcgagctatttacat

SEQ ID NO: 507460 - DNA, 25 bp, Rattus norvegicus
gtgccccaacctaatgttctagaga

SEQ ID NO: 507461 - DNA, 25 bp, Rattus norvegicus
gtgccccaaccttatgttctagaga

SEQ ID NO: 507462 - DNA, 25 bp, Rattus norvegicus
gtgccccaaggcataagagcgctgg

SEQ ID NO: 507463 - DNA, 25 bp, Rattus norvegicus
gtgccccaaggcctacaagacagct

SEQ ID NO: 507464 - DNA, 25 bp, Rattus norvegicus
gtgccccaaggcgtacaagacagct

SEQ ID NO: 507465 - DNA, 25 bp, Rattus norvegicus
gtgccccaaggcttaagagcgctgg

SEQ ID NO: 507466 - DNA, 25 bp, Rattus norvegicus
gtgccccacaacagtaggtacaggg

SEQ ID NO: 507467 - DNA, 25 bp, Rattus norvegicus
gtgccccacaactgtaggtacaggg

SEQ ID NO: 507468 - DNA, 25 bp, Rattus norvegicus
gtgccccacactacatcattttaga

SEQ ID NO: 507469 - DNA, 25 bp, Rattus norvegicus
gtgccccacacttcatcattttaga

SEQ ID NO: 507470 - DNA, 25 bp, Rattus norvegicus
gtgccccacagacaccaatgacatt

SEQ ID NO: 507471 - DNA, 25 bp, Rattus norvegicus
gtgccccacagagaccaatgacatt

SEQ ID NO: 507472 - DNA, 25 bp, Rattus norvegicus
gtgccccactgtacctaggactgga

SEQ ID NO: 507473 - DNA, 25 bp, Rattus norvegicus
gtgccccactgttcctaggactgga

SEQ ID NO: 507474 - DNA, 25 bp, Rattus norvegicus
gtgccccagaacaagctttcttttt

SEQ ID NO: 507475 - DNA, 25 bp, Rattus norvegicus
gtgccccagaactagctttcttttt

SEQ ID NO: 507476 - DNA, 25 bp, Rattus norvegicus
gtgccccagaagctctaggcctgag

SEQ ID NO: 507477 - DNA, 25 bp, Rattus norvegicus
gtgccccagaaggtctaggcctgag

SEQ ID NO: 507478 - DNA, 25 bp, Rattus norvegicus
gtgccccagaccaggaattcggaat

SEQ ID NO: 507479 - DNA, 25 bp, Rattus norvegicus
gtgccccagacctggaattcggaat

SEQ ID NO: 507480 - DNA, 25 bp, Rattus norvegicus
gtgccccagccccataaaaagatgg

SEQ ID NO: 507481 - DNA, 25 bp, Rattus norvegicus
gtgccccagcccgataaaaagatgg

SEQ ID NO: 507482 - DNA, 25 bp, Rattus norvegicus
gtgccccaggcaataatagaccagt

SEQ ID NO: 507483 - DNA, 25 bp, Rattus norvegicus
gtgccccaggcattaatagaccagt

SEQ ID NO: 507484 - DNA, 25 bp, Rattus norvegicus
gtgccccagtggaaaatctgtttgt

SEQ ID NO: 507485 - DNA, 25 bp, Rattus norvegicus
gtgccccagtggagtggttaacgaa

SEQ ID NO: 507486 - DNA, 25 bp, Rattus norvegicus
gtgccccagtggtaaatctgtttgt

SEQ ID NO: 507487 - DNA, 25 bp, Rattus norvegicus
gtgccccagtggtgtggttaacgaa

SEQ ID NO: 507488 - DNA, 25 bp, Rattus norvegicus
gtgccccatagtctcagatgtttgg

SEQ ID NO: 507489 - DNA, 25 bp, Rattus norvegicus
gtgccccatagtgtcagatgtttgg

SEQ ID NO: 507490 - DNA, 25 bp, Rattus norvegicus
gtgccccatcttcattttgagacat

SEQ ID NO: 507491 - DNA, 25 bp, Rattus norvegicus
gtgccccatcttgattttgagacat

SEQ ID NO: 507492 - DNA, 25 bp, Rattus norvegicus
gtgccccatgataatactgtttttg

SEQ ID NO: 507493 - DNA, 25 bp, Rattus norvegicus
gtgccccatgattatactgtttttg

SEQ ID NO: 507494 - DNA, 25 bp, Rattus norvegicus
gtgccccattttaggtggcccataa

SEQ ID NO: 507495 - DNA, 25 bp, Rattus norvegicus
gtgccccatttttggtggcccataa

SEQ ID NO: 507496 - DNA, 25 bp, Rattus norvegicus
gtgcccctacacacaaactagtttg

SEQ ID NO: 507497 - DNA, 25 bp, Rattus norvegicus
gtgcccctacactcaaactagtttg

SEQ ID NO: 507498 - DNA, 25 bp, Rattus norvegicus
gtgcccctagctcagtgtatatgtg

SEQ ID NO: 507499 - DNA, 25 bp, Rattus norvegicus
gtgcccctagctgagtgtatatgtg

SEQ ID NO: 507500 - DNA, 25 bp, Rattus norvegicus
gtgcccctcaacaattttttcactg

SEQ ID NO: 507501 - DNA, 25 bp, Rattus norvegicus
gtgcccctcaactattttttcactg

SEQ ID NO: 507502 - DNA, 25 bp, Rattus norvegicus
gtgcccctcaatcatcgtggataag

SEQ ID NO: 507503 - DNA, 25 bp, Rattus norvegicus
gtgcccctcaatgatcgtggataag

SEQ ID NO: 507504 - DNA, 25 bp, Rattus norvegicus
gtgcccctcactagagcgtgtgtgt

SEQ ID NO: 507505 - DNA, 25 bp, Rattus norvegicus
gtgcccctcacttgagcgtgtgtgt

SEQ ID NO: 507506 - DNA, 25 bp, Rattus norvegicus
gtgcccctcattcagtcatatggtt

SEQ ID NO: 507507 - DNA, 25 bp, Rattus norvegicus
gtgcccctcattgagtcatatggtt

SEQ ID NO: 507508 - DNA, 25 bp, Rattus norvegicus
gtgcccctcctaagtgggagttacg

SEQ ID NO: 507509 - DNA, 25 bp, Rattus norvegicus
gtgcccctcctatgtgggagttacg

SEQ ID NO: 507510 - DNA, 25 bp, Rattus norvegicus
gtgcccctctggattgagaaactga

SEQ ID NO: 507511 - DNA, 25 bp, Rattus norvegicus
gtgcccctctggtttgagaaactga

SEQ ID NO: 507512 - DNA, 25 bp, Rattus norvegicus
gtgcccctgcttcattgaagtgttt

SEQ ID NO: 507513 - DNA, 25 bp, Rattus norvegicus
gtgcccctgcttgattgaagtgttt

SEQ ID NO: 507514 - DNA, 25 bp, Rattus norvegicus
gtgcccctgtgcagagctgaactga

SEQ ID NO: 507515 - DNA, 25 bp, Rattus norvegicus
gtgcccctgtgctgagctgaactga

SEQ ID NO: 507516 - DNA, 25 bp, Rattus norvegicus
gtgcccctgtggaagtctgttactg

SEQ ID NO: 507517 - DNA, 25 bp, Rattus norvegicus
gtgcccctgtggtagtctgttactg

SEQ ID NO: 507518 - DNA, 25 bp, Rattus norvegicus
gtgcccctgtgtccctagagcaaga

SEQ ID NO: 507519 - DNA, 25 bp, Rattus norvegicus
gtgcccctgtgtgcctagagcaaga

SEQ ID NO: 507520 - DNA, 25 bp, Rattus norvegicus
gtgccccttgctcggatttgtaatc

SEQ ID NO: 507521 - DNA, 25 bp, Rattus norvegicus
gtgccccttgctgggatttgtaatc

SEQ ID NO: 507522 - DNA, 25 bp, Rattus norvegicus
gtgcccctttggaagagtcgaagct

SEQ ID NO: 507523 - DNA, 25 bp, Rattus norvegicus
gtgcccctttggtagagtcgaagct

SEQ ID NO: 507524 - DNA, 25 bp, Rattus norvegicus
gtgccccttttgattaccagttatg

SEQ ID NO: 507525 - DNA, 25 bp, Rattus norvegicus
gtgccccttttgtttaccagttatg

SEQ ID NO: 507526 - DNA, 25 bp, Rattus norvegicus
gtgcccgcaaaccagagcattgcat

SEQ ID NO: 507527 - DNA, 25 bp, Rattus norvegicus
gtgcccgcaaacgagagcattgcat

SEQ ID NO: 507528 - DNA, 25 bp, Rattus norvegicus
gtgcccgctccaataagcatgaggt

SEQ ID NO: 507529 - DNA, 25 bp, Rattus norvegicus
gtgcccgctccattaagcatgaggt

SEQ ID NO: 507530 - DNA, 25 bp, Rattus norvegicus
gtgcccgctgggacaaactgtgcaa

SEQ ID NO: 507531 - DNA, 25 bp, Rattus norvegicus
gtgcccgctgggtcaaactgtgcaa

SEQ ID NO: 507532 - DNA, 25 bp, Rattus norvegicus
gtgcccgtataacagcagtaccgaa

SEQ ID NO: 507533 - DNA, 25 bp, Rattus norvegicus
gtgcccgtataagagcagtaccgaa

SEQ ID NO: 507534 - DNA, 25 bp, Rattus norvegicus
gtgcccgtcctgagagcactacagt

SEQ ID NO: 507535 - DNA, 25 bp, Rattus norvegicus
gtgcccgtcctgtgagcactacagt

SEQ ID NO: 507536 - DNA, 25 bp, Rattus norvegicus
gtgcccgtccttctggttgaataaa

SEQ ID NO: 507537 - DNA, 25 bp, Rattus norvegicus
gtgcccgtccttgtggttgaataaa

SEQ ID NO: 507538 - DNA, 25 bp, Rattus norvegicus
gtgcccgtctttatgtactgtaact

SEQ ID NO: 507539 - DNA, 25 bp, Rattus norvegicus
gtgcccgtctttttgtactgtaact

SEQ ID NO: 507540 - DNA, 25 bp, Rattus norvegicus
gtgcccgtgaccataatcctagtgt

SEQ ID NO: 507541 - DNA, 25 bp, Rattus norvegicus
gtgcccgtgaccttaatcctagtgt

SEQ ID NO: 507542 - DNA, 25 bp, Rattus norvegicus
gtgcccgtgggaacttgagcagttt

SEQ ID NO: 507543 - DNA, 25 bp, Rattus norvegicus
gtgcccgtgggatcttgagcagttt

SEQ ID NO: 507544 - DNA, 25 bp, Rattus norvegicus
gtgcccgtggtgatgccatgccccg

SEQ ID NO: 507545 - DNA, 25 bp, Rattus norvegicus
gtgcccgtggtgttgccatgccccg

SEQ ID NO: 507546 - DNA, 25 bp, Rattus norvegicus
gtgcccgtgtcgcagccgcgcgaga

SEQ ID NO: 507547 - DNA, 25 bp, Rattus norvegicus
gtgcccgtgtcggagccgcgcgaga

SEQ ID NO: 507548 - DNA, 25 bp, Rattus norvegicus
gtgcccgtttgtcactaaaacctgt

SEQ ID NO: 507549 - DNA, 25 bp, Rattus norvegicus
gtgcccgtttgtgactaaaacctgt

SEQ ID NO: 507550 - DNA, 25 bp, Rattus norvegicus
gtgccctaactcagctaacatgaca

SEQ ID NO: 507551 - DNA, 25 bp, Rattus norvegicus
gtgccctaactctgctaacatgaca

SEQ ID NO: 507552 - DNA, 25 bp, Rattus norvegicus
gtgccctaagttactgtactcgtat

SEQ ID NO: 507553 - DNA, 25 bp, Rattus norvegicus
gtgccctaagtttctgtactcgtat

SEQ ID NO: 507554 - DNA, 25 bp, Rattus norvegicus
gtgccctacctccagtgaagaagtc

SEQ ID NO: 507555 - DNA, 25 bp, Rattus norvegicus
gtgccctacctcgagtgaagaagtc

SEQ ID NO: 507556 - DNA, 25 bp, Rattus norvegicus
gtgccctagcttcagcagactgatt

SEQ ID NO: 507557 - DNA, 25 bp, Rattus norvegicus
gtgccctagcttgagcagactgatt

SEQ ID NO: 507558 - DNA, 25 bp, Rattus norvegicus
gtgccctaggaaaataactgcttgt

SEQ ID NO: 507559 - DNA, 25 bp, Rattus norvegicus
gtgccctaggaatataactgcttgt

SEQ ID NO: 507560 - DNA, 25 bp, Rattus norvegicus
gtgccctatgccacaagttttgatt

SEQ ID NO: 507561 - DNA, 25 bp, Rattus norvegicus
gtgccctatgcctcaagttttgatt

SEQ ID NO: 507562 - DNA, 25 bp, Rattus norvegicus
gtgccctattataccgatgcgaaaa

SEQ ID NO: 507563 - DNA, 25 bp, Rattus norvegicus
gtgccctattattccgatgcgaaaa

SEQ ID NO: 507564 - DNA, 25 bp, Rattus norvegicus
gtgccctcaccacttgaaaactaaa

SEQ ID NO: 507565 - DNA, 25 bp, Rattus norvegicus
gtgccctcaccagttgaaaactaaa

SEQ ID NO: 507566 - DNA, 25 bp, Rattus norvegicus
gtgccctcagctcgattgtatgtga

SEQ ID NO: 507567 - DNA, 25 bp, Rattus norvegicus
gtgccctcagctggattgtatgtga

SEQ ID NO: 507568 - DNA, 25 bp, Rattus norvegicus
gtgccctcatttagccttgaaatta

SEQ ID NO: 507569 - DNA, 25 bp, Rattus norvegicus
gtgccctcattttgccttgaaatta

SEQ ID NO: 507570 - DNA, 25 bp, Rattus norvegicus
gtgccctccagactgcagggagaaa

SEQ ID NO: 507571 - DNA, 25 bp, Rattus norvegicus
gtgccctccagagtgcagggagaaa

SEQ ID NO: 507572 - DNA, 25 bp, Rattus norvegicus
gtgccctcctcaacatggacagagt

SEQ ID NO: 507573 - DNA, 25 bp, Rattus norvegicus
gtgccctcctcatcatggacagagt

SEQ ID NO: 507574 - DNA, 25 bp, Rattus norvegicus
gtgccctccttccaggtgtatagag

SEQ ID NO: 507575 - DNA, 25 bp, Rattus norvegicus
gtgccctccttcgaggtgtatagag

SEQ ID NO: 507576 - DNA, 25 bp, Rattus norvegicus
gtgccctccttgaatctgaagcagg

SEQ ID NO: 507577 - DNA, 25 bp, Rattus norvegicus
gtgccctccttgtatctgaagcagg

SEQ ID NO: 507578 - DNA, 25 bp, Rattus norvegicus
gtgccctcgatccttggtttagaac

SEQ ID NO: 507579 - DNA, 25 bp, Rattus norvegicus
gtgccctcgatcgttggtttagaac

SEQ ID NO: 507580 - DNA, 25 bp, Rattus norvegicus
gtgccctctatacctcagagcattg

SEQ ID NO: 507581 - DNA, 25 bp, Rattus norvegicus
gtgccctctatagctcagagcattg

SEQ ID NO: 507582 - DNA, 25 bp, Rattus norvegicus
gtgccctctgaaagccaaagacgct

SEQ ID NO: 507583 - DNA, 25 bp, Rattus norvegicus
gtgccctctgaatgccaaagacgct

SEQ ID NO: 507584 - DNA, 25 bp, Rattus norvegicus
gtgccctctgctcgcttagtgagaa

SEQ ID NO: 507585 - DNA, 25 bp, Rattus norvegicus
gtgccctctgctggcttagtgagaa

SEQ ID NO: 507586 - DNA, 25 bp, Rattus norvegicus
gtgccctcttgaatccaagtgtcta

SEQ ID NO: 507587 - DNA, 25 bp, Rattus norvegicus
gtgccctcttgattccaagtgtcta

SEQ ID NO: 507588 - DNA, 25 bp, Rattus norvegicus
gtgccctctttaaactgttgtgtgt

SEQ ID NO: 507589 - DNA, 25 bp, Rattus norvegicus
gtgccctctttatactgttgtgtgt

SEQ ID NO: 507590 - DNA, 25 bp, Rattus norvegicus
gtgccctgacagcacaggttctaga

SEQ ID NO: 507591 - DNA, 25 bp, Rattus norvegicus
gtgccctgacaggacaggttctaga

SEQ ID NO: 507592 - DNA, 25 bp, Rattus norvegicus
gtgccctgacctaccggaagtgaag

SEQ ID NO: 507593 - DNA, 25 bp, Rattus norvegicus
gtgccctgaccttccggaagtgaag

SEQ ID NO: 507594 - DNA, 25 bp, Rattus norvegicus
gtgccctgagcacagcatgcatgag

SEQ ID NO: 507595 - DNA, 25 bp, Rattus norvegicus
gtgccctgagcagagcatgcatgag

SEQ ID NO: 507596 - DNA, 25 bp, Rattus norvegicus
gtgccctgattgaaacccaaaattt

SEQ ID NO: 507597 - DNA, 25 bp, Rattus norvegicus
gtgccctgattgtaacccaaaattt

SEQ ID NO: 507598 - DNA, 25 bp, Rattus norvegicus
gtgccctgcaccaagactttggtta

SEQ ID NO: 507599 - DNA, 25 bp, Rattus norvegicus
gtgccctgcacctagactttggtta

SEQ ID NO: 507600 - DNA, 25 bp, Rattus norvegicus
gtgccctgcagtcggacagatgcca

SEQ ID NO: 507601 - DNA, 25 bp, Rattus norvegicus
gtgccctgcagtgggacagatgcca

SEQ ID NO: 507602 - DNA, 25 bp, Rattus norvegicus
gtgccctgcattaagagctacctga

SEQ ID NO: 507603 - DNA, 25 bp, Rattus norvegicus
gtgccctgcatttagagctacctga

SEQ ID NO: 507604 - DNA, 25 bp, Rattus norvegicus
gtgccctgcgcactatttattgcta

SEQ ID NO: 507605 - DNA, 25 bp, Rattus norvegicus
gtgccctgcgcagtatttattgcta

SEQ ID NO: 507606 - DNA, 25 bp, Rattus norvegicus
gtgccctgcttgacttggagcaaga

SEQ ID NO: 507607 - DNA, 25 bp, Rattus norvegicus
gtgccctgcttgtcttggagcaaga

SEQ ID NO: 507608 - DNA, 25 bp, Rattus norvegicus
gtgccctggagaacagcagcatcat

SEQ ID NO: 507609 - DNA, 25 bp, Rattus norvegicus
gtgccctggagatcagcagcatcat

SEQ ID NO: 507610 - DNA, 25 bp, Rattus norvegicus
gtgccctggattaatgcagtcatta

SEQ ID NO: 507611 - DNA, 25 bp, Rattus norvegicus
gtgccctggatttatgcagtcatta

SEQ ID NO: 507612 - DNA, 25 bp, Rattus norvegicus
gtgccctgggacacaacagaggata

SEQ ID NO: 507613 - DNA, 25 bp, Rattus norvegicus
gtgccctgggactcaacagaggata

SEQ ID NO: 507614 - DNA, 25 bp, Rattus norvegicus
gtgccctgggatcaatgccgtttac

SEQ ID NO: 507615 - DNA, 25 bp, Rattus norvegicus
gtgccctgggatgaatgccgtttac

SEQ ID NO: 507616 - DNA, 25 bp, Rattus norvegicus
gtgccctgggcaagatcctgtggaa

SEQ ID NO: 507617 - DNA, 25 bp, Rattus norvegicus
gtgccctgggcaatatagttctcat

SEQ ID NO: 507618 - DNA, 25 bp, Rattus norvegicus
gtgccctgggcatgatcctgtggaa

SEQ ID NO: 507619 - DNA, 25 bp, Rattus norvegicus
gtgccctgggcattatagttctcat

SEQ ID NO: 507620 - DNA, 25 bp, Rattus norvegicus
gtgccctgtacactgtacgcttgta

SEQ ID NO: 507621 - DNA, 25 bp, Rattus norvegicus
gtgccctgtacagtgtacgcttgta

SEQ ID NO: 507622 - DNA, 25 bp, Rattus norvegicus
gtgccctgtaggagtgaacactgaa

SEQ ID NO: 507623 - DNA, 25 bp, Rattus norvegicus
gtgccctgtaggtgtgaacactgaa

SEQ ID NO: 507624 - DNA, 25 bp, Rattus norvegicus
gtgccctgtagtattgtttgttgcc

SEQ ID NO: 507625 - DNA, 25 bp, Rattus norvegicus
gtgccctgtagttttgtttgttgcc

SEQ ID NO: 507626 - DNA, 25 bp, Rattus norvegicus
gtgccctgtcagcattccttcaagg

SEQ ID NO: 507627 - DNA, 25 bp, Rattus norvegicus
gtgccctgtcaggattccttcaagg

SEQ ID NO: 507628 - DNA, 25 bp, Rattus norvegicus
gtgccctgtgaaaattttttacatt

SEQ ID NO: 507629 - DNA, 25 bp, Rattus norvegicus
gtgccctgtgaatattttttacatt

SEQ ID NO: 507630 - DNA, 25 bp, Rattus norvegicus
gtgccctgtgataacgccttactat

SEQ ID NO: 507631 - DNA, 25 bp, Rattus norvegicus
gtgccctgtgatagacttaagtggt

SEQ ID NO: 507632 - DNA, 25 bp, Rattus norvegicus
gtgccctgtgattacgccttactat

SEQ ID NO: 507633 - DNA, 25 bp, Rattus norvegicus
gtgccctgtgattgacttaagtggt

SEQ ID NO: 507634 - DNA, 25 bp, Rattus norvegicus
gtgccctgtgttaggaaaagtccct

SEQ ID NO: 507635 - DNA, 25 bp, Rattus norvegicus
gtgccctgtgtttggaaaagtccct

SEQ ID NO: 507636 - DNA, 25 bp, Rattus norvegicus
gtgccctgttatcgctgcatgctga

SEQ ID NO: 507637 - DNA, 25 bp, Rattus norvegicus
gtgccctgttatggctgcatgctga

SEQ ID NO: 507638 - DNA, 25 bp, Rattus norvegicus
gtgcccttacctcttgtatctgaaa

SEQ ID NO: 507639 - DNA, 25 bp, Rattus norvegicus
gtgcccttacctgttgtatctgaaa

SEQ ID NO: 507640 - DNA, 25 bp, Rattus norvegicus
gtgcccttaggaccagcaagtgaca

SEQ ID NO: 507641 - DNA, 25 bp, Rattus norvegicus
gtgcccttaggagcagcaagtgaca

SEQ ID NO: 507642 - DNA, 25 bp, Rattus norvegicus
gtgcccttagtcatggatacggtct

SEQ ID NO: 507643 - DNA, 25 bp, Rattus norvegicus
gtgcccttagtcttggatacggtct

SEQ ID NO: 507644 - DNA, 25 bp, Rattus norvegicus
gtgcccttagtgagcgcattagtaa

SEQ ID NO: 507645 - DNA, 25 bp, Rattus norvegicus
gtgcccttagtgtgcgcattagtaa

SEQ ID NO: 507646 - DNA, 25 bp, Rattus norvegicus
gtgcccttagttcttgctgacaaga

SEQ ID NO: 507647 - DNA, 25 bp, Rattus norvegicus
gtgcccttagttgttgctgacaaga

SEQ ID NO: 507648 - DNA, 25 bp, Rattus norvegicus
gtgcccttcagaatgttgcaaggct

SEQ ID NO: 507649 - DNA, 25 bp, Rattus norvegicus
gtgcccttcagattgttgcaaggct

SEQ ID NO: 507650 - DNA, 25 bp, Rattus norvegicus
gtgcccttcattcccttggctaaag

SEQ ID NO: 507651 - DNA, 25 bp, Rattus norvegicus
gtgcccttcattgccttggctaaag

SEQ ID NO: 507652 - DNA, 25 bp, Rattus norvegicus
gtgcccttccacagagttaaaacca

SEQ ID NO: 507653 - DNA, 25 bp, Rattus norvegicus
gtgcccttccactgagttaaaacca

SEQ ID NO: 507654 - DNA, 25 bp, Rattus norvegicus
gtgcccttcctgacttaacaattta

SEQ ID NO: 507655 - DNA, 25 bp, Rattus norvegicus
gtgcccttcctgatttagtttgtat

SEQ ID NO: 507656 - DNA, 25 bp, Rattus norvegicus
gtgcccttcctgtcttaacaattta

SEQ ID NO: 507657 - DNA, 25 bp, Rattus norvegicus
gtgcccttcctgttttagtttgtat

SEQ ID NO: 507658 - DNA, 25 bp, Rattus norvegicus
gtgcccttcggcagagcaggactgt

SEQ ID NO: 507659 - DNA, 25 bp, Rattus norvegicus
gtgcccttcggctgagcaggactgt

SEQ ID NO: 507660 - DNA, 25 bp, Rattus norvegicus
gtgcccttctgaagagtactttacg

SEQ ID NO: 507661 - DNA, 25 bp, Rattus norvegicus
gtgcccttctgatgagtactttacg

SEQ ID NO: 507662 - DNA, 25 bp, Rattus norvegicus
gtgcccttctgtacctggaggatta

SEQ ID NO: 507663 - DNA, 25 bp, Rattus norvegicus
gtgcccttctgttcctggaggatta

SEQ ID NO: 507664 - DNA, 25 bp, Rattus norvegicus
gtgcccttgctgaatgatgtcatgg

SEQ ID NO: 507665 - DNA, 25 bp, Rattus norvegicus
gtgcccttgctgtatgatgtcatgg

SEQ ID NO: 507666 - DNA, 25 bp, Rattus norvegicus
gtgcccttggaaactgaagacctca

SEQ ID NO: 507667 - DNA, 25 bp, Rattus norvegicus
gtgcccttggaatctgaagacctca

SEQ ID NO: 507668 - DNA, 25 bp, Rattus norvegicus
gtgcccttgttcctgaattacacaa

SEQ ID NO: 507669 - DNA, 25 bp, Rattus norvegicus
gtgcccttgttcgtgaattacacaa

SEQ ID NO: 507670 - DNA, 25 bp, Rattus norvegicus
gtgcccttgtttacaacagtttctg

SEQ ID NO: 507671 - DNA, 25 bp, Rattus norvegicus
gtgcccttgttttcaacagtttctg

SEQ ID NO: 507672 - DNA, 25 bp, Rattus norvegicus
gtgccctttggcatctaataaaatg

SEQ ID NO: 507673 - DNA, 25 bp, Rattus norvegicus
gtgccctttggcttctaataaaatg

SEQ ID NO: 507674 - DNA, 25 bp, Rattus norvegicus
gtgccctttgtcaggctgactgtag

SEQ ID NO: 507675 - DNA, 25 bp, Rattus norvegicus
gtgccctttgtctggctgactgtag

SEQ ID NO: 507676 - DNA, 25 bp, Rattus norvegicus
gtgccctttgtgaccagtggtaaac

SEQ ID NO: 507677 - DNA, 25 bp, Rattus norvegicus
gtgccctttgtgtccagtggtaaac

SEQ ID NO: 507678 - DNA, 25 bp, Rattus norvegicus
gtgcccttttagacacttcatcaga

SEQ ID NO: 507679 - DNA, 25 bp, Rattus norvegicus
gtgcccttttagtcacttcatcaga

SEQ ID NO: 507680 - DNA, 25 bp, Rattus norvegicus
gtgccgaaacctaagatccatatcc

SEQ ID NO: 507681 - DNA, 25 bp, Rattus norvegicus
gtgccgaaaccttagatccatatcc

SEQ ID NO: 507682 - DNA, 25 bp, Rattus norvegicus
gtgccgaagggtactcacgggttct

SEQ ID NO: 507683 - DNA, 25 bp, Rattus norvegicus
gtgccgaagggttctcacgggttct

SEQ ID NO: 507684 - DNA, 25 bp, Rattus norvegicus
gtgccgacaacaacaagtcttgcag

SEQ ID NO: 507685 - DNA, 25 bp, Rattus norvegicus
gtgccgacaacatcaagtcttgcag

SEQ ID NO: 507686 - DNA, 25 bp, Rattus norvegicus
gtgccgaggcatcaaaggctagtat

SEQ ID NO: 507687 - DNA, 25 bp, Rattus norvegicus
gtgccgaggcatgaaaggctagtat

SEQ ID NO: 507688 - DNA, 25 bp, Rattus norvegicus
gtgccgagtccacaaatacagagct

SEQ ID NO: 507689 - DNA, 25 bp, Rattus norvegicus
gtgccgagtccagaaatacagagct

SEQ ID NO: 507690 - DNA, 25 bp, Rattus norvegicus
gtgccgatggctaggctgaagattt

SEQ ID NO: 507691 - DNA, 25 bp, Rattus norvegicus
gtgccgatggcttggctgaagattt

SEQ ID NO: 507692 - DNA, 25 bp, Rattus norvegicus
gtgccgcatcgtccgaaacaagcat

SEQ ID NO: 507693 - DNA, 25 bp, Rattus norvegicus
gtgccgcatcgtgcgaaacaagcat

SEQ ID NO: 507694 - DNA, 25 bp, Rattus norvegicus
gtgccgcatgttattctagatgttt

SEQ ID NO: 507695 - DNA, 25 bp, Rattus norvegicus
gtgccgcatgtttttctagatgttt

SEQ ID NO: 507696 - DNA, 25 bp, Rattus norvegicus
gtgccgcattggacacagctgatga

SEQ ID NO: 507697 - DNA, 25 bp, Rattus norvegicus
gtgccgcattggtcacagctgatga

SEQ ID NO: 507698 - DNA, 25 bp, Rattus norvegicus
gtgccgcgcgatcacaagaagccag

SEQ ID NO: 507699 - DNA, 25 bp, Rattus norvegicus
gtgccgcgcgatgacaagaagccag

SEQ ID NO: 507700 - DNA, 25 bp, Rattus norvegicus
gtgccgctccatacagtcataaaat

SEQ ID NO: 507701 - DNA, 25 bp, Rattus norvegicus
gtgccgctccattcagtcataaaat

SEQ ID NO: 507702 - DNA, 25 bp, Rattus norvegicus
gtgccgctcggcagatacggtgcta

SEQ ID NO: 507703 - DNA, 25 bp, Rattus norvegicus
gtgccgctcggctgatacggtgcta

SEQ ID NO: 507704 - DNA, 25 bp, Rattus norvegicus
gtgccgctctcaattacagaacatc

SEQ ID NO: 507705 - DNA, 25 bp, Rattus norvegicus
gtgccgctctcatttacagaacatc

SEQ ID NO: 507706 - DNA, 25 bp, Rattus norvegicus
gtgccgctgaaacgaatcgtgaact

SEQ ID NO: 507707 - DNA, 25 bp, Rattus norvegicus
gtgccgctgaaaggaatcgtgaact

SEQ ID NO: 507708 - DNA, 25 bp, Rattus norvegicus
gtgccgcttattctaggacttttta

SEQ ID NO: 507709 - DNA, 25 bp, Rattus norvegicus
gtgccgcttattgtaggacttttta

SEQ ID NO: 507710 - DNA, 25 bp, Rattus norvegicus
gtgccgcttcgccaatgatcgctaa

SEQ ID NO: 507711 - DNA, 25 bp, Rattus norvegicus
gtgccgcttcgcgaatgatcgctaa

SEQ ID NO: 507712 - DNA, 25 bp, Rattus norvegicus
gtgccgcttgcgcagtttataaaag

SEQ ID NO: 507713 - DNA, 25 bp, Rattus norvegicus
gtgccgcttgcggagtttataaaag

SEQ ID NO: 507714 - DNA, 25 bp, Rattus norvegicus
gtgccggaaaacatcattttgaata

SEQ ID NO: 507715 - DNA, 25 bp, Rattus norvegicus
gtgccggaaaacttcattttgaata

SEQ ID NO: 507716 - DNA, 25 bp, Rattus norvegicus
gtgccggaacagactcagccatgag

SEQ ID NO: 507717 - DNA, 25 bp, Rattus norvegicus
gtgccggaacagtctcagccatgag

SEQ ID NO: 507718 - DNA, 25 bp, Rattus norvegicus
gtgccggatgacagactatgactgt

SEQ ID NO: 507719 - DNA, 25 bp, Rattus norvegicus
gtgccggatgactgactatgactgt

SEQ ID NO: 507720 - DNA, 25 bp, Rattus norvegicus
gtgccggcagtccacaacatggctt

SEQ ID NO: 507721 - DNA, 25 bp, Rattus norvegicus
gtgccggcagtcgacaacatggctt

SEQ ID NO: 507722 - DNA, 25 bp, Rattus norvegicus
gtgccggccatcatgcccaaagtgc

SEQ ID NO: 507723 - DNA, 25 bp, Rattus norvegicus
gtgccggccatcatgtttaaatctg

SEQ ID NO: 507724 - DNA, 25 bp, Rattus norvegicus
gtgccggccatcttgcccaaagtgc

SEQ ID NO: 507725 - DNA, 25 bp, Rattus norvegicus
gtgccggccatcttgtttaaatctg

SEQ ID NO: 507726 - DNA, 25 bp, Rattus norvegicus
gtgccggccattacaagacatgcag

SEQ ID NO: 507727 - DNA, 25 bp, Rattus norvegicus
gtgccggccatttcaagacatgcag

SEQ ID NO: 507728 - DNA, 25 bp, Rattus norvegicus
gtgccggcccagagagccagcagaa

SEQ ID NO: 507729 - DNA, 25 bp, Rattus norvegicus
gtgccggcccagtgagccagcagaa

SEQ ID NO: 507730 - DNA, 25 bp, Rattus norvegicus
gtgccgggtgctctagactacatgt

SEQ ID NO: 507731 - DNA, 25 bp, Rattus norvegicus
gtgccgggtgctgtagactacatgt

SEQ ID NO: 507732 - DNA, 25 bp, Rattus norvegicus
gtgccgggtggtacagaacaacgac

SEQ ID NO: 507733 - DNA, 25 bp, Rattus norvegicus
gtgccgggtggttcagaacaacgac

SEQ ID NO: 507734 - DNA, 25 bp, Rattus norvegicus
gtgccgggttgcaacaaaggtgaca

SEQ ID NO: 507735 - DNA, 25 bp, Rattus norvegicus
gtgccgggttgctacaaaggtgaca

SEQ ID NO: 507736 - DNA, 25 bp, Rattus norvegicus
gtgccggtgaatacttacatggtct

SEQ ID NO: 507737 - DNA, 25 bp, Rattus norvegicus
gtgccggtgaattcttacatggtct

SEQ ID NO: 507738 - DNA, 25 bp, Rattus norvegicus
gtgccggtgctgctgttgaacatca

SEQ ID NO: 507739 - DNA, 25 bp, Rattus norvegicus
gtgccggtgctggtgttgaacatca

SEQ ID NO: 507740 - DNA, 25 bp, Rattus norvegicus
gtgccggtgttgaggtgttacaccc

SEQ ID NO: 507741 - DNA, 25 bp, Rattus norvegicus
gtgccggtgttgtggtgttacaccc

SEQ ID NO: 507742 - DNA, 25 bp, Rattus norvegicus
gtgccgtaccagcatttgatttcta

SEQ ID NO: 507743 - DNA, 25 bp, Rattus norvegicus
gtgccgtaccaggatttgatttcta

SEQ ID NO: 507744 - DNA, 25 bp, Rattus norvegicus
gtgccgtatcggaactctaaactga

SEQ ID NO: 507745 - DNA, 25 bp, Rattus norvegicus
gtgccgtatcggtactctaaactga

SEQ ID NO: 507746 - DNA, 25 bp, Rattus norvegicus
gtgccgtatgtgacaatgcctgtaa

SEQ ID NO: 507747 - DNA, 25 bp, Rattus norvegicus
gtgccgtatgtgtcaatgcctgtaa

SEQ ID NO: 507748 - DNA, 25 bp, Rattus norvegicus
gtgccgtgggcaacagacattcaag

SEQ ID NO: 507749 - DNA, 25 bp, Rattus norvegicus
gtgccgtgggcatcagacattcaag

SEQ ID NO: 507750 - DNA, 25 bp, Rattus norvegicus
gtgccgtggttcagtagactcacaa

SEQ ID NO: 507751 - DNA, 25 bp, Rattus norvegicus
gtgccgtggttctgtagactcacaa

SEQ ID NO: 507752 - DNA, 25 bp, Rattus norvegicus
gtgccgttcgctatggttttacttt

SEQ ID NO: 507753 - DNA, 25 bp, Rattus norvegicus
gtgccgttcgctttggttttacttt

SEQ ID NO: 507754 - DNA, 25 bp, Rattus norvegicus
gtgccgttgtcaatgcctggtgacg

SEQ ID NO: 507755 - DNA, 25 bp, Rattus norvegicus
gtgccgttgtcattgcctggtgacg

SEQ ID NO: 507756 - DNA, 25 bp, Rattus norvegicus
gtgccgtttaagactctgggtataa

SEQ ID NO: 507757 - DNA, 25 bp, Rattus norvegicus
gtgccgtttaagtctctgggtataa

SEQ ID NO: 507758 - DNA, 25 bp, Rattus norvegicus
gtgccgtttgccactcacagagaga

SEQ ID NO: 507759 - DNA, 25 bp, Rattus norvegicus
gtgccgtttgcctctcacagagaga

SEQ ID NO: 507760 - DNA, 25 bp, Rattus norvegicus
gtgccgtttgtcattttgttacatg

SEQ ID NO: 507761 - DNA, 25 bp, Rattus norvegicus
gtgccgtttgtctttttgttacatg

SEQ ID NO: 507762 - DNA, 25 bp, Rattus norvegicus
gtgcctaaaatccagagtcccgaca

SEQ ID NO: 507763 - DNA, 25 bp, Rattus norvegicus
gtgcctaaaatcgagagtcccgaca

SEQ ID NO: 507764 - DNA, 25 bp, Rattus norvegicus
gtgcctaaagaacagcccagatgag

SEQ ID NO: 507765 - DNA, 25 bp, Rattus norvegicus
gtgcctaaagaagagcccagatgag

SEQ ID NO: 507766 - DNA, 25 bp, Rattus norvegicus
gtgcctaaagccaacctaatggaga

SEQ ID NO: 507767 - DNA, 25 bp, Rattus norvegicus
gtgcctaaagcctacctaatggaga

SEQ ID NO: 507768 - DNA, 25 bp, Rattus norvegicus
gtgcctaaagtaatcttttctgaaa

SEQ ID NO: 507769 - DNA, 25 bp, Rattus norvegicus
gtgcctaaagtattcttttctgaaa

SEQ ID NO: 507770 - DNA, 25 bp, Rattus norvegicus
gtgcctaacattatgtgacagcttc

SEQ ID NO: 507771 - DNA, 25 bp, Rattus norvegicus
gtgcctaacattttgtgacagcttc

SEQ ID NO: 507772 - DNA, 25 bp, Rattus norvegicus
gtgcctaaccctctgttcaatagca

SEQ ID NO: 507773 - DNA, 25 bp, Rattus norvegicus
gtgcctaaccctgtgttcaatagca

SEQ ID NO: 507774 - DNA, 25 bp, Rattus norvegicus
gtgcctaagcaaaccatcggttttt

SEQ ID NO: 507775 - DNA, 25 bp, Rattus norvegicus
gtgcctaagcaatccatcggttttt

SEQ ID NO: 507776 - DNA, 25 bp, Rattus norvegicus
gtgcctaaggccatgagatgtttcc

SEQ ID NO: 507777 - DNA, 25 bp, Rattus norvegicus
gtgcctaaggccttgagatgtttcc

SEQ ID NO: 507778 - DNA, 25 bp, Rattus norvegicus
gtgcctaatccacggatcactgtca

SEQ ID NO: 507779 - DNA, 25 bp, Rattus norvegicus
gtgcctaatccagggatcactgtca

SEQ ID NO: 507780 - DNA, 25 bp, Rattus norvegicus
gtgcctaatcccaacactgtttagt

SEQ ID NO: 507781 - DNA, 25 bp, Rattus norvegicus
gtgcctaatccctacactgtttagt

SEQ ID NO: 507782 - DNA, 25 bp, Rattus norvegicus
gtgcctacaatcacttagtaaattc

SEQ ID NO: 507783 - DNA, 25 bp, Rattus norvegicus
gtgcctacaatctcttagtaaattc

SEQ ID NO: 507784 - DNA, 25 bp, Rattus norvegicus
gtgcctaccactcccttcaagaagt

SEQ ID NO: 507785 - DNA, 25 bp, Rattus norvegicus
gtgcctaccactgccttcaagaagt

SEQ ID NO: 507786 - DNA, 25 bp, Rattus norvegicus
gtgcctactgtgagctagagcttaa

SEQ ID NO: 507787 - DNA, 25 bp, Rattus norvegicus
gtgcctactgtgtgctagagcttaa

SEQ ID NO: 507788 - DNA, 25 bp, Rattus norvegicus
gtgcctacttcacagggtctatgca

SEQ ID NO: 507789 - DNA, 25 bp, Rattus norvegicus
gtgcctacttcagagggtctatgca

SEQ ID NO: 507790 - DNA, 25 bp, Rattus norvegicus
gtgcctacttccagagtgcgagtta

SEQ ID NO: 507791 - DNA, 25 bp, Rattus norvegicus
gtgcctacttcctgagtgcgagtta

SEQ ID NO: 507792 - DNA, 25 bp, Rattus norvegicus
gtgcctacttctagttggtgactaa

SEQ ID NO: 507793 - DNA, 25 bp, Rattus norvegicus
gtgcctacttcttgttggtgactaa

SEQ ID NO: 507794 - DNA, 25 bp, Rattus norvegicus
gtgcctagaattagtcccagtgtgt

SEQ ID NO: 507795 - DNA, 25 bp, Rattus norvegicus
gtgcctagaatttgtcccagtgtgt

SEQ ID NO: 507796 - DNA, 25 bp, Rattus norvegicus
gtgcctagactgatactttgccaat

SEQ ID NO: 507797 - DNA, 25 bp, Rattus norvegicus
gtgcctagactgttactttgccaat

SEQ ID NO: 507798 - DNA, 25 bp, Rattus norvegicus
gtgcctagatggactcagacagccc

SEQ ID NO: 507799 - DNA, 25 bp, Rattus norvegicus
gtgcctagatggtctcagacagccc

SEQ ID NO: 507800 - DNA, 25 bp, Rattus norvegicus
gtgcctagctctattgtgttcgtag

SEQ ID NO: 507801 - DNA, 25 bp, Rattus norvegicus
gtgcctagctcttttgtgttcgtag

SEQ ID NO: 507802 - DNA, 25 bp, Rattus norvegicus
gtgcctagtagcagcaaatgcctgg

SEQ ID NO: 507803 - DNA, 25 bp, Rattus norvegicus
gtgcctagtagctgcaaatgcctgg

SEQ ID NO: 507804 - DNA, 25 bp, Rattus norvegicus
gtgcctagtctactactttttcact

SEQ ID NO: 507805 - DNA, 25 bp, Rattus norvegicus
gtgcctagtctagtactttttcact

SEQ ID NO: 507806 - DNA, 25 bp, Rattus norvegicus
gtgcctagttcactgattcatgtgc

SEQ ID NO: 507807 - DNA, 25 bp, Rattus norvegicus
gtgcctagttcagtgattcatgtgc

SEQ ID NO: 507808 - DNA, 25 bp, Rattus norvegicus
gtgcctatagccacacagtctgtga

SEQ ID NO: 507809 - DNA, 25 bp, Rattus norvegicus
gtgcctatagcctcacagtctgtga

SEQ ID NO: 507810 - DNA, 25 bp, Rattus norvegicus
gtgcctatagggacattcatattct

SEQ ID NO: 507811 - DNA, 25 bp, Rattus norvegicus
gtgcctatagggtcattcatattct

SEQ ID NO: 507812 - DNA, 25 bp, Rattus norvegicus
gtgcctatatgaagacctgggagtg

SEQ ID NO: 507813 - DNA, 25 bp, Rattus norvegicus
gtgcctatatgatgacctgggagtg

SEQ ID NO: 507814 - DNA, 25 bp, Rattus norvegicus
gtgcctatgaagatgagccctggat

SEQ ID NO: 507815 - DNA, 25 bp, Rattus norvegicus
gtgcctatgaagttgagccctggat

SEQ ID NO: 507816 - DNA, 25 bp, Rattus norvegicus
gtgcctatgactagcttagcttttt

SEQ ID NO: 507817 - DNA, 25 bp, Rattus norvegicus
gtgcctatgacttgcttagcttttt

SEQ ID NO: 507818 - DNA, 25 bp, Rattus norvegicus
gtgcctatgatcatctgaaaagcag

SEQ ID NO: 507819 - DNA, 25 bp, Rattus norvegicus
gtgcctatgatcttctgaaaagcag

SEQ ID NO: 507820 - DNA, 25 bp, Rattus norvegicus
gtgcctatgtatacattcatgtaca

SEQ ID NO: 507821 - DNA, 25 bp, Rattus norvegicus
gtgcctatgtattcattcatgtaca

SEQ ID NO: 507822 - DNA, 25 bp, Rattus norvegicus
gtgcctatgtgcatgaatctgcctg

SEQ ID NO: 507823 - DNA, 25 bp, Rattus norvegicus
gtgcctatgtgcttgaatctgcctg

SEQ ID NO: 507824 - DNA, 25 bp, Rattus norvegicus
gtgcctatgtttatggtgccttcac

SEQ ID NO: 507825 - DNA, 25 bp, Rattus norvegicus
gtgcctatgtttcggttgcgtgaac

SEQ ID NO: 507826 - DNA, 25 bp, Rattus norvegicus
gtgcctatgtttgggttgcgtgaac

SEQ ID NO: 507827 - DNA, 25 bp, Rattus norvegicus
gtgcctatgtttttggtgccttcac

SEQ ID NO: 507828 - DNA, 25 bp, Rattus norvegicus
gtgcctcaaaccacagggagcaagt

SEQ ID NO: 507829 - DNA, 25 bp, Rattus norvegicus
gtgcctcaaacctcagggagcaagt

SEQ ID NO: 507830 - DNA, 25 bp, Rattus norvegicus
gtgcctcaaataaactgttcccacc

SEQ ID NO: 507831 - DNA, 25 bp, Rattus norvegicus
gtgcctcaaatatactgttcccacc

SEQ ID NO: 507832 - DNA, 25 bp, Rattus norvegicus
gtgcctcaacctattgctttcaata

SEQ ID NO: 507833 - DNA, 25 bp, Rattus norvegicus
gtgcctcaaccttttgctttcaata

SEQ ID NO: 507834 - DNA, 25 bp, Rattus norvegicus
gtgcctcaagcaacagttcatcttt

SEQ ID NO: 507835 - DNA, 25 bp, Rattus norvegicus
gtgcctcaagcatcagttcatcttt

SEQ ID NO: 507836 - DNA, 25 bp, Rattus norvegicus
gtgcctcaaggccacaaacaagatt

SEQ ID NO: 507837 - DNA, 25 bp, Rattus norvegicus
gtgcctcaaggcgacaaacaagatt

SEQ ID NO: 507838 - DNA, 25 bp, Rattus norvegicus
gtgcctcaagtaaacttccctgtta

SEQ ID NO: 507839 - DNA, 25 bp, Rattus norvegicus
gtgcctcaagtatacttccctgtta

SEQ ID NO: 507840 - DNA, 25 bp, Rattus norvegicus
gtgcctcaatttctgtattctcttt

SEQ ID NO: 507841 - DNA, 25 bp, Rattus norvegicus
gtgcctcaatttgtgtattctcttt

SEQ ID NO: 507842 - DNA, 25 bp, Rattus norvegicus
gtgcctcacactaaattacctgcat

SEQ ID NO: 507843 - DNA, 25 bp, Rattus norvegicus
gtgcctcacacttaattacctgcat

SEQ ID NO: 507844 - DNA, 25 bp, Rattus norvegicus
gtgcctcacagaatggagtcgtatc

SEQ ID NO: 507845 - DNA, 25 bp, Rattus norvegicus
gtgcctcacagattggagtcgtatc

SEQ ID NO: 507846 - DNA, 25 bp, Rattus norvegicus
gtgcctcacccaagttcagaatatg

SEQ ID NO: 507847 - DNA, 25 bp, Rattus norvegicus
gtgcctcacccatgttcagaatatg

SEQ ID NO: 507848 - DNA, 25 bp, Rattus norvegicus
gtgcctcaccgaacagattgtctgg

SEQ ID NO: 507849 - DNA, 25 bp, Rattus norvegicus
gtgcctcaccgatcagattgtctgg

SEQ ID NO: 507850 - DNA, 25 bp, Rattus norvegicus
gtgcctcacttcctagggagtttta

SEQ ID NO: 507851 - DNA, 25 bp, Rattus norvegicus
gtgcctcacttcgtagggagtttta

SEQ ID NO: 507852 - DNA, 25 bp, Rattus norvegicus
gtgcctcagacgagacatttttcgg

SEQ ID NO: 507853 - DNA, 25 bp, Rattus norvegicus
gtgcctcagacgtgacatttttcgg

SEQ ID NO: 507854 - DNA, 25 bp, Rattus norvegicus
gtgcctcagactagtgtgtgcatgt

SEQ ID NO: 507855 - DNA, 25 bp, Rattus norvegicus
gtgcctcagacttgtgtgtgcatgt

SEQ ID NO: 507856 - DNA, 25 bp, Rattus norvegicus
gtgcctcagaggagcgatgtagact

SEQ ID NO: 507857 - DNA, 25 bp, Rattus norvegicus
gtgcctcagaggtgcgatgtagact

SEQ ID NO: 507858 - DNA, 25 bp, Rattus norvegicus
gtgcctcagcgtctggttgaaccca

SEQ ID NO: 507859 - DNA, 25 bp, Rattus norvegicus
gtgcctcagcgtgtggttgaaccca

SEQ ID NO: 507860 - DNA, 25 bp, Rattus norvegicus
gtgcctcagtgcctcagtttacttt

SEQ ID NO: 507861 - DNA, 25 bp, Rattus norvegicus
gtgcctcagtgcgtcagtttacttt

SEQ ID NO: 507862 - DNA, 25 bp, Rattus norvegicus
gtgcctcatctgcaaagacattatg

SEQ ID NO: 507863 - DNA, 25 bp, Rattus norvegicus
gtgcctcatctggaaagacattatg

SEQ ID NO: 507864 - DNA, 25 bp, Rattus norvegicus
gtgcctccaaggactgtctagcgat

SEQ ID NO: 507865 - DNA, 25 bp, Rattus norvegicus
gtgcctccaaggtctgtctagcgat

SEQ ID NO: 507866 - DNA, 25 bp, Rattus norvegicus
gtgcctccaatccaatcaggacatg

SEQ ID NO: 507867 - DNA, 25 bp, Rattus norvegicus
gtgcctccaatcgaatcaggacatg

SEQ ID NO: 507868 - DNA, 25 bp, Rattus norvegicus
gtgcctccaatgaaagacttcttta

SEQ ID NO: 507869 - DNA, 25 bp, Rattus norvegicus
gtgcctccaatgtaagacttcttta

SEQ ID NO: 507870 - DNA, 25 bp, Rattus norvegicus
gtgcctccagatcctttcttagagt

SEQ ID NO: 507871 - DNA, 25 bp, Rattus norvegicus
gtgcctccagatgctttcttagagt

SEQ ID NO: 507872 - DNA, 25 bp, Rattus norvegicus
gtgcctccatcaaagtttctgtata

SEQ ID NO: 507873 - DNA, 25 bp, Rattus norvegicus
gtgcctccatcatagtttctgtata

SEQ ID NO: 507874 - DNA, 25 bp, Rattus norvegicus
gtgcctcccaaacccatgtaaatgt

SEQ ID NO: 507875 - DNA, 25 bp, Rattus norvegicus
gtgcctcccaaagccatgtaaatgt

SEQ ID NO: 507876 - DNA, 25 bp, Rattus norvegicus
gtgcctcccaccataacaataatgg

SEQ ID NO: 507877 - DNA, 25 bp, Rattus norvegicus
gtgcctcccaccttaacaataatgg

SEQ ID NO: 507878 - DNA, 25 bp, Rattus norvegicus
gtgcctcccagtaaccatttatgta

SEQ ID NO: 507879 - DNA, 25 bp, Rattus norvegicus
gtgcctcccagttaccatttatgta

SEQ ID NO: 507880 - DNA, 25 bp, Rattus norvegicus
gtgcctcccgctcagatatgtgcca

SEQ ID NO: 507881 - DNA, 25 bp, Rattus norvegicus
gtgcctcccgctgagatatgtgcca

SEQ ID NO: 507882 - DNA, 25 bp, Rattus norvegicus
gtgcctcccttgagaattttaacct

SEQ ID NO: 507883 - DNA, 25 bp, Rattus norvegicus
gtgcctcccttgtgaattttaacct

SEQ ID NO: 507884 - DNA, 25 bp, Rattus norvegicus
gtgcctcctactaataacacacaag

SEQ ID NO: 507885 - DNA, 25 bp, Rattus norvegicus
gtgcctcctacttataacacacaag

SEQ ID NO: 507886 - DNA, 25 bp, Rattus norvegicus
gtgcctcctgctctgtatcgaagtg

SEQ ID NO: 507887 - DNA, 25 bp, Rattus norvegicus
gtgcctcctgctgtgtatcgaagtg

SEQ ID NO: 507888 - DNA, 25 bp, Rattus norvegicus
gtgcctcctggacacagactgtgga

SEQ ID NO: 507889 - DNA, 25 bp, Rattus norvegicus
gtgcctcctggagacagactgtgga

SEQ ID NO: 507890 - DNA, 25 bp, Rattus norvegicus
gtgcctccttttatatcatgtttcc

SEQ ID NO: 507891 - DNA, 25 bp, Rattus norvegicus
gtgcctccttttttatcatgtttcc

SEQ ID NO: 507892 - DNA, 25 bp, Rattus norvegicus
gtgcctcgacaccagagattcgcag

SEQ ID NO: 507893 - DNA, 25 bp, Rattus norvegicus
gtgcctcgacacgagagattcgcag

SEQ ID NO: 507894 - DNA, 25 bp, Rattus norvegicus
gtgcctcgatttcaacaaatgccgt

SEQ ID NO: 507895 - DNA, 25 bp, Rattus norvegicus
gtgcctcgatttgaacaaatgccgt

SEQ ID NO: 507896 - DNA, 25 bp, Rattus norvegicus
gtgcctcggctgaggataactgaaa

SEQ ID NO: 507897 - DNA, 25 bp, Rattus norvegicus
gtgcctcggctgtggataactgaaa

SEQ ID NO: 507898 - DNA, 25 bp, Rattus norvegicus
gtgcctcgtccaagaagtccagtcc

SEQ ID NO: 507899 - DNA, 25 bp, Rattus norvegicus
gtgcctcgtccatgaagtccagtcc

SEQ ID NO: 507900 - DNA, 25 bp, Rattus norvegicus
gtgcctctagacattgctgattgtg

SEQ ID NO: 507901 - DNA, 25 bp, Rattus norvegicus
gtgcctctagactttgctgattgtg

SEQ ID NO: 507902 - DNA, 25 bp, Rattus norvegicus
gtgcctctagcaaatttgtactgac

SEQ ID NO: 507903 - DNA, 25 bp, Rattus norvegicus
gtgcctctagcatatttgtactgac

SEQ ID NO: 507904 - DNA, 25 bp, Rattus norvegicus
gtgcctctaggcaccacatagactc

SEQ ID NO: 507905 - DNA, 25 bp, Rattus norvegicus
gtgcctctaggccacatttattcac

SEQ ID NO: 507906 - DNA, 25 bp, Rattus norvegicus
gtgcctctaggcgacatttattcac

SEQ ID NO: 507907 - DNA, 25 bp, Rattus norvegicus
gtgcctctaggctccacatagactc

SEQ ID NO: 507908 - DNA, 25 bp, Rattus norvegicus
gtgcctctatttatcatctgatccg

SEQ ID NO: 507909 - DNA, 25 bp, Rattus norvegicus
gtgcctctatttttcatctgatccg

SEQ ID NO: 507910 - DNA, 25 bp, Rattus norvegicus
gtgcctctcaccactggttaaaatt

SEQ ID NO: 507911 - DNA, 25 bp, Rattus norvegicus
gtgcctctcacctctggttaaaatt

SEQ ID NO: 507912 - DNA, 25 bp, Rattus norvegicus
gtgcctctcagaactggatccttag

SEQ ID NO: 507913 - DNA, 25 bp, Rattus norvegicus
gtgcctctcagatctggatccttag

SEQ ID NO: 507914 - DNA, 25 bp, Rattus norvegicus
gtgcctctcaggcttggtgaagctc

SEQ ID NO: 507915 - DNA, 25 bp, Rattus norvegicus
gtgcctctcagggttggtgaagctc

SEQ ID NO: 507916 - DNA, 25 bp, Rattus norvegicus
gtgcctctcagtccctgaataaaag

SEQ ID NO: 507917 - DNA, 25 bp, Rattus norvegicus
gtgcctctcagtgcctgaataaaag

SEQ ID NO: 507918 - DNA, 25 bp, Rattus norvegicus
gtgcctctccctatatgttttatac

SEQ ID NO: 507919 - DNA, 25 bp, Rattus norvegicus
gtgcctctccctttatgttttatac

SEQ ID NO: 507920 - DNA, 25 bp, Rattus norvegicus
gtgcctctcctaagtgttccataga

SEQ ID NO: 507921 - DNA, 25 bp, Rattus norvegicus
gtgcctctcctatgtgttccataga

SEQ ID NO: 507922 - DNA, 25 bp, Rattus norvegicus
gtgcctctctcacggcagtgaagat

SEQ ID NO: 507923 - DNA, 25 bp, Rattus norvegicus
gtgcctctctcagggcagtgaagat

SEQ ID NO: 507924 - DNA, 25 bp, Rattus norvegicus
gtgcctctctctctctggagaagga

SEQ ID NO: 507925 - DNA, 25 bp, Rattus norvegicus
gtgcctctctctgtctggagaagga

SEQ ID NO: 507926 - DNA, 25 bp, Rattus norvegicus
gtgcctctctgtcagaaaagccttt

SEQ ID NO: 507927 - DNA, 25 bp, Rattus norvegicus
gtgcctctctgtgagaaaagccttt

SEQ ID NO: 507928 - DNA, 25 bp, Rattus norvegicus
gtgcctctgagtctttggatttata

SEQ ID NO: 507929 - DNA, 25 bp, Rattus norvegicus
gtgcctctgagtgtttggatttata

SEQ ID NO: 507930 - DNA, 25 bp, Rattus norvegicus
gtgcctctgccacgtgactgtagca

SEQ ID NO: 507931 - DNA, 25 bp, Rattus norvegicus
gtgcctctgccaggtgactgtagca

SEQ ID NO: 507932 - DNA, 25 bp, Rattus norvegicus
gtgcctctgggaactaggtctggaa

SEQ ID NO: 507933 - DNA, 25 bp, Rattus norvegicus
gtgcctctgggatctaggtctggaa

SEQ ID NO: 507934 - DNA, 25 bp, Rattus norvegicus
gtgcctctgggcatgtgctaataac

SEQ ID NO: 507935 - DNA, 25 bp, Rattus norvegicus
gtgcctctgggcttgtgctaataac

SEQ ID NO: 507936 - DNA, 25 bp, Rattus norvegicus
gtgcctcttctaaatgctcagtgta

SEQ ID NO: 507937 - DNA, 25 bp, Rattus norvegicus
gtgcctcttctatatgctcagtgta

SEQ ID NO: 507938 - DNA, 25 bp, Rattus norvegicus
gtgcctcttgctatctatcctggaa

SEQ ID NO: 507939 - DNA, 25 bp, Rattus norvegicus
gtgcctcttgctttctatcctggaa

SEQ ID NO: 507940 - DNA, 25 bp, Rattus norvegicus
gtgcctgaagctcagtgtgaagtct

SEQ ID NO: 507941 - DNA, 25 bp, Rattus norvegicus
gtgcctgaagctgagtgtgaagtct

SEQ ID NO: 507942 - DNA, 25 bp, Rattus norvegicus
gtgcctgacacactggacctcttgg

SEQ ID NO: 507943 - DNA, 25 bp, Rattus norvegicus
gtgcctgacacagtggacctcttgg

SEQ ID NO: 507944 - DNA, 25 bp, Rattus norvegicus
gtgcctgaccttcctggtttcttta

SEQ ID NO: 507945 - DNA, 25 bp, Rattus norvegicus
gtgcctgaccttgctggtttcttta

SEQ ID NO: 507946 - DNA, 25 bp, Rattus norvegicus
gtgcctgagaaccaagcctgagaga

SEQ ID NO: 507947 - DNA, 25 bp, Rattus norvegicus
gtgcctgagaacgaagcctgagaga

SEQ ID NO: 507948 - DNA, 25 bp, Rattus norvegicus
gtgcctgagcaccattttgagatta

SEQ ID NO: 507949 - DNA, 25 bp, Rattus norvegicus
gtgcctgagcacgattttgagatta

SEQ ID NO: 507950 - DNA, 25 bp, Rattus norvegicus
gtgcctgagcttaaggaagtcatct

SEQ ID NO: 507951 - DNA, 25 bp, Rattus norvegicus
gtgcctgagctttaggaagtcatct

SEQ ID NO: 507952 - DNA, 25 bp, Rattus norvegicus
gtgcctgatgaaatctgtcctctaa

SEQ ID NO: 507953 - DNA, 25 bp, Rattus norvegicus
gtgcctgatgaattctgtcctctaa

SEQ ID NO: 507954 - DNA, 25 bp, Rattus norvegicus
gtgcctgcaacaactgctactatag

SEQ ID NO: 507955 - DNA, 25 bp, Rattus norvegicus
gtgcctgcaacatctgctactatag

SEQ ID NO: 507956 - DNA, 25 bp, Rattus norvegicus
gtgcctgcagctctatgttccagag

SEQ ID NO: 507957 - DNA, 25 bp, Rattus norvegicus
gtgcctgcagctgtatgttccagag

SEQ ID NO: 507958 - DNA, 25 bp, Rattus norvegicus
gtgcctgcatacagttaaactttag

SEQ ID NO: 507959 - DNA, 25 bp, Rattus norvegicus
gtgcctgcatactgttaaactttag

SEQ ID NO: 507960 - DNA, 25 bp, Rattus norvegicus
gtgcctgcatagctgactttgagat

SEQ ID NO: 507961 - DNA, 25 bp, Rattus norvegicus
gtgcctgcataggtgactttgagat

SEQ ID NO: 507962 - DNA, 25 bp, Rattus norvegicus
gtgcctgcatcgctgataacttgaa

SEQ ID NO: 507963 - DNA, 25 bp, Rattus norvegicus
gtgcctgcatcggtgataacttgaa

SEQ ID NO: 507964 - DNA, 25 bp, Rattus norvegicus
gtgcctgcccatagctgaactgtaa

SEQ ID NO: 507965 - DNA, 25 bp, Rattus norvegicus
gtgcctgcccattgctgaactgtaa

SEQ ID NO: 507966 - DNA, 25 bp, Rattus norvegicus
gtgcctgcccgcaatgatcataata

SEQ ID NO: 507967 - DNA, 25 bp, Rattus norvegicus
gtgcctgcccgctatgatcataata

SEQ ID NO: 507968 - DNA, 25 bp, Rattus norvegicus
gtgcctgcctgcagggagagatacc

SEQ ID NO: 507969 - DNA, 25 bp, Rattus norvegicus
gtgcctgcctgctgggagagatacc

SEQ ID NO: 507970 - DNA, 25 bp, Rattus norvegicus
gtgcctgccttaagtgacttatttg

SEQ ID NO: 507971 - DNA, 25 bp, Rattus norvegicus
gtgcctgccttatgtgacttatttg

SEQ ID NO: 507972 - DNA, 25 bp, Rattus norvegicus
gtgcctgcgacgaagtgttaacctg

SEQ ID NO: 507973 - DNA, 25 bp, Rattus norvegicus
gtgcctgcgacgtagtgttaacctg

SEQ ID NO: 507974 - DNA, 25 bp, Rattus norvegicus
gtgcctgcgatccacaagatgacat

SEQ ID NO: 507975 - DNA, 25 bp, Rattus norvegicus
gtgcctgcgatcgacaagatgacat

SEQ ID NO: 507976 - DNA, 25 bp, Rattus norvegicus
gtgcctgctattccatatgtgccgc

SEQ ID NO: 507977 - DNA, 25 bp, Rattus norvegicus
gtgcctgctattgcatatgtgccgc

SEQ ID NO: 507978 - DNA, 25 bp, Rattus norvegicus
gtgcctgctccacaaggtgtggcaa

SEQ ID NO: 507979 - DNA, 25 bp, Rattus norvegicus
gtgcctgctccagaaggtgtggcaa

SEQ ID NO: 507980 - DNA, 25 bp, Rattus norvegicus
gtgcctgctgtgattgtcatctgat

SEQ ID NO: 507981 - DNA, 25 bp, Rattus norvegicus
gtgcctgctgtgtttgtcatctgat

SEQ ID NO: 507982 - DNA, 25 bp, Rattus norvegicus
gtgcctgcttgcatgttttaagtta

SEQ ID NO: 507983 - DNA, 25 bp, Rattus norvegicus
gtgcctgcttgcttgttttaagtta

SEQ ID NO: 507984 - DNA, 25 bp, Rattus norvegicus
gtgcctgctttcaaattatcatcgt

SEQ ID NO: 507985 - DNA, 25 bp, Rattus norvegicus
gtgcctgctttctaattatcatcgt

SEQ ID NO: 507986 - DNA, 25 bp, Rattus norvegicus
gtgcctggaaaacctctggtcatcg

SEQ ID NO: 507987 - DNA, 25 bp, Rattus norvegicus
gtgcctggaaaagctctggtcatcg

SEQ ID NO: 507988 - DNA, 25 bp, Rattus norvegicus
gtgcctggagtaatctgtccctgaa

SEQ ID NO: 507989 - DNA, 25 bp, Rattus norvegicus
gtgcctggagtattctgtccctgaa

SEQ ID NO: 507990 - DNA, 25 bp, Rattus norvegicus
gtgcctggatttcactgtcactgtg

SEQ ID NO: 507991 - DNA, 25 bp, Rattus norvegicus
gtgcctggatttgactgtcactgtg

SEQ ID NO: 507992 - DNA, 25 bp, Rattus norvegicus
gtgcctggcacaaaagttctcaata

SEQ ID NO: 507993 - DNA, 25 bp, Rattus norvegicus
gtgcctggcacataagttctcaata

SEQ ID NO: 507994 - DNA, 25 bp, Rattus norvegicus
gtgcctggcactagacagaacagta

SEQ ID NO: 507995 - DNA, 25 bp, Rattus norvegicus
gtgcctggcacttgacagaacagta

SEQ ID NO: 507996 - DNA, 25 bp, Rattus norvegicus
gtgcctggcgagattaaactttttt

SEQ ID NO: 507997 - DNA, 25 bp, Rattus norvegicus
gtgcctggcgagtttaaactttttt

SEQ ID NO: 507998 - DNA, 25 bp, Rattus norvegicus
gtgcctggcggacacactagtcatg

SEQ ID NO: 507999 - DNA, 25 bp, Rattus norvegicus
gtgcctggcggagacactagtcatg

SEQ ID NO: 508000 - DNA, 25 bp, Rattus norvegicus
gtgcctggctcaaagtaagcctggt

SEQ ID NO: 508001 - DNA, 25 bp, Rattus norvegicus
gtgcctggctcatagtaagcctggt

SEQ ID NO: 508002 - DNA, 25 bp, Rattus norvegicus
gtgcctggctctcagtaagcatttc

SEQ ID NO: 508003 - DNA, 25 bp, Rattus norvegicus
gtgcctggctctgagtaagcatttc

SEQ ID NO: 508004 - DNA, 25 bp, Rattus norvegicus
gtgcctggctgtctatgcgagaatt

SEQ ID NO: 508005 - DNA, 25 bp, Rattus norvegicus
gtgcctggctgtgtatgcgagaatt

SEQ ID NO: 508006 - DNA, 25 bp, Rattus norvegicus
gtgcctggcttgcaactacgtggac

SEQ ID NO: 508007 - DNA, 25 bp, Rattus norvegicus
gtgcctggcttggaactacgtggac

SEQ ID NO: 508008 - DNA, 25 bp, Rattus norvegicus
gtgcctgggaaaaacaatagtctta

SEQ ID NO: 508009 - DNA, 25 bp, Rattus norvegicus
gtgcctgggaaatacaatagtctta

SEQ ID NO: 508010 - DNA, 25 bp, Rattus norvegicus
gtgcctgggaatccaggtaacgtaa

SEQ ID NO: 508011 - DNA, 25 bp, Rattus norvegicus
gtgcctgggaatgcaggtaacgtaa

SEQ ID NO: 508012 - DNA, 25 bp, Rattus norvegicus
gtgcctgggacaagagctgttgtca

SEQ ID NO: 508013 - DNA, 25 bp, Rattus norvegicus
gtgcctgggacactgtcagctcagt

SEQ ID NO: 508014 - DNA, 25 bp, Rattus norvegicus
gtgcctgggacagtgtcagctcagt

SEQ ID NO: 508015 - DNA, 25 bp, Rattus norvegicus
gtgcctgggacatgagctgttgtca

SEQ ID NO: 508016 - DNA, 25 bp, Rattus norvegicus
gtgcctgggattctgccattgttac

SEQ ID NO: 508017 - DNA, 25 bp, Rattus norvegicus
gtgcctgggattgtgccattgttac

SEQ ID NO: 508018 - DNA, 25 bp, Rattus norvegicus
gtgcctgggcttacaaaacaccttt

SEQ ID NO: 508019 - DNA, 25 bp, Rattus norvegicus
gtgcctgggctttcaaaacaccttt

SEQ ID NO: 508020 - DNA, 25 bp, Rattus norvegicus
gtgcctgggtacagtgtctgcacac

SEQ ID NO: 508021 - DNA, 25 bp, Rattus norvegicus
gtgcctgggtactgtgtctgcacac

SEQ ID NO: 508022 - DNA, 25 bp, Rattus norvegicus
gtgcctgggttcaggtcaatgttgt

SEQ ID NO: 508023 - DNA, 25 bp, Rattus norvegicus
gtgcctgggttctggtcaatgttgt

SEQ ID NO: 508024 - DNA, 25 bp, Rattus norvegicus
gtgcctgggtttctggctttgtata

SEQ ID NO: 508025 - DNA, 25 bp, Rattus norvegicus
gtgcctgggtttgtggctttgtata

SEQ ID NO: 508026 - DNA, 25 bp, Rattus norvegicus
gtgcctggtaccagaggagatcgaa

SEQ ID NO: 508027 - DNA, 25 bp, Rattus norvegicus
gtgcctggtacctgaggagatcgaa

SEQ ID NO: 508028 - DNA, 25 bp, Rattus norvegicus
gtgcctggtgcaaaattatgtcaga

SEQ ID NO: 508029 - DNA, 25 bp, Rattus norvegicus
gtgcctggtgcataattatgtcaga

SEQ ID NO: 508030 - DNA, 25 bp, Rattus norvegicus
gtgcctggttcgactatgacttgga

SEQ ID NO: 508031 - DNA, 25 bp, Rattus norvegicus
gtgcctggttcgtctatgacttgga

SEQ ID NO: 508032 - DNA, 25 bp, Rattus norvegicus
gtgcctggtttacgatctttttcct

SEQ ID NO: 508033 - DNA, 25 bp, Rattus norvegicus
gtgcctggtttaggatctttttcct

SEQ ID NO: 508034 - DNA, 25 bp, Rattus norvegicus
gtgcctgtaacaatggtggtgctga

SEQ ID NO: 508035 - DNA, 25 bp, Rattus norvegicus
gtgcctgtaacattggtggtgctga

SEQ ID NO: 508036 - DNA, 25 bp, Rattus norvegicus
gtgcctgtaccacagtttgcggaca

SEQ ID NO: 508037 - DNA, 25 bp, Rattus norvegicus
gtgcctgtaccagagtttgcggaca

SEQ ID NO: 508038 - DNA, 25 bp, Rattus norvegicus
gtgcctgtactcaacatgacacaaa

SEQ ID NO: 508039 - DNA, 25 bp, Rattus norvegicus
gtgcctgtactctacatgacacaaa

SEQ ID NO: 508040 - DNA, 25 bp, Rattus norvegicus
gtgcctgtagccaggctgggattaa

SEQ ID NO: 508041 - DNA, 25 bp, Rattus norvegicus
gtgcctgtagcctggctgggattaa

SEQ ID NO: 508042 - DNA, 25 bp, Rattus norvegicus
gtgcctgtattaatcaagtcatcat

SEQ ID NO: 508043 - DNA, 25 bp, Rattus norvegicus
gtgcctgtattattcaagtcatcat

SEQ ID NO: 508044 - DNA, 25 bp, Rattus norvegicus
gtgcctgtatttagtcaatgcttgt

SEQ ID NO: 508045 - DNA, 25 bp, Rattus norvegicus
gtgcctgtattttgtcaatgcttgt

SEQ ID NO: 508046 - DNA, 25 bp, Rattus norvegicus
gtgcctgtcaccaaatcagtcattt

SEQ ID NO: 508047 - DNA, 25 bp, Rattus norvegicus
gtgcctgtcacctaatcagtcattt

SEQ ID NO: 508048 - DNA, 25 bp, Rattus norvegicus
gtgcctgtcctacggtctaactcaa

SEQ ID NO: 508049 - DNA, 25 bp, Rattus norvegicus
gtgcctgtcctagggtctaactcaa

SEQ ID NO: 508050 - DNA, 25 bp, Rattus norvegicus
gtgcctgtgaaaatcgtcatgccat

SEQ ID NO: 508051 - DNA, 25 bp, Rattus norvegicus
gtgcctgtgaaattcgtcatgccat

SEQ ID NO: 508052 - DNA, 25 bp, Rattus norvegicus
gtgcctgtgagtcaggaagtactac

SEQ ID NO: 508053 - DNA, 25 bp, Rattus norvegicus
gtgcctgtgagtgaggaagtactac

SEQ ID NO: 508054 - DNA, 25 bp, Rattus norvegicus
gtgcctgtgcaaatgtgtacatgga

SEQ ID NO: 508055 - DNA, 25 bp, Rattus norvegicus
gtgcctgtgcaacaggcgcacgcgg

SEQ ID NO: 508056 - DNA, 25 bp, Rattus norvegicus
gtgcctgtgcaagaggcgcacgcgg

SEQ ID NO: 508057 - DNA, 25 bp, Rattus norvegicus
gtgcctgtgcaattgtgtacatgga

SEQ ID NO: 508058 - DNA, 25 bp, Rattus norvegicus
gtgcctgtgctaacagagctctgtt

SEQ ID NO: 508059 - DNA, 25 bp, Rattus norvegicus
gtgcctgtgctatcagagctctgtt

SEQ ID NO: 508060 - DNA, 25 bp, Rattus norvegicus
gtgcctgtggaacaacttttcaagc

SEQ ID NO: 508061 - DNA, 25 bp, Rattus norvegicus
gtgcctgtggaagaacttttcaagc

SEQ ID NO: 508062 - DNA, 25 bp, Rattus norvegicus
gtgcctgtggagcacatttgctata

SEQ ID NO: 508063 - DNA, 25 bp, Rattus norvegicus
gtgcctgtggaggacatttgctata

SEQ ID NO: 508064 - DNA, 25 bp, Rattus norvegicus
gtgcctgtggatctcgatgttgttt

SEQ ID NO: 508065 - DNA, 25 bp, Rattus norvegicus
gtgcctgtggatgtcgatgttgttt

SEQ ID NO: 508066 - DNA, 25 bp, Rattus norvegicus
gtgcctgtggtaaacatttcggtac

SEQ ID NO: 508067 - DNA, 25 bp, Rattus norvegicus
gtgcctgtggtatacatttcggtac

SEQ ID NO: 508068 - DNA, 25 bp, Rattus norvegicus
gtgcctgtgtaacagccttgaactt

SEQ ID NO: 508069 - DNA, 25 bp, Rattus norvegicus
gtgcctgtgtaagagccttgaactt

SEQ ID NO: 508070 - DNA, 25 bp, Rattus norvegicus
gtgcctgtgtttccctaaaacgaca

SEQ ID NO: 508071 - DNA, 25 bp, Rattus norvegicus
gtgcctgtgtttgcctaaaacgaca

SEQ ID NO: 508072 - DNA, 25 bp, Rattus norvegicus
gtgcctgttcctcatattggatggt

SEQ ID NO: 508073 - DNA, 25 bp, Rattus norvegicus
gtgcctgttcctgatattggatggt

SEQ ID NO: 508074 - DNA, 25 bp, Rattus norvegicus
gtgcctgttcttcattatttcatac

SEQ ID NO: 508075 - DNA, 25 bp, Rattus norvegicus
gtgcctgttcttgattatttcatac

SEQ ID NO: 508076 - DNA, 25 bp, Rattus norvegicus
gtgcctgttgccaccataattgcaa

SEQ ID NO: 508077 - DNA, 25 bp, Rattus norvegicus
gtgcctgttgcctccataattgcaa

SEQ ID NO: 508078 - DNA, 25 bp, Rattus norvegicus
gtgcctgttgctctcaggtatacat

SEQ ID NO: 508079 - DNA, 25 bp, Rattus norvegicus
gtgcctgttgctgtcaggtatacat

SEQ ID NO: 508080 - DNA, 25 bp, Rattus norvegicus
gtgcctgtttcaagttctatgtcat

SEQ ID NO: 508081 - DNA, 25 bp, Rattus norvegicus
gtgcctgtttcatgttctatgtcat

SEQ ID NO: 508082 - DNA, 25 bp, Rattus norvegicus
gtgccttaaaggagagcccgcctga

SEQ ID NO: 508083 - DNA, 25 bp, Rattus norvegicus
gtgccttaaaggtgagcccgcctga

SEQ ID NO: 508084 - DNA, 25 bp, Rattus norvegicus
gtgccttacattctaggttatcctg

SEQ ID NO: 508085 - DNA, 25 bp, Rattus norvegicus
gtgccttacattgtaggttatcctg

SEQ ID NO: 508086 - DNA, 25 bp, Rattus norvegicus
gtgccttaccgaatcataccgtatg

SEQ ID NO: 508087 - DNA, 25 bp, Rattus norvegicus
gtgccttaccgattcataccgtatg

SEQ ID NO: 508088 - DNA, 25 bp, Rattus norvegicus
gtgccttacctgagtgcttttgtgg

SEQ ID NO: 508089 - DNA, 25 bp, Rattus norvegicus
gtgccttacctgtgtgcttttgtgg

SEQ ID NO: 508090 - DNA, 25 bp, Rattus norvegicus
gtgccttacgtgaaagccatgcgtt

SEQ ID NO: 508091 - DNA, 25 bp, Rattus norvegicus
gtgccttacgtgtaagccatgcgtt

SEQ ID NO: 508092 - DNA, 25 bp, Rattus norvegicus
gtgccttactctcctgtcaggtaca

SEQ ID NO: 508093 - DNA, 25 bp, Rattus norvegicus
gtgccttactctgctgtcaggtaca

SEQ ID NO: 508094 - DNA, 25 bp, Rattus norvegicus
gtgccttactgcctaaactttactt

SEQ ID NO: 508095 - DNA, 25 bp, Rattus norvegicus
gtgccttactgcgtaaactttactt

SEQ ID NO: 508096 - DNA, 25 bp, Rattus norvegicus
gtgccttagatcatgagaagtgttc

SEQ ID NO: 508097 - DNA, 25 bp, Rattus norvegicus
gtgccttagatcttgagaagtgttc

SEQ ID NO: 508098 - DNA, 25 bp, Rattus norvegicus
gtgccttagcacaatcaacgggaag

SEQ ID NO: 508099 - DNA, 25 bp, Rattus norvegicus
gtgccttagcactatcaacgggaag

SEQ ID NO: 508100 - DNA, 25 bp, Rattus norvegicus
gtgccttagctgaatttctgtctag

SEQ ID NO: 508101 - DNA, 25 bp, Rattus norvegicus
gtgccttagctgtatttctgtctag

SEQ ID NO: 508102 - DNA, 25 bp, Rattus norvegicus
gtgccttaggttatgaacaatcttt

SEQ ID NO: 508103 - DNA, 25 bp, Rattus norvegicus
gtgccttaggttttgaacaatcttt

SEQ ID NO: 508104 - DNA, 25 bp, Rattus norvegicus
gtgccttagttacttcctaccagag

SEQ ID NO: 508105 - DNA, 25 bp, Rattus norvegicus
gtgccttagttagttcctaccagag

SEQ ID NO: 508106 - DNA, 25 bp, Rattus norvegicus
gtgccttatacccatggaacatgtg

SEQ ID NO: 508107 - DNA, 25 bp, Rattus norvegicus
gtgccttataccgatggaacatgtg

SEQ ID NO: 508108 - DNA, 25 bp, Rattus norvegicus
gtgccttatagaagccacctgggca

SEQ ID NO: 508109 - DNA, 25 bp, Rattus norvegicus
gtgccttatagatgccacctgggca

SEQ ID NO: 508110 - DNA, 25 bp, Rattus norvegicus
gtgccttatcagaacaatagccatg

SEQ ID NO: 508111 - DNA, 25 bp, Rattus norvegicus
gtgccttatcagtacaatagccatg

SEQ ID NO: 508112 - DNA, 25 bp, Rattus norvegicus
gtgccttatgatcctgaactgttgc

SEQ ID NO: 508113 - DNA, 25 bp, Rattus norvegicus
gtgccttatgatgctgaactgttgc

SEQ ID NO: 508114 - DNA, 25 bp, Rattus norvegicus
gtgccttatgccatgattggaccag

SEQ ID NO: 508115 - DNA, 25 bp, Rattus norvegicus
gtgccttatgccttgattggaccag

SEQ ID NO: 508116 - DNA, 25 bp, Rattus norvegicus
gtgccttatgctacttgcactggca

SEQ ID NO: 508117 - DNA, 25 bp, Rattus norvegicus
gtgccttatgcttcttgcactggca

SEQ ID NO: 508118 - DNA, 25 bp, Rattus norvegicus
gtgccttattttatgtttccttgtc

SEQ ID NO: 508119 - DNA, 25 bp, Rattus norvegicus
gtgccttattttttgtttccttgtc

SEQ ID NO: 508120 - DNA, 25 bp, Rattus norvegicus
gtgccttcaaagagtctctcagtat

SEQ ID NO: 508121 - DNA, 25 bp, Rattus norvegicus
gtgccttcaaagtgtctctcagtat

SEQ ID NO: 508122 - DNA, 25 bp, Rattus norvegicus
gtgccttcacacagctttaaacatg

SEQ ID NO: 508123 - DNA, 25 bp, Rattus norvegicus
gtgccttcacactgctttaaacatg

SEQ ID NO: 508124 - DNA, 25 bp, Rattus norvegicus
gtgccttcacatctaagcttttata

SEQ ID NO: 508125 - DNA, 25 bp, Rattus norvegicus
gtgccttcacatgtaagcttttata

SEQ ID NO: 508126 - DNA, 25 bp, Rattus norvegicus
gtgccttcacttccagaatagggat

SEQ ID NO: 508127 - DNA, 25 bp, Rattus norvegicus
gtgccttcacttgcagaatagggat

SEQ ID NO: 508128 - DNA, 25 bp, Rattus norvegicus
gtgccttcagcacatagttcacaaa

SEQ ID NO: 508129 - DNA, 25 bp, Rattus norvegicus
gtgccttcagcagatagttcacaaa

SEQ ID NO: 508130 - DNA, 25 bp, Rattus norvegicus
gtgccttcatctcagatttgttcat

SEQ ID NO: 508131 - DNA, 25 bp, Rattus norvegicus
gtgccttcatctgagatttgttcat

SEQ ID NO: 508132 - DNA, 25 bp, Rattus norvegicus
gtgccttcatgtccagcagccaaga

SEQ ID NO: 508133 - DNA, 25 bp, Rattus norvegicus
gtgccttcatgtgcagcagccaaga

SEQ ID NO: 508134 - DNA, 25 bp, Rattus norvegicus
gtgccttccaatcttgctctaagac

SEQ ID NO: 508135 - DNA, 25 bp, Rattus norvegicus
gtgccttccaatgttgctctaagac

SEQ ID NO: 508136 - DNA, 25 bp, Rattus norvegicus
gtgccttccataaagtaggatgata

SEQ ID NO: 508137 - DNA, 25 bp, Rattus norvegicus
gtgccttccatatagtaggatgata

SEQ ID NO: 508138 - DNA, 25 bp, Rattus norvegicus
gtgccttcccatacatgtgtgtagt

SEQ ID NO: 508139 - DNA, 25 bp, Rattus norvegicus
gtgccttcccattcatgtgtgtagt

SEQ ID NO: 508140 - DNA, 25 bp, Rattus norvegicus
gtgccttccccacggaacagattaa

SEQ ID NO: 508141 - DNA, 25 bp, Rattus norvegicus
gtgccttccccagggaacagattaa

SEQ ID NO: 508142 - DNA, 25 bp, Rattus norvegicus
gtgccttccggacttctttgaactg

SEQ ID NO: 508143 - DNA, 25 bp, Rattus norvegicus
gtgccttccggagttctttgaactg

SEQ ID NO: 508144 - DNA, 25 bp, Rattus norvegicus
gtgccttcctcaagagatactgctt

SEQ ID NO: 508145 - DNA, 25 bp, Rattus norvegicus
gtgccttcctcatgagatactgctt

SEQ ID NO: 508146 - DNA, 25 bp, Rattus norvegicus
gtgccttcgacaccctgtagaagag

SEQ ID NO: 508147 - DNA, 25 bp, Rattus norvegicus
gtgccttcgacagcctgtagaagag

SEQ ID NO: 508148 - DNA, 25 bp, Rattus norvegicus
gtgccttcgggtagctcttgagact

SEQ ID NO: 508149 - DNA, 25 bp, Rattus norvegicus
gtgccttcgggttgctcttgagact

SEQ ID NO: 508150 - DNA, 25 bp, Rattus norvegicus
gtgccttctagaagaatggctttcc

SEQ ID NO: 508151 - DNA, 25 bp, Rattus norvegicus
gtgccttctagatgaatggctttcc

SEQ ID NO: 508152 - DNA, 25 bp, Rattus norvegicus
gtgccttctattaatcgttgactcc

SEQ ID NO: 508153 - DNA, 25 bp, Rattus norvegicus
gtgccttctatttatcgttgactcc

SEQ ID NO: 508154 - DNA, 25 bp, Rattus norvegicus
gtgccttctctcaaatcaatttttc

SEQ ID NO: 508155 - DNA, 25 bp, Rattus norvegicus
gtgccttctctctaatcaatttttc

SEQ ID NO: 508156 - DNA, 25 bp, Rattus norvegicus
gtgccttctgtcaactgttagttac

SEQ ID NO: 508157 - DNA, 25 bp, Rattus norvegicus
gtgccttctgtctactgttagttac

SEQ ID NO: 508158 - DNA, 25 bp, Rattus norvegicus
gtgccttctttgctctcgggtttta

SEQ ID NO: 508159 - DNA, 25 bp, Rattus norvegicus
gtgccttctttggtctcgggtttta

SEQ ID NO: 508160 - DNA, 25 bp, Rattus norvegicus
gtgccttgaattccattgatgctct

SEQ ID NO: 508161 - DNA, 25 bp, Rattus norvegicus
gtgccttgaattgcattgatgctct

SEQ ID NO: 508162 - DNA, 25 bp, Rattus norvegicus
gtgccttgagacatgcttagaaaat

SEQ ID NO: 508163 - DNA, 25 bp, Rattus norvegicus
gtgccttgagacttgcttagaaaat

SEQ ID NO: 508164 - DNA, 25 bp, Rattus norvegicus
gtgccttgagttcatcaatctgctc

SEQ ID NO: 508165 - DNA, 25 bp, Rattus norvegicus
gtgccttgagttgatcaatctgctc

SEQ ID NO: 508166 - DNA, 25 bp, Rattus norvegicus
gtgccttgatgaaaccctctttgct

SEQ ID NO: 508167 - DNA, 25 bp, Rattus norvegicus
gtgccttgatgaagatttcctccag

SEQ ID NO: 508168 - DNA, 25 bp, Rattus norvegicus
gtgccttgatgataccctctttgct

SEQ ID NO: 508169 - DNA, 25 bp, Rattus norvegicus
gtgccttgatgatgatttcctccag

SEQ ID NO: 508170 - DNA, 25 bp, Rattus norvegicus
gtgccttgcaacaatgaagctccac

SEQ ID NO: 508171 - DNA, 25 bp, Rattus norvegicus
gtgccttgcaactatgaagctccac

SEQ ID NO: 508172 - DNA, 25 bp, Rattus norvegicus
gtgccttgcaccactaaaaacagtt

SEQ ID NO: 508173 - DNA, 25 bp, Rattus norvegicus
gtgccttgcacctctaaaaacagtt

SEQ ID NO: 508174 - DNA, 25 bp, Rattus norvegicus
gtgccttgcactcggacagtgtgac

SEQ ID NO: 508175 - DNA, 25 bp, Rattus norvegicus
gtgccttgcactgggacagtgtgac

SEQ ID NO: 508176 - DNA, 25 bp, Rattus norvegicus
gtgccttgctcaatcttgagtagca

SEQ ID NO: 508177 - DNA, 25 bp, Rattus norvegicus
gtgccttgctcattcttgagtagca

SEQ ID NO: 508178 - DNA, 25 bp, Rattus norvegicus
gtgccttggaggagagacaccccgt

SEQ ID NO: 508179 - DNA, 25 bp, Rattus norvegicus
gtgccttggaggtgagacaccccgt

SEQ ID NO: 508180 - DNA, 25 bp, Rattus norvegicus
gtgccttgggctacccagtgagaaa

SEQ ID NO: 508181 - DNA, 25 bp, Rattus norvegicus
gtgccttgggcttcccagtgagaaa

SEQ ID NO: 508182 - DNA, 25 bp, Rattus norvegicus
gtgcctttaaccagcttgcagagat

SEQ ID NO: 508183 - DNA, 25 bp, Rattus norvegicus
gtgcctttaacctgcttgcagagat

SEQ ID NO: 508184 - DNA, 25 bp, Rattus norvegicus
gtgcctttaagccagcctagagctg

SEQ ID NO: 508185 - DNA, 25 bp, Rattus norvegicus
gtgcctttaagcgagcctagagctg

SEQ ID NO: 508186 - DNA, 25 bp, Rattus norvegicus
gtgcctttacctacagtgtatgcta

SEQ ID NO: 508187 - DNA, 25 bp, Rattus norvegicus
gtgcctttaccttcagtgtatgcta

SEQ ID NO: 508188 - DNA, 25 bp, Rattus norvegicus
gtgcctttactgatccaccataatg

SEQ ID NO: 508189 - DNA, 25 bp, Rattus norvegicus
gtgcctttactgttccaccataatg

SEQ ID NO: 508190 - DNA, 25 bp, Rattus norvegicus
gtgcctttagtaaacactgtgcttt

SEQ ID NO: 508191 - DNA, 25 bp, Rattus norvegicus
gtgcctttagtatacactgtgcttt

SEQ ID NO: 508192 - DNA, 25 bp, Rattus norvegicus
gtgcctttagtcataatttaccttg

SEQ ID NO: 508193 - DNA, 25 bp, Rattus norvegicus
gtgcctttagtcttaatttaccttg

SEQ ID NO: 508194 - DNA, 25 bp, Rattus norvegicus
gtgcctttagttccagacactgtgc

SEQ ID NO: 508195 - DNA, 25 bp, Rattus norvegicus
gtgcctttagttgcagacactgtgc

SEQ ID NO: 508196 - DNA, 25 bp, Rattus norvegicus
gtgcctttcacaaggtattggactg

SEQ ID NO: 508197 - DNA, 25 bp, Rattus norvegicus
gtgcctttcacatggtattggactg

SEQ ID NO: 508198 - DNA, 25 bp, Rattus norvegicus
gtgcctttcaggatctatttttgga

SEQ ID NO: 508199 - DNA, 25 bp, Rattus norvegicus
gtgcctttcaggttctatttttgga

SEQ ID NO: 508200 - DNA, 25 bp, Rattus norvegicus
gtgcctttcagtacttaggaatcca

SEQ ID NO: 508201 - DNA, 25 bp, Rattus norvegicus
gtgcctttcagttcttaggaatcca

SEQ ID NO: 508202 - DNA, 25 bp, Rattus norvegicus
gtgcctttcccacggcgaaaagtgt

SEQ ID NO: 508203 - DNA, 25 bp, Rattus norvegicus
gtgcctttcccagggcgaaaagtgt

SEQ ID NO: 508204 - DNA, 25 bp, Rattus norvegicus
gtgcctttctcaccctgctgtgact

SEQ ID NO: 508205 - DNA, 25 bp, Rattus norvegicus
gtgcctttctcagcctgctgtgact

SEQ ID NO: 508206 - DNA, 25 bp, Rattus norvegicus
gtgcctttctctcttgggagttcac

SEQ ID NO: 508207 - DNA, 25 bp, Rattus norvegicus
gtgcctttctctgttgggagttcac

SEQ ID NO: 508208 - DNA, 25 bp, Rattus norvegicus
gtgcctttctggagtcaaacctact

SEQ ID NO: 508209 - DNA, 25 bp, Rattus norvegicus
gtgcctttctggtgtcaaacctact

SEQ ID NO: 508210 - DNA, 25 bp, Rattus norvegicus
gtgcctttctgtacagtcggtaaac

SEQ ID NO: 508211 - DNA, 25 bp, Rattus norvegicus
gtgcctttctgtccttcgggaataa

SEQ ID NO: 508212 - DNA, 25 bp, Rattus norvegicus
gtgcctttctgtgcttcgggaataa

SEQ ID NO: 508213 - DNA, 25 bp, Rattus norvegicus
gtgcctttctgttcagtcggtaaac

SEQ ID NO: 508214 - DNA, 25 bp, Rattus norvegicus
gtgcctttcttaccaacataatatg

SEQ ID NO: 508215 - DNA, 25 bp, Rattus norvegicus
gtgcctttcttagcaacataatatg

SEQ ID NO: 508216 - DNA, 25 bp, Rattus norvegicus
gtgcctttcttcaggatattttatc

SEQ ID NO: 508217 - DNA, 25 bp, Rattus norvegicus
gtgcctttcttctggatattttatc

SEQ ID NO: 508218 - DNA, 25 bp, Rattus norvegicus
gtgcctttctttaccgacgagtgta

SEQ ID NO: 508219 - DNA, 25 bp, Rattus norvegicus
gtgcctttcttttccgacgagtgta

SEQ ID NO: 508220 - DNA, 25 bp, Rattus norvegicus
gtgcctttgaaaagccatagcctca

SEQ ID NO: 508221 - DNA, 25 bp, Rattus norvegicus
gtgcctttgaaatgccatagcctca

SEQ ID NO: 508222 - DNA, 25 bp, Rattus norvegicus
gtgcctttgaatccctttcctgaaa

SEQ ID NO: 508223 - DNA, 25 bp, Rattus norvegicus
gtgcctttgaatgcctttcctgaaa

SEQ ID NO: 508224 - DNA, 25 bp, Rattus norvegicus
gtgcctttgagcactacttgtgcta

SEQ ID NO: 508225 - DNA, 25 bp, Rattus norvegicus
gtgcctttgagctctacttgtgcta

SEQ ID NO: 508226 - DNA, 25 bp, Rattus norvegicus
gtgcctttgatgacgtatctgggag

SEQ ID NO: 508227 - DNA, 25 bp, Rattus norvegicus
gtgcctttgatgagtcacagacaaa

SEQ ID NO: 508228 - DNA, 25 bp, Rattus norvegicus
gtgcctttgatgtcgtatctgggag

SEQ ID NO: 508229 - DNA, 25 bp, Rattus norvegicus
gtgcctttgatgtgtcacagacaaa

SEQ ID NO: 508230 - DNA, 25 bp, Rattus norvegicus
gtgcctttgattaggaacagctcta

SEQ ID NO: 508231 - DNA, 25 bp, Rattus norvegicus
gtgcctttgatttggaacagctcta

SEQ ID NO: 508232 - DNA, 25 bp, Rattus norvegicus
gtgcctttgctcagattcgacatgg

SEQ ID NO: 508233 - DNA, 25 bp, Rattus norvegicus
gtgcctttgctcaggatcgtgcttt

SEQ ID NO: 508234 - DNA, 25 bp, Rattus norvegicus
gtgcctttgctctgattcgacatgg

SEQ ID NO: 508235 - DNA, 25 bp, Rattus norvegicus
gtgcctttgctctggatcgtgcttt

SEQ ID NO: 508236 - DNA, 25 bp, Rattus norvegicus
gtgcctttggaacagactttgatga

SEQ ID NO: 508237 - DNA, 25 bp, Rattus norvegicus
gtgcctttggaacagctgtttacaa

SEQ ID NO: 508238 - DNA, 25 bp, Rattus norvegicus
gtgcctttggaagagactttgatga

SEQ ID NO: 508239 - DNA, 25 bp, Rattus norvegicus
gtgcctttggaagagctgtttacaa

SEQ ID NO: 508240 - DNA, 25 bp, Rattus norvegicus
gtgcctttggatattccggcatgga

SEQ ID NO: 508241 - DNA, 25 bp, Rattus norvegicus
gtgcctttggattttccggcatgga

SEQ ID NO: 508242 - DNA, 25 bp, Rattus norvegicus
gtgcctttgggcacaatgacctaca

SEQ ID NO: 508243 - DNA, 25 bp, Rattus norvegicus
gtgcctttgggctcaatgacctaca

SEQ ID NO: 508244 - DNA, 25 bp, Rattus norvegicus
gtgcctttgtcacctttcagaaggt

SEQ ID NO: 508245 - DNA, 25 bp, Rattus norvegicus
gtgcctttgtcagctttcagaaggt

SEQ ID NO: 508246 - DNA, 25 bp, Rattus norvegicus
gtgcctttgtgtaacagtactgcaa

SEQ ID NO: 508247 - DNA, 25 bp, Rattus norvegicus
gtgcctttgtgttacagtactgcaa

SEQ ID NO: 508248 - DNA, 25 bp, Rattus norvegicus
gtgcctttgttcacttccatggagt

SEQ ID NO: 508249 - DNA, 25 bp, Rattus norvegicus
gtgcctttgttctcttccatggagt

SEQ ID NO: 508250 - DNA, 25 bp, Rattus norvegicus
gtgccttttaacaacggtggatccg

SEQ ID NO: 508251 - DNA, 25 bp, Rattus norvegicus
gtgccttttaactacggtggatccg

SEQ ID NO: 508252 - DNA, 25 bp, Rattus norvegicus
gtgccttttaagacataccaaccat

SEQ ID NO: 508253 - DNA, 25 bp, Rattus norvegicus
gtgccttttaagacattttctgtta

SEQ ID NO: 508254 - DNA, 25 bp, Rattus norvegicus
gtgccttttaagtcataccaaccat

SEQ ID NO: 508255 - DNA, 25 bp, Rattus norvegicus
gtgccttttaagtcattttctgtta

SEQ ID NO: 508256 - DNA, 25 bp, Rattus norvegicus
gtgccttttactcgtatttgagtca

SEQ ID NO: 508257 - DNA, 25 bp, Rattus norvegicus
gtgccttttactggtatttgagtca

SEQ ID NO: 508258 - DNA, 25 bp, Rattus norvegicus
gtgccttttagaagttctgctttct

SEQ ID NO: 508259 - DNA, 25 bp, Rattus norvegicus
gtgccttttagatgttctgctttct

SEQ ID NO: 508260 - DNA, 25 bp, Rattus norvegicus
gtgccttttccacagtcaagggtgt

SEQ ID NO: 508261 - DNA, 25 bp, Rattus norvegicus
gtgccttttccagagtcaagggtgt

SEQ ID NO: 508262 - DNA, 25 bp, Rattus norvegicus
gtgccttttctaaaacactggatta

SEQ ID NO: 508263 - DNA, 25 bp, Rattus norvegicus
gtgccttttctataacactggatta

SEQ ID NO: 508264 - DNA, 25 bp, Rattus norvegicus
gtgccttttctgatgtgatgacatt

SEQ ID NO: 508265 - DNA, 25 bp, Rattus norvegicus
gtgccttttctgttgtgatgacatt

SEQ ID NO: 508266 - DNA, 25 bp, Rattus norvegicus
gtgcctttttcacatgagtcagctg

SEQ ID NO: 508267 - DNA, 25 bp, Rattus norvegicus
gtgcctttttcagatgagtcagctg

SEQ ID NO: 508268 - DNA, 25 bp, Rattus norvegicus
gtgcctttttccatttgtataattg

SEQ ID NO: 508269 - DNA, 25 bp, Rattus norvegicus
gtgcctttttccttttgtataattg

SEQ ID NO: 508270 - DNA, 25 bp, Rattus norvegicus
gtgcctttttgtatcctaagccagc

SEQ ID NO: 508271 - DNA, 25 bp, Rattus norvegicus
gtgcctttttgtttcctaagccagc

SEQ ID NO: 508272 - DNA, 25 bp, Rattus norvegicus
gtgcgaaaggccatcacttcaggtt

SEQ ID NO: 508273 - DNA, 25 bp, Rattus norvegicus
gtgcgaaaggccttcacttcaggtt

SEQ ID NO: 508274 - DNA, 25 bp, Rattus norvegicus
gtgcgaaataacaagtctttcacca

SEQ ID NO: 508275 - DNA, 25 bp, Rattus norvegicus
gtgcgaaataactagtctttcacca

SEQ ID NO: 508276 - DNA, 25 bp, Rattus norvegicus
gtgcgaacagatcaccggaatgctt

SEQ ID NO: 508277 - DNA, 25 bp, Rattus norvegicus
gtgcgaacagatgaccggaatgctt

SEQ ID NO: 508278 - DNA, 25 bp, Rattus norvegicus
gtgcgaaccccaacctgggcgctga

SEQ ID NO: 508279 - DNA, 25 bp, Rattus norvegicus
gtgcgaaccccatcctgggcgctga

SEQ ID NO: 508280 - DNA, 25 bp, Rattus norvegicus
gtgcgaaccggtacctggctatgaa

SEQ ID NO: 508281 - DNA, 25 bp, Rattus norvegicus
gtgcgaaccggttcctggctatgaa

SEQ ID NO: 508282 - DNA, 25 bp, Rattus norvegicus
gtgcgaacgcacctgtcgctcttag

SEQ ID NO: 508283 - DNA, 25 bp, Rattus norvegicus
gtgcgaacgcacgtgtcgctcttag

SEQ ID NO: 508284 - DNA, 25 bp, Rattus norvegicus
gtgcgaagaagcctccttactccag

SEQ ID NO: 508285 - DNA, 25 bp, Rattus norvegicus
gtgcgaagaagcgtccttactccag

SEQ ID NO: 508286 - DNA, 25 bp, Rattus norvegicus
gtgcgaagcgcaaagcgtccggacc

SEQ ID NO: 508287 - DNA, 25 bp, Rattus norvegicus
gtgcgaagcgcatagcgtccggacc

SEQ ID NO: 508288 - DNA, 25 bp, Rattus norvegicus
gtgcgaagtcttaggcgggttaaca

SEQ ID NO: 508289 - DNA, 25 bp, Rattus norvegicus
gtgcgaagtctttggcgggttaaca

SEQ ID NO: 508290 - DNA, 25 bp, Rattus norvegicus
gtgcgaataaagctacaatgtaaag

SEQ ID NO: 508291 - DNA, 25 bp, Rattus norvegicus
gtgcgaataaaggtacaatgtaaag

SEQ ID NO: 508292 - DNA, 25 bp, Rattus norvegicus
gtgcgaatagagctccagatgcctc

SEQ ID NO: 508293 - DNA, 25 bp, Rattus norvegicus
gtgcgaatagaggtccagatgcctc

SEQ ID NO: 508294 - DNA, 25 bp, Rattus norvegicus
gtgcgaatgctgctagtgattgttt

SEQ ID NO: 508295 - DNA, 25 bp, Rattus norvegicus
gtgcgaatgctggtagtgattgttt

SEQ ID NO: 508296 - DNA, 25 bp, Rattus norvegicus
gtgcgacagtccacataggttcaat

SEQ ID NO: 508297 - DNA, 25 bp, Rattus norvegicus
gtgcgacagtcctcataggttcaat

SEQ ID NO: 508298 - DNA, 25 bp, Rattus norvegicus
gtgcgacatattagcagttcccagt

SEQ ID NO: 508299 - DNA, 25 bp, Rattus norvegicus
gtgcgacatatttgcagttcccagt

SEQ ID NO: 508300 - DNA, 25 bp, Rattus norvegicus
gtgcgacccggaagttttagccgcg

SEQ ID NO: 508301 - DNA, 25 bp, Rattus norvegicus
gtgcgacccggatgttttagccgcg

SEQ ID NO: 508302 - DNA, 25 bp, Rattus norvegicus
gtgcgactgaccacacaagaagtta

SEQ ID NO: 508303 - DNA, 25 bp, Rattus norvegicus
gtgcgactgacctcacaagaagtta

SEQ ID NO: 508304 - DNA, 25 bp, Rattus norvegicus
gtgcgacttaaccagaggccaatgt

SEQ ID NO: 508305 - DNA, 25 bp, Rattus norvegicus
gtgcgacttaacgagaggccaatgt

SEQ ID NO: 508306 - DNA, 25 bp, Rattus norvegicus
gtgcgagaaattcctcaggacttca

SEQ ID NO: 508307 - DNA, 25 bp, Rattus norvegicus
gtgcgagaaattgctcaggacttca

SEQ ID NO: 508308 - DNA, 25 bp, Rattus norvegicus
gtgcgagaccaccataagtgccttc

SEQ ID NO: 508309 - DNA, 25 bp, Rattus norvegicus
gtgcgagaccacgataagtgccttc

SEQ ID NO: 508310 - DNA, 25 bp, Rattus norvegicus
gtgcgagactacagtaaggcttcct

SEQ ID NO: 508311 - DNA, 25 bp, Rattus norvegicus
gtgcgagactactgtaaggcttcct

SEQ ID NO: 508312 - DNA, 25 bp, Rattus norvegicus
gtgcgagaggagctgcccaacaaca

SEQ ID NO: 508313 - DNA, 25 bp, Rattus norvegicus
gtgcgagaggaggtgcccaacaaca

SEQ ID NO: 508314 - DNA, 25 bp, Rattus norvegicus
gtgcgagcatgaatcacagcctgca

SEQ ID NO: 508315 - DNA, 25 bp, Rattus norvegicus
gtgcgagcatgattcacagcctgca

SEQ ID NO: 508316 - DNA, 25 bp, Rattus norvegicus
gtgcgagccaaccacatcttgaagc

SEQ ID NO: 508317 - DNA, 25 bp, Rattus norvegicus
gtgcgagccaacgacatcttgaagc

SEQ ID NO: 508318 - DNA, 25 bp, Rattus norvegicus
gtgcgaggcggccatacgcatctac

SEQ ID NO: 508319 - DNA, 25 bp, Rattus norvegicus
gtgcgaggcggcgatacgcatctac

SEQ ID NO: 508320 - DNA, 25 bp, Rattus norvegicus
gtgcgagtgtctaacctacatgagt

SEQ ID NO: 508321 - DNA, 25 bp, Rattus norvegicus
gtgcgagtgtcttacctacatgagt

SEQ ID NO: 508322 - DNA, 25 bp, Rattus norvegicus
gtgcgagtgttcatcaaccagttat

SEQ ID NO: 508323 - DNA, 25 bp, Rattus norvegicus
gtgcgagtgttcttcaaccagttat

SEQ ID NO: 508324 - DNA, 25 bp, Rattus norvegicus
gtgcgatgccttaacttagacacag

SEQ ID NO: 508325 - DNA, 25 bp, Rattus norvegicus
gtgcgatgccttcattttcacgaag

SEQ ID NO: 508326 - DNA, 25 bp, Rattus norvegicus
gtgcgatgccttgattttcacgaag

SEQ ID NO: 508327 - DNA, 25 bp, Rattus norvegicus
gtgcgatgcctttacttagacacag

SEQ ID NO: 508328 - DNA, 25 bp, Rattus norvegicus
gtgcgatgtgcacacactttgcata

SEQ ID NO: 508329 - DNA, 25 bp, Rattus norvegicus
gtgcgatgtgcagacactttgcata

SEQ ID NO: 508330 - DNA, 25 bp, Rattus norvegicus
gtgcgattcctgatcccatgaaata

SEQ ID NO: 508331 - DNA, 25 bp, Rattus norvegicus
gtgcgattcctgttcccatgaaata

SEQ ID NO: 508332 - DNA, 25 bp, Rattus norvegicus
gtgcgcaacaccaaggagcctgtga

SEQ ID NO: 508333 - DNA, 25 bp, Rattus norvegicus
gtgcgcaacacctaggagcctgtga

SEQ ID NO: 508334 - DNA, 25 bp, Rattus norvegicus
gtgcgcaagaacctatcccaaactg

SEQ ID NO: 508335 - DNA, 25 bp, Rattus norvegicus
gtgcgcaagaacgtatcccaaactg

SEQ ID NO: 508336 - DNA, 25 bp, Rattus norvegicus
gtgcgcaagcctcactatgcattga

SEQ ID NO: 508337 - DNA, 25 bp, Rattus norvegicus
gtgcgcaagcctgactatgcattga

SEQ ID NO: 508338 - DNA, 25 bp, Rattus norvegicus
gtgcgcaatgtcactgaagtctctg

SEQ ID NO: 508339 - DNA, 25 bp, Rattus norvegicus
gtgcgcaatgtctctgaagtctctg

SEQ ID NO: 508340 - DNA, 25 bp, Rattus norvegicus
gtgcgcaattggaaacctgttgatt

SEQ ID NO: 508341 - DNA, 25 bp, Rattus norvegicus
gtgcgcaattggtaacctgttgatt

SEQ ID NO: 508342 - DNA, 25 bp, Rattus norvegicus
gtgcgcacatctcctcatccagtgg

SEQ ID NO: 508343 - DNA, 25 bp, Rattus norvegicus
gtgcgcacatctgctcatccagtgg

SEQ ID NO: 508344 - DNA, 25 bp, Rattus norvegicus
gtgcgcaccgtcagctagagccatt

SEQ ID NO: 508345 - DNA, 25 bp, Rattus norvegicus
gtgcgcaccgtctgctagagccatt

SEQ ID NO: 508346 - DNA, 25 bp, Rattus norvegicus
gtgcgcacgggaattggtacaacag

SEQ ID NO: 508347 - DNA, 25 bp, Rattus norvegicus
gtgcgcacgggatttggtacaacag

SEQ ID NO: 508348 - DNA, 25 bp, Rattus norvegicus
gtgcgcactgtcaagttcatgttta

SEQ ID NO: 508349 - DNA, 25 bp, Rattus norvegicus
gtgcgcactgtctagttcatgttta

SEQ ID NO: 508350 - DNA, 25 bp, Rattus norvegicus
gtgcgcagatctattcaacctgagt

SEQ ID NO: 508351 - DNA, 25 bp, Rattus norvegicus
gtgcgcagatcttttcaacctgagt

SEQ ID NO: 508352 - DNA, 25 bp, Rattus norvegicus
gtgcgcagctctcacagaagttcat

SEQ ID NO: 508353 - DNA, 25 bp, Rattus norvegicus
gtgcgcagctctgacagaagttcat

SEQ ID NO: 508354 - DNA, 25 bp, Rattus norvegicus
gtgcgcaggcgcactcaggtagcac

SEQ ID NO: 508355 - DNA, 25 bp, Rattus norvegicus
gtgcgcaggcgctctcaggtagcac

SEQ ID NO: 508356 - DNA, 25 bp, Rattus norvegicus
gtgcgcagggagagtgaaatcaaac

SEQ ID NO: 508357 - DNA, 25 bp, Rattus norvegicus
gtgcgcagggagtgtgaaatcaaac

SEQ ID NO: 508358 - DNA, 25 bp, Rattus norvegicus
gtgcgcagggccaaggtgtcttata

SEQ ID NO: 508359 - DNA, 25 bp, Rattus norvegicus
gtgcgcagggcctaggtgtcttata

SEQ ID NO: 508360 - DNA, 25 bp, Rattus norvegicus
gtgcgcatagacaccaggctcaata

SEQ ID NO: 508361 - DNA, 25 bp, Rattus norvegicus
gtgcgcatagactccaggctcaata

SEQ ID NO: 508362 - DNA, 25 bp, Rattus norvegicus
gtgcgcatccctcgtgagcaaggat

SEQ ID NO: 508363 - DNA, 25 bp, Rattus norvegicus
gtgcgcatccctggtgagcaaggat

SEQ ID NO: 508364 - DNA, 25 bp, Rattus norvegicus
gtgcgcatgattacttgcctttatg

SEQ ID NO: 508365 - DNA, 25 bp, Rattus norvegicus
gtgcgcatgatttcttgcctttatg

SEQ ID NO: 508366 - DNA, 25 bp, Rattus norvegicus
gtgcgcattcttcaaacagggacag

SEQ ID NO: 508367 - DNA, 25 bp, Rattus norvegicus
gtgcgcattcttgaaacagggacag

SEQ ID NO: 508368 - DNA, 25 bp, Rattus norvegicus
gtgcgcatttcacaccaattaatcc

SEQ ID NO: 508369 - DNA, 25 bp, Rattus norvegicus
gtgcgcatttcagaccaattaatcc

SEQ ID NO: 508370 - DNA, 25 bp, Rattus norvegicus
gtgcgcatttccagggtgcgacgcc

SEQ ID NO: 508371 - DNA, 25 bp, Rattus norvegicus
gtgcgcatttcctgggtgcgacgcc

SEQ ID NO: 508372 - DNA, 25 bp, Rattus norvegicus
gtgcgccaggctctatgagaacagt

SEQ ID NO: 508373 - DNA, 25 bp, Rattus norvegicus
gtgcgccaggctgtatgagaacagt

SEQ ID NO: 508374 - DNA, 25 bp, Rattus norvegicus
gtgcgccatgtcctatttattcaga

SEQ ID NO: 508375 - DNA, 25 bp, Rattus norvegicus
gtgcgccatgtcgtatttattcaga

SEQ ID NO: 508376 - DNA, 25 bp, Rattus norvegicus
gtgcgcccgaggctgcatctgcaaa

SEQ ID NO: 508377 - DNA, 25 bp, Rattus norvegicus
gtgcgcccgagggtgcatctgcaaa

SEQ ID NO: 508378 - DNA, 25 bp, Rattus norvegicus
gtgcgccctctgacacataaagtga

SEQ ID NO: 508379 - DNA, 25 bp, Rattus norvegicus
gtgcgccctctgtcacataaagtga

SEQ ID NO: 508380 - DNA, 25 bp, Rattus norvegicus
gtgcgcctcgagagctgggtttcat

SEQ ID NO: 508381 - DNA, 25 bp, Rattus norvegicus
gtgcgcctcgagtgctgggtttcat

SEQ ID NO: 508382 - DNA, 25 bp, Rattus norvegicus
gtgcgcctctctcagaatatataat

SEQ ID NO: 508383 - DNA, 25 bp, Rattus norvegicus
gtgcgcctctctgagaatatataat

SEQ ID NO: 508384 - DNA, 25 bp, Rattus norvegicus
gtgcgcctgctactgcccggtgaat

SEQ ID NO: 508385 - DNA, 25 bp, Rattus norvegicus
gtgcgcctgctagtgcccggtgaat

SEQ ID NO: 508386 - DNA, 25 bp, Rattus norvegicus
gtgcgcctggctagcagttggcttt

SEQ ID NO: 508387 - DNA, 25 bp, Rattus norvegicus
gtgcgcctggcttgcagttggcttt

SEQ ID NO: 508388 - DNA, 25 bp, Rattus norvegicus
gtgcgcctggtaccaaatacggcga

SEQ ID NO: 508389 - DNA, 25 bp, Rattus norvegicus
gtgcgcctggtagcaaatacggcga

SEQ ID NO: 508390 - DNA, 25 bp, Rattus norvegicus
gtgcgcctgtgcctgtgtactaaca

SEQ ID NO: 508391 - DNA, 25 bp, Rattus norvegicus
gtgcgcctgtgcgtgtgtactaaca

SEQ ID NO: 508392 - DNA, 25 bp, Rattus norvegicus
gtgcgccttgatcagctgtgccaaa

SEQ ID NO: 508393 - DNA, 25 bp, Rattus norvegicus
gtgcgccttgatgagctgtgccaaa

SEQ ID NO: 508394 - DNA, 25 bp, Rattus norvegicus
gtgcgcgcacatcttggagacttga

SEQ ID NO: 508395 - DNA, 25 bp, Rattus norvegicus
gtgcgcgcacatgttggagacttga

SEQ ID NO: 508396 - DNA, 25 bp, Rattus norvegicus
gtgcgcgcgaaaagcttctgcaagg

SEQ ID NO: 508397 - DNA, 25 bp, Rattus norvegicus
gtgcgcgcgaaatgcttctgcaagg

SEQ ID NO: 508398 - DNA, 25 bp, Rattus norvegicus
gtgcgcgcgcgacagagatgaaaag

SEQ ID NO: 508399 - DNA, 25 bp, Rattus norvegicus
gtgcgcgcgcgagagagatgaaaag

SEQ ID NO: 508400 - DNA, 25 bp, Rattus norvegicus
gtgcgcgctctccatatcaaagcag

SEQ ID NO: 508401 - DNA, 25 bp, Rattus norvegicus
gtgcgcgctctcgatatcaaagcag

SEQ ID NO: 508402 - DNA, 25 bp, Rattus norvegicus
gtgcgcgctgcgagcatgcttgcca

SEQ ID NO: 508403 - DNA, 25 bp, Rattus norvegicus
gtgcgcgctgcgtgcatgcttgcca

SEQ ID NO: 508404 - DNA, 25 bp, Rattus norvegicus
gtgcgcggaaaacaacgatcccgag

SEQ ID NO: 508405 - DNA, 25 bp, Rattus norvegicus
gtgcgcggaaaagaacgatcccgag

SEQ ID NO: 508406 - DNA, 25 bp, Rattus norvegicus
gtgcgcgtgcacagtattttaaatc

SEQ ID NO: 508407 - DNA, 25 bp, Rattus norvegicus
gtgcgcgtgcactgtattttaaatc

SEQ ID NO: 508408 - DNA, 25 bp, Rattus norvegicus
gtgcgctatactcatgttacatctg

SEQ ID NO: 508409 - DNA, 25 bp, Rattus norvegicus
gtgcgctatactgatgttacatctg

SEQ ID NO: 508410 - DNA, 25 bp, Rattus norvegicus
gtgcgctattacctcaacttggtgc

SEQ ID NO: 508411 - DNA, 25 bp, Rattus norvegicus
gtgcgctattacgtcaacttggtgc

SEQ ID NO: 508412 - DNA, 25 bp, Rattus norvegicus
gtgcgctattggataatgatgtctt

SEQ ID NO: 508413 - DNA, 25 bp, Rattus norvegicus
gtgcgctattggttaatgatgtctt

SEQ ID NO: 508414 - DNA, 25 bp, Rattus norvegicus
gtgcgctcactccttaaggacataa

SEQ ID NO: 508415 - DNA, 25 bp, Rattus norvegicus
gtgcgctcactcgttaaggacataa

SEQ ID NO: 508416 - DNA, 25 bp, Rattus norvegicus
gtgcgctcctttaagaccatgacag

SEQ ID NO: 508417 - DNA, 25 bp, Rattus norvegicus
gtgcgctccttttagaccatgacag

SEQ ID NO: 508418 - DNA, 25 bp, Rattus norvegicus
gtgcgctgacccataaggccgggac

SEQ ID NO: 508419 - DNA, 25 bp, Rattus norvegicus
gtgcgctgacccttaaggccgggac

SEQ ID NO: 508420 - DNA, 25 bp, Rattus norvegicus
gtgcgctgagcacaaccactgtgtg

SEQ ID NO: 508421 - DNA, 25 bp, Rattus norvegicus
gtgcgctgagcagaaccactgtgtg

SEQ ID NO: 508422 - DNA, 25 bp, Rattus norvegicus
gtgcgctgcaacaaaactttgtggc

SEQ ID NO: 508423 - DNA, 25 bp, Rattus norvegicus
gtgcgctgcaactaaactttgtggc

SEQ ID NO: 508424 - DNA, 25 bp, Rattus norvegicus
gtgcgctgcactatctgggcagagt

SEQ ID NO: 508425 - DNA, 25 bp, Rattus norvegicus
gtgcgctgcactttctgggcagagt

SEQ ID NO: 508426 - DNA, 25 bp, Rattus norvegicus
gtgcgctgcgctacctacaggaggc

SEQ ID NO: 508427 - DNA, 25 bp, Rattus norvegicus
gtgcgctgcgcttcctacaggaggc

SEQ ID NO: 508428 - DNA, 25 bp, Rattus norvegicus
gtgcgctgtgaaaccgatgggacca

SEQ ID NO: 508429 - DNA, 25 bp, Rattus norvegicus
gtgcgctgtgaatccgatgggacca

SEQ ID NO: 508430 - DNA, 25 bp, Rattus norvegicus
gtgcgcttcccaccaaaagctacag

SEQ ID NO: 508431 - DNA, 25 bp, Rattus norvegicus
gtgcgcttcccagcaaaagctacag

SEQ ID NO: 508432 - DNA, 25 bp, Rattus norvegicus
gtgcgcttgtcgatttagccgcgaa

SEQ ID NO: 508433 - DNA, 25 bp, Rattus norvegicus
gtgcgcttgtcgttttagccgcgaa

SEQ ID NO: 508434 - DNA, 25 bp, Rattus norvegicus
gtgcggaaaaagaacctactcaaat

SEQ ID NO: 508435 - DNA, 25 bp, Rattus norvegicus
gtgcggaaaaagtacctactcaaat

SEQ ID NO: 508436 - DNA, 25 bp, Rattus norvegicus
gtgcggaacccgctatctgcttgtt

SEQ ID NO: 508437 - DNA, 25 bp, Rattus norvegicus
gtgcggaacccggtatctgcttgtt

SEQ ID NO: 508438 - DNA, 25 bp, Rattus norvegicus
gtgcggaaccttaaagtctccatgg

SEQ ID NO: 508439 - DNA, 25 bp, Rattus norvegicus
gtgcggaacctttaagtctccatgg

SEQ ID NO: 508440 - DNA, 25 bp, Rattus norvegicus
gtgcggaagctcatcatcaggcgac

SEQ ID NO: 508441 - DNA, 25 bp, Rattus norvegicus
gtgcggaagctcttcatcaggcgac

SEQ ID NO: 508442 - DNA, 25 bp, Rattus norvegicus
gtgcggacgcaccatgtttttatgg

SEQ ID NO: 508443 - DNA, 25 bp, Rattus norvegicus
gtgcggacgcacgatgtttttatgg

SEQ ID NO: 508444 - DNA, 25 bp, Rattus norvegicus
gtgcggactagtcaaccaagtgcaa

SEQ ID NO: 508445 - DNA, 25 bp, Rattus norvegicus
gtgcggactagtgaaccaagtgcaa

SEQ ID NO: 508446 - DNA, 25 bp, Rattus norvegicus
gtgcggagaaccactctcatgtatt

SEQ ID NO: 508447 - DNA, 25 bp, Rattus norvegicus
gtgcggagaacctctctcatgtatt

SEQ ID NO: 508448 - DNA, 25 bp, Rattus norvegicus
gtgcggagcctgaaacctacataga

SEQ ID NO: 508449 - DNA, 25 bp, Rattus norvegicus
gtgcggagcctgtaacctacataga

SEQ ID NO: 508450 - DNA, 25 bp, Rattus norvegicus
gtgcggagggagactctcaaacttc

SEQ ID NO: 508451 - DNA, 25 bp, Rattus norvegicus
gtgcggagggagtctctcaaacttc

SEQ ID NO: 508452 - DNA, 25 bp, Rattus norvegicus
gtgcggattgtcattcccctgaagg

SEQ ID NO: 508453 - DNA, 25 bp, Rattus norvegicus
gtgcggattgtctttcccctgaagg

SEQ ID NO: 508454 - DNA, 25 bp, Rattus norvegicus
gtgcggcaactcaagagacacgaag

SEQ ID NO: 508455 - DNA, 25 bp, Rattus norvegicus
gtgcggcaactctagagacacgaag

SEQ ID NO: 508456 - DNA, 25 bp, Rattus norvegicus
gtgcggcacaaacagggagtctctc

SEQ ID NO: 508457 - DNA, 25 bp, Rattus norvegicus
gtgcggcacaaagagggagtctctc

SEQ ID NO: 508458 - DNA, 25 bp, Rattus norvegicus
gtgcggcaccatagtgatgtcaata

SEQ ID NO: 508459 - DNA, 25 bp, Rattus norvegicus
gtgcggcaccattgtgatgtcaata

SEQ ID NO: 508460 - DNA, 25 bp, Rattus norvegicus
gtgcggcagcagatgcagcttgaat

SEQ ID NO: 508461 - DNA, 25 bp, Rattus norvegicus
gtgcggcagcagttgcagcttgaat

SEQ ID NO: 508462 - DNA, 25 bp, Rattus norvegicus
gtgcggcattttctcctgtgaagga

SEQ ID NO: 508463 - DNA, 25 bp, Rattus norvegicus
gtgcggcattttgtcctgtgaagga

SEQ ID NO: 508464 - DNA, 25 bp, Rattus norvegicus
gtgcggccacagagcctaaaatcga

SEQ ID NO: 508465 - DNA, 25 bp, Rattus norvegicus
gtgcggccacagtgcctaaaatcga

SEQ ID NO: 508466 - DNA, 25 bp, Rattus norvegicus
gtgcggccagccctgcacttataag

SEQ ID NO: 508467 - DNA, 25 bp, Rattus norvegicus
gtgcggccagccgtgcacttataag

SEQ ID NO: 508468 - DNA, 25 bp, Rattus norvegicus
gtgcggccataaccgaactcaatgt

SEQ ID NO: 508469 - DNA, 25 bp, Rattus norvegicus
gtgcggccataagcgaactcaatgt

SEQ ID NO: 508470 - DNA, 25 bp, Rattus norvegicus
gtgcggccgaaccagctggaacaat

SEQ ID NO: 508471 - DNA, 25 bp, Rattus norvegicus
gtgcggccgaacgagctggaacaat

SEQ ID NO: 508472 - DNA, 25 bp, Rattus norvegicus
gtgcggcctgcacccagcggcagag

SEQ ID NO: 508473 - DNA, 25 bp, Rattus norvegicus
gtgcggcctgcagccagcggcagag

SEQ ID NO: 508474 - DNA, 25 bp, Rattus norvegicus
gtgcggctacacattcatgtacaca

SEQ ID NO: 508475 - DNA, 25 bp, Rattus norvegicus
gtgcggctacactttcatgtacaca

SEQ ID NO: 508476 - DNA, 25 bp, Rattus norvegicus
gtgcggctcagacgagacccttcga

SEQ ID NO: 508477 - DNA, 25 bp, Rattus norvegicus
gtgcggctcagaggagacccttcga

SEQ ID NO: 508478 - DNA, 25 bp, Rattus norvegicus
gtgcggcttattaccatgcctcaag

SEQ ID NO: 508479 - DNA, 25 bp, Rattus norvegicus
gtgcggcttatttccatgcctcaag

SEQ ID NO: 508480 - DNA, 25 bp, Rattus norvegicus
gtgcgggaaaacatttggactgtaa

SEQ ID NO: 508481 - DNA, 25 bp, Rattus norvegicus
gtgcgggaaaacttttggactgtaa

SEQ ID NO: 508482 - DNA, 25 bp, Rattus norvegicus
gtgcgggaacccagtgccatcgagc

SEQ ID NO: 508483 - DNA, 25 bp, Rattus norvegicus
gtgcgggaaccctgtgccatcgagc

SEQ ID NO: 508484 - DNA, 25 bp, Rattus norvegicus
gtgcgggctcgtcaggaaaccggct

SEQ ID NO: 508485 - DNA, 25 bp, Rattus norvegicus
gtgcgggctcgtgaggaaaccggct

SEQ ID NO: 508486 - DNA, 25 bp, Rattus norvegicus
gtgcgggctttcaccagccagcagg

SEQ ID NO: 508487 - DNA, 25 bp, Rattus norvegicus
gtgcgggctttctccagccagcagg

SEQ ID NO: 508488 - DNA, 25 bp, Rattus norvegicus
gtgcgggttccacttgatgagtttt

SEQ ID NO: 508489 - DNA, 25 bp, Rattus norvegicus
gtgcgggttccagttgatgagtttt

SEQ ID NO: 508490 - DNA, 25 bp, Rattus norvegicus
gtgcgggttgcccatgctgctaaaa

SEQ ID NO: 508491 - DNA, 25 bp, Rattus norvegicus
gtgcgggttgccgatgctgctaaaa

SEQ ID NO: 508492 - DNA, 25 bp, Rattus norvegicus
gtgcggtattctacacagccataaa

SEQ ID NO: 508493 - DNA, 25 bp, Rattus norvegicus
gtgcggtattcttcacagccataaa

SEQ ID NO: 508494 - DNA, 25 bp, Rattus norvegicus
gtgcggtgactgaagttacttcaaa

SEQ ID NO: 508495 - DNA, 25 bp, Rattus norvegicus
gtgcggtgactgtagttacttcaaa

SEQ ID NO: 508496 - DNA, 25 bp, Rattus norvegicus
gtgcggtgcctcaggttgtaagacc

SEQ ID NO: 508497 - DNA, 25 bp, Rattus norvegicus
gtgcggtgcctctggttgtaagacc

SEQ ID NO: 508498 - DNA, 25 bp, Rattus norvegicus
gtgcggtgctggattattctgtctc

SEQ ID NO: 508499 - DNA, 25 bp, Rattus norvegicus
gtgcggtgctggtttattctgtctc

SEQ ID NO: 508500 - DNA, 25 bp, Rattus norvegicus
gtgcggttctaactgaaggacgttt

SEQ ID NO: 508501 - DNA, 25 bp, Rattus norvegicus
gtgcggttctaagtgaaggacgttt

SEQ ID NO: 508502 - DNA, 25 bp, Rattus norvegicus
gtgcggttctgaatctgattgctat

SEQ ID NO: 508503 - DNA, 25 bp, Rattus norvegicus
gtgcggttctgattctgattgctat

SEQ ID NO: 508504 - DNA, 25 bp, Rattus norvegicus
gtgcggtttgcaactgatccgtgtg

SEQ ID NO: 508505 - DNA, 25 bp, Rattus norvegicus
gtgcggtttgcatctgatccgtgtg

SEQ ID NO: 508506 - DNA, 25 bp, Rattus norvegicus
gtgcgtaacaacattggaaacatta

SEQ ID NO: 508507 - DNA, 25 bp, Rattus norvegicus
gtgcgtaacaactttggaaacatta

SEQ ID NO: 508508 - DNA, 25 bp, Rattus norvegicus
gtgcgtaaggacactccgagtctat

SEQ ID NO: 508509 - DNA, 25 bp, Rattus norvegicus
gtgcgtaaggactctccgagtctat

SEQ ID NO: 508510 - DNA, 25 bp, Rattus norvegicus
gtgcgtaatggacaaactgacctat

SEQ ID NO: 508511 - DNA, 25 bp, Rattus norvegicus
gtgcgtaatggagaaactgacctat

SEQ ID NO: 508512 - DNA, 25 bp, Rattus norvegicus
gtgcgtacaataaggtggctgactt

SEQ ID NO: 508513 - DNA, 25 bp, Rattus norvegicus
gtgcgtacaatatggtggctgactt

SEQ ID NO: 508514 - DNA, 25 bp, Rattus norvegicus
gtgcgtacaccacatgacggcttta

SEQ ID NO: 508515 - DNA, 25 bp, Rattus norvegicus
gtgcgtacaccagatgacggcttta

SEQ ID NO: 508516 - DNA, 25 bp, Rattus norvegicus
gtgcgtacacgcacatgtgtacaca

SEQ ID NO: 508517 - DNA, 25 bp, Rattus norvegicus
gtgcgtacacgctcatgtgtacaca

SEQ ID NO: 508518 - DNA, 25 bp, Rattus norvegicus
gtgcgtacatggactctggctcaag

SEQ ID NO: 508519 - DNA, 25 bp, Rattus norvegicus
gtgcgtacatggtctctggctcaag

SEQ ID NO: 508520 - DNA, 25 bp, Rattus norvegicus
gtgcgtattcatcctgacatctaca

SEQ ID NO: 508521 - DNA, 25 bp, Rattus norvegicus
gtgcgtattcatgctgacatctaca

SEQ ID NO: 508522 - DNA, 25 bp, Rattus norvegicus
gtgcgtcatctgcaagcctcatgga

SEQ ID NO: 508523 - DNA, 25 bp, Rattus norvegicus
gtgcgtcatctggaagcctcatgga

SEQ ID NO: 508524 - DNA, 25 bp, Rattus norvegicus
gtgcgtcattatacaggatcccaga

SEQ ID NO: 508525 - DNA, 25 bp, Rattus norvegicus
gtgcgtcattattcaggatcccaga

SEQ ID NO: 508526 - DNA, 25 bp, Rattus norvegicus
gtgcgtccaaggctgaccatttatg

SEQ ID NO: 508527 - DNA, 25 bp, Rattus norvegicus
gtgcgtccaagggtgaccatttatg

SEQ ID NO: 508528 - DNA, 25 bp, Rattus norvegicus
gtgcgtccactgaactgagcagtga

SEQ ID NO: 508529 - DNA, 25 bp, Rattus norvegicus
gtgcgtccactgtactgagcagtga

SEQ ID NO: 508530 - DNA, 25 bp, Rattus norvegicus
gtgcgtcccaaacatggctcagcat

SEQ ID NO: 508531 - DNA, 25 bp, Rattus norvegicus
gtgcgtcccaaagatggctcagcat

SEQ ID NO: 508532 - DNA, 25 bp, Rattus norvegicus
gtgcgtcccagtctaggttacagaa

SEQ ID NO: 508533 - DNA, 25 bp, Rattus norvegicus
gtgcgtcccagtgtaggttacagaa

SEQ ID NO: 508534 - DNA, 25 bp, Rattus norvegicus
gtgcgtccgcataagcagaaggctc

SEQ ID NO: 508535 - DNA, 25 bp, Rattus norvegicus
gtgcgtccgcattagcagaaggctc

SEQ ID NO: 508536 - DNA, 25 bp, Rattus norvegicus
gtgcgtccgggcagttgcggataaa

SEQ ID NO: 508537 - DNA, 25 bp, Rattus norvegicus
gtgcgtccgggctgttgcggataaa

SEQ ID NO: 508538 - DNA, 25 bp, Rattus norvegicus
gtgcgtcgttttacccatgagataa

SEQ ID NO: 508539 - DNA, 25 bp, Rattus norvegicus
gtgcgtcgtttttcccatgagataa

SEQ ID NO: 508540 - DNA, 25 bp, Rattus norvegicus
gtgcgtctattaacacatcctaaga

SEQ ID NO: 508541 - DNA, 25 bp, Rattus norvegicus
gtgcgtctattatcacatcctaaga

SEQ ID NO: 508542 - DNA, 25 bp, Rattus norvegicus
gtgcgtctccagctggctgatgtac

SEQ ID NO: 508543 - DNA, 25 bp, Rattus norvegicus
gtgcgtctccaggtggctgatgtac

SEQ ID NO: 508544 - DNA, 25 bp, Rattus norvegicus
gtgcgtctcctgacaaagggaggct

SEQ ID NO: 508545 - DNA, 25 bp, Rattus norvegicus
gtgcgtctcctgtcaaagggaggct

SEQ ID NO: 508546 - DNA, 25 bp, Rattus norvegicus
gtgcgtctgccgaggacactcagtg

SEQ ID NO: 508547 - DNA, 25 bp, Rattus norvegicus
gtgcgtctgccgtggacactcagtg

SEQ ID NO: 508548 - DNA, 25 bp, Rattus norvegicus
gtgcgtctgcttactgcctgtaaaa

SEQ ID NO: 508549 - DNA, 25 bp, Rattus norvegicus
gtgcgtctgctttctgcctgtaaaa

SEQ ID NO: 508550 - DNA, 25 bp, Rattus norvegicus
gtgcgtcttagtcacaagtccctga

SEQ ID NO: 508551 - DNA, 25 bp, Rattus norvegicus
gtgcgtcttagtgacaagtccctga

SEQ ID NO: 508552 - DNA, 25 bp, Rattus norvegicus
gtgcgtcttccacaagtggcttcaa

SEQ ID NO: 508553 - DNA, 25 bp, Rattus norvegicus
gtgcgtcttccagaagtggcttcaa

SEQ ID NO: 508554 - DNA, 25 bp, Rattus norvegicus
gtgcgtcttctcaaataccaagcta

SEQ ID NO: 508555 - DNA, 25 bp, Rattus norvegicus
gtgcgtcttctctaataccaagcta

SEQ ID NO: 508556 - DNA, 25 bp, Rattus norvegicus
gtgcgtgaaaacatatgtggccctt

SEQ ID NO: 508557 - DNA, 25 bp, Rattus norvegicus
gtgcgtgaaaacttatgtggccctt

SEQ ID NO: 508558 - DNA, 25 bp, Rattus norvegicus
gtgcgtgaagagagctcgtcctcag

SEQ ID NO: 508559 - DNA, 25 bp, Rattus norvegicus
gtgcgtgaagagtgctcgtcctcag

SEQ ID NO: 508560 - DNA, 25 bp, Rattus norvegicus
gtgcgtgagcacagggttcatatac

SEQ ID NO: 508561 - DNA, 25 bp, Rattus norvegicus
gtgcgtgagcactgggttcatatac

SEQ ID NO: 508562 - DNA, 25 bp, Rattus norvegicus
gtgcgtgcatgtatgtggactcctg

SEQ ID NO: 508563 - DNA, 25 bp, Rattus norvegicus
gtgcgtgcatgtttgtggactcctg

SEQ ID NO: 508564 - DNA, 25 bp, Rattus norvegicus
gtgcgtgcccacctcggagagcaac

SEQ ID NO: 508565 - DNA, 25 bp, Rattus norvegicus
gtgcgtgcccacgtcggagagcaac

SEQ ID NO: 508566 - DNA, 25 bp, Rattus norvegicus
gtgcgtgcccgtcagtttgcagcca

SEQ ID NO: 508567 - DNA, 25 bp, Rattus norvegicus
gtgcgtgcccgtgagtttgcagcca

SEQ ID NO: 508568 - DNA, 25 bp, Rattus norvegicus
gtgcgtgcctgtctgatgtatattg

SEQ ID NO: 508569 - DNA, 25 bp, Rattus norvegicus
gtgcgtgcctgtgtgatgtatattg

SEQ ID NO: 508570 - DNA, 25 bp, Rattus norvegicus
gtgcgtgcgtgtctaacattccaaa

SEQ ID NO: 508571 - DNA, 25 bp, Rattus norvegicus
gtgcgtgcgtgtgtaacattccaaa

SEQ ID NO: 508572 - DNA, 25 bp, Rattus norvegicus
gtgcgtgctccgcatgaaccaggca

SEQ ID NO: 508573 - DNA, 25 bp, Rattus norvegicus
gtgcgtgctccggatgaaccaggca

SEQ ID NO: 508574 - DNA, 25 bp, Rattus norvegicus
gtgcgtgctctcagatatctagaat

SEQ ID NO: 508575 - DNA, 25 bp, Rattus norvegicus
gtgcgtgctctctgatatctagaat

SEQ ID NO: 508576 - DNA, 25 bp, Rattus norvegicus
gtgcgtgctgacacagagcgccaga

SEQ ID NO: 508577 - DNA, 25 bp, Rattus norvegicus
gtgcgtgctgactcagagcgccaga

SEQ ID NO: 508578 - DNA, 25 bp, Rattus norvegicus
gtgcgtggaatgactggcctacttc

SEQ ID NO: 508579 - DNA, 25 bp, Rattus norvegicus
gtgcgtggaatgtctggcctacttc

SEQ ID NO: 508580 - DNA, 25 bp, Rattus norvegicus
gtgcgtggagacacacacctagaat

SEQ ID NO: 508581 - DNA, 25 bp, Rattus norvegicus
gtgcgtggagactcacacctagaat

SEQ ID NO: 508582 - DNA, 25 bp, Rattus norvegicus
gtgcgtggtgccaaccagtggatca

SEQ ID NO: 508583 - DNA, 25 bp, Rattus norvegicus
gtgcgtggtgcctaccagtggatca

SEQ ID NO: 508584 - DNA, 25 bp, Rattus norvegicus
gtgcgtggtgttcgaaagcattcca

SEQ ID NO: 508585 - DNA, 25 bp, Rattus norvegicus
gtgcgtggtgttggaaagcattcca

SEQ ID NO: 508586 - DNA, 25 bp, Rattus norvegicus
gtgcgtgtactaattctaaaaacca

SEQ ID NO: 508587 - DNA, 25 bp, Rattus norvegicus
gtgcgtgtactatttctaaaaacca

SEQ ID NO: 508588 - DNA, 25 bp, Rattus norvegicus
gtgcgtgtgtgcctggaccttatac

SEQ ID NO: 508589 - DNA, 25 bp, Rattus norvegicus
gtgcgtgtgtgcgtggaccttatac

SEQ ID NO: 508590 - DNA, 25 bp, Rattus norvegicus
gtgcgtgttcatctgggagtcctca

SEQ ID NO: 508591 - DNA, 25 bp, Rattus norvegicus
gtgcgtgttcatgtgggagtcctca

SEQ ID NO: 508592 - DNA, 25 bp, Rattus norvegicus
gtgcgtgttgacaacagtggaccca

SEQ ID NO: 508593 - DNA, 25 bp, Rattus norvegicus
gtgcgtgttgactacagtggaccca

SEQ ID NO: 508594 - DNA, 25 bp, Rattus norvegicus
gtgcgtgtttttctaaatcagttcc

SEQ ID NO: 508595 - DNA, 25 bp, Rattus norvegicus
gtgcgtgtttttgtaaatcagttcc

SEQ ID NO: 508596 - DNA, 25 bp, Rattus norvegicus
gtgcgttaagacaatcagatcagga

SEQ ID NO: 508597 - DNA, 25 bp, Rattus norvegicus
gtgcgttaagactatcagatcagga

SEQ ID NO: 508598 - DNA, 25 bp, Rattus norvegicus
gtgcgttatgagagagtaccagcta

SEQ ID NO: 508599 - DNA, 25 bp, Rattus norvegicus
gtgcgttatgagtgagtaccagcta

SEQ ID NO: 508600 - DNA, 25 bp, Rattus norvegicus
gtgcgttccataatgtgataaggta

SEQ ID NO: 508601 - DNA, 25 bp, Rattus norvegicus
gtgcgttccatattgtgataaggta

SEQ ID NO: 508602 - DNA, 25 bp, Rattus norvegicus
gtgcgttcttatataatgtctgatt

SEQ ID NO: 508603 - DNA, 25 bp, Rattus norvegicus
gtgcgttcttatttaatgtctgatt

SEQ ID NO: 508604 - DNA, 25 bp, Rattus norvegicus
gtgcgttcttgcaacctggctaatg

SEQ ID NO: 508605 - DNA, 25 bp, Rattus norvegicus
gtgcgttcttgctacctggctaatg

SEQ ID NO: 508606 - DNA, 25 bp, Rattus norvegicus
gtgcgttgctggcaccattactata

SEQ ID NO: 508607 - DNA, 25 bp, Rattus norvegicus
gtgcgttgctgggaccattactata

SEQ ID NO: 508608 - DNA, 25 bp, Rattus norvegicus
gtgcgtttcctaagtttgtttatac

SEQ ID NO: 508609 - DNA, 25 bp, Rattus norvegicus
gtgcgtttcctatgtttgtttatac

SEQ ID NO: 508610 - DNA, 25 bp, Rattus norvegicus
gtgcgtttctggcacctgccaaaag

SEQ ID NO: 508611 - DNA, 25 bp, Rattus norvegicus
gtgcgtttctgggacctgccaaaag

SEQ ID NO: 508612 - DNA, 25 bp, Rattus norvegicus
gtgcgtttctgtctgattgaaccca

SEQ ID NO: 508613 - DNA, 25 bp, Rattus norvegicus
gtgcgtttctgtgtgattgaaccca

SEQ ID NO: 508614 - DNA, 25 bp, Rattus norvegicus
gtgcgtttcttgcaggcagaatttc

SEQ ID NO: 508615 - DNA, 25 bp, Rattus norvegicus
gtgcgtttcttggaggcagaatttc

SEQ ID NO: 508616 - DNA, 25 bp, Rattus norvegicus
gtgcgtttgtaactgttctctcatc

SEQ ID NO: 508617 - DNA, 25 bp, Rattus norvegicus
gtgcgtttgtaagtgttctctcatc

SEQ ID NO: 508618 - DNA, 25 bp, Rattus norvegicus
gtgctaaacgttactgtggaccctg

SEQ ID NO: 508619 - DNA, 25 bp, Rattus norvegicus
gtgctaaacgtttctgtggaccctg

SEQ ID NO: 508620 - DNA, 25 bp, Rattus norvegicus
gtgctaaactgcaccatgtttcaaa

SEQ ID NO: 508621 - DNA, 25 bp, Rattus norvegicus
gtgctaaactgctccatgtttcaaa

SEQ ID NO: 508622 - DNA, 25 bp, Rattus norvegicus
gtgctaaactggacaaacacgctta

SEQ ID NO: 508623 - DNA, 25 bp, Rattus norvegicus
gtgctaaactggtcaaacacgctta

SEQ ID NO: 508624 - DNA, 25 bp, Rattus norvegicus
gtgctaaagaaacccatgttccatg

SEQ ID NO: 508625 - DNA, 25 bp, Rattus norvegicus
gtgctaaagaaagccatgttccatg

SEQ ID NO: 508626 - DNA, 25 bp, Rattus norvegicus
gtgctaaagcagaggagctcacgct

SEQ ID NO: 508627 - DNA, 25 bp, Rattus norvegicus
gtgctaaagcagtggagctcacgct

SEQ ID NO: 508628 - DNA, 25 bp, Rattus norvegicus
gtgctaaatgtcattgctcacacag

SEQ ID NO: 508629 - DNA, 25 bp, Rattus norvegicus
gtgctaaatgtctttgctcacacag

SEQ ID NO: 508630 - DNA, 25 bp, Rattus norvegicus
gtgctaacaacactgacgctctggc

SEQ ID NO: 508631 - DNA, 25 bp, Rattus norvegicus
gtgctaacaacagtgacgctctggc

SEQ ID NO: 508632 - DNA, 25 bp, Rattus norvegicus
gtgctaacacagaccgtgacggcca

SEQ ID NO: 508633 - DNA, 25 bp, Rattus norvegicus
gtgctaacacagtccgtgacggcca

SEQ ID NO: 508634 - DNA, 25 bp, Rattus norvegicus
gtgctaacatatctccaggatcctg

SEQ ID NO: 508635 - DNA, 25 bp, Rattus norvegicus
gtgctaacatatgtccaggatcctg

SEQ ID NO: 508636 - DNA, 25 bp, Rattus norvegicus
gtgctaaccctaatcaatgtgccaa

SEQ ID NO: 508637 - DNA, 25 bp, Rattus norvegicus
gtgctaaccctattcaatgtgccaa

SEQ ID NO: 508638 - DNA, 25 bp, Rattus norvegicus
gtgctaacgcacacgaaacggagtc

SEQ ID NO: 508639 - DNA, 25 bp, Rattus norvegicus
gtgctaacgcactcgaaacggagtc

SEQ ID NO: 508640 - DNA, 25 bp, Rattus norvegicus
gtgctaacgccgagaaatgctgccc

SEQ ID NO: 508641 - DNA, 25 bp, Rattus norvegicus
gtgctaacgccgtgaaatgctgccc

SEQ ID NO: 508642 - DNA, 25 bp, Rattus norvegicus
gtgctaactactacttgaaactatt

SEQ ID NO: 508643 - DNA, 25 bp, Rattus norvegicus
gtgctaactacttcttgaaactatt

SEQ ID NO: 508644 - DNA, 25 bp, Rattus norvegicus
gtgctaactggaccctacttacata

SEQ ID NO: 508645 - DNA, 25 bp, Rattus norvegicus
gtgctaactggagcctacttacata

SEQ ID NO: 508646 - DNA, 25 bp, Rattus norvegicus
gtgctaacttcaacgggcaggcgct

SEQ ID NO: 508647 - DNA, 25 bp, Rattus norvegicus
gtgctaacttcatcgggcaggcgct

SEQ ID NO: 508648 - DNA, 25 bp, Rattus norvegicus
gtgctaagactgcaaacggtccctc

SEQ ID NO: 508649 - DNA, 25 bp, Rattus norvegicus
gtgctaagactggaaacggtccctc

SEQ ID NO: 508650 - DNA, 25 bp, Rattus norvegicus
gtgctaagagcacaaacgcaattct

SEQ ID NO: 508651 - DNA, 25 bp, Rattus norvegicus
gtgctaagagcagaaacgcaattct

SEQ ID NO: 508652 - DNA, 25 bp, Rattus norvegicus
gtgctaagagccctgtctatggact

SEQ ID NO: 508653 - DNA, 25 bp, Rattus norvegicus
gtgctaagagccgtgtctatggact

SEQ ID NO: 508654 - DNA, 25 bp, Rattus norvegicus
gtgctaagcacactctttgtaacaa

SEQ ID NO: 508655 - DNA, 25 bp, Rattus norvegicus
gtgctaagcacagtctttgtaacaa

SEQ ID NO: 508656 - DNA, 25 bp, Rattus norvegicus
gtgctaagccctagagtctgagttt

SEQ ID NO: 508657 - DNA, 25 bp, Rattus norvegicus
gtgctaagcccttgagtctgagttt

SEQ ID NO: 508658 - DNA, 25 bp, Rattus norvegicus
gtgctaagccttatccaaacacttg

SEQ ID NO: 508659 - DNA, 25 bp, Rattus norvegicus
gtgctaagccttttccaaacacttg

SEQ ID NO: 508660 - DNA, 25 bp, Rattus norvegicus
gtgctaagctgcaggatgctgaaat

SEQ ID NO: 508661 - DNA, 25 bp, Rattus norvegicus
gtgctaagctgctggatgctgaaat

SEQ ID NO: 508662 - DNA, 25 bp, Rattus norvegicus
gtgctaagttaaccaggtctgcaca

SEQ ID NO: 508663 - DNA, 25 bp, Rattus norvegicus
gtgctaagttaagcaggtctgcaca

SEQ ID NO: 508664 - DNA, 25 bp, Rattus norvegicus
gtgctaatgtccattgagtccttaa

SEQ ID NO: 508665 - DNA, 25 bp, Rattus norvegicus
gtgctaatgtcctttgagtccttaa

SEQ ID NO: 508666 - DNA, 25 bp, Rattus norvegicus
gtgctaatgtctactataaagtcta

SEQ ID NO: 508667 - DNA, 25 bp, Rattus norvegicus
gtgctaatgtcttctataaagtcta

SEQ ID NO: 508668 - DNA, 25 bp, Rattus norvegicus
gtgctaattcacatcctgtctgaaa

SEQ ID NO: 508669 - DNA, 25 bp, Rattus norvegicus
gtgctaattcacttcctgtctgaaa

SEQ ID NO: 508670 - DNA, 25 bp, Rattus norvegicus
gtgctaattcctccataatccaatg

SEQ ID NO: 508671 - DNA, 25 bp, Rattus norvegicus
gtgctaattcctgcataatccaatg

SEQ ID NO: 508672 - DNA, 25 bp, Rattus norvegicus
gtgctaattgtaatcttttctctga

SEQ ID NO: 508673 - DNA, 25 bp, Rattus norvegicus
gtgctaattgtattcttttctctga

SEQ ID NO: 508674 - DNA, 25 bp, Rattus norvegicus
gtgctaatttggcagattctcagac

SEQ ID NO: 508675 - DNA, 25 bp, Rattus norvegicus
gtgctaatttgggagattctcagac

SEQ ID NO: 508676 - DNA, 25 bp, Rattus norvegicus
gtgctacaaacaataatccatttaa

SEQ ID NO: 508677 - DNA, 25 bp, Rattus norvegicus
gtgctacaaacattaatccatttaa

SEQ ID NO: 508678 - DNA, 25 bp, Rattus norvegicus
gtgctacaagcacacggtgggacct

SEQ ID NO: 508679 - DNA, 25 bp, Rattus norvegicus
gtgctacaagcagacggtgggacct

SEQ ID NO: 508680 - DNA, 25 bp, Rattus norvegicus
gtgctacacagcaggctttcaggag

SEQ ID NO: 508681 - DNA, 25 bp, Rattus norvegicus
gtgctacacagctggctttcaggag

SEQ ID NO: 508682 - DNA, 25 bp, Rattus norvegicus
gtgctacacatcatttgtataaagt

SEQ ID NO: 508683 - DNA, 25 bp, Rattus norvegicus
gtgctacacatcttttgtataaagt

SEQ ID NO: 508684 - DNA, 25 bp, Rattus norvegicus
gtgctacacatgctgtgacctccag

SEQ ID NO: 508685 - DNA, 25 bp, Rattus norvegicus
gtgctacacatggtgtgacctccag

SEQ ID NO: 508686 - DNA, 25 bp, Rattus norvegicus
gtgctacataatcgtgttttggttt

SEQ ID NO: 508687 - DNA, 25 bp, Rattus norvegicus
gtgctacataatggtgttttggttt

SEQ ID NO: 508688 - DNA, 25 bp, Rattus norvegicus
gtgctacatacacttcagctccagt

SEQ ID NO: 508689 - DNA, 25 bp, Rattus norvegicus
gtgctacatacagttcagctccagt

SEQ ID NO: 508690 - DNA, 25 bp, Rattus norvegicus
gtgctacatcacagatctttacaaa

SEQ ID NO: 508691 - DNA, 25 bp, Rattus norvegicus
gtgctacatcactgatctttacaaa

SEQ ID NO: 508692 - DNA, 25 bp, Rattus norvegicus
gtgctaccagcactcctaagtaaag

SEQ ID NO: 508693 - DNA, 25 bp, Rattus norvegicus
gtgctaccagcagtcctaagtaaag

SEQ ID NO: 508694 - DNA, 25 bp, Rattus norvegicus
gtgctacccagaaacacagccagga

SEQ ID NO: 508695 - DNA, 25 bp, Rattus norvegicus
gtgctacccagatacacagccagga

SEQ ID NO: 508696 - DNA, 25 bp, Rattus norvegicus
gtgctacctaagaaagtcttccccg

SEQ ID NO: 508697 - DNA, 25 bp, Rattus norvegicus
gtgctacctaagtaagtcttccccg

SEQ ID NO: 508698 - DNA, 25 bp, Rattus norvegicus
gtgctacctctgagcttgctataga

SEQ ID NO: 508699 - DNA, 25 bp, Rattus norvegicus
gtgctacctctgtgcttgctataga

SEQ ID NO: 508700 - DNA, 25 bp, Rattus norvegicus
gtgctacctgctcattgtggtcaag

SEQ ID NO: 508701 - DNA, 25 bp, Rattus norvegicus
gtgctacctgctgattgtggtcaag

SEQ ID NO: 508702 - DNA, 25 bp, Rattus norvegicus
gtgctaccttttctggtgagagcca

SEQ ID NO: 508703 - DNA, 25 bp, Rattus norvegicus
gtgctaccttttgtggtgagagcca

SEQ ID NO: 508704 - DNA, 25 bp, Rattus norvegicus
gtgctactcattcctctagattctg

SEQ ID NO: 508705 - DNA, 25 bp, Rattus norvegicus
gtgctactcattgctctagattctg

SEQ ID NO: 508706 - DNA, 25 bp, Rattus norvegicus
gtgctactcgacaaacaggtggaaa

SEQ ID NO: 508707 - DNA, 25 bp, Rattus norvegicus
gtgctactcgactaacaggtggaaa

SEQ ID NO: 508708 - DNA, 25 bp, Rattus norvegicus
gtgctactgtaaatatacctcttta

SEQ ID NO: 508709 - DNA, 25 bp, Rattus norvegicus
gtgctactgtaattatacctcttta

SEQ ID NO: 508710 - DNA, 25 bp, Rattus norvegicus
gtgctactgtggcaagtcttctcat

SEQ ID NO: 508711 - DNA, 25 bp, Rattus norvegicus
gtgctactgtgggaagtcttctcat

SEQ ID NO: 508712 - DNA, 25 bp, Rattus norvegicus
gtgctacttattctacttcgtggag

SEQ ID NO: 508713 - DNA, 25 bp, Rattus norvegicus
gtgctacttattgtacttcgtggag

SEQ ID NO: 508714 - DNA, 25 bp, Rattus norvegicus
gtgctacttctgaggatgctgacga

SEQ ID NO: 508715 - DNA, 25 bp, Rattus norvegicus
gtgctacttctgtggatgctgacga

SEQ ID NO: 508716 - DNA, 25 bp, Rattus norvegicus
gtgctacttgaaaacagccttgcag

SEQ ID NO: 508717 - DNA, 25 bp, Rattus norvegicus
gtgctacttgaatacagccttgcag

SEQ ID NO: 508718 - DNA, 25 bp, Rattus norvegicus
gtgctacttgatctgtgtatgtttg

SEQ ID NO: 508719 - DNA, 25 bp, Rattus norvegicus
gtgctacttgatgtgtgtatgtttg

SEQ ID NO: 508720 - DNA, 25 bp, Rattus norvegicus
gtgctacttggcattaatcttctgg

SEQ ID NO: 508721 - DNA, 25 bp, Rattus norvegicus
gtgctacttggctttaatcttctgg

SEQ ID NO: 508722 - DNA, 25 bp, Rattus norvegicus
gtgctacttgtgaatctctgagaat

SEQ ID NO: 508723 - DNA, 25 bp, Rattus norvegicus
gtgctacttgtgtatctctgagaat

SEQ ID NO: 508724 - DNA, 25 bp, Rattus norvegicus
gtgctagaaagtcctacccatgtca

SEQ ID NO: 508725 - DNA, 25 bp, Rattus norvegicus
gtgctagaaagtgctacccatgtca

SEQ ID NO: 508726 - DNA, 25 bp, Rattus norvegicus
gtgctagaaatcaaaccgtgctcct

SEQ ID NO: 508727 - DNA, 25 bp, Rattus norvegicus
gtgctagaaatctaaccgtgctcct

SEQ ID NO: 508728 - DNA, 25 bp, Rattus norvegicus
gtgctagaagccacagaattttgta

SEQ ID NO: 508729 - DNA, 25 bp, Rattus norvegicus
gtgctagaagcctcagaattttgta

SEQ ID NO: 508730 - DNA, 25 bp, Rattus norvegicus
gtgctagaatcacaggcatatgcaa

SEQ ID NO: 508731 - DNA, 25 bp, Rattus norvegicus
gtgctagaatcagaggcatatgcaa

SEQ ID NO: 508732 - DNA, 25 bp, Rattus norvegicus
gtgctagactggatctgccgaagat

SEQ ID NO: 508733 - DNA, 25 bp, Rattus norvegicus
gtgctagactggttctgccgaagat

SEQ ID NO: 508734 - DNA, 25 bp, Rattus norvegicus
gtgctagagaatcaacccagggctt

SEQ ID NO: 508735 - DNA, 25 bp, Rattus norvegicus
gtgctagagaatgaacccagggctt

SEQ ID NO: 508736 - DNA, 25 bp, Rattus norvegicus
gtgctagagagcaaagtcttcccca

SEQ ID NO: 508737 - DNA, 25 bp, Rattus norvegicus
gtgctagagagctaagtcttcccca

SEQ ID NO: 508738 - DNA, 25 bp, Rattus norvegicus
gtgctagatcccattaatgtatatg

SEQ ID NO: 508739 - DNA, 25 bp, Rattus norvegicus
gtgctagatccctttaatgtatatg

SEQ ID NO: 508740 - DNA, 25 bp, Rattus norvegicus
gtgctagcatcaatctgcattgcct

SEQ ID NO: 508741 - DNA, 25 bp, Rattus norvegicus
gtgctagcatcattctgcattgcct

SEQ ID NO: 508742 - DNA, 25 bp, Rattus norvegicus
gtgctagcctaccatgagcgaagct

SEQ ID NO: 508743 - DNA, 25 bp, Rattus norvegicus
gtgctagcctacgatgagcgaagct

SEQ ID NO: 508744 - DNA, 25 bp, Rattus norvegicus
gtgctagccttccagcggtatcaga

SEQ ID NO: 508745 - DNA, 25 bp, Rattus norvegicus
gtgctagccttcgagcggtatcaga

SEQ ID NO: 508746 - DNA, 25 bp, Rattus norvegicus
gtgctagctagcacctcagtttctg

SEQ ID NO: 508747 - DNA, 25 bp, Rattus norvegicus
gtgctagctagctcctcagtttctg

SEQ ID NO: 508748 - DNA, 25 bp, Rattus norvegicus
gtgctaggactacaagggaacccag

SEQ ID NO: 508749 - DNA, 25 bp, Rattus norvegicus
gtgctaggactagaagggaacccag

SEQ ID NO: 508750 - DNA, 25 bp, Rattus norvegicus
gtgctaggattacagtgacatcacc

SEQ ID NO: 508751 - DNA, 25 bp, Rattus norvegicus
gtgctaggattagagtgacatcacc

SEQ ID NO: 508752 - DNA, 25 bp, Rattus norvegicus
gtgctaggcacacagtagctgttca

SEQ ID NO: 508753 - DNA, 25 bp, Rattus norvegicus
gtgctaggcacagagtagctgttca

SEQ ID NO: 508754 - DNA, 25 bp, Rattus norvegicus
gtgctaggccgtatttaggacccag

SEQ ID NO: 508755 - DNA, 25 bp, Rattus norvegicus
gtgctaggccgtttttaggacccag

SEQ ID NO: 508756 - DNA, 25 bp, Rattus norvegicus
gtgctaggtctgcagtagccgtcca

SEQ ID NO: 508757 - DNA, 25 bp, Rattus norvegicus
gtgctaggtctggagtagccgtcca

SEQ ID NO: 508758 - DNA, 25 bp, Rattus norvegicus
gtgctagtattcctaagacctaagt

SEQ ID NO: 508759 - DNA, 25 bp, Rattus norvegicus
gtgctagtattcgtaagacctaagt

SEQ ID NO: 508760 - DNA, 25 bp, Rattus norvegicus
gtgctagtcagtcccctggtgctga

SEQ ID NO: 508761 - DNA, 25 bp, Rattus norvegicus
gtgctagtcagtgccctggtgctga

SEQ ID NO: 508762 - DNA, 25 bp, Rattus norvegicus
gtgctagtctggacttttttaagtc

SEQ ID NO: 508763 - DNA, 25 bp, Rattus norvegicus
gtgctagtctggtcttttttaagtc

SEQ ID NO: 508764 - DNA, 25 bp, Rattus norvegicus
gtgctagttcttcatgcttctttaa

SEQ ID NO: 508765 - DNA, 25 bp, Rattus norvegicus
gtgctagttcttgatgcttctttaa

SEQ ID NO: 508766 - DNA, 25 bp, Rattus norvegicus
gtgctataaatacccaccacagcca

SEQ ID NO: 508767 - DNA, 25 bp, Rattus norvegicus
gtgctataaatagccaccacagcca

SEQ ID NO: 508768 - DNA, 25 bp, Rattus norvegicus
gtgctatacaacatataggaaccct

SEQ ID NO: 508769 - DNA, 25 bp, Rattus norvegicus
gtgctatacaacttataggaaccct

SEQ ID NO: 508770 - DNA, 25 bp, Rattus norvegicus
gtgctataccagaggtttggcctgc

SEQ ID NO: 508771 - DNA, 25 bp, Rattus norvegicus
gtgctataccagtggtttggcctgc

SEQ ID NO: 508772 - DNA, 25 bp, Rattus norvegicus
gtgctataggccaagggtcatttat

SEQ ID NO: 508773 - DNA, 25 bp, Rattus norvegicus
gtgctataggcctagggtcatttat

SEQ ID NO: 508774 - DNA, 25 bp, Rattus norvegicus
gtgctatatagccacacaccacgca

SEQ ID NO: 508775 - DNA, 25 bp, Rattus norvegicus
gtgctatatagcgacacaccacgca

SEQ ID NO: 508776 - DNA, 25 bp, Rattus norvegicus
gtgctatattttatgacctgcttca

SEQ ID NO: 508777 - DNA, 25 bp, Rattus norvegicus
gtgctatattttttgacctgcttca

SEQ ID NO: 508778 - DNA, 25 bp, Rattus norvegicus
gtgctatcacgccatatttaaattg

SEQ ID NO: 508779 - DNA, 25 bp, Rattus norvegicus
gtgctatcacgcgatatttaaattg

SEQ ID NO: 508780 - DNA, 25 bp, Rattus norvegicus
gtgctatcccaaatttttatatgtc

SEQ ID NO: 508781 - DNA, 25 bp, Rattus norvegicus
gtgctatcccaattttttatatgtc

SEQ ID NO: 508782 - DNA, 25 bp, Rattus norvegicus
gtgctatcccttaccatagttaagc

SEQ ID NO: 508783 - DNA, 25 bp, Rattus norvegicus
gtgctatccctttccatagttaagc

SEQ ID NO: 508784 - DNA, 25 bp, Rattus norvegicus
gtgctatcctgaccaagtttgcttt

SEQ ID NO: 508785 - DNA, 25 bp, Rattus norvegicus
gtgctatcctgagcaagtttgcttt

SEQ ID NO: 508786 - DNA, 25 bp, Rattus norvegicus
gtgctatgatttcaccatggcatta

SEQ ID NO: 508787 - DNA, 25 bp, Rattus norvegicus
gtgctatgatttgaccatggcatta

SEQ ID NO: 508788 - DNA, 25 bp, Rattus norvegicus
gtgctatgctctaaccagaactgtg

SEQ ID NO: 508789 - DNA, 25 bp, Rattus norvegicus
gtgctatgctcttaccagaactgtg

SEQ ID NO: 508790 - DNA, 25 bp, Rattus norvegicus
gtgctatggcacaaatcccactaaa

SEQ ID NO: 508791 - DNA, 25 bp, Rattus norvegicus
gtgctatggcactaatcccactaaa

SEQ ID NO: 508792 - DNA, 25 bp, Rattus norvegicus
gtgctatggcgacaaggatctgtta

SEQ ID NO: 508793 - DNA, 25 bp, Rattus norvegicus
gtgctatggcgagaaggatctgtta

SEQ ID NO: 508794 - DNA, 25 bp, Rattus norvegicus
gtgctatggcggagtctgtgcccaa

SEQ ID NO: 508795 - DNA, 25 bp, Rattus norvegicus
gtgctatggcggtgtctgtgcccaa

SEQ ID NO: 508796 - DNA, 25 bp, Rattus norvegicus
gtgctatgggatcagtttttaaact

SEQ ID NO: 508797 - DNA, 25 bp, Rattus norvegicus
gtgctatgggatgagtttttaaact

SEQ ID NO: 508798 - DNA, 25 bp, Rattus norvegicus
gtgctatgttgccctagacttcgag

SEQ ID NO: 508799 - DNA, 25 bp, Rattus norvegicus
gtgctatgttgcgctagacttcgag

SEQ ID NO: 508800 - DNA, 25 bp, Rattus norvegicus
gtgctattaacgatgcttcctgatg

SEQ ID NO: 508801 - DNA, 25 bp, Rattus norvegicus
gtgctattaacgttgcttcctgatg

SEQ ID NO: 508802 - DNA, 25 bp, Rattus norvegicus
gtgctattacacacctttaatcgag

SEQ ID NO: 508803 - DNA, 25 bp, Rattus norvegicus
gtgctattacactcctttaatcgag

SEQ ID NO: 508804 - DNA, 25 bp, Rattus norvegicus
gtgctattgatcactgattggccta

SEQ ID NO: 508805 - DNA, 25 bp, Rattus norvegicus
gtgctattgatctctgattggccta

SEQ ID NO: 508806 - DNA, 25 bp, Rattus norvegicus
gtgctattgtgcatggacatgatca

SEQ ID NO: 508807 - DNA, 25 bp, Rattus norvegicus
gtgctattgtgcttggacatgatca

SEQ ID NO: 508808 - DNA, 25 bp, Rattus norvegicus
gtgctatttattcccaactcagaga

SEQ ID NO: 508809 - DNA, 25 bp, Rattus norvegicus
gtgctatttattgccaactcagaga

SEQ ID NO: 508810 - DNA, 25 bp, Rattus norvegicus
gtgctatttgagaacacttataaga

SEQ ID NO: 508811 - DNA, 25 bp, Rattus norvegicus
gtgctatttgagtacacttataaga

SEQ ID NO: 508812 - DNA, 25 bp, Rattus norvegicus
gtgctatttggcctgcttacaaagg

SEQ ID NO: 508813 - DNA, 25 bp, Rattus norvegicus
gtgctatttggcgtgcttacaaagg

SEQ ID NO: 508814 - DNA, 25 bp, Rattus norvegicus
gtgctattttcacagtaagtacact

SEQ ID NO: 508815 - DNA, 25 bp, Rattus norvegicus
gtgctattttcagagtaagtacact

SEQ ID NO: 508816 - DNA, 25 bp, Rattus norvegicus
gtgctattttttctgttgcttaaat

SEQ ID NO: 508817 - DNA, 25 bp, Rattus norvegicus
gtgctattttttgtgttgcttaaat

SEQ ID NO: 508818 - DNA, 25 bp, Rattus norvegicus
gtgctcaaattgattaatgcctctg

SEQ ID NO: 508819 - DNA, 25 bp, Rattus norvegicus
gtgctcaaattgtttaatgcctctg

SEQ ID NO: 508820 - DNA, 25 bp, Rattus norvegicus
gtgctcaacagtcgttgactttcca

SEQ ID NO: 508821 - DNA, 25 bp, Rattus norvegicus
gtgctcaacagtggttgactttcca

SEQ ID NO: 508822 - DNA, 25 bp, Rattus norvegicus
gtgctcaaccacaaagttcttcaga

SEQ ID NO: 508823 - DNA, 25 bp, Rattus norvegicus
gtgctcaaccactaagttcttcaga

SEQ ID NO: 508824 - DNA, 25 bp, Rattus norvegicus
gtgctcaacgtgcagtcctagcctg

SEQ ID NO: 508825 - DNA, 25 bp, Rattus norvegicus
gtgctcaacgtggagtcctagcctg

SEQ ID NO: 508826 - DNA, 25 bp, Rattus norvegicus
gtgctcaagccgattgctttctaaa

SEQ ID NO: 508827 - DNA, 25 bp, Rattus norvegicus
gtgctcaagccgtttgctttctaaa

SEQ ID NO: 508828 - DNA, 25 bp, Rattus norvegicus
gtgctcaagttcataaacctatctg

SEQ ID NO: 508829 - DNA, 25 bp, Rattus norvegicus
gtgctcaagttcttaaacctatctg

SEQ ID NO: 508830 - DNA, 25 bp, Rattus norvegicus
gtgctcacacagacactggactacg

SEQ ID NO: 508831 - DNA, 25 bp, Rattus norvegicus
gtgctcacacagtcactggactacg

SEQ ID NO: 508832 - DNA, 25 bp, Rattus norvegicus
gtgctcacagtcacgatggaccaga

SEQ ID NO: 508833 - DNA, 25 bp, Rattus norvegicus
gtgctcacagtctcgatggaccaga

SEQ ID NO: 508834 - DNA, 25 bp, Rattus norvegicus
gtgctcacatagaacatccagaaca

SEQ ID NO: 508835 - DNA, 25 bp, Rattus norvegicus
gtgctcacatagtacatccagaaca

SEQ ID NO: 508836 - DNA, 25 bp, Rattus norvegicus
gtgctcacatgtacccgtattaaca

SEQ ID NO: 508837 - DNA, 25 bp, Rattus norvegicus
gtgctcacatgttcccgtattaaca

SEQ ID NO: 508838 - DNA, 25 bp, Rattus norvegicus
gtgctcacattgatgatagtgtcct

SEQ ID NO: 508839 - DNA, 25 bp, Rattus norvegicus
gtgctcacattgttgatagtgtcct

SEQ ID NO: 508840 - DNA, 25 bp, Rattus norvegicus
gtgctcaccactctgactcatgaaa

SEQ ID NO: 508841 - DNA, 25 bp, Rattus norvegicus
gtgctcaccactgtgactcatgaaa

SEQ ID NO: 508842 - DNA, 25 bp, Rattus norvegicus
gtgctcaccctgatggagtcagaaa

SEQ ID NO: 508843 - DNA, 25 bp, Rattus norvegicus
gtgctcaccctgttggagtcagaaa

SEQ ID NO: 508844 - DNA, 25 bp, Rattus norvegicus
gtgctcaccggaatgtgatctggtt

SEQ ID NO: 508845 - DNA, 25 bp, Rattus norvegicus
gtgctcaccggattgtgatctggtt

SEQ ID NO: 508846 - DNA, 25 bp, Rattus norvegicus
gtgctcacggtgaacatattggtag

SEQ ID NO: 508847 - DNA, 25 bp, Rattus norvegicus
gtgctcacggtgtacatattggtag

SEQ ID NO: 508848 - DNA, 25 bp, Rattus norvegicus
gtgctcactgagaagataccggaag

SEQ ID NO: 508849 - DNA, 25 bp, Rattus norvegicus
gtgctcactgagtagataccggaag

SEQ ID NO: 508850 - DNA, 25 bp, Rattus norvegicus
gtgctcacttacatatattagacga

SEQ ID NO: 508851 - DNA, 25 bp, Rattus norvegicus
gtgctcacttacttatattagacga

SEQ ID NO: 508852 - DNA, 25 bp, Rattus norvegicus
gtgctcagaactctgcaagtacaaa

SEQ ID NO: 508853 - DNA, 25 bp, Rattus norvegicus
gtgctcagaactgtgcaagtacaaa

SEQ ID NO: 508854 - DNA, 25 bp, Rattus norvegicus
gtgctcagaagcaggcagtatcccc

SEQ ID NO: 508855 - DNA, 25 bp, Rattus norvegicus
gtgctcagaagctggcagtatcccc

SEQ ID NO: 508856 - DNA, 25 bp, Rattus norvegicus
gtgctcagaattacgatgtcatacg

SEQ ID NO: 508857 - DNA, 25 bp, Rattus norvegicus
gtgctcagaatttcgatgtcatacg

SEQ ID NO: 508858 - DNA, 25 bp, Rattus norvegicus
gtgctcagagacatcacaaatgttt

SEQ ID NO: 508859 - DNA, 25 bp, Rattus norvegicus
gtgctcagagacttcacaaatgttt

SEQ ID NO: 508860 - DNA, 25 bp, Rattus norvegicus
gtgctcagattgaaacctctgccta

SEQ ID NO: 508861 - DNA, 25 bp, Rattus norvegicus
gtgctcagattgtaacctctgccta

SEQ ID NO: 508862 - DNA, 25 bp, Rattus norvegicus
gtgctcagccccagaagacaagatg

SEQ ID NO: 508863 - DNA, 25 bp, Rattus norvegicus
gtgctcagcccctgaagacaagatg

SEQ ID NO: 508864 - DNA, 25 bp, Rattus norvegicus
gtgctcagcggtactgtttcaggca

SEQ ID NO: 508865 - DNA, 25 bp, Rattus norvegicus
gtgctcagcggttctgtttcaggca

SEQ ID NO: 508866 - DNA, 25 bp, Rattus norvegicus
gtgctcagcttgacgaagatggata

SEQ ID NO: 508867 - DNA, 25 bp, Rattus norvegicus
gtgctcagcttgtcgaagatggata

SEQ ID NO: 508868 - DNA, 25 bp, Rattus norvegicus
gtgctcaggagtccagaaaccccaa

SEQ ID NO: 508869 - DNA, 25 bp, Rattus norvegicus
gtgctcaggagtgcagaaaccccaa

SEQ ID NO: 508870 - DNA, 25 bp, Rattus norvegicus
gtgctcaggcaaatattttgctaag

SEQ ID NO: 508871 - DNA, 25 bp, Rattus norvegicus
gtgctcaggcaattattttgctaag

SEQ ID NO: 508872 - DNA, 25 bp, Rattus norvegicus
gtgctcagggaaagggactcgctca

SEQ ID NO: 508873 - DNA, 25 bp, Rattus norvegicus
gtgctcagggaaatggccttcattc

SEQ ID NO: 508874 - DNA, 25 bp, Rattus norvegicus
gtgctcagggaatgggactcgctca

SEQ ID NO: 508875 - DNA, 25 bp, Rattus norvegicus
gtgctcagggaattggccttcattc

SEQ ID NO: 508876 - DNA, 25 bp, Rattus norvegicus
gtgctcagggctcgccttaacttct

SEQ ID NO: 508877 - DNA, 25 bp, Rattus norvegicus
gtgctcagggctggccttaacttct

SEQ ID NO: 508878 - DNA, 25 bp, Rattus norvegicus
gtgctcataccaaggctcgtacaaa

SEQ ID NO: 508879 - DNA, 25 bp, Rattus norvegicus
gtgctcataccatggctcgtacaaa

SEQ ID NO: 508880 - DNA, 25 bp, Rattus norvegicus
gtgctcatagcactgactcattctt

SEQ ID NO: 508881 - DNA, 25 bp, Rattus norvegicus
gtgctcatagcagtgactcattctt

SEQ ID NO: 508882 - DNA, 25 bp, Rattus norvegicus
gtgctcatattacagaagttcagtg

SEQ ID NO: 508883 - DNA, 25 bp, Rattus norvegicus
gtgctcatattagagaagttcagtg

SEQ ID NO: 508884 - DNA, 25 bp, Rattus norvegicus
gtgctcatcatacagttctgccagt

SEQ ID NO: 508885 - DNA, 25 bp, Rattus norvegicus
gtgctcatcatagagttctgccagt

SEQ ID NO: 508886 - DNA, 25 bp, Rattus norvegicus
gtgctcatccatctgacctcggaga

SEQ ID NO: 508887 - DNA, 25 bp, Rattus norvegicus
gtgctcatccatgtgacctcggaga

SEQ ID NO: 508888 - DNA, 25 bp, Rattus norvegicus
gtgctcatctcccattgtgagggtt

SEQ ID NO: 508889 - DNA, 25 bp, Rattus norvegicus
gtgctcatctccgattgtgagggtt

SEQ ID NO: 508890 - DNA, 25 bp, Rattus norvegicus
gtgctcatctgtcaagccttactac

SEQ ID NO: 508891 - DNA, 25 bp, Rattus norvegicus
gtgctcatctgtgaagccttactac

SEQ ID NO: 508892 - DNA, 25 bp, Rattus norvegicus
gtgctcatgtatatgtctgcatgca

SEQ ID NO: 508893 - DNA, 25 bp, Rattus norvegicus
gtgctcatgtatttgtctgcatgca

SEQ ID NO: 508894 - DNA, 25 bp, Rattus norvegicus
gtgctcattcccatgatgtgtacaa

SEQ ID NO: 508895 - DNA, 25 bp, Rattus norvegicus
gtgctcattcccatgcttatttttt

SEQ ID NO: 508896 - DNA, 25 bp, Rattus norvegicus
gtgctcattcccttgatgtgtacaa

SEQ ID NO: 508897 - DNA, 25 bp, Rattus norvegicus
gtgctcattcccttgcttatttttt

SEQ ID NO: 508898 - DNA, 25 bp, Rattus norvegicus
gtgctcattggtcacgtaatctccg

SEQ ID NO: 508899 - DNA, 25 bp, Rattus norvegicus
gtgctcattggtgacgtaatctccg

SEQ ID NO: 508900 - DNA, 25 bp, Rattus norvegicus
gtgctcattgttctagaaccttgct

SEQ ID NO: 508901 - DNA, 25 bp, Rattus norvegicus
gtgctcattgttgtagaaccttgct

SEQ ID NO: 508902 - DNA, 25 bp, Rattus norvegicus
gtgctccaaaatacattctaaatat

SEQ ID NO: 508903 - DNA, 25 bp, Rattus norvegicus
gtgctccaaaattcattctaaatat

SEQ ID NO: 508904 - DNA, 25 bp, Rattus norvegicus
gtgctccaaccaagcccggaaaaat

SEQ ID NO: 508905 - DNA, 25 bp, Rattus norvegicus
gtgctccaaccatgcccggaaaaat

SEQ ID NO: 508906 - DNA, 25 bp, Rattus norvegicus
gtgctccaaggacgtagccactgcc

SEQ ID NO: 508907 - DNA, 25 bp, Rattus norvegicus
gtgctccaaggaggtagccactgcc

SEQ ID NO: 508908 - DNA, 25 bp, Rattus norvegicus
gtgctccaagtgacaaatgttccgc

SEQ ID NO: 508909 - DNA, 25 bp, Rattus norvegicus
gtgctccaagtgtcaaatgttccgc

SEQ ID NO: 508910 - DNA, 25 bp, Rattus norvegicus
gtgctccactgtacttcgagtctgt

SEQ ID NO: 508911 - DNA, 25 bp, Rattus norvegicus
gtgctccactgttcttcgagtctgt

SEQ ID NO: 508912 - DNA, 25 bp, Rattus norvegicus
gtgctccacttaatgtttcctaggg

SEQ ID NO: 508913 - DNA, 25 bp, Rattus norvegicus
gtgctccacttattgtttcctaggg

SEQ ID NO: 508914 - DNA, 25 bp, Rattus norvegicus
gtgctccagagccattcagggtttt

SEQ ID NO: 508915 - DNA, 25 bp, Rattus norvegicus
gtgctccagagcgattcagggtttt

SEQ ID NO: 508916 - DNA, 25 bp, Rattus norvegicus
gtgctccagcaaaactgcattctat

SEQ ID NO: 508917 - DNA, 25 bp, Rattus norvegicus
gtgctccagcaatactgcattctat

SEQ ID NO: 508918 - DNA, 25 bp, Rattus norvegicus
gtgctccagctaatttttctatttc

SEQ ID NO: 508919 - DNA, 25 bp, Rattus norvegicus
gtgctccagctattttttctatttc

SEQ ID NO: 508920 - DNA, 25 bp, Rattus norvegicus
gtgctccagcttccctttaaatgat

SEQ ID NO: 508921 - DNA, 25 bp, Rattus norvegicus
gtgctccagcttgcctttaaatgat

SEQ ID NO: 508922 - DNA, 25 bp, Rattus norvegicus
gtgctccaggaaactgtttgccaag

SEQ ID NO: 508923 - DNA, 25 bp, Rattus norvegicus
gtgctccaggaatctgtttgccaag

SEQ ID NO: 508924 - DNA, 25 bp, Rattus norvegicus
gtgctccaggctaggctgtggttca

SEQ ID NO: 508925 - DNA, 25 bp, Rattus norvegicus
gtgctccaggcttggctgtggttca

SEQ ID NO: 508926 - DNA, 25 bp, Rattus norvegicus
gtgctccagggccattacagaattt

SEQ ID NO: 508927 - DNA, 25 bp, Rattus norvegicus
gtgctccagggcgattacagaattt

SEQ ID NO: 508928 - DNA, 25 bp, Rattus norvegicus
gtgctccaggttagtcaagctcagc

SEQ ID NO: 508929 - DNA, 25 bp, Rattus norvegicus
gtgctccaggtttgtcaagctcagc

SEQ ID NO: 508930 - DNA, 25 bp, Rattus norvegicus
gtgctccataggagctgcttgatga

SEQ ID NO: 508931 - DNA, 25 bp, Rattus norvegicus
gtgctccataggtgctgcttgatga

SEQ ID NO: 508932 - DNA, 25 bp, Rattus norvegicus
gtgctccatcaaatccaggcaattt

SEQ ID NO: 508933 - DNA, 25 bp, Rattus norvegicus
gtgctccatcaattccaggcaattt

SEQ ID NO: 508934 - DNA, 25 bp, Rattus norvegicus
gtgctccatcagcttgaggtgttaa

SEQ ID NO: 508935 - DNA, 25 bp, Rattus norvegicus
gtgctccatcaggttgaggtgttaa

SEQ ID NO: 508936 - DNA, 25 bp, Rattus norvegicus
gtgctccatctcagaggctaaggca

SEQ ID NO: 508937 - DNA, 25 bp, Rattus norvegicus
gtgctccatctctgaggctaaggca

SEQ ID NO: 508938 - DNA, 25 bp, Rattus norvegicus
gtgctccatgtgactgattagcgtt

SEQ ID NO: 508939 - DNA, 25 bp, Rattus norvegicus
gtgctccatgtgtctgattagcgtt

SEQ ID NO: 508940 - DNA, 25 bp, Rattus norvegicus
gtgctccattctactagtgacagtt

SEQ ID NO: 508941 - DNA, 25 bp, Rattus norvegicus
gtgctccattctccatcacaagagt

SEQ ID NO: 508942 - DNA, 25 bp, Rattus norvegicus
gtgctccattctgcatcacaagagt

SEQ ID NO: 508943 - DNA, 25 bp, Rattus norvegicus
gtgctccattcttctagtgacagtt

SEQ ID NO: 508944 - DNA, 25 bp, Rattus norvegicus
gtgctcccacccaactggaaatatg

SEQ ID NO: 508945 - DNA, 25 bp, Rattus norvegicus
gtgctcccaccctactggaaatatg

SEQ ID NO: 508946 - DNA, 25 bp, Rattus norvegicus
gtgctcccagagctttctaaggtgc

SEQ ID NO: 508947 - DNA, 25 bp, Rattus norvegicus
gtgctcccagaggtttctaaggtgc

SEQ ID NO: 508948 - DNA, 25 bp, Rattus norvegicus
gtgctcccagcaaagatgtgtgaca

SEQ ID NO: 508949 - DNA, 25 bp, Rattus norvegicus
gtgctcccagcatagatgtgtgaca

SEQ ID NO: 508950 - DNA, 25 bp, Rattus norvegicus
gtgctcccagttagactttcgtatt

SEQ ID NO: 508951 - DNA, 25 bp, Rattus norvegicus
gtgctcccagtttgactttcgtatt

SEQ ID NO: 508952 - DNA, 25 bp, Rattus norvegicus
gtgctccccacgcaacacgatgatg

SEQ ID NO: 508953 - DNA, 25 bp, Rattus norvegicus
gtgctccccacggaacacgatgatg

SEQ ID NO: 508954 - DNA, 25 bp, Rattus norvegicus
gtgctccccagacgaagggctcttg

SEQ ID NO: 508955 - DNA, 25 bp, Rattus norvegicus
gtgctccccagaggaagggctcttg

SEQ ID NO: 508956 - DNA, 25 bp, Rattus norvegicus
gtgctcccgactagagactggacag

SEQ ID NO: 508957 - DNA, 25 bp, Rattus norvegicus
gtgctcccgacttgagactggacag

SEQ ID NO: 508958 - DNA, 25 bp, Rattus norvegicus
gtgctcccgctgagtgtgaaaggca

SEQ ID NO: 508959 - DNA, 25 bp, Rattus norvegicus
gtgctcccgctgtgtgtgaaaggca

SEQ ID NO: 508960 - DNA, 25 bp, Rattus norvegicus
gtgctcccgggaagctgaaaggtta

SEQ ID NO: 508961 - DNA, 25 bp, Rattus norvegicus
gtgctcccgggatgctgaaaggtta

SEQ ID NO: 508962 - DNA, 25 bp, Rattus norvegicus
gtgctccctctaagcaaagttcata

SEQ ID NO: 508963 - DNA, 25 bp, Rattus norvegicus
gtgctccctctaccttgttaggaat

SEQ ID NO: 508964 - DNA, 25 bp, Rattus norvegicus
gtgctccctctagcttgttaggaat

SEQ ID NO: 508965 - DNA, 25 bp, Rattus norvegicus
gtgctccctctatgcaaagttcata

SEQ ID NO: 508966 - DNA, 25 bp, Rattus norvegicus
gtgctccctggcaacttaggaatgt

SEQ ID NO: 508967 - DNA, 25 bp, Rattus norvegicus
gtgctccctggctacttaggaatgt

SEQ ID NO: 508968 - DNA, 25 bp, Rattus norvegicus
gtgctccctttgaggaatacatagg

SEQ ID NO: 508969 - DNA, 25 bp, Rattus norvegicus
gtgctccctttgtggaatacatagg

SEQ ID NO: 508970 - DNA, 25 bp, Rattus norvegicus
gtgctccgccagaatgtggatcctg

SEQ ID NO: 508971 - DNA, 25 bp, Rattus norvegicus
gtgctccgccagtatgtggatcctg

SEQ ID NO: 508972 - DNA, 25 bp, Rattus norvegicus
gtgctccgtgatctgtgtatgtgtc

SEQ ID NO: 508973 - DNA, 25 bp, Rattus norvegicus
gtgctccgtgatgtgtgtatgtgtc

SEQ ID NO: 508974 - DNA, 25 bp, Rattus norvegicus
gtgctccgtggaccctcaaacagaa

SEQ ID NO: 508975 - DNA, 25 bp, Rattus norvegicus
gtgctccgtggagcctcaaacagaa

SEQ ID NO: 508976 - DNA, 25 bp, Rattus norvegicus
gtgctcctaagaatggctgatactt

SEQ ID NO: 508977 - DNA, 25 bp, Rattus norvegicus
gtgctcctaagattggctgatactt

SEQ ID NO: 508978 - DNA, 25 bp, Rattus norvegicus
gtgctcctaataaatgtggtccttt

SEQ ID NO: 508979 - DNA, 25 bp, Rattus norvegicus
gtgctcctaatatatgtggtccttt

SEQ ID NO: 508980 - DNA, 25 bp, Rattus norvegicus
gtgctcctaatccagatgatccatt

SEQ ID NO: 508981 - DNA, 25 bp, Rattus norvegicus
gtgctcctaatcgagatgatccatt

SEQ ID NO: 508982 - DNA, 25 bp, Rattus norvegicus
gtgctcctcagaatctgtgttcaga

SEQ ID NO: 508983 - DNA, 25 bp, Rattus norvegicus
gtgctcctcagattctgtgttcaga

SEQ ID NO: 508984 - DNA, 25 bp, Rattus norvegicus
gtgctcctcagtagttgacttggct

SEQ ID NO: 508985 - DNA, 25 bp, Rattus norvegicus
gtgctcctcagttgttgacttggct

SEQ ID NO: 508986 - DNA, 25 bp, Rattus norvegicus
gtgctcctcattctagtgtttgtgt

SEQ ID NO: 508987 - DNA, 25 bp, Rattus norvegicus
gtgctcctcattgtagtgtttgtgt

SEQ ID NO: 508988 - DNA, 25 bp, Rattus norvegicus
gtgctcctcggacagtaccaatgga

SEQ ID NO: 508989 - DNA, 25 bp, Rattus norvegicus
gtgctcctcggagagtaccaatgga

SEQ ID NO: 508990 - DNA, 25 bp, Rattus norvegicus
gtgctcctgaatctactttttatat

SEQ ID NO: 508991 - DNA, 25 bp, Rattus norvegicus
gtgctcctgaatgtactttttatat

SEQ ID NO: 508992 - DNA, 25 bp, Rattus norvegicus
gtgctcctgcggacatgagtgccgt

SEQ ID NO: 508993 - DNA, 25 bp, Rattus norvegicus
gtgctcctgcggtcatgagtgccgt

SEQ ID NO: 508994 - DNA, 25 bp, Rattus norvegicus
gtgctccttacgaggatttcacaca

SEQ ID NO: 508995 - DNA, 25 bp, Rattus norvegicus
gtgctccttacgtggatttcacaca

SEQ ID NO: 508996 - DNA, 25 bp, Rattus norvegicus
gtgctccttgctcgcgaaaagtcgc

SEQ ID NO: 508997 - DNA, 25 bp, Rattus norvegicus
gtgctccttgctggcgaaaagtcgc

SEQ ID NO: 508998 - DNA, 25 bp, Rattus norvegicus
gtgctccttgtgagtagatgtcctc

SEQ ID NO: 508999 - DNA, 25 bp, Rattus norvegicus
gtgctccttgtgtgtagatgtcctc

SEQ ID NO: 509000 - DNA, 25 bp, Rattus norvegicus
gtgctcctttaaaccatgcaagata

SEQ ID NO: 509001 - DNA, 25 bp, Rattus norvegicus
gtgctcctttaatccatgcaagata

SEQ ID NO: 509002 - DNA, 25 bp, Rattus norvegicus
gtgctcctttagagtcaacctgaca

SEQ ID NO: 509003 - DNA, 25 bp, Rattus norvegicus
gtgctcctttagtgtcaacctgaca

SEQ ID NO: 509004 - DNA, 25 bp, Rattus norvegicus
gtgctcctttgccaatttgttaaga

SEQ ID NO: 509005 - DNA, 25 bp, Rattus norvegicus
gtgctcctttgcgaatttgttaaga

SEQ ID NO: 509006 - DNA, 25 bp, Rattus norvegicus
gtgctcgaaactagctgaaatccat

SEQ ID NO: 509007 - DNA, 25 bp, Rattus norvegicus
gtgctcgaaacttgctgaaatccat

SEQ ID NO: 509008 - DNA, 25 bp, Rattus norvegicus
gtgctcgatcgcaaaggctcggaca

SEQ ID NO: 509009 - DNA, 25 bp, Rattus norvegicus
gtgctcgatcgctaaggctcggaca

SEQ ID NO: 509010 - DNA, 25 bp, Rattus norvegicus
gtgctcgatgtgaaccactccagaa

SEQ ID NO: 509011 - DNA, 25 bp, Rattus norvegicus
gtgctcgatgtgtaccactccagaa

SEQ ID NO: 509012 - DNA, 25 bp, Rattus norvegicus
gtgctcgcagcacccgactgagtat

SEQ ID NO: 509013 - DNA, 25 bp, Rattus norvegicus
gtgctcgcagcagccgactgagtat

SEQ ID NO: 509014 - DNA, 25 bp, Rattus norvegicus
gtgctcggaaaacacctgagtcctt

SEQ ID NO: 509015 - DNA, 25 bp, Rattus norvegicus
gtgctcggaaaagacctgagtcctt

SEQ ID NO: 509016 - DNA, 25 bp, Rattus norvegicus
gtgctcggcaaaaccttgtagtgtt

SEQ ID NO: 509017 - DNA, 25 bp, Rattus norvegicus
gtgctcggcaaatccttgtagtgtt

SEQ ID NO: 509018 - DNA, 25 bp, Rattus norvegicus
gtgctcggctgcaacatcagtgtga

SEQ ID NO: 509019 - DNA, 25 bp, Rattus norvegicus
gtgctcggctgctacatcagtgtga

SEQ ID NO: 509020 - DNA, 25 bp, Rattus norvegicus
gtgctcggtcatctcaacttactat

SEQ ID NO: 509021 - DNA, 25 bp, Rattus norvegicus
gtgctcggtcatgtcaacttactat

SEQ ID NO: 509022 - DNA, 25 bp, Rattus norvegicus
gtgctcgtaagtcctcatgttttta

SEQ ID NO: 509023 - DNA, 25 bp, Rattus norvegicus
gtgctcgtaagtgctcatgttttta

SEQ ID NO: 509024 - DNA, 25 bp, Rattus norvegicus
gtgctcgtgcatacctttaatttca

SEQ ID NO: 509025 - DNA, 25 bp, Rattus norvegicus
gtgctcgtgcattcctttaatttca

SEQ ID NO: 509026 - DNA, 25 bp, Rattus norvegicus
gtgctcgtgccactgctgacaagta

SEQ ID NO: 509027 - DNA, 25 bp, Rattus norvegicus
gtgctcgtgccagtgctgacaagta

SEQ ID NO: 509028 - DNA, 25 bp, Rattus norvegicus
gtgctcgtgtttccttttaatactt

SEQ ID NO: 509029 - DNA, 25 bp, Rattus norvegicus
gtgctcgtgtttgcttttaatactt

SEQ ID NO: 509030 - DNA, 25 bp, Rattus norvegicus
gtgctctaagcactggttctcaggt

SEQ ID NO: 509031 - DNA, 25 bp, Rattus norvegicus
gtgctctaagcagtggttctcaggt

SEQ ID NO: 509032 - DNA, 25 bp, Rattus norvegicus
gtgctctaagccatggaacgatctc

SEQ ID NO: 509033 - DNA, 25 bp, Rattus norvegicus
gtgctctaagccttggaacgatctc

SEQ ID NO: 509034 - DNA, 25 bp, Rattus norvegicus
gtgctctaaggcctatattcataca

SEQ ID NO: 509035 - DNA, 25 bp, Rattus norvegicus
gtgctctaaggcgtatattcataca

SEQ ID NO: 509036 - DNA, 25 bp, Rattus norvegicus
gtgctctaagtccaagttcgattct

SEQ ID NO: 509037 - DNA, 25 bp, Rattus norvegicus
gtgctctaagtcgaagttcgattct

SEQ ID NO: 509038 - DNA, 25 bp, Rattus norvegicus
gtgctctagcttaacttttcaattt

SEQ ID NO: 509039 - DNA, 25 bp, Rattus norvegicus
gtgctctagctttacttttcaattt

SEQ ID NO: 509040 - DNA, 25 bp, Rattus norvegicus
gtgctctaggtcagctgtcttagaa

SEQ ID NO: 509041 - DNA, 25 bp, Rattus norvegicus
gtgctctaggtctgctgtcttagaa

SEQ ID NO: 509042 - DNA, 25 bp, Rattus norvegicus
gtgctctatcacagacctaaacttc

SEQ ID NO: 509043 - DNA, 25 bp, Rattus norvegicus
gtgctctatcactgacctaaacttc

SEQ ID NO: 509044 - DNA, 25 bp, Rattus norvegicus
gtgctctatctgaaacactcaagac

SEQ ID NO: 509045 - DNA, 25 bp, Rattus norvegicus
gtgctctatctgtaacactcaagac

SEQ ID NO: 509046 - DNA, 25 bp, Rattus norvegicus
gtgctctattataagcctgcctgta

SEQ ID NO: 509047 - DNA, 25 bp, Rattus norvegicus
gtgctctattattagcctgcctgta

SEQ ID NO: 509048 - DNA, 25 bp, Rattus norvegicus
gtgctctcacttcttgaaagctcta

SEQ ID NO: 509049 - DNA, 25 bp, Rattus norvegicus
gtgctctcacttgttgaaagctcta

SEQ ID NO: 509050 - DNA, 25 bp, Rattus norvegicus
gtgctctcagacctatgaccaggaa

SEQ ID NO: 509051 - DNA, 25 bp, Rattus norvegicus
gtgctctcagacgtatgaccaggaa

SEQ ID NO: 509052 - DNA, 25 bp, Rattus norvegicus
gtgctctcagctaagtgcctgtaga

SEQ ID NO: 509053 - DNA, 25 bp, Rattus norvegicus
gtgctctcagcttagtgcctgtaga

SEQ ID NO: 509054 - DNA, 25 bp, Rattus norvegicus
gtgctctcagtgcatcatgcttgta

SEQ ID NO: 509055 - DNA, 25 bp, Rattus norvegicus
gtgctctcagtggatcatgcttgta

SEQ ID NO: 509056 - DNA, 25 bp, Rattus norvegicus
gtgctctccatgctaatttccaagg

SEQ ID NO: 509057 - DNA, 25 bp, Rattus norvegicus
gtgctctccatggtaatttccaagg

SEQ ID NO: 509058 - DNA, 25 bp, Rattus norvegicus
gtgctctcccttctatttactttaa

SEQ ID NO: 509059 - DNA, 25 bp, Rattus norvegicus
gtgctctcccttgtatttactttaa

SEQ ID NO: 509060 - DNA, 25 bp, Rattus norvegicus
gtgctctccgagctcaggaagactg

SEQ ID NO: 509061 - DNA, 25 bp, Rattus norvegicus
gtgctctccgaggtcaggaagactg

SEQ ID NO: 509062 - DNA, 25 bp, Rattus norvegicus
gtgctctcctgtaagaagacatcat

SEQ ID NO: 509063 - DNA, 25 bp, Rattus norvegicus
gtgctctcctgtattaatgatcctg

SEQ ID NO: 509064 - DNA, 25 bp, Rattus norvegicus
gtgctctcctgttagaagacatcat

SEQ ID NO: 509065 - DNA, 25 bp, Rattus norvegicus
gtgctctcctgttttaatgatcctg

SEQ ID NO: 509066 - DNA, 25 bp, Rattus norvegicus
gtgctctctcacagtcttgataagc

SEQ ID NO: 509067 - DNA, 25 bp, Rattus norvegicus
gtgctctctcactgtcttgataagc

SEQ ID NO: 509068 - DNA, 25 bp, Rattus norvegicus
gtgctctctcctaatttaactgaac

SEQ ID NO: 509069 - DNA, 25 bp, Rattus norvegicus
gtgctctctccttatttaactgaac

SEQ ID NO: 509070 - DNA, 25 bp, Rattus norvegicus
gtgctctcttcaatgccatgaacag

SEQ ID NO: 509071 - DNA, 25 bp, Rattus norvegicus
gtgctctcttcattgccatgaacag

SEQ ID NO: 509072 - DNA, 25 bp, Rattus norvegicus
gtgctctgacacagaccttgaagag

SEQ ID NO: 509073 - DNA, 25 bp, Rattus norvegicus
gtgctctgacactgaccttgaagag

SEQ ID NO: 509074 - DNA, 25 bp, Rattus norvegicus
gtgctctgagtcatcgtactggaac

SEQ ID NO: 509075 - DNA, 25 bp, Rattus norvegicus
gtgctctgagtcttcgtactggaac

SEQ ID NO: 509076 - DNA, 25 bp, Rattus norvegicus
gtgctctgatgactgcagcccataa

SEQ ID NO: 509077 - DNA, 25 bp, Rattus norvegicus
gtgctctgatgagtgcagcccataa

SEQ ID NO: 509078 - DNA, 25 bp, Rattus norvegicus
gtgctctgctttagtctgagatgca

SEQ ID NO: 509079 - DNA, 25 bp, Rattus norvegicus
gtgctctgcttttgtctgagatgca

SEQ ID NO: 509080 - DNA, 25 bp, Rattus norvegicus
gtgctctggctaatggcaaatgact

SEQ ID NO: 509081 - DNA, 25 bp, Rattus norvegicus
gtgctctggctattggcaaatgact

SEQ ID NO: 509082 - DNA, 25 bp, Rattus norvegicus
gtgctctgggctcttttgttacaaa

SEQ ID NO: 509083 - DNA, 25 bp, Rattus norvegicus
gtgctctgggctgttttgttacaaa

SEQ ID NO: 509084 - DNA, 25 bp, Rattus norvegicus
gtgctctgggtgacaggtgtacata

SEQ ID NO: 509085 - DNA, 25 bp, Rattus norvegicus
gtgctctgggtgtcaggtgtacata

SEQ ID NO: 509086 - DNA, 25 bp, Rattus norvegicus
gtgctctgtagaagctcctggaaat

SEQ ID NO: 509087 - DNA, 25 bp, Rattus norvegicus
gtgctctgtagaaggattttccctt

SEQ ID NO: 509088 - DNA, 25 bp, Rattus norvegicus
gtgctctgtagatgctcctggaaat

SEQ ID NO: 509089 - DNA, 25 bp, Rattus norvegicus
gtgctctgtagatggattttccctt

SEQ ID NO: 509090 - DNA, 25 bp, Rattus norvegicus
gtgctctgtgacagctgccgagaac

SEQ ID NO: 509091 - DNA, 25 bp, Rattus norvegicus
gtgctctgtgacataacgtaactgt

SEQ ID NO: 509092 - DNA, 25 bp, Rattus norvegicus
gtgctctgtgactgctgccgagaac

SEQ ID NO: 509093 - DNA, 25 bp, Rattus norvegicus
gtgctctgtgacttaacgtaactgt

SEQ ID NO: 509094 - DNA, 25 bp, Rattus norvegicus
gtgctctgttgaagatctcagtcca

SEQ ID NO: 509095 - DNA, 25 bp, Rattus norvegicus
gtgctctgttgatgatctcagtcca

SEQ ID NO: 509096 - DNA, 25 bp, Rattus norvegicus
gtgctcttaactattgagtaatctc

SEQ ID NO: 509097 - DNA, 25 bp, Rattus norvegicus
gtgctcttaacttttgagtaatctc

SEQ ID NO: 509098 - DNA, 25 bp, Rattus norvegicus
gtgctcttagtgctgtaatggcttt

SEQ ID NO: 509099 - DNA, 25 bp, Rattus norvegicus
gtgctcttagtggtgtaatggcttt

SEQ ID NO: 509100 - DNA, 25 bp, Rattus norvegicus
gtgctcttcctcataatctgcaata

SEQ ID NO: 509101 - DNA, 25 bp, Rattus norvegicus
gtgctcttcctcttaatctgcaata

SEQ ID NO: 509102 - DNA, 25 bp, Rattus norvegicus
gtgctcttcgccagaaagctgtttt

SEQ ID NO: 509103 - DNA, 25 bp, Rattus norvegicus
gtgctcttcgcctgaaagctgtttt

SEQ ID NO: 509104 - DNA, 25 bp, Rattus norvegicus
gtgctcttcttccataatagtgaca

SEQ ID NO: 509105 - DNA, 25 bp, Rattus norvegicus
gtgctcttcttcgataatagtgaca

SEQ ID NO: 509106 - DNA, 25 bp, Rattus norvegicus
gtgctcttctttctctccaaaagaa

SEQ ID NO: 509107 - DNA, 25 bp, Rattus norvegicus
gtgctcttctttgtctccaaaagaa

SEQ ID NO: 509108 - DNA, 25 bp, Rattus norvegicus
gtgctcttgactctcttttgtaaat

SEQ ID NO: 509109 - DNA, 25 bp, Rattus norvegicus
gtgctcttgactgtcttttgtaaat

SEQ ID NO: 509110 - DNA, 25 bp, Rattus norvegicus
gtgctcttgggaagcatgcctggat

SEQ ID NO: 509111 - DNA, 25 bp, Rattus norvegicus
gtgctcttgggatgcatgcctggat

SEQ ID NO: 509112 - DNA, 25 bp, Rattus norvegicus
gtgctcttggtcagactttctggaa

SEQ ID NO: 509113 - DNA, 25 bp, Rattus norvegicus
gtgctcttggtctgactttctggaa

SEQ ID NO: 509114 - DNA, 25 bp, Rattus norvegicus
gtgctcttgtggcttcattcagtag

SEQ ID NO: 509115 - DNA, 25 bp, Rattus norvegicus
gtgctcttgtgggttcattcagtag

SEQ ID NO: 509116 - DNA, 25 bp, Rattus norvegicus
gtgctctttagccagtatctgtaaa

SEQ ID NO: 509117 - DNA, 25 bp, Rattus norvegicus
gtgctctttagcgagtatctgtaaa

SEQ ID NO: 509118 - DNA, 25 bp, Rattus norvegicus
gtgctctttgagagcagctgacgta

SEQ ID NO: 509119 - DNA, 25 bp, Rattus norvegicus
gtgctctttgagtgcagctgacgta

SEQ ID NO: 509120 - DNA, 25 bp, Rattus norvegicus
gtgctctttgccatattcaatcttg

SEQ ID NO: 509121 - DNA, 25 bp, Rattus norvegicus
gtgctctttgccttattcaatcttg

SEQ ID NO: 509122 - DNA, 25 bp, Rattus norvegicus
gtgctctttgggattttcctgtaca

SEQ ID NO: 509123 - DNA, 25 bp, Rattus norvegicus
gtgctctttgggtttttcctgtaca

SEQ ID NO: 509124 - DNA, 25 bp, Rattus norvegicus
gtgctctttgtcattgggtggataa

SEQ ID NO: 509125 - DNA, 25 bp, Rattus norvegicus
gtgctctttgtctttgggtggataa

SEQ ID NO: 509126 - DNA, 25 bp, Rattus norvegicus
gtgctctttgttaccttatattcgc

SEQ ID NO: 509127 - DNA, 25 bp, Rattus norvegicus
gtgctctttgtttccttatattcgc

SEQ ID NO: 509128 - DNA, 25 bp, Rattus norvegicus
gtgctcttttataggcttccataat

SEQ ID NO: 509129 - DNA, 25 bp, Rattus norvegicus
gtgctcttttattggcttccataat

SEQ ID NO: 509130 - DNA, 25 bp, Rattus norvegicus
gtgctctttttcatagactgtttgt

SEQ ID NO: 509131 - DNA, 25 bp, Rattus norvegicus
gtgctctttttcttagactgtttgt

SEQ ID NO: 509132 - DNA, 25 bp, Rattus norvegicus
gtgctgaaaagccagttgaagtctg

SEQ ID NO: 509133 - DNA, 25 bp, Rattus norvegicus
gtgctgaaaagcgagttgaagtctg

SEQ ID NO: 509134 - DNA, 25 bp, Rattus norvegicus
gtgctgaaactgatcattcccactt

SEQ ID NO: 509135 - DNA, 25 bp, Rattus norvegicus
gtgctgaaactgttcattcccactt

SEQ ID NO: 509136 - DNA, 25 bp, Rattus norvegicus
gtgctgaaagttctgcacttcagaa

SEQ ID NO: 509137 - DNA, 25 bp, Rattus norvegicus
gtgctgaaagttgtgcacttcagaa

SEQ ID NO: 509138 - DNA, 25 bp, Rattus norvegicus
gtgctgaacagtaggcgcgccgcca

SEQ ID NO: 509139 - DNA, 25 bp, Rattus norvegicus
gtgctgaacagttggcgcgccgcca

SEQ ID NO: 509140 - DNA, 25 bp, Rattus norvegicus
gtgctgaacctgagtgagaccccag

SEQ ID NO: 509141 - DNA, 25 bp, Rattus norvegicus
gtgctgaacctgtgtgagaccccag

SEQ ID NO: 509142 - DNA, 25 bp, Rattus norvegicus
gtgctgaactccagtcccggtgaca

SEQ ID NO: 509143 - DNA, 25 bp, Rattus norvegicus
gtgctgaactcctgtcccggtgaca

SEQ ID NO: 509144 - DNA, 25 bp, Rattus norvegicus
gtgctgaactgtcgttagagatgat

SEQ ID NO: 509145 - DNA, 25 bp, Rattus norvegicus
gtgctgaactgtggttagagatgat

SEQ ID NO: 509146 - DNA, 25 bp, Rattus norvegicus
gtgctgaagagtccacatttccaca

SEQ ID NO: 509147 - DNA, 25 bp, Rattus norvegicus
gtgctgaagagtgcacatttccaca

SEQ ID NO: 509148 - DNA, 25 bp, Rattus norvegicus
gtgctgaatctgctcaaagccaaca

SEQ ID NO: 509149 - DNA, 25 bp, Rattus norvegicus
gtgctgaatctggtcaaagccaaca

SEQ ID NO: 509150 - DNA, 25 bp, Rattus norvegicus
gtgctgaatcttcgaggaggtttcg

SEQ ID NO: 509151 - DNA, 25 bp, Rattus norvegicus
gtgctgaatcttggaggaggtttcg

SEQ ID NO: 509152 - DNA, 25 bp, Rattus norvegicus
gtgctgaatgaacatcctgtcccta

SEQ ID NO: 509153 - DNA, 25 bp, Rattus norvegicus
gtgctgaatgaactccataggcttt

SEQ ID NO: 509154 - DNA, 25 bp, Rattus norvegicus
gtgctgaatgaagatcctgtcccta

SEQ ID NO: 509155 - DNA, 25 bp, Rattus norvegicus
gtgctgaatgaagtccataggcttt

SEQ ID NO: 509156 - DNA, 25 bp, Rattus norvegicus
gtgctgacaagcctgatagcctgaa

SEQ ID NO: 509157 - DNA, 25 bp, Rattus norvegicus
gtgctgacaagcgtgatagcctgaa

SEQ ID NO: 509158 - DNA, 25 bp, Rattus norvegicus
gtgctgacaaggactactcttggaa

SEQ ID NO: 509159 - DNA, 25 bp, Rattus norvegicus
gtgctgacaaggtctactcttggaa

SEQ ID NO: 509160 - DNA, 25 bp, Rattus norvegicus
gtgctgacaattaagctgctcctcc

SEQ ID NO: 509161 - DNA, 25 bp, Rattus norvegicus
gtgctgacaatttagctgctcctcc

SEQ ID NO: 509162 - DNA, 25 bp, Rattus norvegicus
gtgctgacacacatctgttgtaacc

SEQ ID NO: 509163 - DNA, 25 bp, Rattus norvegicus
gtgctgacacacttctgttgtaacc

SEQ ID NO: 509164 - DNA, 25 bp, Rattus norvegicus
gtgctgacacgcagcattctgaata

SEQ ID NO: 509165 - DNA, 25 bp, Rattus norvegicus
gtgctgacacgctgcattctgaata

SEQ ID NO: 509166 - DNA, 25 bp, Rattus norvegicus
gtgctgacacttcgtctccctaaga

SEQ ID NO: 509167 - DNA, 25 bp, Rattus norvegicus
gtgctgacacttggtctccctaaga

SEQ ID NO: 509168 - DNA, 25 bp, Rattus norvegicus
gtgctgacagcaactggtgcagttc

SEQ ID NO: 509169 - DNA, 25 bp, Rattus norvegicus
gtgctgacagcatctggtgcagttc

SEQ ID NO: 509170 - DNA, 25 bp, Rattus norvegicus
gtgctgacagccattttaaccaaca

SEQ ID NO: 509171 - DNA, 25 bp, Rattus norvegicus
gtgctgacagcctttttaaccaaca

SEQ ID NO: 509172 - DNA, 25 bp, Rattus norvegicus
gtgctgacataaaaccatttctgat

SEQ ID NO: 509173 - DNA, 25 bp, Rattus norvegicus
gtgctgacataataccatttctgat

SEQ ID NO: 509174 - DNA, 25 bp, Rattus norvegicus
gtgctgacatataagcttacaggaa

SEQ ID NO: 509175 - DNA, 25 bp, Rattus norvegicus
gtgctgacatattagcttacaggaa

SEQ ID NO: 509176 - DNA, 25 bp, Rattus norvegicus
gtgctgaccaacatgatgtcttttt

SEQ ID NO: 509177 - DNA, 25 bp, Rattus norvegicus
gtgctgaccaacttgatgtcttttt

SEQ ID NO: 509178 - DNA, 25 bp, Rattus norvegicus
gtgctgaccacgactttatgagtcg

SEQ ID NO: 509179 - DNA, 25 bp, Rattus norvegicus
gtgctgaccacgtctttatgagtcg

SEQ ID NO: 509180 - DNA, 25 bp, Rattus norvegicus
gtgctgaccactagagatacatatt

SEQ ID NO: 509181 - DNA, 25 bp, Rattus norvegicus
gtgctgaccacttgagatacatatt

SEQ ID NO: 509182 - DNA, 25 bp, Rattus norvegicus
gtgctgaccatgatccagtgacgtc

SEQ ID NO: 509183 - DNA, 25 bp, Rattus norvegicus
gtgctgaccatgttccagtgacgtc

SEQ ID NO: 509184 - DNA, 25 bp, Rattus norvegicus
gtgctgacccgtcgtactgagactc

SEQ ID NO: 509185 - DNA, 25 bp, Rattus norvegicus
gtgctgacccgtggtactgagactc

SEQ ID NO: 509186 - DNA, 25 bp, Rattus norvegicus
gtgctgacccttaacatattttgct

SEQ ID NO: 509187 - DNA, 25 bp, Rattus norvegicus
gtgctgacccttctgattccaatga

SEQ ID NO: 509188 - DNA, 25 bp, Rattus norvegicus
gtgctgacccttgtgattccaatga

SEQ ID NO: 509189 - DNA, 25 bp, Rattus norvegicus
gtgctgaccctttacatattttgct

SEQ ID NO: 509190 - DNA, 25 bp, Rattus norvegicus
gtgctgacctcaaccaacaggatgt

SEQ ID NO: 509191 - DNA, 25 bp, Rattus norvegicus
gtgctgacctcatccaacaggatgt

SEQ ID NO: 509192 - DNA, 25 bp, Rattus norvegicus
gtgctgacgacacgatgttcctcat

SEQ ID NO: 509193 - DNA, 25 bp, Rattus norvegicus
gtgctgacgacaggatgttcctcat

SEQ ID NO: 509194 - DNA, 25 bp, Rattus norvegicus
gtgctgacgctgatcagactagcta

SEQ ID NO: 509195 - DNA, 25 bp, Rattus norvegicus
gtgctgacgctgttcagactagcta

SEQ ID NO: 509196 - DNA, 25 bp, Rattus norvegicus
gtgctgactgctattggagaaacca

SEQ ID NO: 509197 - DNA, 25 bp, Rattus norvegicus
gtgctgactgcttttggagaaacca

SEQ ID NO: 509198 - DNA, 25 bp, Rattus norvegicus
gtgctgactggacacttgtttcgat

SEQ ID NO: 509199 - DNA, 25 bp, Rattus norvegicus
gtgctgactggagacttgtttcgat

SEQ ID NO: 509200 - DNA, 25 bp, Rattus norvegicus
gtgctgactgggagacaagctatca

SEQ ID NO: 509201 - DNA, 25 bp, Rattus norvegicus
gtgctgactgggtgacaagctatca

SEQ ID NO: 509202 - DNA, 25 bp, Rattus norvegicus
gtgctgactgtaccgaaggcatgcc

SEQ ID NO: 509203 - DNA, 25 bp, Rattus norvegicus
gtgctgactgtagcgaaggcatgcc

SEQ ID NO: 509204 - DNA, 25 bp, Rattus norvegicus
gtgctgacttcaagtctctttttag

SEQ ID NO: 509205 - DNA, 25 bp, Rattus norvegicus
gtgctgacttcatgtctctttttag

SEQ ID NO: 509206 - DNA, 25 bp, Rattus norvegicus
gtgctgacttctatgttactacttg

SEQ ID NO: 509207 - DNA, 25 bp, Rattus norvegicus
gtgctgacttctttgttactacttg

SEQ ID NO: 509208 - DNA, 25 bp, Rattus norvegicus
gtgctgacttgtctactgttataca

SEQ ID NO: 509209 - DNA, 25 bp, Rattus norvegicus
gtgctgacttgtgtactgttataca

SEQ ID NO: 509210 - DNA, 25 bp, Rattus norvegicus
gtgctgagagacactggcttgtcag

SEQ ID NO: 509211 - DNA, 25 bp, Rattus norvegicus
gtgctgagagactctggcttgtcag

SEQ ID NO: 509212 - DNA, 25 bp, Rattus norvegicus
gtgctgagatacactggtaccacgc

SEQ ID NO: 509213 - DNA, 25 bp, Rattus norvegicus
gtgctgagatactctggtaccacgc

SEQ ID NO: 509214 - DNA, 25 bp, Rattus norvegicus
gtgctgagatttacctttaggtgtc

SEQ ID NO: 509215 - DNA, 25 bp, Rattus norvegicus
gtgctgagattttcctttaggtgtc

SEQ ID NO: 509216 - DNA, 25 bp, Rattus norvegicus
gtgctgagcagaatatggatgtact

SEQ ID NO: 509217 - DNA, 25 bp, Rattus norvegicus
gtgctgagcagattatggatgtact

SEQ ID NO: 509218 - DNA, 25 bp, Rattus norvegicus
gtgctgagcccactctttaataaag

SEQ ID NO: 509219 - DNA, 25 bp, Rattus norvegicus
gtgctgagcccagtctttaataaag

SEQ ID NO: 509220 - DNA, 25 bp, Rattus norvegicus
gtgctgagcgtaagaagtggttttc

SEQ ID NO: 509221 - DNA, 25 bp, Rattus norvegicus
gtgctgagcgtatgaagtggttttc

SEQ ID NO: 509222 - DNA, 25 bp, Rattus norvegicus
gtgctgagcgtcatccacacaagga

SEQ ID NO: 509223 - DNA, 25 bp, Rattus norvegicus
gtgctgagcgtcttccacacaagga

SEQ ID NO: 509224 - DNA, 25 bp, Rattus norvegicus
gtgctgagcttcacattgaactcta

SEQ ID NO: 509225 - DNA, 25 bp, Rattus norvegicus
gtgctgagcttctcattgaactcta

SEQ ID NO: 509226 - DNA, 25 bp, Rattus norvegicus
gtgctgaggaacagtgtcccgtgtt

SEQ ID NO: 509227 - DNA, 25 bp, Rattus norvegicus
gtgctgaggaactgtgtcccgtgtt

SEQ ID NO: 509228 - DNA, 25 bp, Rattus norvegicus
gtgctgagggaacacctggaaaaac

SEQ ID NO: 509229 - DNA, 25 bp, Rattus norvegicus
gtgctgagggaagacctggaaaaac

SEQ ID NO: 509230 - DNA, 25 bp, Rattus norvegicus
gtgctgagtaagcttccacttgtaa

SEQ ID NO: 509231 - DNA, 25 bp, Rattus norvegicus
gtgctgagtaaggttccacttgtaa

SEQ ID NO: 509232 - DNA, 25 bp, Rattus norvegicus
gtgctgagtataatgtccctccttt

SEQ ID NO: 509233 - DNA, 25 bp, Rattus norvegicus
gtgctgagtatattgtccctccttt

SEQ ID NO: 509234 - DNA, 25 bp, Rattus norvegicus
gtgctgagtctacggcacggatatt

SEQ ID NO: 509235 - DNA, 25 bp, Rattus norvegicus
gtgctgagtctagggcacggatatt

SEQ ID NO: 509236 - DNA, 25 bp, Rattus norvegicus
gtgctgagttttctggtcctttggc

SEQ ID NO: 509237 - DNA, 25 bp, Rattus norvegicus
gtgctgagttttgtggtcctttggc

SEQ ID NO: 509238 - DNA, 25 bp, Rattus norvegicus
gtgctgatccacaagccaaatgggt

SEQ ID NO: 509239 - DNA, 25 bp, Rattus norvegicus
gtgctgatccactagccaaatgggt

SEQ ID NO: 509240 - DNA, 25 bp, Rattus norvegicus
gtgctgatctacattttccagggca

SEQ ID NO: 509241 - DNA, 25 bp, Rattus norvegicus
gtgctgatctactttttccagggca

SEQ ID NO: 509242 - DNA, 25 bp, Rattus norvegicus
gtgctgatgacacccctgaggcttc

SEQ ID NO: 509243 - DNA, 25 bp, Rattus norvegicus
gtgctgatgacagccctgaggcttc

SEQ ID NO: 509244 - DNA, 25 bp, Rattus norvegicus
gtgctgatgattatcctctgttttt

SEQ ID NO: 509245 - DNA, 25 bp, Rattus norvegicus
gtgctgatgattttcctctgttttt

SEQ ID NO: 509246 - DNA, 25 bp, Rattus norvegicus
gtgctgatgccgactgatgttgaat

SEQ ID NO: 509247 - DNA, 25 bp, Rattus norvegicus
gtgctgatgccgtctgatgttgaat

SEQ ID NO: 509248 - DNA, 25 bp, Rattus norvegicus
gtgctgatggccatggtcaagaaaa

SEQ ID NO: 509249 - DNA, 25 bp, Rattus norvegicus
gtgctgatggccttggtcaagaaaa

SEQ ID NO: 509250 - DNA, 25 bp, Rattus norvegicus
gtgctgattcagctgggcgtcatcc

SEQ ID NO: 509251 - DNA, 25 bp, Rattus norvegicus
gtgctgattcaggtgggcgtcatcc

SEQ ID NO: 509252 - DNA, 25 bp, Rattus norvegicus
gtgctgattgatccccgtgactgcc

SEQ ID NO: 509253 - DNA, 25 bp, Rattus norvegicus
gtgctgattgatgcccgtgactgcc

SEQ ID NO: 509254 - DNA, 25 bp, Rattus norvegicus
gtgctgattgtgagattcactcctc

SEQ ID NO: 509255 - DNA, 25 bp, Rattus norvegicus
gtgctgattgtgtgattcactcctc

SEQ ID NO: 509256 - DNA, 25 bp, Rattus norvegicus
gtgctgatttggaatggctccacca

SEQ ID NO: 509257 - DNA, 25 bp, Rattus norvegicus
gtgctgatttggtatggctccacca

SEQ ID NO: 509258 - DNA, 25 bp, Rattus norvegicus
gtgctgcaagtgcttcctgctaaga

SEQ ID NO: 509259 - DNA, 25 bp, Rattus norvegicus
gtgctgcaagtggttcctgctaaga

SEQ ID NO: 509260 - DNA, 25 bp, Rattus norvegicus
gtgctgcacttaagtcaaagcctcc

SEQ ID NO: 509261 - DNA, 25 bp, Rattus norvegicus
gtgctgcacttatgtcaaagcctcc

SEQ ID NO: 509262 - DNA, 25 bp, Rattus norvegicus
gtgctgcagcacaactgaatctttc

SEQ ID NO: 509263 - DNA, 25 bp, Rattus norvegicus
gtgctgcagcactactgaatctttc

SEQ ID NO: 509264 - DNA, 25 bp, Rattus norvegicus
gtgctgcaggtcaaaccatgcctag

SEQ ID NO: 509265 - DNA, 25 bp, Rattus norvegicus
gtgctgcaggtctaaccatgcctag

SEQ ID NO: 509266 - DNA, 25 bp, Rattus norvegicus
gtgctgcagttacatcctggttcaa

SEQ ID NO: 509267 - DNA, 25 bp, Rattus norvegicus
gtgctgcagttagatcctggttcaa

SEQ ID NO: 509268 - DNA, 25 bp, Rattus norvegicus
gtgctgcatctaagtgcacttcata

SEQ ID NO: 509269 - DNA, 25 bp, Rattus norvegicus
gtgctgcatctatgtgcacttcata

SEQ ID NO: 509270 - DNA, 25 bp, Rattus norvegicus
gtgctgcatctcagtgttaaaacca

SEQ ID NO: 509271 - DNA, 25 bp, Rattus norvegicus
gtgctgcatctctgtgttaaaacca

SEQ ID NO: 509272 - DNA, 25 bp, Rattus norvegicus
gtgctgccaaggagcaggagcctca

SEQ ID NO: 509273 - DNA, 25 bp, Rattus norvegicus
gtgctgccaaggtgcaggagcctca

SEQ ID NO: 509274 - DNA, 25 bp, Rattus norvegicus
gtgctgccagctatgtgaaagtaca

SEQ ID NO: 509275 - DNA, 25 bp, Rattus norvegicus
gtgctgccagctttgtgaaagtaca

SEQ ID NO: 509276 - DNA, 25 bp, Rattus norvegicus
gtgctgccattcagtgcagtgtgta

SEQ ID NO: 509277 - DNA, 25 bp, Rattus norvegicus
gtgctgccattctgtgcagtgtgta

SEQ ID NO: 509278 - DNA, 25 bp, Rattus norvegicus
gtgctgcccagccagatccaggaaa

SEQ ID NO: 509279 - DNA, 25 bp, Rattus norvegicus
gtgctgcccagcgagatccaggaaa

SEQ ID NO: 509280 - DNA, 25 bp, Rattus norvegicus
gtgctgcccctcaggtgggacccag

SEQ ID NO: 509281 - DNA, 25 bp, Rattus norvegicus
gtgctgcccctctggtgggacccag

SEQ ID NO: 509282 - DNA, 25 bp, Rattus norvegicus
gtgctgccctaaatcttctgaaatg

SEQ ID NO: 509283 - DNA, 25 bp, Rattus norvegicus
gtgctgccctaattcttctgaaatg

SEQ ID NO: 509284 - DNA, 25 bp, Rattus norvegicus
gtgctgccgaacatcacagtaattt

SEQ ID NO: 509285 - DNA, 25 bp, Rattus norvegicus
gtgctgccgaacttcacagtaattt

SEQ ID NO: 509286 - DNA, 25 bp, Rattus norvegicus
gtgctgcctactacggtatctatga

SEQ ID NO: 509287 - DNA, 25 bp, Rattus norvegicus
gtgctgcctacttcggtatctatga

SEQ ID NO: 509288 - DNA, 25 bp, Rattus norvegicus
gtgctgcctcacaccaaaaaatggt

SEQ ID NO: 509289 - DNA, 25 bp, Rattus norvegicus
gtgctgcctcactccaaaaaatggt

SEQ ID NO: 509290 - DNA, 25 bp, Rattus norvegicus
gtgctgcctctgatttcctagaaga

SEQ ID NO: 509291 - DNA, 25 bp, Rattus norvegicus
gtgctgcctctgttttcctagaaga

SEQ ID NO: 509292 - DNA, 25 bp, Rattus norvegicus
gtgctgcctcttcatcaccagtggt

SEQ ID NO: 509293 - DNA, 25 bp, Rattus norvegicus
gtgctgcctcttgatcaccagtggt

SEQ ID NO: 509294 - DNA, 25 bp, Rattus norvegicus
gtgctgcgagctaacgtgtgaattc

SEQ ID NO: 509295 - DNA, 25 bp, Rattus norvegicus
gtgctgcgagcttacgtgtgaattc

SEQ ID NO: 509296 - DNA, 25 bp, Rattus norvegicus
gtgctgcgagttatgggcaaaccca

SEQ ID NO: 509297 - DNA, 25 bp, Rattus norvegicus
gtgctgcgagttttgggcaaaccca

SEQ ID NO: 509298 - DNA, 25 bp, Rattus norvegicus
gtgctgcggatcattatagccttta

SEQ ID NO: 509299 - DNA, 25 bp, Rattus norvegicus
gtgctgcggatctttatagccttta

SEQ ID NO: 509300 - DNA, 25 bp, Rattus norvegicus
gtgctgctacatcgattgctgcttt

SEQ ID NO: 509301 - DNA, 25 bp, Rattus norvegicus
gtgctgctacatggattgctgcttt

SEQ ID NO: 509302 - DNA, 25 bp, Rattus norvegicus
gtgctgctacgtctatcaattttta

SEQ ID NO: 509303 - DNA, 25 bp, Rattus norvegicus
gtgctgctacgtgtatcaattttta

SEQ ID NO: 509304 - DNA, 25 bp, Rattus norvegicus
gtgctgctcaaaaaccccgaggtgg

SEQ ID NO: 509305 - DNA, 25 bp, Rattus norvegicus
gtgctgctcaaataccccgaggtgg

SEQ ID NO: 509306 - DNA, 25 bp, Rattus norvegicus
gtgctgctccaaatgttctttctat

SEQ ID NO: 509307 - DNA, 25 bp, Rattus norvegicus
gtgctgctccaattgttctttctat

SEQ ID NO: 509308 - DNA, 25 bp, Rattus norvegicus
gtgctgctccacagaaaagcggaca

SEQ ID NO: 509309 - DNA, 25 bp, Rattus norvegicus
gtgctgctccactgaaaagcggaca

SEQ ID NO: 509310 - DNA, 25 bp, Rattus norvegicus
gtgctgctccagaactatggcatga

SEQ ID NO: 509311 - DNA, 25 bp, Rattus norvegicus
gtgctgctccagtactatggcatga

SEQ ID NO: 509312 - DNA, 25 bp, Rattus norvegicus
gtgctgctctatcactagtgtactt

SEQ ID NO: 509313 - DNA, 25 bp, Rattus norvegicus
gtgctgctctatgactagtgtactt

SEQ ID NO: 509314 - DNA, 25 bp, Rattus norvegicus
gtgctgctctgtactacagctgaaa

SEQ ID NO: 509315 - DNA, 25 bp, Rattus norvegicus
gtgctgctctgttctacagctgaaa

SEQ ID NO: 509316 - DNA, 25 bp, Rattus norvegicus
gtgctgctcttgatttgatgcccat

SEQ ID NO: 509317 - DNA, 25 bp, Rattus norvegicus
gtgctgctcttgttttgatgcccat

SEQ ID NO: 509318 - DNA, 25 bp, Rattus norvegicus
gtgctgctgctgctcatcgactatg

SEQ ID NO: 509319 - DNA, 25 bp, Rattus norvegicus
gtgctgctgctggtcatcgactatg

SEQ ID NO: 509320 - DNA, 25 bp, Rattus norvegicus
gtgctgctggagatcattatctgat

SEQ ID NO: 509321 - DNA, 25 bp, Rattus norvegicus
gtgctgctggagttcattatctgat

SEQ ID NO: 509322 - DNA, 25 bp, Rattus norvegicus
gtgctgctgtagcttagaacactgt

SEQ ID NO: 509323 - DNA, 25 bp, Rattus norvegicus
gtgctgctgtaggttagaacactgt

SEQ ID NO: 509324 - DNA, 25 bp, Rattus norvegicus
gtgctgctgtcacatagagtcccac

SEQ ID NO: 509325 - DNA, 25 bp, Rattus norvegicus
gtgctgctgtcagatagagtcccac

SEQ ID NO: 509326 - DNA, 25 bp, Rattus norvegicus
gtgctgctgtcgactgtgtcaagga

SEQ ID NO: 509327 - DNA, 25 bp, Rattus norvegicus
gtgctgctgtcgtctgtgtcaagga

SEQ ID NO: 509328 - DNA, 25 bp, Rattus norvegicus
gtgctgctgtctcttaaggattatc

SEQ ID NO: 509329 - DNA, 25 bp, Rattus norvegicus
gtgctgctgtctgttaaggattatc

SEQ ID NO: 509330 - DNA, 25 bp, Rattus norvegicus
gtgctgctgtggaaccctaatcccc

SEQ ID NO: 509331 - DNA, 25 bp, Rattus norvegicus
gtgctgctgtggtaccctaatcccc

SEQ ID NO: 509332 - DNA, 25 bp, Rattus norvegicus
gtgctgctgttactgcaactgctgt

SEQ ID NO: 509333 - DNA, 25 bp, Rattus norvegicus
gtgctgctgttagtgcaactgctgt

SEQ ID NO: 509334 - DNA, 25 bp, Rattus norvegicus
gtgctgcttcttctccaaggcttga

SEQ ID NO: 509335 - DNA, 25 bp, Rattus norvegicus
gtgctgcttcttgtccaaggcttga

SEQ ID NO: 509336 - DNA, 25 bp, Rattus norvegicus
gtgctgcttgacctgccagtaaaca

SEQ ID NO: 509337 - DNA, 25 bp, Rattus norvegicus
gtgctgcttgacgtgccagtaaaca

SEQ ID NO: 509338 - DNA, 25 bp, Rattus norvegicus
gtgctgctttaaactattatacttt

SEQ ID NO: 509339 - DNA, 25 bp, Rattus norvegicus
gtgctgctttaatctattatacttt

SEQ ID NO: 509340 - DNA, 25 bp, Rattus norvegicus
gtgctggaaagccagagttgactct

SEQ ID NO: 509341 - DNA, 25 bp, Rattus norvegicus
gtgctggaaagcgagagttgactct

SEQ ID NO: 509342 - DNA, 25 bp, Rattus norvegicus
gtgctggaaattcgacctgcgtcct

SEQ ID NO: 509343 - DNA, 25 bp, Rattus norvegicus
gtgctggaaattggacctgcgtcct

SEQ ID NO: 509344 - DNA, 25 bp, Rattus norvegicus
gtgctggaacttcccacgatgtgtt

SEQ ID NO: 509345 - DNA, 25 bp, Rattus norvegicus
gtgctggaacttgccacgatgtgtt

SEQ ID NO: 509346 - DNA, 25 bp, Rattus norvegicus
gtgctggaattgcaggcatacacca

SEQ ID NO: 509347 - DNA, 25 bp, Rattus norvegicus
gtgctggaattggaggcatacacca

SEQ ID NO: 509348 - DNA, 25 bp, Rattus norvegicus
gtgctggacaccagctggatccata

SEQ ID NO: 509349 - DNA, 25 bp, Rattus norvegicus
gtgctggacacctgctggatccata

SEQ ID NO: 509350 - DNA, 25 bp, Rattus norvegicus
gtgctggaccacatcaacattgaaa

SEQ ID NO: 509351 - DNA, 25 bp, Rattus norvegicus
gtgctggaccacttcaacattgaaa

SEQ ID NO: 509352 - DNA, 25 bp, Rattus norvegicus
gtgctggaccctcagtaacgtagga

SEQ ID NO: 509353 - DNA, 25 bp, Rattus norvegicus
gtgctggaccctgagtaacgtagga

SEQ ID NO: 509354 - DNA, 25 bp, Rattus norvegicus
gtgctggactgacaagatccactgt

SEQ ID NO: 509355 - DNA, 25 bp, Rattus norvegicus
gtgctggactgagaagatccactgt

SEQ ID NO: 509356 - DNA, 25 bp, Rattus norvegicus
gtgctggagcaaacacccgcctcta

SEQ ID NO: 509357 - DNA, 25 bp, Rattus norvegicus
gtgctggagcaatcacccgcctcta

SEQ ID NO: 509358 - DNA, 25 bp, Rattus norvegicus
gtgctggagccaccctgaaagcctg

SEQ ID NO: 509359 - DNA, 25 bp, Rattus norvegicus
gtgctggagccagcctgaaagcctg

SEQ ID NO: 509360 - DNA, 25 bp, Rattus norvegicus
gtgctggagctacaaaacgacctgc

SEQ ID NO: 509361 - DNA, 25 bp, Rattus norvegicus
gtgctggagctagaaaacgacctgc

SEQ ID NO: 509362 - DNA, 25 bp, Rattus norvegicus
gtgctggatcctacctagggatgga

SEQ ID NO: 509363 - DNA, 25 bp, Rattus norvegicus
gtgctggatccttcctagggatgga

SEQ ID NO: 509364 - DNA, 25 bp, Rattus norvegicus
gtgctggcaaacatacctcttggaa

SEQ ID NO: 509365 - DNA, 25 bp, Rattus norvegicus
gtgctggcaaacttacctcttggaa

SEQ ID NO: 509366 - DNA, 25 bp, Rattus norvegicus
gtgctggcaactactgtttgacgtc

SEQ ID NO: 509367 - DNA, 25 bp, Rattus norvegicus
gtgctggcaacttctgtttgacgtc

SEQ ID NO: 509368 - DNA, 25 bp, Rattus norvegicus
gtgctggcacatagcaagtcctctg

SEQ ID NO: 509369 - DNA, 25 bp, Rattus norvegicus
gtgctggcacattgcaagtcctctg

SEQ ID NO: 509370 - DNA, 25 bp, Rattus norvegicus
gtgctggcacttagtaggtcctcaa

SEQ ID NO: 509371 - DNA, 25 bp, Rattus norvegicus
gtgctggcactttgtaggtcctcaa

SEQ ID NO: 509372 - DNA, 25 bp, Rattus norvegicus
gtgctggcagccaacgtggttttca

SEQ ID NO: 509373 - DNA, 25 bp, Rattus norvegicus
gtgctggcagcctacgtggttttca

SEQ ID NO: 509374 - DNA, 25 bp, Rattus norvegicus
gtgctggcatgtatccacacatgca

SEQ ID NO: 509375 - DNA, 25 bp, Rattus norvegicus
gtgctggcatgtttccacacatgca

SEQ ID NO: 509376 - DNA, 25 bp, Rattus norvegicus
gtgctggccaccagaattattttgt

SEQ ID NO: 509377 - DNA, 25 bp, Rattus norvegicus
gtgctggccacctgaattattttgt

SEQ ID NO: 509378 - DNA, 25 bp, Rattus norvegicus
gtgctggccatcctggtgaattgct

SEQ ID NO: 509379 - DNA, 25 bp, Rattus norvegicus
gtgctggccatcgtggtgaattgct

SEQ ID NO: 509380 - DNA, 25 bp, Rattus norvegicus
gtgctggccctcatgagtgctgaga

SEQ ID NO: 509381 - DNA, 25 bp, Rattus norvegicus
gtgctggccctcttgagtgctgaga

SEQ ID NO: 509382 - DNA, 25 bp, Rattus norvegicus
gtgctggcctatcctttcagtgatc

SEQ ID NO: 509383 - DNA, 25 bp, Rattus norvegicus
gtgctggcctatgctttcagtgatc

SEQ ID NO: 509384 - DNA, 25 bp, Rattus norvegicus
gtgctggcgcacatgcttcgagttc

SEQ ID NO: 509385 - DNA, 25 bp, Rattus norvegicus
gtgctggcgcacttgcttcgagttc

SEQ ID NO: 509386 - DNA, 25 bp, Rattus norvegicus
gtgctggctaaccaagaacttgtta

SEQ ID NO: 509387 - DNA, 25 bp, Rattus norvegicus
gtgctggctaacgaagaacttgtta

SEQ ID NO: 509388 - DNA, 25 bp, Rattus norvegicus
gtgctggctctacgcccatgaggat

SEQ ID NO: 509389 - DNA, 25 bp, Rattus norvegicus
gtgctggctctaggcccatgaggat

SEQ ID NO: 509390 - DNA, 25 bp, Rattus norvegicus
gtgctggctgtcatgggcattgtac

SEQ ID NO: 509391 - DNA, 25 bp, Rattus norvegicus
gtgctggctgtcttgggcattgtac

SEQ ID NO: 509392 - DNA, 25 bp, Rattus norvegicus
gtgctgggaagcacatccattctaa

SEQ ID NO: 509393 - DNA, 25 bp, Rattus norvegicus
gtgctgggaagctcatccattctaa

SEQ ID NO: 509394 - DNA, 25 bp, Rattus norvegicus
gtgctgggaccaaaacaactgttct

SEQ ID NO: 509395 - DNA, 25 bp, Rattus norvegicus
gtgctgggaccataacaactgttct

SEQ ID NO: 509396 - DNA, 25 bp, Rattus norvegicus
gtgctgggagataaacccggacgct

SEQ ID NO: 509397 - DNA, 25 bp, Rattus norvegicus
gtgctgggagattaacccggacgct

SEQ ID NO: 509398 - DNA, 25 bp, Rattus norvegicus
gtgctgggcacacgaactgtatgtc

SEQ ID NO: 509399 - DNA, 25 bp, Rattus norvegicus
gtgctgggcacaggaactgtatgtc

SEQ ID NO: 509400 - DNA, 25 bp, Rattus norvegicus
gtgctgggcctaagtctcaagccag

SEQ ID NO: 509401 - DNA, 25 bp, Rattus norvegicus
gtgctgggcctatgtctcaagccag

SEQ ID NO: 509402 - DNA, 25 bp, Rattus norvegicus
gtgctgggtcggaattttgtacttg

SEQ ID NO: 509403 - DNA, 25 bp, Rattus norvegicus
gtgctgggtcggtattttgtacttg

SEQ ID NO: 509404 - DNA, 25 bp, Rattus norvegicus
gtgctgggtggtcatcagtcacaat

SEQ ID NO: 509405 - DNA, 25 bp, Rattus norvegicus
gtgctgggtggtgatcagtcacaat

SEQ ID NO: 509406 - DNA, 25 bp, Rattus norvegicus
gtgctgggtgtcagctaaaacttcc

SEQ ID NO: 509407 - DNA, 25 bp, Rattus norvegicus
gtgctgggtgtctgctaaaacttcc

SEQ ID NO: 509408 - DNA, 25 bp, Rattus norvegicus
gtgctgggttacacaccgcaagttc

SEQ ID NO: 509409 - DNA, 25 bp, Rattus norvegicus
gtgctgggttactcaccgcaagttc

SEQ ID NO: 509410 - DNA, 25 bp, Rattus norvegicus
gtgctggtaacaaagtcgggcccaa

SEQ ID NO: 509411 - DNA, 25 bp, Rattus norvegicus
gtgctggtaacatagtcgggcccaa

SEQ ID NO: 509412 - DNA, 25 bp, Rattus norvegicus
gtgctggtaattagaccctggtcct

SEQ ID NO: 509413 - DNA, 25 bp, Rattus norvegicus
gtgctggtaatttgaccctggtcct

SEQ ID NO: 509414 - DNA, 25 bp, Rattus norvegicus
gtgctggtagcaatgtctatgtgca

SEQ ID NO: 509415 - DNA, 25 bp, Rattus norvegicus
gtgctggtagcattgtctatgtgca

SEQ ID NO: 509416 - DNA, 25 bp, Rattus norvegicus
gtgctggtagtaaaagtctgctctc

SEQ ID NO: 509417 - DNA, 25 bp, Rattus norvegicus
gtgctggtagtataagtctgctctc

SEQ ID NO: 509418 - DNA, 25 bp, Rattus norvegicus
gtgctggtcaccagaacgccacagg

SEQ ID NO: 509419 - DNA, 25 bp, Rattus norvegicus
gtgctggtcacctgaacgccacagg

SEQ ID NO: 509420 - DNA, 25 bp, Rattus norvegicus
gtgctggtcattataatctttcgaa

SEQ ID NO: 509421 - DNA, 25 bp, Rattus norvegicus
gtgctggtcattttaatctttcgaa

SEQ ID NO: 509422 - DNA, 25 bp, Rattus norvegicus
gtgctggtcgtcacattcaggagtg

SEQ ID NO: 509423 - DNA, 25 bp, Rattus norvegicus
gtgctggtcgtctcattcaggagtg

SEQ ID NO: 509424 - DNA, 25 bp, Rattus norvegicus
gtgctggtgctaatctgaacactga

SEQ ID NO: 509425 - DNA, 25 bp, Rattus norvegicus
gtgctggtgctattctgaacactga

SEQ ID NO: 509426 - DNA, 25 bp, Rattus norvegicus
gtgctggtgcttctcaatcgtggtc

SEQ ID NO: 509427 - DNA, 25 bp, Rattus norvegicus
gtgctggtgcttgtcaatcgtggtc

SEQ ID NO: 509428 - DNA, 25 bp, Rattus norvegicus
gtgctggtgtggattcattgtttta

SEQ ID NO: 509429 - DNA, 25 bp, Rattus norvegicus
gtgctggtgtggtttcattgtttta

SEQ ID NO: 509430 - DNA, 25 bp, Rattus norvegicus
gtgctggttgccacattttagcaag

SEQ ID NO: 509431 - DNA, 25 bp, Rattus norvegicus
gtgctggttgcctcattttagcaag

SEQ ID NO: 509432 - DNA, 25 bp, Rattus norvegicus
gtgctggttggacacagagcctaca

SEQ ID NO: 509433 - DNA, 25 bp, Rattus norvegicus
gtgctggttggagacagagcctaca

SEQ ID NO: 509434 - DNA, 25 bp, Rattus norvegicus
gtgctggttggcactattaggatgt

SEQ ID NO: 509435 - DNA, 25 bp, Rattus norvegicus
gtgctggttggctctattaggatgt

SEQ ID NO: 509436 - DNA, 25 bp, Rattus norvegicus
gtgctggtttgaatgcatgctctat

SEQ ID NO: 509437 - DNA, 25 bp, Rattus norvegicus
gtgctggtttgattgcatgctctat

SEQ ID NO: 509438 - DNA, 25 bp, Rattus norvegicus
gtgctggttttgctcacaagccata

SEQ ID NO: 509439 - DNA, 25 bp, Rattus norvegicus
gtgctggttttggtcacaagccata

SEQ ID NO: 509440 - DNA, 25 bp, Rattus norvegicus
gtgctgtaaatcaggctgtggccgc

SEQ ID NO: 509441 - DNA, 25 bp, Rattus norvegicus
gtgctgtaaatctggctgtggccgc

SEQ ID NO: 509442 - DNA, 25 bp, Rattus norvegicus
gtgctgtaaggacccattcaccatt

SEQ ID NO: 509443 - DNA, 25 bp, Rattus norvegicus
gtgctgtaaggagccattcaccatt

SEQ ID NO: 509444 - DNA, 25 bp, Rattus norvegicus
gtgctgtacaagcaaccacaacatc

SEQ ID NO: 509445 - DNA, 25 bp, Rattus norvegicus
gtgctgtacaaggaaccacaacatc

SEQ ID NO: 509446 - DNA, 25 bp, Rattus norvegicus
gtgctgtacagaacactctcattaa

SEQ ID NO: 509447 - DNA, 25 bp, Rattus norvegicus
gtgctgtacagatcactctcattaa

SEQ ID NO: 509448 - DNA, 25 bp, Rattus norvegicus
gtgctgtacagccttttaaagtctg

SEQ ID NO: 509449 - DNA, 25 bp, Rattus norvegicus
gtgctgtacagcgttttaaagtctg

SEQ ID NO: 509450 - DNA, 25 bp, Rattus norvegicus
gtgctgtaccacacggaggacactc

SEQ ID NO: 509451 - DNA, 25 bp, Rattus norvegicus
gtgctgtaccactcggaggacactc

SEQ ID NO: 509452 - DNA, 25 bp, Rattus norvegicus
gtgctgtacctgctcattgggctga

SEQ ID NO: 509453 - DNA, 25 bp, Rattus norvegicus
gtgctgtacctggtcattgggctga

SEQ ID NO: 509454 - DNA, 25 bp, Rattus norvegicus
gtgctgtacgcccacatcaagatgg

SEQ ID NO: 509455 - DNA, 25 bp, Rattus norvegicus
gtgctgtacgccgacatcaagatgg

SEQ ID NO: 509456 - DNA, 25 bp, Rattus norvegicus
gtgctgtacttgcatgacatggata

SEQ ID NO: 509457 - DNA, 25 bp, Rattus norvegicus
gtgctgtacttggatgacatggata

SEQ ID NO: 509458 - DNA, 25 bp, Rattus norvegicus
gtgctgtagattatgacctcgcttt

SEQ ID NO: 509459 - DNA, 25 bp, Rattus norvegicus
gtgctgtagattttgacctcgcttt

SEQ ID NO: 509460 - DNA, 25 bp, Rattus norvegicus
gtgctgtatgaaatctgattggttt

SEQ ID NO: 509461 - DNA, 25 bp, Rattus norvegicus
gtgctgtatgaattctgattggttt

SEQ ID NO: 509462 - DNA, 25 bp, Rattus norvegicus
gtgctgtattctcctagctattata

SEQ ID NO: 509463 - DNA, 25 bp, Rattus norvegicus
gtgctgtattctgctagctattata

SEQ ID NO: 509464 - DNA, 25 bp, Rattus norvegicus
gtgctgtcacccagcagatgtccaa

SEQ ID NO: 509465 - DNA, 25 bp, Rattus norvegicus
gtgctgtcaccctgcagatgtccaa

SEQ ID NO: 509466 - DNA, 25 bp, Rattus norvegicus
gtgctgtcagcaccaataggctctg

SEQ ID NO: 509467 - DNA, 25 bp, Rattus norvegicus
gtgctgtcagcagcaataggctctg

SEQ ID NO: 509468 - DNA, 25 bp, Rattus norvegicus
gtgctgtcccgcaggacactggctt

SEQ ID NO: 509469 - DNA, 25 bp, Rattus norvegicus
gtgctgtcccgctggacactggctt

SEQ ID NO: 509470 - DNA, 25 bp, Rattus norvegicus
gtgctgtcctatcggtcactaatgg

SEQ ID NO: 509471 - DNA, 25 bp, Rattus norvegicus
gtgctgtcctatgggtcactaatgg

SEQ ID NO: 509472 - DNA, 25 bp, Rattus norvegicus
gtgctgtcctggcaagccacttaat

SEQ ID NO: 509473 - DNA, 25 bp, Rattus norvegicus
gtgctgtcctgggaagccacttaat

SEQ ID NO: 509474 - DNA, 25 bp, Rattus norvegicus
gtgctgtcctgtcgagggagggcgt

SEQ ID NO: 509475 - DNA, 25 bp, Rattus norvegicus
gtgctgtcctgtggagggagggcgt

SEQ ID NO: 509476 - DNA, 25 bp, Rattus norvegicus
gtgctgtctgcaatttcttggagaa

SEQ ID NO: 509477 - DNA, 25 bp, Rattus norvegicus
gtgctgtctgcattttcttggagaa

SEQ ID NO: 509478 - DNA, 25 bp, Rattus norvegicus
gtgctgtctttcatcctctaggaag

SEQ ID NO: 509479 - DNA, 25 bp, Rattus norvegicus
gtgctgtctttcttcctctaggaag

SEQ ID NO: 509480 - DNA, 25 bp, Rattus norvegicus
gtgctgtgacacctgtaattcatct

SEQ ID NO: 509481 - DNA, 25 bp, Rattus norvegicus
gtgctgtgacacgtgtaattcatct

SEQ ID NO: 509482 - DNA, 25 bp, Rattus norvegicus
gtgctgtgacagagttgcggaccca

SEQ ID NO: 509483 - DNA, 25 bp, Rattus norvegicus
gtgctgtgacagtgttgcggaccca

SEQ ID NO: 509484 - DNA, 25 bp, Rattus norvegicus
gtgctgtgactcattcttagtgctc

SEQ ID NO: 509485 - DNA, 25 bp, Rattus norvegicus
gtgctgtgactctttcttagtgctc

SEQ ID NO: 509486 - DNA, 25 bp, Rattus norvegicus
gtgctgtgcaacaccaccataaaga

SEQ ID NO: 509487 - DNA, 25 bp, Rattus norvegicus
gtgctgtgcaactccaccataaaga

SEQ ID NO: 509488 - DNA, 25 bp, Rattus norvegicus
gtgctgtgcactcagttgaacccca

SEQ ID NO: 509489 - DNA, 25 bp, Rattus norvegicus
gtgctgtgcactgagttgaacccca

SEQ ID NO: 509490 - DNA, 25 bp, Rattus norvegicus
gtgctgtgcagcaacaccagtgtgc

SEQ ID NO: 509491 - DNA, 25 bp, Rattus norvegicus
gtgctgtgcagctacaccagtgtgc

SEQ ID NO: 509492 - DNA, 25 bp, Rattus norvegicus
gtgctgtgcatgagtatcgccacca

SEQ ID NO: 509493 - DNA, 25 bp, Rattus norvegicus
gtgctgtgcatgtgtatcgccacca

SEQ ID NO: 509494 - DNA, 25 bp, Rattus norvegicus
gtgctgtgccataaggtagtgccca

SEQ ID NO: 509495 - DNA, 25 bp, Rattus norvegicus
gtgctgtgccattaggtagtgccca

SEQ ID NO: 509496 - DNA, 25 bp, Rattus norvegicus
gtgctgtgcgttagggctctgccaa

SEQ ID NO: 509497 - DNA, 25 bp, Rattus norvegicus
gtgctgtgcgtttgggctctgccaa

SEQ ID NO: 509498 - DNA, 25 bp, Rattus norvegicus
gtgctgtgctcacaacaagccttaa

SEQ ID NO: 509499 - DNA, 25 bp, Rattus norvegicus
gtgctgtgctcagaacaagccttaa

SEQ ID NO: 509500 - DNA, 25 bp, Rattus norvegicus
gtgctgtggcgcaggctatccatgt

SEQ ID NO: 509501 - DNA, 25 bp, Rattus norvegicus
gtgctgtggcgctggctatccatgt

SEQ ID NO: 509502 - DNA, 25 bp, Rattus norvegicus
gtgctgtggctcattgagtatcacc

SEQ ID NO: 509503 - DNA, 25 bp, Rattus norvegicus
gtgctgtggctctttgagtatcacc

SEQ ID NO: 509504 - DNA, 25 bp, Rattus norvegicus
gtgctgtgggaaccaaccaaggaca

SEQ ID NO: 509505 - DNA, 25 bp, Rattus norvegicus
gtgctgtgggaagcaaccaaggaca

SEQ ID NO: 509506 - DNA, 25 bp, Rattus norvegicus
gtgctgtgggacacacggtgacaca

SEQ ID NO: 509507 - DNA, 25 bp, Rattus norvegicus
gtgctgtgggactcacggtgacaca

SEQ ID NO: 509508 - DNA, 25 bp, Rattus norvegicus
gtgctgtggtgaagcctctggctca

SEQ ID NO: 509509 - DNA, 25 bp, Rattus norvegicus
gtgctgtggtgatgcctctggctca

SEQ ID NO: 509510 - DNA, 25 bp, Rattus norvegicus
gtgctgtggttcctggagtacctca

SEQ ID NO: 509511 - DNA, 25 bp, Rattus norvegicus
gtgctgtggttcgtggagtacctca

SEQ ID NO: 509512 - DNA, 25 bp, Rattus norvegicus
gtgctgtgtaacatcatctgtcgag

SEQ ID NO: 509513 - DNA, 25 bp, Rattus norvegicus
gtgctgtgtaacttcatctgtcgag

SEQ ID NO: 509514 - DNA, 25 bp, Rattus norvegicus
gtgctgtgtacaccattgctaacca

SEQ ID NO: 509515 - DNA, 25 bp, Rattus norvegicus
gtgctgtgtacagcattgctaacca

SEQ ID NO: 509516 - DNA, 25 bp, Rattus norvegicus
gtgctgtgtatcaccacctggtctt

SEQ ID NO: 509517 - DNA, 25 bp, Rattus norvegicus
gtgctgtgtatctccacctggtctt

SEQ ID NO: 509518 - DNA, 25 bp, Rattus norvegicus
gtgctgtgtcagagttgtgcacatt

SEQ ID NO: 509519 - DNA, 25 bp, Rattus norvegicus
gtgctgtgtcagtgttgtgcacatt

SEQ ID NO: 509520 - DNA, 25 bp, Rattus norvegicus
gtgctgtgtccaaggatatcaccaa

SEQ ID NO: 509521 - DNA, 25 bp, Rattus norvegicus
gtgctgtgtccatggatatcaccaa

SEQ ID NO: 509522 - DNA, 25 bp, Rattus norvegicus
gtgctgtgtcggatttgtccaggaa

SEQ ID NO: 509523 - DNA, 25 bp, Rattus norvegicus
gtgctgtgtcggttttgtccaggaa

SEQ ID NO: 509524 - DNA, 25 bp, Rattus norvegicus
gtgctgtgtgaaccaggaaccttct

SEQ ID NO: 509525 - DNA, 25 bp, Rattus norvegicus
gtgctgtgtgaagcaggaaccttct

SEQ ID NO: 509526 - DNA, 25 bp, Rattus norvegicus
gtgctgtgtgatcggtgcccaggga

SEQ ID NO: 509527 - DNA, 25 bp, Rattus norvegicus
gtgctgtgtgatgggtgcccaggga

SEQ ID NO: 509528 - DNA, 25 bp, Rattus norvegicus
gtgctgtgtgcccagcttctgagaa

SEQ ID NO: 509529 - DNA, 25 bp, Rattus norvegicus
gtgctgtgtgccgagcttctgagaa

SEQ ID NO: 509530 - DNA, 25 bp, Rattus norvegicus
gtgctgtgtgttctgtggcttacat

SEQ ID NO: 509531 - DNA, 25 bp, Rattus norvegicus
gtgctgtgtgttgtgtggcttacat

SEQ ID NO: 509532 - DNA, 25 bp, Rattus norvegicus
gtgctgtgttacattgagtctgttc

SEQ ID NO: 509533 - DNA, 25 bp, Rattus norvegicus
gtgctgtgttactttgagtctgttc

SEQ ID NO: 509534 - DNA, 25 bp, Rattus norvegicus
gtgctgtgttatacctgggttttaa

SEQ ID NO: 509535 - DNA, 25 bp, Rattus norvegicus
gtgctgtgttattcctgggttttaa

SEQ ID NO: 509536 - DNA, 25 bp, Rattus norvegicus
gtgctgtgttcccagaagctcaacc

SEQ ID NO: 509537 - DNA, 25 bp, Rattus norvegicus
gtgctgtgttccgagaagctcaacc

SEQ ID NO: 509538 - DNA, 25 bp, Rattus norvegicus
gtgctgtgtttaatcagtattagct

SEQ ID NO: 509539 - DNA, 25 bp, Rattus norvegicus
gtgctgtgtttattcagtattagct

SEQ ID NO: 509540 - DNA, 25 bp, Rattus norvegicus
gtgctgttaatcactggttgtttac

SEQ ID NO: 509541 - DNA, 25 bp, Rattus norvegicus
gtgctgttaatctctggttgtttac

SEQ ID NO: 509542 - DNA, 25 bp, Rattus norvegicus
gtgctgttacagactgctgggactc

SEQ ID NO: 509543 - DNA, 25 bp, Rattus norvegicus
gtgctgttacagtctgctgggactc

SEQ ID NO: 509544 - DNA, 25 bp, Rattus norvegicus
gtgctgttaccgaccaggatacaaa

SEQ ID NO: 509545 - DNA, 25 bp, Rattus norvegicus
gtgctgttaccgtccaggatacaaa

SEQ ID NO: 509546 - DNA, 25 bp, Rattus norvegicus
gtgctgttacgtcgacaccttttaa

SEQ ID NO: 509547 - DNA, 25 bp, Rattus norvegicus
gtgctgttacgtggacaccttttaa

SEQ ID NO: 509548 - DNA, 25 bp, Rattus norvegicus
gtgctgttcagcctatgagtaccat

SEQ ID NO: 509549 - DNA, 25 bp, Rattus norvegicus
gtgctgttcagcgtatgagtaccat

SEQ ID NO: 509550 - DNA, 25 bp, Rattus norvegicus
gtgctgttccataactgacaccatg

SEQ ID NO: 509551 - DNA, 25 bp, Rattus norvegicus
gtgctgttccattactgacaccatg

SEQ ID NO: 509552 - DNA, 25 bp, Rattus norvegicus
gtgctgttctccaagagccaagcag

SEQ ID NO: 509553 - DNA, 25 bp, Rattus norvegicus
gtgctgttctcctagagccaagcag

SEQ ID NO: 509554 - DNA, 25 bp, Rattus norvegicus
gtgctgttctgacagagccacgttt

SEQ ID NO: 509555 - DNA, 25 bp, Rattus norvegicus
gtgctgttctgagagagccacgttt

SEQ ID NO: 509556 - DNA, 25 bp, Rattus norvegicus
gtgctgttctgcagatgcctttaat

SEQ ID NO: 509557 - DNA, 25 bp, Rattus norvegicus
gtgctgttctgctgatgcctttaat

SEQ ID NO: 509558 - DNA, 25 bp, Rattus norvegicus
gtgctgttctttccagatgacacct

SEQ ID NO: 509559 - DNA, 25 bp, Rattus norvegicus
gtgctgttctttgcagatgacacct

SEQ ID NO: 509560 - DNA, 25 bp, Rattus norvegicus
gtgctgttgacgagccactggtaaa

SEQ ID NO: 509561 - DNA, 25 bp, Rattus norvegicus
gtgctgttgacgtgccactggtaaa

SEQ ID NO: 509562 - DNA, 25 bp, Rattus norvegicus
gtgctgttgctgacatcaggacgga

SEQ ID NO: 509563 - DNA, 25 bp, Rattus norvegicus
gtgctgttgctgtcatcaggacgga

SEQ ID NO: 509564 - DNA, 25 bp, Rattus norvegicus
gtgctgtttcacaacttgttcttat

SEQ ID NO: 509565 - DNA, 25 bp, Rattus norvegicus
gtgctgtttcactacttgttcttat

SEQ ID NO: 509566 - DNA, 25 bp, Rattus norvegicus
gtgctgtttcggcaaagtcactttc

SEQ ID NO: 509567 - DNA, 25 bp, Rattus norvegicus
gtgctgtttcgggaaagtcactttc

SEQ ID NO: 509568 - DNA, 25 bp, Rattus norvegicus
gtgctgtttcttacaccaaaatgtt

SEQ ID NO: 509569 - DNA, 25 bp, Rattus norvegicus
gtgctgtttctttcaccaaaatgtt

SEQ ID NO: 509570 - DNA, 25 bp, Rattus norvegicus
gtgctgtttttcctttaaaatcatt

SEQ ID NO: 509571 - DNA, 25 bp, Rattus norvegicus
gtgctgtttttcgtttaaaatcatt

SEQ ID NO: 509572 - DNA, 25 bp, Rattus norvegicus
gtgcttaaatcaagtgcatctttgg

SEQ ID NO: 509573 - DNA, 25 bp, Rattus norvegicus
gtgcttaaatcatgtgcatctttgg

SEQ ID NO: 509574 - DNA, 25 bp, Rattus norvegicus
gtgcttaacatgacaaaggaaggca

SEQ ID NO: 509575 - DNA, 25 bp, Rattus norvegicus
gtgcttaacatgtcaaaggaaggca

SEQ ID NO: 509576 - DNA, 25 bp, Rattus norvegicus
gtgcttaacttcaaccctagagtct

SEQ ID NO: 509577 - DNA, 25 bp, Rattus norvegicus
gtgcttaacttctaccctagagtct

SEQ ID NO: 509578 - DNA, 25 bp, Rattus norvegicus
gtgcttaatcatacttcatccaaat

SEQ ID NO: 509579 - DNA, 25 bp, Rattus norvegicus
gtgcttaatcattcttcatccaaat

SEQ ID NO: 509580 - DNA, 25 bp, Rattus norvegicus
gtgcttaatgggatcctttattctt

SEQ ID NO: 509581 - DNA, 25 bp, Rattus norvegicus
gtgcttaatgggttcctttattctt

SEQ ID NO: 509582 - DNA, 25 bp, Rattus norvegicus
gtgcttaattgtccccttttttctg

SEQ ID NO: 509583 - DNA, 25 bp, Rattus norvegicus
gtgcttaattgtgcccttttttctg

SEQ ID NO: 509584 - DNA, 25 bp, Rattus norvegicus
gtgcttaccagcagtcactgaagct

SEQ ID NO: 509585 - DNA, 25 bp, Rattus norvegicus
gtgcttaccagctgtcactgaagct

SEQ ID NO: 509586 - DNA, 25 bp, Rattus norvegicus
gtgcttacctgtaaaatactccctt

SEQ ID NO: 509587 - DNA, 25 bp, Rattus norvegicus
gtgcttacctgttaaatactccctt

SEQ ID NO: 509588 - DNA, 25 bp, Rattus norvegicus
gtgcttactgtaacataaaggtgtc

SEQ ID NO: 509589 - DNA, 25 bp, Rattus norvegicus
gtgcttactgtatcataaaggtgtc

SEQ ID NO: 509590 - DNA, 25 bp, Rattus norvegicus
gtgcttacttacagagggcggcgac

SEQ ID NO: 509591 - DNA, 25 bp, Rattus norvegicus
gtgcttacttactgagggcggcgac

SEQ ID NO: 509592 - DNA, 25 bp, Rattus norvegicus
gtgcttactttgaggtaacacccta

SEQ ID NO: 509593 - DNA, 25 bp, Rattus norvegicus
gtgcttactttgataatctgccatt

SEQ ID NO: 509594 - DNA, 25 bp, Rattus norvegicus
gtgcttactttgtggtaacacccta

SEQ ID NO: 509595 - DNA, 25 bp, Rattus norvegicus
gtgcttactttgttaatctgccatt

SEQ ID NO: 509596 - DNA, 25 bp, Rattus norvegicus
gtgcttacttttctatgtctgcttt

SEQ ID NO: 509597 - DNA, 25 bp, Rattus norvegicus
gtgcttacttttgtatgtctgcttt

SEQ ID NO: 509598 - DNA, 25 bp, Rattus norvegicus
gtgcttagacagacccacggagcag

SEQ ID NO: 509599 - DNA, 25 bp, Rattus norvegicus
gtgcttagacagtcccacggagcag

SEQ ID NO: 509600 - DNA, 25 bp, Rattus norvegicus
gtgcttagaccaactctatcgtact

SEQ ID NO: 509601 - DNA, 25 bp, Rattus norvegicus
gtgcttagaccatctctatcgtact

SEQ ID NO: 509602 - DNA, 25 bp, Rattus norvegicus
gtgcttagcagaatgatgttcattt

SEQ ID NO: 509603 - DNA, 25 bp, Rattus norvegicus
gtgcttagcagattgatgttcattt

SEQ ID NO: 509604 - DNA, 25 bp, Rattus norvegicus
gtgcttagcaggagacacagttcct

SEQ ID NO: 509605 - DNA, 25 bp, Rattus norvegicus
gtgcttagcaggtgacacagttcct

SEQ ID NO: 509606 - DNA, 25 bp, Rattus norvegicus
gtgcttagccctcctgatttgggaa

SEQ ID NO: 509607 - DNA, 25 bp, Rattus norvegicus
gtgcttagccctgctgatttgggaa

SEQ ID NO: 509608 - DNA, 25 bp, Rattus norvegicus
gtgcttagtctgaagctgagtgtat

SEQ ID NO: 509609 - DNA, 25 bp, Rattus norvegicus
gtgcttagtctgtagctgagtgtat

SEQ ID NO: 509610 - DNA, 25 bp, Rattus norvegicus
gtgcttataaacattcttccaggat

SEQ ID NO: 509611 - DNA, 25 bp, Rattus norvegicus
gtgcttataaactttcttccaggat

SEQ ID NO: 509612 - DNA, 25 bp, Rattus norvegicus
gtgcttataagtactgtttgtctaa

SEQ ID NO: 509613 - DNA, 25 bp, Rattus norvegicus
gtgcttataagttctgtttgtctaa

SEQ ID NO: 509614 - DNA, 25 bp, Rattus norvegicus
gtgcttatccacaacaattccatta

SEQ ID NO: 509615 - DNA, 25 bp, Rattus norvegicus
gtgcttatccactacaattccatta

SEQ ID NO: 509616 - DNA, 25 bp, Rattus norvegicus
gtgcttatcctgactatgtttacat

SEQ ID NO: 509617 - DNA, 25 bp, Rattus norvegicus
gtgcttatcctgtctatgtttacat

SEQ ID NO: 509618 - DNA, 25 bp, Rattus norvegicus
gtgcttatctgcctatctttggaat

SEQ ID NO: 509619 - DNA, 25 bp, Rattus norvegicus
gtgcttatctgcgtatctttggaat

SEQ ID NO: 509620 - DNA, 25 bp, Rattus norvegicus
gtgcttatgagcaaccatgtgtgtt

SEQ ID NO: 509621 - DNA, 25 bp, Rattus norvegicus
gtgcttatgagctaccatgtgtgtt

SEQ ID NO: 509622 - DNA, 25 bp, Rattus norvegicus
gtgcttatgtgccagccctgtgtta

SEQ ID NO: 509623 - DNA, 25 bp, Rattus norvegicus
gtgcttatgtgcgagccctgtgtta

SEQ ID NO: 509624 - DNA, 25 bp, Rattus norvegicus
gtgcttattataaaggctggagaac

SEQ ID NO: 509625 - DNA, 25 bp, Rattus norvegicus
gtgcttattatataggctggagaac

SEQ ID NO: 509626 - DNA, 25 bp, Rattus norvegicus
gtgcttattctcaacttcatgttta

SEQ ID NO: 509627 - DNA, 25 bp, Rattus norvegicus
gtgcttattctctacttcatgttta

SEQ ID NO: 509628 - DNA, 25 bp, Rattus norvegicus
gtgcttatttcgatctttgctagag

SEQ ID NO: 509629 - DNA, 25 bp, Rattus norvegicus
gtgcttatttcgttctttgctagag

SEQ ID NO: 509630 - DNA, 25 bp, Rattus norvegicus
gtgcttcaacagatcaaagacagtg

SEQ ID NO: 509631 - DNA, 25 bp, Rattus norvegicus
gtgcttcaacagttcaaagacagtg

SEQ ID NO: 509632 - DNA, 25 bp, Rattus norvegicus
gtgcttcaagagctccactggttgg

SEQ ID NO: 509633 - DNA, 25 bp, Rattus norvegicus
gtgcttcaagaggtccactggttgg

SEQ ID NO: 509634 - DNA, 25 bp, Rattus norvegicus
gtgcttcaagctactagaactccaa

SEQ ID NO: 509635 - DNA, 25 bp, Rattus norvegicus
gtgcttcaagcttctagaactccaa

SEQ ID NO: 509636 - DNA, 25 bp, Rattus norvegicus
gtgcttcactgtcactgtagtccca

SEQ ID NO: 509637 - DNA, 25 bp, Rattus norvegicus
gtgcttcactgtgactgtagtccca

SEQ ID NO: 509638 - DNA, 25 bp, Rattus norvegicus
gtgcttcagacactggctttctcaa

SEQ ID NO: 509639 - DNA, 25 bp, Rattus norvegicus
gtgcttcagacagtggctttctcaa

SEQ ID NO: 509640 - DNA, 25 bp, Rattus norvegicus
gtgcttcagcatagatgatctcgga

SEQ ID NO: 509641 - DNA, 25 bp, Rattus norvegicus
gtgcttcagcattgatgatctcgga

SEQ ID NO: 509642 - DNA, 25 bp, Rattus norvegicus
gtgcttcaggccatgaaatcgtttt

SEQ ID NO: 509643 - DNA, 25 bp, Rattus norvegicus
gtgcttcaggccttgaaatcgtttt

SEQ ID NO: 509644 - DNA, 25 bp, Rattus norvegicus
gtgcttcagggcagaattcctccag

SEQ ID NO: 509645 - DNA, 25 bp, Rattus norvegicus
gtgcttcagggctgaattcctccag

SEQ ID NO: 509646 - DNA, 25 bp, Rattus norvegicus
gtgcttcagtttattgatctcgagt

SEQ ID NO: 509647 - DNA, 25 bp, Rattus norvegicus
gtgcttcagttttttgatctcgagt

SEQ ID NO: 509648 - DNA, 25 bp, Rattus norvegicus
gtgcttcatagcaacgggctgcata

SEQ ID NO: 509649 - DNA, 25 bp, Rattus norvegicus
gtgcttcatagctacgggctgcata

SEQ ID NO: 509650 - DNA, 25 bp, Rattus norvegicus
gtgcttcatcaacgaccaactcatg

SEQ ID NO: 509651 - DNA, 25 bp, Rattus norvegicus
gtgcttcatcaaggaccaactcatg

SEQ ID NO: 509652 - DNA, 25 bp, Rattus norvegicus
gtgcttcatcccattctggtttgag

SEQ ID NO: 509653 - DNA, 25 bp, Rattus norvegicus
gtgcttcatccctttctggtttgag

SEQ ID NO: 509654 - DNA, 25 bp, Rattus norvegicus
gtgcttcatgttcgctactcacaca

SEQ ID NO: 509655 - DNA, 25 bp, Rattus norvegicus
gtgcttcatgttggctactcacaca

SEQ ID NO: 509656 - DNA, 25 bp, Rattus norvegicus
gtgcttcatttaacagcttctgctg

SEQ ID NO: 509657 - DNA, 25 bp, Rattus norvegicus
gtgcttcatttatcagcttctgctg

SEQ ID NO: 509658 - DNA, 25 bp, Rattus norvegicus
gtgcttcatttccttggtgtgccca

SEQ ID NO: 509659 - DNA, 25 bp, Rattus norvegicus
gtgcttcatttcgttggtgtgccca

SEQ ID NO: 509660 - DNA, 25 bp, Rattus norvegicus
gtgcttccaaatcgtttgatgacat

SEQ ID NO: 509661 - DNA, 25 bp, Rattus norvegicus
gtgcttccaaatggtttgatgacat

SEQ ID NO: 509662 - DNA, 25 bp, Rattus norvegicus
gtgcttccaacaagctaattaatta

SEQ ID NO: 509663 - DNA, 25 bp, Rattus norvegicus
gtgcttccaacacactaaataggga

SEQ ID NO: 509664 - DNA, 25 bp, Rattus norvegicus
gtgcttccaacagactaaataggga

SEQ ID NO: 509665 - DNA, 25 bp, Rattus norvegicus
gtgcttccaacatgctaattaatta

SEQ ID NO: 509666 - DNA, 25 bp, Rattus norvegicus
gtgcttccaggaactaaatgtcttt

SEQ ID NO: 509667 - DNA, 25 bp, Rattus norvegicus
gtgcttccaggatctaaatgtcttt

SEQ ID NO: 509668 - DNA, 25 bp, Rattus norvegicus
gtgcttcccaagaagatcttatcgt

SEQ ID NO: 509669 - DNA, 25 bp, Rattus norvegicus
gtgcttcccaagtagatcttatcgt

SEQ ID NO: 509670 - DNA, 25 bp, Rattus norvegicus
gtgcttcccatgcactatcgtcaat

SEQ ID NO: 509671 - DNA, 25 bp, Rattus norvegicus
gtgcttcccatgctggatgatgtct

SEQ ID NO: 509672 - DNA, 25 bp, Rattus norvegicus
gtgcttcccatggactatcgtcaat

SEQ ID NO: 509673 - DNA, 25 bp, Rattus norvegicus
gtgcttcccatggtggatgatgtct

SEQ ID NO: 509674 - DNA, 25 bp, Rattus norvegicus
gtgcttcccgtgctgctgttgatgc

SEQ ID NO: 509675 - DNA, 25 bp, Rattus norvegicus
gtgcttcccgtggtgctgttgatgc

SEQ ID NO: 509676 - DNA, 25 bp, Rattus norvegicus
gtgcttccctctcttatggctatat

SEQ ID NO: 509677 - DNA, 25 bp, Rattus norvegicus
gtgcttccctctgttatggctatat

SEQ ID NO: 509678 - DNA, 25 bp, Rattus norvegicus
gtgcttccggtgcaacagtacccag

SEQ ID NO: 509679 - DNA, 25 bp, Rattus norvegicus
gtgcttccggtggaacagtacccag

SEQ ID NO: 509680 - DNA, 25 bp, Rattus norvegicus
gtgcttccgttaatttctgagggta

SEQ ID NO: 509681 - DNA, 25 bp, Rattus norvegicus
gtgcttccgttattttctgagggta

SEQ ID NO: 509682 - DNA, 25 bp, Rattus norvegicus
gtgcttcctactacttcgagatcag

SEQ ID NO: 509683 - DNA, 25 bp, Rattus norvegicus
gtgcttcctacttcttcgagatcag

SEQ ID NO: 509684 - DNA, 25 bp, Rattus norvegicus
gtgcttcctgccataagtgacaagt

SEQ ID NO: 509685 - DNA, 25 bp, Rattus norvegicus
gtgcttcctgccttaagtgacaagt

SEQ ID NO: 509686 - DNA, 25 bp, Rattus norvegicus
gtgcttccttccctaacacgggtga

SEQ ID NO: 509687 - DNA, 25 bp, Rattus norvegicus
gtgcttccttccgtaacacgggtga

SEQ ID NO: 509688 - DNA, 25 bp, Rattus norvegicus
gtgcttcgcatgaacagggccacac

SEQ ID NO: 509689 - DNA, 25 bp, Rattus norvegicus
gtgcttcgcatgtacagggccacac

SEQ ID NO: 509690 - DNA, 25 bp, Rattus norvegicus
gtgcttcgcctgaccaagatgtgac

SEQ ID NO: 509691 - DNA, 25 bp, Rattus norvegicus
gtgcttcgcctgtccaagatgtgac

SEQ ID NO: 509692 - DNA, 25 bp, Rattus norvegicus
gtgcttcgcgtgactggatatctaa

SEQ ID NO: 509693 - DNA, 25 bp, Rattus norvegicus
gtgcttcgcgtgtctggatatctaa

SEQ ID NO: 509694 - DNA, 25 bp, Rattus norvegicus
gtgcttcgctttctgaaaggccaat

SEQ ID NO: 509695 - DNA, 25 bp, Rattus norvegicus
gtgcttcgctttgtgaaaggccaat

SEQ ID NO: 509696 - DNA, 25 bp, Rattus norvegicus
gtgcttcgggctatatagggctgaa

SEQ ID NO: 509697 - DNA, 25 bp, Rattus norvegicus
gtgcttcgggctttatagggctgaa

SEQ ID NO: 509698 - DNA, 25 bp, Rattus norvegicus
gtgcttcgtcaaattttaacgtgaa

SEQ ID NO: 509699 - DNA, 25 bp, Rattus norvegicus
gtgcttcgtcaatttttaacgtgaa

SEQ ID NO: 509700 - DNA, 25 bp, Rattus norvegicus
gtgcttctaactcgccagctttcaa

SEQ ID NO: 509701 - DNA, 25 bp, Rattus norvegicus
gtgcttctaactggccagctttcaa

SEQ ID NO: 509702 - DNA, 25 bp, Rattus norvegicus
gtgcttctagagaaactcagttgta

SEQ ID NO: 509703 - DNA, 25 bp, Rattus norvegicus
gtgcttctagagtaactcagttgta

SEQ ID NO: 509704 - DNA, 25 bp, Rattus norvegicus
gtgcttctagctcacttgattctaa

SEQ ID NO: 509705 - DNA, 25 bp, Rattus norvegicus
gtgcttctagctgacttgattctaa

SEQ ID NO: 509706 - DNA, 25 bp, Rattus norvegicus
gtgcttctcgtcctgactgaagtag

SEQ ID NO: 509707 - DNA, 25 bp, Rattus norvegicus
gtgcttctcgtcgtgactgaagtag

SEQ ID NO: 509708 - DNA, 25 bp, Rattus norvegicus
gtgcttctcgttaaatcacctttac

SEQ ID NO: 509709 - DNA, 25 bp, Rattus norvegicus
gtgcttctcgtttaatcacctttac

SEQ ID NO: 509710 - DNA, 25 bp, Rattus norvegicus
gtgcttctctcaccctttcaagaaa

SEQ ID NO: 509711 - DNA, 25 bp, Rattus norvegicus
gtgcttctctcagcctttcaagaaa

SEQ ID NO: 509712 - DNA, 25 bp, Rattus norvegicus
gtgcttctctgcattatgcatcagg

SEQ ID NO: 509713 - DNA, 25 bp, Rattus norvegicus
gtgcttctctgctttatgcatcagg

SEQ ID NO: 509714 - DNA, 25 bp, Rattus norvegicus
gtgcttctgaagaccaaacgatgta

SEQ ID NO: 509715 - DNA, 25 bp, Rattus norvegicus
gtgcttctgaagtccaaacgatgta

SEQ ID NO: 509716 - DNA, 25 bp, Rattus norvegicus
gtgcttctgagaaggacgacgaccc

SEQ ID NO: 509717 - DNA, 25 bp, Rattus norvegicus
gtgcttctgagatggacgacgaccc

SEQ ID NO: 509718 - DNA, 25 bp, Rattus norvegicus
gtgcttctgagcaaaggccaaggaa

SEQ ID NO: 509719 - DNA, 25 bp, Rattus norvegicus
gtgcttctgagctaaggccaaggaa

SEQ ID NO: 509720 - DNA, 25 bp, Rattus norvegicus
gtgcttctgcacacgtgtatgcgta

SEQ ID NO: 509721 - DNA, 25 bp, Rattus norvegicus
gtgcttctgcactcgtgtatgcgta

SEQ ID NO: 509722 - DNA, 25 bp, Rattus norvegicus
gtgcttctgcccaaagtggtcaaca

SEQ ID NO: 509723 - DNA, 25 bp, Rattus norvegicus
gtgcttctgccctaagtggtcaaca

SEQ ID NO: 509724 - DNA, 25 bp, Rattus norvegicus
gtgcttctggacactagatcaggcc

SEQ ID NO: 509725 - DNA, 25 bp, Rattus norvegicus
gtgcttctggactctagatcaggcc

SEQ ID NO: 509726 - DNA, 25 bp, Rattus norvegicus
gtgcttctggccaagctacttggga

SEQ ID NO: 509727 - DNA, 25 bp, Rattus norvegicus
gtgcttctggcctagctacttggga

SEQ ID NO: 509728 - DNA, 25 bp, Rattus norvegicus
gtgcttctgggtatttgtatcatgt

SEQ ID NO: 509729 - DNA, 25 bp, Rattus norvegicus
gtgcttctgggtttttgtatcatgt

SEQ ID NO: 509730 - DNA, 25 bp, Rattus norvegicus
gtgcttctgtaacttcctgatgcat

SEQ ID NO: 509731 - DNA, 25 bp, Rattus norvegicus
gtgcttctgtaagttcctgatgcat

SEQ ID NO: 509732 - DNA, 25 bp, Rattus norvegicus
gtgcttctgtagacacaatcttctg

SEQ ID NO: 509733 - DNA, 25 bp, Rattus norvegicus
gtgcttctgtagtcacaatcttctg

SEQ ID NO: 509734 - DNA, 25 bp, Rattus norvegicus
gtgcttctgtgaatacacttctttt

SEQ ID NO: 509735 - DNA, 25 bp, Rattus norvegicus
gtgcttctgtgattacacttctttt

SEQ ID NO: 509736 - DNA, 25 bp, Rattus norvegicus
gtgcttctgtgcaaaccttgtttaa

SEQ ID NO: 509737 - DNA, 25 bp, Rattus norvegicus
gtgcttctgtgctaaccttgtttaa

SEQ ID NO: 509738 - DNA, 25 bp, Rattus norvegicus
gtgcttcttcaactacatacactga

SEQ ID NO: 509739 - DNA, 25 bp, Rattus norvegicus
gtgcttcttcaagtacatacactga

SEQ ID NO: 509740 - DNA, 25 bp, Rattus norvegicus
gtgcttcttctaattataaggttga

SEQ ID NO: 509741 - DNA, 25 bp, Rattus norvegicus
gtgcttcttctactaagtatcgctc

SEQ ID NO: 509742 - DNA, 25 bp, Rattus norvegicus
gtgcttcttctagtaagtatcgctc

SEQ ID NO: 509743 - DNA, 25 bp, Rattus norvegicus
gtgcttcttctatttataaggttga

SEQ ID NO: 509744 - DNA, 25 bp, Rattus norvegicus
gtgcttcttgccctcgtaggtaatg

SEQ ID NO: 509745 - DNA, 25 bp, Rattus norvegicus
gtgcttcttgccgtcgtaggtaatg

SEQ ID NO: 509746 - DNA, 25 bp, Rattus norvegicus
gtgcttcttgttagagaacttcctt

SEQ ID NO: 509747 - DNA, 25 bp, Rattus norvegicus
gtgcttcttgtttgagaacttcctt

SEQ ID NO: 509748 - DNA, 25 bp, Rattus norvegicus
gtgcttctttgtcctaatacatggg

SEQ ID NO: 509749 - DNA, 25 bp, Rattus norvegicus
gtgcttctttgtgctaatacatggg

SEQ ID NO: 509750 - DNA, 25 bp, Rattus norvegicus
gtgcttgaaaatctgctttccttct

SEQ ID NO: 509751 - DNA, 25 bp, Rattus norvegicus
gtgcttgaaaatgtgctttccttct

SEQ ID NO: 509752 - DNA, 25 bp, Rattus norvegicus
gtgcttgaaagtcggcaggtcctct

SEQ ID NO: 509753 - DNA, 25 bp, Rattus norvegicus
gtgcttgaaagtgggcaggtcctct

SEQ ID NO: 509754 - DNA, 25 bp, Rattus norvegicus
gtgcttgaagatacaggcttgcgtt

SEQ ID NO: 509755 - DNA, 25 bp, Rattus norvegicus
gtgcttgaagattcaggcttgcgtt

SEQ ID NO: 509756 - DNA, 25 bp, Rattus norvegicus
gtgcttgaatttagccaggctcctc

SEQ ID NO: 509757 - DNA, 25 bp, Rattus norvegicus
gtgcttgaattttgccaggctcctc

SEQ ID NO: 509758 - DNA, 25 bp, Rattus norvegicus
gtgcttgacttgctcacaacatgtt

SEQ ID NO: 509759 - DNA, 25 bp, Rattus norvegicus
gtgcttgacttggtcacaacatgtt

SEQ ID NO: 509760 - DNA, 25 bp, Rattus norvegicus
gtgcttgagagaaaactccctccct

SEQ ID NO: 509761 - DNA, 25 bp, Rattus norvegicus
gtgcttgagagataactccctccct

SEQ ID NO: 509762 - DNA, 25 bp, Rattus norvegicus
gtgcttgatcaaatgtctgtcccag

SEQ ID NO: 509763 - DNA, 25 bp, Rattus norvegicus
gtgcttgatcaattgtctgtcccag

SEQ ID NO: 509764 - DNA, 25 bp, Rattus norvegicus
gtgcttgatcacagaatccattccc

SEQ ID NO: 509765 - DNA, 25 bp, Rattus norvegicus
gtgcttgatcactgaatccattccc

SEQ ID NO: 509766 - DNA, 25 bp, Rattus norvegicus
gtgcttgcaaggacagttggcttat

SEQ ID NO: 509767 - DNA, 25 bp, Rattus norvegicus
gtgcttgcaaggtcagttggcttat

SEQ ID NO: 509768 - DNA, 25 bp, Rattus norvegicus
gtgcttgcacagattttagtcattc

SEQ ID NO: 509769 - DNA, 25 bp, Rattus norvegicus
gtgcttgcacagtttttagtcattc

SEQ ID NO: 509770 - DNA, 25 bp, Rattus norvegicus
gtgcttgcaccaatgacgctggtaa

SEQ ID NO: 509771 - DNA, 25 bp, Rattus norvegicus
gtgcttgcaccattgacgctggtaa

SEQ ID NO: 509772 - DNA, 25 bp, Rattus norvegicus
gtgcttgcatgcatttggacgagag

SEQ ID NO: 509773 - DNA, 25 bp, Rattus norvegicus
gtgcttgcatgcttttggacgagag

SEQ ID NO: 509774 - DNA, 25 bp, Rattus norvegicus
gtgcttgccaataggctatggttct

SEQ ID NO: 509775 - DNA, 25 bp, Rattus norvegicus
gtgcttgccaattggctatggttct

SEQ ID NO: 509776 - DNA, 25 bp, Rattus norvegicus
gtgcttgccaccaaaaggatgtcca

SEQ ID NO: 509777 - DNA, 25 bp, Rattus norvegicus
gtgcttgccacctaaaggatgtcca

SEQ ID NO: 509778 - DNA, 25 bp, Rattus norvegicus
gtgcttgccctgcttttagagacta

SEQ ID NO: 509779 - DNA, 25 bp, Rattus norvegicus
gtgcttgccctggttttagagacta

SEQ ID NO: 509780 - DNA, 25 bp, Rattus norvegicus
gtgcttgcctgaccacactaaggag

SEQ ID NO: 509781 - DNA, 25 bp, Rattus norvegicus
gtgcttgcctgagcacactaaggag

SEQ ID NO: 509782 - DNA, 25 bp, Rattus norvegicus
gtgcttgcctgtaaaatttgcattt

SEQ ID NO: 509783 - DNA, 25 bp, Rattus norvegicus
gtgcttgcctgtctttttcaacttg

SEQ ID NO: 509784 - DNA, 25 bp, Rattus norvegicus
gtgcttgcctgtgtttttcaacttg

SEQ ID NO: 509785 - DNA, 25 bp, Rattus norvegicus
gtgcttgcctgttaaatttgcattt

SEQ ID NO: 509786 - DNA, 25 bp, Rattus norvegicus
gtgcttgccttgagcatcaataaac

SEQ ID NO: 509787 - DNA, 25 bp, Rattus norvegicus
gtgcttgccttgtgcatcaataaac

SEQ ID NO: 509788 - DNA, 25 bp, Rattus norvegicus
gtgcttgctaaaatgattcttctta

SEQ ID NO: 509789 - DNA, 25 bp, Rattus norvegicus
gtgcttgctaaattgattcttctta

SEQ ID NO: 509790 - DNA, 25 bp, Rattus norvegicus
gtgcttgctcaacttcccaaatatg

SEQ ID NO: 509791 - DNA, 25 bp, Rattus norvegicus
gtgcttgctcaagttcccaaatatg

SEQ ID NO: 509792 - DNA, 25 bp, Rattus norvegicus
gtgcttgctcaccataacaacacta

SEQ ID NO: 509793 - DNA, 25 bp, Rattus norvegicus
gtgcttgctcacgataacaacacta

SEQ ID NO: 509794 - DNA, 25 bp, Rattus norvegicus
gtgcttgctcagaagtgattcttct

SEQ ID NO: 509795 - DNA, 25 bp, Rattus norvegicus
gtgcttgctcagtagtgattcttct

SEQ ID NO: 509796 - DNA, 25 bp, Rattus norvegicus
gtgcttgctgggaagacttttcatc

SEQ ID NO: 509797 - DNA, 25 bp, Rattus norvegicus
gtgcttgctgggtagacttttcatc

SEQ ID NO: 509798 - DNA, 25 bp, Rattus norvegicus
gtgcttgctgttaggacagactact

SEQ ID NO: 509799 - DNA, 25 bp, Rattus norvegicus
gtgcttgctgttattcagaccccct

SEQ ID NO: 509800 - DNA, 25 bp, Rattus norvegicus
gtgcttgctgtttggacagactact

SEQ ID NO: 509801 - DNA, 25 bp, Rattus norvegicus
gtgcttgctgtttttcagaccccct

SEQ ID NO: 509802 - DNA, 25 bp, Rattus norvegicus
gtgcttgcttaacatcctgttgcat

SEQ ID NO: 509803 - DNA, 25 bp, Rattus norvegicus
gtgcttgcttaagatcctgttgcat

SEQ ID NO: 509804 - DNA, 25 bp, Rattus norvegicus
gtgcttgcttagagtgcctggcaga

SEQ ID NO: 509805 - DNA, 25 bp, Rattus norvegicus
gtgcttgcttagtgtgcctggcaga

SEQ ID NO: 509806 - DNA, 25 bp, Rattus norvegicus
gtgcttggaacacagcgagtgctca

SEQ ID NO: 509807 - DNA, 25 bp, Rattus norvegicus
gtgcttggaacagagcgagtgctca

SEQ ID NO: 509808 - DNA, 25 bp, Rattus norvegicus
gtgcttggaagcacgtgacatccgg

SEQ ID NO: 509809 - DNA, 25 bp, Rattus norvegicus
gtgcttggaagctcgtgacatccgg

SEQ ID NO: 509810 - DNA, 25 bp, Rattus norvegicus
gtgcttggaagtagctgtgccacgc

SEQ ID NO: 509811 - DNA, 25 bp, Rattus norvegicus
gtgcttggaagttgctgtgccacgc

SEQ ID NO: 509812 - DNA, 25 bp, Rattus norvegicus
gtgcttggacataggcttgggccac

SEQ ID NO: 509813 - DNA, 25 bp, Rattus norvegicus
gtgcttggacattggcttgggccac

SEQ ID NO: 509814 - DNA, 25 bp, Rattus norvegicus
gtgcttggacctaaaggacttttca

SEQ ID NO: 509815 - DNA, 25 bp, Rattus norvegicus
gtgcttggaccttaaggacttttca

SEQ ID NO: 509816 - DNA, 25 bp, Rattus norvegicus
gtgcttggactgagctggcatttaa

SEQ ID NO: 509817 - DNA, 25 bp, Rattus norvegicus
gtgcttggactgtgctggcatttaa

SEQ ID NO: 509818 - DNA, 25 bp, Rattus norvegicus
gtgcttggagtcagcacccaagaat

SEQ ID NO: 509819 - DNA, 25 bp, Rattus norvegicus
gtgcttggagtctgcacccaagaat

SEQ ID NO: 509820 - DNA, 25 bp, Rattus norvegicus
gtgcttggatacaataataccttaa

SEQ ID NO: 509821 - DNA, 25 bp, Rattus norvegicus
gtgcttggatactataataccttaa

SEQ ID NO: 509822 - DNA, 25 bp, Rattus norvegicus
gtgcttggcacaaggtattactgtt

SEQ ID NO: 509823 - DNA, 25 bp, Rattus norvegicus
gtgcttggcacatggtattactgtt

SEQ ID NO: 509824 - DNA, 25 bp, Rattus norvegicus
gtgcttggcctactctacaattgtt

SEQ ID NO: 509825 - DNA, 25 bp, Rattus norvegicus
gtgcttggcctagtctacaattgtt

SEQ ID NO: 509826 - DNA, 25 bp, Rattus norvegicus
gtgcttggcctgattttatcacatc

SEQ ID NO: 509827 - DNA, 25 bp, Rattus norvegicus
gtgcttggcctgtttttatcacatc

SEQ ID NO: 509828 - DNA, 25 bp, Rattus norvegicus
gtgcttggctacaacttttgtcaat

SEQ ID NO: 509829 - DNA, 25 bp, Rattus norvegicus
gtgcttggctactacttttgtcaat

SEQ ID NO: 509830 - DNA, 25 bp, Rattus norvegicus
gtgcttggctttcaattgtatgttt

SEQ ID NO: 509831 - DNA, 25 bp, Rattus norvegicus
gtgcttggctttgaattgtatgttt

SEQ ID NO: 509832 - DNA, 25 bp, Rattus norvegicus
gtgcttgggaatcccctcaggactt

SEQ ID NO: 509833 - DNA, 25 bp, Rattus norvegicus
gtgcttgggaatgccctcaggactt

SEQ ID NO: 509834 - DNA, 25 bp, Rattus norvegicus
gtgcttgggcacacaataaatcagt

SEQ ID NO: 509835 - DNA, 25 bp, Rattus norvegicus
gtgcttgggcactcaataaatcagt

SEQ ID NO: 509836 - DNA, 25 bp, Rattus norvegicus
gtgcttgggtgcattgtacagagat

SEQ ID NO: 509837 - DNA, 25 bp, Rattus norvegicus
gtgcttgggtgctttgtacagagat

SEQ ID NO: 509838 - DNA, 25 bp, Rattus norvegicus
gtgcttggtctcatatgacccacat

SEQ ID NO: 509839 - DNA, 25 bp, Rattus norvegicus
gtgcttggtctcttatgacccacat

SEQ ID NO: 509840 - DNA, 25 bp, Rattus norvegicus
gtgcttggtgagacgtggttctaaa

SEQ ID NO: 509841 - DNA, 25 bp, Rattus norvegicus
gtgcttggtgagtcgtggttctaaa

SEQ ID NO: 509842 - DNA, 25 bp, Rattus norvegicus
gtgcttggtgatcttagacttcatt

SEQ ID NO: 509843 - DNA, 25 bp, Rattus norvegicus
gtgcttggtgatgttagacttcatt

SEQ ID NO: 509844 - DNA, 25 bp, Rattus norvegicus
gtgcttggtggacctgttttagcca

SEQ ID NO: 509845 - DNA, 25 bp, Rattus norvegicus
gtgcttggtggagctgttttagcca

SEQ ID NO: 509846 - DNA, 25 bp, Rattus norvegicus
gtgcttggtgtcattgcatgacatg

SEQ ID NO: 509847 - DNA, 25 bp, Rattus norvegicus
gtgcttggtgtctttgcatgacatg

SEQ ID NO: 509848 - DNA, 25 bp, Rattus norvegicus
gtgcttggtgttctcaaggcaaagt

SEQ ID NO: 509849 - DNA, 25 bp, Rattus norvegicus
gtgcttggtgttgtcaaggcaaagt

SEQ ID NO: 509850 - DNA, 25 bp, Rattus norvegicus
gtgcttgtcagtacgctggtagtga

SEQ ID NO: 509851 - DNA, 25 bp, Rattus norvegicus
gtgcttgtcagttcgctggtagtga

SEQ ID NO: 509852 - DNA, 25 bp, Rattus norvegicus
gtgcttgtcctgcaaatgagcccct

SEQ ID NO: 509853 - DNA, 25 bp, Rattus norvegicus
gtgcttgtcctggaaatgagcccct

SEQ ID NO: 509854 - DNA, 25 bp, Rattus norvegicus
gtgcttgtccttcgttaacatcaga

SEQ ID NO: 509855 - DNA, 25 bp, Rattus norvegicus
gtgcttgtccttggttaacatcaga

SEQ ID NO: 509856 - DNA, 25 bp, Rattus norvegicus
gtgcttgtcgatctcttcttactgc

SEQ ID NO: 509857 - DNA, 25 bp, Rattus norvegicus
gtgcttgtcgatgtcttcttactgc

SEQ ID NO: 509858 - DNA, 25 bp, Rattus norvegicus
gtgcttgtctggcatcttccgggcc

SEQ ID NO: 509859 - DNA, 25 bp, Rattus norvegicus
gtgcttgtctgggatcttccgggcc

SEQ ID NO: 509860 - DNA, 25 bp, Rattus norvegicus
gtgcttgtgaccctaataaattcca

SEQ ID NO: 509861 - DNA, 25 bp, Rattus norvegicus
gtgcttgtgaccgtaataaattcca

SEQ ID NO: 509862 - DNA, 25 bp, Rattus norvegicus
gtgcttgtgactacattgtggccaa

SEQ ID NO: 509863 - DNA, 25 bp, Rattus norvegicus
gtgcttgtgacttcattgtggccaa

SEQ ID NO: 509864 - DNA, 25 bp, Rattus norvegicus
gtgcttgtgagtcacctaccaaact

SEQ ID NO: 509865 - DNA, 25 bp, Rattus norvegicus
gtgcttgtgagtgacctaccaaact

SEQ ID NO: 509866 - DNA, 25 bp, Rattus norvegicus
gtgcttgtgtgtacgcaggaagacc

SEQ ID NO: 509867 - DNA, 25 bp, Rattus norvegicus
gtgcttgtgtgttcgcaggaagacc

SEQ ID NO: 509868 - DNA, 25 bp, Rattus norvegicus
gtgcttgttaaacacttgccttgtg

SEQ ID NO: 509869 - DNA, 25 bp, Rattus norvegicus
gtgcttgttaaagacttgccttgtg

SEQ ID NO: 509870 - DNA, 25 bp, Rattus norvegicus
gtgcttgttacccttagtgtcctaa

SEQ ID NO: 509871 - DNA, 25 bp, Rattus norvegicus
gtgcttgttaccgttagtgtcctaa

SEQ ID NO: 509872 - DNA, 25 bp, Rattus norvegicus
gtgcttgttactaatttacttgtta

SEQ ID NO: 509873 - DNA, 25 bp, Rattus norvegicus
gtgcttgttacttatttacttgtta

SEQ ID NO: 509874 - DNA, 25 bp, Rattus norvegicus
gtgcttgttccaaagggcagatcct

SEQ ID NO: 509875 - DNA, 25 bp, Rattus norvegicus
gtgcttgttccatagggcagatcct

SEQ ID NO: 509876 - DNA, 25 bp, Rattus norvegicus
gtgcttgttccgcagtgaaagtcac

SEQ ID NO: 509877 - DNA, 25 bp, Rattus norvegicus
gtgcttgttccggagtgaaagtcac

SEQ ID NO: 509878 - DNA, 25 bp, Rattus norvegicus
gtgcttgttgaacctttataagtag

SEQ ID NO: 509879 - DNA, 25 bp, Rattus norvegicus
gtgcttgttgaagctttataagtag

SEQ ID NO: 509880 - DNA, 25 bp, Rattus norvegicus
gtgcttgtttccctatcatgcaata

SEQ ID NO: 509881 - DNA, 25 bp, Rattus norvegicus
gtgcttgtttccgtatcatgcaata

SEQ ID NO: 509882 - DNA, 25 bp, Rattus norvegicus
gtgctttaaagcacaaggatgcctc

SEQ ID NO: 509883 - DNA, 25 bp, Rattus norvegicus
gtgctttaaagcctttgtacacagg

SEQ ID NO: 509884 - DNA, 25 bp, Rattus norvegicus
gtgctttaaagcgtttgtacacagg

SEQ ID NO: 509885 - DNA, 25 bp, Rattus norvegicus
gtgctttaaagctcaaggatgcctc

SEQ ID NO: 509886 - DNA, 25 bp, Rattus norvegicus
gtgctttaagcaagcctaagaggta

SEQ ID NO: 509887 - DNA, 25 bp, Rattus norvegicus
gtgctttaagcatgcctaagaggta

SEQ ID NO: 509888 - DNA, 25 bp, Rattus norvegicus
gtgctttaataaactgactgccttt

SEQ ID NO: 509889 - DNA, 25 bp, Rattus norvegicus
gtgctttaataatctgactgccttt

SEQ ID NO: 509890 - DNA, 25 bp, Rattus norvegicus
gtgctttaatttaacaaccctggcg

SEQ ID NO: 509891 - DNA, 25 bp, Rattus norvegicus
gtgctttaattttacaaccctggcg

SEQ ID NO: 509892 - DNA, 25 bp, Rattus norvegicus
gtgctttacaggctaagttgttcaa

SEQ ID NO: 509893 - DNA, 25 bp, Rattus norvegicus
gtgctttacagggtaagttgttcaa

SEQ ID NO: 509894 - DNA, 25 bp, Rattus norvegicus
gtgctttacagtaggcatcctggga

SEQ ID NO: 509895 - DNA, 25 bp, Rattus norvegicus
gtgctttacagttggcatcctggga

SEQ ID NO: 509896 - DNA, 25 bp, Rattus norvegicus
gtgctttacgttaggacacctttgt

SEQ ID NO: 509897 - DNA, 25 bp, Rattus norvegicus
gtgctttacgtttggacacctttgt

SEQ ID NO: 509898 - DNA, 25 bp, Rattus norvegicus
gtgctttactatatccttttgctta

SEQ ID NO: 509899 - DNA, 25 bp, Rattus norvegicus
gtgctttactatttccttttgctta

SEQ ID NO: 509900 - DNA, 25 bp, Rattus norvegicus
gtgctttactctaattaatttctga

SEQ ID NO: 509901 - DNA, 25 bp, Rattus norvegicus
gtgctttactcttattaatttctga

SEQ ID NO: 509902 - DNA, 25 bp, Rattus norvegicus
gtgctttaggaaattattgacagtt

SEQ ID NO: 509903 - DNA, 25 bp, Rattus norvegicus
gtgctttaggaatttattgacagtt

SEQ ID NO: 509904 - DNA, 25 bp, Rattus norvegicus
gtgctttagtcaaagcagccttctg

SEQ ID NO: 509905 - DNA, 25 bp, Rattus norvegicus
gtgctttagtcatagcagccttctg

SEQ ID NO: 509906 - DNA, 25 bp, Rattus norvegicus
gtgctttatatcatgtacctctgta

SEQ ID NO: 509907 - DNA, 25 bp, Rattus norvegicus
gtgctttatatcttgtacctctgta

SEQ ID NO: 509908 - DNA, 25 bp, Rattus norvegicus
gtgctttatcaccatctgttgtttg

SEQ ID NO: 509909 - DNA, 25 bp, Rattus norvegicus
gtgctttatcacgatctgttgtttg

SEQ ID NO: 509910 - DNA, 25 bp, Rattus norvegicus
gtgctttatggcaggcgcaaactcg

SEQ ID NO: 509911 - DNA, 25 bp, Rattus norvegicus
gtgctttatggctggcgcaaactcg

SEQ ID NO: 509912 - DNA, 25 bp, Rattus norvegicus
gtgctttcaaaacttacatgtttgt

SEQ ID NO: 509913 - DNA, 25 bp, Rattus norvegicus
gtgctttcaaaagttacatgtttgt

SEQ ID NO: 509914 - DNA, 25 bp, Rattus norvegicus
gtgctttcagcacacccaggagatg

SEQ ID NO: 509915 - DNA, 25 bp, Rattus norvegicus
gtgctttcagcagacccaggagatg

SEQ ID NO: 509916 - DNA, 25 bp, Rattus norvegicus
gtgctttcagtaacatatacaggtt

SEQ ID NO: 509917 - DNA, 25 bp, Rattus norvegicus
gtgctttcagtatcatatacaggtt

SEQ ID NO: 509918 - DNA, 25 bp, Rattus norvegicus
gtgctttccacaaagctcaggatgt

SEQ ID NO: 509919 - DNA, 25 bp, Rattus norvegicus
gtgctttccacaatactatgcattt

SEQ ID NO: 509920 - DNA, 25 bp, Rattus norvegicus
gtgctttccacaattgtttttctct

SEQ ID NO: 509921 - DNA, 25 bp, Rattus norvegicus
gtgctttccacactggttcaaggac

SEQ ID NO: 509922 - DNA, 25 bp, Rattus norvegicus
gtgctttccacagtggttcaaggac

SEQ ID NO: 509923 - DNA, 25 bp, Rattus norvegicus
gtgctttccacatagctcaggatgt

SEQ ID NO: 509924 - DNA, 25 bp, Rattus norvegicus
gtgctttccacattactatgcattt

SEQ ID NO: 509925 - DNA, 25 bp, Rattus norvegicus
gtgctttccacatttgtttttctct

SEQ ID NO: 509926 - DNA, 25 bp, Rattus norvegicus
gtgctttccagcaggattgagctca

SEQ ID NO: 509927 - DNA, 25 bp, Rattus norvegicus
gtgctttccagctggattgagctca

SEQ ID NO: 509928 - DNA, 25 bp, Rattus norvegicus
gtgctttccatcagactgctgttca

SEQ ID NO: 509929 - DNA, 25 bp, Rattus norvegicus
gtgctttccatcctagccaataaga

SEQ ID NO: 509930 - DNA, 25 bp, Rattus norvegicus
gtgctttccatcgtagccaataaga

SEQ ID NO: 509931 - DNA, 25 bp, Rattus norvegicus
gtgctttccatctgactgctgttca

SEQ ID NO: 509932 - DNA, 25 bp, Rattus norvegicus
gtgctttcccgaactgtgttagaca

SEQ ID NO: 509933 - DNA, 25 bp, Rattus norvegicus
gtgctttcccgatctgtgttagaca

SEQ ID NO: 509934 - DNA, 25 bp, Rattus norvegicus
gtgctttccgcgaacagaagtgctt

SEQ ID NO: 509935 - DNA, 25 bp, Rattus norvegicus
gtgctttccgcgtacagaagtgctt

SEQ ID NO: 509936 - DNA, 25 bp, Rattus norvegicus
gtgctttccttcaaagcgatcatgg

SEQ ID NO: 509937 - DNA, 25 bp, Rattus norvegicus
gtgctttccttctaagcgatcatgg

SEQ ID NO: 509938 - DNA, 25 bp, Rattus norvegicus
gtgctttcgtttcttttcttacaag

SEQ ID NO: 509939 - DNA, 25 bp, Rattus norvegicus
gtgctttcgtttgttttcttacaag

SEQ ID NO: 509940 - DNA, 25 bp, Rattus norvegicus
gtgctttctcacctcttatcataga

SEQ ID NO: 509941 - DNA, 25 bp, Rattus norvegicus
gtgctttctcacgtcttatcataga

SEQ ID NO: 509942 - DNA, 25 bp, Rattus norvegicus
gtgctttctcatagcgttggttaac

SEQ ID NO: 509943 - DNA, 25 bp, Rattus norvegicus
gtgctttctcattgcgttggttaac

SEQ ID NO: 509944 - DNA, 25 bp, Rattus norvegicus
gtgctttctcctcttctttaattat

SEQ ID NO: 509945 - DNA, 25 bp, Rattus norvegicus
gtgctttctcctgttctttaattat

SEQ ID NO: 509946 - DNA, 25 bp, Rattus norvegicus
gtgctttctggtcacatagttacat

SEQ ID NO: 509947 - DNA, 25 bp, Rattus norvegicus
gtgctttctggtgacatagttacat

SEQ ID NO: 509948 - DNA, 25 bp, Rattus norvegicus
gtgctttcttagctcaaattggagt

SEQ ID NO: 509949 - DNA, 25 bp, Rattus norvegicus
gtgctttcttaggtcaaattggagt

SEQ ID NO: 509950 - DNA, 25 bp, Rattus norvegicus
gtgctttcttcactggaatctatgg

SEQ ID NO: 509951 - DNA, 25 bp, Rattus norvegicus
gtgctttcttcagtggaatctatgg

SEQ ID NO: 509952 - DNA, 25 bp, Rattus norvegicus
gtgctttcttccctctgggttaaca

SEQ ID NO: 509953 - DNA, 25 bp, Rattus norvegicus
gtgctttcttccgtctgggttaaca

SEQ ID NO: 509954 - DNA, 25 bp, Rattus norvegicus
gtgctttgaaatacctgctgacctg

SEQ ID NO: 509955 - DNA, 25 bp, Rattus norvegicus
gtgctttgaaattcctgctgacctg

SEQ ID NO: 509956 - DNA, 25 bp, Rattus norvegicus
gtgctttgaagcagacggctctgag

SEQ ID NO: 509957 - DNA, 25 bp, Rattus norvegicus
gtgctttgaagctgacggctctgag

SEQ ID NO: 509958 - DNA, 25 bp, Rattus norvegicus
gtgctttgataccatctggaatgta

SEQ ID NO: 509959 - DNA, 25 bp, Rattus norvegicus
gtgctttgatacgatctggaatgta

SEQ ID NO: 509960 - DNA, 25 bp, Rattus norvegicus
gtgctttgcaccctatgtgattacc

SEQ ID NO: 509961 - DNA, 25 bp, Rattus norvegicus
gtgctttgcaccgtatgtgattacc

SEQ ID NO: 509962 - DNA, 25 bp, Rattus norvegicus
gtgctttgcattatggtatagacat

SEQ ID NO: 509963 - DNA, 25 bp, Rattus norvegicus
gtgctttgcattttggtatagacat

SEQ ID NO: 509964 - DNA, 25 bp, Rattus norvegicus
gtgctttgccctaaccttattagaa

SEQ ID NO: 509965 - DNA, 25 bp, Rattus norvegicus
gtgctttgcccttaccttattagaa

SEQ ID NO: 509966 - DNA, 25 bp, Rattus norvegicus
gtgctttgcgtgatatttttctacc

SEQ ID NO: 509967 - DNA, 25 bp, Rattus norvegicus
gtgctttgcgtgttatttttctacc

SEQ ID NO: 509968 - DNA, 25 bp, Rattus norvegicus
gtgctttgcttcactctgtgctata

SEQ ID NO: 509969 - DNA, 25 bp, Rattus norvegicus
gtgctttgcttctctctgtgctata

SEQ ID NO: 509970 - DNA, 25 bp, Rattus norvegicus
gtgctttgcttgctgtcaaccttaa

SEQ ID NO: 509971 - DNA, 25 bp, Rattus norvegicus
gtgctttgcttggtgtcaaccttaa

SEQ ID NO: 509972 - DNA, 25 bp, Rattus norvegicus
gtgctttggaaaatctgcatgtcta

SEQ ID NO: 509973 - DNA, 25 bp, Rattus norvegicus
gtgctttggaaattctgcatgtcta

SEQ ID NO: 509974 - DNA, 25 bp, Rattus norvegicus
gtgctttggcttcatgtctacagta

SEQ ID NO: 509975 - DNA, 25 bp, Rattus norvegicus
gtgctttggcttgatgtctacagta

SEQ ID NO: 509976 - DNA, 25 bp, Rattus norvegicus
gtgctttggtgtcctggctcatatc

SEQ ID NO: 509977 - DNA, 25 bp, Rattus norvegicus
gtgctttggtgtgctggctcatatc

SEQ ID NO: 509978 - DNA, 25 bp, Rattus norvegicus
gtgctttggttcactgttgtgaaac

SEQ ID NO: 509979 - DNA, 25 bp, Rattus norvegicus
gtgctttggttctctgttgtgaaac

SEQ ID NO: 509980 - DNA, 25 bp, Rattus norvegicus
gtgctttgttatccgcacaatggct

SEQ ID NO: 509981 - DNA, 25 bp, Rattus norvegicus
gtgctttgttatgcgcacaatggct

SEQ ID NO: 509982 - DNA, 25 bp, Rattus norvegicus
gtgctttgttctcaaatgttcccta

SEQ ID NO: 509983 - DNA, 25 bp, Rattus norvegicus
gtgctttgttctgaaatgttcccta

SEQ ID NO: 509984 - DNA, 25 bp, Rattus norvegicus
gtgcttttaaacctctgaacttctt

SEQ ID NO: 509985 - DNA, 25 bp, Rattus norvegicus
gtgcttttaaacgtctgaacttctt

SEQ ID NO: 509986 - DNA, 25 bp, Rattus norvegicus
gtgcttttaatcctgatgatagttt

SEQ ID NO: 509987 - DNA, 25 bp, Rattus norvegicus
gtgcttttaatcgtgatgatagttt

SEQ ID NO: 509988 - DNA, 25 bp, Rattus norvegicus
gtgcttttagagatttcgccgcaga

SEQ ID NO: 509989 - DNA, 25 bp, Rattus norvegicus
gtgcttttagagttttcgccgcaga

SEQ ID NO: 509990 - DNA, 25 bp, Rattus norvegicus
gtgcttttagcaatgtatctgatat

SEQ ID NO: 509991 - DNA, 25 bp, Rattus norvegicus
gtgcttttagcattgtatctgatat

SEQ ID NO: 509992 - DNA, 25 bp, Rattus norvegicus
gtgcttttcatgctgaatgtcttct

SEQ ID NO: 509993 - DNA, 25 bp, Rattus norvegicus
gtgcttttcatggtgaatgtcttct

SEQ ID NO: 509994 - DNA, 25 bp, Rattus norvegicus
gtgcttttccagatccaggatggcc

SEQ ID NO: 509995 - DNA, 25 bp, Rattus norvegicus
gtgcttttccagttccaggatggcc

SEQ ID NO: 509996 - DNA, 25 bp, Rattus norvegicus
gtgcttttcccaatttatccttgaa

SEQ ID NO: 509997 - DNA, 25 bp, Rattus norvegicus
gtgcttttcccattttatccttgaa

SEQ ID NO: 509998 - DNA, 25 bp, Rattus norvegicus
gtgcttttctacaagtatcctccag

SEQ ID NO: 509999 - DNA, 25 bp, Rattus norvegicus
gtgcttttctacattttcatatggg

SEQ ID NO: 510000 - DNA, 25 bp, Rattus norvegicus
gtgcttttctactagtatcctccag

SEQ ID NO: 510001 - DNA, 25 bp, Rattus norvegicus
gtgcttttctactttttcatatggg

SEQ ID NO: 510002 - DNA, 25 bp, Rattus norvegicus
gtgcttttctatagcagagggttct

SEQ ID NO: 510003 - DNA, 25 bp, Rattus norvegicus
gtgcttttctattgcagagggttct

SEQ ID NO: 510004 - DNA, 25 bp, Rattus norvegicus
gtgcttttctgtatgggtgcaacat

SEQ ID NO: 510005 - DNA, 25 bp, Rattus norvegicus
gtgcttttctgtttgggtgcaacat

SEQ ID NO: 510006 - DNA, 25 bp, Rattus norvegicus
gtgcttttcttcaaacagctacatc

SEQ ID NO: 510007 - DNA, 25 bp, Rattus norvegicus
gtgcttttcttctaacagctacatc

SEQ ID NO: 510008 - DNA, 25 bp, Rattus norvegicus
gtgcttttgaatcgcaccatctttc

SEQ ID NO: 510009 - DNA, 25 bp, Rattus norvegicus
gtgcttttgaatggcaccatctttc

SEQ ID NO: 510010 - DNA, 25 bp, Rattus norvegicus
gtgcttttgcatcttgaatgctcct

SEQ ID NO: 510011 - DNA, 25 bp, Rattus norvegicus
gtgcttttgcatgttgaatgctcct

SEQ ID NO: 510012 - DNA, 25 bp, Rattus norvegicus
gtgcttttgcggcttagacacgaag

SEQ ID NO: 510013 - DNA, 25 bp, Rattus norvegicus
gtgcttttgcgggttagacacgaag

SEQ ID NO: 510014 - DNA, 25 bp, Rattus norvegicus
gtgcttttgtataagttaaccatca

SEQ ID NO: 510015 - DNA, 25 bp, Rattus norvegicus
gtgcttttgtattagttaaccatca

SEQ ID NO: 510016 - DNA, 25 bp, Rattus norvegicus
gtgcttttgtggctaaaatgattac

SEQ ID NO: 510017 - DNA, 25 bp, Rattus norvegicus
gtgcttttgtgggtaaaatgattac

SEQ ID NO: 510018 - DNA, 25 bp, Rattus norvegicus
gtgctttttaacaactgggactcaa

SEQ ID NO: 510019 - DNA, 25 bp, Rattus norvegicus
gtgctttttaactactgggactcaa

SEQ ID NO: 510020 - DNA, 25 bp, Rattus norvegicus
gtgctttttaatctaccttctgtag

SEQ ID NO: 510021 - DNA, 25 bp, Rattus norvegicus
gtgctttttaatgtaccttctgtag

SEQ ID NO: 510022 - DNA, 25 bp, Rattus norvegicus
gtgctttttataagtgtgcccaaat

SEQ ID NO: 510023 - DNA, 25 bp, Rattus norvegicus
gtgctttttatatgtgtgcccaaat

SEQ ID NO: 510024 - DNA, 25 bp, Rattus norvegicus
gtgctttttatcactgggtgactgt

SEQ ID NO: 510025 - DNA, 25 bp, Rattus norvegicus
gtgctttttatctctgggtgactgt

SEQ ID NO: 510026 - DNA, 25 bp, Rattus norvegicus
gtgctttttatgaaccaaccattgc

SEQ ID NO: 510027 - DNA, 25 bp, Rattus norvegicus
gtgctttttatgtaccaaccattgc

SEQ ID NO: 510028 - DNA, 25 bp, Rattus norvegicus
gtgctttttcacacgtgttggtaat

SEQ ID NO: 510029 - DNA, 25 bp, Rattus norvegicus
gtgctttttcactcgtgttggtaat

SEQ ID NO: 510030 - DNA, 25 bp, Rattus norvegicus
gtgctttttcagcaaccagggtctt

SEQ ID NO: 510031 - DNA, 25 bp, Rattus norvegicus
gtgctttttcaggaaccagggtctt

SEQ ID NO: 510032 - DNA, 25 bp, Rattus norvegicus
gtgctttttgctcactgaaatttct

SEQ ID NO: 510033 - DNA, 25 bp, Rattus norvegicus
gtgctttttgctgactgaaatttct

SEQ ID NO: 510034 - DNA, 25 bp, Rattus norvegicus
gtgcttttttttctacctgacatgt

SEQ ID NO: 510035 - DNA, 25 bp, Rattus norvegicus
gtgcttttttttgtacctgacatgt

SEQ ID NO: 510036 - DNA, 25 bp, Rattus norvegicus
gtggaaaacttcaaccaggcactta

SEQ ID NO: 510037 - DNA, 25 bp, Rattus norvegicus
gtggaaaacttctaccaggcactta

SEQ ID NO: 510038 - DNA, 25 bp, Rattus norvegicus
gtggaaaattcaccgtcgccattgc

SEQ ID NO: 510039 - DNA, 25 bp, Rattus norvegicus
gtggaaaattcagcgtcgccattgc

SEQ ID NO: 510040 - DNA, 25 bp, Rattus norvegicus
gtggaaacaatcacctcaggctcat

SEQ ID NO: 510041 - DNA, 25 bp, Rattus norvegicus
gtggaaacaatcatcctctcacttg

SEQ ID NO: 510042 - DNA, 25 bp, Rattus norvegicus
gtggaaacaatctcctcaggctcat

SEQ ID NO: 510043 - DNA, 25 bp, Rattus norvegicus
gtggaaacaatcttcctctcacttg

SEQ ID NO: 510044 - DNA, 25 bp, Rattus norvegicus
gtggaaacacaaactgggctggaca

SEQ ID NO: 510045 - DNA, 25 bp, Rattus norvegicus
gtggaaacacaatctgggctggaca

SEQ ID NO: 510046 - DNA, 25 bp, Rattus norvegicus
gtggaaacacagctaccaggtcttt

SEQ ID NO: 510047 - DNA, 25 bp, Rattus norvegicus
gtggaaacacaggtaccaggtcttt

SEQ ID NO: 510048 - DNA, 25 bp, Rattus norvegicus
gtggaaacactacgtctccgatctt

SEQ ID NO: 510049 - DNA, 25 bp, Rattus norvegicus
gtggaaacactaggtctccgatctt

SEQ ID NO: 510050 - DNA, 25 bp, Rattus norvegicus
gtggaaacaggcctgtgacctcagc

SEQ ID NO: 510051 - DNA, 25 bp, Rattus norvegicus
gtggaaacaggcgtgtgacctcagc

SEQ ID NO: 510052 - DNA, 25 bp, Rattus norvegicus
gtggaaaccactcccttaacagagt

SEQ ID NO: 510053 - DNA, 25 bp, Rattus norvegicus
gtggaaaccactgccttaacagagt

SEQ ID NO: 510054 - DNA, 25 bp, Rattus norvegicus
gtggaaacgaccatggcctgtattt

SEQ ID NO: 510055 - DNA, 25 bp, Rattus norvegicus
gtggaaacgaccttggcctgtattt

SEQ ID NO: 510056 - DNA, 25 bp, Rattus norvegicus
gtggaaacgtctatggaggtcctaa

SEQ ID NO: 510057 - DNA, 25 bp, Rattus norvegicus
gtggaaacgtctttggaggtcctaa

SEQ ID NO: 510058 - DNA, 25 bp, Rattus norvegicus
gtggaaacgtgcaaactttctgtaa

SEQ ID NO: 510059 - DNA, 25 bp, Rattus norvegicus
gtggaaacgtgctaactttctgtaa

SEQ ID NO: 510060 - DNA, 25 bp, Rattus norvegicus
gtggaaactcacattactcatgcaa

SEQ ID NO: 510061 - DNA, 25 bp, Rattus norvegicus
gtggaaactcactttactcatgcaa

SEQ ID NO: 510062 - DNA, 25 bp, Rattus norvegicus
gtggaaactccactcgggtgaactc

SEQ ID NO: 510063 - DNA, 25 bp, Rattus norvegicus
gtggaaactccagtcgggtgaactc

SEQ ID NO: 510064 - DNA, 25 bp, Rattus norvegicus
gtggaaactcttcagcggcagcttc

SEQ ID NO: 510065 - DNA, 25 bp, Rattus norvegicus
gtggaaactcttgagcggcagcttc

SEQ ID NO: 510066 - DNA, 25 bp, Rattus norvegicus
gtggaaactgatctgtgcctgctgc

SEQ ID NO: 510067 - DNA, 25 bp, Rattus norvegicus
gtggaaactgatgtgtgcctgctgc

SEQ ID NO: 510068 - DNA, 25 bp, Rattus norvegicus
gtggaaactggaatttgtacatatt

SEQ ID NO: 510069 - DNA, 25 bp, Rattus norvegicus
gtggaaactggattttgtacatatt

SEQ ID NO: 510070 - DNA, 25 bp, Rattus norvegicus
gtggaaacttggcacatacgccttt

SEQ ID NO: 510071 - DNA, 25 bp, Rattus norvegicus
gtggaaacttgggacatacgccttt

SEQ ID NO: 510072 - DNA, 25 bp, Rattus norvegicus
gtggaaagacttacagccagccgtc

SEQ ID NO: 510073 - DNA, 25 bp, Rattus norvegicus
gtggaaagactttcagccagccgtc

SEQ ID NO: 510074 - DNA, 25 bp, Rattus norvegicus
gtggaaagcagtctgctccttgcat

SEQ ID NO: 510075 - DNA, 25 bp, Rattus norvegicus
gtggaaagcagtgtgctccttgcat

SEQ ID NO: 510076 - DNA, 25 bp, Rattus norvegicus
gtggaaagctaaccctgagacagac

SEQ ID NO: 510077 - DNA, 25 bp, Rattus norvegicus
gtggaaagctaagcctgagacagac

SEQ ID NO: 510078 - DNA, 25 bp, Rattus norvegicus
gtggaaagctttaacaaacctctga

SEQ ID NO: 510079 - DNA, 25 bp, Rattus norvegicus
gtggaaagcttttacaaacctctga

SEQ ID NO: 510080 - DNA, 25 bp, Rattus norvegicus
gtggaaagtctacgtctattcccct

SEQ ID NO: 510081 - DNA, 25 bp, Rattus norvegicus
gtggaaagtctaggtctattcccct

SEQ ID NO: 510082 - DNA, 25 bp, Rattus norvegicus
gtggaaagttccacacgtaacttca

SEQ ID NO: 510083 - DNA, 25 bp, Rattus norvegicus
gtggaaagttcctcacgtaacttca

SEQ ID NO: 510084 - DNA, 25 bp, Rattus norvegicus
gtggaaatcaaaccttgcaagcaac

SEQ ID NO: 510085 - DNA, 25 bp, Rattus norvegicus
gtggaaatcaaagcttgcaagcaac

SEQ ID NO: 510086 - DNA, 25 bp, Rattus norvegicus
gtggaaatcaacacaatgcagcctt

SEQ ID NO: 510087 - DNA, 25 bp, Rattus norvegicus
gtggaaatcaactcaatgcagcctt

SEQ ID NO: 510088 - DNA, 25 bp, Rattus norvegicus
gtggaaatcacacttgcccatctct

SEQ ID NO: 510089 - DNA, 25 bp, Rattus norvegicus
gtggaaatcacagttgcccatctct

SEQ ID NO: 510090 - DNA, 25 bp, Rattus norvegicus
gtggaaatcaccacaaagctaaaga

SEQ ID NO: 510091 - DNA, 25 bp, Rattus norvegicus
gtggaaatcacctcaaagctaaaga

SEQ ID NO: 510092 - DNA, 25 bp, Rattus norvegicus
gtggaaatcagtccctgagcctcct

SEQ ID NO: 510093 - DNA, 25 bp, Rattus norvegicus
gtggaaatcagtgcctgagcctcct

SEQ ID NO: 510094 - DNA, 25 bp, Rattus norvegicus
gtggaaatcatgagtgttcctgtaa

SEQ ID NO: 510095 - DNA, 25 bp, Rattus norvegicus
gtggaaatcatgataccagtgtttt

SEQ ID NO: 510096 - DNA, 25 bp, Rattus norvegicus
gtggaaatcatgtgtgttcctgtaa

SEQ ID NO: 510097 - DNA, 25 bp, Rattus norvegicus
gtggaaatcatgttaccagtgtttt

SEQ ID NO: 510098 - DNA, 25 bp, Rattus norvegicus
gtggaaatcccacattagctccttc

SEQ ID NO: 510099 - DNA, 25 bp, Rattus norvegicus
gtggaaatcccagattagctccttc

SEQ ID NO: 510100 - DNA, 25 bp, Rattus norvegicus
gtggaaatccctatctgtttgtgtg

SEQ ID NO: 510101 - DNA, 25 bp, Rattus norvegicus
gtggaaatccctttctgtttgtgtg

SEQ ID NO: 510102 - DNA, 25 bp, Rattus norvegicus
gtggaaatgaccactatgcccatct

SEQ ID NO: 510103 - DNA, 25 bp, Rattus norvegicus
gtggaaatgacctctatgcccatct

SEQ ID NO: 510104 - DNA, 25 bp, Rattus norvegicus
gtggaaatgcatattacctgcctcc

SEQ ID NO: 510105 - DNA, 25 bp, Rattus norvegicus
gtggaaatgcattttacctgcctcc

SEQ ID NO: 510106 - DNA, 25 bp, Rattus norvegicus
gtggaaatgctcacctgcacaaaca

SEQ ID NO: 510107 - DNA, 25 bp, Rattus norvegicus
gtggaaatgctctcctgcacaaaca

SEQ ID NO: 510108 - DNA, 25 bp, Rattus norvegicus
gtggaaatgtaactgcagagccaaa

SEQ ID NO: 510109 - DNA, 25 bp, Rattus norvegicus
gtggaaatgtaagtgcagagccaaa

SEQ ID NO: 510110 - DNA, 25 bp, Rattus norvegicus
gtggaaattctcactcaacctgcag

SEQ ID NO: 510111 - DNA, 25 bp, Rattus norvegicus
gtggaaattctctctcaacctgcag

SEQ ID NO: 510112 - DNA, 25 bp, Rattus norvegicus
gtggaacaacctacgtactgcctca

SEQ ID NO: 510113 - DNA, 25 bp, Rattus norvegicus
gtggaacaacctataaagctctaaa

SEQ ID NO: 510114 - DNA, 25 bp, Rattus norvegicus
gtggaacaaccttcgtactgcctca

SEQ ID NO: 510115 - DNA, 25 bp, Rattus norvegicus
gtggaacaacctttaaagctctaaa

SEQ ID NO: 510116 - DNA, 25 bp, Rattus norvegicus
gtggaacaacgccatcaccatggac

SEQ ID NO: 510117 - DNA, 25 bp, Rattus norvegicus
gtggaacaacgcgatcaccatggac

SEQ ID NO: 510118 - DNA, 25 bp, Rattus norvegicus
gtggaacaagcgaccctattttctc

SEQ ID NO: 510119 - DNA, 25 bp, Rattus norvegicus
gtggaacaagcgtccctattttctc

SEQ ID NO: 510120 - DNA, 25 bp, Rattus norvegicus
gtggaacacaaactatgtcccattt

SEQ ID NO: 510121 - DNA, 25 bp, Rattus norvegicus
gtggaacacaaagtatgtcccattt

SEQ ID NO: 510122 - DNA, 25 bp, Rattus norvegicus
gtggaacacgtgaacaatcctgtat

SEQ ID NO: 510123 - DNA, 25 bp, Rattus norvegicus
gtggaacacgtgtacaatcctgtat

SEQ ID NO: 510124 - DNA, 25 bp, Rattus norvegicus
gtggaacagaatccgagctcttgta

SEQ ID NO: 510125 - DNA, 25 bp, Rattus norvegicus
gtggaacagaatgcgagctcttgta

SEQ ID NO: 510126 - DNA, 25 bp, Rattus norvegicus
gtggaacagccgcaagtcttgactt

SEQ ID NO: 510127 - DNA, 25 bp, Rattus norvegicus
gtggaacagccggaagtcttgactt

SEQ ID NO: 510128 - DNA, 25 bp, Rattus norvegicus
gtggaacatacccaagctgggcctt

SEQ ID NO: 510129 - DNA, 25 bp, Rattus norvegicus
gtggaacataccgaagctgggcctt

SEQ ID NO: 510130 - DNA, 25 bp, Rattus norvegicus
gtggaacatgtaccctagcatctgg

SEQ ID NO: 510131 - DNA, 25 bp, Rattus norvegicus
gtggaacatgtagcctagcatctgg

SEQ ID NO: 510132 - DNA, 25 bp, Rattus norvegicus
gtggaacatgttctcaccccagcac

SEQ ID NO: 510133 - DNA, 25 bp, Rattus norvegicus
gtggaacatgttgtcaccccagcac

SEQ ID NO: 510134 - DNA, 25 bp, Rattus norvegicus
gtggaacattgtactcaccttcggc

SEQ ID NO: 510135 - DNA, 25 bp, Rattus norvegicus
gtggaacattgtcccacacactgca

SEQ ID NO: 510136 - DNA, 25 bp, Rattus norvegicus
gtggaacattgtgccacacactgca

SEQ ID NO: 510137 - DNA, 25 bp, Rattus norvegicus
gtggaacattgttctcaccttcggc

SEQ ID NO: 510138 - DNA, 25 bp, Rattus norvegicus
gtggaaccaaccaagacctcgtgtt

SEQ ID NO: 510139 - DNA, 25 bp, Rattus norvegicus
gtggaaccaacctagacctcgtgtt

SEQ ID NO: 510140 - DNA, 25 bp, Rattus norvegicus
gtggaaccaggcatcatccatctat

SEQ ID NO: 510141 - DNA, 25 bp, Rattus norvegicus
gtggaaccaggcttcatccatctat

SEQ ID NO: 510142 - DNA, 25 bp, Rattus norvegicus
gtggaaccagttacagcagatcaaa

SEQ ID NO: 510143 - DNA, 25 bp, Rattus norvegicus
gtggaaccagtttcagcagatcaaa

SEQ ID NO: 510144 - DNA, 25 bp, Rattus norvegicus
gtggaacccactcaacaggcacagt

SEQ ID NO: 510145 - DNA, 25 bp, Rattus norvegicus
gtggaacccactgaacaggcacagt

SEQ ID NO: 510146 - DNA, 25 bp, Rattus norvegicus
gtggaaccctgcacatttcggaatg

SEQ ID NO: 510147 - DNA, 25 bp, Rattus norvegicus
gtggaaccctgcagcaagcacagaa

SEQ ID NO: 510148 - DNA, 25 bp, Rattus norvegicus
gtggaaccctgctcatttcggaatg

SEQ ID NO: 510149 - DNA, 25 bp, Rattus norvegicus
gtggaaccctgctgcaagcacagaa

SEQ ID NO: 510150 - DNA, 25 bp, Rattus norvegicus
gtggaaccgctgagcacagtgacct

SEQ ID NO: 510151 - DNA, 25 bp, Rattus norvegicus
gtggaaccgctgtgcacagtgacct

SEQ ID NO: 510152 - DNA, 25 bp, Rattus norvegicus
gtggaaccgtggctcaatccagccg

SEQ ID NO: 510153 - DNA, 25 bp, Rattus norvegicus
gtggaaccgtgggtcaatccagccg

SEQ ID NO: 510154 - DNA, 25 bp, Rattus norvegicus
gtggaacctgagcaccatgaagtcc

SEQ ID NO: 510155 - DNA, 25 bp, Rattus norvegicus
gtggaacctgaggaccatgaagtcc

SEQ ID NO: 510156 - DNA, 25 bp, Rattus norvegicus
gtggaacctgcgacagtttgcaatg

SEQ ID NO: 510157 - DNA, 25 bp, Rattus norvegicus
gtggaacctgcgtcagtttgcaatg

SEQ ID NO: 510158 - DNA, 25 bp, Rattus norvegicus
gtggaacctgtcacctgtgggcaga

SEQ ID NO: 510159 - DNA, 25 bp, Rattus norvegicus
gtggaacctgtctcctgtgggcaga

SEQ ID NO: 510160 - DNA, 25 bp, Rattus norvegicus
gtggaaccttacataccttgtgctg

SEQ ID NO: 510161 - DNA, 25 bp, Rattus norvegicus
gtggaaccttacttaccttgtgctg

SEQ ID NO: 510162 - DNA, 25 bp, Rattus norvegicus
gtggaaccttctaactttctgactt

SEQ ID NO: 510163 - DNA, 25 bp, Rattus norvegicus
gtggaaccttcttactttctgactt

SEQ ID NO: 510164 - DNA, 25 bp, Rattus norvegicus
gtggaacggatgcatgctccccaat

SEQ ID NO: 510165 - DNA, 25 bp, Rattus norvegicus
gtggaacggatggatgctccccaat

SEQ ID NO: 510166 - DNA, 25 bp, Rattus norvegicus
gtggaacgggtcattctgtctcttc

SEQ ID NO: 510167 - DNA, 25 bp, Rattus norvegicus
gtggaacgggtctttctgtctcttc

SEQ ID NO: 510168 - DNA, 25 bp, Rattus norvegicus
gtggaactacagatccagcagctgg

SEQ ID NO: 510169 - DNA, 25 bp, Rattus norvegicus
gtggaactacagttccagcagctgg

SEQ ID NO: 510170 - DNA, 25 bp, Rattus norvegicus
gtggaactacgcacaccaaatgtgt

SEQ ID NO: 510171 - DNA, 25 bp, Rattus norvegicus
gtggaactacgctcaccaaatgtgt

SEQ ID NO: 510172 - DNA, 25 bp, Rattus norvegicus
gtggaactagacacgctgtgctctc

SEQ ID NO: 510173 - DNA, 25 bp, Rattus norvegicus
gtggaactagactcgctgtgctctc

SEQ ID NO: 510174 - DNA, 25 bp, Rattus norvegicus
gtggaactaggcacatgtctgctcc

SEQ ID NO: 510175 - DNA, 25 bp, Rattus norvegicus
gtggaactaggctcatgtctgctcc

SEQ ID NO: 510176 - DNA, 25 bp, Rattus norvegicus
gtggaactagtgacccttggagact

SEQ ID NO: 510177 - DNA, 25 bp, Rattus norvegicus
gtggaactagtgtcccttggagact

SEQ ID NO: 510178 - DNA, 25 bp, Rattus norvegicus
gtggaactatgaccccggagtgcaa

SEQ ID NO: 510179 - DNA, 25 bp, Rattus norvegicus
gtggaactatgagcccggagtgcaa

SEQ ID NO: 510180 - DNA, 25 bp, Rattus norvegicus
gtggaactcaaccagtcatctgcta

SEQ ID NO: 510181 - DNA, 25 bp, Rattus norvegicus
gtggaactcaacgagtcatctgcta

SEQ ID NO: 510182 - DNA, 25 bp, Rattus norvegicus
gtggaactcagcacataggcagtac

SEQ ID NO: 510183 - DNA, 25 bp, Rattus norvegicus
gtggaactcagctcataggcagtac

SEQ ID NO: 510184 - DNA, 25 bp, Rattus norvegicus
gtggaactcatgagcacctatgcat

SEQ ID NO: 510185 - DNA, 25 bp, Rattus norvegicus
gtggaactcatgtgcacctatgcat

SEQ ID NO: 510186 - DNA, 25 bp, Rattus norvegicus
gtggaactcattatttggctgtctg

SEQ ID NO: 510187 - DNA, 25 bp, Rattus norvegicus
gtggaactcattttttggctgtctg

SEQ ID NO: 510188 - DNA, 25 bp, Rattus norvegicus
gtggaactctaccagcaccaagaat

SEQ ID NO: 510189 - DNA, 25 bp, Rattus norvegicus
gtggaactctacgagcaccaagaat

SEQ ID NO: 510190 - DNA, 25 bp, Rattus norvegicus
gtggaactcttaccctaaatgcttg

SEQ ID NO: 510191 - DNA, 25 bp, Rattus norvegicus
gtggaactcttagcctaaatgcttg

SEQ ID NO: 510192 - DNA, 25 bp, Rattus norvegicus
gtggaactctttcagggaccataga

SEQ ID NO: 510193 - DNA, 25 bp, Rattus norvegicus
gtggaactctttgagggaccataga

SEQ ID NO: 510194 - DNA, 25 bp, Rattus norvegicus
gtggaactgcgaccgcaacttgcag

SEQ ID NO: 510195 - DNA, 25 bp, Rattus norvegicus
gtggaactgcgagcgcaacttgcag

SEQ ID NO: 510196 - DNA, 25 bp, Rattus norvegicus
gtggaactgttcctctgagcaccag

SEQ ID NO: 510197 - DNA, 25 bp, Rattus norvegicus
gtggaactgttcgtctgagcaccag

SEQ ID NO: 510198 - DNA, 25 bp, Rattus norvegicus
gtggaactgtttcccagctgagctg

SEQ ID NO: 510199 - DNA, 25 bp, Rattus norvegicus
gtggaactgtttgccagctgagctg

SEQ ID NO: 510200 - DNA, 25 bp, Rattus norvegicus
gtggaacttctcaattctcttatga

SEQ ID NO: 510201 - DNA, 25 bp, Rattus norvegicus
gtggaacttctctattctcttatga

SEQ ID NO: 510202 - DNA, 25 bp, Rattus norvegicus
gtggaacttgaaagaaccacagtta

SEQ ID NO: 510203 - DNA, 25 bp, Rattus norvegicus
gtggaacttgaatgaaccacagtta

SEQ ID NO: 510204 - DNA, 25 bp, Rattus norvegicus
gtggaacttggtccctctttgttgc

SEQ ID NO: 510205 - DNA, 25 bp, Rattus norvegicus
gtggaacttggtgcctctttgttgc

SEQ ID NO: 510206 - DNA, 25 bp, Rattus norvegicus
gtggaactttcacgaggcaaaccct

SEQ ID NO: 510207 - DNA, 25 bp, Rattus norvegicus
gtggaactttcaggaggcaaaccct

SEQ ID NO: 510208 - DNA, 25 bp, Rattus norvegicus
gtggaagaacacaggcatctcccta

SEQ ID NO: 510209 - DNA, 25 bp, Rattus norvegicus
gtggaagaacactggcatctcccta

SEQ ID NO: 510210 - DNA, 25 bp, Rattus norvegicus
gtggaagacaacagattatgggccc

SEQ ID NO: 510211 - DNA, 25 bp, Rattus norvegicus
gtggaagacaactgattatgggccc

SEQ ID NO: 510212 - DNA, 25 bp, Rattus norvegicus
gtggaagacacacaaccgcagtgat

SEQ ID NO: 510213 - DNA, 25 bp, Rattus norvegicus
gtggaagacacactgactctgactt

SEQ ID NO: 510214 - DNA, 25 bp, Rattus norvegicus
gtggaagacacagaaccgcagtgat

SEQ ID NO: 510215 - DNA, 25 bp, Rattus norvegicus
gtggaagacacagtgactctgactt

SEQ ID NO: 510216 - DNA, 25 bp, Rattus norvegicus
gtggaagacaccctccctattatac

SEQ ID NO: 510217 - DNA, 25 bp, Rattus norvegicus
gtggaagacaccgtccctattatac

SEQ ID NO: 510218 - DNA, 25 bp, Rattus norvegicus
gtggaagacagacaccttgttgagt

SEQ ID NO: 510219 - DNA, 25 bp, Rattus norvegicus
gtggaagacagacccgcagtgtttt

SEQ ID NO: 510220 - DNA, 25 bp, Rattus norvegicus
gtggaagacagagaccttgttgagt

SEQ ID NO: 510221 - DNA, 25 bp, Rattus norvegicus
gtggaagacagagccgcagtgtttt

SEQ ID NO: 510222 - DNA, 25 bp, Rattus norvegicus
gtggaagacatgagccgtgtataat

SEQ ID NO: 510223 - DNA, 25 bp, Rattus norvegicus
gtggaagacatgtgccgtgtataat

SEQ ID NO: 510224 - DNA, 25 bp, Rattus norvegicus
gtggaagacccaagtcagatctctt

SEQ ID NO: 510225 - DNA, 25 bp, Rattus norvegicus
gtggaagacccatgtcagatctctt

SEQ ID NO: 510226 - DNA, 25 bp, Rattus norvegicus
gtggaagacttcagcagactaacct

SEQ ID NO: 510227 - DNA, 25 bp, Rattus norvegicus
gtggaagacttctgcagactaacct

SEQ ID NO: 510228 - DNA, 25 bp, Rattus norvegicus
gtggaagagcacatccgtcggagcc

SEQ ID NO: 510229 - DNA, 25 bp, Rattus norvegicus
gtggaagagcacttccgtcggagcc

SEQ ID NO: 510230 - DNA, 25 bp, Rattus norvegicus
gtggaagagccgagcgtacagccca

SEQ ID NO: 510231 - DNA, 25 bp, Rattus norvegicus
gtggaagagccgtgcgtacagccca

SEQ ID NO: 510232 - DNA, 25 bp, Rattus norvegicus
gtggaagagctcataggccggccca

SEQ ID NO: 510233 - DNA, 25 bp, Rattus norvegicus
gtggaagagctcttaggccggccca

SEQ ID NO: 510234 - DNA, 25 bp, Rattus norvegicus
gtggaagaggataacgtgactaaca

SEQ ID NO: 510235 - DNA, 25 bp, Rattus norvegicus
gtggaagaggattacgtgactaaca

SEQ ID NO: 510236 - DNA, 25 bp, Rattus norvegicus
gtggaagagggaagccccctataat

SEQ ID NO: 510237 - DNA, 25 bp, Rattus norvegicus
gtggaagagggatgccccctataat

SEQ ID NO: 510238 - DNA, 25 bp, Rattus norvegicus
gtggaagaggtgacactccccaaaa

SEQ ID NO: 510239 - DNA, 25 bp, Rattus norvegicus
gtggaagaggtgtcactccccaaaa

SEQ ID NO: 510240 - DNA, 25 bp, Rattus norvegicus
gtggaagagtctcggagtttcctaa

SEQ ID NO: 510241 - DNA, 25 bp, Rattus norvegicus
gtggaagagtctgggagtttcctaa

SEQ ID NO: 510242 - DNA, 25 bp, Rattus norvegicus
gtggaagatcacctgccttgaatgc

SEQ ID NO: 510243 - DNA, 25 bp, Rattus norvegicus
gtggaagatcacgtgccttgaatgc

SEQ ID NO: 510244 - DNA, 25 bp, Rattus norvegicus
gtggaagatgaacctctctggaagt

SEQ ID NO: 510245 - DNA, 25 bp, Rattus norvegicus
gtggaagatgaagctctctggaagt

SEQ ID NO: 510246 - DNA, 25 bp, Rattus norvegicus
gtggaagatgacaagccagaagtag

SEQ ID NO: 510247 - DNA, 25 bp, Rattus norvegicus
gtggaagatgactagccagaagtag

SEQ ID NO: 510248 - DNA, 25 bp, Rattus norvegicus
gtggaagcaagactatctcaggttt

SEQ ID NO: 510249 - DNA, 25 bp, Rattus norvegicus
gtggaagcaagagtatctcaggttt

SEQ ID NO: 510250 - DNA, 25 bp, Rattus norvegicus
gtggaagcactgagttccaagcacc

SEQ ID NO: 510251 - DNA, 25 bp, Rattus norvegicus
gtggaagcactgtgttccaagcacc

SEQ ID NO: 510252 - DNA, 25 bp, Rattus norvegicus
gtggaagcagagatccctttcaacc

SEQ ID NO: 510253 - DNA, 25 bp, Rattus norvegicus
gtggaagcagagttccctttcaacc

SEQ ID NO: 510254 - DNA, 25 bp, Rattus norvegicus
gtggaagcagctctcttgaagagaa

SEQ ID NO: 510255 - DNA, 25 bp, Rattus norvegicus
gtggaagcagctgtcttgaagagaa

SEQ ID NO: 510256 - DNA, 25 bp, Rattus norvegicus
gtggaagccacaccttgtacatagt

SEQ ID NO: 510257 - DNA, 25 bp, Rattus norvegicus
gtggaagccacagcttgtacatagt

SEQ ID NO: 510258 - DNA, 25 bp, Rattus norvegicus
gtggaagccactactaaatgatcag

SEQ ID NO: 510259 - DNA, 25 bp, Rattus norvegicus
gtggaagccacttctaaatgatcag

SEQ ID NO: 510260 - DNA, 25 bp, Rattus norvegicus
gtggaagcccaacatgactcaataa

SEQ ID NO: 510261 - DNA, 25 bp, Rattus norvegicus
gtggaagcccaagatgactcaataa

SEQ ID NO: 510262 - DNA, 25 bp, Rattus norvegicus
gtggaagcccagatactctcaaagt

SEQ ID NO: 510263 - DNA, 25 bp, Rattus norvegicus
gtggaagcccagttactctcaaagt

SEQ ID NO: 510264 - DNA, 25 bp, Rattus norvegicus
gtggaagcccggaggcacatcctag

SEQ ID NO: 510265 - DNA, 25 bp, Rattus norvegicus
gtggaagcccggtggcacatcctag

SEQ ID NO: 510266 - DNA, 25 bp, Rattus norvegicus
gtggaagccgatactcctgtaggaa

SEQ ID NO: 510267 - DNA, 25 bp, Rattus norvegicus
gtggaagccgattctcctgtaggaa

SEQ ID NO: 510268 - DNA, 25 bp, Rattus norvegicus
gtggaagcctggacatgcacacaga

SEQ ID NO: 510269 - DNA, 25 bp, Rattus norvegicus
gtggaagcctggtcatgcacacaga

SEQ ID NO: 510270 - DNA, 25 bp, Rattus norvegicus
gtggaagccttgatgcaccggacat

SEQ ID NO: 510271 - DNA, 25 bp, Rattus norvegicus
gtggaagccttgttgcaccggacat

SEQ ID NO: 510272 - DNA, 25 bp, Rattus norvegicus
gtggaagcgcacagggccgaaatta

SEQ ID NO: 510273 - DNA, 25 bp, Rattus norvegicus
gtggaagcgcactgggccgaaatta

SEQ ID NO: 510274 - DNA, 25 bp, Rattus norvegicus
gtggaagcgcttaagggtccctgcc

SEQ ID NO: 510275 - DNA, 25 bp, Rattus norvegicus
gtggaagcgctttagggtccctgcc

SEQ ID NO: 510276 - DNA, 25 bp, Rattus norvegicus
gtggaagcgtcaccctaaaaatctt

SEQ ID NO: 510277 - DNA, 25 bp, Rattus norvegicus
gtggaagcgtcagcctaaaaatctt

SEQ ID NO: 510278 - DNA, 25 bp, Rattus norvegicus
gtggaagctatgacccaagacctcc

SEQ ID NO: 510279 - DNA, 25 bp, Rattus norvegicus
gtggaagctatgtcccaagacctcc

SEQ ID NO: 510280 - DNA, 25 bp, Rattus norvegicus
gtggaagctctgagcgcaggccata

SEQ ID NO: 510281 - DNA, 25 bp, Rattus norvegicus
gtggaagctctgtgcgcaggccata

SEQ ID NO: 510282 - DNA, 25 bp, Rattus norvegicus
gtggaagctggccaataaccttctt

SEQ ID NO: 510283 - DNA, 25 bp, Rattus norvegicus
gtggaagctggcgaataaccttctt

SEQ ID NO: 510284 - DNA, 25 bp, Rattus norvegicus
gtggaagctgtgcacgctaccaaag

SEQ ID NO: 510285 - DNA, 25 bp, Rattus norvegicus
gtggaagctgtggacgctaccaaag

SEQ ID NO: 510286 - DNA, 25 bp, Rattus norvegicus
gtggaaggaagtccccactccaggc

SEQ ID NO: 510287 - DNA, 25 bp, Rattus norvegicus
gtggaaggaagtgcccactccaggc

SEQ ID NO: 510288 - DNA, 25 bp, Rattus norvegicus
gtggaaggatctatccccactgtta

SEQ ID NO: 510289 - DNA, 25 bp, Rattus norvegicus
gtggaaggatctttccccactgtta

SEQ ID NO: 510290 - DNA, 25 bp, Rattus norvegicus
gtggaaggcatcaggtgattcattt

SEQ ID NO: 510291 - DNA, 25 bp, Rattus norvegicus
gtggaaggcatctggtgattcattt

SEQ ID NO: 510292 - DNA, 25 bp, Rattus norvegicus
gtggaaggctaccatcgaactttaa

SEQ ID NO: 510293 - DNA, 25 bp, Rattus norvegicus
gtggaaggctacgatcgaactttaa

SEQ ID NO: 510294 - DNA, 25 bp, Rattus norvegicus
gtggaagtacatcgcctcattaggg

SEQ ID NO: 510295 - DNA, 25 bp, Rattus norvegicus
gtggaagtacatggcctcattaggg

SEQ ID NO: 510296 - DNA, 25 bp, Rattus norvegicus
gtggaagtcgccctgttatgagaca

SEQ ID NO: 510297 - DNA, 25 bp, Rattus norvegicus
gtggaagtcgccgtgttatgagaca

SEQ ID NO: 510298 - DNA, 25 bp, Rattus norvegicus
gtggaagtgaccctaaaacagtgtt

SEQ ID NO: 510299 - DNA, 25 bp, Rattus norvegicus
gtggaagtgaccgtaaaacagtgtt

SEQ ID NO: 510300 - DNA, 25 bp, Rattus norvegicus
gtggaagtgactcctatctctgtat

SEQ ID NO: 510301 - DNA, 25 bp, Rattus norvegicus
gtggaagtgactgctatctctgtat

SEQ ID NO: 510302 - DNA, 25 bp, Rattus norvegicus
gtggaagtggtcagctctagagtaa

SEQ ID NO: 510303 - DNA, 25 bp, Rattus norvegicus
gtggaagtggtctgctctagagtaa

SEQ ID NO: 510304 - DNA, 25 bp, Rattus norvegicus
gtggaataagttatatcttctgtaa

SEQ ID NO: 510305 - DNA, 25 bp, Rattus norvegicus
gtggaataagttttatcttctgtaa

SEQ ID NO: 510306 - DNA, 25 bp, Rattus norvegicus
gtggaataatttccagtctttcttc

SEQ ID NO: 510307 - DNA, 25 bp, Rattus norvegicus
gtggaataatttgcagtctttcttc

SEQ ID NO: 510308 - DNA, 25 bp, Rattus norvegicus
gtggaatacattctcccctatgtcg

SEQ ID NO: 510309 - DNA, 25 bp, Rattus norvegicus
gtggaatacattgtcccctatgtcg

SEQ ID NO: 510310 - DNA, 25 bp, Rattus norvegicus
gtggaatatgagcagattacgcccc

SEQ ID NO: 510311 - DNA, 25 bp, Rattus norvegicus
gtggaatatgaggagattacgcccc

SEQ ID NO: 510312 - DNA, 25 bp, Rattus norvegicus
gtggaatattttctccctggatttt

SEQ ID NO: 510313 - DNA, 25 bp, Rattus norvegicus
gtggaatattttgtccctggatttt

SEQ ID NO: 510314 - DNA, 25 bp, Rattus norvegicus
gtggaatcaagccatgcctggcaaa

SEQ ID NO: 510315 - DNA, 25 bp, Rattus norvegicus
gtggaatcaagcgatgcctggcaaa

SEQ ID NO: 510316 - DNA, 25 bp, Rattus norvegicus
gtggaatcacctctgcagactggga

SEQ ID NO: 510317 - DNA, 25 bp, Rattus norvegicus
gtggaatcacctgtgcagactggga

SEQ ID NO: 510318 - DNA, 25 bp, Rattus norvegicus
gtggaatcacttagtataactctac

SEQ ID NO: 510319 - DNA, 25 bp, Rattus norvegicus
gtggaatcacttcagagctctttaa

SEQ ID NO: 510320 - DNA, 25 bp, Rattus norvegicus
gtggaatcacttgagagctctttaa

SEQ ID NO: 510321 - DNA, 25 bp, Rattus norvegicus
gtggaatcactttgtataactctac

SEQ ID NO: 510322 - DNA, 25 bp, Rattus norvegicus
gtggaatcatcactcttgaagatca

SEQ ID NO: 510323 - DNA, 25 bp, Rattus norvegicus
gtggaatcatcagtcttgaagatca

SEQ ID NO: 510324 - DNA, 25 bp, Rattus norvegicus
gtggaatcctcaattaacttctata

SEQ ID NO: 510325 - DNA, 25 bp, Rattus norvegicus
gtggaatcctcatttaacttctata

SEQ ID NO: 510326 - DNA, 25 bp, Rattus norvegicus
gtggaatcctgtccaaagcctgtga

SEQ ID NO: 510327 - DNA, 25 bp, Rattus norvegicus
gtggaatcctgtgcaaagcctgtga

SEQ ID NO: 510328 - DNA, 25 bp, Rattus norvegicus
gtggaatcgcccaggagaccggctt

SEQ ID NO: 510329 - DNA, 25 bp, Rattus norvegicus
gtggaatcgccctggagaccggctt

SEQ ID NO: 510330 - DNA, 25 bp, Rattus norvegicus
gtggaatctaagaacagccctcaat

SEQ ID NO: 510331 - DNA, 25 bp, Rattus norvegicus
gtggaatctaagtacagccctcaat

SEQ ID NO: 510332 - DNA, 25 bp, Rattus norvegicus
gtggaatctactactcggttcttgc

SEQ ID NO: 510333 - DNA, 25 bp, Rattus norvegicus
gtggaatctacttctcggttcttgc

SEQ ID NO: 510334 - DNA, 25 bp, Rattus norvegicus
gtggaatctcacatctaggttaaag

SEQ ID NO: 510335 - DNA, 25 bp, Rattus norvegicus
gtggaatctcacttctaggttaaag

SEQ ID NO: 510336 - DNA, 25 bp, Rattus norvegicus
gtggaatctgggacttcttcatgcc

SEQ ID NO: 510337 - DNA, 25 bp, Rattus norvegicus
gtggaatctgggtcttcttcatgcc

SEQ ID NO: 510338 - DNA, 25 bp, Rattus norvegicus
gtggaatgactcagtagcccttaag

SEQ ID NO: 510339 - DNA, 25 bp, Rattus norvegicus
gtggaatgactctgtagcccttaag

SEQ ID NO: 510340 - DNA, 25 bp, Rattus norvegicus
gtggaatgattcaacgcccaggctc

SEQ ID NO: 510341 - DNA, 25 bp, Rattus norvegicus
gtggaatgattcacatcctctcaag

SEQ ID NO: 510342 - DNA, 25 bp, Rattus norvegicus
gtggaatgattctacgcccaggctc

SEQ ID NO: 510343 - DNA, 25 bp, Rattus norvegicus
gtggaatgattctcatcctctcaag

SEQ ID NO: 510344 - DNA, 25 bp, Rattus norvegicus
gtggaatgcctgaatgctttgtttg

SEQ ID NO: 510345 - DNA, 25 bp, Rattus norvegicus
gtggaatgcctgtatgctttgtttg

SEQ ID NO: 510346 - DNA, 25 bp, Rattus norvegicus
gtggaatggaacacaaagacaatat

SEQ ID NO: 510347 - DNA, 25 bp, Rattus norvegicus
gtggaatggaactcaaagacaatat

SEQ ID NO: 510348 - DNA, 25 bp, Rattus norvegicus
gtggaatgtagtccccaaatttgat

SEQ ID NO: 510349 - DNA, 25 bp, Rattus norvegicus
gtggaatgtagtgcccaaatttgat

SEQ ID NO: 510350 - DNA, 25 bp, Rattus norvegicus
gtggaatgttcaaagcctgctggga

SEQ ID NO: 510351 - DNA, 25 bp, Rattus norvegicus
gtggaatgttcatagcctgctggga

SEQ ID NO: 510352 - DNA, 25 bp, Rattus norvegicus
gtggaatgtttgagccctgtttcca

SEQ ID NO: 510353 - DNA, 25 bp, Rattus norvegicus
gtggaatgtttgtgccctgtttcca

SEQ ID NO: 510354 - DNA, 25 bp, Rattus norvegicus
gtggaattacagattccgcccacta

SEQ ID NO: 510355 - DNA, 25 bp, Rattus norvegicus
gtggaattacagtttccgcccacta

SEQ ID NO: 510356 - DNA, 25 bp, Rattus norvegicus
gtggaattatctccaacctttctgt

SEQ ID NO: 510357 - DNA, 25 bp, Rattus norvegicus
gtggaattatctgcaacctttctgt

SEQ ID NO: 510358 - DNA, 25 bp, Rattus norvegicus
gtggaattccaccagctgaaccgag

SEQ ID NO: 510359 - DNA, 25 bp, Rattus norvegicus
gtggaattccacgagctgaaccgag

SEQ ID NO: 510360 - DNA, 25 bp, Rattus norvegicus
gtggaattctttactgtctctataa

SEQ ID NO: 510361 - DNA, 25 bp, Rattus norvegicus
gtggaattcttttctgtctctataa

SEQ ID NO: 510362 - DNA, 25 bp, Rattus norvegicus
gtggaattgccacagaatcagagtt

SEQ ID NO: 510363 - DNA, 25 bp, Rattus norvegicus
gtggaattgccagagaatcagagtt

SEQ ID NO: 510364 - DNA, 25 bp, Rattus norvegicus
gtggaattgcccaaacctcaagtga

SEQ ID NO: 510365 - DNA, 25 bp, Rattus norvegicus
gtggaattgccctaacctcaagtga

SEQ ID NO: 510366 - DNA, 25 bp, Rattus norvegicus
gtggaatttcacctgtgtacctgag

SEQ ID NO: 510367 - DNA, 25 bp, Rattus norvegicus
gtggaatttcacgtgtgtacctgag

SEQ ID NO: 510368 - DNA, 25 bp, Rattus norvegicus
gtggacaaaagaccctatgaacaga

SEQ ID NO: 510369 - DNA, 25 bp, Rattus norvegicus
gtggacaaaagagcctatgaacaga

SEQ ID NO: 510370 - DNA, 25 bp, Rattus norvegicus
gtggacaaaattcgccagtttcaga

SEQ ID NO: 510371 - DNA, 25 bp, Rattus norvegicus
gtggacaaaattggccagtttcaga

SEQ ID NO: 510372 - DNA, 25 bp, Rattus norvegicus
gtggacaaacgtagtgacccctatc

SEQ ID NO: 510373 - DNA, 25 bp, Rattus norvegicus
gtggacaaacgttgtgacccctatc

SEQ ID NO: 510374 - DNA, 25 bp, Rattus norvegicus
gtggacaaagctacctttctccatg

SEQ ID NO: 510375 - DNA, 25 bp, Rattus norvegicus
gtggacaaagcttcctttctccatg

SEQ ID NO: 510376 - DNA, 25 bp, Rattus norvegicus
gtggacaaattaccccagctataag

SEQ ID NO: 510377 - DNA, 25 bp, Rattus norvegicus
gtggacaaattacttcgagacattt

SEQ ID NO: 510378 - DNA, 25 bp, Rattus norvegicus
gtggacaaattagcccagctataag

SEQ ID NO: 510379 - DNA, 25 bp, Rattus norvegicus
gtggacaaattagttcgagacattt

SEQ ID NO: 510380 - DNA, 25 bp, Rattus norvegicus
gtggacaacactaaccatcacagta

SEQ ID NO: 510381 - DNA, 25 bp, Rattus norvegicus
gtggacaacacttaccatcacagta

SEQ ID NO: 510382 - DNA, 25 bp, Rattus norvegicus
gtggacaaccgcatcagactgccgg

SEQ ID NO: 510383 - DNA, 25 bp, Rattus norvegicus
gtggacaaccgcttcagactgccgg

SEQ ID NO: 510384 - DNA, 25 bp, Rattus norvegicus
gtggacaaccggatccgcggagctt

SEQ ID NO: 510385 - DNA, 25 bp, Rattus norvegicus
gtggacaaccggttccgcggagctt

SEQ ID NO: 510386 - DNA, 25 bp, Rattus norvegicus
gtggacaactccaacaagtgtgatg

SEQ ID NO: 510387 - DNA, 25 bp, Rattus norvegicus
gtggacaactcctacaagtgtgatg

SEQ ID NO: 510388 - DNA, 25 bp, Rattus norvegicus
gtggacaattccctcagcacctggg

SEQ ID NO: 510389 - DNA, 25 bp, Rattus norvegicus
gtggacaattccgtcagcacctggg

SEQ ID NO: 510390 - DNA, 25 bp, Rattus norvegicus
gtggacacaaaaacttttcccagag

SEQ ID NO: 510391 - DNA, 25 bp, Rattus norvegicus
gtggacacaaaatcttttcccagag

SEQ ID NO: 510392 - DNA, 25 bp, Rattus norvegicus
gtggacacaactcggcattttctga

SEQ ID NO: 510393 - DNA, 25 bp, Rattus norvegicus
gtggacacaactgggcattttctga

SEQ ID NO: 510394 - DNA, 25 bp, Rattus norvegicus
gtggacacacaacggagctgtcttt

SEQ ID NO: 510395 - DNA, 25 bp, Rattus norvegicus
gtggacacacaagggagctgtcttt

SEQ ID NO: 510396 - DNA, 25 bp, Rattus norvegicus
gtggacacacagctctttgttatat

SEQ ID NO: 510397 - DNA, 25 bp, Rattus norvegicus
gtggacacacaggtctttgttatat

SEQ ID NO: 510398 - DNA, 25 bp, Rattus norvegicus
gtggacacacatcgtgacaagccaa

SEQ ID NO: 510399 - DNA, 25 bp, Rattus norvegicus
gtggacacacatggtgacaagccaa

SEQ ID NO: 510400 - DNA, 25 bp, Rattus norvegicus
gtggacacaccccttgataattaag

SEQ ID NO: 510401 - DNA, 25 bp, Rattus norvegicus
gtggacacacccgttgataattaag

SEQ ID NO: 510402 - DNA, 25 bp, Rattus norvegicus
gtggacacacctacatcaaaagcat

SEQ ID NO: 510403 - DNA, 25 bp, Rattus norvegicus
gtggacacaccttcatcaaaagcat

SEQ ID NO: 510404 - DNA, 25 bp, Rattus norvegicus
gtggacacacttatctctttatgat

SEQ ID NO: 510405 - DNA, 25 bp, Rattus norvegicus
gtggacacacttttctctttatgat

SEQ ID NO: 510406 - DNA, 25 bp, Rattus norvegicus
gtggacacatcacctgtctcaagct

SEQ ID NO: 510407 - DNA, 25 bp, Rattus norvegicus
gtggacacatcagctgtctcaagct

SEQ ID NO: 510408 - DNA, 25 bp, Rattus norvegicus
gtggacaccataaatctcagatgct

SEQ ID NO: 510409 - DNA, 25 bp, Rattus norvegicus
gtggacaccatatatctcagatgct

SEQ ID NO: 510410 - DNA, 25 bp, Rattus norvegicus
gtggacacctcgaggacgcttatgt

SEQ ID NO: 510411 - DNA, 25 bp, Rattus norvegicus
gtggacacctcgtggacgcttatgt

SEQ ID NO: 510412 - DNA, 25 bp, Rattus norvegicus
gtggacacgtctctgaatgaccctg

SEQ ID NO: 510413 - DNA, 25 bp, Rattus norvegicus
gtggacacgtctgtgaatgaccctg

SEQ ID NO: 510414 - DNA, 25 bp, Rattus norvegicus
gtggacacgtgtacactctacacat

SEQ ID NO: 510415 - DNA, 25 bp, Rattus norvegicus
gtggacacgtgttcactctacacat

SEQ ID NO: 510416 - DNA, 25 bp, Rattus norvegicus
gtggacactaagcatatacctcaaa

SEQ ID NO: 510417 - DNA, 25 bp, Rattus norvegicus
gtggacactaaggatatacctcaaa

SEQ ID NO: 510418 - DNA, 25 bp, Rattus norvegicus
gtggacactatcaatggtgccttga

SEQ ID NO: 510419 - DNA, 25 bp, Rattus norvegicus
gtggacactatctatggtgccttga

SEQ ID NO: 510420 - DNA, 25 bp, Rattus norvegicus
gtggacactgagaacatccgccgtg

SEQ ID NO: 510421 - DNA, 25 bp, Rattus norvegicus
gtggacactgagtacatccgccgtg

SEQ ID NO: 510422 - DNA, 25 bp, Rattus norvegicus
gtggacactgggactgcacagcgat

SEQ ID NO: 510423 - DNA, 25 bp, Rattus norvegicus
gtggacactgggatatggttctcaa

SEQ ID NO: 510424 - DNA, 25 bp, Rattus norvegicus
gtggacactgggtctgcacagcgat

SEQ ID NO: 510425 - DNA, 25 bp, Rattus norvegicus
gtggacactgggttatggttctcaa

SEQ ID NO: 510426 - DNA, 25 bp, Rattus norvegicus
gtggacagaagaacctacacaagaa

SEQ ID NO: 510427 - DNA, 25 bp, Rattus norvegicus
gtggacagaagatcctacacaagaa

SEQ ID NO: 510428 - DNA, 25 bp, Rattus norvegicus
gtggacagacacaggccagggccaa

SEQ ID NO: 510429 - DNA, 25 bp, Rattus norvegicus
gtggacagacacatcacggcaatct

SEQ ID NO: 510430 - DNA, 25 bp, Rattus norvegicus
gtggacagacactggccagggccaa

SEQ ID NO: 510431 - DNA, 25 bp, Rattus norvegicus
gtggacagacacttcacggcaatct

SEQ ID NO: 510432 - DNA, 25 bp, Rattus norvegicus
gtggacagagacaccttactgaaag

SEQ ID NO: 510433 - DNA, 25 bp, Rattus norvegicus
gtggacagagactccttactgaaag

SEQ ID NO: 510434 - DNA, 25 bp, Rattus norvegicus
gtggacagagagattcaagcctata

SEQ ID NO: 510435 - DNA, 25 bp, Rattus norvegicus
gtggacagagagtttcaagcctata

SEQ ID NO: 510436 - DNA, 25 bp, Rattus norvegicus
gtggacagaggtatcctcctcagaa

SEQ ID NO: 510437 - DNA, 25 bp, Rattus norvegicus
gtggacagaggtttcctcctcagaa

SEQ ID NO: 510438 - DNA, 25 bp, Rattus norvegicus
gtggacagataacctgacgcccctg

SEQ ID NO: 510439 - DNA, 25 bp, Rattus norvegicus
gtggacagataagctgacgcccctg

SEQ ID NO: 510440 - DNA, 25 bp, Rattus norvegicus
gtggacagatccaatggctttgaac

SEQ ID NO: 510441 - DNA, 25 bp, Rattus norvegicus
gtggacagatcctatggctttgaac

SEQ ID NO: 510442 - DNA, 25 bp, Rattus norvegicus
gtggacagatgtacctctcaagcag

SEQ ID NO: 510443 - DNA, 25 bp, Rattus norvegicus
gtggacagatgttcctctcaagcag

SEQ ID NO: 510444 - DNA, 25 bp, Rattus norvegicus
gtggacagcacccaaatgacccaga

SEQ ID NO: 510445 - DNA, 25 bp, Rattus norvegicus
gtggacagcaccgaaatgacccaga

SEQ ID NO: 510446 - DNA, 25 bp, Rattus norvegicus
gtggacagctgcctaatatgtcagt

SEQ ID NO: 510447 - DNA, 25 bp, Rattus norvegicus
gtggacagctgcgtaatatgtcagt

SEQ ID NO: 510448 - DNA, 25 bp, Rattus norvegicus
gtggacaggctcattatacaaacta

SEQ ID NO: 510449 - DNA, 25 bp, Rattus norvegicus
gtggacaggctctttatacaaacta

SEQ ID NO: 510450 - DNA, 25 bp, Rattus norvegicus
gtggacagggtccttggcattcact

SEQ ID NO: 510451 - DNA, 25 bp, Rattus norvegicus
gtggacagggtcgttggcattcact

SEQ ID NO: 510452 - DNA, 25 bp, Rattus norvegicus
gtggacagtcgacagcgtgtactaa

SEQ ID NO: 510453 - DNA, 25 bp, Rattus norvegicus
gtggacagtcgagagcgtgtactaa

SEQ ID NO: 510454 - DNA, 25 bp, Rattus norvegicus
gtggacagtctgagttacagcccgt

SEQ ID NO: 510455 - DNA, 25 bp, Rattus norvegicus
gtggacagtctgtgttacagcccgt

SEQ ID NO: 510456 - DNA, 25 bp, Rattus norvegicus
gtggacagtgacaagcacctacttc

SEQ ID NO: 510457 - DNA, 25 bp, Rattus norvegicus
gtggacagtgacacgcacttatttc

SEQ ID NO: 510458 - DNA, 25 bp, Rattus norvegicus
gtggacagtgacactacttttctac

SEQ ID NO: 510459 - DNA, 25 bp, Rattus norvegicus
gtggacagtgactagcacctacttc

SEQ ID NO: 510460 - DNA, 25 bp, Rattus norvegicus
gtggacagtgactcgcacttatttc

SEQ ID NO: 510461 - DNA, 25 bp, Rattus norvegicus
gtggacagtgactctacttttctac

SEQ ID NO: 510462 - DNA, 25 bp, Rattus norvegicus
gtggacagtgtcaagctcaggagct

SEQ ID NO: 510463 - DNA, 25 bp, Rattus norvegicus
gtggacagtgtctagctcaggagct

SEQ ID NO: 510464 - DNA, 25 bp, Rattus norvegicus
gtggacagttttcagtactcacaga

SEQ ID NO: 510465 - DNA, 25 bp, Rattus norvegicus
gtggacagttttgagtactcacaga

SEQ ID NO: 510466 - DNA, 25 bp, Rattus norvegicus
gtggacatagctaataccttcccag

SEQ ID NO: 510467 - DNA, 25 bp, Rattus norvegicus
gtggacatagctatgttgtgcggaa

SEQ ID NO: 510468 - DNA, 25 bp, Rattus norvegicus
gtggacatagcttataccttcccag

SEQ ID NO: 510469 - DNA, 25 bp, Rattus norvegicus
gtggacatagctttgttgtgcggaa

SEQ ID NO: 510470 - DNA, 25 bp, Rattus norvegicus
gtggacatcagcctaagacctggtg

SEQ ID NO: 510471 - DNA, 25 bp, Rattus norvegicus
gtggacatcagcgtaagacctggtg

SEQ ID NO: 510472 - DNA, 25 bp, Rattus norvegicus
gtggacatcagtaccttgtttcatt

SEQ ID NO: 510473 - DNA, 25 bp, Rattus norvegicus
gtggacatcagttccttgtttcatt

SEQ ID NO: 510474 - DNA, 25 bp, Rattus norvegicus
gtggacatcatcagtgtcaccgtag

SEQ ID NO: 510475 - DNA, 25 bp, Rattus norvegicus
gtggacatcatctgtgtcaccgtag

SEQ ID NO: 510476 - DNA, 25 bp, Rattus norvegicus
gtggacatccgacgctgtgaccagt

SEQ ID NO: 510477 - DNA, 25 bp, Rattus norvegicus
gtggacatccgaggctgtgaccagt

SEQ ID NO: 510478 - DNA, 25 bp, Rattus norvegicus
gtggacatcctcacgcgagaaaggc

SEQ ID NO: 510479 - DNA, 25 bp, Rattus norvegicus
gtggacatcctctcgcgagaaaggc

SEQ ID NO: 510480 - DNA, 25 bp, Rattus norvegicus
gtggacatctatctgccaggctgcc

SEQ ID NO: 510481 - DNA, 25 bp, Rattus norvegicus
gtggacatctatgtgccaggctgcc

SEQ ID NO: 510482 - DNA, 25 bp, Rattus norvegicus
gtggacatctggacacttgtaaaca

SEQ ID NO: 510483 - DNA, 25 bp, Rattus norvegicus
gtggacatctggtcacttgtaaaca

SEQ ID NO: 510484 - DNA, 25 bp, Rattus norvegicus
gtggacatcttaaccctttgacaga

SEQ ID NO: 510485 - DNA, 25 bp, Rattus norvegicus
gtggacatcttatccctttgacaga

SEQ ID NO: 510486 - DNA, 25 bp, Rattus norvegicus
gtggacatctttccatgtcacacag

SEQ ID NO: 510487 - DNA, 25 bp, Rattus norvegicus
gtggacatctttgcatgtcacacag

SEQ ID NO: 510488 - DNA, 25 bp, Rattus norvegicus
gtggacatgccacttgagagtcttt

SEQ ID NO: 510489 - DNA, 25 bp, Rattus norvegicus
gtggacatgccagttgagagtcttt

SEQ ID NO: 510490 - DNA, 25 bp, Rattus norvegicus
gtggacatgcgcagtacagagcttt

SEQ ID NO: 510491 - DNA, 25 bp, Rattus norvegicus
gtggacatgcgctgtacagagcttt

SEQ ID NO: 510492 - DNA, 25 bp, Rattus norvegicus
gtggacatggtcaaggaacaactca

SEQ ID NO: 510493 - DNA, 25 bp, Rattus norvegicus
gtggacatggtctaggaacaactca

SEQ ID NO: 510494 - DNA, 25 bp, Rattus norvegicus
gtggacatgtctcctattgctgtga

SEQ ID NO: 510495 - DNA, 25 bp, Rattus norvegicus
gtggacatgtctgctattgctgtga

SEQ ID NO: 510496 - DNA, 25 bp, Rattus norvegicus
gtggacatgttcactttcaatgaag

SEQ ID NO: 510497 - DNA, 25 bp, Rattus norvegicus
gtggacatgttctctttcaatgaag

SEQ ID NO: 510498 - DNA, 25 bp, Rattus norvegicus
gtggacattaacacctgtaaccaga

SEQ ID NO: 510499 - DNA, 25 bp, Rattus norvegicus
gtggacattaactcctgtaaccaga

SEQ ID NO: 510500 - DNA, 25 bp, Rattus norvegicus
gtggacattactcattacagcaaag

SEQ ID NO: 510501 - DNA, 25 bp, Rattus norvegicus
gtggacattactgattacagcaaag

SEQ ID NO: 510502 - DNA, 25 bp, Rattus norvegicus
gtggacattagacataccggcgcta

SEQ ID NO: 510503 - DNA, 25 bp, Rattus norvegicus
gtggacattagagataccggcgcta

SEQ ID NO: 510504 - DNA, 25 bp, Rattus norvegicus
gtggacattcacaattgccagggaa

SEQ ID NO: 510505 - DNA, 25 bp, Rattus norvegicus
gtggacattcactattgccagggaa

SEQ ID NO: 510506 - DNA, 25 bp, Rattus norvegicus
gtggacattcatctattgctcaagc

SEQ ID NO: 510507 - DNA, 25 bp, Rattus norvegicus
gtggacattcatgtattgctcaagc

SEQ ID NO: 510508 - DNA, 20 bp, Rattus norvegicus
gtggacattccacactgtgg

SEQ ID NO: 510509 - DNA, 20 bp, Rattus norvegicus
gtggacattccccactgtgg

SEQ ID NO: 510510 - DNA, 20 bp, Rattus norvegicus
gtggacattccgcactgtgg

SEQ ID NO: 510511 - DNA, 20 bp, Rattus norvegicus
gtggacattcctcactgtgg

SEQ ID NO: 510512 - DNA, 25 bp, Rattus norvegicus
gtggacattggcataaacctcgaca

SEQ ID NO: 510513 - DNA, 25 bp, Rattus norvegicus
gtggacattggcttaaacctcgaca

SEQ ID NO: 510514 - DNA, 25 bp, Rattus norvegicus
gtggacattgttcccatcaacgacc

SEQ ID NO: 510515 - DNA, 25 bp, Rattus norvegicus
gtggacattgttgccatcaacgacc

SEQ ID NO: 510516 - DNA, 25 bp, Rattus norvegicus
gtggacatttacattgatcattcaa

SEQ ID NO: 510517 - DNA, 25 bp, Rattus norvegicus
gtggacatttactttgatcattcaa

SEQ ID NO: 510518 - DNA, 25 bp, Rattus norvegicus
gtggacattttcaactaaagttagt

SEQ ID NO: 510519 - DNA, 25 bp, Rattus norvegicus
gtggacattttctactaaagttagt

SEQ ID NO: 510520 - DNA, 25 bp, Rattus norvegicus
gtggaccaaacccaatggactactg

SEQ ID NO: 510521 - DNA, 25 bp, Rattus norvegicus
gtggaccaaaccgaatggactactg

SEQ ID NO: 510522 - DNA, 25 bp, Rattus norvegicus
gtggaccaagatctgagctttcagt

SEQ ID NO: 510523 - DNA, 25 bp, Rattus norvegicus
gtggaccaagatgtgagctttcagt

SEQ ID NO: 510524 - DNA, 25 bp, Rattus norvegicus
gtggaccaatccagtagcgcaagaa

SEQ ID NO: 510525 - DNA, 25 bp, Rattus norvegicus
gtggaccaatcctgtagcgcaagaa

SEQ ID NO: 510526 - DNA, 25 bp, Rattus norvegicus
gtggaccaatgccaacggacttctc

SEQ ID NO: 510527 - DNA, 25 bp, Rattus norvegicus
gtggaccaatgcgaacggacttctc

SEQ ID NO: 510528 - DNA, 25 bp, Rattus norvegicus
gtggaccacactattgagtatcaag

SEQ ID NO: 510529 - DNA, 25 bp, Rattus norvegicus
gtggaccacacttttgagtatcaag

SEQ ID NO: 510530 - DNA, 25 bp, Rattus norvegicus
gtggaccacagcctgaaaggtttgt

SEQ ID NO: 510531 - DNA, 25 bp, Rattus norvegicus
gtggaccacagcgtgaaaggtttgt

SEQ ID NO: 510532 - DNA, 25 bp, Rattus norvegicus
gtggaccacagtcaactgcagggca

SEQ ID NO: 510533 - DNA, 25 bp, Rattus norvegicus
gtggaccacagtgaactgcagggca

SEQ ID NO: 510534 - DNA, 25 bp, Rattus norvegicus
gtggaccaccatacacgttaacagt

SEQ ID NO: 510535 - DNA, 25 bp, Rattus norvegicus
gtggaccaccattcacgttaacagt

SEQ ID NO: 510536 - DNA, 25 bp, Rattus norvegicus
gtggaccacccactgagttggcaaa

SEQ ID NO: 510537 - DNA, 25 bp, Rattus norvegicus
gtggaccacccagtgagttggcaaa

SEQ ID NO: 510538 - DNA, 25 bp, Rattus norvegicus
gtggaccactggagagaccaagggt

SEQ ID NO: 510539 - DNA, 25 bp, Rattus norvegicus
gtggaccactggtgagaccaagggt

SEQ ID NO: 510540 - DNA, 25 bp, Rattus norvegicus
gtggaccagcgaccgcgcagcaaac

SEQ ID NO: 510541 - DNA, 25 bp, Rattus norvegicus
gtggaccagcgagcgcgcagcaaac

SEQ ID NO: 510542 - DNA, 25 bp, Rattus norvegicus
gtggaccaggcacatagccttccag

SEQ ID NO: 510543 - DNA, 25 bp, Rattus norvegicus
gtggaccaggcagatagccttccag

SEQ ID NO: 510544 - DNA, 25 bp, Rattus norvegicus
gtggaccagggtagcttcgaaagaa

SEQ ID NO: 510545 - DNA, 25 bp, Rattus norvegicus
gtggaccagggttgcttcgaaagaa

SEQ ID NO: 510546 - DNA, 25 bp, Rattus norvegicus
gtggaccatgccaaaagattccgcc

SEQ ID NO: 510547 - DNA, 25 bp, Rattus norvegicus
gtggaccatgcctaaagattccgcc

SEQ ID NO: 510548 - DNA, 25 bp, Rattus norvegicus
gtggaccatgtgaggatgccccaga

SEQ ID NO: 510549 - DNA, 25 bp, Rattus norvegicus
gtggaccatgtgtggatgccccaga

SEQ ID NO: 510550 - DNA, 25 bp, Rattus norvegicus
gtggaccattttctgtctgactgca

SEQ ID NO: 510551 - DNA, 25 bp, Rattus norvegicus
gtggaccattttgtgtctgactgca

SEQ ID NO: 510552 - DNA, 25 bp, Rattus norvegicus
gtggacccacagaggatatctattt

SEQ ID NO: 510553 - DNA, 25 bp, Rattus norvegicus
gtggacccacagtggatatctattt

SEQ ID NO: 510554 - DNA, 25 bp, Rattus norvegicus
gtggacccaggactgcgtttctaag

SEQ ID NO: 510555 - DNA, 25 bp, Rattus norvegicus
gtggacccaggagtgcgtttctaag

SEQ ID NO: 510556 - DNA, 25 bp, Rattus norvegicus
gtggacccagggattactctgtaaa

SEQ ID NO: 510557 - DNA, 25 bp, Rattus norvegicus
gtggacccagggtttactctgtaaa

SEQ ID NO: 510558 - DNA, 25 bp, Rattus norvegicus
gtggacccagtgacttgcaccagaa

SEQ ID NO: 510559 - DNA, 25 bp, Rattus norvegicus
gtggacccagtgtcttgcaccagaa

SEQ ID NO: 510560 - DNA, 25 bp, Rattus norvegicus
gtggacccatgccagaataaactgt

SEQ ID NO: 510561 - DNA, 25 bp, Rattus norvegicus
gtggacccatgcgagaataaactgt

SEQ ID NO: 510562 - DNA, 25 bp, Rattus norvegicus
gtggacccatggaagtctcgccagg

SEQ ID NO: 510563 - DNA, 25 bp, Rattus norvegicus
gtggacccatggtagtctcgccagg

SEQ ID NO: 510564 - DNA, 25 bp, Rattus norvegicus
gtggaccccagtaacatctttggaa

SEQ ID NO: 510565 - DNA, 25 bp, Rattus norvegicus
gtggaccccagttacatctttggaa

SEQ ID NO: 510566 - DNA, 25 bp, Rattus norvegicus
gtggaccccgaacagtcctgagaga

SEQ ID NO: 510567 - DNA, 25 bp, Rattus norvegicus
gtggaccccgaagagtcctgagaga

SEQ ID NO: 510568 - DNA, 25 bp, Rattus norvegicus
gtggaccgagagcacagtccccaga

SEQ ID NO: 510569 - DNA, 25 bp, Rattus norvegicus
gtggaccgagaggacagtccccaga

SEQ ID NO: 510570 - DNA, 25 bp, Rattus norvegicus
gtggaccgcttacaagtttagcctg

SEQ ID NO: 510571 - DNA, 25 bp, Rattus norvegicus
gtggaccgcttagaagtttagcctg

SEQ ID NO: 510572 - DNA, 25 bp, Rattus norvegicus
gtggaccggaggcaacctcaccctg

SEQ ID NO: 510573 - DNA, 25 bp, Rattus norvegicus
gtggaccggagggaacctcaccctg

SEQ ID NO: 510574 - DNA, 25 bp, Rattus norvegicus
gtggaccgtggtctcactagacaac

SEQ ID NO: 510575 - DNA, 25 bp, Rattus norvegicus
gtggaccgtggtgtcactagacaac

SEQ ID NO: 510576 - DNA, 25 bp, Rattus norvegicus
gtggacctcacactggacagctcgt

SEQ ID NO: 510577 - DNA, 25 bp, Rattus norvegicus
gtggacctcacagtggacagctcgt

SEQ ID NO: 510578 - DNA, 25 bp, Rattus norvegicus
gtggacctcatgccctacatggcct

SEQ ID NO: 510579 - DNA, 25 bp, Rattus norvegicus
gtggacctcatggcctacatggcct

SEQ ID NO: 510580 - DNA, 25 bp, Rattus norvegicus
gtggacctcgttacgggtgtgcctc

SEQ ID NO: 510581 - DNA, 25 bp, Rattus norvegicus
gtggacctcgtttcgggtgtgcctc

SEQ ID NO: 510582 - DNA, 25 bp, Rattus norvegicus
gtggacctctaaaggcacctcactg

SEQ ID NO: 510583 - DNA, 25 bp, Rattus norvegicus
gtggacctctaatggcacctcactg

SEQ ID NO: 510584 - DNA, 25 bp, Rattus norvegicus
gtggacctctctccagccaagatga

SEQ ID NO: 510585 - DNA, 25 bp, Rattus norvegicus
gtggacctctctgcagccaagatga

SEQ ID NO: 510586 - DNA, 25 bp, Rattus norvegicus
gtggacctctgtcatttcagggcca

SEQ ID NO: 510587 - DNA, 25 bp, Rattus norvegicus
gtggacctctgtctacactatcaat

SEQ ID NO: 510588 - DNA, 25 bp, Rattus norvegicus
gtggacctctgtgatttcagggcca

SEQ ID NO: 510589 - DNA, 25 bp, Rattus norvegicus
gtggacctctgtgtacactatcaat

SEQ ID NO: 510590 - DNA, 25 bp, Rattus norvegicus
gtggacctggctctgcgaataaagc

SEQ ID NO: 510591 - DNA, 25 bp, Rattus norvegicus
gtggacctggctgtgcgaataaagc

SEQ ID NO: 510592 - DNA, 25 bp, Rattus norvegicus
gtggacctgggaagcttctacttgc

SEQ ID NO: 510593 - DNA, 25 bp, Rattus norvegicus
gtggacctgggatgcttctacttgc

SEQ ID NO: 510594 - DNA, 25 bp, Rattus norvegicus
gtggacctggttccagctcctgagt

SEQ ID NO: 510595 - DNA, 25 bp, Rattus norvegicus
gtggacctggttgcagctcctgagt

SEQ ID NO: 510596 - DNA, 25 bp, Rattus norvegicus
gtggaccttacgagtcaattcaaag

SEQ ID NO: 510597 - DNA, 25 bp, Rattus norvegicus
gtggaccttacgtgtcaattcaaag

SEQ ID NO: 510598 - DNA, 25 bp, Rattus norvegicus
gtggaccttcgaaattaccttgagc

SEQ ID NO: 510599 - DNA, 25 bp, Rattus norvegicus
gtggaccttcgatattaccttgagc

SEQ ID NO: 510600 - DNA, 25 bp, Rattus norvegicus
gtggaccttgagatgacccagggat

SEQ ID NO: 510601 - DNA, 25 bp, Rattus norvegicus
gtggaccttgagttgacccagggat

SEQ ID NO: 510602 - DNA, 25 bp, Rattus norvegicus
gtggaccttgataattcatgaccta

SEQ ID NO: 510603 - DNA, 25 bp, Rattus norvegicus
gtggaccttgattattcatgaccta

SEQ ID NO: 510604 - DNA, 25 bp, Rattus norvegicus
gtggaccttggaatcgctctgggca

SEQ ID NO: 510605 - DNA, 25 bp, Rattus norvegicus
gtggaccttggattcgctctgggca

SEQ ID NO: 510606 - DNA, 25 bp, Rattus norvegicus
gtggaccttggcctgggccgggtat

SEQ ID NO: 510607 - DNA, 25 bp, Rattus norvegicus
gtggaccttggcgtgggccgggtat

SEQ ID NO: 510608 - DNA, 25 bp, Rattus norvegicus
gtggaccttgtacactatctcttgg

SEQ ID NO: 510609 - DNA, 25 bp, Rattus norvegicus
gtggaccttgtagactatctcttgg

SEQ ID NO: 510610 - DNA, 25 bp, Rattus norvegicus
gtggaccttgttaaccagtctggaa

SEQ ID NO: 510611 - DNA, 25 bp, Rattus norvegicus
gtggaccttgtttaccagtctggaa

SEQ ID NO: 510612 - DNA, 25 bp, Rattus norvegicus
gtggacctttccaagatgcagaacg

SEQ ID NO: 510613 - DNA, 25 bp, Rattus norvegicus
gtggacctttcctagatgcagaacg

SEQ ID NO: 510614 - DNA, 25 bp, Rattus norvegicus
gtggacctttctacaagcagctgac

SEQ ID NO: 510615 - DNA, 25 bp, Rattus norvegicus
gtggacctttcttcaagcagctgac

SEQ ID NO: 510616 - DNA, 25 bp, Rattus norvegicus
gtggacgacatgctcacactggcca

SEQ ID NO: 510617 - DNA, 25 bp, Rattus norvegicus
gtggacgacatggtcacactggcca

SEQ ID NO: 510618 - DNA, 25 bp, Rattus norvegicus
gtggacgagcatctctgtctgcaga

SEQ ID NO: 510619 - DNA, 25 bp, Rattus norvegicus
gtggacgagcatgtctgtctgcaga

SEQ ID NO: 510620 - DNA, 25 bp, Rattus norvegicus
gtggacgagcgtccgcatgctaatc

SEQ ID NO: 510621 - DNA, 25 bp, Rattus norvegicus
gtggacgagcgtgcgcatgctaatc

SEQ ID NO: 510622 - DNA, 25 bp, Rattus norvegicus
gtggacgagtatacagagaccttaa

SEQ ID NO: 510623 - DNA, 25 bp, Rattus norvegicus
gtggacgagtattcagagaccttaa

SEQ ID NO: 510624 - DNA, 25 bp, Rattus norvegicus
gtggacgccatgattcatgctgcca

SEQ ID NO: 510625 - DNA, 25 bp, Rattus norvegicus
gtggacgccatgtttcatgctgcca

SEQ ID NO: 510626 - DNA, 25 bp, Rattus norvegicus
gtggacgcctacaaacatcatgaat

SEQ ID NO: 510627 - DNA, 25 bp, Rattus norvegicus
gtggacgcctactaacatcatgaat

SEQ ID NO: 510628 - DNA, 25 bp, Rattus norvegicus
gtggacgcctgacaagcttcacggt

SEQ ID NO: 510629 - DNA, 25 bp, Rattus norvegicus
gtggacgcctgagaagcttcacggt

SEQ ID NO: 510630 - DNA, 25 bp, Rattus norvegicus
gtggacgcctgcacgatgacccgtc

SEQ ID NO: 510631 - DNA, 25 bp, Rattus norvegicus
gtggacgcctgctcgatgacccgtc

SEQ ID NO: 510632 - DNA, 25 bp, Rattus norvegicus
gtggacggacctcctgatctagatg

SEQ ID NO: 510633 - DNA, 25 bp, Rattus norvegicus
gtggacggacctgctgatctagatg

SEQ ID NO: 510634 - DNA, 25 bp, Rattus norvegicus
gtggacggatctcaattcggctttt

SEQ ID NO: 510635 - DNA, 25 bp, Rattus norvegicus
gtggacggatctgaattcggctttt

SEQ ID NO: 510636 - DNA, 25 bp, Rattus norvegicus
gtggacgtcaggaaaggtctgccct

SEQ ID NO: 510637 - DNA, 25 bp, Rattus norvegicus
gtggacgtcaggtaaggtctgccct

SEQ ID NO: 510638 - DNA, 25 bp, Rattus norvegicus
gtggacgtccaacatacttgctgaa

SEQ ID NO: 510639 - DNA, 25 bp, Rattus norvegicus
gtggacgtccaactaaacaaacgtg

SEQ ID NO: 510640 - DNA, 25 bp, Rattus norvegicus
gtggacgtccaagatacttgctgaa

SEQ ID NO: 510641 - DNA, 25 bp, Rattus norvegicus
gtggacgtccaagtaaacaaacgtg

SEQ ID NO: 510642 - DNA, 25 bp, Rattus norvegicus
gtggacgtcctgagctcagatggat

SEQ ID NO: 510643 - DNA, 25 bp, Rattus norvegicus
gtggacgtcctgtgctcagatggat

SEQ ID NO: 510644 - DNA, 25 bp, Rattus norvegicus
gtggacgtgaaccagcactccgaag

SEQ ID NO: 510645 - DNA, 25 bp, Rattus norvegicus
gtggacgtgaacgagcactccgaag

SEQ ID NO: 510646 - DNA, 25 bp, Rattus norvegicus
gtggacgtttaaattgtacgacatc

SEQ ID NO: 510647 - DNA, 25 bp, Rattus norvegicus
gtggacgtttaatttgtacgacatc

SEQ ID NO: 510648 - DNA, 25 bp, Rattus norvegicus
gtggacgttttaatttatgacagct

SEQ ID NO: 510649 - DNA, 25 bp, Rattus norvegicus
gtggacgttttattttatgacagct

SEQ ID NO: 510650 - DNA, 25 bp, Rattus norvegicus
gtggactaatttcagatcattgtgg

SEQ ID NO: 510651 - DNA, 25 bp, Rattus norvegicus
gtggactaatttgagatcattgtgg

SEQ ID NO: 510652 - DNA, 25 bp, Rattus norvegicus
gtggactaccatagagccgtgcaga

SEQ ID NO: 510653 - DNA, 25 bp, Rattus norvegicus
gtggactaccattgagccgtgcaga

SEQ ID NO: 510654 - DNA, 25 bp, Rattus norvegicus
gtggactacctgatcaatggcatgt

SEQ ID NO: 510655 - DNA, 25 bp, Rattus norvegicus
gtggactacctgttcaatggcatgt

SEQ ID NO: 510656 - DNA, 25 bp, Rattus norvegicus
gtggactactccaaattcgggaaca

SEQ ID NO: 510657 - DNA, 25 bp, Rattus norvegicus
gtggactactcctaattcgggaaca

SEQ ID NO: 510658 - DNA, 25 bp, Rattus norvegicus
gtggactagagcattgccctaatca

SEQ ID NO: 510659 - DNA, 25 bp, Rattus norvegicus
gtggactagagctttgccctaatca

SEQ ID NO: 510660 - DNA, 25 bp, Rattus norvegicus
gtggactaggccagcctcacagaga

SEQ ID NO: 510661 - DNA, 25 bp, Rattus norvegicus
gtggactaggcctgcctcacagaga

SEQ ID NO: 510662 - DNA, 25 bp, Rattus norvegicus
gtggactatatgatcatcctaagta

SEQ ID NO: 510663 - DNA, 25 bp, Rattus norvegicus
gtggactatatgttcatcctaagta

SEQ ID NO: 510664 - DNA, 25 bp, Rattus norvegicus
gtggactatgaccaaaggaacatct

SEQ ID NO: 510665 - DNA, 25 bp, Rattus norvegicus
gtggactatgacgaaaggaacatct

SEQ ID NO: 510666 - DNA, 25 bp, Rattus norvegicus
gtggactatgctcaaaaactgccgt

SEQ ID NO: 510667 - DNA, 25 bp, Rattus norvegicus
gtggactatgctgaaaaactgccgt

SEQ ID NO: 510668 - DNA, 25 bp, Rattus norvegicus
gtggactcacacagcagtcacttgt

SEQ ID NO: 510669 - DNA, 25 bp, Rattus norvegicus
gtggactcacactgcagtcacttgt

SEQ ID NO: 510670 - DNA, 25 bp, Rattus norvegicus
gtggactcactaccagcgatctaat

SEQ ID NO: 510671 - DNA, 25 bp, Rattus norvegicus
gtggactcactagcagcgatctaat

SEQ ID NO: 510672 - DNA, 25 bp, Rattus norvegicus
gtggactcactcagcgaaggtctgg

SEQ ID NO: 510673 - DNA, 25 bp, Rattus norvegicus
gtggactcactctgcgaaggtctgg

SEQ ID NO: 510674 - DNA, 25 bp, Rattus norvegicus
gtggactcactgacatatttgattc

SEQ ID NO: 510675 - DNA, 25 bp, Rattus norvegicus
gtggactcactgatgcccccctggg

SEQ ID NO: 510676 - DNA, 25 bp, Rattus norvegicus
gtggactcactgtcatatttgattc

SEQ ID NO: 510677 - DNA, 25 bp, Rattus norvegicus
gtggactcactgttgcccccctggg

SEQ ID NO: 510678 - DNA, 25 bp, Rattus norvegicus
gtggactcatcccagttcagtgaat

SEQ ID NO: 510679 - DNA, 25 bp, Rattus norvegicus
gtggactcatccctaaactcaaact

SEQ ID NO: 510680 - DNA, 25 bp, Rattus norvegicus
gtggactcatccgagttcagtgaat

SEQ ID NO: 510681 - DNA, 25 bp, Rattus norvegicus
gtggactcatccgtaaactcaaact

SEQ ID NO: 510682 - DNA, 25 bp, Rattus norvegicus
gtggactccagtcagctagtaacgc

SEQ ID NO: 510683 - DNA, 25 bp, Rattus norvegicus
gtggactccagtgagctagtaacgc

SEQ ID NO: 510684 - DNA, 25 bp, Rattus norvegicus
gtggactccccgaagtattatagca

SEQ ID NO: 510685 - DNA, 25 bp, Rattus norvegicus
gtggactccccgtagtattatagca

SEQ ID NO: 510686 - DNA, 25 bp, Rattus norvegicus
gtggactcctccattcaagctgcag

SEQ ID NO: 510687 - DNA, 25 bp, Rattus norvegicus
gtggactcctcctttcaagctgcag

SEQ ID NO: 510688 - DNA, 25 bp, Rattus norvegicus
gtggactcgataactgtgctctatc

SEQ ID NO: 510689 - DNA, 25 bp, Rattus norvegicus
gtggactcgatatctgtgctctatc

SEQ ID NO: 510690 - DNA, 25 bp, Rattus norvegicus
gtggactctaaactgtacttttctt

SEQ ID NO: 510691 - DNA, 25 bp, Rattus norvegicus
gtggactctaaagtgtacttttctt

SEQ ID NO: 510692 - DNA, 25 bp, Rattus norvegicus
gtggactctagcattatcagactac

SEQ ID NO: 510693 - DNA, 25 bp, Rattus norvegicus
gtggactctagctttatcagactac

SEQ ID NO: 510694 - DNA, 25 bp, Rattus norvegicus
gtggactctccacgttttcaattaa

SEQ ID NO: 510695 - DNA, 25 bp, Rattus norvegicus
gtggactctccaggttttcaattaa

SEQ ID NO: 510696 - DNA, 25 bp, Rattus norvegicus
gtggactctctgacatatcctttat

SEQ ID NO: 510697 - DNA, 25 bp, Rattus norvegicus
gtggactctctgtcatatcctttat

SEQ ID NO: 510698 - DNA, 25 bp, Rattus norvegicus
gtggactcttatacttttttcatta

SEQ ID NO: 510699 - DNA, 25 bp, Rattus norvegicus
gtggactcttattcttttttcatta

SEQ ID NO: 510700 - DNA, 25 bp, Rattus norvegicus
gtggactgaacacagtcggccgaca

SEQ ID NO: 510701 - DNA, 25 bp, Rattus norvegicus
gtggactgaacagagtcggccgaca

SEQ ID NO: 510702 - DNA, 25 bp, Rattus norvegicus
gtggactgacacctttaggctttga

SEQ ID NO: 510703 - DNA, 25 bp, Rattus norvegicus
gtggactgacacgtttaggctttga

SEQ ID NO: 510704 - DNA, 25 bp, Rattus norvegicus
gtggactgcataccctgagagcatc

SEQ ID NO: 510705 - DNA, 25 bp, Rattus norvegicus
gtggactgcatagcctgagagcatc

SEQ ID NO: 510706 - DNA, 25 bp, Rattus norvegicus
gtggactgcatcaatatccgcacgg

SEQ ID NO: 510707 - DNA, 25 bp, Rattus norvegicus
gtggactgcatctatatccgcacgg

SEQ ID NO: 510708 - DNA, 25 bp, Rattus norvegicus
gtggactgctagagtacagcctgca

SEQ ID NO: 510709 - DNA, 25 bp, Rattus norvegicus
gtggactgctagtgtacagcctgca

SEQ ID NO: 510710 - DNA, 25 bp, Rattus norvegicus
gtggactgctctcttggtctcacca

SEQ ID NO: 510711 - DNA, 25 bp, Rattus norvegicus
gtggactgctctgttggtctcacca

SEQ ID NO: 510712 - DNA, 25 bp, Rattus norvegicus
gtggactgtactccacgtcagggca

SEQ ID NO: 510713 - DNA, 25 bp, Rattus norvegicus
gtggactgtactgcacgtcagggca

SEQ ID NO: 510714 - DNA, 25 bp, Rattus norvegicus
gtggactgtcagagtggtataaaat

SEQ ID NO: 510715 - DNA, 25 bp, Rattus norvegicus
gtggactgtcagtgtggtataaaat

SEQ ID NO: 510716 - DNA, 25 bp, Rattus norvegicus
gtggactgtcttctaacgagctttg

SEQ ID NO: 510717 - DNA, 25 bp, Rattus norvegicus
gtggactgtcttgtaacgagctttg

SEQ ID NO: 510718 - DNA, 25 bp, Rattus norvegicus
gtggactgtggcacgggatatacaa

SEQ ID NO: 510719 - DNA, 25 bp, Rattus norvegicus
gtggactgtggctcgggatatacaa

SEQ ID NO: 510720 - DNA, 25 bp, Rattus norvegicus
gtggactgttctaactgatgtgcgt

SEQ ID NO: 510721 - DNA, 25 bp, Rattus norvegicus
gtggactgttcttactgatgtgcgt

SEQ ID NO: 510722 - DNA, 25 bp, Rattus norvegicus
gtggactgttgtatacgctaatcta

SEQ ID NO: 510723 - DNA, 25 bp, Rattus norvegicus
gtggactgttgtttacgctaatcta

SEQ ID NO: 510724 - DNA, 25 bp, Rattus norvegicus
gtggacttacaccttaacaagcgtg

SEQ ID NO: 510725 - DNA, 25 bp, Rattus norvegicus
gtggacttacacgttaacaagcgtg

SEQ ID NO: 510726 - DNA, 25 bp, Rattus norvegicus
gtggacttcacaagaactcgctgtt

SEQ ID NO: 510727 - DNA, 25 bp, Rattus norvegicus
gtggacttcacatgaactcgctgtt

SEQ ID NO: 510728 - DNA, 25 bp, Rattus norvegicus
gtggacttcagaaatttgagccttt

SEQ ID NO: 510729 - DNA, 25 bp, Rattus norvegicus
gtggacttcagatatttgagccttt

SEQ ID NO: 510730 - DNA, 25 bp, Rattus norvegicus
gtggacttcccaagcagagacttgc

SEQ ID NO: 510731 - DNA, 25 bp, Rattus norvegicus
gtggacttcccatgcagagacttgc

SEQ ID NO: 510732 - DNA, 25 bp, Rattus norvegicus
gtggacttcgctcgctggctatgca

SEQ ID NO: 510733 - DNA, 25 bp, Rattus norvegicus
gtggacttcgctggctggctatgca

SEQ ID NO: 510734 - DNA, 25 bp, Rattus norvegicus
gtggacttgagcacaccatcaacat

SEQ ID NO: 510735 - DNA, 25 bp, Rattus norvegicus
gtggacttgagctcaccatcaacat

SEQ ID NO: 510736 - DNA, 25 bp, Rattus norvegicus
gtggacttgcctactcagagctggg

SEQ ID NO: 510737 - DNA, 25 bp, Rattus norvegicus
gtggacttgccttctcagagctggg

SEQ ID NO: 510738 - DNA, 25 bp, Rattus norvegicus
gtggacttgctgactggtgagccca

SEQ ID NO: 510739 - DNA, 25 bp, Rattus norvegicus
gtggacttgctgtctggtgagccca

SEQ ID NO: 510740 - DNA, 25 bp, Rattus norvegicus
gtggacttggacacactggtgagcc

SEQ ID NO: 510741 - DNA, 25 bp, Rattus norvegicus
gtggacttggactcactggtgagcc

SEQ ID NO: 510742 - DNA, 25 bp, Rattus norvegicus
gtggacttgtacaaccaacgctact

SEQ ID NO: 510743 - DNA, 25 bp, Rattus norvegicus
gtggacttgtactaccaacgctact

SEQ ID NO: 510744 - DNA, 25 bp, Rattus norvegicus
gtggactttatgcattttgtttgct

SEQ ID NO: 510745 - DNA, 25 bp, Rattus norvegicus
gtggactttatggattttgtttgct

SEQ ID NO: 510746 - DNA, 25 bp, Rattus norvegicus
gtggactttctacgatttctttttg

SEQ ID NO: 510747 - DNA, 25 bp, Rattus norvegicus
gtggactttctaggatttctttttg

SEQ ID NO: 510748 - DNA, 25 bp, Rattus norvegicus
gtggactttgaaatgctgctggccc

SEQ ID NO: 510749 - DNA, 25 bp, Rattus norvegicus
gtggactttgaattgctgctggccc

SEQ ID NO: 510750 - DNA, 25 bp, Rattus norvegicus
gtggacttttacacaagctggtctt

SEQ ID NO: 510751 - DNA, 25 bp, Rattus norvegicus
gtggacttttactcaagctggtctt

SEQ ID NO: 510752 - DNA, 25 bp, Rattus norvegicus
gtggagaaacttaacccagactagt

SEQ ID NO: 510753 - DNA, 25 bp, Rattus norvegicus
gtggagaaactttacccagactagt

SEQ ID NO: 510754 - DNA, 25 bp, Rattus norvegicus
gtggagaaccatcaaggacctatga

SEQ ID NO: 510755 - DNA, 25 bp, Rattus norvegicus
gtggagaaccatgaaggacctatga

SEQ ID NO: 510756 - DNA, 25 bp, Rattus norvegicus
gtggagaactgacctggcctgcctt

SEQ ID NO: 510757 - DNA, 25 bp, Rattus norvegicus
gtggagaactgagctggcctgcctt

SEQ ID NO: 510758 - DNA, 25 bp, Rattus norvegicus
gtggagaagcacatgtgtcatgcat

SEQ ID NO: 510759 - DNA, 25 bp, Rattus norvegicus
gtggagaagcacttgtgtcatgcat

SEQ ID NO: 510760 - DNA, 25 bp, Rattus norvegicus
gtggagaagcccaccaagtgcggct

SEQ ID NO: 510761 - DNA, 25 bp, Rattus norvegicus
gtggagaagccctccaagtgcggct

SEQ ID NO: 510762 - DNA, 25 bp, Rattus norvegicus
gtggagaagttcctagccgagcttt

SEQ ID NO: 510763 - DNA, 25 bp, Rattus norvegicus
gtggagaagttcgtagccgagcttt

SEQ ID NO: 510764 - DNA, 25 bp, Rattus norvegicus
gtggagaatacgcagcccattatga

SEQ ID NO: 510765 - DNA, 25 bp, Rattus norvegicus
gtggagaatacggagcccattatga

SEQ ID NO: 510766 - DNA, 25 bp, Rattus norvegicus
gtggagacacacctaggacctaact

SEQ ID NO: 510767 - DNA, 25 bp, Rattus norvegicus
gtggagacacacgtaggacctaact

SEQ ID NO: 510768 - DNA, 25 bp, Rattus norvegicus
gtggagacactgacaccaggcatgt

SEQ ID NO: 510769 - DNA, 25 bp, Rattus norvegicus
gtggagacactgtcaccaggcatgt

SEQ ID NO: 510770 - DNA, 25 bp, Rattus norvegicus
gtggagacatgtcccatcaactgtg

SEQ ID NO: 510771 - DNA, 25 bp, Rattus norvegicus
gtggagacatgtgccatcaactgtg

SEQ ID NO: 510772 - DNA, 25 bp, Rattus norvegicus
gtggagaccatcatgacgctgcgca

SEQ ID NO: 510773 - DNA, 25 bp, Rattus norvegicus
gtggagaccatcttgacgctgcgca

SEQ ID NO: 510774 - DNA, 25 bp, Rattus norvegicus
gtggagaccccaactcttaaaagat

SEQ ID NO: 510775 - DNA, 25 bp, Rattus norvegicus
gtggagaccccatctcttaaaagat

SEQ ID NO: 510776 - DNA, 25 bp, Rattus norvegicus
gtggagacctacacagtcaactttg

SEQ ID NO: 510777 - DNA, 25 bp, Rattus norvegicus
gtggagacctactcagtcaactttg

SEQ ID NO: 510778 - DNA, 25 bp, Rattus norvegicus
gtggagacctatcagattggatttc

SEQ ID NO: 510779 - DNA, 25 bp, Rattus norvegicus
gtggagacctatgagattggatttc

SEQ ID NO: 510780 - DNA, 25 bp, Rattus norvegicus
gtggagacctcaaacgactgtgctt

SEQ ID NO: 510781 - DNA, 25 bp, Rattus norvegicus
gtggagacctcactccttggttgga

SEQ ID NO: 510782 - DNA, 25 bp, Rattus norvegicus
gtggagacctcagtccttggttgga

SEQ ID NO: 510783 - DNA, 25 bp, Rattus norvegicus
gtggagacctcatacgactgtgctt

SEQ ID NO: 510784 - DNA, 25 bp, Rattus norvegicus
gtggagacctgccactgcatcgctg

SEQ ID NO: 510785 - DNA, 25 bp, Rattus norvegicus
gtggagacctgcgactgcatcgctg

SEQ ID NO: 510786 - DNA, 25 bp, Rattus norvegicus
gtggagacggcaatcgcatctataa

SEQ ID NO: 510787 - DNA, 25 bp, Rattus norvegicus
gtggagacggcattcgcatctataa

SEQ ID NO: 510788 - DNA, 25 bp, Rattus norvegicus
gtggagacggttctttgactgtatt

SEQ ID NO: 510789 - DNA, 25 bp, Rattus norvegicus
gtggagacggttgtttgactgtatt

SEQ ID NO: 510790 - DNA, 25 bp, Rattus norvegicus
gtggagacgtgacacaggacccttc

SEQ ID NO: 510791 - DNA, 25 bp, Rattus norvegicus
gtggagacgtgagacaggacccttc

SEQ ID NO: 510792 - DNA, 25 bp, Rattus norvegicus
gtggagactaagattgcgtcccctc

SEQ ID NO: 510793 - DNA, 25 bp, Rattus norvegicus
gtggagactaagtttgcgtcccctc

SEQ ID NO: 510794 - DNA, 25 bp, Rattus norvegicus
gtggagactgccacagattactgta

SEQ ID NO: 510795 - DNA, 25 bp, Rattus norvegicus
gtggagactgcctcagattactgta

SEQ ID NO: 510796 - DNA, 25 bp, Rattus norvegicus
gtggagagaacaagccccttcaaga

SEQ ID NO: 510797 - DNA, 25 bp, Rattus norvegicus
gtggagagaacatgccccttcaaga

SEQ ID NO: 510798 - DNA, 25 bp, Rattus norvegicus
gtggagagacacataagccttactg

SEQ ID NO: 510799 - DNA, 25 bp, Rattus norvegicus
gtggagagacacttaagccttactg

SEQ ID NO: 510800 - DNA, 25 bp, Rattus norvegicus
gtggagagacccacggcgagaacca

SEQ ID NO: 510801 - DNA, 25 bp, Rattus norvegicus
gtggagagaccctcggcgagaacca

SEQ ID NO: 510802 - DNA, 25 bp, Rattus norvegicus
gtggagagccagagtttttccaaag

SEQ ID NO: 510803 - DNA, 25 bp, Rattus norvegicus
gtggagagccagtgtttttccaaag

SEQ ID NO: 510804 - DNA, 25 bp, Rattus norvegicus
gtggagagctatccctcccctgtga

SEQ ID NO: 510805 - DNA, 25 bp, Rattus norvegicus
gtggagagctatgcctcccctgtga

SEQ ID NO: 510806 - DNA, 25 bp, Rattus norvegicus
gtggagagctccatttgcagctgtc

SEQ ID NO: 510807 - DNA, 25 bp, Rattus norvegicus
gtggagagctccttttgcagctgtc

SEQ ID NO: 510808 - DNA, 25 bp, Rattus norvegicus
gtggagagctgtctaccactctaaa

SEQ ID NO: 510809 - DNA, 25 bp, Rattus norvegicus
gtggagagctgtgtaccactctaaa

SEQ ID NO: 510810 - DNA, 25 bp, Rattus norvegicus
gtggagagtttccagcagctgctca

SEQ ID NO: 510811 - DNA, 25 bp, Rattus norvegicus
gtggagagtttcgagcagctgctca

SEQ ID NO: 510812 - DNA, 25 bp, Rattus norvegicus
gtggagatactgctgaaatcactca

SEQ ID NO: 510813 - DNA, 25 bp, Rattus norvegicus
gtggagatactggtgaaatcactca

SEQ ID NO: 510814 - DNA, 25 bp, Rattus norvegicus
gtggagatctcactgacctgcaaaa

SEQ ID NO: 510815 - DNA, 25 bp, Rattus norvegicus
gtggagatctcagtgacctgcaaaa

SEQ ID NO: 510816 - DNA, 25 bp, Rattus norvegicus
gtggagatctcccttatgtatgtaa

SEQ ID NO: 510817 - DNA, 25 bp, Rattus norvegicus
gtggagatctccgttatgtatgtaa

SEQ ID NO: 510818 - DNA, 25 bp, Rattus norvegicus
gtggagatcttcaccaatgggcagt

SEQ ID NO: 510819 - DNA, 25 bp, Rattus norvegicus
gtggagatcttctccaatgggcagt

SEQ ID NO: 510820 - DNA, 25 bp, Rattus norvegicus
gtggagatgaccaacctgagcctct

SEQ ID NO: 510821 - DNA, 25 bp, Rattus norvegicus
gtggagatgaccacggagctcttca

SEQ ID NO: 510822 - DNA, 25 bp, Rattus norvegicus
gtggagatgacctacctgagcctct

SEQ ID NO: 510823 - DNA, 25 bp, Rattus norvegicus
gtggagatgacctcggagctcttca

SEQ ID NO: 510824 - DNA, 25 bp, Rattus norvegicus
gtggagatgccgaggtgaccccact

SEQ ID NO: 510825 - DNA, 25 bp, Rattus norvegicus
gtggagatgccgtggtgaccccact

SEQ ID NO: 510826 - DNA, 25 bp, Rattus norvegicus
gtggagattgccatccgaaatactg

SEQ ID NO: 510827 - DNA, 25 bp, Rattus norvegicus
gtggagattgccttccgaaatactg

SEQ ID NO: 510828 - DNA, 25 bp, Rattus norvegicus
gtggagatttctatttccctggttt

SEQ ID NO: 510829 - DNA, 25 bp, Rattus norvegicus
gtggagatttctttttccctggttt

SEQ ID NO: 510830 - DNA, 25 bp, Rattus norvegicus
gtggagcaccagcatctgtagactg

SEQ ID NO: 510831 - DNA, 25 bp, Rattus norvegicus
gtggagcaccaggatctgtagactg

SEQ ID NO: 510832 - DNA, 25 bp, Rattus norvegicus
gtggagcacccacgttggagcatca

SEQ ID NO: 510833 - DNA, 25 bp, Rattus norvegicus
gtggagcacccaggttggagcatca

SEQ ID NO: 510834 - DNA, 25 bp, Rattus norvegicus
gtggagcaccctcaaaaagccgtgc

SEQ ID NO: 510835 - DNA, 25 bp, Rattus norvegicus
gtggagcaccctgaaaaagccgtgc

SEQ ID NO: 510836 - DNA, 25 bp, Rattus norvegicus
gtggagcactgtcatcactgtcatt

SEQ ID NO: 510837 - DNA, 25 bp, Rattus norvegicus
gtggagcactgtgatcactgtcatt

SEQ ID NO: 510838 - DNA, 25 bp, Rattus norvegicus
gtggagcaggtgcaacctttccaaa

SEQ ID NO: 510839 - DNA, 25 bp, Rattus norvegicus
gtggagcaggtggaacctttccaaa

SEQ ID NO: 510840 - DNA, 25 bp, Rattus norvegicus
gtggagcataaaccagtgccctggc

SEQ ID NO: 510841 - DNA, 25 bp, Rattus norvegicus
gtggagcataaagcagtgccctggc

SEQ ID NO: 510842 - DNA, 25 bp, Rattus norvegicus
gtggagcatgtcaaagtagctgcat

SEQ ID NO: 510843 - DNA, 25 bp, Rattus norvegicus
gtggagcatgtctaagtagctgcat

SEQ ID NO: 510844 - DNA, 25 bp, Rattus norvegicus
gtggagcattgcagtgcatctgccg

SEQ ID NO: 510845 - DNA, 25 bp, Rattus norvegicus
gtggagcattgctgtgcatctgccg

SEQ ID NO: 510846 - DNA, 25 bp, Rattus norvegicus
gtggagccaccaccaagtgtgataa

SEQ ID NO: 510847 - DNA, 25 bp, Rattus norvegicus
gtggagccaccagcaagtgtgataa

SEQ ID NO: 510848 - DNA, 25 bp, Rattus norvegicus
gtggagccacccaggaatcagcaca

SEQ ID NO: 510849 - DNA, 25 bp, Rattus norvegicus
gtggagccaccctggaatcagcaca

SEQ ID NO: 510850 - DNA, 25 bp, Rattus norvegicus
gtggagccagaacttcttgatatca

SEQ ID NO: 510851 - DNA, 25 bp, Rattus norvegicus
gtggagccagaagttcttgatatca

SEQ ID NO: 510852 - DNA, 25 bp, Rattus norvegicus
gtggagccagccaggtcctgtatca

SEQ ID NO: 510853 - DNA, 25 bp, Rattus norvegicus
gtggagccagcctggtcctgtatca

SEQ ID NO: 510854 - DNA, 25 bp, Rattus norvegicus
gtggagcccaaaacccatctaaagg

SEQ ID NO: 510855 - DNA, 25 bp, Rattus norvegicus
gtggagcccaaatcccatctaaagg

SEQ ID NO: 510856 - DNA, 25 bp, Rattus norvegicus
gtggagcccctcaaaaagaagccat

SEQ ID NO: 510857 - DNA, 25 bp, Rattus norvegicus
gtggagcccctccaaacagtggaag

SEQ ID NO: 510858 - DNA, 25 bp, Rattus norvegicus
gtggagcccctcgaaacagtggaag

SEQ ID NO: 510859 - DNA, 25 bp, Rattus norvegicus
gtggagcccctctaaaagaagccat

SEQ ID NO: 510860 - DNA, 25 bp, Rattus norvegicus
gtggagccctagaatgtcagcctca

SEQ ID NO: 510861 - DNA, 25 bp, Rattus norvegicus
gtggagccctagtatgtcagcctca

SEQ ID NO: 510862 - DNA, 25 bp, Rattus norvegicus
gtggagccctgacgagatcacccta

SEQ ID NO: 510863 - DNA, 25 bp, Rattus norvegicus
gtggagccctgaggagatcacccta

SEQ ID NO: 510864 - DNA, 25 bp, Rattus norvegicus
gtggagccgccaatacttttattta

SEQ ID NO: 510865 - DNA, 25 bp, Rattus norvegicus
gtggagccgccattacttttattta

SEQ ID NO: 510866 - DNA, 25 bp, Rattus norvegicus
gtggagcctaagagtcagcagacat

SEQ ID NO: 510867 - DNA, 25 bp, Rattus norvegicus
gtggagcctaagtgtcagcagacat

SEQ ID NO: 510868 - DNA, 25 bp, Rattus norvegicus
gtggagcctcccagtacaagcagca

SEQ ID NO: 510869 - DNA, 25 bp, Rattus norvegicus
gtggagcctccctgtacaagcagca

SEQ ID NO: 510870 - DNA, 25 bp, Rattus norvegicus
gtggagcctgaaagctcataccata

SEQ ID NO: 510871 - DNA, 25 bp, Rattus norvegicus
gtggagcctgaatgctcataccata

SEQ ID NO: 510872 - DNA, 25 bp, Rattus norvegicus
gtggagcctgggagtgctttttata

SEQ ID NO: 510873 - DNA, 25 bp, Rattus norvegicus
gtggagcctgggtgtgctttttata

SEQ ID NO: 510874 - DNA, 25 bp, Rattus norvegicus
gtggagcctgttatgttccaagtaa

SEQ ID NO: 510875 - DNA, 25 bp, Rattus norvegicus
gtggagcctgttttgttccaagtaa

SEQ ID NO: 510876 - DNA, 25 bp, Rattus norvegicus
gtggagcgtgccctgggctccccaa

SEQ ID NO: 510877 - DNA, 25 bp, Rattus norvegicus
gtggagcgtgccgtgggctccccaa

SEQ ID NO: 510878 - DNA, 25 bp, Rattus norvegicus
gtggagctactcattcatcagaaag

SEQ ID NO: 510879 - DNA, 25 bp, Rattus norvegicus
gtggagctactctttcatcagaaag

SEQ ID NO: 510880 - DNA, 25 bp, Rattus norvegicus
gtggagctatagaatgtcctatcta

SEQ ID NO: 510881 - DNA, 25 bp, Rattus norvegicus
gtggagctatagtatgtcctatcta

SEQ ID NO: 510882 - DNA, 25 bp, Rattus norvegicus
gtggagctcatgaggaccaacccca

SEQ ID NO: 510883 - DNA, 25 bp, Rattus norvegicus
gtggagctcatgtggaccaacccca

SEQ ID NO: 510884 - DNA, 25 bp, Rattus norvegicus
gtggagctctgtcaagcacagccag

SEQ ID NO: 510885 - DNA, 25 bp, Rattus norvegicus
gtggagctctgtgaagcacagccag

SEQ ID NO: 510886 - DNA, 25 bp, Rattus norvegicus
gtggagctgagactctcgtttactc

SEQ ID NO: 510887 - DNA, 25 bp, Rattus norvegicus
gtggagctgagagtctcgtttactc

SEQ ID NO: 510888 - DNA, 25 bp, Rattus norvegicus
gtggagctgctcaacttagagtgaa

SEQ ID NO: 510889 - DNA, 25 bp, Rattus norvegicus
gtggagctgctcaggcaaagtcagt

SEQ ID NO: 510890 - DNA, 25 bp, Rattus norvegicus
gtggagctgctctacttagagtgaa

SEQ ID NO: 510891 - DNA, 25 bp, Rattus norvegicus
gtggagctgctctggcaaagtcagt

SEQ ID NO: 510892 - DNA, 25 bp, Rattus norvegicus
gtggagctggatacgaactcaggtc

SEQ ID NO: 510893 - DNA, 25 bp, Rattus norvegicus
gtggagctggattcgaactcaggtc

SEQ ID NO: 510894 - DNA, 25 bp, Rattus norvegicus
gtggagctggtgatcaagcctagca

SEQ ID NO: 510895 - DNA, 25 bp, Rattus norvegicus
gtggagctggtgttcaagcctagca

SEQ ID NO: 510896 - DNA, 25 bp, Rattus norvegicus
gtggagctgttcactgactgacact

SEQ ID NO: 510897 - DNA, 25 bp, Rattus norvegicus
gtggagctgttctctgactgacact

SEQ ID NO: 510898 - DNA, 25 bp, Rattus norvegicus
gtggaggaaccaaaggacagcccct

SEQ ID NO: 510899 - DNA, 25 bp, Rattus norvegicus
gtggaggaaccataggacagcccct

SEQ ID NO: 510900 - DNA, 25 bp, Rattus norvegicus
gtggaggaaccgcttctcatgccat

SEQ ID NO: 510901 - DNA, 25 bp, Rattus norvegicus
gtggaggaaccggttctcatgccat

SEQ ID NO: 510902 - DNA, 25 bp, Rattus norvegicus
gtggaggaactcatgtggatagccc

SEQ ID NO: 510903 - DNA, 25 bp, Rattus norvegicus
gtggaggaactcttgtggatagccc

SEQ ID NO: 510904 - DNA, 25 bp, Rattus norvegicus
gtggaggacacgactctgaaccgtt

SEQ ID NO: 510905 - DNA, 25 bp, Rattus norvegicus
gtggaggacacgtctctgaaccgtt

SEQ ID NO: 510906 - DNA, 25 bp, Rattus norvegicus
gtggaggaccttcagttacgctctg

SEQ ID NO: 510907 - DNA, 25 bp, Rattus norvegicus
gtggaggaccttgagttacgctctg

SEQ ID NO: 510908 - DNA, 25 bp, Rattus norvegicus
gtggaggactgcatcattcacatca

SEQ ID NO: 510909 - DNA, 25 bp, Rattus norvegicus
gtggaggactgcttcattcacatca

SEQ ID NO: 510910 - DNA, 25 bp, Rattus norvegicus
gtggaggagctaactcggatccatt

SEQ ID NO: 510911 - DNA, 25 bp, Rattus norvegicus
gtggaggagctatctcggatccatt

SEQ ID NO: 510912 - DNA, 25 bp, Rattus norvegicus
gtggaggagtttagctaccagccca

SEQ ID NO: 510913 - DNA, 25 bp, Rattus norvegicus
gtggaggagttttgctaccagccca

SEQ ID NO: 510914 - DNA, 25 bp, Rattus norvegicus
gtggaggataacagccccagaatgc

SEQ ID NO: 510915 - DNA, 25 bp, Rattus norvegicus
gtggaggataactgccccagaatgc

SEQ ID NO: 510916 - DNA, 25 bp, Rattus norvegicus
gtggaggcacacacagcaatactgt

SEQ ID NO: 510917 - DNA, 25 bp, Rattus norvegicus
gtggaggcacactcagcaatactgt

SEQ ID NO: 510918 - DNA, 25 bp, Rattus norvegicus
gtggaggcaccaccggcggcggcaa

SEQ ID NO: 510919 - DNA, 25 bp, Rattus norvegicus
gtggaggcaccagcggcggcggcaa

SEQ ID NO: 510920 - DNA, 25 bp, Rattus norvegicus
gtggaggcagcaaataacatcccct

SEQ ID NO: 510921 - DNA, 25 bp, Rattus norvegicus
gtggaggcagcaactcgaacaccat

SEQ ID NO: 510922 - DNA, 25 bp, Rattus norvegicus
gtggaggcagcatataacatcccct

SEQ ID NO: 510923 - DNA, 25 bp, Rattus norvegicus
gtggaggcagcatctcgaacaccat

SEQ ID NO: 510924 - DNA, 25 bp, Rattus norvegicus
gtggaggcagccagctgtttctgta

SEQ ID NO: 510925 - DNA, 25 bp, Rattus norvegicus
gtggaggcagcctgctgtttctgta

SEQ ID NO: 510926 - DNA, 25 bp, Rattus norvegicus
gtggaggcagcgacaccaaaaagcg

SEQ ID NO: 510927 - DNA, 25 bp, Rattus norvegicus
gtggaggcagcgtcaccaaaaagcg

SEQ ID NO: 510928 - DNA, 25 bp, Rattus norvegicus
gtggaggcagttactttatctctat

SEQ ID NO: 510929 - DNA, 25 bp, Rattus norvegicus
gtggaggcagtttctttatctctat

SEQ ID NO: 510930 - DNA, 25 bp, Rattus norvegicus
gtggaggcattcacagcagcgtttt

SEQ ID NO: 510931 - DNA, 25 bp, Rattus norvegicus
gtggaggcattctcagcagcgtttt

SEQ ID NO: 510932 - DNA, 25 bp, Rattus norvegicus
gtggaggcatttcctttttctaagg

SEQ ID NO: 510933 - DNA, 25 bp, Rattus norvegicus
gtggaggcatttgctttttctaagg

SEQ ID NO: 510934 - DNA, 25 bp, Rattus norvegicus
gtggaggccactctaatgactcttg

SEQ ID NO: 510935 - DNA, 25 bp, Rattus norvegicus
gtggaggccactgtaatgactcttg

SEQ ID NO: 510936 - DNA, 25 bp, Rattus norvegicus
gtggaggccccaagagaccatctgg

SEQ ID NO: 510937 - DNA, 25 bp, Rattus norvegicus
gtggaggccccatgagaccatctgg

SEQ ID NO: 510938 - DNA, 25 bp, Rattus norvegicus
gtggaggcctcccttacactaggtg

SEQ ID NO: 510939 - DNA, 25 bp, Rattus norvegicus
gtggaggcctccgttacactaggtg

SEQ ID NO: 510940 - DNA, 25 bp, Rattus norvegicus
gtggaggcctctaatgaagtacatt

SEQ ID NO: 510941 - DNA, 25 bp, Rattus norvegicus
gtggaggcctcttatgaagtacatt

SEQ ID NO: 510942 - DNA, 25 bp, Rattus norvegicus
gtggaggcctgaccagatcttgtcc

SEQ ID NO: 510943 - DNA, 25 bp, Rattus norvegicus
gtggaggcctgagcagatcttgtcc

SEQ ID NO: 510944 - DNA, 25 bp, Rattus norvegicus
gtggaggcggaaccataaccatata

SEQ ID NO: 510945 - DNA, 25 bp, Rattus norvegicus
gtggaggcggaagcataaccatata

SEQ ID NO: 510946 - DNA, 25 bp, Rattus norvegicus
gtggaggctaaactagtcgcaacaa

SEQ ID NO: 510947 - DNA, 25 bp, Rattus norvegicus
gtggaggctaaagtagtcgcaacaa

SEQ ID NO: 510948 - DNA, 25 bp, Rattus norvegicus
gtggaggctaccattcttggagaaa

SEQ ID NO: 510949 - DNA, 25 bp, Rattus norvegicus
gtggaggctacctttcttggagaaa

SEQ ID NO: 510950 - DNA, 25 bp, Rattus norvegicus
gtggaggctgctaatgactatgaga

SEQ ID NO: 510951 - DNA, 25 bp, Rattus norvegicus
gtggaggctgcttatgactatgaga

SEQ ID NO: 510952 - DNA, 25 bp, Rattus norvegicus
gtggaggcttcaaagagcacttctc

SEQ ID NO: 510953 - DNA, 25 bp, Rattus norvegicus
gtggaggcttcatagagcacttctc

SEQ ID NO: 510954 - DNA, 25 bp, Rattus norvegicus
gtggaggcttctcatacgtgtatga

SEQ ID NO: 510955 - DNA, 25 bp, Rattus norvegicus
gtggaggcttctgatacgtgtatga

SEQ ID NO: 510956 - DNA, 25 bp, Rattus norvegicus
gtggaggcttgcaatccattagcat

SEQ ID NO: 510957 - DNA, 25 bp, Rattus norvegicus
gtggaggcttgctatccattagcat

SEQ ID NO: 510958 - DNA, 25 bp, Rattus norvegicus
gtggagggaacacatggactcatct

SEQ ID NO: 510959 - DNA, 25 bp, Rattus norvegicus
gtggagggaacagatggactcatct

SEQ ID NO: 510960 - DNA, 25 bp, Rattus norvegicus
gtggagggtaccacaccacaggtca

SEQ ID NO: 510961 - DNA, 25 bp, Rattus norvegicus
gtggagggtacctcaccacaggtca

SEQ ID NO: 510962 - DNA, 25 bp, Rattus norvegicus
gtggagggtcccaaagaccccagct

SEQ ID NO: 510963 - DNA, 25 bp, Rattus norvegicus
gtggagggtccctaagaccccagct

SEQ ID NO: 510964 - DNA, 25 bp, Rattus norvegicus
gtggaggtagcgacttcagtgcaat

SEQ ID NO: 510965 - DNA, 25 bp, Rattus norvegicus
gtggaggtagcgtcttcagtgcaat

SEQ ID NO: 510966 - DNA, 25 bp, Rattus norvegicus
gtggaggtcacaattcagagtagat

SEQ ID NO: 510967 - DNA, 25 bp, Rattus norvegicus
gtggaggtcacatttcagagtagat

SEQ ID NO: 510968 - DNA, 25 bp, Rattus norvegicus
gtggaggtgcaccatctcaccaagg

SEQ ID NO: 510969 - DNA, 25 bp, Rattus norvegicus
gtggaggtgcacgatctcaccaagg

SEQ ID NO: 510970 - DNA, 25 bp, Rattus norvegicus
gtggaggtgccacagccaatattaa

SEQ ID NO: 510971 - DNA, 25 bp, Rattus norvegicus
gtggaggtgccagagccaatattaa

SEQ ID NO: 510972 - DNA, 25 bp, Rattus norvegicus
gtggaggttttgcttcatctgtatt

SEQ ID NO: 510973 - DNA, 25 bp, Rattus norvegicus
gtggaggttttggttcatctgtatt

SEQ ID NO: 510974 - DNA, 25 bp, Rattus norvegicus
gtggagtacagcacctgtgacacca

SEQ ID NO: 510975 - DNA, 25 bp, Rattus norvegicus
gtggagtacagctcctgtgacacca

SEQ ID NO: 510976 - DNA, 25 bp, Rattus norvegicus
gtggagtagactcattttacaatgt

SEQ ID NO: 510977 - DNA, 25 bp, Rattus norvegicus
gtggagtagactgattttacaatgt

SEQ ID NO: 510978 - DNA, 25 bp, Rattus norvegicus
gtggagtatctcatcacattgctga

SEQ ID NO: 510979 - DNA, 25 bp, Rattus norvegicus
gtggagtatctcttcacattgctga

SEQ ID NO: 510980 - DNA, 25 bp, Rattus norvegicus
gtggagtatttaagctcccagcctt

SEQ ID NO: 510981 - DNA, 25 bp, Rattus norvegicus
gtggagtatttatgctcccagcctt

SEQ ID NO: 510982 - DNA, 25 bp, Rattus norvegicus
gtggagtcaagcacggagccagctc

SEQ ID NO: 510983 - DNA, 25 bp, Rattus norvegicus
gtggagtcaagctcggagccagctc

SEQ ID NO: 510984 - DNA, 25 bp, Rattus norvegicus
gtggagtcattcatctatcactgtg

SEQ ID NO: 510985 - DNA, 25 bp, Rattus norvegicus
gtggagtcattcttctatcactgtg

SEQ ID NO: 510986 - DNA, 25 bp, Rattus norvegicus
gtggagtccaaacacttctgggtta

SEQ ID NO: 510987 - DNA, 25 bp, Rattus norvegicus
gtggagtccaaagacttctgggtta

SEQ ID NO: 510988 - DNA, 25 bp, Rattus norvegicus
gtggagtccttcagccaaaaacctt

SEQ ID NO: 510989 - DNA, 25 bp, Rattus norvegicus
gtggagtccttctgccaaaaacctt

SEQ ID NO: 510990 - DNA, 25 bp, Rattus norvegicus
gtggagtctccaagctgagagcacc

SEQ ID NO: 510991 - DNA, 25 bp, Rattus norvegicus
gtggagtctccatgctgagagcacc

SEQ ID NO: 510992 - DNA, 25 bp, Rattus norvegicus
gtggagtctgcacctcagtcaggca

SEQ ID NO: 510993 - DNA, 25 bp, Rattus norvegicus
gtggagtctgcagctcagtcaggca

SEQ ID NO: 510994 - DNA, 25 bp, Rattus norvegicus
gtggagtcttccagaactacattat

SEQ ID NO: 510995 - DNA, 25 bp, Rattus norvegicus
gtggagtcttcctgaactacattat

SEQ ID NO: 510996 - DNA, 25 bp, Rattus norvegicus
gtggagtgcagtacatgcctgagta

SEQ ID NO: 510997 - DNA, 25 bp, Rattus norvegicus
gtggagtgcagttcatgcctgagta

SEQ ID NO: 510998 - DNA, 25 bp, Rattus norvegicus
gtggagtgccaaccattttaacttt

SEQ ID NO: 510999 - DNA, 25 bp, Rattus norvegicus
gtggagtgccaagcattttaacttt

SEQ ID NO: 511000 - DNA, 25 bp, Rattus norvegicus
gtggagtgcctcatggattctaaat

SEQ ID NO: 511001 - DNA, 25 bp, Rattus norvegicus
gtggagtgcctcttggattctaaat

SEQ ID NO: 511002 - DNA, 25 bp, Rattus norvegicus
gtggagtggcccacttctggatcat

SEQ ID NO: 511003 - DNA, 25 bp, Rattus norvegicus
gtggagtggccctcttctggatcat

SEQ ID NO: 511004 - DNA, 25 bp, Rattus norvegicus
gtggagtggctcagtcctgatgtct

SEQ ID NO: 511005 - DNA, 25 bp, Rattus norvegicus
gtggagtggctctgtcctgatgtct

SEQ ID NO: 511006 - DNA, 25 bp, Rattus norvegicus
gtggagtggtacatgcgtgcccaac

SEQ ID NO: 511007 - DNA, 25 bp, Rattus norvegicus
gtggagtggtacttgcgtgcccaac

SEQ ID NO: 511008 - DNA, 25 bp, Rattus norvegicus
gtggagtgtttacaccttgctgtaa

SEQ ID NO: 511009 - DNA, 25 bp, Rattus norvegicus
gtggagtgtttagaccttgctgtaa

SEQ ID NO: 511010 - DNA, 25 bp, Rattus norvegicus
gtggagttaactacgggcctgctat

SEQ ID NO: 511011 - DNA, 25 bp, Rattus norvegicus
gtggagttaactctttcctcacagc

SEQ ID NO: 511012 - DNA, 25 bp, Rattus norvegicus
gtggagttaactgtttcctcacagc

SEQ ID NO: 511013 - DNA, 25 bp, Rattus norvegicus
gtggagttaacttcgggcctgctat

SEQ ID NO: 511014 - DNA, 25 bp, Rattus norvegicus
gtggagttagcacctccttatcttc

SEQ ID NO: 511015 - DNA, 25 bp, Rattus norvegicus
gtggagttagcagctccttatcttc

SEQ ID NO: 511016 - DNA, 25 bp, Rattus norvegicus
gtggagttcaggacctggccccaga

SEQ ID NO: 511017 - DNA, 25 bp, Rattus norvegicus
gtggagttcaggtcctggccccaga

SEQ ID NO: 511018 - DNA, 25 bp, Rattus norvegicus
gtggagttctctctgaaacgttcct

SEQ ID NO: 511019 - DNA, 25 bp, Rattus norvegicus
gtggagttctctgtgaaacgttcct

SEQ ID NO: 511020 - DNA, 25 bp, Rattus norvegicus
gtggagttgaaaacccagcagctgc

SEQ ID NO: 511021 - DNA, 25 bp, Rattus norvegicus
gtggagttgaaatcccagcagctgc

SEQ ID NO: 511022 - DNA, 25 bp, Rattus norvegicus
gtggagttgaaccagacacctttct

SEQ ID NO: 511023 - DNA, 25 bp, Rattus norvegicus
gtggagttgaacgagacacctttct

SEQ ID NO: 511024 - DNA, 25 bp, Rattus norvegicus
gtggagttgccaccatcacgtgtag

SEQ ID NO: 511025 - DNA, 25 bp, Rattus norvegicus
gtggagttgccagcatcacgtgtag

SEQ ID NO: 511026 - DNA, 25 bp, Rattus norvegicus
gtggagttgtctagctgatgaagcc

SEQ ID NO: 511027 - DNA, 25 bp, Rattus norvegicus
gtggagttgtcttgctgatgaagcc

SEQ ID NO: 511028 - DNA, 25 bp, Rattus norvegicus
gtggagtttccaatagctgagacaa

SEQ ID NO: 511029 - DNA, 25 bp, Rattus norvegicus
gtggagtttccattagctgagacaa

SEQ ID NO: 511030 - DNA, 25 bp, Rattus norvegicus
gtggagtttcctatctatccaatcc

SEQ ID NO: 511031 - DNA, 25 bp, Rattus norvegicus
gtggagtttcctttctatccaatcc

SEQ ID NO: 511032 - DNA, 25 bp, Rattus norvegicus
gtggagtttgcaccggctttcttca

SEQ ID NO: 511033 - DNA, 25 bp, Rattus norvegicus
gtggagtttgcagcggctttcttca

SEQ ID NO: 511034 - DNA, 25 bp, Rattus norvegicus
gtggagtttgtaacgcaggcgcaat

SEQ ID NO: 511035 - DNA, 25 bp, Rattus norvegicus
gtggagtttgtatcgcaggcgcaat

SEQ ID NO: 511036 - DNA, 25 bp, Rattus norvegicus
gtggataatctaaagacacctgtag

SEQ ID NO: 511037 - DNA, 25 bp, Rattus norvegicus
gtggataatctatagacacctgtag

SEQ ID NO: 511038 - DNA, 25 bp, Rattus norvegicus
gtggataatgcactacttgctcctg

SEQ ID NO: 511039 - DNA, 25 bp, Rattus norvegicus
gtggataatgcagtacttgctcctg

SEQ ID NO: 511040 - DNA, 25 bp, Rattus norvegicus
gtggataatggtacttcagcctggg

SEQ ID NO: 511041 - DNA, 25 bp, Rattus norvegicus
gtggataatggttcttcagcctggg

SEQ ID NO: 511042 - DNA, 25 bp, Rattus norvegicus
gtggatacatccagggtgttacaat

SEQ ID NO: 511043 - DNA, 25 bp, Rattus norvegicus
gtggatacatcctgggtgttacaat

SEQ ID NO: 511044 - DNA, 25 bp, Rattus norvegicus
gtggataccaacctcattgaattcg

SEQ ID NO: 511045 - DNA, 25 bp, Rattus norvegicus
gtggataccaacgtcattgaattcg

SEQ ID NO: 511046 - DNA, 25 bp, Rattus norvegicus
gtggataccacacttgcacagaagt

SEQ ID NO: 511047 - DNA, 25 bp, Rattus norvegicus
gtggataccacagttgcacagaagt

SEQ ID NO: 511048 - DNA, 25 bp, Rattus norvegicus
gtggataccctgcacgatttcatgt

SEQ ID NO: 511049 - DNA, 25 bp, Rattus norvegicus
gtggataccctggacgatttcatgt

SEQ ID NO: 511050 - DNA, 25 bp, Rattus norvegicus
gtggataccttcagggcttttgaac

SEQ ID NO: 511051 - DNA, 25 bp, Rattus norvegicus
gtggataccttctgggcttttgaac

SEQ ID NO: 511052 - DNA, 25 bp, Rattus norvegicus
gtggatagaaagctgttagtctcgt

SEQ ID NO: 511053 - DNA, 25 bp, Rattus norvegicus
gtggatagaaaggtgttagtctcgt

SEQ ID NO: 511054 - DNA, 25 bp, Rattus norvegicus
gtggatagatagcatcctgtcagcc

SEQ ID NO: 511055 - DNA, 25 bp, Rattus norvegicus
gtggatagataggatcctgtcagcc

SEQ ID NO: 511056 - DNA, 25 bp, Rattus norvegicus
gtggatagatccagggcacctgcag

SEQ ID NO: 511057 - DNA, 25 bp, Rattus norvegicus
gtggatagatcctgggcacctgcag

SEQ ID NO: 511058 - DNA, 25 bp, Rattus norvegicus
gtggatagcaagacatgttctcaat

SEQ ID NO: 511059 - DNA, 25 bp, Rattus norvegicus
gtggatagcaagtcatgttctcaat

SEQ ID NO: 511060 - DNA, 25 bp, Rattus norvegicus
gtggatagcacccacagaacttcca

SEQ ID NO: 511061 - DNA, 25 bp, Rattus norvegicus
gtggatagcaccgacagaacttcca

SEQ ID NO: 511062 - DNA, 25 bp, Rattus norvegicus
gtggatagtcttaggcctgggaaca

SEQ ID NO: 511063 - DNA, 25 bp, Rattus norvegicus
gtggatagtctttggcctgggaaca

SEQ ID NO: 511064 - DNA, 25 bp, Rattus norvegicus
gtggatagttcccatacttacttaa

SEQ ID NO: 511065 - DNA, 25 bp, Rattus norvegicus
gtggatagttccgatacttacttaa

SEQ ID NO: 511066 - DNA, 25 bp, Rattus norvegicus
gtggatatacttccctgtttgctgc

SEQ ID NO: 511067 - DNA, 25 bp, Rattus norvegicus
gtggatatacttgcctgtttgctgc

SEQ ID NO: 511068 - DNA, 25 bp, Rattus norvegicus
gtggatatggcaaccgagtggccct

SEQ ID NO: 511069 - DNA, 25 bp, Rattus norvegicus
gtggatatggcatccgagtggccct

SEQ ID NO: 511070 - DNA, 25 bp, Rattus norvegicus
gtggatattcttagcacacactgcc

SEQ ID NO: 511071 - DNA, 25 bp, Rattus norvegicus
gtggatattctttgcacacactgcc

SEQ ID NO: 511072 - DNA, 25 bp, Rattus norvegicus
gtggatattgtaccccatctgcata

SEQ ID NO: 511073 - DNA, 25 bp, Rattus norvegicus
gtggatattgtagcccatctgcata

SEQ ID NO: 511074 - DNA, 25 bp, Rattus norvegicus
gtggatcacagactcaaatccctga

SEQ ID NO: 511075 - DNA, 25 bp, Rattus norvegicus
gtggatcacagagtcaaatccctga

SEQ ID NO: 511076 - DNA, 25 bp, Rattus norvegicus
gtggatcagaaactgtcctccgaaa

SEQ ID NO: 511077 - DNA, 25 bp, Rattus norvegicus
gtggatcagaaagtgtcctccgaaa

SEQ ID NO: 511078 - DNA, 25 bp, Rattus norvegicus
gtggatcagactcgcagcgcacact

SEQ ID NO: 511079 - DNA, 25 bp, Rattus norvegicus
gtggatcagactggcagcgcacact

SEQ ID NO: 511080 - DNA, 25 bp, Rattus norvegicus
gtggatcagtccatttaggagaact

SEQ ID NO: 511081 - DNA, 25 bp, Rattus norvegicus
gtggatcagtccttttaggagaact

SEQ ID NO: 511082 - DNA, 25 bp, Rattus norvegicus
gtggatcataggcaagccccacttg

SEQ ID NO: 511083 - DNA, 25 bp, Rattus norvegicus
gtggatcatagggaagccccacttg

SEQ ID NO: 511084 - DNA, 25 bp, Rattus norvegicus
gtggatccaaggactgtttcccaaa

SEQ ID NO: 511085 - DNA, 25 bp, Rattus norvegicus
gtggatccaaggtctgtttcccaaa

SEQ ID NO: 511086 - DNA, 25 bp, Rattus norvegicus
gtggatccatgcctatgtcatctac

SEQ ID NO: 511087 - DNA, 25 bp, Rattus norvegicus
gtggatccatgcgtatgtcatctac

SEQ ID NO: 511088 - DNA, 25 bp, Rattus norvegicus
gtggatcccatgagtcttcagtaga

SEQ ID NO: 511089 - DNA, 25 bp, Rattus norvegicus
gtggatcccatgtgtcttcagtaga

SEQ ID NO: 511090 - DNA, 25 bp, Rattus norvegicus
gtggatccctttctggacacaagaa

SEQ ID NO: 511091 - DNA, 25 bp, Rattus norvegicus
gtggatccctttgtggacacaagaa

SEQ ID NO: 511092 - DNA, 25 bp, Rattus norvegicus
gtggatccgcggctcccggaggagc

SEQ ID NO: 511093 - DNA, 25 bp, Rattus norvegicus
gtggatccgcgggtcccggaggagc

SEQ ID NO: 511094 - DNA, 25 bp, Rattus norvegicus
gtggatccggacactggcatcatgg

SEQ ID NO: 511095 - DNA, 25 bp, Rattus norvegicus
gtggatccggactctggcatcatgg

SEQ ID NO: 511096 - DNA, 25 bp, Rattus norvegicus
gtggatcctgacacagctgagctgc

SEQ ID NO: 511097 - DNA, 25 bp, Rattus norvegicus
gtggatcctgactcagctgagctgc

SEQ ID NO: 511098 - DNA, 25 bp, Rattus norvegicus
gtggatcctggaaaccagaacctta

SEQ ID NO: 511099 - DNA, 25 bp, Rattus norvegicus
gtggatcctggataccagaacctta

SEQ ID NO: 511100 - DNA, 25 bp, Rattus norvegicus
gtggatcctggtaccctgtttggaa

SEQ ID NO: 511101 - DNA, 25 bp, Rattus norvegicus
gtggatcctggttccctgtttggaa

SEQ ID NO: 511102 - DNA, 25 bp, Rattus norvegicus
gtggatccttgaattgaccagcctc

SEQ ID NO: 511103 - DNA, 25 bp, Rattus norvegicus
gtggatccttgatttgaccagcctc

SEQ ID NO: 511104 - DNA, 25 bp, Rattus norvegicus
gtggatcgatcacactgtacctgat

SEQ ID NO: 511105 - DNA, 25 bp, Rattus norvegicus
gtggatcgatcagactgtacctgat

SEQ ID NO: 511106 - DNA, 25 bp, Rattus norvegicus
gtggatctcagtattgactcttagt

SEQ ID NO: 511107 - DNA, 25 bp, Rattus norvegicus
gtggatctcagttttgactcttagt

SEQ ID NO: 511108 - DNA, 25 bp, Rattus norvegicus
gtggatctccttacttagcatccaa

SEQ ID NO: 511109 - DNA, 25 bp, Rattus norvegicus
gtggatctcctttcttagcatccaa

SEQ ID NO: 511110 - DNA, 25 bp, Rattus norvegicus
gtggatctcggactgaacaccaacg

SEQ ID NO: 511111 - DNA, 25 bp, Rattus norvegicus
gtggatctcggagtgaacaccaacg

SEQ ID NO: 511112 - DNA, 25 bp, Rattus norvegicus
gtggatctctgacgaagcggcccgc

SEQ ID NO: 511113 - DNA, 25 bp, Rattus norvegicus
gtggatctctgaggaagcggcccgc

SEQ ID NO: 511114 - DNA, 25 bp, Rattus norvegicus
gtggatctctgtatatgtcctgaca

SEQ ID NO: 511115 - DNA, 25 bp, Rattus norvegicus
gtggatctctgtttatgtcctgaca

SEQ ID NO: 511116 - DNA, 25 bp, Rattus norvegicus
gtggatctcttacttcaggcctaag

SEQ ID NO: 511117 - DNA, 25 bp, Rattus norvegicus
gtggatctcttagttcaggcctaag

SEQ ID NO: 511118 - DNA, 25 bp, Rattus norvegicus
gtggatctgaagcttcctttgtgtc

SEQ ID NO: 511119 - DNA, 25 bp, Rattus norvegicus
gtggatctgaaggttcctttgtgtc

SEQ ID NO: 511120 - DNA, 25 bp, Rattus norvegicus
gtggatctgacaagccgcctggaga

SEQ ID NO: 511121 - DNA, 25 bp, Rattus norvegicus
gtggatctgacatgccgcctggaga

SEQ ID NO: 511122 - DNA, 25 bp, Rattus norvegicus
gtggatctggttccaatgtgacccc

SEQ ID NO: 511123 - DNA, 25 bp, Rattus norvegicus
gtggatctggttgcaatgtgacccc

SEQ ID NO: 511124 - DNA, 25 bp, Rattus norvegicus
gtggatcttaaccattcacctgacc

SEQ ID NO: 511125 - DNA, 25 bp, Rattus norvegicus
gtggatcttaacgattcacctgacc

SEQ ID NO: 511126 - DNA, 25 bp, Rattus norvegicus
gtggatcttactctgtcgtttgccc

SEQ ID NO: 511127 - DNA, 25 bp, Rattus norvegicus
gtggatcttactgtgtcgtttgccc

SEQ ID NO: 511128 - DNA, 25 bp, Rattus norvegicus
gtggatcttattactgcctgtgaca

SEQ ID NO: 511129 - DNA, 25 bp, Rattus norvegicus
gtggatcttatttctgcctgtgaca

SEQ ID NO: 511130 - DNA, 25 bp, Rattus norvegicus
gtggatcttgagactcaggcttctc

SEQ ID NO: 511131 - DNA, 25 bp, Rattus norvegicus
gtggatcttgagtctcaggcttctc

SEQ ID NO: 511132 - DNA, 25 bp, Rattus norvegicus
gtggatctttgtcggtcatgctgac

SEQ ID NO: 511133 - DNA, 25 bp, Rattus norvegicus
gtggatctttgtgggtcatgctgac

SEQ ID NO: 511134 - DNA, 25 bp, Rattus norvegicus
gtggatctttttcagccctcaacta

SEQ ID NO: 511135 - DNA, 25 bp, Rattus norvegicus
gtggatctttttgagccctcaacta

SEQ ID NO: 511136 - DNA, 25 bp, Rattus norvegicus
gtggatgaaagcacttttcctagtt

SEQ ID NO: 511137 - DNA, 25 bp, Rattus norvegicus
gtggatgaaagcagaggacccctct

SEQ ID NO: 511138 - DNA, 25 bp, Rattus norvegicus
gtggatgaaagctcttttcctagtt

SEQ ID NO: 511139 - DNA, 25 bp, Rattus norvegicus
gtggatgaaagctgaggacccctct

SEQ ID NO: 511140 - DNA, 25 bp, Rattus norvegicus
gtggatgaaatcaccctagttccct

SEQ ID NO: 511141 - DNA, 25 bp, Rattus norvegicus
gtggatgaaatctccctagttccct

SEQ ID NO: 511142 - DNA, 25 bp, Rattus norvegicus
gtggatgaagagaactgactatcac

SEQ ID NO: 511143 - DNA, 25 bp, Rattus norvegicus
gtggatgaagagtactgactatcac

SEQ ID NO: 511144 - DNA, 25 bp, Rattus norvegicus
gtggatgacacaaagaaacctacga

SEQ ID NO: 511145 - DNA, 25 bp, Rattus norvegicus
gtggatgacacatagaaacctacga

SEQ ID NO: 511146 - DNA, 25 bp, Rattus norvegicus
gtggatgaccacactcatggtgaac

SEQ ID NO: 511147 - DNA, 25 bp, Rattus norvegicus
gtggatgaccactctcatggtgaac

SEQ ID NO: 511148 - DNA, 25 bp, Rattus norvegicus
gtggatgacgttccgcgtcacagtc

SEQ ID NO: 511149 - DNA, 25 bp, Rattus norvegicus
gtggatgacgttgcgcgtcacagtc

SEQ ID NO: 511150 - DNA, 25 bp, Rattus norvegicus
gtggatgacttcaaccagcagtctt

SEQ ID NO: 511151 - DNA, 25 bp, Rattus norvegicus
gtggatgacttctaccagcagtctt

SEQ ID NO: 511152 - DNA, 25 bp, Rattus norvegicus
gtggatgacttgcttctcagcgtat

SEQ ID NO: 511153 - DNA, 25 bp, Rattus norvegicus
gtggatgacttggttctcagcgtat

SEQ ID NO: 511154 - DNA, 25 bp, Rattus norvegicus
gtggatgactttcaagactataact

SEQ ID NO: 511155 - DNA, 25 bp, Rattus norvegicus
gtggatgactttgaagactataact

SEQ ID NO: 511156 - DNA, 25 bp, Rattus norvegicus
gtggatgagacaagccggactactt

SEQ ID NO: 511157 - DNA, 25 bp, Rattus norvegicus
gtggatgagacatgccggactactt

SEQ ID NO: 511158 - DNA, 25 bp, Rattus norvegicus
gtggatgatcatctttacaccattt

SEQ ID NO: 511159 - DNA, 25 bp, Rattus norvegicus
gtggatgatcatgtttacaccattt

SEQ ID NO: 511160 - DNA, 25 bp, Rattus norvegicus
gtggatgatccacaccatggttctt

SEQ ID NO: 511161 - DNA, 25 bp, Rattus norvegicus
gtggatgatccagaccatggttctt

SEQ ID NO: 511162 - DNA, 25 bp, Rattus norvegicus
gtggatgcaacaaaggaatcttcaa

SEQ ID NO: 511163 - DNA, 25 bp, Rattus norvegicus
gtggatgcaacataggaatcttcaa

SEQ ID NO: 511164 - DNA, 25 bp, Rattus norvegicus
gtggatgcaatgacaattacctgtt

SEQ ID NO: 511165 - DNA, 25 bp, Rattus norvegicus
gtggatgcaatgtcaattacctgtt

SEQ ID NO: 511166 - DNA, 25 bp, Rattus norvegicus
gtggatgcagacacttgcccgagat

SEQ ID NO: 511167 - DNA, 25 bp, Rattus norvegicus
gtggatgcagactcttgcccgagat

SEQ ID NO: 511168 - DNA, 25 bp, Rattus norvegicus
gtggatgcataacttctggatcaca

SEQ ID NO: 511169 - DNA, 25 bp, Rattus norvegicus
gtggatgcataagttctggatcaca

SEQ ID NO: 511170 - DNA, 25 bp, Rattus norvegicus
gtggatgccaacctgagtgttctca

SEQ ID NO: 511171 - DNA, 25 bp, Rattus norvegicus
gtggatgccaacgtgagtgttctca

SEQ ID NO: 511172 - DNA, 25 bp, Rattus norvegicus
gtggatgccaagagcagagccctct

SEQ ID NO: 511173 - DNA, 25 bp, Rattus norvegicus
gtggatgccaagtgcagagccctct

SEQ ID NO: 511174 - DNA, 25 bp, Rattus norvegicus
gtggatgccattatccgacaggaat

SEQ ID NO: 511175 - DNA, 25 bp, Rattus norvegicus
gtggatgccattttccgacaggaat

SEQ ID NO: 511176 - DNA, 25 bp, Rattus norvegicus
gtggatgccgtcaaatgcctttaga

SEQ ID NO: 511177 - DNA, 25 bp, Rattus norvegicus
gtggatgccgtctaatgcctttaga

SEQ ID NO: 511178 - DNA, 25 bp, Rattus norvegicus
gtggatgcctatctgtgttcaccat

SEQ ID NO: 511179 - DNA, 25 bp, Rattus norvegicus
gtggatgcctatgtgtgttcaccat

SEQ ID NO: 511180 - DNA, 25 bp, Rattus norvegicus
gtggatgcctgtctgatcactgcag

SEQ ID NO: 511181 - DNA, 25 bp, Rattus norvegicus
gtggatgcctgtgtgatcactgcag

SEQ ID NO: 511182 - DNA, 25 bp, Rattus norvegicus
gtggatgccttactttttggataac

SEQ ID NO: 511183 - DNA, 25 bp, Rattus norvegicus
gtggatgccttagtttttggataac

SEQ ID NO: 511184 - DNA, 25 bp, Rattus norvegicus
gtggatgcgcatctggagtaactta

SEQ ID NO: 511185 - DNA, 25 bp, Rattus norvegicus
gtggatgcgcatgtggagtaactta

SEQ ID NO: 511186 - DNA, 25 bp, Rattus norvegicus
gtggatgctgaaagttgcctgctag

SEQ ID NO: 511187 - DNA, 25 bp, Rattus norvegicus
gtggatgctgaatgttgcctgctag

SEQ ID NO: 511188 - DNA, 25 bp, Rattus norvegicus
gtggatgctggtcacactgactgat

SEQ ID NO: 511189 - DNA, 25 bp, Rattus norvegicus
gtggatgctggtgacactgactgat

SEQ ID NO: 511190 - DNA, 25 bp, Rattus norvegicus
gtggatgctttaaactctgctcagt

SEQ ID NO: 511191 - DNA, 25 bp, Rattus norvegicus
gtggatgctttatactctgctcagt

SEQ ID NO: 511192 - DNA, 25 bp, Rattus norvegicus
gtggatggaattcgttgtcccctcc

SEQ ID NO: 511193 - DNA, 25 bp, Rattus norvegicus
gtggatggaattggttgtcccctcc

SEQ ID NO: 511194 - DNA, 25 bp, Rattus norvegicus
gtggatggaccaatctttctggaaa

SEQ ID NO: 511195 - DNA, 25 bp, Rattus norvegicus
gtggatggaccattctttctggaaa

SEQ ID NO: 511196 - DNA, 25 bp, Rattus norvegicus
gtggatggcagaacccgagaagctc

SEQ ID NO: 511197 - DNA, 25 bp, Rattus norvegicus
gtggatggcagatcccgagaagctc

SEQ ID NO: 511198 - DNA, 25 bp, Rattus norvegicus
gtggatggccacagatactacaaaa

SEQ ID NO: 511199 - DNA, 25 bp, Rattus norvegicus
gtggatggccactgatactacaaaa

SEQ ID NO: 511200 - DNA, 25 bp, Rattus norvegicus
gtggatggctgcaccaccaaatcat

SEQ ID NO: 511201 - DNA, 25 bp, Rattus norvegicus
gtggatggctgctccaccaaatcat

SEQ ID NO: 511202 - DNA, 25 bp, Rattus norvegicus
gtggatgggactcttggctataaca

SEQ ID NO: 511203 - DNA, 25 bp, Rattus norvegicus
gtggatgggactgttggctataaca

SEQ ID NO: 511204 - DNA, 25 bp, Rattus norvegicus
gtggatggtgccaacgaaacccttt

SEQ ID NO: 511205 - DNA, 25 bp, Rattus norvegicus
gtggatggtgcctacgaaacccttt

SEQ ID NO: 511206 - DNA, 25 bp, Rattus norvegicus
gtggatgtaagccttttgcctctct

SEQ ID NO: 511207 - DNA, 25 bp, Rattus norvegicus
gtggatgtaagcgttttgcctctct

SEQ ID NO: 511208 - DNA, 25 bp, Rattus norvegicus
gtggatgtatagctcattgccattt

SEQ ID NO: 511209 - DNA, 25 bp, Rattus norvegicus
gtggatgtataggtcattgccattt

SEQ ID NO: 511210 - DNA, 25 bp, Rattus norvegicus
gtggatgtcactatttgtaactggt

SEQ ID NO: 511211 - DNA, 25 bp, Rattus norvegicus
gtggatgtcactttttgtaactggt

SEQ ID NO: 511212 - DNA, 25 bp, Rattus norvegicus
gtggatgtcatgctgctctgagcac

SEQ ID NO: 511213 - DNA, 25 bp, Rattus norvegicus
gtggatgtcatggtgctctgagcac

SEQ ID NO: 511214 - DNA, 25 bp, Rattus norvegicus
gtggatgtctacatgcaggcacaaa

SEQ ID NO: 511215 - DNA, 25 bp, Rattus norvegicus
gtggatgtctacttgcaggcacaaa

SEQ ID NO: 511216 - DNA, 25 bp, Rattus norvegicus
gtggatgtctgcattttgtttctgt

SEQ ID NO: 511217 - DNA, 25 bp, Rattus norvegicus
gtggatgtctgctttttgtttctgt

SEQ ID NO: 511218 - DNA, 25 bp, Rattus norvegicus
gtggatgtctgtctgatgccattcc

SEQ ID NO: 511219 - DNA, 25 bp, Rattus norvegicus
gtggatgtctgtgtgatgccattcc

SEQ ID NO: 511220 - DNA, 25 bp, Rattus norvegicus
gtggatgtgagtacattgctgtaga

SEQ ID NO: 511221 - DNA, 25 bp, Rattus norvegicus
gtggatgtgagttcattgctgtaga

SEQ ID NO: 511222 - DNA, 25 bp, Rattus norvegicus
gtggatgtgggcattaacacctcac

SEQ ID NO: 511223 - DNA, 25 bp, Rattus norvegicus
gtggatgtgggctttaacacctcac

SEQ ID NO: 511224 - DNA, 25 bp, Rattus norvegicus
gtggatgttcctcaatgcggcccag

SEQ ID NO: 511225 - DNA, 25 bp, Rattus norvegicus
gtggatgttcctgaatgcggcccag

SEQ ID NO: 511226 - DNA, 25 bp, Rattus norvegicus
gtggatgttctcattttgcactaga

SEQ ID NO: 511227 - DNA, 25 bp, Rattus norvegicus
gtggatgttctctttttgcactaga

SEQ ID NO: 511228 - DNA, 25 bp, Rattus norvegicus
gtggatgttgttccccatgttgaca

SEQ ID NO: 511229 - DNA, 25 bp, Rattus norvegicus
gtggatgttgttgcccatgttgaca

SEQ ID NO: 511230 - DNA, 25 bp, Rattus norvegicus
gtggattaaagcctcctggaagaag

SEQ ID NO: 511231 - DNA, 25 bp, Rattus norvegicus
gtggattaaagcgtcctggaagaag

SEQ ID NO: 511232 - DNA, 25 bp, Rattus norvegicus
gtggattacaaaactcctcgactgc

SEQ ID NO: 511233 - DNA, 25 bp, Rattus norvegicus
gtggattacaaatctcctcgactgc

SEQ ID NO: 511234 - DNA, 25 bp, Rattus norvegicus
gtggattacctgctacttggacatg

SEQ ID NO: 511235 - DNA, 25 bp, Rattus norvegicus
gtggattacctggtacttggacatg

SEQ ID NO: 511236 - DNA, 25 bp, Rattus norvegicus
gtggattattaaaagtcacccaatt

SEQ ID NO: 511237 - DNA, 25 bp, Rattus norvegicus
gtggattattaatagtcacccaatt

SEQ ID NO: 511238 - DNA, 25 bp, Rattus norvegicus
gtggattcaacacattttcccagaa

SEQ ID NO: 511239 - DNA, 25 bp, Rattus norvegicus
gtggattcaacagattttcccagaa

SEQ ID NO: 511240 - DNA, 25 bp, Rattus norvegicus
gtggattccaggacaaccagagcta

SEQ ID NO: 511241 - DNA, 25 bp, Rattus norvegicus
gtggattccaggtcaaccagagcta

SEQ ID NO: 511242 - DNA, 25 bp, Rattus norvegicus
gtggattccatgcatgccttagata

SEQ ID NO: 511243 - DNA, 25 bp, Rattus norvegicus
gtggattccatggatgccttagata

SEQ ID NO: 511244 - DNA, 25 bp, Rattus norvegicus
gtggattccattcttcaccacacat

SEQ ID NO: 511245 - DNA, 25 bp, Rattus norvegicus
gtggattccattgttcaccacacat

SEQ ID NO: 511246 - DNA, 25 bp, Rattus norvegicus
gtggattccccaaggacactgatct

SEQ ID NO: 511247 - DNA, 25 bp, Rattus norvegicus
gtggattccccatggacactgatct

SEQ ID NO: 511248 - DNA, 25 bp, Rattus norvegicus
gtggattccctcaaccagaagatgg

SEQ ID NO: 511249 - DNA, 25 bp, Rattus norvegicus
gtggattccctctaccagaagatgg

SEQ ID NO: 511250 - DNA, 25 bp, Rattus norvegicus
gtggattccggtactagagcgcgtt

SEQ ID NO: 511251 - DNA, 25 bp, Rattus norvegicus
gtggattccggttctagagcgcgtt

SEQ ID NO: 511252 - DNA, 25 bp, Rattus norvegicus
gtggattcctggatccagtgcatga

SEQ ID NO: 511253 - DNA, 25 bp, Rattus norvegicus
gtggattcctggttccagtgcatga

SEQ ID NO: 511254 - DNA, 25 bp, Rattus norvegicus
gtggattctagtcagcatggcccct

SEQ ID NO: 511255 - DNA, 25 bp, Rattus norvegicus
gtggattctagtgagcatggcccct

SEQ ID NO: 511256 - DNA, 25 bp, Rattus norvegicus
gtggattctccacagaagaacagca

SEQ ID NO: 511257 - DNA, 25 bp, Rattus norvegicus
gtggattctccagagaagaacagca

SEQ ID NO: 511258 - DNA, 25 bp, Rattus norvegicus
gtggattctcctcatggtctggagc

SEQ ID NO: 511259 - DNA, 25 bp, Rattus norvegicus
gtggattctcctgatggtctggagc

SEQ ID NO: 511260 - DNA, 25 bp, Rattus norvegicus
gtggattcttctacacacccatgtc

SEQ ID NO: 511261 - DNA, 25 bp, Rattus norvegicus
gtggattcttcttcacacccatgtc

SEQ ID NO: 511262 - DNA, 25 bp, Rattus norvegicus
gtggattgacacacgatccttgtgt

SEQ ID NO: 511263 - DNA, 25 bp, Rattus norvegicus
gtggattgacactcgatccttgtgt

SEQ ID NO: 511264 - DNA, 25 bp, Rattus norvegicus
gtggattgctgactgcattgcccag

SEQ ID NO: 511265 - DNA, 25 bp, Rattus norvegicus
gtggattgctgagtgcattgcccag

SEQ ID NO: 511266 - DNA, 25 bp, Rattus norvegicus
gtggattgtccacagcatactataa

SEQ ID NO: 511267 - DNA, 25 bp, Rattus norvegicus
gtggattgtccagagcatactataa

SEQ ID NO: 511268 - DNA, 25 bp, Rattus norvegicus
gtggattgtcctacctagagagatc

SEQ ID NO: 511269 - DNA, 25 bp, Rattus norvegicus
gtggattgtccttcctagagagatc

SEQ ID NO: 511270 - DNA, 25 bp, Rattus norvegicus
gtggatttacgtacatctgttcagt

SEQ ID NO: 511271 - DNA, 25 bp, Rattus norvegicus
gtggatttacgttcatctgttcagt

SEQ ID NO: 511272 - DNA, 25 bp, Rattus norvegicus
gtggatttatacaccttttaagact

SEQ ID NO: 511273 - DNA, 25 bp, Rattus norvegicus
gtggatttatactccttttaagact

SEQ ID NO: 511274 - DNA, 25 bp, Rattus norvegicus
gtggatttatctcagttcccttcag

SEQ ID NO: 511275 - DNA, 25 bp, Rattus norvegicus
gtggatttatctgagttcccttcag

SEQ ID NO: 511276 - DNA, 25 bp, Rattus norvegicus
gtggatttcaagacccattaggagc

SEQ ID NO: 511277 - DNA, 25 bp, Rattus norvegicus
gtggatttcaagtcccattaggagc

SEQ ID NO: 511278 - DNA, 25 bp, Rattus norvegicus
gtggatttccaaagcattatttctg

SEQ ID NO: 511279 - DNA, 25 bp, Rattus norvegicus
gtggatttccaatgcattatttctg

SEQ ID NO: 511280 - DNA, 25 bp, Rattus norvegicus
gtggatttccccagccgtggaagaa

SEQ ID NO: 511281 - DNA, 25 bp, Rattus norvegicus
gtggatttcccctgccgtggaagaa

SEQ ID NO: 511282 - DNA, 25 bp, Rattus norvegicus
gtggatttctataatcactcgatgt

SEQ ID NO: 511283 - DNA, 25 bp, Rattus norvegicus
gtggatttctattatcactcgatgt

SEQ ID NO: 511284 - DNA, 25 bp, Rattus norvegicus
gtggatttcttcaatttactttaat

SEQ ID NO: 511285 - DNA, 25 bp, Rattus norvegicus
gtggatttcttctatttactttaat

SEQ ID NO: 511286 - DNA, 25 bp, Rattus norvegicus
gtggatttgtctaccagcaaagcca

SEQ ID NO: 511287 - DNA, 25 bp, Rattus norvegicus
gtggatttgtcttccagcaaagcca

SEQ ID NO: 511288 - DNA, 25 bp, Rattus norvegicus
gtggattttaaccatctttaagctt

SEQ ID NO: 511289 - DNA, 25 bp, Rattus norvegicus
gtggattttaacgatctttaagctt

SEQ ID NO: 511290 - DNA, 25 bp, Rattus norvegicus
gtggattttaggatcccttcatcaa

SEQ ID NO: 511291 - DNA, 25 bp, Rattus norvegicus
gtggattttaggttcccttcatcaa

SEQ ID NO: 511292 - DNA, 25 bp, Rattus norvegicus
gtggattttatacccctttcagtca

SEQ ID NO: 511293 - DNA, 25 bp, Rattus norvegicus
gtggattttatagccctttcagtca

SEQ ID NO: 511294 - DNA, 25 bp, Rattus norvegicus
gtggattttctaagaggaacgcctt

SEQ ID NO: 511295 - DNA, 25 bp, Rattus norvegicus
gtggattttctatgaggaacgcctt

SEQ ID NO: 511296 - DNA, 25 bp, Rattus norvegicus
gtggattttctcagttaactgtgat

SEQ ID NO: 511297 - DNA, 25 bp, Rattus norvegicus
gtggattttctctgttaactgtgat

SEQ ID NO: 511298 - DNA, 25 bp, Rattus norvegicus
gtggattttcttagctatggtgttt

SEQ ID NO: 511299 - DNA, 25 bp, Rattus norvegicus
gtggattttctttgctatggtgttt

SEQ ID NO: 511300 - DNA, 25 bp, Rattus norvegicus
gtggatttttagcatctgagcagta

SEQ ID NO: 511301 - DNA, 25 bp, Rattus norvegicus
gtggatttttaggatctgagcagta

SEQ ID NO: 511302 - DNA, 25 bp, Rattus norvegicus
gtggatttttccattatggtgctga

SEQ ID NO: 511303 - DNA, 25 bp, Rattus norvegicus
gtggatttttcctttatggtgctga

SEQ ID NO: 511304 - DNA, 25 bp, Rattus norvegicus
gtggcaaaagccactgtgtctttgg

SEQ ID NO: 511305 - DNA, 25 bp, Rattus norvegicus
gtggcaaaagcctctgtgtctttgg

SEQ ID NO: 511306 - DNA, 25 bp, Rattus norvegicus
gtggcaaaaggtattcttgttctgc

SEQ ID NO: 511307 - DNA, 25 bp, Rattus norvegicus
gtggcaaaaggttttcttgttctgc

SEQ ID NO: 511308 - DNA, 25 bp, Rattus norvegicus
gtggcaaacaacctgttttcgagct

SEQ ID NO: 511309 - DNA, 25 bp, Rattus norvegicus
gtggcaaacaacgtgttttcgagct

SEQ ID NO: 511310 - DNA, 25 bp, Rattus norvegicus
gtggcaaacggcctttgactaagtt

SEQ ID NO: 511311 - DNA, 25 bp, Rattus norvegicus
gtggcaaacggcgtttgactaagtt

SEQ ID NO: 511312 - DNA, 25 bp, Rattus norvegicus
gtggcaaactagacagcgtcacagt

SEQ ID NO: 511313 - DNA, 25 bp, Rattus norvegicus
gtggcaaactagtcagcgtcacagt

SEQ ID NO: 511314 - DNA, 25 bp, Rattus norvegicus
gtggcaaagaggcttccagccaagt

SEQ ID NO: 511315 - DNA, 25 bp, Rattus norvegicus
gtggcaaagagggttccagccaagt

SEQ ID NO: 511316 - DNA, 25 bp, Rattus norvegicus
gtggcaaagcccaggttaaccaact

SEQ ID NO: 511317 - DNA, 25 bp, Rattus norvegicus
gtggcaaagccccacatacaatgtg

SEQ ID NO: 511318 - DNA, 25 bp, Rattus norvegicus
gtggcaaagcccgacatacaatgtg

SEQ ID NO: 511319 - DNA, 25 bp, Rattus norvegicus
gtggcaaagccctggttaaccaact

SEQ ID NO: 511320 - DNA, 25 bp, Rattus norvegicus
gtggcaaagcctacaacagaagttc

SEQ ID NO: 511321 - DNA, 25 bp, Rattus norvegicus
gtggcaaagccttcaacagaagttc

SEQ ID NO: 511322 - DNA, 25 bp, Rattus norvegicus
gtggcaaagtctcagtcccaacttc

SEQ ID NO: 511323 - DNA, 25 bp, Rattus norvegicus
gtggcaaagtctgagtcccaacttc

SEQ ID NO: 511324 - DNA, 25 bp, Rattus norvegicus
gtggcaaatacgaggctgacttcag

SEQ ID NO: 511325 - DNA, 25 bp, Rattus norvegicus
gtggcaaatacgtggctgacttcag

SEQ ID NO: 511326 - DNA, 25 bp, Rattus norvegicus
gtggcaaatataactctttatgcag

SEQ ID NO: 511327 - DNA, 25 bp, Rattus norvegicus
gtggcaaatatatctctttatgcag

SEQ ID NO: 511328 - DNA, 25 bp, Rattus norvegicus
gtggcaaatgttctcatgtactgct

SEQ ID NO: 511329 - DNA, 25 bp, Rattus norvegicus
gtggcaaatgttgtcatgtactgct

SEQ ID NO: 511330 - DNA, 25 bp, Rattus norvegicus
gtggcaaattctatactaggagctc

SEQ ID NO: 511331 - DNA, 25 bp, Rattus norvegicus
gtggcaaattctttactaggagctc

SEQ ID NO: 511332 - DNA, 25 bp, Rattus norvegicus
gtggcaaattggagttcggcttctt

SEQ ID NO: 511333 - DNA, 25 bp, Rattus norvegicus
gtggcaaattggtgttcggcttctt

SEQ ID NO: 511334 - DNA, 25 bp, Rattus norvegicus
gtggcaaattttaatccagctttca

SEQ ID NO: 511335 - DNA, 25 bp, Rattus norvegicus
gtggcaaatttttatccagctttca

SEQ ID NO: 511336 - DNA, 25 bp, Rattus norvegicus
gtggcaacagggacctttctctctt

SEQ ID NO: 511337 - DNA, 25 bp, Rattus norvegicus
gtggcaacagggtcctttctctctt

SEQ ID NO: 511338 - DNA, 25 bp, Rattus norvegicus
gtggcaacagtcacctgtcgtcatg

SEQ ID NO: 511339 - DNA, 25 bp, Rattus norvegicus
gtggcaacagtctcctgtcgtcatg

SEQ ID NO: 511340 - DNA, 25 bp, Rattus norvegicus
gtggcaaccaagaattttgatcatt

SEQ ID NO: 511341 - DNA, 25 bp, Rattus norvegicus
gtggcaaccaagtattttgatcatt

SEQ ID NO: 511342 - DNA, 25 bp, Rattus norvegicus
gtggcaaccttgaccctgtgggtta

SEQ ID NO: 511343 - DNA, 25 bp, Rattus norvegicus
gtggcaaccttgtccctgtgggtta

SEQ ID NO: 511344 - DNA, 25 bp, Rattus norvegicus
gtggcaactaacaaatcctgaccct

SEQ ID NO: 511345 - DNA, 25 bp, Rattus norvegicus
gtggcaactaactaatcctgaccct

SEQ ID NO: 511346 - DNA, 25 bp, Rattus norvegicus
gtggcaactgctctgcagacattag

SEQ ID NO: 511347 - DNA, 25 bp, Rattus norvegicus
gtggcaactgctgtgcagacattag

SEQ ID NO: 511348 - DNA, 25 bp, Rattus norvegicus
gtggcaagacccagaacacgttcta

SEQ ID NO: 511349 - DNA, 25 bp, Rattus norvegicus
gtggcaagaccctgaacacgttcta

SEQ ID NO: 511350 - DNA, 25 bp, Rattus norvegicus
gtggcaagcacccatacccaatgaa

SEQ ID NO: 511351 - DNA, 25 bp, Rattus norvegicus
gtggcaagcaccgatacccaatgaa

SEQ ID NO: 511352 - DNA, 25 bp, Rattus norvegicus
gtggcaagcactacatctacacatg

SEQ ID NO: 511353 - DNA, 25 bp, Rattus norvegicus
gtggcaagcacttcatctacacatg

SEQ ID NO: 511354 - DNA, 25 bp, Rattus norvegicus
gtggcaagcagcctttaactcttct

SEQ ID NO: 511355 - DNA, 25 bp, Rattus norvegicus
gtggcaagcagcgtttaactcttct

SEQ ID NO: 511356 - DNA, 25 bp, Rattus norvegicus
gtggcaagcatacactctgcacatg

SEQ ID NO: 511357 - DNA, 25 bp, Rattus norvegicus
gtggcaagcatagactctgcacatg

SEQ ID NO: 511358 - DNA, 25 bp, Rattus norvegicus
gtggcaagcgctacacacagaagca

SEQ ID NO: 511359 - DNA, 25 bp, Rattus norvegicus
gtggcaagcgcttcacacagaagca

SEQ ID NO: 511360 - DNA, 25 bp, Rattus norvegicus
gtggcaagctcacgtggcatcactg

SEQ ID NO: 511361 - DNA, 25 bp, Rattus norvegicus
gtggcaagctcaggtggcatcactg

SEQ ID NO: 511362 - DNA, 25 bp, Rattus norvegicus
gtggcaagctctcctggttatgata

SEQ ID NO: 511363 - DNA, 25 bp, Rattus norvegicus
gtggcaagctctgctggttatgata

SEQ ID NO: 511364 - DNA, 25 bp, Rattus norvegicus
gtggcaagcttgagtttgattccta

SEQ ID NO: 511365 - DNA, 25 bp, Rattus norvegicus
gtggcaagcttgtgtttgattccta

SEQ ID NO: 511366 - DNA, 25 bp, Rattus norvegicus
gtggcaaggaccacaggcaccgcgc

SEQ ID NO: 511367 - DNA, 25 bp, Rattus norvegicus
gtggcaaggacctcaggcaccgcgc

SEQ ID NO: 511368 - DNA, 25 bp, Rattus norvegicus
gtggcaagtcacaaggaaacctcaa

SEQ ID NO: 511369 - DNA, 25 bp, Rattus norvegicus
gtggcaagtcactaggaaacctcaa

SEQ ID NO: 511370 - DNA, 25 bp, Rattus norvegicus
gtggcaagtcagaacaggctaccct

SEQ ID NO: 511371 - DNA, 25 bp, Rattus norvegicus
gtggcaagtcagtacaggctaccct

SEQ ID NO: 511372 - DNA, 25 bp, Rattus norvegicus
gtggcaagtgatatctttgattcaa

SEQ ID NO: 511373 - DNA, 25 bp, Rattus norvegicus
gtggcaagtgatttctttgattcaa

SEQ ID NO: 511374 - DNA, 25 bp, Rattus norvegicus
gtggcaagtgtcactctcttcttgt

SEQ ID NO: 511375 - DNA, 25 bp, Rattus norvegicus
gtggcaagtgtctctctcttcttgt

SEQ ID NO: 511376 - DNA, 25 bp, Rattus norvegicus
gtggcaatccacatataacctgtaa

SEQ ID NO: 511377 - DNA, 25 bp, Rattus norvegicus
gtggcaatccacttataacctgtaa

SEQ ID NO: 511378 - DNA, 25 bp, Rattus norvegicus
gtggcaatgacaacgctctggtcaa

SEQ ID NO: 511379 - DNA, 25 bp, Rattus norvegicus
gtggcaatgacatcgctctggtcaa

SEQ ID NO: 511380 - DNA, 25 bp, Rattus norvegicus
gtggcaatgcatatgactttcttct

SEQ ID NO: 511381 - DNA, 25 bp, Rattus norvegicus
gtggcaatgcatttgactttcttct

SEQ ID NO: 511382 - DNA, 25 bp, Rattus norvegicus
gtggcaatggataaacatacccctt

SEQ ID NO: 511383 - DNA, 25 bp, Rattus norvegicus
gtggcaatggattaacatacccctt

SEQ ID NO: 511384 - DNA, 25 bp, Rattus norvegicus
gtggcacaaactacccaaacttgac

SEQ ID NO: 511385 - DNA, 25 bp, Rattus norvegicus
gtggcacaaacttcccaaacttgac

SEQ ID NO: 511386 - DNA, 25 bp, Rattus norvegicus
gtggcacaacacatcaagcctcagt

SEQ ID NO: 511387 - DNA, 25 bp, Rattus norvegicus
gtggcacaacacttcaagcctcagt

SEQ ID NO: 511388 - DNA, 25 bp, Rattus norvegicus
gtggcacaacgactgctttaactgt

SEQ ID NO: 511389 - DNA, 25 bp, Rattus norvegicus
gtggcacaacgagtgctttaactgt

SEQ ID NO: 511390 - DNA, 25 bp, Rattus norvegicus
gtggcacacacacaaatatcagttt

SEQ ID NO: 511391 - DNA, 25 bp, Rattus norvegicus
gtggcacacacagaaatatcagttt

SEQ ID NO: 511392 - DNA, 25 bp, Rattus norvegicus
gtggcacacactctggctcagcagt

SEQ ID NO: 511393 - DNA, 25 bp, Rattus norvegicus
gtggcacacactgtggctcagcagt

SEQ ID NO: 511394 - DNA, 25 bp, Rattus norvegicus
gtggcacacaggcataattctgctc

SEQ ID NO: 511395 - DNA, 25 bp, Rattus norvegicus
gtggcacacagggataattctgctc

SEQ ID NO: 511396 - DNA, 25 bp, Rattus norvegicus
gtggcacactccagtctcaagagga

SEQ ID NO: 511397 - DNA, 25 bp, Rattus norvegicus
gtggcacactcctgtctcaagagga

SEQ ID NO: 511398 - DNA, 25 bp, Rattus norvegicus
gtggcacacttaactcctgcaggct

SEQ ID NO: 511399 - DNA, 25 bp, Rattus norvegicus
gtggcacacttatctcctgcaggct

SEQ ID NO: 511400 - DNA, 25 bp, Rattus norvegicus
gtggcacaggagagtagcaatcaca

SEQ ID NO: 511401 - DNA, 25 bp, Rattus norvegicus
gtggcacaggagtgtagcaatcaca

SEQ ID NO: 511402 - DNA, 25 bp, Rattus norvegicus
gtggcacagtttctttataccttct

SEQ ID NO: 511403 - DNA, 25 bp, Rattus norvegicus
gtggcacagtttgtttataccttct

SEQ ID NO: 511404 - DNA, 25 bp, Rattus norvegicus
gtggcacatatcagcaaatatcgaa

SEQ ID NO: 511405 - DNA, 25 bp, Rattus norvegicus
gtggcacatatctgcaaatatcgaa

SEQ ID NO: 511406 - DNA, 25 bp, Rattus norvegicus
gtggcacatgcacgcagctctaatg

SEQ ID NO: 511407 - DNA, 25 bp, Rattus norvegicus
gtggcacatgcaggcagctctaatg

SEQ ID NO: 511408 - DNA, 25 bp, Rattus norvegicus
gtggcacatggacattcagaggaca

SEQ ID NO: 511409 - DNA, 25 bp, Rattus norvegicus
gtggcacatggagattcagaggaca

SEQ ID NO: 511410 - DNA, 25 bp, Rattus norvegicus
gtggcacattccattcttcaatcca

SEQ ID NO: 511411 - DNA, 25 bp, Rattus norvegicus
gtggcacattcctttcttcaatcca

SEQ ID NO: 511412 - DNA, 25 bp, Rattus norvegicus
gtggcaccaatgacacatacaccat

SEQ ID NO: 511413 - DNA, 25 bp, Rattus norvegicus
gtggcaccaatgtcacatacaccat

SEQ ID NO: 511414 - DNA, 25 bp, Rattus norvegicus
gtggcaccacaactgggttacagag

SEQ ID NO: 511415 - DNA, 25 bp, Rattus norvegicus
gtggcaccacaagtgggttacagag

SEQ ID NO: 511416 - DNA, 25 bp, Rattus norvegicus
gtggcaccacttacgagatttctgt

SEQ ID NO: 511417 - DNA, 25 bp, Rattus norvegicus
gtggcaccactttcgagatttctgt

SEQ ID NO: 511418 - DNA, 25 bp, Rattus norvegicus
gtggcacccaaacacagcagatctg

SEQ ID NO: 511419 - DNA, 25 bp, Rattus norvegicus
gtggcacccaaagacagcagatctg

SEQ ID NO: 511420 - DNA, 25 bp, Rattus norvegicus
gtggcacccacaaactttcaaacaa

SEQ ID NO: 511421 - DNA, 25 bp, Rattus norvegicus
gtggcacccacatactttcaaacaa

SEQ ID NO: 511422 - DNA, 25 bp, Rattus norvegicus
gtggcaccctcaagcaaggagactg

SEQ ID NO: 511423 - DNA, 25 bp, Rattus norvegicus
gtggcaccctcatgcaaggagactg

SEQ ID NO: 511424 - DNA, 25 bp, Rattus norvegicus
gtggcacctatcacactgtatttta

SEQ ID NO: 511425 - DNA, 25 bp, Rattus norvegicus
gtggcacctatctcactgtatttta

SEQ ID NO: 511426 - DNA, 25 bp, Rattus norvegicus
gtggcacctcggaggtgctcatctg

SEQ ID NO: 511427 - DNA, 25 bp, Rattus norvegicus
gtggcacctcggtggtgctcatctg

SEQ ID NO: 511428 - DNA, 25 bp, Rattus norvegicus
gtggcacctgctcgacagtgtgccc

SEQ ID NO: 511429 - DNA, 25 bp, Rattus norvegicus
gtggcacctgctggacagtgtgccc

SEQ ID NO: 511430 - DNA, 25 bp, Rattus norvegicus
gtggcacctggacatttattttaca

SEQ ID NO: 511431 - DNA, 25 bp, Rattus norvegicus
gtggcacctggagatttattttaca

SEQ ID NO: 511432 - DNA, 25 bp, Rattus norvegicus
gtggcaccttgactttcaatgggcc

SEQ ID NO: 511433 - DNA, 25 bp, Rattus norvegicus
gtggcaccttgagtttcaatgggcc

SEQ ID NO: 511434 - DNA, 25 bp, Rattus norvegicus
gtggcaccttgtcctaagattcaga

SEQ ID NO: 511435 - DNA, 25 bp, Rattus norvegicus
gtggcaccttgtgctaagattcaga

SEQ ID NO: 511436 - DNA, 25 bp, Rattus norvegicus
gtggcacctttgagcatgctacttg

SEQ ID NO: 511437 - DNA, 25 bp, Rattus norvegicus
gtggcacctttgtgcatgctacttg

SEQ ID NO: 511438 - DNA, 25 bp, Rattus norvegicus
gtggcacgctttattaataatcatt

SEQ ID NO: 511439 - DNA, 25 bp, Rattus norvegicus
gtggcacgcttttttaataatcatt

SEQ ID NO: 511440 - DNA, 25 bp, Rattus norvegicus
gtggcacggaacagcacttggaacc

SEQ ID NO: 511441 - DNA, 25 bp, Rattus norvegicus
gtggcacggaactgcacttggaacc

SEQ ID NO: 511442 - DNA, 25 bp, Rattus norvegicus
gtggcacggcaaacttcagaactca

SEQ ID NO: 511443 - DNA, 25 bp, Rattus norvegicus
gtggcacggcaatcttcagaactca

SEQ ID NO: 511444 - DNA, 25 bp, Rattus norvegicus
gtggcacggtgaacacttgctgact

SEQ ID NO: 511445 - DNA, 25 bp, Rattus norvegicus
gtggcacggtgatcacttgctgact

SEQ ID NO: 511446 - DNA, 25 bp, Rattus norvegicus
gtggcacgtccccataggatggtaa

SEQ ID NO: 511447 - DNA, 25 bp, Rattus norvegicus
gtggcacgtcccgataggatggtaa

SEQ ID NO: 511448 - DNA, 25 bp, Rattus norvegicus
gtggcacgtggtacaatttctggca

SEQ ID NO: 511449 - DNA, 25 bp, Rattus norvegicus
gtggcacgtggttcaatttctggca

SEQ ID NO: 511450 - DNA, 25 bp, Rattus norvegicus
gtggcacgtgtgcttgtaaccgtat

SEQ ID NO: 511451 - DNA, 25 bp, Rattus norvegicus
gtggcacgtgtggttgtaaccgtat

SEQ ID NO: 511452 - DNA, 25 bp, Rattus norvegicus
gtggcactatcaaccttaaaattat

SEQ ID NO: 511453 - DNA, 25 bp, Rattus norvegicus
gtggcactatcatccttaaaattat

SEQ ID NO: 511454 - DNA, 25 bp, Rattus norvegicus
gtggcactatcgctgttttaagaaa

SEQ ID NO: 511455 - DNA, 25 bp, Rattus norvegicus
gtggcactatcggtgttttaagaaa

SEQ ID NO: 511456 - DNA, 25 bp, Rattus norvegicus
gtggcactattaataagcctcccca

SEQ ID NO: 511457 - DNA, 25 bp, Rattus norvegicus
gtggcactattattaagcctcccca

SEQ ID NO: 511458 - DNA, 25 bp, Rattus norvegicus
gtggcactcaaaccttctgtggagc

SEQ ID NO: 511459 - DNA, 25 bp, Rattus norvegicus
gtggcactcaaagcttctgtggagc

SEQ ID NO: 511460 - DNA, 25 bp, Rattus norvegicus
gtggcactcacaacatgtaccgaga

SEQ ID NO: 511461 - DNA, 25 bp, Rattus norvegicus
gtggcactcacatcatgtaccgaga

SEQ ID NO: 511462 - DNA, 25 bp, Rattus norvegicus
gtggcactcacccacctaatagaat

SEQ ID NO: 511463 - DNA, 25 bp, Rattus norvegicus
gtggcactcaccgacctaatagaat

SEQ ID NO: 511464 - DNA, 25 bp, Rattus norvegicus
gtggcactcattatccaattattta

SEQ ID NO: 511465 - DNA, 25 bp, Rattus norvegicus
gtggcactcattttccaattattta

SEQ ID NO: 511466 - DNA, 25 bp, Rattus norvegicus
gtggcactcctacgaagacgcatgt

SEQ ID NO: 511467 - DNA, 25 bp, Rattus norvegicus
gtggcactcctaggaagacgcatgt

SEQ ID NO: 511468 - DNA, 25 bp, Rattus norvegicus
gtggcactcggtcacatcgaatcaa

SEQ ID NO: 511469 - DNA, 25 bp, Rattus norvegicus
gtggcactcggtgacatcgaatcaa

SEQ ID NO: 511470 - DNA, 25 bp, Rattus norvegicus
gtggcactgccaagacataggacca

SEQ ID NO: 511471 - DNA, 25 bp, Rattus norvegicus
gtggcactgccatgacataggacca

SEQ ID NO: 511472 - DNA, 25 bp, Rattus norvegicus
gtggcactgctaagtcaactgaact

SEQ ID NO: 511473 - DNA, 25 bp, Rattus norvegicus
gtggcactgctatgtcaactgaact

SEQ ID NO: 511474 - DNA, 25 bp, Rattus norvegicus
gtggcactgctgactgtcatgggaa

SEQ ID NO: 511475 - DNA, 25 bp, Rattus norvegicus
gtggcactgctgtctgtcatgggaa

SEQ ID NO: 511476 - DNA, 25 bp, Rattus norvegicus
gtggcactggacacttgcttgctta

SEQ ID NO: 511477 - DNA, 25 bp, Rattus norvegicus
gtggcactggactcttgcttgctta

SEQ ID NO: 511478 - DNA, 25 bp, Rattus norvegicus
gtggcactggctaaatgctgttaat

SEQ ID NO: 511479 - DNA, 25 bp, Rattus norvegicus
gtggcactggctaagaacagactca

SEQ ID NO: 511480 - DNA, 25 bp, Rattus norvegicus
gtggcactggcttaatgctgttaat

SEQ ID NO: 511481 - DNA, 25 bp, Rattus norvegicus
gtggcactggcttagaacagactca

SEQ ID NO: 511482 - DNA, 25 bp, Rattus norvegicus
gtggcactgtgcacatcggatgttc

SEQ ID NO: 511483 - DNA, 25 bp, Rattus norvegicus
gtggcactgtgctcatcggatgttc

SEQ ID NO: 511484 - DNA, 25 bp, Rattus norvegicus
gtggcacttcagacctccgatgcag

SEQ ID NO: 511485 - DNA, 25 bp, Rattus norvegicus
gtggcacttcagtcctccgatgcag

SEQ ID NO: 511486 - DNA, 25 bp, Rattus norvegicus
gtggcacttcctccgcaactgatgg

SEQ ID NO: 511487 - DNA, 25 bp, Rattus norvegicus
gtggcacttcctgcgcaactgatgg

SEQ ID NO: 511488 - DNA, 25 bp, Rattus norvegicus
gtggcacttcttcatacgctggata

SEQ ID NO: 511489 - DNA, 25 bp, Rattus norvegicus
gtggcacttcttgatacgctggata

SEQ ID NO: 511490 - DNA, 25 bp, Rattus norvegicus
gtggcacttgacaatgtgtagcctt

SEQ ID NO: 511491 - DNA, 25 bp, Rattus norvegicus
gtggcacttgactatgtgtagcctt

SEQ ID NO: 511492 - DNA, 25 bp, Rattus norvegicus
gtggcacttgagaagtccagggctc

SEQ ID NO: 511493 - DNA, 25 bp, Rattus norvegicus
gtggcacttgagtagtccagggctc

SEQ ID NO: 511494 - DNA, 25 bp, Rattus norvegicus
gtggcacttggcaatttctttttca

SEQ ID NO: 511495 - DNA, 25 bp, Rattus norvegicus
gtggcacttggctatttctttttca

SEQ ID NO: 511496 - DNA, 25 bp, Rattus norvegicus
gtggcacttgtcctagaggctgtca

SEQ ID NO: 511497 - DNA, 25 bp, Rattus norvegicus
gtggcacttgtcgtagaggctgtca

SEQ ID NO: 511498 - DNA, 25 bp, Rattus norvegicus
gtggcacttgtgcattttatgtgtg

SEQ ID NO: 511499 - DNA, 25 bp, Rattus norvegicus
gtggcacttgtggattttatgtgtg

SEQ ID NO: 511500 - DNA, 25 bp, Rattus norvegicus
gtggcactttcacacaaactttcgg

SEQ ID NO: 511501 - DNA, 25 bp, Rattus norvegicus
gtggcactttcagacaaactttcgg

SEQ ID NO: 511502 - DNA, 25 bp, Rattus norvegicus
gtggcactttgtactcctatgtcag

SEQ ID NO: 511503 - DNA, 25 bp, Rattus norvegicus
gtggcactttgttctcctatgtcag

SEQ ID NO: 511504 - DNA, 25 bp, Rattus norvegicus
gtggcacttttaatgatagaatgta

SEQ ID NO: 511505 - DNA, 25 bp, Rattus norvegicus
gtggcacttttattgatagaatgta

SEQ ID NO: 511506 - DNA, 25 bp, Rattus norvegicus
gtggcagaaaatccaggcacctttg

SEQ ID NO: 511507 - DNA, 25 bp, Rattus norvegicus
gtggcagaaaatgcaggcacctttg

SEQ ID NO: 511508 - DNA, 25 bp, Rattus norvegicus
gtggcagaacaaactgctcccatca

SEQ ID NO: 511509 - DNA, 25 bp, Rattus norvegicus
gtggcagaacaatctgctcccatca

SEQ ID NO: 511510 - DNA, 25 bp, Rattus norvegicus
gtggcagaacacctttcaagagctt

SEQ ID NO: 511511 - DNA, 25 bp, Rattus norvegicus
gtggcagaacacgtttcaagagctt

SEQ ID NO: 511512 - DNA, 25 bp, Rattus norvegicus
gtggcagaaccacggctgatgctca

SEQ ID NO: 511513 - DNA, 25 bp, Rattus norvegicus
gtggcagaaccagggctgatgctca

SEQ ID NO: 511514 - DNA, 25 bp, Rattus norvegicus
gtggcagaattccaggcagactcaa

SEQ ID NO: 511515 - DNA, 25 bp, Rattus norvegicus
gtggcagaattcgaggcagactcaa

SEQ ID NO: 511516 - DNA, 25 bp, Rattus norvegicus
gtggcagacacaaatacgcttaagt

SEQ ID NO: 511517 - DNA, 25 bp, Rattus norvegicus
gtggcagacacatatacgcttaagt

SEQ ID NO: 511518 - DNA, 25 bp, Rattus norvegicus
gtggcagagattattccagcccctg

SEQ ID NO: 511519 - DNA, 25 bp, Rattus norvegicus
gtggcagagatttttccagcccctg

SEQ ID NO: 511520 - DNA, 25 bp, Rattus norvegicus
gtggcagagcagaggcttcttccat

SEQ ID NO: 511521 - DNA, 25 bp, Rattus norvegicus
gtggcagagcagtggcttcttccat

SEQ ID NO: 511522 - DNA, 25 bp, Rattus norvegicus
gtggcagagccaagaagcatcagca

SEQ ID NO: 511523 - DNA, 25 bp, Rattus norvegicus
gtggcagagccatgaagcatcagca

SEQ ID NO: 511524 - DNA, 25 bp, Rattus norvegicus
gtggcagagcccattgatttttagt

SEQ ID NO: 511525 - DNA, 25 bp, Rattus norvegicus
gtggcagagccctttgatttttagt

SEQ ID NO: 511526 - DNA, 25 bp, Rattus norvegicus
gtggcagaggccagtccatcatgag

SEQ ID NO: 511527 - DNA, 25 bp, Rattus norvegicus
gtggcagaggcctgtccatcatgag

SEQ ID NO: 511528 - DNA, 25 bp, Rattus norvegicus
gtggcagatatgagtccccgaagaa

SEQ ID NO: 511529 - DNA, 25 bp, Rattus norvegicus
gtggcagatatgtgtccccgaagaa

SEQ ID NO: 511530 - DNA, 25 bp, Rattus norvegicus
gtggcagatcgaacgtgagcttgat

SEQ ID NO: 511531 - DNA, 25 bp, Rattus norvegicus
gtggcagatcgatcgtgagcttgat

SEQ ID NO: 511532 - DNA, 25 bp, Rattus norvegicus
gtggcagatggcacctgtcaggaca

SEQ ID NO: 511533 - DNA, 25 bp, Rattus norvegicus
gtggcagatggctcctgtcaggaca

SEQ ID NO: 511534 - DNA, 25 bp, Rattus norvegicus
gtggcagatgggagaccctaccctg

SEQ ID NO: 511535 - DNA, 25 bp, Rattus norvegicus
gtggcagatgggtgaccctaccctg

SEQ ID NO: 511536 - DNA, 25 bp, Rattus norvegicus
gtggcagcactcagagccggtcata

SEQ ID NO: 511537 - DNA, 25 bp, Rattus norvegicus
gtggcagcactctgagccggtcata

SEQ ID NO: 511538 - DNA, 25 bp, Rattus norvegicus
gtggcagcagacacaaccggatcag

SEQ ID NO: 511539 - DNA, 25 bp, Rattus norvegicus
gtggcagcagactcaaccggatcag

SEQ ID NO: 511540 - DNA, 25 bp, Rattus norvegicus
gtggcagcaggaccttgagatatct

SEQ ID NO: 511541 - DNA, 25 bp, Rattus norvegicus
gtggcagcaggagcttgagatatct

SEQ ID NO: 511542 - DNA, 25 bp, Rattus norvegicus
gtggcagcagtaattatgaataata

SEQ ID NO: 511543 - DNA, 25 bp, Rattus norvegicus
gtggcagcagtatttatgaataata

SEQ ID NO: 511544 - DNA, 25 bp, Rattus norvegicus
gtggcagccaacatcatgaaccaaa

SEQ ID NO: 511545 - DNA, 25 bp, Rattus norvegicus
gtggcagccaacttcatgaaccaaa

SEQ ID NO: 511546 - DNA, 25 bp, Rattus norvegicus
gtggcagccagcacagtcttgcagg

SEQ ID NO: 511547 - DNA, 25 bp, Rattus norvegicus
gtggcagccagctcagtcttgcagg

SEQ ID NO: 511548 - DNA, 25 bp, Rattus norvegicus
gtggcagccagtaaagcaccagtgg

SEQ ID NO: 511549 - DNA, 25 bp, Rattus norvegicus
gtggcagccagttaagcaccagtgg

SEQ ID NO: 511550 - DNA, 25 bp, Rattus norvegicus
gtggcagccctcaacaagtggagtc

SEQ ID NO: 511551 - DNA, 25 bp, Rattus norvegicus
gtggcagccctctacaagtggagtc

SEQ ID NO: 511552 - DNA, 25 bp, Rattus norvegicus
gtggcagcctgtctagttgctaacc

SEQ ID NO: 511553 - DNA, 25 bp, Rattus norvegicus
gtggcagcctgtgtagttgctaacc

SEQ ID NO: 511554 - DNA, 25 bp, Rattus norvegicus
gtggcagccttcacactgggaagga

SEQ ID NO: 511555 - DNA, 25 bp, Rattus norvegicus
gtggcagccttctcactgggaagga

SEQ ID NO: 511556 - DNA, 25 bp, Rattus norvegicus
gtggcagcgacgaccctcagccgag

SEQ ID NO: 511557 - DNA, 25 bp, Rattus norvegicus
gtggcagcgacgtccctcagccgag

SEQ ID NO: 511558 - DNA, 25 bp, Rattus norvegicus
gtggcagcgcgtcagtaactttaag

SEQ ID NO: 511559 - DNA, 25 bp, Rattus norvegicus
gtggcagcgcgtgagtaactttaag

SEQ ID NO: 511560 - DNA, 25 bp, Rattus norvegicus
gtggcagctaatcatggccccatgc

SEQ ID NO: 511561 - DNA, 25 bp, Rattus norvegicus
gtggcagctaatgatggccccatgc

SEQ ID NO: 511562 - DNA, 25 bp, Rattus norvegicus
gtggcagctagtaagcactttcagc

SEQ ID NO: 511563 - DNA, 25 bp, Rattus norvegicus
gtggcagctagttagcactttcagc

SEQ ID NO: 511564 - DNA, 25 bp, Rattus norvegicus
gtggcagctcaaactgtagcttcag

SEQ ID NO: 511565 - DNA, 25 bp, Rattus norvegicus
gtggcagctcaatctgtagcttcag

SEQ ID NO: 511566 - DNA, 25 bp, Rattus norvegicus
gtggcagctccacggttatagtgtc

SEQ ID NO: 511567 - DNA, 25 bp, Rattus norvegicus
gtggcagctccagggttatagtgtc

SEQ ID NO: 511568 - DNA, 25 bp, Rattus norvegicus
gtggcagctgccaacaagaagcatt

SEQ ID NO: 511569 - DNA, 25 bp, Rattus norvegicus
gtggcagctgcctacaagaagcatt

SEQ ID NO: 511570 - DNA, 25 bp, Rattus norvegicus
gtggcaggaaccagtgctctgtgac

SEQ ID NO: 511571 - DNA, 25 bp, Rattus norvegicus
gtggcaggaacctgtgctctgtgac

SEQ ID NO: 511572 - DNA, 25 bp, Rattus norvegicus
gtggcaggaactcataagtccacat

SEQ ID NO: 511573 - DNA, 25 bp, Rattus norvegicus
gtggcaggaactgataagtccacat

SEQ ID NO: 511574 - DNA, 25 bp, Rattus norvegicus
gtggcaggacaaccactccatcaga

SEQ ID NO: 511575 - DNA, 25 bp, Rattus norvegicus
gtggcaggacaagcactccatcaga

SEQ ID NO: 511576 - DNA, 25 bp, Rattus norvegicus
gtggcaggaccaataagtgatctcc

SEQ ID NO: 511577 - DNA, 25 bp, Rattus norvegicus
gtggcaggaccattaagtgatctcc

SEQ ID NO: 511578 - DNA, 25 bp, Rattus norvegicus
gtggcaggacccatacaggactcag

SEQ ID NO: 511579 - DNA, 25 bp, Rattus norvegicus
gtggcaggacccttacaggactcag

SEQ ID NO: 511580 - DNA, 25 bp, Rattus norvegicus
gtggcaggactcatcacagtcgtga

SEQ ID NO: 511581 - DNA, 25 bp, Rattus norvegicus
gtggcaggactcttcacagtcgtga

SEQ ID NO: 511582 - DNA, 25 bp, Rattus norvegicus
gtggcaggagtcacttctggagcat

SEQ ID NO: 511583 - DNA, 25 bp, Rattus norvegicus
gtggcaggagtctcttctggagcat

SEQ ID NO: 511584 - DNA, 25 bp, Rattus norvegicus
gtggcaggagtgaccaagagaccca

SEQ ID NO: 511585 - DNA, 25 bp, Rattus norvegicus
gtggcaggagtgtccaagagaccca

SEQ ID NO: 511586 - DNA, 25 bp, Rattus norvegicus
gtggcaggcccaaactgacagcagt

SEQ ID NO: 511587 - DNA, 25 bp, Rattus norvegicus
gtggcaggcccatactgacagcagt

SEQ ID NO: 511588 - DNA, 25 bp, Rattus norvegicus
gtggcaggctccactggaaactaat

SEQ ID NO: 511589 - DNA, 25 bp, Rattus norvegicus
gtggcaggctcctctggaaactaat

SEQ ID NO: 511590 - DNA, 25 bp, Rattus norvegicus
gtggcagggtctctgcagctttcaa

SEQ ID NO: 511591 - DNA, 25 bp, Rattus norvegicus
gtggcagggtctgtgcagctttcaa

SEQ ID NO: 511592 - DNA, 25 bp, Rattus norvegicus
gtggcagtagacactgcaccggaca

SEQ ID NO: 511593 - DNA, 25 bp, Rattus norvegicus
gtggcagtagactctgcaccggaca

SEQ ID NO: 511594 - DNA, 25 bp, Rattus norvegicus
gtggcagtatggagccggcctttca

SEQ ID NO: 511595 - DNA, 25 bp, Rattus norvegicus
gtggcagtatggtgccggcctttca

SEQ ID NO: 511596 - DNA, 25 bp, Rattus norvegicus
gtggcagtcctgcaggctcatcatg

SEQ ID NO: 511597 - DNA, 25 bp, Rattus norvegicus
gtggcagtcctggaggctcatcatg

SEQ ID NO: 511598 - DNA, 25 bp, Rattus norvegicus
gtggcagtctaacagctacctcgga

SEQ ID NO: 511599 - DNA, 25 bp, Rattus norvegicus
gtggcagtctaagagctacctcgga

SEQ ID NO: 511600 - DNA, 25 bp, Rattus norvegicus
gtggcagtctgcaactagaacgtga

SEQ ID NO: 511601 - DNA, 25 bp, Rattus norvegicus
gtggcagtctgctactagaacgtga

SEQ ID NO: 511602 - DNA, 25 bp, Rattus norvegicus
gtggcagtgagcaaaatcaaggtta

SEQ ID NO: 511603 - DNA, 25 bp, Rattus norvegicus
gtggcagtgagctaaatcaaggtta

SEQ ID NO: 511604 - DNA, 25 bp, Rattus norvegicus
gtggcagtgcctccgcatgaccatc

SEQ ID NO: 511605 - DNA, 25 bp, Rattus norvegicus
gtggcagtgcctgcgcatgaccatc

SEQ ID NO: 511606 - DNA, 25 bp, Rattus norvegicus
gtggcagtggaacctcgactaagaa

SEQ ID NO: 511607 - DNA, 25 bp, Rattus norvegicus
gtggcagtggaagctcgactaagaa

SEQ ID NO: 511608 - DNA, 25 bp, Rattus norvegicus
gtggcagttccacaagagactacag

SEQ ID NO: 511609 - DNA, 25 bp, Rattus norvegicus
gtggcagttccagaagagactacag

SEQ ID NO: 511610 - DNA, 25 bp, Rattus norvegicus
gtggcagttctcaaagtcagttaac

SEQ ID NO: 511611 - DNA, 25 bp, Rattus norvegicus
gtggcagttctcatctccataaaga

SEQ ID NO: 511612 - DNA, 25 bp, Rattus norvegicus
gtggcagttctctaagtcagttaac

SEQ ID NO: 511613 - DNA, 25 bp, Rattus norvegicus
gtggcagttctcttctccataaaga

SEQ ID NO: 511614 - DNA, 25 bp, Rattus norvegicus
gtggcagttggaaatgtcctcatac

SEQ ID NO: 511615 - DNA, 25 bp, Rattus norvegicus
gtggcagttggatatgtcctcatac

SEQ ID NO: 511616 - DNA, 25 bp, Rattus norvegicus
gtggcataaaccctctgcatcaaat

SEQ ID NO: 511617 - DNA, 25 bp, Rattus norvegicus
gtggcataaaccgtctgcatcaaat

SEQ ID NO: 511618 - DNA, 25 bp, Rattus norvegicus
gtggcataactcagagggtcgccct

SEQ ID NO: 511619 - DNA, 25 bp, Rattus norvegicus
gtggcataactctgagggtcgccct

SEQ ID NO: 511620 - DNA, 25 bp, Rattus norvegicus
gtggcataactgactgtaccctgaa

SEQ ID NO: 511621 - DNA, 25 bp, Rattus norvegicus
gtggcataactgtctgtaccctgaa

SEQ ID NO: 511622 - DNA, 25 bp, Rattus norvegicus
gtggcataaggtcatgttccccgtt

SEQ ID NO: 511623 - DNA, 25 bp, Rattus norvegicus
gtggcataaggtgatgttccccgtt

SEQ ID NO: 511624 - DNA, 25 bp, Rattus norvegicus
gtggcatactggagagcaatactaa

SEQ ID NO: 511625 - DNA, 25 bp, Rattus norvegicus
gtggcatactggtgagcaatactaa

SEQ ID NO: 511626 - DNA, 25 bp, Rattus norvegicus
gtggcatagctcaccaggtgaggac

SEQ ID NO: 511627 - DNA, 25 bp, Rattus norvegicus
gtggcatagctctccaggtgaggac

SEQ ID NO: 511628 - DNA, 25 bp, Rattus norvegicus
gtggcatataacattaatccaatac

SEQ ID NO: 511629 - DNA, 25 bp, Rattus norvegicus
gtggcatataactttaatccaatac

SEQ ID NO: 511630 - DNA, 25 bp, Rattus norvegicus
gtggcatattgtaaactctatcata

SEQ ID NO: 511631 - DNA, 25 bp, Rattus norvegicus
gtggcatattgttaactctatcata

SEQ ID NO: 511632 - DNA, 25 bp, Rattus norvegicus
gtggcatcaaccaacgagacttact

SEQ ID NO: 511633 - DNA, 25 bp, Rattus norvegicus
gtggcatcaacctacgagacttact

SEQ ID NO: 511634 - DNA, 25 bp, Rattus norvegicus
gtggcatcacctatgaccgcaagga

SEQ ID NO: 511635 - DNA, 25 bp, Rattus norvegicus
gtggcatcacctttgaccgcaagga

SEQ ID NO: 511636 - DNA, 25 bp, Rattus norvegicus
gtggcatcagccattgtagacaatg

SEQ ID NO: 511637 - DNA, 25 bp, Rattus norvegicus
gtggcatcagcctttgtagacaatg

SEQ ID NO: 511638 - DNA, 25 bp, Rattus norvegicus
gtggcatcatgcaacagggagagac

SEQ ID NO: 511639 - DNA, 25 bp, Rattus norvegicus
gtggcatcatgctacagggagagac

SEQ ID NO: 511640 - DNA, 25 bp, Rattus norvegicus
gtggcatccaccaagaatcaggcta

SEQ ID NO: 511641 - DNA, 25 bp, Rattus norvegicus
gtggcatccacctagaatcaggcta

SEQ ID NO: 511642 - DNA, 25 bp, Rattus norvegicus
gtggcatccccgagcaaatacagtc

SEQ ID NO: 511643 - DNA, 25 bp, Rattus norvegicus
gtggcatccccgtgcaaatacagtc

SEQ ID NO: 511644 - DNA, 25 bp, Rattus norvegicus
gtggcatcctgtacactgctaaaac

SEQ ID NO: 511645 - DNA, 25 bp, Rattus norvegicus
gtggcatcctgttcactgctaaaac

SEQ ID NO: 511646 - DNA, 25 bp, Rattus norvegicus
gtggcatccttgactggcagggcaa

SEQ ID NO: 511647 - DNA, 25 bp, Rattus norvegicus
gtggcatccttgtctggcagggcaa

SEQ ID NO: 511648 - DNA, 25 bp, Rattus norvegicus
gtggcatcctttactcttatttcaa

SEQ ID NO: 511649 - DNA, 25 bp, Rattus norvegicus
gtggcatccttttctcttatttcaa

SEQ ID NO: 511650 - DNA, 25 bp, Rattus norvegicus
gtggcatctaacctagcagcattga

SEQ ID NO: 511651 - DNA, 25 bp, Rattus norvegicus
gtggcatctaacgtagcagcattga

SEQ ID NO: 511652 - DNA, 25 bp, Rattus norvegicus
gtggcatctcctcaaagtggacctt

SEQ ID NO: 511653 - DNA, 25 bp, Rattus norvegicus
gtggcatctcctgaaagtggacctt

SEQ ID NO: 511654 - DNA, 25 bp, Rattus norvegicus
gtggcatctctcctggaaaccaaca

SEQ ID NO: 511655 - DNA, 25 bp, Rattus norvegicus
gtggcatctctcgtggaaaccaaca

SEQ ID NO: 511656 - DNA, 25 bp, Rattus norvegicus
gtggcatctgcgagttcatcagcaa

SEQ ID NO: 511657 - DNA, 25 bp, Rattus norvegicus
gtggcatctgcgtgttcatcagcaa

SEQ ID NO: 511658 - DNA, 25 bp, Rattus norvegicus
gtggcatcttcacctataccaggta

SEQ ID NO: 511659 - DNA, 25 bp, Rattus norvegicus
gtggcatcttcagctataccaggta

SEQ ID NO: 511660 - DNA, 25 bp, Rattus norvegicus
gtggcatgaaccagctacacaggct

SEQ ID NO: 511661 - DNA, 25 bp, Rattus norvegicus
gtggcatgaacctgctacacaggct

SEQ ID NO: 511662 - DNA, 25 bp, Rattus norvegicus
gtggcatgatgacagctatctgaac

SEQ ID NO: 511663 - DNA, 25 bp, Rattus norvegicus
gtggcatgatgagagctatctgaac

SEQ ID NO: 511664 - DNA, 25 bp, Rattus norvegicus
gtggcatgattaacatttaccatgg

SEQ ID NO: 511665 - DNA, 25 bp, Rattus norvegicus
gtggcatgattatcatttaccatgg

SEQ ID NO: 511666 - DNA, 25 bp, Rattus norvegicus
gtggcatgattcacttactagtgca

SEQ ID NO: 511667 - DNA, 25 bp, Rattus norvegicus
gtggcatgattctcttactagtgca

SEQ ID NO: 511668 - DNA, 25 bp, Rattus norvegicus
gtggcatgcagaatacacgggcaaa

SEQ ID NO: 511669 - DNA, 25 bp, Rattus norvegicus
gtggcatgcagattacacgggcaaa

SEQ ID NO: 511670 - DNA, 25 bp, Rattus norvegicus
gtggcatgccctcagaaacatacag

SEQ ID NO: 511671 - DNA, 25 bp, Rattus norvegicus
gtggcatgccctgagaaacatacag

SEQ ID NO: 511672 - DNA, 25 bp, Rattus norvegicus
gtggcatgctacataatctgttctg

SEQ ID NO: 511673 - DNA, 25 bp, Rattus norvegicus
gtggcatgctacttaatctgttctg

SEQ ID NO: 511674 - DNA, 25 bp, Rattus norvegicus
gtggcatgctgcagtggtgatttct

SEQ ID NO: 511675 - DNA, 25 bp, Rattus norvegicus
gtggcatgctgctgtggtgatttct

SEQ ID NO: 511676 - DNA, 25 bp, Rattus norvegicus
gtggcatggaccagcacactgagtt

SEQ ID NO: 511677 - DNA, 25 bp, Rattus norvegicus
gtggcatggacctgcacactgagtt

SEQ ID NO: 511678 - DNA, 25 bp, Rattus norvegicus
gtggcatgggacattatgcatccat

SEQ ID NO: 511679 - DNA, 25 bp, Rattus norvegicus
gtggcatgggactttatgcatccat

SEQ ID NO: 511680 - DNA, 25 bp, Rattus norvegicus
gtggcatgggatactgtatggaact

SEQ ID NO: 511681 - DNA, 25 bp, Rattus norvegicus
gtggcatgggattctgtatggaact

SEQ ID NO: 511682 - DNA, 25 bp, Rattus norvegicus
gtggcatggtatatggaatcttcag

SEQ ID NO: 511683 - DNA, 25 bp, Rattus norvegicus
gtggcatggtatttggaatcttcag

SEQ ID NO: 511684 - DNA, 25 bp, Rattus norvegicus
gtggcatggtgtcgtatgcttccat

SEQ ID NO: 511685 - DNA, 25 bp, Rattus norvegicus
gtggcatggtgtggtatgcttccat

SEQ ID NO: 511686 - DNA, 25 bp, Rattus norvegicus
gtggcatgtgacactattttctatc

SEQ ID NO: 511687 - DNA, 25 bp, Rattus norvegicus
gtggcatgtgactctattttctatc

SEQ ID NO: 511688 - DNA, 25 bp, Rattus norvegicus
gtggcatgtgccagagtccctcaga

SEQ ID NO: 511689 - DNA, 25 bp, Rattus norvegicus
gtggcatgtgcctgagtccctcaga

SEQ ID NO: 511690 - DNA, 25 bp, Rattus norvegicus
gtggcatgttctctgcaataggcat

SEQ ID NO: 511691 - DNA, 25 bp, Rattus norvegicus
gtggcatgttctgtgcaataggcat

SEQ ID NO: 511692 - DNA, 25 bp, Rattus norvegicus
gtggcattaaagagctgcttcctcg

SEQ ID NO: 511693 - DNA, 25 bp, Rattus norvegicus
gtggcattaaagtgctgcttcctcg

SEQ ID NO: 511694 - DNA, 25 bp, Rattus norvegicus
gtggcattacacaattaccagttaa

SEQ ID NO: 511695 - DNA, 25 bp, Rattus norvegicus
gtggcattacactattaccagttaa

SEQ ID NO: 511696 - DNA, 25 bp, Rattus norvegicus
gtggcattacatagggatcatttag

SEQ ID NO: 511697 - DNA, 25 bp, Rattus norvegicus
gtggcattacattgggatcatttag

SEQ ID NO: 511698 - DNA, 25 bp, Rattus norvegicus
gtggcattagcgatccacctgacag

SEQ ID NO: 511699 - DNA, 25 bp, Rattus norvegicus
gtggcattagcgttccacctgacag

SEQ ID NO: 511700 - DNA, 25 bp, Rattus norvegicus
gtggcattcaagctggtagtcgttt

SEQ ID NO: 511701 - DNA, 25 bp, Rattus norvegicus
gtggcattcaaggtggtagtcgttt

SEQ ID NO: 511702 - DNA, 25 bp, Rattus norvegicus
gtggcattcacactactaaacttga

SEQ ID NO: 511703 - DNA, 25 bp, Rattus norvegicus
gtggcattcacagtactaaacttga

SEQ ID NO: 511704 - DNA, 25 bp, Rattus norvegicus
gtggcattctccaaatgcttcctaa

SEQ ID NO: 511705 - DNA, 25 bp, Rattus norvegicus
gtggcattctcctaatgcttcctaa

SEQ ID NO: 511706 - DNA, 25 bp, Rattus norvegicus
gtggcattcttaagatttcctccaa

SEQ ID NO: 511707 - DNA, 25 bp, Rattus norvegicus
gtggcattcttatgatttcctccaa

SEQ ID NO: 511708 - DNA, 25 bp, Rattus norvegicus
gtggcattgagtcccagcctgtgta

SEQ ID NO: 511709 - DNA, 25 bp, Rattus norvegicus
gtggcattgagtgccagcctgtgta

SEQ ID NO: 511710 - DNA, 25 bp, Rattus norvegicus
gtggcattgcatatagcagctggaa

SEQ ID NO: 511711 - DNA, 25 bp, Rattus norvegicus
gtggcattgcatttagcagctggaa

SEQ ID NO: 511712 - DNA, 25 bp, Rattus norvegicus
gtggcattgctaaaagcttagccta

SEQ ID NO: 511713 - DNA, 25 bp, Rattus norvegicus
gtggcattgctataagcttagccta

SEQ ID NO: 511714 - DNA, 25 bp, Rattus norvegicus
gtggcattgtatacctgggcttaat

SEQ ID NO: 511715 - DNA, 25 bp, Rattus norvegicus
gtggcattgtattcctgggcttaat

SEQ ID NO: 511716 - DNA, 25 bp, Rattus norvegicus
gtggcatttatccttagtcttttat

SEQ ID NO: 511717 - DNA, 25 bp, Rattus norvegicus
gtggcatttatcgttagtcttttat

SEQ ID NO: 511718 - DNA, 25 bp, Rattus norvegicus
gtggcatttctaagtgcagcaaccc

SEQ ID NO: 511719 - DNA, 25 bp, Rattus norvegicus
gtggcatttctatgtgcagcaaccc

SEQ ID NO: 511720 - DNA, 25 bp, Rattus norvegicus
gtggcatttctgagctgtgacaaat

SEQ ID NO: 511721 - DNA, 25 bp, Rattus norvegicus
gtggcatttctgtgctgtgacaaat

SEQ ID NO: 511722 - DNA, 25 bp, Rattus norvegicus
gtggccaaaattccttccctagtac

SEQ ID NO: 511723 - DNA, 25 bp, Rattus norvegicus
gtggccaaaattgcttccctagtac

SEQ ID NO: 511724 - DNA, 25 bp, Rattus norvegicus
gtggccaaacgtcttttcaagaaat

SEQ ID NO: 511725 - DNA, 25 bp, Rattus norvegicus
gtggccaaacgtgttttcaagaaat

SEQ ID NO: 511726 - DNA, 25 bp, Rattus norvegicus
gtggccaaactcaacaccacaggag

SEQ ID NO: 511727 - DNA, 25 bp, Rattus norvegicus
gtggccaaactctacaccacaggag

SEQ ID NO: 511728 - DNA, 25 bp, Rattus norvegicus
gtggccaaaggactgcacccttatc

SEQ ID NO: 511729 - DNA, 25 bp, Rattus norvegicus
gtggccaaaggagtgcacccttatc

SEQ ID NO: 511730 - DNA, 25 bp, Rattus norvegicus
gtggccaagacacagccttaatgat

SEQ ID NO: 511731 - DNA, 25 bp, Rattus norvegicus
gtggccaagacagagccttaatgat

SEQ ID NO: 511732 - DNA, 25 bp, Rattus norvegicus
gtggccaagaggctcctttaatcaa

SEQ ID NO: 511733 - DNA, 25 bp, Rattus norvegicus
gtggccaagagggtcctttaatcaa

SEQ ID NO: 511734 - DNA, 25 bp, Rattus norvegicus
gtggccaagattctgtctgaccgca

SEQ ID NO: 511735 - DNA, 25 bp, Rattus norvegicus
gtggccaagattgtgtctgaccgca

SEQ ID NO: 511736 - DNA, 25 bp, Rattus norvegicus
gtggccaagcagcacctagctgcag

SEQ ID NO: 511737 - DNA, 25 bp, Rattus norvegicus
gtggccaagcaggacctagctgcag

SEQ ID NO: 511738 - DNA, 25 bp, Rattus norvegicus
gtggccaagcttaatattttcgtgt

SEQ ID NO: 511739 - DNA, 25 bp, Rattus norvegicus
gtggccaagcttcttaatagatctt

SEQ ID NO: 511740 - DNA, 25 bp, Rattus norvegicus
gtggccaagcttgttaatagatctt

SEQ ID NO: 511741 - DNA, 25 bp, Rattus norvegicus
gtggccaagctttatattttcgtgt

SEQ ID NO: 511742 - DNA, 25 bp, Rattus norvegicus
gtggccaaggcaattctaggcttac

SEQ ID NO: 511743 - DNA, 25 bp, Rattus norvegicus
gtggccaaggcatttctaggcttac

SEQ ID NO: 511744 - DNA, 25 bp, Rattus norvegicus
gtggccaagggcaagcaatgttctg

SEQ ID NO: 511745 - DNA, 25 bp, Rattus norvegicus
gtggccaagggctagcaatgttctg

SEQ ID NO: 511746 - DNA, 25 bp, Rattus norvegicus
gtggccaagttcatagtcgctgtgt

SEQ ID NO: 511747 - DNA, 25 bp, Rattus norvegicus
gtggccaagttcttagtcgctgtgt

SEQ ID NO: 511748 - DNA, 25 bp, Rattus norvegicus
gtggccacaaaccagtatcaaccat

SEQ ID NO: 511749 - DNA, 25 bp, Rattus norvegicus
gtggccacaaacgagtatcaaccat

SEQ ID NO: 511750 - DNA, 25 bp, Rattus norvegicus
gtggccacacacatatgactatgta

SEQ ID NO: 511751 - DNA, 25 bp, Rattus norvegicus
gtggccacacacttatgactatgta

SEQ ID NO: 511752 - DNA, 25 bp, Rattus norvegicus
gtggccacacagatacaagggatgc

SEQ ID NO: 511753 - DNA, 25 bp, Rattus norvegicus
gtggccacacagcatcagagagcat

SEQ ID NO: 511754 - DNA, 25 bp, Rattus norvegicus
gtggccacacaggatcagagagcat

SEQ ID NO: 511755 - DNA, 25 bp, Rattus norvegicus
gtggccacacagttacaagggatgc

SEQ ID NO: 511756 - DNA, 25 bp, Rattus norvegicus
gtggccacactgagtatgaatgagt

SEQ ID NO: 511757 - DNA, 25 bp, Rattus norvegicus
gtggccacactgtgtatgaatgagt

SEQ ID NO: 511758 - DNA, 25 bp, Rattus norvegicus
gtggccacagacaaactagaatcat

SEQ ID NO: 511759 - DNA, 25 bp, Rattus norvegicus
gtggccacagactaactagaatcat

SEQ ID NO: 511760 - DNA, 25 bp, Rattus norvegicus
gtggccacaggcacctttgaagata

SEQ ID NO: 511761 - DNA, 25 bp, Rattus norvegicus
gtggccacaggctcctttgaagata

SEQ ID NO: 511762 - DNA, 25 bp, Rattus norvegicus
gtggccacagggagttccagagcac

SEQ ID NO: 511763 - DNA, 25 bp, Rattus norvegicus
gtggccacagggtgttccagagcac

SEQ ID NO: 511764 - DNA, 25 bp, Rattus norvegicus
gtggccacatagacttgctcacaac

SEQ ID NO: 511765 - DNA, 25 bp, Rattus norvegicus
gtggccacatagtcttgctcacaac

SEQ ID NO: 511766 - DNA, 25 bp, Rattus norvegicus
gtggccacatgcaactgagtcggat

SEQ ID NO: 511767 - DNA, 25 bp, Rattus norvegicus
gtggccacatgctactgagtcggat

SEQ ID NO: 511768 - DNA, 25 bp, Rattus norvegicus
gtggccaccaacaaagatgaaaacc

SEQ ID NO: 511769 - DNA, 25 bp, Rattus norvegicus
gtggccaccaactaagatgaaaacc

SEQ ID NO: 511770 - DNA, 25 bp, Rattus norvegicus
gtggccaccagcagtagttcacggg

SEQ ID NO: 511771 - DNA, 25 bp, Rattus norvegicus
gtggccaccagctgtagttcacggg

SEQ ID NO: 511772 - DNA, 25 bp, Rattus norvegicus
gtggccacccaaaacagtgaggata

SEQ ID NO: 511773 - DNA, 25 bp, Rattus norvegicus
gtggccacccaatacagtgaggata

SEQ ID NO: 511774 - DNA, 25 bp, Rattus norvegicus
gtggccacccagatgttaaaaacca

SEQ ID NO: 511775 - DNA, 25 bp, Rattus norvegicus
gtggccacccagcaacaggttgatc

SEQ ID NO: 511776 - DNA, 25 bp, Rattus norvegicus
gtggccacccaggaacaggttgatc

SEQ ID NO: 511777 - DNA, 25 bp, Rattus norvegicus
gtggccacccagttgttaaaaacca

SEQ ID NO: 511778 - DNA, 25 bp, Rattus norvegicus
gtggccaccttacctcagcgagagg

SEQ ID NO: 511779 - DNA, 25 bp, Rattus norvegicus
gtggccaccttagctcagcgagagg

SEQ ID NO: 511780 - DNA, 25 bp, Rattus norvegicus
gtggccacctttaggttatcaatgt

SEQ ID NO: 511781 - DNA, 25 bp, Rattus norvegicus
gtggccaccttttggttatcaatgt

SEQ ID NO: 511782 - DNA, 25 bp, Rattus norvegicus
gtggccacgagtcctccatgaagaa

SEQ ID NO: 511783 - DNA, 25 bp, Rattus norvegicus
gtggccacgagtgctccatgaagaa

SEQ ID NO: 511784 - DNA, 25 bp, Rattus norvegicus
gtggccacggatcacataagtgcgt

SEQ ID NO: 511785 - DNA, 25 bp, Rattus norvegicus
gtggccacggatgacataagtgcgt

SEQ ID NO: 511786 - DNA, 25 bp, Rattus norvegicus
gtggccacgtggctttcattcagta

SEQ ID NO: 511787 - DNA, 25 bp, Rattus norvegicus
gtggccacgtgggtttcattcagta

SEQ ID NO: 511788 - DNA, 25 bp, Rattus norvegicus
gtggccagacctcacttggtgcaaa

SEQ ID NO: 511789 - DNA, 25 bp, Rattus norvegicus
gtggccagacctgacttggtgcaaa

SEQ ID NO: 511790 - DNA, 25 bp, Rattus norvegicus
gtggccagagaccagtttgcatcat

SEQ ID NO: 511791 - DNA, 25 bp, Rattus norvegicus
gtggccagagacgagtttgcatcat

SEQ ID NO: 511792 - DNA, 25 bp, Rattus norvegicus
gtggccagatgcactagccaatgaa

SEQ ID NO: 511793 - DNA, 25 bp, Rattus norvegicus
gtggccagatgctctagccaatgaa

SEQ ID NO: 511794 - DNA, 25 bp, Rattus norvegicus
gtggccagcccaaagtggtggtcaa

SEQ ID NO: 511795 - DNA, 25 bp, Rattus norvegicus
gtggccagcccatagtggtggtcaa

SEQ ID NO: 511796 - DNA, 25 bp, Rattus norvegicus
gtggccagccggcttaaaaaatctg

SEQ ID NO: 511797 - DNA, 25 bp, Rattus norvegicus
gtggccagccgggttaaaaaatctg

SEQ ID NO: 511798 - DNA, 25 bp, Rattus norvegicus
gtggccagcgctatttgttgctgcg

SEQ ID NO: 511799 - DNA, 25 bp, Rattus norvegicus
gtggccagcgctttttgttgctgcg

SEQ ID NO: 511800 - DNA, 25 bp, Rattus norvegicus
gtggccagctggactgcccatgatg

SEQ ID NO: 511801 - DNA, 25 bp, Rattus norvegicus
gtggccagctggtctgcccatgatg

SEQ ID NO: 511802 - DNA, 25 bp, Rattus norvegicus
gtggccaggctcagatctgatctgt

SEQ ID NO: 511803 - DNA, 25 bp, Rattus norvegicus
gtggccaggctctgatctgatctgt

SEQ ID NO: 511804 - DNA, 25 bp, Rattus norvegicus
gtggccagtatgaaccctaagtcag

SEQ ID NO: 511805 - DNA, 25 bp, Rattus norvegicus
gtggccagtatgtaccctaagtcag

SEQ ID NO: 511806 - DNA, 25 bp, Rattus norvegicus
gtggccagtattagtcccagcctgg

SEQ ID NO: 511807 - DNA, 25 bp, Rattus norvegicus
gtggccagtatttgtcccagcctgg

SEQ ID NO: 511808 - DNA, 25 bp, Rattus norvegicus
gtggccagtctgagcagagcagtat

SEQ ID NO: 511809 - DNA, 25 bp, Rattus norvegicus
gtggccagtctgtgcagagcagtat

SEQ ID NO: 511810 - DNA, 25 bp, Rattus norvegicus
gtggccagtgtgcaccatgtagcaa

SEQ ID NO: 511811 - DNA, 25 bp, Rattus norvegicus
gtggccagtgtggaccatgtagcaa

SEQ ID NO: 511812 - DNA, 25 bp, Rattus norvegicus
gtggccagtttcatccgacagcggg

SEQ ID NO: 511813 - DNA, 25 bp, Rattus norvegicus
gtggccagtttcttccgacagcggg

SEQ ID NO: 511814 - DNA, 25 bp, Rattus norvegicus
gtggccataaagcttgagctcattc

SEQ ID NO: 511815 - DNA, 25 bp, Rattus norvegicus
gtggccataaaggttgagctcattc

SEQ ID NO: 511816 - DNA, 25 bp, Rattus norvegicus
gtggccatacttaactcagttgctt

SEQ ID NO: 511817 - DNA, 25 bp, Rattus norvegicus
gtggccatacttcataggctattac

SEQ ID NO: 511818 - DNA, 25 bp, Rattus norvegicus
gtggccatacttgataggctattac

SEQ ID NO: 511819 - DNA, 25 bp, Rattus norvegicus
gtggccatactttactcagttgctt

SEQ ID NO: 511820 - DNA, 25 bp, Rattus norvegicus
gtggccatagcactaccagatttgg

SEQ ID NO: 511821 - DNA, 25 bp, Rattus norvegicus
gtggccatagcagtaccagatttgg

SEQ ID NO: 511822 - DNA, 25 bp, Rattus norvegicus
gtggccataggcctggagtcttcta

SEQ ID NO: 511823 - DNA, 25 bp, Rattus norvegicus
gtggccataggcgtggagtcttcta

SEQ ID NO: 511824 - DNA, 25 bp, Rattus norvegicus
gtggccatagttacagttccgcttt

SEQ ID NO: 511825 - DNA, 25 bp, Rattus norvegicus
gtggccatagtttcagttccgcttt

SEQ ID NO: 511826 - DNA, 25 bp, Rattus norvegicus
gtggccatatgcaacagtttgacaa

SEQ ID NO: 511827 - DNA, 25 bp, Rattus norvegicus
gtggccatatgctacagtttgacaa

SEQ ID NO: 511828 - DNA, 25 bp, Rattus norvegicus
gtggccatcactatgcacaggaagc

SEQ ID NO: 511829 - DNA, 25 bp, Rattus norvegicus
gtggccatcactttgcacaggaagc

SEQ ID NO: 511830 - DNA, 25 bp, Rattus norvegicus
gtggccatcatacgagcaaacagac

SEQ ID NO: 511831 - DNA, 25 bp, Rattus norvegicus
gtggccatcataggagcaaacagac

SEQ ID NO: 511832 - DNA, 25 bp, Rattus norvegicus
gtggccatccggactctgtagatgt

SEQ ID NO: 511833 - DNA, 25 bp, Rattus norvegicus
gtggccatccggtctctgtagatgt

SEQ ID NO: 511834 - DNA, 25 bp, Rattus norvegicus
gtggccatcgtaattattcagtgtc

SEQ ID NO: 511835 - DNA, 25 bp, Rattus norvegicus
gtggccatcgtatttattcagtgtc

SEQ ID NO: 511836 - DNA, 25 bp, Rattus norvegicus
gtggccatctgcaactgtgaattct

SEQ ID NO: 511837 - DNA, 25 bp, Rattus norvegicus
gtggccatctgctactgtgaattct

SEQ ID NO: 511838 - DNA, 25 bp, Rattus norvegicus
gtggccatcttcagcacatcatgaa

SEQ ID NO: 511839 - DNA, 25 bp, Rattus norvegicus
gtggccatcttctgcacatcatgaa

SEQ ID NO: 511840 - DNA, 25 bp, Rattus norvegicus
gtggccatgaagatccttcgggctt

SEQ ID NO: 511841 - DNA, 25 bp, Rattus norvegicus
gtggccatgaagttccttcgggctt

SEQ ID NO: 511842 - DNA, 25 bp, Rattus norvegicus
gtggccatgacaactcaatcttgta

SEQ ID NO: 511843 - DNA, 25 bp, Rattus norvegicus
gtggccatgacatctcaatcttgta

SEQ ID NO: 511844 - DNA, 25 bp, Rattus norvegicus
gtggccatgactatgaggaacttta

SEQ ID NO: 511845 - DNA, 25 bp, Rattus norvegicus
gtggccatgactttgaggaacttta

SEQ ID NO: 511846 - DNA, 25 bp, Rattus norvegicus
gtggccatggaacactgttacttca

SEQ ID NO: 511847 - DNA, 25 bp, Rattus norvegicus
gtggccatggaagactgttacttca

SEQ ID NO: 511848 - DNA, 25 bp, Rattus norvegicus
gtggccatggtgatttgtgatactt

SEQ ID NO: 511849 - DNA, 25 bp, Rattus norvegicus
gtggccatggtgttttgtgatactt

SEQ ID NO: 511850 - DNA, 25 bp, Rattus norvegicus
gtggccatgtacaggttgcctgtaa

SEQ ID NO: 511851 - DNA, 25 bp, Rattus norvegicus
gtggccatgtaccaaaccagctgta

SEQ ID NO: 511852 - DNA, 25 bp, Rattus norvegicus
gtggccatgtacgaaaccagctgta

SEQ ID NO: 511853 - DNA, 25 bp, Rattus norvegicus
gtggccatgtactggttgcctgtaa

SEQ ID NO: 511854 - DNA, 25 bp, Rattus norvegicus
gtggccatgtgtccacctagtgaga

SEQ ID NO: 511855 - DNA, 25 bp, Rattus norvegicus
gtggccatgtgtgcacctagtgaga

SEQ ID NO: 511856 - DNA, 25 bp, Rattus norvegicus
gtggccattaacaagattatcgatt

SEQ ID NO: 511857 - DNA, 25 bp, Rattus norvegicus
gtggccattaactagattatcgatt

SEQ ID NO: 511858 - DNA, 25 bp, Rattus norvegicus
gtggccattattcaaacagtttgta

SEQ ID NO: 511859 - DNA, 25 bp, Rattus norvegicus
gtggccattattgaaacagtttgta

SEQ ID NO: 511860 - DNA, 25 bp, Rattus norvegicus
gtggccattcagactcagttcagaa

SEQ ID NO: 511861 - DNA, 25 bp, Rattus norvegicus
gtggccattcagatcagtttcatgt

SEQ ID NO: 511862 - DNA, 25 bp, Rattus norvegicus
gtggccattcagtctcagttcagaa

SEQ ID NO: 511863 - DNA, 25 bp, Rattus norvegicus
gtggccattcagttcagtttcatgt

SEQ ID NO: 511864 - DNA, 25 bp, Rattus norvegicus
gtggccatttgtcggagtccaataa

SEQ ID NO: 511865 - DNA, 25 bp, Rattus norvegicus
gtggccatttgtgggagtccaataa

SEQ ID NO: 511866 - DNA, 25 bp, Rattus norvegicus
gtggcccaaaccacaggaagcttag

SEQ ID NO: 511867 - DNA, 25 bp, Rattus norvegicus
gtggcccaaacctcaggaagcttag

SEQ ID NO: 511868 - DNA, 25 bp, Rattus norvegicus
gtggcccaactcctcttataataag

SEQ ID NO: 511869 - DNA, 25 bp, Rattus norvegicus
gtggcccaactcgtcttataataag

SEQ ID NO: 511870 - DNA, 25 bp, Rattus norvegicus
gtggcccaactgctggaccattgat

SEQ ID NO: 511871 - DNA, 25 bp, Rattus norvegicus
gtggcccaactggtggaccattgat

SEQ ID NO: 511872 - DNA, 25 bp, Rattus norvegicus
gtggcccaagataacagttcagatt

SEQ ID NO: 511873 - DNA, 25 bp, Rattus norvegicus
gtggcccaagattacagttcagatt

SEQ ID NO: 511874 - DNA, 25 bp, Rattus norvegicus
gtggcccaagtcagctgtgtggttt

SEQ ID NO: 511875 - DNA, 25 bp, Rattus norvegicus
gtggcccaagtctgctgtgtggttt

SEQ ID NO: 511876 - DNA, 25 bp, Rattus norvegicus
gtggcccaatcaagaagagctactg

SEQ ID NO: 511877 - DNA, 25 bp, Rattus norvegicus
gtggcccaatcatgaagagctactg

SEQ ID NO: 511878 - DNA, 25 bp, Rattus norvegicus
gtggcccaattccattgggatggaa

SEQ ID NO: 511879 - DNA, 25 bp, Rattus norvegicus
gtggcccaattcgattgggatggaa

SEQ ID NO: 511880 - DNA, 25 bp, Rattus norvegicus
gtggcccacaaaagccatttctttg

SEQ ID NO: 511881 - DNA, 25 bp, Rattus norvegicus
gtggcccacaaatgccatttctttg

SEQ ID NO: 511882 - DNA, 25 bp, Rattus norvegicus
gtggcccaccggaagataagctgtc

SEQ ID NO: 511883 - DNA, 25 bp, Rattus norvegicus
gtggcccaccggtagataagctgtc

SEQ ID NO: 511884 - DNA, 25 bp, Rattus norvegicus
gtggcccagacaaagtcaccatcag

SEQ ID NO: 511885 - DNA, 25 bp, Rattus norvegicus
gtggcccagacatagtcaccatcag

SEQ ID NO: 511886 - DNA, 25 bp, Rattus norvegicus
gtggcccagagaacattgtggacat

SEQ ID NO: 511887 - DNA, 25 bp, Rattus norvegicus
gtggcccagagatcattgtggacat

SEQ ID NO: 511888 - DNA, 25 bp, Rattus norvegicus
gtggcccagcttctcatgattcaag

SEQ ID NO: 511889 - DNA, 25 bp, Rattus norvegicus
gtggcccagcttgtcatgattcaag

SEQ ID NO: 511890 - DNA, 25 bp, Rattus norvegicus
gtggcccaggacatcacaattgagc

SEQ ID NO: 511891 - DNA, 25 bp, Rattus norvegicus
gtggcccaggacttcacaattgagc

SEQ ID NO: 511892 - DNA, 25 bp, Rattus norvegicus
gtggcccaggatagcatccaatgca

SEQ ID NO: 511893 - DNA, 25 bp, Rattus norvegicus
gtggcccaggattgcatccaatgca

SEQ ID NO: 511894 - DNA, 25 bp, Rattus norvegicus
gtggcccagggcattgtcagttatc

SEQ ID NO: 511895 - DNA, 25 bp, Rattus norvegicus
gtggcccagggctttgtcagttatc

SEQ ID NO: 511896 - DNA, 25 bp, Rattus norvegicus
gtggcccataatatgtatttgctgc

SEQ ID NO: 511897 - DNA, 25 bp, Rattus norvegicus
gtggcccataatttgtatttgctgc

SEQ ID NO: 511898 - DNA, 25 bp, Rattus norvegicus
gtggcccatgttcaggtatttaaaa

SEQ ID NO: 511899 - DNA, 25 bp, Rattus norvegicus
gtggcccatgttgaggtatttaaaa

SEQ ID NO: 511900 - DNA, 25 bp, Rattus norvegicus
gtggcccattctaaattgctgctaa

SEQ ID NO: 511901 - DNA, 25 bp, Rattus norvegicus
gtggcccattcttaattgctgctaa

SEQ ID NO: 511902 - DNA, 25 bp, Rattus norvegicus
gtggccccaatcaggaaccttcgag

SEQ ID NO: 511903 - DNA, 25 bp, Rattus norvegicus
gtggccccaatctggaaccttcgag

SEQ ID NO: 511904 - DNA, 25 bp, Rattus norvegicus
gtggccccacaaaaaagttctctat

SEQ ID NO: 511905 - DNA, 25 bp, Rattus norvegicus
gtggccccacaataaagttctctat

SEQ ID NO: 511906 - DNA, 25 bp, Rattus norvegicus
gtggccccaccaaacgcaggactgg

SEQ ID NO: 511907 - DNA, 25 bp, Rattus norvegicus
gtggccccaccatacgcaggactgg

SEQ ID NO: 511908 - DNA, 25 bp, Rattus norvegicus
gtggccccacccagtaggtagagaa

SEQ ID NO: 511909 - DNA, 25 bp, Rattus norvegicus
gtggccccaccctgtaggtagagaa

SEQ ID NO: 511910 - DNA, 25 bp, Rattus norvegicus
gtggccccagcaatgtcaacggcaa

SEQ ID NO: 511911 - DNA, 25 bp, Rattus norvegicus
gtggccccagcactcaggagtttga

SEQ ID NO: 511912 - DNA, 25 bp, Rattus norvegicus
gtggccccagcagtcaggagtttga

SEQ ID NO: 511913 - DNA, 25 bp, Rattus norvegicus
gtggccccagcattgtcaacggcaa

SEQ ID NO: 511914 - DNA, 25 bp, Rattus norvegicus
gtggccccagtgagcgtatgtcttc

SEQ ID NO: 511915 - DNA, 25 bp, Rattus norvegicus
gtggccccagtgtgcgtatgtcttc

SEQ ID NO: 511916 - DNA, 25 bp, Rattus norvegicus
gtggccccatcaaggtcaaagccat

SEQ ID NO: 511917 - DNA, 25 bp, Rattus norvegicus
gtggccccatcatggtcaaagccat

SEQ ID NO: 511918 - DNA, 25 bp, Rattus norvegicus
gtggccccatccagtagctgaggaa

SEQ ID NO: 511919 - DNA, 25 bp, Rattus norvegicus
gtggccccatcctgtagctgaggaa

SEQ ID NO: 511920 - DNA, 25 bp, Rattus norvegicus
gtggccccattcatggaccgagaca

SEQ ID NO: 511921 - DNA, 25 bp, Rattus norvegicus
gtggccccattcttggaccgagaca

SEQ ID NO: 511922 - DNA, 25 bp, Rattus norvegicus
gtggcccctgacatcagtaaatgct

SEQ ID NO: 511923 - DNA, 25 bp, Rattus norvegicus
gtggcccctgacttcagtaaatgct

SEQ ID NO: 511924 - DNA, 25 bp, Rattus norvegicus
gtggcccctgctaatgagtagtgga

SEQ ID NO: 511925 - DNA, 25 bp, Rattus norvegicus
gtggcccctgcttatgagtagtgga

SEQ ID NO: 511926 - DNA, 25 bp, Rattus norvegicus
gtggcccctgttactagatttgtgg

SEQ ID NO: 511927 - DNA, 25 bp, Rattus norvegicus
gtggcccctgtttctagatttgtgg

SEQ ID NO: 511928 - DNA, 25 bp, Rattus norvegicus
gtggcccgatgtatattaatcccgt

SEQ ID NO: 511929 - DNA, 25 bp, Rattus norvegicus
gtggcccgatgtttattaatcccgt

SEQ ID NO: 511930 - DNA, 25 bp, Rattus norvegicus
gtggcccgcagcacagagaaatgta

SEQ ID NO: 511931 - DNA, 25 bp, Rattus norvegicus
gtggcccgcagctcagagaaatgta

SEQ ID NO: 511932 - DNA, 25 bp, Rattus norvegicus
gtggcccgcccacataagatttcag

SEQ ID NO: 511933 - DNA, 25 bp, Rattus norvegicus
gtggcccgcccagataagatttcag

SEQ ID NO: 511934 - DNA, 25 bp, Rattus norvegicus
gtggcccgcgcccaggaatccgagg

SEQ ID NO: 511935 - DNA, 25 bp, Rattus norvegicus
gtggcccgcgccgaggaatccgagg

SEQ ID NO: 511936 - DNA, 25 bp, Rattus norvegicus
gtggcccgctacaagttttacctgg

SEQ ID NO: 511937 - DNA, 25 bp, Rattus norvegicus
gtggcccgctactagttttacctgg

SEQ ID NO: 511938 - DNA, 25 bp, Rattus norvegicus
gtggcccggatgaccatcgacgatg

SEQ ID NO: 511939 - DNA, 25 bp, Rattus norvegicus
gtggcccggatgtccatcgacgatg

SEQ ID NO: 511940 - DNA, 25 bp, Rattus norvegicus
gtggcccgggtcaacgagacagtgg

SEQ ID NO: 511941 - DNA, 25 bp, Rattus norvegicus
gtggcccgggtctacgagacagtgg

SEQ ID NO: 511942 - DNA, 25 bp, Rattus norvegicus
gtggcccgggttatgttgcatacca

SEQ ID NO: 511943 - DNA, 25 bp, Rattus norvegicus
gtggcccgggttttgttgcatacca

SEQ ID NO: 511944 - DNA, 25 bp, Rattus norvegicus
gtggccctaaaaatcttgtggagca

SEQ ID NO: 511945 - DNA, 25 bp, Rattus norvegicus
gtggccctaaaattcttgtggagca

SEQ ID NO: 511946 - DNA, 25 bp, Rattus norvegicus
gtggccctaaataacagtgtcatca

SEQ ID NO: 511947 - DNA, 25 bp, Rattus norvegicus
gtggccctaaattacagtgtcatca

SEQ ID NO: 511948 - DNA, 25 bp, Rattus norvegicus
gtggccctaatgcactgagctgtta

SEQ ID NO: 511949 - DNA, 25 bp, Rattus norvegicus
gtggccctaatggactgagctgtta

SEQ ID NO: 511950 - DNA, 25 bp, Rattus norvegicus
gtggccctcacaacaaagggcaggt

SEQ ID NO: 511951 - DNA, 25 bp, Rattus norvegicus
gtggccctcacacgctgagtgctca

SEQ ID NO: 511952 - DNA, 25 bp, Rattus norvegicus
gtggccctcacaggctgagtgctca

SEQ ID NO: 511953 - DNA, 25 bp, Rattus norvegicus
gtggccctcacatcaaagggcaggt

SEQ ID NO: 511954 - DNA, 25 bp, Rattus norvegicus
gtggccctcagcatacagaagaata

SEQ ID NO: 511955 - DNA, 25 bp, Rattus norvegicus
gtggccctcagcttacagaagaata

SEQ ID NO: 511956 - DNA, 25 bp, Rattus norvegicus
gtggccctcagtattatgactcttg

SEQ ID NO: 511957 - DNA, 25 bp, Rattus norvegicus
gtggccctcagttttatgactcttg

SEQ ID NO: 511958 - DNA, 25 bp, Rattus norvegicus
gtggccctcatcaagagtgcagctg

SEQ ID NO: 511959 - DNA, 25 bp, Rattus norvegicus
gtggccctcatctagagtgcagctg

SEQ ID NO: 511960 - DNA, 25 bp, Rattus norvegicus
gtggccctctgactgtttatttaag

SEQ ID NO: 511961 - DNA, 25 bp, Rattus norvegicus
gtggccctctgagtgtttatttaag

SEQ ID NO: 511962 - DNA, 25 bp, Rattus norvegicus
gtggccctctttctaacggtagttg

SEQ ID NO: 511963 - DNA, 25 bp, Rattus norvegicus
gtggccctctttgtaacggtagttg

SEQ ID NO: 511964 - DNA, 25 bp, Rattus norvegicus
gtggccctgatcactgaattacatt

SEQ ID NO: 511965 - DNA, 25 bp, Rattus norvegicus
gtggccctgatctctgaattacatt

SEQ ID NO: 511966 - DNA, 25 bp, Rattus norvegicus
gtggccctgccaaaagtgtcattgt

SEQ ID NO: 511967 - DNA, 25 bp, Rattus norvegicus
gtggccctgccataagtgtcattgt

SEQ ID NO: 511968 - DNA, 25 bp, Rattus norvegicus
gtggccctgctccagagatggacaa

SEQ ID NO: 511969 - DNA, 25 bp, Rattus norvegicus
gtggccctgctcgagagatggacaa

SEQ ID NO: 511970 - DNA, 25 bp, Rattus norvegicus
gtggccctggccattgcagagatgc

SEQ ID NO: 511971 - DNA, 25 bp, Rattus norvegicus
gtggccctggcctttgcagagatgc

SEQ ID NO: 511972 - DNA, 25 bp, Rattus norvegicus
gtggccctggctatgtcatcagtga

SEQ ID NO: 511973 - DNA, 25 bp, Rattus norvegicus
gtggccctggctttgtcatcagtga

SEQ ID NO: 511974 - DNA, 25 bp, Rattus norvegicus
gtggccctgtaaaattttacctatc

SEQ ID NO: 511975 - DNA, 25 bp, Rattus norvegicus
gtggccctgtaatattttacctatc

SEQ ID NO: 511976 - DNA, 25 bp, Rattus norvegicus
gtggccctgttaaacaagattgtga

SEQ ID NO: 511977 - DNA, 25 bp, Rattus norvegicus
gtggccctgttatacaagattgtga

SEQ ID NO: 511978 - DNA, 25 bp, Rattus norvegicus
gtggcccttattatccaacaatctg

SEQ ID NO: 511979 - DNA, 25 bp, Rattus norvegicus
gtggcccttattttccaacaatctg

SEQ ID NO: 511980 - DNA, 25 bp, Rattus norvegicus
gtggcccttctacccgagcagaaat

SEQ ID NO: 511981 - DNA, 25 bp, Rattus norvegicus
gtggcccttctagccgagcagaaat

SEQ ID NO: 511982 - DNA, 25 bp, Rattus norvegicus
gtggcccttgaaaaaatccaagact

SEQ ID NO: 511983 - DNA, 25 bp, Rattus norvegicus
gtggcccttgaataaatccaagact

SEQ ID NO: 511984 - DNA, 25 bp, Rattus norvegicus
gtggcccttgacagactgttgtgag

SEQ ID NO: 511985 - DNA, 25 bp, Rattus norvegicus
gtggcccttgactgactgttgtgag

SEQ ID NO: 511986 - DNA, 25 bp, Rattus norvegicus
gtggcccttgctatggagttttcaa

SEQ ID NO: 511987 - DNA, 25 bp, Rattus norvegicus
gtggcccttgctttggagttttcaa

SEQ ID NO: 511988 - DNA, 25 bp, Rattus norvegicus
gtggcccttggaaactgagagtctc

SEQ ID NO: 511989 - DNA, 25 bp, Rattus norvegicus
gtggcccttggatactgagagtctc

SEQ ID NO: 511990 - DNA, 25 bp, Rattus norvegicus
gtggcccttgggatgacgtcacagt

SEQ ID NO: 511991 - DNA, 25 bp, Rattus norvegicus
gtggcccttgggttgacgtcacagt

SEQ ID NO: 511992 - DNA, 25 bp, Rattus norvegicus
gtggccctttgtaacttcatttagt

SEQ ID NO: 511993 - DNA, 25 bp, Rattus norvegicus
gtggccctttgttacttcatttagt

SEQ ID NO: 511994 - DNA, 25 bp, Rattus norvegicus
gtggccgaacagacgggtgcttcct

SEQ ID NO: 511995 - DNA, 25 bp, Rattus norvegicus
gtggccgaacagtcgggtgcttcct

SEQ ID NO: 511996 - DNA, 25 bp, Rattus norvegicus
gtggccgaagctactggtctttctc

SEQ ID NO: 511997 - DNA, 25 bp, Rattus norvegicus
gtggccgaagcttctggtctttctc

SEQ ID NO: 511998 - DNA, 25 bp, Rattus norvegicus
gtggccgacatgcttcatgaacagc

SEQ ID NO: 511999 - DNA, 25 bp, Rattus norvegicus
gtggccgacatggttcatgaacagc

SEQ ID NO: 512000 - DNA, 25 bp, Rattus norvegicus
gtggccgagcccaagtatgatccta

SEQ ID NO: 512001 - DNA, 25 bp, Rattus norvegicus
gtggccgagccctagtatgatccta

SEQ ID NO: 512002 - DNA, 25 bp, Rattus norvegicus
gtggccgcaaacctggcatctgctg

SEQ ID NO: 512003 - DNA, 25 bp, Rattus norvegicus
gtggccgcaaacgtggcatctgctg

SEQ ID NO: 512004 - DNA, 25 bp, Rattus norvegicus
gtggccgcaagcagcctgagtgtca

SEQ ID NO: 512005 - DNA, 25 bp, Rattus norvegicus
gtggccgcaagctgcctgagtgtca

SEQ ID NO: 512006 - DNA, 25 bp, Rattus norvegicus
gtggccgcaccgatggtctgcaaag

SEQ ID NO: 512007 - DNA, 25 bp, Rattus norvegicus
gtggccgcaccgttggtctgcaaag

SEQ ID NO: 512008 - DNA, 25 bp, Rattus norvegicus
gtggccgcaggcaaattcaaactcc

SEQ ID NO: 512009 - DNA, 25 bp, Rattus norvegicus
gtggccgcaggctaattcaaactcc

SEQ ID NO: 512010 - DNA, 25 bp, Rattus norvegicus
gtggccgcatctacagactgtgctg

SEQ ID NO: 512011 - DNA, 25 bp, Rattus norvegicus
gtggccgcatcttcagactgtgctg

SEQ ID NO: 512012 - DNA, 25 bp, Rattus norvegicus
gtggccgccataattgacaagtttg

SEQ ID NO: 512013 - DNA, 25 bp, Rattus norvegicus
gtggccgccatatttgacaagtttg

SEQ ID NO: 512014 - DNA, 25 bp, Rattus norvegicus
gtggccgcgggacgcagcgagctgc

SEQ ID NO: 512015 - DNA, 25 bp, Rattus norvegicus
gtggccgcgggaggcagcgagctgc

SEQ ID NO: 512016 - DNA, 25 bp, Rattus norvegicus
gtggccggacaaagaaccttctaca

SEQ ID NO: 512017 - DNA, 25 bp, Rattus norvegicus
gtggccggacaatgaaccttctaca

SEQ ID NO: 512018 - DNA, 25 bp, Rattus norvegicus
gtggccggatccaagttcctgagga

SEQ ID NO: 512019 - DNA, 25 bp, Rattus norvegicus
gtggccggatcctagttcctgagga

SEQ ID NO: 512020 - DNA, 25 bp, Rattus norvegicus
gtggccggcgatcctaatagtaacc

SEQ ID NO: 512021 - DNA, 25 bp, Rattus norvegicus
gtggccggcgatgctaatagtaacc

SEQ ID NO: 512022 - DNA, 25 bp, Rattus norvegicus
gtggccgggcacatacgtctgcagt

SEQ ID NO: 512023 - DNA, 25 bp, Rattus norvegicus
gtggccgggcacttacgtctgcagt

SEQ ID NO: 512024 - DNA, 25 bp, Rattus norvegicus
gtggccgtagccatatcgagtctgg

SEQ ID NO: 512025 - DNA, 25 bp, Rattus norvegicus
gtggccgtagccttatcgagtctgg

SEQ ID NO: 512026 - DNA, 25 bp, Rattus norvegicus
gtggccgtgccaattaaacaggttt

SEQ ID NO: 512027 - DNA, 25 bp, Rattus norvegicus
gtggccgtgccatttaaacaggttt

SEQ ID NO: 512028 - DNA, 25 bp, Rattus norvegicus
gtggccgtgcggaaatttcattaaa

SEQ ID NO: 512029 - DNA, 25 bp, Rattus norvegicus
gtggccgtgcggtaatttcattaaa

SEQ ID NO: 512030 - DNA, 25 bp, Rattus norvegicus
gtggccgtggatactaaccctctga

SEQ ID NO: 512031 - DNA, 25 bp, Rattus norvegicus
gtggccgtggatataactgacttgg

SEQ ID NO: 512032 - DNA, 25 bp, Rattus norvegicus
gtggccgtggattctaaccctctga

SEQ ID NO: 512033 - DNA, 25 bp, Rattus norvegicus
gtggccgtggatttaactgacttgg

SEQ ID NO: 512034 - DNA, 25 bp, Rattus norvegicus
gtggcctaaagaagtcttttgtaat

SEQ ID NO: 512035 - DNA, 25 bp, Rattus norvegicus
gtggcctaaagatgtcttttgtaat

SEQ ID NO: 512036 - DNA, 25 bp, Rattus norvegicus
gtggcctaaatgaggcttcagcagg

SEQ ID NO: 512037 - DNA, 25 bp, Rattus norvegicus
gtggcctaaatgtggcttcagcagg

SEQ ID NO: 512038 - DNA, 25 bp, Rattus norvegicus
gtggcctaagcccaagattctggca

SEQ ID NO: 512039 - DNA, 25 bp, Rattus norvegicus
gtggcctaagccgaagattctggca

SEQ ID NO: 512040 - DNA, 25 bp, Rattus norvegicus
gtggcctaaggcacagtgtaagctt

SEQ ID NO: 512041 - DNA, 25 bp, Rattus norvegicus
gtggcctaaggctcagtgtaagctt

SEQ ID NO: 512042 - DNA, 25 bp, Rattus norvegicus
gtggcctacaaaacacctgtcagtg

SEQ ID NO: 512043 - DNA, 25 bp, Rattus norvegicus
gtggcctacaaatcacctgtcagtg

SEQ ID NO: 512044 - DNA, 25 bp, Rattus norvegicus
gtggcctacagcactggagccaagg

SEQ ID NO: 512045 - DNA, 25 bp, Rattus norvegicus
gtggcctacagctctggagccaagg

SEQ ID NO: 512046 - DNA, 25 bp, Rattus norvegicus
gtggcctacgcccttaagttaggct

SEQ ID NO: 512047 - DNA, 25 bp, Rattus norvegicus
gtggcctacgccgttaagttaggct

SEQ ID NO: 512048 - DNA, 25 bp, Rattus norvegicus
gtggcctactggactcaaggagcct

SEQ ID NO: 512049 - DNA, 25 bp, Rattus norvegicus
gtggcctactggtctcaaggagcct

SEQ ID NO: 512050 - DNA, 25 bp, Rattus norvegicus
gtggcctacttaaacttagcaccat

SEQ ID NO: 512051 - DNA, 25 bp, Rattus norvegicus
gtggcctacttatacttagcaccat

SEQ ID NO: 512052 - DNA, 25 bp, Rattus norvegicus
gtggcctactttagcctgtattaca

SEQ ID NO: 512053 - DNA, 25 bp, Rattus norvegicus
gtggcctacttttgcctgtattaca

SEQ ID NO: 512054 - DNA, 25 bp, Rattus norvegicus
gtggcctagaagacactgcttcctt

SEQ ID NO: 512055 - DNA, 25 bp, Rattus norvegicus
gtggcctagaagtcactgcttcctt

SEQ ID NO: 512056 - DNA, 25 bp, Rattus norvegicus
gtggcctagagaatcacatctgact

SEQ ID NO: 512057 - DNA, 25 bp, Rattus norvegicus
gtggcctagagattcacatctgact

SEQ ID NO: 512058 - DNA, 25 bp, Rattus norvegicus
gtggcctagcagatatatctcatat

SEQ ID NO: 512059 - DNA, 25 bp, Rattus norvegicus
gtggcctagcagttatatctcatat

SEQ ID NO: 512060 - DNA, 25 bp, Rattus norvegicus
gtggcctatgggaaccagggcagca

SEQ ID NO: 512061 - DNA, 25 bp, Rattus norvegicus
gtggcctatgggtaccagggcagca

SEQ ID NO: 512062 - DNA, 25 bp, Rattus norvegicus
gtggcctcaaccatttccggcaaat

SEQ ID NO: 512063 - DNA, 25 bp, Rattus norvegicus
gtggcctcaaccttttccggcaaat

SEQ ID NO: 512064 - DNA, 25 bp, Rattus norvegicus
gtggcctcacaaagcacatgacgat

SEQ ID NO: 512065 - DNA, 25 bp, Rattus norvegicus
gtggcctcacaatgcacatgacgat

SEQ ID NO: 512066 - DNA, 25 bp, Rattus norvegicus
gtggcctcacccatgttgtggctga

SEQ ID NO: 512067 - DNA, 25 bp, Rattus norvegicus
gtggcctcacccttgttgtggctga

SEQ ID NO: 512068 - DNA, 25 bp, Rattus norvegicus
gtggcctcactgaacggtgtgcagt

SEQ ID NO: 512069 - DNA, 25 bp, Rattus norvegicus
gtggcctcactgtacggtgtgcagt

SEQ ID NO: 512070 - DNA, 25 bp, Rattus norvegicus
gtggcctcagcgctccggttttctc

SEQ ID NO: 512071 - DNA, 25 bp, Rattus norvegicus
gtggcctcagcggtccggttttctc

SEQ ID NO: 512072 - DNA, 25 bp, Rattus norvegicus
gtggcctcaggaatgattgcaatta

SEQ ID NO: 512073 - DNA, 25 bp, Rattus norvegicus
gtggcctcaggattgattgcaatta

SEQ ID NO: 512074 - DNA, 25 bp, Rattus norvegicus
gtggcctccagaagggcttttcaag

SEQ ID NO: 512075 - DNA, 25 bp, Rattus norvegicus
gtggcctccagatgggcttttcaag

SEQ ID NO: 512076 - DNA, 25 bp, Rattus norvegicus
gtggcctccagcagtgatggtccat

SEQ ID NO: 512077 - DNA, 25 bp, Rattus norvegicus
gtggcctccagctgtgatggtccat

SEQ ID NO: 512078 - DNA, 25 bp, Rattus norvegicus
gtggcctccccactggatgtggtaa

SEQ ID NO: 512079 - DNA, 25 bp, Rattus norvegicus
gtggcctccccagtggatgtggtaa

SEQ ID NO: 512080 - DNA, 25 bp, Rattus norvegicus
gtggcctcctgacgcacagataata

SEQ ID NO: 512081 - DNA, 25 bp, Rattus norvegicus
gtggcctcctgaggcacagataata

SEQ ID NO: 512082 - DNA, 25 bp, Rattus norvegicus
gtggcctcctgcagataaagtgtcc

SEQ ID NO: 512083 - DNA, 25 bp, Rattus norvegicus
gtggcctcctgctgataaagtgtcc

SEQ ID NO: 512084 - DNA, 25 bp, Rattus norvegicus
gtggcctccttgcaaactgagatgt

SEQ ID NO: 512085 - DNA, 25 bp, Rattus norvegicus
gtggcctccttggaaactgagatgt

SEQ ID NO: 512086 - DNA, 25 bp, Rattus norvegicus
gtggcctctagcactccaaaactta

SEQ ID NO: 512087 - DNA, 25 bp, Rattus norvegicus
gtggcctctagctctccaaaactta

SEQ ID NO: 512088 - DNA, 25 bp, Rattus norvegicus
gtggcctctatgatctttttcattg

SEQ ID NO: 512089 - DNA, 25 bp, Rattus norvegicus
gtggcctctatgttctttttcattg

SEQ ID NO: 512090 - DNA, 25 bp, Rattus norvegicus
gtggcctctcaaaattccatcatat

SEQ ID NO: 512091 - DNA, 25 bp, Rattus norvegicus
gtggcctctcaatattccatcatat

SEQ ID NO: 512092 - DNA, 25 bp, Rattus norvegicus
gtggcctctcagaggattctttttc

SEQ ID NO: 512093 - DNA, 25 bp, Rattus norvegicus
gtggcctctcagtggattctttttc

SEQ ID NO: 512094 - DNA, 25 bp, Rattus norvegicus
gtggcctctccaagataaactcatt

SEQ ID NO: 512095 - DNA, 25 bp, Rattus norvegicus
gtggcctctccatgataaactcatt

SEQ ID NO: 512096 - DNA, 25 bp, Rattus norvegicus
gtggcctctcctcagtattatttaa

SEQ ID NO: 512097 - DNA, 25 bp, Rattus norvegicus
gtggcctctcctgagtattatttaa

SEQ ID NO: 512098 - DNA, 25 bp, Rattus norvegicus
gtggcctctgaactggtacgcacca

SEQ ID NO: 512099 - DNA, 25 bp, Rattus norvegicus
gtggcctctgaagtggtacgcacca

SEQ ID NO: 512100 - DNA, 25 bp, Rattus norvegicus
gtggcctctgagactgtgaagaatc

SEQ ID NO: 512101 - DNA, 25 bp, Rattus norvegicus
gtggcctctgagtctgtgaagaatc

SEQ ID NO: 512102 - DNA, 25 bp, Rattus norvegicus
gtggcctctgctcttaagtgcacaa

SEQ ID NO: 512103 - DNA, 25 bp, Rattus norvegicus
gtggcctctgctgttaagtgcacaa

SEQ ID NO: 512104 - DNA, 25 bp, Rattus norvegicus
gtggcctctgttctgactctggtga

SEQ ID NO: 512105 - DNA, 25 bp, Rattus norvegicus
gtggcctctgttgtgactctggtga

SEQ ID NO: 512106 - DNA, 25 bp, Rattus norvegicus
gtggcctctttgaaccggaagcaga

SEQ ID NO: 512107 - DNA, 25 bp, Rattus norvegicus
gtggcctctttgtaccggaagcaga

SEQ ID NO: 512108 - DNA, 25 bp, Rattus norvegicus
gtggcctgactcacataaaggtgtt

SEQ ID NO: 512109 - DNA, 25 bp, Rattus norvegicus
gtggcctgactctcataaaggtgtt

SEQ ID NO: 512110 - DNA, 25 bp, Rattus norvegicus
gtggcctgagatctcacagcacaat

SEQ ID NO: 512111 - DNA, 25 bp, Rattus norvegicus
gtggcctgagatgtcacagcacaat

SEQ ID NO: 512112 - DNA, 25 bp, Rattus norvegicus
gtggcctgagttcactgccaacaaa

SEQ ID NO: 512113 - DNA, 25 bp, Rattus norvegicus
gtggcctgagttgactgccaacaaa

SEQ ID NO: 512114 - DNA, 25 bp, Rattus norvegicus
gtggcctgattgacaatgtcatata

SEQ ID NO: 512115 - DNA, 25 bp, Rattus norvegicus
gtggcctgattgtcaatgtcatata

SEQ ID NO: 512116 - DNA, 25 bp, Rattus norvegicus
gtggcctgcacccacacaggagaga

SEQ ID NO: 512117 - DNA, 25 bp, Rattus norvegicus
gtggcctgcaccgacacaggagaga

SEQ ID NO: 512118 - DNA, 25 bp, Rattus norvegicus
gtggcctgcattatgagagtctggt

SEQ ID NO: 512119 - DNA, 25 bp, Rattus norvegicus
gtggcctgcattttgagagtctggt

SEQ ID NO: 512120 - DNA, 25 bp, Rattus norvegicus
gtggcctgcctcaatgtatatttat

SEQ ID NO: 512121 - DNA, 25 bp, Rattus norvegicus
gtggcctgcctctatgtatatttat

SEQ ID NO: 512122 - DNA, 25 bp, Rattus norvegicus
gtggcctgcgttcctaaccagcaga

SEQ ID NO: 512123 - DNA, 25 bp, Rattus norvegicus
gtggcctgcgttgctaaccagcaga

SEQ ID NO: 512124 - DNA, 25 bp, Rattus norvegicus
gtggcctgctggactgctggaacca

SEQ ID NO: 512125 - DNA, 25 bp, Rattus norvegicus
gtggcctgctggtctgctggaacca

SEQ ID NO: 512126 - DNA, 25 bp, Rattus norvegicus
gtggcctggacaagggactctgccc

SEQ ID NO: 512127 - DNA, 25 bp, Rattus norvegicus
gtggcctggacatgggactctgccc

SEQ ID NO: 512128 - DNA, 25 bp, Rattus norvegicus
gtggcctggagtatagctcactata

SEQ ID NO: 512129 - DNA, 25 bp, Rattus norvegicus
gtggcctggagtttagctcactata

SEQ ID NO: 512130 - DNA, 25 bp, Rattus norvegicus
gtggcctggctcatgaagagtcttt

SEQ ID NO: 512131 - DNA, 25 bp, Rattus norvegicus
gtggcctggctcttgaagagtcttt

SEQ ID NO: 512132 - DNA, 25 bp, Rattus norvegicus
gtggcctgggctattgttaattgcc

SEQ ID NO: 512133 - DNA, 25 bp, Rattus norvegicus
gtggcctgggcttttgttaattgcc

SEQ ID NO: 512134 - DNA, 25 bp, Rattus norvegicus
gtggcctgtattatgcttatgcatt

SEQ ID NO: 512135 - DNA, 25 bp, Rattus norvegicus
gtggcctgtattcgtgcctggcacc

SEQ ID NO: 512136 - DNA, 25 bp, Rattus norvegicus
gtggcctgtattggtgcctggcacc

SEQ ID NO: 512137 - DNA, 25 bp, Rattus norvegicus
gtggcctgtattttgcttatgcatt

SEQ ID NO: 512138 - DNA, 25 bp, Rattus norvegicus
gtggcctgtggaaccaggacagccc

SEQ ID NO: 512139 - DNA, 25 bp, Rattus norvegicus
gtggcctgtggatccaggacagccc

SEQ ID NO: 512140 - DNA, 25 bp, Rattus norvegicus
gtggcctgttcacagacatctagca

SEQ ID NO: 512141 - DNA, 25 bp, Rattus norvegicus
gtggcctgttcagagacatctagca

SEQ ID NO: 512142 - DNA, 25 bp, Rattus norvegicus
gtggcctgtttaaaagttgtactaa

SEQ ID NO: 512143 - DNA, 25 bp, Rattus norvegicus
gtggcctgtttataagttgtactaa

SEQ ID NO: 512144 - DNA, 25 bp, Rattus norvegicus
gtggcctgtttgacacaagcgatga

SEQ ID NO: 512145 - DNA, 25 bp, Rattus norvegicus
gtggcctgtttgtcacaagcgatga

SEQ ID NO: 512146 - DNA, 25 bp, Rattus norvegicus
gtggccttagcaactgggcagttcc

SEQ ID NO: 512147 - DNA, 25 bp, Rattus norvegicus
gtggccttagcatctgggcagttcc

SEQ ID NO: 512148 - DNA, 25 bp, Rattus norvegicus
gtggccttagtcatagattgtagga

SEQ ID NO: 512149 - DNA, 25 bp, Rattus norvegicus
gtggccttagtcttagattgtagga

SEQ ID NO: 512150 - DNA, 25 bp, Rattus norvegicus
gtggccttcaacactcagacttaga

SEQ ID NO: 512151 - DNA, 25 bp, Rattus norvegicus
gtggccttcaacaggattatcgtgc

SEQ ID NO: 512152 - DNA, 25 bp, Rattus norvegicus
gtggccttcaactctcagacttaga

SEQ ID NO: 512153 - DNA, 25 bp, Rattus norvegicus
gtggccttcaactggattatcgtgc

SEQ ID NO: 512154 - DNA, 25 bp, Rattus norvegicus
gtggccttcaagcttcgaatcaaca

SEQ ID NO: 512155 - DNA, 25 bp, Rattus norvegicus
gtggccttcaaggttcgaatcaaca

SEQ ID NO: 512156 - DNA, 25 bp, Rattus norvegicus
gtggccttcagcatcgtatacatcc

SEQ ID NO: 512157 - DNA, 25 bp, Rattus norvegicus
gtggccttcagcttcgtatacatcc

SEQ ID NO: 512158 - DNA, 25 bp, Rattus norvegicus
gtggccttcattcaaactgatgaga

SEQ ID NO: 512159 - DNA, 25 bp, Rattus norvegicus
gtggccttcattgaaactgatgaga

SEQ ID NO: 512160 - DNA, 25 bp, Rattus norvegicus
gtggccttccacaaactgaagctaa

SEQ ID NO: 512161 - DNA, 25 bp, Rattus norvegicus
gtggccttccactaactgaagctaa

SEQ ID NO: 512162 - DNA, 25 bp, Rattus norvegicus
gtggccttccatattaaacccagaa

SEQ ID NO: 512163 - DNA, 25 bp, Rattus norvegicus
gtggccttccattttaaacccagaa

SEQ ID NO: 512164 - DNA, 25 bp, Rattus norvegicus
gtggccttcccactgttagtcattc

SEQ ID NO: 512165 - DNA, 25 bp, Rattus norvegicus
gtggccttcccagtgttagtcattc

SEQ ID NO: 512166 - DNA, 25 bp, Rattus norvegicus
gtggccttccggcagatacacaagg

SEQ ID NO: 512167 - DNA, 25 bp, Rattus norvegicus
gtggccttccgggagatacacaagg

SEQ ID NO: 512168 - DNA, 25 bp, Rattus norvegicus
gtggccttcctgaaattgcttctat

SEQ ID NO: 512169 - DNA, 25 bp, Rattus norvegicus
gtggccttcctgtaattgcttctat

SEQ ID NO: 512170 - DNA, 25 bp, Rattus norvegicus
gtggccttcgcgaatctgcaggagt

SEQ ID NO: 512171 - DNA, 25 bp, Rattus norvegicus
gtggccttcgcgtatctgcaggagt

SEQ ID NO: 512172 - DNA, 25 bp, Rattus norvegicus
gtggccttctcactagatctttaga

SEQ ID NO: 512173 - DNA, 25 bp, Rattus norvegicus
gtggccttctcagtagatctttaga

SEQ ID NO: 512174 - DNA, 25 bp, Rattus norvegicus
gtggccttctgcagtgtctcgacaa

SEQ ID NO: 512175 - DNA, 25 bp, Rattus norvegicus
gtggccttctgcatgaaaaccatgg

SEQ ID NO: 512176 - DNA, 25 bp, Rattus norvegicus
gtggccttctgctgtgtctcgacaa

SEQ ID NO: 512177 - DNA, 25 bp, Rattus norvegicus
gtggccttctgcttgaaaaccatgg

SEQ ID NO: 512178 - DNA, 25 bp, Rattus norvegicus
gtggccttgaacacaactgctttag

SEQ ID NO: 512179 - DNA, 25 bp, Rattus norvegicus
gtggccttgaactcaactgctttag

SEQ ID NO: 512180 - DNA, 25 bp, Rattus norvegicus
gtggccttgactctgtcctctgaaa

SEQ ID NO: 512181 - DNA, 25 bp, Rattus norvegicus
gtggccttgactgtgtcctctgaaa

SEQ ID NO: 512182 - DNA, 25 bp, Rattus norvegicus
gtggccttgctaatcgtcatttcta

SEQ ID NO: 512183 - DNA, 25 bp, Rattus norvegicus
gtggccttgctattcgtcatttcta

SEQ ID NO: 512184 - DNA, 25 bp, Rattus norvegicus
gtggccttgcttacacgaggtttgc

SEQ ID NO: 512185 - DNA, 25 bp, Rattus norvegicus
gtggccttgctttcacgaggtttgc

SEQ ID NO: 512186 - DNA, 25 bp, Rattus norvegicus
gtggccttgggcagattcctttaaa

SEQ ID NO: 512187 - DNA, 25 bp, Rattus norvegicus
gtggccttgggctgattcctttaaa

SEQ ID NO: 512188 - DNA, 25 bp, Rattus norvegicus
gtggccttgtgcacaccccagaaaa

SEQ ID NO: 512189 - DNA, 25 bp, Rattus norvegicus
gtggccttgtgctcaccccagaaaa

SEQ ID NO: 512190 - DNA, 25 bp, Rattus norvegicus
gtggccttgttcaagtgacttgtga

SEQ ID NO: 512191 - DNA, 25 bp, Rattus norvegicus
gtggccttgttcaggtcacaggctg

SEQ ID NO: 512192 - DNA, 25 bp, Rattus norvegicus
gtggccttgttctagtgacttgtga

SEQ ID NO: 512193 - DNA, 25 bp, Rattus norvegicus
gtggccttgttctggtcacaggctg

SEQ ID NO: 512194 - DNA, 25 bp, Rattus norvegicus
gtggcctttacacctgggacatgtc

SEQ ID NO: 512195 - DNA, 25 bp, Rattus norvegicus
gtggcctttacagctgggacatgtc

SEQ ID NO: 512196 - DNA, 25 bp, Rattus norvegicus
gtggcctttaccaccatagacaggg

SEQ ID NO: 512197 - DNA, 25 bp, Rattus norvegicus
gtggcctttacctccatagacaggg

SEQ ID NO: 512198 - DNA, 25 bp, Rattus norvegicus
gtggcctttcagctagggattcttc

SEQ ID NO: 512199 - DNA, 25 bp, Rattus norvegicus
gtggcctttcaggtagggattcttc

SEQ ID NO: 512200 - DNA, 25 bp, Rattus norvegicus
gtggcctttgccagtgacacagtgt

SEQ ID NO: 512201 - DNA, 25 bp, Rattus norvegicus
gtggcctttgcctgtgacacagtgt

SEQ ID NO: 512202 - DNA, 25 bp, Rattus norvegicus
gtggcctttgctccagatggctgat

SEQ ID NO: 512203 - DNA, 25 bp, Rattus norvegicus
gtggcctttgctgcagatggctgat

SEQ ID NO: 512204 - DNA, 25 bp, Rattus norvegicus
gtggccttttctctaatagctgatt

SEQ ID NO: 512205 - DNA, 25 bp, Rattus norvegicus
gtggccttttctgtaatagctgatt

SEQ ID NO: 512206 - DNA, 25 bp, Rattus norvegicus
gtggcctttttgaaccaagactttg

SEQ ID NO: 512207 - DNA, 25 bp, Rattus norvegicus
gtggcctttttgtaccaagactttg

SEQ ID NO: 512208 - DNA, 25 bp, Rattus norvegicus
gtggcgaaatctctagacacccaaa

SEQ ID NO: 512209 - DNA, 25 bp, Rattus norvegicus
gtggcgaaatctgtagacacccaaa

SEQ ID NO: 512210 - DNA, 25 bp, Rattus norvegicus
gtggcgaacaagagctacagtttct

SEQ ID NO: 512211 - DNA, 25 bp, Rattus norvegicus
gtggcgaacaagtgctacagtttct

SEQ ID NO: 512212 - DNA, 25 bp, Rattus norvegicus
gtggcgaatttgctcttatatttgt

SEQ ID NO: 512213 - DNA, 25 bp, Rattus norvegicus
gtggcgaatttggtcttatatttgt

SEQ ID NO: 512214 - DNA, 25 bp, Rattus norvegicus
gtggcgaccatgcataccatcatga

SEQ ID NO: 512215 - DNA, 25 bp, Rattus norvegicus
gtggcgaccatggataccatcatga

SEQ ID NO: 512216 - DNA, 25 bp, Rattus norvegicus
gtggcgatatatccagtaacactgg

SEQ ID NO: 512217 - DNA, 25 bp, Rattus norvegicus
gtggcgatatatgcagtaacactgg

SEQ ID NO: 512218 - DNA, 25 bp, Rattus norvegicus
gtggcgatttagcacacactctaag

SEQ ID NO: 512219 - DNA, 25 bp, Rattus norvegicus
gtggcgatttaggacacactctaag

SEQ ID NO: 512220 - DNA, 25 bp, Rattus norvegicus
gtggcgcacaagagattatgggtaa

SEQ ID NO: 512221 - DNA, 25 bp, Rattus norvegicus
gtggcgcacaagtgattatgggtaa

SEQ ID NO: 512222 - DNA, 25 bp, Rattus norvegicus
gtggcgcataaaagcctgctggctc

SEQ ID NO: 512223 - DNA, 25 bp, Rattus norvegicus
gtggcgcataaatgcctgctggctc

SEQ ID NO: 512224 - DNA, 25 bp, Rattus norvegicus
gtggcgcctagacacttgttacccc

SEQ ID NO: 512225 - DNA, 25 bp, Rattus norvegicus
gtggcgcctagagacttgttacccc

SEQ ID NO: 512226 - DNA, 25 bp, Rattus norvegicus
gtggcgcggccactagggtgatgcg

SEQ ID NO: 512227 - DNA, 25 bp, Rattus norvegicus
gtggcgcggccagtagggtgatgcg

SEQ ID NO: 512228 - DNA, 25 bp, Rattus norvegicus
gtggcgctgcaaaccagtcttgcta

SEQ ID NO: 512229 - DNA, 25 bp, Rattus norvegicus
gtggcgctgcaatccagtcttgcta

SEQ ID NO: 512230 - DNA, 25 bp, Rattus norvegicus
gtggcgctggagacagagtctggaa

SEQ ID NO: 512231 - DNA, 25 bp, Rattus norvegicus
gtggcgctggagtcagagtctggaa

SEQ ID NO: 512232 - DNA, 25 bp, Rattus norvegicus
gtggcgctgttcagaagactcgtaa

SEQ ID NO: 512233 - DNA, 25 bp, Rattus norvegicus
gtggcgctgttctgaagactcgtaa

SEQ ID NO: 512234 - DNA, 25 bp, Rattus norvegicus
gtggcgcttcaaatatgtcatgtac

SEQ ID NO: 512235 - DNA, 25 bp, Rattus norvegicus
gtggcgcttcaattatgtcatgtac

SEQ ID NO: 512236 - DNA, 25 bp, Rattus norvegicus
gtggcgcttctgcttggattagcct

SEQ ID NO: 512237 - DNA, 25 bp, Rattus norvegicus
gtggcgcttctggttggattagcct

SEQ ID NO: 512238 - DNA, 25 bp, Rattus norvegicus
gtggcggacaagactgcagagctct

SEQ ID NO: 512239 - DNA, 25 bp, Rattus norvegicus
gtggcggacaagtctgcagagctct

SEQ ID NO: 512240 - DNA, 25 bp, Rattus norvegicus
gtggcggatcaccactacattggat

SEQ ID NO: 512241 - DNA, 25 bp, Rattus norvegicus
gtggcggatcacgactacattggat

SEQ ID NO: 512242 - DNA, 25 bp, Rattus norvegicus
gtggcggcaaagattttatgtatta

SEQ ID NO: 512243 - DNA, 25 bp, Rattus norvegicus
gtggcggcaaagtttttatgtatta

SEQ ID NO: 512244 - DNA, 25 bp, Rattus norvegicus
gtggcggcattcagtatcggttaca

SEQ ID NO: 512245 - DNA, 25 bp, Rattus norvegicus
gtggcggcattctgtatcggttaca

SEQ ID NO: 512246 - DNA, 25 bp, Rattus norvegicus
gtggcggcgcagacacaccgcgaat

SEQ ID NO: 512247 - DNA, 25 bp, Rattus norvegicus
gtggcggcgcagtcacaccgcgaat

SEQ ID NO: 512248 - DNA, 25 bp, Rattus norvegicus
gtggcggctcatccctagaactcct

SEQ ID NO: 512249 - DNA, 25 bp, Rattus norvegicus
gtggcggctcatgcctagaactcct

SEQ ID NO: 512250 - DNA, 25 bp, Rattus norvegicus
gtggcggctcgaaccagcagaaaca

SEQ ID NO: 512251 - DNA, 25 bp, Rattus norvegicus
gtggcggctcgatccagcagaaaca

SEQ ID NO: 512252 - DNA, 25 bp, Rattus norvegicus
gtggcggctgttcttgttcctctgc

SEQ ID NO: 512253 - DNA, 25 bp, Rattus norvegicus
gtggcggctgttgttgttcctctgc

SEQ ID NO: 512254 - DNA, 25 bp, Rattus norvegicus
gtggcggcttagaatttggcaaatc

SEQ ID NO: 512255 - DNA, 25 bp, Rattus norvegicus
gtggcggcttagtatttggcaaatc

SEQ ID NO: 512256 - DNA, 25 bp, Rattus norvegicus
gtggcgggcttcacaaggccactta

SEQ ID NO: 512257 - DNA, 25 bp, Rattus norvegicus
gtggcgggcttctcaaggccactta

SEQ ID NO: 512258 - DNA, 25 bp, Rattus norvegicus
gtggcgggtcgcaggccattcaggc

SEQ ID NO: 512259 - DNA, 25 bp, Rattus norvegicus
gtggcgggtcgctggccattcaggc

SEQ ID NO: 512260 - DNA, 25 bp, Rattus norvegicus
gtggcggtcctgcagtttgaactac

SEQ ID NO: 512261 - DNA, 25 bp, Rattus norvegicus
gtggcggtcctggagtttgaactac

SEQ ID NO: 512262 - DNA, 25 bp, Rattus norvegicus
gtggcggttcacattaggtatatca

SEQ ID NO: 512263 - DNA, 25 bp, Rattus norvegicus
gtggcggttcactttaggtatatca

SEQ ID NO: 512264 - DNA, 25 bp, Rattus norvegicus
gtggcggttgctagctaagtatgta

SEQ ID NO: 512265 - DNA, 25 bp, Rattus norvegicus
gtggcggttgcttgctaagtatgta

SEQ ID NO: 512266 - DNA, 25 bp, Rattus norvegicus
gtggcgtacaccagtaagcccggca

SEQ ID NO: 512267 - DNA, 25 bp, Rattus norvegicus
gtggcgtacacctgtaagcccggca

SEQ ID NO: 512268 - DNA, 25 bp, Rattus norvegicus
gtggcgtatgcaccccagaataaat

SEQ ID NO: 512269 - DNA, 25 bp, Rattus norvegicus
gtggcgtatgcagcccagaataaat

SEQ ID NO: 512270 - DNA, 25 bp, Rattus norvegicus
gtggcgtatgctagctggtgcctac

SEQ ID NO: 512271 - DNA, 25 bp, Rattus norvegicus
gtggcgtatgcttgctggtgcctac

SEQ ID NO: 512272 - DNA, 25 bp, Rattus norvegicus
gtggcgtgccttagcatctaaaagt

SEQ ID NO: 512273 - DNA, 25 bp, Rattus norvegicus
gtggcgtgcctttgcatctaaaagt

SEQ ID NO: 512274 - DNA, 25 bp, Rattus norvegicus
gtggcgttaagtcacattcctgtgg

SEQ ID NO: 512275 - DNA, 25 bp, Rattus norvegicus
gtggcgttaagtgacattcctgtgg

SEQ ID NO: 512276 - DNA, 25 bp, Rattus norvegicus
gtggcgttgcacatgagatcatact

SEQ ID NO: 512277 - DNA, 25 bp, Rattus norvegicus
gtggcgttgcacttgagatcatact

SEQ ID NO: 512278 - DNA, 25 bp, Rattus norvegicus
gtggcgttgtgtctactcaaaacct

SEQ ID NO: 512279 - DNA, 25 bp, Rattus norvegicus
gtggcgttgtgtgtactcaaaacct

SEQ ID NO: 512280 - DNA, 25 bp, Rattus norvegicus
gtggcgtttggcatcaccattgact

SEQ ID NO: 512281 - DNA, 25 bp, Rattus norvegicus
gtggcgtttggcttcaccattgact

SEQ ID NO: 512282 - DNA, 25 bp, Rattus norvegicus
gtggcgtttttaattgattcagtgt

SEQ ID NO: 512283 - DNA, 25 bp, Rattus norvegicus
gtggcgtttttatttgattcagtgt

SEQ ID NO: 512284 - DNA, 25 bp, Rattus norvegicus
gtggctaaagccctgtaagaagtca

SEQ ID NO: 512285 - DNA, 25 bp, Rattus norvegicus
gtggctaaagccgtgtaagaagtca

SEQ ID NO: 512286 - DNA, 25 bp, Rattus norvegicus
gtggctaacactccaagcctgtgca

SEQ ID NO: 512287 - DNA, 25 bp, Rattus norvegicus
gtggctaacactgcaagcctgtgca

SEQ ID NO: 512288 - DNA, 25 bp, Rattus norvegicus
gtggctaaggaccaagaccatccaa

SEQ ID NO: 512289 - DNA, 25 bp, Rattus norvegicus
gtggctaaggacgaagaccatccaa

SEQ ID NO: 512290 - DNA, 25 bp, Rattus norvegicus
gtggctaagtaaacccagtgctcat

SEQ ID NO: 512291 - DNA, 25 bp, Rattus norvegicus
gtggctaagtaatcccagtgctcat

SEQ ID NO: 512292 - DNA, 25 bp, Rattus norvegicus
gtggctaagttcagctggctacctg

SEQ ID NO: 512293 - DNA, 25 bp, Rattus norvegicus
gtggctaagttctgctggctacctg

SEQ ID NO: 512294 - DNA, 25 bp, Rattus norvegicus
gtggctaatactacattccttttgt

SEQ ID NO: 512295 - DNA, 25 bp, Rattus norvegicus
gtggctaatacttcattccttttgt

SEQ ID NO: 512296 - DNA, 25 bp, Rattus norvegicus
gtggctaatatgagattccctcctg

SEQ ID NO: 512297 - DNA, 25 bp, Rattus norvegicus
gtggctaatatgtgattccctcctg

SEQ ID NO: 512298 - DNA, 25 bp, Rattus norvegicus
gtggctaattagagcttgttactat

SEQ ID NO: 512299 - DNA, 25 bp, Rattus norvegicus
gtggctaattagtgcttgttactat

SEQ ID NO: 512300 - DNA, 25 bp, Rattus norvegicus
gtggctaattctctaacatagtctt

SEQ ID NO: 512301 - DNA, 25 bp, Rattus norvegicus
gtggctaattctgtaacatagtctt

SEQ ID NO: 512302 - DNA, 25 bp, Rattus norvegicus
gtggctacacacagatagaaacctt

SEQ ID NO: 512303 - DNA, 25 bp, Rattus norvegicus
gtggctacacactgatagaaacctt

SEQ ID NO: 512304 - DNA, 25 bp, Rattus norvegicus
gtggctacagaacggctctgcctaa

SEQ ID NO: 512305 - DNA, 25 bp, Rattus norvegicus
gtggctacagaagggctctgcctaa

SEQ ID NO: 512306 - DNA, 25 bp, Rattus norvegicus
gtggctacagctaaatctattttga

SEQ ID NO: 512307 - DNA, 25 bp, Rattus norvegicus
gtggctacagcttaatctattttga

SEQ ID NO: 512308 - DNA, 25 bp, Rattus norvegicus
gtggctacatgtatctacttggctg

SEQ ID NO: 512309 - DNA, 25 bp, Rattus norvegicus
gtggctacatgtatgcggacagaca

SEQ ID NO: 512310 - DNA, 25 bp, Rattus norvegicus
gtggctacatgtttctacttggctg

SEQ ID NO: 512311 - DNA, 25 bp, Rattus norvegicus
gtggctacatgtttgcggacagaca

SEQ ID NO: 512312 - DNA, 25 bp, Rattus norvegicus
gtggctacccacacagtattctgtg

SEQ ID NO: 512313 - DNA, 25 bp, Rattus norvegicus
gtggctacccactcagtattctgtg

SEQ ID NO: 512314 - DNA, 25 bp, Rattus norvegicus
gtggctaccctcatgagaactgtgt

SEQ ID NO: 512315 - DNA, 25 bp, Rattus norvegicus
gtggctaccctcttgagaactgtgt

SEQ ID NO: 512316 - DNA, 25 bp, Rattus norvegicus
gtggctaccctgagaaagacctgac

SEQ ID NO: 512317 - DNA, 25 bp, Rattus norvegicus
gtggctaccctgtgaaagacctgac

SEQ ID NO: 512318 - DNA, 25 bp, Rattus norvegicus
gtggctaccggtcctaagaacagac

SEQ ID NO: 512319 - DNA, 25 bp, Rattus norvegicus
gtggctaccggtgctaagaacagac

SEQ ID NO: 512320 - DNA, 25 bp, Rattus norvegicus
gtggctacctccatcaatgaagctg

SEQ ID NO: 512321 - DNA, 25 bp, Rattus norvegicus
gtggctacctccttcaatgaagctg

SEQ ID NO: 512322 - DNA, 25 bp, Rattus norvegicus
gtggctacgtttacttggtgcagtt

SEQ ID NO: 512323 - DNA, 25 bp, Rattus norvegicus
gtggctacgttttcttggtgcagtt

SEQ ID NO: 512324 - DNA, 25 bp, Rattus norvegicus
gtggctactacacactgtactatac

SEQ ID NO: 512325 - DNA, 25 bp, Rattus norvegicus
gtggctactacagactgtactatac

SEQ ID NO: 512326 - DNA, 25 bp, Rattus norvegicus
gtggctactattctcccttataaat

SEQ ID NO: 512327 - DNA, 25 bp, Rattus norvegicus
gtggctactattgtcccttataaat

SEQ ID NO: 512328 - DNA, 25 bp, Rattus norvegicus
gtggctactgacacctaagctacaa

SEQ ID NO: 512329 - DNA, 25 bp, Rattus norvegicus
gtggctactgactcctaagctacaa

SEQ ID NO: 512330 - DNA, 25 bp, Rattus norvegicus
gtggctagacacatggtttcctggt

SEQ ID NO: 512331 - DNA, 25 bp, Rattus norvegicus
gtggctagacacttggtttcctggt

SEQ ID NO: 512332 - DNA, 25 bp, Rattus norvegicus
gtggctagacttcgctcaggataat

SEQ ID NO: 512333 - DNA, 25 bp, Rattus norvegicus
gtggctagacttggctcaggataat

SEQ ID NO: 512334 - DNA, 25 bp, Rattus norvegicus
gtggctagagatattcaagcatttt

SEQ ID NO: 512335 - DNA, 25 bp, Rattus norvegicus
gtggctagagattttcaagcatttt

SEQ ID NO: 512336 - DNA, 25 bp, Rattus norvegicus
gtggctagagtcatgggtccgttca

SEQ ID NO: 512337 - DNA, 25 bp, Rattus norvegicus
gtggctagagtcttgggtccgttca

SEQ ID NO: 512338 - DNA, 25 bp, Rattus norvegicus
gtggctagcaataacgctgcgtgta

SEQ ID NO: 512339 - DNA, 25 bp, Rattus norvegicus
gtggctagcaattacgctgcgtgta

SEQ ID NO: 512340 - DNA, 25 bp, Rattus norvegicus
gtggctagcatcatgaaccttttat

SEQ ID NO: 512341 - DNA, 25 bp, Rattus norvegicus
gtggctagcatcttgaaccttttat

SEQ ID NO: 512342 - DNA, 25 bp, Rattus norvegicus
gtggctagccatctcttagtttaga

SEQ ID NO: 512343 - DNA, 25 bp, Rattus norvegicus
gtggctagccatgtcttagtttaga

SEQ ID NO: 512344 - DNA, 25 bp, Rattus norvegicus
gtggctagctccaaaaccatggtca

SEQ ID NO: 512345 - DNA, 25 bp, Rattus norvegicus
gtggctagctcctaaaccatggtca

SEQ ID NO: 512346 - DNA, 25 bp, Rattus norvegicus
gtggctagctggataagtgtcttca

SEQ ID NO: 512347 - DNA, 25 bp, Rattus norvegicus
gtggctagctggttaagtgtcttca

SEQ ID NO: 512348 - DNA, 25 bp, Rattus norvegicus
gtggctagggcacttagctgaactt

SEQ ID NO: 512349 - DNA, 25 bp, Rattus norvegicus
gtggctagggcagttagctgaactt

SEQ ID NO: 512350 - DNA, 25 bp, Rattus norvegicus
gtggctagtctgagacgtccgtggt

SEQ ID NO: 512351 - DNA, 25 bp, Rattus norvegicus
gtggctagtctgtgacgtccgtggt

SEQ ID NO: 512352 - DNA, 25 bp, Rattus norvegicus
gtggctagtgcaagactctggttat

SEQ ID NO: 512353 - DNA, 25 bp, Rattus norvegicus
gtggctagtgcatgactctggttat

SEQ ID NO: 512354 - DNA, 25 bp, Rattus norvegicus
gtggctagtgctctaatttcactta

SEQ ID NO: 512355 - DNA, 25 bp, Rattus norvegicus
gtggctagtgctgtaatttcactta

SEQ ID NO: 512356 - DNA, 25 bp, Rattus norvegicus
gtggctatacacaattgttactaaa

SEQ ID NO: 512357 - DNA, 25 bp, Rattus norvegicus
gtggctatacacagtctcagttcaa

SEQ ID NO: 512358 - DNA, 25 bp, Rattus norvegicus
gtggctatacactattgttactaaa

SEQ ID NO: 512359 - DNA, 25 bp, Rattus norvegicus
gtggctatacactgtctcagttcaa

SEQ ID NO: 512360 - DNA, 25 bp, Rattus norvegicus
gtggctataccaactacattcagaa

SEQ ID NO: 512361 - DNA, 25 bp, Rattus norvegicus
gtggctataccatctacattcagaa

SEQ ID NO: 512362 - DNA, 25 bp, Rattus norvegicus
gtggctatactaacttactggagat

SEQ ID NO: 512363 - DNA, 25 bp, Rattus norvegicus
gtggctatactatcttactggagat

SEQ ID NO: 512364 - DNA, 25 bp, Rattus norvegicus
gtggctatagagaccttgaccataa

SEQ ID NO: 512365 - DNA, 25 bp, Rattus norvegicus
gtggctatagagtccttgaccataa

SEQ ID NO: 512366 - DNA, 25 bp, Rattus norvegicus
gtggctatatggctgtcttctgtaa

SEQ ID NO: 512367 - DNA, 25 bp, Rattus norvegicus
gtggctatatgggtgtcttctgtaa

SEQ ID NO: 512368 - DNA, 25 bp, Rattus norvegicus
gtggctatcaacatgtgagaggcga

SEQ ID NO: 512369 - DNA, 25 bp, Rattus norvegicus
gtggctatcaacttgtgagaggcga

SEQ ID NO: 512370 - DNA, 25 bp, Rattus norvegicus
gtggctatccagattgtatttcctt

SEQ ID NO: 512371 - DNA, 25 bp, Rattus norvegicus
gtggctatccagtttgtatttcctt

SEQ ID NO: 512372 - DNA, 25 bp, Rattus norvegicus
gtggctatccttcaggactttgacc

SEQ ID NO: 512373 - DNA, 25 bp, Rattus norvegicus
gtggctatccttgaggactttgacc

SEQ ID NO: 512374 - DNA, 25 bp, Rattus norvegicus
gtggctatcgtgattgtttcacaca

SEQ ID NO: 512375 - DNA, 25 bp, Rattus norvegicus
gtggctatcgtgtttgtttcacaca

SEQ ID NO: 512376 - DNA, 25 bp, Rattus norvegicus
gtggctatctcgctccgtggagcat

SEQ ID NO: 512377 - DNA, 25 bp, Rattus norvegicus
gtggctatctcggtccgtggagcat

SEQ ID NO: 512378 - DNA, 25 bp, Rattus norvegicus
gtggctatgccgaagtgcctgtacc

SEQ ID NO: 512379 - DNA, 25 bp, Rattus norvegicus
gtggctatgccgtagtgcctgtacc

SEQ ID NO: 512380 - DNA, 25 bp, Rattus norvegicus
gtggctattaatacttcagtctgca

SEQ ID NO: 512381 - DNA, 25 bp, Rattus norvegicus
gtggctattaattcttcagtctgca

SEQ ID NO: 512382 - DNA, 25 bp, Rattus norvegicus
gtggctattaccaaacagttcctca

SEQ ID NO: 512383 - DNA, 25 bp, Rattus norvegicus
gtggctattacctaacagttcctca

SEQ ID NO: 512384 - DNA, 25 bp, Rattus norvegicus
gtggctattgagcaccggaatgaaa

SEQ ID NO: 512385 - DNA, 25 bp, Rattus norvegicus
gtggctattgaggaccggaatgaaa

SEQ ID NO: 512386 - DNA, 25 bp, Rattus norvegicus
gtggctcaacagagaacacgtgctt

SEQ ID NO: 512387 - DNA, 25 bp, Rattus norvegicus
gtggctcaacagtgaacacgtgctt

SEQ ID NO: 512388 - DNA, 25 bp, Rattus norvegicus
gtggctcaagatcttgctatcaacc

SEQ ID NO: 512389 - DNA, 25 bp, Rattus norvegicus
gtggctcaagatgttgctatcaacc

SEQ ID NO: 512390 - DNA, 25 bp, Rattus norvegicus
gtggctcaccgacaagttcttgcgc

SEQ ID NO: 512391 - DNA, 25 bp, Rattus norvegicus
gtggctcaccgagaagttcttgcgc

SEQ ID NO: 512392 - DNA, 25 bp, Rattus norvegicus
gtggctcacctgctgcattgaagag

SEQ ID NO: 512393 - DNA, 25 bp, Rattus norvegicus
gtggctcacctggtgcattgaagag

SEQ ID NO: 512394 - DNA, 25 bp, Rattus norvegicus
gtggctcactgcctgggatctttac

SEQ ID NO: 512395 - DNA, 25 bp, Rattus norvegicus
gtggctcactgcgtgggatctttac

SEQ ID NO: 512396 - DNA, 25 bp, Rattus norvegicus
gtggctcactgtcgaaagcttctgt

SEQ ID NO: 512397 - DNA, 25 bp, Rattus norvegicus
gtggctcactgtggaaagcttctgt

SEQ ID NO: 512398 - DNA, 25 bp, Rattus norvegicus
gtggctcagatgctggctacactat

SEQ ID NO: 512399 - DNA, 25 bp, Rattus norvegicus
gtggctcagatggtggctacactat

SEQ ID NO: 512400 - DNA, 25 bp, Rattus norvegicus
gtggctcaggagagacaagttgcta

SEQ ID NO: 512401 - DNA, 25 bp, Rattus norvegicus
gtggctcaggagtgacaagttgcta

SEQ ID NO: 512402 - DNA, 25 bp, Rattus norvegicus
gtggctcaggccattggtccatgtg

SEQ ID NO: 512403 - DNA, 25 bp, Rattus norvegicus
gtggctcaggcctttggtccatgtg

SEQ ID NO: 512404 - DNA, 25 bp, Rattus norvegicus
gtggctcagggtcaagctttagttc

SEQ ID NO: 512405 - DNA, 25 bp, Rattus norvegicus
gtggctcagggtgaagctttagttc

SEQ ID NO: 512406 - DNA, 25 bp, Rattus norvegicus
gtggctcatccacggtttcttaaac

SEQ ID NO: 512407 - DNA, 25 bp, Rattus norvegicus
gtggctcatccagggtttcttaaac

SEQ ID NO: 512408 - DNA, 25 bp, Rattus norvegicus
gtggctcatcccagggcaaatgatg

SEQ ID NO: 512409 - DNA, 25 bp, Rattus norvegicus
gtggctcatccctgggcaaatgatg

SEQ ID NO: 512410 - DNA, 25 bp, Rattus norvegicus
gtggctcatcgaatttggcaagacc

SEQ ID NO: 512411 - DNA, 25 bp, Rattus norvegicus
gtggctcatcgattttggcaagacc

SEQ ID NO: 512412 - DNA, 25 bp, Rattus norvegicus
gtggctcatggcaagggccccagaa

SEQ ID NO: 512413 - DNA, 25 bp, Rattus norvegicus
gtggctcatggctagggccccagaa

SEQ ID NO: 512414 - DNA, 25 bp, Rattus norvegicus
gtggctcatggtcctcaagatctca

SEQ ID NO: 512415 - DNA, 25 bp, Rattus norvegicus
gtggctcatggtgctcaagatctca

SEQ ID NO: 512416 - DNA, 25 bp, Rattus norvegicus
gtggctcattgtatgtttgtcaacc

SEQ ID NO: 512417 - DNA, 25 bp, Rattus norvegicus
gtggctcattgtttgtttgtcaacc

SEQ ID NO: 512418 - DNA, 25 bp, Rattus norvegicus
gtggctcatttgcaaggactattat

SEQ ID NO: 512419 - DNA, 25 bp, Rattus norvegicus
gtggctcatttggaaggactattat

SEQ ID NO: 512420 - DNA, 25 bp, Rattus norvegicus
gtggctccagaacgcacacaatgct

SEQ ID NO: 512421 - DNA, 25 bp, Rattus norvegicus
gtggctccagaaggcacacaatgct

SEQ ID NO: 512422 - DNA, 25 bp, Rattus norvegicus
gtggctccaggcatcaaagggacct

SEQ ID NO: 512423 - DNA, 25 bp, Rattus norvegicus
gtggctccaggcttcaaagggacct

SEQ ID NO: 512424 - DNA, 25 bp, Rattus norvegicus
gtggctccatgtaagctaccttata

SEQ ID NO: 512425 - DNA, 25 bp, Rattus norvegicus
gtggctccatgtagacatccaggtg

SEQ ID NO: 512426 - DNA, 25 bp, Rattus norvegicus
gtggctccatgttagctaccttata

SEQ ID NO: 512427 - DNA, 25 bp, Rattus norvegicus
gtggctccatgttgacatccaggtg

SEQ ID NO: 512428 - DNA, 25 bp, Rattus norvegicus
gtggctcccacaacatgacaaatat

SEQ ID NO: 512429 - DNA, 25 bp, Rattus norvegicus
gtggctcccacatcatgacaaatat

SEQ ID NO: 512430 - DNA, 25 bp, Rattus norvegicus
gtggctcccctaactgggcagacag

SEQ ID NO: 512431 - DNA, 25 bp, Rattus norvegicus
gtggctcccctatctgggcagacag

SEQ ID NO: 512432 - DNA, 25 bp, Rattus norvegicus
gtggctcccgatatggcttcggatt

SEQ ID NO: 512433 - DNA, 25 bp, Rattus norvegicus
gtggctcccgatttggcttcggatt

SEQ ID NO: 512434 - DNA, 25 bp, Rattus norvegicus
gtggctccctagactcagtatctca

SEQ ID NO: 512435 - DNA, 25 bp, Rattus norvegicus
gtggctccctagtctcagtatctca

SEQ ID NO: 512436 - DNA, 25 bp, Rattus norvegicus
gtggctccgacgaggctactttgca

SEQ ID NO: 512437 - DNA, 25 bp, Rattus norvegicus
gtggctccgacgtggctactttgca

SEQ ID NO: 512438 - DNA, 25 bp, Rattus norvegicus
gtggctcctaccattaagacagcaa

SEQ ID NO: 512439 - DNA, 25 bp, Rattus norvegicus
gtggctcctacctttaagacagcaa

SEQ ID NO: 512440 - DNA, 25 bp, Rattus norvegicus
gtggctcctactctgtgataactaa

SEQ ID NO: 512441 - DNA, 25 bp, Rattus norvegicus
gtggctcctactgtgtgataactaa

SEQ ID NO: 512442 - DNA, 25 bp, Rattus norvegicus
gtggctcctatcagcacagacaaga

SEQ ID NO: 512443 - DNA, 25 bp, Rattus norvegicus
gtggctcctatctgcacagacaaga

SEQ ID NO: 512444 - DNA, 25 bp, Rattus norvegicus
gtggctcctgtaagttttattccca

SEQ ID NO: 512445 - DNA, 25 bp, Rattus norvegicus
gtggctcctgtatgttttattccca

SEQ ID NO: 512446 - DNA, 25 bp, Rattus norvegicus
gtggctcctgtgaggacctgcgtcc

SEQ ID NO: 512447 - DNA, 25 bp, Rattus norvegicus
gtggctcctgtgtggacctgcgtcc

SEQ ID NO: 512448 - DNA, 25 bp, Rattus norvegicus
gtggctccttcaccaagaagtccga

SEQ ID NO: 512449 - DNA, 25 bp, Rattus norvegicus
gtggctccttcacgacacttctgaa

SEQ ID NO: 512450 - DNA, 25 bp, Rattus norvegicus
gtggctccttcagcaagaagtccga

SEQ ID NO: 512451 - DNA, 25 bp, Rattus norvegicus
gtggctccttcaggacacttctgaa

SEQ ID NO: 512452 - DNA, 25 bp, Rattus norvegicus
gtggctccttgacaatcagaactct

SEQ ID NO: 512453 - DNA, 25 bp, Rattus norvegicus
gtggctccttgagaatcagaactct

SEQ ID NO: 512454 - DNA, 25 bp, Rattus norvegicus
gtggctcgaaatctggccctgacta

SEQ ID NO: 512455 - DNA, 25 bp, Rattus norvegicus
gtggctcgaaatgtggccctgacta

SEQ ID NO: 512456 - DNA, 25 bp, Rattus norvegicus
gtggctcgaacacatgctgcatctt

SEQ ID NO: 512457 - DNA, 25 bp, Rattus norvegicus
gtggctcgaacagatgctgcatctt

SEQ ID NO: 512458 - DNA, 25 bp, Rattus norvegicus
gtggctcgggctagcagacagcttc

SEQ ID NO: 512459 - DNA, 25 bp, Rattus norvegicus
gtggctcgggcttgcagacagcttc

SEQ ID NO: 512460 - DNA, 25 bp, Rattus norvegicus
gtggctctaacacagaccctgggtt

SEQ ID NO: 512461 - DNA, 25 bp, Rattus norvegicus
gtggctctaacagagaccctgggtt

SEQ ID NO: 512462 - DNA, 25 bp, Rattus norvegicus
gtggctctaactcctgccaacccag

SEQ ID NO: 512463 - DNA, 25 bp, Rattus norvegicus
gtggctctaactgctgccaacccag

SEQ ID NO: 512464 - DNA, 25 bp, Rattus norvegicus
gtggctctacaacctcaatctgaac

SEQ ID NO: 512465 - DNA, 25 bp, Rattus norvegicus
gtggctctacaagctcaatctgaac

SEQ ID NO: 512466 - DNA, 25 bp, Rattus norvegicus
gtggctctacttaatgtagcctgta

SEQ ID NO: 512467 - DNA, 25 bp, Rattus norvegicus
gtggctctactttatgtagcctgta

SEQ ID NO: 512468 - DNA, 25 bp, Rattus norvegicus
gtggctctagtacgagatgtagctt

SEQ ID NO: 512469 - DNA, 25 bp, Rattus norvegicus
gtggctctagtaggagatgtagctt

SEQ ID NO: 512470 - DNA, 25 bp, Rattus norvegicus
gtggctctcaacagctgttagtaat

SEQ ID NO: 512471 - DNA, 25 bp, Rattus norvegicus
gtggctctcaactgctgttagtaat

SEQ ID NO: 512472 - DNA, 25 bp, Rattus norvegicus
gtggctctcacccacagtagaaagc

SEQ ID NO: 512473 - DNA, 25 bp, Rattus norvegicus
gtggctctcaccgacagtagaaagc

SEQ ID NO: 512474 - DNA, 25 bp, Rattus norvegicus
gtggctctcatacactgttcttaac

SEQ ID NO: 512475 - DNA, 25 bp, Rattus norvegicus
gtggctctcatagactgttcttaac

SEQ ID NO: 512476 - DNA, 25 bp, Rattus norvegicus
gtggctctcatccagtcatattgtc

SEQ ID NO: 512477 - DNA, 25 bp, Rattus norvegicus
gtggctctcatcgagtcatattgtc

SEQ ID NO: 512478 - DNA, 25 bp, Rattus norvegicus
gtggctctcatgcttccctaataaa

SEQ ID NO: 512479 - DNA, 25 bp, Rattus norvegicus
gtggctctcatggttccctaataaa

SEQ ID NO: 512480 - DNA, 25 bp, Rattus norvegicus
gtggctctccaacaatatgtactta

SEQ ID NO: 512481 - DNA, 25 bp, Rattus norvegicus
gtggctctccaagaatatgtactta

SEQ ID NO: 512482 - DNA, 25 bp, Rattus norvegicus
gtggctctcctacgaagcttaaact

SEQ ID NO: 512483 - DNA, 25 bp, Rattus norvegicus
gtggctctcctaggaagcttaaact

SEQ ID NO: 512484 - DNA, 25 bp, Rattus norvegicus
gtggctctcctgagcaaactattta

SEQ ID NO: 512485 - DNA, 25 bp, Rattus norvegicus
gtggctctcctgtgcaaactattta

SEQ ID NO: 512486 - DNA, 25 bp, Rattus norvegicus
gtggctctctccataggctgataag

SEQ ID NO: 512487 - DNA, 25 bp, Rattus norvegicus
gtggctctctccttaggctgataag

SEQ ID NO: 512488 - DNA, 25 bp, Rattus norvegicus
gtggctctcttcaagagtccgcagg

SEQ ID NO: 512489 - DNA, 25 bp, Rattus norvegicus
gtggctctcttctagagtccgcagg

SEQ ID NO: 512490 - DNA, 25 bp, Rattus norvegicus
gtggctctcttgaatgacagcttgt

SEQ ID NO: 512491 - DNA, 25 bp, Rattus norvegicus
gtggctctcttgtatgacagcttgt

SEQ ID NO: 512492 - DNA, 25 bp, Rattus norvegicus
gtggctctgacccaaatccagctat

SEQ ID NO: 512493 - DNA, 25 bp, Rattus norvegicus
gtggctctgaccgaaatccagctat

SEQ ID NO: 512494 - DNA, 25 bp, Rattus norvegicus
gtggctctgcaacttaaacatctct

SEQ ID NO: 512495 - DNA, 25 bp, Rattus norvegicus
gtggctctgcaagttaaacatctct

SEQ ID NO: 512496 - DNA, 25 bp, Rattus norvegicus
gtggctctgggacatgtatcttcta

SEQ ID NO: 512497 - DNA, 25 bp, Rattus norvegicus
gtggctctgggagatgtatcttcta

SEQ ID NO: 512498 - DNA, 25 bp, Rattus norvegicus
gtggctctgtacagttgaaggtctc

SEQ ID NO: 512499 - DNA, 25 bp, Rattus norvegicus
gtggctctgtactgttgaaggtctc

SEQ ID NO: 512500 - DNA, 25 bp, Rattus norvegicus
gtggctctgtctcaaaggattacaa

SEQ ID NO: 512501 - DNA, 25 bp, Rattus norvegicus
gtggctctgtctgaaaggattacaa

SEQ ID NO: 512502 - DNA, 25 bp, Rattus norvegicus
gtggctcttcttcctgtgaatgatg

SEQ ID NO: 512503 - DNA, 25 bp, Rattus norvegicus
gtggctcttcttgctgtgaatgatg

SEQ ID NO: 512504 - DNA, 25 bp, Rattus norvegicus
gtggctcttgggacacttatcagtg

SEQ ID NO: 512505 - DNA, 25 bp, Rattus norvegicus
gtggctcttgggtcacttatcagtg

SEQ ID NO: 512506 - DNA, 25 bp, Rattus norvegicus
gtggctcttgtaattggtgaccctg

SEQ ID NO: 512507 - DNA, 25 bp, Rattus norvegicus
gtggctcttgtatttggtgaccctg

SEQ ID NO: 512508 - DNA, 25 bp, Rattus norvegicus
gtggctcttgtgaactattgtctct

SEQ ID NO: 512509 - DNA, 25 bp, Rattus norvegicus
gtggctcttgtgtactattgtctct

SEQ ID NO: 512510 - DNA, 25 bp, Rattus norvegicus
gtggctcttttgatctttcttaagt

SEQ ID NO: 512511 - DNA, 25 bp, Rattus norvegicus
gtggctcttttgttctttcttaagt

SEQ ID NO: 512512 - DNA, 25 bp, Rattus norvegicus
gtggctgaaaagcttcttctgtgag

SEQ ID NO: 512513 - DNA, 25 bp, Rattus norvegicus
gtggctgaaaaggttcttctgtgag

SEQ ID NO: 512514 - DNA, 25 bp, Rattus norvegicus
gtggctgaaactccagcaggtctaa

SEQ ID NO: 512515 - DNA, 25 bp, Rattus norvegicus
gtggctgaaactcgcttttcgggac

SEQ ID NO: 512516 - DNA, 25 bp, Rattus norvegicus
gtggctgaaactgcagcaggtctaa

SEQ ID NO: 512517 - DNA, 25 bp, Rattus norvegicus
gtggctgaaactggcttttcgggac

SEQ ID NO: 512518 - DNA, 25 bp, Rattus norvegicus
gtggctgaaccaagctccatcaaag

SEQ ID NO: 512519 - DNA, 25 bp, Rattus norvegicus
gtggctgaaccatgctccatcaaag

SEQ ID NO: 512520 - DNA, 25 bp, Rattus norvegicus
gtggctgaactgaaacatcaaatgt

SEQ ID NO: 512521 - DNA, 25 bp, Rattus norvegicus
gtggctgaactgtaacatcaaatgt

SEQ ID NO: 512522 - DNA, 25 bp, Rattus norvegicus
gtggctgaagaccacactctatatc

SEQ ID NO: 512523 - DNA, 25 bp, Rattus norvegicus
gtggctgaagacgacactctatatc

SEQ ID NO: 512524 - DNA, 25 bp, Rattus norvegicus
gtggctgaagtgatccctaggtatc

SEQ ID NO: 512525 - DNA, 25 bp, Rattus norvegicus
gtggctgaagtgttccctaggtatc

SEQ ID NO: 512526 - DNA, 25 bp, Rattus norvegicus
gtggctgaagttcacgtctgacgac

SEQ ID NO: 512527 - DNA, 25 bp, Rattus norvegicus
gtggctgaagttgacgtctgacgac

SEQ ID NO: 512528 - DNA, 25 bp, Rattus norvegicus
gtggctgaatatcaactacctggct

SEQ ID NO: 512529 - DNA, 25 bp, Rattus norvegicus
gtggctgaatatgaactacctggct

SEQ ID NO: 512530 - DNA, 25 bp, Rattus norvegicus
gtggctgacaatatcacatagcttg

SEQ ID NO: 512531 - DNA, 25 bp, Rattus norvegicus
gtggctgacaatttcacatagcttg

SEQ ID NO: 512532 - DNA, 25 bp, Rattus norvegicus
gtggctgaccaacgtatcaggccct

SEQ ID NO: 512533 - DNA, 25 bp, Rattus norvegicus
gtggctgaccaaggtatcaggccct

SEQ ID NO: 512534 - DNA, 25 bp, Rattus norvegicus
gtggctgaccagatgacactgctgc

SEQ ID NO: 512535 - DNA, 25 bp, Rattus norvegicus
gtggctgaccagttgacactgctgc

SEQ ID NO: 512536 - DNA, 25 bp, Rattus norvegicus
gtggctgacctcatctgaagctggt

SEQ ID NO: 512537 - DNA, 25 bp, Rattus norvegicus
gtggctgacctcttctgaagctggt

SEQ ID NO: 512538 - DNA, 25 bp, Rattus norvegicus
gtggctgactacactgactcagaga

SEQ ID NO: 512539 - DNA, 25 bp, Rattus norvegicus
gtggctgactactctgactcagaga

SEQ ID NO: 512540 - DNA, 25 bp, Rattus norvegicus
gtggctgacttcacactatcacgtg

SEQ ID NO: 512541 - DNA, 25 bp, Rattus norvegicus
gtggctgacttctcactatcacgtg

SEQ ID NO: 512542 - DNA, 25 bp, Rattus norvegicus
gtggctgagctgatgtaatcttcat

SEQ ID NO: 512543 - DNA, 25 bp, Rattus norvegicus
gtggctgagctgttgtaatcttcat

SEQ ID NO: 512544 - DNA, 25 bp, Rattus norvegicus
gtggctgaggaccacaggcccaacc

SEQ ID NO: 512545 - DNA, 25 bp, Rattus norvegicus
gtggctgaggacgacaggcccaacc

SEQ ID NO: 512546 - DNA, 25 bp, Rattus norvegicus
gtggctgaggagattccaggaccaa

SEQ ID NO: 512547 - DNA, 25 bp, Rattus norvegicus
gtggctgaggagtttccaggaccaa

SEQ ID NO: 512548 - DNA, 25 bp, Rattus norvegicus
gtggctgagtgtcacctggtatata

SEQ ID NO: 512549 - DNA, 25 bp, Rattus norvegicus
gtggctgagtgtgacctggtatata

SEQ ID NO: 512550 - DNA, 25 bp, Rattus norvegicus
gtggctgataacatacctgagaatt

SEQ ID NO: 512551 - DNA, 25 bp, Rattus norvegicus
gtggctgataacttacctgagaatt

SEQ ID NO: 512552 - DNA, 25 bp, Rattus norvegicus
gtggctgatactagaaacctggttc

SEQ ID NO: 512553 - DNA, 25 bp, Rattus norvegicus
gtggctgatacttgaaacctggttc

SEQ ID NO: 512554 - DNA, 25 bp, Rattus norvegicus
gtggctgatggtctacaagcccaca

SEQ ID NO: 512555 - DNA, 25 bp, Rattus norvegicus
gtggctgatggtgtacaagcccaca

SEQ ID NO: 512556 - DNA, 25 bp, Rattus norvegicus
gtggctgcaaccagttaacccaata

SEQ ID NO: 512557 - DNA, 25 bp, Rattus norvegicus
gtggctgcaacctgttaacccaata

SEQ ID NO: 512558 - DNA, 25 bp, Rattus norvegicus
gtggctgcaacgcagaactgttttc

SEQ ID NO: 512559 - DNA, 25 bp, Rattus norvegicus
gtggctgcaacggagaactgttttc

SEQ ID NO: 512560 - DNA, 25 bp, Rattus norvegicus
gtggctgcaaggagagaccctgtct

SEQ ID NO: 512561 - DNA, 25 bp, Rattus norvegicus
gtggctgcaaggtgagaccctgtct

SEQ ID NO: 512562 - DNA, 25 bp, Rattus norvegicus
gtggctgcagaaccagcaacctgta

SEQ ID NO: 512563 - DNA, 25 bp, Rattus norvegicus
gtggctgcagaagcagcaacctgta

SEQ ID NO: 512564 - DNA, 25 bp, Rattus norvegicus
gtggctgcagatccggtcatgtcac

SEQ ID NO: 512565 - DNA, 25 bp, Rattus norvegicus
gtggctgcagatgcggtcatgtcac

SEQ ID NO: 512566 - DNA, 25 bp, Rattus norvegicus
gtggctgcagccacaaggtcttcaa

SEQ ID NO: 512567 - DNA, 25 bp, Rattus norvegicus
gtggctgcagcctcaaggtcttcaa

SEQ ID NO: 512568 - DNA, 25 bp, Rattus norvegicus
gtggctgcagctcccatagaaagcc

SEQ ID NO: 512569 - DNA, 25 bp, Rattus norvegicus
gtggctgcagctctttcagaactgt

SEQ ID NO: 512570 - DNA, 25 bp, Rattus norvegicus
gtggctgcagctgccatagaaagcc

SEQ ID NO: 512571 - DNA, 25 bp, Rattus norvegicus
gtggctgcagctgtttcagaactgt

SEQ ID NO: 512572 - DNA, 25 bp, Rattus norvegicus
gtggctgcatttatggatcatcctg

SEQ ID NO: 512573 - DNA, 25 bp, Rattus norvegicus
gtggctgcatttcctgtgtctgccg

SEQ ID NO: 512574 - DNA, 25 bp, Rattus norvegicus
gtggctgcatttgctgtgtctgccg

SEQ ID NO: 512575 - DNA, 25 bp, Rattus norvegicus
gtggctgcatttttggatcatcctg

SEQ ID NO: 512576 - DNA, 25 bp, Rattus norvegicus
gtggctgccactcactggaagtttc

SEQ ID NO: 512577 - DNA, 25 bp, Rattus norvegicus
gtggctgccactgactggaagtttc

SEQ ID NO: 512578 - DNA, 25 bp, Rattus norvegicus
gtggctgcccatattgcactgagct

SEQ ID NO: 512579 - DNA, 25 bp, Rattus norvegicus
gtggctgcccattttgcactgagct

SEQ ID NO: 512580 - DNA, 25 bp, Rattus norvegicus
gtggctgccccaagaatagcaatat

SEQ ID NO: 512581 - DNA, 25 bp, Rattus norvegicus
gtggctgccccatgaatagcaatat

SEQ ID NO: 512582 - DNA, 25 bp, Rattus norvegicus
gtggctgcccctcttacagaaggaa

SEQ ID NO: 512583 - DNA, 25 bp, Rattus norvegicus
gtggctgcccctgttacagaaggaa

SEQ ID NO: 512584 - DNA, 25 bp, Rattus norvegicus
gtggctgccggaaacccggccgcta

SEQ ID NO: 512585 - DNA, 25 bp, Rattus norvegicus
gtggctgccggatacccggccgcta

SEQ ID NO: 512586 - DNA, 25 bp, Rattus norvegicus
gtggctgcctggagaacatccgcga

SEQ ID NO: 512587 - DNA, 25 bp, Rattus norvegicus
gtggctgcctggtgaacatccgcga

SEQ ID NO: 512588 - DNA, 25 bp, Rattus norvegicus
gtggctgcgacaccttgaaaaccaa

SEQ ID NO: 512589 - DNA, 25 bp, Rattus norvegicus
gtggctgcgacagcttgaaaaccaa

SEQ ID NO: 512590 - DNA, 25 bp, Rattus norvegicus
gtggctgcgtctcatttgttctgaa

SEQ ID NO: 512591 - DNA, 25 bp, Rattus norvegicus
gtggctgcgtctgatttgttctgaa

SEQ ID NO: 512592 - DNA, 25 bp, Rattus norvegicus
gtggctgctcacctctcctcagatt

SEQ ID NO: 512593 - DNA, 25 bp, Rattus norvegicus
gtggctgctcacgtctcctcagatt

SEQ ID NO: 512594 - DNA, 25 bp, Rattus norvegicus
gtggctgctcctagactgcagggta

SEQ ID NO: 512595 - DNA, 25 bp, Rattus norvegicus
gtggctgctccttgactgcagggta

SEQ ID NO: 512596 - DNA, 25 bp, Rattus norvegicus
gtggctgctgagacccaaactgaga

SEQ ID NO: 512597 - DNA, 25 bp, Rattus norvegicus
gtggctgctgagtcccaaactgaga

SEQ ID NO: 512598 - DNA, 25 bp, Rattus norvegicus
gtggctgctggcatacctggagaac

SEQ ID NO: 512599 - DNA, 25 bp, Rattus norvegicus
gtggctgctggcttacctggagaac

SEQ ID NO: 512600 - DNA, 25 bp, Rattus norvegicus
gtggctgctttcagccgaccttgga

SEQ ID NO: 512601 - DNA, 25 bp, Rattus norvegicus
gtggctgctttcattttatttccca

SEQ ID NO: 512602 - DNA, 25 bp, Rattus norvegicus
gtggctgctttctgccgaccttgga

SEQ ID NO: 512603 - DNA, 25 bp, Rattus norvegicus
gtggctgctttctttttatttccca

SEQ ID NO: 512604 - DNA, 25 bp, Rattus norvegicus
gtggctgctttgagatcacccacac

SEQ ID NO: 512605 - DNA, 25 bp, Rattus norvegicus
gtggctgctttgtgatcacccacac

SEQ ID NO: 512606 - DNA, 25 bp, Rattus norvegicus
gtggctggaaagcaccagtctgtcc

SEQ ID NO: 512607 - DNA, 25 bp, Rattus norvegicus
gtggctggaaaggaccagtctgtcc

SEQ ID NO: 512608 - DNA, 25 bp, Rattus norvegicus
gtggctggacagaaactcatctatg

SEQ ID NO: 512609 - DNA, 25 bp, Rattus norvegicus
gtggctggacagtaactcatctatg

SEQ ID NO: 512610 - DNA, 25 bp, Rattus norvegicus
gtggctggagacaacacttcatcag

SEQ ID NO: 512611 - DNA, 25 bp, Rattus norvegicus
gtggctggagactacacttcatcag

SEQ ID NO: 512612 - DNA, 25 bp, Rattus norvegicus
gtggctggagcaacgacatctcctg

SEQ ID NO: 512613 - DNA, 25 bp, Rattus norvegicus
gtggctggagcatcgacatctcctg

SEQ ID NO: 512614 - DNA, 25 bp, Rattus norvegicus
gtggctggatgaacacccatctgaa

SEQ ID NO: 512615 - DNA, 25 bp, Rattus norvegicus
gtggctggatgatcacccatctgaa

SEQ ID NO: 512616 - DNA, 25 bp, Rattus norvegicus
gtggctggcctgaagaatatcttca

SEQ ID NO: 512617 - DNA, 25 bp, Rattus norvegicus
gtggctggcctgtagaatatcttca

SEQ ID NO: 512618 - DNA, 25 bp, Rattus norvegicus
gtggctggcgaacccgatcttcccg

SEQ ID NO: 512619 - DNA, 25 bp, Rattus norvegicus
gtggctggcgaagccgatcttcccg

SEQ ID NO: 512620 - DNA, 25 bp, Rattus norvegicus
gtggctggcgctaccagtgttaaaa

SEQ ID NO: 512621 - DNA, 25 bp, Rattus norvegicus
gtggctggcgcttccagtgttaaaa

SEQ ID NO: 512622 - DNA, 25 bp, Rattus norvegicus
gtggctggcgtaaggtgcctcttca

SEQ ID NO: 512623 - DNA, 25 bp, Rattus norvegicus
gtggctggcgtatggtgcctcttca

SEQ ID NO: 512624 - DNA, 25 bp, Rattus norvegicus
gtggctgggaacatactacgtaggc

SEQ ID NO: 512625 - DNA, 25 bp, Rattus norvegicus
gtggctgggaacttactacgtaggc

SEQ ID NO: 512626 - DNA, 25 bp, Rattus norvegicus
gtggctgggctaccaagatgaccta

SEQ ID NO: 512627 - DNA, 25 bp, Rattus norvegicus
gtggctgggctagcaagatgaccta

SEQ ID NO: 512628 - DNA, 25 bp, Rattus norvegicus
gtggctgggcttagtgtccacatca

SEQ ID NO: 512629 - DNA, 25 bp, Rattus norvegicus
gtggctgggctttgtgtccacatca

SEQ ID NO: 512630 - DNA, 25 bp, Rattus norvegicus
gtggctggtcctatttggatcttaa

SEQ ID NO: 512631 - DNA, 25 bp, Rattus norvegicus
gtggctggtcctttttggatcttaa

SEQ ID NO: 512632 - DNA, 25 bp, Rattus norvegicus
gtggctggtgtgacctgcacagcat

SEQ ID NO: 512633 - DNA, 25 bp, Rattus norvegicus
gtggctggtgtgtcctgcacagcat

SEQ ID NO: 512634 - DNA, 25 bp, Rattus norvegicus
gtggctggtttaacaccgtgcaagg

SEQ ID NO: 512635 - DNA, 25 bp, Rattus norvegicus
gtggctggtttatcaccgtgcaagg

SEQ ID NO: 512636 - DNA, 25 bp, Rattus norvegicus
gtggctgtaaccctagagcactgtg

SEQ ID NO: 512637 - DNA, 25 bp, Rattus norvegicus
gtggctgtaaccgtagagcactgtg

SEQ ID NO: 512638 - DNA, 25 bp, Rattus norvegicus
gtggctgtaaggcaatgaatgatca

SEQ ID NO: 512639 - DNA, 25 bp, Rattus norvegicus
gtggctgtaagggaatgaatgatca

SEQ ID NO: 512640 - DNA, 25 bp, Rattus norvegicus
gtggctgtacacatggtataccaaa

SEQ ID NO: 512641 - DNA, 25 bp, Rattus norvegicus
gtggctgtacacttggtataccaaa

SEQ ID NO: 512642 - DNA, 25 bp, Rattus norvegicus
gtggctgtacttccagatcggatac

SEQ ID NO: 512643 - DNA, 25 bp, Rattus norvegicus
gtggctgtacttgcagatcggatac

SEQ ID NO: 512644 - DNA, 25 bp, Rattus norvegicus
gtggctgtagacacacattagggta

SEQ ID NO: 512645 - DNA, 25 bp, Rattus norvegicus
gtggctgtagactcacattagggta

SEQ ID NO: 512646 - DNA, 25 bp, Rattus norvegicus
gtggctgtcaagaattttcatgata

SEQ ID NO: 512647 - DNA, 25 bp, Rattus norvegicus
gtggctgtcaagcatattgctgttt

SEQ ID NO: 512648 - DNA, 25 bp, Rattus norvegicus
gtggctgtcaaggatattgctgttt

SEQ ID NO: 512649 - DNA, 25 bp, Rattus norvegicus
gtggctgtcaagtattttcatgata

SEQ ID NO: 512650 - DNA, 25 bp, Rattus norvegicus
gtggctgtcacacgtctgtctgcaa

SEQ ID NO: 512651 - DNA, 25 bp, Rattus norvegicus
gtggctgtcacaggtctgtctgcaa

SEQ ID NO: 512652 - DNA, 25 bp, Rattus norvegicus
gtggctgtcaccacttgaatggcac

SEQ ID NO: 512653 - DNA, 25 bp, Rattus norvegicus
gtggctgtcacctcttgaatggcac

SEQ ID NO: 512654 - DNA, 25 bp, Rattus norvegicus
gtggctgtcactcagccaggtttct

SEQ ID NO: 512655 - DNA, 25 bp, Rattus norvegicus
gtggctgtcactgagccaggtttct

SEQ ID NO: 512656 - DNA, 25 bp, Rattus norvegicus
gtggctgtcagacgagtgcatcaac

SEQ ID NO: 512657 - DNA, 25 bp, Rattus norvegicus
gtggctgtcagaggagtgcatcaac

SEQ ID NO: 512658 - DNA, 25 bp, Rattus norvegicus
gtggctgtcattctacttgtggccc

SEQ ID NO: 512659 - DNA, 25 bp, Rattus norvegicus
gtggctgtcattgtacttgtggccc

SEQ ID NO: 512660 - DNA, 25 bp, Rattus norvegicus
gtggctgtcccacttcctggtatac

SEQ ID NO: 512661 - DNA, 25 bp, Rattus norvegicus
gtggctgtcccagttcctggtatac

SEQ ID NO: 512662 - DNA, 25 bp, Rattus norvegicus
gtggctgtccccaagataggaatgt

SEQ ID NO: 512663 - DNA, 25 bp, Rattus norvegicus
gtggctgtcccctagataggaatgt

SEQ ID NO: 512664 - DNA, 25 bp, Rattus norvegicus
gtggctgtccgtcggccgtggagga

SEQ ID NO: 512665 - DNA, 25 bp, Rattus norvegicus
gtggctgtccgtgggccgtggagga

SEQ ID NO: 512666 - DNA, 25 bp, Rattus norvegicus
gtggctgtcctaagatatccctttg

SEQ ID NO: 512667 - DNA, 25 bp, Rattus norvegicus
gtggctgtcctatgatatccctttg

SEQ ID NO: 512668 - DNA, 25 bp, Rattus norvegicus
gtggctgtcttgcattctttgaata

SEQ ID NO: 512669 - DNA, 25 bp, Rattus norvegicus
gtggctgtcttggattctttgaata

SEQ ID NO: 512670 - DNA, 25 bp, Rattus norvegicus
gtggctgtgaaacgctttaactggt

SEQ ID NO: 512671 - DNA, 25 bp, Rattus norvegicus
gtggctgtgaaaggctttaactggt

SEQ ID NO: 512672 - DNA, 25 bp, Rattus norvegicus
gtggctgtgaagagacaaaccctgt

SEQ ID NO: 512673 - DNA, 25 bp, Rattus norvegicus
gtggctgtgaagtgacaaaccctgt

SEQ ID NO: 512674 - DNA, 25 bp, Rattus norvegicus
gtggctgtgaccattctggaataac

SEQ ID NO: 512675 - DNA, 25 bp, Rattus norvegicus
gtggctgtgacctttctggaataac

SEQ ID NO: 512676 - DNA, 25 bp, Rattus norvegicus
gtggctgtgataagccctgagtgta

SEQ ID NO: 512677 - DNA, 25 bp, Rattus norvegicus
gtggctgtgatatgccctgagtgta

SEQ ID NO: 512678 - DNA, 25 bp, Rattus norvegicus
gtggctgtgccgctgtgacaacaca

SEQ ID NO: 512679 - DNA, 25 bp, Rattus norvegicus
gtggctgtgccggtgtgacaacaca

SEQ ID NO: 512680 - DNA, 25 bp, Rattus norvegicus
gtggctgtggccagctatctagcgt

SEQ ID NO: 512681 - DNA, 25 bp, Rattus norvegicus
gtggctgtggcctgctatctagcgt

SEQ ID NO: 512682 - DNA, 25 bp, Rattus norvegicus
gtggctgtgtgtatcatttctgtgt

SEQ ID NO: 512683 - DNA, 25 bp, Rattus norvegicus
gtggctgtgtgtttcatttctgtgt

SEQ ID NO: 512684 - DNA, 25 bp, Rattus norvegicus
gtggctgttatactagactgtttca

SEQ ID NO: 512685 - DNA, 25 bp, Rattus norvegicus
gtggctgttatagtagactgtttca

SEQ ID NO: 512686 - DNA, 25 bp, Rattus norvegicus
gtggctgttatcaggcacatatagc

SEQ ID NO: 512687 - DNA, 25 bp, Rattus norvegicus
gtggctgttatctggcacatatagc

SEQ ID NO: 512688 - DNA, 25 bp, Rattus norvegicus
gtggctgttattcctcaagttgtta

SEQ ID NO: 512689 - DNA, 25 bp, Rattus norvegicus
gtggctgttattcctggtcttgaat

SEQ ID NO: 512690 - DNA, 25 bp, Rattus norvegicus
gtggctgttattgctcaagttgtta

SEQ ID NO: 512691 - DNA, 25 bp, Rattus norvegicus
gtggctgttattgctggtcttgaat

SEQ ID NO: 512692 - DNA, 25 bp, Rattus norvegicus
gtggctgttcacactctggcttgtc

SEQ ID NO: 512693 - DNA, 25 bp, Rattus norvegicus
gtggctgttcactctctggcttgtc

SEQ ID NO: 512694 - DNA, 25 bp, Rattus norvegicus
gtggctgttgataaaaccatcccct

SEQ ID NO: 512695 - DNA, 25 bp, Rattus norvegicus
gtggctgttgattaaaccatcccct

SEQ ID NO: 512696 - DNA, 25 bp, Rattus norvegicus
gtggctgttgggaatgttgctttct

SEQ ID NO: 512697 - DNA, 25 bp, Rattus norvegicus
gtggctgttgggtatgttgctttct

SEQ ID NO: 512698 - DNA, 25 bp, Rattus norvegicus
gtggctgttggtaacaaacatccct

SEQ ID NO: 512699 - DNA, 25 bp, Rattus norvegicus
gtggctgttggtaacctccaaatgg

SEQ ID NO: 512700 - DNA, 25 bp, Rattus norvegicus
gtggctgttggttacaaacatccct

SEQ ID NO: 512701 - DNA, 25 bp, Rattus norvegicus
gtggctgttggttacctccaaatgg

SEQ ID NO: 512702 - DNA, 25 bp, Rattus norvegicus
gtggctgttgttaaatcatactgtg

SEQ ID NO: 512703 - DNA, 25 bp, Rattus norvegicus
gtggctgttgtttaatcatactgtg

SEQ ID NO: 512704 - DNA, 25 bp, Rattus norvegicus
gtggctgttttcaactgcaaaccga

SEQ ID NO: 512705 - DNA, 25 bp, Rattus norvegicus
gtggctgttttctactgcaaaccga

SEQ ID NO: 512706 - DNA, 25 bp, Rattus norvegicus
gtggcttaaacaatttcgtgacttg

SEQ ID NO: 512707 - DNA, 25 bp, Rattus norvegicus
gtggcttaaacattttcgtgacttg

SEQ ID NO: 512708 - DNA, 25 bp, Rattus norvegicus
gtggcttaaaccacctgatcagaaa

SEQ ID NO: 512709 - DNA, 25 bp, Rattus norvegicus
gtggcttaaacctcctgatcagaaa

SEQ ID NO: 512710 - DNA, 25 bp, Rattus norvegicus
gtggcttaatacaacctacatgagg

SEQ ID NO: 512711 - DNA, 25 bp, Rattus norvegicus
gtggcttaatacattcattcttagg

SEQ ID NO: 512712 - DNA, 25 bp, Rattus norvegicus
gtggcttaatactacctacatgagg

SEQ ID NO: 512713 - DNA, 25 bp, Rattus norvegicus
gtggcttaatactttcattcttagg

SEQ ID NO: 512714 - DNA, 25 bp, Rattus norvegicus
gtggcttacactctgatctaatctg

SEQ ID NO: 512715 - DNA, 25 bp, Rattus norvegicus
gtggcttacactgtgatctaatctg

SEQ ID NO: 512716 - DNA, 25 bp, Rattus norvegicus
gtggcttacagtactttacttagaa

SEQ ID NO: 512717 - DNA, 25 bp, Rattus norvegicus
gtggcttacagtcacaccagttcca

SEQ ID NO: 512718 - DNA, 25 bp, Rattus norvegicus
gtggcttacagtgacaccagttcca

SEQ ID NO: 512719 - DNA, 25 bp, Rattus norvegicus
gtggcttacagttctttacttagaa

SEQ ID NO: 512720 - DNA, 25 bp, Rattus norvegicus
gtggcttacctgaatggcatcatca

SEQ ID NO: 512721 - DNA, 25 bp, Rattus norvegicus
gtggcttacctgtatggcatcatca

SEQ ID NO: 512722 - DNA, 25 bp, Rattus norvegicus
gtggcttactcccttgagacaagga

SEQ ID NO: 512723 - DNA, 25 bp, Rattus norvegicus
gtggcttactccgttgagacaagga

SEQ ID NO: 512724 - DNA, 25 bp, Rattus norvegicus
gtggcttacttgctgttatgtttcc

SEQ ID NO: 512725 - DNA, 25 bp, Rattus norvegicus
gtggcttacttggtgttatgtttcc

SEQ ID NO: 512726 - DNA, 25 bp, Rattus norvegicus
gtggcttactttcctgatgggaata

SEQ ID NO: 512727 - DNA, 25 bp, Rattus norvegicus
gtggcttactttgctgatgggaata

SEQ ID NO: 512728 - DNA, 25 bp, Rattus norvegicus
gtggcttagctcaagaaccctaatt

SEQ ID NO: 512729 - DNA, 25 bp, Rattus norvegicus
gtggcttagctctagaaccctaatt

SEQ ID NO: 512730 - DNA, 25 bp, Rattus norvegicus
gtggcttatataactacgtcattgt

SEQ ID NO: 512731 - DNA, 25 bp, Rattus norvegicus
gtggcttatataatctcctttctct

SEQ ID NO: 512732 - DNA, 25 bp, Rattus norvegicus
gtggcttatatatctacgtcattgt

SEQ ID NO: 512733 - DNA, 25 bp, Rattus norvegicus
gtggcttatatattctcctttctct

SEQ ID NO: 512734 - DNA, 25 bp, Rattus norvegicus
gtggcttatgacaggaggatactct

SEQ ID NO: 512735 - DNA, 25 bp, Rattus norvegicus
gtggcttatgactggaggatactct

SEQ ID NO: 512736 - DNA, 25 bp, Rattus norvegicus
gtggcttatgccagtcatccagcac

SEQ ID NO: 512737 - DNA, 25 bp, Rattus norvegicus
gtggcttatgcctgtcatccagcac

SEQ ID NO: 512738 - DNA, 25 bp, Rattus norvegicus
gtggcttcaagcatagcttctcaga

SEQ ID NO: 512739 - DNA, 25 bp, Rattus norvegicus
gtggcttcaagcttagcttctcaga

SEQ ID NO: 512740 - DNA, 25 bp, Rattus norvegicus
gtggcttcaccacagaatgttttca

SEQ ID NO: 512741 - DNA, 25 bp, Rattus norvegicus
gtggcttcaccagagaatgttttca

SEQ ID NO: 512742 - DNA, 25 bp, Rattus norvegicus
gtggcttcacctcgcatcaagagac

SEQ ID NO: 512743 - DNA, 25 bp, Rattus norvegicus
gtggcttcacctggcatcaagagac

SEQ ID NO: 512744 - DNA, 25 bp, Rattus norvegicus
gtggcttcagatctactttggttaa

SEQ ID NO: 512745 - DNA, 25 bp, Rattus norvegicus
gtggcttcagatgtactttggttaa

SEQ ID NO: 512746 - DNA, 25 bp, Rattus norvegicus
gtggcttcagccaaagctctcgaaa

SEQ ID NO: 512747 - DNA, 25 bp, Rattus norvegicus
gtggcttcagcctaagctctcgaaa

SEQ ID NO: 512748 - DNA, 25 bp, Rattus norvegicus
gtggcttcaggaatacctacatcgt

SEQ ID NO: 512749 - DNA, 25 bp, Rattus norvegicus
gtggcttcaggattacctacatcgt

SEQ ID NO: 512750 - DNA, 25 bp, Rattus norvegicus
gtggcttccaagaaacttagaacca

SEQ ID NO: 512751 - DNA, 25 bp, Rattus norvegicus
gtggcttccaagtaacttagaacca

SEQ ID NO: 512752 - DNA, 25 bp, Rattus norvegicus
gtggcttccaataacaatggctacc

SEQ ID NO: 512753 - DNA, 25 bp, Rattus norvegicus
gtggcttccaattacaatggctacc

SEQ ID NO: 512754 - DNA, 25 bp, Rattus norvegicus
gtggcttccgtgactactcagaaat

SEQ ID NO: 512755 - DNA, 25 bp, Rattus norvegicus
gtggcttccgtgtctactcagaaat

SEQ ID NO: 512756 - DNA, 25 bp, Rattus norvegicus
gtggcttcctccagtgggaactatc

SEQ ID NO: 512757 - DNA, 25 bp, Rattus norvegicus
gtggcttcctcctgtgggaactatc

SEQ ID NO: 512758 - DNA, 25 bp, Rattus norvegicus
gtggcttcctctctattcatgaatt

SEQ ID NO: 512759 - DNA, 25 bp, Rattus norvegicus
gtggcttcctctgtattcatgaatt

SEQ ID NO: 512760 - DNA, 25 bp, Rattus norvegicus
gtggcttcctttcatgtcaaaatgt

SEQ ID NO: 512761 - DNA, 25 bp, Rattus norvegicus
gtggcttcctttgatgtcaaaatgt

SEQ ID NO: 512762 - DNA, 25 bp, Rattus norvegicus
gtggcttcggagagcttttcagaac

SEQ ID NO: 512763 - DNA, 25 bp, Rattus norvegicus
gtggcttcggagtgcttttcagaac

SEQ ID NO: 512764 - DNA, 25 bp, Rattus norvegicus
gtggcttctaacagcaatctttctg

SEQ ID NO: 512765 - DNA, 25 bp, Rattus norvegicus
gtggcttctaactgcaatctttctg

SEQ ID NO: 512766 - DNA, 25 bp, Rattus norvegicus
gtggcttctaggagcccgagtagca

SEQ ID NO: 512767 - DNA, 25 bp, Rattus norvegicus
gtggcttctaggtgcccgagtagca

SEQ ID NO: 512768 - DNA, 25 bp, Rattus norvegicus
gtggcttctattaaagcaccgaggt

SEQ ID NO: 512769 - DNA, 25 bp, Rattus norvegicus
gtggcttctatttaagcaccgaggt

SEQ ID NO: 512770 - DNA, 25 bp, Rattus norvegicus
gtggcttctcaaatacctggataaa

SEQ ID NO: 512771 - DNA, 25 bp, Rattus norvegicus
gtggcttctcaattacctggataaa

SEQ ID NO: 512772 - DNA, 25 bp, Rattus norvegicus
gtggcttctccaacgatgtgcgaga

SEQ ID NO: 512773 - DNA, 25 bp, Rattus norvegicus
gtggcttctccatcgatgtgcgaga

SEQ ID NO: 512774 - DNA, 25 bp, Rattus norvegicus
gtggcttctcgaatctgcaaaggct

SEQ ID NO: 512775 - DNA, 25 bp, Rattus norvegicus
gtggcttctcgattctgcaaaggct

SEQ ID NO: 512776 - DNA, 25 bp, Rattus norvegicus
gtggcttctgcacaaattcttactg

SEQ ID NO: 512777 - DNA, 25 bp, Rattus norvegicus
gtggcttctgcacctccagaaaaag

SEQ ID NO: 512778 - DNA, 25 bp, Rattus norvegicus
gtggcttctgcagaaattcttactg

SEQ ID NO: 512779 - DNA, 25 bp, Rattus norvegicus
gtggcttctgcagctccagaaaaag

SEQ ID NO: 512780 - DNA, 25 bp, Rattus norvegicus
gtggcttctgccaaccttagaaatg

SEQ ID NO: 512781 - DNA, 25 bp, Rattus norvegicus
gtggcttctgcctaccttagaaatg

SEQ ID NO: 512782 - DNA, 25 bp, Rattus norvegicus
gtggcttctgctatagcccaagaac

SEQ ID NO: 512783 - DNA, 25 bp, Rattus norvegicus
gtggcttctgctttagcccaagaac

SEQ ID NO: 512784 - DNA, 25 bp, Rattus norvegicus
gtggcttgaaatctcctctttggaa

SEQ ID NO: 512785 - DNA, 25 bp, Rattus norvegicus
gtggcttgaaatgtcctctttggaa

SEQ ID NO: 512786 - DNA, 25 bp, Rattus norvegicus
gtggcttgaagtactagacttgtat

SEQ ID NO: 512787 - DNA, 25 bp, Rattus norvegicus
gtggcttgaagttctagacttgtat

SEQ ID NO: 512788 - DNA, 25 bp, Rattus norvegicus
gtggcttgacatatactgtcccaat

SEQ ID NO: 512789 - DNA, 25 bp, Rattus norvegicus
gtggcttgacatttactgtcccaat

SEQ ID NO: 512790 - DNA, 25 bp, Rattus norvegicus
gtggcttgacggaacaccattgctc

SEQ ID NO: 512791 - DNA, 25 bp, Rattus norvegicus
gtggcttgacggtacaccattgctc

SEQ ID NO: 512792 - DNA, 25 bp, Rattus norvegicus
gtggcttgcaatattcttagtgttt

SEQ ID NO: 512793 - DNA, 25 bp, Rattus norvegicus
gtggcttgcaattttcttagtgttt

SEQ ID NO: 512794 - DNA, 25 bp, Rattus norvegicus
gtggcttgcacaaaccttactttta

SEQ ID NO: 512795 - DNA, 25 bp, Rattus norvegicus
gtggcttgcacataccttactttta

SEQ ID NO: 512796 - DNA, 25 bp, Rattus norvegicus
gtggcttgcaggatgggctcccaaa

SEQ ID NO: 512797 - DNA, 25 bp, Rattus norvegicus
gtggcttgcaggttgggctcccaaa

SEQ ID NO: 512798 - DNA, 25 bp, Rattus norvegicus
gtggcttgctccattttgaatctaa

SEQ ID NO: 512799 - DNA, 25 bp, Rattus norvegicus
gtggcttgctcctttttgaatctaa

SEQ ID NO: 512800 - DNA, 25 bp, Rattus norvegicus
gtggcttgctctattgctgaaatca

SEQ ID NO: 512801 - DNA, 25 bp, Rattus norvegicus
gtggcttgctcttttgctgaaatca

SEQ ID NO: 512802 - DNA, 25 bp, Rattus norvegicus
gtggcttggcagctctttgtaaaag

SEQ ID NO: 512803 - DNA, 25 bp, Rattus norvegicus
gtggcttggcaggtctttgtaaaag

SEQ ID NO: 512804 - DNA, 25 bp, Rattus norvegicus
gtggcttgtataagaaccaaacaca

SEQ ID NO: 512805 - DNA, 25 bp, Rattus norvegicus
gtggcttgtatatgaaccaaacaca

SEQ ID NO: 512806 - DNA, 25 bp, Rattus norvegicus
gtggcttgtcatcaaatctttgctg

SEQ ID NO: 512807 - DNA, 25 bp, Rattus norvegicus
gtggcttgtcatgaaatctttgctg

SEQ ID NO: 512808 - DNA, 25 bp, Rattus norvegicus
gtggcttgtcctacttgatgataga

SEQ ID NO: 512809 - DNA, 25 bp, Rattus norvegicus
gtggcttgtccttcttgatgataga

SEQ ID NO: 512810 - DNA, 25 bp, Rattus norvegicus
gtggcttgtctgatttctattcttc

SEQ ID NO: 512811 - DNA, 25 bp, Rattus norvegicus
gtggcttgtctgttttctattcttc

SEQ ID NO: 512812 - DNA, 25 bp, Rattus norvegicus
gtggcttgtgacctcttatctaata

SEQ ID NO: 512813 - DNA, 25 bp, Rattus norvegicus
gtggcttgtgacgtcttatctaata

SEQ ID NO: 512814 - DNA, 25 bp, Rattus norvegicus
gtggctttaacactgagtggctgtc

SEQ ID NO: 512815 - DNA, 25 bp, Rattus norvegicus
gtggctttaacactgtctgacccag

SEQ ID NO: 512816 - DNA, 25 bp, Rattus norvegicus
gtggctttaacagtgagtggctgtc

SEQ ID NO: 512817 - DNA, 25 bp, Rattus norvegicus
gtggctttaacagtgtctgacccag

SEQ ID NO: 512818 - DNA, 25 bp, Rattus norvegicus
gtggctttattaacagacctggatc

SEQ ID NO: 512819 - DNA, 25 bp, Rattus norvegicus
gtggctttattatcagacctggatc

SEQ ID NO: 512820 - DNA, 25 bp, Rattus norvegicus
gtggctttcattctccttcctttga

SEQ ID NO: 512821 - DNA, 25 bp, Rattus norvegicus
gtggctttcattgtccttcctttga

SEQ ID NO: 512822 - DNA, 25 bp, Rattus norvegicus
gtggctttctacacagcttaaactt

SEQ ID NO: 512823 - DNA, 25 bp, Rattus norvegicus
gtggctttctactcagcttaaactt

SEQ ID NO: 512824 - DNA, 25 bp, Rattus norvegicus
gtggctttctgtcatagttgtgtcc

SEQ ID NO: 512825 - DNA, 25 bp, Rattus norvegicus
gtggctttctgtgatagttgtgtcc

SEQ ID NO: 512826 - DNA, 25 bp, Rattus norvegicus
gtggctttcttcaacagcaactacc

SEQ ID NO: 512827 - DNA, 25 bp, Rattus norvegicus
gtggctttcttctacagcaactacc

SEQ ID NO: 512828 - DNA, 25 bp, Rattus norvegicus
gtggctttgaaaaaactatggacct

SEQ ID NO: 512829 - DNA, 25 bp, Rattus norvegicus
gtggctttgaaataactatggacct

SEQ ID NO: 512830 - DNA, 25 bp, Rattus norvegicus
gtggctttgagaacttaaacctggt

SEQ ID NO: 512831 - DNA, 25 bp, Rattus norvegicus
gtggctttgagatcttaaacctggt

SEQ ID NO: 512832 - DNA, 25 bp, Rattus norvegicus
gtggctttgatcagggactacatgc

SEQ ID NO: 512833 - DNA, 25 bp, Rattus norvegicus
gtggctttgatctgggactacatgc

SEQ ID NO: 512834 - DNA, 25 bp, Rattus norvegicus
gtggctttgccaaaatacctccaac

SEQ ID NO: 512835 - DNA, 25 bp, Rattus norvegicus
gtggctttgccaccaacttgatatt

SEQ ID NO: 512836 - DNA, 25 bp, Rattus norvegicus
gtggctttgccagcaacttgatatt

SEQ ID NO: 512837 - DNA, 25 bp, Rattus norvegicus
gtggctttgccataatacctccaac

SEQ ID NO: 512838 - DNA, 25 bp, Rattus norvegicus
gtggctttgcctagtcatcagagaa

SEQ ID NO: 512839 - DNA, 25 bp, Rattus norvegicus
gtggctttgccttgtcatcagagaa

SEQ ID NO: 512840 - DNA, 25 bp, Rattus norvegicus
gtggctttggctacaagttctcaag

SEQ ID NO: 512841 - DNA, 25 bp, Rattus norvegicus
gtggctttggcttcaagttctcaag

SEQ ID NO: 512842 - DNA, 25 bp, Rattus norvegicus
gtggctttgtcacaaatgtcatccc

SEQ ID NO: 512843 - DNA, 25 bp, Rattus norvegicus
gtggctttgtcagaaatgtcatccc

SEQ ID NO: 512844 - DNA, 25 bp, Rattus norvegicus
gtggctttgttgatgtggcttaata

SEQ ID NO: 512845 - DNA, 25 bp, Rattus norvegicus
gtggctttgttgttgtggcttaata

SEQ ID NO: 512846 - DNA, 25 bp, Rattus norvegicus
gtggcttttaatactcacacttggg

SEQ ID NO: 512847 - DNA, 25 bp, Rattus norvegicus
gtggcttttaattctcacacttggg

SEQ ID NO: 512848 - DNA, 25 bp, Rattus norvegicus
gtggcttttcatctgttctttagat

SEQ ID NO: 512849 - DNA, 25 bp, Rattus norvegicus
gtggcttttcatgtgttctttagat

SEQ ID NO: 512850 - DNA, 25 bp, Rattus norvegicus
gtggcttttggcagaaacctgtgta

SEQ ID NO: 512851 - DNA, 25 bp, Rattus norvegicus
gtggcttttggctgaaacctgtgta

SEQ ID NO: 512852 - DNA, 25 bp, Rattus norvegicus
gtggcttttggtagtcccagtggaa

SEQ ID NO: 512853 - DNA, 25 bp, Rattus norvegicus
gtggcttttggttgtcccagtggaa

SEQ ID NO: 512854 - DNA, 25 bp, Rattus norvegicus
gtggctttttggaaaggctgctaat

SEQ ID NO: 512855 - DNA, 25 bp, Rattus norvegicus
gtggctttttggtaaggctgctaat

SEQ ID NO: 512856 - DNA, 25 bp, Rattus norvegicus
gtgggaaaactccagtcttgcggca

SEQ ID NO: 512857 - DNA, 25 bp, Rattus norvegicus
gtgggaaaactcgagtcttgcggca

SEQ ID NO: 512858 - DNA, 25 bp, Rattus norvegicus
gtgggaaaacttcatagattctatg

SEQ ID NO: 512859 - DNA, 25 bp, Rattus norvegicus
gtgggaaaacttgatagattctatg

SEQ ID NO: 512860 - DNA, 25 bp, Rattus norvegicus
gtgggaaaagctacatttgtagctc

SEQ ID NO: 512861 - DNA, 25 bp, Rattus norvegicus
gtgggaaaagcttcatttgtagctc

SEQ ID NO: 512862 - DNA, 25 bp, Rattus norvegicus
gtgggaaacagaacatggcatctct

SEQ ID NO: 512863 - DNA, 25 bp, Rattus norvegicus
gtgggaaacagatcatggcatctct

SEQ ID NO: 512864 - DNA, 25 bp, Rattus norvegicus
gtgggaaacccaagacatgagtctt

SEQ ID NO: 512865 - DNA, 25 bp, Rattus norvegicus
gtgggaaacccatgacatgagtctt

SEQ ID NO: 512866 - DNA, 25 bp, Rattus norvegicus
gtgggaaactgcattcagactctcc

SEQ ID NO: 512867 - DNA, 25 bp, Rattus norvegicus
gtgggaaactgctttcagactctcc

SEQ ID NO: 512868 - DNA, 25 bp, Rattus norvegicus
gtgggaaacttaactgcttgcatat

SEQ ID NO: 512869 - DNA, 25 bp, Rattus norvegicus
gtgggaaacttatctgcttgcatat

SEQ ID NO: 512870 - DNA, 25 bp, Rattus norvegicus
gtgggaaagcgtaccgaacctcctg

SEQ ID NO: 512871 - DNA, 25 bp, Rattus norvegicus
gtgggaaagcgttccgaacctcctg

SEQ ID NO: 512872 - DNA, 25 bp, Rattus norvegicus
gtgggaaagctcaaaaccactccct

SEQ ID NO: 512873 - DNA, 25 bp, Rattus norvegicus
gtgggaaagctcctcaagctcagta

SEQ ID NO: 512874 - DNA, 25 bp, Rattus norvegicus
gtgggaaagctcgtcaagctcagta

SEQ ID NO: 512875 - DNA, 25 bp, Rattus norvegicus
gtgggaaagctctaaaccactccct

SEQ ID NO: 512876 - DNA, 25 bp, Rattus norvegicus
gtgggaaaggagactctcatagcct

SEQ ID NO: 512877 - DNA, 25 bp, Rattus norvegicus
gtgggaaaggagtctctcatagcct

SEQ ID NO: 512878 - DNA, 25 bp, Rattus norvegicus
gtgggaaatcctatactcaatgttc

SEQ ID NO: 512879 - DNA, 25 bp, Rattus norvegicus
gtgggaaatcctttactcaatgttc

SEQ ID NO: 512880 - DNA, 25 bp, Rattus norvegicus
gtgggaacacgtctgccatgctaca

SEQ ID NO: 512881 - DNA, 25 bp, Rattus norvegicus
gtgggaacacgtgtgccatgctaca

SEQ ID NO: 512882 - DNA, 25 bp, Rattus norvegicus
gtgggaacactgcttgctgacttca

SEQ ID NO: 512883 - DNA, 25 bp, Rattus norvegicus
gtgggaacactggttgctgacttca

SEQ ID NO: 512884 - DNA, 25 bp, Rattus norvegicus
gtgggaacacttactcaattgaggt

SEQ ID NO: 512885 - DNA, 25 bp, Rattus norvegicus
gtgggaacactttctcaattgaggt

SEQ ID NO: 512886 - DNA, 25 bp, Rattus norvegicus
gtgggaacagaaacattatcattac

SEQ ID NO: 512887 - DNA, 25 bp, Rattus norvegicus
gtgggaacagaatcattatcattac

SEQ ID NO: 512888 - DNA, 25 bp, Rattus norvegicus
gtgggaacaggtagccttgcgctct

SEQ ID NO: 512889 - DNA, 25 bp, Rattus norvegicus
gtgggaacaggttgccttgcgctct

SEQ ID NO: 512890 - DNA, 25 bp, Rattus norvegicus
gtgggaaccaaaccaggtcacttct

SEQ ID NO: 512891 - DNA, 25 bp, Rattus norvegicus
gtgggaaccaaagcaggtcacttct

SEQ ID NO: 512892 - DNA, 25 bp, Rattus norvegicus
gtgggaaccactcgtacacgcacct

SEQ ID NO: 512893 - DNA, 25 bp, Rattus norvegicus
gtgggaaccactggtacacgcacct

SEQ ID NO: 512894 - DNA, 25 bp, Rattus norvegicus
gtgggaaccctgctattgcaaagtg

SEQ ID NO: 512895 - DNA, 25 bp, Rattus norvegicus
gtgggaaccctggtattgcaaagtg

SEQ ID NO: 512896 - DNA, 25 bp, Rattus norvegicus
gtgggaaccgcgacattccaaagtg

SEQ ID NO: 512897 - DNA, 25 bp, Rattus norvegicus
gtgggaaccgcgtcattccaaagtg

SEQ ID NO: 512898 - DNA, 25 bp, Rattus norvegicus
gtgggaacgttcaagtctttgacat

SEQ ID NO: 512899 - DNA, 25 bp, Rattus norvegicus
gtgggaacgttctagtctttgacat

SEQ ID NO: 512900 - DNA, 25 bp, Rattus norvegicus
gtgggaactcaaaacaaagcctatg

SEQ ID NO: 512901 - DNA, 25 bp, Rattus norvegicus
gtgggaactcaatacaaagcctatg

SEQ ID NO: 512902 - DNA, 25 bp, Rattus norvegicus
gtgggaactctgatgttaagctaag

SEQ ID NO: 512903 - DNA, 25 bp, Rattus norvegicus
gtgggaactctgttgttaagctaag

SEQ ID NO: 512904 - DNA, 25 bp, Rattus norvegicus
gtgggaactcttccaggctatctat

SEQ ID NO: 512905 - DNA, 25 bp, Rattus norvegicus
gtgggaactcttgcaggctatctat

SEQ ID NO: 512906 - DNA, 25 bp, Rattus norvegicus
gtgggaactgaactcttgtactgca

SEQ ID NO: 512907 - DNA, 25 bp, Rattus norvegicus
gtgggaactgaagtcttgtactgca

SEQ ID NO: 512908 - DNA, 25 bp, Rattus norvegicus
gtgggaacttacaacactcttctct

SEQ ID NO: 512909 - DNA, 25 bp, Rattus norvegicus
gtgggaacttactacactcttctct

SEQ ID NO: 512910 - DNA, 25 bp, Rattus norvegicus
gtgggaactttcctccattaatgta

SEQ ID NO: 512911 - DNA, 25 bp, Rattus norvegicus
gtgggaactttcgtccattaatgta

SEQ ID NO: 512912 - DNA, 25 bp, Rattus norvegicus
gtgggaagaaccaactctcataagt

SEQ ID NO: 512913 - DNA, 25 bp, Rattus norvegicus
gtgggaagaacctactctcataagt

SEQ ID NO: 512914 - DNA, 25 bp, Rattus norvegicus
gtgggaagacacaggaggctctcaa

SEQ ID NO: 512915 - DNA, 25 bp, Rattus norvegicus
gtgggaagacactggaggctctcaa

SEQ ID NO: 512916 - DNA, 25 bp, Rattus norvegicus
gtgggaagatggctcctctctatca

SEQ ID NO: 512917 - DNA, 25 bp, Rattus norvegicus
gtgggaagatgggtcctctctatca

SEQ ID NO: 512918 - DNA, 25 bp, Rattus norvegicus
gtgggaagcaaacagcccctgctga

SEQ ID NO: 512919 - DNA, 25 bp, Rattus norvegicus
gtgggaagcaaagagcccctgctga

SEQ ID NO: 512920 - DNA, 25 bp, Rattus norvegicus
gtgggaagcacacttatgtccgcag

SEQ ID NO: 512921 - DNA, 25 bp, Rattus norvegicus
gtgggaagcacagttatgtccgcag

SEQ ID NO: 512922 - DNA, 25 bp, Rattus norvegicus
gtgggaagccctctccatgaaggaa

SEQ ID NO: 512923 - DNA, 25 bp, Rattus norvegicus
gtgggaagccctgtccatgaaggaa

SEQ ID NO: 512924 - DNA, 25 bp, Rattus norvegicus
gtgggaagcctcacaaactcagcta

SEQ ID NO: 512925 - DNA, 25 bp, Rattus norvegicus
gtgggaagcctctcaaactcagcta

SEQ ID NO: 512926 - DNA, 25 bp, Rattus norvegicus
gtgggaagcctgagccagcagacac

SEQ ID NO: 512927 - DNA, 25 bp, Rattus norvegicus
gtgggaagcctgtgccagcagacac

SEQ ID NO: 512928 - DNA, 25 bp, Rattus norvegicus
gtgggaaggacgaggcgcgcctggc

SEQ ID NO: 512929 - DNA, 25 bp, Rattus norvegicus
gtgggaaggacgtggcgcgcctggc

SEQ ID NO: 512930 - DNA, 25 bp, Rattus norvegicus
gtgggaaggcacaagcctgttgtct

SEQ ID NO: 512931 - DNA, 25 bp, Rattus norvegicus
gtgggaaggcactagcctgttgtct

SEQ ID NO: 512932 - DNA, 25 bp, Rattus norvegicus
gtgggaagtcctactgagacccagg

SEQ ID NO: 512933 - DNA, 25 bp, Rattus norvegicus
gtgggaagtccttctgagacccagg

SEQ ID NO: 512934 - DNA, 25 bp, Rattus norvegicus
gtgggaataactcctgtccattcaa

SEQ ID NO: 512935 - DNA, 25 bp, Rattus norvegicus
gtgggaataactgctgtccattcaa

SEQ ID NO: 512936 - DNA, 25 bp, Rattus norvegicus
gtgggaatcacactcacatgacctg

SEQ ID NO: 512937 - DNA, 25 bp, Rattus norvegicus
gtgggaatcacagtcacatgacctg

SEQ ID NO: 512938 - DNA, 25 bp, Rattus norvegicus
gtgggaatcccaactcacatgttca

SEQ ID NO: 512939 - DNA, 25 bp, Rattus norvegicus
gtgggaatcccatctcacatgttca

SEQ ID NO: 512940 - DNA, 25 bp, Rattus norvegicus
gtgggaatctccatttggacacgat

SEQ ID NO: 512941 - DNA, 25 bp, Rattus norvegicus
gtgggaatctccttttggacacgat

SEQ ID NO: 512942 - DNA, 25 bp, Rattus norvegicus
gtgggaatctctctgaccagtgaga

SEQ ID NO: 512943 - DNA, 25 bp, Rattus norvegicus
gtgggaatctctgtgaccagtgaga

SEQ ID NO: 512944 - DNA, 25 bp, Rattus norvegicus
gtgggaatctgaaccgttgccgtct

SEQ ID NO: 512945 - DNA, 25 bp, Rattus norvegicus
gtgggaatctgatccgttgccgtct

SEQ ID NO: 512946 - DNA, 25 bp, Rattus norvegicus
gtgggaatctgtaaggcacctttct

SEQ ID NO: 512947 - DNA, 25 bp, Rattus norvegicus
gtgggaatctgttaggcacctttct

SEQ ID NO: 512948 - DNA, 25 bp, Rattus norvegicus
gtgggaatgccaacacctattcctg

SEQ ID NO: 512949 - DNA, 25 bp, Rattus norvegicus
gtgggaatgccatcacctattcctg

SEQ ID NO: 512950 - DNA, 25 bp, Rattus norvegicus
gtgggaatgttccatgcatcccttt

SEQ ID NO: 512951 - DNA, 25 bp, Rattus norvegicus
gtgggaatgttcgatgcatcccttt

SEQ ID NO: 512952 - DNA, 25 bp, Rattus norvegicus
gtgggaattctgaaacataaagcgg

SEQ ID NO: 512953 - DNA, 25 bp, Rattus norvegicus
gtgggaattctgtaacataaagcgg

SEQ ID NO: 512954 - DNA, 25 bp, Rattus norvegicus
gtgggaattgacacaatgccctcaa

SEQ ID NO: 512955 - DNA, 25 bp, Rattus norvegicus
gtgggaattgactcaatgccctcaa

SEQ ID NO: 512956 - DNA, 25 bp, Rattus norvegicus
gtgggacaaaatcgcgcctcatgca

SEQ ID NO: 512957 - DNA, 25 bp, Rattus norvegicus
gtgggacaaaatggcgcctcatgca

SEQ ID NO: 512958 - DNA, 25 bp, Rattus norvegicus
gtgggacaaacaatccccatgtggg

SEQ ID NO: 512959 - DNA, 25 bp, Rattus norvegicus
gtgggacaaacattccccatgtggg

SEQ ID NO: 512960 - DNA, 25 bp, Rattus norvegicus
gtgggacacagcatactcttagctt

SEQ ID NO: 512961 - DNA, 25 bp, Rattus norvegicus
gtgggacacagcttactcttagctt

SEQ ID NO: 512962 - DNA, 25 bp, Rattus norvegicus
gtgggacacattccatcacatggca

SEQ ID NO: 512963 - DNA, 25 bp, Rattus norvegicus
gtgggacacattgcatcacatggca

SEQ ID NO: 512964 - DNA, 25 bp, Rattus norvegicus
gtgggacacgcgcatacaagagatt

SEQ ID NO: 512965 - DNA, 25 bp, Rattus norvegicus
gtgggacacgcggatacaagagatt

SEQ ID NO: 512966 - DNA, 25 bp, Rattus norvegicus
gtgggacacggcagcggccctaaac

SEQ ID NO: 512967 - DNA, 25 bp, Rattus norvegicus
gtgggacacggctgcggccctaaac

SEQ ID NO: 512968 - DNA, 25 bp, Rattus norvegicus
gtgggacactatcgtgccctcgtga

SEQ ID NO: 512969 - DNA, 25 bp, Rattus norvegicus
gtgggacactatggtgccctcgtga

SEQ ID NO: 512970 - DNA, 25 bp, Rattus norvegicus
gtgggacagctcacacgtgtctgaa

SEQ ID NO: 512971 - DNA, 25 bp, Rattus norvegicus
gtgggacagctctcacgtgtctgaa

SEQ ID NO: 512972 - DNA, 25 bp, Rattus norvegicus
gtgggacagcttactgaatttgctt

SEQ ID NO: 512973 - DNA, 25 bp, Rattus norvegicus
gtgggacagctttctgaatttgctt

SEQ ID NO: 512974 - DNA, 25 bp, Rattus norvegicus
gtgggacagtctacgcaccaaagat

SEQ ID NO: 512975 - DNA, 25 bp, Rattus norvegicus
gtgggacagtcttcgcaccaaagat

SEQ ID NO: 512976 - DNA, 25 bp, Rattus norvegicus
gtgggacatcgaccagcctcggctc

SEQ ID NO: 512977 - DNA, 25 bp, Rattus norvegicus
gtgggacatcgagcagcctcggctc

SEQ ID NO: 512978 - DNA, 25 bp, Rattus norvegicus
gtgggacatttgctaccgagaacaa

SEQ ID NO: 512979 - DNA, 25 bp, Rattus norvegicus
gtgggacatttggtaccgagaacaa

SEQ ID NO: 512980 - DNA, 25 bp, Rattus norvegicus
gtgggaccacaccttatactgatgg

SEQ ID NO: 512981 - DNA, 25 bp, Rattus norvegicus
gtgggaccacacgttatactgatgg

SEQ ID NO: 512982 - DNA, 25 bp, Rattus norvegicus
gtgggaccaggaactctactattag

SEQ ID NO: 512983 - DNA, 25 bp, Rattus norvegicus
gtgggaccaggatctctactattag

SEQ ID NO: 512984 - DNA, 25 bp, Rattus norvegicus
gtgggaccatctctggaagccagta

SEQ ID NO: 512985 - DNA, 25 bp, Rattus norvegicus
gtgggaccatctgtggaagccagta

SEQ ID NO: 512986 - DNA, 25 bp, Rattus norvegicus
gtgggacccactccctgtggagaaa

SEQ ID NO: 512987 - DNA, 25 bp, Rattus norvegicus
gtgggacccactgcctgtggagaaa

SEQ ID NO: 512988 - DNA, 25 bp, Rattus norvegicus
gtgggaccctttactggctgacagc

SEQ ID NO: 512989 - DNA, 25 bp, Rattus norvegicus
gtgggacccttttctggctgacagc

SEQ ID NO: 512990 - DNA, 25 bp, Rattus norvegicus
gtgggacctagcactgaccagattt

SEQ ID NO: 512991 - DNA, 25 bp, Rattus norvegicus
gtgggacctagctctgaccagattt

SEQ ID NO: 512992 - DNA, 25 bp, Rattus norvegicus
gtgggacctctgagtctggctccat

SEQ ID NO: 512993 - DNA, 25 bp, Rattus norvegicus
gtgggacctctgtgtctggctccat

SEQ ID NO: 512994 - DNA, 25 bp, Rattus norvegicus
gtgggacctgtgatgttgatttata

SEQ ID NO: 512995 - DNA, 25 bp, Rattus norvegicus
gtgggacctgtgttgttgatttata

SEQ ID NO: 512996 - DNA, 25 bp, Rattus norvegicus
gtgggacctttcagtggacatacac

SEQ ID NO: 512997 - DNA, 25 bp, Rattus norvegicus
gtgggacctttctgtggacatacac

SEQ ID NO: 512998 - DNA, 25 bp, Rattus norvegicus
gtgggacgaataatttgatcttaat

SEQ ID NO: 512999 - DNA, 25 bp, Rattus norvegicus
gtgggacgaatattttgatcttaat

SEQ ID NO: 513000 - DNA, 25 bp, Rattus norvegicus
gtgggacgtgttcagcatatgtctt

SEQ ID NO: 513001 - DNA, 25 bp, Rattus norvegicus
gtgggacgtgttgagcatatgtctt

SEQ ID NO: 513002 - DNA, 25 bp, Rattus norvegicus
gtgggactaaaacgtctgacctcac

SEQ ID NO: 513003 - DNA, 25 bp, Rattus norvegicus
gtgggactaaaaggtctgacctcac

SEQ ID NO: 513004 - DNA, 25 bp, Rattus norvegicus
gtgggactaaatccttctagaacat

SEQ ID NO: 513005 - DNA, 25 bp, Rattus norvegicus
gtgggactaaatgcttctagaacat

SEQ ID NO: 513006 - DNA, 25 bp, Rattus norvegicus
gtgggactacaaatgggttgttcta

SEQ ID NO: 513007 - DNA, 25 bp, Rattus norvegicus
gtgggactacaattgggttgttcta

SEQ ID NO: 513008 - DNA, 25 bp, Rattus norvegicus
gtgggactagttaacctttcagccg

SEQ ID NO: 513009 - DNA, 25 bp, Rattus norvegicus
gtgggactagttcaatgccgtgtac

SEQ ID NO: 513010 - DNA, 25 bp, Rattus norvegicus
gtgggactagttgaatgccgtgtac

SEQ ID NO: 513011 - DNA, 25 bp, Rattus norvegicus
gtgggactagtttacctttcagccg

SEQ ID NO: 513012 - DNA, 25 bp, Rattus norvegicus
gtgggactatacacgtttgatcttt

SEQ ID NO: 513013 - DNA, 25 bp, Rattus norvegicus
gtgggactatactcgtttgatcttt

SEQ ID NO: 513014 - DNA, 25 bp, Rattus norvegicus
gtgggactcaaactcttcatcatct

SEQ ID NO: 513015 - DNA, 25 bp, Rattus norvegicus
gtgggactcaaagtcttcatcatct

SEQ ID NO: 513016 - DNA, 25 bp, Rattus norvegicus
gtgggactcaggaattaaactcagg

SEQ ID NO: 513017 - DNA, 25 bp, Rattus norvegicus
gtgggactcaggtattaaactcagg

SEQ ID NO: 513018 - DNA, 25 bp, Rattus norvegicus
gtgggactccgaagtttttatctct

SEQ ID NO: 513019 - DNA, 25 bp, Rattus norvegicus
gtgggactccgatgtttttatctct

SEQ ID NO: 513020 - DNA, 25 bp, Rattus norvegicus
gtgggactcgtgcaacaagctgaaa

SEQ ID NO: 513021 - DNA, 25 bp, Rattus norvegicus
gtgggactcgtggaacaagctgaaa

SEQ ID NO: 513022 - DNA, 25 bp, Rattus norvegicus
gtgggactctctcaatcatcttcat

SEQ ID NO: 513023 - DNA, 25 bp, Rattus norvegicus
gtgggactctctgaatcatcttcat

SEQ ID NO: 513024 - DNA, 25 bp, Rattus norvegicus
gtgggactctgtaacagcaacacaa

SEQ ID NO: 513025 - DNA, 25 bp, Rattus norvegicus
gtgggactctgttacagcaacacaa

SEQ ID NO: 513026 - DNA, 25 bp, Rattus norvegicus
gtgggactcttgcttctgtgagcct

SEQ ID NO: 513027 - DNA, 25 bp, Rattus norvegicus
gtgggactcttggttctgtgagcct

SEQ ID NO: 513028 - DNA, 25 bp, Rattus norvegicus
gtgggactgcttcacattcacagta

SEQ ID NO: 513029 - DNA, 25 bp, Rattus norvegicus
gtgggactgcttgacattcacagta

SEQ ID NO: 513030 - DNA, 25 bp, Rattus norvegicus
gtgggactggatcctaccaactgtt

SEQ ID NO: 513031 - DNA, 25 bp, Rattus norvegicus
gtgggactggatgctaccaactgtt

SEQ ID NO: 513032 - DNA, 25 bp, Rattus norvegicus
gtgggacttcatcagttaagacctt

SEQ ID NO: 513033 - DNA, 25 bp, Rattus norvegicus
gtgggacttcatgagttaagacctt

SEQ ID NO: 513034 - DNA, 25 bp, Rattus norvegicus
gtgggacttcctctcttcagaaata

SEQ ID NO: 513035 - DNA, 25 bp, Rattus norvegicus
gtgggacttcctgtcttcagaaata

SEQ ID NO: 513036 - DNA, 25 bp, Rattus norvegicus
gtgggacttgtcatggattgtcctg

SEQ ID NO: 513037 - DNA, 25 bp, Rattus norvegicus
gtgggacttgtcttggattgtcctg

SEQ ID NO: 513038 - DNA, 25 bp, Rattus norvegicus
gtgggacttgttcttgtgacttgaa

SEQ ID NO: 513039 - DNA, 25 bp, Rattus norvegicus
gtgggacttgttgttgtgacttgaa

SEQ ID NO: 513040 - DNA, 25 bp, Rattus norvegicus
gtgggactttggatacagtgattta

SEQ ID NO: 513041 - DNA, 25 bp, Rattus norvegicus
gtgggactttggttacagtgattta

SEQ ID NO: 513042 - DNA, 25 bp, Rattus norvegicus
gtgggagaatatagatcagcgattt

SEQ ID NO: 513043 - DNA, 25 bp, Rattus norvegicus
gtgggagaatattgatcagcgattt

SEQ ID NO: 513044 - DNA, 25 bp, Rattus norvegicus
gtgggagacccacggctcgaactct

SEQ ID NO: 513045 - DNA, 25 bp, Rattus norvegicus
gtgggagacccagggctcgaactct

SEQ ID NO: 513046 - DNA, 25 bp, Rattus norvegicus
gtgggagagacgaactgacagataa

SEQ ID NO: 513047 - DNA, 25 bp, Rattus norvegicus
gtgggagagacgtactgacagataa

SEQ ID NO: 513048 - DNA, 25 bp, Rattus norvegicus
gtgggagagtcaacttgtccagtgt

SEQ ID NO: 513049 - DNA, 25 bp, Rattus norvegicus
gtgggagagtcatcttgtccagtgt

SEQ ID NO: 513050 - DNA, 25 bp, Rattus norvegicus
gtgggagatcgcagcggtcaacact

SEQ ID NO: 513051 - DNA, 25 bp, Rattus norvegicus
gtgggagatcgctgcggtcaacact

SEQ ID NO: 513052 - DNA, 25 bp, Rattus norvegicus
gtgggagatgtaaatgcctgtgtat

SEQ ID NO: 513053 - DNA, 25 bp, Rattus norvegicus
gtgggagatgtatatgcctgtgtat

SEQ ID NO: 513054 - DNA, 25 bp, Rattus norvegicus
gtgggagatgtcacctaagcaacat

SEQ ID NO: 513055 - DNA, 25 bp, Rattus norvegicus
gtgggagatgtctcctaagcaacat

SEQ ID NO: 513056 - DNA, 25 bp, Rattus norvegicus
gtgggagatgttcctttttgtccca

SEQ ID NO: 513057 - DNA, 25 bp, Rattus norvegicus
gtgggagatgttgctttttgtccca

SEQ ID NO: 513058 - DNA, 25 bp, Rattus norvegicus
gtgggagcaacaaatccaggtataa

SEQ ID NO: 513059 - DNA, 25 bp, Rattus norvegicus
gtgggagcaacatatccaggtataa

SEQ ID NO: 513060 - DNA, 25 bp, Rattus norvegicus
gtgggagcagtgaccctgcaaactg

SEQ ID NO: 513061 - DNA, 25 bp, Rattus norvegicus
gtgggagcagtgtccctgcaaactg

SEQ ID NO: 513062 - DNA, 25 bp, Rattus norvegicus
gtgggagccactatagtctccattg

SEQ ID NO: 513063 - DNA, 25 bp, Rattus norvegicus
gtgggagccactattttgtacagag

SEQ ID NO: 513064 - DNA, 25 bp, Rattus norvegicus
gtgggagccactttagtctccattg

SEQ ID NO: 513065 - DNA, 25 bp, Rattus norvegicus
gtgggagccacttttttgtacagag

SEQ ID NO: 513066 - DNA, 25 bp, Rattus norvegicus
gtgggagccagaaacctgaccattt

SEQ ID NO: 513067 - DNA, 25 bp, Rattus norvegicus
gtgggagccagatacctgaccattt

SEQ ID NO: 513068 - DNA, 25 bp, Rattus norvegicus
gtgggagccccgaggctgcgatcac

SEQ ID NO: 513069 - DNA, 25 bp, Rattus norvegicus
gtgggagccccgtggctgcgatcac

SEQ ID NO: 513070 - DNA, 25 bp, Rattus norvegicus
gtgggagccgccatgttcagagact

SEQ ID NO: 513071 - DNA, 25 bp, Rattus norvegicus
gtgggagccgccttgttcagagact

SEQ ID NO: 513072 - DNA, 25 bp, Rattus norvegicus
gtgggagcctcaccctgtgtagatc

SEQ ID NO: 513073 - DNA, 25 bp, Rattus norvegicus
gtgggagcctcaccctgtgtagatt

SEQ ID NO: 513074 - DNA, 25 bp, Rattus norvegicus
gtgggagcctcagcctgtgtagatc

SEQ ID NO: 513075 - DNA, 25 bp, Rattus norvegicus
gtgggagcctcagcctgtgtagatt

SEQ ID NO: 513076 - DNA, 25 bp, Rattus norvegicus
gtgggagcctctagaccttgggcaa

SEQ ID NO: 513077 - DNA, 25 bp, Rattus norvegicus
gtgggagcctcttgaccttgggcaa

SEQ ID NO: 513078 - DNA, 25 bp, Rattus norvegicus
gtgggagctaatccagccaagccat

SEQ ID NO: 513079 - DNA, 25 bp, Rattus norvegicus
gtgggagctaatgcagccaagccat

SEQ ID NO: 513080 - DNA, 25 bp, Rattus norvegicus
gtgggagctcacatcatatttaaca

SEQ ID NO: 513081 - DNA, 25 bp, Rattus norvegicus
gtgggagctcacttcatatttaaca

SEQ ID NO: 513082 - DNA, 25 bp, Rattus norvegicus
gtgggagctcagacatctcaaaggt

SEQ ID NO: 513083 - DNA, 25 bp, Rattus norvegicus
gtgggagctcagtcatctcaaaggt

SEQ ID NO: 513084 - DNA, 25 bp, Rattus norvegicus
gtgggagctctcaaactagcagctg

SEQ ID NO: 513085 - DNA, 25 bp, Rattus norvegicus
gtgggagctctctaactagcagctg

SEQ ID NO: 513086 - DNA, 25 bp, Rattus norvegicus
gtgggagctgacactattacagttg

SEQ ID NO: 513087 - DNA, 25 bp, Rattus norvegicus
gtgggagctgactctattacagttg

SEQ ID NO: 513088 - DNA, 25 bp, Rattus norvegicus
gtgggagctgttcttcacaggcttc

SEQ ID NO: 513089 - DNA, 25 bp, Rattus norvegicus
gtgggagctgttgttcacaggcttc

SEQ ID NO: 513090 - DNA, 25 bp, Rattus norvegicus
gtgggagctttcaaatcgggccttt

SEQ ID NO: 513091 - DNA, 25 bp, Rattus norvegicus
gtgggagctttcagcaagacatcta

SEQ ID NO: 513092 - DNA, 25 bp, Rattus norvegicus
gtgggagctttctaatcgggccttt

SEQ ID NO: 513093 - DNA, 25 bp, Rattus norvegicus
gtgggagctttctgcaagacatcta

SEQ ID NO: 513094 - DNA, 25 bp, Rattus norvegicus
gtgggaggacacacgtactacgcca

SEQ ID NO: 513095 - DNA, 25 bp, Rattus norvegicus
gtgggaggacactcgtactacgcca

SEQ ID NO: 513096 - DNA, 25 bp, Rattus norvegicus
gtgggaggaccacacaaactctgga

SEQ ID NO: 513097 - DNA, 25 bp, Rattus norvegicus
gtgggaggaccagacaaactctgga

SEQ ID NO: 513098 - DNA, 25 bp, Rattus norvegicus
gtgggaggcacaatctcagaggcct

SEQ ID NO: 513099 - DNA, 25 bp, Rattus norvegicus
gtgggaggcacattctcagaggcct

SEQ ID NO: 513100 - DNA, 25 bp, Rattus norvegicus
gtgggaggcagaacgaaaacaaatc

SEQ ID NO: 513101 - DNA, 25 bp, Rattus norvegicus
gtgggaggcagatcgaaaacaaatc

SEQ ID NO: 513102 - DNA, 25 bp, Rattus norvegicus
gtgggaggccaaatgtctgaagaaa

SEQ ID NO: 513103 - DNA, 25 bp, Rattus norvegicus
gtgggaggccaactttttcatagta

SEQ ID NO: 513104 - DNA, 25 bp, Rattus norvegicus
gtgggaggccaagtttttcatagta

SEQ ID NO: 513105 - DNA, 25 bp, Rattus norvegicus
gtgggaggccaattgtctgaagaaa

SEQ ID NO: 513106 - DNA, 25 bp, Rattus norvegicus
gtgggaggccaccagcagccaattc

SEQ ID NO: 513107 - DNA, 25 bp, Rattus norvegicus
gtgggaggccacgagcagccaattc

SEQ ID NO: 513108 - DNA, 25 bp, Rattus norvegicus
gtgggaggcccacggctttgcctag

SEQ ID NO: 513109 - DNA, 25 bp, Rattus norvegicus
gtgggaggcccagggctttgcctag

SEQ ID NO: 513110 - DNA, 25 bp, Rattus norvegicus
gtgggaggctctaagtgagcacctt

SEQ ID NO: 513111 - DNA, 25 bp, Rattus norvegicus
gtgggaggctcttagtgagcacctt

SEQ ID NO: 513112 - DNA, 25 bp, Rattus norvegicus
gtgggaggcttcatgggatcatcac

SEQ ID NO: 513113 - DNA, 25 bp, Rattus norvegicus
gtgggaggcttcttgggatcatcac

SEQ ID NO: 513114 - DNA, 25 bp, Rattus norvegicus
gtgggagggctaatctctaaggcat

SEQ ID NO: 513115 - DNA, 25 bp, Rattus norvegicus
gtgggagggctattctctaaggcat

SEQ ID NO: 513116 - DNA, 25 bp, Rattus norvegicus
gtgggagggcttccttatccatcag

SEQ ID NO: 513117 - DNA, 25 bp, Rattus norvegicus
gtgggagggcttgcttatccatcag

SEQ ID NO: 513118 - DNA, 25 bp, Rattus norvegicus
gtgggaggttacaggcatttcaaaa

SEQ ID NO: 513119 - DNA, 25 bp, Rattus norvegicus
gtgggaggttactggcatttcaaaa

SEQ ID NO: 513120 - DNA, 25 bp, Rattus norvegicus
gtgggagtaacacgaggcatttttt

SEQ ID NO: 513121 - DNA, 25 bp, Rattus norvegicus
gtgggagtaacaggaggcatttttt

SEQ ID NO: 513122 - DNA, 25 bp, Rattus norvegicus
gtgggagtacttagcatgtttggtt

SEQ ID NO: 513123 - DNA, 25 bp, Rattus norvegicus
gtgggagtactttgcatgtttggtt

SEQ ID NO: 513124 - DNA, 25 bp, Rattus norvegicus
gtgggagtccagattcaactccaca

SEQ ID NO: 513125 - DNA, 25 bp, Rattus norvegicus
gtgggagtccagtttcaactccaca

SEQ ID NO: 513126 - DNA, 25 bp, Rattus norvegicus
gtgggagtccccaacagtaagccag

SEQ ID NO: 513127 - DNA, 25 bp, Rattus norvegicus
gtgggagtcccctacagtaagccag

SEQ ID NO: 513128 - DNA, 25 bp, Rattus norvegicus
gtgggagtcgtcagaaacatgcatg

SEQ ID NO: 513129 - DNA, 25 bp, Rattus norvegicus
gtgggagtcgtctgaaacatgcatg

SEQ ID NO: 513130 - DNA, 25 bp, Rattus norvegicus
gtgggagtgcaaacctgtacagtca

SEQ ID NO: 513131 - DNA, 25 bp, Rattus norvegicus
gtgggagtgcaatcctgtacagtca

SEQ ID NO: 513132 - DNA, 25 bp, Rattus norvegicus
gtgggagttcccagttaacaatgaa

SEQ ID NO: 513133 - DNA, 25 bp, Rattus norvegicus
gtgggagttccctgttaacaatgaa

SEQ ID NO: 513134 - DNA, 25 bp, Rattus norvegicus
gtgggagttctaaagttctgttgct

SEQ ID NO: 513135 - DNA, 25 bp, Rattus norvegicus
gtgggagttctatagttctgttgct

SEQ ID NO: 513136 - DNA, 25 bp, Rattus norvegicus
gtgggagtttctctcccaacatggg

SEQ ID NO: 513137 - DNA, 25 bp, Rattus norvegicus
gtgggagtttctgtcccaacatggg

SEQ ID NO: 513138 - DNA, 25 bp, Rattus norvegicus
gtgggataatcaccaccgtgggaaa

SEQ ID NO: 513139 - DNA, 25 bp, Rattus norvegicus
gtgggataatcagcaccgtgggaaa

SEQ ID NO: 513140 - DNA, 25 bp, Rattus norvegicus
gtgggatacagcctacttttcaacc

SEQ ID NO: 513141 - DNA, 25 bp, Rattus norvegicus
gtgggatacagcgtacttttcaacc

SEQ ID NO: 513142 - DNA, 25 bp, Rattus norvegicus
gtgggataccttcatcacacaagtc

SEQ ID NO: 513143 - DNA, 25 bp, Rattus norvegicus
gtgggataccttgatcacacaagtc

SEQ ID NO: 513144 - DNA, 25 bp, Rattus norvegicus
gtgggatacgccatgtccagcaggc

SEQ ID NO: 513145 - DNA, 25 bp, Rattus norvegicus
gtgggatacgccttgtccagcaggc

SEQ ID NO: 513146 - DNA, 25 bp, Rattus norvegicus
gtgggatacgtcatctgtgtaacta

SEQ ID NO: 513147 - DNA, 25 bp, Rattus norvegicus
gtgggatacgtcttctgtgtaacta

SEQ ID NO: 513148 - DNA, 25 bp, Rattus norvegicus
gtgggatacttcaaaaggagaacaa

SEQ ID NO: 513149 - DNA, 25 bp, Rattus norvegicus
gtgggatacttctaaaggagaacaa

SEQ ID NO: 513150 - DNA, 25 bp, Rattus norvegicus
gtgggatagggcattccattccctg

SEQ ID NO: 513151 - DNA, 25 bp, Rattus norvegicus
gtgggatagggctttccattccctg

SEQ ID NO: 513152 - DNA, 25 bp, Rattus norvegicus
gtgggatatctgactactgggtcat

SEQ ID NO: 513153 - DNA, 25 bp, Rattus norvegicus
gtgggatatctgtctactgggtcat

SEQ ID NO: 513154 - DNA, 25 bp, Rattus norvegicus
gtgggatcacatacctggaaccctc

SEQ ID NO: 513155 - DNA, 25 bp, Rattus norvegicus
gtgggatcacattcctggaaccctc

SEQ ID NO: 513156 - DNA, 25 bp, Rattus norvegicus
gtgggatcactgcaacagagcacct

SEQ ID NO: 513157 - DNA, 25 bp, Rattus norvegicus
gtgggatcactggaacagagcacct

SEQ ID NO: 513158 - DNA, 25 bp, Rattus norvegicus
gtgggatcagttcaggctccaaact

SEQ ID NO: 513159 - DNA, 25 bp, Rattus norvegicus
gtgggatcagttgaggctccaaact

SEQ ID NO: 513160 - DNA, 25 bp, Rattus norvegicus
gtgggatcccagcaatccgaggacc

SEQ ID NO: 513161 - DNA, 25 bp, Rattus norvegicus
gtgggatcccaggaatccgaggacc

SEQ ID NO: 513162 - DNA, 25 bp, Rattus norvegicus
gtgggatccctgaatcgtagtggcc

SEQ ID NO: 513163 - DNA, 25 bp, Rattus norvegicus
gtgggatccctgtatcgtagtggcc

SEQ ID NO: 513164 - DNA, 25 bp, Rattus norvegicus
gtgggatcgttcagttggcattacc

SEQ ID NO: 513165 - DNA, 25 bp, Rattus norvegicus
gtgggatcgttctgttggcattacc

SEQ ID NO: 513166 - DNA, 25 bp, Rattus norvegicus
gtgggatcttctaaaccgattctga

SEQ ID NO: 513167 - DNA, 25 bp, Rattus norvegicus
gtgggatcttcttaaccgattctga

SEQ ID NO: 513168 - DNA, 25 bp, Rattus norvegicus
gtgggatgaactcggtcagctccat

SEQ ID NO: 513169 - DNA, 25 bp, Rattus norvegicus
gtgggatgaactgggtcagctccat

SEQ ID NO: 513170 - DNA, 25 bp, Rattus norvegicus
gtgggatgaatcagccaagcacaat

SEQ ID NO: 513171 - DNA, 25 bp, Rattus norvegicus
gtgggatgaatctgccaagcacaat

SEQ ID NO: 513172 - DNA, 25 bp, Rattus norvegicus
gtgggatgacttattgaagcctgat

SEQ ID NO: 513173 - DNA, 25 bp, Rattus norvegicus
gtgggatgactttttgaagcctgat

SEQ ID NO: 513174 - DNA, 25 bp, Rattus norvegicus
gtgggatgagtcctgctgccccaac

SEQ ID NO: 513175 - DNA, 25 bp, Rattus norvegicus
gtgggatgagtcgtgctgccccaac

SEQ ID NO: 513176 - DNA, 25 bp, Rattus norvegicus
gtgggatgcagcagttcctaagcac

SEQ ID NO: 513177 - DNA, 25 bp, Rattus norvegicus
gtgggatgcagctgttcctaagcac

SEQ ID NO: 513178 - DNA, 25 bp, Rattus norvegicus
gtgggatgcatgactctgtatttat

SEQ ID NO: 513179 - DNA, 25 bp, Rattus norvegicus
gtgggatgcatgtctctgtatttat

SEQ ID NO: 513180 - DNA, 25 bp, Rattus norvegicus
gtgggatgcttcaaccaaaggacgt

SEQ ID NO: 513181 - DNA, 25 bp, Rattus norvegicus
gtgggatgcttctaccaaaggacgt

SEQ ID NO: 513182 - DNA, 25 bp, Rattus norvegicus
gtgggatgtctcacctgagattaca

SEQ ID NO: 513183 - DNA, 25 bp, Rattus norvegicus
gtgggatgtctctcctgagattaca

SEQ ID NO: 513184 - DNA, 25 bp, Rattus norvegicus
gtgggatgtctgagacactcattta

SEQ ID NO: 513185 - DNA, 25 bp, Rattus norvegicus
gtgggatgtctgtgacactcattta

SEQ ID NO: 513186 - DNA, 25 bp, Rattus norvegicus
gtgggattaagcagcagtctacaaa

SEQ ID NO: 513187 - DNA, 25 bp, Rattus norvegicus
gtgggattaagctgcagtctacaaa

SEQ ID NO: 513188 - DNA, 25 bp, Rattus norvegicus
gtgggattaagtctccttctgtacc

SEQ ID NO: 513189 - DNA, 25 bp, Rattus norvegicus
gtgggattaagtgtccttctgtacc

SEQ ID NO: 513190 - DNA, 25 bp, Rattus norvegicus
gtgggattacacatgctctcataat

SEQ ID NO: 513191 - DNA, 25 bp, Rattus norvegicus
gtgggattacacttgctctcataat

SEQ ID NO: 513192 - DNA, 25 bp, Rattus norvegicus
gtgggattaccccactgccgctgtc

SEQ ID NO: 513193 - DNA, 25 bp, Rattus norvegicus
gtgggattacccgactgccgctgtc

SEQ ID NO: 513194 - DNA, 25 bp, Rattus norvegicus
gtgggattataacctgctaacatta

SEQ ID NO: 513195 - DNA, 25 bp, Rattus norvegicus
gtgggattataagctgctaacatta

SEQ ID NO: 513196 - DNA, 25 bp, Rattus norvegicus
gtgggattcagcacaattgctcagt

SEQ ID NO: 513197 - DNA, 25 bp, Rattus norvegicus
gtgggattcagctcaattgctcagt

SEQ ID NO: 513198 - DNA, 25 bp, Rattus norvegicus
gtgggattcatgcacctgtgtattc

SEQ ID NO: 513199 - DNA, 25 bp, Rattus norvegicus
gtgggattcatggacctgtgtattc

SEQ ID NO: 513200 - DNA, 25 bp, Rattus norvegicus
gtgggattggccctttgcgacactc

SEQ ID NO: 513201 - DNA, 25 bp, Rattus norvegicus
gtgggattggccgtttgcgacactc

SEQ ID NO: 513202 - DNA, 25 bp, Rattus norvegicus
gtgggattgtctccggctattatga

SEQ ID NO: 513203 - DNA, 25 bp, Rattus norvegicus
gtgggattgtctgcggctattatga

SEQ ID NO: 513204 - DNA, 25 bp, Rattus norvegicus
gtgggattttctctacaatggctag

SEQ ID NO: 513205 - DNA, 25 bp, Rattus norvegicus
gtgggattttctgtacaatggctag

SEQ ID NO: 513206 - DNA, 25 bp, Rattus norvegicus
gtgggcaaaagcaccgaatacttgt

SEQ ID NO: 513207 - DNA, 25 bp, Rattus norvegicus
gtgggcaaaagctccgaatacttgt

SEQ ID NO: 513208 - DNA, 25 bp, Rattus norvegicus
gtgggcaaactacattttcttcatt

SEQ ID NO: 513209 - DNA, 25 bp, Rattus norvegicus
gtgggcaaactagattttcttcatt

SEQ ID NO: 513210 - DNA, 25 bp, Rattus norvegicus
gtgggcaaagtgctacacatgtcct

SEQ ID NO: 513211 - DNA, 25 bp, Rattus norvegicus
gtgggcaaagtggtacacatgtcct

SEQ ID NO: 513212 - DNA, 25 bp, Rattus norvegicus
gtgggcaacatcacttaatttcaac

SEQ ID NO: 513213 - DNA, 25 bp, Rattus norvegicus
gtgggcaacatctcttaatttcaac

SEQ ID NO: 513214 - DNA, 25 bp, Rattus norvegicus
gtgggcaaccaaaacctgaactcgc

SEQ ID NO: 513215 - DNA, 25 bp, Rattus norvegicus
gtgggcaaccaatacctgaactcgc

SEQ ID NO: 513216 - DNA, 25 bp, Rattus norvegicus
gtgggcaactccaaagagcaccttc

SEQ ID NO: 513217 - DNA, 25 bp, Rattus norvegicus
gtgggcaactcctaagagcaccttc

SEQ ID NO: 513218 - DNA, 25 bp, Rattus norvegicus
gtgggcaacttgctgcagtgtcata

SEQ ID NO: 513219 - DNA, 25 bp, Rattus norvegicus
gtgggcaacttggtgcagtgtcata

SEQ ID NO: 513220 - DNA, 25 bp, Rattus norvegicus
gtgggcaactttaccttctgaagtc

SEQ ID NO: 513221 - DNA, 25 bp, Rattus norvegicus
gtgggcaacttttccttctgaagtc

SEQ ID NO: 513222 - DNA, 25 bp, Rattus norvegicus
gtgggcaagacgactcaggtcacgc

SEQ ID NO: 513223 - DNA, 25 bp, Rattus norvegicus
gtgggcaagacgtctcaggtcacgc

SEQ ID NO: 513224 - DNA, 25 bp, Rattus norvegicus
gtgggcaagcctctgcttgatacat

SEQ ID NO: 513225 - DNA, 25 bp, Rattus norvegicus
gtgggcaagcctgtgcttgatacat

SEQ ID NO: 513226 - DNA, 25 bp, Rattus norvegicus
gtgggcaaggcgaggctcacacaaa

SEQ ID NO: 513227 - DNA, 25 bp, Rattus norvegicus
gtgggcaaggcgtggctcacacaaa

SEQ ID NO: 513228 - DNA, 25 bp, Rattus norvegicus
gtgggcacaaacataacctaagtca

SEQ ID NO: 513229 - DNA, 25 bp, Rattus norvegicus
gtgggcacaaacatcagaggactct

SEQ ID NO: 513230 - DNA, 25 bp, Rattus norvegicus
gtgggcacaaacttaacctaagtca

SEQ ID NO: 513231 - DNA, 25 bp, Rattus norvegicus
gtgggcacaaacttcagaggactct

SEQ ID NO: 513232 - DNA, 25 bp, Rattus norvegicus
gtgggcacaagtcctctagtcatga

SEQ ID NO: 513233 - DNA, 25 bp, Rattus norvegicus
gtgggcacaagtgctctagtcatga

SEQ ID NO: 513234 - DNA, 25 bp, Rattus norvegicus
gtgggcacacagacatgccgcagaa

SEQ ID NO: 513235 - DNA, 25 bp, Rattus norvegicus
gtgggcacacagtcatgccgcagaa

SEQ ID NO: 513236 - DNA, 25 bp, Rattus norvegicus
gtgggcacagacagaggctccagaa

SEQ ID NO: 513237 - DNA, 25 bp, Rattus norvegicus
gtgggcacagactgaggctccagaa

SEQ ID NO: 513238 - DNA, 25 bp, Rattus norvegicus
gtgggcacatttccccactgctggt

SEQ ID NO: 513239 - DNA, 25 bp, Rattus norvegicus
gtgggcacatttgcccactgctggt

SEQ ID NO: 513240 - DNA, 25 bp, Rattus norvegicus
gtgggcaccaagactcgaaggcagc

SEQ ID NO: 513241 - DNA, 25 bp, Rattus norvegicus
gtgggcaccaagtctcgaaggcagc

SEQ ID NO: 513242 - DNA, 25 bp, Rattus norvegicus
gtgggcaccatcattgacagtggcc

SEQ ID NO: 513243 - DNA, 25 bp, Rattus norvegicus
gtgggcaccatctttgacagtggcc

SEQ ID NO: 513244 - DNA, 25 bp, Rattus norvegicus
gtgggcaccatgatgacctgtgcgt

SEQ ID NO: 513245 - DNA, 25 bp, Rattus norvegicus
gtgggcaccatgttgacctgtgcgt

SEQ ID NO: 513246 - DNA, 25 bp, Rattus norvegicus
gtgggcacccataggttacctaatc

SEQ ID NO: 513247 - DNA, 25 bp, Rattus norvegicus
gtgggcacccattggttacctaatc

SEQ ID NO: 513248 - DNA, 25 bp, Rattus norvegicus
gtgggcacctcaacaactatggcgt

SEQ ID NO: 513249 - DNA, 25 bp, Rattus norvegicus
gtgggcacctcatcaactatggcgt

SEQ ID NO: 513250 - DNA, 25 bp, Rattus norvegicus
gtgggcacctctacaaagggtcttt

SEQ ID NO: 513251 - DNA, 25 bp, Rattus norvegicus
gtgggcacctcttcaaagggtcttt

SEQ ID NO: 513252 - DNA, 25 bp, Rattus norvegicus
gtgggcacctgacttatgcaactca

SEQ ID NO: 513253 - DNA, 25 bp, Rattus norvegicus
gtgggcacctgagttatgcaactca

SEQ ID NO: 513254 - DNA, 25 bp, Rattus norvegicus
gtgggcaccttcatggtgcgcgaca

SEQ ID NO: 513255 - DNA, 25 bp, Rattus norvegicus
gtgggcaccttcttggtgcgcgaca

SEQ ID NO: 513256 - DNA, 25 bp, Rattus norvegicus
gtgggcactagaactcctgaaattt

SEQ ID NO: 513257 - DNA, 25 bp, Rattus norvegicus
gtgggcactagatctcctgaaattt

SEQ ID NO: 513258 - DNA, 25 bp, Rattus norvegicus
gtgggcactgcgctcgtgcacattc

SEQ ID NO: 513259 - DNA, 25 bp, Rattus norvegicus
gtgggcactgcggtcgtgcacattc

SEQ ID NO: 513260 - DNA, 25 bp, Rattus norvegicus
gtgggcactgggataacgctaggcg

SEQ ID NO: 513261 - DNA, 25 bp, Rattus norvegicus
gtgggcactgggttaacgctaggcg

SEQ ID NO: 513262 - DNA, 25 bp, Rattus norvegicus
gtgggcacttacatagcttgttctc

SEQ ID NO: 513263 - DNA, 25 bp, Rattus norvegicus
gtgggcacttacttagcttgttctc

SEQ ID NO: 513264 - DNA, 25 bp, Rattus norvegicus
gtgggcacttatattatcctcttct

SEQ ID NO: 513265 - DNA, 25 bp, Rattus norvegicus
gtgggcacttattttatcctcttct

SEQ ID NO: 513266 - DNA, 25 bp, Rattus norvegicus
gtgggcagactcacgacatttagat

SEQ ID NO: 513267 - DNA, 25 bp, Rattus norvegicus
gtgggcagactctcgacatttagat

SEQ ID NO: 513268 - DNA, 25 bp, Rattus norvegicus
gtgggcagagacaggcaaactataa

SEQ ID NO: 513269 - DNA, 25 bp, Rattus norvegicus
gtgggcagagactggcaaactataa

SEQ ID NO: 513270 - DNA, 25 bp, Rattus norvegicus
gtgggcagcacacaacttctcctgt

SEQ ID NO: 513271 - DNA, 25 bp, Rattus norvegicus
gtgggcagcacagaacttctcctgt

SEQ ID NO: 513272 - DNA, 25 bp, Rattus norvegicus
gtgggcagccagacagtatgttgta

SEQ ID NO: 513273 - DNA, 25 bp, Rattus norvegicus
gtgggcagccagtcagtatgttgta

SEQ ID NO: 513274 - DNA, 25 bp, Rattus norvegicus
gtgggcagccctatgaagtgctcat

SEQ ID NO: 513275 - DNA, 25 bp, Rattus norvegicus
gtgggcagccctttgaagtgctcat

SEQ ID NO: 513276 - DNA, 25 bp, Rattus norvegicus
gtgggcagcctgatgagaagtctca

SEQ ID NO: 513277 - DNA, 25 bp, Rattus norvegicus
gtgggcagcctgttgagaagtctca

SEQ ID NO: 513278 - DNA, 25 bp, Rattus norvegicus
gtgggcagctacatctacgacaagg

SEQ ID NO: 513279 - DNA, 25 bp, Rattus norvegicus
gtgggcagctacttctacgacaagg

SEQ ID NO: 513280 - DNA, 25 bp, Rattus norvegicus
gtgggcagctttaatcaatatcagt

SEQ ID NO: 513281 - DNA, 25 bp, Rattus norvegicus
gtgggcagcttttatcaatatcagt

SEQ ID NO: 513282 - DNA, 25 bp, Rattus norvegicus
gtgggcagggctaagacgtcaacat

SEQ ID NO: 513283 - DNA, 25 bp, Rattus norvegicus
gtgggcagggcttagacgtcaacat

SEQ ID NO: 513284 - DNA, 25 bp, Rattus norvegicus
gtgggcagtcccatcagagagacca

SEQ ID NO: 513285 - DNA, 25 bp, Rattus norvegicus
gtgggcagtcccttcagagagacca

SEQ ID NO: 513286 - DNA, 25 bp, Rattus norvegicus
gtgggcagtctcatcctgggatata

SEQ ID NO: 513287 - DNA, 25 bp, Rattus norvegicus
gtgggcagtctcttcctgggatata

SEQ ID NO: 513288 - DNA, 25 bp, Rattus norvegicus
gtgggcagtgctcctcccgtgtcca

SEQ ID NO: 513289 - DNA, 25 bp, Rattus norvegicus
gtgggcagtgctgctcccgtgtcca

SEQ ID NO: 513290 - DNA, 25 bp, Rattus norvegicus
gtgggcagtggcattagaaattctc

SEQ ID NO: 513291 - DNA, 25 bp, Rattus norvegicus
gtgggcagtggctttagaaattctc

SEQ ID NO: 513292 - DNA, 25 bp, Rattus norvegicus
gtgggcagtgttaacagccctcgac

SEQ ID NO: 513293 - DNA, 25 bp, Rattus norvegicus
gtgggcagtgttaagcaccctggca

SEQ ID NO: 513294 - DNA, 25 bp, Rattus norvegicus
gtgggcagtgtttacagccctcgac

SEQ ID NO: 513295 - DNA, 25 bp, Rattus norvegicus
gtgggcagtgtttagcaccctggca

SEQ ID NO: 513296 - DNA, 25 bp, Rattus norvegicus
gtgggcagttggatttttcccccat

SEQ ID NO: 513297 - DNA, 25 bp, Rattus norvegicus
gtgggcagttggttttttcccccat

SEQ ID NO: 513298 - DNA, 25 bp, Rattus norvegicus
gtgggcagttgtcttacgcctttat

SEQ ID NO: 513299 - DNA, 25 bp, Rattus norvegicus
gtgggcagttgtgttacgcctttat

SEQ ID NO: 513300 - DNA, 25 bp, Rattus norvegicus
gtgggcatacagagaatcctttgat

SEQ ID NO: 513301 - DNA, 25 bp, Rattus norvegicus
gtgggcatacagtgaatcctttgat

SEQ ID NO: 513302 - DNA, 25 bp, Rattus norvegicus
gtgggcatagacactgacagttaac

SEQ ID NO: 513303 - DNA, 25 bp, Rattus norvegicus
gtgggcatagactctgacagttaac

SEQ ID NO: 513304 - DNA, 25 bp, Rattus norvegicus
gtgggcatcactacaggcatgtgga

SEQ ID NO: 513305 - DNA, 25 bp, Rattus norvegicus
gtgggcatcactaccaaagacaact

SEQ ID NO: 513306 - DNA, 25 bp, Rattus norvegicus
gtgggcatcacttcaggcatgtgga

SEQ ID NO: 513307 - DNA, 25 bp, Rattus norvegicus
gtgggcatcacttccaaagacaact

SEQ ID NO: 513308 - DNA, 25 bp, Rattus norvegicus
gtgggcatcagacatacttatggtg

SEQ ID NO: 513309 - DNA, 25 bp, Rattus norvegicus
gtgggcatcagagatacttatggtg

SEQ ID NO: 513310 - DNA, 25 bp, Rattus norvegicus
gtgggcatccagcttggacacatta

SEQ ID NO: 513311 - DNA, 25 bp, Rattus norvegicus
gtgggcatccaggttggacacatta

SEQ ID NO: 513312 - DNA, 25 bp, Rattus norvegicus
gtgggcatccatatagcttcaggta

SEQ ID NO: 513313 - DNA, 25 bp, Rattus norvegicus
gtgggcatccatttagcttcaggta

SEQ ID NO: 513314 - DNA, 25 bp, Rattus norvegicus
gtgggcatccttcgattgagatcta

SEQ ID NO: 513315 - DNA, 25 bp, Rattus norvegicus
gtgggcatccttggattgagatcta

SEQ ID NO: 513316 - DNA, 25 bp, Rattus norvegicus
gtgggcatcgctcccttctgtctgg

SEQ ID NO: 513317 - DNA, 25 bp, Rattus norvegicus
gtgggcatcgctgccttctgtctgg

SEQ ID NO: 513318 - DNA, 25 bp, Rattus norvegicus
gtgggcatctctcgcctatgagaca

SEQ ID NO: 513319 - DNA, 25 bp, Rattus norvegicus
gtgggcatctctggcctatgagaca

SEQ ID NO: 513320 - DNA, 25 bp, Rattus norvegicus
gtgggcatctgtatttccaaagtgc

SEQ ID NO: 513321 - DNA, 25 bp, Rattus norvegicus
gtgggcatctgtttttccaaagtgc

SEQ ID NO: 513322 - DNA, 25 bp, Rattus norvegicus
gtgggcatcttgagaccgtgaacct

SEQ ID NO: 513323 - DNA, 25 bp, Rattus norvegicus
gtgggcatcttgtgaccgtgaacct

SEQ ID NO: 513324 - DNA, 25 bp, Rattus norvegicus
gtgggcatgaaaacacctgcacaga

SEQ ID NO: 513325 - DNA, 25 bp, Rattus norvegicus
gtgggcatgaaatcacctgcacaga

SEQ ID NO: 513326 - DNA, 25 bp, Rattus norvegicus
gtgggcatgactattgaaacatcaa

SEQ ID NO: 513327 - DNA, 25 bp, Rattus norvegicus
gtgggcatgacttttgaaacatcaa

SEQ ID NO: 513328 - DNA, 25 bp, Rattus norvegicus
gtgggcatgatccacctcacggaat

SEQ ID NO: 513329 - DNA, 25 bp, Rattus norvegicus
gtgggcatgatcgacctcacggaat

SEQ ID NO: 513330 - DNA, 25 bp, Rattus norvegicus
gtgggcatggaaagactcaaaactt

SEQ ID NO: 513331 - DNA, 25 bp, Rattus norvegicus
gtgggcatggaatgactcaaaactt

SEQ ID NO: 513332 - DNA, 25 bp, Rattus norvegicus
gtgggcatggacataacaccctcat

SEQ ID NO: 513333 - DNA, 25 bp, Rattus norvegicus
gtgggcatggacttaacaccctcat

SEQ ID NO: 513334 - DNA, 25 bp, Rattus norvegicus
gtgggcatgggtatctattctgaca

SEQ ID NO: 513335 - DNA, 25 bp, Rattus norvegicus
gtgggcatgggtttctattctgaca

SEQ ID NO: 513336 - DNA, 25 bp, Rattus norvegicus
gtgggcatgtccatttttcgtaaaa

SEQ ID NO: 513337 - DNA, 25 bp, Rattus norvegicus
gtgggcatgtccttttttcgtaaaa

SEQ ID NO: 513338 - DNA, 25 bp, Rattus norvegicus
gtgggcatgttgatggcttccaatc

SEQ ID NO: 513339 - DNA, 25 bp, Rattus norvegicus
gtgggcatgttgttggcttccaatc

SEQ ID NO: 513340 - DNA, 25 bp, Rattus norvegicus
gtgggcattcttcatacttctagtt

SEQ ID NO: 513341 - DNA, 25 bp, Rattus norvegicus
gtgggcattcttgatacttctagtt

SEQ ID NO: 513342 - DNA, 25 bp, Rattus norvegicus
gtgggcattgctcctgatctggaac

SEQ ID NO: 513343 - DNA, 25 bp, Rattus norvegicus
gtgggcattgctgctgatctggaac

SEQ ID NO: 513344 - DNA, 25 bp, Rattus norvegicus
gtgggcattgggagtactgatctac

SEQ ID NO: 513345 - DNA, 25 bp, Rattus norvegicus
gtgggcattgggtgtactgatctac

SEQ ID NO: 513346 - DNA, 25 bp, Rattus norvegicus
gtgggcatttacaccaatatttact

SEQ ID NO: 513347 - DNA, 25 bp, Rattus norvegicus
gtgggcatttacactgttttacagc

SEQ ID NO: 513348 - DNA, 25 bp, Rattus norvegicus
gtgggcatttactccaatatttact

SEQ ID NO: 513349 - DNA, 25 bp, Rattus norvegicus
gtgggcatttactctgttttacagc

SEQ ID NO: 513350 - DNA, 25 bp, Rattus norvegicus
gtgggcatttatacattcctgatta

SEQ ID NO: 513351 - DNA, 25 bp, Rattus norvegicus
gtgggcatttattcattcctgatta

SEQ ID NO: 513352 - DNA, 25 bp, Rattus norvegicus
gtgggccaaacaccatgctttgagc

SEQ ID NO: 513353 - DNA, 25 bp, Rattus norvegicus
gtgggccaaacagcatgctttgagc

SEQ ID NO: 513354 - DNA, 25 bp, Rattus norvegicus
gtgggccaacacaatatctgtaaca

SEQ ID NO: 513355 - DNA, 25 bp, Rattus norvegicus
gtgggccaacactatatctgtaaca

SEQ ID NO: 513356 - DNA, 25 bp, Rattus norvegicus
gtgggccaagccatcaacgaattaa

SEQ ID NO: 513357 - DNA, 25 bp, Rattus norvegicus
gtgggccaagccttcaacgaattaa

SEQ ID NO: 513358 - DNA, 25 bp, Rattus norvegicus
gtgggccaagtgagactgttcctga

SEQ ID NO: 513359 - DNA, 25 bp, Rattus norvegicus
gtgggccaagtgcaaaccggaattc

SEQ ID NO: 513360 - DNA, 25 bp, Rattus norvegicus
gtgggccaagtggaaaccggaattc

SEQ ID NO: 513361 - DNA, 25 bp, Rattus norvegicus
gtgggccaagtgtgactgttcctga

SEQ ID NO: 513362 - DNA, 25 bp, Rattus norvegicus
gtgggccaatatccagacttatcta

SEQ ID NO: 513363 - DNA, 25 bp, Rattus norvegicus
gtgggccaatatgcagacttatcta

SEQ ID NO: 513364 - DNA, 25 bp, Rattus norvegicus
gtgggccacaaaagatgcgcgtcct

SEQ ID NO: 513365 - DNA, 25 bp, Rattus norvegicus
gtgggccacaaatgatgcgcgtcct

SEQ ID NO: 513366 - DNA, 25 bp, Rattus norvegicus
gtgggccacagaccaagtgactact

SEQ ID NO: 513367 - DNA, 25 bp, Rattus norvegicus
gtgggccacagagcaagtgactact

SEQ ID NO: 513368 - DNA, 25 bp, Rattus norvegicus
gtgggccaccctcagcacaaaggaa

SEQ ID NO: 513369 - DNA, 25 bp, Rattus norvegicus
gtgggccaccctgagcacaaaggaa

SEQ ID NO: 513370 - DNA, 25 bp, Rattus norvegicus
gtgggccacctgagcagcaagcata

SEQ ID NO: 513371 - DNA, 25 bp, Rattus norvegicus
gtgggccacctgtgcagcaagcata

SEQ ID NO: 513372 - DNA, 25 bp, Rattus norvegicus
gtgggccagccgattgaccatcatg

SEQ ID NO: 513373 - DNA, 25 bp, Rattus norvegicus
gtgggccagccgtttgaccatcatg

SEQ ID NO: 513374 - DNA, 25 bp, Rattus norvegicus
gtgggccaggctctcactgtgaaat

SEQ ID NO: 513375 - DNA, 25 bp, Rattus norvegicus
gtgggccaggctgtcactgtgaaat

SEQ ID NO: 513376 - DNA, 25 bp, Rattus norvegicus
gtgggccagtacctactgtatggct

SEQ ID NO: 513377 - DNA, 25 bp, Rattus norvegicus
gtgggccagtacgtactgtatggct

SEQ ID NO: 513378 - DNA, 25 bp, Rattus norvegicus
gtgggccataaaatccctgccgtga

SEQ ID NO: 513379 - DNA, 25 bp, Rattus norvegicus
gtgggccataaattccctgccgtga

SEQ ID NO: 513380 - DNA, 25 bp, Rattus norvegicus
gtgggccataatatctggtgcatct

SEQ ID NO: 513381 - DNA, 25 bp, Rattus norvegicus
gtgggccataatttctggtgcatct

SEQ ID NO: 513382 - DNA, 25 bp, Rattus norvegicus
gtgggccatttacaactttgcgtac

SEQ ID NO: 513383 - DNA, 25 bp, Rattus norvegicus
gtgggccatttagaactttgcgtac

SEQ ID NO: 513384 - DNA, 25 bp, Rattus norvegicus
gtgggccattttatggtgtgtgcat

SEQ ID NO: 513385 - DNA, 25 bp, Rattus norvegicus
gtgggccattttttggtgtgtgcat

SEQ ID NO: 513386 - DNA, 25 bp, Rattus norvegicus
gtgggcccacatacagcaccaagga

SEQ ID NO: 513387 - DNA, 25 bp, Rattus norvegicus
gtgggcccacattcagcaccaagga

SEQ ID NO: 513388 - DNA, 25 bp, Rattus norvegicus
gtgggcccatgcacttggaacaaaa

SEQ ID NO: 513389 - DNA, 25 bp, Rattus norvegicus
gtgggcccatgctcttggaacaaaa

SEQ ID NO: 513390 - DNA, 25 bp, Rattus norvegicus
gtgggcccctgaacattctagcaga

SEQ ID NO: 513391 - DNA, 25 bp, Rattus norvegicus
gtgggcccctgatcattctagcaga

SEQ ID NO: 513392 - DNA, 25 bp, Rattus norvegicus
gtgggccctgaacacatgacgctat

SEQ ID NO: 513393 - DNA, 25 bp, Rattus norvegicus
gtgggccctgaagacatgacgctat

SEQ ID NO: 513394 - DNA, 25 bp, Rattus norvegicus
gtgggccctgttcttgtgaagtcca

SEQ ID NO: 513395 - DNA, 25 bp, Rattus norvegicus
gtgggccctgttgttgtgaagtcca

SEQ ID NO: 513396 - DNA, 25 bp, Rattus norvegicus
gtgggcccttccaggaatgaccaaa

SEQ ID NO: 513397 - DNA, 25 bp, Rattus norvegicus
gtgggcccttcctggaatgaccaaa

SEQ ID NO: 513398 - DNA, 25 bp, Rattus norvegicus
gtgggccgggatcgagcagcgcgtc

SEQ ID NO: 513399 - DNA, 25 bp, Rattus norvegicus
gtgggccgggatggagcagcgcgtc

SEQ ID NO: 513400 - DNA, 25 bp, Rattus norvegicus
gtgggcctaactaggtaatgtactg

SEQ ID NO: 513401 - DNA, 25 bp, Rattus norvegicus
gtgggcctaacttggtaatgtactg

SEQ ID NO: 513402 - DNA, 25 bp, Rattus norvegicus
gtgggcctcaagactgacctagtga

SEQ ID NO: 513403 - DNA, 25 bp, Rattus norvegicus
gtgggcctcaagtctgacctagtga

SEQ ID NO: 513404 - DNA, 25 bp, Rattus norvegicus
gtgggcctcaatacgaatactgtaa

SEQ ID NO: 513405 - DNA, 25 bp, Rattus norvegicus
gtgggcctcaattcgaatactgtaa

SEQ ID NO: 513406 - DNA, 25 bp, Rattus norvegicus
gtgggcctcagcattaaggttgttt

SEQ ID NO: 513407 - DNA, 25 bp, Rattus norvegicus
gtgggcctcagctttaaggttgttt

SEQ ID NO: 513408 - DNA, 25 bp, Rattus norvegicus
gtgggcctcagtatatgagaagctc

SEQ ID NO: 513409 - DNA, 25 bp, Rattus norvegicus
gtgggcctcagtttatgagaagctc

SEQ ID NO: 513410 - DNA, 25 bp, Rattus norvegicus
gtgggcctcttacacactgtggaag

SEQ ID NO: 513411 - DNA, 25 bp, Rattus norvegicus
gtgggcctcttagacactgtggaag

SEQ ID NO: 513412 - DNA, 25 bp, Rattus norvegicus
gtgggcctgattaataatcccctcc

SEQ ID NO: 513413 - DNA, 25 bp, Rattus norvegicus
gtgggcctgatttataatcccctcc

SEQ ID NO: 513414 - DNA, 25 bp, Rattus norvegicus
gtgggcctgcagaactgagcacaga

SEQ ID NO: 513415 - DNA, 25 bp, Rattus norvegicus
gtgggcctgcagtactgagcacaga

SEQ ID NO: 513416 - DNA, 25 bp, Rattus norvegicus
gtgggcctgggaccatcgtggagat

SEQ ID NO: 513417 - DNA, 25 bp, Rattus norvegicus
gtgggcctgggagcatcgtggagat

SEQ ID NO: 513418 - DNA, 25 bp, Rattus norvegicus
gtgggcctggtaccacatgtctgtc

SEQ ID NO: 513419 - DNA, 25 bp, Rattus norvegicus
gtgggcctggtagcacatgtctgtc

SEQ ID NO: 513420 - DNA, 25 bp, Rattus norvegicus
gtgggccttgtgagaccagttacaa

SEQ ID NO: 513421 - DNA, 25 bp, Rattus norvegicus
gtgggccttgtgtgaccagttacaa

SEQ ID NO: 513422 - DNA, 25 bp, Rattus norvegicus
gtgggcctttgaaatcacagcagaa

SEQ ID NO: 513423 - DNA, 25 bp, Rattus norvegicus
gtgggcctttgatatcacagcagaa

SEQ ID NO: 513424 - DNA, 25 bp, Rattus norvegicus
gtgggcgacactatcaatacagcat

SEQ ID NO: 513425 - DNA, 25 bp, Rattus norvegicus
gtgggcgacactttcaatacagcat

SEQ ID NO: 513426 - DNA, 25 bp, Rattus norvegicus
gtgggcgacgctatgaacgtccatt

SEQ ID NO: 513427 - DNA, 25 bp, Rattus norvegicus
gtgggcgacgctttgaacgtccatt

SEQ ID NO: 513428 - DNA, 25 bp, Rattus norvegicus
gtgggcgcaagtacacataccgctt

SEQ ID NO: 513429 - DNA, 25 bp, Rattus norvegicus
gtgggcgcaagttcacataccgctt

SEQ ID NO: 513430 - DNA, 25 bp, Rattus norvegicus
gtgggcgcacccaaggagctcagaa

SEQ ID NO: 513431 - DNA, 25 bp, Rattus norvegicus
gtgggcgcaccctaggagctcagaa

SEQ ID NO: 513432 - DNA, 25 bp, Rattus norvegicus
gtgggcgcccatattttgaaatgca

SEQ ID NO: 513433 - DNA, 25 bp, Rattus norvegicus
gtgggcgcccattttttgaaatgca

SEQ ID NO: 513434 - DNA, 25 bp, Rattus norvegicus
gtgggcgcctttcatacttttaacg

SEQ ID NO: 513435 - DNA, 25 bp, Rattus norvegicus
gtgggcgcctttgatacttttaacg

SEQ ID NO: 513436 - DNA, 25 bp, Rattus norvegicus
gtgggcgcgggccgctccaagagcc

SEQ ID NO: 513437 - DNA, 25 bp, Rattus norvegicus
gtgggcgcgggcggctccaagagcc

SEQ ID NO: 513438 - DNA, 25 bp, Rattus norvegicus
gtgggcggcagacatgtcttttcct

SEQ ID NO: 513439 - DNA, 25 bp, Rattus norvegicus
gtgggcggcagagatgtcttttcct

SEQ ID NO: 513440 - DNA, 25 bp, Rattus norvegicus
gtgggcggcgccctcgggcggctac

SEQ ID NO: 513441 - DNA, 25 bp, Rattus norvegicus
gtgggcggcgccgtcgggcggctac

SEQ ID NO: 513442 - DNA, 25 bp, Rattus norvegicus
gtgggcgtagccacagtactgtcat

SEQ ID NO: 513443 - DNA, 25 bp, Rattus norvegicus
gtgggcgtagcctcagtactgtcat

SEQ ID NO: 513444 - DNA, 25 bp, Rattus norvegicus
gtgggcgtccatacttatcaactaa

SEQ ID NO: 513445 - DNA, 25 bp, Rattus norvegicus
gtgggcgtccatagacactattgtt

SEQ ID NO: 513446 - DNA, 25 bp, Rattus norvegicus
gtgggcgtccattcttatcaactaa

SEQ ID NO: 513447 - DNA, 25 bp, Rattus norvegicus
gtgggcgtccattgacactattgtt

SEQ ID NO: 513448 - DNA, 25 bp, Rattus norvegicus
gtgggcgtgaatacatgcagactca

SEQ ID NO: 513449 - DNA, 25 bp, Rattus norvegicus
gtgggcgtgaattcatgcagactca

SEQ ID NO: 513450 - DNA, 25 bp, Rattus norvegicus
gtgggcgtgagacttgtattcttaa

SEQ ID NO: 513451 - DNA, 25 bp, Rattus norvegicus
gtgggcgtgagagttgtattcttaa

SEQ ID NO: 513452 - DNA, 25 bp, Rattus norvegicus
gtgggcgtggcacctcataaagaca

SEQ ID NO: 513453 - DNA, 25 bp, Rattus norvegicus
gtgggcgtggcagctcataaagaca

SEQ ID NO: 513454 - DNA, 25 bp, Rattus norvegicus
gtgggctaacctagaatcttgactt

SEQ ID NO: 513455 - DNA, 25 bp, Rattus norvegicus
gtgggctaaccttgaatcttgactt

SEQ ID NO: 513456 - DNA, 25 bp, Rattus norvegicus
gtgggctaactgagtgcctgctgaa

SEQ ID NO: 513457 - DNA, 25 bp, Rattus norvegicus
gtgggctaactgtgtgcctgctgaa

SEQ ID NO: 513458 - DNA, 25 bp, Rattus norvegicus
gtgggctaagacagcctccctcagg

SEQ ID NO: 513459 - DNA, 25 bp, Rattus norvegicus
gtgggctaagactgcctccctcagg

SEQ ID NO: 513460 - DNA, 25 bp, Rattus norvegicus
gtgggctaagccagctactgtgaga

SEQ ID NO: 513461 - DNA, 25 bp, Rattus norvegicus
gtgggctaagcctgctactgtgaga

SEQ ID NO: 513462 - DNA, 25 bp, Rattus norvegicus
gtgggctaaggaagctgccatcacc

SEQ ID NO: 513463 - DNA, 25 bp, Rattus norvegicus
gtgggctaaggatgctgccatcacc

SEQ ID NO: 513464 - DNA, 25 bp, Rattus norvegicus
gtgggctaccacagagaatactaca

SEQ ID NO: 513465 - DNA, 25 bp, Rattus norvegicus
gtgggctaccactgagaatactaca

SEQ ID NO: 513466 - DNA, 25 bp, Rattus norvegicus
gtgggctacgccatagactacaatg

SEQ ID NO: 513467 - DNA, 25 bp, Rattus norvegicus
gtgggctacgccttagactacaatg

SEQ ID NO: 513468 - DNA, 25 bp, Rattus norvegicus
gtgggctactgtacatactgttttt

SEQ ID NO: 513469 - DNA, 25 bp, Rattus norvegicus
gtgggctactgttcatactgttttt

SEQ ID NO: 513470 - DNA, 25 bp, Rattus norvegicus
gtgggctagccacactggatcccaa

SEQ ID NO: 513471 - DNA, 25 bp, Rattus norvegicus
gtgggctagccagactggatcccaa

SEQ ID NO: 513472 - DNA, 25 bp, Rattus norvegicus
gtgggctatcacatctgaagaacgt

SEQ ID NO: 513473 - DNA, 25 bp, Rattus norvegicus
gtgggctatcacttctgaagaacgt

SEQ ID NO: 513474 - DNA, 25 bp, Rattus norvegicus
gtgggctcaagcagtggctaaactc

SEQ ID NO: 513475 - DNA, 25 bp, Rattus norvegicus
gtgggctcaagctgtggctaaactc

SEQ ID NO: 513476 - DNA, 25 bp, Rattus norvegicus
gtgggctcacaacaaagactgcgca

SEQ ID NO: 513477 - DNA, 25 bp, Rattus norvegicus
gtgggctcacaagaaagactgcgca

SEQ ID NO: 513478 - DNA, 25 bp, Rattus norvegicus
gtgggctcagcactcatcataggtt

SEQ ID NO: 513479 - DNA, 25 bp, Rattus norvegicus
gtgggctcagcagtcatcataggtt

SEQ ID NO: 513480 - DNA, 25 bp, Rattus norvegicus
gtgggctcaggtcccttaagcaaga

SEQ ID NO: 513481 - DNA, 25 bp, Rattus norvegicus
gtgggctcaggtgccttaagcaaga

SEQ ID NO: 513482 - DNA, 25 bp, Rattus norvegicus
gtgggctcagtgaacgtgcgcttca

SEQ ID NO: 513483 - DNA, 25 bp, Rattus norvegicus
gtgggctcagtgtacgtgcgcttca

SEQ ID NO: 513484 - DNA, 25 bp, Rattus norvegicus
gtgggctcataaagcggcctcctaa

SEQ ID NO: 513485 - DNA, 25 bp, Rattus norvegicus
gtgggctcataatgcggcctcctaa

SEQ ID NO: 513486 - DNA, 25 bp, Rattus norvegicus
gtgggctccagcattactagatctg

SEQ ID NO: 513487 - DNA, 25 bp, Rattus norvegicus
gtgggctccagctttactagatctg

SEQ ID NO: 513488 - DNA, 25 bp, Rattus norvegicus
gtgggctccagtcataccttttgtt

SEQ ID NO: 513489 - DNA, 25 bp, Rattus norvegicus
gtgggctccagtgataccttttgtt

SEQ ID NO: 513490 - DNA, 25 bp, Rattus norvegicus
gtgggctccatgatgttagggacaa

SEQ ID NO: 513491 - DNA, 25 bp, Rattus norvegicus
gtgggctccatgattctgtgacaac

SEQ ID NO: 513492 - DNA, 25 bp, Rattus norvegicus
gtgggctccatgttgttagggacaa

SEQ ID NO: 513493 - DNA, 25 bp, Rattus norvegicus
gtgggctccatgtttctgtgacaac

SEQ ID NO: 513494 - DNA, 25 bp, Rattus norvegicus
gtgggctcgggacagactttctata

SEQ ID NO: 513495 - DNA, 25 bp, Rattus norvegicus
gtgggctcgggagagactttctata

SEQ ID NO: 513496 - DNA, 25 bp, Rattus norvegicus
gtgggctcggtacctaatgtctttg

SEQ ID NO: 513497 - DNA, 25 bp, Rattus norvegicus
gtgggctcggtagctaatgtctttg

SEQ ID NO: 513498 - DNA, 25 bp, Rattus norvegicus
gtgggctctagcatggccatggaca

SEQ ID NO: 513499 - DNA, 25 bp, Rattus norvegicus
gtgggctctagcttggccatggaca

SEQ ID NO: 513500 - DNA, 25 bp, Rattus norvegicus
gtgggctctcacagtatgtgttcaa

SEQ ID NO: 513501 - DNA, 25 bp, Rattus norvegicus
gtgggctctcactgtatgtgttcaa

SEQ ID NO: 513502 - DNA, 25 bp, Rattus norvegicus
gtgggctctcttctacatagttgga

SEQ ID NO: 513503 - DNA, 25 bp, Rattus norvegicus
gtgggctctcttgtacatagttgga

SEQ ID NO: 513504 - DNA, 25 bp, Rattus norvegicus
gtgggctctggcaaccaaggtaagc

SEQ ID NO: 513505 - DNA, 25 bp, Rattus norvegicus
gtgggctctggctaccaaggtaagc

SEQ ID NO: 513506 - DNA, 25 bp, Rattus norvegicus
gtgggctcttcaacagtggtcagca

SEQ ID NO: 513507 - DNA, 25 bp, Rattus norvegicus
gtgggctcttcatcagtggtcagca

SEQ ID NO: 513508 - DNA, 25 bp, Rattus norvegicus
gtgggctgactgcacaaatcggcca

SEQ ID NO: 513509 - DNA, 25 bp, Rattus norvegicus
gtgggctgactgcagctaaacttca

SEQ ID NO: 513510 - DNA, 25 bp, Rattus norvegicus
gtgggctgactggacaaatcggcca

SEQ ID NO: 513511 - DNA, 25 bp, Rattus norvegicus
gtgggctgactggagctaaacttca

SEQ ID NO: 513512 - DNA, 25 bp, Rattus norvegicus
gtgggctgagacacctcgaacagac

SEQ ID NO: 513513 - DNA, 25 bp, Rattus norvegicus
gtgggctgagactcctcgaacagac

SEQ ID NO: 513514 - DNA, 25 bp, Rattus norvegicus
gtgggctgagccaccttgaggacta

SEQ ID NO: 513515 - DNA, 25 bp, Rattus norvegicus
gtgggctgagcctccttgaggacta

SEQ ID NO: 513516 - DNA, 25 bp, Rattus norvegicus
gtgggctgagtaattggcacaactc

SEQ ID NO: 513517 - DNA, 25 bp, Rattus norvegicus
gtgggctgagtatttggcacaactc

SEQ ID NO: 513518 - DNA, 25 bp, Rattus norvegicus
gtgggctgcagcagattcacagtca

SEQ ID NO: 513519 - DNA, 25 bp, Rattus norvegicus
gtgggctgcagctgattcacagtca

SEQ ID NO: 513520 - DNA, 25 bp, Rattus norvegicus
gtgggctgggtccttccatgtcaat

SEQ ID NO: 513521 - DNA, 25 bp, Rattus norvegicus
gtgggctgggtcgttccatgtcaat

SEQ ID NO: 513522 - DNA, 25 bp, Rattus norvegicus
gtgggctgggttcagaacaccaaca

SEQ ID NO: 513523 - DNA, 25 bp, Rattus norvegicus
gtgggctgggttgagaacaccaaca

SEQ ID NO: 513524 - DNA, 25 bp, Rattus norvegicus
gtgggctgtacgacggccagacaca

SEQ ID NO: 513525 - DNA, 25 bp, Rattus norvegicus
gtgggctgtacgtcggccagacaca

SEQ ID NO: 513526 - DNA, 25 bp, Rattus norvegicus
gtgggctgtggcagatcccgcacct

SEQ ID NO: 513527 - DNA, 25 bp, Rattus norvegicus
gtgggctgtggctgatcccgcacct

SEQ ID NO: 513528 - DNA, 25 bp, Rattus norvegicus
gtgggcttaattacctgccatccag

SEQ ID NO: 513529 - DNA, 25 bp, Rattus norvegicus
gtgggcttaatttcctgccatccag

SEQ ID NO: 513530 - DNA, 25 bp, Rattus norvegicus
gtgggcttatagacaacttttatgc

SEQ ID NO: 513531 - DNA, 25 bp, Rattus norvegicus
gtgggcttatagtcaacttttatgc

SEQ ID NO: 513532 - DNA, 25 bp, Rattus norvegicus
gtgggcttcagacttaaggctgaca

SEQ ID NO: 513533 - DNA, 25 bp, Rattus norvegicus
gtgggcttcagagttaaggctgaca

SEQ ID NO: 513534 - DNA, 25 bp, Rattus norvegicus
gtgggcttcagtatcgggaccagaa

SEQ ID NO: 513535 - DNA, 25 bp, Rattus norvegicus
gtgggcttcagtttcgggaccagaa

SEQ ID NO: 513536 - DNA, 25 bp, Rattus norvegicus
gtgggcttcatcaccctgaaaagga

SEQ ID NO: 513537 - DNA, 25 bp, Rattus norvegicus
gtgggcttcatctccctgaaaagga

SEQ ID NO: 513538 - DNA, 25 bp, Rattus norvegicus
gtgggcttcctcagatgggtttaca

SEQ ID NO: 513539 - DNA, 25 bp, Rattus norvegicus
gtgggcttcctctgatgggtttaca

SEQ ID NO: 513540 - DNA, 25 bp, Rattus norvegicus
gtgggcttcttccaaaacctcttca

SEQ ID NO: 513541 - DNA, 25 bp, Rattus norvegicus
gtgggcttcttcgaaaacctcttca

SEQ ID NO: 513542 - DNA, 25 bp, Rattus norvegicus
gtgggcttgctcatattttgaattt

SEQ ID NO: 513543 - DNA, 25 bp, Rattus norvegicus
gtgggcttgctcttattttgaattt

SEQ ID NO: 513544 - DNA, 25 bp, Rattus norvegicus
gtgggcttggttctatacatctcta

SEQ ID NO: 513545 - DNA, 25 bp, Rattus norvegicus
gtgggcttggttgtatacatctcta

SEQ ID NO: 513546 - DNA, 25 bp, Rattus norvegicus
gtgggcttgttaaccatcgctgcta

SEQ ID NO: 513547 - DNA, 25 bp, Rattus norvegicus
gtgggcttgttatccatcgctgcta

SEQ ID NO: 513548 - DNA, 25 bp, Rattus norvegicus
gtgggctttagactcaggatgtaca

SEQ ID NO: 513549 - DNA, 25 bp, Rattus norvegicus
gtgggctttagagtcaggatgtaca

SEQ ID NO: 513550 - DNA, 25 bp, Rattus norvegicus
gtgggctttccacgtgcatcacaag

SEQ ID NO: 513551 - DNA, 25 bp, Rattus norvegicus
gtgggctttccaggtgcatcacaag

SEQ ID NO: 513552 - DNA, 25 bp, Rattus norvegicus
gtgggctttgatatgctggagttac

SEQ ID NO: 513553 - DNA, 25 bp, Rattus norvegicus
gtgggctttgatttgctggagttac

SEQ ID NO: 513554 - DNA, 25 bp, Rattus norvegicus
gtgggctttgctagaagatttcatc

SEQ ID NO: 513555 - DNA, 25 bp, Rattus norvegicus
gtgggctttgcttgaagatttcatc

SEQ ID NO: 513556 - DNA, 25 bp, Rattus norvegicus
gtgggcttttacactaaactgtgtt

SEQ ID NO: 513557 - DNA, 25 bp, Rattus norvegicus
gtgggcttttactctaaactgtgtt

SEQ ID NO: 513558 - DNA, 25 bp, Rattus norvegicus
gtggggactgggacaacctttatgt

SEQ ID NO: 513559 - DNA, 25 bp, Rattus norvegicus
gtggggactgggtcaacctttatgt

SEQ ID NO: 513560 - DNA, 25 bp, Rattus norvegicus
gtgggtaaaacgaccttgctgcagc

SEQ ID NO: 513561 - DNA, 25 bp, Rattus norvegicus
gtgggtaaaacgtccttgctgcagc

SEQ ID NO: 513562 - DNA, 25 bp, Rattus norvegicus
gtgggtaaaatcacttaagcgacgt

SEQ ID NO: 513563 - DNA, 25 bp, Rattus norvegicus
gtgggtaaaatctcttaagcgacgt

SEQ ID NO: 513564 - DNA, 25 bp, Rattus norvegicus
gtgggtaaacaaaacttttctgcca

SEQ ID NO: 513565 - DNA, 25 bp, Rattus norvegicus
gtgggtaaacaatacttttctgcca

SEQ ID NO: 513566 - DNA, 25 bp, Rattus norvegicus
gtgggtaacagcacttgctgtgtgt

SEQ ID NO: 513567 - DNA, 25 bp, Rattus norvegicus
gtgggtaacagctcttgctgtgtgt

SEQ ID NO: 513568 - DNA, 25 bp, Rattus norvegicus
gtgggtaaccaccagcggaatgtct

SEQ ID NO: 513569 - DNA, 25 bp, Rattus norvegicus
gtgggtaaccacgagcggaatgtct

SEQ ID NO: 513570 - DNA, 25 bp, Rattus norvegicus
gtgggtaaccagatttcctttgcag

SEQ ID NO: 513571 - DNA, 25 bp, Rattus norvegicus
gtgggtaaccagttttcctttgcag

SEQ ID NO: 513572 - DNA, 25 bp, Rattus norvegicus
gtgggtaacccactcatttaaccag

SEQ ID NO: 513573 - DNA, 25 bp, Rattus norvegicus
gtgggtaacccagtcatttaaccag

SEQ ID NO: 513574 - DNA, 25 bp, Rattus norvegicus
gtgggtaaccccagacaagcacaga

SEQ ID NO: 513575 - DNA, 25 bp, Rattus norvegicus
gtgggtaacccctgacaagcacaga

SEQ ID NO: 513576 - DNA, 25 bp, Rattus norvegicus
gtgggtaactatataggccagtctt

SEQ ID NO: 513577 - DNA, 25 bp, Rattus norvegicus
gtgggtaactatttaggccagtctt

SEQ ID NO: 513578 - DNA, 25 bp, Rattus norvegicus
gtgggtaagagccaagcactgctaa

SEQ ID NO: 513579 - DNA, 25 bp, Rattus norvegicus
gtgggtaagagcgaagcactgctaa

SEQ ID NO: 513580 - DNA, 25 bp, Rattus norvegicus
gtgggtaatgccatagtgctattta

SEQ ID NO: 513581 - DNA, 25 bp, Rattus norvegicus
gtgggtaatgccttagtgctattta

SEQ ID NO: 513582 - DNA, 25 bp, Rattus norvegicus
gtgggtaattgcagactcctgagtt

SEQ ID NO: 513583 - DNA, 25 bp, Rattus norvegicus
gtgggtaattgctgactcctgagtt

SEQ ID NO: 513584 - DNA, 25 bp, Rattus norvegicus
gtgggtacacatcctcttatcaaac

SEQ ID NO: 513585 - DNA, 25 bp, Rattus norvegicus
gtgggtacacatgctcttatcaaac

SEQ ID NO: 513586 - DNA, 25 bp, Rattus norvegicus
gtgggtacagagactcatccctgtg

SEQ ID NO: 513587 - DNA, 25 bp, Rattus norvegicus
gtgggtacagagtctcatccctgtg

SEQ ID NO: 513588 - DNA, 25 bp, Rattus norvegicus
gtgggtaccggcaggatctcagtcc

SEQ ID NO: 513589 - DNA, 25 bp, Rattus norvegicus
gtgggtaccggctggatctcagtcc

SEQ ID NO: 513590 - DNA, 25 bp, Rattus norvegicus
gtgggtactcatcgttaagtgactt

SEQ ID NO: 513591 - DNA, 25 bp, Rattus norvegicus
gtgggtactcatggttaagtgactt

SEQ ID NO: 513592 - DNA, 25 bp, Rattus norvegicus
gtgggtactgtgaactgaacttgga

SEQ ID NO: 513593 - DNA, 25 bp, Rattus norvegicus
gtgggtactgtgtactgaacttgga

SEQ ID NO: 513594 - DNA, 25 bp, Rattus norvegicus
gtgggtactttaagacagggctgcc

SEQ ID NO: 513595 - DNA, 25 bp, Rattus norvegicus
gtgggtactttatgacagggctgcc

SEQ ID NO: 513596 - DNA, 25 bp, Rattus norvegicus
gtgggtagcgctccctgtcctttca

SEQ ID NO: 513597 - DNA, 25 bp, Rattus norvegicus
gtgggtagcgctgcctgtcctttca

SEQ ID NO: 513598 - DNA, 25 bp, Rattus norvegicus
gtgggtaggcctactggtccattcc

SEQ ID NO: 513599 - DNA, 25 bp, Rattus norvegicus
gtgggtaggcctcgctcctccacga

SEQ ID NO: 513600 - DNA, 25 bp, Rattus norvegicus
gtgggtaggcctggctcctccacga

SEQ ID NO: 513601 - DNA, 25 bp, Rattus norvegicus
gtgggtaggccttctggtccattcc

SEQ ID NO: 513602 - DNA, 25 bp, Rattus norvegicus
gtgggtagtatcattccctacgcag

SEQ ID NO: 513603 - DNA, 25 bp, Rattus norvegicus
gtgggtagtatctttccctacgcag

SEQ ID NO: 513604 - DNA, 25 bp, Rattus norvegicus
gtgggtagtccccacttctgcagaa

SEQ ID NO: 513605 - DNA, 25 bp, Rattus norvegicus
gtgggtagtcccgacttctgcagaa

SEQ ID NO: 513606 - DNA, 25 bp, Rattus norvegicus
gtgggtatacatacataggtctttg

SEQ ID NO: 513607 - DNA, 25 bp, Rattus norvegicus
gtgggtatacattcataggtctttg

SEQ ID NO: 513608 - DNA, 25 bp, Rattus norvegicus
gtgggtatagtgagactcctttaaa

SEQ ID NO: 513609 - DNA, 25 bp, Rattus norvegicus
gtgggtatagtgtgactcctttaaa

SEQ ID NO: 513610 - DNA, 25 bp, Rattus norvegicus
gtgggtatccctctgacgaggtagg

SEQ ID NO: 513611 - DNA, 25 bp, Rattus norvegicus
gtgggtatccctgtgacgaggtagg

SEQ ID NO: 513612 - DNA, 25 bp, Rattus norvegicus
gtgggtatctgaacacctacacaca

SEQ ID NO: 513613 - DNA, 25 bp, Rattus norvegicus
gtgggtatctgatcacctacacaca

SEQ ID NO: 513614 - DNA, 25 bp, Rattus norvegicus
gtgggtattctcaattttgtaacat

SEQ ID NO: 513615 - DNA, 25 bp, Rattus norvegicus
gtgggtattctctattttgtaacat

SEQ ID NO: 513616 - DNA, 25 bp, Rattus norvegicus
gtgggtatttctcttttgacacaga

SEQ ID NO: 513617 - DNA, 25 bp, Rattus norvegicus
gtgggtatttctgttttgacacaga

SEQ ID NO: 513618 - DNA, 25 bp, Rattus norvegicus
gtgggtattttcaaagcccatccct

SEQ ID NO: 513619 - DNA, 25 bp, Rattus norvegicus
gtgggtattttctaagcccatccct

SEQ ID NO: 513620 - DNA, 25 bp, Rattus norvegicus
gtgggtcacacgcttatgtagtaga

SEQ ID NO: 513621 - DNA, 25 bp, Rattus norvegicus
gtgggtcacacggttatgtagtaga

SEQ ID NO: 513622 - DNA, 25 bp, Rattus norvegicus
gtgggtcacatcatgtgtgtgtcag

SEQ ID NO: 513623 - DNA, 25 bp, Rattus norvegicus
gtgggtcacatcttgtgtgtgtcag

SEQ ID NO: 513624 - DNA, 25 bp, Rattus norvegicus
gtgggtcatagtcataccttctgat

SEQ ID NO: 513625 - DNA, 25 bp, Rattus norvegicus
gtgggtcatagtgataccttctgat

SEQ ID NO: 513626 - DNA, 25 bp, Rattus norvegicus
gtgggtcatctaaaagttaacaacg

SEQ ID NO: 513627 - DNA, 25 bp, Rattus norvegicus
gtgggtcatctataagttaacaacg

SEQ ID NO: 513628 - DNA, 25 bp, Rattus norvegicus
gtgggtccaaagactcacatctgtt

SEQ ID NO: 513629 - DNA, 25 bp, Rattus norvegicus
gtgggtccaaagatagcatcatgat

SEQ ID NO: 513630 - DNA, 25 bp, Rattus norvegicus
gtgggtccaaagtctcacatctgtt

SEQ ID NO: 513631 - DNA, 25 bp, Rattus norvegicus
gtgggtccaaagttagcatcatgat

SEQ ID NO: 513632 - DNA, 25 bp, Rattus norvegicus
gtgggtccaagcaaatgcgcctgac

SEQ ID NO: 513633 - DNA, 25 bp, Rattus norvegicus
gtgggtccaagctaatgcgcctgac

SEQ ID NO: 513634 - DNA, 25 bp, Rattus norvegicus
gtgggtccaggaaacatgcaaatac

SEQ ID NO: 513635 - DNA, 25 bp, Rattus norvegicus
gtgggtccaggatacatgcaaatac

SEQ ID NO: 513636 - DNA, 25 bp, Rattus norvegicus
gtgggtccagttacaaggcatgtac

SEQ ID NO: 513637 - DNA, 25 bp, Rattus norvegicus
gtgggtccagtttcaaggcatgtac

SEQ ID NO: 513638 - DNA, 25 bp, Rattus norvegicus
gtgggtccatctcgccacgaatggc

SEQ ID NO: 513639 - DNA, 25 bp, Rattus norvegicus
gtgggtccatctggccacgaatggc

SEQ ID NO: 513640 - DNA, 25 bp, Rattus norvegicus
gtgggtcccatgcacaaggttccat

SEQ ID NO: 513641 - DNA, 25 bp, Rattus norvegicus
gtgggtcccatggacaaggttccat

SEQ ID NO: 513642 - DNA, 25 bp, Rattus norvegicus
gtgggtcccgagctgctggcggcgg

SEQ ID NO: 513643 - DNA, 25 bp, Rattus norvegicus
gtgggtcccgaggtgctggcggcgg

SEQ ID NO: 513644 - DNA, 25 bp, Rattus norvegicus
gtgggtccctcaagcagagacgtcg

SEQ ID NO: 513645 - DNA, 25 bp, Rattus norvegicus
gtgggtccctcatgcagagacgtcg

SEQ ID NO: 513646 - DNA, 25 bp, Rattus norvegicus
gtgggtccctttaactgaaggcatg

SEQ ID NO: 513647 - DNA, 25 bp, Rattus norvegicus
gtgggtcccttttactgaaggcatg

SEQ ID NO: 513648 - DNA, 25 bp, Rattus norvegicus
gtgggtccgcctcgaggttatacca

SEQ ID NO: 513649 - DNA, 25 bp, Rattus norvegicus
gtgggtccgcctggaggttatacca

SEQ ID NO: 513650 - DNA, 25 bp, Rattus norvegicus
gtgggtcctctacgaggagcccaac

SEQ ID NO: 513651 - DNA, 25 bp, Rattus norvegicus
gtgggtcctctaggaggagcccaac

SEQ ID NO: 513652 - DNA, 25 bp, Rattus norvegicus
gtgggtcctgcacttgcttaggttc

SEQ ID NO: 513653 - DNA, 25 bp, Rattus norvegicus
gtgggtcctgcagttgcttaggttc

SEQ ID NO: 513654 - DNA, 25 bp, Rattus norvegicus
gtgggtcctgctactatatgtccat

SEQ ID NO: 513655 - DNA, 25 bp, Rattus norvegicus
gtgggtcctgcttctatatgtccat

SEQ ID NO: 513656 - DNA, 25 bp, Rattus norvegicus
gtgggtcctggactccagttctaat

SEQ ID NO: 513657 - DNA, 25 bp, Rattus norvegicus
gtgggtcctggacttcaatctcaga

SEQ ID NO: 513658 - DNA, 25 bp, Rattus norvegicus
gtgggtcctggagtccagttctaat

SEQ ID NO: 513659 - DNA, 25 bp, Rattus norvegicus
gtgggtcctggagttcaatctcaga

SEQ ID NO: 513660 - DNA, 25 bp, Rattus norvegicus
gtgggtcctgttcattttgcgaccg

SEQ ID NO: 513661 - DNA, 25 bp, Rattus norvegicus
gtgggtcctgttgattttgcgaccg

SEQ ID NO: 513662 - DNA, 25 bp, Rattus norvegicus
gtgggtccttctctgtgggcctttt

SEQ ID NO: 513663 - DNA, 25 bp, Rattus norvegicus
gtgggtccttctgtgtgggcctttt

SEQ ID NO: 513664 - DNA, 25 bp, Rattus norvegicus
gtgggtcgacctaaagatagcttca

SEQ ID NO: 513665 - DNA, 25 bp, Rattus norvegicus
gtgggtcgaccttaagatagcttca

SEQ ID NO: 513666 - DNA, 25 bp, Rattus norvegicus
gtgggtcgatccctacgaagtgtcc

SEQ ID NO: 513667 - DNA, 25 bp, Rattus norvegicus
gtgggtcgatccgtacgaagtgtcc

SEQ ID NO: 513668 - DNA, 25 bp, Rattus norvegicus
gtgggtcgcccacgccaccagggtg

SEQ ID NO: 513669 - DNA, 25 bp, Rattus norvegicus
gtgggtcgcccaggccaccagggtg

SEQ ID NO: 513670 - DNA, 25 bp, Rattus norvegicus
gtgggtctaggacctctttagaact

SEQ ID NO: 513671 - DNA, 25 bp, Rattus norvegicus
gtgggtctaggagctctttagaact

SEQ ID NO: 513672 - DNA, 25 bp, Rattus norvegicus
gtgggtctccaaaaagtggttccat

SEQ ID NO: 513673 - DNA, 25 bp, Rattus norvegicus
gtgggtctccaataagtggttccat

SEQ ID NO: 513674 - DNA, 25 bp, Rattus norvegicus
gtgggtctcgttctttcttcattgc

SEQ ID NO: 513675 - DNA, 25 bp, Rattus norvegicus
gtgggtctcgttgtttcttcattgc

SEQ ID NO: 513676 - DNA, 25 bp, Rattus norvegicus
gtgggtctctagcaatctcaggatc

SEQ ID NO: 513677 - DNA, 25 bp, Rattus norvegicus
gtgggtctctaggaatctcaggatc

SEQ ID NO: 513678 - DNA, 25 bp, Rattus norvegicus
gtgggtctgacacaccaccacagga

SEQ ID NO: 513679 - DNA, 25 bp, Rattus norvegicus
gtgggtctgacagaccaccacagga

SEQ ID NO: 513680 - DNA, 25 bp, Rattus norvegicus
gtgggtctgggcagtaattgatcaa

SEQ ID NO: 513681 - DNA, 25 bp, Rattus norvegicus
gtgggtctgggctgtaattgatcaa

SEQ ID NO: 513682 - DNA, 25 bp, Rattus norvegicus
gtgggtctgtctacatactgtacaa

SEQ ID NO: 513683 - DNA, 25 bp, Rattus norvegicus
gtgggtctgtcttcatactgtacaa

SEQ ID NO: 513684 - DNA, 25 bp, Rattus norvegicus
gtgggtcttaacattgtgatactaa

SEQ ID NO: 513685 - DNA, 25 bp, Rattus norvegicus
gtgggtcttaactttgtgatactaa

SEQ ID NO: 513686 - DNA, 25 bp, Rattus norvegicus
gtgggtgaaaaaacaagtactcgtt

SEQ ID NO: 513687 - DNA, 25 bp, Rattus norvegicus
gtgggtgaaaaatcaagtactcgtt

SEQ ID NO: 513688 - DNA, 25 bp, Rattus norvegicus
gtgggtgaaccacactgaccagctt

SEQ ID NO: 513689 - DNA, 25 bp, Rattus norvegicus
gtgggtgaaccagactgaccagctt

SEQ ID NO: 513690 - DNA, 25 bp, Rattus norvegicus
gtgggtgaactacacattccaggga

SEQ ID NO: 513691 - DNA, 25 bp, Rattus norvegicus
gtgggtgaactagacattccaggga

SEQ ID NO: 513692 - DNA, 25 bp, Rattus norvegicus
gtgggtgaatgtacgcatctctgag

SEQ ID NO: 513693 - DNA, 25 bp, Rattus norvegicus
gtgggtgaatgttcgcatctctgag

SEQ ID NO: 513694 - DNA, 25 bp, Rattus norvegicus
gtgggtgacactacccataggattt

SEQ ID NO: 513695 - DNA, 25 bp, Rattus norvegicus
gtgggtgacacttcccataggattt

SEQ ID NO: 513696 - DNA, 25 bp, Rattus norvegicus
gtgggtgacagtcgcctcgcatcac

SEQ ID NO: 513697 - DNA, 25 bp, Rattus norvegicus
gtgggtgacagtggcctcgcatcac

SEQ ID NO: 513698 - DNA, 25 bp, Rattus norvegicus
gtgggtgacatcaacctggcttgca

SEQ ID NO: 513699 - DNA, 25 bp, Rattus norvegicus
gtgggtgacatctacctggcttgca

SEQ ID NO: 513700 - DNA, 25 bp, Rattus norvegicus
gtgggtgacccacaagctcacatgg

SEQ ID NO: 513701 - DNA, 25 bp, Rattus norvegicus
gtgggtgacccagaagctcacatgg

SEQ ID NO: 513702 - DNA, 25 bp, Rattus norvegicus
gtgggtgacgctagaacattcttct

SEQ ID NO: 513703 - DNA, 25 bp, Rattus norvegicus
gtgggtgacgcttgaacattcttct

SEQ ID NO: 513704 - DNA, 25 bp, Rattus norvegicus
gtgggtgactctagccccatttgaa

SEQ ID NO: 513705 - DNA, 25 bp, Rattus norvegicus
gtgggtgactcttgccccatttgaa

SEQ ID NO: 513706 - DNA, 25 bp, Rattus norvegicus
gtgggtgagttcaggctcaagaaac

SEQ ID NO: 513707 - DNA, 25 bp, Rattus norvegicus
gtgggtgagttctggctcaagaaac

SEQ ID NO: 513708 - DNA, 25 bp, Rattus norvegicus
gtgggtgatgtcagtgcagtatatt

SEQ ID NO: 513709 - DNA, 25 bp, Rattus norvegicus
gtgggtgatgtctgtgcagtatatt

SEQ ID NO: 513710 - DNA, 25 bp, Rattus norvegicus
gtgggtgcaagcatacctctgctaa

SEQ ID NO: 513711 - DNA, 25 bp, Rattus norvegicus
gtgggtgcaagcttacctctgctaa

SEQ ID NO: 513712 - DNA, 25 bp, Rattus norvegicus
gtgggtgcaatgaaggcctcatcct

SEQ ID NO: 513713 - DNA, 25 bp, Rattus norvegicus
gtgggtgcaatgtaggcctcatcct

SEQ ID NO: 513714 - DNA, 25 bp, Rattus norvegicus
gtgggtgcatttattaagctgtctt

SEQ ID NO: 513715 - DNA, 25 bp, Rattus norvegicus
gtgggtgcattttttaagctgtctt

SEQ ID NO: 513716 - DNA, 25 bp, Rattus norvegicus
gtgggtgccaaaatgttcttcttaa

SEQ ID NO: 513717 - DNA, 25 bp, Rattus norvegicus
gtgggtgccaaattgttcttcttaa

SEQ ID NO: 513718 - DNA, 25 bp, Rattus norvegicus
gtgggtgccaataggctcccagaca

SEQ ID NO: 513719 - DNA, 25 bp, Rattus norvegicus
gtgggtgccaattggctcccagaca

SEQ ID NO: 513720 - DNA, 25 bp, Rattus norvegicus
gtgggtgccacaatgttgctgccct

SEQ ID NO: 513721 - DNA, 25 bp, Rattus norvegicus
gtgggtgccacattgttgctgccct

SEQ ID NO: 513722 - DNA, 25 bp, Rattus norvegicus
gtgggtgccaggaatcaaaagatga

SEQ ID NO: 513723 - DNA, 25 bp, Rattus norvegicus
gtgggtgccaggtatcaaaagatga

SEQ ID NO: 513724 - DNA, 25 bp, Rattus norvegicus
gtgggtgccatgaggatccttagtc

SEQ ID NO: 513725 - DNA, 25 bp, Rattus norvegicus
gtgggtgccatgtggatccttagtc

SEQ ID NO: 513726 - DNA, 25 bp, Rattus norvegicus
gtgggtgcccaccagatgaatgcct

SEQ ID NO: 513727 - DNA, 25 bp, Rattus norvegicus
gtgggtgcccacgagatgaatgcct

SEQ ID NO: 513728 - DNA, 25 bp, Rattus norvegicus
gtgggtgcctggatacatcggagca

SEQ ID NO: 513729 - DNA, 25 bp, Rattus norvegicus
gtgggtgcctggttacatcggagca

SEQ ID NO: 513730 - DNA, 25 bp, Rattus norvegicus
gtgggtgccttgatggcttctccag

SEQ ID NO: 513731 - DNA, 25 bp, Rattus norvegicus
gtgggtgccttgttggcttctccag

SEQ ID NO: 513732 - DNA, 25 bp, Rattus norvegicus
gtgggtgctactcacattgctgtcc

SEQ ID NO: 513733 - DNA, 25 bp, Rattus norvegicus
gtgggtgctactgacattgctgtcc

SEQ ID NO: 513734 - DNA, 25 bp, Rattus norvegicus
gtgggtgctcctatctatgagtgaa

SEQ ID NO: 513735 - DNA, 25 bp, Rattus norvegicus
gtgggtgctcctttctatgagtgaa

SEQ ID NO: 513736 - DNA, 25 bp, Rattus norvegicus
gtgggtgctgacaactgttagtgtc

SEQ ID NO: 513737 - DNA, 25 bp, Rattus norvegicus
gtgggtgctgactactgttagtgtc

SEQ ID NO: 513738 - DNA, 25 bp, Rattus norvegicus
gtgggtgcttttctgttagtaactc

SEQ ID NO: 513739 - DNA, 25 bp, Rattus norvegicus
gtgggtgcttttgtgttagtaactc

SEQ ID NO: 513740 - DNA, 25 bp, Rattus norvegicus
gtgggtggaagcctcaagttactca

SEQ ID NO: 513741 - DNA, 25 bp, Rattus norvegicus
gtgggtggaagcgtcaagttactca

SEQ ID NO: 513742 - DNA, 25 bp, Rattus norvegicus
gtgggtggctgactctttgctcatc

SEQ ID NO: 513743 - DNA, 25 bp, Rattus norvegicus
gtgggtggctgagtctttgctcatc

SEQ ID NO: 513744 - DNA, 25 bp, Rattus norvegicus
gtgggtggctttaatggctttacca

SEQ ID NO: 513745 - DNA, 25 bp, Rattus norvegicus
gtgggtggcttttatggctttacca

SEQ ID NO: 513746 - DNA, 25 bp, Rattus norvegicus
gtgggtgggaatcattccagtcaat

SEQ ID NO: 513747 - DNA, 25 bp, Rattus norvegicus
gtgggtgggaatgattccagtcaat

SEQ ID NO: 513748 - DNA, 25 bp, Rattus norvegicus
gtgggtgggcctaattttgctgccc

SEQ ID NO: 513749 - DNA, 25 bp, Rattus norvegicus
gtgggtgggccttattttgctgccc

SEQ ID NO: 513750 - DNA, 25 bp, Rattus norvegicus
gtgggtgggcttacctgaaatcgaa

SEQ ID NO: 513751 - DNA, 25 bp, Rattus norvegicus
gtgggtgggctttcctgaaatcgaa

SEQ ID NO: 513752 - DNA, 25 bp, Rattus norvegicus
gtgggtggtgctattgccagaacac

SEQ ID NO: 513753 - DNA, 25 bp, Rattus norvegicus
gtgggtggtgcttttgccagaacac

SEQ ID NO: 513754 - DNA, 25 bp, Rattus norvegicus
gtgggtggtggtattccttgaaatc

SEQ ID NO: 513755 - DNA, 25 bp, Rattus norvegicus
gtgggtggtggttttccttgaaatc

SEQ ID NO: 513756 - DNA, 25 bp, Rattus norvegicus
gtgggtgtagtacgtttcacactaa

SEQ ID NO: 513757 - DNA, 25 bp, Rattus norvegicus
gtgggtgtagtaggtttcacactaa

SEQ ID NO: 513758 - DNA, 25 bp, Rattus norvegicus
gtgggtgtccacatgtacgcgatgt

SEQ ID NO: 513759 - DNA, 25 bp, Rattus norvegicus
gtgggtgtccacttgtacgcgatgt

SEQ ID NO: 513760 - DNA, 25 bp, Rattus norvegicus
gtgggtgtccccacattgcagagcc

SEQ ID NO: 513761 - DNA, 25 bp, Rattus norvegicus
gtgggtgtcccctcattgcagagcc

SEQ ID NO: 513762 - DNA, 25 bp, Rattus norvegicus
gtgggtgtggccagcaacttcacat

SEQ ID NO: 513763 - DNA, 25 bp, Rattus norvegicus
gtgggtgtggcctgcaacttcacat

SEQ ID NO: 513764 - DNA, 25 bp, Rattus norvegicus
gtgggtgtggtgacacgcttccatt

SEQ ID NO: 513765 - DNA, 25 bp, Rattus norvegicus
gtgggtgtggtgtcacgcttccatt

SEQ ID NO: 513766 - DNA, 25 bp, Rattus norvegicus
gtgggtgttatcatccctgagggct

SEQ ID NO: 513767 - DNA, 25 bp, Rattus norvegicus
gtgggtgttatcttccctgagggct

SEQ ID NO: 513768 - DNA, 25 bp, Rattus norvegicus
gtgggtgttgccagattgtacttca

SEQ ID NO: 513769 - DNA, 25 bp, Rattus norvegicus
gtgggtgttgcctgattgtacttca

SEQ ID NO: 513770 - DNA, 25 bp, Rattus norvegicus
gtgggttacagactccttgcttcga

SEQ ID NO: 513771 - DNA, 25 bp, Rattus norvegicus
gtgggttacagagtccttgcttcga

SEQ ID NO: 513772 - DNA, 25 bp, Rattus norvegicus
gtgggttacctgaaggatgtcatac

SEQ ID NO: 513773 - DNA, 25 bp, Rattus norvegicus
gtgggttacctgtaggatgtcatac

SEQ ID NO: 513774 - DNA, 25 bp, Rattus norvegicus
gtgggttactcccatgtctttgtag

SEQ ID NO: 513775 - DNA, 25 bp, Rattus norvegicus
gtgggttactccgatgtctttgtag

SEQ ID NO: 513776 - DNA, 25 bp, Rattus norvegicus
gtgggttactggaaccaactcgtga

SEQ ID NO: 513777 - DNA, 25 bp, Rattus norvegicus
gtgggttactggtaccaactcgtga

SEQ ID NO: 513778 - DNA, 25 bp, Rattus norvegicus
gtgggttagcacaactccagtggaa

SEQ ID NO: 513779 - DNA, 25 bp, Rattus norvegicus
gtgggttagcactactccagtggaa

SEQ ID NO: 513780 - DNA, 25 bp, Rattus norvegicus
gtgggttcaaacacaggcctgtgct

SEQ ID NO: 513781 - DNA, 25 bp, Rattus norvegicus
gtgggttcaaactcaggcctgtgct

SEQ ID NO: 513782 - DNA, 25 bp, Rattus norvegicus
gtgggttcagatatagtacctataa

SEQ ID NO: 513783 - DNA, 25 bp, Rattus norvegicus
gtgggttcagatttagtacctataa

SEQ ID NO: 513784 - DNA, 25 bp, Rattus norvegicus
gtgggttcagtccagctattatcgc

SEQ ID NO: 513785 - DNA, 25 bp, Rattus norvegicus
gtgggttcagtcgagctattatcgc

SEQ ID NO: 513786 - DNA, 25 bp, Rattus norvegicus
gtgggttcatttcgaatagcgtgct

SEQ ID NO: 513787 - DNA, 25 bp, Rattus norvegicus
gtgggttcatttggaatagcgtgct

SEQ ID NO: 513788 - DNA, 25 bp, Rattus norvegicus
gtgggttccaaacaacgctcgtatg

SEQ ID NO: 513789 - DNA, 25 bp, Rattus norvegicus
gtgggttccaaagaacgctcgtatg

SEQ ID NO: 513790 - DNA, 25 bp, Rattus norvegicus
gtgggttccaatagcttgatcttta

SEQ ID NO: 513791 - DNA, 25 bp, Rattus norvegicus
gtgggttccaattgcttgatcttta

SEQ ID NO: 513792 - DNA, 25 bp, Rattus norvegicus
gtgggttccataaaattgtcctctg

SEQ ID NO: 513793 - DNA, 25 bp, Rattus norvegicus
gtgggttccatataattgtcctctg

SEQ ID NO: 513794 - DNA, 25 bp, Rattus norvegicus
gtgggttcctctatagtaacagcca

SEQ ID NO: 513795 - DNA, 25 bp, Rattus norvegicus
gtgggttcctctttagtaacagcca

SEQ ID NO: 513796 - DNA, 25 bp, Rattus norvegicus
gtgggttcctgtcaaaacatgcctc

SEQ ID NO: 513797 - DNA, 25 bp, Rattus norvegicus
gtgggttcctgtgaaaacatgcctc

SEQ ID NO: 513798 - DNA, 25 bp, Rattus norvegicus
gtgggttcgcacctgaatacagtct

SEQ ID NO: 513799 - DNA, 25 bp, Rattus norvegicus
gtgggttcgcacgtgaatacagtct

SEQ ID NO: 513800 - DNA, 25 bp, Rattus norvegicus
gtgggttctcttcacattttatgta

SEQ ID NO: 513801 - DNA, 25 bp, Rattus norvegicus
gtgggttctcttgacattttatgta

SEQ ID NO: 513802 - DNA, 25 bp, Rattus norvegicus
gtgggttctgttacgtggaatacta

SEQ ID NO: 513803 - DNA, 25 bp, Rattus norvegicus
gtgggttctgtttcgtggaatacta

SEQ ID NO: 513804 - DNA, 25 bp, Rattus norvegicus
gtgggttgatcacacaccattcaat

SEQ ID NO: 513805 - DNA, 25 bp, Rattus norvegicus
gtgggttgatcagacaccattcaat

SEQ ID NO: 513806 - DNA, 25 bp, Rattus norvegicus
gtgggttgcaaacctcagtgctgca

SEQ ID NO: 513807 - DNA, 25 bp, Rattus norvegicus
gtgggttgcaaagctcagtgctgca

SEQ ID NO: 513808 - DNA, 25 bp, Rattus norvegicus
gtgggttgctgtaggtatatctgta

SEQ ID NO: 513809 - DNA, 25 bp, Rattus norvegicus
gtgggttgctgttggtatatctgta

SEQ ID NO: 513810 - DNA, 25 bp, Rattus norvegicus
gtgggttggaaacctccatgtgtta

SEQ ID NO: 513811 - DNA, 25 bp, Rattus norvegicus
gtgggttggaaagctccatgtgtta

SEQ ID NO: 513812 - DNA, 25 bp, Rattus norvegicus
gtgggttgttccagcagacctctga

SEQ ID NO: 513813 - DNA, 25 bp, Rattus norvegicus
gtgggttgttcctgcagacctctga

SEQ ID NO: 513814 - DNA, 25 bp, Rattus norvegicus
gtgggttgttgcacacacctctgag

SEQ ID NO: 513815 - DNA, 25 bp, Rattus norvegicus
gtgggttgttgctcacacctctgag

SEQ ID NO: 513816 - DNA, 25 bp, Rattus norvegicus
gtgggtttacaaccgcagcagttac

SEQ ID NO: 513817 - DNA, 25 bp, Rattus norvegicus
gtgggtttacaagcgcagcagttac

SEQ ID NO: 513818 - DNA, 25 bp, Rattus norvegicus
gtgggtttacacatctattggtggt

SEQ ID NO: 513819 - DNA, 25 bp, Rattus norvegicus
gtgggtttacacttctattggtggt

SEQ ID NO: 513820 - DNA, 25 bp, Rattus norvegicus
gtgggtttacttcatttcaggtcat

SEQ ID NO: 513821 - DNA, 25 bp, Rattus norvegicus
gtgggtttacttgatttcaggtcat

SEQ ID NO: 513822 - DNA, 25 bp, Rattus norvegicus
gtgggtttagtgattctgtccttat

SEQ ID NO: 513823 - DNA, 25 bp, Rattus norvegicus
gtgggtttagtgtttctgtccttat

SEQ ID NO: 513824 - DNA, 25 bp, Rattus norvegicus
gtgggtttattcatattgtcctgat

SEQ ID NO: 513825 - DNA, 25 bp, Rattus norvegicus
gtgggtttattcttattgtcctgat

SEQ ID NO: 513826 - DNA, 25 bp, Rattus norvegicus
gtgggtttcagtacctacataccta

SEQ ID NO: 513827 - DNA, 25 bp, Rattus norvegicus
gtgggtttcagtcttcccagaaaat

SEQ ID NO: 513828 - DNA, 25 bp, Rattus norvegicus
gtgggtttcagtgttcccagaaaat

SEQ ID NO: 513829 - DNA, 25 bp, Rattus norvegicus
gtgggtttcagttcctacataccta

SEQ ID NO: 513830 - DNA, 25 bp, Rattus norvegicus
gtgggtttcctaatacactctgcag

SEQ ID NO: 513831 - DNA, 25 bp, Rattus norvegicus
gtgggtttcctattacactctgcag

SEQ ID NO: 513832 - DNA, 25 bp, Rattus norvegicus
gtgggtttcctgctaaattttgttg

SEQ ID NO: 513833 - DNA, 25 bp, Rattus norvegicus
gtgggtttcctggtaaattttgttg

SEQ ID NO: 513834 - DNA, 25 bp, Rattus norvegicus
gtgggtttctaaaacaaagtctgac

SEQ ID NO: 513835 - DNA, 25 bp, Rattus norvegicus
gtgggtttctaatacaaagtctgac

SEQ ID NO: 513836 - DNA, 25 bp, Rattus norvegicus
gtgggtttctatctattgagggtta

SEQ ID NO: 513837 - DNA, 25 bp, Rattus norvegicus
gtgggtttctatgtattgagggtta

SEQ ID NO: 513838 - DNA, 25 bp, Rattus norvegicus
gtgggtttctgacacttccgcagca

SEQ ID NO: 513839 - DNA, 25 bp, Rattus norvegicus
gtgggtttctgagacttccgcagca

SEQ ID NO: 513840 - DNA, 25 bp, Rattus norvegicus
gtgggtttctgcatataaaacttta

SEQ ID NO: 513841 - DNA, 25 bp, Rattus norvegicus
gtgggtttctgccatcgtatcattt

SEQ ID NO: 513842 - DNA, 25 bp, Rattus norvegicus
gtgggtttctgcgatcgtatcattt

SEQ ID NO: 513843 - DNA, 25 bp, Rattus norvegicus
gtgggtttctgcttataaaacttta

SEQ ID NO: 513844 - DNA, 25 bp, Rattus norvegicus
gtgggttttcataaggccctcaagt

SEQ ID NO: 513845 - DNA, 25 bp, Rattus norvegicus
gtgggttttcattaggccctcaagt

SEQ ID NO: 513846 - DNA, 25 bp, Rattus norvegicus
gtgggttttcttcttctcgaagaca

SEQ ID NO: 513847 - DNA, 25 bp, Rattus norvegicus
gtgggttttcttgttctcgaagaca

SEQ ID NO: 513848 - DNA, 25 bp, Rattus norvegicus
gtgggttttgtcaatccctaaatga

SEQ ID NO: 513849 - DNA, 25 bp, Rattus norvegicus
gtgggttttgtcattctatccaaca

SEQ ID NO: 513850 - DNA, 25 bp, Rattus norvegicus
gtgggttttgtctatccctaaatga

SEQ ID NO: 513851 - DNA, 25 bp, Rattus norvegicus
gtgggttttgtctttctatccaaca

SEQ ID NO: 513852 - DNA, 25 bp, Rattus norvegicus
gtgggttttgtgatcatgatgctgt

SEQ ID NO: 513853 - DNA, 25 bp, Rattus norvegicus
gtgggttttgtgttcatgatgctgt

SEQ ID NO: 513854 - DNA, 25 bp, Rattus norvegicus
gtgggtttttctaggacctagcaag

SEQ ID NO: 513855 - DNA, 25 bp, Rattus norvegicus
gtgggtttttcttggacctagcaag

SEQ ID NO: 513856 - DNA, 25 bp, Rattus norvegicus
gtggtaaaactgcactacatgctta

SEQ ID NO: 513857 - DNA, 25 bp, Rattus norvegicus
gtggtaaaactggactacatgctta

SEQ ID NO: 513858 - DNA, 25 bp, Rattus norvegicus
gtggtaaagcgcacgcccggcattc

SEQ ID NO: 513859 - DNA, 25 bp, Rattus norvegicus
gtggtaaagcgctcgcccggcattc

SEQ ID NO: 513860 - DNA, 25 bp, Rattus norvegicus
gtggtaacaacactattcatgctta

SEQ ID NO: 513861 - DNA, 25 bp, Rattus norvegicus
gtggtaacaacagtattcatgctta

SEQ ID NO: 513862 - DNA, 25 bp, Rattus norvegicus
gtggtaacaagcacttttctgtagt

SEQ ID NO: 513863 - DNA, 25 bp, Rattus norvegicus
gtggtaacaagctcttttctgtagt

SEQ ID NO: 513864 - DNA, 25 bp, Rattus norvegicus
gtggtaacaattcctccaggtctgt

SEQ ID NO: 513865 - DNA, 25 bp, Rattus norvegicus
gtggtaacaattgctccaggtctgt

SEQ ID NO: 513866 - DNA, 25 bp, Rattus norvegicus
gtggtaactgatcaattgatgtctt

SEQ ID NO: 513867 - DNA, 25 bp, Rattus norvegicus
gtggtaactgatgaattgatgtctt

SEQ ID NO: 513868 - DNA, 25 bp, Rattus norvegicus
gtggtaaggcctatgcatgtcaaag

SEQ ID NO: 513869 - DNA, 25 bp, Rattus norvegicus
gtggtaaggcctttgcatgtcaaag

SEQ ID NO: 513870 - DNA, 25 bp, Rattus norvegicus
gtggtaatagtgacatcggctgccc

SEQ ID NO: 513871 - DNA, 25 bp, Rattus norvegicus
gtggtaatagtgtcatcggctgccc

SEQ ID NO: 513872 - DNA, 25 bp, Rattus norvegicus
gtggtaatcactatcgtcattctca

SEQ ID NO: 513873 - DNA, 25 bp, Rattus norvegicus
gtggtaatcactttcgtcattctca

SEQ ID NO: 513874 - DNA, 25 bp, Rattus norvegicus
gtggtaatcagtattatctttcgaa

SEQ ID NO: 513875 - DNA, 25 bp, Rattus norvegicus
gtggtaatcagttttatctttcgaa

SEQ ID NO: 513876 - DNA, 25 bp, Rattus norvegicus
gtggtaatgcttattctccatttcc

SEQ ID NO: 513877 - DNA, 25 bp, Rattus norvegicus
gtggtaatgctttttctccatttcc

SEQ ID NO: 513878 - DNA, 25 bp, Rattus norvegicus
gtggtacaagttaacacctgtgtat

SEQ ID NO: 513879 - DNA, 25 bp, Rattus norvegicus
gtggtacaagtttacacctgtgtat

SEQ ID NO: 513880 - DNA, 25 bp, Rattus norvegicus
gtggtacaatacatgcctagctttg

SEQ ID NO: 513881 - DNA, 25 bp, Rattus norvegicus
gtggtacaatacttgcctagctttg

SEQ ID NO: 513882 - DNA, 25 bp, Rattus norvegicus
gtggtacacatcagtgactccagca

SEQ ID NO: 513883 - DNA, 25 bp, Rattus norvegicus
gtggtacacatctgtgactccagca

SEQ ID NO: 513884 - DNA, 25 bp, Rattus norvegicus
gtggtacaccacaaaagactcggct

SEQ ID NO: 513885 - DNA, 25 bp, Rattus norvegicus
gtggtacaccactaaagactcggct

SEQ ID NO: 513886 - DNA, 25 bp, Rattus norvegicus
gtggtacacccaaccttgctccagt

SEQ ID NO: 513887 - DNA, 25 bp, Rattus norvegicus
gtggtacacccatccttgctccagt

SEQ ID NO: 513888 - DNA, 25 bp, Rattus norvegicus
gtggtacacctgagagctgctctgc

SEQ ID NO: 513889 - DNA, 25 bp, Rattus norvegicus
gtggtacacctgtgagctgctctgc

SEQ ID NO: 513890 - DNA, 25 bp, Rattus norvegicus
gtggtacacgttagacagcgtccat

SEQ ID NO: 513891 - DNA, 25 bp, Rattus norvegicus
gtggtacacgtttgacagcgtccat

SEQ ID NO: 513892 - DNA, 25 bp, Rattus norvegicus
gtggtacagaagacacctctgccct

SEQ ID NO: 513893 - DNA, 25 bp, Rattus norvegicus
gtggtacagaagtcacctctgccct

SEQ ID NO: 513894 - DNA, 25 bp, Rattus norvegicus
gtggtacagcacatgtctaatacaa

SEQ ID NO: 513895 - DNA, 25 bp, Rattus norvegicus
gtggtacagcacttgtctaatacaa

SEQ ID NO: 513896 - DNA, 25 bp, Rattus norvegicus
gtggtacatcacctgagctcaagtc

SEQ ID NO: 513897 - DNA, 25 bp, Rattus norvegicus
gtggtacatcacgtgagctcaagtc

SEQ ID NO: 513898 - DNA, 25 bp, Rattus norvegicus
gtggtaccagacagccagattatca

SEQ ID NO: 513899 - DNA, 25 bp, Rattus norvegicus
gtggtaccagactgccagattatca

SEQ ID NO: 513900 - DNA, 25 bp, Rattus norvegicus
gtggtaccgcccaggccttaaatca

SEQ ID NO: 513901 - DNA, 25 bp, Rattus norvegicus
gtggtaccgccctggccttaaatca

SEQ ID NO: 513902 - DNA, 25 bp, Rattus norvegicus
gtggtacctaaccttgtcctgaccg

SEQ ID NO: 513903 - DNA, 25 bp, Rattus norvegicus
gtggtacctaacgttgtcctgaccg

SEQ ID NO: 513904 - DNA, 25 bp, Rattus norvegicus
gtggtacctggtccctgtcttgaga

SEQ ID NO: 513905 - DNA, 25 bp, Rattus norvegicus
gtggtacctggtgcctgtcttgaga

SEQ ID NO: 513906 - DNA, 25 bp, Rattus norvegicus
gtggtacgagctctgaatgctgtca

SEQ ID NO: 513907 - DNA, 25 bp, Rattus norvegicus
gtggtacgagctgtgaatgctgtca

SEQ ID NO: 513908 - DNA, 25 bp, Rattus norvegicus
gtggtacgttcacaaactccagtct

SEQ ID NO: 513909 - DNA, 25 bp, Rattus norvegicus
gtggtacgttcagaaactccagtct

SEQ ID NO: 513910 - DNA, 25 bp, Rattus norvegicus
gtggtactacagctgccaatgtctg

SEQ ID NO: 513911 - DNA, 25 bp, Rattus norvegicus
gtggtactacaggtgccaatgtctg

SEQ ID NO: 513912 - DNA, 25 bp, Rattus norvegicus
gtggtactaccaagaaattactgtt

SEQ ID NO: 513913 - DNA, 25 bp, Rattus norvegicus
gtggtactaccatgaaattactgtt

SEQ ID NO: 513914 - DNA, 25 bp, Rattus norvegicus
gtggtactagaaagctctgcccaat

SEQ ID NO: 513915 - DNA, 25 bp, Rattus norvegicus
gtggtactagaatgctctgcccaat

SEQ ID NO: 513916 - DNA, 25 bp, Rattus norvegicus
gtggtactagttaattcacacctga

SEQ ID NO: 513917 - DNA, 25 bp, Rattus norvegicus
gtggtactagtttattcacacctga

SEQ ID NO: 513918 - DNA, 25 bp, Rattus norvegicus
gtggtactcctgactcagtgtgaag

SEQ ID NO: 513919 - DNA, 25 bp, Rattus norvegicus
gtggtactcctgtctcagtgtgaag

SEQ ID NO: 513920 - DNA, 25 bp, Rattus norvegicus
gtggtactgacgcactcttaggaaa

SEQ ID NO: 513921 - DNA, 25 bp, Rattus norvegicus
gtggtactgacggactcttaggaaa

SEQ ID NO: 513922 - DNA, 25 bp, Rattus norvegicus
gtggtactgggacaactcttcttcc

SEQ ID NO: 513923 - DNA, 25 bp, Rattus norvegicus
gtggtactgggagaactcttcttcc

SEQ ID NO: 513924 - DNA, 25 bp, Rattus norvegicus
gtggtactgtacaagcttggcttct

SEQ ID NO: 513925 - DNA, 25 bp, Rattus norvegicus
gtggtactgtactagcttggcttct

SEQ ID NO: 513926 - DNA, 25 bp, Rattus norvegicus
gtggtacttattccaaggctgctca

SEQ ID NO: 513927 - DNA, 25 bp, Rattus norvegicus
gtggtacttattgcaaggctgctca

SEQ ID NO: 513928 - DNA, 25 bp, Rattus norvegicus
gtggtacttcaaatcctgttttaat

SEQ ID NO: 513929 - DNA, 25 bp, Rattus norvegicus
gtggtacttcaattcctgttttaat

SEQ ID NO: 513930 - DNA, 25 bp, Rattus norvegicus
gtggtacttccaatcttttaactgt

SEQ ID NO: 513931 - DNA, 25 bp, Rattus norvegicus
gtggtacttccattcttttaactgt

SEQ ID NO: 513932 - DNA, 25 bp, Rattus norvegicus
gtggtacttggtatttaaatgactg

SEQ ID NO: 513933 - DNA, 25 bp, Rattus norvegicus
gtggtacttggtttttaaatgactg

SEQ ID NO: 513934 - DNA, 25 bp, Rattus norvegicus
gtggtactttgcattgctgaggtat

SEQ ID NO: 513935 - DNA, 25 bp, Rattus norvegicus
gtggtactttgctttgctgaggtat

SEQ ID NO: 513936 - DNA, 25 bp, Rattus norvegicus
gtggtactttggagcttactctatt

SEQ ID NO: 513937 - DNA, 25 bp, Rattus norvegicus
gtggtactttggtgcttactctatt

SEQ ID NO: 513938 - DNA, 25 bp, Rattus norvegicus
gtggtacttttcaacgcggcagagg

SEQ ID NO: 513939 - DNA, 25 bp, Rattus norvegicus
gtggtacttttctacgcggcagagg

SEQ ID NO: 513940 - DNA, 25 bp, Rattus norvegicus
gtggtagaaaacacagtccggcaac

SEQ ID NO: 513941 - DNA, 25 bp, Rattus norvegicus
gtggtagaaaactcagtccggcaac

SEQ ID NO: 513942 - DNA, 25 bp, Rattus norvegicus
gtggtagaacacagcagctgtcgcc

SEQ ID NO: 513943 - DNA, 25 bp, Rattus norvegicus
gtggtagaacactgcagctgtcgcc

SEQ ID NO: 513944 - DNA, 25 bp, Rattus norvegicus
gtggtagaaccaataccaggccctc

SEQ ID NO: 513945 - DNA, 25 bp, Rattus norvegicus
gtggtagaaccactggccatcactt

SEQ ID NO: 513946 - DNA, 25 bp, Rattus norvegicus
gtggtagaaccagtggccatcactt

SEQ ID NO: 513947 - DNA, 25 bp, Rattus norvegicus
gtggtagaaccattaccaggccctc

SEQ ID NO: 513948 - DNA, 25 bp, Rattus norvegicus
gtggtagacaccagtatcgtcgcca

SEQ ID NO: 513949 - DNA, 25 bp, Rattus norvegicus
gtggtagacacctgtatcgtcgcca

SEQ ID NO: 513950 - DNA, 25 bp, Rattus norvegicus
gtggtagaccatcactgacaccctt

SEQ ID NO: 513951 - DNA, 25 bp, Rattus norvegicus
gtggtagaccatgactgacaccctt

SEQ ID NO: 513952 - DNA, 25 bp, Rattus norvegicus
gtggtagacccccaaatgagagcta

SEQ ID NO: 513953 - DNA, 25 bp, Rattus norvegicus
gtggtagaccccgaaatgagagcta

SEQ ID NO: 513954 - DNA, 25 bp, Rattus norvegicus
gtggtagagctcacctggctaagga

SEQ ID NO: 513955 - DNA, 25 bp, Rattus norvegicus
gtggtagagctctcctggctaagga

SEQ ID NO: 513956 - DNA, 25 bp, Rattus norvegicus
gtggtagaggacattcctagaaagc

SEQ ID NO: 513957 - DNA, 25 bp, Rattus norvegicus
gtggtagaggactttcctagaaagc

SEQ ID NO: 513958 - DNA, 25 bp, Rattus norvegicus
gtggtagatcagactttacttgcaa

SEQ ID NO: 513959 - DNA, 25 bp, Rattus norvegicus
gtggtagatcagtctttacttgcaa

SEQ ID NO: 513960 - DNA, 25 bp, Rattus norvegicus
gtggtagatcccaggcccagcatgt

SEQ ID NO: 513961 - DNA, 25 bp, Rattus norvegicus
gtggtagatccctggcccagcatgt

SEQ ID NO: 513962 - DNA, 25 bp, Rattus norvegicus
gtggtagcaatccttaacttattag

SEQ ID NO: 513963 - DNA, 25 bp, Rattus norvegicus
gtggtagcaatcgttaacttattag

SEQ ID NO: 513964 - DNA, 25 bp, Rattus norvegicus
gtggtagcactgatttctttctttt

SEQ ID NO: 513965 - DNA, 25 bp, Rattus norvegicus
gtggtagcactgttttctttctttt

SEQ ID NO: 513966 - DNA, 25 bp, Rattus norvegicus
gtggtagccctcattctgtgaatgg

SEQ ID NO: 513967 - DNA, 25 bp, Rattus norvegicus
gtggtagccctctttctgtgaatgg

SEQ ID NO: 513968 - DNA, 25 bp, Rattus norvegicus
gtggtagcggcgaaaatcctttcct

SEQ ID NO: 513969 - DNA, 25 bp, Rattus norvegicus
gtggtagcggcgtaaatcctttcct

SEQ ID NO: 513970 - DNA, 25 bp, Rattus norvegicus
gtggtagctggaagacgctcccaaa

SEQ ID NO: 513971 - DNA, 25 bp, Rattus norvegicus
gtggtagctggatgacgctcccaaa

SEQ ID NO: 513972 - DNA, 25 bp, Rattus norvegicus
gtggtagctgttagttcacaggcca

SEQ ID NO: 513973 - DNA, 25 bp, Rattus norvegicus
gtggtagctgtttgttcacaggcca

SEQ ID NO: 513974 - DNA, 25 bp, Rattus norvegicus
gtggtaggccagattcagatagttt

SEQ ID NO: 513975 - DNA, 25 bp, Rattus norvegicus
gtggtaggccagtttcagatagttt

SEQ ID NO: 513976 - DNA, 25 bp, Rattus norvegicus
gtggtagggtttacgcagttatgca

SEQ ID NO: 513977 - DNA, 25 bp, Rattus norvegicus
gtggtagggttttcgcagttatgca

SEQ ID NO: 513978 - DNA, 25 bp, Rattus norvegicus
gtggtaggtgtgctattcatcatca

SEQ ID NO: 513979 - DNA, 25 bp, Rattus norvegicus
gtggtaggtgtggtattcatcatca

SEQ ID NO: 513980 - DNA, 25 bp, Rattus norvegicus
gtggtagtcataatcttccatcact

SEQ ID NO: 513981 - DNA, 25 bp, Rattus norvegicus
gtggtagtcatattcttccatcact

SEQ ID NO: 513982 - DNA, 25 bp, Rattus norvegicus
gtggtagtgcacacagtgactggta

SEQ ID NO: 513983 - DNA, 25 bp, Rattus norvegicus
gtggtagtgcactcagtgactggta

SEQ ID NO: 513984 - DNA, 25 bp, Rattus norvegicus
gtggtagttggtcgtttccgccctg

SEQ ID NO: 513985 - DNA, 25 bp, Rattus norvegicus
gtggtagttggtggtttccgccctg

SEQ ID NO: 513986 - DNA, 25 bp, Rattus norvegicus
gtggtagtttcaatcttcaaggctc

SEQ ID NO: 513987 - DNA, 25 bp, Rattus norvegicus
gtggtagtttcattcttcaaggctc

SEQ ID NO: 513988 - DNA, 25 bp, Rattus norvegicus
gtggtataagcgcagagtccccgac

SEQ ID NO: 513989 - DNA, 25 bp, Rattus norvegicus
gtggtataagcggagagtccccgac

SEQ ID NO: 513990 - DNA, 25 bp, Rattus norvegicus
gtggtataatttccagttactctgt

SEQ ID NO: 513991 - DNA, 25 bp, Rattus norvegicus
gtggtataatttgcagttactctgt

SEQ ID NO: 513992 - DNA, 25 bp, Rattus norvegicus
gtggtatacactattgatctcagag

SEQ ID NO: 513993 - DNA, 25 bp, Rattus norvegicus
gtggtatacacttttgatctcagag

SEQ ID NO: 513994 - DNA, 25 bp, Rattus norvegicus
gtggtatagcagaggctccagtctc

SEQ ID NO: 513995 - DNA, 25 bp, Rattus norvegicus
gtggtatagcagtggctccagtctc

SEQ ID NO: 513996 - DNA, 25 bp, Rattus norvegicus
gtggtatagctcagacctctatgct

SEQ ID NO: 513997 - DNA, 25 bp, Rattus norvegicus
gtggtatagctctgacctctatgct

SEQ ID NO: 513998 - DNA, 25 bp, Rattus norvegicus
gtggtatatccaaagaaaatgagtt

SEQ ID NO: 513999 - DNA, 25 bp, Rattus norvegicus
gtggtatatccatagaaaatgagtt

SEQ ID NO: 514000 - DNA, 25 bp, Rattus norvegicus
gtggtatcacttctagcaattcgct

SEQ ID NO: 514001 - DNA, 25 bp, Rattus norvegicus
gtggtatcacttgtagcaattcgct

SEQ ID NO: 514002 - DNA, 25 bp, Rattus norvegicus
gtggtatctcttagaaccttccaag

SEQ ID NO: 514003 - DNA, 25 bp, Rattus norvegicus
gtggtatctctttgaaccttccaag

SEQ ID NO: 514004 - DNA, 25 bp, Rattus norvegicus
gtggtatcttccatcagaatcatct

SEQ ID NO: 514005 - DNA, 25 bp, Rattus norvegicus
gtggtatcttccttcagaatcatct

SEQ ID NO: 514006 - DNA, 25 bp, Rattus norvegicus
gtggtatgacccacactgtgacgat

SEQ ID NO: 514007 - DNA, 25 bp, Rattus norvegicus
gtggtatgaccctcactgtgacgat

SEQ ID NO: 514008 - DNA, 25 bp, Rattus norvegicus
gtggtatgccacagactcatttatt

SEQ ID NO: 514009 - DNA, 25 bp, Rattus norvegicus
gtggtatgccactgactcatttatt

SEQ ID NO: 514010 - DNA, 25 bp, Rattus norvegicus
gtggtattcagactcagacccaggg

SEQ ID NO: 514011 - DNA, 25 bp, Rattus norvegicus
gtggtattcagagtcagacccaggg

SEQ ID NO: 514012 - DNA, 25 bp, Rattus norvegicus
gtggtattcagcactggcagcctag

SEQ ID NO: 514013 - DNA, 25 bp, Rattus norvegicus
gtggtattcagctctggcagcctag

SEQ ID NO: 514014 - DNA, 25 bp, Rattus norvegicus
gtggtattcaggcttcgtgctctcc

SEQ ID NO: 514015 - DNA, 25 bp, Rattus norvegicus
gtggtattcagggttcgtgctctcc

SEQ ID NO: 514016 - DNA, 25 bp, Rattus norvegicus
gtggtattcattattggccctgaca

SEQ ID NO: 514017 - DNA, 25 bp, Rattus norvegicus
gtggtattcatttttggccctgaca

SEQ ID NO: 514018 - DNA, 25 bp, Rattus norvegicus
gtggtattccttactttgaggccag

SEQ ID NO: 514019 - DNA, 25 bp, Rattus norvegicus
gtggtattcctttctttgaggccag

SEQ ID NO: 514020 - DNA, 25 bp, Rattus norvegicus
gtggtattgcttacacagatatatt

SEQ ID NO: 514021 - DNA, 25 bp, Rattus norvegicus
gtggtattgctttcacagatatatt

SEQ ID NO: 514022 - DNA, 25 bp, Rattus norvegicus
gtggtattgggccatcttcttggaa

SEQ ID NO: 514023 - DNA, 25 bp, Rattus norvegicus
gtggtattgggcgatcttcttggaa

SEQ ID NO: 514024 - DNA, 25 bp, Rattus norvegicus
gtggtatttcaacctcttgctttag

SEQ ID NO: 514025 - DNA, 25 bp, Rattus norvegicus
gtggtatttcaagctcttgctttag

SEQ ID NO: 514026 - DNA, 25 bp, Rattus norvegicus
gtggtatttcagctcagtgctcctc

SEQ ID NO: 514027 - DNA, 25 bp, Rattus norvegicus
gtggtatttcaggtcagtgctcctc

SEQ ID NO: 514028 - DNA, 25 bp, Rattus norvegicus
gtggtatttccaaacgtgacttatc

SEQ ID NO: 514029 - DNA, 25 bp, Rattus norvegicus
gtggtatttccatacgtgacttatc

SEQ ID NO: 514030 - DNA, 25 bp, Rattus norvegicus
gtggtattttcaccaatagggcctt

SEQ ID NO: 514031 - DNA, 25 bp, Rattus norvegicus
gtggtattttcagcaatagggcctt

SEQ ID NO: 514032 - DNA, 25 bp, Rattus norvegicus
gtggtcaaaaacactctcaaccctg

SEQ ID NO: 514033 - DNA, 25 bp, Rattus norvegicus
gtggtcaaaaactctctcaaccctg

SEQ ID NO: 514034 - DNA, 25 bp, Rattus norvegicus
gtggtcaaaaatctccgctgctcag

SEQ ID NO: 514035 - DNA, 25 bp, Rattus norvegicus
gtggtcaaaaatgtccgctgctcag

SEQ ID NO: 514036 - DNA, 25 bp, Rattus norvegicus
gtggtcaaccacagagtcttcaaga

SEQ ID NO: 514037 - DNA, 25 bp, Rattus norvegicus
gtggtcaaccactgagtcttcaaga

SEQ ID NO: 514038 - DNA, 25 bp, Rattus norvegicus
gtggtcaagcggcaagcacagtctc

SEQ ID NO: 514039 - DNA, 25 bp, Rattus norvegicus
gtggtcaagcgggaagcacagtctc

SEQ ID NO: 514040 - DNA, 25 bp, Rattus norvegicus
gtggtcaatgttaacaagccctgag

SEQ ID NO: 514041 - DNA, 25 bp, Rattus norvegicus
gtggtcaatgtttacaagccctgag

SEQ ID NO: 514042 - DNA, 25 bp, Rattus norvegicus
gtggtcacaaccatgtgatgtctgg

SEQ ID NO: 514043 - DNA, 25 bp, Rattus norvegicus
gtggtcacaaccttgtgatgtctgg

SEQ ID NO: 514044 - DNA, 25 bp, Rattus norvegicus
gtggtcacactcactttgctagaga

SEQ ID NO: 514045 - DNA, 25 bp, Rattus norvegicus
gtggtcacactctctttgctagaga

SEQ ID NO: 514046 - DNA, 25 bp, Rattus norvegicus
gtggtcacagcaccagtgatgtctt

SEQ ID NO: 514047 - DNA, 25 bp, Rattus norvegicus
gtggtcacagcactgctcttggaca

SEQ ID NO: 514048 - DNA, 25 bp, Rattus norvegicus
gtggtcacagcagcagtgatgtctt

SEQ ID NO: 514049 - DNA, 25 bp, Rattus norvegicus
gtggtcacagcagtgctcttggaca

SEQ ID NO: 514050 - DNA, 25 bp, Rattus norvegicus
gtggtcacagccacagtgaggcatt

SEQ ID NO: 514051 - DNA, 25 bp, Rattus norvegicus
gtggtcacagcctcagtgaggcatt

SEQ ID NO: 514052 - DNA, 25 bp, Rattus norvegicus
gtggtcacagctactcagggatcag

SEQ ID NO: 514053 - DNA, 25 bp, Rattus norvegicus
gtggtcacagcttctcagggatcag

SEQ ID NO: 514054 - DNA, 25 bp, Rattus norvegicus
gtggtcacagggaagtctaatgtct

SEQ ID NO: 514055 - DNA, 25 bp, Rattus norvegicus
gtggtcacagggactgctctgctgc

SEQ ID NO: 514056 - DNA, 25 bp, Rattus norvegicus
gtggtcacagggtagtctaatgtct

SEQ ID NO: 514057 - DNA, 25 bp, Rattus norvegicus
gtggtcacagggtctgctctgctgc

SEQ ID NO: 514058 - DNA, 25 bp, Rattus norvegicus
gtggtcacatgaactacatccaagt

SEQ ID NO: 514059 - DNA, 25 bp, Rattus norvegicus
gtggtcacatgatctacatccaagt

SEQ ID NO: 514060 - DNA, 25 bp, Rattus norvegicus
gtggtcaccacaccacgctctggag

SEQ ID NO: 514061 - DNA, 25 bp, Rattus norvegicus
gtggtcaccacagcacgctctggag

SEQ ID NO: 514062 - DNA, 25 bp, Rattus norvegicus
gtggtcaccaccaaactcagtaaag

SEQ ID NO: 514063 - DNA, 25 bp, Rattus norvegicus
gtggtcaccacctaactcagtaaag

SEQ ID NO: 514064 - DNA, 25 bp, Rattus norvegicus
gtggtcaccttcagttcagtagcag

SEQ ID NO: 514065 - DNA, 25 bp, Rattus norvegicus
gtggtcaccttctgttcagtagcag

SEQ ID NO: 514066 - DNA, 25 bp, Rattus norvegicus
gtggtcacgtgcatagtctttagtc

SEQ ID NO: 514067 - DNA, 25 bp, Rattus norvegicus
gtggtcacgtgcttagtctttagtc

SEQ ID NO: 514068 - DNA, 25 bp, Rattus norvegicus
gtggtcactcaacttcgctcctttt

SEQ ID NO: 514069 - DNA, 25 bp, Rattus norvegicus
gtggtcactcaagttcgctcctttt

SEQ ID NO: 514070 - DNA, 25 bp, Rattus norvegicus
gtggtcactcagctcaacaaggttg

SEQ ID NO: 514071 - DNA, 25 bp, Rattus norvegicus
gtggtcactcaggtcaacaaggttg

SEQ ID NO: 514072 - DNA, 25 bp, Rattus norvegicus
gtggtcacttacctgtaagctcaga

SEQ ID NO: 514073 - DNA, 25 bp, Rattus norvegicus
gtggtcacttacgtgtaagctcaga

SEQ ID NO: 514074 - DNA, 25 bp, Rattus norvegicus
gtggtcagaccccttaactgtgaat

SEQ ID NO: 514075 - DNA, 25 bp, Rattus norvegicus
gtggtcagacccgttaactgtgaat

SEQ ID NO: 514076 - DNA, 25 bp, Rattus norvegicus
gtggtcagacttaatttgaggcatc

SEQ ID NO: 514077 - DNA, 25 bp, Rattus norvegicus
gtggtcagactttatttgaggcatc

SEQ ID NO: 514078 - DNA, 25 bp, Rattus norvegicus
gtggtcagcaagcttagcctgcgct

SEQ ID NO: 514079 - DNA, 25 bp, Rattus norvegicus
gtggtcagcaaggttagcctgcgct

SEQ ID NO: 514080 - DNA, 25 bp, Rattus norvegicus
gtggtcagcactacaggacggcctt

SEQ ID NO: 514081 - DNA, 25 bp, Rattus norvegicus
gtggtcagcacttcaggacggcctt

SEQ ID NO: 514082 - DNA, 25 bp, Rattus norvegicus
gtggtcagcagcaactgccactgga

SEQ ID NO: 514083 - DNA, 25 bp, Rattus norvegicus
gtggtcagcagctactgccactgga

SEQ ID NO: 514084 - DNA, 25 bp, Rattus norvegicus
gtggtcagcagtcccaggtttgtaa

SEQ ID NO: 514085 - DNA, 25 bp, Rattus norvegicus
gtggtcagcagtgccaggtttgtaa

SEQ ID NO: 514086 - DNA, 25 bp, Rattus norvegicus
gtggtcagtgcaatgttttttaaac

SEQ ID NO: 514087 - DNA, 25 bp, Rattus norvegicus
gtggtcagtgcattgttttttaaac

SEQ ID NO: 514088 - DNA, 25 bp, Rattus norvegicus
gtggtcagttagatgcagtgtcctc

SEQ ID NO: 514089 - DNA, 25 bp, Rattus norvegicus
gtggtcagttagttgcagtgtcctc

SEQ ID NO: 514090 - DNA, 25 bp, Rattus norvegicus
gtggtcatcaaacaactggaggagt

SEQ ID NO: 514091 - DNA, 25 bp, Rattus norvegicus
gtggtcatcaaagaactggaggagt

SEQ ID NO: 514092 - DNA, 25 bp, Rattus norvegicus
gtggtcatcaccaaccaaccaacgt

SEQ ID NO: 514093 - DNA, 25 bp, Rattus norvegicus
gtggtcatcacctaccaaccaacgt

SEQ ID NO: 514094 - DNA, 25 bp, Rattus norvegicus
gtggtcatcattatctctgtgtgca

SEQ ID NO: 514095 - DNA, 25 bp, Rattus norvegicus
gtggtcatcattcccttctcgtcaa

SEQ ID NO: 514096 - DNA, 25 bp, Rattus norvegicus
gtggtcatcattgccttctcgtcaa

SEQ ID NO: 514097 - DNA, 25 bp, Rattus norvegicus
gtggtcatcattttctctgtgtgca

SEQ ID NO: 514098 - DNA, 25 bp, Rattus norvegicus
gtggtcatgacaaccttgtgcgttc

SEQ ID NO: 514099 - DNA, 25 bp, Rattus norvegicus
gtggtcatgacatccttgtgcgttc

SEQ ID NO: 514100 - DNA, 25 bp, Rattus norvegicus
gtggtcatgcaacacgagtccttcc

SEQ ID NO: 514101 - DNA, 25 bp, Rattus norvegicus
gtggtcatgcaagacgagtccttcc

SEQ ID NO: 514102 - DNA, 25 bp, Rattus norvegicus
gtggtcattactcttactgttgtca

SEQ ID NO: 514103 - DNA, 25 bp, Rattus norvegicus
gtggtcattactgttactgttgtca

SEQ ID NO: 514104 - DNA, 25 bp, Rattus norvegicus
gtggtcattctcaatgcccataact

SEQ ID NO: 514105 - DNA, 25 bp, Rattus norvegicus
gtggtcattctctatgcccataact

SEQ ID NO: 514106 - DNA, 25 bp, Rattus norvegicus
gtggtcatttccactgcagaataaa

SEQ ID NO: 514107 - DNA, 25 bp, Rattus norvegicus
gtggtcatttcctctgcagaataaa

SEQ ID NO: 514108 - DNA, 25 bp, Rattus norvegicus
gtggtcattttcagtgtggactaaa

SEQ ID NO: 514109 - DNA, 25 bp, Rattus norvegicus
gtggtcattttctgtgtggactaaa

SEQ ID NO: 514110 - DNA, 25 bp, Rattus norvegicus
gtggtccaaactcatttaccaaaat

SEQ ID NO: 514111 - DNA, 25 bp, Rattus norvegicus
gtggtccaaactgatttaccaaaat

SEQ ID NO: 514112 - DNA, 25 bp, Rattus norvegicus
gtggtccaagcaatgcccaacagtc

SEQ ID NO: 514113 - DNA, 25 bp, Rattus norvegicus
gtggtccaagcattgcccaacagtc

SEQ ID NO: 514114 - DNA, 25 bp, Rattus norvegicus
gtggtccaagctatggcgcgcagaa

SEQ ID NO: 514115 - DNA, 25 bp, Rattus norvegicus
gtggtccaagctttggcgcgcagaa

SEQ ID NO: 514116 - DNA, 25 bp, Rattus norvegicus
gtggtccaaggtaccagctctgtaa

SEQ ID NO: 514117 - DNA, 25 bp, Rattus norvegicus
gtggtccaaggttccagctctgtaa

SEQ ID NO: 514118 - DNA, 25 bp, Rattus norvegicus
gtggtccacacgaacaccatgacac

SEQ ID NO: 514119 - DNA, 25 bp, Rattus norvegicus
gtggtccacacgtacaccatgacac

SEQ ID NO: 514120 - DNA, 25 bp, Rattus norvegicus
gtggtccacaggatgagcgtgcaca

SEQ ID NO: 514121 - DNA, 25 bp, Rattus norvegicus
gtggtccacaggttgagcgtgcaca

SEQ ID NO: 514122 - DNA, 25 bp, Rattus norvegicus
gtggtccagacgagttcagcggtac

SEQ ID NO: 514123 - DNA, 25 bp, Rattus norvegicus
gtggtccagacgtgttcagcggtac

SEQ ID NO: 514124 - DNA, 25 bp, Rattus norvegicus
gtggtccagcgccattcagaatgtg

SEQ ID NO: 514125 - DNA, 25 bp, Rattus norvegicus
gtggtccagcgcgattcagaatgtg

SEQ ID NO: 514126 - DNA, 25 bp, Rattus norvegicus
gtggtccaggttatattgttcaaat

SEQ ID NO: 514127 - DNA, 25 bp, Rattus norvegicus
gtggtccaggttttattgttcaaat

SEQ ID NO: 514128 - DNA, 25 bp, Rattus norvegicus
gtggtccatactatacttttgcgag

SEQ ID NO: 514129 - DNA, 25 bp, Rattus norvegicus
gtggtccatactttacttttgcgag

SEQ ID NO: 514130 - DNA, 25 bp, Rattus norvegicus
gtggtccatatgaagccccgcagtg

SEQ ID NO: 514131 - DNA, 25 bp, Rattus norvegicus
gtggtccatatgtagccccgcagtg

SEQ ID NO: 514132 - DNA, 25 bp, Rattus norvegicus
gtggtccatctgagtactgctgaac

SEQ ID NO: 514133 - DNA, 25 bp, Rattus norvegicus
gtggtccatctgtgtactgctgaac

SEQ ID NO: 514134 - DNA, 25 bp, Rattus norvegicus
gtggtcccagcaattaaccttaaat

SEQ ID NO: 514135 - DNA, 25 bp, Rattus norvegicus
gtggtcccagcatttaaccttaaat

SEQ ID NO: 514136 - DNA, 25 bp, Rattus norvegicus
gtggtcccagctcatacatctgaaa

SEQ ID NO: 514137 - DNA, 25 bp, Rattus norvegicus
gtggtcccagctgatacatctgaaa

SEQ ID NO: 514138 - DNA, 25 bp, Rattus norvegicus
gtggtcccattcaccaggcttgggt

SEQ ID NO: 514139 - DNA, 25 bp, Rattus norvegicus
gtggtcccattctccaggcttgggt

SEQ ID NO: 514140 - DNA, 25 bp, Rattus norvegicus
gtggtccccaaaactacttgcattg

SEQ ID NO: 514141 - DNA, 25 bp, Rattus norvegicus
gtggtccccaaatctacttgcattg

SEQ ID NO: 514142 - DNA, 25 bp, Rattus norvegicus
gtggtccccaacataccgtgcggag

SEQ ID NO: 514143 - DNA, 25 bp, Rattus norvegicus
gtggtccccaacttaccgtgcggag

SEQ ID NO: 514144 - DNA, 25 bp, Rattus norvegicus
gtggtccccagaccctaagcggaaa

SEQ ID NO: 514145 - DNA, 25 bp, Rattus norvegicus
gtggtccccagagcctaagcggaaa

SEQ ID NO: 514146 - DNA, 25 bp, Rattus norvegicus
gtggtccccatcagaaagctggctg

SEQ ID NO: 514147 - DNA, 25 bp, Rattus norvegicus
gtggtccccatcctctgaaatgtgt

SEQ ID NO: 514148 - DNA, 25 bp, Rattus norvegicus
gtggtccccatcgtctgaaatgtgt

SEQ ID NO: 514149 - DNA, 25 bp, Rattus norvegicus
gtggtccccatctgaaagctggctg

SEQ ID NO: 514150 - DNA, 25 bp, Rattus norvegicus
gtggtcccctagctaaaatgactca

SEQ ID NO: 514151 - DNA, 25 bp, Rattus norvegicus
gtggtcccctaggtaaaatgactca

SEQ ID NO: 514152 - DNA, 25 bp, Rattus norvegicus
gtggtcccctcactgaatgtacagt

SEQ ID NO: 514153 - DNA, 25 bp, Rattus norvegicus
gtggtcccctcagtgaatgtacagt

SEQ ID NO: 514154 - DNA, 25 bp, Rattus norvegicus
gtggtcccgttcaaagcattttctt

SEQ ID NO: 514155 - DNA, 25 bp, Rattus norvegicus
gtggtcccgttctaagcattttctt

SEQ ID NO: 514156 - DNA, 25 bp, Rattus norvegicus
gtggtccctaaaaagtcagtggcct

SEQ ID NO: 514157 - DNA, 25 bp, Rattus norvegicus
gtggtccctaaatagtcagtggcct

SEQ ID NO: 514158 - DNA, 25 bp, Rattus norvegicus
gtggtccctatcatgttgctgctgc

SEQ ID NO: 514159 - DNA, 25 bp, Rattus norvegicus
gtggtccctatcttgttgctgctgc

SEQ ID NO: 514160 - DNA, 25 bp, Rattus norvegicus
gtggtccctcacagaacatgctagt

SEQ ID NO: 514161 - DNA, 25 bp, Rattus norvegicus
gtggtccctcaccaagactaggcta

SEQ ID NO: 514162 - DNA, 25 bp, Rattus norvegicus
gtggtccctcacgaagactaggcta

SEQ ID NO: 514163 - DNA, 25 bp, Rattus norvegicus
gtggtccctcactgaacatgctagt

SEQ ID NO: 514164 - DNA, 25 bp, Rattus norvegicus
gtggtccctttgagcttgtcagaga

SEQ ID NO: 514165 - DNA, 25 bp, Rattus norvegicus
gtggtccctttgtgcttgtcagaga

SEQ ID NO: 514166 - DNA, 25 bp, Rattus norvegicus
gtggtccgcatcaagattgcctact

SEQ ID NO: 514167 - DNA, 25 bp, Rattus norvegicus
gtggtccgcatctagattgcctact

SEQ ID NO: 514168 - DNA, 25 bp, Rattus norvegicus
gtggtcctaaatccagttctcacat

SEQ ID NO: 514169 - DNA, 25 bp, Rattus norvegicus
gtggtcctaaatgcagttctcacat

SEQ ID NO: 514170 - DNA, 25 bp, Rattus norvegicus
gtggtcctagagcatatgtctccag

SEQ ID NO: 514171 - DNA, 25 bp, Rattus norvegicus
gtggtcctagaggatatgtctccag

SEQ ID NO: 514172 - DNA, 25 bp, Rattus norvegicus
gtggtcctcaaactctatcctaaca

SEQ ID NO: 514173 - DNA, 25 bp, Rattus norvegicus
gtggtcctcaaagtctatcctaaca

SEQ ID NO: 514174 - DNA, 25 bp, Rattus norvegicus
gtggtcctcagcactagagcatgga

SEQ ID NO: 514175 - DNA, 25 bp, Rattus norvegicus
gtggtcctcagctctagagcatgga

SEQ ID NO: 514176 - DNA, 25 bp, Rattus norvegicus
gtggtcctgaccagagctttcaaag

SEQ ID NO: 514177 - DNA, 25 bp, Rattus norvegicus
gtggtcctgacctgagctttcaaag

SEQ ID NO: 514178 - DNA, 25 bp, Rattus norvegicus
gtggtcctggtcattctagaacctg

SEQ ID NO: 514179 - DNA, 25 bp, Rattus norvegicus
gtggtcctggtctttctagaacctg

SEQ ID NO: 514180 - DNA, 25 bp, Rattus norvegicus
gtggtccttaacactgggaagcact

SEQ ID NO: 514181 - DNA, 25 bp, Rattus norvegicus
gtggtccttaactctgggaagcact

SEQ ID NO: 514182 - DNA, 25 bp, Rattus norvegicus
gtggtccttagtacagtgacatcta

SEQ ID NO: 514183 - DNA, 25 bp, Rattus norvegicus
gtggtccttagtcagcagccagaag

SEQ ID NO: 514184 - DNA, 25 bp, Rattus norvegicus
gtggtccttagtgagcagccagaag

SEQ ID NO: 514185 - DNA, 25 bp, Rattus norvegicus
gtggtccttagttcagtgacatcta

SEQ ID NO: 514186 - DNA, 25 bp, Rattus norvegicus
gtggtccttgcaactctgatatata

SEQ ID NO: 514187 - DNA, 25 bp, Rattus norvegicus
gtggtccttgcatctctgatatata

SEQ ID NO: 514188 - DNA, 25 bp, Rattus norvegicus
gtggtccttggcaggcaagcgaatc

SEQ ID NO: 514189 - DNA, 25 bp, Rattus norvegicus
gtggtccttggctggcaagcgaatc

SEQ ID NO: 514190 - DNA, 25 bp, Rattus norvegicus
gtggtcctttacaaacttcttccag

SEQ ID NO: 514191 - DNA, 25 bp, Rattus norvegicus
gtggtcctttactaacttcttccag

SEQ ID NO: 514192 - DNA, 25 bp, Rattus norvegicus
gtggtcctttgacgcttcaagcaca

SEQ ID NO: 514193 - DNA, 25 bp, Rattus norvegicus
gtggtcctttgaggcttcaagcaca

SEQ ID NO: 514194 - DNA, 25 bp, Rattus norvegicus
gtggtcgaatgaaatgtgcttcccc

SEQ ID NO: 514195 - DNA, 25 bp, Rattus norvegicus
gtggtcgaatgatatgtgcttcccc

SEQ ID NO: 514196 - DNA, 25 bp, Rattus norvegicus
gtggtcgattccatcgtctatacaa

SEQ ID NO: 514197 - DNA, 25 bp, Rattus norvegicus
gtggtcgattccttcgtctatacaa

SEQ ID NO: 514198 - DNA, 25 bp, Rattus norvegicus
gtggtcgctactactcgaacatatg

SEQ ID NO: 514199 - DNA, 25 bp, Rattus norvegicus
gtggtcgctacttctcgaacatatg

SEQ ID NO: 514200 - DNA, 25 bp, Rattus norvegicus
gtggtcgggcacagcacctagcaaa

SEQ ID NO: 514201 - DNA, 25 bp, Rattus norvegicus
gtggtcgggcactgcacctagcaaa

SEQ ID NO: 514202 - DNA, 25 bp, Rattus norvegicus
gtggtcgtatttcctttataacttt

SEQ ID NO: 514203 - DNA, 25 bp, Rattus norvegicus
gtggtcgtatttgctttataacttt

SEQ ID NO: 514204 - DNA, 25 bp, Rattus norvegicus
gtggtcgtcaagaaacatcaatttg

SEQ ID NO: 514205 - DNA, 25 bp, Rattus norvegicus
gtggtcgtcaagtaacatcaatttg

SEQ ID NO: 514206 - DNA, 25 bp, Rattus norvegicus
gtggtcgtccaaataactcaatctt

SEQ ID NO: 514207 - DNA, 25 bp, Rattus norvegicus
gtggtcgtccaattaactcaatctt

SEQ ID NO: 514208 - DNA, 25 bp, Rattus norvegicus
gtggtcgtcctaatcgtggcagcag

SEQ ID NO: 514209 - DNA, 25 bp, Rattus norvegicus
gtggtcgtcctattcgtggcagcag

SEQ ID NO: 514210 - DNA, 25 bp, Rattus norvegicus
gtggtcgtgaataccatccagcgtc

SEQ ID NO: 514211 - DNA, 25 bp, Rattus norvegicus
gtggtcgtgaattccatccagcgtc

SEQ ID NO: 514212 - DNA, 25 bp, Rattus norvegicus
gtggtctaacatattctcagggttc

SEQ ID NO: 514213 - DNA, 25 bp, Rattus norvegicus
gtggtctaacattttctcagggttc

SEQ ID NO: 514214 - DNA, 25 bp, Rattus norvegicus
gtggtctaatagctggaattttcat

SEQ ID NO: 514215 - DNA, 25 bp, Rattus norvegicus
gtggtctaataggtggaattttcat

SEQ ID NO: 514216 - DNA, 25 bp, Rattus norvegicus
gtggtctaatccaatagtccttatt

SEQ ID NO: 514217 - DNA, 25 bp, Rattus norvegicus
gtggtctaatcctatagtccttatt

SEQ ID NO: 514218 - DNA, 25 bp, Rattus norvegicus
gtggtctaatttctcttatttatgg

SEQ ID NO: 514219 - DNA, 25 bp, Rattus norvegicus
gtggtctaatttgtcttatttatgg

SEQ ID NO: 514220 - DNA, 25 bp, Rattus norvegicus
gtggtctataggctccaccagccct

SEQ ID NO: 514221 - DNA, 25 bp, Rattus norvegicus
gtggtctatagggtccaccagccct

SEQ ID NO: 514222 - DNA, 25 bp, Rattus norvegicus
gtggtctatgctaccagattggctg

SEQ ID NO: 514223 - DNA, 25 bp, Rattus norvegicus
gtggtctatgctcacaccatggaga

SEQ ID NO: 514224 - DNA, 25 bp, Rattus norvegicus
gtggtctatgctgacaccatggaga

SEQ ID NO: 514225 - DNA, 25 bp, Rattus norvegicus
gtggtctatgcttccagattggctg

SEQ ID NO: 514226 - DNA, 25 bp, Rattus norvegicus
gtggtctcacacataggtacgtcct

SEQ ID NO: 514227 - DNA, 25 bp, Rattus norvegicus
gtggtctcacacatcaggtttaaac

SEQ ID NO: 514228 - DNA, 25 bp, Rattus norvegicus
gtggtctcacacttaggtacgtcct

SEQ ID NO: 514229 - DNA, 25 bp, Rattus norvegicus
gtggtctcacacttcaggtttaaac

SEQ ID NO: 514230 - DNA, 25 bp, Rattus norvegicus
gtggtctcacagcattgctgctaca

SEQ ID NO: 514231 - DNA, 25 bp, Rattus norvegicus
gtggtctcacaggattgctgctaca

SEQ ID NO: 514232 - DNA, 25 bp, Rattus norvegicus
gtggtctcatgcacaaggtggtgta

SEQ ID NO: 514233 - DNA, 25 bp, Rattus norvegicus
gtggtctcatgctcaaggtggtgta

SEQ ID NO: 514234 - DNA, 25 bp, Rattus norvegicus
gtggtctccacacgtactgacagca

SEQ ID NO: 514235 - DNA, 25 bp, Rattus norvegicus
gtggtctccacaggtactgacagca

SEQ ID NO: 514236 - DNA, 25 bp, Rattus norvegicus
gtggtctccacgaaggtgctgtccg

SEQ ID NO: 514237 - DNA, 25 bp, Rattus norvegicus
gtggtctccacgtaggtgctgtccg

SEQ ID NO: 514238 - DNA, 25 bp, Rattus norvegicus
gtggtctccctcctagctaaaatga

SEQ ID NO: 514239 - DNA, 25 bp, Rattus norvegicus
gtggtctccctcgtagctaaaatga

SEQ ID NO: 514240 - DNA, 25 bp, Rattus norvegicus
gtggtctcctcgacagtgaagagtc

SEQ ID NO: 514241 - DNA, 25 bp, Rattus norvegicus
gtggtctcctcgtcagtgaagagtc

SEQ ID NO: 514242 - DNA, 25 bp, Rattus norvegicus
gtggtctcgctcagacaaagggttt

SEQ ID NO: 514243 - DNA, 25 bp, Rattus norvegicus
gtggtctcgctctgacaaagggttt

SEQ ID NO: 514244 - DNA, 25 bp, Rattus norvegicus
gtggtctcggagaacatgctctgcg

SEQ ID NO: 514245 - DNA, 25 bp, Rattus norvegicus
gtggtctcggagctttgtgaattct

SEQ ID NO: 514246 - DNA, 25 bp, Rattus norvegicus
gtggtctcggaggtttgtgaattct

SEQ ID NO: 514247 - DNA, 25 bp, Rattus norvegicus
gtggtctcggagtacatgctctgcg

SEQ ID NO: 514248 - DNA, 25 bp, Rattus norvegicus
gtggtctctccaaggcgatttacag

SEQ ID NO: 514249 - DNA, 25 bp, Rattus norvegicus
gtggtctctccatggcgatttacag

SEQ ID NO: 514250 - DNA, 25 bp, Rattus norvegicus
gtggtctctcttaagctttgtacat

SEQ ID NO: 514251 - DNA, 25 bp, Rattus norvegicus
gtggtctctctttagctttgtacat

SEQ ID NO: 514252 - DNA, 25 bp, Rattus norvegicus
gtggtctctgacctcaaaggacaat

SEQ ID NO: 514253 - DNA, 25 bp, Rattus norvegicus
gtggtctctgacgtcaaaggacaat

SEQ ID NO: 514254 - DNA, 25 bp, Rattus norvegicus
gtggtctgacacctgattggctcat

SEQ ID NO: 514255 - DNA, 25 bp, Rattus norvegicus
gtggtctgacacgtgattggctcat

SEQ ID NO: 514256 - DNA, 25 bp, Rattus norvegicus
gtggtctgaggcatatagagcatat

SEQ ID NO: 514257 - DNA, 25 bp, Rattus norvegicus
gtggtctgaggcttatagagcatat

SEQ ID NO: 514258 - DNA, 25 bp, Rattus norvegicus
gtggtctgagttataactcccagga

SEQ ID NO: 514259 - DNA, 25 bp, Rattus norvegicus
gtggtctgagttttaactcccagga

SEQ ID NO: 514260 - DNA, 25 bp, Rattus norvegicus
gtggtctgcatgacacaatgtgtgt

SEQ ID NO: 514261 - DNA, 25 bp, Rattus norvegicus
gtggtctgcatgtcacaatgtgtgt

SEQ ID NO: 514262 - DNA, 25 bp, Rattus norvegicus
gtggtctgctttattaatccctgaa

SEQ ID NO: 514263 - DNA, 25 bp, Rattus norvegicus
gtggtctgcttttttaatccctgaa

SEQ ID NO: 514264 - DNA, 25 bp, Rattus norvegicus
gtggtctggacaaagcttgtattct

SEQ ID NO: 514265 - DNA, 25 bp, Rattus norvegicus
gtggtctggacatagcttgtattct

SEQ ID NO: 514266 - DNA, 25 bp, Rattus norvegicus
gtggtctggctcagtactgatctgg

SEQ ID NO: 514267 - DNA, 25 bp, Rattus norvegicus
gtggtctggctctgtactgatctgg

SEQ ID NO: 514268 - DNA, 25 bp, Rattus norvegicus
gtggtctgtaatctaagcacgttac

SEQ ID NO: 514269 - DNA, 25 bp, Rattus norvegicus
gtggtctgtaatgtaagcacgttac

SEQ ID NO: 514270 - DNA, 25 bp, Rattus norvegicus
gtggtctgtacgaggtcaggtccct

SEQ ID NO: 514271 - DNA, 25 bp, Rattus norvegicus
gtggtctgtacgtggtcaggtccct

SEQ ID NO: 514272 - DNA, 25 bp, Rattus norvegicus
gtggtctgtgcccatcattccaaat

SEQ ID NO: 514273 - DNA, 25 bp, Rattus norvegicus
gtggtctgtgccgatcattccaaat

SEQ ID NO: 514274 - DNA, 25 bp, Rattus norvegicus
gtggtctgtgtcataaagtgctgct

SEQ ID NO: 514275 - DNA, 25 bp, Rattus norvegicus
gtggtctgtgtcttaaagtgctgct

SEQ ID NO: 514276 - DNA, 25 bp, Rattus norvegicus
gtggtcttaggtagaacccaggcta

SEQ ID NO: 514277 - DNA, 25 bp, Rattus norvegicus
gtggtcttaggttgaacccaggcta

SEQ ID NO: 514278 - DNA, 25 bp, Rattus norvegicus
gtggtcttcagtcttaacgcatcat

SEQ ID NO: 514279 - DNA, 25 bp, Rattus norvegicus
gtggtcttcagtgttaacgcatcat

SEQ ID NO: 514280 - DNA, 25 bp, Rattus norvegicus
gtggtcttcatcagtataaccctga

SEQ ID NO: 514281 - DNA, 25 bp, Rattus norvegicus
gtggtcttcatctgtataaccctga

SEQ ID NO: 514282 - DNA, 25 bp, Rattus norvegicus
gtggtcttccagacagcgtgcgaac

SEQ ID NO: 514283 - DNA, 25 bp, Rattus norvegicus
gtggtcttccagtcagcgtgcgaac

SEQ ID NO: 514284 - DNA, 25 bp, Rattus norvegicus
gtggtcttcctaaatacttctctag

SEQ ID NO: 514285 - DNA, 25 bp, Rattus norvegicus
gtggtcttcctatatacttctctag

SEQ ID NO: 514286 - DNA, 25 bp, Rattus norvegicus
gtggtcttctcaacactcaaagtca

SEQ ID NO: 514287 - DNA, 25 bp, Rattus norvegicus
gtggtcttctcatcactcaaagtca

SEQ ID NO: 514288 - DNA, 25 bp, Rattus norvegicus
gtggtcttgaacatgtggccgcctg

SEQ ID NO: 514289 - DNA, 25 bp, Rattus norvegicus
gtggtcttgaacttgtggccgcctg

SEQ ID NO: 514290 - DNA, 25 bp, Rattus norvegicus
gtggtcttgaccacaaggacctcct

SEQ ID NO: 514291 - DNA, 25 bp, Rattus norvegicus
gtggtcttgacctcaaggacctcct

SEQ ID NO: 514292 - DNA, 25 bp, Rattus norvegicus
gtggtcttgccaacagtataataca

SEQ ID NO: 514293 - DNA, 25 bp, Rattus norvegicus
gtggtcttgccatcagtataataca

SEQ ID NO: 514294 - DNA, 25 bp, Rattus norvegicus
gtggtcttggtcacttgcatcatcg

SEQ ID NO: 514295 - DNA, 25 bp, Rattus norvegicus
gtggtcttggtctcttgcatcatcg

SEQ ID NO: 514296 - DNA, 25 bp, Rattus norvegicus
gtggtcttggtgagaactgtaaact

SEQ ID NO: 514297 - DNA, 25 bp, Rattus norvegicus
gtggtcttggtgtgaactgtaaact

SEQ ID NO: 514298 - DNA, 25 bp, Rattus norvegicus
gtggtctttagacggcttttccagt

SEQ ID NO: 514299 - DNA, 25 bp, Rattus norvegicus
gtggtctttagagggcttttccagt

SEQ ID NO: 514300 - DNA, 25 bp, Rattus norvegicus
gtggtctttagtcttccagggcaca

SEQ ID NO: 514301 - DNA, 25 bp, Rattus norvegicus
gtggtctttagtgttccagggcaca

SEQ ID NO: 514302 - DNA, 25 bp, Rattus norvegicus
gtggtctttatcagcctgttactca

SEQ ID NO: 514303 - DNA, 25 bp, Rattus norvegicus
gtggtctttatctgcctgttactca

SEQ ID NO: 514304 - DNA, 25 bp, Rattus norvegicus
gtggtctttcacatgcttaactgca

SEQ ID NO: 514305 - DNA, 25 bp, Rattus norvegicus
gtggtctttcacttgcttaactgca

SEQ ID NO: 514306 - DNA, 25 bp, Rattus norvegicus
gtggtctttctcacattcgtgggca

SEQ ID NO: 514307 - DNA, 25 bp, Rattus norvegicus
gtggtctttctctcattcgtgggca

SEQ ID NO: 514308 - DNA, 25 bp, Rattus norvegicus
gtggtctttgaaaaatgttgtttgc

SEQ ID NO: 514309 - DNA, 25 bp, Rattus norvegicus
gtggtctttgaataatgttgtttgc

SEQ ID NO: 514310 - DNA, 25 bp, Rattus norvegicus
gtggtgaacagaaaccttctacccc

SEQ ID NO: 514311 - DNA, 25 bp, Rattus norvegicus
gtggtgaacagataccttctacccc

SEQ ID NO: 514312 - DNA, 25 bp, Rattus norvegicus
gtggtgaacgcacagcgggctctta

SEQ ID NO: 514313 - DNA, 25 bp, Rattus norvegicus
gtggtgaacgcagagcgggctctta

SEQ ID NO: 514314 - DNA, 25 bp, Rattus norvegicus
gtggtgaatccacaatcctacactt

SEQ ID NO: 514315 - DNA, 25 bp, Rattus norvegicus
gtggtgaatccagaatcctacactt

SEQ ID NO: 514316 - DNA, 25 bp, Rattus norvegicus
gtggtgaattgcaacctcattggcc

SEQ ID NO: 514317 - DNA, 25 bp, Rattus norvegicus
gtggtgaattgctacctcattggcc

SEQ ID NO: 514318 - DNA, 25 bp, Rattus norvegicus
gtggtgaatttacccgtagcagcat

SEQ ID NO: 514319 - DNA, 25 bp, Rattus norvegicus
gtggtgaatttagccgtagcagcat

SEQ ID NO: 514320 - DNA, 25 bp, Rattus norvegicus
gtggtgacaagaccagagcccctac

SEQ ID NO: 514321 - DNA, 25 bp, Rattus norvegicus
gtggtgacaagagcagagcccctac

SEQ ID NO: 514322 - DNA, 25 bp, Rattus norvegicus
gtggtgacagctatctcaaggtttt

SEQ ID NO: 514323 - DNA, 25 bp, Rattus norvegicus
gtggtgacagctttctcaaggtttt

SEQ ID NO: 514324 - DNA, 25 bp, Rattus norvegicus
gtggtgacaggaatgctggccctca

SEQ ID NO: 514325 - DNA, 25 bp, Rattus norvegicus
gtggtgacaggattgctggccctca

SEQ ID NO: 514326 - DNA, 25 bp, Rattus norvegicus
gtggtgaccaagactgcgctcctga

SEQ ID NO: 514327 - DNA, 25 bp, Rattus norvegicus
gtggtgaccaagtctgcgctcctga

SEQ ID NO: 514328 - DNA, 25 bp, Rattus norvegicus
gtggtgaccagcattttgtttcctc

SEQ ID NO: 514329 - DNA, 25 bp, Rattus norvegicus
gtggtgaccagctttttgtttcctc

SEQ ID NO: 514330 - DNA, 25 bp, Rattus norvegicus
gtggtgaccagtctcatcagccttc

SEQ ID NO: 514331 - DNA, 25 bp, Rattus norvegicus
gtggtgaccagtgtcatcagccttc

SEQ ID NO: 514332 - DNA, 25 bp, Rattus norvegicus
gtggtgaccctcacgcgcgctggct

SEQ ID NO: 514333 - DNA, 25 bp, Rattus norvegicus
gtggtgaccctctcgcgcgctggct

SEQ ID NO: 514334 - DNA, 25 bp, Rattus norvegicus
gtggtgaccctgaaaaatgtgcttt

SEQ ID NO: 514335 - DNA, 25 bp, Rattus norvegicus
gtggtgaccctgtaaaatgtgcttt

SEQ ID NO: 514336 - DNA, 25 bp, Rattus norvegicus
gtggtgacccttctgttatttccat

SEQ ID NO: 514337 - DNA, 25 bp, Rattus norvegicus
gtggtgacccttgtgttatttccat

SEQ ID NO: 514338 - DNA, 25 bp, Rattus norvegicus
gtggtgaccttcctgcgtctttgat

SEQ ID NO: 514339 - DNA, 25 bp, Rattus norvegicus
gtggtgaccttcgtgcgtctttgat

SEQ ID NO: 514340 - DNA, 25 bp, Rattus norvegicus
gtggtgacctttaatctgtctctaa

SEQ ID NO: 514341 - DNA, 25 bp, Rattus norvegicus
gtggtgaccttttatctgtctctaa

SEQ ID NO: 514342 - DNA, 25 bp, Rattus norvegicus
gtggtgacggaactcaatggcctcc

SEQ ID NO: 514343 - DNA, 25 bp, Rattus norvegicus
gtggtgacggaagtcaatggcctcc

SEQ ID NO: 514344 - DNA, 25 bp, Rattus norvegicus
gtggtgacggtactgaaattgaccc

SEQ ID NO: 514345 - DNA, 25 bp, Rattus norvegicus
gtggtgacggtagtgaaattgaccc

SEQ ID NO: 514346 - DNA, 25 bp, Rattus norvegicus
gtggtgactgcactcaacaggctaa

SEQ ID NO: 514347 - DNA, 25 bp, Rattus norvegicus
gtggtgactgcagtcaacaggctaa

SEQ ID NO: 514348 - DNA, 25 bp, Rattus norvegicus
gtggtgacttagaacttggaaactt

SEQ ID NO: 514349 - DNA, 25 bp, Rattus norvegicus
gtggtgacttagtacttggaaactt

SEQ ID NO: 514350 - DNA, 25 bp, Rattus norvegicus
gtggtgacttcacacgccataatgg

SEQ ID NO: 514351 - DNA, 25 bp, Rattus norvegicus
gtggtgacttcagacgccataatgg

SEQ ID NO: 514352 - DNA, 25 bp, Rattus norvegicus
gtggtgagaatacttaaactctctc

SEQ ID NO: 514353 - DNA, 25 bp, Rattus norvegicus
gtggtgagaatagttaaactctctc

SEQ ID NO: 514354 - DNA, 25 bp, Rattus norvegicus
gtggtgagacacaggttgttctctt

SEQ ID NO: 514355 - DNA, 25 bp, Rattus norvegicus
gtggtgagacactggttgttctctt

SEQ ID NO: 514356 - DNA, 25 bp, Rattus norvegicus
gtggtgagagctatctcccggtttc

SEQ ID NO: 514357 - DNA, 25 bp, Rattus norvegicus
gtggtgagagctttctcccggtttc

SEQ ID NO: 514358 - DNA, 25 bp, Rattus norvegicus
gtggtgagataaccccatccagttt

SEQ ID NO: 514359 - DNA, 25 bp, Rattus norvegicus
gtggtgagataagcccatccagttt

SEQ ID NO: 514360 - DNA, 25 bp, Rattus norvegicus
gtggtgagcacaatgttcccctcct

SEQ ID NO: 514361 - DNA, 25 bp, Rattus norvegicus
gtggtgagcacattgttcccctcct

SEQ ID NO: 514362 - DNA, 25 bp, Rattus norvegicus
gtggtgagcctcattggtgtgaaaa

SEQ ID NO: 514363 - DNA, 25 bp, Rattus norvegicus
gtggtgagcctctttggtgtgaaaa

SEQ ID NO: 514364 - DNA, 25 bp, Rattus norvegicus
gtggtgagcgcactgctatatttat

SEQ ID NO: 514365 - DNA, 25 bp, Rattus norvegicus
gtggtgagcgcagtgctatatttat

SEQ ID NO: 514366 - DNA, 25 bp, Rattus norvegicus
gtggtgagctacaggtcagcctgct

SEQ ID NO: 514367 - DNA, 25 bp, Rattus norvegicus
gtggtgagctactggtcagcctgct

SEQ ID NO: 514368 - DNA, 25 bp, Rattus norvegicus
gtggtgatcaccctgcaaattaata

SEQ ID NO: 514369 - DNA, 25 bp, Rattus norvegicus
gtggtgatcaccgtgcaaattaata

SEQ ID NO: 514370 - DNA, 25 bp, Rattus norvegicus
gtggtgatccggacacaatgcacat

SEQ ID NO: 514371 - DNA, 25 bp, Rattus norvegicus
gtggtgatccggtcacaatgcacat

SEQ ID NO: 514372 - DNA, 25 bp, Rattus norvegicus
gtggtgatctgtcttgttccagcat

SEQ ID NO: 514373 - DNA, 25 bp, Rattus norvegicus
gtggtgatctgtgttgttccagcat

SEQ ID NO: 514374 - DNA, 25 bp, Rattus norvegicus
gtggtgatgaatactgccgccgtta

SEQ ID NO: 514375 - DNA, 25 bp, Rattus norvegicus
gtggtgatgaattctgccgccgtta

SEQ ID NO: 514376 - DNA, 25 bp, Rattus norvegicus
gtggtgatgacacccttcgcagacc

SEQ ID NO: 514377 - DNA, 25 bp, Rattus norvegicus
gtggtgatgacagccttcgcagacc

SEQ ID NO: 514378 - DNA, 25 bp, Rattus norvegicus
gtggtgatgaccagggcgatctcat

SEQ ID NO: 514379 - DNA, 25 bp, Rattus norvegicus
gtggtgatgacctgggcgatctcat

SEQ ID NO: 514380 - DNA, 25 bp, Rattus norvegicus
gtggtgatgacgctaaccctgactc

SEQ ID NO: 514381 - DNA, 25 bp, Rattus norvegicus
gtggtgatgacggtaaccctgactc

SEQ ID NO: 514382 - DNA, 25 bp, Rattus norvegicus
gtggtgatgcggattctcctgaaaa

SEQ ID NO: 514383 - DNA, 25 bp, Rattus norvegicus
gtggtgatgcggtttctcctgaaaa

SEQ ID NO: 514384 - DNA, 25 bp, Rattus norvegicus
gtggtgatggtcacctctctggtag

SEQ ID NO: 514385 - DNA, 25 bp, Rattus norvegicus
gtggtgatggtcatcgcatactgcc

SEQ ID NO: 514386 - DNA, 25 bp, Rattus norvegicus
gtggtgatggtctcctctctggtag

SEQ ID NO: 514387 - DNA, 25 bp, Rattus norvegicus
gtggtgatggtcttcgcatactgcc

SEQ ID NO: 514388 - DNA, 25 bp, Rattus norvegicus
gtggtgatggtgatactcctcactc

SEQ ID NO: 514389 - DNA, 25 bp, Rattus norvegicus
gtggtgatggtgttactcctcactc

SEQ ID NO: 514390 - DNA, 25 bp, Rattus norvegicus
gtggtgatgtccattcaggttccca

SEQ ID NO: 514391 - DNA, 25 bp, Rattus norvegicus
gtggtgatgtcctttcaggttccca

SEQ ID NO: 514392 - DNA, 25 bp, Rattus norvegicus
gtggtgattgctacagcactggccg

SEQ ID NO: 514393 - DNA, 25 bp, Rattus norvegicus
gtggtgattgcttcagcactggccg

SEQ ID NO: 514394 - DNA, 25 bp, Rattus norvegicus
gtggtgattggtcgctacagcaaac

SEQ ID NO: 514395 - DNA, 25 bp, Rattus norvegicus
gtggtgattggtggctacagcaaac

SEQ ID NO: 514396 - DNA, 25 bp, Rattus norvegicus
gtggtgcaagatcccttggttgcta

SEQ ID NO: 514397 - DNA, 25 bp, Rattus norvegicus
gtggtgcaagatgccttggttgcta

SEQ ID NO: 514398 - DNA, 25 bp, Rattus norvegicus
gtggtgcacaagagacactccaaat

SEQ ID NO: 514399 - DNA, 25 bp, Rattus norvegicus
gtggtgcacaagtgacactccaaat

SEQ ID NO: 514400 - DNA, 25 bp, Rattus norvegicus
gtggtgcacagacgtcacagacata

SEQ ID NO: 514401 - DNA, 25 bp, Rattus norvegicus
gtggtgcacagaggtcacagacata

SEQ ID NO: 514402 - DNA, 25 bp, Rattus norvegicus
gtggtgcacataaatacaggtagac

SEQ ID NO: 514403 - DNA, 25 bp, Rattus norvegicus
gtggtgcacatatatacaggtagac

SEQ ID NO: 514404 - DNA, 25 bp, Rattus norvegicus
gtggtgcacatcacacgggcgctgt

SEQ ID NO: 514405 - DNA, 25 bp, Rattus norvegicus
gtggtgcacatctcacgggcgctgt

SEQ ID NO: 514406 - DNA, 25 bp, Rattus norvegicus
gtggtgcaccacctgatgacgacat

SEQ ID NO: 514407 - DNA, 25 bp, Rattus norvegicus
gtggtgcaccacgtgatgacgacat

SEQ ID NO: 514408 - DNA, 25 bp, Rattus norvegicus
gtggtgcacgttacaagttttcttg

SEQ ID NO: 514409 - DNA, 25 bp, Rattus norvegicus
gtggtgcacgtttcaagttttcttg

SEQ ID NO: 514410 - DNA, 25 bp, Rattus norvegicus
gtggtgcactgaaatgttcatccgt

SEQ ID NO: 514411 - DNA, 25 bp, Rattus norvegicus
gtggtgcactgatatgttcatccgt

SEQ ID NO: 514412 - DNA, 25 bp, Rattus norvegicus
gtggtgcatccacgacactgagcct

SEQ ID NO: 514413 - DNA, 25 bp, Rattus norvegicus
gtggtgcatccaggacactgagcct

SEQ ID NO: 514414 - DNA, 25 bp, Rattus norvegicus
gtggtgcatgatcgtctgtaagcca

SEQ ID NO: 514415 - DNA, 25 bp, Rattus norvegicus
gtggtgcatgatggtctgtaagcca

SEQ ID NO: 514416 - DNA, 25 bp, Rattus norvegicus
gtggtgccagaaacccaacttaaca

SEQ ID NO: 514417 - DNA, 25 bp, Rattus norvegicus
gtggtgccagaatcccaacttaaca

SEQ ID NO: 514418 - DNA, 25 bp, Rattus norvegicus
gtggtgccagggacctatgcatata

SEQ ID NO: 514419 - DNA, 25 bp, Rattus norvegicus
gtggtgccagggtcctatgcatata

SEQ ID NO: 514420 - DNA, 25 bp, Rattus norvegicus
gtggtgcccattcaagttctgccca

SEQ ID NO: 514421 - DNA, 25 bp, Rattus norvegicus
gtggtgcccattgaagttctgccca

SEQ ID NO: 514422 - DNA, 25 bp, Rattus norvegicus
gtggtgccccaaattaatcctggca

SEQ ID NO: 514423 - DNA, 25 bp, Rattus norvegicus
gtggtgccccaatttaatcctggca

SEQ ID NO: 514424 - DNA, 25 bp, Rattus norvegicus
gtggtgccccgtccagtgtgaacat

SEQ ID NO: 514425 - DNA, 25 bp, Rattus norvegicus
gtggtgccccgtgcagtgtgaacat

SEQ ID NO: 514426 - DNA, 25 bp, Rattus norvegicus
gtggtgcctaacaacgacaacgtgc

SEQ ID NO: 514427 - DNA, 25 bp, Rattus norvegicus
gtggtgcctaactacgacaacgtgc

SEQ ID NO: 514428 - DNA, 25 bp, Rattus norvegicus
gtggtgcctattaattttgtctgtt

SEQ ID NO: 514429 - DNA, 25 bp, Rattus norvegicus
gtggtgcctatttattttgtctgtt

SEQ ID NO: 514430 - DNA, 25 bp, Rattus norvegicus
gtggtgccttcacccctaccaaaga

SEQ ID NO: 514431 - DNA, 25 bp, Rattus norvegicus
gtggtgccttcagccctaccaaaga

SEQ ID NO: 514432 - DNA, 25 bp, Rattus norvegicus
gtggtgccttgtaccagcttttcca

SEQ ID NO: 514433 - DNA, 25 bp, Rattus norvegicus
gtggtgccttgttccagcttttcca

SEQ ID NO: 514434 - DNA, 25 bp, Rattus norvegicus
gtggtgctaaaaattgctttcctca

SEQ ID NO: 514435 - DNA, 25 bp, Rattus norvegicus
gtggtgctaaaatttgctttcctca

SEQ ID NO: 514436 - DNA, 25 bp, Rattus norvegicus
gtggtgctagcacaagccatatttg

SEQ ID NO: 514437 - DNA, 25 bp, Rattus norvegicus
gtggtgctagcagaagccatatttg

SEQ ID NO: 514438 - DNA, 25 bp, Rattus norvegicus
gtggtgctagggacatgtgtttcta

SEQ ID NO: 514439 - DNA, 25 bp, Rattus norvegicus
gtggtgctagggtcatgtgtttcta

SEQ ID NO: 514440 - DNA, 25 bp, Rattus norvegicus
gtggtgctagttattactggctaca

SEQ ID NO: 514441 - DNA, 25 bp, Rattus norvegicus
gtggtgctagtttttactggctaca

SEQ ID NO: 514442 - DNA, 25 bp, Rattus norvegicus
gtggtgctcatcagcccgcaggatg

SEQ ID NO: 514443 - DNA, 25 bp, Rattus norvegicus
gtggtgctcatctgcccgcaggatg

SEQ ID NO: 514444 - DNA, 25 bp, Rattus norvegicus
gtggtgctgctacattaaataagat

SEQ ID NO: 514445 - DNA, 25 bp, Rattus norvegicus
gtggtgctgctagattaaataagat

SEQ ID NO: 514446 - DNA, 25 bp, Rattus norvegicus
gtggtgctgctgcacttatgcattt

SEQ ID NO: 514447 - DNA, 25 bp, Rattus norvegicus
gtggtgctgctggacttatgcattt

SEQ ID NO: 514448 - DNA, 25 bp, Rattus norvegicus
gtggtgctttaactttcaggacttg

SEQ ID NO: 514449 - DNA, 25 bp, Rattus norvegicus
gtggtgctttaagtttcaggacttg

SEQ ID NO: 514450 - DNA, 25 bp, Rattus norvegicus
gtggtgctttataatttctgtagta

SEQ ID NO: 514451 - DNA, 25 bp, Rattus norvegicus
gtggtgctttattatttctgtagta

SEQ ID NO: 514452 - DNA, 25 bp, Rattus norvegicus
gtggtgctttgaactgcagctcctc

SEQ ID NO: 514453 - DNA, 25 bp, Rattus norvegicus
gtggtgctttgatctgcagctcctc

SEQ ID NO: 514454 - DNA, 25 bp, Rattus norvegicus
gtggtggaaaagaaactccctcagt

SEQ ID NO: 514455 - DNA, 25 bp, Rattus norvegicus
gtggtggaaaagtaactccctcagt

SEQ ID NO: 514456 - DNA, 25 bp, Rattus norvegicus
gtggtggacactacctggtctgcag

SEQ ID NO: 514457 - DNA, 25 bp, Rattus norvegicus
gtggtggacacttcctggtctgcag

SEQ ID NO: 514458 - DNA, 25 bp, Rattus norvegicus
gtggtggagcaaccctgcactgcct

SEQ ID NO: 514459 - DNA, 25 bp, Rattus norvegicus
gtggtggagcaagcctgcactgcct

SEQ ID NO: 514460 - DNA, 25 bp, Rattus norvegicus
gtggtggagcacactcttagaagca

SEQ ID NO: 514461 - DNA, 25 bp, Rattus norvegicus
gtggtggagcactctcttagaagca

SEQ ID NO: 514462 - DNA, 25 bp, Rattus norvegicus
gtggtggaggtgagcacccctttaa

SEQ ID NO: 514463 - DNA, 25 bp, Rattus norvegicus
gtggtggaggtgtgcacccctttaa

SEQ ID NO: 514464 - DNA, 25 bp, Rattus norvegicus
gtggtggatagcacaaagccatcaa

SEQ ID NO: 514465 - DNA, 25 bp, Rattus norvegicus
gtggtggatagctcaaagccatcaa

SEQ ID NO: 514466 - DNA, 25 bp, Rattus norvegicus
gtggtggcacacactgtgatctcag

SEQ ID NO: 514467 - DNA, 25 bp, Rattus norvegicus
gtggtggcacactctgtgatctcag

SEQ ID NO: 514468 - DNA, 25 bp, Rattus norvegicus
gtggtggcagggaccttcccgacaa

SEQ ID NO: 514469 - DNA, 25 bp, Rattus norvegicus
gtggtggcagggtccttcccgacaa

SEQ ID NO: 514470 - DNA, 25 bp, Rattus norvegicus
gtggtggccaaaagtcagaactgac

SEQ ID NO: 514471 - DNA, 25 bp, Rattus norvegicus
gtggtggccaaatgtcagaactgac

SEQ ID NO: 514472 - DNA, 25 bp, Rattus norvegicus
gtggtggccaagcaccttttagcta

SEQ ID NO: 514473 - DNA, 25 bp, Rattus norvegicus
gtggtggccaaggaccttttagcta

SEQ ID NO: 514474 - DNA, 25 bp, Rattus norvegicus
gtggtggcccttccagagctctaag

SEQ ID NO: 514475 - DNA, 25 bp, Rattus norvegicus
gtggtggcccttgcagagctctaag

SEQ ID NO: 514476 - DNA, 25 bp, Rattus norvegicus
gtggtggcgacaaatcagacagttc

SEQ ID NO: 514477 - DNA, 25 bp, Rattus norvegicus
gtggtggcgacatatcagacagttc

SEQ ID NO: 514478 - DNA, 25 bp, Rattus norvegicus
gtggtggcgcctcctttgaatccca

SEQ ID NO: 514479 - DNA, 25 bp, Rattus norvegicus
gtggtggcgcctgctttgaatccca

SEQ ID NO: 514480 - DNA, 25 bp, Rattus norvegicus
gtggtggcgctgagcagcatcctca

SEQ ID NO: 514481 - DNA, 25 bp, Rattus norvegicus
gtggtggcgctgtgcagcatcctca

SEQ ID NO: 514482 - DNA, 25 bp, Rattus norvegicus
gtggtggctataaatcagattgtca

SEQ ID NO: 514483 - DNA, 25 bp, Rattus norvegicus
gtggtggctatatatcagattgtca

SEQ ID NO: 514484 - DNA, 25 bp, Rattus norvegicus
gtggtggctcctaggacccttcaca

SEQ ID NO: 514485 - DNA, 25 bp, Rattus norvegicus
gtggtggctccttggacccttcaca

SEQ ID NO: 514486 - DNA, 25 bp, Rattus norvegicus
gtggtggctgccatgttttctgcac

SEQ ID NO: 514487 - DNA, 25 bp, Rattus norvegicus
gtggtggctgccttgttttctgcac

SEQ ID NO: 514488 - DNA, 25 bp, Rattus norvegicus
gtggtggctgtaaacctggtacatc

SEQ ID NO: 514489 - DNA, 25 bp, Rattus norvegicus
gtggtggctgtatacctggtacatc

SEQ ID NO: 514490 - DNA, 25 bp, Rattus norvegicus
gtggtggctgtgaccactgatgact

SEQ ID NO: 514491 - DNA, 25 bp, Rattus norvegicus
gtggtggctgtgtccactgatgact

SEQ ID NO: 514492 - DNA, 25 bp, Rattus norvegicus
gtggtggcttccagcagccagacag

SEQ ID NO: 514493 - DNA, 25 bp, Rattus norvegicus
gtggtggcttcctgcagccagacag

SEQ ID NO: 514494 - DNA, 25 bp, Rattus norvegicus
gtggtgggatttcctgctaccccaa

SEQ ID NO: 514495 - DNA, 25 bp, Rattus norvegicus
gtggtgggatttgctgctaccccaa

SEQ ID NO: 514496 - DNA, 25 bp, Rattus norvegicus
gtggtgggcacaacacttatgagct

SEQ ID NO: 514497 - DNA, 25 bp, Rattus norvegicus
gtggtgggcacatcacttatgagct

SEQ ID NO: 514498 - DNA, 25 bp, Rattus norvegicus
gtggtgggcagcatcagtacactga

SEQ ID NO: 514499 - DNA, 25 bp, Rattus norvegicus
gtggtgggcagcttcagtacactga

SEQ ID NO: 514500 - DNA, 25 bp, Rattus norvegicus
gtggtgggctgcaaagcaaatacaa

SEQ ID NO: 514501 - DNA, 25 bp, Rattus norvegicus
gtggtgggctgctaagcaaatacaa

SEQ ID NO: 514502 - DNA, 25 bp, Rattus norvegicus
gtggtgggtccaatttttcattagg

SEQ ID NO: 514503 - DNA, 25 bp, Rattus norvegicus
gtggtgggtccattttttcattagg

SEQ ID NO: 514504 - DNA, 25 bp, Rattus norvegicus
gtggtggtaaatctttcgcccaaat

SEQ ID NO: 514505 - DNA, 25 bp, Rattus norvegicus
gtggtggtaaatgtttcgcccaaat

SEQ ID NO: 514506 - DNA, 25 bp, Rattus norvegicus
gtggtggtagagattgccagcccct

SEQ ID NO: 514507 - DNA, 25 bp, Rattus norvegicus
gtggtggtagagtttgccagcccct

SEQ ID NO: 514508 - DNA, 25 bp, Rattus norvegicus
gtggtggtcaatatacttctgcctt

SEQ ID NO: 514509 - DNA, 25 bp, Rattus norvegicus
gtggtggtcaatttacttctgcctt

SEQ ID NO: 514510 - DNA, 25 bp, Rattus norvegicus
gtggtggtcatcaggaatcgtccca

SEQ ID NO: 514511 - DNA, 25 bp, Rattus norvegicus
gtggtggtcatctggaatcgtccca

SEQ ID NO: 514512 - DNA, 25 bp, Rattus norvegicus
gtggtggtccctacgcagtaaaatc

SEQ ID NO: 514513 - DNA, 25 bp, Rattus norvegicus
gtggtggtcccttcgcagtaaaatc

SEQ ID NO: 514514 - DNA, 25 bp, Rattus norvegicus
gtggtggtcctaacttatgccaata

SEQ ID NO: 514515 - DNA, 25 bp, Rattus norvegicus
gtggtggtcctatcttatgccaata

SEQ ID NO: 514516 - DNA, 25 bp, Rattus norvegicus
gtggtggtctgcaaactttacttac

SEQ ID NO: 514517 - DNA, 25 bp, Rattus norvegicus
gtggtggtctgctaactttacttac

SEQ ID NO: 514518 - DNA, 25 bp, Rattus norvegicus
gtggtggtgactcacatactttttc

SEQ ID NO: 514519 - DNA, 25 bp, Rattus norvegicus
gtggtggtgactgacatactttttc

SEQ ID NO: 514520 - DNA, 25 bp, Rattus norvegicus
gtggtggtgccacaccccatttctt

SEQ ID NO: 514521 - DNA, 25 bp, Rattus norvegicus
gtggtggtgccagaccccatttctt

SEQ ID NO: 514522 - DNA, 25 bp, Rattus norvegicus
gtggtggtgctaacgactcttgcct

SEQ ID NO: 514523 - DNA, 25 bp, Rattus norvegicus
gtggtggtgctatcgactcttgcct

SEQ ID NO: 514524 - DNA, 25 bp, Rattus norvegicus
gtggtggtgtgcaactttccagttc

SEQ ID NO: 514525 - DNA, 25 bp, Rattus norvegicus
gtggtggtgtgctactttccagttc

SEQ ID NO: 514526 - DNA, 25 bp, Rattus norvegicus
gtggtggtgttcatctcttccagaa

SEQ ID NO: 514527 - DNA, 25 bp, Rattus norvegicus
gtggtggtgttcttctcttccagaa

SEQ ID NO: 514528 - DNA, 25 bp, Rattus norvegicus
gtggtggtgtttcctttcatcctct

SEQ ID NO: 514529 - DNA, 25 bp, Rattus norvegicus
gtggtggtgtttgctttcatcctct

SEQ ID NO: 514530 - DNA, 25 bp, Rattus norvegicus
gtggtggtttctccggctttgtcaa

SEQ ID NO: 514531 - DNA, 25 bp, Rattus norvegicus
gtggtggtttctgcggctttgtcaa

SEQ ID NO: 514532 - DNA, 25 bp, Rattus norvegicus
gtggtgtaaactccattcccacacg

SEQ ID NO: 514533 - DNA, 25 bp, Rattus norvegicus
gtggtgtaaactgcattcccacacg

SEQ ID NO: 514534 - DNA, 25 bp, Rattus norvegicus
gtggtgtaacacacgtctactgtta

SEQ ID NO: 514535 - DNA, 25 bp, Rattus norvegicus
gtggtgtaacactcgtctactgtta

SEQ ID NO: 514536 - DNA, 25 bp, Rattus norvegicus
gtggtgtaccagcaatgccttaggt

SEQ ID NO: 514537 - DNA, 25 bp, Rattus norvegicus
gtggtgtaccaggaatgccttaggt

SEQ ID NO: 514538 - DNA, 25 bp, Rattus norvegicus
gtggtgtagagcactagggtcccat

SEQ ID NO: 514539 - DNA, 25 bp, Rattus norvegicus
gtggtgtagagctctagggtcccat

SEQ ID NO: 514540 - DNA, 25 bp, Rattus norvegicus
gtggtgtagattccaaggcccctcc

SEQ ID NO: 514541 - DNA, 25 bp, Rattus norvegicus
gtggtgtagattgcaaggcccctcc

SEQ ID NO: 514542 - DNA, 25 bp, Rattus norvegicus
gtggtgtagtttattccgtgtctgc

SEQ ID NO: 514543 - DNA, 25 bp, Rattus norvegicus
gtggtgtagttttttccgtgtctgc

SEQ ID NO: 514544 - DNA, 25 bp, Rattus norvegicus
gtggtgtatcaaatgttcctattaa

SEQ ID NO: 514545 - DNA, 25 bp, Rattus norvegicus
gtggtgtatcaattgttcctattaa

SEQ ID NO: 514546 - DNA, 25 bp, Rattus norvegicus
gtggtgtatgttatatccttatctt

SEQ ID NO: 514547 - DNA, 25 bp, Rattus norvegicus
gtggtgtatgttttatccttatctt

SEQ ID NO: 514548 - DNA, 25 bp, Rattus norvegicus
gtggtgtcaatacttctgttcttat

SEQ ID NO: 514549 - DNA, 25 bp, Rattus norvegicus
gtggtgtcaatagttctgttcttat

SEQ ID NO: 514550 - DNA, 25 bp, Rattus norvegicus
gtggtgtccagcactggccagatgc

SEQ ID NO: 514551 - DNA, 25 bp, Rattus norvegicus
gtggtgtccagctctggccagatgc

SEQ ID NO: 514552 - DNA, 25 bp, Rattus norvegicus
gtggtgtcccttcactgaagtctgg

SEQ ID NO: 514553 - DNA, 25 bp, Rattus norvegicus
gtggtgtcccttgactgaagtctgg

SEQ ID NO: 514554 - DNA, 25 bp, Rattus norvegicus
gtggtgtcctcactactgtttctta

SEQ ID NO: 514555 - DNA, 25 bp, Rattus norvegicus
gtggtgtcctcagtactgtttctta

SEQ ID NO: 514556 - DNA, 25 bp, Rattus norvegicus
gtggtgtcgtctatcttcagagcga

SEQ ID NO: 514557 - DNA, 25 bp, Rattus norvegicus
gtggtgtcgtctttcttcagagcga

SEQ ID NO: 514558 - DNA, 25 bp, Rattus norvegicus
gtggtgtctacaatatgccctgtga

SEQ ID NO: 514559 - DNA, 25 bp, Rattus norvegicus
gtggtgtctacattatgccctgtga

SEQ ID NO: 514560 - DNA, 25 bp, Rattus norvegicus
gtggtgtctaccacgggttctgact

SEQ ID NO: 514561 - DNA, 25 bp, Rattus norvegicus
gtggtgtctacctcgggttctgact

SEQ ID NO: 514562 - DNA, 25 bp, Rattus norvegicus
gtggtgtctcttccattagtcaaca

SEQ ID NO: 514563 - DNA, 25 bp, Rattus norvegicus
gtggtgtctcttcctgtgttcacac

SEQ ID NO: 514564 - DNA, 25 bp, Rattus norvegicus
gtggtgtctcttgcattagtcaaca

SEQ ID NO: 514565 - DNA, 25 bp, Rattus norvegicus
gtggtgtctcttgctgtgttcacac

SEQ ID NO: 514566 - DNA, 25 bp, Rattus norvegicus
gtggtgtctgttctacagcttgtga

SEQ ID NO: 514567 - DNA, 25 bp, Rattus norvegicus
gtggtgtctgttgtacagcttgtga

SEQ ID NO: 514568 - DNA, 25 bp, Rattus norvegicus
gtggtgtcttagaagcactttgctt

SEQ ID NO: 514569 - DNA, 25 bp, Rattus norvegicus
gtggtgtcttagtagcactttgctt

SEQ ID NO: 514570 - DNA, 25 bp, Rattus norvegicus
gtggtgtgactgaactcccagaaca

SEQ ID NO: 514571 - DNA, 25 bp, Rattus norvegicus
gtggtgtgactgcatgtacttgcat

SEQ ID NO: 514572 - DNA, 25 bp, Rattus norvegicus
gtggtgtgactggatgtacttgcat

SEQ ID NO: 514573 - DNA, 25 bp, Rattus norvegicus
gtggtgtgactgtactcccagaaca

SEQ ID NO: 514574 - DNA, 25 bp, Rattus norvegicus
gtggtgtgcaccatacttgactatg

SEQ ID NO: 514575 - DNA, 25 bp, Rattus norvegicus
gtggtgtgcaccttacttgactatg

SEQ ID NO: 514576 - DNA, 25 bp, Rattus norvegicus
gtggtgtggacccacagtctgacta

SEQ ID NO: 514577 - DNA, 25 bp, Rattus norvegicus
gtggtgtggaccgacagtctgacta

SEQ ID NO: 514578 - DNA, 25 bp, Rattus norvegicus
gtggtgtgggctatatttgcttaaa

SEQ ID NO: 514579 - DNA, 25 bp, Rattus norvegicus
gtggtgtgggctttatttgcttaaa

SEQ ID NO: 514580 - DNA, 25 bp, Rattus norvegicus
gtggtgtggtacacagaacactgct

SEQ ID NO: 514581 - DNA, 25 bp, Rattus norvegicus
gtggtgtggtactcagaacactgct

SEQ ID NO: 514582 - DNA, 25 bp, Rattus norvegicus
gtggtgtggtcgcatgctttttaaa

SEQ ID NO: 514583 - DNA, 25 bp, Rattus norvegicus
gtggtgtggtcggatgctttttaaa

SEQ ID NO: 514584 - DNA, 25 bp, Rattus norvegicus
gtggtgtgtcatattcagcccctct

SEQ ID NO: 514585 - DNA, 25 bp, Rattus norvegicus
gtggtgtgtcattttcagcccctct

SEQ ID NO: 514586 - DNA, 25 bp, Rattus norvegicus
gtggtgtgtgtacgcacttcctcca

SEQ ID NO: 514587 - DNA, 25 bp, Rattus norvegicus
gtggtgtgtgtaggcacttcctcca

SEQ ID NO: 514588 - DNA, 25 bp, Rattus norvegicus
gtggtgtgttatctcttctagtcta

SEQ ID NO: 514589 - DNA, 25 bp, Rattus norvegicus
gtggtgtgttatgtcttctagtcta

SEQ ID NO: 514590 - DNA, 25 bp, Rattus norvegicus
gtggtgtgttccagtagcagccaac

SEQ ID NO: 514591 - DNA, 25 bp, Rattus norvegicus
gtggtgtgttcctgtagcagccaac

SEQ ID NO: 514592 - DNA, 25 bp, Rattus norvegicus
gtggtgtgttttaagtgctattcat

SEQ ID NO: 514593 - DNA, 25 bp, Rattus norvegicus
gtggtgtgtttttagtgctattcat

SEQ ID NO: 514594 - DNA, 25 bp, Rattus norvegicus
gtggtgttacatcactactgagagt

SEQ ID NO: 514595 - DNA, 25 bp, Rattus norvegicus
gtggtgttacatgactactgagagt

SEQ ID NO: 514596 - DNA, 25 bp, Rattus norvegicus
gtggtgttagcgacgtcgcctagca

SEQ ID NO: 514597 - DNA, 25 bp, Rattus norvegicus
gtggtgttagcgtcgtcgcctagca

SEQ ID NO: 514598 - DNA, 25 bp, Rattus norvegicus
gtggtgttccacagccttgaataaa

SEQ ID NO: 514599 - DNA, 25 bp, Rattus norvegicus
gtggtgttccactgccttgaataaa

SEQ ID NO: 514600 - DNA, 25 bp, Rattus norvegicus
gtggtgttccagaaacgttccacca

SEQ ID NO: 514601 - DNA, 25 bp, Rattus norvegicus
gtggtgttccagtaacgttccacca

SEQ ID NO: 514602 - DNA, 25 bp, Rattus norvegicus
gtggtgttctgcattctaggcaaaa

SEQ ID NO: 514603 - DNA, 25 bp, Rattus norvegicus
gtggtgttctgctttctaggcaaaa

SEQ ID NO: 514604 - DNA, 25 bp, Rattus norvegicus
gtggtgttgcagatttcacatactt

SEQ ID NO: 514605 - DNA, 25 bp, Rattus norvegicus
gtggtgttgcagttttcacatactt

SEQ ID NO: 514606 - DNA, 25 bp, Rattus norvegicus
gtggtgttgcgcacatttatcagga

SEQ ID NO: 514607 - DNA, 25 bp, Rattus norvegicus
gtggtgttgcgctcatttatcagga

SEQ ID NO: 514608 - DNA, 25 bp, Rattus norvegicus
gtggtgttgttactacagccttcta

SEQ ID NO: 514609 - DNA, 25 bp, Rattus norvegicus
gtggtgttgttagtacagccttcta

SEQ ID NO: 514610 - DNA, 25 bp, Rattus norvegicus
gtggtgtttacacccgactttgaca

SEQ ID NO: 514611 - DNA, 25 bp, Rattus norvegicus
gtggtgtttacagccgactttgaca

SEQ ID NO: 514612 - DNA, 25 bp, Rattus norvegicus
gtggtgtttttaatgggctagagca

SEQ ID NO: 514613 - DNA, 25 bp, Rattus norvegicus
gtggtgtttttattgggctagagca

SEQ ID NO: 514614 - DNA, 25 bp, Rattus norvegicus
gtggttaaaaacactcctgtgtgct

SEQ ID NO: 514615 - DNA, 25 bp, Rattus norvegicus
gtggttaaaaactctcctgtgtgct

SEQ ID NO: 514616 - DNA, 25 bp, Rattus norvegicus
gtggttaaaagtcggctgcctctca

SEQ ID NO: 514617 - DNA, 25 bp, Rattus norvegicus
gtggttaaaagtgggctgcctctca

SEQ ID NO: 514618 - DNA, 25 bp, Rattus norvegicus
gtggttaaacttaagttcatgacat

SEQ ID NO: 514619 - DNA, 25 bp, Rattus norvegicus
gtggttaaactttagttcatgacat

SEQ ID NO: 514620 - DNA, 25 bp, Rattus norvegicus
gtggttaaagccagtgaatattttt

SEQ ID NO: 514621 - DNA, 25 bp, Rattus norvegicus
gtggttaaagcctgtgaatattttt

SEQ ID NO: 514622 - DNA, 25 bp, Rattus norvegicus
gtggttaacaacacttactgctcgt

SEQ ID NO: 514623 - DNA, 25 bp, Rattus norvegicus
gtggttaacaactcttactgctcgt

SEQ ID NO: 514624 - DNA, 25 bp, Rattus norvegicus
gtggttaagactcactgcttgcttt

SEQ ID NO: 514625 - DNA, 25 bp, Rattus norvegicus
gtggttaagactgactgcttgcttt

SEQ ID NO: 514626 - DNA, 25 bp, Rattus norvegicus
gtggttaagagcagtgatactctcc

SEQ ID NO: 514627 - DNA, 25 bp, Rattus norvegicus
gtggttaagagctgtgatactctcc

SEQ ID NO: 514628 - DNA, 25 bp, Rattus norvegicus
gtggttaagattatctcttcctcct

SEQ ID NO: 514629 - DNA, 25 bp, Rattus norvegicus
gtggttaagattttctcttcctcct

SEQ ID NO: 514630 - DNA, 25 bp, Rattus norvegicus
gtggttaaggacaatcgtaatctga

SEQ ID NO: 514631 - DNA, 25 bp, Rattus norvegicus
gtggttaaggacatttacagctctt

SEQ ID NO: 514632 - DNA, 25 bp, Rattus norvegicus
gtggttaaggactatcgtaatctga

SEQ ID NO: 514633 - DNA, 25 bp, Rattus norvegicus
gtggttaaggacttttacagctctt

SEQ ID NO: 514634 - DNA, 25 bp, Rattus norvegicus
gtggttaagggcactcgttcttgca

SEQ ID NO: 514635 - DNA, 25 bp, Rattus norvegicus
gtggttaagggctctcgttcttgca

SEQ ID NO: 514636 - DNA, 25 bp, Rattus norvegicus
gtggttaatagaattcctcagcttg

SEQ ID NO: 514637 - DNA, 25 bp, Rattus norvegicus
gtggttaatagatttcctcagcttg

SEQ ID NO: 514638 - DNA, 25 bp, Rattus norvegicus
gtggttaatagtattcctcttgctt

SEQ ID NO: 514639 - DNA, 25 bp, Rattus norvegicus
gtggttaatagttttcctcttgctt

SEQ ID NO: 514640 - DNA, 25 bp, Rattus norvegicus
gtggttaatatcatatgtctgtatg

SEQ ID NO: 514641 - DNA, 25 bp, Rattus norvegicus
gtggttaatatcttatgtctgtatg

SEQ ID NO: 514642 - DNA, 25 bp, Rattus norvegicus
gtggttaatgatattgggctactct

SEQ ID NO: 514643 - DNA, 25 bp, Rattus norvegicus
gtggttaatgattttgggctactct

SEQ ID NO: 514644 - DNA, 25 bp, Rattus norvegicus
gtggttaattctcactcattcacac

SEQ ID NO: 514645 - DNA, 25 bp, Rattus norvegicus
gtggttaattctgactcattcacac

SEQ ID NO: 514646 - DNA, 25 bp, Rattus norvegicus
gtggttacaaacaagagtctgggca

SEQ ID NO: 514647 - DNA, 25 bp, Rattus norvegicus
gtggttacaaactagagtctgggca

SEQ ID NO: 514648 - DNA, 25 bp, Rattus norvegicus
gtggttacattcaggctctcttaga

SEQ ID NO: 514649 - DNA, 25 bp, Rattus norvegicus
gtggttacattctggctctcttaga

SEQ ID NO: 514650 - DNA, 25 bp, Rattus norvegicus
gtggttaccgcaagctaggcgacac

SEQ ID NO: 514651 - DNA, 25 bp, Rattus norvegicus
gtggttaccgcatgctaggcgacac

SEQ ID NO: 514652 - DNA, 25 bp, Rattus norvegicus
gtggttacctaactgtggtcttctt

SEQ ID NO: 514653 - DNA, 25 bp, Rattus norvegicus
gtggttacctaagtgtggtcttctt

SEQ ID NO: 514654 - DNA, 25 bp, Rattus norvegicus
gtggttactgccaaatgctttttaa

SEQ ID NO: 514655 - DNA, 25 bp, Rattus norvegicus
gtggttactgcctaatgctttttaa

SEQ ID NO: 514656 - DNA, 25 bp, Rattus norvegicus
gtggttagagatcatacctccatac

SEQ ID NO: 514657 - DNA, 25 bp, Rattus norvegicus
gtggttagagatgatacctccatac

SEQ ID NO: 514658 - DNA, 25 bp, Rattus norvegicus
gtggttagtaacagcatcttaattg

SEQ ID NO: 514659 - DNA, 25 bp, Rattus norvegicus
gtggttagtaactgcatcttaattg

SEQ ID NO: 514660 - DNA, 25 bp, Rattus norvegicus
gtggttataaccctgcagcatgcag

SEQ ID NO: 514661 - DNA, 25 bp, Rattus norvegicus
gtggttataaccgtgcagcatgcag

SEQ ID NO: 514662 - DNA, 25 bp, Rattus norvegicus
gtggttatcaccacgtcatttgtaa

SEQ ID NO: 514663 - DNA, 25 bp, Rattus norvegicus
gtggttatcacctcgtcatttgtaa

SEQ ID NO: 514664 - DNA, 25 bp, Rattus norvegicus
gtggttatcagaccaaacagatcat

SEQ ID NO: 514665 - DNA, 25 bp, Rattus norvegicus
gtggttatcagagcaaacagatcat

SEQ ID NO: 514666 - DNA, 25 bp, Rattus norvegicus
gtggttatcatgatcagttgctgct

SEQ ID NO: 514667 - DNA, 25 bp, Rattus norvegicus
gtggttatcatgttcagttgctgct

SEQ ID NO: 514668 - DNA, 25 bp, Rattus norvegicus
gtggttatctatcaattccaatata

SEQ ID NO: 514669 - DNA, 25 bp, Rattus norvegicus
gtggttatctatgaattccaatata

SEQ ID NO: 514670 - DNA, 25 bp, Rattus norvegicus
gtggttatctcaattacccaaactt

SEQ ID NO: 514671 - DNA, 25 bp, Rattus norvegicus
gtggttatctcatttacccaaactt

SEQ ID NO: 514672 - DNA, 25 bp, Rattus norvegicus
gtggttatgcaaatcctcaactggg

SEQ ID NO: 514673 - DNA, 25 bp, Rattus norvegicus
gtggttatgcaattcctcaactggg

SEQ ID NO: 514674 - DNA, 25 bp, Rattus norvegicus
gtggttatgccacatgtcatgactt

SEQ ID NO: 514675 - DNA, 25 bp, Rattus norvegicus
gtggttatgccagatgtcatgactt

SEQ ID NO: 514676 - DNA, 25 bp, Rattus norvegicus
gtggttattaacaccagttcctaag

SEQ ID NO: 514677 - DNA, 25 bp, Rattus norvegicus
gtggttattaactccagttcctaag

SEQ ID NO: 514678 - DNA, 25 bp, Rattus norvegicus
gtggttcaagatatacaagccaaac

SEQ ID NO: 514679 - DNA, 25 bp, Rattus norvegicus
gtggttcaagatttacaagccaaac

SEQ ID NO: 514680 - DNA, 25 bp, Rattus norvegicus
gtggttcacacaattacgtttacaa

SEQ ID NO: 514681 - DNA, 25 bp, Rattus norvegicus
gtggttcacacatttacgtttacaa

SEQ ID NO: 514682 - DNA, 25 bp, Rattus norvegicus
gtggttcacataccaaaccctgtag

SEQ ID NO: 514683 - DNA, 25 bp, Rattus norvegicus
gtggttcacatagcaaaccctgtag

SEQ ID NO: 514684 - DNA, 25 bp, Rattus norvegicus
gtggttcactgactctacttttctc

SEQ ID NO: 514685 - DNA, 25 bp, Rattus norvegicus
gtggttcactgagtctacttttctc

SEQ ID NO: 514686 - DNA, 25 bp, Rattus norvegicus
gtggttcagaacctctgatggtgct

SEQ ID NO: 514687 - DNA, 25 bp, Rattus norvegicus
gtggttcagaacgtctgatggtgct

SEQ ID NO: 514688 - DNA, 25 bp, Rattus norvegicus
gtggttcagtcacatgtgcctgtga

SEQ ID NO: 514689 - DNA, 25 bp, Rattus norvegicus
gtggttcagtcagatgtgcctgtga

SEQ ID NO: 514690 - DNA, 25 bp, Rattus norvegicus
gtggttcagtgtctgctacgagcca

SEQ ID NO: 514691 - DNA, 25 bp, Rattus norvegicus
gtggttcagtgtgtgctacgagcca

SEQ ID NO: 514692 - DNA, 25 bp, Rattus norvegicus
gtggttcataaacgcactcactaaa

SEQ ID NO: 514693 - DNA, 25 bp, Rattus norvegicus
gtggttcataaaggcactcactaaa

SEQ ID NO: 514694 - DNA, 25 bp, Rattus norvegicus
gtggttcatcaccatctataattcc

SEQ ID NO: 514695 - DNA, 25 bp, Rattus norvegicus
gtggttcatcacgatctataattcc

SEQ ID NO: 514696 - DNA, 25 bp, Rattus norvegicus
gtggttcatctccaacaagtacctg

SEQ ID NO: 514697 - DNA, 25 bp, Rattus norvegicus
gtggttcatctcgaacaagtacctg

SEQ ID NO: 514698 - DNA, 25 bp, Rattus norvegicus
gtggttcatgtacagttcctttaat

SEQ ID NO: 514699 - DNA, 25 bp, Rattus norvegicus
gtggttcatgtagagttcctttaat

SEQ ID NO: 514700 - DNA, 25 bp, Rattus norvegicus
gtggttccaaggcacagctcacaac

SEQ ID NO: 514701 - DNA, 25 bp, Rattus norvegicus
gtggttccaagggacagctcacaac

SEQ ID NO: 514702 - DNA, 25 bp, Rattus norvegicus
gtggttccacccctaggctggtcat

SEQ ID NO: 514703 - DNA, 25 bp, Rattus norvegicus
gtggttccacccgtaggctggtcat

SEQ ID NO: 514704 - DNA, 25 bp, Rattus norvegicus
gtggttccatcaaattgtgactgaa

SEQ ID NO: 514705 - DNA, 25 bp, Rattus norvegicus
gtggttccatcatattgtgactgaa

SEQ ID NO: 514706 - DNA, 25 bp, Rattus norvegicus
gtggttccctagctgattagatcat

SEQ ID NO: 514707 - DNA, 25 bp, Rattus norvegicus
gtggttccctaggtgattagatcat

SEQ ID NO: 514708 - DNA, 25 bp, Rattus norvegicus
gtggttccgaagaagtcctgtttct

SEQ ID NO: 514709 - DNA, 25 bp, Rattus norvegicus
gtggttccgaagtagtcctgtttct

SEQ ID NO: 514710 - DNA, 25 bp, Rattus norvegicus
gtggttccgtagacctagagtgtac

SEQ ID NO: 514711 - DNA, 25 bp, Rattus norvegicus
gtggttccgtagtcctagagtgtac

SEQ ID NO: 514712 - DNA, 25 bp, Rattus norvegicus
gtggttcctaatccagtgacccttt

SEQ ID NO: 514713 - DNA, 25 bp, Rattus norvegicus
gtggttcctaatgcagtgacccttt

SEQ ID NO: 514714 - DNA, 25 bp, Rattus norvegicus
gtggttcctacaatttgaatgtcaa

SEQ ID NO: 514715 - DNA, 25 bp, Rattus norvegicus
gtggttcctacattttgaatgtcaa

SEQ ID NO: 514716 - DNA, 25 bp, Rattus norvegicus
gtggttcctcggacaatggtgctag

SEQ ID NO: 514717 - DNA, 25 bp, Rattus norvegicus
gtggttcctcggtcaatggtgctag

SEQ ID NO: 514718 - DNA, 25 bp, Rattus norvegicus
gtggttcctgacattttcacagtga

SEQ ID NO: 514719 - DNA, 25 bp, Rattus norvegicus
gtggttcctgactttttcacagtga

SEQ ID NO: 514720 - DNA, 25 bp, Rattus norvegicus
gtggttccttctcaggagcagacgt

SEQ ID NO: 514721 - DNA, 25 bp, Rattus norvegicus
gtggttccttctgaggagcagacgt

SEQ ID NO: 514722 - DNA, 25 bp, Rattus norvegicus
gtggttcctttcagcttgcctgaaa

SEQ ID NO: 514723 - DNA, 25 bp, Rattus norvegicus
gtggttcctttctgcttgcctgaaa

SEQ ID NO: 514724 - DNA, 25 bp, Rattus norvegicus
gtggttcgacttccaaaggtcccgg

SEQ ID NO: 514725 - DNA, 25 bp, Rattus norvegicus
gtggttcgacttgcaaaggtcccgg

SEQ ID NO: 514726 - DNA, 25 bp, Rattus norvegicus
gtggttcggagcatatacttactgt

SEQ ID NO: 514727 - DNA, 25 bp, Rattus norvegicus
gtggttcggagcttatacttactgt

SEQ ID NO: 514728 - DNA, 25 bp, Rattus norvegicus
gtggttcgttgacagacacgctcca

SEQ ID NO: 514729 - DNA, 25 bp, Rattus norvegicus
gtggttcgttgagagacacgctcca

SEQ ID NO: 514730 - DNA, 25 bp, Rattus norvegicus
gtggttctacctcgataacgccatt

SEQ ID NO: 514731 - DNA, 25 bp, Rattus norvegicus
gtggttctacctggataacgccatt

SEQ ID NO: 514732 - DNA, 25 bp, Rattus norvegicus
gtggttctaggacccatcaagtgaa

SEQ ID NO: 514733 - DNA, 25 bp, Rattus norvegicus
gtggttctaggagccatcaagtgaa

SEQ ID NO: 514734 - DNA, 25 bp, Rattus norvegicus
gtggttctatctacagacgtgactc

SEQ ID NO: 514735 - DNA, 25 bp, Rattus norvegicus
gtggttctatcttcagacgtgactc

SEQ ID NO: 514736 - DNA, 25 bp, Rattus norvegicus
gtggttctatggatcagctgtatgt

SEQ ID NO: 514737 - DNA, 25 bp, Rattus norvegicus
gtggttctatggttcagctgtatgt

SEQ ID NO: 514738 - DNA, 25 bp, Rattus norvegicus
gtggttctattcacctctagaagtc

SEQ ID NO: 514739 - DNA, 25 bp, Rattus norvegicus
gtggttctattctcctctagaagtc

SEQ ID NO: 514740 - DNA, 25 bp, Rattus norvegicus
gtggttctcaagaacaggcatgttg

SEQ ID NO: 514741 - DNA, 25 bp, Rattus norvegicus
gtggttctcaagtacaggcatgttg

SEQ ID NO: 514742 - DNA, 25 bp, Rattus norvegicus
gtggttctcactaggtggaagctct

SEQ ID NO: 514743 - DNA, 25 bp, Rattus norvegicus
gtggttctcacttggtggaagctct

SEQ ID NO: 514744 - DNA, 25 bp, Rattus norvegicus
gtggttctcagcagtgtactgtaca

SEQ ID NO: 514745 - DNA, 25 bp, Rattus norvegicus
gtggttctcagctgtgtactgtaca

SEQ ID NO: 514746 - DNA, 25 bp, Rattus norvegicus
gtggttctcaggacccgacgggaat

SEQ ID NO: 514747 - DNA, 25 bp, Rattus norvegicus
gtggttctcaggtcccgacgggaat

SEQ ID NO: 514748 - DNA, 25 bp, Rattus norvegicus
gtggttctcccaattcaagagttgt

SEQ ID NO: 514749 - DNA, 25 bp, Rattus norvegicus
gtggttctcccatttcaagagttgt

SEQ ID NO: 514750 - DNA, 25 bp, Rattus norvegicus
gtggttctctctaagcagactgtag

SEQ ID NO: 514751 - DNA, 25 bp, Rattus norvegicus
gtggttctctcttagcagactgtag

SEQ ID NO: 514752 - DNA, 25 bp, Rattus norvegicus
gtggttctctgacttccatacataa

SEQ ID NO: 514753 - DNA, 25 bp, Rattus norvegicus
gtggttctctgagttccatacataa

SEQ ID NO: 514754 - DNA, 25 bp, Rattus norvegicus
gtggttctctttcaatgctagcacc

SEQ ID NO: 514755 - DNA, 25 bp, Rattus norvegicus
gtggttctctttgaatgctagcacc

SEQ ID NO: 514756 - DNA, 25 bp, Rattus norvegicus
gtggttctgacaaggtaacctcctc

SEQ ID NO: 514757 - DNA, 25 bp, Rattus norvegicus
gtggttctgacatggtaacctcctc

SEQ ID NO: 514758 - DNA, 25 bp, Rattus norvegicus
gtggttctgcatcctcaattctgag

SEQ ID NO: 514759 - DNA, 25 bp, Rattus norvegicus
gtggttctgcatgctcaattctgag

SEQ ID NO: 514760 - DNA, 25 bp, Rattus norvegicus
gtggttctggatactttggagattt

SEQ ID NO: 514761 - DNA, 25 bp, Rattus norvegicus
gtggttctggattctttggagattt

SEQ ID NO: 514762 - DNA, 25 bp, Rattus norvegicus
gtggttctgtagaatacccgccatg

SEQ ID NO: 514763 - DNA, 25 bp, Rattus norvegicus
gtggttctgtagtatacccgccatg

SEQ ID NO: 514764 - DNA, 25 bp, Rattus norvegicus
gtggttcttagtcgcattactcagc

SEQ ID NO: 514765 - DNA, 25 bp, Rattus norvegicus
gtggttcttagtggcattactcagc

SEQ ID NO: 514766 - DNA, 25 bp, Rattus norvegicus
gtggttcttcaaagcacacttgaac

SEQ ID NO: 514767 - DNA, 25 bp, Rattus norvegicus
gtggttcttcaatgcacacttgaac

SEQ ID NO: 514768 - DNA, 25 bp, Rattus norvegicus
gtggttcttgaaactgttaaggcca

SEQ ID NO: 514769 - DNA, 25 bp, Rattus norvegicus
gtggttcttgaatctgttaaggcca

SEQ ID NO: 514770 - DNA, 25 bp, Rattus norvegicus
gtggttcttgtaccctgtaacagta

SEQ ID NO: 514771 - DNA, 25 bp, Rattus norvegicus
gtggttcttgtagcctgtaacagta

SEQ ID NO: 514772 - DNA, 25 bp, Rattus norvegicus
gtggttctttcaagttccactgtgt

SEQ ID NO: 514773 - DNA, 25 bp, Rattus norvegicus
gtggttctttcatgttccactgtgt

SEQ ID NO: 514774 - DNA, 25 bp, Rattus norvegicus
gtggttctttctaagtctactgttc

SEQ ID NO: 514775 - DNA, 25 bp, Rattus norvegicus
gtggttctttcttagtctactgttc

SEQ ID NO: 514776 - DNA, 25 bp, Rattus norvegicus
gtggttgaacatatgccaagcatga

SEQ ID NO: 514777 - DNA, 25 bp, Rattus norvegicus
gtggttgaacatttgccaagcatga

SEQ ID NO: 514778 - DNA, 25 bp, Rattus norvegicus
gtggttgaaccacactccgagacag

SEQ ID NO: 514779 - DNA, 25 bp, Rattus norvegicus
gtggttgaaccagactccgagacag

SEQ ID NO: 514780 - DNA, 25 bp, Rattus norvegicus
gtggttgaaggacagccagccccta

SEQ ID NO: 514781 - DNA, 25 bp, Rattus norvegicus
gtggttgaaggagagccagccccta

SEQ ID NO: 514782 - DNA, 25 bp, Rattus norvegicus
gtggttgacaggcattttatttttg

SEQ ID NO: 514783 - DNA, 25 bp, Rattus norvegicus
gtggttgacagggattttatttttg

SEQ ID NO: 514784 - DNA, 25 bp, Rattus norvegicus
gtggttgagcctaattccgtttctt

SEQ ID NO: 514785 - DNA, 25 bp, Rattus norvegicus
gtggttgagccttattccgtttctt

SEQ ID NO: 514786 - DNA, 25 bp, Rattus norvegicus
gtggttgaggtcatcacacagttca

SEQ ID NO: 514787 - DNA, 25 bp, Rattus norvegicus
gtggttgaggtcttcacacagttca

SEQ ID NO: 514788 - DNA, 25 bp, Rattus norvegicus
gtggttgataacagtgccatctgca

SEQ ID NO: 514789 - DNA, 25 bp, Rattus norvegicus
gtggttgataactgtgccatctgca

SEQ ID NO: 514790 - DNA, 25 bp, Rattus norvegicus
gtggttgatacaaggagccctcacc

SEQ ID NO: 514791 - DNA, 25 bp, Rattus norvegicus
gtggttgatacatggagccctcacc

SEQ ID NO: 514792 - DNA, 25 bp, Rattus norvegicus
gtggttgatagcagctctcacatag

SEQ ID NO: 514793 - DNA, 25 bp, Rattus norvegicus
gtggttgatagctgctctcacatag

SEQ ID NO: 514794 - DNA, 25 bp, Rattus norvegicus
gtggttgatatgataacgtcctcaa

SEQ ID NO: 514795 - DNA, 25 bp, Rattus norvegicus
gtggttgatatgttaacgtcctcaa

SEQ ID NO: 514796 - DNA, 25 bp, Rattus norvegicus
gtggttgatggacccgtattcattc

SEQ ID NO: 514797 - DNA, 25 bp, Rattus norvegicus
gtggttgatggagccgtattcattc

SEQ ID NO: 514798 - DNA, 25 bp, Rattus norvegicus
gtggttgatgtaagtgcctccagcc

SEQ ID NO: 514799 - DNA, 25 bp, Rattus norvegicus
gtggttgatgtatgtgcctccagcc

SEQ ID NO: 514800 - DNA, 25 bp, Rattus norvegicus
gtggttgcagctcactatgtattcc

SEQ ID NO: 514801 - DNA, 25 bp, Rattus norvegicus
gtggttgcagctgactatgtattcc

SEQ ID NO: 514802 - DNA, 25 bp, Rattus norvegicus
gtggttgccacaaactcctggagga

SEQ ID NO: 514803 - DNA, 25 bp, Rattus norvegicus
gtggttgccacatactcctggagga

SEQ ID NO: 514804 - DNA, 25 bp, Rattus norvegicus
gtggttgcccctctaattccagaac

SEQ ID NO: 514805 - DNA, 25 bp, Rattus norvegicus
gtggttgcccctgtaattccagaac

SEQ ID NO: 514806 - DNA, 25 bp, Rattus norvegicus
gtggttgccggcatgtgctcttaac

SEQ ID NO: 514807 - DNA, 25 bp, Rattus norvegicus
gtggttgccggcttgtgctcttaac

SEQ ID NO: 514808 - DNA, 25 bp, Rattus norvegicus
gtggttgcctttctcagtgtgtttc

SEQ ID NO: 514809 - DNA, 25 bp, Rattus norvegicus
gtggttgcctttgtcagtgtgtttc

SEQ ID NO: 514810 - DNA, 25 bp, Rattus norvegicus
gtggttgctggaaggatgacctcca

SEQ ID NO: 514811 - DNA, 25 bp, Rattus norvegicus
gtggttgctggatggatgacctcca

SEQ ID NO: 514812 - DNA, 25 bp, Rattus norvegicus
gtggttgctttgaagaggactctga

SEQ ID NO: 514813 - DNA, 25 bp, Rattus norvegicus
gtggttgctttgtagaggactctga

SEQ ID NO: 514814 - DNA, 25 bp, Rattus norvegicus
gtggttgcttttatccataaactga

SEQ ID NO: 514815 - DNA, 25 bp, Rattus norvegicus
gtggttgcttttttccataaactga

SEQ ID NO: 514816 - DNA, 25 bp, Rattus norvegicus
gtggttggcatcagtgtcccagtct

SEQ ID NO: 514817 - DNA, 25 bp, Rattus norvegicus
gtggttggcatctgtgtcccagtct

SEQ ID NO: 514818 - DNA, 25 bp, Rattus norvegicus
gtggttggccacagaaagccgccat

SEQ ID NO: 514819 - DNA, 25 bp, Rattus norvegicus
gtggttggccactgaaagccgccat

SEQ ID NO: 514820 - DNA, 25 bp, Rattus norvegicus
gtggttggcgcaaatcttcaaggtt

SEQ ID NO: 514821 - DNA, 25 bp, Rattus norvegicus
gtggttggcgcatatcttcaaggtt

SEQ ID NO: 514822 - DNA, 25 bp, Rattus norvegicus
gtggttggtaatcccctgggtacac

SEQ ID NO: 514823 - DNA, 25 bp, Rattus norvegicus
gtggttggtaatgccctgggtacac

SEQ ID NO: 514824 - DNA, 25 bp, Rattus norvegicus
gtggttggtgacatttagcagaatc

SEQ ID NO: 514825 - DNA, 25 bp, Rattus norvegicus
gtggttggtgacttttagcagaatc

SEQ ID NO: 514826 - DNA, 25 bp, Rattus norvegicus
gtggttgtaaatatcacccatcctg

SEQ ID NO: 514827 - DNA, 25 bp, Rattus norvegicus
gtggttgtaaatttcacccatcctg

SEQ ID NO: 514828 - DNA, 25 bp, Rattus norvegicus
gtggttgtactgaggtcatgactgt

SEQ ID NO: 514829 - DNA, 25 bp, Rattus norvegicus
gtggttgtactgtggtcatgactgt

SEQ ID NO: 514830 - DNA, 25 bp, Rattus norvegicus
gtggttgtagccactcctgagaatc

SEQ ID NO: 514831 - DNA, 25 bp, Rattus norvegicus
gtggttgtagcctctcctgagaatc

SEQ ID NO: 514832 - DNA, 25 bp, Rattus norvegicus
gtggttgtattgactggtactttgt

SEQ ID NO: 514833 - DNA, 25 bp, Rattus norvegicus
gtggttgtattgtctggtactttgt

SEQ ID NO: 514834 - DNA, 25 bp, Rattus norvegicus
gtggttgtcaagacagtcatcacac

SEQ ID NO: 514835 - DNA, 25 bp, Rattus norvegicus
gtggttgtcaagtcagtcatcacac

SEQ ID NO: 514836 - DNA, 25 bp, Rattus norvegicus
gtggttgtccaaaccgtgagaactt

SEQ ID NO: 514837 - DNA, 25 bp, Rattus norvegicus
gtggttgtccaatccgtgagaactt

SEQ ID NO: 514838 - DNA, 25 bp, Rattus norvegicus
gtggttgtctccaattataacttct

SEQ ID NO: 514839 - DNA, 25 bp, Rattus norvegicus
gtggttgtctcctattataacttct

SEQ ID NO: 514840 - DNA, 25 bp, Rattus norvegicus
gtggttgtctctcactatgcccatt

SEQ ID NO: 514841 - DNA, 25 bp, Rattus norvegicus
gtggttgtctctgactatgcccatt

SEQ ID NO: 514842 - DNA, 25 bp, Rattus norvegicus
gtggttgtgagccaggacacacact

SEQ ID NO: 514843 - DNA, 25 bp, Rattus norvegicus
gtggttgtgagcgaggacacacact

SEQ ID NO: 514844 - DNA, 25 bp, Rattus norvegicus
gtggttgtgatgacactgttctact

SEQ ID NO: 514845 - DNA, 25 bp, Rattus norvegicus
gtggttgtgatgtcactgttctact

SEQ ID NO: 514846 - DNA, 25 bp, Rattus norvegicus
gtggttgtgcatatctttagtccta

SEQ ID NO: 514847 - DNA, 25 bp, Rattus norvegicus
gtggttgtgcatttctttagtccta

SEQ ID NO: 514848 - DNA, 25 bp, Rattus norvegicus
gtggttgtgtttagatcagcttcct

SEQ ID NO: 514849 - DNA, 25 bp, Rattus norvegicus
gtggttgtgttttgatcagcttcct

SEQ ID NO: 514850 - DNA, 25 bp, Rattus norvegicus
gtggttgttacccacaattactgtg

SEQ ID NO: 514851 - DNA, 25 bp, Rattus norvegicus
gtggttgttaccgacaattactgtg

SEQ ID NO: 514852 - DNA, 25 bp, Rattus norvegicus
gtggttgtttggagacccaggcaaa

SEQ ID NO: 514853 - DNA, 25 bp, Rattus norvegicus
gtggttgtttggtgacccaggcaaa

SEQ ID NO: 514854 - DNA, 25 bp, Rattus norvegicus
gtggttgttttcctatgcacagcga

SEQ ID NO: 514855 - DNA, 25 bp, Rattus norvegicus
gtggttgttttcgtatgcacagcga

SEQ ID NO: 514856 - DNA, 25 bp, Rattus norvegicus
gtggttgttttgcaccatcggctaa

SEQ ID NO: 514857 - DNA, 25 bp, Rattus norvegicus
gtggttgttttggaccatcggctaa

SEQ ID NO: 514858 - DNA, 25 bp, Rattus norvegicus
gtggtttacatgatgctgttctcat

SEQ ID NO: 514859 - DNA, 25 bp, Rattus norvegicus
gtggtttacatgcagtcccagagtt

SEQ ID NO: 514860 - DNA, 25 bp, Rattus norvegicus
gtggtttacatggagtcccagagtt

SEQ ID NO: 514861 - DNA, 25 bp, Rattus norvegicus
gtggtttacatgttgctgttctcat

SEQ ID NO: 514862 - DNA, 25 bp, Rattus norvegicus
gtggtttaggcaatcctcaagcccc

SEQ ID NO: 514863 - DNA, 25 bp, Rattus norvegicus
gtggtttaggcattcctcaagcccc

SEQ ID NO: 514864 - DNA, 25 bp, Rattus norvegicus
gtggtttatactacagcttcttgct

SEQ ID NO: 514865 - DNA, 25 bp, Rattus norvegicus
gtggtttatacttcagcttcttgct

SEQ ID NO: 514866 - DNA, 25 bp, Rattus norvegicus
gtggtttcacttatcctgcgtttca

SEQ ID NO: 514867 - DNA, 25 bp, Rattus norvegicus
gtggtttcacttttcctgcgtttca

SEQ ID NO: 514868 - DNA, 25 bp, Rattus norvegicus
gtggtttcagccatgattctccttt

SEQ ID NO: 514869 - DNA, 25 bp, Rattus norvegicus
gtggtttcagccttgattctccttt

SEQ ID NO: 514870 - DNA, 25 bp, Rattus norvegicus
gtggtttcagttcttatgacccaac

SEQ ID NO: 514871 - DNA, 25 bp, Rattus norvegicus
gtggtttcagttgttatgacccaac

SEQ ID NO: 514872 - DNA, 25 bp, Rattus norvegicus
gtggtttcatgcatgtcactgatat

SEQ ID NO: 514873 - DNA, 25 bp, Rattus norvegicus
gtggtttcatgcttgtcactgatat

SEQ ID NO: 514874 - DNA, 25 bp, Rattus norvegicus
gtggtttccacgatactagattagc

SEQ ID NO: 514875 - DNA, 25 bp, Rattus norvegicus
gtggtttccacgttactagattagc

SEQ ID NO: 514876 - DNA, 25 bp, Rattus norvegicus
gtggtttccaggacacagcagtacc

SEQ ID NO: 514877 - DNA, 25 bp, Rattus norvegicus
gtggtttccaggtcacagcagtacc

SEQ ID NO: 514878 - DNA, 25 bp, Rattus norvegicus
gtggtttccagtctcttagggctaa

SEQ ID NO: 514879 - DNA, 25 bp, Rattus norvegicus
gtggtttccagtgtcttagggctaa

SEQ ID NO: 514880 - DNA, 25 bp, Rattus norvegicus
gtggtttccatcagtgaagcaccat

SEQ ID NO: 514881 - DNA, 25 bp, Rattus norvegicus
gtggtttccatctgtgaagcaccat

SEQ ID NO: 514882 - DNA, 25 bp, Rattus norvegicus
gtggtttcccatctctacaaagttt

SEQ ID NO: 514883 - DNA, 25 bp, Rattus norvegicus
gtggtttcccatgtctacaaagttt

SEQ ID NO: 514884 - DNA, 25 bp, Rattus norvegicus
gtggtttccctgagcaaggctgctg

SEQ ID NO: 514885 - DNA, 25 bp, Rattus norvegicus
gtggtttccctgtgcaaggctgctg

SEQ ID NO: 514886 - DNA, 25 bp, Rattus norvegicus
gtggtttcctgaattgtcactcaat

SEQ ID NO: 514887 - DNA, 25 bp, Rattus norvegicus
gtggtttcctgatttgtcactcaat

SEQ ID NO: 514888 - DNA, 25 bp, Rattus norvegicus
gtggtttctaggcagacatctcaac

SEQ ID NO: 514889 - DNA, 25 bp, Rattus norvegicus
gtggtttctagggagacatctcaac

SEQ ID NO: 514890 - DNA, 25 bp, Rattus norvegicus
gtggtttctcaccttaactatatta

SEQ ID NO: 514891 - DNA, 25 bp, Rattus norvegicus
gtggtttctcacgttaactatatta

SEQ ID NO: 514892 - DNA, 25 bp, Rattus norvegicus
gtggtttctcagataatacatagct

SEQ ID NO: 514893 - DNA, 25 bp, Rattus norvegicus
gtggtttctcagttaatacatagct

SEQ ID NO: 514894 - DNA, 25 bp, Rattus norvegicus
gtggtttctgccattagccatgatt

SEQ ID NO: 514895 - DNA, 25 bp, Rattus norvegicus
gtggtttctgcctttagccatgatt

SEQ ID NO: 514896 - DNA, 25 bp, Rattus norvegicus
gtggtttctggtcacacatgctgaa

SEQ ID NO: 514897 - DNA, 25 bp, Rattus norvegicus
gtggtttctggtgacacatgctgaa

SEQ ID NO: 514898 - DNA, 25 bp, Rattus norvegicus
gtggtttctgttacttgagagaatt

SEQ ID NO: 514899 - DNA, 25 bp, Rattus norvegicus
gtggtttctgttagtgttgtgctga

SEQ ID NO: 514900 - DNA, 25 bp, Rattus norvegicus
gtggtttctgtttcttgagagaatt

SEQ ID NO: 514901 - DNA, 25 bp, Rattus norvegicus
gtggtttctgtttgtgttgtgctga

SEQ ID NO: 514902 - DNA, 25 bp, Rattus norvegicus
gtggtttcttccaaaattgctctgg

SEQ ID NO: 514903 - DNA, 25 bp, Rattus norvegicus
gtggtttcttcctaaattgctctgg

SEQ ID NO: 514904 - DNA, 25 bp, Rattus norvegicus
gtggtttgaatacacctggcctagg

SEQ ID NO: 514905 - DNA, 25 bp, Rattus norvegicus
gtggtttgaatagacctggcctagg

SEQ ID NO: 514906 - DNA, 25 bp, Rattus norvegicus
gtggtttgaatgagactgaccccta

SEQ ID NO: 514907 - DNA, 25 bp, Rattus norvegicus
gtggtttgaatgtgactgaccccta

SEQ ID NO: 514908 - DNA, 25 bp, Rattus norvegicus
gtggtttgactcaacccagggcaat

SEQ ID NO: 514909 - DNA, 25 bp, Rattus norvegicus
gtggtttgactctacccagggcaat

SEQ ID NO: 514910 - DNA, 25 bp, Rattus norvegicus
gtggtttgatttactgtgtgcttta

SEQ ID NO: 514911 - DNA, 25 bp, Rattus norvegicus
gtggtttgattttctgtgtgcttta

SEQ ID NO: 514912 - DNA, 25 bp, Rattus norvegicus
gtggtttgcaaccaccgtctaggaa

SEQ ID NO: 514913 - DNA, 25 bp, Rattus norvegicus
gtggtttgcaacgaccgtctaggaa

SEQ ID NO: 514914 - DNA, 25 bp, Rattus norvegicus
gtggtttgctcacaatgtccaatat

SEQ ID NO: 514915 - DNA, 25 bp, Rattus norvegicus
gtggtttgctcagaatgtccaatat

SEQ ID NO: 514916 - DNA, 25 bp, Rattus norvegicus
gtggtttgtaagaacgctctgtaaa

SEQ ID NO: 514917 - DNA, 25 bp, Rattus norvegicus
gtggtttgtaagtacgctctgtaaa

SEQ ID NO: 514918 - DNA, 25 bp, Rattus norvegicus
gtggtttgtaccatagatcccgccg

SEQ ID NO: 514919 - DNA, 25 bp, Rattus norvegicus
gtggtttgtaccttagatcccgccg

SEQ ID NO: 514920 - DNA, 25 bp, Rattus norvegicus
gtggtttgtataaagaacactaagg

SEQ ID NO: 514921 - DNA, 25 bp, Rattus norvegicus
gtggtttgtatatagaacactaagg

SEQ ID NO: 514922 - DNA, 25 bp, Rattus norvegicus
gtggtttgtcatcttgttctgatct

SEQ ID NO: 514923 - DNA, 25 bp, Rattus norvegicus
gtggtttgtcatgttgttctgatct

SEQ ID NO: 514924 - DNA, 25 bp, Rattus norvegicus
gtggtttgtcccattataaatcaga

SEQ ID NO: 514925 - DNA, 25 bp, Rattus norvegicus
gtggtttgtccctttataaatcaga

SEQ ID NO: 514926 - DNA, 25 bp, Rattus norvegicus
gtggtttgttccatgatgacacaac

SEQ ID NO: 514927 - DNA, 25 bp, Rattus norvegicus
gtggtttgttccttgatgacacaac

SEQ ID NO: 514928 - DNA, 25 bp, Rattus norvegicus
gtggttttaactcccacctagtggc

SEQ ID NO: 514929 - DNA, 25 bp, Rattus norvegicus
gtggttttaactgccacctagtggc

SEQ ID NO: 514930 - DNA, 25 bp, Rattus norvegicus
gtggttttacagatcagccaacctg

SEQ ID NO: 514931 - DNA, 25 bp, Rattus norvegicus
gtggttttacagctccatcaggaac

SEQ ID NO: 514932 - DNA, 25 bp, Rattus norvegicus
gtggttttacaggtccatcaggaac

SEQ ID NO: 514933 - DNA, 25 bp, Rattus norvegicus
gtggttttacagttcagccaacctg

SEQ ID NO: 514934 - DNA, 25 bp, Rattus norvegicus
gtggttttacatactcctttcatta

SEQ ID NO: 514935 - DNA, 25 bp, Rattus norvegicus
gtggttttacattctcctttcatta

SEQ ID NO: 514936 - DNA, 25 bp, Rattus norvegicus
gtggttttagctcaacccatgggaa

SEQ ID NO: 514937 - DNA, 25 bp, Rattus norvegicus
gtggttttagctgaacccatgggaa

SEQ ID NO: 514938 - DNA, 25 bp, Rattus norvegicus
gtggttttagttcttctatctgtac

SEQ ID NO: 514939 - DNA, 25 bp, Rattus norvegicus
gtggttttagttgttctatctgtac

SEQ ID NO: 514940 - DNA, 25 bp, Rattus norvegicus
gtggttttcagcaactgcatttctt

SEQ ID NO: 514941 - DNA, 25 bp, Rattus norvegicus
gtggttttcagctactgcatttctt

SEQ ID NO: 514942 - DNA, 25 bp, Rattus norvegicus
gtggttttcaggactgcaccagaga

SEQ ID NO: 514943 - DNA, 25 bp, Rattus norvegicus
gtggttttcaggtctgcaccagaga

SEQ ID NO: 514944 - DNA, 25 bp, Rattus norvegicus
gtggttttctatatcacactatgaa

SEQ ID NO: 514945 - DNA, 25 bp, Rattus norvegicus
gtggttttctatttcacactatgaa

SEQ ID NO: 514946 - DNA, 25 bp, Rattus norvegicus
gtggttttgcagcagtagaactcca

SEQ ID NO: 514947 - DNA, 25 bp, Rattus norvegicus
gtggttttgcaggagtagaactcca

SEQ ID NO: 514948 - DNA, 25 bp, Rattus norvegicus
gtggttttgtctctgttgagtcctc

SEQ ID NO: 514949 - DNA, 25 bp, Rattus norvegicus
gtggttttgtctgtgttgagtcctc

SEQ ID NO: 514950 - DNA, 25 bp, Rattus norvegicus
gtggttttgtttctgccatctcaaa

SEQ ID NO: 514951 - DNA, 25 bp, Rattus norvegicus
gtggttttgtttgtgccatctcaaa

SEQ ID NO: 514952 - DNA, 25 bp, Rattus norvegicus
gtggtttttaatcaaagctggcttt

SEQ ID NO: 514953 - DNA, 25 bp, Rattus norvegicus
gtggtttttaatgaaagctggcttt

SEQ ID NO: 514954 - DNA, 25 bp, Rattus norvegicus
gtggtttttctcaagtcggactgct

SEQ ID NO: 514955 - DNA, 25 bp, Rattus norvegicus
gtggtttttctctagtcggactgct

SEQ ID NO: 514956 - DNA, 25 bp, Rattus norvegicus
gtggtttttgtcctccacaaatcat

SEQ ID NO: 514957 - DNA, 25 bp, Rattus norvegicus
gtggtttttgtcgtccacaaatcat

SEQ ID NO: 514958 - DNA, 25 bp, Rattus norvegicus
gtgtaaaaatagctggccttttcca

SEQ ID NO: 514959 - DNA, 25 bp, Rattus norvegicus
gtgtaaaaataggtggccttttcca

SEQ ID NO: 514960 - DNA, 25 bp, Rattus norvegicus
gtgtaaaacaatctcctagttgaat

SEQ ID NO: 514961 - DNA, 25 bp, Rattus norvegicus
gtgtaaaacaatgtcctagttgaat

SEQ ID NO: 514962 - DNA, 25 bp, Rattus norvegicus
gtgtaaaacactaccctgtatctgt

SEQ ID NO: 514963 - DNA, 25 bp, Rattus norvegicus
gtgtaaaacacttccctgtatctgt

SEQ ID NO: 514964 - DNA, 25 bp, Rattus norvegicus
gtgtaaaacagcatatacccagtat

SEQ ID NO: 514965 - DNA, 25 bp, Rattus norvegicus
gtgtaaaacagcttatacccagtat

SEQ ID NO: 514966 - DNA, 25 bp, Rattus norvegicus
gtgtaaaaccttcctctcagatcaa

SEQ ID NO: 514967 - DNA, 25 bp, Rattus norvegicus
gtgtaaaaccttgctctcagatcaa

SEQ ID NO: 514968 - DNA, 25 bp, Rattus norvegicus
gtgtaaaactaccagtacctttgtg

SEQ ID NO: 514969 - DNA, 25 bp, Rattus norvegicus
gtgtaaaactacgagtacctttgtg

SEQ ID NO: 514970 - DNA, 25 bp, Rattus norvegicus
gtgtaaaagcgtcctgcccctttaa

SEQ ID NO: 514971 - DNA, 25 bp, Rattus norvegicus
gtgtaaaagcgtgctgcccctttaa

SEQ ID NO: 514972 - DNA, 25 bp, Rattus norvegicus
gtgtaaaataaaacctctcgttcag

SEQ ID NO: 514973 - DNA, 25 bp, Rattus norvegicus
gtgtaaaataaatcctctcgttcag

SEQ ID NO: 514974 - DNA, 25 bp, Rattus norvegicus
gtgtaaaatactaatgctctcttct

SEQ ID NO: 514975 - DNA, 25 bp, Rattus norvegicus
gtgtaaaatacttatgctctcttct

SEQ ID NO: 514976 - DNA, 25 bp, Rattus norvegicus
gtgtaaaatcctaccataaaatgct

SEQ ID NO: 514977 - DNA, 25 bp, Rattus norvegicus
gtgtaaaatccttccataaaatgct

SEQ ID NO: 514978 - DNA, 25 bp, Rattus norvegicus
gtgtaaacacatcatctcatcggct

SEQ ID NO: 514979 - DNA, 25 bp, Rattus norvegicus
gtgtaaacacatgatctcatcggct

SEQ ID NO: 514980 - DNA, 25 bp, Rattus norvegicus
gtgtaaacactgatgactgccaaac

SEQ ID NO: 514981 - DNA, 25 bp, Rattus norvegicus
gtgtaaacactgttgactgccaaac

SEQ ID NO: 514982 - DNA, 25 bp, Rattus norvegicus
gtgtaaacaggtacccatcgcagag

SEQ ID NO: 514983 - DNA, 25 bp, Rattus norvegicus
gtgtaaacaggttcccatcgcagag

SEQ ID NO: 514984 - DNA, 25 bp, Rattus norvegicus
gtgtaaacatcccttgctgacagaa

SEQ ID NO: 514985 - DNA, 25 bp, Rattus norvegicus
gtgtaaacatccgttgctgacagaa

SEQ ID NO: 514986 - DNA, 25 bp, Rattus norvegicus
gtgtaaacccaacactcatgcagtg

SEQ ID NO: 514987 - DNA, 25 bp, Rattus norvegicus
gtgtaaacccaagactcatgcagtg

SEQ ID NO: 514988 - DNA, 25 bp, Rattus norvegicus
gtgtaaacctgactaagccactgtt

SEQ ID NO: 514989 - DNA, 25 bp, Rattus norvegicus
gtgtaaacctgagtaagccactgtt

SEQ ID NO: 514990 - DNA, 25 bp, Rattus norvegicus
gtgtaaacggtcagattccagcttt

SEQ ID NO: 514991 - DNA, 25 bp, Rattus norvegicus
gtgtaaacggtctgattccagcttt

SEQ ID NO: 514992 - DNA, 25 bp, Rattus norvegicus
gtgtaaacgttacttgctggcttta

SEQ ID NO: 514993 - DNA, 25 bp, Rattus norvegicus
gtgtaaacgttagttgctggcttta

SEQ ID NO: 514994 - DNA, 25 bp, Rattus norvegicus
gtgtaaactcaacccactgctggag

SEQ ID NO: 514995 - DNA, 25 bp, Rattus norvegicus
gtgtaaactcaagccactgctggag

SEQ ID NO: 514996 - DNA, 25 bp, Rattus norvegicus
gtgtaaacttcaaaccatactgtca

SEQ ID NO: 514997 - DNA, 25 bp, Rattus norvegicus
gtgtaaacttcataccatactgtca

SEQ ID NO: 514998 - DNA, 25 bp, Rattus norvegicus
gtgtaaagatcacatctgccactat

SEQ ID NO: 514999 - DNA, 25 bp, Rattus norvegicus
gtgtaaagatcagatctgccactat

SEQ ID NO: 515000 - DNA, 25 bp, Rattus norvegicus
gtgtaaagccgtcctttgtcaaaga

SEQ ID NO: 515001 - DNA, 25 bp, Rattus norvegicus
gtgtaaagccgtgctttgtcaaaga

SEQ ID NO: 515002 - DNA, 25 bp, Rattus norvegicus
gtgtaaagcctgctcagcaatctgt

SEQ ID NO: 515003 - DNA, 25 bp, Rattus norvegicus
gtgtaaagcctggtcagcaatctgt

SEQ ID NO: 515004 - DNA, 25 bp, Rattus norvegicus
gtgtaaagctaacatgcatcgcaaa

SEQ ID NO: 515005 - DNA, 25 bp, Rattus norvegicus
gtgtaaagctaagatgcatcgcaaa

SEQ ID NO: 515006 - DNA, 25 bp, Rattus norvegicus
gtgtaaagctagctaccccaggcgc

SEQ ID NO: 515007 - DNA, 25 bp, Rattus norvegicus
gtgtaaagctaggtaccccaggcgc

SEQ ID NO: 515008 - DNA, 25 bp, Rattus norvegicus
gtgtaaagttttctgttcctgtaga

SEQ ID NO: 515009 - DNA, 25 bp, Rattus norvegicus
gtgtaaagttttgtgttcctgtaga

SEQ ID NO: 515010 - DNA, 25 bp, Rattus norvegicus
gtgtaaatagtccaccacttggttt

SEQ ID NO: 515011 - DNA, 25 bp, Rattus norvegicus
gtgtaaatagtcgaccacttggttt

SEQ ID NO: 515012 - DNA, 25 bp, Rattus norvegicus
gtgtaaatctgtctttaccttggat

SEQ ID NO: 515013 - DNA, 25 bp, Rattus norvegicus
gtgtaaatctgtgtttaccttggat

SEQ ID NO: 515014 - DNA, 25 bp, Rattus norvegicus
gtgtaaatgcagaaactccgagtgt

SEQ ID NO: 515015 - DNA, 25 bp, Rattus norvegicus
gtgtaaatgcagtaactccgagtgt

SEQ ID NO: 515016 - DNA, 25 bp, Rattus norvegicus
gtgtaaatgctgctattcccttgcc

SEQ ID NO: 515017 - DNA, 25 bp, Rattus norvegicus
gtgtaaatgctggtattcccttgcc

SEQ ID NO: 515018 - DNA, 25 bp, Rattus norvegicus
gtgtaaattcagaagcttttgtcca

SEQ ID NO: 515019 - DNA, 25 bp, Rattus norvegicus
gtgtaaattcagtagcttttgtcca

SEQ ID NO: 515020 - DNA, 25 bp, Rattus norvegicus
gtgtaacaaatcatccccaacatgg

SEQ ID NO: 515021 - DNA, 25 bp, Rattus norvegicus
gtgtaacaaatcttccccaacatgg

SEQ ID NO: 515022 - DNA, 25 bp, Rattus norvegicus
gtgtaacaatagaccaaccaggatt

SEQ ID NO: 515023 - DNA, 25 bp, Rattus norvegicus
gtgtaacaatagtccaaccaggatt

SEQ ID NO: 515024 - DNA, 25 bp, Rattus norvegicus
gtgtaacacatgcagcgagcgcaca

SEQ ID NO: 515025 - DNA, 25 bp, Rattus norvegicus
gtgtaacacatggagcgagcgcaca

SEQ ID NO: 515026 - DNA, 25 bp, Rattus norvegicus
gtgtaacaccacctctaccgcagag

SEQ ID NO: 515027 - DNA, 25 bp, Rattus norvegicus
gtgtaacaccacgtctaccgcagag

SEQ ID NO: 515028 - DNA, 25 bp, Rattus norvegicus
gtgtaacaccggagggccaaacctg

SEQ ID NO: 515029 - DNA, 25 bp, Rattus norvegicus
gtgtaacaccggtgggccaaacctg

SEQ ID NO: 515030 - DNA, 25 bp, Rattus norvegicus
gtgtaacacgttatcatgtttgctg

SEQ ID NO: 515031 - DNA, 25 bp, Rattus norvegicus
gtgtaacacgttttcatgtttgctg

SEQ ID NO: 515032 - DNA, 25 bp, Rattus norvegicus
gtgtaacactatcgctttgcttctg

SEQ ID NO: 515033 - DNA, 25 bp, Rattus norvegicus
gtgtaacactatggctttgcttctg

SEQ ID NO: 515034 - DNA, 25 bp, Rattus norvegicus
gtgtaacactgacacagtctggcca

SEQ ID NO: 515035 - DNA, 25 bp, Rattus norvegicus
gtgtaacactgactacagcgactgt

SEQ ID NO: 515036 - DNA, 25 bp, Rattus norvegicus
gtgtaacactgagacagtctggcca

SEQ ID NO: 515037 - DNA, 25 bp, Rattus norvegicus
gtgtaacactgagtacagcgactgt

SEQ ID NO: 515038 - DNA, 25 bp, Rattus norvegicus
gtgtaaccaagtctgctcttcttta

SEQ ID NO: 515039 - DNA, 25 bp, Rattus norvegicus
gtgtaaccaagtgtgctcttcttta

SEQ ID NO: 515040 - DNA, 25 bp, Rattus norvegicus
gtgtaaccactgatggcatagctgt

SEQ ID NO: 515041 - DNA, 25 bp, Rattus norvegicus
gtgtaaccactgttggcatagctgt

SEQ ID NO: 515042 - DNA, 25 bp, Rattus norvegicus
gtgtaaccacttctatgcagtgcct

SEQ ID NO: 515043 - DNA, 25 bp, Rattus norvegicus
gtgtaaccacttgtatgcagtgcct

SEQ ID NO: 515044 - DNA, 25 bp, Rattus norvegicus
gtgtaaccgaatccttggctttcaa

SEQ ID NO: 515045 - DNA, 25 bp, Rattus norvegicus
gtgtaaccgaatgcttggctttcaa

SEQ ID NO: 515046 - DNA, 25 bp, Rattus norvegicus
gtgtaaccggttcttcagtctctaa

SEQ ID NO: 515047 - DNA, 25 bp, Rattus norvegicus
gtgtaaccggttgttcagtctctaa

SEQ ID NO: 515048 - DNA, 25 bp, Rattus norvegicus
gtgtaaccttagctatccacgttat

SEQ ID NO: 515049 - DNA, 25 bp, Rattus norvegicus
gtgtaaccttaggtatccacgttat

SEQ ID NO: 515050 - DNA, 25 bp, Rattus norvegicus
gtgtaactagtgaagcattgcgtaa

SEQ ID NO: 515051 - DNA, 25 bp, Rattus norvegicus
gtgtaactagtgtagcattgcgtaa

SEQ ID NO: 515052 - DNA, 25 bp, Rattus norvegicus
gtgtaactcagacaactccagcaca

SEQ ID NO: 515053 - DNA, 25 bp, Rattus norvegicus
gtgtaactcagagaactccagcaca

SEQ ID NO: 515054 - DNA, 25 bp, Rattus norvegicus
gtgtaactcagtcctgctgtccaca

SEQ ID NO: 515055 - DNA, 25 bp, Rattus norvegicus
gtgtaactcagtgctgctgtccaca

SEQ ID NO: 515056 - DNA, 25 bp, Rattus norvegicus
gtgtaactgacgattttcctttcag

SEQ ID NO: 515057 - DNA, 25 bp, Rattus norvegicus
gtgtaactgacgtttttcctttcag

SEQ ID NO: 515058 - DNA, 25 bp, Rattus norvegicus
gtgtaactgtatcctctagcagaat

SEQ ID NO: 515059 - DNA, 25 bp, Rattus norvegicus
gtgtaactgtatgctctagcagaat

SEQ ID NO: 515060 - DNA, 25 bp, Rattus norvegicus
gtgtaactgtgcatcatcgttccaa

SEQ ID NO: 515061 - DNA, 25 bp, Rattus norvegicus
gtgtaactgtgcattttatttcaat

SEQ ID NO: 515062 - DNA, 25 bp, Rattus norvegicus
gtgtaactgtgcttcatcgttccaa

SEQ ID NO: 515063 - DNA, 25 bp, Rattus norvegicus
gtgtaactgtgctttttatttcaat

SEQ ID NO: 515064 - DNA, 25 bp, Rattus norvegicus
gtgtaactgtgtacagggccacaat

SEQ ID NO: 515065 - DNA, 25 bp, Rattus norvegicus
gtgtaactgtgttcagggccacaat

SEQ ID NO: 515066 - DNA, 25 bp, Rattus norvegicus
gtgtaacttattcggtcaccaggcc

SEQ ID NO: 515067 - DNA, 25 bp, Rattus norvegicus
gtgtaacttattgggtcaccaggcc

SEQ ID NO: 515068 - DNA, 25 bp, Rattus norvegicus
gtgtaacttcctaaccatggacagt

SEQ ID NO: 515069 - DNA, 25 bp, Rattus norvegicus
gtgtaacttccttaccatggacagt

SEQ ID NO: 515070 - DNA, 25 bp, Rattus norvegicus
gtgtaacttcttccactactgtggc

SEQ ID NO: 515071 - DNA, 25 bp, Rattus norvegicus
gtgtaacttcttgcactactgtggc

SEQ ID NO: 515072 - DNA, 25 bp, Rattus norvegicus
gtgtaactttgcaacatgtttttgt

SEQ ID NO: 515073 - DNA, 25 bp, Rattus norvegicus
gtgtaactttgctacatgtttttgt

SEQ ID NO: 515074 - DNA, 25 bp, Rattus norvegicus
gtgtaagaaaacactacgtggtcaa

SEQ ID NO: 515075 - DNA, 25 bp, Rattus norvegicus
gtgtaagaaaactctacgtggtcaa

SEQ ID NO: 515076 - DNA, 25 bp, Rattus norvegicus
gtgtaagaaactccacatccgtgtg

SEQ ID NO: 515077 - DNA, 25 bp, Rattus norvegicus
gtgtaagaaactgcacatccgtgtg

SEQ ID NO: 515078 - DNA, 25 bp, Rattus norvegicus
gtgtaagacacacaggcagccttgc

SEQ ID NO: 515079 - DNA, 25 bp, Rattus norvegicus
gtgtaagacacagaggcagccttgc

SEQ ID NO: 515080 - DNA, 25 bp, Rattus norvegicus
gtgtaagagcttaccccaggacgtt

SEQ ID NO: 515081 - DNA, 25 bp, Rattus norvegicus
gtgtaagagctttccccaggacgtt

SEQ ID NO: 515082 - DNA, 25 bp, Rattus norvegicus
gtgtaagcaagaactccaggatgtc

SEQ ID NO: 515083 - DNA, 25 bp, Rattus norvegicus
gtgtaagcaagatctccaggatgtc

SEQ ID NO: 515084 - DNA, 25 bp, Rattus norvegicus
gtgtaagcactcatgtttgtctcag

SEQ ID NO: 515085 - DNA, 25 bp, Rattus norvegicus
gtgtaagcactcttgtttgtctcag

SEQ ID NO: 515086 - DNA, 25 bp, Rattus norvegicus
gtgtaagccatcatactcggtgtca

SEQ ID NO: 515087 - DNA, 25 bp, Rattus norvegicus
gtgtaagccatcttactcggtgtca

SEQ ID NO: 515088 - DNA, 25 bp, Rattus norvegicus
gtgtaagccatgctaagctctccat

SEQ ID NO: 515089 - DNA, 25 bp, Rattus norvegicus
gtgtaagccatggtaagctctccat

SEQ ID NO: 515090 - DNA, 25 bp, Rattus norvegicus
gtgtaagcctggcagtttcttcact

SEQ ID NO: 515091 - DNA, 25 bp, Rattus norvegicus
gtgtaagcctgggagtttcttcact

SEQ ID NO: 515092 - DNA, 25 bp, Rattus norvegicus
gtgtaagctcagactatacccggtc

SEQ ID NO: 515093 - DNA, 25 bp, Rattus norvegicus
gtgtaagctcagaggctgcacccaa

SEQ ID NO: 515094 - DNA, 25 bp, Rattus norvegicus
gtgtaagctcagtctatacccggtc

SEQ ID NO: 515095 - DNA, 25 bp, Rattus norvegicus
gtgtaagctcagtggctgcacccaa

SEQ ID NO: 515096 - DNA, 25 bp, Rattus norvegicus
gtgtaagctcttatagatgctgcct

SEQ ID NO: 515097 - DNA, 25 bp, Rattus norvegicus
gtgtaagctcttttagatgctgcct

SEQ ID NO: 515098 - DNA, 25 bp, Rattus norvegicus
gtgtaagctgcgcacctgcctgaca

SEQ ID NO: 515099 - DNA, 25 bp, Rattus norvegicus
gtgtaagctgcggacctgcctgaca

SEQ ID NO: 515100 - DNA, 25 bp, Rattus norvegicus
gtgtaagctgttcacacctccgctt

SEQ ID NO: 515101 - DNA, 25 bp, Rattus norvegicus
gtgtaagctgttgacacctccgctt

SEQ ID NO: 515102 - DNA, 25 bp, Rattus norvegicus
gtgtaaggccagatggcctgctcct

SEQ ID NO: 515103 - DNA, 25 bp, Rattus norvegicus
gtgtaaggccagttggcctgctcct

SEQ ID NO: 515104 - DNA, 25 bp, Rattus norvegicus
gtgtaaggccctaggacatccatga

SEQ ID NO: 515105 - DNA, 25 bp, Rattus norvegicus
gtgtaaggcccttggacatccatga

SEQ ID NO: 515106 - DNA, 25 bp, Rattus norvegicus
gtgtaaggctgcatccatggaattc

SEQ ID NO: 515107 - DNA, 25 bp, Rattus norvegicus
gtgtaaggctgcttccatggaattc

SEQ ID NO: 515108 - DNA, 25 bp, Rattus norvegicus
gtgtaagggtgcagccacacctgga

SEQ ID NO: 515109 - DNA, 25 bp, Rattus norvegicus
gtgtaagggtgctgccacacctgga

SEQ ID NO: 515110 - DNA, 25 bp, Rattus norvegicus
gtgtaagtcaacctaccaaatgctt

SEQ ID NO: 515111 - DNA, 25 bp, Rattus norvegicus
gtgtaagtcaacgtaccaaatgctt

SEQ ID NO: 515112 - DNA, 25 bp, Rattus norvegicus
gtgtaagtggtcaactggtctcacc

SEQ ID NO: 515113 - DNA, 25 bp, Rattus norvegicus
gtgtaagtggtctactggtctcacc

SEQ ID NO: 515114 - DNA, 25 bp, Rattus norvegicus
gtgtaagtgtggaccacggcattct

SEQ ID NO: 515115 - DNA, 25 bp, Rattus norvegicus
gtgtaagtgtggtccacggcattct

SEQ ID NO: 515116 - DNA, 25 bp, Rattus norvegicus
gtgtaagttccccagtagcttgtac

SEQ ID NO: 515117 - DNA, 25 bp, Rattus norvegicus
gtgtaagttcccgagtagcttgtac

SEQ ID NO: 515118 - DNA, 25 bp, Rattus norvegicus
gtgtaataacacattcgagggctta

SEQ ID NO: 515119 - DNA, 25 bp, Rattus norvegicus
gtgtaataacactttcgagggctta

SEQ ID NO: 515120 - DNA, 25 bp, Rattus norvegicus
gtgtaataatagatcatgtccccaa

SEQ ID NO: 515121 - DNA, 25 bp, Rattus norvegicus
gtgtaataatagttcatgtccccaa

SEQ ID NO: 515122 - DNA, 25 bp, Rattus norvegicus
gtgtaataatcaacggcattgccat

SEQ ID NO: 515123 - DNA, 25 bp, Rattus norvegicus
gtgtaataatcatcggcattgccat

SEQ ID NO: 515124 - DNA, 25 bp, Rattus norvegicus
gtgtaatactcaaaggccatcctcc

SEQ ID NO: 515125 - DNA, 25 bp, Rattus norvegicus
gtgtaatactcataggccatcctcc

SEQ ID NO: 515126 - DNA, 25 bp, Rattus norvegicus
gtgtaataggccatttctgctttaa

SEQ ID NO: 515127 - DNA, 25 bp, Rattus norvegicus
gtgtaataggccttttctgctttaa

SEQ ID NO: 515128 - DNA, 25 bp, Rattus norvegicus
gtgtaatatcacagcattcttgcat

SEQ ID NO: 515129 - DNA, 25 bp, Rattus norvegicus
gtgtaatatcactgcattcttgcat

SEQ ID NO: 515130 - DNA, 25 bp, Rattus norvegicus
gtgtaatcaagacccggactagagt

SEQ ID NO: 515131 - DNA, 25 bp, Rattus norvegicus
gtgtaatcaagagccggactagagt

SEQ ID NO: 515132 - DNA, 25 bp, Rattus norvegicus
gtgtaatcactcctctgaagccctc

SEQ ID NO: 515133 - DNA, 25 bp, Rattus norvegicus
gtgtaatcactcgtctgaagccctc

SEQ ID NO: 515134 - DNA, 25 bp, Rattus norvegicus
gtgtaatcatgcctccaactgggct

SEQ ID NO: 515135 - DNA, 25 bp, Rattus norvegicus
gtgtaatcatgcgtccaactgggct

SEQ ID NO: 515136 - DNA, 25 bp, Rattus norvegicus
gtgtaatcccatctactggtgtttc

SEQ ID NO: 515137 - DNA, 25 bp, Rattus norvegicus
gtgtaatcccatgtactggtgtttc

SEQ ID NO: 515138 - DNA, 25 bp, Rattus norvegicus
gtgtaatccctacgcttcaaccctg

SEQ ID NO: 515139 - DNA, 25 bp, Rattus norvegicus
gtgtaatccctaggcttcaaccctg

SEQ ID NO: 515140 - DNA, 25 bp, Rattus norvegicus
gtgtaatcctgtcatgggactgccc

SEQ ID NO: 515141 - DNA, 25 bp, Rattus norvegicus
gtgtaatcctgtgatgggactgccc

SEQ ID NO: 515142 - DNA, 25 bp, Rattus norvegicus
gtgtaatcgcatctgcaggcaccac

SEQ ID NO: 515143 - DNA, 25 bp, Rattus norvegicus
gtgtaatcgcatgtgcaggcaccac

SEQ ID NO: 515144 - DNA, 25 bp, Rattus norvegicus
gtgtaatgacttcctaacctttgaa

SEQ ID NO: 515145 - DNA, 25 bp, Rattus norvegicus
gtgtaatgacttgctaacctttgaa

SEQ ID NO: 515146 - DNA, 25 bp, Rattus norvegicus
gtgtaatgccaaaacttttccttgt

SEQ ID NO: 515147 - DNA, 25 bp, Rattus norvegicus
gtgtaatgccaatacttttccttgt

SEQ ID NO: 515148 - DNA, 25 bp, Rattus norvegicus
gtgtaatgcttaagctcacccacat

SEQ ID NO: 515149 - DNA, 25 bp, Rattus norvegicus
gtgtaatgcttatgctcacccacat

SEQ ID NO: 515150 - DNA, 25 bp, Rattus norvegicus
gtgtaatgctttctggttctcttcc

SEQ ID NO: 515151 - DNA, 25 bp, Rattus norvegicus
gtgtaatgctttgtggttctcttcc

SEQ ID NO: 515152 - DNA, 25 bp, Rattus norvegicus
gtgtaatggacgctgatactgccta

SEQ ID NO: 515153 - DNA, 25 bp, Rattus norvegicus
gtgtaatggacggtgatactgccta

SEQ ID NO: 515154 - DNA, 25 bp, Rattus norvegicus
gtgtaatggactaccttcacataaa

SEQ ID NO: 515155 - DNA, 25 bp, Rattus norvegicus
gtgtaatggacttccttcacataaa

SEQ ID NO: 515156 - DNA, 25 bp, Rattus norvegicus
gtgtaatggttactaagcgtcatct

SEQ ID NO: 515157 - DNA, 25 bp, Rattus norvegicus
gtgtaatggttagtaagcgtcatct

SEQ ID NO: 515158 - DNA, 25 bp, Rattus norvegicus
gtgtaattacatcttgtgtcccaag

SEQ ID NO: 515159 - DNA, 25 bp, Rattus norvegicus
gtgtaattacatgttgtgtcccaag

SEQ ID NO: 515160 - DNA, 25 bp, Rattus norvegicus
gtgtaattgctacattctctgatgt

SEQ ID NO: 515161 - DNA, 25 bp, Rattus norvegicus
gtgtaattgctagattctctgatgt

SEQ ID NO: 515162 - DNA, 25 bp, Rattus norvegicus
gtgtaattgtccaaatgccaacatt

SEQ ID NO: 515163 - DNA, 25 bp, Rattus norvegicus
gtgtaattgtcctaatgccaacatt

SEQ ID NO: 515164 - DNA, 25 bp, Rattus norvegicus
gtgtaattgttcagatagaccccaa

SEQ ID NO: 515165 - DNA, 25 bp, Rattus norvegicus
gtgtaattgttctgatagaccccaa

SEQ ID NO: 515166 - DNA, 25 bp, Rattus norvegicus
gtgtaatttagcatatgacagcgct

SEQ ID NO: 515167 - DNA, 25 bp, Rattus norvegicus
gtgtaatttagcttatgacagcgct

SEQ ID NO: 515168 - DNA, 25 bp, Rattus norvegicus
gtgtaatttcagacattcgggttag

SEQ ID NO: 515169 - DNA, 25 bp, Rattus norvegicus
gtgtaatttcagtcattcgggttag

SEQ ID NO: 515170 - DNA, 25 bp, Rattus norvegicus
gtgtaattttgcatcctaaatggta

SEQ ID NO: 515171 - DNA, 25 bp, Rattus norvegicus
gtgtaattttgcttcctaaatggta

SEQ ID NO: 515172 - DNA, 25 bp, Rattus norvegicus
gtgtaattttttcccctgcagaatg

SEQ ID NO: 515173 - DNA, 25 bp, Rattus norvegicus
gtgtaattttttgccctgcagaatg

SEQ ID NO: 515174 - DNA, 25 bp, Rattus norvegicus
gtgtacaaacgaagtgccccattga

SEQ ID NO: 515175 - DNA, 25 bp, Rattus norvegicus
gtgtacaaacgatgtgccccattga

SEQ ID NO: 515176 - DNA, 25 bp, Rattus norvegicus
gtgtacaaaggtcagagcctcgcct

SEQ ID NO: 515177 - DNA, 25 bp, Rattus norvegicus
gtgtacaaaggtgagagcctcgcct

SEQ ID NO: 515178 - DNA, 25 bp, Rattus norvegicus
gtgtacaacactacaggaccttgtt

SEQ ID NO: 515179 - DNA, 25 bp, Rattus norvegicus
gtgtacaacacttcaggaccttgtt

SEQ ID NO: 515180 - DNA, 25 bp, Rattus norvegicus
gtgtacaacccacacctgtttatct

SEQ ID NO: 515181 - DNA, 25 bp, Rattus norvegicus
gtgtacaacccagacctgtttatct

SEQ ID NO: 515182 - DNA, 25 bp, Rattus norvegicus
gtgtacaagcatacccctgaaatcc

SEQ ID NO: 515183 - DNA, 25 bp, Rattus norvegicus
gtgtacaagcattcccctgaaatcc

SEQ ID NO: 515184 - DNA, 25 bp, Rattus norvegicus
gtgtacaaggatcacgccaacagca

SEQ ID NO: 515185 - DNA, 25 bp, Rattus norvegicus
gtgtacaaggatgacgccaacagca

SEQ ID NO: 515186 - DNA, 25 bp, Rattus norvegicus
gtgtacaatgccatgtgctaagaat

SEQ ID NO: 515187 - DNA, 25 bp, Rattus norvegicus
gtgtacaatgccttgtgctaagaat

SEQ ID NO: 515188 - DNA, 25 bp, Rattus norvegicus
gtgtacaattagaaccatggccctc

SEQ ID NO: 515189 - DNA, 25 bp, Rattus norvegicus
gtgtacaattagtaccatggccctc

SEQ ID NO: 515190 - DNA, 25 bp, Rattus norvegicus
gtgtacaattgacccacatttgctg

SEQ ID NO: 515191 - DNA, 25 bp, Rattus norvegicus
gtgtacaattgagccacatttgctg

SEQ ID NO: 515192 - DNA, 25 bp, Rattus norvegicus
gtgtacacaaagactagggcccatt

SEQ ID NO: 515193 - DNA, 25 bp, Rattus norvegicus
gtgtacacaaagtctagggcccatt

SEQ ID NO: 515194 - DNA, 25 bp, Rattus norvegicus
gtgtacacagacatatgagctcttt

SEQ ID NO: 515195 - DNA, 25 bp, Rattus norvegicus
gtgtacacagacttatgagctcttt

SEQ ID NO: 515196 - DNA, 25 bp, Rattus norvegicus
gtgtacacagtgcagctgttcctgg

SEQ ID NO: 515197 - DNA, 25 bp, Rattus norvegicus
gtgtacacagtggagctgttcctgg

SEQ ID NO: 515198 - DNA, 25 bp, Rattus norvegicus
gtgtacacatgtccctgtgtcttcc

SEQ ID NO: 515199 - DNA, 25 bp, Rattus norvegicus
gtgtacacatgtgcctgtgtcttcc

SEQ ID NO: 515200 - DNA, 25 bp, Rattus norvegicus
gtgtacacattcatcgtgggcacaa

SEQ ID NO: 515201 - DNA, 25 bp, Rattus norvegicus
gtgtacacattcttcgtgggcacaa

SEQ ID NO: 515202 - DNA, 25 bp, Rattus norvegicus
gtgtacacccgtaaacagcctggca

SEQ ID NO: 515203 - DNA, 25 bp, Rattus norvegicus
gtgtacacccgttaacagcctggca

SEQ ID NO: 515204 - DNA, 25 bp, Rattus norvegicus
gtgtacaccttgaatgcctggctgg

SEQ ID NO: 515205 - DNA, 25 bp, Rattus norvegicus
gtgtacaccttgtatgcctggctgg

SEQ ID NO: 515206 - DNA, 25 bp, Rattus norvegicus
gtgtacacgagtaccccgtggtatg

SEQ ID NO: 515207 - DNA, 25 bp, Rattus norvegicus
gtgtacacgagttccccgtggtatg

SEQ ID NO: 515208 - DNA, 25 bp, Rattus norvegicus
gtgtacacgggcctgtaagtgcata

SEQ ID NO: 515209 - DNA, 25 bp, Rattus norvegicus
gtgtacacgggcgtgtaagtgcata

SEQ ID NO: 515210 - DNA, 25 bp, Rattus norvegicus
gtgtacacgtacatccaggagttct

SEQ ID NO: 515211 - DNA, 25 bp, Rattus norvegicus
gtgtacacgtacttccaggagttct

SEQ ID NO: 515212 - DNA, 25 bp, Rattus norvegicus
gtgtacacgtgacatggcttccttt

SEQ ID NO: 515213 - DNA, 25 bp, Rattus norvegicus
gtgtacacgtgagatggcttccttt

SEQ ID NO: 515214 - DNA, 25 bp, Rattus norvegicus
gtgtacactctgaaacctgatctac

SEQ ID NO: 515215 - DNA, 25 bp, Rattus norvegicus
gtgtacactctgatcttgtttgttt

SEQ ID NO: 515216 - DNA, 25 bp, Rattus norvegicus
gtgtacactctgtaacctgatctac

SEQ ID NO: 515217 - DNA, 25 bp, Rattus norvegicus
gtgtacactctgttcttgtttgttt

SEQ ID NO: 515218 - DNA, 25 bp, Rattus norvegicus
gtgtacactgataacaggaggactt

SEQ ID NO: 515219 - DNA, 25 bp, Rattus norvegicus
gtgtacactgattacaggaggactt

SEQ ID NO: 515220 - DNA, 25 bp, Rattus norvegicus
gtgtacactgtacacacacgcgtct

SEQ ID NO: 515221 - DNA, 25 bp, Rattus norvegicus
gtgtacactgtagacacacgcgtct

SEQ ID NO: 515222 - DNA, 25 bp, Rattus norvegicus
gtgtacacttctctacatactgacc

SEQ ID NO: 515223 - DNA, 25 bp, Rattus norvegicus
gtgtacacttctgtacatactgacc

SEQ ID NO: 515224 - DNA, 25 bp, Rattus norvegicus
gtgtacactttaatgtctaaccaag

SEQ ID NO: 515225 - DNA, 25 bp, Rattus norvegicus
gtgtacactttattgtctaaccaag

SEQ ID NO: 515226 - DNA, 25 bp, Rattus norvegicus
gtgtacagaacacaccaagctcaag

SEQ ID NO: 515227 - DNA, 25 bp, Rattus norvegicus
gtgtacagaacagaccaagctcaag

SEQ ID NO: 515228 - DNA, 25 bp, Rattus norvegicus
gtgtacagagaacatttccaagatg

SEQ ID NO: 515229 - DNA, 25 bp, Rattus norvegicus
gtgtacagagaagatttccaagatg

SEQ ID NO: 515230 - DNA, 25 bp, Rattus norvegicus
gtgtacagagccatctacaacagat

SEQ ID NO: 515231 - DNA, 25 bp, Rattus norvegicus
gtgtacagagccttctacaacagat

SEQ ID NO: 515232 - DNA, 25 bp, Rattus norvegicus
gtgtacagcggcatgggtccagatt

SEQ ID NO: 515233 - DNA, 25 bp, Rattus norvegicus
gtgtacagcggcttgggtccagatt

SEQ ID NO: 515234 - DNA, 25 bp, Rattus norvegicus
gtgtacaggattaccactctgccag

SEQ ID NO: 515235 - DNA, 25 bp, Rattus norvegicus
gtgtacaggatttccactctgccag

SEQ ID NO: 515236 - DNA, 25 bp, Rattus norvegicus
gtgtacaggctgacaaaattcacaa

SEQ ID NO: 515237 - DNA, 25 bp, Rattus norvegicus
gtgtacaggctgtcaaaattcacaa

SEQ ID NO: 515238 - DNA, 25 bp, Rattus norvegicus
gtgtacaggtagatctgaccaacag

SEQ ID NO: 515239 - DNA, 25 bp, Rattus norvegicus
gtgtacaggtagttctgaccaacag

SEQ ID NO: 515240 - DNA, 25 bp, Rattus norvegicus
gtgtacagtccacactggctatgtg

SEQ ID NO: 515241 - DNA, 25 bp, Rattus norvegicus
gtgtacagtccagactggctatgtg

SEQ ID NO: 515242 - DNA, 25 bp, Rattus norvegicus
gtgtacataaaactccttaccctgt

SEQ ID NO: 515243 - DNA, 25 bp, Rattus norvegicus
gtgtacataaaagtccttaccctgt

SEQ ID NO: 515244 - DNA, 25 bp, Rattus norvegicus
gtgtacatactgagctaactggctt

SEQ ID NO: 515245 - DNA, 25 bp, Rattus norvegicus
gtgtacatactgtgctaactggctt

SEQ ID NO: 515246 - DNA, 25 bp, Rattus norvegicus
gtgtacatagtactcatcaagtctt

SEQ ID NO: 515247 - DNA, 25 bp, Rattus norvegicus
gtgtacatagtagtcatcaagtctt

SEQ ID NO: 515248 - DNA, 25 bp, Rattus norvegicus
gtgtacatcaagcacctcaaggaca

SEQ ID NO: 515249 - DNA, 25 bp, Rattus norvegicus
gtgtacatcaaggacctcaaggaca

SEQ ID NO: 515250 - DNA, 25 bp, Rattus norvegicus
gtgtacatccagacccagaagtgca

SEQ ID NO: 515251 - DNA, 25 bp, Rattus norvegicus
gtgtacatccagtcccagaagtgca

SEQ ID NO: 515252 - DNA, 25 bp, Rattus norvegicus
gtgtacatgcagcagttcccacaga

SEQ ID NO: 515253 - DNA, 25 bp, Rattus norvegicus
gtgtacatgcaggagttcccacaga

SEQ ID NO: 515254 - DNA, 25 bp, Rattus norvegicus
gtgtacatttgtatgcattccagtt

SEQ ID NO: 515255 - DNA, 25 bp, Rattus norvegicus
gtgtacatttgtttgcattccagtt

SEQ ID NO: 515256 - DNA, 25 bp, Rattus norvegicus
gtgtaccacagtacccacaatggtg

SEQ ID NO: 515257 - DNA, 25 bp, Rattus norvegicus
gtgtaccacagttcccacaatggtg

SEQ ID NO: 515258 - DNA, 25 bp, Rattus norvegicus
gtgtaccaccaaactgtgaaccaga

SEQ ID NO: 515259 - DNA, 25 bp, Rattus norvegicus
gtgtaccaccaatctgtgaaccaga

SEQ ID NO: 515260 - DNA, 25 bp, Rattus norvegicus
gtgtaccaccacaggctagcaatta

SEQ ID NO: 515261 - DNA, 25 bp, Rattus norvegicus
gtgtaccaccactggctagcaatta

SEQ ID NO: 515262 - DNA, 25 bp, Rattus norvegicus
gtgtaccaccagagctgtggcagaa

SEQ ID NO: 515263 - DNA, 25 bp, Rattus norvegicus
gtgtaccaccagtgctgtggcagaa

SEQ ID NO: 515264 - DNA, 25 bp, Rattus norvegicus
gtgtaccacgtgaatcacaacacag

SEQ ID NO: 515265 - DNA, 25 bp, Rattus norvegicus
gtgtaccacgtgtatcacaacacag

SEQ ID NO: 515266 - DNA, 25 bp, Rattus norvegicus
gtgtaccagattctgtgctctgaaa

SEQ ID NO: 515267 - DNA, 25 bp, Rattus norvegicus
gtgtaccagattgtgtgctctgaaa

SEQ ID NO: 515268 - DNA, 25 bp, Rattus norvegicus
gtgtaccattcaatttcgtgtccaa

SEQ ID NO: 515269 - DNA, 25 bp, Rattus norvegicus
gtgtaccattcattttcgtgtccaa

SEQ ID NO: 515270 - DNA, 25 bp, Rattus norvegicus
gtgtacccaatcacgacaggaggat

SEQ ID NO: 515271 - DNA, 25 bp, Rattus norvegicus
gtgtacccaatctcgacaggaggat

SEQ ID NO: 515272 - DNA, 25 bp, Rattus norvegicus
gtgtacccacatatataatcttgtc

SEQ ID NO: 515273 - DNA, 25 bp, Rattus norvegicus
gtgtacccacatttataatcttgtc

SEQ ID NO: 515274 - DNA, 25 bp, Rattus norvegicus
gtgtacccactcaaataggcactgg

SEQ ID NO: 515275 - DNA, 25 bp, Rattus norvegicus
gtgtacccactctaataggcactgg

SEQ ID NO: 515276 - DNA, 25 bp, Rattus norvegicus
gtgtaccccgatatcaatgtcatca

SEQ ID NO: 515277 - DNA, 25 bp, Rattus norvegicus
gtgtaccccgatttcaatgtcatca

SEQ ID NO: 515278 - DNA, 25 bp, Rattus norvegicus
gtgtacccgcttcttttaggcttgg

SEQ ID NO: 515279 - DNA, 25 bp, Rattus norvegicus
gtgtacccgcttgttttaggcttgg

SEQ ID NO: 515280 - DNA, 25 bp, Rattus norvegicus
gtgtacccgtcaactcggtgggaaa

SEQ ID NO: 515281 - DNA, 25 bp, Rattus norvegicus
gtgtacccgtcatctcggtgggaaa

SEQ ID NO: 515282 - DNA, 25 bp, Rattus norvegicus
gtgtaccctgacagcatcatgtgtg

SEQ ID NO: 515283 - DNA, 25 bp, Rattus norvegicus
gtgtaccctgactgcatcatgtgtg

SEQ ID NO: 515284 - DNA, 25 bp, Rattus norvegicus
gtgtaccctggacccgacggtgcac

SEQ ID NO: 515285 - DNA, 25 bp, Rattus norvegicus
gtgtaccctggagccgacggtgcac

SEQ ID NO: 515286 - DNA, 25 bp, Rattus norvegicus
gtgtaccctttcattttcatatcta

SEQ ID NO: 515287 - DNA, 25 bp, Rattus norvegicus
gtgtaccctttctttttcatatcta

SEQ ID NO: 515288 - DNA, 25 bp, Rattus norvegicus
gtgtaccctttgcttcaagtcacat

SEQ ID NO: 515289 - DNA, 25 bp, Rattus norvegicus
gtgtaccctttggttcaagtcacat

SEQ ID NO: 515290 - DNA, 25 bp, Rattus norvegicus
gtgtaccgccgtccgggtcgcgatg

SEQ ID NO: 515291 - DNA, 25 bp, Rattus norvegicus
gtgtaccgccgtgcgggtcgcgatg

SEQ ID NO: 515292 - DNA, 25 bp, Rattus norvegicus
gtgtaccggcttagggcatttggac

SEQ ID NO: 515293 - DNA, 25 bp, Rattus norvegicus
gtgtaccggctttgggcatttggac

SEQ ID NO: 515294 - DNA, 25 bp, Rattus norvegicus
gtgtaccgtgtcatgagttcattat

SEQ ID NO: 515295 - DNA, 25 bp, Rattus norvegicus
gtgtaccgtgtcttgagttcattat

SEQ ID NO: 515296 - DNA, 25 bp, Rattus norvegicus
gtgtacctaaacagtcattccttgt

SEQ ID NO: 515297 - DNA, 25 bp, Rattus norvegicus
gtgtacctaaactgtcattccttgt

SEQ ID NO: 515298 - DNA, 25 bp, Rattus norvegicus
gtgtacctaaagaaccctcagatgg

SEQ ID NO: 515299 - DNA, 25 bp, Rattus norvegicus
gtgtacctaaagtaccctcagatgg

SEQ ID NO: 515300 - DNA, 25 bp, Rattus norvegicus
gtgtacctaagtcgatcgtcaccct

SEQ ID NO: 515301 - DNA, 25 bp, Rattus norvegicus
gtgtacctaagtggatcgtcaccct

SEQ ID NO: 515302 - DNA, 25 bp, Rattus norvegicus
gtgtacctagggaaggctgaccagt

SEQ ID NO: 515303 - DNA, 25 bp, Rattus norvegicus
gtgtacctagggtaggctgaccagt

SEQ ID NO: 515304 - DNA, 25 bp, Rattus norvegicus
gtgtacctcaggaccagattgtgtt

SEQ ID NO: 515305 - DNA, 25 bp, Rattus norvegicus
gtgtacctcaggtccagattgtgtt

SEQ ID NO: 515306 - DNA, 25 bp, Rattus norvegicus
gtgtacctccagacatctctaaagt

SEQ ID NO: 515307 - DNA, 25 bp, Rattus norvegicus
gtgtacctccagtcatctctaaagt

SEQ ID NO: 515308 - DNA, 25 bp, Rattus norvegicus
gtgtacctcgccaatacagaggaga

SEQ ID NO: 515309 - DNA, 25 bp, Rattus norvegicus
gtgtacctcgcctatacagaggaga

SEQ ID NO: 515310 - DNA, 25 bp, Rattus norvegicus
gtgtacctgagaagacctgactcta

SEQ ID NO: 515311 - DNA, 25 bp, Rattus norvegicus
gtgtacctgagatgacctgactcta

SEQ ID NO: 515312 - DNA, 25 bp, Rattus norvegicus
gtgtacctgagtctccagaatcctg

SEQ ID NO: 515313 - DNA, 25 bp, Rattus norvegicus
gtgtacctgagtgtccagaatcctg

SEQ ID NO: 515314 - DNA, 25 bp, Rattus norvegicus
gtgtacctggtacagtgcattctat

SEQ ID NO: 515315 - DNA, 25 bp, Rattus norvegicus
gtgtacctggtagagtgcattctat

SEQ ID NO: 515316 - DNA, 25 bp, Rattus norvegicus
gtgtacctggtgaatttctctacct

SEQ ID NO: 515317 - DNA, 25 bp, Rattus norvegicus
gtgtacctggtgtatttctctacct

SEQ ID NO: 515318 - DNA, 25 bp, Rattus norvegicus
gtgtacctggttctcttacaaactt

SEQ ID NO: 515319 - DNA, 25 bp, Rattus norvegicus
gtgtacctggttgtcttacaaactt

SEQ ID NO: 515320 - DNA, 25 bp, Rattus norvegicus
gtgtacctgtaactggcagtccttc

SEQ ID NO: 515321 - DNA, 25 bp, Rattus norvegicus
gtgtacctgtaagtggcagtccttc

SEQ ID NO: 515322 - DNA, 25 bp, Rattus norvegicus
gtgtaccttagtaggcagtgtttgc

SEQ ID NO: 515323 - DNA, 25 bp, Rattus norvegicus
gtgtaccttagttggcagtgtttgc

SEQ ID NO: 515324 - DNA, 25 bp, Rattus norvegicus
gtgtaccttcagaattactgcagtt

SEQ ID NO: 515325 - DNA, 25 bp, Rattus norvegicus
gtgtaccttcagtattactgcagtt

SEQ ID NO: 515326 - DNA, 25 bp, Rattus norvegicus
gtgtacgagaccataagattgcctg

SEQ ID NO: 515327 - DNA, 25 bp, Rattus norvegicus
gtgtacgagaccttaagattgcctg

SEQ ID NO: 515328 - DNA, 25 bp, Rattus norvegicus
gtgtacgagagacacctacctgagt

SEQ ID NO: 515329 - DNA, 25 bp, Rattus norvegicus
gtgtacgagagagacctacctgagt

SEQ ID NO: 515330 - DNA, 25 bp, Rattus norvegicus
gtgtacgatctgaccaagtttctcg

SEQ ID NO: 515331 - DNA, 25 bp, Rattus norvegicus
gtgtacgatctgtccaagtttctcg

SEQ ID NO: 515332 - DNA, 25 bp, Rattus norvegicus
gtgtacgcaactccccagttgaaaa

SEQ ID NO: 515333 - DNA, 25 bp, Rattus norvegicus
gtgtacgcaactgcccagttgaaaa

SEQ ID NO: 515334 - DNA, 25 bp, Rattus norvegicus
gtgtacgcaggtaccaccggcagag

SEQ ID NO: 515335 - DNA, 25 bp, Rattus norvegicus
gtgtacgcaggttccaccggcagag

SEQ ID NO: 515336 - DNA, 25 bp, Rattus norvegicus
gtgtacgctgggatcctgaaggctc

SEQ ID NO: 515337 - DNA, 25 bp, Rattus norvegicus
gtgtacgctgggttcctgaaggctc

SEQ ID NO: 515338 - DNA, 25 bp, Rattus norvegicus
gtgtacggacccagagccggaagtc

SEQ ID NO: 515339 - DNA, 25 bp, Rattus norvegicus
gtgtacggaccctgagccggaagtc

SEQ ID NO: 515340 - DNA, 25 bp, Rattus norvegicus
gtgtacggtacactctacagccttt

SEQ ID NO: 515341 - DNA, 25 bp, Rattus norvegicus
gtgtacggtacagtctacagccttt

SEQ ID NO: 515342 - DNA, 25 bp, Rattus norvegicus
gtgtacgtatgaatcctggactgag

SEQ ID NO: 515343 - DNA, 25 bp, Rattus norvegicus
gtgtacgtatgattcctggactgag

SEQ ID NO: 515344 - DNA, 25 bp, Rattus norvegicus
gtgtacgtcatgaatctgggctaga

SEQ ID NO: 515345 - DNA, 25 bp, Rattus norvegicus
gtgtacgtcatgtatctgggctaga

SEQ ID NO: 515346 - DNA, 25 bp, Rattus norvegicus
gtgtacgtgcacacatgcggcataa

SEQ ID NO: 515347 - DNA, 25 bp, Rattus norvegicus
gtgtacgtgcactcatgcggcataa

SEQ ID NO: 515348 - DNA, 25 bp, Rattus norvegicus
gtgtacgtgggacctcagagaccat

SEQ ID NO: 515349 - DNA, 25 bp, Rattus norvegicus
gtgtacgtgggagctcagagaccat

SEQ ID NO: 515350 - DNA, 25 bp, Rattus norvegicus
gtgtacgtgtatagacctgagcagt

SEQ ID NO: 515351 - DNA, 25 bp, Rattus norvegicus
gtgtacgtgtattgacctgagcagt

SEQ ID NO: 515352 - DNA, 25 bp, Rattus norvegicus
gtgtacgtgtgcattaaagacattt

SEQ ID NO: 515353 - DNA, 25 bp, Rattus norvegicus
gtgtacgtgtgctttaaagacattt

SEQ ID NO: 515354 - DNA, 25 bp, Rattus norvegicus
gtgtacgtgtgtcatttgtgtgttc

SEQ ID NO: 515355 - DNA, 25 bp, Rattus norvegicus
gtgtacgtgtgtctgattgtgctca

SEQ ID NO: 515356 - DNA, 25 bp, Rattus norvegicus
gtgtacgtgtgtgatttgtgtgttc

SEQ ID NO: 515357 - DNA, 25 bp, Rattus norvegicus
gtgtacgtgtgtgtgattgtgctca

SEQ ID NO: 515358 - DNA, 25 bp, Rattus norvegicus
gtgtacgtgttcatccacctgtgga

SEQ ID NO: 515359 - DNA, 25 bp, Rattus norvegicus
gtgtacgtgttcttccacctgtgga

SEQ ID NO: 515360 - DNA, 25 bp, Rattus norvegicus
gtgtacgttagaatggaagctcctc

SEQ ID NO: 515361 - DNA, 25 bp, Rattus norvegicus
gtgtacgttagattggaagctcctc

SEQ ID NO: 515362 - DNA, 25 bp, Rattus norvegicus
gtgtactacaccctgaaagacgctg

SEQ ID NO: 515363 - DNA, 25 bp, Rattus norvegicus
gtgtactacaccgtgaaagacgctg

SEQ ID NO: 515364 - DNA, 25 bp, Rattus norvegicus
gtgtactaccttcttcacaacagtg

SEQ ID NO: 515365 - DNA, 25 bp, Rattus norvegicus
gtgtactaccttgttcacaacagtg

SEQ ID NO: 515366 - DNA, 25 bp, Rattus norvegicus
gtgtactcaactcgtaactcttggc

SEQ ID NO: 515367 - DNA, 25 bp, Rattus norvegicus
gtgtactcaactggtaactcttggc

SEQ ID NO: 515368 - DNA, 25 bp, Rattus norvegicus
gtgtactcaagtaggtgcaccacta

SEQ ID NO: 515369 - DNA, 25 bp, Rattus norvegicus
gtgtactcaagttggtgcaccacta

SEQ ID NO: 515370 - DNA, 25 bp, Rattus norvegicus
gtgtactcaggcacagactatccat

SEQ ID NO: 515371 - DNA, 25 bp, Rattus norvegicus
gtgtactcaggctcagactatccat

SEQ ID NO: 515372 - DNA, 25 bp, Rattus norvegicus
gtgtactcatgcacgtgcacatatc

SEQ ID NO: 515373 - DNA, 25 bp, Rattus norvegicus
gtgtactcatgctcgtgcacatatc

SEQ ID NO: 515374 - DNA, 25 bp, Rattus norvegicus
gtgtactcccatcactaagaactgc

SEQ ID NO: 515375 - DNA, 25 bp, Rattus norvegicus
gtgtactcccatgactaagaactgc

SEQ ID NO: 515376 - DNA, 25 bp, Rattus norvegicus
gtgtactctagaattctgcttgcat

SEQ ID NO: 515377 - DNA, 25 bp, Rattus norvegicus
gtgtactctagatttctgcttgcat

SEQ ID NO: 515378 - DNA, 25 bp, Rattus norvegicus
gtgtactgaaaactccggacttctg

SEQ ID NO: 515379 - DNA, 25 bp, Rattus norvegicus
gtgtactgaaaagtccggacttctg

SEQ ID NO: 515380 - DNA, 25 bp, Rattus norvegicus
gtgtactgaaccatgtgctgccttt

SEQ ID NO: 515381 - DNA, 25 bp, Rattus norvegicus
gtgtactgaaccttgtgctgccttt

SEQ ID NO: 515382 - DNA, 25 bp, Rattus norvegicus
gtgtactgacctaggtaccttgata

SEQ ID NO: 515383 - DNA, 25 bp, Rattus norvegicus
gtgtactgaccttggtaccttgata

SEQ ID NO: 515384 - DNA, 25 bp, Rattus norvegicus
gtgtactgacgaccaggattcttca

SEQ ID NO: 515385 - DNA, 25 bp, Rattus norvegicus
gtgtactgacgagcaggattcttca

SEQ ID NO: 515386 - DNA, 25 bp, Rattus norvegicus
gtgtactgaggtattgggccatttc

SEQ ID NO: 515387 - DNA, 25 bp, Rattus norvegicus
gtgtactgaggttttgggccatttc

SEQ ID NO: 515388 - DNA, 25 bp, Rattus norvegicus
gtgtactgcataccctgggccacag

SEQ ID NO: 515389 - DNA, 25 bp, Rattus norvegicus
gtgtactgcatagcctgggccacag

SEQ ID NO: 515390 - DNA, 25 bp, Rattus norvegicus
gtgtactgccaacgctagttagctt

SEQ ID NO: 515391 - DNA, 25 bp, Rattus norvegicus
gtgtactgccaaggctagttagctt

SEQ ID NO: 515392 - DNA, 25 bp, Rattus norvegicus
gtgtactgggatacctagggatacc

SEQ ID NO: 515393 - DNA, 25 bp, Rattus norvegicus
gtgtactgggattcctagggatacc

SEQ ID NO: 515394 - DNA, 25 bp, Rattus norvegicus
gtgtactgtaggctgcgcccactga

SEQ ID NO: 515395 - DNA, 25 bp, Rattus norvegicus
gtgtactgtagggtgcgcccactga

SEQ ID NO: 515396 - DNA, 25 bp, Rattus norvegicus
gtgtactgtattacattacaaaaca

SEQ ID NO: 515397 - DNA, 25 bp, Rattus norvegicus
gtgtactgtatttcattacaaaaca

SEQ ID NO: 515398 - DNA, 25 bp, Rattus norvegicus
gtgtacttaccgcatagggcagagc

SEQ ID NO: 515399 - DNA, 25 bp, Rattus norvegicus
gtgtacttaccggatagggcagagc

SEQ ID NO: 515400 - DNA, 25 bp, Rattus norvegicus
gtgtacttactcactagtgtgtgtg

SEQ ID NO: 515401 - DNA, 25 bp, Rattus norvegicus
gtgtacttactctctagtgtgtgtg

SEQ ID NO: 515402 - DNA, 25 bp, Rattus norvegicus
gtgtacttacttcgagcttgtcaga

SEQ ID NO: 515403 - DNA, 25 bp, Rattus norvegicus
gtgtacttacttggagcttgtcaga

SEQ ID NO: 515404 - DNA, 25 bp, Rattus norvegicus
gtgtacttatgtcaccatgtggtgt

SEQ ID NO: 515405 - DNA, 25 bp, Rattus norvegicus
gtgtacttatgtgaccatgtggtgt

SEQ ID NO: 515406 - DNA, 25 bp, Rattus norvegicus
gtgtacttattcaccaagcgctacg

SEQ ID NO: 515407 - DNA, 25 bp, Rattus norvegicus
gtgtacttattctccaagcgctacg

SEQ ID NO: 515408 - DNA, 25 bp, Rattus norvegicus
gtgtacttcacaagtttctgcacag

SEQ ID NO: 515409 - DNA, 25 bp, Rattus norvegicus
gtgtacttcacatgtttctgcacag

SEQ ID NO: 515410 - DNA, 25 bp, Rattus norvegicus
gtgtacttcctgacgagaattcttg

SEQ ID NO: 515411 - DNA, 25 bp, Rattus norvegicus
gtgtacttcctgtcgagaattcttg

SEQ ID NO: 515412 - DNA, 25 bp, Rattus norvegicus
gtgtacttctagagtttgcaatctg

SEQ ID NO: 515413 - DNA, 25 bp, Rattus norvegicus
gtgtacttctagtgtttgcaatctg

SEQ ID NO: 515414 - DNA, 25 bp, Rattus norvegicus
gtgtacttgagccagaaacctagtt

SEQ ID NO: 515415 - DNA, 25 bp, Rattus norvegicus
gtgtacttgagcgagaaacctagtt

SEQ ID NO: 515416 - DNA, 25 bp, Rattus norvegicus
gtgtacttgcatactgtagttcaca

SEQ ID NO: 515417 - DNA, 25 bp, Rattus norvegicus
gtgtacttgcattctgtagttcaca

SEQ ID NO: 515418 - DNA, 25 bp, Rattus norvegicus
gtgtacttgcttatctccaaagtaa

SEQ ID NO: 515419 - DNA, 25 bp, Rattus norvegicus
gtgtacttgcttttctccaaagtaa

SEQ ID NO: 515420 - DNA, 25 bp, Rattus norvegicus
gtgtacttgggacgtaccaagccct

SEQ ID NO: 515421 - DNA, 25 bp, Rattus norvegicus
gtgtacttgggaggtaccaagccct

SEQ ID NO: 515422 - DNA, 25 bp, Rattus norvegicus
gtgtacttgggtatcaaagattgtt

SEQ ID NO: 515423 - DNA, 25 bp, Rattus norvegicus
gtgtacttgggtttcaaagattgtt

SEQ ID NO: 515424 - DNA, 25 bp, Rattus norvegicus
gtgtacttggtaatgaagctgctct

SEQ ID NO: 515425 - DNA, 25 bp, Rattus norvegicus
gtgtacttggtattgaagctgctct

SEQ ID NO: 515426 - DNA, 25 bp, Rattus norvegicus
gtgtacttgtaaacccagttcgttc

SEQ ID NO: 515427 - DNA, 25 bp, Rattus norvegicus
gtgtacttgtaatcccagttcgttc

SEQ ID NO: 515428 - DNA, 25 bp, Rattus norvegicus
gtgtactttgcacctttcttctgaa

SEQ ID NO: 515429 - DNA, 25 bp, Rattus norvegicus
gtgtactttgcagctttcttctgaa

SEQ ID NO: 515430 - DNA, 25 bp, Rattus norvegicus
gtgtactttgtgaccgagagcttca

SEQ ID NO: 515431 - DNA, 25 bp, Rattus norvegicus
gtgtactttgtgtccgagagcttca

SEQ ID NO: 515432 - DNA, 25 bp, Rattus norvegicus
gtgtacttttctctttctacgtgtc

SEQ ID NO: 515433 - DNA, 25 bp, Rattus norvegicus
gtgtacttttctgtttctacgtgtc

SEQ ID NO: 515434 - DNA, 25 bp, Rattus norvegicus
gtgtagaaagcccttatgccctcca

SEQ ID NO: 515435 - DNA, 25 bp, Rattus norvegicus
gtgtagaaagccgttatgccctcca

SEQ ID NO: 515436 - DNA, 25 bp, Rattus norvegicus
gtgtagaacaccatgctcagcttac

SEQ ID NO: 515437 - DNA, 25 bp, Rattus norvegicus
gtgtagaacaccttgctcagcttac

SEQ ID NO: 515438 - DNA, 25 bp, Rattus norvegicus
gtgtagaaccagagtcttgccagga

SEQ ID NO: 515439 - DNA, 25 bp, Rattus norvegicus
gtgtagaaccagtgtcttgccagga

SEQ ID NO: 515440 - DNA, 25 bp, Rattus norvegicus
gtgtagaagattaccccaacgcact

SEQ ID NO: 515441 - DNA, 25 bp, Rattus norvegicus
gtgtagaagatttccccaacgcact

SEQ ID NO: 515442 - DNA, 25 bp, Rattus norvegicus
gtgtagacagtcaccaaatccgtcc

SEQ ID NO: 515443 - DNA, 25 bp, Rattus norvegicus
gtgtagacagtctccaaatccgtcc

SEQ ID NO: 515444 - DNA, 25 bp, Rattus norvegicus
gtgtagacagttctctcagttatgc

SEQ ID NO: 515445 - DNA, 25 bp, Rattus norvegicus
gtgtagacagttgtctcagttatgc

SEQ ID NO: 515446 - DNA, 25 bp, Rattus norvegicus
gtgtagaccccacagcaacagcttc

SEQ ID NO: 515447 - DNA, 25 bp, Rattus norvegicus
gtgtagaccccagagcaacagcttc

SEQ ID NO: 515448 - DNA, 25 bp, Rattus norvegicus
gtgtagactaaactcatggctgact

SEQ ID NO: 515449 - DNA, 25 bp, Rattus norvegicus
gtgtagactaaagtcatggctgact

SEQ ID NO: 515450 - DNA, 25 bp, Rattus norvegicus
gtgtagagcactcgccttatgcacg

SEQ ID NO: 515451 - DNA, 25 bp, Rattus norvegicus
gtgtagagcactggccttatgcacg

SEQ ID NO: 515452 - DNA, 25 bp, Rattus norvegicus
gtgtagagccacagagcgatccctg

SEQ ID NO: 515453 - DNA, 25 bp, Rattus norvegicus
gtgtagagccactgagcgatccctg

SEQ ID NO: 515454 - DNA, 25 bp, Rattus norvegicus
gtgtagagcgacatctcaaaagtgt

SEQ ID NO: 515455 - DNA, 25 bp, Rattus norvegicus
gtgtagagcgacttctcaaaagtgt

SEQ ID NO: 515456 - DNA, 25 bp, Rattus norvegicus
gtgtagaggtacctggcaaacccct

SEQ ID NO: 515457 - DNA, 25 bp, Rattus norvegicus
gtgtagaggtacgtggcaaacccct

SEQ ID NO: 515458 - DNA, 25 bp, Rattus norvegicus
gtgtagagtacccaggaaccgattt

SEQ ID NO: 515459 - DNA, 25 bp, Rattus norvegicus
gtgtagagtaccgaggaaccgattt

SEQ ID NO: 515460 - DNA, 25 bp, Rattus norvegicus
gtgtagagtcaaccctttagaaata

SEQ ID NO: 515461 - DNA, 25 bp, Rattus norvegicus
gtgtagagtcaagcctttagaaata

SEQ ID NO: 515462 - DNA, 25 bp, Rattus norvegicus
gtgtagagtcggagcagccaagaat

SEQ ID NO: 515463 - DNA, 25 bp, Rattus norvegicus
gtgtagagtcggtgcagccaagaat

SEQ ID NO: 515464 - DNA, 25 bp, Rattus norvegicus
gtgtagagtcttattatagtataac

SEQ ID NO: 515465 - DNA, 25 bp, Rattus norvegicus
gtgtagagtctttttatagtataac

SEQ ID NO: 515466 - DNA, 25 bp, Rattus norvegicus
gtgtagatacagacccgcatgtgtc

SEQ ID NO: 515467 - DNA, 25 bp, Rattus norvegicus
gtgtagatacagtcccgcatgtgtc

SEQ ID NO: 515468 - DNA, 25 bp, Rattus norvegicus
gtgtagatccaaccactatccaaac

SEQ ID NO: 515469 - DNA, 25 bp, Rattus norvegicus
gtgtagatccaagcactatccaaac

SEQ ID NO: 515470 - DNA, 25 bp, Rattus norvegicus
gtgtagattcttatatggtggagca

SEQ ID NO: 515471 - DNA, 25 bp, Rattus norvegicus
gtgtagattcttatgctagcctctc

SEQ ID NO: 515472 - DNA, 25 bp, Rattus norvegicus
gtgtagattcttttatggtggagca

SEQ ID NO: 515473 - DNA, 25 bp, Rattus norvegicus
gtgtagattcttttgctagcctctc

SEQ ID NO: 515474 - DNA, 25 bp, Rattus norvegicus
gtgtagcaaagactgctctgcactc

SEQ ID NO: 515475 - DNA, 25 bp, Rattus norvegicus
gtgtagcaaagagtgctctgcactc

SEQ ID NO: 515476 - DNA, 25 bp, Rattus norvegicus
gtgtagcaactaccaggtgacttca

SEQ ID NO: 515477 - DNA, 25 bp, Rattus norvegicus
gtgtagcaactagcaggtgacttca

SEQ ID NO: 515478 - DNA, 25 bp, Rattus norvegicus
gtgtagcacaacacacatgtggaag

SEQ ID NO: 515479 - DNA, 25 bp, Rattus norvegicus
gtgtagcacaactcacatgtggaag

SEQ ID NO: 515480 - DNA, 25 bp, Rattus norvegicus
gtgtagcacacaattggaccttttt

SEQ ID NO: 515481 - DNA, 25 bp, Rattus norvegicus
gtgtagcacacatttggaccttttt

SEQ ID NO: 515482 - DNA, 25 bp, Rattus norvegicus
gtgtagcaccacacgcgatggtttg

SEQ ID NO: 515483 - DNA, 25 bp, Rattus norvegicus
gtgtagcaccactcgcgatggtttg

SEQ ID NO: 515484 - DNA, 25 bp, Rattus norvegicus
gtgtagcacctgacatggcagtaca

SEQ ID NO: 515485 - DNA, 25 bp, Rattus norvegicus
gtgtagcacctgtcatggcagtaca

SEQ ID NO: 515486 - DNA, 25 bp, Rattus norvegicus
gtgtagcatataccattgtaattcc

SEQ ID NO: 515487 - DNA, 25 bp, Rattus norvegicus
gtgtagcatatagcattgtaattcc

SEQ ID NO: 515488 - DNA, 25 bp, Rattus norvegicus
gtgtagcatctcattttcaccgacc

SEQ ID NO: 515489 - DNA, 25 bp, Rattus norvegicus
gtgtagcatctctttttcaccgacc

SEQ ID NO: 515490 - DNA, 25 bp, Rattus norvegicus
gtgtagcatgtgattcacccaggga

SEQ ID NO: 515491 - DNA, 25 bp, Rattus norvegicus
gtgtagcatgtgtttcacccaggga

SEQ ID NO: 515492 - DNA, 25 bp, Rattus norvegicus
gtgtagccaaggatgtccttcagct

SEQ ID NO: 515493 - DNA, 25 bp, Rattus norvegicus
gtgtagccaaggttgtccttcagct

SEQ ID NO: 515494 - DNA, 25 bp, Rattus norvegicus
gtgtagccagtcacggaacatgcaa

SEQ ID NO: 515495 - DNA, 25 bp, Rattus norvegicus
gtgtagccagtctcggaacatgcaa

SEQ ID NO: 515496 - DNA, 25 bp, Rattus norvegicus
gtgtagccatcgagacctagactgg

SEQ ID NO: 515497 - DNA, 25 bp, Rattus norvegicus
gtgtagccatcgtgacctagactgg

SEQ ID NO: 515498 - DNA, 25 bp, Rattus norvegicus
gtgtagccatctaaggctttgccgt

SEQ ID NO: 515499 - DNA, 25 bp, Rattus norvegicus
gtgtagccatcttaggctttgccgt

SEQ ID NO: 515500 - DNA, 25 bp, Rattus norvegicus
gtgtagccatgtcccagtgacaagt

SEQ ID NO: 515501 - DNA, 25 bp, Rattus norvegicus
gtgtagccatgtgccagtgacaagt

SEQ ID NO: 515502 - DNA, 25 bp, Rattus norvegicus
gtgtagccatttagaagtctgacct

SEQ ID NO: 515503 - DNA, 25 bp, Rattus norvegicus
gtgtagccattttgaagtctgacct

SEQ ID NO: 515504 - DNA, 25 bp, Rattus norvegicus
gtgtagccctgtatggccttagact

SEQ ID NO: 515505 - DNA, 25 bp, Rattus norvegicus
gtgtagccctgtttggccttagact

SEQ ID NO: 515506 - DNA, 25 bp, Rattus norvegicus
gtgtagcctcaccagctctgagaaa

SEQ ID NO: 515507 - DNA, 25 bp, Rattus norvegicus
gtgtagcctcacgagctctgagaaa

SEQ ID NO: 515508 - DNA, 25 bp, Rattus norvegicus
gtgtagcctgtgaacgtcctaagca

SEQ ID NO: 515509 - DNA, 25 bp, Rattus norvegicus
gtgtagcctgtgtacgtcctaagca

SEQ ID NO: 515510 - DNA, 25 bp, Rattus norvegicus
gtgtagccttatatgcaagaagtcc

SEQ ID NO: 515511 - DNA, 25 bp, Rattus norvegicus
gtgtagccttatttgcaagaagtcc

SEQ ID NO: 515512 - DNA, 25 bp, Rattus norvegicus
gtgtagccttgaccgtgggcacatt

SEQ ID NO: 515513 - DNA, 25 bp, Rattus norvegicus
gtgtagccttgagcgtgggcacatt

SEQ ID NO: 515514 - DNA, 25 bp, Rattus norvegicus
gtgtagctatcaactcctttaaaat

SEQ ID NO: 515515 - DNA, 25 bp, Rattus norvegicus
gtgtagctatcatctcctttaaaat

SEQ ID NO: 515516 - DNA, 25 bp, Rattus norvegicus
gtgtagctcacaattcttttcctat

SEQ ID NO: 515517 - DNA, 25 bp, Rattus norvegicus
gtgtagctcacatttcttttcctat

SEQ ID NO: 515518 - DNA, 25 bp, Rattus norvegicus
gtgtagctccacagtttgaagtgtt

SEQ ID NO: 515519 - DNA, 25 bp, Rattus norvegicus
gtgtagctccaccatacgctattgt

SEQ ID NO: 515520 - DNA, 25 bp, Rattus norvegicus
gtgtagctccacgatacgctattgt

SEQ ID NO: 515521 - DNA, 25 bp, Rattus norvegicus
gtgtagctccactgtttgaagtgtt

SEQ ID NO: 515522 - DNA, 25 bp, Rattus norvegicus
gtgtagctccagagtgaccaagttt

SEQ ID NO: 515523 - DNA, 25 bp, Rattus norvegicus
gtgtagctccagtgtgaccaagttt

SEQ ID NO: 515524 - DNA, 25 bp, Rattus norvegicus
gtgtagctctcaacagtggcttttt

SEQ ID NO: 515525 - DNA, 25 bp, Rattus norvegicus
gtgtagctctcatcagtggcttttt

SEQ ID NO: 515526 - DNA, 25 bp, Rattus norvegicus
gtgtagctgtgaccaccacctggag

SEQ ID NO: 515527 - DNA, 25 bp, Rattus norvegicus
gtgtagctgtgagcaccacctggag

SEQ ID NO: 515528 - DNA, 25 bp, Rattus norvegicus
gtgtagcttaagcactcacttcttc

SEQ ID NO: 515529 - DNA, 25 bp, Rattus norvegicus
gtgtagcttaaggactcacttcttc

SEQ ID NO: 515530 - DNA, 25 bp, Rattus norvegicus
gtgtagcttcaacaactcgcagtac

SEQ ID NO: 515531 - DNA, 25 bp, Rattus norvegicus
gtgtagcttcaagaactcgcagtac

SEQ ID NO: 515532 - DNA, 25 bp, Rattus norvegicus
gtgtagctttttacagcccacatta

SEQ ID NO: 515533 - DNA, 25 bp, Rattus norvegicus
gtgtagcttttttcagcccacatta

SEQ ID NO: 515534 - DNA, 25 bp, Rattus norvegicus
gtgtaggaatctcttggaatcatga

SEQ ID NO: 515535 - DNA, 25 bp, Rattus norvegicus
gtgtaggaatctgttggaatcatga

SEQ ID NO: 515536 - DNA, 25 bp, Rattus norvegicus
gtgtaggactctagtgttcttgggt

SEQ ID NO: 515537 - DNA, 25 bp, Rattus norvegicus
gtgtaggactcttgtgttcttgggt

SEQ ID NO: 515538 - DNA, 25 bp, Rattus norvegicus
gtgtaggcagctctaggatcccaaa

SEQ ID NO: 515539 - DNA, 25 bp, Rattus norvegicus
gtgtaggcagctgtaggatcccaaa

SEQ ID NO: 515540 - DNA, 25 bp, Rattus norvegicus
gtgtaggcatctccaacggatggct

SEQ ID NO: 515541 - DNA, 25 bp, Rattus norvegicus
gtgtaggcatctgcaacggatggct

SEQ ID NO: 515542 - DNA, 25 bp, Rattus norvegicus
gtgtaggcattactatcactgtgtc

SEQ ID NO: 515543 - DNA, 25 bp, Rattus norvegicus
gtgtaggcattagtatcactgtgtc

SEQ ID NO: 515544 - DNA, 25 bp, Rattus norvegicus
gtgtaggcgagcaggcacatttccc

SEQ ID NO: 515545 - DNA, 25 bp, Rattus norvegicus
gtgtaggcgagctggcacatttccc

SEQ ID NO: 515546 - DNA, 25 bp, Rattus norvegicus
gtgtaggctaacatctaggtcagtt

SEQ ID NO: 515547 - DNA, 25 bp, Rattus norvegicus
gtgtaggctaacttctaggtcagtt

SEQ ID NO: 515548 - DNA, 25 bp, Rattus norvegicus
gtgtaggctcaaaccatgcagttca

SEQ ID NO: 515549 - DNA, 25 bp, Rattus norvegicus
gtgtaggctcaatccatgcagttca

SEQ ID NO: 515550 - DNA, 25 bp, Rattus norvegicus
gtgtaggctttaatacccttgtcct

SEQ ID NO: 515551 - DNA, 25 bp, Rattus norvegicus
gtgtaggctttattacccttgtcct

SEQ ID NO: 515552 - DNA, 25 bp, Rattus norvegicus
gtgtagggcaccacagaactgtgtc

SEQ ID NO: 515553 - DNA, 25 bp, Rattus norvegicus
gtgtagggcacctcagaactgtgtc

SEQ ID NO: 515554 - DNA, 25 bp, Rattus norvegicus
gtgtagggtgtgacctcctgtctca

SEQ ID NO: 515555 - DNA, 25 bp, Rattus norvegicus
gtgtagggtgtgtcctcctgtctca

SEQ ID NO: 515556 - DNA, 25 bp, Rattus norvegicus
gtgtaggtacaaagtgtctctttca

SEQ ID NO: 515557 - DNA, 25 bp, Rattus norvegicus
gtgtaggtacaatgtgtctctttca

SEQ ID NO: 515558 - DNA, 25 bp, Rattus norvegicus
gtgtaggtacacacagaggccaaaa

SEQ ID NO: 515559 - DNA, 25 bp, Rattus norvegicus
gtgtaggtacactcagaggccaaaa

SEQ ID NO: 515560 - DNA, 25 bp, Rattus norvegicus
gtgtaggtccttctgcggagccctc

SEQ ID NO: 515561 - DNA, 25 bp, Rattus norvegicus
gtgtaggtccttcttaagctagaca

SEQ ID NO: 515562 - DNA, 25 bp, Rattus norvegicus
gtgtaggtccttgtgcggagccctc

SEQ ID NO: 515563 - DNA, 25 bp, Rattus norvegicus
gtgtaggtccttgttaagctagaca

SEQ ID NO: 515564 - DNA, 25 bp, Rattus norvegicus
gtgtaggtgtgcctggctcatatcc

SEQ ID NO: 515565 - DNA, 25 bp, Rattus norvegicus
gtgtaggtgtgcgtggctcatatcc

SEQ ID NO: 515566 - DNA, 25 bp, Rattus norvegicus
gtgtagtaagacagcatctcaaaac

SEQ ID NO: 515567 - DNA, 25 bp, Rattus norvegicus
gtgtagtaagactgcatctcaaaac

SEQ ID NO: 515568 - DNA, 25 bp, Rattus norvegicus
gtgtagtacacacccacaaatcacc

SEQ ID NO: 515569 - DNA, 25 bp, Rattus norvegicus
gtgtagtacacagccacaaatcacc

SEQ ID NO: 515570 - DNA, 25 bp, Rattus norvegicus
gtgtagtagcttcctgattacctag

SEQ ID NO: 515571 - DNA, 25 bp, Rattus norvegicus
gtgtagtagcttgctgattacctag

SEQ ID NO: 515572 - DNA, 25 bp, Rattus norvegicus
gtgtagtatccacttagctgccaag

SEQ ID NO: 515573 - DNA, 25 bp, Rattus norvegicus
gtgtagtatccagttagctgccaag

SEQ ID NO: 515574 - DNA, 25 bp, Rattus norvegicus
gtgtagtattgcctctatgtaccaa

SEQ ID NO: 515575 - DNA, 25 bp, Rattus norvegicus
gtgtagtattgcgtctatgtaccaa

SEQ ID NO: 515576 - DNA, 25 bp, Rattus norvegicus
gtgtagtccacgctgctactgagca

SEQ ID NO: 515577 - DNA, 25 bp, Rattus norvegicus
gtgtagtccacggtgctactgagca

SEQ ID NO: 515578 - DNA, 25 bp, Rattus norvegicus
gtgtagtcccacatggctatgacaa

SEQ ID NO: 515579 - DNA, 25 bp, Rattus norvegicus
gtgtagtcccacttggctatgacaa

SEQ ID NO: 515580 - DNA, 25 bp, Rattus norvegicus
gtgtagtccgacagtcctagaactc

SEQ ID NO: 515581 - DNA, 25 bp, Rattus norvegicus
gtgtagtccgactgtcctagaactc

SEQ ID NO: 515582 - DNA, 25 bp, Rattus norvegicus
gtgtagtcgacaattgctttctgta

SEQ ID NO: 515583 - DNA, 25 bp, Rattus norvegicus
gtgtagtcgacatttgctttctgta

SEQ ID NO: 515584 - DNA, 25 bp, Rattus norvegicus
gtgtagtctgacactggagtcccca

SEQ ID NO: 515585 - DNA, 25 bp, Rattus norvegicus
gtgtagtctgactctggagtcccca

SEQ ID NO: 515586 - DNA, 25 bp, Rattus norvegicus
gtgtagtctgtgcatcagcagtctc

SEQ ID NO: 515587 - DNA, 25 bp, Rattus norvegicus
gtgtagtctgtggatcagcagtctc

SEQ ID NO: 515588 - DNA, 25 bp, Rattus norvegicus
gtgtagtgacttaccttgttctaga

SEQ ID NO: 515589 - DNA, 25 bp, Rattus norvegicus
gtgtagtgactttccttgttctaga

SEQ ID NO: 515590 - DNA, 25 bp, Rattus norvegicus
gtgtagtgtctactcacaaggtgat

SEQ ID NO: 515591 - DNA, 25 bp, Rattus norvegicus
gtgtagtgtctagtcacaaggtgat

SEQ ID NO: 515592 - DNA, 25 bp, Rattus norvegicus
gtgtagtgttccaagattcagctga

SEQ ID NO: 515593 - DNA, 25 bp, Rattus norvegicus
gtgtagtgttcctagattcagctga

SEQ ID NO: 515594 - DNA, 25 bp, Rattus norvegicus
gtgtagtgttgccagctgattctaa

SEQ ID NO: 515595 - DNA, 25 bp, Rattus norvegicus
gtgtagtgttgcgagctgattctaa

SEQ ID NO: 515596 - DNA, 25 bp, Rattus norvegicus
gtgtagttaacaccccgtgatcagt

SEQ ID NO: 515597 - DNA, 25 bp, Rattus norvegicus
gtgtagttaacagcccgtgatcagt

SEQ ID NO: 515598 - DNA, 25 bp, Rattus norvegicus
gtgtagttcaaacccttcacagttc

SEQ ID NO: 515599 - DNA, 25 bp, Rattus norvegicus
gtgtagttcaaagccttcacagttc

SEQ ID NO: 515600 - DNA, 25 bp, Rattus norvegicus
gtgtagttcaccatgcagcacttga

SEQ ID NO: 515601 - DNA, 25 bp, Rattus norvegicus
gtgtagttcaccttgcagcacttga

SEQ ID NO: 515602 - DNA, 25 bp, Rattus norvegicus
gtgtagttcagcagtttttacttta

SEQ ID NO: 515603 - DNA, 25 bp, Rattus norvegicus
gtgtagttcagctgtttttacttta

SEQ ID NO: 515604 - DNA, 25 bp, Rattus norvegicus
gtgtagttcatgatgcaccacatta

SEQ ID NO: 515605 - DNA, 25 bp, Rattus norvegicus
gtgtagttcatgttgcaccacatta

SEQ ID NO: 515606 - DNA, 25 bp, Rattus norvegicus
gtgtagttcggtcctttgttcaaag

SEQ ID NO: 515607 - DNA, 25 bp, Rattus norvegicus
gtgtagttcggtgctttgttcaaag

SEQ ID NO: 515608 - DNA, 25 bp, Rattus norvegicus
gtgtagttgtggacatgggctccat

SEQ ID NO: 515609 - DNA, 25 bp, Rattus norvegicus
gtgtagttgtggtcatgggctccat

SEQ ID NO: 515610 - DNA, 25 bp, Rattus norvegicus
gtgtagtttctgattggcaaggtga

SEQ ID NO: 515611 - DNA, 25 bp, Rattus norvegicus
gtgtagtttctgtttggcaaggtga

SEQ ID NO: 515612 - DNA, 25 bp, Rattus norvegicus
gtgtagtttcttcagcttggttcct

SEQ ID NO: 515613 - DNA, 25 bp, Rattus norvegicus
gtgtagtttcttgagcttggttcct

SEQ ID NO: 515614 - DNA, 25 bp, Rattus norvegicus
gtgtagttttgaacaggtgaagtca

SEQ ID NO: 515615 - DNA, 25 bp, Rattus norvegicus
gtgtagttttgactgtgcttagcta

SEQ ID NO: 515616 - DNA, 25 bp, Rattus norvegicus
gtgtagttttgagtgtgcttagcta

SEQ ID NO: 515617 - DNA, 25 bp, Rattus norvegicus
gtgtagttttgatcaggtgaagtca

SEQ ID NO: 515618 - DNA, 25 bp, Rattus norvegicus
gtgtataagctgagcagaaccccac

SEQ ID NO: 515619 - DNA, 25 bp, Rattus norvegicus
gtgtataagctgtgcagaaccccac

SEQ ID NO: 515620 - DNA, 25 bp, Rattus norvegicus
gtgtataataacacactcgtgagca

SEQ ID NO: 515621 - DNA, 25 bp, Rattus norvegicus
gtgtataataactcactcgtgagca

SEQ ID NO: 515622 - DNA, 25 bp, Rattus norvegicus
gtgtataatgttctgtcttaatatt

SEQ ID NO: 515623 - DNA, 25 bp, Rattus norvegicus
gtgtataatgttgtgtcttaatatt

SEQ ID NO: 515624 - DNA, 25 bp, Rattus norvegicus
gtgtataattcgctctgctttgtct

SEQ ID NO: 515625 - DNA, 25 bp, Rattus norvegicus
gtgtataattcggtctgctttgtct

SEQ ID NO: 515626 - DNA, 25 bp, Rattus norvegicus
gtgtatacacgaacatttttacctt

SEQ ID NO: 515627 - DNA, 25 bp, Rattus norvegicus
gtgtatacacgatcatttttacctt

SEQ ID NO: 515628 - DNA, 25 bp, Rattus norvegicus
gtgtatacagacactcatacatgca

SEQ ID NO: 515629 - DNA, 25 bp, Rattus norvegicus
gtgtatacagactctcatacatgca

SEQ ID NO: 515630 - DNA, 25 bp, Rattus norvegicus
gtgtataccataccaattgtcctac

SEQ ID NO: 515631 - DNA, 25 bp, Rattus norvegicus
gtgtataccatagcaattgtcctac

SEQ ID NO: 515632 - DNA, 25 bp, Rattus norvegicus
gtgtatacccgtctatgcatgcaga

SEQ ID NO: 515633 - DNA, 25 bp, Rattus norvegicus
gtgtatacccgtgtatgcatgcaga

SEQ ID NO: 515634 - DNA, 25 bp, Rattus norvegicus
gtgtatacctccagattattgctga

SEQ ID NO: 515635 - DNA, 25 bp, Rattus norvegicus
gtgtatacctcctgattattgctga

SEQ ID NO: 515636 - DNA, 25 bp, Rattus norvegicus
gtgtatacctgcaaagactggctat

SEQ ID NO: 515637 - DNA, 25 bp, Rattus norvegicus
gtgtatacctgctaagactggctat

SEQ ID NO: 515638 - DNA, 25 bp, Rattus norvegicus
gtgtatactactcttcttggtgcta

SEQ ID NO: 515639 - DNA, 25 bp, Rattus norvegicus
gtgtatactactgttcttggtgcta

SEQ ID NO: 515640 - DNA, 25 bp, Rattus norvegicus
gtgtatactgcacggagttcctcca

SEQ ID NO: 515641 - DNA, 25 bp, Rattus norvegicus
gtgtatactgcagggagttcctcca

SEQ ID NO: 515642 - DNA, 25 bp, Rattus norvegicus
gtgtatactgggagggctttctgca

SEQ ID NO: 515643 - DNA, 25 bp, Rattus norvegicus
gtgtatactgggtgggctttctgca

SEQ ID NO: 515644 - DNA, 25 bp, Rattus norvegicus
gtgtatacttcaatgctggacagga

SEQ ID NO: 515645 - DNA, 25 bp, Rattus norvegicus
gtgtatacttcattgctggacagga

SEQ ID NO: 515646 - DNA, 25 bp, Rattus norvegicus
gtgtatagatgcagccgttgcaggc

SEQ ID NO: 515647 - DNA, 25 bp, Rattus norvegicus
gtgtatagatgctgccgttgcaggc

SEQ ID NO: 515648 - DNA, 25 bp, Rattus norvegicus
gtgtatagcttcaatatatcatgtt

SEQ ID NO: 515649 - DNA, 25 bp, Rattus norvegicus
gtgtatagcttctatatatcatgtt

SEQ ID NO: 515650 - DNA, 25 bp, Rattus norvegicus
gtgtataggaacacccaaagcctgc

SEQ ID NO: 515651 - DNA, 25 bp, Rattus norvegicus
gtgtataggaactcccaaagcctgc

SEQ ID NO: 515652 - DNA, 25 bp, Rattus norvegicus
gtgtatataactactgtactagtca

SEQ ID NO: 515653 - DNA, 25 bp, Rattus norvegicus
gtgtatataacttctgtactagtca

SEQ ID NO: 515654 - DNA, 25 bp, Rattus norvegicus
gtgtatatactcatctctctggcag

SEQ ID NO: 515655 - DNA, 25 bp, Rattus norvegicus
gtgtatatactcttctctctggcag

SEQ ID NO: 515656 - DNA, 25 bp, Rattus norvegicus
gtgtatatagcaccatgggctgtgt

SEQ ID NO: 515657 - DNA, 25 bp, Rattus norvegicus
gtgtatatagcagcatgggctgtgt

SEQ ID NO: 515658 - DNA, 25 bp, Rattus norvegicus
gtgtatatctttccaatctatttta

SEQ ID NO: 515659 - DNA, 25 bp, Rattus norvegicus
gtgtatatctttgcaatctatttta

SEQ ID NO: 515660 - DNA, 25 bp, Rattus norvegicus
gtgtatatgtcaaccacaagggctg

SEQ ID NO: 515661 - DNA, 25 bp, Rattus norvegicus
gtgtatatgtcatccacaagggctg

SEQ ID NO: 515662 - DNA, 25 bp, Rattus norvegicus
gtgtatatgtgaagctctgctcggc

SEQ ID NO: 515663 - DNA, 25 bp, Rattus norvegicus
gtgtatatgtgatgctctgctcggc

SEQ ID NO: 515664 - DNA, 25 bp, Rattus norvegicus
gtgtatattacaacctgctgcctag

SEQ ID NO: 515665 - DNA, 25 bp, Rattus norvegicus
gtgtatattacaccaatgccactgt

SEQ ID NO: 515666 - DNA, 25 bp, Rattus norvegicus
gtgtatattacagcaatgccactgt

SEQ ID NO: 515667 - DNA, 25 bp, Rattus norvegicus
gtgtatattacatcctgctgcctag

SEQ ID NO: 515668 - DNA, 25 bp, Rattus norvegicus
gtgtatattaccagttgctgtgata

SEQ ID NO: 515669 - DNA, 25 bp, Rattus norvegicus
gtgtatattacctgttgctgtgata

SEQ ID NO: 515670 - DNA, 25 bp, Rattus norvegicus
gtgtatattagaagttcctcggaac

SEQ ID NO: 515671 - DNA, 25 bp, Rattus norvegicus
gtgtatattagatgttcctcggaac

SEQ ID NO: 515672 - DNA, 25 bp, Rattus norvegicus
gtgtatattcccatctaagtctcag

SEQ ID NO: 515673 - DNA, 25 bp, Rattus norvegicus
gtgtatattcccttctaagtctcag

SEQ ID NO: 515674 - DNA, 25 bp, Rattus norvegicus
gtgtatatttcaacagggacccttg

SEQ ID NO: 515675 - DNA, 25 bp, Rattus norvegicus
gtgtatatttcatcagggacccttg

SEQ ID NO: 515676 - DNA, 25 bp, Rattus norvegicus
gtgtatcaactactcatcttctgtt

SEQ ID NO: 515677 - DNA, 25 bp, Rattus norvegicus
gtgtatcaactagtcatcttctgtt

SEQ ID NO: 515678 - DNA, 25 bp, Rattus norvegicus
gtgtatcaagtaatcaactggcagt

SEQ ID NO: 515679 - DNA, 25 bp, Rattus norvegicus
gtgtatcaagtattcaactggcagt

SEQ ID NO: 515680 - DNA, 25 bp, Rattus norvegicus
gtgtatcacagtattctttatgcag

SEQ ID NO: 515681 - DNA, 25 bp, Rattus norvegicus
gtgtatcacagttttctttatgcag

SEQ ID NO: 515682 - DNA, 25 bp, Rattus norvegicus
gtgtatcagcccatgagtgctgcat

SEQ ID NO: 515683 - DNA, 25 bp, Rattus norvegicus
gtgtatcagcccttgagtgctgcat

SEQ ID NO: 515684 - DNA, 25 bp, Rattus norvegicus
gtgtatcatcctaatagacctttgc

SEQ ID NO: 515685 - DNA, 25 bp, Rattus norvegicus
gtgtatcatccttatagacctttgc

SEQ ID NO: 515686 - DNA, 25 bp, Rattus norvegicus
gtgtatcatgatcaccttttacaaa

SEQ ID NO: 515687 - DNA, 25 bp, Rattus norvegicus
gtgtatcatgatgaccttttacaaa

SEQ ID NO: 515688 - DNA, 25 bp, Rattus norvegicus
gtgtatcatgtgaagtgtgctttta

SEQ ID NO: 515689 - DNA, 25 bp, Rattus norvegicus
gtgtatcatgtgagtacctggtgcc

SEQ ID NO: 515690 - DNA, 25 bp, Rattus norvegicus
gtgtatcatgtgtagtgtgctttta

SEQ ID NO: 515691 - DNA, 25 bp, Rattus norvegicus
gtgtatcatgtgtgtacctggtgcc

SEQ ID NO: 515692 - DNA, 25 bp, Rattus norvegicus
gtgtatcattacaaacccagtagtc

SEQ ID NO: 515693 - DNA, 25 bp, Rattus norvegicus
gtgtatcattactaacccagtagtc

SEQ ID NO: 515694 - DNA, 25 bp, Rattus norvegicus
gtgtatcattagctgctggttgcct

SEQ ID NO: 515695 - DNA, 25 bp, Rattus norvegicus
gtgtatcattaggtgctggttgcct

SEQ ID NO: 515696 - DNA, 25 bp, Rattus norvegicus
gtgtatccacagacttaagcaagcg

SEQ ID NO: 515697 - DNA, 25 bp, Rattus norvegicus
gtgtatccacagtcttaagcaagcg

SEQ ID NO: 515698 - DNA, 25 bp, Rattus norvegicus
gtgtatccatgccacagctaagaat

SEQ ID NO: 515699 - DNA, 25 bp, Rattus norvegicus
gtgtatccatgcgacagctaagaat

SEQ ID NO: 515700 - DNA, 25 bp, Rattus norvegicus
gtgtatccatgtagggtctctagct

SEQ ID NO: 515701 - DNA, 25 bp, Rattus norvegicus
gtgtatccatgttgggtctctagct

SEQ ID NO: 515702 - DNA, 25 bp, Rattus norvegicus
gtgtatccctggctttgtggaacta

SEQ ID NO: 515703 - DNA, 25 bp, Rattus norvegicus
gtgtatccctgggtttgtggaacta

SEQ ID NO: 515704 - DNA, 25 bp, Rattus norvegicus
gtgtatcccttgaataaccgattgt

SEQ ID NO: 515705 - DNA, 25 bp, Rattus norvegicus
gtgtatcccttgaccgcgtggagga

SEQ ID NO: 515706 - DNA, 25 bp, Rattus norvegicus
gtgtatcccttgtataaccgattgt

SEQ ID NO: 515707 - DNA, 25 bp, Rattus norvegicus
gtgtatcccttgtccgcgtggagga

SEQ ID NO: 515708 - DNA, 25 bp, Rattus norvegicus
gtgtatcctaaacagtactgatctt

SEQ ID NO: 515709 - DNA, 25 bp, Rattus norvegicus
gtgtatcctaaagagtactgatctt

SEQ ID NO: 515710 - DNA, 25 bp, Rattus norvegicus
gtgtatcctgaacacgacttttctt

SEQ ID NO: 515711 - DNA, 25 bp, Rattus norvegicus
gtgtatcctgaagacgacttttctt

SEQ ID NO: 515712 - DNA, 25 bp, Rattus norvegicus
gtgtatcctgataacttttccaaga

SEQ ID NO: 515713 - DNA, 25 bp, Rattus norvegicus
gtgtatcctgattacttttccaaga

SEQ ID NO: 515714 - DNA, 25 bp, Rattus norvegicus
gtgtatcgcactaactagctttaaa

SEQ ID NO: 515715 - DNA, 25 bp, Rattus norvegicus
gtgtatcgcacttactagctttaaa

SEQ ID NO: 515716 - DNA, 25 bp, Rattus norvegicus
gtgtatcgcattagtatctggaccc

SEQ ID NO: 515717 - DNA, 25 bp, Rattus norvegicus
gtgtatcgcatttgtatctggaccc

SEQ ID NO: 515718 - DNA, 25 bp, Rattus norvegicus
gtgtatctatgcatgtctctgtgtg

SEQ ID NO: 515719 - DNA, 25 bp, Rattus norvegicus
gtgtatctatgcttgtctctgtgtg

SEQ ID NO: 515720 - DNA, 25 bp, Rattus norvegicus
gtgtatctattaccgccaggtatgt

SEQ ID NO: 515721 - DNA, 25 bp, Rattus norvegicus
gtgtatctattagcgccaggtatgt

SEQ ID NO: 515722 - DNA, 25 bp, Rattus norvegicus
gtgtatctcagaaaaccctggaaca

SEQ ID NO: 515723 - DNA, 25 bp, Rattus norvegicus
gtgtatctcagataaccctggaaca

SEQ ID NO: 515724 - DNA, 25 bp, Rattus norvegicus
gtgtatctgaaccattgagcctgaa

SEQ ID NO: 515725 - DNA, 25 bp, Rattus norvegicus
gtgtatctgaacgattgagcctgaa

SEQ ID NO: 515726 - DNA, 25 bp, Rattus norvegicus
gtgtatctgaatctgcctgcatgag

SEQ ID NO: 515727 - DNA, 25 bp, Rattus norvegicus
gtgtatctgaatgtgcctgcatgag

SEQ ID NO: 515728 - DNA, 25 bp, Rattus norvegicus
gtgtatctgtccagttatgctgtca

SEQ ID NO: 515729 - DNA, 25 bp, Rattus norvegicus
gtgtatctgtcctgttatgctgtca

SEQ ID NO: 515730 - DNA, 25 bp, Rattus norvegicus
gtgtatctgtctagattgccctaat

SEQ ID NO: 515731 - DNA, 25 bp, Rattus norvegicus
gtgtatctgtcttgattgccctaat

SEQ ID NO: 515732 - DNA, 25 bp, Rattus norvegicus
gtgtatcttctgattcattgtgtag

SEQ ID NO: 515733 - DNA, 25 bp, Rattus norvegicus
gtgtatcttctgtttcattgtgtag

SEQ ID NO: 515734 - DNA, 25 bp, Rattus norvegicus
gtgtatgaaacaatattgtcctata

SEQ ID NO: 515735 - DNA, 25 bp, Rattus norvegicus
gtgtatgaaacattattgtcctata

SEQ ID NO: 515736 - DNA, 25 bp, Rattus norvegicus
gtgtatgaaacccagctcacgattt

SEQ ID NO: 515737 - DNA, 25 bp, Rattus norvegicus
gtgtatgaaaccgagctcacgattt

SEQ ID NO: 515738 - DNA, 25 bp, Rattus norvegicus
gtgtatgaccatctgtagcccaagg

SEQ ID NO: 515739 - DNA, 25 bp, Rattus norvegicus
gtgtatgaccatgtgtagcccaagg

SEQ ID NO: 515740 - DNA, 25 bp, Rattus norvegicus
gtgtatgacttcacccgagtctttg

SEQ ID NO: 515741 - DNA, 25 bp, Rattus norvegicus
gtgtatgacttctcccgagtctttg

SEQ ID NO: 515742 - DNA, 25 bp, Rattus norvegicus
gtgtatgatcccaagtactgcctga

SEQ ID NO: 515743 - DNA, 25 bp, Rattus norvegicus
gtgtatgatcccacactgatcgagt

SEQ ID NO: 515744 - DNA, 25 bp, Rattus norvegicus
gtgtatgatccctagtactgcctga

SEQ ID NO: 515745 - DNA, 25 bp, Rattus norvegicus
gtgtatgatccctcactgatcgagt

SEQ ID NO: 515746 - DNA, 25 bp, Rattus norvegicus
gtgtatgattgtccttctgcctcag

SEQ ID NO: 515747 - DNA, 25 bp, Rattus norvegicus
gtgtatgattgtgcttctgcctcag

SEQ ID NO: 515748 - DNA, 25 bp, Rattus norvegicus
gtgtatgcaaagattctcgcttatg

SEQ ID NO: 515749 - DNA, 25 bp, Rattus norvegicus
gtgtatgcaaagtttctcgcttatg

SEQ ID NO: 515750 - DNA, 25 bp, Rattus norvegicus
gtgtatgcacatattggctcctgac

SEQ ID NO: 515751 - DNA, 25 bp, Rattus norvegicus
gtgtatgcacattttggctcctgac

SEQ ID NO: 515752 - DNA, 25 bp, Rattus norvegicus
gtgtatgcagaacccactgttcaga

SEQ ID NO: 515753 - DNA, 25 bp, Rattus norvegicus
gtgtatgcagaagccactgttcaga

SEQ ID NO: 515754 - DNA, 25 bp, Rattus norvegicus
gtgtatgcagagcatgctccctggt

SEQ ID NO: 515755 - DNA, 25 bp, Rattus norvegicus
gtgtatgcagaggatgctccctggt

SEQ ID NO: 515756 - DNA, 25 bp, Rattus norvegicus
gtgtatgcctacaactttctacata

SEQ ID NO: 515757 - DNA, 25 bp, Rattus norvegicus
gtgtatgcctactactttctacata

SEQ ID NO: 515758 - DNA, 25 bp, Rattus norvegicus
gtgtatgctaggagatacccttaga

SEQ ID NO: 515759 - DNA, 25 bp, Rattus norvegicus
gtgtatgctaggtgatacccttaga

SEQ ID NO: 515760 - DNA, 25 bp, Rattus norvegicus
gtgtatgctatgctacaatcaggtg

SEQ ID NO: 515761 - DNA, 25 bp, Rattus norvegicus
gtgtatgctatggtacaatcaggtg

SEQ ID NO: 515762 - DNA, 25 bp, Rattus norvegicus
gtgtatgctgcgaagtctttcctca

SEQ ID NO: 515763 - DNA, 25 bp, Rattus norvegicus
gtgtatgctgcgtagtctttcctca

SEQ ID NO: 515764 - DNA, 25 bp, Rattus norvegicus
gtgtatgctgtaactgtcactgaca

SEQ ID NO: 515765 - DNA, 25 bp, Rattus norvegicus
gtgtatgctgtatctgtcactgaca

SEQ ID NO: 515766 - DNA, 25 bp, Rattus norvegicus
gtgtatgctgttacattattgtaca

SEQ ID NO: 515767 - DNA, 25 bp, Rattus norvegicus
gtgtatgctgtttcattattgtaca

SEQ ID NO: 515768 - DNA, 25 bp, Rattus norvegicus
gtgtatggacacctctttgaaccac

SEQ ID NO: 515769 - DNA, 25 bp, Rattus norvegicus
gtgtatggacacgtctttgaaccac

SEQ ID NO: 515770 - DNA, 25 bp, Rattus norvegicus
gtgtatggacttcgttttgtagcaa

SEQ ID NO: 515771 - DNA, 25 bp, Rattus norvegicus
gtgtatggacttggttttgtagcaa

SEQ ID NO: 515772 - DNA, 25 bp, Rattus norvegicus
gtgtatggcacacttagatcttagt

SEQ ID NO: 515773 - DNA, 25 bp, Rattus norvegicus
gtgtatggcacagttagatcttagt

SEQ ID NO: 515774 - DNA, 25 bp, Rattus norvegicus
gtgtatggcattacttcttctaact

SEQ ID NO: 515775 - DNA, 25 bp, Rattus norvegicus
gtgtatggcatttcttcttctaact

SEQ ID NO: 515776 - DNA, 25 bp, Rattus norvegicus
gtgtatggccagactcctaaagaaa

SEQ ID NO: 515777 - DNA, 25 bp, Rattus norvegicus
gtgtatggccagtctcctaaagaaa

SEQ ID NO: 515778 - DNA, 25 bp, Rattus norvegicus
gtgtatgggcacaagcaaccaccaa

SEQ ID NO: 515779 - DNA, 25 bp, Rattus norvegicus
gtgtatgggcactagcaaccaccaa

SEQ ID NO: 515780 - DNA, 25 bp, Rattus norvegicus
gtgtatgggctcacaacttgtttgg

SEQ ID NO: 515781 - DNA, 25 bp, Rattus norvegicus
gtgtatgggctctcaacttgtttgg

SEQ ID NO: 515782 - DNA, 25 bp, Rattus norvegicus
gtgtatggtacaccgatgtgttttc

SEQ ID NO: 515783 - DNA, 25 bp, Rattus norvegicus
gtgtatggtacagcgatgtgttttc

SEQ ID NO: 515784 - DNA, 25 bp, Rattus norvegicus
gtgtatggtcaaatactgcaaagta

SEQ ID NO: 515785 - DNA, 25 bp, Rattus norvegicus
gtgtatggtcaattactgcaaagta

SEQ ID NO: 515786 - DNA, 25 bp, Rattus norvegicus
gtgtatggtgtgagccaaacctgct

SEQ ID NO: 515787 - DNA, 25 bp, Rattus norvegicus
gtgtatggtgtgtgccaaacctgct

SEQ ID NO: 515788 - DNA, 25 bp, Rattus norvegicus
gtgtatgtacacctgcaagatctag

SEQ ID NO: 515789 - DNA, 25 bp, Rattus norvegicus
gtgtatgtacacgtgcaagatctag

SEQ ID NO: 515790 - DNA, 25 bp, Rattus norvegicus
gtgtatgtataacctttcctatgga

SEQ ID NO: 515791 - DNA, 25 bp, Rattus norvegicus
gtgtatgtataagctttcctatgga

SEQ ID NO: 515792 - DNA, 25 bp, Rattus norvegicus
gtgtatgtatctcggttctcagccc

SEQ ID NO: 515793 - DNA, 25 bp, Rattus norvegicus
gtgtatgtatctgggttctcagccc

SEQ ID NO: 515794 - DNA, 25 bp, Rattus norvegicus
gtgtatgtctgaagtaggatgccaa

SEQ ID NO: 515795 - DNA, 25 bp, Rattus norvegicus
gtgtatgtctgatgtaggatgccaa

SEQ ID NO: 515796 - DNA, 25 bp, Rattus norvegicus
gtgtatgtgcatagcgtctcttgga

SEQ ID NO: 515797 - DNA, 25 bp, Rattus norvegicus
gtgtatgtgcattgcgtctcttgga

SEQ ID NO: 515798 - DNA, 25 bp, Rattus norvegicus
gtgtatgtgctgagaggatctctct

SEQ ID NO: 515799 - DNA, 25 bp, Rattus norvegicus
gtgtatgtgctgtgaggatctctct

SEQ ID NO: 515800 - DNA, 25 bp, Rattus norvegicus
gtgtatgtgggacttccatccatgc

SEQ ID NO: 515801 - DNA, 25 bp, Rattus norvegicus
gtgtatgtgggagttccatccatgc

SEQ ID NO: 515802 - DNA, 25 bp, Rattus norvegicus
gtgtatgtggttctcagcgtttgtc

SEQ ID NO: 515803 - DNA, 25 bp, Rattus norvegicus
gtgtatgtggttgtcagcgtttgtc

SEQ ID NO: 515804 - DNA, 25 bp, Rattus norvegicus
gtgtatgtgtataacaaaacagcta

SEQ ID NO: 515805 - DNA, 25 bp, Rattus norvegicus
gtgtatgtgtattacaaaacagcta

SEQ ID NO: 515806 - DNA, 25 bp, Rattus norvegicus
gtgtatgtgtctatctaacttctaa

SEQ ID NO: 515807 - DNA, 25 bp, Rattus norvegicus
gtgtatgtgtctcatctgctacctg

SEQ ID NO: 515808 - DNA, 25 bp, Rattus norvegicus
gtgtatgtgtctgatctgctacctg

SEQ ID NO: 515809 - DNA, 25 bp, Rattus norvegicus
gtgtatgtgtctttctaacttctaa

SEQ ID NO: 515810 - DNA, 25 bp, Rattus norvegicus
gtgtatgtgtggcaaggcctatttt

SEQ ID NO: 515811 - DNA, 25 bp, Rattus norvegicus
gtgtatgtgtgggaaggcctatttt

SEQ ID NO: 515812 - DNA, 25 bp, Rattus norvegicus
gtgtatgtgtgtattcaaccttgat

SEQ ID NO: 515813 - DNA, 25 bp, Rattus norvegicus
gtgtatgtgtgttttcaaccttgat

SEQ ID NO: 515814 - DNA, 25 bp, Rattus norvegicus
gtgtatgtgttcaacctggtgtgaa

SEQ ID NO: 515815 - DNA, 25 bp, Rattus norvegicus
gtgtatgtgttctacctggtgtgaa

SEQ ID NO: 515816 - DNA, 25 bp, Rattus norvegicus
gtgtatgtgttgaattctctgcaga

SEQ ID NO: 515817 - DNA, 25 bp, Rattus norvegicus
gtgtatgtgttgcatggctccagaa

SEQ ID NO: 515818 - DNA, 25 bp, Rattus norvegicus
gtgtatgtgttggatggctccagaa

SEQ ID NO: 515819 - DNA, 25 bp, Rattus norvegicus
gtgtatgtgttgtattctctgcaga

SEQ ID NO: 515820 - DNA, 25 bp, Rattus norvegicus
gtgtatgttacaagccttctcagaa

SEQ ID NO: 515821 - DNA, 25 bp, Rattus norvegicus
gtgtatgttacatgccttctcagaa

SEQ ID NO: 515822 - DNA, 25 bp, Rattus norvegicus
gtgtatgttcatctttctcagtatt

SEQ ID NO: 515823 - DNA, 25 bp, Rattus norvegicus
gtgtatgttcatgtttctcagtatt

SEQ ID NO: 515824 - DNA, 25 bp, Rattus norvegicus
gtgtatgttctaaaggactgacctt

SEQ ID NO: 515825 - DNA, 25 bp, Rattus norvegicus
gtgtatgttctataggactgacctt

SEQ ID NO: 515826 - DNA, 25 bp, Rattus norvegicus
gtgtatgttgctattgtttggttgg

SEQ ID NO: 515827 - DNA, 25 bp, Rattus norvegicus
gtgtatgttgcttttgtttggttgg

SEQ ID NO: 515828 - DNA, 25 bp, Rattus norvegicus
gtgtatgttggcctgttactgatat

SEQ ID NO: 515829 - DNA, 25 bp, Rattus norvegicus
gtgtatgttggcgtgttactgatat

SEQ ID NO: 515830 - DNA, 25 bp, Rattus norvegicus
gtgtatgtttttcagttcaaagtca

SEQ ID NO: 515831 - DNA, 25 bp, Rattus norvegicus
gtgtatgtttttgagttcaaagtca

SEQ ID NO: 515832 - DNA, 25 bp, Rattus norvegicus
gtgtattaactcaccattcacttag

SEQ ID NO: 515833 - DNA, 25 bp, Rattus norvegicus
gtgtattaactctccattcacttag

SEQ ID NO: 515834 - DNA, 25 bp, Rattus norvegicus
gtgtattaagatattctcccacaag

SEQ ID NO: 515835 - DNA, 25 bp, Rattus norvegicus
gtgtattaagattttctcccacaag

SEQ ID NO: 515836 - DNA, 25 bp, Rattus norvegicus
gtgtattacagaacttgcctaggag

SEQ ID NO: 515837 - DNA, 25 bp, Rattus norvegicus
gtgtattacagatcttgcctaggag

SEQ ID NO: 515838 - DNA, 25 bp, Rattus norvegicus
gtgtattatgtcaacgggcctgcca

SEQ ID NO: 515839 - DNA, 25 bp, Rattus norvegicus
gtgtattatgtctacgggcctgcca

SEQ ID NO: 515840 - DNA, 25 bp, Rattus norvegicus
gtgtattatttcaactgttaagctg

SEQ ID NO: 515841 - DNA, 25 bp, Rattus norvegicus
gtgtattatttctactgttaagctg

SEQ ID NO: 515842 - DNA, 25 bp, Rattus norvegicus
gtgtattcaacaatttcccattatt

SEQ ID NO: 515843 - DNA, 25 bp, Rattus norvegicus
gtgtattcaacattttcccattatt

SEQ ID NO: 515844 - DNA, 25 bp, Rattus norvegicus
gtgtattcaaggcaacggagtctca

SEQ ID NO: 515845 - DNA, 25 bp, Rattus norvegicus
gtgtattcaagggaacggagtctca

SEQ ID NO: 515846 - DNA, 25 bp, Rattus norvegicus
gtgtattcagcaactctgtgcggtt

SEQ ID NO: 515847 - DNA, 25 bp, Rattus norvegicus
gtgtattcagcatctctgtgcggtt

SEQ ID NO: 515848 - DNA, 25 bp, Rattus norvegicus
gtgtattcagtaagctccaatcctc

SEQ ID NO: 515849 - DNA, 25 bp, Rattus norvegicus
gtgtattcagtatgctccaatcctc

SEQ ID NO: 515850 - DNA, 25 bp, Rattus norvegicus
gtgtattcagtgattatttcctcaa

SEQ ID NO: 515851 - DNA, 25 bp, Rattus norvegicus
gtgtattcagtgtttatttcctcaa

SEQ ID NO: 515852 - DNA, 25 bp, Rattus norvegicus
gtgtattcatctactggcttaaagc

SEQ ID NO: 515853 - DNA, 25 bp, Rattus norvegicus
gtgtattcatctactttaccaaaag

SEQ ID NO: 515854 - DNA, 25 bp, Rattus norvegicus
gtgtattcatctcctggatcttgta

SEQ ID NO: 515855 - DNA, 25 bp, Rattus norvegicus
gtgtattcatctgctggatcttgta

SEQ ID NO: 515856 - DNA, 25 bp, Rattus norvegicus
gtgtattcatcttctggcttaaagc

SEQ ID NO: 515857 - DNA, 25 bp, Rattus norvegicus
gtgtattcatcttctttaccaaaag

SEQ ID NO: 515858 - DNA, 25 bp, Rattus norvegicus
gtgtattccaagataactaggccta

SEQ ID NO: 515859 - DNA, 25 bp, Rattus norvegicus
gtgtattccaagttaactaggccta

SEQ ID NO: 515860 - DNA, 25 bp, Rattus norvegicus
gtgtattccatgaatgagatccata

SEQ ID NO: 515861 - DNA, 25 bp, Rattus norvegicus
gtgtattccatgtatgagatccata

SEQ ID NO: 515862 - DNA, 25 bp, Rattus norvegicus
gtgtattccctcatctgggaaccgt

SEQ ID NO: 515863 - DNA, 25 bp, Rattus norvegicus
gtgtattccctcttctgggaaccgt

SEQ ID NO: 515864 - DNA, 25 bp, Rattus norvegicus
gtgtattcctgtcctctatgttaga

SEQ ID NO: 515865 - DNA, 25 bp, Rattus norvegicus
gtgtattcctgtgctctatgttaga

SEQ ID NO: 515866 - DNA, 25 bp, Rattus norvegicus
gtgtattccttaatctcttaatgtt

SEQ ID NO: 515867 - DNA, 25 bp, Rattus norvegicus
gtgtattccttattctcttaatgtt

SEQ ID NO: 515868 - DNA, 25 bp, Rattus norvegicus
gtgtattcctttacaggtctgcaga

SEQ ID NO: 515869 - DNA, 25 bp, Rattus norvegicus
gtgtattccttttcaggtctgcaga

SEQ ID NO: 515870 - DNA, 25 bp, Rattus norvegicus
gtgtattcgattccccttttagcaa

SEQ ID NO: 515871 - DNA, 25 bp, Rattus norvegicus
gtgtattcgattgcccttttagcaa

SEQ ID NO: 515872 - DNA, 25 bp, Rattus norvegicus
gtgtattctctgcatccctaagtgc

SEQ ID NO: 515873 - DNA, 25 bp, Rattus norvegicus
gtgtattctctggatccctaagtgc

SEQ ID NO: 515874 - DNA, 25 bp, Rattus norvegicus
gtgtattctgatatcttaagcggtc

SEQ ID NO: 515875 - DNA, 25 bp, Rattus norvegicus
gtgtattctgatttcttaagcggtc

SEQ ID NO: 515876 - DNA, 25 bp, Rattus norvegicus
gtgtattcttacaccaacagtcctg

SEQ ID NO: 515877 - DNA, 25 bp, Rattus norvegicus
gtgtattcttactccaacagtcctg

SEQ ID NO: 515878 - DNA, 25 bp, Rattus norvegicus
gtgtattgaaaacattgccatttta

SEQ ID NO: 515879 - DNA, 25 bp, Rattus norvegicus
gtgtattgaaaagattgccatttta

SEQ ID NO: 515880 - DNA, 25 bp, Rattus norvegicus
gtgtattgagtcacacagctctcgc

SEQ ID NO: 515881 - DNA, 25 bp, Rattus norvegicus
gtgtattgagtctcacagctctcgc

SEQ ID NO: 515882 - DNA, 25 bp, Rattus norvegicus
gtgtattgctgtactccttgaaatc

SEQ ID NO: 515883 - DNA, 25 bp, Rattus norvegicus
gtgtattgctgttctccttgaaatc

SEQ ID NO: 515884 - DNA, 25 bp, Rattus norvegicus
gtgtattggtacattcatttgcagt

SEQ ID NO: 515885 - DNA, 25 bp, Rattus norvegicus
gtgtattggtactttcatttgcagt

SEQ ID NO: 515886 - DNA, 25 bp, Rattus norvegicus
gtgtattgtgtacactcccagacca

SEQ ID NO: 515887 - DNA, 25 bp, Rattus norvegicus
gtgtattgtgtagactcccagacca

SEQ ID NO: 515888 - DNA, 25 bp, Rattus norvegicus
gtgtattgttttcatcaaatgctga

SEQ ID NO: 515889 - DNA, 25 bp, Rattus norvegicus
gtgtattgttttgatcaaatgctga

SEQ ID NO: 515890 - DNA, 25 bp, Rattus norvegicus
gtgtatttacagatgcccttttttg

SEQ ID NO: 515891 - DNA, 25 bp, Rattus norvegicus
gtgtatttacagttgcccttttttg

SEQ ID NO: 515892 - DNA, 25 bp, Rattus norvegicus
gtgtatttagtcatccagttgcatt

SEQ ID NO: 515893 - DNA, 25 bp, Rattus norvegicus
gtgtatttagtcttccagttgcatt

SEQ ID NO: 515894 - DNA, 25 bp, Rattus norvegicus
gtgtatttatgaagtcgctgccttt

SEQ ID NO: 515895 - DNA, 25 bp, Rattus norvegicus
gtgtatttatgatgtcgctgccttt

SEQ ID NO: 515896 - DNA, 25 bp, Rattus norvegicus
gtgtatttcacaacaggacaccgag

SEQ ID NO: 515897 - DNA, 25 bp, Rattus norvegicus
gtgtatttcacatcaggacaccgag

SEQ ID NO: 515898 - DNA, 25 bp, Rattus norvegicus
gtgtatttcaggcagctctggtaca

SEQ ID NO: 515899 - DNA, 25 bp, Rattus norvegicus
gtgtatttcagggagctctggtaca

SEQ ID NO: 515900 - DNA, 25 bp, Rattus norvegicus
gtgtatttctacagccattcatggg

SEQ ID NO: 515901 - DNA, 25 bp, Rattus norvegicus
gtgtatttctactgccattcatggg

SEQ ID NO: 515902 - DNA, 25 bp, Rattus norvegicus
gtgtatttcttcacagtgtcagtag

SEQ ID NO: 515903 - DNA, 25 bp, Rattus norvegicus
gtgtatttcttctcagtgtcagtag

SEQ ID NO: 515904 - DNA, 25 bp, Rattus norvegicus
gtgtatttgatgcttttctctatta

SEQ ID NO: 515905 - DNA, 25 bp, Rattus norvegicus
gtgtatttgatggttttctctatta

SEQ ID NO: 515906 - DNA, 25 bp, Rattus norvegicus
gtgtatttgcaaacgttgatcaatt

SEQ ID NO: 515907 - DNA, 25 bp, Rattus norvegicus
gtgtatttgcaatcgttgatcaatt

SEQ ID NO: 515908 - DNA, 25 bp, Rattus norvegicus
gtgtatttgcctatccttacaatga

SEQ ID NO: 515909 - DNA, 25 bp, Rattus norvegicus
gtgtatttgcctttccttacaatga

SEQ ID NO: 515910 - DNA, 25 bp, Rattus norvegicus
gtgtatttgtaaagctggttcacca

SEQ ID NO: 515911 - DNA, 25 bp, Rattus norvegicus
gtgtatttgtaatgctggttcacca

SEQ ID NO: 515912 - DNA, 25 bp, Rattus norvegicus
gtgtattttataatgcgggaatgct

SEQ ID NO: 515913 - DNA, 25 bp, Rattus norvegicus
gtgtattttatattgcgggaatgct

SEQ ID NO: 515914 - DNA, 25 bp, Rattus norvegicus
gtgtattttattcatcctggaacaa

SEQ ID NO: 515915 - DNA, 25 bp, Rattus norvegicus
gtgtattttattgatcctggaacaa

SEQ ID NO: 515916 - DNA, 25 bp, Rattus norvegicus
gtgtattttccactattagtacctc

SEQ ID NO: 515917 - DNA, 25 bp, Rattus norvegicus
gtgtattttccagtattagtacctc

SEQ ID NO: 515918 - DNA, 25 bp, Rattus norvegicus
gtgtattttctgagtgcttcttccg

SEQ ID NO: 515919 - DNA, 25 bp, Rattus norvegicus
gtgtattttctgtgtgcttcttccg

SEQ ID NO: 515920 - DNA, 25 bp, Rattus norvegicus
gtgtattttgatatcccatgtgtat

SEQ ID NO: 515921 - DNA, 25 bp, Rattus norvegicus
gtgtattttgatttcccatgtgtat

SEQ ID NO: 515922 - DNA, 25 bp, Rattus norvegicus
gtgtattttgttatatatgctctag

SEQ ID NO: 515923 - DNA, 25 bp, Rattus norvegicus
gtgtattttgttccttcctgtaatc

SEQ ID NO: 515924 - DNA, 25 bp, Rattus norvegicus
gtgtattttgttgcttcctgtaatc

SEQ ID NO: 515925 - DNA, 25 bp, Rattus norvegicus
gtgtattttgttttatatgctctag

SEQ ID NO: 515926 - DNA, 25 bp, Rattus norvegicus
gtgtatttttaaactcaatttagtt

SEQ ID NO: 515927 - DNA, 25 bp, Rattus norvegicus
gtgtatttttaaccactcaatgtag

SEQ ID NO: 515928 - DNA, 25 bp, Rattus norvegicus
gtgtatttttaacctccctgagcgt

SEQ ID NO: 515929 - DNA, 25 bp, Rattus norvegicus
gtgtatttttaagcactcaatgtag

SEQ ID NO: 515930 - DNA, 25 bp, Rattus norvegicus
gtgtatttttaagctccctgagcgt

SEQ ID NO: 515931 - DNA, 25 bp, Rattus norvegicus
gtgtatttttaatctcaatttagtt

SEQ ID NO: 515932 - DNA, 25 bp, Rattus norvegicus
gtgtatttttggacgggttggcatt

SEQ ID NO: 515933 - DNA, 25 bp, Rattus norvegicus
gtgtatttttggtcgggttggcatt

SEQ ID NO: 515934 - DNA, 25 bp, Rattus norvegicus
gtgtcaaaaccacctttatggagtg

SEQ ID NO: 515935 - DNA, 25 bp, Rattus norvegicus
gtgtcaaaaccagctttatggagtg

SEQ ID NO: 515936 - DNA, 25 bp, Rattus norvegicus
gtgtcaaaacttaactgtgtccgat

SEQ ID NO: 515937 - DNA, 25 bp, Rattus norvegicus
gtgtcaaaactttactgtgtccgat

SEQ ID NO: 515938 - DNA, 25 bp, Rattus norvegicus
gtgtcaaacaacatgtggcttctta

SEQ ID NO: 515939 - DNA, 25 bp, Rattus norvegicus
gtgtcaaacaacttgtggcttctta

SEQ ID NO: 515940 - DNA, 25 bp, Rattus norvegicus
gtgtcaaactgtctgttcacgtctt

SEQ ID NO: 515941 - DNA, 25 bp, Rattus norvegicus
gtgtcaaactgtgtgttcacgtctt

SEQ ID NO: 515942 - DNA, 25 bp, Rattus norvegicus
gtgtcaaaggctattctgttacttg

SEQ ID NO: 515943 - DNA, 25 bp, Rattus norvegicus
gtgtcaaaggctcggtactcctatt

SEQ ID NO: 515944 - DNA, 25 bp, Rattus norvegicus
gtgtcaaaggctgggtactcctatt

SEQ ID NO: 515945 - DNA, 25 bp, Rattus norvegicus
gtgtcaaaggcttttctgttacttg

SEQ ID NO: 515946 - DNA, 25 bp, Rattus norvegicus
gtgtcaaatgccacatgatgtcatc

SEQ ID NO: 515947 - DNA, 25 bp, Rattus norvegicus
gtgtcaaatgcctcatgatgtcatc

SEQ ID NO: 515948 - DNA, 25 bp, Rattus norvegicus
gtgtcaacacacaagctattctgct

SEQ ID NO: 515949 - DNA, 25 bp, Rattus norvegicus
gtgtcaacacacaggtcttttctgg

SEQ ID NO: 515950 - DNA, 25 bp, Rattus norvegicus
gtgtcaacacactagctattctgct

SEQ ID NO: 515951 - DNA, 25 bp, Rattus norvegicus
gtgtcaacacactggtcttttctgg

SEQ ID NO: 515952 - DNA, 25 bp, Rattus norvegicus
gtgtcaaccagcaaaaccagggctt

SEQ ID NO: 515953 - DNA, 25 bp, Rattus norvegicus
gtgtcaaccagctaaaccagggctt

SEQ ID NO: 515954 - DNA, 25 bp, Rattus norvegicus
gtgtcaacccttacatctatggctt

SEQ ID NO: 515955 - DNA, 25 bp, Rattus norvegicus
gtgtcaaccctttcatctatggctt

SEQ ID NO: 515956 - DNA, 25 bp, Rattus norvegicus
gtgtcaacgcttctgttgcacccgg

SEQ ID NO: 515957 - DNA, 25 bp, Rattus norvegicus
gtgtcaacgcttgtgttgcacccgg

SEQ ID NO: 515958 - DNA, 25 bp, Rattus norvegicus
gtgtcaactctcaacctgtgtttaa

SEQ ID NO: 515959 - DNA, 25 bp, Rattus norvegicus
gtgtcaactctctacctgtgtttaa

SEQ ID NO: 515960 - DNA, 25 bp, Rattus norvegicus
gtgtcaactgctctaaatcctggga

SEQ ID NO: 515961 - DNA, 25 bp, Rattus norvegicus
gtgtcaactgctgtaaatcctggga

SEQ ID NO: 515962 - DNA, 25 bp, Rattus norvegicus
gtgtcaacttgcatagacgctttaa

SEQ ID NO: 515963 - DNA, 25 bp, Rattus norvegicus
gtgtcaacttgcttagacgctttaa

SEQ ID NO: 515964 - DNA, 25 bp, Rattus norvegicus
gtgtcaagagtcaggttttctgcct

SEQ ID NO: 515965 - DNA, 25 bp, Rattus norvegicus
gtgtcaagagtctggttttctgcct

SEQ ID NO: 515966 - DNA, 25 bp, Rattus norvegicus
gtgtcaagatcgagtctccatgcta

SEQ ID NO: 515967 - DNA, 25 bp, Rattus norvegicus
gtgtcaagatcgtgtctccatgcta

SEQ ID NO: 515968 - DNA, 25 bp, Rattus norvegicus
gtgtcaagcttaactccaaggccaa

SEQ ID NO: 515969 - DNA, 25 bp, Rattus norvegicus
gtgtcaagcttatctccaaggccaa

SEQ ID NO: 515970 - DNA, 25 bp, Rattus norvegicus
gtgtcaagggctatctttggtgact

SEQ ID NO: 515971 - DNA, 25 bp, Rattus norvegicus
gtgtcaagggctttctttggtgact

SEQ ID NO: 515972 - DNA, 25 bp, Rattus norvegicus
gtgtcaagtccaagggcagggtact

SEQ ID NO: 515973 - DNA, 25 bp, Rattus norvegicus
gtgtcaagtccatgggcagggtact

SEQ ID NO: 515974 - DNA, 25 bp, Rattus norvegicus
gtgtcaagtgttattgatcgactcg

SEQ ID NO: 515975 - DNA, 25 bp, Rattus norvegicus
gtgtcaagtgtttttgatcgactcg

SEQ ID NO: 515976 - DNA, 25 bp, Rattus norvegicus
gtgtcaagttggctggtgctaccca

SEQ ID NO: 515977 - DNA, 25 bp, Rattus norvegicus
gtgtcaagttgggtggtgctaccca

SEQ ID NO: 515978 - DNA, 25 bp, Rattus norvegicus
gtgtcaataaagatcatttgccctc

SEQ ID NO: 515979 - DNA, 25 bp, Rattus norvegicus
gtgtcaataaagttcatttgccctc

SEQ ID NO: 515980 - DNA, 25 bp, Rattus norvegicus
gtgtcaatgaatctggtttgtcaaa

SEQ ID NO: 515981 - DNA, 25 bp, Rattus norvegicus
gtgtcaatgaatgtggtttgtcaaa

SEQ ID NO: 515982 - DNA, 25 bp, Rattus norvegicus
gtgtcaatgctgacatggccaacct

SEQ ID NO: 515983 - DNA, 25 bp, Rattus norvegicus
gtgtcaatgctgtcatggccaacct

SEQ ID NO: 515984 - DNA, 25 bp, Rattus norvegicus
gtgtcaattccacatgtgtgcccac

SEQ ID NO: 515985 - DNA, 25 bp, Rattus norvegicus
gtgtcaattccagatgtgtgcccac

SEQ ID NO: 515986 - DNA, 25 bp, Rattus norvegicus
gtgtcaattttcagagctctccaca

SEQ ID NO: 515987 - DNA, 25 bp, Rattus norvegicus
gtgtcaattttctgagctctccaca

SEQ ID NO: 515988 - DNA, 25 bp, Rattus norvegicus
gtgtcaatttttctagtccattcaa

SEQ ID NO: 515989 - DNA, 25 bp, Rattus norvegicus
gtgtcaatttttgtagtccattcaa

SEQ ID NO: 515990 - DNA, 25 bp, Rattus norvegicus
gtgtcacaaaaccatttatgttacc

SEQ ID NO: 515991 - DNA, 25 bp, Rattus norvegicus
gtgtcacaaaacgatttatgttacc

SEQ ID NO: 515992 - DNA, 25 bp, Rattus norvegicus
gtgtcacaaggcacaacgatcggca

SEQ ID NO: 515993 - DNA, 25 bp, Rattus norvegicus
gtgtcacaaggctcaacgatcggca

SEQ ID NO: 515994 - DNA, 25 bp, Rattus norvegicus
gtgtcacacacccaaaacgcgcagg

SEQ ID NO: 515995 - DNA, 25 bp, Rattus norvegicus
gtgtcacacaccgaaaacgcgcagg

SEQ ID NO: 515996 - DNA, 25 bp, Rattus norvegicus
gtgtcacactgtcccagcaaagtca

SEQ ID NO: 515997 - DNA, 25 bp, Rattus norvegicus
gtgtcacactgtgccagcaaagtca

SEQ ID NO: 515998 - DNA, 25 bp, Rattus norvegicus
gtgtcacacttaatgatgctctctg

SEQ ID NO: 515999 - DNA, 25 bp, Rattus norvegicus
gtgtcacacttattgatgctctctg

SEQ ID NO: 516000 - DNA, 25 bp, Rattus norvegicus
gtgtcacagaaaaagcagcggcctc

SEQ ID NO: 516001 - DNA, 25 bp, Rattus norvegicus
gtgtcacagaaatagcagcggcctc

SEQ ID NO: 516002 - DNA, 25 bp, Rattus norvegicus
gtgtcacagaacagagtctcctgct

SEQ ID NO: 516003 - DNA, 25 bp, Rattus norvegicus
gtgtcacagaactgagtctcctgct

SEQ ID NO: 516004 - DNA, 25 bp, Rattus norvegicus
gtgtcacagagcaggacagcaagga

SEQ ID NO: 516005 - DNA, 25 bp, Rattus norvegicus
gtgtcacagagctggacagcaagga

SEQ ID NO: 516006 - DNA, 25 bp, Rattus norvegicus
gtgtcacagccacaacgatgttcct

SEQ ID NO: 516007 - DNA, 25 bp, Rattus norvegicus
gtgtcacagccagaacgatgttcct

SEQ ID NO: 516008 - DNA, 25 bp, Rattus norvegicus
gtgtcacagcctctgaaatgggtcc

SEQ ID NO: 516009 - DNA, 25 bp, Rattus norvegicus
gtgtcacagcctgtgaaatgggtcc

SEQ ID NO: 516010 - DNA, 25 bp, Rattus norvegicus
gtgtcacagtgaagtgcctctcaca

SEQ ID NO: 516011 - DNA, 25 bp, Rattus norvegicus
gtgtcacagtgatgtgcctctcaca

SEQ ID NO: 516012 - DNA, 25 bp, Rattus norvegicus
gtgtcacagtggctcaggtcgtcat

SEQ ID NO: 516013 - DNA, 25 bp, Rattus norvegicus
gtgtcacagtgggtcaggtcgtcat

SEQ ID NO: 516014 - DNA, 25 bp, Rattus norvegicus
gtgtcacatacacccttggtacttt

SEQ ID NO: 516015 - DNA, 25 bp, Rattus norvegicus
gtgtcacatacagccttggtacttt

SEQ ID NO: 516016 - DNA, 25 bp, Rattus norvegicus
gtgtcacatcctaatctacttgtgc

SEQ ID NO: 516017 - DNA, 25 bp, Rattus norvegicus
gtgtcacatccttatctacttgtgc

SEQ ID NO: 516018 - DNA, 25 bp, Rattus norvegicus
gtgtcaccagggatagactcttgag

SEQ ID NO: 516019 - DNA, 25 bp, Rattus norvegicus
gtgtcaccagggttagactcttgag

SEQ ID NO: 516020 - DNA, 25 bp, Rattus norvegicus
gtgtcaccatcaacatccttattgg

SEQ ID NO: 516021 - DNA, 25 bp, Rattus norvegicus
gtgtcaccatcatcatccttattgg

SEQ ID NO: 516022 - DNA, 25 bp, Rattus norvegicus
gtgtcaccatcgaccagagcctgag

SEQ ID NO: 516023 - DNA, 25 bp, Rattus norvegicus
gtgtcaccatcgtccagagcctgag

SEQ ID NO: 516024 - DNA, 25 bp, Rattus norvegicus
gtgtcaccatgcacttgtggagtat

SEQ ID NO: 516025 - DNA, 25 bp, Rattus norvegicus
gtgtcaccatgctcttgtggagtat

SEQ ID NO: 516026 - DNA, 25 bp, Rattus norvegicus
gtgtcacccaatcccacaagaaagg

SEQ ID NO: 516027 - DNA, 25 bp, Rattus norvegicus
gtgtcacccaatgccacaagaaagg

SEQ ID NO: 516028 - DNA, 25 bp, Rattus norvegicus
gtgtcacccgataggctctaattaa

SEQ ID NO: 516029 - DNA, 25 bp, Rattus norvegicus
gtgtcacccgattggctctaattaa

SEQ ID NO: 516030 - DNA, 25 bp, Rattus norvegicus
gtgtcaccctgacagtaagacagag

SEQ ID NO: 516031 - DNA, 25 bp, Rattus norvegicus
gtgtcaccctgagagtaagacagag

SEQ ID NO: 516032 - DNA, 25 bp, Rattus norvegicus
gtgtcacccttgctctcagagcaga

SEQ ID NO: 516033 - DNA, 25 bp, Rattus norvegicus
gtgtcacccttggtctcagagcaga

SEQ ID NO: 516034 - DNA, 25 bp, Rattus norvegicus
gtgtcaccgaccagagggcctggaa

SEQ ID NO: 516035 - DNA, 25 bp, Rattus norvegicus
gtgtcaccgacctgagggcctggaa

SEQ ID NO: 516036 - DNA, 25 bp, Rattus norvegicus
gtgtcaccggatcatggtcacctga

SEQ ID NO: 516037 - DNA, 25 bp, Rattus norvegicus
gtgtcaccggatgatggtcacctga

SEQ ID NO: 516038 - DNA, 25 bp, Rattus norvegicus
gtgtcaccgtagaagactacttcaa

SEQ ID NO: 516039 - DNA, 25 bp, Rattus norvegicus
gtgtcaccgtagtagactacttcaa

SEQ ID NO: 516040 - DNA, 25 bp, Rattus norvegicus
gtgtcacctaatatggctttccgag

SEQ ID NO: 516041 - DNA, 25 bp, Rattus norvegicus
gtgtcacctaatttggctttccgag

SEQ ID NO: 516042 - DNA, 25 bp, Rattus norvegicus
gtgtcacctgcaactcacagaagtt

SEQ ID NO: 516043 - DNA, 25 bp, Rattus norvegicus
gtgtcacctgcatctcacagaagtt

SEQ ID NO: 516044 - DNA, 25 bp, Rattus norvegicus
gtgtcacctggacggactcccttca

SEQ ID NO: 516045 - DNA, 25 bp, Rattus norvegicus
gtgtcacctggagggactcccttca

SEQ ID NO: 516046 - DNA, 25 bp, Rattus norvegicus
gtgtcacctgtcactctgttaggaa

SEQ ID NO: 516047 - DNA, 25 bp, Rattus norvegicus
gtgtcacctgtctctctgttaggaa

SEQ ID NO: 516048 - DNA, 25 bp, Rattus norvegicus
gtgtcacctgtgaaaatcaaatcaa

SEQ ID NO: 516049 - DNA, 25 bp, Rattus norvegicus
gtgtcacctgtgtaaatcaaatcaa

SEQ ID NO: 516050 - DNA, 25 bp, Rattus norvegicus
gtgtcaccttaaccagatttatctg

SEQ ID NO: 516051 - DNA, 25 bp, Rattus norvegicus
gtgtcaccttaagcagatttatctg

SEQ ID NO: 516052 - DNA, 25 bp, Rattus norvegicus
gtgtcaccttccagtgcacactaag

SEQ ID NO: 516053 - DNA, 25 bp, Rattus norvegicus
gtgtcaccttcctgtgcacactaag

SEQ ID NO: 516054 - DNA, 25 bp, Rattus norvegicus
gtgtcaccttctcatgcacagtgca

SEQ ID NO: 516055 - DNA, 25 bp, Rattus norvegicus
gtgtcaccttctgatgcacagtgca

SEQ ID NO: 516056 - DNA, 25 bp, Rattus norvegicus
gtgtcacgattcacaaatgttctgg

SEQ ID NO: 516057 - DNA, 25 bp, Rattus norvegicus
gtgtcacgattctcaaatgttctgg

SEQ ID NO: 516058 - DNA, 25 bp, Rattus norvegicus
gtgtcactacagcatgttccaatag

SEQ ID NO: 516059 - DNA, 25 bp, Rattus norvegicus
gtgtcactacaggatgttccaatag

SEQ ID NO: 516060 - DNA, 25 bp, Rattus norvegicus
gtgtcactacttagatgaaccgaag

SEQ ID NO: 516061 - DNA, 25 bp, Rattus norvegicus
gtgtcactactttgatgaaccgaag

SEQ ID NO: 516062 - DNA, 25 bp, Rattus norvegicus
gtgtcactagacacttgcagggttc

SEQ ID NO: 516063 - DNA, 25 bp, Rattus norvegicus
gtgtcactagactcttgcagggttc

SEQ ID NO: 516064 - DNA, 25 bp, Rattus norvegicus
gtgtcactagagaaggcgcagatcc

SEQ ID NO: 516065 - DNA, 25 bp, Rattus norvegicus
gtgtcactagagtaggcgcagatcc

SEQ ID NO: 516066 - DNA, 25 bp, Rattus norvegicus
gtgtcactagatatctgttcacgtt

SEQ ID NO: 516067 - DNA, 25 bp, Rattus norvegicus
gtgtcactagatttctgttcacgtt

SEQ ID NO: 516068 - DNA, 25 bp, Rattus norvegicus
gtgtcactattgcacttaacagctg

SEQ ID NO: 516069 - DNA, 25 bp, Rattus norvegicus
gtgtcactattggacttaacagctg

SEQ ID NO: 516070 - DNA, 25 bp, Rattus norvegicus
gtgtcactcagcatgcattagcctt

SEQ ID NO: 516071 - DNA, 25 bp, Rattus norvegicus
gtgtcactcagcttgcattagcctt

SEQ ID NO: 516072 - DNA, 25 bp, Rattus norvegicus
gtgtcactcatgacactaccttcag

SEQ ID NO: 516073 - DNA, 25 bp, Rattus norvegicus
gtgtcactcatgtcactaccttcag

SEQ ID NO: 516074 - DNA, 25 bp, Rattus norvegicus
gtgtcactcctcagcagttaggcta

SEQ ID NO: 516075 - DNA, 25 bp, Rattus norvegicus
gtgtcactcctctgcagttaggcta

SEQ ID NO: 516076 - DNA, 25 bp, Rattus norvegicus
gtgtcactcctgaatgcatactcca

SEQ ID NO: 516077 - DNA, 25 bp, Rattus norvegicus
gtgtcactcctgtatgcatactcca

SEQ ID NO: 516078 - DNA, 25 bp, Rattus norvegicus
gtgtcactctgcactctgggagaaa

SEQ ID NO: 516079 - DNA, 25 bp, Rattus norvegicus
gtgtcactctgctctctgggagaaa

SEQ ID NO: 516080 - DNA, 25 bp, Rattus norvegicus
gtgtcactcttcacatttcccgaat

SEQ ID NO: 516081 - DNA, 25 bp, Rattus norvegicus
gtgtcactcttctcatttcccgaat

SEQ ID NO: 516082 - DNA, 25 bp, Rattus norvegicus
gtgtcactgaagagtgtcctgcctt

SEQ ID NO: 516083 - DNA, 25 bp, Rattus norvegicus
gtgtcactgaagtgtgtcctgcctt

SEQ ID NO: 516084 - DNA, 25 bp, Rattus norvegicus
gtgtcactgccaacaacggaaccag

SEQ ID NO: 516085 - DNA, 25 bp, Rattus norvegicus
gtgtcactgccatcaacggaaccag

SEQ ID NO: 516086 - DNA, 25 bp, Rattus norvegicus
gtgtcactgccgctcatgcttagag

SEQ ID NO: 516087 - DNA, 25 bp, Rattus norvegicus
gtgtcactgccggtcatgcttagag

SEQ ID NO: 516088 - DNA, 25 bp, Rattus norvegicus
gtgtcactgcctatcagaggtgatt

SEQ ID NO: 516089 - DNA, 25 bp, Rattus norvegicus
gtgtcactgcctttcagaggtgatt

SEQ ID NO: 516090 - DNA, 25 bp, Rattus norvegicus
gtgtcactgcggagctctgtggcca

SEQ ID NO: 516091 - DNA, 25 bp, Rattus norvegicus
gtgtcactgcggtgctctgtggcca

SEQ ID NO: 516092 - DNA, 25 bp, Rattus norvegicus
gtgtcactgctcctgaaactcgatg

SEQ ID NO: 516093 - DNA, 25 bp, Rattus norvegicus
gtgtcactgctcgtgaaactcgatg

SEQ ID NO: 516094 - DNA, 25 bp, Rattus norvegicus
gtgtcactggatcaccatgacggta

SEQ ID NO: 516095 - DNA, 25 bp, Rattus norvegicus
gtgtcactggatgaccatgacggta

SEQ ID NO: 516096 - DNA, 25 bp, Rattus norvegicus
gtgtcactggcaaactgaagatcct

SEQ ID NO: 516097 - DNA, 25 bp, Rattus norvegicus
gtgtcactggcatactgaagatcct

SEQ ID NO: 516098 - DNA, 25 bp, Rattus norvegicus
gtgtcactggtacttttcaaactgt

SEQ ID NO: 516099 - DNA, 25 bp, Rattus norvegicus
gtgtcactggtagttttcaaactgt

SEQ ID NO: 516100 - DNA, 25 bp, Rattus norvegicus
gtgtcactgtccctctgagatccgc

SEQ ID NO: 516101 - DNA, 25 bp, Rattus norvegicus
gtgtcactgtccgtctgagatccgc

SEQ ID NO: 516102 - DNA, 25 bp, Rattus norvegicus
gtgtcacttcagacgatgtcatcct

SEQ ID NO: 516103 - DNA, 25 bp, Rattus norvegicus
gtgtcacttcagtcgatgtcatcct

SEQ ID NO: 516104 - DNA, 25 bp, Rattus norvegicus
gtgtcacttctgaacttgctactaa

SEQ ID NO: 516105 - DNA, 25 bp, Rattus norvegicus
gtgtcacttctgtacttgctactaa

SEQ ID NO: 516106 - DNA, 25 bp, Rattus norvegicus
gtgtcacttggcacatgactgccta

SEQ ID NO: 516107 - DNA, 25 bp, Rattus norvegicus
gtgtcacttggctcatgactgccta

SEQ ID NO: 516108 - DNA, 25 bp, Rattus norvegicus
gtgtcacttggtcattacccctgag

SEQ ID NO: 516109 - DNA, 25 bp, Rattus norvegicus
gtgtcacttggtgattacccctgag

SEQ ID NO: 516110 - DNA, 25 bp, Rattus norvegicus
gtgtcactttatagtggagtccctg

SEQ ID NO: 516111 - DNA, 25 bp, Rattus norvegicus
gtgtcactttattgtggagtccctg

SEQ ID NO: 516112 - DNA, 25 bp, Rattus norvegicus
gtgtcactttctacactttcaaaag

SEQ ID NO: 516113 - DNA, 25 bp, Rattus norvegicus
gtgtcactttcttcactttcaaaag

SEQ ID NO: 516114 - DNA, 25 bp, Rattus norvegicus
gtgtcactttgacccaagcaattac

SEQ ID NO: 516115 - DNA, 25 bp, Rattus norvegicus
gtgtcactttgagccaagcaattac

SEQ ID NO: 516116 - DNA, 25 bp, Rattus norvegicus
gtgtcagaaaccaaactccagtcag

SEQ ID NO: 516117 - DNA, 25 bp, Rattus norvegicus
gtgtcagaaacctaactccagtcag

SEQ ID NO: 516118 - DNA, 25 bp, Rattus norvegicus
gtgtcagaagtgcacgtcttgtcca

SEQ ID NO: 516119 - DNA, 25 bp, Rattus norvegicus
gtgtcagaagtggacgtcttgtcca

SEQ ID NO: 516120 - DNA, 25 bp, Rattus norvegicus
gtgtcagaatcaaccaccatgctgt

SEQ ID NO: 516121 - DNA, 25 bp, Rattus norvegicus
gtgtcagaatcatccaccatgctgt

SEQ ID NO: 516122 - DNA, 25 bp, Rattus norvegicus
gtgtcagacaacagcctttccagtt

SEQ ID NO: 516123 - DNA, 25 bp, Rattus norvegicus
gtgtcagacaactgcctttccagtt

SEQ ID NO: 516124 - DNA, 25 bp, Rattus norvegicus
gtgtcagacactaggtaggaataac

SEQ ID NO: 516125 - DNA, 25 bp, Rattus norvegicus
gtgtcagacactcagtgataagcaa

SEQ ID NO: 516126 - DNA, 25 bp, Rattus norvegicus
gtgtcagacactgagtgataagcaa

SEQ ID NO: 516127 - DNA, 25 bp, Rattus norvegicus
gtgtcagacacttggtaggaataac

SEQ ID NO: 516128 - DNA, 25 bp, Rattus norvegicus
gtgtcagacaggcattctccatgtt

SEQ ID NO: 516129 - DNA, 25 bp, Rattus norvegicus
gtgtcagacagggattctccatgtt

SEQ ID NO: 516130 - DNA, 25 bp, Rattus norvegicus
gtgtcagacctcataatgggccagt

SEQ ID NO: 516131 - DNA, 25 bp, Rattus norvegicus
gtgtcagacctcttaatgggccagt

SEQ ID NO: 516132 - DNA, 25 bp, Rattus norvegicus
gtgtcagagaatccagaccactcca

SEQ ID NO: 516133 - DNA, 25 bp, Rattus norvegicus
gtgtcagagaatgcagaccactcca

SEQ ID NO: 516134 - DNA, 25 bp, Rattus norvegicus
gtgtcagagacaaactttttaaact

SEQ ID NO: 516135 - DNA, 25 bp, Rattus norvegicus
gtgtcagagacatactttttaaact

SEQ ID NO: 516136 - DNA, 25 bp, Rattus norvegicus
gtgtcagagagcctttgtcgtattt

SEQ ID NO: 516137 - DNA, 25 bp, Rattus norvegicus
gtgtcagagagcgtttgtcgtattt

SEQ ID NO: 516138 - DNA, 25 bp, Rattus norvegicus
gtgtcagagatcaccgcttactgca

SEQ ID NO: 516139 - DNA, 25 bp, Rattus norvegicus
gtgtcagagatctccgcttactgca

SEQ ID NO: 516140 - DNA, 25 bp, Rattus norvegicus
gtgtcagatctcacagaacattagg

SEQ ID NO: 516141 - DNA, 25 bp, Rattus norvegicus
gtgtcagatctctcagaacattagg

SEQ ID NO: 516142 - DNA, 25 bp, Rattus norvegicus
gtgtcagatgggaaagcctcccaga

SEQ ID NO: 516143 - DNA, 25 bp, Rattus norvegicus
gtgtcagatgggtaagcctcccaga

SEQ ID NO: 516144 - DNA, 25 bp, Rattus norvegicus
gtgtcagattaacccctgtctctta

SEQ ID NO: 516145 - DNA, 25 bp, Rattus norvegicus
gtgtcagattaagccctgtctctta

SEQ ID NO: 516146 - DNA, 25 bp, Rattus norvegicus
gtgtcagattagattcccagggctc

SEQ ID NO: 516147 - DNA, 25 bp, Rattus norvegicus
gtgtcagattagtttcccagggctc

SEQ ID NO: 516148 - DNA, 25 bp, Rattus norvegicus
gtgtcagattataccaagcttgttc

SEQ ID NO: 516149 - DNA, 25 bp, Rattus norvegicus
gtgtcagattattccaagcttgttc

SEQ ID NO: 516150 - DNA, 25 bp, Rattus norvegicus
gtgtcagcacttcgtgatctagcat

SEQ ID NO: 516151 - DNA, 25 bp, Rattus norvegicus
gtgtcagcacttggtgatctagcat

SEQ ID NO: 516152 - DNA, 25 bp, Rattus norvegicus
gtgtcagcaggccatgcactacaaa

SEQ ID NO: 516153 - DNA, 25 bp, Rattus norvegicus
gtgtcagcaggcgatgcactacaaa

SEQ ID NO: 516154 - DNA, 25 bp, Rattus norvegicus
gtgtcagcagtaatggcggcgtcca

SEQ ID NO: 516155 - DNA, 25 bp, Rattus norvegicus
gtgtcagcagtattggcggcgtcca

SEQ ID NO: 516156 - DNA, 25 bp, Rattus norvegicus
gtgtcagcagtgatcaggaaactac

SEQ ID NO: 516157 - DNA, 25 bp, Rattus norvegicus
gtgtcagcagtgttcaggaaactac

SEQ ID NO: 516158 - DNA, 25 bp, Rattus norvegicus
gtgtcagcattcagcggtccagggt

SEQ ID NO: 516159 - DNA, 25 bp, Rattus norvegicus
gtgtcagcattctgcggtccagggt

SEQ ID NO: 516160 - DNA, 25 bp, Rattus norvegicus
gtgtcagccaagaactccaggatga

SEQ ID NO: 516161 - DNA, 25 bp, Rattus norvegicus
gtgtcagccaagtactccaggatga

SEQ ID NO: 516162 - DNA, 25 bp, Rattus norvegicus
gtgtcagcgaggaggtatcgatttt

SEQ ID NO: 516163 - DNA, 25 bp, Rattus norvegicus
gtgtcagcgaggtggtatcgatttt

SEQ ID NO: 516164 - DNA, 25 bp, Rattus norvegicus
gtgtcagcggtcagaactcactgag

SEQ ID NO: 516165 - DNA, 25 bp, Rattus norvegicus
gtgtcagcggtctgaactcactgag

SEQ ID NO: 516166 - DNA, 25 bp, Rattus norvegicus
gtgtcagctaaaactggactggcca

SEQ ID NO: 516167 - DNA, 25 bp, Rattus norvegicus
gtgtcagctaaacagcaaagttcaa

SEQ ID NO: 516168 - DNA, 25 bp, Rattus norvegicus
gtgtcagctaaagagcaaagttcaa

SEQ ID NO: 516169 - DNA, 25 bp, Rattus norvegicus
gtgtcagctaaatctggactggcca

SEQ ID NO: 516170 - DNA, 25 bp, Rattus norvegicus
gtgtcagctcagagggcactggatt

SEQ ID NO: 516171 - DNA, 25 bp, Rattus norvegicus
gtgtcagctcagtgggcactggatt

SEQ ID NO: 516172 - DNA, 25 bp, Rattus norvegicus
gtgtcagctgatcacctcctcaaga

SEQ ID NO: 516173 - DNA, 25 bp, Rattus norvegicus
gtgtcagctgatgacctcctcaaga

SEQ ID NO: 516174 - DNA, 25 bp, Rattus norvegicus
gtgtcagctgtacccaagggtcaca

SEQ ID NO: 516175 - DNA, 25 bp, Rattus norvegicus
gtgtcagctgtagccaagggtcaca

SEQ ID NO: 516176 - DNA, 25 bp, Rattus norvegicus
gtgtcagcttgtacctgctaggtaa

SEQ ID NO: 516177 - DNA, 25 bp, Rattus norvegicus
gtgtcagcttgttcctgctaggtaa

SEQ ID NO: 516178 - DNA, 25 bp, Rattus norvegicus
gtgtcaggaatcaattcggctcctc

SEQ ID NO: 516179 - DNA, 25 bp, Rattus norvegicus
gtgtcaggaatctattcggctcctc

SEQ ID NO: 516180 - DNA, 25 bp, Rattus norvegicus
gtgtcaggaatgactccaaccctgt

SEQ ID NO: 516181 - DNA, 25 bp, Rattus norvegicus
gtgtcaggaatgtctccaaccctgt

SEQ ID NO: 516182 - DNA, 25 bp, Rattus norvegicus
gtgtcaggagtaatttgggagtaat

SEQ ID NO: 516183 - DNA, 25 bp, Rattus norvegicus
gtgtcaggagtattttgggagtaat

SEQ ID NO: 516184 - DNA, 25 bp, Rattus norvegicus
gtgtcaggcagcacgcaccgaagtg

SEQ ID NO: 516185 - DNA, 25 bp, Rattus norvegicus
gtgtcaggcagctcgcaccgaagtg

SEQ ID NO: 516186 - DNA, 25 bp, Rattus norvegicus
gtgtcaggcctgcagagcaacagca

SEQ ID NO: 516187 - DNA, 25 bp, Rattus norvegicus
gtgtcaggcctggagagcaacagca

SEQ ID NO: 516188 - DNA, 25 bp, Rattus norvegicus
gtgtcaggcggtcgcacccaaagac

SEQ ID NO: 516189 - DNA, 25 bp, Rattus norvegicus
gtgtcaggcggtggcacccaaagac

SEQ ID NO: 516190 - DNA, 25 bp, Rattus norvegicus
gtgtcaggcgtgattaagcatgccc

SEQ ID NO: 516191 - DNA, 25 bp, Rattus norvegicus
gtgtcaggcgtgtttaagcatgccc

SEQ ID NO: 516192 - DNA, 25 bp, Rattus norvegicus
gtgtcagggaagcatcttgcttatt

SEQ ID NO: 516193 - DNA, 25 bp, Rattus norvegicus
gtgtcagggaaggatcttgcttatt

SEQ ID NO: 516194 - DNA, 25 bp, Rattus norvegicus
gtgtcagggacacatgccgatcatg

SEQ ID NO: 516195 - DNA, 25 bp, Rattus norvegicus
gtgtcagggacagatgccgatcatg

SEQ ID NO: 516196 - DNA, 25 bp, Rattus norvegicus
gtgtcagggtttacatttatctttc

SEQ ID NO: 516197 - DNA, 25 bp, Rattus norvegicus
gtgtcagggttttcatttatctttc

SEQ ID NO: 516198 - DNA, 25 bp, Rattus norvegicus
gtgtcaggtctgagaggtctgctca

SEQ ID NO: 516199 - DNA, 25 bp, Rattus norvegicus
gtgtcaggtctgtgaggtctgctca

SEQ ID NO: 516200 - DNA, 25 bp, Rattus norvegicus
gtgtcaggtgagcaagtctccaaat

SEQ ID NO: 516201 - DNA, 25 bp, Rattus norvegicus
gtgtcaggtgaggaagtctccaaat

SEQ ID NO: 516202 - DNA, 25 bp, Rattus norvegicus
gtgtcaggttagcatgctgccagca

SEQ ID NO: 516203 - DNA, 25 bp, Rattus norvegicus
gtgtcaggttaggatgctgccagca

SEQ ID NO: 516204 - DNA, 25 bp, Rattus norvegicus
gtgtcagtaggtaggcagtgtctcc

SEQ ID NO: 516205 - DNA, 25 bp, Rattus norvegicus
gtgtcagtaggttggcagtgtctcc

SEQ ID NO: 516206 - DNA, 25 bp, Rattus norvegicus
gtgtcagtatggctagctgccgtcc

SEQ ID NO: 516207 - DNA, 25 bp, Rattus norvegicus
gtgtcagtatgggtagctgccgtcc

SEQ ID NO: 516208 - DNA, 25 bp, Rattus norvegicus
gtgtcagtcaccacatgttcacaag

SEQ ID NO: 516209 - DNA, 25 bp, Rattus norvegicus
gtgtcagtcacctcatgttcacaag

SEQ ID NO: 516210 - DNA, 25 bp, Rattus norvegicus
gtgtcagtcactagaatttctcctc

SEQ ID NO: 516211 - DNA, 25 bp, Rattus norvegicus
gtgtcagtcacttgaatttctcctc

SEQ ID NO: 516212 - DNA, 25 bp, Rattus norvegicus
gtgtcagtcggccatcaggtccaat

SEQ ID NO: 516213 - DNA, 25 bp, Rattus norvegicus
gtgtcagtcggcgatcaggtccaat

SEQ ID NO: 516214 - DNA, 25 bp, Rattus norvegicus
gtgtcagtcttcctgtgtgcgctaa

SEQ ID NO: 516215 - DNA, 25 bp, Rattus norvegicus
gtgtcagtcttcgtgtgtgcgctaa

SEQ ID NO: 516216 - DNA, 25 bp, Rattus norvegicus
gtgtcagtgacaaggagagctctgt

SEQ ID NO: 516217 - DNA, 25 bp, Rattus norvegicus
gtgtcagtgacacctacagcaggca

SEQ ID NO: 516218 - DNA, 25 bp, Rattus norvegicus
gtgtcagtgacagctacagcaggca

SEQ ID NO: 516219 - DNA, 25 bp, Rattus norvegicus
gtgtcagtgacatggagagctctgt

SEQ ID NO: 516220 - DNA, 25 bp, Rattus norvegicus
gtgtcagtgacgctacctgtacaat

SEQ ID NO: 516221 - DNA, 25 bp, Rattus norvegicus
gtgtcagtgacggtacctgtacaat

SEQ ID NO: 516222 - DNA, 25 bp, Rattus norvegicus
gtgtcagtgcccaggtccgagagaa

SEQ ID NO: 516223 - DNA, 25 bp, Rattus norvegicus
gtgtcagtgccctggtccgagagaa

SEQ ID NO: 516224 - DNA, 25 bp, Rattus norvegicus
gtgtcagtggtgaccttgatgccct

SEQ ID NO: 516225 - DNA, 25 bp, Rattus norvegicus
gtgtcagtggtgtccttgatgccct

SEQ ID NO: 516226 - DNA, 25 bp, Rattus norvegicus
gtgtcagtgttcacagtccagccct

SEQ ID NO: 516227 - DNA, 25 bp, Rattus norvegicus
gtgtcagtgttctcagtccagccct

SEQ ID NO: 516228 - DNA, 25 bp, Rattus norvegicus
gtgtcagttacaagatcttccttta

SEQ ID NO: 516229 - DNA, 25 bp, Rattus norvegicus
gtgtcagttacactcagcagaaaaa

SEQ ID NO: 516230 - DNA, 25 bp, Rattus norvegicus
gtgtcagttacagtcagcagaaaaa

SEQ ID NO: 516231 - DNA, 25 bp, Rattus norvegicus
gtgtcagttacatgatcttccttta

SEQ ID NO: 516232 - DNA, 25 bp, Rattus norvegicus
gtgtcagttagaatagggtagctta

SEQ ID NO: 516233 - DNA, 25 bp, Rattus norvegicus
gtgtcagttagattagggtagctta

SEQ ID NO: 516234 - DNA, 25 bp, Rattus norvegicus
gtgtcagttaggattcaaccattca

SEQ ID NO: 516235 - DNA, 25 bp, Rattus norvegicus
gtgtcagttaggtttcaaccattca

SEQ ID NO: 516236 - DNA, 25 bp, Rattus norvegicus
gtgtcagttcagatcaaggaccttt

SEQ ID NO: 516237 - DNA, 25 bp, Rattus norvegicus
gtgtcagttcagttcaaggaccttt

SEQ ID NO: 516238 - DNA, 25 bp, Rattus norvegicus
gtgtcagttccactgaggaccacag

SEQ ID NO: 516239 - DNA, 25 bp, Rattus norvegicus
gtgtcagttccagtgaggaccacag

SEQ ID NO: 516240 - DNA, 25 bp, Rattus norvegicus
gtgtcagttctaacagagtcacctg

SEQ ID NO: 516241 - DNA, 25 bp, Rattus norvegicus
gtgtcagttctatcagagtcacctg

SEQ ID NO: 516242 - DNA, 25 bp, Rattus norvegicus
gtgtcagttgaacgtattgggccaa

SEQ ID NO: 516243 - DNA, 25 bp, Rattus norvegicus
gtgtcagttgaaggtattgggccaa

SEQ ID NO: 516244 - DNA, 25 bp, Rattus norvegicus
gtgtcagtttccctcaggttatatt

SEQ ID NO: 516245 - DNA, 25 bp, Rattus norvegicus
gtgtcagtttccgtcaggttatatt

SEQ ID NO: 516246 - DNA, 25 bp, Rattus norvegicus
gtgtcagttttcaactgtaccgggt

SEQ ID NO: 516247 - DNA, 25 bp, Rattus norvegicus
gtgtcagttttcagttggttatgtc

SEQ ID NO: 516248 - DNA, 25 bp, Rattus norvegicus
gtgtcagttttctactgtaccgggt

SEQ ID NO: 516249 - DNA, 25 bp, Rattus norvegicus
gtgtcagttttctgttggttatgtc

SEQ ID NO: 516250 - DNA, 25 bp, Rattus norvegicus
gtgtcagttttgacagcaagcattt

SEQ ID NO: 516251 - DNA, 25 bp, Rattus norvegicus
gtgtcagttttgtcagcaagcattt

SEQ ID NO: 516252 - DNA, 25 bp, Rattus norvegicus
gtgtcataaacaccccacagtagaa

SEQ ID NO: 516253 - DNA, 25 bp, Rattus norvegicus
gtgtcataaacagcccacagtagaa

SEQ ID NO: 516254 - DNA, 25 bp, Rattus norvegicus
gtgtcataagttccagtctctctgt

SEQ ID NO: 516255 - DNA, 25 bp, Rattus norvegicus
gtgtcataagttgcagtctctctgt

SEQ ID NO: 516256 - DNA, 25 bp, Rattus norvegicus
gtgtcataattcctctactcagttc

SEQ ID NO: 516257 - DNA, 25 bp, Rattus norvegicus
gtgtcataattcgtctactcagttc

SEQ ID NO: 516258 - DNA, 25 bp, Rattus norvegicus
gtgtcatagcttcaactgggtcctg

SEQ ID NO: 516259 - DNA, 25 bp, Rattus norvegicus
gtgtcatagcttgaactgggtcctg

SEQ ID NO: 516260 - DNA, 25 bp, Rattus norvegicus
gtgtcatatccaagtgtgcccttag

SEQ ID NO: 516261 - DNA, 25 bp, Rattus norvegicus
gtgtcatatccatgtgtgcccttag

SEQ ID NO: 516262 - DNA, 25 bp, Rattus norvegicus
gtgtcatcacagatctccaaagagc

SEQ ID NO: 516263 - DNA, 25 bp, Rattus norvegicus
gtgtcatcacagttctccaaagagc

SEQ ID NO: 516264 - DNA, 25 bp, Rattus norvegicus
gtgtcatcagaaccagtcaccgtct

SEQ ID NO: 516265 - DNA, 25 bp, Rattus norvegicus
gtgtcatcagaagcagtcaccgtct

SEQ ID NO: 516266 - DNA, 25 bp, Rattus norvegicus
gtgtcatcccaacggagtcacacca

SEQ ID NO: 516267 - DNA, 25 bp, Rattus norvegicus
gtgtcatcccaagggagtcacacca

SEQ ID NO: 516268 - DNA, 25 bp, Rattus norvegicus
gtgtcatctgatccagcctatggca

SEQ ID NO: 516269 - DNA, 25 bp, Rattus norvegicus
gtgtcatctgatgcagcctatggca

SEQ ID NO: 516270 - DNA, 25 bp, Rattus norvegicus
gtgtcatctgcaatgctgttcagga

SEQ ID NO: 516271 - DNA, 25 bp, Rattus norvegicus
gtgtcatctgcattgctgttcagga

SEQ ID NO: 516272 - DNA, 25 bp, Rattus norvegicus
gtgtcatctgccctgctggttcctt

SEQ ID NO: 516273 - DNA, 25 bp, Rattus norvegicus
gtgtcatctgccgtgctggttcctt

SEQ ID NO: 516274 - DNA, 25 bp, Rattus norvegicus
gtgtcatctgctagtctctgagtgc

SEQ ID NO: 516275 - DNA, 25 bp, Rattus norvegicus
gtgtcatctgcttgtctctgagtgc

SEQ ID NO: 516276 - DNA, 25 bp, Rattus norvegicus
gtgtcatctggactgacattccctc

SEQ ID NO: 516277 - DNA, 25 bp, Rattus norvegicus
gtgtcatctggagtgacattccctc

SEQ ID NO: 516278 - DNA, 25 bp, Rattus norvegicus
gtgtcatctgtaacttgcactgtaa

SEQ ID NO: 516279 - DNA, 25 bp, Rattus norvegicus
gtgtcatctgtatcttgcactgtaa

SEQ ID NO: 516280 - DNA, 25 bp, Rattus norvegicus
gtgtcatcttctacctcagggacaa

SEQ ID NO: 516281 - DNA, 25 bp, Rattus norvegicus
gtgtcatcttcttcctcagggacaa

SEQ ID NO: 516282 - DNA, 25 bp, Rattus norvegicus
gtgtcatcttgcagttttggtacta

SEQ ID NO: 516283 - DNA, 25 bp, Rattus norvegicus
gtgtcatcttgctgttttggtacta

SEQ ID NO: 516284 - DNA, 25 bp, Rattus norvegicus
gtgtcatgaaacattcttgctttaa

SEQ ID NO: 516285 - DNA, 25 bp, Rattus norvegicus
gtgtcatgaaactttcttgctttaa

SEQ ID NO: 516286 - DNA, 25 bp, Rattus norvegicus
gtgtcatgaagcatattctacctgg

SEQ ID NO: 516287 - DNA, 25 bp, Rattus norvegicus
gtgtcatgaagcttattctacctgg

SEQ ID NO: 516288 - DNA, 25 bp, Rattus norvegicus
gtgtcatgactactactaactgtgg

SEQ ID NO: 516289 - DNA, 25 bp, Rattus norvegicus
gtgtcatgactagtactaactgtgg

SEQ ID NO: 516290 - DNA, 25 bp, Rattus norvegicus
gtgtcatgagaactttgctcctgga

SEQ ID NO: 516291 - DNA, 25 bp, Rattus norvegicus
gtgtcatgagaagtttgctcctgga

SEQ ID NO: 516292 - DNA, 25 bp, Rattus norvegicus
gtgtcatgatttctgtctgtaccag

SEQ ID NO: 516293 - DNA, 25 bp, Rattus norvegicus
gtgtcatgatttgtgtctgtaccag

SEQ ID NO: 516294 - DNA, 25 bp, Rattus norvegicus
gtgtcatgcatgacaggccccaagt

SEQ ID NO: 516295 - DNA, 25 bp, Rattus norvegicus
gtgtcatgcatgtcaggccccaagt

SEQ ID NO: 516296 - DNA, 25 bp, Rattus norvegicus
gtgtcatgctctccgttggtataat

SEQ ID NO: 516297 - DNA, 25 bp, Rattus norvegicus
gtgtcatgctctgcgttggtataat

SEQ ID NO: 516298 - DNA, 25 bp, Rattus norvegicus
gtgtcatggcatatcatttaccttg

SEQ ID NO: 516299 - DNA, 25 bp, Rattus norvegicus
gtgtcatggcatttcatttaccttg

SEQ ID NO: 516300 - DNA, 25 bp, Rattus norvegicus
gtgtcatggtgaacatgtggatgtc

SEQ ID NO: 516301 - DNA, 25 bp, Rattus norvegicus
gtgtcatggtgatcatgtggatgtc

SEQ ID NO: 516302 - DNA, 25 bp, Rattus norvegicus
gtgtcatggtgtcccatcgatctgg

SEQ ID NO: 516303 - DNA, 25 bp, Rattus norvegicus
gtgtcatggtgtgccatcgatctgg

SEQ ID NO: 516304 - DNA, 25 bp, Rattus norvegicus
gtgtcatggtttcagaatccccttt

SEQ ID NO: 516305 - DNA, 25 bp, Rattus norvegicus
gtgtcatggtttgagaatccccttt

SEQ ID NO: 516306 - DNA, 25 bp, Rattus norvegicus
gtgtcatgtaatactcttcagtgga

SEQ ID NO: 516307 - DNA, 25 bp, Rattus norvegicus
gtgtcatgtaattctcttcagtgga

SEQ ID NO: 516308 - DNA, 25 bp, Rattus norvegicus
gtgtcatgtgacatctctgggatac

SEQ ID NO: 516309 - DNA, 25 bp, Rattus norvegicus
gtgtcatgtgacttctctgggatac

SEQ ID NO: 516310 - DNA, 25 bp, Rattus norvegicus
gtgtcatgtggccatcaggaagtct

SEQ ID NO: 516311 - DNA, 25 bp, Rattus norvegicus
gtgtcatgtggcgatcaggaagtct

SEQ ID NO: 516312 - DNA, 25 bp, Rattus norvegicus
gtgtcatgtgtaatggtctgcgtat

SEQ ID NO: 516313 - DNA, 25 bp, Rattus norvegicus
gtgtcatgtgtattggtctgcgtat

SEQ ID NO: 516314 - DNA, 25 bp, Rattus norvegicus
gtgtcattcattcgagaccacccac

SEQ ID NO: 516315 - DNA, 25 bp, Rattus norvegicus
gtgtcattcattggagaccacccac

SEQ ID NO: 516316 - DNA, 25 bp, Rattus norvegicus
gtgtcattgcaaccctctgagctga

SEQ ID NO: 516317 - DNA, 25 bp, Rattus norvegicus
gtgtcattgcaagcctctgagctga

SEQ ID NO: 516318 - DNA, 25 bp, Rattus norvegicus
gtgtcattgccaaccagcagcaggt

SEQ ID NO: 516319 - DNA, 25 bp, Rattus norvegicus
gtgtcattgccatccagcagcaggt

SEQ ID NO: 516320 - DNA, 25 bp, Rattus norvegicus
gtgtcattggttcattttctggcta

SEQ ID NO: 516321 - DNA, 25 bp, Rattus norvegicus
gtgtcattggttgattttctggcta

SEQ ID NO: 516322 - DNA, 25 bp, Rattus norvegicus
gtgtcattgtccacacttgggagga

SEQ ID NO: 516323 - DNA, 25 bp, Rattus norvegicus
gtgtcattgtcctcacttgggagga

SEQ ID NO: 516324 - DNA, 25 bp, Rattus norvegicus
gtgtcatttccgctcagacagctga

SEQ ID NO: 516325 - DNA, 25 bp, Rattus norvegicus
gtgtcatttccggtcagacagctga

SEQ ID NO: 516326 - DNA, 25 bp, Rattus norvegicus
gtgtcatttcctcctgcagattctg

SEQ ID NO: 516327 - DNA, 25 bp, Rattus norvegicus
gtgtcatttcctgctgcagattctg

SEQ ID NO: 516328 - DNA, 25 bp, Rattus norvegicus
gtgtcatttgacacctctgagtcac

SEQ ID NO: 516329 - DNA, 25 bp, Rattus norvegicus
gtgtcatttgactcctctgagtcac

SEQ ID NO: 516330 - DNA, 25 bp, Rattus norvegicus
gtgtcatttgcaacccagatgtaaa

SEQ ID NO: 516331 - DNA, 25 bp, Rattus norvegicus
gtgtcatttgcacatagacccaaga

SEQ ID NO: 516332 - DNA, 25 bp, Rattus norvegicus
gtgtcatttgcagatagacccaaga

SEQ ID NO: 516333 - DNA, 25 bp, Rattus norvegicus
gtgtcatttgcatcccagatgtaaa

SEQ ID NO: 516334 - DNA, 25 bp, Rattus norvegicus
gtgtcatttgtaaaactctaaacgc

SEQ ID NO: 516335 - DNA, 25 bp, Rattus norvegicus
gtgtcatttgtataactctaaacgc

SEQ ID NO: 516336 - DNA, 25 bp, Rattus norvegicus
gtgtcattttcgatcaactgtgtca

SEQ ID NO: 516337 - DNA, 25 bp, Rattus norvegicus
gtgtcattttcgttcaactgtgtca

SEQ ID NO: 516338 - DNA, 25 bp, Rattus norvegicus
gtgtcattttgcacatagctttatc

SEQ ID NO: 516339 - DNA, 25 bp, Rattus norvegicus
gtgtcattttgctcatagctttatc

SEQ ID NO: 516340 - DNA, 25 bp, Rattus norvegicus
gtgtcattttgtctaagactgtcta

SEQ ID NO: 516341 - DNA, 25 bp, Rattus norvegicus
gtgtcattttgtgtaagactgtcta

SEQ ID NO: 516342 - DNA, 25 bp, Rattus norvegicus
gtgtcatttttcaactgcgcagggc

SEQ ID NO: 516343 - DNA, 25 bp, Rattus norvegicus
gtgtcatttttctactgcgcagggc

SEQ ID NO: 516344 - DNA, 25 bp, Rattus norvegicus
gtgtccaaacttctgcagtggccaa

SEQ ID NO: 516345 - DNA, 25 bp, Rattus norvegicus
gtgtccaaacttgtgcagtggccaa

SEQ ID NO: 516346 - DNA, 25 bp, Rattus norvegicus
gtgtccaaatggatcagccttgctg

SEQ ID NO: 516347 - DNA, 25 bp, Rattus norvegicus
gtgtccaaatggttcagccttgctg

SEQ ID NO: 516348 - DNA, 25 bp, Rattus norvegicus
gtgtccaacattattgatgaccctc

SEQ ID NO: 516349 - DNA, 25 bp, Rattus norvegicus
gtgtccaacatttttgatgaccctc

SEQ ID NO: 516350 - DNA, 25 bp, Rattus norvegicus
gtgtccaacctgaagatgggtcaca

SEQ ID NO: 516351 - DNA, 25 bp, Rattus norvegicus
gtgtccaacctgtagatgggtcaca

SEQ ID NO: 516352 - DNA, 25 bp, Rattus norvegicus
gtgtccaagacaaagtactgcctcc

SEQ ID NO: 516353 - DNA, 25 bp, Rattus norvegicus
gtgtccaagacacaagctgaggttt

SEQ ID NO: 516354 - DNA, 25 bp, Rattus norvegicus
gtgtccaagacagaagctgaggttt

SEQ ID NO: 516355 - DNA, 25 bp, Rattus norvegicus
gtgtccaagacatagtactgcctcc

SEQ ID NO: 516356 - DNA, 25 bp, Rattus norvegicus
gtgtccaaggaaaagctattatatt

SEQ ID NO: 516357 - DNA, 25 bp, Rattus norvegicus
gtgtccaaggaatagctattatatt

SEQ ID NO: 516358 - DNA, 25 bp, Rattus norvegicus
gtgtccaagggtacccaccaggcag

SEQ ID NO: 516359 - DNA, 25 bp, Rattus norvegicus
gtgtccaagggttcccaccaggcag

SEQ ID NO: 516360 - DNA, 25 bp, Rattus norvegicus
gtgtccaagtggatgcctttcaaag

SEQ ID NO: 516361 - DNA, 25 bp, Rattus norvegicus
gtgtccaagtggttgcctttcaaag

SEQ ID NO: 516362 - DNA, 25 bp, Rattus norvegicus
gtgtccaagttcatggttcctctgt

SEQ ID NO: 516363 - DNA, 25 bp, Rattus norvegicus
gtgtccaagttcttggttcctctgt

SEQ ID NO: 516364 - DNA, 25 bp, Rattus norvegicus
gtgtccaataaaccgagtcccagat

SEQ ID NO: 516365 - DNA, 25 bp, Rattus norvegicus
gtgtccaataaagcgagtcccagat

SEQ ID NO: 516366 - DNA, 25 bp, Rattus norvegicus
gtgtccaatcctaagcactacaaaa

SEQ ID NO: 516367 - DNA, 25 bp, Rattus norvegicus
gtgtccaatccttagcactacaaaa

SEQ ID NO: 516368 - DNA, 25 bp, Rattus norvegicus
gtgtccaatgacaagggctgttttc

SEQ ID NO: 516369 - DNA, 25 bp, Rattus norvegicus
gtgtccaatgactagggctgttttc

SEQ ID NO: 516370 - DNA, 25 bp, Rattus norvegicus
gtgtccaatggaacttcctagtgaa

SEQ ID NO: 516371 - DNA, 25 bp, Rattus norvegicus
gtgtccaatggatcttcctagtgaa

SEQ ID NO: 516372 - DNA, 25 bp, Rattus norvegicus
gtgtccacactaactgtatggccag

SEQ ID NO: 516373 - DNA, 25 bp, Rattus norvegicus
gtgtccacactatctgtatggccag

SEQ ID NO: 516374 - DNA, 25 bp, Rattus norvegicus
gtgtccacagacattcaccaatagg

SEQ ID NO: 516375 - DNA, 25 bp, Rattus norvegicus
gtgtccacagaccattcagagcaag

SEQ ID NO: 516376 - DNA, 25 bp, Rattus norvegicus
gtgtccacagacgattcagagcaag

SEQ ID NO: 516377 - DNA, 25 bp, Rattus norvegicus
gtgtccacagactttcaccaatagg

SEQ ID NO: 516378 - DNA, 25 bp, Rattus norvegicus
gtgtccacagttactggaggtccaa

SEQ ID NO: 516379 - DNA, 25 bp, Rattus norvegicus
gtgtccacagtttctggaggtccaa

SEQ ID NO: 516380 - DNA, 25 bp, Rattus norvegicus
gtgtccacatcactggttgttgcag

SEQ ID NO: 516381 - DNA, 25 bp, Rattus norvegicus
gtgtccacatcagtggttgttgcag

SEQ ID NO: 516382 - DNA, 25 bp, Rattus norvegicus
gtgtccacatcgaaccaaagactga

SEQ ID NO: 516383 - DNA, 25 bp, Rattus norvegicus
gtgtccacatcgtaccaaagactga

SEQ ID NO: 516384 - DNA, 25 bp, Rattus norvegicus
gtgtccaccctgatctgctgtagtg

SEQ ID NO: 516385 - DNA, 25 bp, Rattus norvegicus
gtgtccaccctgttctgctgtagtg

SEQ ID NO: 516386 - DNA, 25 bp, Rattus norvegicus
gtgtccacgctcacagacaaagaag

SEQ ID NO: 516387 - DNA, 25 bp, Rattus norvegicus
gtgtccacgctctcagacaaagaag

SEQ ID NO: 516388 - DNA, 25 bp, Rattus norvegicus
gtgtccacgtgccagtaatagattt

SEQ ID NO: 516389 - DNA, 25 bp, Rattus norvegicus
gtgtccacgtgcgagtaatagattt

SEQ ID NO: 516390 - DNA, 25 bp, Rattus norvegicus
gtgtccactagaattgactgttctt

SEQ ID NO: 516391 - DNA, 25 bp, Rattus norvegicus
gtgtccactagatttgactgttctt

SEQ ID NO: 516392 - DNA, 25 bp, Rattus norvegicus
gtgtccactggacaagcacataata

SEQ ID NO: 516393 - DNA, 25 bp, Rattus norvegicus
gtgtccactggagaagcacataata

SEQ ID NO: 516394 - DNA, 25 bp, Rattus norvegicus
gtgtccacttataattgcattgctg

SEQ ID NO: 516395 - DNA, 25 bp, Rattus norvegicus
gtgtccacttattattgcattgctg

SEQ ID NO: 516396 - DNA, 25 bp, Rattus norvegicus
gtgtccacttggatttctattccag

SEQ ID NO: 516397 - DNA, 25 bp, Rattus norvegicus
gtgtccacttggttttctattccag

SEQ ID NO: 516398 - DNA, 25 bp, Rattus norvegicus
gtgtccagaaatccaggcgttccca

SEQ ID NO: 516399 - DNA, 25 bp, Rattus norvegicus
gtgtccagaaatgcaggcgttccca

SEQ ID NO: 516400 - DNA, 25 bp, Rattus norvegicus
gtgtccagacccagtattgcagtgc

SEQ ID NO: 516401 - DNA, 25 bp, Rattus norvegicus
gtgtccagaccctgtattgcagtgc

SEQ ID NO: 516402 - DNA, 25 bp, Rattus norvegicus
gtgtccagacgtcaaccatctatgg

SEQ ID NO: 516403 - DNA, 25 bp, Rattus norvegicus
gtgtccagacgtgaaccatctatgg

SEQ ID NO: 516404 - DNA, 25 bp, Rattus norvegicus
gtgtccagactcatacaactgtaca

SEQ ID NO: 516405 - DNA, 25 bp, Rattus norvegicus
gtgtccagactcttacaactgtaca

SEQ ID NO: 516406 - DNA, 25 bp, Rattus norvegicus
gtgtccagagatcacagaccaggcc

SEQ ID NO: 516407 - DNA, 25 bp, Rattus norvegicus
gtgtccagagatgacagaccaggcc

SEQ ID NO: 516408 - DNA, 25 bp, Rattus norvegicus
gtgtccagaggaatctattttttaa

SEQ ID NO: 516409 - DNA, 25 bp, Rattus norvegicus
gtgtccagaggacctttggtccagt

SEQ ID NO: 516410 - DNA, 25 bp, Rattus norvegicus
gtgtccagaggagctttggtccagt

SEQ ID NO: 516411 - DNA, 25 bp, Rattus norvegicus
gtgtccagaggattctattttttaa

SEQ ID NO: 516412 - DNA, 25 bp, Rattus norvegicus
gtgtccagcaataagcgggcttcta

SEQ ID NO: 516413 - DNA, 25 bp, Rattus norvegicus
gtgtccagcaattagcgggcttcta

SEQ ID NO: 516414 - DNA, 25 bp, Rattus norvegicus
gtgtccagcacacaatcatccttgg

SEQ ID NO: 516415 - DNA, 25 bp, Rattus norvegicus
gtgtccagcacagaatcatccttgg

SEQ ID NO: 516416 - DNA, 25 bp, Rattus norvegicus
gtgtccagccggctatcattgaaga

SEQ ID NO: 516417 - DNA, 25 bp, Rattus norvegicus
gtgtccagccgggtatcattgaaga

SEQ ID NO: 516418 - DNA, 25 bp, Rattus norvegicus
gtgtccagctaaattgatctttttt

SEQ ID NO: 516419 - DNA, 25 bp, Rattus norvegicus
gtgtccagctaatttgatctttttt

SEQ ID NO: 516420 - DNA, 25 bp, Rattus norvegicus
gtgtccagctggagttaagcctatt

SEQ ID NO: 516421 - DNA, 25 bp, Rattus norvegicus
gtgtccagctggtgttaagcctatt

SEQ ID NO: 516422 - DNA, 25 bp, Rattus norvegicus
gtgtccagctgtcacagaacctggg

SEQ ID NO: 516423 - DNA, 25 bp, Rattus norvegicus
gtgtccagctgtgacagaacctggg

SEQ ID NO: 516424 - DNA, 25 bp, Rattus norvegicus
gtgtccagctttctagcctatcaga

SEQ ID NO: 516425 - DNA, 25 bp, Rattus norvegicus
gtgtccagctttgtagcctatcaga

SEQ ID NO: 516426 - DNA, 25 bp, Rattus norvegicus
gtgtccaggaccactaccctgagga

SEQ ID NO: 516427 - DNA, 25 bp, Rattus norvegicus
gtgtccaggacctctaccctgagga

SEQ ID NO: 516428 - DNA, 25 bp, Rattus norvegicus
gtgtccagggctatagggtgacctt

SEQ ID NO: 516429 - DNA, 25 bp, Rattus norvegicus
gtgtccagggctttagggtgacctt

SEQ ID NO: 516430 - DNA, 25 bp, Rattus norvegicus
gtgtccagtaggatggccaagcaca

SEQ ID NO: 516431 - DNA, 25 bp, Rattus norvegicus
gtgtccagtaggttggccaagcaca

SEQ ID NO: 516432 - DNA, 25 bp, Rattus norvegicus
gtgtccagtcccaaactgactgttg

SEQ ID NO: 516433 - DNA, 25 bp, Rattus norvegicus
gtgtccagtccctaactgactgttg

SEQ ID NO: 516434 - DNA, 25 bp, Rattus norvegicus
gtgtccagtgaactggaggttctca

SEQ ID NO: 516435 - DNA, 25 bp, Rattus norvegicus
gtgtccagtgaagtggaggttctca

SEQ ID NO: 516436 - DNA, 25 bp, Rattus norvegicus
gtgtccagtgaccagagctcttcag

SEQ ID NO: 516437 - DNA, 25 bp, Rattus norvegicus
gtgtccagtgacgagagctcttcag

SEQ ID NO: 516438 - DNA, 25 bp, Rattus norvegicus
gtgtccagtgatcctcaatttctaa

SEQ ID NO: 516439 - DNA, 25 bp, Rattus norvegicus
gtgtccagtgatgctcaatttctaa

SEQ ID NO: 516440 - DNA, 25 bp, Rattus norvegicus
gtgtccagtgccacttaagctagta

SEQ ID NO: 516441 - DNA, 25 bp, Rattus norvegicus
gtgtccagtgcctcttaagctagta

SEQ ID NO: 516442 - DNA, 25 bp, Rattus norvegicus
gtgtccagtgctccaattaatcatc

SEQ ID NO: 516443 - DNA, 25 bp, Rattus norvegicus
gtgtccagtgctgcaattaatcatc

SEQ ID NO: 516444 - DNA, 25 bp, Rattus norvegicus
gtgtccagttggaaatcccaggcat

SEQ ID NO: 516445 - DNA, 25 bp, Rattus norvegicus
gtgtccagttggtaatcccaggcat

SEQ ID NO: 516446 - DNA, 25 bp, Rattus norvegicus
gtgtccatatgtctcagctttcaaa

SEQ ID NO: 516447 - DNA, 25 bp, Rattus norvegicus
gtgtccatatgtgtcagctttcaaa

SEQ ID NO: 516448 - DNA, 25 bp, Rattus norvegicus
gtgtccatcacactcaactgatatt

SEQ ID NO: 516449 - DNA, 25 bp, Rattus norvegicus
gtgtccatcacagtcaactgatatt

SEQ ID NO: 516450 - DNA, 25 bp, Rattus norvegicus
gtgtccatcactccctcagatgagt

SEQ ID NO: 516451 - DNA, 25 bp, Rattus norvegicus
gtgtccatcactgcctcagatgagt

SEQ ID NO: 516452 - DNA, 25 bp, Rattus norvegicus
gtgtccatcataaccttgccaagaa

SEQ ID NO: 516453 - DNA, 25 bp, Rattus norvegicus
gtgtccatcatatccttgccaagaa

SEQ ID NO: 516454 - DNA, 25 bp, Rattus norvegicus
gtgtccatcctaaagccttcttaag

SEQ ID NO: 516455 - DNA, 25 bp, Rattus norvegicus
gtgtccatcctatagccttcttaag

SEQ ID NO: 516456 - DNA, 25 bp, Rattus norvegicus
gtgtccatctcaagtttgacctgaa

SEQ ID NO: 516457 - DNA, 25 bp, Rattus norvegicus
gtgtccatctcatgtttgacctgaa

SEQ ID NO: 516458 - DNA, 25 bp, Rattus norvegicus
gtgtccatctctacatttccttaaa

SEQ ID NO: 516459 - DNA, 25 bp, Rattus norvegicus
gtgtccatctcttcatttccttaaa

SEQ ID NO: 516460 - DNA, 25 bp, Rattus norvegicus
gtgtccatctttcgtaatgctagta

SEQ ID NO: 516461 - DNA, 25 bp, Rattus norvegicus
gtgtccatctttggtaatgctagta

SEQ ID NO: 516462 - DNA, 25 bp, Rattus norvegicus
gtgtccatggctccaatggcattga

SEQ ID NO: 516463 - DNA, 25 bp, Rattus norvegicus
gtgtccatggctgcaatggcattga

SEQ ID NO: 516464 - DNA, 25 bp, Rattus norvegicus
gtgtccatgggcattatagcgcttt

SEQ ID NO: 516465 - DNA, 25 bp, Rattus norvegicus
gtgtccatgggctttatagcgcttt

SEQ ID NO: 516466 - DNA, 25 bp, Rattus norvegicus
gtgtccatgtggctttgccgagctc

SEQ ID NO: 516467 - DNA, 25 bp, Rattus norvegicus
gtgtccatgtgggtttgccgagctc

SEQ ID NO: 516468 - DNA, 25 bp, Rattus norvegicus
gtgtccatgttacggcacacaaaca

SEQ ID NO: 516469 - DNA, 25 bp, Rattus norvegicus
gtgtccatgttagggcacacaaaca

SEQ ID NO: 516470 - DNA, 25 bp, Rattus norvegicus
gtgtccatgttcagctgatcccaca

SEQ ID NO: 516471 - DNA, 25 bp, Rattus norvegicus
gtgtccatgttctgctgatcccaca

SEQ ID NO: 516472 - DNA, 25 bp, Rattus norvegicus
gtgtccattaagagccatgtagttt

SEQ ID NO: 516473 - DNA, 25 bp, Rattus norvegicus
gtgtccattaagtgccatgtagttt

SEQ ID NO: 516474 - DNA, 25 bp, Rattus norvegicus
gtgtccattaccagtacctcaagga

SEQ ID NO: 516475 - DNA, 25 bp, Rattus norvegicus
gtgtccattacctgtacctcaagga

SEQ ID NO: 516476 - DNA, 25 bp, Rattus norvegicus
gtgtccattgaacaaagtggttttg

SEQ ID NO: 516477 - DNA, 25 bp, Rattus norvegicus
gtgtccattgaagaaagtggttttg

SEQ ID NO: 516478 - DNA, 25 bp, Rattus norvegicus
gtgtccatttccacagtggatttgt

SEQ ID NO: 516479 - DNA, 25 bp, Rattus norvegicus
gtgtccatttcctcagtggatttgt

SEQ ID NO: 516480 - DNA, 25 bp, Rattus norvegicus
gtgtcccaaatacgtgacccgcaga

SEQ ID NO: 516481 - DNA, 25 bp, Rattus norvegicus
gtgtcccaaataggtgacccgcaga

SEQ ID NO: 516482 - DNA, 25 bp, Rattus norvegicus
gtgtcccaacaccagtcagtggttg

SEQ ID NO: 516483 - DNA, 25 bp, Rattus norvegicus
gtgtcccaacacgagtcagtggttg

SEQ ID NO: 516484 - DNA, 25 bp, Rattus norvegicus
gtgtcccaagaaaccaaatcgagtc

SEQ ID NO: 516485 - DNA, 25 bp, Rattus norvegicus
gtgtcccaagaatccaaatcgagtc

SEQ ID NO: 516486 - DNA, 25 bp, Rattus norvegicus
gtgtcccaatcaagtacctttctaa

SEQ ID NO: 516487 - DNA, 25 bp, Rattus norvegicus
gtgtcccaatcatgtacctttctaa

SEQ ID NO: 516488 - DNA, 25 bp, Rattus norvegicus
gtgtcccacagcaaaatgtagttca

SEQ ID NO: 516489 - DNA, 25 bp, Rattus norvegicus
gtgtcccacagctaaatgtagttca

SEQ ID NO: 516490 - DNA, 25 bp, Rattus norvegicus
gtgtcccacgtgaaagaggcgcagt

SEQ ID NO: 516491 - DNA, 25 bp, Rattus norvegicus
gtgtcccacgtgtaagaggcgcagt

SEQ ID NO: 516492 - DNA, 25 bp, Rattus norvegicus
gtgtcccaggagaggactctctgct

SEQ ID NO: 516493 - DNA, 25 bp, Rattus norvegicus
gtgtcccaggagagtttgacctcat

SEQ ID NO: 516494 - DNA, 25 bp, Rattus norvegicus
gtgtcccaggagtggactctctgct

SEQ ID NO: 516495 - DNA, 25 bp, Rattus norvegicus
gtgtcccaggagtgtttgacctcat

SEQ ID NO: 516496 - DNA, 25 bp, Rattus norvegicus
gtgtcccaggcacccctagatatgt

SEQ ID NO: 516497 - DNA, 25 bp, Rattus norvegicus
gtgtcccaggcagccctagatatgt

SEQ ID NO: 516498 - DNA, 25 bp, Rattus norvegicus
gtgtcccataatataatttgctgta

SEQ ID NO: 516499 - DNA, 25 bp, Rattus norvegicus
gtgtcccataatttaatttgctgta

SEQ ID NO: 516500 - DNA, 25 bp, Rattus norvegicus
gtgtcccatcaaatctgtttcgttg

SEQ ID NO: 516501 - DNA, 25 bp, Rattus norvegicus
gtgtcccatcaattctgtttcgttg

SEQ ID NO: 516502 - DNA, 25 bp, Rattus norvegicus
gtgtcccattggcatcatctttatt

SEQ ID NO: 516503 - DNA, 25 bp, Rattus norvegicus
gtgtcccattgggatcatctttatt

SEQ ID NO: 516504 - DNA, 25 bp, Rattus norvegicus
gtgtcccatttcacttttgctttgt

SEQ ID NO: 516505 - DNA, 25 bp, Rattus norvegicus
gtgtcccatttctcttttgctttgt

SEQ ID NO: 516506 - DNA, 25 bp, Rattus norvegicus
gtgtccccaaagatatccctaaaga

SEQ ID NO: 516507 - DNA, 25 bp, Rattus norvegicus
gtgtccccaaagttatccctaaaga

SEQ ID NO: 516508 - DNA, 25 bp, Rattus norvegicus
gtgtccccacatcttgtgaactcta

SEQ ID NO: 516509 - DNA, 25 bp, Rattus norvegicus
gtgtccccacatgttgtgaactcta

SEQ ID NO: 516510 - DNA, 25 bp, Rattus norvegicus
gtgtccccagagctttacagagcca

SEQ ID NO: 516511 - DNA, 25 bp, Rattus norvegicus
gtgtccccagaggtttacagagcca

SEQ ID NO: 516512 - DNA, 25 bp, Rattus norvegicus
gtgtccccagggataaaggtcacat

SEQ ID NO: 516513 - DNA, 25 bp, Rattus norvegicus
gtgtccccagggttaaaggtcacat

SEQ ID NO: 516514 - DNA, 25 bp, Rattus norvegicus
gtgtccccataactacagctctagg

SEQ ID NO: 516515 - DNA, 25 bp, Rattus norvegicus
gtgtccccataagtacagctctagg

SEQ ID NO: 516516 - DNA, 25 bp, Rattus norvegicus
gtgtccccatctctcacaaattatg

SEQ ID NO: 516517 - DNA, 25 bp, Rattus norvegicus
gtgtccccatctgtcacaaattatg

SEQ ID NO: 516518 - DNA, 25 bp, Rattus norvegicus
gtgtccccgaatagcgctttctggc

SEQ ID NO: 516519 - DNA, 25 bp, Rattus norvegicus
gtgtccccgaattgcgctttctggc

SEQ ID NO: 516520 - DNA, 25 bp, Rattus norvegicus
gtgtccccgagcaggcctaggccgg

SEQ ID NO: 516521 - DNA, 25 bp, Rattus norvegicus
gtgtccccgagctggcctaggccgg

SEQ ID NO: 516522 - DNA, 25 bp, Rattus norvegicus
gtgtccccgattccaagagcagctg

SEQ ID NO: 516523 - DNA, 25 bp, Rattus norvegicus
gtgtccccgattgcaagagcagctg

SEQ ID NO: 516524 - DNA, 25 bp, Rattus norvegicus
gtgtcccctctgagagtttatgata

SEQ ID NO: 516525 - DNA, 25 bp, Rattus norvegicus
gtgtcccctctgtgagtttatgata

SEQ ID NO: 516526 - DNA, 25 bp, Rattus norvegicus
gtgtcccctgaacatatgattcttt

SEQ ID NO: 516527 - DNA, 25 bp, Rattus norvegicus
gtgtcccctgaagatatgattcttt

SEQ ID NO: 516528 - DNA, 25 bp, Rattus norvegicus
gtgtcccctgacatcagaacatatg

SEQ ID NO: 516529 - DNA, 25 bp, Rattus norvegicus
gtgtcccctgacttcagaacatatg

SEQ ID NO: 516530 - DNA, 25 bp, Rattus norvegicus
gtgtcccctgtaaccttgtgagtat

SEQ ID NO: 516531 - DNA, 25 bp, Rattus norvegicus
gtgtcccctgtatccttgtgagtat

SEQ ID NO: 516532 - DNA, 25 bp, Rattus norvegicus
gtgtccccttctcactaggctgtca

SEQ ID NO: 516533 - DNA, 25 bp, Rattus norvegicus
gtgtccccttctgactaggctgtca

SEQ ID NO: 516534 - DNA, 25 bp, Rattus norvegicus
gtgtccccttgaccaataaacatgt

SEQ ID NO: 516535 - DNA, 25 bp, Rattus norvegicus
gtgtccccttgagcaataaacatgt

SEQ ID NO: 516536 - DNA, 25 bp, Rattus norvegicus
gtgtcccgaagcaggtgtctgaata

SEQ ID NO: 516537 - DNA, 25 bp, Rattus norvegicus
gtgtcccgaagctggtgtctgaata

SEQ ID NO: 516538 - DNA, 25 bp, Rattus norvegicus
gtgtcccgaattcctgtaaatatat

SEQ ID NO: 516539 - DNA, 25 bp, Rattus norvegicus
gtgtcccgaattgctgtaaatatat

SEQ ID NO: 516540 - DNA, 25 bp, Rattus norvegicus
gtgtcccgatataagtgttccgtac

SEQ ID NO: 516541 - DNA, 25 bp, Rattus norvegicus
gtgtcccgatattagtgttccgtac

SEQ ID NO: 516542 - DNA, 25 bp, Rattus norvegicus
gtgtcccggagaagctggtctgata

SEQ ID NO: 516543 - DNA, 25 bp, Rattus norvegicus
gtgtcccggagatgctggtctgata

SEQ ID NO: 516544 - DNA, 25 bp, Rattus norvegicus
gtgtcccggttgctgagcccactga

SEQ ID NO: 516545 - DNA, 25 bp, Rattus norvegicus
gtgtcccggttggtgagcccactga

SEQ ID NO: 516546 - DNA, 25 bp, Rattus norvegicus
gtgtcccgtagacaacaactgtcaa

SEQ ID NO: 516547 - DNA, 25 bp, Rattus norvegicus
gtgtcccgtagagaacaactgtcaa

SEQ ID NO: 516548 - DNA, 25 bp, Rattus norvegicus
gtgtcccgtgaactgtgagtactgc

SEQ ID NO: 516549 - DNA, 25 bp, Rattus norvegicus
gtgtcccgtgaagtgtgagtactgc

SEQ ID NO: 516550 - DNA, 25 bp, Rattus norvegicus
gtgtccctagaacattcctgtggtg

SEQ ID NO: 516551 - DNA, 25 bp, Rattus norvegicus
gtgtccctagaagattcctgtggtg

SEQ ID NO: 516552 - DNA, 25 bp, Rattus norvegicus
gtgtccctaggcatggcagttgaga

SEQ ID NO: 516553 - DNA, 25 bp, Rattus norvegicus
gtgtccctaggcttggcagttgaga

SEQ ID NO: 516554 - DNA, 25 bp, Rattus norvegicus
gtgtccctatggaaggtcccactga

SEQ ID NO: 516555 - DNA, 25 bp, Rattus norvegicus
gtgtccctatggtaggtcccactga

SEQ ID NO: 516556 - DNA, 25 bp, Rattus norvegicus
gtgtccctattcagcattgtttaca

SEQ ID NO: 516557 - DNA, 25 bp, Rattus norvegicus
gtgtccctattctgcattgtttaca

SEQ ID NO: 516558 - DNA, 25 bp, Rattus norvegicus
gtgtccctcacacagaatcgataga

SEQ ID NO: 516559 - DNA, 25 bp, Rattus norvegicus
gtgtccctcacagagaatcgataga

SEQ ID NO: 516560 - DNA, 25 bp, Rattus norvegicus
gtgtccctcagaacactcattagac

SEQ ID NO: 516561 - DNA, 25 bp, Rattus norvegicus
gtgtccctcagatcactcattagac

SEQ ID NO: 516562 - DNA, 25 bp, Rattus norvegicus
gtgtccctcagcatttgattacttg

SEQ ID NO: 516563 - DNA, 25 bp, Rattus norvegicus
gtgtccctcagcttttgattacttg

SEQ ID NO: 516564 - DNA, 25 bp, Rattus norvegicus
gtgtccctccagctgtttctagtta

SEQ ID NO: 516565 - DNA, 25 bp, Rattus norvegicus
gtgtccctccaggtgtttctagtta

SEQ ID NO: 516566 - DNA, 25 bp, Rattus norvegicus
gtgtccctccatatgaaggctgtgg

SEQ ID NO: 516567 - DNA, 25 bp, Rattus norvegicus
gtgtccctccatttgaaggctgtgg

SEQ ID NO: 516568 - DNA, 25 bp, Rattus norvegicus
gtgtccctcctgcttctggagacgt

SEQ ID NO: 516569 - DNA, 25 bp, Rattus norvegicus
gtgtccctcctggttctggagacgt

SEQ ID NO: 516570 - DNA, 25 bp, Rattus norvegicus
gtgtccctcgatagacaatagcatt

SEQ ID NO: 516571 - DNA, 25 bp, Rattus norvegicus
gtgtccctcgattgacaatagcatt

SEQ ID NO: 516572 - DNA, 25 bp, Rattus norvegicus
gtgtccctcgcgagaggaacacgat

SEQ ID NO: 516573 - DNA, 25 bp, Rattus norvegicus
gtgtccctcgcgtgaggaacacgat

SEQ ID NO: 516574 - DNA, 25 bp, Rattus norvegicus
gtgtccctcggcaccttttgtggca

SEQ ID NO: 516575 - DNA, 25 bp, Rattus norvegicus
gtgtccctcggctccttttgtggca

SEQ ID NO: 516576 - DNA, 25 bp, Rattus norvegicus
gtgtccctctacaggaaggcaggca

SEQ ID NO: 516577 - DNA, 25 bp, Rattus norvegicus
gtgtccctctacctctactgtagaa

SEQ ID NO: 516578 - DNA, 25 bp, Rattus norvegicus
gtgtccctctacgtctactgtagaa

SEQ ID NO: 516579 - DNA, 25 bp, Rattus norvegicus
gtgtccctctactggaaggcaggca

SEQ ID NO: 516580 - DNA, 25 bp, Rattus norvegicus
gtgtccctcttaaactgtctagtgg

SEQ ID NO: 516581 - DNA, 25 bp, Rattus norvegicus
gtgtccctcttatactgtctagtgg

SEQ ID NO: 516582 - DNA, 25 bp, Rattus norvegicus
gtgtccctgcaaccaaatctaacaa

SEQ ID NO: 516583 - DNA, 25 bp, Rattus norvegicus
gtgtccctgcaactcaggaggagtt

SEQ ID NO: 516584 - DNA, 25 bp, Rattus norvegicus
gtgtccctgcaagcaaatctaacaa

SEQ ID NO: 516585 - DNA, 25 bp, Rattus norvegicus
gtgtccctgcaagtcaggaggagtt

SEQ ID NO: 516586 - DNA, 25 bp, Rattus norvegicus
gtgtccctgctcactgattttgtaa

SEQ ID NO: 516587 - DNA, 25 bp, Rattus norvegicus
gtgtccctgctctctgattttgtaa

SEQ ID NO: 516588 - DNA, 25 bp, Rattus norvegicus
gtgtccctgctgctctagaaagcaa

SEQ ID NO: 516589 - DNA, 25 bp, Rattus norvegicus
gtgtccctgctggtctagaaagcaa

SEQ ID NO: 516590 - DNA, 25 bp, Rattus norvegicus
gtgtccctggctacagaaaacctag

SEQ ID NO: 516591 - DNA, 25 bp, Rattus norvegicus
gtgtccctggcttcagaaaacctag

SEQ ID NO: 516592 - DNA, 25 bp, Rattus norvegicus
gtgtccctgggaaacaaccaacttg

SEQ ID NO: 516593 - DNA, 25 bp, Rattus norvegicus
gtgtccctgggatacaaccaacttg

SEQ ID NO: 516594 - DNA, 25 bp, Rattus norvegicus
gtgtccctgtccctagtctaaaaag

SEQ ID NO: 516595 - DNA, 25 bp, Rattus norvegicus
gtgtccctgtccgtagtctaaaaag

SEQ ID NO: 516596 - DNA, 25 bp, Rattus norvegicus
gtgtcccttaagagttggtagctgt

SEQ ID NO: 516597 - DNA, 25 bp, Rattus norvegicus
gtgtcccttaagtgttggtagctgt

SEQ ID NO: 516598 - DNA, 25 bp, Rattus norvegicus
gtgtcccttgctcctcataaagtta

SEQ ID NO: 516599 - DNA, 25 bp, Rattus norvegicus
gtgtcccttgctgctcataaagtta

SEQ ID NO: 516600 - DNA, 25 bp, Rattus norvegicus
gtgtccctttgcctcatgtaggaag

SEQ ID NO: 516601 - DNA, 25 bp, Rattus norvegicus
gtgtccctttgcgtcatgtaggaag

SEQ ID NO: 516602 - DNA, 25 bp, Rattus norvegicus
gtgtccgaatggatatgttcagtgt

SEQ ID NO: 516603 - DNA, 25 bp, Rattus norvegicus
gtgtccgaatggttatgttcagtgt

SEQ ID NO: 516604 - DNA, 25 bp, Rattus norvegicus
gtgtccgagaccaatgataccagag

SEQ ID NO: 516605 - DNA, 25 bp, Rattus norvegicus
gtgtccgagacctatgataccagag

SEQ ID NO: 516606 - DNA, 25 bp, Rattus norvegicus
gtgtccgagctgatcagtttgttac

SEQ ID NO: 516607 - DNA, 25 bp, Rattus norvegicus
gtgtccgagctgttcagtttgttac

SEQ ID NO: 516608 - DNA, 25 bp, Rattus norvegicus
gtgtccgataccaaaatgcttcagt

SEQ ID NO: 516609 - DNA, 25 bp, Rattus norvegicus
gtgtccgatacctaaatgcttcagt

SEQ ID NO: 516610 - DNA, 25 bp, Rattus norvegicus
gtgtccgctattaggttaaacctga

SEQ ID NO: 516611 - DNA, 25 bp, Rattus norvegicus
gtgtccgctatttggttaaacctga

SEQ ID NO: 516612 - DNA, 25 bp, Rattus norvegicus
gtgtccgctctcatttggaaattaa

SEQ ID NO: 516613 - DNA, 25 bp, Rattus norvegicus
gtgtccgctctcttttggaaattaa

SEQ ID NO: 516614 - DNA, 25 bp, Rattus norvegicus
gtgtccgctcttacacgatgatgaa

SEQ ID NO: 516615 - DNA, 25 bp, Rattus norvegicus
gtgtccgctctttcacgatgatgaa

SEQ ID NO: 516616 - DNA, 25 bp, Rattus norvegicus
gtgtccggaattactgccttaacct

SEQ ID NO: 516617 - DNA, 25 bp, Rattus norvegicus
gtgtccggaatttctgccttaacct

SEQ ID NO: 516618 - DNA, 25 bp, Rattus norvegicus
gtgtccgggcgaccggatcccgctt

SEQ ID NO: 516619 - DNA, 25 bp, Rattus norvegicus
gtgtccgggcgagcggatcccgctt

SEQ ID NO: 516620 - DNA, 25 bp, Rattus norvegicus
gtgtccggttttcgatttagttcat

SEQ ID NO: 516621 - DNA, 25 bp, Rattus norvegicus
gtgtccggttttggatttagttcat

SEQ ID NO: 516622 - DNA, 25 bp, Rattus norvegicus
gtgtccgtacagaccacagaccaga

SEQ ID NO: 516623 - DNA, 25 bp, Rattus norvegicus
gtgtccgtacagtccacagaccaga

SEQ ID NO: 516624 - DNA, 25 bp, Rattus norvegicus
gtgtccgtctccacaggaagtgaaa

SEQ ID NO: 516625 - DNA, 25 bp, Rattus norvegicus
gtgtccgtctcctcaggaagtgaaa

SEQ ID NO: 516626 - DNA, 25 bp, Rattus norvegicus
gtgtccgtggcgatcagatttatat

SEQ ID NO: 516627 - DNA, 25 bp, Rattus norvegicus
gtgtccgtggcgttcagatttatat

SEQ ID NO: 516628 - DNA, 25 bp, Rattus norvegicus
gtgtccgtgtgcaatcattaactgg

SEQ ID NO: 516629 - DNA, 25 bp, Rattus norvegicus
gtgtccgtgtgctatcattaactgg

SEQ ID NO: 516630 - DNA, 25 bp, Rattus norvegicus
gtgtccgttcatagccagttatatt

SEQ ID NO: 516631 - DNA, 25 bp, Rattus norvegicus
gtgtccgttcattgccagttatatt

SEQ ID NO: 516632 - DNA, 25 bp, Rattus norvegicus
gtgtccgttcctcgattaaaagtgc

SEQ ID NO: 516633 - DNA, 25 bp, Rattus norvegicus
gtgtccgttcctggattaaaagtgc

SEQ ID NO: 516634 - DNA, 25 bp, Rattus norvegicus
gtgtcctaaacaatagatccccata

SEQ ID NO: 516635 - DNA, 25 bp, Rattus norvegicus
gtgtcctaaacacagcatcgcatcg

SEQ ID NO: 516636 - DNA, 25 bp, Rattus norvegicus
gtgtcctaaacagagcatcgcatcg

SEQ ID NO: 516637 - DNA, 25 bp, Rattus norvegicus
gtgtcctaaacattagatccccata

SEQ ID NO: 516638 - DNA, 25 bp, Rattus norvegicus
gtgtcctaacatctcatccaataaa

SEQ ID NO: 516639 - DNA, 25 bp, Rattus norvegicus
gtgtcctaacatgtcatccaataaa

SEQ ID NO: 516640 - DNA, 25 bp, Rattus norvegicus
gtgtcctacagtctctatgttagct

SEQ ID NO: 516641 - DNA, 25 bp, Rattus norvegicus
gtgtcctacagtgtctatgttagct

SEQ ID NO: 516642 - DNA, 25 bp, Rattus norvegicus
gtgtcctacccgcaagccgacggtg

SEQ ID NO: 516643 - DNA, 25 bp, Rattus norvegicus
gtgtcctacccggaagccgacggtg

SEQ ID NO: 516644 - DNA, 25 bp, Rattus norvegicus
gtgtcctacgctagtatttgcttgc

SEQ ID NO: 516645 - DNA, 25 bp, Rattus norvegicus
gtgtcctacgcttgtatttgcttgc

SEQ ID NO: 516646 - DNA, 25 bp, Rattus norvegicus
gtgtcctaggacactgggccagcca

SEQ ID NO: 516647 - DNA, 25 bp, Rattus norvegicus
gtgtcctaggactctgggccagcca

SEQ ID NO: 516648 - DNA, 25 bp, Rattus norvegicus
gtgtcctagttgatgtcatttcaaa

SEQ ID NO: 516649 - DNA, 25 bp, Rattus norvegicus
gtgtcctagttgttgtcatttcaaa

SEQ ID NO: 516650 - DNA, 25 bp, Rattus norvegicus
gtgtcctatcctagaatccatatgt

SEQ ID NO: 516651 - DNA, 25 bp, Rattus norvegicus
gtgtcctatccttgaatccatatgt

SEQ ID NO: 516652 - DNA, 25 bp, Rattus norvegicus
gtgtcctatggacatcgtagcagga

SEQ ID NO: 516653 - DNA, 25 bp, Rattus norvegicus
gtgtcctatggagatcgtagcagga

SEQ ID NO: 516654 - DNA, 25 bp, Rattus norvegicus
gtgtcctattttaaaagctgctttc

SEQ ID NO: 516655 - DNA, 25 bp, Rattus norvegicus
gtgtcctatttttaaagctgctttc

SEQ ID NO: 516656 - DNA, 25 bp, Rattus norvegicus
gtgtcctcaccactgactaaatgta

SEQ ID NO: 516657 - DNA, 25 bp, Rattus norvegicus
gtgtcctcaccagtgactaaatgta

SEQ ID NO: 516658 - DNA, 25 bp, Rattus norvegicus
gtgtcctcagagagcccctcagata

SEQ ID NO: 516659 - DNA, 25 bp, Rattus norvegicus
gtgtcctcagagtgcccctcagata

SEQ ID NO: 516660 - DNA, 25 bp, Rattus norvegicus
gtgtcctcaggccatgctcatgaac

SEQ ID NO: 516661 - DNA, 25 bp, Rattus norvegicus
gtgtcctcaggcgatgctcatgaac

SEQ ID NO: 516662 - DNA, 25 bp, Rattus norvegicus
gtgtcctcagtgagggaaagctctt

SEQ ID NO: 516663 - DNA, 25 bp, Rattus norvegicus
gtgtcctcagtgtgggaaagctctt

SEQ ID NO: 516664 - DNA, 25 bp, Rattus norvegicus
gtgtcctcagttcttctgtgtctgg

SEQ ID NO: 516665 - DNA, 25 bp, Rattus norvegicus
gtgtcctcagttgttctgtgtctgg

SEQ ID NO: 516666 - DNA, 25 bp, Rattus norvegicus
gtgtcctcattgctcacagcagatg

SEQ ID NO: 516667 - DNA, 25 bp, Rattus norvegicus
gtgtcctcattggtcacagcagatg

SEQ ID NO: 516668 - DNA, 25 bp, Rattus norvegicus
gtgtcctccatcctggttaccgtag

SEQ ID NO: 516669 - DNA, 25 bp, Rattus norvegicus
gtgtcctccatcgtggttaccgtag

SEQ ID NO: 516670 - DNA, 25 bp, Rattus norvegicus
gtgtcctcccttcagctgtttggtt

SEQ ID NO: 516671 - DNA, 25 bp, Rattus norvegicus
gtgtcctcccttgagctgtttggtt

SEQ ID NO: 516672 - DNA, 25 bp, Rattus norvegicus
gtgtcctccgagattttattagtat

SEQ ID NO: 516673 - DNA, 25 bp, Rattus norvegicus
gtgtcctccgagtttttattagtat

SEQ ID NO: 516674 - DNA, 25 bp, Rattus norvegicus
gtgtcctcctcgctactgcaagaaa

SEQ ID NO: 516675 - DNA, 25 bp, Rattus norvegicus
gtgtcctcctcggtactgcaagaaa

SEQ ID NO: 516676 - DNA, 25 bp, Rattus norvegicus
gtgtcctcgatcctgactcaagcaa

SEQ ID NO: 516677 - DNA, 25 bp, Rattus norvegicus
gtgtcctcgatcgtgactcaagcaa

SEQ ID NO: 516678 - DNA, 25 bp, Rattus norvegicus
gtgtcctcgatgaccatactcactg

SEQ ID NO: 516679 - DNA, 25 bp, Rattus norvegicus
gtgtcctcgatgtccatactcactg

SEQ ID NO: 516680 - DNA, 25 bp, Rattus norvegicus
gtgtcctcgcccattgaaggccgcg

SEQ ID NO: 516681 - DNA, 25 bp, Rattus norvegicus
gtgtcctcgccctttgaaggccgcg

SEQ ID NO: 516682 - DNA, 25 bp, Rattus norvegicus
gtgtcctcgtccataaacctgtgat

SEQ ID NO: 516683 - DNA, 25 bp, Rattus norvegicus
gtgtcctcgtccttaaacctgtgat

SEQ ID NO: 516684 - DNA, 25 bp, Rattus norvegicus
gtgtcctctatgacaacgtggtcta

SEQ ID NO: 516685 - DNA, 25 bp, Rattus norvegicus
gtgtcctctatgtcaacgtggtcta

SEQ ID NO: 516686 - DNA, 25 bp, Rattus norvegicus
gtgtcctctcccaacaatattatca

SEQ ID NO: 516687 - DNA, 25 bp, Rattus norvegicus
gtgtcctctccctacaatattatca

SEQ ID NO: 516688 - DNA, 25 bp, Rattus norvegicus
gtgtcctctctccagggtggtagct

SEQ ID NO: 516689 - DNA, 25 bp, Rattus norvegicus
gtgtcctctctcgagggtggtagct

SEQ ID NO: 516690 - DNA, 25 bp, Rattus norvegicus
gtgtcctctgatcgtcaaagtcctg

SEQ ID NO: 516691 - DNA, 25 bp, Rattus norvegicus
gtgtcctctgatggtcaaagtcctg

SEQ ID NO: 516692 - DNA, 25 bp, Rattus norvegicus
gtgtcctctgcaaactgtgctcaaa

SEQ ID NO: 516693 - DNA, 25 bp, Rattus norvegicus
gtgtcctctgcatactgtgctcaaa

SEQ ID NO: 516694 - DNA, 25 bp, Rattus norvegicus
gtgtcctctgcgattggtgtctggc

SEQ ID NO: 516695 - DNA, 25 bp, Rattus norvegicus
gtgtcctctgcgtttggtgtctggc

SEQ ID NO: 516696 - DNA, 25 bp, Rattus norvegicus
gtgtcctctgtgcaaacagcctctg

SEQ ID NO: 516697 - DNA, 25 bp, Rattus norvegicus
gtgtcctctgtggaaacagcctctg

SEQ ID NO: 516698 - DNA, 25 bp, Rattus norvegicus
gtgtcctcttagattcgaagccaca

SEQ ID NO: 516699 - DNA, 25 bp, Rattus norvegicus
gtgtcctcttagtttcgaagccaca

SEQ ID NO: 516700 - DNA, 25 bp, Rattus norvegicus
gtgtcctcttgcatcttgtctgaag

SEQ ID NO: 516701 - DNA, 25 bp, Rattus norvegicus
gtgtcctcttgcttcttgtctgaag

SEQ ID NO: 516702 - DNA, 25 bp, Rattus norvegicus
gtgtcctgaaatcttaactgagtct

SEQ ID NO: 516703 - DNA, 25 bp, Rattus norvegicus
gtgtcctgaaatgttaactgagtct

SEQ ID NO: 516704 - DNA, 25 bp, Rattus norvegicus
gtgtcctgacatcacttgtacagat

SEQ ID NO: 516705 - DNA, 25 bp, Rattus norvegicus
gtgtcctgacatgacttgtacagat

SEQ ID NO: 516706 - DNA, 25 bp, Rattus norvegicus
gtgtcctgactcagtcttaagtgca

SEQ ID NO: 516707 - DNA, 25 bp, Rattus norvegicus
gtgtcctgactctgtcttaagtgca

SEQ ID NO: 516708 - DNA, 25 bp, Rattus norvegicus
gtgtcctgcaccaggaagttgtgat

SEQ ID NO: 516709 - DNA, 25 bp, Rattus norvegicus
gtgtcctgcacctggaagttgtgat

SEQ ID NO: 516710 - DNA, 25 bp, Rattus norvegicus
gtgtcctgcattcttcagtcataga

SEQ ID NO: 516711 - DNA, 25 bp, Rattus norvegicus
gtgtcctgcattgttcagtcataga

SEQ ID NO: 516712 - DNA, 25 bp, Rattus norvegicus
gtgtcctgcttcataatcctgacag

SEQ ID NO: 516713 - DNA, 25 bp, Rattus norvegicus
gtgtcctgcttcttaatcctgacag

SEQ ID NO: 516714 - DNA, 25 bp, Rattus norvegicus
gtgtcctggaatcagatccacctga

SEQ ID NO: 516715 - DNA, 25 bp, Rattus norvegicus
gtgtcctggaatgagatccacctga

SEQ ID NO: 516716 - DNA, 25 bp, Rattus norvegicus
gtgtcctggacacgaggcatttcct

SEQ ID NO: 516717 - DNA, 25 bp, Rattus norvegicus
gtgtcctggacaggaggcatttcct

SEQ ID NO: 516718 - DNA, 25 bp, Rattus norvegicus
gtgtcctggatcattgcttccttct

SEQ ID NO: 516719 - DNA, 25 bp, Rattus norvegicus
gtgtcctggatccacggcaagcaag

SEQ ID NO: 516720 - DNA, 25 bp, Rattus norvegicus
gtgtcctggatcgacggcaagcaag

SEQ ID NO: 516721 - DNA, 25 bp, Rattus norvegicus
gtgtcctggatctttgcttccttct

SEQ ID NO: 516722 - DNA, 25 bp, Rattus norvegicus
gtgtcctggccacatatggaggcat

SEQ ID NO: 516723 - DNA, 25 bp, Rattus norvegicus
gtgtcctggccagatatggaggcat

SEQ ID NO: 516724 - DNA, 25 bp, Rattus norvegicus
gtgtcctgggacatgcctagcacag

SEQ ID NO: 516725 - DNA, 25 bp, Rattus norvegicus
gtgtcctgggacttgcctagcacag

SEQ ID NO: 516726 - DNA, 25 bp, Rattus norvegicus
gtgtcctgggagagaatggcatatc

SEQ ID NO: 516727 - DNA, 25 bp, Rattus norvegicus
gtgtcctgggagtgaatggcatatc

SEQ ID NO: 516728 - DNA, 25 bp, Rattus norvegicus
gtgtcctggttaactccagctttaa

SEQ ID NO: 516729 - DNA, 25 bp, Rattus norvegicus
gtgtcctggttatctccagctttaa

SEQ ID NO: 516730 - DNA, 25 bp, Rattus norvegicus
gtgtcctgtgaactctgaacttgaa

SEQ ID NO: 516731 - DNA, 25 bp, Rattus norvegicus
gtgtcctgtgaagtctgaacttgaa

SEQ ID NO: 516732 - DNA, 25 bp, Rattus norvegicus
gtgtcctgtgtcagagctccaagct

SEQ ID NO: 516733 - DNA, 25 bp, Rattus norvegicus
gtgtcctgtgtctgagctccaagct

SEQ ID NO: 516734 - DNA, 25 bp, Rattus norvegicus
gtgtcctgtgttagtaaacccaagt

SEQ ID NO: 516735 - DNA, 25 bp, Rattus norvegicus
gtgtcctgtgtttgtaaacccaagt

SEQ ID NO: 516736 - DNA, 25 bp, Rattus norvegicus
gtgtcctgttgtcatttctgttaaa

SEQ ID NO: 516737 - DNA, 25 bp, Rattus norvegicus
gtgtcctgttgtgatttctgttaaa

SEQ ID NO: 516738 - DNA, 25 bp, Rattus norvegicus
gtgtccttaaagagtggctcacctt

SEQ ID NO: 516739 - DNA, 25 bp, Rattus norvegicus
gtgtccttaaagtgtggctcacctt

SEQ ID NO: 516740 - DNA, 25 bp, Rattus norvegicus
gtgtccttaattcctcacatgcaag

SEQ ID NO: 516741 - DNA, 25 bp, Rattus norvegicus
gtgtccttaattgctcacatgcaag

SEQ ID NO: 516742 - DNA, 25 bp, Rattus norvegicus
gtgtccttacatatatgaccacagg

SEQ ID NO: 516743 - DNA, 25 bp, Rattus norvegicus
gtgtccttacatttatgaccacagg

SEQ ID NO: 516744 - DNA, 25 bp, Rattus norvegicus
gtgtccttaccaaacagtgaagctt

SEQ ID NO: 516745 - DNA, 25 bp, Rattus norvegicus
gtgtccttaccatacagtgaagctt

SEQ ID NO: 516746 - DNA, 25 bp, Rattus norvegicus
gtgtccttacctaacatggcatgaa

SEQ ID NO: 516747 - DNA, 25 bp, Rattus norvegicus
gtgtccttaccttacatggcatgaa

SEQ ID NO: 516748 - DNA, 25 bp, Rattus norvegicus
gtgtccttaggacagccacagctgt

SEQ ID NO: 516749 - DNA, 25 bp, Rattus norvegicus
gtgtccttaggagagccacagctgt

SEQ ID NO: 516750 - DNA, 25 bp, Rattus norvegicus
gtgtccttagtgcagttgatgtctt

SEQ ID NO: 516751 - DNA, 25 bp, Rattus norvegicus
gtgtccttagtggagttgatgtctt

SEQ ID NO: 516752 - DNA, 25 bp, Rattus norvegicus
gtgtccttatagaaacccttactcg

SEQ ID NO: 516753 - DNA, 25 bp, Rattus norvegicus
gtgtccttatagtaacccttactcg

SEQ ID NO: 516754 - DNA, 25 bp, Rattus norvegicus
gtgtccttatcgagtgtctgtctga

SEQ ID NO: 516755 - DNA, 25 bp, Rattus norvegicus
gtgtccttatcgtgtgtctgtctga

SEQ ID NO: 516756 - DNA, 25 bp, Rattus norvegicus
gtgtccttcaaacatatcctgcaac

SEQ ID NO: 516757 - DNA, 25 bp, Rattus norvegicus
gtgtccttcaaagatatcctgcaac

SEQ ID NO: 516758 - DNA, 25 bp, Rattus norvegicus
gtgtccttcagacaggctagctgta

SEQ ID NO: 516759 - DNA, 25 bp, Rattus norvegicus
gtgtccttcagagaggctagctgta

SEQ ID NO: 516760 - DNA, 25 bp, Rattus norvegicus
gtgtccttccaaaaactaaatgccg

SEQ ID NO: 516761 - DNA, 25 bp, Rattus norvegicus
gtgtccttccaataactaaatgccg

SEQ ID NO: 516762 - DNA, 25 bp, Rattus norvegicus
gtgtccttctcactgagactgggaa

SEQ ID NO: 516763 - DNA, 25 bp, Rattus norvegicus
gtgtccttctcagtgagactgggaa

SEQ ID NO: 516764 - DNA, 25 bp, Rattus norvegicus
gtgtccttgaggatctgtatctctt

SEQ ID NO: 516765 - DNA, 25 bp, Rattus norvegicus
gtgtccttgaggttctgtatctctt

SEQ ID NO: 516766 - DNA, 25 bp, Rattus norvegicus
gtgtccttgcctcctgtcaggaaaa

SEQ ID NO: 516767 - DNA, 25 bp, Rattus norvegicus
gtgtccttgcctgctgtcaggaaaa

SEQ ID NO: 516768 - DNA, 25 bp, Rattus norvegicus
gtgtccttggcacaatttgtcatga

SEQ ID NO: 516769 - DNA, 25 bp, Rattus norvegicus
gtgtccttggcagaatttgtcatga

SEQ ID NO: 516770 - DNA, 25 bp, Rattus norvegicus
gtgtccttggctagcatagatgttt

SEQ ID NO: 516771 - DNA, 25 bp, Rattus norvegicus
gtgtccttggcttgcatagatgttt

SEQ ID NO: 516772 - DNA, 25 bp, Rattus norvegicus
gtgtccttgtcacggtttcttctca

SEQ ID NO: 516773 - DNA, 25 bp, Rattus norvegicus
gtgtccttgtcagggtttcttctca

SEQ ID NO: 516774 - DNA, 25 bp, Rattus norvegicus
gtgtccttgtgtacatctgtcatgg

SEQ ID NO: 516775 - DNA, 25 bp, Rattus norvegicus
gtgtccttgtgttcatctgtcatgg

SEQ ID NO: 516776 - DNA, 25 bp, Rattus norvegicus
gtgtcctttaaacccagtgtgctag

SEQ ID NO: 516777 - DNA, 25 bp, Rattus norvegicus
gtgtcctttaaagccagtgtgctag

SEQ ID NO: 516778 - DNA, 25 bp, Rattus norvegicus
gtgtcctttgccatgcatgcagaag

SEQ ID NO: 516779 - DNA, 25 bp, Rattus norvegicus
gtgtcctttgccttgcatgcagaag

SEQ ID NO: 516780 - DNA, 25 bp, Rattus norvegicus
gtgtcctttgctagtattttgtact

SEQ ID NO: 516781 - DNA, 25 bp, Rattus norvegicus
gtgtcctttgcttgtattttgtact

SEQ ID NO: 516782 - DNA, 25 bp, Rattus norvegicus
gtgtccttttagaccatcttttctg

SEQ ID NO: 516783 - DNA, 25 bp, Rattus norvegicus
gtgtccttttagtccatcttttctg

SEQ ID NO: 516784 - DNA, 25 bp, Rattus norvegicus
gtgtccttttcgctggtactgatga

SEQ ID NO: 516785 - DNA, 25 bp, Rattus norvegicus
gtgtccttttcggtggtactgatga

SEQ ID NO: 516786 - DNA, 25 bp, Rattus norvegicus
gtgtccttttttcatggctgtaccg

SEQ ID NO: 516787 - DNA, 25 bp, Rattus norvegicus
gtgtccttttttgatggctgtaccg

SEQ ID NO: 516788 - DNA, 25 bp, Rattus norvegicus
gtgtcgaaatagaagctcccagagg

SEQ ID NO: 516789 - DNA, 25 bp, Rattus norvegicus
gtgtcgaaatagtagctcccagagg

SEQ ID NO: 516790 - DNA, 25 bp, Rattus norvegicus
gtgtcgaacttaagcctcttttggc

SEQ ID NO: 516791 - DNA, 25 bp, Rattus norvegicus
gtgtcgaacttatgcctcttttggc

SEQ ID NO: 516792 - DNA, 25 bp, Rattus norvegicus
gtgtcgaagatcacgtcaccggtgc

SEQ ID NO: 516793 - DNA, 25 bp, Rattus norvegicus
gtgtcgaagatctcgtcaccggtgc

SEQ ID NO: 516794 - DNA, 25 bp, Rattus norvegicus
gtgtcgacacgcaggcttagcaata

SEQ ID NO: 516795 - DNA, 25 bp, Rattus norvegicus
gtgtcgacacgctggcttagcaata

SEQ ID NO: 516796 - DNA, 25 bp, Rattus norvegicus
gtgtcgacccggcatcccgctaaga

SEQ ID NO: 516797 - DNA, 25 bp, Rattus norvegicus
gtgtcgacccgggatcccgctaaga

SEQ ID NO: 516798 - DNA, 25 bp, Rattus norvegicus
gtgtcgactggaattgccttttgta

SEQ ID NO: 516799 - DNA, 25 bp, Rattus norvegicus
gtgtcgactggatttgccttttgta

SEQ ID NO: 516800 - DNA, 25 bp, Rattus norvegicus
gtgtcgaggtccagcatcagtacga

SEQ ID NO: 516801 - DNA, 25 bp, Rattus norvegicus
gtgtcgaggtcctgcatcagtacga

SEQ ID NO: 516802 - DNA, 25 bp, Rattus norvegicus
gtgtcgcagactagaaccttcagat

SEQ ID NO: 516803 - DNA, 25 bp, Rattus norvegicus
gtgtcgcagacttgaaccttcagat

SEQ ID NO: 516804 - DNA, 25 bp, Rattus norvegicus
gtgtcgcagaggaggcccatcctag

SEQ ID NO: 516805 - DNA, 25 bp, Rattus norvegicus
gtgtcgcagaggtggcccatcctag

SEQ ID NO: 516806 - DNA, 25 bp, Rattus norvegicus
gtgtcgcatacacgttaggctgcct

SEQ ID NO: 516807 - DNA, 25 bp, Rattus norvegicus
gtgtcgcatacaggttaggctgcct

SEQ ID NO: 516808 - DNA, 25 bp, Rattus norvegicus
gtgtcgcatctgatgtacctttggg

SEQ ID NO: 516809 - DNA, 25 bp, Rattus norvegicus
gtgtcgcatctgttgtacctttggg

SEQ ID NO: 516810 - DNA, 25 bp, Rattus norvegicus
gtgtcgccaagcatatagctaggaa

SEQ ID NO: 516811 - DNA, 25 bp, Rattus norvegicus
gtgtcgccaagcttatagctaggaa

SEQ ID NO: 516812 - DNA, 25 bp, Rattus norvegicus
gtgtcgccaattatgcccaagatgc

SEQ ID NO: 516813 - DNA, 25 bp, Rattus norvegicus
gtgtcgccaattttgcccaagatgc

SEQ ID NO: 516814 - DNA, 25 bp, Rattus norvegicus
gtgtcgccacatccagcaagataca

SEQ ID NO: 516815 - DNA, 25 bp, Rattus norvegicus
gtgtcgccacatgcagcaagataca

SEQ ID NO: 516816 - DNA, 25 bp, Rattus norvegicus
gtgtcgctgatgagctgtggactaa

SEQ ID NO: 516817 - DNA, 25 bp, Rattus norvegicus
gtgtcgctgatgtgctgtggactaa

SEQ ID NO: 516818 - DNA, 25 bp, Rattus norvegicus
gtgtcgctgcagctttacctggaat

SEQ ID NO: 516819 - DNA, 25 bp, Rattus norvegicus
gtgtcgctgcaggtttacctggaat

SEQ ID NO: 516820 - DNA, 25 bp, Rattus norvegicus
gtgtcgctgcttagtcccagacaaa

SEQ ID NO: 516821 - DNA, 25 bp, Rattus norvegicus
gtgtcgctgctttgtcccagacaaa

SEQ ID NO: 516822 - DNA, 25 bp, Rattus norvegicus
gtgtcggaaattaccagcctctctg

SEQ ID NO: 516823 - DNA, 25 bp, Rattus norvegicus
gtgtcggaaatttccagcctctctg

SEQ ID NO: 516824 - DNA, 25 bp, Rattus norvegicus
gtgtcggacatcagcaagactttca

SEQ ID NO: 516825 - DNA, 25 bp, Rattus norvegicus
gtgtcggacatctgcaagactttca

SEQ ID NO: 516826 - DNA, 25 bp, Rattus norvegicus
gtgtcggagcctcaggagcttccct

SEQ ID NO: 516827 - DNA, 25 bp, Rattus norvegicus
gtgtcggagcctgaggagcttccct

SEQ ID NO: 516828 - DNA, 25 bp, Rattus norvegicus
gtgtcggaggagagagttttcccaa

SEQ ID NO: 516829 - DNA, 25 bp, Rattus norvegicus
gtgtcggaggagtgagttttcccaa

SEQ ID NO: 516830 - DNA, 25 bp, Rattus norvegicus
gtgtcggctctaataccagaaacct

SEQ ID NO: 516831 - DNA, 25 bp, Rattus norvegicus
gtgtcggctctattaccagaaacct

SEQ ID NO: 516832 - DNA, 25 bp, Rattus norvegicus
gtgtcggctgtcactcatacaggac

SEQ ID NO: 516833 - DNA, 25 bp, Rattus norvegicus
gtgtcggctgtctctcatacaggac

SEQ ID NO: 516834 - DNA, 25 bp, Rattus norvegicus
gtgtcgggaaccctgagaatccaca

SEQ ID NO: 516835 - DNA, 25 bp, Rattus norvegicus
gtgtcgggaaccgtgagaatccaca

SEQ ID NO: 516836 - DNA, 25 bp, Rattus norvegicus
gtgtcgggcaagaataccttcaaag

SEQ ID NO: 516837 - DNA, 25 bp, Rattus norvegicus
gtgtcgggcaagtataccttcaaag

SEQ ID NO: 516838 - DNA, 25 bp, Rattus norvegicus
gtgtcgggcacaaagatcaaggaat

SEQ ID NO: 516839 - DNA, 25 bp, Rattus norvegicus
gtgtcgggcacatagatcaaggaat

SEQ ID NO: 516840 - DNA, 25 bp, Rattus norvegicus
gtgtcgggccacaggatgtgtttca

SEQ ID NO: 516841 - DNA, 25 bp, Rattus norvegicus
gtgtcgggccactggatgtgtttca

SEQ ID NO: 516842 - DNA, 25 bp, Rattus norvegicus
gtgtcggtcgtcagtctggtcagaa

SEQ ID NO: 516843 - DNA, 25 bp, Rattus norvegicus
gtgtcggtcgtctgtctggtcagaa

SEQ ID NO: 516844 - DNA, 25 bp, Rattus norvegicus
gtgtcggtgctgactggcattatta

SEQ ID NO: 516845 - DNA, 25 bp, Rattus norvegicus
gtgtcggtgctgtctggcattatta

SEQ ID NO: 516846 - DNA, 25 bp, Rattus norvegicus
gtgtcgtactagctatgactcttta

SEQ ID NO: 516847 - DNA, 25 bp, Rattus norvegicus
gtgtcgtactaggtatgactcttta

SEQ ID NO: 516848 - DNA, 25 bp, Rattus norvegicus
gtgtcgtatgatatccgctgcacaa

SEQ ID NO: 516849 - DNA, 25 bp, Rattus norvegicus
gtgtcgtatgatttccgctgcacaa

SEQ ID NO: 516850 - DNA, 25 bp, Rattus norvegicus
gtgtcgtcacagaaacgatctctga

SEQ ID NO: 516851 - DNA, 25 bp, Rattus norvegicus
gtgtcgtcacagtaacgatctctga

SEQ ID NO: 516852 - DNA, 25 bp, Rattus norvegicus
gtgtcgtcatttccaaggaccacat

SEQ ID NO: 516853 - DNA, 25 bp, Rattus norvegicus
gtgtcgtcatttgcaaggaccacat

SEQ ID NO: 516854 - DNA, 25 bp, Rattus norvegicus
gtgtcgtccacaatgaaagcattca

SEQ ID NO: 516855 - DNA, 25 bp, Rattus norvegicus
gtgtcgtccacattgaaagcattca

SEQ ID NO: 516856 - DNA, 25 bp, Rattus norvegicus
gtgtcgtccacgaagccgacaataa

SEQ ID NO: 516857 - DNA, 25 bp, Rattus norvegicus
gtgtcgtccacgtagccgacaataa

SEQ ID NO: 516858 - DNA, 25 bp, Rattus norvegicus
gtgtcgtctcttatcttagatgtct

SEQ ID NO: 516859 - DNA, 25 bp, Rattus norvegicus
gtgtcgtctcttttcttagatgtct

SEQ ID NO: 516860 - DNA, 25 bp, Rattus norvegicus
gtgtcgtctttcatcagagcgatgc

SEQ ID NO: 516861 - DNA, 25 bp, Rattus norvegicus
gtgtcgtctttcttcagagcgatgc

SEQ ID NO: 516862 - DNA, 25 bp, Rattus norvegicus
gtgtcgtgcaggaggctctacaatg

SEQ ID NO: 516863 - DNA, 25 bp, Rattus norvegicus
gtgtcgtgcaggtggctctacaatg

SEQ ID NO: 516864 - DNA, 25 bp, Rattus norvegicus
gtgtcgtggatccagatgcatctta

SEQ ID NO: 516865 - DNA, 25 bp, Rattus norvegicus
gtgtcgtggatcgagatgcatctta

SEQ ID NO: 516866 - DNA, 25 bp, Rattus norvegicus
gtgtcgtgtaatcccaatgagtgtt

SEQ ID NO: 516867 - DNA, 25 bp, Rattus norvegicus
gtgtcgtgtaatgccaatgagtgtt

SEQ ID NO: 516868 - DNA, 25 bp, Rattus norvegicus
gtgtcgttcctacttaaatgctgtg

SEQ ID NO: 516869 - DNA, 25 bp, Rattus norvegicus
gtgtcgttcctagttaaatgctgtg

SEQ ID NO: 516870 - DNA, 25 bp, Rattus norvegicus
gtgtcgtttttcattgtctgctgtc

SEQ ID NO: 516871 - DNA, 25 bp, Rattus norvegicus
gtgtcgtttttctttgtctgctgtc

SEQ ID NO: 516872 - DNA, 25 bp, Rattus norvegicus
gtgtctaaatgtctggccaccagtg

SEQ ID NO: 516873 - DNA, 25 bp, Rattus norvegicus
gtgtctaaatgtgtggccaccagtg

SEQ ID NO: 516874 - DNA, 25 bp, Rattus norvegicus
gtgtctaaatttatattactttggg

SEQ ID NO: 516875 - DNA, 25 bp, Rattus norvegicus
gtgtctaaatttttattactttggg

SEQ ID NO: 516876 - DNA, 25 bp, Rattus norvegicus
gtgtctaacaagcatctgtcctgaa

SEQ ID NO: 516877 - DNA, 25 bp, Rattus norvegicus
gtgtctaacaaggatctgtcctgaa

SEQ ID NO: 516878 - DNA, 25 bp, Rattus norvegicus
gtgtctaactatctcaccgcatgat

SEQ ID NO: 516879 - DNA, 25 bp, Rattus norvegicus
gtgtctaactatgtcaccgcatgat

SEQ ID NO: 516880 - DNA, 25 bp, Rattus norvegicus
gtgtctaagactaaaatgcgagagc

SEQ ID NO: 516881 - DNA, 25 bp, Rattus norvegicus
gtgtctaagacttaaatgcgagagc

SEQ ID NO: 516882 - DNA, 25 bp, Rattus norvegicus
gtgtctaagtcacaacatcctaaaa

SEQ ID NO: 516883 - DNA, 25 bp, Rattus norvegicus
gtgtctaagtcagaacatcctaaaa

SEQ ID NO: 516884 - DNA, 25 bp, Rattus norvegicus
gtgtctaatcctagtgtgaactaaa

SEQ ID NO: 516885 - DNA, 25 bp, Rattus norvegicus
gtgtctaatccttgtgtgaactaaa

SEQ ID NO: 516886 - DNA, 25 bp, Rattus norvegicus
gtgtctaatgcaacagtattctgag

SEQ ID NO: 516887 - DNA, 25 bp, Rattus norvegicus
gtgtctaatgcatcagtattctgag

SEQ ID NO: 516888 - DNA, 25 bp, Rattus norvegicus
gtgtctacaaaaatctgggttttca

SEQ ID NO: 516889 - DNA, 25 bp, Rattus norvegicus
gtgtctacaaaattctgggttttca

SEQ ID NO: 516890 - DNA, 25 bp, Rattus norvegicus
gtgtctacaatgaccaagatctcta

SEQ ID NO: 516891 - DNA, 25 bp, Rattus norvegicus
gtgtctacaatgtccaagatctcta

SEQ ID NO: 516892 - DNA, 25 bp, Rattus norvegicus
gtgtctacaccaacagcgctgtcaa

SEQ ID NO: 516893 - DNA, 25 bp, Rattus norvegicus
gtgtctacaccatcagcgctgtcaa

SEQ ID NO: 516894 - DNA, 25 bp, Rattus norvegicus
gtgtctacactgaaatcttaagcca

SEQ ID NO: 516895 - DNA, 25 bp, Rattus norvegicus
gtgtctacactgtaatcttaagcca

SEQ ID NO: 516896 - DNA, 25 bp, Rattus norvegicus
gtgtctaccaccaagcctgtttgat

SEQ ID NO: 516897 - DNA, 25 bp, Rattus norvegicus
gtgtctaccacctagcctgtttgat

SEQ ID NO: 516898 - DNA, 25 bp, Rattus norvegicus
gtgtctaccctacgttaccacttag

SEQ ID NO: 516899 - DNA, 25 bp, Rattus norvegicus
gtgtctaccctaggttaccacttag

SEQ ID NO: 516900 - DNA, 25 bp, Rattus norvegicus
gtgtctaccctgaatgtgctgtcta

SEQ ID NO: 516901 - DNA, 25 bp, Rattus norvegicus
gtgtctaccctgtatgtgctgtcta

SEQ ID NO: 516902 - DNA, 25 bp, Rattus norvegicus
gtgtctacgcacagagcgcctgcat

SEQ ID NO: 516903 - DNA, 25 bp, Rattus norvegicus
gtgtctacgcactgagcgcctgcat

SEQ ID NO: 516904 - DNA, 25 bp, Rattus norvegicus
gtgtctactcacaaggtgatatttg

SEQ ID NO: 516905 - DNA, 25 bp, Rattus norvegicus
gtgtctactcactaggtgatatttg

SEQ ID NO: 516906 - DNA, 25 bp, Rattus norvegicus
gtgtctactccacgtcaaggtcaag

SEQ ID NO: 516907 - DNA, 25 bp, Rattus norvegicus
gtgtctactccaggtcaaggtcaag

SEQ ID NO: 516908 - DNA, 25 bp, Rattus norvegicus
gtgtctactgttaatttattgtact

SEQ ID NO: 516909 - DNA, 25 bp, Rattus norvegicus
gtgtctactgtttatttattgtact

SEQ ID NO: 516910 - DNA, 25 bp, Rattus norvegicus
gtgtctacttccatttcccagaaga

SEQ ID NO: 516911 - DNA, 25 bp, Rattus norvegicus
gtgtctacttccttttcccagaaga

SEQ ID NO: 516912 - DNA, 25 bp, Rattus norvegicus
gtgtctagaatactgcttctccaaa

SEQ ID NO: 516913 - DNA, 25 bp, Rattus norvegicus
gtgtctagaatagtgcttctccaaa

SEQ ID NO: 516914 - DNA, 25 bp, Rattus norvegicus
gtgtctagaccccaagacaattaca

SEQ ID NO: 516915 - DNA, 25 bp, Rattus norvegicus
gtgtctagacccgaagacaattaca

SEQ ID NO: 516916 - DNA, 25 bp, Rattus norvegicus
gtgtctagacgcctttgtatttctc

SEQ ID NO: 516917 - DNA, 25 bp, Rattus norvegicus
gtgtctagacgcgtttgtatttctc

SEQ ID NO: 516918 - DNA, 25 bp, Rattus norvegicus
gtgtctagacttagtgtttctggtt

SEQ ID NO: 516919 - DNA, 25 bp, Rattus norvegicus
gtgtctagactttgtgtttctggtt

SEQ ID NO: 516920 - DNA, 25 bp, Rattus norvegicus
gtgtctagagacaggtgctctccat

SEQ ID NO: 516921 - DNA, 25 bp, Rattus norvegicus
gtgtctagagactggtgctctccat

SEQ ID NO: 516922 - DNA, 25 bp, Rattus norvegicus
gtgtctagagcaatgccttccttgt

SEQ ID NO: 516923 - DNA, 25 bp, Rattus norvegicus
gtgtctagagcattgccttccttgt

SEQ ID NO: 516924 - DNA, 25 bp, Rattus norvegicus
gtgtctagagctacaggatgttcca

SEQ ID NO: 516925 - DNA, 25 bp, Rattus norvegicus
gtgtctagagcttcaggatgttcca

SEQ ID NO: 516926 - DNA, 25 bp, Rattus norvegicus
gtgtctagagttacctgcttctgaa

SEQ ID NO: 516927 - DNA, 25 bp, Rattus norvegicus
gtgtctagagtttcctgcttctgaa

SEQ ID NO: 516928 - DNA, 25 bp, Rattus norvegicus
gtgtctagatcacattgcctttttt

SEQ ID NO: 516929 - DNA, 25 bp, Rattus norvegicus
gtgtctagatcagattgcctttttt

SEQ ID NO: 516930 - DNA, 25 bp, Rattus norvegicus
gtgtctagcagactcgagctgatgc

SEQ ID NO: 516931 - DNA, 25 bp, Rattus norvegicus
gtgtctagcagagtcgagctgatgc

SEQ ID NO: 516932 - DNA, 25 bp, Rattus norvegicus
gtgtctaggcagcacctgtggccaa

SEQ ID NO: 516933 - DNA, 25 bp, Rattus norvegicus
gtgtctaggcaggacctgtggccaa

SEQ ID NO: 516934 - DNA, 25 bp, Rattus norvegicus
gtgtctagggtcatccccgaggtga

SEQ ID NO: 516935 - DNA, 25 bp, Rattus norvegicus
gtgtctagggtcttccccgaggtga

SEQ ID NO: 516936 - DNA, 25 bp, Rattus norvegicus
gtgtctagtagaaaaagccccaact

SEQ ID NO: 516937 - DNA, 25 bp, Rattus norvegicus
gtgtctagtagataaagccccaact

SEQ ID NO: 516938 - DNA, 25 bp, Rattus norvegicus
gtgtctatcttacattttggctaat

SEQ ID NO: 516939 - DNA, 25 bp, Rattus norvegicus
gtgtctatcttagattttggctaat

SEQ ID NO: 516940 - DNA, 25 bp, Rattus norvegicus
gtgtctatcttcagtattttatgcc

SEQ ID NO: 516941 - DNA, 25 bp, Rattus norvegicus
gtgtctatcttctgtattttatgcc

SEQ ID NO: 516942 - DNA, 25 bp, Rattus norvegicus
gtgtctatgaggagcagtgccacat

SEQ ID NO: 516943 - DNA, 25 bp, Rattus norvegicus
gtgtctatgaggtgcagtgccacat

SEQ ID NO: 516944 - DNA, 25 bp, Rattus norvegicus
gtgtctatgatactgcgccctgtgc

SEQ ID NO: 516945 - DNA, 25 bp, Rattus norvegicus
gtgtctatgatagtgcgccctgtgc

SEQ ID NO: 516946 - DNA, 25 bp, Rattus norvegicus
gtgtctatgctgaacaggccatacc

SEQ ID NO: 516947 - DNA, 25 bp, Rattus norvegicus
gtgtctatgctgtacaggccatacc

SEQ ID NO: 516948 - DNA, 25 bp, Rattus norvegicus
gtgtctatggccacttcaggactga

SEQ ID NO: 516949 - DNA, 25 bp, Rattus norvegicus
gtgtctatggcctcttcaggactga

SEQ ID NO: 516950 - DNA, 25 bp, Rattus norvegicus
gtgtctatgtcaaaagttcttatat

SEQ ID NO: 516951 - DNA, 25 bp, Rattus norvegicus
gtgtctatgtcataagttcttatat

SEQ ID NO: 516952 - DNA, 25 bp, Rattus norvegicus
gtgtctattcacaatgcattttatt

SEQ ID NO: 516953 - DNA, 25 bp, Rattus norvegicus
gtgtctattcactatgcattttatt

SEQ ID NO: 516954 - DNA, 25 bp, Rattus norvegicus
gtgtctattcctctgacctgtgaag

SEQ ID NO: 516955 - DNA, 25 bp, Rattus norvegicus
gtgtctattcctgtgacctgtgaag

SEQ ID NO: 516956 - DNA, 25 bp, Rattus norvegicus
gtgtctattgtcaattgctactgca

SEQ ID NO: 516957 - DNA, 25 bp, Rattus norvegicus
gtgtctattgtctattgctactgca

SEQ ID NO: 516958 - DNA, 25 bp, Rattus norvegicus
gtgtctatttgactttactcctctc

SEQ ID NO: 516959 - DNA, 25 bp, Rattus norvegicus
gtgtctatttgagtttactcctctc

SEQ ID NO: 516960 - DNA, 25 bp, Rattus norvegicus
gtgtctcaacctcccaagaggaggg

SEQ ID NO: 516961 - DNA, 25 bp, Rattus norvegicus
gtgtctcaacctgccaagaggaggg

SEQ ID NO: 516962 - DNA, 25 bp, Rattus norvegicus
gtgtctcaagcccaggatgtttatt

SEQ ID NO: 516963 - DNA, 25 bp, Rattus norvegicus
gtgtctcaagccgaggatgtttatt

SEQ ID NO: 516964 - DNA, 25 bp, Rattus norvegicus
gtgtctcaagtgactccatgatata

SEQ ID NO: 516965 - DNA, 25 bp, Rattus norvegicus
gtgtctcaagtgtctccatgatata

SEQ ID NO: 516966 - DNA, 25 bp, Rattus norvegicus
gtgtctcaatgcagaacccatacca

SEQ ID NO: 516967 - DNA, 25 bp, Rattus norvegicus
gtgtctcaatgctgaacccatacca

SEQ ID NO: 516968 - DNA, 25 bp, Rattus norvegicus
gtgtctcacaaaagactgatttact

SEQ ID NO: 516969 - DNA, 25 bp, Rattus norvegicus
gtgtctcacaaatgactgatttact

SEQ ID NO: 516970 - DNA, 25 bp, Rattus norvegicus
gtgtctcacaagaacctactgggca

SEQ ID NO: 516971 - DNA, 25 bp, Rattus norvegicus
gtgtctcacaagtacctactgggca

SEQ ID NO: 516972 - DNA, 25 bp, Rattus norvegicus
gtgtctcacaccagaaggatgctct

SEQ ID NO: 516973 - DNA, 25 bp, Rattus norvegicus
gtgtctcacacctgaaggatgctct

SEQ ID NO: 516974 - DNA, 25 bp, Rattus norvegicus
gtgtctcacatgaatgccagggctt

SEQ ID NO: 516975 - DNA, 25 bp, Rattus norvegicus
gtgtctcacatgtatgccagggctt

SEQ ID NO: 516976 - DNA, 25 bp, Rattus norvegicus
gtgtctcaccaaatatccaactgtt

SEQ ID NO: 516977 - DNA, 25 bp, Rattus norvegicus
gtgtctcaccaattatccaactgtt

SEQ ID NO: 516978 - DNA, 25 bp, Rattus norvegicus
gtgtctcaccagagtgcatatgggc

SEQ ID NO: 516979 - DNA, 25 bp, Rattus norvegicus
gtgtctcaccagtgtgcatatgggc

SEQ ID NO: 516980 - DNA, 25 bp, Rattus norvegicus
gtgtctcagaccaaggccagtaagt

SEQ ID NO: 516981 - DNA, 25 bp, Rattus norvegicus
gtgtctcagacctaggccagtaagt

SEQ ID NO: 516982 - DNA, 25 bp, Rattus norvegicus
gtgtctcagcacacagcagagggtt

SEQ ID NO: 516983 - DNA, 25 bp, Rattus norvegicus
gtgtctcagcactcagcagagggtt

SEQ ID NO: 516984 - DNA, 25 bp, Rattus norvegicus
gtgtctcagggcactggctcagtag

SEQ ID NO: 516985 - DNA, 25 bp, Rattus norvegicus
gtgtctcagggctctggctcagtag

SEQ ID NO: 516986 - DNA, 25 bp, Rattus norvegicus
gtgtctcagtgcatttcattagttg

SEQ ID NO: 516987 - DNA, 25 bp, Rattus norvegicus
gtgtctcagtgcttttcattagttg

SEQ ID NO: 516988 - DNA, 25 bp, Rattus norvegicus
gtgtctcatataatcagtccgtcat

SEQ ID NO: 516989 - DNA, 25 bp, Rattus norvegicus
gtgtctcatatattcagtccgtcat

SEQ ID NO: 516990 - DNA, 25 bp, Rattus norvegicus
gtgtctcatcaaagctactctggaa

SEQ ID NO: 516991 - DNA, 25 bp, Rattus norvegicus
gtgtctcatcaatgctactctggaa

SEQ ID NO: 516992 - DNA, 25 bp, Rattus norvegicus
gtgtctcatgcgcttaagtcaacta

SEQ ID NO: 516993 - DNA, 25 bp, Rattus norvegicus
gtgtctcatgcggttaagtcaacta

SEQ ID NO: 516994 - DNA, 25 bp, Rattus norvegicus
gtgtctcatggtccagaattgcaga

SEQ ID NO: 516995 - DNA, 25 bp, Rattus norvegicus
gtgtctcatggtgcagaattgcaga

SEQ ID NO: 516996 - DNA, 25 bp, Rattus norvegicus
gtgtctcattcccaagtgacagtta

SEQ ID NO: 516997 - DNA, 25 bp, Rattus norvegicus
gtgtctcattccgaagtgacagtta

SEQ ID NO: 516998 - DNA, 25 bp, Rattus norvegicus
gtgtctccaatgctgttcggcgcag

SEQ ID NO: 516999 - DNA, 25 bp, Rattus norvegicus
gtgtctccaatggtgttcggcgcag

SEQ ID NO: 517000 - DNA, 25 bp, Rattus norvegicus
gtgtctccacaaatgaagccggtcc

SEQ ID NO: 517001 - DNA, 25 bp, Rattus norvegicus
gtgtctccacaacgccatcaaaacc

SEQ ID NO: 517002 - DNA, 25 bp, Rattus norvegicus
gtgtctccacaaggccatcaaaacc

SEQ ID NO: 517003 - DNA, 25 bp, Rattus norvegicus
gtgtctccacaattgaagccggtcc

SEQ ID NO: 517004 - DNA, 25 bp, Rattus norvegicus
gtgtctccacaccatgtgcagcaga

SEQ ID NO: 517005 - DNA, 25 bp, Rattus norvegicus
gtgtctccacacgatgtgcagcaga

SEQ ID NO: 517006 - DNA, 25 bp, Rattus norvegicus
gtgtctccacgtatcaatcttgttt

SEQ ID NO: 517007 - DNA, 25 bp, Rattus norvegicus
gtgtctccacgtttcaatcttgttt

SEQ ID NO: 517008 - DNA, 25 bp, Rattus norvegicus
gtgtctccagatcctattacaaagt

SEQ ID NO: 517009 - DNA, 25 bp, Rattus norvegicus
gtgtctccagatgctattacaaagt

SEQ ID NO: 517010 - DNA, 25 bp, Rattus norvegicus
gtgtctccagggacttcaagcacaa

SEQ ID NO: 517011 - DNA, 25 bp, Rattus norvegicus
gtgtctccagggtcttcaagcacaa

SEQ ID NO: 517012 - DNA, 25 bp, Rattus norvegicus
gtgtctccagtgcatcagctttaga

SEQ ID NO: 517013 - DNA, 25 bp, Rattus norvegicus
gtgtctccagtggatcagctttaga

SEQ ID NO: 517014 - DNA, 25 bp, Rattus norvegicus
gtgtctccattgacctctagaagga

SEQ ID NO: 517015 - DNA, 25 bp, Rattus norvegicus
gtgtctccattgtcctctagaagga

SEQ ID NO: 517016 - DNA, 25 bp, Rattus norvegicus
gtgtctcccaacactgaatgggtgc

SEQ ID NO: 517017 - DNA, 25 bp, Rattus norvegicus
gtgtctcccaactctgaatgggtgc

SEQ ID NO: 517018 - DNA, 25 bp, Rattus norvegicus
gtgtctcccacaatcattctgaaga

SEQ ID NO: 517019 - DNA, 25 bp, Rattus norvegicus
gtgtctcccacattcattctgaaga

SEQ ID NO: 517020 - DNA, 25 bp, Rattus norvegicus
gtgtctcccactaggactggtggtg

SEQ ID NO: 517021 - DNA, 25 bp, Rattus norvegicus
gtgtctcccacttggactggtggtg

SEQ ID NO: 517022 - DNA, 25 bp, Rattus norvegicus
gtgtctcccagtatttatctcatga

SEQ ID NO: 517023 - DNA, 25 bp, Rattus norvegicus
gtgtctcccagtttttatctcatga

SEQ ID NO: 517024 - DNA, 25 bp, Rattus norvegicus
gtgtctcccatcatggcaacacctg

SEQ ID NO: 517025 - DNA, 25 bp, Rattus norvegicus
gtgtctcccatcttggcaacacctg

SEQ ID NO: 517026 - DNA, 25 bp, Rattus norvegicus
gtgtctccccggctagattgtaagc

SEQ ID NO: 517027 - DNA, 25 bp, Rattus norvegicus
gtgtctccccgggtagattgtaagc

SEQ ID NO: 517028 - DNA, 25 bp, Rattus norvegicus
gtgtctcccctgacagtgaaaacca

SEQ ID NO: 517029 - DNA, 25 bp, Rattus norvegicus
gtgtctcccctgtcagtgaaaacca

SEQ ID NO: 517030 - DNA, 25 bp, Rattus norvegicus
gtgtctcccgatctactgtagagat

SEQ ID NO: 517031 - DNA, 25 bp, Rattus norvegicus
gtgtctcccgatgtactgtagagat

SEQ ID NO: 517032 - DNA, 25 bp, Rattus norvegicus
gtgtctcccttcaacattgtaacag

SEQ ID NO: 517033 - DNA, 25 bp, Rattus norvegicus
gtgtctcccttctacattgtaacag

SEQ ID NO: 517034 - DNA, 25 bp, Rattus norvegicus
gtgtctcctacaccatgatgaccca

SEQ ID NO: 517035 - DNA, 25 bp, Rattus norvegicus
gtgtctcctacagcatgatgaccca

SEQ ID NO: 517036 - DNA, 25 bp, Rattus norvegicus
gtgtctcctacccaatggtgccaaa

SEQ ID NO: 517037 - DNA, 25 bp, Rattus norvegicus
gtgtctcctaccgaatggtgccaaa

SEQ ID NO: 517038 - DNA, 25 bp, Rattus norvegicus
gtgtctcctcaaaacagtaagccaa

SEQ ID NO: 517039 - DNA, 25 bp, Rattus norvegicus
gtgtctcctcaacgaaactggcgac

SEQ ID NO: 517040 - DNA, 25 bp, Rattus norvegicus
gtgtctcctcaaggaaactggcgac

SEQ ID NO: 517041 - DNA, 25 bp, Rattus norvegicus
gtgtctcctcaatacagtaagccaa

SEQ ID NO: 517042 - DNA, 25 bp, Rattus norvegicus
gtgtctcctcagcacattttactgt

SEQ ID NO: 517043 - DNA, 25 bp, Rattus norvegicus
gtgtctcctcaggacattttactgt

SEQ ID NO: 517044 - DNA, 25 bp, Rattus norvegicus
gtgtctcctgccctcgttgttagag

SEQ ID NO: 517045 - DNA, 25 bp, Rattus norvegicus
gtgtctcctgccgtcgttgttagag

SEQ ID NO: 517046 - DNA, 25 bp, Rattus norvegicus
gtgtctcctgctaagttaatgctcc

SEQ ID NO: 517047 - DNA, 25 bp, Rattus norvegicus
gtgtctcctgcttagttaatgctcc

SEQ ID NO: 517048 - DNA, 25 bp, Rattus norvegicus
gtgtctcctgtgatgagcagctgtc

SEQ ID NO: 517049 - DNA, 25 bp, Rattus norvegicus
gtgtctcctgtgttgagcagctgtc

SEQ ID NO: 517050 - DNA, 25 bp, Rattus norvegicus
gtgtctccttttcgaaatctattga

SEQ ID NO: 517051 - DNA, 25 bp, Rattus norvegicus
gtgtctccttttggaaatctattga

SEQ ID NO: 517052 - DNA, 25 bp, Rattus norvegicus
gtgtctcgctatctaacctaggctg

SEQ ID NO: 517053 - DNA, 25 bp, Rattus norvegicus
gtgtctcgctatgtaacctaggctg

SEQ ID NO: 517054 - DNA, 25 bp, Rattus norvegicus
gtgtctcgtcccaagcatttttaaa

SEQ ID NO: 517055 - DNA, 25 bp, Rattus norvegicus
gtgtctcgtccctagcatttttaaa

SEQ ID NO: 517056 - DNA, 25 bp, Rattus norvegicus
gtgtctcgtctccacaatatgatgt

SEQ ID NO: 517057 - DNA, 25 bp, Rattus norvegicus
gtgtctcgtctcgacaatatgatgt

SEQ ID NO: 517058 - DNA, 25 bp, Rattus norvegicus
gtgtctcgttctatgtagtattgat

SEQ ID NO: 517059 - DNA, 25 bp, Rattus norvegicus
gtgtctcgttctttgtagtattgat

SEQ ID NO: 517060 - DNA, 25 bp, Rattus norvegicus
gtgtctctaaggctgtttctttctt

SEQ ID NO: 517061 - DNA, 25 bp, Rattus norvegicus
gtgtctctaagggtgtttctttctt

SEQ ID NO: 517062 - DNA, 25 bp, Rattus norvegicus
gtgtctctactgattgcttcaacta

SEQ ID NO: 517063 - DNA, 25 bp, Rattus norvegicus
gtgtctctactgtttgcttcaacta

SEQ ID NO: 517064 - DNA, 25 bp, Rattus norvegicus
gtgtctctacttcactttctaggca

SEQ ID NO: 517065 - DNA, 25 bp, Rattus norvegicus
gtgtctctacttgactttctaggca

SEQ ID NO: 517066 - DNA, 25 bp, Rattus norvegicus
gtgtctctagacaggtttagccaac

SEQ ID NO: 517067 - DNA, 25 bp, Rattus norvegicus
gtgtctctagactggtttagccaac

SEQ ID NO: 517068 - DNA, 25 bp, Rattus norvegicus
gtgtctctagccatcatataatcat

SEQ ID NO: 517069 - DNA, 25 bp, Rattus norvegicus
gtgtctctagccttcatataatcat

SEQ ID NO: 517070 - DNA, 25 bp, Rattus norvegicus
gtgtctctcaatcgttccatttgta

SEQ ID NO: 517071 - DNA, 25 bp, Rattus norvegicus
gtgtctctcaatggttccatttgta

SEQ ID NO: 517072 - DNA, 25 bp, Rattus norvegicus
gtgtctctcagtataaagccatgct

SEQ ID NO: 517073 - DNA, 25 bp, Rattus norvegicus
gtgtctctcagtttaaagccatgct

SEQ ID NO: 517074 - DNA, 25 bp, Rattus norvegicus
gtgtctctccaacagaatgaggtat

SEQ ID NO: 517075 - DNA, 25 bp, Rattus norvegicus
gtgtctctccaagagaatgaggtat

SEQ ID NO: 517076 - DNA, 25 bp, Rattus norvegicus
gtgtctctccatcacagatttccat

SEQ ID NO: 517077 - DNA, 25 bp, Rattus norvegicus
gtgtctctccatgacagatttccat

SEQ ID NO: 517078 - DNA, 25 bp, Rattus norvegicus
gtgtctctcgctatgaacatcattg

SEQ ID NO: 517079 - DNA, 25 bp, Rattus norvegicus
gtgtctctcgctttgaacatcattg

SEQ ID NO: 517080 - DNA, 25 bp, Rattus norvegicus
gtgtctctcgggattcattgtgaga

SEQ ID NO: 517081 - DNA, 25 bp, Rattus norvegicus
gtgtctctcgggtttcattgtgaga

SEQ ID NO: 517082 - DNA, 25 bp, Rattus norvegicus
gtgtctctctccacatgtgtaaatg

SEQ ID NO: 517083 - DNA, 25 bp, Rattus norvegicus
gtgtctctctcctcatgtgtaaatg

SEQ ID NO: 517084 - DNA, 25 bp, Rattus norvegicus
gtgtctctcttaacctcaggattta

SEQ ID NO: 517085 - DNA, 25 bp, Rattus norvegicus
gtgtctctcttacctgttgacgtca

SEQ ID NO: 517086 - DNA, 25 bp, Rattus norvegicus
gtgtctctcttagctgttgacgtca

SEQ ID NO: 517087 - DNA, 25 bp, Rattus norvegicus
gtgtctctcttatcctcaggattta

SEQ ID NO: 517088 - DNA, 25 bp, Rattus norvegicus
gtgtctctgaacaatctgagtgctg

SEQ ID NO: 517089 - DNA, 25 bp, Rattus norvegicus
gtgtctctgaactatctgagtgctg

SEQ ID NO: 517090 - DNA, 25 bp, Rattus norvegicus
gtgtctctgacaaagcatactctgg

SEQ ID NO: 517091 - DNA, 25 bp, Rattus norvegicus
gtgtctctgacatagcatactctgg

SEQ ID NO: 517092 - DNA, 25 bp, Rattus norvegicus
gtgtctctgactatatcatctgtct

SEQ ID NO: 517093 - DNA, 25 bp, Rattus norvegicus
gtgtctctgactttatcatctgtct

SEQ ID NO: 517094 - DNA, 25 bp, Rattus norvegicus
gtgtctctgcacaaggtggcacctt

SEQ ID NO: 517095 - DNA, 25 bp, Rattus norvegicus
gtgtctctgcactaggtggcacctt

SEQ ID NO: 517096 - DNA, 25 bp, Rattus norvegicus
gtgtctctgccaaacacagttgctt

SEQ ID NO: 517097 - DNA, 25 bp, Rattus norvegicus
gtgtctctgccatacacagttgctt

SEQ ID NO: 517098 - DNA, 25 bp, Rattus norvegicus
gtgtctctggtacccaggacagcca

SEQ ID NO: 517099 - DNA, 25 bp, Rattus norvegicus
gtgtctctggtagccaggacagcca

SEQ ID NO: 517100 - DNA, 25 bp, Rattus norvegicus
gtgtctctgtagagataacaagttt

SEQ ID NO: 517101 - DNA, 25 bp, Rattus norvegicus
gtgtctctgtagtgataacaagttt

SEQ ID NO: 517102 - DNA, 25 bp, Rattus norvegicus
gtgtctctgtccatgaaagttgtca

SEQ ID NO: 517103 - DNA, 25 bp, Rattus norvegicus
gtgtctctgtccttgaaagttgtca

SEQ ID NO: 517104 - DNA, 25 bp, Rattus norvegicus
gtgtctctgtgtaatctctttagaa

SEQ ID NO: 517105 - DNA, 25 bp, Rattus norvegicus
gtgtctctgtgttatctctttagaa

SEQ ID NO: 517106 - DNA, 25 bp, Rattus norvegicus
gtgtctcttaagattccctggaatc

SEQ ID NO: 517107 - DNA, 25 bp, Rattus norvegicus
gtgtctcttaagtttccctggaatc

SEQ ID NO: 517108 - DNA, 25 bp, Rattus norvegicus
gtgtctcttcacacagaacttctac

SEQ ID NO: 517109 - DNA, 25 bp, Rattus norvegicus
gtgtctcttcactcagaacttctac

SEQ ID NO: 517110 - DNA, 25 bp, Rattus norvegicus
gtgtctcttctcatgcccagtgtgt

SEQ ID NO: 517111 - DNA, 25 bp, Rattus norvegicus
gtgtctcttctcttgcccagtgtgt

SEQ ID NO: 517112 - DNA, 25 bp, Rattus norvegicus
gtgtctcttctgacattccaaatgt

SEQ ID NO: 517113 - DNA, 25 bp, Rattus norvegicus
gtgtctcttctgtcattccaaatgt

SEQ ID NO: 517114 - DNA, 25 bp, Rattus norvegicus
gtgtctcttgttcccttcattagaa

SEQ ID NO: 517115 - DNA, 25 bp, Rattus norvegicus
gtgtctcttgttgccttcattagaa

SEQ ID NO: 517116 - DNA, 25 bp, Rattus norvegicus
gtgtctctttcaatttaggctgcaa

SEQ ID NO: 517117 - DNA, 25 bp, Rattus norvegicus
gtgtctctttcattttaggctgcaa

SEQ ID NO: 517118 - DNA, 25 bp, Rattus norvegicus
gtgtctcttttgattctctgtcata

SEQ ID NO: 517119 - DNA, 25 bp, Rattus norvegicus
gtgtctcttttgtttctctgtcata

SEQ ID NO: 517120 - DNA, 25 bp, Rattus norvegicus
gtgtctgaaactaccccaccaggat

SEQ ID NO: 517121 - DNA, 25 bp, Rattus norvegicus
gtgtctgaaactcccaggatgctgg

SEQ ID NO: 517122 - DNA, 25 bp, Rattus norvegicus
gtgtctgaaactgccaggatgctgg

SEQ ID NO: 517123 - DNA, 25 bp, Rattus norvegicus
gtgtctgaaacttccccaccaggat

SEQ ID NO: 517124 - DNA, 25 bp, Rattus norvegicus
gtgtctgaaatactacttaaaactc

SEQ ID NO: 517125 - DNA, 25 bp, Rattus norvegicus
gtgtctgaaatagtacttaaaactc

SEQ ID NO: 517126 - DNA, 25 bp, Rattus norvegicus
gtgtctgaaatgcttcaaagtggtc

SEQ ID NO: 517127 - DNA, 25 bp, Rattus norvegicus
gtgtctgaaatggttcaaagtggtc

SEQ ID NO: 517128 - DNA, 25 bp, Rattus norvegicus
gtgtctgaaattctggtggtcctga

SEQ ID NO: 517129 - DNA, 25 bp, Rattus norvegicus
gtgtctgaaattgtggtggtcctga

SEQ ID NO: 517130 - DNA, 25 bp, Rattus norvegicus
gtgtctgaacagctattgaacctgt

SEQ ID NO: 517131 - DNA, 25 bp, Rattus norvegicus
gtgtctgaacaggtattgaacctgt

SEQ ID NO: 517132 - DNA, 25 bp, Rattus norvegicus
gtgtctgaagtcactcatactctgg

SEQ ID NO: 517133 - DNA, 25 bp, Rattus norvegicus
gtgtctgaagtctctcatactctgg

SEQ ID NO: 517134 - DNA, 25 bp, Rattus norvegicus
gtgtctgaatccataatggccttaa

SEQ ID NO: 517135 - DNA, 25 bp, Rattus norvegicus
gtgtctgaatccttaatggccttaa

SEQ ID NO: 517136 - DNA, 25 bp, Rattus norvegicus
gtgtctgaatctacttgtttcctga

SEQ ID NO: 517137 - DNA, 25 bp, Rattus norvegicus
gtgtctgaatcttcttgtttcctga

SEQ ID NO: 517138 - DNA, 25 bp, Rattus norvegicus
gtgtctgacaccataaccagcttta

SEQ ID NO: 517139 - DNA, 25 bp, Rattus norvegicus
gtgtctgacaccttaaccagcttta

SEQ ID NO: 517140 - DNA, 25 bp, Rattus norvegicus
gtgtctgacatcctgggatctgcta

SEQ ID NO: 517141 - DNA, 25 bp, Rattus norvegicus
gtgtctgacatcgtgggatctgcta

SEQ ID NO: 517142 - DNA, 25 bp, Rattus norvegicus
gtgtctgacattctaacatcttcca

SEQ ID NO: 517143 - DNA, 25 bp, Rattus norvegicus
gtgtctgacattgtaacatcttcca

SEQ ID NO: 517144 - DNA, 25 bp, Rattus norvegicus
gtgtctgaccatctctgcacaaggt

SEQ ID NO: 517145 - DNA, 25 bp, Rattus norvegicus
gtgtctgaccatcttagagtagttg

SEQ ID NO: 517146 - DNA, 25 bp, Rattus norvegicus
gtgtctgaccatgtctgcacaaggt

SEQ ID NO: 517147 - DNA, 25 bp, Rattus norvegicus
gtgtctgaccatgttagagtagttg

SEQ ID NO: 517148 - DNA, 25 bp, Rattus norvegicus
gtgtctgacctaatgcttggcactg

SEQ ID NO: 517149 - DNA, 25 bp, Rattus norvegicus
gtgtctgacctattgcttggcactg

SEQ ID NO: 517150 - DNA, 25 bp, Rattus norvegicus
gtgtctgactggcaacaaaccacta

SEQ ID NO: 517151 - DNA, 25 bp, Rattus norvegicus
gtgtctgactgggaacaaaccacta

SEQ ID NO: 517152 - DNA, 25 bp, Rattus norvegicus
gtgtctgactttcccaagctgccca

SEQ ID NO: 517153 - DNA, 25 bp, Rattus norvegicus
gtgtctgactttgccaagctgccca

SEQ ID NO: 517154 - DNA, 25 bp, Rattus norvegicus
gtgtctgagagcacgggcagcatcc

SEQ ID NO: 517155 - DNA, 25 bp, Rattus norvegicus
gtgtctgagagctcgggcagcatcc

SEQ ID NO: 517156 - DNA, 25 bp, Rattus norvegicus
gtgtctgagatactgactgtcattt

SEQ ID NO: 517157 - DNA, 25 bp, Rattus norvegicus
gtgtctgagatagtgactgtcattt

SEQ ID NO: 517158 - DNA, 25 bp, Rattus norvegicus
gtgtctgagcttatgaacatgcccc

SEQ ID NO: 517159 - DNA, 25 bp, Rattus norvegicus
gtgtctgagcttttgaacatgcccc

SEQ ID NO: 517160 - DNA, 25 bp, Rattus norvegicus
gtgtctgaggccagagaatcgtcat

SEQ ID NO: 517161 - DNA, 25 bp, Rattus norvegicus
gtgtctgaggcctgagaatcgtcat

SEQ ID NO: 517162 - DNA, 25 bp, Rattus norvegicus
gtgtctgaggtgattcgttgtccac

SEQ ID NO: 517163 - DNA, 25 bp, Rattus norvegicus
gtgtctgaggtgtttcgttgtccac

SEQ ID NO: 517164 - DNA, 25 bp, Rattus norvegicus
gtgtctgataacaaggcttccctgc

SEQ ID NO: 517165 - DNA, 25 bp, Rattus norvegicus
gtgtctgataactaggcttccctgc

SEQ ID NO: 517166 - DNA, 25 bp, Rattus norvegicus
gtgtctgatacaccaccaagtagta

SEQ ID NO: 517167 - DNA, 25 bp, Rattus norvegicus
gtgtctgatacagcaccaagtagta

SEQ ID NO: 517168 - DNA, 25 bp, Rattus norvegicus
gtgtctgatgtgattaggatgtcct

SEQ ID NO: 517169 - DNA, 25 bp, Rattus norvegicus
gtgtctgatgtgtttaggatgtcct

SEQ ID NO: 517170 - DNA, 25 bp, Rattus norvegicus
gtgtctgattcccatttctcttgag

SEQ ID NO: 517171 - DNA, 25 bp, Rattus norvegicus
gtgtctgattccgatttctcttgag

SEQ ID NO: 517172 - DNA, 25 bp, Rattus norvegicus
gtgtctgatttcaccccaatggaca

SEQ ID NO: 517173 - DNA, 25 bp, Rattus norvegicus
gtgtctgatttctccccaatggaca

SEQ ID NO: 517174 - DNA, 25 bp, Rattus norvegicus
gtgtctgcaaatactaccctacata

SEQ ID NO: 517175 - DNA, 25 bp, Rattus norvegicus
gtgtctgcaaattctaccctacata

SEQ ID NO: 517176 - DNA, 25 bp, Rattus norvegicus
gtgtctgcaagccttatagcgtgat

SEQ ID NO: 517177 - DNA, 25 bp, Rattus norvegicus
gtgtctgcaagcgttatagcgtgat

SEQ ID NO: 517178 - DNA, 25 bp, Rattus norvegicus
gtgtctgcaaggagtcctgagttta

SEQ ID NO: 517179 - DNA, 25 bp, Rattus norvegicus
gtgtctgcaaggtgtcctgagttta

SEQ ID NO: 517180 - DNA, 25 bp, Rattus norvegicus
gtgtctgcacacagcctgaaatcca

SEQ ID NO: 517181 - DNA, 25 bp, Rattus norvegicus
gtgtctgcacactgcctgaaatcca

SEQ ID NO: 517182 - DNA, 25 bp, Rattus norvegicus
gtgtctgcacccagatatctggcta

SEQ ID NO: 517183 - DNA, 25 bp, Rattus norvegicus
gtgtctgcaccctgatatctggcta

SEQ ID NO: 517184 - DNA, 25 bp, Rattus norvegicus
gtgtctgcagacagcgtgagttcct

SEQ ID NO: 517185 - DNA, 25 bp, Rattus norvegicus
gtgtctgcagactgcgtgagttcct

SEQ ID NO: 517186 - DNA, 25 bp, Rattus norvegicus
gtgtctgcagatagccacaagcttt

SEQ ID NO: 517187 - DNA, 25 bp, Rattus norvegicus
gtgtctgcagattgccacaagcttt

SEQ ID NO: 517188 - DNA, 25 bp, Rattus norvegicus
gtgtctgcaggtatcagtcaccaca

SEQ ID NO: 517189 - DNA, 25 bp, Rattus norvegicus
gtgtctgcaggtttcagtcaccaca

SEQ ID NO: 517190 - DNA, 25 bp, Rattus norvegicus
gtgtctgcagtgctgaagtcgtttc

SEQ ID NO: 517191 - DNA, 25 bp, Rattus norvegicus
gtgtctgcagtggtgaagtcgtttc

SEQ ID NO: 517192 - DNA, 25 bp, Rattus norvegicus
gtgtctgccaccagtacggttggga

SEQ ID NO: 517193 - DNA, 25 bp, Rattus norvegicus
gtgtctgccacctgtacggttggga

SEQ ID NO: 517194 - DNA, 25 bp, Rattus norvegicus
gtgtctgccagacctgcacgagcgt

SEQ ID NO: 517195 - DNA, 25 bp, Rattus norvegicus
gtgtctgccagagctgcacgagcgt

SEQ ID NO: 517196 - DNA, 25 bp, Rattus norvegicus
gtgtctgccatgatggagctttgac

SEQ ID NO: 517197 - DNA, 25 bp, Rattus norvegicus
gtgtctgccatgttggagctttgac

SEQ ID NO: 517198 - DNA, 25 bp, Rattus norvegicus
gtgtctgccctacaaattgatctgt

SEQ ID NO: 517199 - DNA, 25 bp, Rattus norvegicus
gtgtctgccctagaaattgatctgt

SEQ ID NO: 517200 - DNA, 25 bp, Rattus norvegicus
gtgtctgcctaccatcattttaatt

SEQ ID NO: 517201 - DNA, 25 bp, Rattus norvegicus
gtgtctgcctacgatcattttaatt

SEQ ID NO: 517202 - DNA, 25 bp, Rattus norvegicus
gtgtctgcctctatttaagctctaa

SEQ ID NO: 517203 - DNA, 25 bp, Rattus norvegicus
gtgtctgcctctttttaagctctaa

SEQ ID NO: 517204 - DNA, 25 bp, Rattus norvegicus
gtgtctgcgcttccattcatactgt

SEQ ID NO: 517205 - DNA, 25 bp, Rattus norvegicus
gtgtctgcgcttgcattcatactgt

SEQ ID NO: 517206 - DNA, 25 bp, Rattus norvegicus
gtgtctgcggcacagactggcacca

SEQ ID NO: 517207 - DNA, 25 bp, Rattus norvegicus
gtgtctgcggcagagactggcacca

SEQ ID NO: 517208 - DNA, 25 bp, Rattus norvegicus
gtgtctgctcatatattccactcta

SEQ ID NO: 517209 - DNA, 25 bp, Rattus norvegicus
gtgtctgctcatttattccactcta

SEQ ID NO: 517210 - DNA, 25 bp, Rattus norvegicus
gtgtctgctcccctgaagtagtaat

SEQ ID NO: 517211 - DNA, 25 bp, Rattus norvegicus
gtgtctgctcccgtgaagtagtaat

SEQ ID NO: 517212 - DNA, 25 bp, Rattus norvegicus
gtgtctgctctacctcagtgtgaag

SEQ ID NO: 517213 - DNA, 25 bp, Rattus norvegicus
gtgtctgctctagctcagtgtgaag

SEQ ID NO: 517214 - DNA, 25 bp, Rattus norvegicus
gtgtctgctcttatgtttgggcatc

SEQ ID NO: 517215 - DNA, 25 bp, Rattus norvegicus
gtgtctgctcttttgtttgggcatc

SEQ ID NO: 517216 - DNA, 25 bp, Rattus norvegicus
gtgtctgctggtcatgtgctagata

SEQ ID NO: 517217 - DNA, 25 bp, Rattus norvegicus
gtgtctgctggtgatgtgctagata

SEQ ID NO: 517218 - DNA, 25 bp, Rattus norvegicus
gtgtctgcttgcatcaaccgaggat

SEQ ID NO: 517219 - DNA, 25 bp, Rattus norvegicus
gtgtctgcttgcttcaaccgaggat

SEQ ID NO: 517220 - DNA, 25 bp, Rattus norvegicus
gtgtctgctttactcagaagctgct

SEQ ID NO: 517221 - DNA, 25 bp, Rattus norvegicus
gtgtctgctttagtcagaagctgct

SEQ ID NO: 517222 - DNA, 25 bp, Rattus norvegicus
gtgtctggaagcattcaccagccaa

SEQ ID NO: 517223 - DNA, 25 bp, Rattus norvegicus
gtgtctggaagctttcaccagccaa

SEQ ID NO: 517224 - DNA, 25 bp, Rattus norvegicus
gtgtctggaatgcttatggcctaac

SEQ ID NO: 517225 - DNA, 25 bp, Rattus norvegicus
gtgtctggaatggttatggcctaac

SEQ ID NO: 517226 - DNA, 25 bp, Rattus norvegicus
gtgtctggctaactgtgctgcacat

SEQ ID NO: 517227 - DNA, 25 bp, Rattus norvegicus
gtgtctggctaagtgtgctgcacat

SEQ ID NO: 517228 - DNA, 25 bp, Rattus norvegicus
gtgtctggctacattgcacatctgc

SEQ ID NO: 517229 - DNA, 25 bp, Rattus norvegicus
gtgtctggctactttgcacatctgc

SEQ ID NO: 517230 - DNA, 25 bp, Rattus norvegicus
gtgtctggctttcacagagtatcta

SEQ ID NO: 517231 - DNA, 25 bp, Rattus norvegicus
gtgtctggctttgacagagtatcta

SEQ ID NO: 517232 - DNA, 25 bp, Rattus norvegicus
gtgtctgggatccatgtactccttt

SEQ ID NO: 517233 - DNA, 25 bp, Rattus norvegicus
gtgtctgggatcgatgtactccttt

SEQ ID NO: 517234 - DNA, 25 bp, Rattus norvegicus
gtgtctgggctactaaaccaatttt

SEQ ID NO: 517235 - DNA, 25 bp, Rattus norvegicus
gtgtctgggctagtaaaccaatttt

SEQ ID NO: 517236 - DNA, 25 bp, Rattus norvegicus
gtgtctggtcacatatttctctaaa

SEQ ID NO: 517237 - DNA, 25 bp, Rattus norvegicus
gtgtctggtcacttatttctctaaa

SEQ ID NO: 517238 - DNA, 25 bp, Rattus norvegicus
gtgtctggtcagaactgttacctgc

SEQ ID NO: 517239 - DNA, 25 bp, Rattus norvegicus
gtgtctggtcagtactgttacctgc

SEQ ID NO: 517240 - DNA, 25 bp, Rattus norvegicus
gtgtctggttgtcctttgtttgaag

SEQ ID NO: 517241 - DNA, 25 bp, Rattus norvegicus
gtgtctggttgtgctttgtttgaag

SEQ ID NO: 517242 - DNA, 25 bp, Rattus norvegicus
gtgtctggtttcactagctatcgca

SEQ ID NO: 517243 - DNA, 25 bp, Rattus norvegicus
gtgtctggtttctctagctatcgca

SEQ ID NO: 517244 - DNA, 25 bp, Rattus norvegicus
gtgtctgtaagtcggcttcaggcta

SEQ ID NO: 517245 - DNA, 25 bp, Rattus norvegicus
gtgtctgtaagtgggcttcaggcta

SEQ ID NO: 517246 - DNA, 25 bp, Rattus norvegicus
gtgtctgtaatcagccactgttagg

SEQ ID NO: 517247 - DNA, 25 bp, Rattus norvegicus
gtgtctgtaatctgccactgttagg

SEQ ID NO: 517248 - DNA, 25 bp, Rattus norvegicus
gtgtctgtaccacgaccttgatttt

SEQ ID NO: 517249 - DNA, 25 bp, Rattus norvegicus
gtgtctgtaccaggaccttgatttt

SEQ ID NO: 517250 - DNA, 25 bp, Rattus norvegicus
gtgtctgtactaaggccccagagga

SEQ ID NO: 517251 - DNA, 25 bp, Rattus norvegicus
gtgtctgtactatggccccagagga

SEQ ID NO: 517252 - DNA, 25 bp, Rattus norvegicus
gtgtctgtacttcttgagcatctct

SEQ ID NO: 517253 - DNA, 25 bp, Rattus norvegicus
gtgtctgtacttgttgagcatctct

SEQ ID NO: 517254 - DNA, 25 bp, Rattus norvegicus
gtgtctgtatacacgccaaaggcag

SEQ ID NO: 517255 - DNA, 25 bp, Rattus norvegicus
gtgtctgtatactcgccaaaggcag

SEQ ID NO: 517256 - DNA, 25 bp, Rattus norvegicus
gtgtctgtatggaattcggagcccc

SEQ ID NO: 517257 - DNA, 25 bp, Rattus norvegicus
gtgtctgtatggtattcggagcccc

SEQ ID NO: 517258 - DNA, 25 bp, Rattus norvegicus
gtgtctgtatgtcagagttttcctt

SEQ ID NO: 517259 - DNA, 25 bp, Rattus norvegicus
gtgtctgtatgtgagagttttcctt

SEQ ID NO: 517260 - DNA, 25 bp, Rattus norvegicus
gtgtctgtcacaactcaatgtggct

SEQ ID NO: 517261 - DNA, 25 bp, Rattus norvegicus
gtgtctgtcacatctcaatgtggct

SEQ ID NO: 517262 - DNA, 25 bp, Rattus norvegicus
gtgtctgtcagtatccatgcataaa

SEQ ID NO: 517263 - DNA, 25 bp, Rattus norvegicus
gtgtctgtcagtttccatgcataaa

SEQ ID NO: 517264 - DNA, 25 bp, Rattus norvegicus
gtgtctgtcatgaaaccattcctaa

SEQ ID NO: 517265 - DNA, 25 bp, Rattus norvegicus
gtgtctgtcatgtaaccattcctaa

SEQ ID NO: 517266 - DNA, 25 bp, Rattus norvegicus
gtgtctgtcattcatgagccatcat

SEQ ID NO: 517267 - DNA, 25 bp, Rattus norvegicus
gtgtctgtcattgatgagccatcat

SEQ ID NO: 517268 - DNA, 25 bp, Rattus norvegicus
gtgtctgtccagctcaacattcacc

SEQ ID NO: 517269 - DNA, 25 bp, Rattus norvegicus
gtgtctgtccagctttcactgtgca

SEQ ID NO: 517270 - DNA, 25 bp, Rattus norvegicus
gtgtctgtccaggtcaacattcacc

SEQ ID NO: 517271 - DNA, 25 bp, Rattus norvegicus
gtgtctgtccaggtttcactgtgca

SEQ ID NO: 517272 - DNA, 25 bp, Rattus norvegicus
gtgtctgtcggtactcctttgagaa

SEQ ID NO: 517273 - DNA, 25 bp, Rattus norvegicus
gtgtctgtcggttctcctttgagaa

SEQ ID NO: 517274 - DNA, 25 bp, Rattus norvegicus
gtgtctgtctcaaccctttaagaac

SEQ ID NO: 517275 - DNA, 25 bp, Rattus norvegicus
gtgtctgtctcatccctttaagaac

SEQ ID NO: 517276 - DNA, 25 bp, Rattus norvegicus
gtgtctgtctctaagaacatgctta

SEQ ID NO: 517277 - DNA, 25 bp, Rattus norvegicus
gtgtctgtctcttagaacatgctta

SEQ ID NO: 517278 - DNA, 25 bp, Rattus norvegicus
gtgtctgtctgcaaaatgggcacca

SEQ ID NO: 517279 - DNA, 25 bp, Rattus norvegicus
gtgtctgtctgcaagacttcatgca

SEQ ID NO: 517280 - DNA, 25 bp, Rattus norvegicus
gtgtctgtctgctaaatgggcacca

SEQ ID NO: 517281 - DNA, 25 bp, Rattus norvegicus
gtgtctgtctgctagacttcatgca

SEQ ID NO: 517282 - DNA, 25 bp, Rattus norvegicus
gtgtctgtcttgacttttgtctctt

SEQ ID NO: 517283 - DNA, 25 bp, Rattus norvegicus
gtgtctgtcttgtcttttgtctctt

SEQ ID NO: 517284 - DNA, 25 bp, Rattus norvegicus
gtgtctgtgaaaaccctgctttaaa

SEQ ID NO: 517285 - DNA, 25 bp, Rattus norvegicus
gtgtctgtgaaatccctgctttaaa

SEQ ID NO: 517286 - DNA, 25 bp, Rattus norvegicus
gtgtctgtgaacaacaactgtgcca

SEQ ID NO: 517287 - DNA, 25 bp, Rattus norvegicus
gtgtctgtgaactacaactgtgcca

SEQ ID NO: 517288 - DNA, 25 bp, Rattus norvegicus
gtgtctgtgaccaggattctaggtg

SEQ ID NO: 517289 - DNA, 25 bp, Rattus norvegicus
gtgtctgtgacctggattctaggtg

SEQ ID NO: 517290 - DNA, 25 bp, Rattus norvegicus
gtgtctgtgaggcactcgatgcaac

SEQ ID NO: 517291 - DNA, 25 bp, Rattus norvegicus
gtgtctgtgagggactcgatgcaac

SEQ ID NO: 517292 - DNA, 25 bp, Rattus norvegicus
gtgtctgtgatcagtctccagcaca

SEQ ID NO: 517293 - DNA, 25 bp, Rattus norvegicus
gtgtctgtgatctgtctccagcaca

SEQ ID NO: 517294 - DNA, 25 bp, Rattus norvegicus
gtgtctgtgatgatacagcctttcg

SEQ ID NO: 517295 - DNA, 25 bp, Rattus norvegicus
gtgtctgtgatgttacagcctttcg

SEQ ID NO: 517296 - DNA, 25 bp, Rattus norvegicus
gtgtctgtgctactagacccaggcc

SEQ ID NO: 517297 - DNA, 25 bp, Rattus norvegicus
gtgtctgtgctagtagacccaggcc

SEQ ID NO: 517298 - DNA, 25 bp, Rattus norvegicus
gtgtctgtgctcaaaggactgcctt

SEQ ID NO: 517299 - DNA, 25 bp, Rattus norvegicus
gtgtctgtgctctaaggactgcctt

SEQ ID NO: 517300 - DNA, 25 bp, Rattus norvegicus
gtgtctgtgcttatcagaattactt

SEQ ID NO: 517301 - DNA, 25 bp, Rattus norvegicus
gtgtctgtgcttttcagaattactt

SEQ ID NO: 517302 - DNA, 25 bp, Rattus norvegicus
gtgtctgtggacactcgtggacagc

SEQ ID NO: 517303 - DNA, 25 bp, Rattus norvegicus
gtgtctgtggactctcgtggacagc

SEQ ID NO: 517304 - DNA, 25 bp, Rattus norvegicus
gtgtctgtggcaatctctataaagt

SEQ ID NO: 517305 - DNA, 25 bp, Rattus norvegicus
gtgtctgtggcaatgtgtctttata

SEQ ID NO: 517306 - DNA, 25 bp, Rattus norvegicus
gtgtctgtggcattctctataaagt

SEQ ID NO: 517307 - DNA, 25 bp, Rattus norvegicus
gtgtctgtggcattgtgtctttata

SEQ ID NO: 517308 - DNA, 25 bp, Rattus norvegicus
gtgtctgtggctcacatgactgcac

SEQ ID NO: 517309 - DNA, 25 bp, Rattus norvegicus
gtgtctgtggctgacatgactgcac

SEQ ID NO: 517310 - DNA, 25 bp, Rattus norvegicus
gtgtctgtgtatacacacaactaga

SEQ ID NO: 517311 - DNA, 25 bp, Rattus norvegicus
gtgtctgtgtattcacacaactaga

SEQ ID NO: 517312 - DNA, 25 bp, Rattus norvegicus
gtgtctgtgtgcataccataacaac

SEQ ID NO: 517313 - DNA, 25 bp, Rattus norvegicus
gtgtctgtgtgcttaccataacaac

SEQ ID NO: 517314 - DNA, 25 bp, Rattus norvegicus
gtgtctgttacaaactattgcatat

SEQ ID NO: 517315 - DNA, 25 bp, Rattus norvegicus
gtgtctgttacatactattgcatat

SEQ ID NO: 517316 - DNA, 25 bp, Rattus norvegicus
gtgtctgttagcagttcaacacgtg

SEQ ID NO: 517317 - DNA, 25 bp, Rattus norvegicus
gtgtctgttagctgttcaacacgtg

SEQ ID NO: 517318 - DNA, 25 bp, Rattus norvegicus
gtgtctgttatgcacatgagtgttt

SEQ ID NO: 517319 - DNA, 25 bp, Rattus norvegicus
gtgtctgttatggacatgagtgttt

SEQ ID NO: 517320 - DNA, 25 bp, Rattus norvegicus
gtgtctgttgagagatggctacctt

SEQ ID NO: 517321 - DNA, 25 bp, Rattus norvegicus
gtgtctgttgagtgatggctacctt

SEQ ID NO: 517322 - DNA, 25 bp, Rattus norvegicus
gtgtctgttgtaattcgttttcttt

SEQ ID NO: 517323 - DNA, 25 bp, Rattus norvegicus
gtgtctgttgtatttcgttttcttt

SEQ ID NO: 517324 - DNA, 25 bp, Rattus norvegicus
gtgtctgttgtcagcttgcaggcac

SEQ ID NO: 517325 - DNA, 25 bp, Rattus norvegicus
gtgtctgttgtctgcttgcaggcac

SEQ ID NO: 517326 - DNA, 25 bp, Rattus norvegicus
gtgtctgtttccagttatgcttctc

SEQ ID NO: 517327 - DNA, 25 bp, Rattus norvegicus
gtgtctgtttcctgttatgcttctc

SEQ ID NO: 517328 - DNA, 25 bp, Rattus norvegicus
gtgtcttaagtaatcacggttattt

SEQ ID NO: 517329 - DNA, 25 bp, Rattus norvegicus
gtgtcttaagtattcacggttattt

SEQ ID NO: 517330 - DNA, 25 bp, Rattus norvegicus
gtgtcttaagtcatgtgctcagctg

SEQ ID NO: 517331 - DNA, 25 bp, Rattus norvegicus
gtgtcttaagtcttgtgctcagctg

SEQ ID NO: 517332 - DNA, 25 bp, Rattus norvegicus
gtgtcttaatatcctttactggctg

SEQ ID NO: 517333 - DNA, 25 bp, Rattus norvegicus
gtgtcttaatatgctttactggctg

SEQ ID NO: 517334 - DNA, 25 bp, Rattus norvegicus
gtgtcttaatctcttgacgacctca

SEQ ID NO: 517335 - DNA, 25 bp, Rattus norvegicus
gtgtcttaatctgttgacgacctca

SEQ ID NO: 517336 - DNA, 25 bp, Rattus norvegicus
gtgtcttaattcactcctaataaac

SEQ ID NO: 517337 - DNA, 25 bp, Rattus norvegicus
gtgtcttaattcatgtcccatctgt

SEQ ID NO: 517338 - DNA, 25 bp, Rattus norvegicus
gtgtcttaattctctcctaataaac

SEQ ID NO: 517339 - DNA, 25 bp, Rattus norvegicus
gtgtcttaattcttgtcccatctgt

SEQ ID NO: 517340 - DNA, 25 bp, Rattus norvegicus
gtgtcttacccacgtagtagccata

SEQ ID NO: 517341 - DNA, 25 bp, Rattus norvegicus
gtgtcttacccaggtagtagccata

SEQ ID NO: 517342 - DNA, 25 bp, Rattus norvegicus
gtgtcttactccatagcaacctgaa

SEQ ID NO: 517343 - DNA, 25 bp, Rattus norvegicus
gtgtcttactccttagcaacctgaa

SEQ ID NO: 517344 - DNA, 25 bp, Rattus norvegicus
gtgtcttactctctagttgagccca

SEQ ID NO: 517345 - DNA, 25 bp, Rattus norvegicus
gtgtcttactctgtagttgagccca

SEQ ID NO: 517346 - DNA, 25 bp, Rattus norvegicus
gtgtcttagaacaagactcccagga

SEQ ID NO: 517347 - DNA, 25 bp, Rattus norvegicus
gtgtcttagaactagactcccagga

SEQ ID NO: 517348 - DNA, 25 bp, Rattus norvegicus
gtgtcttagcttcttcatgaattcc

SEQ ID NO: 517349 - DNA, 25 bp, Rattus norvegicus
gtgtcttagcttgttcatgaattcc

SEQ ID NO: 517350 - DNA, 25 bp, Rattus norvegicus
gtgtcttatacaccatagttcctaa

SEQ ID NO: 517351 - DNA, 25 bp, Rattus norvegicus
gtgtcttatacagcatagttcctaa

SEQ ID NO: 517352 - DNA, 25 bp, Rattus norvegicus
gtgtcttcaaccacggcggttggct

SEQ ID NO: 517353 - DNA, 25 bp, Rattus norvegicus
gtgtcttcaaccaggtactgtttaa

SEQ ID NO: 517354 - DNA, 25 bp, Rattus norvegicus
gtgtcttcaacctcggcggttggct

SEQ ID NO: 517355 - DNA, 25 bp, Rattus norvegicus
gtgtcttcaacctggtactgtttaa

SEQ ID NO: 517356 - DNA, 25 bp, Rattus norvegicus
gtgtcttcacagagctcataggacg

SEQ ID NO: 517357 - DNA, 25 bp, Rattus norvegicus
gtgtcttcacagtgctcataggacg

SEQ ID NO: 517358 - DNA, 25 bp, Rattus norvegicus
gtgtcttcacccagagaataaccaa

SEQ ID NO: 517359 - DNA, 25 bp, Rattus norvegicus
gtgtcttcaccctgagaataaccaa

SEQ ID NO: 517360 - DNA, 25 bp, Rattus norvegicus
gtgtcttcactgaccccagggtaag

SEQ ID NO: 517361 - DNA, 25 bp, Rattus norvegicus
gtgtcttcactgcattttatttaaa

SEQ ID NO: 517362 - DNA, 25 bp, Rattus norvegicus
gtgtcttcactggattttatttaaa

SEQ ID NO: 517363 - DNA, 25 bp, Rattus norvegicus
gtgtcttcactgtccccagggtaag

SEQ ID NO: 517364 - DNA, 25 bp, Rattus norvegicus
gtgtcttcagcacagaacccagtca

SEQ ID NO: 517365 - DNA, 25 bp, Rattus norvegicus
gtgtcttcagcagagaacccagtca

SEQ ID NO: 517366 - DNA, 25 bp, Rattus norvegicus
gtgtcttcagtacaggtaacttctt

SEQ ID NO: 517367 - DNA, 25 bp, Rattus norvegicus
gtgtcttcagtagaggtaacttctt

SEQ ID NO: 517368 - DNA, 25 bp, Rattus norvegicus
gtgtcttcagttacttctccattga

SEQ ID NO: 517369 - DNA, 25 bp, Rattus norvegicus
gtgtcttcagtttcttctccattga

SEQ ID NO: 517370 - DNA, 25 bp, Rattus norvegicus
gtgtcttccagacctgcagccgtgg

SEQ ID NO: 517371 - DNA, 25 bp, Rattus norvegicus
gtgtcttccagagctgcagccgtgg

SEQ ID NO: 517372 - DNA, 25 bp, Rattus norvegicus
gtgtcttcccacatgttttgatagc

SEQ ID NO: 517373 - DNA, 25 bp, Rattus norvegicus
gtgtcttcccacttgttttgatagc

SEQ ID NO: 517374 - DNA, 25 bp, Rattus norvegicus
gtgtcttcccctcgccttgggcgtt

SEQ ID NO: 517375 - DNA, 25 bp, Rattus norvegicus
gtgtcttcccctggccttgggcgtt

SEQ ID NO: 517376 - DNA, 25 bp, Rattus norvegicus
gtgtcttcccgaaaactgggactct

SEQ ID NO: 517377 - DNA, 25 bp, Rattus norvegicus
gtgtcttcccgataactgggactct

SEQ ID NO: 517378 - DNA, 25 bp, Rattus norvegicus
gtgtcttccctgaactatgtgttga

SEQ ID NO: 517379 - DNA, 25 bp, Rattus norvegicus
gtgtcttccctgtactatgtgttga

SEQ ID NO: 517380 - DNA, 25 bp, Rattus norvegicus
gtgtcttcctgcagtagcctgggtt

SEQ ID NO: 517381 - DNA, 25 bp, Rattus norvegicus
gtgtcttcctgctgtagcctgggtt

SEQ ID NO: 517382 - DNA, 25 bp, Rattus norvegicus
gtgtcttcctttctcctttgtgttc

SEQ ID NO: 517383 - DNA, 25 bp, Rattus norvegicus
gtgtcttcctttgtcctttgtgttc

SEQ ID NO: 517384 - DNA, 25 bp, Rattus norvegicus
gtgtcttctaagaaaggatacccca

SEQ ID NO: 517385 - DNA, 25 bp, Rattus norvegicus
gtgtcttctaagtaaggatacccca

SEQ ID NO: 517386 - DNA, 25 bp, Rattus norvegicus
gtgtcttctaccagcaccagatgaa

SEQ ID NO: 517387 - DNA, 25 bp, Rattus norvegicus
gtgtcttctacctgcaccagatgaa

SEQ ID NO: 517388 - DNA, 25 bp, Rattus norvegicus
gtgtcttctcaccttgaaactgcat

SEQ ID NO: 517389 - DNA, 25 bp, Rattus norvegicus
gtgtcttctcacgttgaaactgcat

SEQ ID NO: 517390 - DNA, 25 bp, Rattus norvegicus
gtgtcttctgatctactactgccga

SEQ ID NO: 517391 - DNA, 25 bp, Rattus norvegicus
gtgtcttctgatgtactactgccga

SEQ ID NO: 517392 - DNA, 25 bp, Rattus norvegicus
gtgtcttcttggagcattctacaga

SEQ ID NO: 517393 - DNA, 25 bp, Rattus norvegicus
gtgtcttcttggtgcattctacaga

SEQ ID NO: 517394 - DNA, 25 bp, Rattus norvegicus
gtgtcttgaataaattgctctattt

SEQ ID NO: 517395 - DNA, 25 bp, Rattus norvegicus
gtgtcttgaatatattgctctattt

SEQ ID NO: 517396 - DNA, 25 bp, Rattus norvegicus
gtgtcttgaattaccatctcaatgt

SEQ ID NO: 517397 - DNA, 25 bp, Rattus norvegicus
gtgtcttgaatttccatctcaatgt

SEQ ID NO: 517398 - DNA, 25 bp, Rattus norvegicus
gtgtcttgacatccctgttacagaa

SEQ ID NO: 517399 - DNA, 25 bp, Rattus norvegicus
gtgtcttgacatgcctgttacagaa

SEQ ID NO: 517400 - DNA, 25 bp, Rattus norvegicus
gtgtcttgacttattatcaccacat

SEQ ID NO: 517401 - DNA, 25 bp, Rattus norvegicus
gtgtcttgactttttatcaccacat

SEQ ID NO: 517402 - DNA, 25 bp, Rattus norvegicus
gtgtcttgcaaaacctcccgaaagg

SEQ ID NO: 517403 - DNA, 25 bp, Rattus norvegicus
gtgtcttgcaaatcctcccgaaagg

SEQ ID NO: 517404 - DNA, 25 bp, Rattus norvegicus
gtgtcttgcaatagtccagaagtag

SEQ ID NO: 517405 - DNA, 25 bp, Rattus norvegicus
gtgtcttgcaattgtccagaagtag

SEQ ID NO: 517406 - DNA, 25 bp, Rattus norvegicus
gtgtcttgccagagtttcctacacg

SEQ ID NO: 517407 - DNA, 25 bp, Rattus norvegicus
gtgtcttgccagtgtttcctacacg

SEQ ID NO: 517408 - DNA, 25 bp, Rattus norvegicus
gtgtcttgcctgcactgtggactat

SEQ ID NO: 517409 - DNA, 25 bp, Rattus norvegicus
gtgtcttgcctggactgtggactat

SEQ ID NO: 517410 - DNA, 25 bp, Rattus norvegicus
gtgtcttgctctaggtggctgtgtc

SEQ ID NO: 517411 - DNA, 25 bp, Rattus norvegicus
gtgtcttgctcttggtggctgtgtc

SEQ ID NO: 517412 - DNA, 25 bp, Rattus norvegicus
gtgtcttgctgacacctcaaagtct

SEQ ID NO: 517413 - DNA, 25 bp, Rattus norvegicus
gtgtcttgctgagacctcaaagtct

SEQ ID NO: 517414 - DNA, 25 bp, Rattus norvegicus
gtgtcttgcttcactgttcctgtta

SEQ ID NO: 517415 - DNA, 25 bp, Rattus norvegicus
gtgtcttgcttctctgttcctgtta

SEQ ID NO: 517416 - DNA, 25 bp, Rattus norvegicus
gtgtcttgctttatgatgggtacca

SEQ ID NO: 517417 - DNA, 25 bp, Rattus norvegicus
gtgtcttgctttttgatgggtacca

SEQ ID NO: 517418 - DNA, 25 bp, Rattus norvegicus
gtgtcttggtctctgtacagttgca

SEQ ID NO: 517419 - DNA, 25 bp, Rattus norvegicus
gtgtcttggtctgtgtacagttgca

SEQ ID NO: 517420 - DNA, 25 bp, Rattus norvegicus
gtgtcttggtgtcagctcacacaat

SEQ ID NO: 517421 - DNA, 25 bp, Rattus norvegicus
gtgtcttggtgtgagctcacacaat

SEQ ID NO: 517422 - DNA, 25 bp, Rattus norvegicus
gtgtcttgtaagaaactggcccctg

SEQ ID NO: 517423 - DNA, 25 bp, Rattus norvegicus
gtgtcttgtaagtaactggcccctg

SEQ ID NO: 517424 - DNA, 25 bp, Rattus norvegicus
gtgtcttgtattaaacgctcttatt

SEQ ID NO: 517425 - DNA, 25 bp, Rattus norvegicus
gtgtcttgtatttaacgctcttatt

SEQ ID NO: 517426 - DNA, 25 bp, Rattus norvegicus
gtgtcttgtcttacctggcaaagct

SEQ ID NO: 517427 - DNA, 25 bp, Rattus norvegicus
gtgtcttgtctttcctggcaaagct

SEQ ID NO: 517428 - DNA, 25 bp, Rattus norvegicus
gtgtcttgttcaaagtgtggtccat

SEQ ID NO: 517429 - DNA, 25 bp, Rattus norvegicus
gtgtcttgttcatagtgtggtccat

SEQ ID NO: 517430 - DNA, 25 bp, Rattus norvegicus
gtgtctttaagcagttttcctatgt

SEQ ID NO: 517431 - DNA, 25 bp, Rattus norvegicus
gtgtctttaagctgttttcctatgt

SEQ ID NO: 517432 - DNA, 25 bp, Rattus norvegicus
gtgtctttacaactcatagacctca

SEQ ID NO: 517433 - DNA, 25 bp, Rattus norvegicus
gtgtctttacaagtcatagacctca

SEQ ID NO: 517434 - DNA, 25 bp, Rattus norvegicus
gtgtctttacacaaggtggcaagct

SEQ ID NO: 517435 - DNA, 25 bp, Rattus norvegicus
gtgtctttacactaggtggcaagct

SEQ ID NO: 517436 - DNA, 25 bp, Rattus norvegicus
gtgtctttacatactacaaatttaa

SEQ ID NO: 517437 - DNA, 25 bp, Rattus norvegicus
gtgtctttacattctacaaatttaa

SEQ ID NO: 517438 - DNA, 25 bp, Rattus norvegicus
gtgtctttacttaagctgatggttc

SEQ ID NO: 517439 - DNA, 25 bp, Rattus norvegicus
gtgtctttacttagtggctttccta

SEQ ID NO: 517440 - DNA, 25 bp, Rattus norvegicus
gtgtctttactttagctgatggttc

SEQ ID NO: 517441 - DNA, 25 bp, Rattus norvegicus
gtgtctttactttgtggctttccta

SEQ ID NO: 517442 - DNA, 25 bp, Rattus norvegicus
gtgtctttatatagcatcctttctt

SEQ ID NO: 517443 - DNA, 25 bp, Rattus norvegicus
gtgtctttatattgcatcctttctt

SEQ ID NO: 517444 - DNA, 25 bp, Rattus norvegicus
gtgtctttcagcctgtccatgatgc

SEQ ID NO: 517445 - DNA, 25 bp, Rattus norvegicus
gtgtctttcagcgtgtccatgatgc

SEQ ID NO: 517446 - DNA, 25 bp, Rattus norvegicus
gtgtctttcaggattcttagggatg

SEQ ID NO: 517447 - DNA, 25 bp, Rattus norvegicus
gtgtctttcaggtttcttagggatg

SEQ ID NO: 517448 - DNA, 25 bp, Rattus norvegicus
gtgtctttcccgactgaacgtgccg

SEQ ID NO: 517449 - DNA, 25 bp, Rattus norvegicus
gtgtctttcccgtctgaacgtgccg

SEQ ID NO: 517450 - DNA, 25 bp, Rattus norvegicus
gtgtctttcctgattaaggtcctgg

SEQ ID NO: 517451 - DNA, 25 bp, Rattus norvegicus
gtgtctttcctgtttaaggtcctgg

SEQ ID NO: 517452 - DNA, 25 bp, Rattus norvegicus
gtgtctttcgaaaataccccttgag

SEQ ID NO: 517453 - DNA, 25 bp, Rattus norvegicus
gtgtctttcgaatataccccttgag

SEQ ID NO: 517454 - DNA, 25 bp, Rattus norvegicus
gtgtctttctacctctaactaatca

SEQ ID NO: 517455 - DNA, 25 bp, Rattus norvegicus
gtgtctttctacgtctaactaatca

SEQ ID NO: 517456 - DNA, 25 bp, Rattus norvegicus
gtgtctttctggcatggaaacctgc

SEQ ID NO: 517457 - DNA, 25 bp, Rattus norvegicus
gtgtctttctgggatggaaacctgc

SEQ ID NO: 517458 - DNA, 25 bp, Rattus norvegicus
gtgtctttcttaaaagctccttcct

SEQ ID NO: 517459 - DNA, 25 bp, Rattus norvegicus
gtgtctttcttataagctccttcct

SEQ ID NO: 517460 - DNA, 25 bp, Rattus norvegicus
gtgtctttgaatatgcggtcagcaa

SEQ ID NO: 517461 - DNA, 25 bp, Rattus norvegicus
gtgtctttgaatttgcggtcagcaa

SEQ ID NO: 517462 - DNA, 25 bp, Rattus norvegicus
gtgtctttgacaacaatggcccctg

SEQ ID NO: 517463 - DNA, 25 bp, Rattus norvegicus
gtgtctttgacatcaatggcccctg

SEQ ID NO: 517464 - DNA, 25 bp, Rattus norvegicus
gtgtctttgactcagtcttattttt

SEQ ID NO: 517465 - DNA, 25 bp, Rattus norvegicus
gtgtctttgactgagtcttattttt

SEQ ID NO: 517466 - DNA, 25 bp, Rattus norvegicus
gtgtctttgatgctgttttctaact

SEQ ID NO: 517467 - DNA, 25 bp, Rattus norvegicus
gtgtctttgatggtgttttctaact

SEQ ID NO: 517468 - DNA, 25 bp, Rattus norvegicus
gtgtctttgccccagggacgcctgc

SEQ ID NO: 517469 - DNA, 25 bp, Rattus norvegicus
gtgtctttgcccgagggacgcctgc

SEQ ID NO: 517470 - DNA, 25 bp, Rattus norvegicus
gtgtctttgctcaaaaaatgatcct

SEQ ID NO: 517471 - DNA, 25 bp, Rattus norvegicus
gtgtctttgctctaaaaatgatcct

SEQ ID NO: 517472 - DNA, 25 bp, Rattus norvegicus
gtgtctttgctgatacacacagcgt

SEQ ID NO: 517473 - DNA, 25 bp, Rattus norvegicus
gtgtctttgctgttacacacagcgt

SEQ ID NO: 517474 - DNA, 25 bp, Rattus norvegicus
gtgtctttggaacttcacttatcat

SEQ ID NO: 517475 - DNA, 25 bp, Rattus norvegicus
gtgtctttggaagttcacttatcat

SEQ ID NO: 517476 - DNA, 25 bp, Rattus norvegicus
gtgtctttgggcagggaactccacg

SEQ ID NO: 517477 - DNA, 25 bp, Rattus norvegicus
gtgtctttgggctgggaactccacg

SEQ ID NO: 517478 - DNA, 25 bp, Rattus norvegicus
gtgtctttgtcaatcaccagaccat

SEQ ID NO: 517479 - DNA, 25 bp, Rattus norvegicus
gtgtctttgtcattcaccagaccat

SEQ ID NO: 517480 - DNA, 25 bp, Rattus norvegicus
gtgtctttgtctctatggtatcttt

SEQ ID NO: 517481 - DNA, 25 bp, Rattus norvegicus
gtgtctttgtctgtatggtatcttt

SEQ ID NO: 517482 - DNA, 25 bp, Rattus norvegicus
gtgtctttgtgcatgcctgttagaa

SEQ ID NO: 517483 - DNA, 25 bp, Rattus norvegicus
gtgtctttgtgcctgccttggccat

SEQ ID NO: 517484 - DNA, 25 bp, Rattus norvegicus
gtgtctttgtgcgtgccttggccat

SEQ ID NO: 517485 - DNA, 25 bp, Rattus norvegicus
gtgtctttgtgcttgcctgttagaa

SEQ ID NO: 517486 - DNA, 25 bp, Rattus norvegicus
gtgtctttgtggaaagctgcagtct

SEQ ID NO: 517487 - DNA, 25 bp, Rattus norvegicus
gtgtctttgtggtaagctgcagtct

SEQ ID NO: 517488 - DNA, 25 bp, Rattus norvegicus
gtgtctttgtgtagtttactcggga

SEQ ID NO: 517489 - DNA, 25 bp, Rattus norvegicus
gtgtctttgtgtctgagcaccgagc

SEQ ID NO: 517490 - DNA, 25 bp, Rattus norvegicus
gtgtctttgtgtgtgagcaccgagc

SEQ ID NO: 517491 - DNA, 25 bp, Rattus norvegicus
gtgtctttgtgttgtttactcggga

SEQ ID NO: 517492 - DNA, 25 bp, Rattus norvegicus
gtgtcttttaatatcattctcattg

SEQ ID NO: 517493 - DNA, 25 bp, Rattus norvegicus
gtgtcttttaatttcattctcattg

SEQ ID NO: 517494 - DNA, 25 bp, Rattus norvegicus
gtgtcttttcctccttgttgaatgt

SEQ ID NO: 517495 - DNA, 25 bp, Rattus norvegicus
gtgtcttttcctgcttgttgaatgt

SEQ ID NO: 517496 - DNA, 25 bp, Rattus norvegicus
gtgtcttttgcaagattctctggat

SEQ ID NO: 517497 - DNA, 25 bp, Rattus norvegicus
gtgtcttttgcacggcataatggca

SEQ ID NO: 517498 - DNA, 25 bp, Rattus norvegicus
gtgtcttttgcactcctttatccaa

SEQ ID NO: 517499 - DNA, 25 bp, Rattus norvegicus
gtgtcttttgcagggcataatggca

SEQ ID NO: 517500 - DNA, 25 bp, Rattus norvegicus
gtgtcttttgcagtcctttatccaa

SEQ ID NO: 517501 - DNA, 25 bp, Rattus norvegicus
gtgtcttttgcatgattctctggat

SEQ ID NO: 517502 - DNA, 25 bp, Rattus norvegicus
gtgtcttttttaagtgaaccactca

SEQ ID NO: 517503 - DNA, 25 bp, Rattus norvegicus
gtgtcttttttatgtgaaccactca

SEQ ID NO: 517504 - DNA, 25 bp, Rattus norvegicus
gtgtgaaaacagcagtccatcccaa

SEQ ID NO: 517505 - DNA, 25 bp, Rattus norvegicus
gtgtgaaaacaggagtccatcccaa

SEQ ID NO: 517506 - DNA, 25 bp, Rattus norvegicus
gtgtgaaaaccaattccacgctcag

SEQ ID NO: 517507 - DNA, 25 bp, Rattus norvegicus
gtgtgaaaaccatttccacgctcag

SEQ ID NO: 517508 - DNA, 25 bp, Rattus norvegicus
gtgtgaaaacgaacaccgccaagac

SEQ ID NO: 517509 - DNA, 25 bp, Rattus norvegicus
gtgtgaaaacgatcaccgccaagac

SEQ ID NO: 517510 - DNA, 25 bp, Rattus norvegicus
gtgtgaaaatacatggcccctcaaa

SEQ ID NO: 517511 - DNA, 25 bp, Rattus norvegicus
gtgtgaaaatacttggcccctcaaa

SEQ ID NO: 517512 - DNA, 25 bp, Rattus norvegicus
gtgtgaaacataccttcctccactg

SEQ ID NO: 517513 - DNA, 25 bp, Rattus norvegicus
gtgtgaaacatagcttcctccactg

SEQ ID NO: 517514 - DNA, 25 bp, Rattus norvegicus
gtgtgaaaccttacagtggccctca

SEQ ID NO: 517515 - DNA, 25 bp, Rattus norvegicus
gtgtgaaacctttcagtggccctca

SEQ ID NO: 517516 - DNA, 25 bp, Rattus norvegicus
gtgtgaaagccaacagcccatacaa

SEQ ID NO: 517517 - DNA, 25 bp, Rattus norvegicus
gtgtgaaagccatcagcccatacaa

SEQ ID NO: 517518 - DNA, 25 bp, Rattus norvegicus
gtgtgaaaggcgacctcctaacgca

SEQ ID NO: 517519 - DNA, 25 bp, Rattus norvegicus
gtgtgaaaggcgtcctcctaacgca

SEQ ID NO: 517520 - DNA, 25 bp, Rattus norvegicus
gtgtgaaatgatccttcaggcatca

SEQ ID NO: 517521 - DNA, 25 bp, Rattus norvegicus
gtgtgaaatgatgcttcaggcatca

SEQ ID NO: 517522 - DNA, 25 bp, Rattus norvegicus
gtgtgaaatgtgatctcccgggaga

SEQ ID NO: 517523 - DNA, 25 bp, Rattus norvegicus
gtgtgaaatgtgttctcccgggaga

SEQ ID NO: 517524 - DNA, 25 bp, Rattus norvegicus
gtgtgaacacacattctctgacctc

SEQ ID NO: 517525 - DNA, 25 bp, Rattus norvegicus
gtgtgaacacactttctctgacctc

SEQ ID NO: 517526 - DNA, 25 bp, Rattus norvegicus
gtgtgaacattaccttcaaccttaa

SEQ ID NO: 517527 - DNA, 25 bp, Rattus norvegicus
gtgtgaacattagcttcaaccttaa

SEQ ID NO: 517528 - DNA, 25 bp, Rattus norvegicus
gtgtgaacattccttttgatgctgt

SEQ ID NO: 517529 - DNA, 25 bp, Rattus norvegicus
gtgtgaacattcgttttgatgctgt

SEQ ID NO: 517530 - DNA, 25 bp, Rattus norvegicus
gtgtgaaccacaaacactgtgtcat

SEQ ID NO: 517531 - DNA, 25 bp, Rattus norvegicus
gtgtgaaccacatacactgtgtcat

SEQ ID NO: 517532 - DNA, 25 bp, Rattus norvegicus
gtgtgaaccatgaacggaccgactt

SEQ ID NO: 517533 - DNA, 25 bp, Rattus norvegicus
gtgtgaaccatgtacggaccgactt

SEQ ID NO: 517534 - DNA, 25 bp, Rattus norvegicus
gtgtgaacccaaaaaagactgtttg

SEQ ID NO: 517535 - DNA, 25 bp, Rattus norvegicus
gtgtgaacccaataaagactgtttg

SEQ ID NO: 517536 - DNA, 25 bp, Rattus norvegicus
gtgtgaacccttaatttggtcaata

SEQ ID NO: 517537 - DNA, 25 bp, Rattus norvegicus
gtgtgaaccctttatttggtcaata

SEQ ID NO: 517538 - DNA, 25 bp, Rattus norvegicus
gtgtgaacctagctaaaagacagcc

SEQ ID NO: 517539 - DNA, 25 bp, Rattus norvegicus
gtgtgaacctaggtaaaagacagcc

SEQ ID NO: 517540 - DNA, 25 bp, Rattus norvegicus
gtgtgaacctctcggctcatgaaat

SEQ ID NO: 517541 - DNA, 25 bp, Rattus norvegicus
gtgtgaacctctgggctcatgaaat

SEQ ID NO: 517542 - DNA, 25 bp, Rattus norvegicus
gtgtgaactacaccactgggcatag

SEQ ID NO: 517543 - DNA, 25 bp, Rattus norvegicus
gtgtgaactacagcactgggcatag

SEQ ID NO: 517544 - DNA, 25 bp, Rattus norvegicus
gtgtgaactcacagttgcttttcta

SEQ ID NO: 517545 - DNA, 25 bp, Rattus norvegicus
gtgtgaactcactgttgcttttcta

SEQ ID NO: 517546 - DNA, 25 bp, Rattus norvegicus
gtgtgaactccaaaggtgctgttat

SEQ ID NO: 517547 - DNA, 25 bp, Rattus norvegicus
gtgtgaactccataggtgctgttat

SEQ ID NO: 517548 - DNA, 25 bp, Rattus norvegicus
gtgtgaactggcaacgcaggccatt

SEQ ID NO: 517549 - DNA, 25 bp, Rattus norvegicus
gtgtgaactggctacgcaggccatt

SEQ ID NO: 517550 - DNA, 25 bp, Rattus norvegicus
gtgtgaactgtaaacttctctaaat

SEQ ID NO: 517551 - DNA, 25 bp, Rattus norvegicus
gtgtgaactgtatacttctctaaat

SEQ ID NO: 517552 - DNA, 25 bp, Rattus norvegicus
gtgtgaacttgactccactgtccta

SEQ ID NO: 517553 - DNA, 25 bp, Rattus norvegicus
gtgtgaacttgagtccactgtccta

SEQ ID NO: 517554 - DNA, 25 bp, Rattus norvegicus
gtgtgaactttactgcatggccaaa

SEQ ID NO: 517555 - DNA, 25 bp, Rattus norvegicus
gtgtgaactttagtgcatggccaaa

SEQ ID NO: 517556 - DNA, 25 bp, Rattus norvegicus
gtgtgaagacccaggtgtccacaga

SEQ ID NO: 517557 - DNA, 25 bp, Rattus norvegicus
gtgtgaagaccctggtgtccacaga

SEQ ID NO: 517558 - DNA, 25 bp, Rattus norvegicus
gtgtgaagcagacctagtactcctc

SEQ ID NO: 517559 - DNA, 25 bp, Rattus norvegicus
gtgtgaagcagagctagtactcctc

SEQ ID NO: 517560 - DNA, 25 bp, Rattus norvegicus
gtgtgaagcctacgatcacttccgt

SEQ ID NO: 517561 - DNA, 25 bp, Rattus norvegicus
gtgtgaagcctaggatcacttccgt

SEQ ID NO: 517562 - DNA, 25 bp, Rattus norvegicus
gtgtgaagctgtcaacccactgagc

SEQ ID NO: 517563 - DNA, 25 bp, Rattus norvegicus
gtgtgaagctgtgaacccactgagc

SEQ ID NO: 517564 - DNA, 25 bp, Rattus norvegicus
gtgtgaagtactctctttcgccaaa

SEQ ID NO: 517565 - DNA, 25 bp, Rattus norvegicus
gtgtgaagtactgtctttcgccaaa

SEQ ID NO: 517566 - DNA, 25 bp, Rattus norvegicus
gtgtgaagtcagcagccaactatga

SEQ ID NO: 517567 - DNA, 25 bp, Rattus norvegicus
gtgtgaagtcaggagccaactatga

SEQ ID NO: 517568 - DNA, 25 bp, Rattus norvegicus
gtgtgaagtctgaagccgtatcatc

SEQ ID NO: 517569 - DNA, 25 bp, Rattus norvegicus
gtgtgaagtctgtagccgtatcatc

SEQ ID NO: 517570 - DNA, 25 bp, Rattus norvegicus
gtgtgaataataatgtgcccaccag

SEQ ID NO: 517571 - DNA, 25 bp, Rattus norvegicus
gtgtgaataatattgtgcccaccag

SEQ ID NO: 517572 - DNA, 25 bp, Rattus norvegicus
gtgtgaataggccttctgcgctaca

SEQ ID NO: 517573 - DNA, 25 bp, Rattus norvegicus
gtgtgaataggcgttctgcgctaca

SEQ ID NO: 517574 - DNA, 25 bp, Rattus norvegicus
gtgtgaatagtaccagttgtccaga

SEQ ID NO: 517575 - DNA, 25 bp, Rattus norvegicus
gtgtgaatagtagcagttgtccaga

SEQ ID NO: 517576 - DNA, 25 bp, Rattus norvegicus
gtgtgaatatgcaatgggagtccca

SEQ ID NO: 517577 - DNA, 25 bp, Rattus norvegicus
gtgtgaatatgctatgggagtccca

SEQ ID NO: 517578 - DNA, 25 bp, Rattus norvegicus
gtgtgaatatttcgacatgctgtat

SEQ ID NO: 517579 - DNA, 25 bp, Rattus norvegicus
gtgtgaatatttggacatgctgtat

SEQ ID NO: 517580 - DNA, 25 bp, Rattus norvegicus
gtgtgaatcacaccccaatgctgcg

SEQ ID NO: 517581 - DNA, 25 bp, Rattus norvegicus
gtgtgaatcacagcccaatgctgcg

SEQ ID NO: 517582 - DNA, 25 bp, Rattus norvegicus
gtgtgaatcatgcagttctcgtggt

SEQ ID NO: 517583 - DNA, 25 bp, Rattus norvegicus
gtgtgaatcatggagttctcgtggt

SEQ ID NO: 517584 - DNA, 25 bp, Rattus norvegicus
gtgtgaatgcaaatccctgtctcca

SEQ ID NO: 517585 - DNA, 25 bp, Rattus norvegicus
gtgtgaatgcaattccctgtctcca

SEQ ID NO: 517586 - DNA, 25 bp, Rattus norvegicus
gtgtgaattcatctactctactcag

SEQ ID NO: 517587 - DNA, 25 bp, Rattus norvegicus
gtgtgaattcatgtactctactcag

SEQ ID NO: 517588 - DNA, 25 bp, Rattus norvegicus
gtgtgaattcccacctcaagacgca

SEQ ID NO: 517589 - DNA, 25 bp, Rattus norvegicus
gtgtgaattccctcctcaagacgca

SEQ ID NO: 517590 - DNA, 25 bp, Rattus norvegicus
gtgtgaattcgactttacaccctta

SEQ ID NO: 517591 - DNA, 25 bp, Rattus norvegicus
gtgtgaattcgagtttacaccctta

SEQ ID NO: 517592 - DNA, 25 bp, Rattus norvegicus
gtgtgaattgtactccagcctggtc

SEQ ID NO: 517593 - DNA, 25 bp, Rattus norvegicus
gtgtgaattgtagtccagcctggtc

SEQ ID NO: 517594 - DNA, 25 bp, Rattus norvegicus
gtgtgaatttctaagggtctctttg

SEQ ID NO: 517595 - DNA, 25 bp, Rattus norvegicus
gtgtgaatttcttagggtctctttg

SEQ ID NO: 517596 - DNA, 25 bp, Rattus norvegicus
gtgtgacaaacaatctgccctatac

SEQ ID NO: 517597 - DNA, 25 bp, Rattus norvegicus
gtgtgacaaacattctgccctatac

SEQ ID NO: 517598 - DNA, 25 bp, Rattus norvegicus
gtgtgacaaataagccctcacccgt

SEQ ID NO: 517599 - DNA, 25 bp, Rattus norvegicus
gtgtgacaaatatgccctcacccgt

SEQ ID NO: 517600 - DNA, 25 bp, Rattus norvegicus
gtgtgacaacgcaggctttgatgcc

SEQ ID NO: 517601 - DNA, 25 bp, Rattus norvegicus
gtgtgacaacgctggctttgatgcc

SEQ ID NO: 517602 - DNA, 25 bp, Rattus norvegicus
gtgtgacaagatccccagtgtgaca

SEQ ID NO: 517603 - DNA, 25 bp, Rattus norvegicus
gtgtgacaagatgcccagtgtgaca

SEQ ID NO: 517604 - DNA, 25 bp, Rattus norvegicus
gtgtgacacaatccaccgtggttta

SEQ ID NO: 517605 - DNA, 25 bp, Rattus norvegicus
gtgtgacacaatgcaccgtggttta

SEQ ID NO: 517606 - DNA, 25 bp, Rattus norvegicus
gtgtgacaccaaacggacttccaga

SEQ ID NO: 517607 - DNA, 25 bp, Rattus norvegicus
gtgtgacaccaatcggacttccaga

SEQ ID NO: 517608 - DNA, 25 bp, Rattus norvegicus
gtgtgacagagcaaaaagccacttg

SEQ ID NO: 517609 - DNA, 25 bp, Rattus norvegicus
gtgtgacagagctaaaagccacttg

SEQ ID NO: 517610 - DNA, 25 bp, Rattus norvegicus
gtgtgacagcatatctcatattaga

SEQ ID NO: 517611 - DNA, 25 bp, Rattus norvegicus
gtgtgacagcatttctcatattaga

SEQ ID NO: 517612 - DNA, 25 bp, Rattus norvegicus
gtgtgacagcgactacagcaccagt

SEQ ID NO: 517613 - DNA, 25 bp, Rattus norvegicus
gtgtgacagcgagtacagcaccagt

SEQ ID NO: 517614 - DNA, 25 bp, Rattus norvegicus
gtgtgacagctcaaggtgtggccca

SEQ ID NO: 517615 - DNA, 25 bp, Rattus norvegicus
gtgtgacagctctaggtgtggccca

SEQ ID NO: 517616 - DNA, 25 bp, Rattus norvegicus
gtgtgacaggctaggatccactcct

SEQ ID NO: 517617 - DNA, 25 bp, Rattus norvegicus
gtgtgacaggcttggatccactcct

SEQ ID NO: 517618 - DNA, 25 bp, Rattus norvegicus
gtgtgacagggcattctctttaaaa

SEQ ID NO: 517619 - DNA, 25 bp, Rattus norvegicus
gtgtgacagggctttctctttaaaa

SEQ ID NO: 517620 - DNA, 25 bp, Rattus norvegicus
gtgtgacagtgcctctgtttagttt

SEQ ID NO: 517621 - DNA, 25 bp, Rattus norvegicus
gtgtgacagtgcgtctgtttagttt

SEQ ID NO: 517622 - DNA, 25 bp, Rattus norvegicus
gtgtgacatcgacattcgcccgggt

SEQ ID NO: 517623 - DNA, 25 bp, Rattus norvegicus
gtgtgacatcgagattcgcccgggt

SEQ ID NO: 517624 - DNA, 25 bp, Rattus norvegicus
gtgtgacatctaatttctggtggag

SEQ ID NO: 517625 - DNA, 25 bp, Rattus norvegicus
gtgtgacatctattttctggtggag

SEQ ID NO: 517626 - DNA, 25 bp, Rattus norvegicus
gtgtgacatgacagaaccctgcact

SEQ ID NO: 517627 - DNA, 25 bp, Rattus norvegicus
gtgtgacatgactgaaccctgcact

SEQ ID NO: 517628 - DNA, 25 bp, Rattus norvegicus
gtgtgacatgttaacggacccgaat

SEQ ID NO: 517629 - DNA, 25 bp, Rattus norvegicus
gtgtgacatgtttacggacccgaat

SEQ ID NO: 517630 - DNA, 25 bp, Rattus norvegicus
gtgtgaccagctccagcaggttaaa

SEQ ID NO: 517631 - DNA, 25 bp, Rattus norvegicus
gtgtgaccagctgcagcaggttaaa

SEQ ID NO: 517632 - DNA, 25 bp, Rattus norvegicus
gtgtgaccattaactcttcatgacc

SEQ ID NO: 517633 - DNA, 25 bp, Rattus norvegicus
gtgtgaccattatctcttcatgacc

SEQ ID NO: 517634 - DNA, 25 bp, Rattus norvegicus
gtgtgacccaagcaatgtggttatt

SEQ ID NO: 517635 - DNA, 25 bp, Rattus norvegicus
gtgtgacccaaggaatgtggttatt

SEQ ID NO: 517636 - DNA, 25 bp, Rattus norvegicus
gtgtgaccccaaccattatcagcgg

SEQ ID NO: 517637 - DNA, 25 bp, Rattus norvegicus
gtgtgaccccaagcattatcagcgg

SEQ ID NO: 517638 - DNA, 25 bp, Rattus norvegicus
gtgtgacccgtcctaaagaagccat

SEQ ID NO: 517639 - DNA, 25 bp, Rattus norvegicus
gtgtgacccgtcgtaaagaagccat

SEQ ID NO: 517640 - DNA, 25 bp, Rattus norvegicus
gtgtgaccctgtagtgaactgcatc

SEQ ID NO: 517641 - DNA, 25 bp, Rattus norvegicus
gtgtgaccctgttgtgaactgcatc

SEQ ID NO: 517642 - DNA, 25 bp, Rattus norvegicus
gtgtgaccgctgacaagacgcttgt

SEQ ID NO: 517643 - DNA, 25 bp, Rattus norvegicus
gtgtgaccgctgtcaagacgcttgt

SEQ ID NO: 517644 - DNA, 25 bp, Rattus norvegicus
gtgtgacctaaacaactggaacggg

SEQ ID NO: 517645 - DNA, 25 bp, Rattus norvegicus
gtgtgacctaaagaactggaacggg

SEQ ID NO: 517646 - DNA, 25 bp, Rattus norvegicus
gtgtgacctcatctgtattgttacc

SEQ ID NO: 517647 - DNA, 25 bp, Rattus norvegicus
gtgtgacctcatgtgtattgttacc

SEQ ID NO: 517648 - DNA, 25 bp, Rattus norvegicus
gtgtgacctctcagttgccagggtg

SEQ ID NO: 517649 - DNA, 25 bp, Rattus norvegicus
gtgtgacctctctgttgccagggtg

SEQ ID NO: 517650 - DNA, 25 bp, Rattus norvegicus
gtgtgacctgaaagcccatattcca

SEQ ID NO: 517651 - DNA, 25 bp, Rattus norvegicus
gtgtgacctgaatgcccatattcca

SEQ ID NO: 517652 - DNA, 25 bp, Rattus norvegicus
gtgtgacctgctatcctttgtattc

SEQ ID NO: 517653 - DNA, 25 bp, Rattus norvegicus
gtgtgacctgctttcctttgtattc

SEQ ID NO: 517654 - DNA, 25 bp, Rattus norvegicus
gtgtgacctgtcatgcagtatacaa

SEQ ID NO: 517655 - DNA, 25 bp, Rattus norvegicus
gtgtgacctgtcttgcagtatacaa

SEQ ID NO: 517656 - DNA, 25 bp, Rattus norvegicus
gtgtgacctgtgaggaataccacat

SEQ ID NO: 517657 - DNA, 25 bp, Rattus norvegicus
gtgtgacctgtgtggaataccacat

SEQ ID NO: 517658 - DNA, 25 bp, Rattus norvegicus
gtgtgacctgttaccttttaactga

SEQ ID NO: 517659 - DNA, 25 bp, Rattus norvegicus
gtgtgacctgtttccttttaactga

SEQ ID NO: 517660 - DNA, 25 bp, Rattus norvegicus
gtgtgaccttctcctttgagatttt

SEQ ID NO: 517661 - DNA, 25 bp, Rattus norvegicus
gtgtgaccttctgctttgagatttt

SEQ ID NO: 517662 - DNA, 25 bp, Rattus norvegicus
gtgtgaccttgccaggagtctgtct

SEQ ID NO: 517663 - DNA, 25 bp, Rattus norvegicus
gtgtgaccttgcgaggagtctgtct

SEQ ID NO: 517664 - DNA, 25 bp, Rattus norvegicus
gtgtgactaaaccagccactcattg

SEQ ID NO: 517665 - DNA, 25 bp, Rattus norvegicus
gtgtgactaaacgagccactcattg

SEQ ID NO: 517666 - DNA, 25 bp, Rattus norvegicus
gtgtgactaacacccaatagctatg

SEQ ID NO: 517667 - DNA, 25 bp, Rattus norvegicus
gtgtgactaacagccaatagctatg

SEQ ID NO: 517668 - DNA, 25 bp, Rattus norvegicus
gtgtgactagcccagaaatactccc

SEQ ID NO: 517669 - DNA, 25 bp, Rattus norvegicus
gtgtgactagccgagaaatactccc

SEQ ID NO: 517670 - DNA, 25 bp, Rattus norvegicus
gtgtgactcaacacaggacatttaa

SEQ ID NO: 517671 - DNA, 25 bp, Rattus norvegicus
gtgtgactcaactcaggacatttaa

SEQ ID NO: 517672 - DNA, 25 bp, Rattus norvegicus
gtgtgactcagtactttcttaccaa

SEQ ID NO: 517673 - DNA, 25 bp, Rattus norvegicus
gtgtgactcagttctttcttaccaa

SEQ ID NO: 517674 - DNA, 25 bp, Rattus norvegicus
gtgtgactccacaactgaacagtgt

SEQ ID NO: 517675 - DNA, 25 bp, Rattus norvegicus
gtgtgactccactactgaacagtgt

SEQ ID NO: 517676 - DNA, 25 bp, Rattus norvegicus
gtgtgactcgctagcacagatcgaa

SEQ ID NO: 517677 - DNA, 25 bp, Rattus norvegicus
gtgtgactcgctctttgtaccgcga

SEQ ID NO: 517678 - DNA, 25 bp, Rattus norvegicus
gtgtgactcgctgtttgtaccgcga

SEQ ID NO: 517679 - DNA, 25 bp, Rattus norvegicus
gtgtgactcgcttgcacagatcgaa

SEQ ID NO: 517680 - DNA, 25 bp, Rattus norvegicus
gtgtgactgagtaggcacaagccac

SEQ ID NO: 517681 - DNA, 25 bp, Rattus norvegicus
gtgtgactgagtccatcgatgcctc

SEQ ID NO: 517682 - DNA, 25 bp, Rattus norvegicus
gtgtgactgagtgcatcgatgcctc

SEQ ID NO: 517683 - DNA, 25 bp, Rattus norvegicus
gtgtgactgagttggcacaagccac

SEQ ID NO: 517684 - DNA, 25 bp, Rattus norvegicus
gtgtgactgataattctattccgaa

SEQ ID NO: 517685 - DNA, 25 bp, Rattus norvegicus
gtgtgactgatatttctattccgaa

SEQ ID NO: 517686 - DNA, 25 bp, Rattus norvegicus
gtgtgactgatcactcgtgattgat

SEQ ID NO: 517687 - DNA, 25 bp, Rattus norvegicus
gtgtgactgatctctcgtgattgat

SEQ ID NO: 517688 - DNA, 25 bp, Rattus norvegicus
gtgtgactgatgagtgtcaagtgtt

SEQ ID NO: 517689 - DNA, 25 bp, Rattus norvegicus
gtgtgactgatgtgtgtcaagtgtt

SEQ ID NO: 517690 - DNA, 25 bp, Rattus norvegicus
gtgtgactgcggaaacctgggctca

SEQ ID NO: 517691 - DNA, 25 bp, Rattus norvegicus
gtgtgactgcggtaacctgggctca

SEQ ID NO: 517692 - DNA, 25 bp, Rattus norvegicus
gtgtgactgcgtaccactggaacaa

SEQ ID NO: 517693 - DNA, 25 bp, Rattus norvegicus
gtgtgactgcgttccactggaacaa

SEQ ID NO: 517694 - DNA, 25 bp, Rattus norvegicus
gtgtgactgtatccttactacttca

SEQ ID NO: 517695 - DNA, 25 bp, Rattus norvegicus
gtgtgactgtatgcttactacttca

SEQ ID NO: 517696 - DNA, 25 bp, Rattus norvegicus
gtgtgactgtgaactctcgaacccg

SEQ ID NO: 517697 - DNA, 25 bp, Rattus norvegicus
gtgtgactgtgatctctcgaacccg

SEQ ID NO: 517698 - DNA, 25 bp, Rattus norvegicus
gtgtgactgttaatcagctgcctcc

SEQ ID NO: 517699 - DNA, 25 bp, Rattus norvegicus
gtgtgactgttattcagctgcctcc

SEQ ID NO: 517700 - DNA, 25 bp, Rattus norvegicus
gtgtgactgttcatgcaccatggca

SEQ ID NO: 517701 - DNA, 25 bp, Rattus norvegicus
gtgtgactgttcttgcaccatggca

SEQ ID NO: 517702 - DNA, 25 bp, Rattus norvegicus
gtgtgactgtttcaggttcctcaca

SEQ ID NO: 517703 - DNA, 25 bp, Rattus norvegicus
gtgtgactgtttgaggttcctcaca

SEQ ID NO: 517704 - DNA, 25 bp, Rattus norvegicus
gtgtgacttagccattgagcccgcc

SEQ ID NO: 517705 - DNA, 25 bp, Rattus norvegicus
gtgtgacttagcgattgagcccgcc

SEQ ID NO: 517706 - DNA, 25 bp, Rattus norvegicus
gtgtgacttatcaaacctttcctat

SEQ ID NO: 517707 - DNA, 25 bp, Rattus norvegicus
gtgtgacttatctaacctttcctat

SEQ ID NO: 517708 - DNA, 25 bp, Rattus norvegicus
gtgtgacttccgaagctgcataaat

SEQ ID NO: 517709 - DNA, 25 bp, Rattus norvegicus
gtgtgacttccgtagctgcataaat

SEQ ID NO: 517710 - DNA, 25 bp, Rattus norvegicus
gtgtgacttctacctgctcagattc

SEQ ID NO: 517711 - DNA, 25 bp, Rattus norvegicus
gtgtgacttctagctgctcagattc

SEQ ID NO: 517712 - DNA, 25 bp, Rattus norvegicus
gtgtgactttctacttttcaactgc

SEQ ID NO: 517713 - DNA, 25 bp, Rattus norvegicus
gtgtgactttcttcttttcaactgc

SEQ ID NO: 517714 - DNA, 25 bp, Rattus norvegicus
gtgtgagaacatcttccctccttag

SEQ ID NO: 517715 - DNA, 25 bp, Rattus norvegicus
gtgtgagaacatgttccctccttag

SEQ ID NO: 517716 - DNA, 25 bp, Rattus norvegicus
gtgtgagaaccacggccagcaagat

SEQ ID NO: 517717 - DNA, 25 bp, Rattus norvegicus
gtgtgagaaccagggccagcaagat

SEQ ID NO: 517718 - DNA, 25 bp, Rattus norvegicus
gtgtgagaagtccagttcccatgaa

SEQ ID NO: 517719 - DNA, 25 bp, Rattus norvegicus
gtgtgagaagtcgagttcccatgaa

SEQ ID NO: 517720 - DNA, 25 bp, Rattus norvegicus
gtgtgagacaatactgccagctttt

SEQ ID NO: 517721 - DNA, 25 bp, Rattus norvegicus
gtgtgagacaattctgccagctttt

SEQ ID NO: 517722 - DNA, 25 bp, Rattus norvegicus
gtgtgagacatgctgtgctgacatc

SEQ ID NO: 517723 - DNA, 25 bp, Rattus norvegicus
gtgtgagacatggtgtgctgacatc

SEQ ID NO: 517724 - DNA, 25 bp, Rattus norvegicus
gtgtgagacattacctctgcaatgg

SEQ ID NO: 517725 - DNA, 25 bp, Rattus norvegicus
gtgtgagacatttcctctgcaatgg

SEQ ID NO: 517726 - DNA, 25 bp, Rattus norvegicus
gtgtgagactctcatccccaagatt

SEQ ID NO: 517727 - DNA, 25 bp, Rattus norvegicus
gtgtgagactctgatccccaagatt

SEQ ID NO: 517728 - DNA, 25 bp, Rattus norvegicus
gtgtgagagcttcaagactgacctt

SEQ ID NO: 517729 - DNA, 25 bp, Rattus norvegicus
gtgtgagagcttgaagactgacctt

SEQ ID NO: 517730 - DNA, 25 bp, Rattus norvegicus
gtgtgagagtccatacagctgcatg

SEQ ID NO: 517731 - DNA, 25 bp, Rattus norvegicus
gtgtgagagtccttacagctgcatg

SEQ ID NO: 517732 - DNA, 25 bp, Rattus norvegicus
gtgtgagatctccagggcaattttc

SEQ ID NO: 517733 - DNA, 25 bp, Rattus norvegicus
gtgtgagatctcgagggcaattttc

SEQ ID NO: 517734 - DNA, 25 bp, Rattus norvegicus
gtgtgagatgcacacctagaacgtg

SEQ ID NO: 517735 - DNA, 25 bp, Rattus norvegicus
gtgtgagatgcagacctagaacgtg

SEQ ID NO: 517736 - DNA, 25 bp, Rattus norvegicus
gtgtgagatgccatgcaacctgacc

SEQ ID NO: 517737 - DNA, 25 bp, Rattus norvegicus
gtgtgagatgccttgcaacctgacc

SEQ ID NO: 517738 - DNA, 25 bp, Rattus norvegicus
gtgtgagattcacccttcaacagaa

SEQ ID NO: 517739 - DNA, 25 bp, Rattus norvegicus
gtgtgagattcagccttcaacagaa

SEQ ID NO: 517740 - DNA, 25 bp, Rattus norvegicus
gtgtgagattttagttttccgctaa

SEQ ID NO: 517741 - DNA, 25 bp, Rattus norvegicus
gtgtgagatttttgttttccgctaa

SEQ ID NO: 517742 - DNA, 25 bp, Rattus norvegicus
gtgtgagcaacacctactgacgcta

SEQ ID NO: 517743 - DNA, 25 bp, Rattus norvegicus
gtgtgagcaacagctactgacgcta

SEQ ID NO: 517744 - DNA, 25 bp, Rattus norvegicus
gtgtgagcagcaaggtcctccaggt

SEQ ID NO: 517745 - DNA, 25 bp, Rattus norvegicus
gtgtgagcagcatggtcctccaggt

SEQ ID NO: 517746 - DNA, 25 bp, Rattus norvegicus
gtgtgagcatggagcccagccacta

SEQ ID NO: 517747 - DNA, 25 bp, Rattus norvegicus
gtgtgagcatggtgcccagccacta

SEQ ID NO: 517748 - DNA, 25 bp, Rattus norvegicus
gtgtgagccaaaaccatgaaatcga

SEQ ID NO: 517749 - DNA, 25 bp, Rattus norvegicus
gtgtgagccaaatccatgaaatcga

SEQ ID NO: 517750 - DNA, 25 bp, Rattus norvegicus
gtgtgagccaatctaagtacgggac

SEQ ID NO: 517751 - DNA, 25 bp, Rattus norvegicus
gtgtgagccaatgtaagtacgggac

SEQ ID NO: 517752 - DNA, 25 bp, Rattus norvegicus
gtgtgagccactacatctggccttt

SEQ ID NO: 517753 - DNA, 25 bp, Rattus norvegicus
gtgtgagccacttcatctggccttt

SEQ ID NO: 517754 - DNA, 25 bp, Rattus norvegicus
gtgtgagccaggaagcagcatcccc

SEQ ID NO: 517755 - DNA, 25 bp, Rattus norvegicus
gtgtgagccaggtagcagcatcccc

SEQ ID NO: 517756 - DNA, 25 bp, Rattus norvegicus
gtgtgagccagtctcttgttaataa

SEQ ID NO: 517757 - DNA, 25 bp, Rattus norvegicus
gtgtgagccagtgtcttgttaataa

SEQ ID NO: 517758 - DNA, 25 bp, Rattus norvegicus
gtgtgagccatcaactttggtcatg

SEQ ID NO: 517759 - DNA, 25 bp, Rattus norvegicus
gtgtgagccatcagtttccaacatg

SEQ ID NO: 517760 - DNA, 25 bp, Rattus norvegicus
gtgtgagccatctactttggtcatg

SEQ ID NO: 517761 - DNA, 25 bp, Rattus norvegicus
gtgtgagccatctgtttccaacatg

SEQ ID NO: 517762 - DNA, 25 bp, Rattus norvegicus
gtgtgagccccaatgggatgtgctc

SEQ ID NO: 517763 - DNA, 25 bp, Rattus norvegicus
gtgtgagccccattgggatgtgctc

SEQ ID NO: 517764 - DNA, 25 bp, Rattus norvegicus
gtgtgagccgctctgaacttggttc

SEQ ID NO: 517765 - DNA, 25 bp, Rattus norvegicus
gtgtgagccgctgtgaacttggttc

SEQ ID NO: 517766 - DNA, 25 bp, Rattus norvegicus
gtgtgagcctgaccactggtcccaa

SEQ ID NO: 517767 - DNA, 25 bp, Rattus norvegicus
gtgtgagcctgagcactggtcccaa

SEQ ID NO: 517768 - DNA, 25 bp, Rattus norvegicus
gtgtgagcggatacgggctcccaaa

SEQ ID NO: 517769 - DNA, 25 bp, Rattus norvegicus
gtgtgagcggattcgggctcccaaa

SEQ ID NO: 517770 - DNA, 25 bp, Rattus norvegicus
gtgtgagctccactcattgatatag

SEQ ID NO: 517771 - DNA, 25 bp, Rattus norvegicus
gtgtgagctccagtcattgatatag

SEQ ID NO: 517772 - DNA, 25 bp, Rattus norvegicus
gtgtgagctgccagtgtctgttaac

SEQ ID NO: 517773 - DNA, 25 bp, Rattus norvegicus
gtgtgagctgcctgtgtctgttaac

SEQ ID NO: 517774 - DNA, 25 bp, Rattus norvegicus
gtgtgagcttttccaggctcctgca

SEQ ID NO: 517775 - DNA, 25 bp, Rattus norvegicus
gtgtgagcttttgcaggctcctgca

SEQ ID NO: 517776 - DNA, 25 bp, Rattus norvegicus
gtgtgaggagacagtacccacccag

SEQ ID NO: 517777 - DNA, 25 bp, Rattus norvegicus
gtgtgaggagactgtacccacccag

SEQ ID NO: 517778 - DNA, 25 bp, Rattus norvegicus
gtgtgaggcaacatgagacccttgt

SEQ ID NO: 517779 - DNA, 25 bp, Rattus norvegicus
gtgtgaggcaacttgagacccttgt

SEQ ID NO: 517780 - DNA, 25 bp, Rattus norvegicus
gtgtgaggcccgacacaagatccag

SEQ ID NO: 517781 - DNA, 25 bp, Rattus norvegicus
gtgtgaggcccgctcacaaactcag

SEQ ID NO: 517782 - DNA, 25 bp, Rattus norvegicus
gtgtgaggcccggtcacaaactcag

SEQ ID NO: 517783 - DNA, 25 bp, Rattus norvegicus
gtgtgaggcccgtcacaagatccag

SEQ ID NO: 517784 - DNA, 25 bp, Rattus norvegicus
gtgtgaggccttccttcctggtgtc

SEQ ID NO: 517785 - DNA, 25 bp, Rattus norvegicus
gtgtgaggccttgcttcctggtgtc

SEQ ID NO: 517786 - DNA, 25 bp, Rattus norvegicus
gtgtgaggctctagggtccctatta

SEQ ID NO: 517787 - DNA, 25 bp, Rattus norvegicus
gtgtgaggctcttgggtccctatta

SEQ ID NO: 517788 - DNA, 25 bp, Rattus norvegicus
gtgtgaggcttcctggcgtctttcc

SEQ ID NO: 517789 - DNA, 25 bp, Rattus norvegicus
gtgtgaggcttcgtggcgtctttcc

SEQ ID NO: 517790 - DNA, 25 bp, Rattus norvegicus
gtgtgaggtgtcatagccataatat

SEQ ID NO: 517791 - DNA, 25 bp, Rattus norvegicus
gtgtgaggtgtcttagccataatat

SEQ ID NO: 517792 - DNA, 25 bp, Rattus norvegicus
gtgtgaggttttcatttgctgcctt

SEQ ID NO: 517793 - DNA, 25 bp, Rattus norvegicus
gtgtgaggttttgatttgctgcctt

SEQ ID NO: 517794 - DNA, 25 bp, Rattus norvegicus
gtgtgagtacagctttctagtggat

SEQ ID NO: 517795 - DNA, 25 bp, Rattus norvegicus
gtgtgagtacaggtttctagtggat

SEQ ID NO: 517796 - DNA, 25 bp, Rattus norvegicus
gtgtgagtccttactgtttgatttc

SEQ ID NO: 517797 - DNA, 25 bp, Rattus norvegicus
gtgtgagtcctttctgtttgatttc

SEQ ID NO: 517798 - DNA, 25 bp, Rattus norvegicus
gtgtgagtctagcattgcctcagga

SEQ ID NO: 517799 - DNA, 25 bp, Rattus norvegicus
gtgtgagtctaggattgcctcagga

SEQ ID NO: 517800 - DNA, 25 bp, Rattus norvegicus
gtgtgagtctggaggtgctgtcctg

SEQ ID NO: 517801 - DNA, 25 bp, Rattus norvegicus
gtgtgagtctggcaaccctgcgctc

SEQ ID NO: 517802 - DNA, 25 bp, Rattus norvegicus
gtgtgagtctgggaaccctgcgctc

SEQ ID NO: 517803 - DNA, 25 bp, Rattus norvegicus
gtgtgagtctggtggtgctgtcctg

SEQ ID NO: 517804 - DNA, 25 bp, Rattus norvegicus
gtgtgagtgaagagaccgtctcctc

SEQ ID NO: 517805 - DNA, 25 bp, Rattus norvegicus
gtgtgagtgaagtgaccgtctcctc

SEQ ID NO: 517806 - DNA, 25 bp, Rattus norvegicus
gtgtgagtgctaaccgtgagcgcct

SEQ ID NO: 517807 - DNA, 25 bp, Rattus norvegicus
gtgtgagtgctatccgtgagcgcct

SEQ ID NO: 517808 - DNA, 25 bp, Rattus norvegicus
gtgtgagtgggtatttaatctgtat

SEQ ID NO: 517809 - DNA, 25 bp, Rattus norvegicus
gtgtgagtgggtttttaatctgtat

SEQ ID NO: 517810 - DNA, 25 bp, Rattus norvegicus
gtgtgagtgtacatctggatcctgc

SEQ ID NO: 517811 - DNA, 25 bp, Rattus norvegicus
gtgtgagtgtacttctggatcctgc

SEQ ID NO: 517812 - DNA, 25 bp, Rattus norvegicus
gtgtgagttcacaacagcctgagct

SEQ ID NO: 517813 - DNA, 25 bp, Rattus norvegicus
gtgtgagttcactacagcctgagct

SEQ ID NO: 517814 - DNA, 25 bp, Rattus norvegicus
gtgtgagttcgacggctgtgaccga

SEQ ID NO: 517815 - DNA, 25 bp, Rattus norvegicus
gtgtgagttcgagggctgtgaccga

SEQ ID NO: 517816 - DNA, 25 bp, Rattus norvegicus
gtgtgagttgagaactggtgtctca

SEQ ID NO: 517817 - DNA, 25 bp, Rattus norvegicus
gtgtgagttgagtactggtgtctca

SEQ ID NO: 517818 - DNA, 25 bp, Rattus norvegicus
gtgtgagttgcgctttctgcgccct

SEQ ID NO: 517819 - DNA, 25 bp, Rattus norvegicus
gtgtgagttgcggtttctgcgccct

SEQ ID NO: 517820 - DNA, 25 bp, Rattus norvegicus
gtgtgagtttcaatacacccaggga

SEQ ID NO: 517821 - DNA, 25 bp, Rattus norvegicus
gtgtgagtttcattacacccaggga

SEQ ID NO: 517822 - DNA, 25 bp, Rattus norvegicus
gtgtgataagaaagctcaagttagc

SEQ ID NO: 517823 - DNA, 25 bp, Rattus norvegicus
gtgtgataagaatgctcaagttagc

SEQ ID NO: 517824 - DNA, 25 bp, Rattus norvegicus
gtgtgataatcaagtctacagctaa

SEQ ID NO: 517825 - DNA, 25 bp, Rattus norvegicus
gtgtgataatcatgtctacagctaa

SEQ ID NO: 517826 - DNA, 25 bp, Rattus norvegicus
gtgtgatacatcactcatgcagttt

SEQ ID NO: 517827 - DNA, 25 bp, Rattus norvegicus
gtgtgatacatctctcatgcagttt

SEQ ID NO: 517828 - DNA, 25 bp, Rattus norvegicus
gtgtgataccgaaaggtctgccttt

SEQ ID NO: 517829 - DNA, 25 bp, Rattus norvegicus
gtgtgataccgataggtctgccttt

SEQ ID NO: 517830 - DNA, 25 bp, Rattus norvegicus
gtgtgatactcgctgtagccactac

SEQ ID NO: 517831 - DNA, 25 bp, Rattus norvegicus
gtgtgatactcggtgtagccactac

SEQ ID NO: 517832 - DNA, 25 bp, Rattus norvegicus
gtgtgatacttgcaatttttactct

SEQ ID NO: 517833 - DNA, 25 bp, Rattus norvegicus
gtgtgatacttggaatttttactct

SEQ ID NO: 517834 - DNA, 25 bp, Rattus norvegicus
gtgtgataggacaccgggttaccaa

SEQ ID NO: 517835 - DNA, 25 bp, Rattus norvegicus
gtgtgataggactccgggttaccaa

SEQ ID NO: 517836 - DNA, 25 bp, Rattus norvegicus
gtgtgatagtccattactgcctagg

SEQ ID NO: 517837 - DNA, 25 bp, Rattus norvegicus
gtgtgatagtcctttactgcctagg

SEQ ID NO: 517838 - DNA, 25 bp, Rattus norvegicus
gtgtgatagtctcattcacttcaat

SEQ ID NO: 517839 - DNA, 25 bp, Rattus norvegicus
gtgtgatagtctgattcacttcaat

SEQ ID NO: 517840 - DNA, 25 bp, Rattus norvegicus
gtgtgatagtgacagcaccgactgc

SEQ ID NO: 517841 - DNA, 25 bp, Rattus norvegicus
gtgtgatagtgagagcaccgactgc

SEQ ID NO: 517842 - DNA, 25 bp, Rattus norvegicus
gtgtgatatacaagcataaactaca

SEQ ID NO: 517843 - DNA, 25 bp, Rattus norvegicus
gtgtgatatacatgcataaactaca

SEQ ID NO: 517844 - DNA, 25 bp, Rattus norvegicus
gtgtgatattttctgtcccctgccc

SEQ ID NO: 517845 - DNA, 25 bp, Rattus norvegicus
gtgtgatattttgtgtcccctgccc

SEQ ID NO: 517846 - DNA, 25 bp, Rattus norvegicus
gtgtgatcatccaactccagcgtgg

SEQ ID NO: 517847 - DNA, 25 bp, Rattus norvegicus
gtgtgatcatcctactccagcgtgg

SEQ ID NO: 517848 - DNA, 25 bp, Rattus norvegicus
gtgtgatccaagcagctgaggtccc

SEQ ID NO: 517849 - DNA, 25 bp, Rattus norvegicus
gtgtgatccaaggagctgaggtccc

SEQ ID NO: 517850 - DNA, 25 bp, Rattus norvegicus
gtgtgatccacaagcctagttatcc

SEQ ID NO: 517851 - DNA, 25 bp, Rattus norvegicus
gtgtgatccacatgcctagttatcc

SEQ ID NO: 517852 - DNA, 25 bp, Rattus norvegicus
gtgtgatccagcagccatctagaag

SEQ ID NO: 517853 - DNA, 25 bp, Rattus norvegicus
gtgtgatccagctgccatctagaag

SEQ ID NO: 517854 - DNA, 25 bp, Rattus norvegicus
gtgtgatcctcaaccttattcgcat

SEQ ID NO: 517855 - DNA, 25 bp, Rattus norvegicus
gtgtgatcctcatccttattcgcat

SEQ ID NO: 517856 - DNA, 25 bp, Rattus norvegicus
gtgtgatcctggagtcttcccggga

SEQ ID NO: 517857 - DNA, 25 bp, Rattus norvegicus
gtgtgatcctggtgtcttcccggga

SEQ ID NO: 517858 - DNA, 25 bp, Rattus norvegicus
gtgtgatcctgtaacatcgtcgcca

SEQ ID NO: 517859 - DNA, 25 bp, Rattus norvegicus
gtgtgatcctgttacatcgtcgcca

SEQ ID NO: 517860 - DNA, 25 bp, Rattus norvegicus
gtgtgatctcacagtctacttactg

SEQ ID NO: 517861 - DNA, 25 bp, Rattus norvegicus
gtgtgatctcactgtctacttactg

SEQ ID NO: 517862 - DNA, 25 bp, Rattus norvegicus
gtgtgatctccacgatgcaccagca

SEQ ID NO: 517863 - DNA, 25 bp, Rattus norvegicus
gtgtgatctccaggatgcaccagca

SEQ ID NO: 517864 - DNA, 25 bp, Rattus norvegicus
gtgtgatctgtgacaaccaactggt

SEQ ID NO: 517865 - DNA, 25 bp, Rattus norvegicus
gtgtgatctgtgtcaaccaactggt

SEQ ID NO: 517866 - DNA, 25 bp, Rattus norvegicus
gtgtgatgacaaatcctcgcactcc

SEQ ID NO: 517867 - DNA, 25 bp, Rattus norvegicus
gtgtgatgacaattcctcgcactcc

SEQ ID NO: 517868 - DNA, 25 bp, Rattus norvegicus
gtgtgatgacatctgattccagatc

SEQ ID NO: 517869 - DNA, 25 bp, Rattus norvegicus
gtgtgatgacatgtgattccagatc

SEQ ID NO: 517870 - DNA, 25 bp, Rattus norvegicus
gtgtgatggcccatgcctggcgact

SEQ ID NO: 517871 - DNA, 25 bp, Rattus norvegicus
gtgtgatggcccttgcctggcgact

SEQ ID NO: 517872 - DNA, 25 bp, Rattus norvegicus
gtgtgatggctcatgtttctaacca

SEQ ID NO: 517873 - DNA, 25 bp, Rattus norvegicus
gtgtgatggctcttgtttctaacca

SEQ ID NO: 517874 - DNA, 25 bp, Rattus norvegicus
gtgtgatgtcccagttgaggatgat

SEQ ID NO: 517875 - DNA, 25 bp, Rattus norvegicus
gtgtgatgtccctgttgaggatgat

SEQ ID NO: 517876 - DNA, 25 bp, Rattus norvegicus
gtgtgattcatcaactaatctaggt

SEQ ID NO: 517877 - DNA, 25 bp, Rattus norvegicus
gtgtgattcatctactaatctaggt

SEQ ID NO: 517878 - DNA, 25 bp, Rattus norvegicus
gtgtgattccagataagcctttcct

SEQ ID NO: 517879 - DNA, 25 bp, Rattus norvegicus
gtgtgattccagttaagcctttcct

SEQ ID NO: 517880 - DNA, 25 bp, Rattus norvegicus
gtgtgattgaaaattggcctcctta

SEQ ID NO: 517881 - DNA, 25 bp, Rattus norvegicus
gtgtgattgaaatttggcctcctta

SEQ ID NO: 517882 - DNA, 25 bp, Rattus norvegicus
gtgtgattgctactgccgttgccaa

SEQ ID NO: 517883 - DNA, 25 bp, Rattus norvegicus
gtgtgattgctagtgccgttgccaa

SEQ ID NO: 517884 - DNA, 25 bp, Rattus norvegicus
gtgtgattgcttctcaggcctatgg

SEQ ID NO: 517885 - DNA, 25 bp, Rattus norvegicus
gtgtgattgcttgtcaggcctatgg

SEQ ID NO: 517886 - DNA, 25 bp, Rattus norvegicus
gtgtgatttaatcaggccactcttg

SEQ ID NO: 517887 - DNA, 25 bp, Rattus norvegicus
gtgtgatttaatgaggccactcttg

SEQ ID NO: 517888 - DNA, 25 bp, Rattus norvegicus
gtgtgatttcatacataccttcctt

SEQ ID NO: 517889 - DNA, 25 bp, Rattus norvegicus
gtgtgatttcattcataccttcctt

SEQ ID NO: 517890 - DNA, 25 bp, Rattus norvegicus
gtgtgatttctgatgctaactgcca

SEQ ID NO: 517891 - DNA, 25 bp, Rattus norvegicus
gtgtgatttctgttgctaactgcca

SEQ ID NO: 517892 - DNA, 25 bp, Rattus norvegicus
gtgtgatttgaaccatgcttgacta

SEQ ID NO: 517893 - DNA, 25 bp, Rattus norvegicus
gtgtgatttgaagcatgcttgacta

SEQ ID NO: 517894 - DNA, 25 bp, Rattus norvegicus
gtgtgattttgccagttgcagatag

SEQ ID NO: 517895 - DNA, 25 bp, Rattus norvegicus
gtgtgattttgcgagttgcagatag

SEQ ID NO: 517896 - DNA, 25 bp, Rattus norvegicus
gtgtgcaaacacacttaagggcatc

SEQ ID NO: 517897 - DNA, 25 bp, Rattus norvegicus
gtgtgcaaacactcttaagggcatc

SEQ ID NO: 517898 - DNA, 25 bp, Rattus norvegicus
gtgtgcaaacccaagagtctcactg

SEQ ID NO: 517899 - DNA, 25 bp, Rattus norvegicus
gtgtgcaaaccctagagtctcactg

SEQ ID NO: 517900 - DNA, 25 bp, Rattus norvegicus
gtgtgcaaagttccccacagcggct

SEQ ID NO: 517901 - DNA, 25 bp, Rattus norvegicus
gtgtgcaaagttgcccacagcggct

SEQ ID NO: 517902 - DNA, 25 bp, Rattus norvegicus
gtgtgcaaatacacaagcccctagg

SEQ ID NO: 517903 - DNA, 25 bp, Rattus norvegicus
gtgtgcaaatactcaagcccctagg

SEQ ID NO: 517904 - DNA, 25 bp, Rattus norvegicus
gtgtgcaacactattttgtaatcac

SEQ ID NO: 517905 - DNA, 25 bp, Rattus norvegicus
gtgtgcaacacttttttgtaatcac

SEQ ID NO: 517906 - DNA, 25 bp, Rattus norvegicus
gtgtgcaaccatctgcttcaaattg

SEQ ID NO: 517907 - DNA, 25 bp, Rattus norvegicus
gtgtgcaaccatgtgcttcaaattg

SEQ ID NO: 517908 - DNA, 25 bp, Rattus norvegicus
gtgtgcaagatgcatcctcatgctt

SEQ ID NO: 517909 - DNA, 25 bp, Rattus norvegicus
gtgtgcaagatggatcctcatgctt

SEQ ID NO: 517910 - DNA, 25 bp, Rattus norvegicus
gtgtgcaagctcatcacctgtgtga

SEQ ID NO: 517911 - DNA, 25 bp, Rattus norvegicus
gtgtgcaagctcttcacctgtgtga

SEQ ID NO: 517912 - DNA, 25 bp, Rattus norvegicus
gtgtgcaaggagatccgccataact

SEQ ID NO: 517913 - DNA, 25 bp, Rattus norvegicus
gtgtgcaaggagttccgccataact

SEQ ID NO: 517914 - DNA, 25 bp, Rattus norvegicus
gtgtgcaatcctatgtgctgaagat

SEQ ID NO: 517915 - DNA, 25 bp, Rattus norvegicus
gtgtgcaatcctttgtgctgaagat

SEQ ID NO: 517916 - DNA, 25 bp, Rattus norvegicus
gtgtgcaatgccagtgttggccaga

SEQ ID NO: 517917 - DNA, 25 bp, Rattus norvegicus
gtgtgcaatgcctgtgttggccaga

SEQ ID NO: 517918 - DNA, 25 bp, Rattus norvegicus
gtgtgcaatggcattcacctgtctg

SEQ ID NO: 517919 - DNA, 25 bp, Rattus norvegicus
gtgtgcaatggctttcacctgtctg

SEQ ID NO: 517920 - DNA, 25 bp, Rattus norvegicus
gtgtgcaattacactagcagcttct

SEQ ID NO: 517921 - DNA, 25 bp, Rattus norvegicus
gtgtgcaattactctagcagcttct

SEQ ID NO: 517922 - DNA, 25 bp, Rattus norvegicus
gtgtgcacaaatacatctttctggg

SEQ ID NO: 517923 - DNA, 25 bp, Rattus norvegicus
gtgtgcacaaattcatctttctggg

SEQ ID NO: 517924 - DNA, 25 bp, Rattus norvegicus
gtgtgcacaacgatgaactcttcgg

SEQ ID NO: 517925 - DNA, 25 bp, Rattus norvegicus
gtgtgcacaacgttgaactcttcgg

SEQ ID NO: 517926 - DNA, 25 bp, Rattus norvegicus
gtgtgcacacacacgcggaaacatg

SEQ ID NO: 517927 - DNA, 25 bp, Rattus norvegicus
gtgtgcacacactcgcggaaacatg

SEQ ID NO: 517928 - DNA, 25 bp, Rattus norvegicus
gtgtgcacacataagcccgtgtaga

SEQ ID NO: 517929 - DNA, 25 bp, Rattus norvegicus
gtgtgcacacattagcccgtgtaga

SEQ ID NO: 517930 - DNA, 25 bp, Rattus norvegicus
gtgtgcacagcacggcgggtaggac

SEQ ID NO: 517931 - DNA, 25 bp, Rattus norvegicus
gtgtgcacagcagggcgggtaggac

SEQ ID NO: 517932 - DNA, 25 bp, Rattus norvegicus
gtgtgcacaggtatctattccaaat

SEQ ID NO: 517933 - DNA, 25 bp, Rattus norvegicus
gtgtgcacaggtttctattccaaat

SEQ ID NO: 517934 - DNA, 25 bp, Rattus norvegicus
gtgtgcacatacatggacctcccca

SEQ ID NO: 517935 - DNA, 25 bp, Rattus norvegicus
gtgtgcacatacttggacctcccca

SEQ ID NO: 517936 - DNA, 25 bp, Rattus norvegicus
gtgtgcaccaccaacgtttggtgaa

SEQ ID NO: 517937 - DNA, 25 bp, Rattus norvegicus
gtgtgcaccacctacgtttggtgaa

SEQ ID NO: 517938 - DNA, 25 bp, Rattus norvegicus
gtgtgcaccatgactcaggactcaa

SEQ ID NO: 517939 - DNA, 25 bp, Rattus norvegicus
gtgtgcaccatgtctcaggactcaa

SEQ ID NO: 517940 - DNA, 25 bp, Rattus norvegicus
gtgtgcaccattcctactgtagtag

SEQ ID NO: 517941 - DNA, 25 bp, Rattus norvegicus
gtgtgcaccattgctactgtagtag

SEQ ID NO: 517942 - DNA, 25 bp, Rattus norvegicus
gtgtgcaccccacagtgtcttctgt

SEQ ID NO: 517943 - DNA, 25 bp, Rattus norvegicus
gtgtgcaccccagagtgtcttctgt

SEQ ID NO: 517944 - DNA, 25 bp, Rattus norvegicus
gtgtgcaccctgacctagcagtgag

SEQ ID NO: 517945 - DNA, 25 bp, Rattus norvegicus
gtgtgcaccctgtcctagcagtgag

SEQ ID NO: 517946 - DNA, 25 bp, Rattus norvegicus
gtgtgcacctccctttttggagaca

SEQ ID NO: 517947 - DNA, 25 bp, Rattus norvegicus
gtgtgcacctccgtttttggagaca

SEQ ID NO: 517948 - DNA, 25 bp, Rattus norvegicus
gtgtgcacctgtccatacgtgtgca

SEQ ID NO: 517949 - DNA, 25 bp, Rattus norvegicus
gtgtgcacctgtgcatacgtgtgca

SEQ ID NO: 517950 - DNA, 25 bp, Rattus norvegicus
gtgtgcacgaccctaatagcgagta

SEQ ID NO: 517951 - DNA, 25 bp, Rattus norvegicus
gtgtgcacgaccgtaatagcgagta

SEQ ID NO: 517952 - DNA, 25 bp, Rattus norvegicus
gtgtgcactaccatacagttgtttt

SEQ ID NO: 517953 - DNA, 25 bp, Rattus norvegicus
gtgtgcactaccttacagttgtttt

SEQ ID NO: 517954 - DNA, 25 bp, Rattus norvegicus
gtgtgcactagcacaactgtccaca

SEQ ID NO: 517955 - DNA, 25 bp, Rattus norvegicus
gtgtgcactagctcaactgtccaca

SEQ ID NO: 517956 - DNA, 25 bp, Rattus norvegicus
gtgtgcactcagaactctttttaaa

SEQ ID NO: 517957 - DNA, 25 bp, Rattus norvegicus
gtgtgcactcagtactctttttaaa

SEQ ID NO: 517958 - DNA, 25 bp, Rattus norvegicus
gtgtgcactcgaagacattgctgtc

SEQ ID NO: 517959 - DNA, 25 bp, Rattus norvegicus
gtgtgcactcgatgacattgctgtc

SEQ ID NO: 517960 - DNA, 25 bp, Rattus norvegicus
gtgtgcactgtcaatttacatccgt

SEQ ID NO: 517961 - DNA, 25 bp, Rattus norvegicus
gtgtgcactgtctatttacatccgt

SEQ ID NO: 517962 - DNA, 25 bp, Rattus norvegicus
gtgtgcacttacagtatatctcctt

SEQ ID NO: 517963 - DNA, 25 bp, Rattus norvegicus
gtgtgcacttactgtatatctcctt

SEQ ID NO: 517964 - DNA, 25 bp, Rattus norvegicus
gtgtgcagaacacccttagttccga

SEQ ID NO: 517965 - DNA, 25 bp, Rattus norvegicus
gtgtgcagaacagccttagttccga

SEQ ID NO: 517966 - DNA, 25 bp, Rattus norvegicus
gtgtgcagaactccatgaactacct

SEQ ID NO: 517967 - DNA, 25 bp, Rattus norvegicus
gtgtgcagaactgcatgaactacct

SEQ ID NO: 517968 - DNA, 25 bp, Rattus norvegicus
gtgtgcagaagaaacccttccccaa

SEQ ID NO: 517969 - DNA, 25 bp, Rattus norvegicus
gtgtgcagaagatacccttccccaa

SEQ ID NO: 517970 - DNA, 25 bp, Rattus norvegicus
gtgtgcagacaaatcttttgttcat

SEQ ID NO: 517971 - DNA, 25 bp, Rattus norvegicus
gtgtgcagacaattcttttgttcat

SEQ ID NO: 517972 - DNA, 25 bp, Rattus norvegicus
gtgtgcagacagctacgtcactaca

SEQ ID NO: 517973 - DNA, 25 bp, Rattus norvegicus
gtgtgcagacaggtacgtcactaca

SEQ ID NO: 517974 - DNA, 25 bp, Rattus norvegicus
gtgtgcagacatattcttgaagcta

SEQ ID NO: 517975 - DNA, 25 bp, Rattus norvegicus
gtgtgcagacatattgctgtcagct

SEQ ID NO: 517976 - DNA, 25 bp, Rattus norvegicus
gtgtgcagacattttcttgaagcta

SEQ ID NO: 517977 - DNA, 25 bp, Rattus norvegicus
gtgtgcagacattttgctgtcagct

SEQ ID NO: 517978 - DNA, 25 bp, Rattus norvegicus
gtgtgcagacccaagtcatcgttta

SEQ ID NO: 517979 - DNA, 25 bp, Rattus norvegicus
gtgtgcagaccctagtcatcgttta

SEQ ID NO: 517980 - DNA, 25 bp, Rattus norvegicus
gtgtgcagaggcattttcgttcccc

SEQ ID NO: 517981 - DNA, 25 bp, Rattus norvegicus
gtgtgcagaggctttttcgttcccc

SEQ ID NO: 517982 - DNA, 25 bp, Rattus norvegicus
gtgtgcagatgccagtttgtttccc

SEQ ID NO: 517983 - DNA, 25 bp, Rattus norvegicus
gtgtgcagatgcgagtttgtttccc

SEQ ID NO: 517984 - DNA, 25 bp, Rattus norvegicus
gtgtgcagcaaaagcttcaaccgga

SEQ ID NO: 517985 - DNA, 25 bp, Rattus norvegicus
gtgtgcagcaaatgcttcaaccgga

SEQ ID NO: 517986 - DNA, 25 bp, Rattus norvegicus
gtgtgcagcaacacgtgtgggctct

SEQ ID NO: 517987 - DNA, 25 bp, Rattus norvegicus
gtgtgcagcaactcgtgtgggctct

SEQ ID NO: 517988 - DNA, 25 bp, Rattus norvegicus
gtgtgcagcaccatgggttgctcac

SEQ ID NO: 517989 - DNA, 25 bp, Rattus norvegicus
gtgtgcagcaccttgggttgctcac

SEQ ID NO: 517990 - DNA, 25 bp, Rattus norvegicus
gtgtgcagccagataccaccaataa

SEQ ID NO: 517991 - DNA, 25 bp, Rattus norvegicus
gtgtgcagccagttaccaccaataa

SEQ ID NO: 517992 - DNA, 25 bp, Rattus norvegicus
gtgtgcagcgatctctcttggacct

SEQ ID NO: 517993 - DNA, 25 bp, Rattus norvegicus
gtgtgcagcgatgtctcttggacct

SEQ ID NO: 517994 - DNA, 25 bp, Rattus norvegicus
gtgtgcagcgtgagttaatgtgaat

SEQ ID NO: 517995 - DNA, 25 bp, Rattus norvegicus
gtgtgcagcgtgtgttaatgtgaat

SEQ ID NO: 517996 - DNA, 25 bp, Rattus norvegicus
gtgtgcagctccacctagcagaaca

SEQ ID NO: 517997 - DNA, 25 bp, Rattus norvegicus
gtgtgcagctcctcctagcagaaca

SEQ ID NO: 517998 - DNA, 25 bp, Rattus norvegicus
gtgtgcaggacaccagccacagtct

SEQ ID NO: 517999 - DNA, 25 bp, Rattus norvegicus
gtgtgcaggacagcagccacagtct

SEQ ID NO: 518000 - DNA, 25 bp, Rattus norvegicus
gtgtgcaggactctgaatggtacct

SEQ ID NO: 518001 - DNA, 25 bp, Rattus norvegicus
gtgtgcaggactgtgaatggtacct

SEQ ID NO: 518002 - DNA, 25 bp, Rattus norvegicus
gtgtgcaggagaagaccacttattt

SEQ ID NO: 518003 - DNA, 25 bp, Rattus norvegicus
gtgtgcaggagatgaccacttattt

SEQ ID NO: 518004 - DNA, 25 bp, Rattus norvegicus
gtgtgcaggcctatgatcctaggta

SEQ ID NO: 518005 - DNA, 25 bp, Rattus norvegicus
gtgtgcaggcctttgatcctaggta

SEQ ID NO: 518006 - DNA, 25 bp, Rattus norvegicus
gtgtgcaggtacaatccaaagcatt

SEQ ID NO: 518007 - DNA, 25 bp, Rattus norvegicus
gtgtgcaggtactatccaaagcatt

SEQ ID NO: 518008 - DNA, 25 bp, Rattus norvegicus
gtgtgcagtattaacagctccgcca

SEQ ID NO: 518009 - DNA, 25 bp, Rattus norvegicus
gtgtgcagtatttacagctccgcca

SEQ ID NO: 518010 - DNA, 25 bp, Rattus norvegicus
gtgtgcagtcaaatgtacccaacat

SEQ ID NO: 518011 - DNA, 25 bp, Rattus norvegicus
gtgtgcagtcaattgtacccaacat

SEQ ID NO: 518012 - DNA, 25 bp, Rattus norvegicus
gtgtgcagtcacaccaagtaacgta

SEQ ID NO: 518013 - DNA, 25 bp, Rattus norvegicus
gtgtgcagtcactccaagtaacgta

SEQ ID NO: 518014 - DNA, 25 bp, Rattus norvegicus
gtgtgcagtgtcatatatttcattc

SEQ ID NO: 518015 - DNA, 25 bp, Rattus norvegicus
gtgtgcagtgtcttatatttcattc

SEQ ID NO: 518016 - DNA, 25 bp, Rattus norvegicus
gtgtgcagttcaaggaccgtcttaa

SEQ ID NO: 518017 - DNA, 25 bp, Rattus norvegicus
gtgtgcagttcatggaccgtcttaa

SEQ ID NO: 518018 - DNA, 25 bp, Rattus norvegicus
gtgtgcatacacatcttcagacggt

SEQ ID NO: 518019 - DNA, 25 bp, Rattus norvegicus
gtgtgcatacacttcttcagacggt

SEQ ID NO: 518020 - DNA, 25 bp, Rattus norvegicus
gtgtgcatacatatactcttaggga

SEQ ID NO: 518021 - DNA, 25 bp, Rattus norvegicus
gtgtgcatacatttactcttaggga

SEQ ID NO: 518022 - DNA, 25 bp, Rattus norvegicus
gtgtgcatatttcagagccaggccc

SEQ ID NO: 518023 - DNA, 25 bp, Rattus norvegicus
gtgtgcatatttgagagccaggccc

SEQ ID NO: 518024 - DNA, 25 bp, Rattus norvegicus
gtgtgcatcaccaagtcctgtttat

SEQ ID NO: 518025 - DNA, 25 bp, Rattus norvegicus
gtgtgcatcacctagtcctgtttat

SEQ ID NO: 518026 - DNA, 25 bp, Rattus norvegicus
gtgtgcatcactcatagttgacctt

SEQ ID NO: 518027 - DNA, 25 bp, Rattus norvegicus
gtgtgcatcactgatagttgacctt

SEQ ID NO: 518028 - DNA, 25 bp, Rattus norvegicus
gtgtgcatcatgaacactcatgccc

SEQ ID NO: 518029 - DNA, 25 bp, Rattus norvegicus
gtgtgcatcatgacagtggtatcag

SEQ ID NO: 518030 - DNA, 25 bp, Rattus norvegicus
gtgtgcatcatgtacactcatgccc

SEQ ID NO: 518031 - DNA, 25 bp, Rattus norvegicus
gtgtgcatcatgtcagtggtatcag

SEQ ID NO: 518032 - DNA, 25 bp, Rattus norvegicus
gtgtgcatccagcaacactgaccaa

SEQ ID NO: 518033 - DNA, 25 bp, Rattus norvegicus
gtgtgcatccaggaacactgaccaa

SEQ ID NO: 518034 - DNA, 25 bp, Rattus norvegicus
gtgtgcatcccaacaacttgtataa

SEQ ID NO: 518035 - DNA, 25 bp, Rattus norvegicus
gtgtgcatcccatcaacttgtataa

SEQ ID NO: 518036 - DNA, 25 bp, Rattus norvegicus
gtgtgcatctcacttgggccttgtg

SEQ ID NO: 518037 - DNA, 25 bp, Rattus norvegicus
gtgtgcatctcagttgggccttgtg

SEQ ID NO: 518038 - DNA, 25 bp, Rattus norvegicus
gtgtgcatcttgaacagagccctgt

SEQ ID NO: 518039 - DNA, 25 bp, Rattus norvegicus
gtgtgcatcttgtacagagccctgt

SEQ ID NO: 518040 - DNA, 25 bp, Rattus norvegicus
gtgtgcatgaacacttgcggccttc

SEQ ID NO: 518041 - DNA, 25 bp, Rattus norvegicus
gtgtgcatgaactcttgcggccttc

SEQ ID NO: 518042 - DNA, 25 bp, Rattus norvegicus
gtgtgcatgactatttggactcagt

SEQ ID NO: 518043 - DNA, 25 bp, Rattus norvegicus
gtgtgcatgactttttggactcagt

SEQ ID NO: 518044 - DNA, 25 bp, Rattus norvegicus
gtgtgcatgagaccctgacttacaa

SEQ ID NO: 518045 - DNA, 25 bp, Rattus norvegicus
gtgtgcatgagagcctgacttacaa

SEQ ID NO: 518046 - DNA, 25 bp, Rattus norvegicus
gtgtgcatgagcatagccacttcct

SEQ ID NO: 518047 - DNA, 25 bp, Rattus norvegicus
gtgtgcatgagcttagccacttcct

SEQ ID NO: 518048 - DNA, 25 bp, Rattus norvegicus
gtgtgcatgcctatgtctttttgac

SEQ ID NO: 518049 - DNA, 25 bp, Rattus norvegicus
gtgtgcatgcctttgtctttttgac

SEQ ID NO: 518050 - DNA, 25 bp, Rattus norvegicus
gtgtgcatggccagtttgtgtgcaa

SEQ ID NO: 518051 - DNA, 25 bp, Rattus norvegicus
gtgtgcatggccatccaacagggca

SEQ ID NO: 518052 - DNA, 25 bp, Rattus norvegicus
gtgtgcatggcctgtttgtgtgcaa

SEQ ID NO: 518053 - DNA, 25 bp, Rattus norvegicus
gtgtgcatggccttccaacagggca

SEQ ID NO: 518054 - DNA, 25 bp, Rattus norvegicus
gtgtgcatgtataaactgctccttt

SEQ ID NO: 518055 - DNA, 25 bp, Rattus norvegicus
gtgtgcatgtattaactgctccttt

SEQ ID NO: 518056 - DNA, 25 bp, Rattus norvegicus
gtgtgcatgtgcaacctagtcaggt

SEQ ID NO: 518057 - DNA, 25 bp, Rattus norvegicus
gtgtgcatgtgctacctagtcaggt

SEQ ID NO: 518058 - DNA, 25 bp, Rattus norvegicus
gtgtgcatgtgtcactgatttcaga

SEQ ID NO: 518059 - DNA, 25 bp, Rattus norvegicus
gtgtgcatgtgtcttcgtatacata

SEQ ID NO: 518060 - DNA, 25 bp, Rattus norvegicus
gtgtgcatgtgtgactgatttcaga

SEQ ID NO: 518061 - DNA, 25 bp, Rattus norvegicus
gtgtgcatgtgtgttcgtatacata

SEQ ID NO: 518062 - DNA, 25 bp, Rattus norvegicus
gtgtgcattcatctcccgtaaaaca

SEQ ID NO: 518063 - DNA, 25 bp, Rattus norvegicus
gtgtgcattcatgtcccgtaaaaca

SEQ ID NO: 518064 - DNA, 25 bp, Rattus norvegicus
gtgtgcattgcgacatttgttacca

SEQ ID NO: 518065 - DNA, 25 bp, Rattus norvegicus
gtgtgcattgcgtcatttgttacca

SEQ ID NO: 518066 - DNA, 25 bp, Rattus norvegicus
gtgtgcattgtaagtttccagctaa

SEQ ID NO: 518067 - DNA, 25 bp, Rattus norvegicus
gtgtgcattgtatgtttccagctaa

SEQ ID NO: 518068 - DNA, 25 bp, Rattus norvegicus
gtgtgcatttaaacctcgaagtaat

SEQ ID NO: 518069 - DNA, 25 bp, Rattus norvegicus
gtgtgcatttaatcctcgaagtaat

SEQ ID NO: 518070 - DNA, 25 bp, Rattus norvegicus
gtgtgcatttcacaagtacattgga

SEQ ID NO: 518071 - DNA, 25 bp, Rattus norvegicus
gtgtgcatttcagaagtacattgga

SEQ ID NO: 518072 - DNA, 25 bp, Rattus norvegicus
gtgtgcatttctaaggtgaacgctc

SEQ ID NO: 518073 - DNA, 25 bp, Rattus norvegicus
gtgtgcatttctctgtcactgtaac

SEQ ID NO: 518074 - DNA, 25 bp, Rattus norvegicus
gtgtgcatttctgtgtcactgtaac

SEQ ID NO: 518075 - DNA, 25 bp, Rattus norvegicus
gtgtgcatttcttaggtgaacgctc

SEQ ID NO: 518076 - DNA, 25 bp, Rattus norvegicus
gtgtgcatttttctacgctttattt

SEQ ID NO: 518077 - DNA, 25 bp, Rattus norvegicus
gtgtgcatttttgtacgctttattt

SEQ ID NO: 518078 - DNA, 25 bp, Rattus norvegicus
gtgtgccaaaccctgaagaccagaa

SEQ ID NO: 518079 - DNA, 25 bp, Rattus norvegicus
gtgtgccaaaccgtgaagaccagaa

SEQ ID NO: 518080 - DNA, 25 bp, Rattus norvegicus
gtgtgccaaagaaccagtgtcgccc

SEQ ID NO: 518081 - DNA, 25 bp, Rattus norvegicus
gtgtgccaaagatccagtgtcgccc

SEQ ID NO: 518082 - DNA, 25 bp, Rattus norvegicus
gtgtgccaacaaccattttataacc

SEQ ID NO: 518083 - DNA, 25 bp, Rattus norvegicus
gtgtgccaacaagcattttataacc

SEQ ID NO: 518084 - DNA, 25 bp, Rattus norvegicus
gtgtgccaagaaacgcaggctctgg

SEQ ID NO: 518085 - DNA, 25 bp, Rattus norvegicus
gtgtgccaagaatcgcaggctctgg

SEQ ID NO: 518086 - DNA, 25 bp, Rattus norvegicus
gtgtgccacacaagtagccctggat

SEQ ID NO: 518087 - DNA, 25 bp, Rattus norvegicus
gtgtgccacacacggtgacataaag

SEQ ID NO: 518088 - DNA, 25 bp, Rattus norvegicus
gtgtgccacacagggtgacataaag

SEQ ID NO: 518089 - DNA, 25 bp, Rattus norvegicus
gtgtgccacacatgtagccctggat

SEQ ID NO: 518090 - DNA, 25 bp, Rattus norvegicus
gtgtgccacatgcttgacttacaga

SEQ ID NO: 518091 - DNA, 25 bp, Rattus norvegicus
gtgtgccacatggttgacttacaga

SEQ ID NO: 518092 - DNA, 25 bp, Rattus norvegicus
gtgtgccaccacaaatggaatagat

SEQ ID NO: 518093 - DNA, 25 bp, Rattus norvegicus
gtgtgccaccacaacgtcagagtta

SEQ ID NO: 518094 - DNA, 25 bp, Rattus norvegicus
gtgtgccaccactaatggaatagat

SEQ ID NO: 518095 - DNA, 25 bp, Rattus norvegicus
gtgtgccaccactacgtcagagtta

SEQ ID NO: 518096 - DNA, 25 bp, Rattus norvegicus
gtgtgccaccagcaagagcaactga

SEQ ID NO: 518097 - DNA, 25 bp, Rattus norvegicus
gtgtgccaccaggaagagcaactga

SEQ ID NO: 518098 - DNA, 25 bp, Rattus norvegicus
gtgtgccaccatccccaattaagag

SEQ ID NO: 518099 - DNA, 25 bp, Rattus norvegicus
gtgtgccaccatgcccaattaagag

SEQ ID NO: 518100 - DNA, 25 bp, Rattus norvegicus
gtgtgccaccccatgagaagtactg

SEQ ID NO: 518101 - DNA, 25 bp, Rattus norvegicus
gtgtgccaccccttgagaagtactg

SEQ ID NO: 518102 - DNA, 25 bp, Rattus norvegicus
gtgtgccactgaaccatcaggtagg

SEQ ID NO: 518103 - DNA, 25 bp, Rattus norvegicus
gtgtgccactgatccatcaggtagg

SEQ ID NO: 518104 - DNA, 25 bp, Rattus norvegicus
gtgtgccagaatatggtcacccggg

SEQ ID NO: 518105 - DNA, 25 bp, Rattus norvegicus
gtgtgccagaatttggtcacccggg

SEQ ID NO: 518106 - DNA, 25 bp, Rattus norvegicus
gtgtgccagagaccttgattcagta

SEQ ID NO: 518107 - DNA, 25 bp, Rattus norvegicus
gtgtgccagagagcttgattcagta

SEQ ID NO: 518108 - DNA, 25 bp, Rattus norvegicus
gtgtgccagcagcaccctttaggta

SEQ ID NO: 518109 - DNA, 25 bp, Rattus norvegicus
gtgtgccagcaggaccctttaggta

SEQ ID NO: 518110 - DNA, 25 bp, Rattus norvegicus
gtgtgccagcataccatacaacggg

SEQ ID NO: 518111 - DNA, 25 bp, Rattus norvegicus
gtgtgccagcattccatacaacggg

SEQ ID NO: 518112 - DNA, 25 bp, Rattus norvegicus
gtgtgccaggacacagaccaggaca

SEQ ID NO: 518113 - DNA, 25 bp, Rattus norvegicus
gtgtgccaggactcagaccaggaca

SEQ ID NO: 518114 - DNA, 25 bp, Rattus norvegicus
gtgtgccaggatctgctcaaattca

SEQ ID NO: 518115 - DNA, 25 bp, Rattus norvegicus
gtgtgccaggatgtgctcaaattca

SEQ ID NO: 518116 - DNA, 25 bp, Rattus norvegicus
gtgtgccatacactctcttgaggga

SEQ ID NO: 518117 - DNA, 25 bp, Rattus norvegicus
gtgtgccatacagtctcttgaggga

SEQ ID NO: 518118 - DNA, 25 bp, Rattus norvegicus
gtgtgccatgtaagacacgagcata

SEQ ID NO: 518119 - DNA, 25 bp, Rattus norvegicus
gtgtgccatgtatgacacgagcata

SEQ ID NO: 518120 - DNA, 25 bp, Rattus norvegicus
gtgtgcccaaaaatagtcatgccgt

SEQ ID NO: 518121 - DNA, 25 bp, Rattus norvegicus
gtgtgcccaaaattagtcatgccgt

SEQ ID NO: 518122 - DNA, 25 bp, Rattus norvegicus
gtgtgcccaactctgtaatccaaat

SEQ ID NO: 518123 - DNA, 25 bp, Rattus norvegicus
gtgtgcccaactgtgtaatccaaat

SEQ ID NO: 518124 - DNA, 25 bp, Rattus norvegicus
gtgtgcccagaacctctatgcagaa

SEQ ID NO: 518125 - DNA, 25 bp, Rattus norvegicus
gtgtgcccagaagctctatgcagaa

SEQ ID NO: 518126 - DNA, 25 bp, Rattus norvegicus
gtgtgcccagacaataacttccaga

SEQ ID NO: 518127 - DNA, 25 bp, Rattus norvegicus
gtgtgcccagactataacttccaga

SEQ ID NO: 518128 - DNA, 25 bp, Rattus norvegicus
gtgtgccccaataggcgaacgtaag

SEQ ID NO: 518129 - DNA, 25 bp, Rattus norvegicus
gtgtgccccaattggcgaacgtaag

SEQ ID NO: 518130 - DNA, 25 bp, Rattus norvegicus
gtgtgccccatcatcgtgggtgcaa

SEQ ID NO: 518131 - DNA, 25 bp, Rattus norvegicus
gtgtgccccatcttcgtgggtgcaa

SEQ ID NO: 518132 - DNA, 25 bp, Rattus norvegicus
gtgtgccccgggagttctcttactt

SEQ ID NO: 518133 - DNA, 25 bp, Rattus norvegicus
gtgtgccccgggtgttctcttactt

SEQ ID NO: 518134 - DNA, 25 bp, Rattus norvegicus
gtgtgccccttacatagtattctta

SEQ ID NO: 518135 - DNA, 25 bp, Rattus norvegicus
gtgtgccccttagatagtattctta

SEQ ID NO: 518136 - DNA, 25 bp, Rattus norvegicus
gtgtgccctagacgtcacttgataa

SEQ ID NO: 518137 - DNA, 25 bp, Rattus norvegicus
gtgtgccctagaggtcacttgataa

SEQ ID NO: 518138 - DNA, 25 bp, Rattus norvegicus
gtgtgccctcaaacatgatttatct

SEQ ID NO: 518139 - DNA, 25 bp, Rattus norvegicus
gtgtgccctcaatcatgatttatct

SEQ ID NO: 518140 - DNA, 25 bp, Rattus norvegicus
gtgtgccctctgacattagatttta

SEQ ID NO: 518141 - DNA, 25 bp, Rattus norvegicus
gtgtgccctctgtcattagatttta

SEQ ID NO: 518142 - DNA, 25 bp, Rattus norvegicus
gtgtgccctgccaatgagctgcatt

SEQ ID NO: 518143 - DNA, 25 bp, Rattus norvegicus
gtgtgccctgcctatgagctgcatt

SEQ ID NO: 518144 - DNA, 25 bp, Rattus norvegicus
gtgtgccctgggatcacattagcat

SEQ ID NO: 518145 - DNA, 25 bp, Rattus norvegicus
gtgtgccctgggttcacattagcat

SEQ ID NO: 518146 - DNA, 25 bp, Rattus norvegicus
gtgtgccctgtgactttattctttt

SEQ ID NO: 518147 - DNA, 25 bp, Rattus norvegicus
gtgtgccctgtgtctttattctttt

SEQ ID NO: 518148 - DNA, 25 bp, Rattus norvegicus
gtgtgccgactgcacattgagccca

SEQ ID NO: 518149 - DNA, 25 bp, Rattus norvegicus
gtgtgccgactggacattgagccca

SEQ ID NO: 518150 - DNA, 25 bp, Rattus norvegicus
gtgtgccgatacacctgcaatcctg

SEQ ID NO: 518151 - DNA, 25 bp, Rattus norvegicus
gtgtgccgatactcctgcaatcctg

SEQ ID NO: 518152 - DNA, 25 bp, Rattus norvegicus
gtgtgccgattacttattttacaaa

SEQ ID NO: 518153 - DNA, 25 bp, Rattus norvegicus
gtgtgccgattagttattttacaaa

SEQ ID NO: 518154 - DNA, 25 bp, Rattus norvegicus
gtgtgccgccacctgttgcagttct

SEQ ID NO: 518155 - DNA, 25 bp, Rattus norvegicus
gtgtgccgccacgtgttgcagttct

SEQ ID NO: 518156 - DNA, 25 bp, Rattus norvegicus
gtgtgccgccctatattaagggctc

SEQ ID NO: 518157 - DNA, 25 bp, Rattus norvegicus
gtgtgccgccctttattaagggctc

SEQ ID NO: 518158 - DNA, 25 bp, Rattus norvegicus
gtgtgccgctagcaccaatttttgg

SEQ ID NO: 518159 - DNA, 25 bp, Rattus norvegicus
gtgtgccgctaggaccaatttttgg

SEQ ID NO: 518160 - DNA, 25 bp, Rattus norvegicus
gtgtgccgtattactgtgttttgat

SEQ ID NO: 518161 - DNA, 25 bp, Rattus norvegicus
gtgtgccgtatttctgtgttttgat

SEQ ID NO: 518162 - DNA, 25 bp, Rattus norvegicus
gtgtgccgttctcctcaaaactaag

SEQ ID NO: 518163 - DNA, 25 bp, Rattus norvegicus
gtgtgccgttctgctcaaaactaag

SEQ ID NO: 518164 - DNA, 25 bp, Rattus norvegicus
gtgtgccgtttgactttttgttaca

SEQ ID NO: 518165 - DNA, 25 bp, Rattus norvegicus
gtgtgccgtttgtctttttgttaca

SEQ ID NO: 518166 - DNA, 25 bp, Rattus norvegicus
gtgtgcctaaacatttatttctgct

SEQ ID NO: 518167 - DNA, 25 bp, Rattus norvegicus
gtgtgcctaaacttttatttctgct

SEQ ID NO: 518168 - DNA, 25 bp, Rattus norvegicus
gtgtgcctacacagtatgtttcata

SEQ ID NO: 518169 - DNA, 25 bp, Rattus norvegicus
gtgtgcctacactgtatgtttcata

SEQ ID NO: 518170 - DNA, 25 bp, Rattus norvegicus
gtgtgcctaccgcatgcatgagtgc

SEQ ID NO: 518171 - DNA, 25 bp, Rattus norvegicus
gtgtgcctaccggatgcatgagtgc

SEQ ID NO: 518172 - DNA, 25 bp, Rattus norvegicus
gtgtgcctagagagcggcccttaca

SEQ ID NO: 518173 - DNA, 25 bp, Rattus norvegicus
gtgtgcctagagtgcggcccttaca

SEQ ID NO: 518174 - DNA, 25 bp, Rattus norvegicus
gtgtgcctcagaattatcctgtcct

SEQ ID NO: 518175 - DNA, 25 bp, Rattus norvegicus
gtgtgcctcagatttatcctgtcct

SEQ ID NO: 518176 - DNA, 25 bp, Rattus norvegicus
gtgtgcctccacctggtggtgacaa

SEQ ID NO: 518177 - DNA, 25 bp, Rattus norvegicus
gtgtgcctccacgtggtggtgacaa

SEQ ID NO: 518178 - DNA, 25 bp, Rattus norvegicus
gtgtgcctccagctggatgacttga

SEQ ID NO: 518179 - DNA, 25 bp, Rattus norvegicus
gtgtgcctccaggtggatgacttga

SEQ ID NO: 518180 - DNA, 25 bp, Rattus norvegicus
gtgtgcctctacaaacaggtttctt

SEQ ID NO: 518181 - DNA, 25 bp, Rattus norvegicus
gtgtgcctctactaacaggtttctt

SEQ ID NO: 518182 - DNA, 25 bp, Rattus norvegicus
gtgtgcctgagcatttgtggtccca

SEQ ID NO: 518183 - DNA, 25 bp, Rattus norvegicus
gtgtgcctgagcttttgtggtccca

SEQ ID NO: 518184 - DNA, 25 bp, Rattus norvegicus
gtgtgcctgagtatccatcgaatag

SEQ ID NO: 518185 - DNA, 25 bp, Rattus norvegicus
gtgtgcctgagtatctgctttctga

SEQ ID NO: 518186 - DNA, 25 bp, Rattus norvegicus
gtgtgcctgagtttccatcgaatag

SEQ ID NO: 518187 - DNA, 25 bp, Rattus norvegicus
gtgtgcctgagtttctgctttctga

SEQ ID NO: 518188 - DNA, 25 bp, Rattus norvegicus
gtgtgcctgcagagaggcttgtcat

SEQ ID NO: 518189 - DNA, 25 bp, Rattus norvegicus
gtgtgcctgcagatgcccaaatagg

SEQ ID NO: 518190 - DNA, 25 bp, Rattus norvegicus
gtgtgcctgcagatgtatacttgac

SEQ ID NO: 518191 - DNA, 25 bp, Rattus norvegicus
gtgtgcctgcagtgaggcttgtcat

SEQ ID NO: 518192 - DNA, 25 bp, Rattus norvegicus
gtgtgcctgcagttgcccaaatagg

SEQ ID NO: 518193 - DNA, 25 bp, Rattus norvegicus
gtgtgcctgcagttgtatacttgac

SEQ ID NO: 518194 - DNA, 25 bp, Rattus norvegicus
gtgtgcctgccactccagactggga

SEQ ID NO: 518195 - DNA, 25 bp, Rattus norvegicus
gtgtgcctgccagtccagactggga

SEQ ID NO: 518196 - DNA, 25 bp, Rattus norvegicus
gtgtgcctgcccagtatctgtgcta

SEQ ID NO: 518197 - DNA, 25 bp, Rattus norvegicus
gtgtgcctgccctgtatctgtgcta

SEQ ID NO: 518198 - DNA, 25 bp, Rattus norvegicus
gtgtgcctggagattaccctggaca

SEQ ID NO: 518199 - DNA, 25 bp, Rattus norvegicus
gtgtgcctggagtttaccctggaca

SEQ ID NO: 518200 - DNA, 25 bp, Rattus norvegicus
gtgtgcctgtgcctgtgtcactgct

SEQ ID NO: 518201 - DNA, 25 bp, Rattus norvegicus
gtgtgcctgtgcgtgtgtcactgct

SEQ ID NO: 518202 - DNA, 25 bp, Rattus norvegicus
gtgtgcctgtgtagataagcagtct

SEQ ID NO: 518203 - DNA, 25 bp, Rattus norvegicus
gtgtgcctgtgtctgagtgaatata

SEQ ID NO: 518204 - DNA, 25 bp, Rattus norvegicus
gtgtgcctgtgtgtgagtgaatata

SEQ ID NO: 518205 - DNA, 25 bp, Rattus norvegicus
gtgtgcctgtgttgataagcagtct

SEQ ID NO: 518206 - DNA, 25 bp, Rattus norvegicus
gtgtgccttactatataacgttttg

SEQ ID NO: 518207 - DNA, 25 bp, Rattus norvegicus
gtgtgccttactttataacgttttg

SEQ ID NO: 518208 - DNA, 25 bp, Rattus norvegicus
gtgtgccttatgcttcttgcactgg

SEQ ID NO: 518209 - DNA, 25 bp, Rattus norvegicus
gtgtgccttatggttcttgcactgg

SEQ ID NO: 518210 - DNA, 25 bp, Rattus norvegicus
gtgtgccttccgcaacctctttggg

SEQ ID NO: 518211 - DNA, 25 bp, Rattus norvegicus
gtgtgccttccggaacctctttggg

SEQ ID NO: 518212 - DNA, 25 bp, Rattus norvegicus
gtgtgccttctgataacttgttgta

SEQ ID NO: 518213 - DNA, 25 bp, Rattus norvegicus
gtgtgccttctgttaacttgttgta

SEQ ID NO: 518214 - DNA, 25 bp, Rattus norvegicus
gtgtgccttgagcaagtctcatttt

SEQ ID NO: 518215 - DNA, 25 bp, Rattus norvegicus
gtgtgccttgaggaagtctcatttt

SEQ ID NO: 518216 - DNA, 25 bp, Rattus norvegicus
gtgtgccttgctataccaaacaaat

SEQ ID NO: 518217 - DNA, 25 bp, Rattus norvegicus
gtgtgccttgctttaccaaacaaat

SEQ ID NO: 518218 - DNA, 25 bp, Rattus norvegicus
gtgtgcctttacctcattctgagaa

SEQ ID NO: 518219 - DNA, 25 bp, Rattus norvegicus
gtgtgcctttacgtcattctgagaa

SEQ ID NO: 518220 - DNA, 25 bp, Rattus norvegicus
gtgtgcctttccagatctgagaaca

SEQ ID NO: 518221 - DNA, 25 bp, Rattus norvegicus
gtgtgcctttcctgatctgagaaca

SEQ ID NO: 518222 - DNA, 25 bp, Rattus norvegicus
gtgtgcgaggctcctctctcttgca

SEQ ID NO: 518223 - DNA, 25 bp, Rattus norvegicus
gtgtgcgaggctgctctctcttgca

SEQ ID NO: 518224 - DNA, 25 bp, Rattus norvegicus
gtgtgcgccccacatagacactgga

SEQ ID NO: 518225 - DNA, 25 bp, Rattus norvegicus
gtgtgcgccccagatagacactgga

SEQ ID NO: 518226 - DNA, 25 bp, Rattus norvegicus
gtgtgcgcctgtagagtgatactga

SEQ ID NO: 518227 - DNA, 25 bp, Rattus norvegicus
gtgtgcgcctgttgagtgatactga

SEQ ID NO: 518228 - DNA, 25 bp, Rattus norvegicus
gtgtgcgcgcgaagcagacgccgca

SEQ ID NO: 518229 - DNA, 25 bp, Rattus norvegicus
gtgtgcgcgcgatgcagacgccgca

SEQ ID NO: 518230 - DNA, 25 bp, Rattus norvegicus
gtgtgcgctccactcggaaaccgga

SEQ ID NO: 518231 - DNA, 25 bp, Rattus norvegicus
gtgtgcgctccagtcggaaaccgga

SEQ ID NO: 518232 - DNA, 25 bp, Rattus norvegicus
gtgtgcgctcgtccacgcacatgca

SEQ ID NO: 518233 - DNA, 25 bp, Rattus norvegicus
gtgtgcgctcgtgcacgcacatgca

SEQ ID NO: 518234 - DNA, 25 bp, Rattus norvegicus
gtgtgcggactcatggatgcttcac

SEQ ID NO: 518235 - DNA, 25 bp, Rattus norvegicus
gtgtgcggactcttggatgcttcac

SEQ ID NO: 518236 - DNA, 25 bp, Rattus norvegicus
gtgtgcggcggtcataacacgggct

SEQ ID NO: 518237 - DNA, 25 bp, Rattus norvegicus
gtgtgcggcggtgataacacgggct

SEQ ID NO: 518238 - DNA, 25 bp, Rattus norvegicus
gtgtgcggctctactacattggagg

SEQ ID NO: 518239 - DNA, 25 bp, Rattus norvegicus
gtgtgcggctcttctacattggagg

SEQ ID NO: 518240 - DNA, 25 bp, Rattus norvegicus
gtgtgcggtcttcgctttgacaaat

SEQ ID NO: 518241 - DNA, 25 bp, Rattus norvegicus
gtgtgcggtcttggctttgacaaat

SEQ ID NO: 518242 - DNA, 25 bp, Rattus norvegicus
gtgtgcggtgccacttagaggacca

SEQ ID NO: 518243 - DNA, 25 bp, Rattus norvegicus
gtgtgcggtgcctcttagaggacca

SEQ ID NO: 518244 - DNA, 25 bp, Rattus norvegicus
gtgtgcgtacccaggctgcaataag

SEQ ID NO: 518245 - DNA, 25 bp, Rattus norvegicus
gtgtgcgtaccctggctgcaataag

SEQ ID NO: 518246 - DNA, 25 bp, Rattus norvegicus
gtgtgcgtcaacacgcgccagaacg

SEQ ID NO: 518247 - DNA, 25 bp, Rattus norvegicus
gtgtgcgtcaactcgcgccagaacg

SEQ ID NO: 518248 - DNA, 25 bp, Rattus norvegicus
gtgtgcgtcctcagatgcgccttta

SEQ ID NO: 518249 - DNA, 25 bp, Rattus norvegicus
gtgtgcgtcctctgatgcgccttta

SEQ ID NO: 518250 - DNA, 25 bp, Rattus norvegicus
gtgtgcgtggctcatatcctgcaac

SEQ ID NO: 518251 - DNA, 25 bp, Rattus norvegicus
gtgtgcgtggctgatatcctgcaac

SEQ ID NO: 518252 - DNA, 25 bp, Rattus norvegicus
gtgtgcgtgtgtccgggccgcagcg

SEQ ID NO: 518253 - DNA, 25 bp, Rattus norvegicus
gtgtgcgtgtgtgcgggccgcagcg

SEQ ID NO: 518254 - DNA, 25 bp, Rattus norvegicus
gtgtgcgtgttgcttctatggatta

SEQ ID NO: 518255 - DNA, 25 bp, Rattus norvegicus
gtgtgcgtgttggttctatggatta

SEQ ID NO: 518256 - DNA, 25 bp, Rattus norvegicus
gtgtgcgttattagtcagtggccat

SEQ ID NO: 518257 - DNA, 25 bp, Rattus norvegicus
gtgtgcgttatttgtcagtggccat

SEQ ID NO: 518258 - DNA, 25 bp, Rattus norvegicus
gtgtgctaacaacagtgacgctctg

SEQ ID NO: 518259 - DNA, 25 bp, Rattus norvegicus
gtgtgctaacaagagtgacgctctg

SEQ ID NO: 518260 - DNA, 25 bp, Rattus norvegicus
gtgtgctaatgtcgacttctgccca

SEQ ID NO: 518261 - DNA, 25 bp, Rattus norvegicus
gtgtgctaatgtggacttctgccca

SEQ ID NO: 518262 - DNA, 25 bp, Rattus norvegicus
gtgtgctaattcaggcctaacttct

SEQ ID NO: 518263 - DNA, 25 bp, Rattus norvegicus
gtgtgctaattctggcctaacttct

SEQ ID NO: 518264 - DNA, 25 bp, Rattus norvegicus
gtgtgctaatttctgcccatggcag

SEQ ID NO: 518265 - DNA, 25 bp, Rattus norvegicus
gtgtgctaatttgtgcccatggcag

SEQ ID NO: 518266 - DNA, 25 bp, Rattus norvegicus
gtgtgctacccacttctagacactg

SEQ ID NO: 518267 - DNA, 25 bp, Rattus norvegicus
gtgtgctacccagttctagacactg

SEQ ID NO: 518268 - DNA, 25 bp, Rattus norvegicus
gtgtgctacgtgaaccaccaaaaca

SEQ ID NO: 518269 - DNA, 25 bp, Rattus norvegicus
gtgtgctacgtgtaccaccaaaaca

SEQ ID NO: 518270 - DNA, 25 bp, Rattus norvegicus
gtgtgctactagcacatgttcgcat

SEQ ID NO: 518271 - DNA, 25 bp, Rattus norvegicus
gtgtgctactaggacatgttcgcat

SEQ ID NO: 518272 - DNA, 25 bp, Rattus norvegicus
gtgtgctaggctccaagatacccaa

SEQ ID NO: 518273 - DNA, 25 bp, Rattus norvegicus
gtgtgctaggctgcaagatacccaa

SEQ ID NO: 518274 - DNA, 25 bp, Rattus norvegicus
gtgtgctaggtgagcatgctatcaa

SEQ ID NO: 518275 - DNA, 25 bp, Rattus norvegicus
gtgtgctaggtgtgcatgctatcaa

SEQ ID NO: 518276 - DNA, 25 bp, Rattus norvegicus
gtgtgctatccaagccaaacgtgta

SEQ ID NO: 518277 - DNA, 25 bp, Rattus norvegicus
gtgtgctatccatgccaaacgtgta

SEQ ID NO: 518278 - DNA, 25 bp, Rattus norvegicus
gtgtgctatggaattgtctttataa

SEQ ID NO: 518279 - DNA, 25 bp, Rattus norvegicus
gtgtgctatggatttgtctttataa

SEQ ID NO: 518280 - DNA, 25 bp, Rattus norvegicus
gtgtgctatggcaccttctacaatc

SEQ ID NO: 518281 - DNA, 25 bp, Rattus norvegicus
gtgtgctatggccactgtcaaagct

SEQ ID NO: 518282 - DNA, 25 bp, Rattus norvegicus
gtgtgctatggcgactgtcaaagct

SEQ ID NO: 518283 - DNA, 25 bp, Rattus norvegicus
gtgtgctatggctccttctacaatc

SEQ ID NO: 518284 - DNA, 25 bp, Rattus norvegicus
gtgtgctatttgactgactgagaaa

SEQ ID NO: 518285 - DNA, 25 bp, Rattus norvegicus
gtgtgctatttgtctgactgagaaa

SEQ ID NO: 518286 - DNA, 25 bp, Rattus norvegicus
gtgtgctcaatcaccattatgtcca

SEQ ID NO: 518287 - DNA, 25 bp, Rattus norvegicus
gtgtgctcaatctccattatgtcca

SEQ ID NO: 518288 - DNA, 25 bp, Rattus norvegicus
gtgtgctcacaaaatcatatacatt

SEQ ID NO: 518289 - DNA, 25 bp, Rattus norvegicus
gtgtgctcacaatatcatatacatt

SEQ ID NO: 518290 - DNA, 25 bp, Rattus norvegicus
gtgtgctcacaccaaagaccttaat

SEQ ID NO: 518291 - DNA, 25 bp, Rattus norvegicus
gtgtgctcacacgaaagaccttaat

SEQ ID NO: 518292 - DNA, 25 bp, Rattus norvegicus
gtgtgctcagaactctctttaccaa

SEQ ID NO: 518293 - DNA, 25 bp, Rattus norvegicus
gtgtgctcagaagtctctttaccaa

SEQ ID NO: 518294 - DNA, 25 bp, Rattus norvegicus
gtgtgctcaggtccattccaaagaa

SEQ ID NO: 518295 - DNA, 25 bp, Rattus norvegicus
gtgtgctcaggtgcattccaaagaa

SEQ ID NO: 518296 - DNA, 25 bp, Rattus norvegicus
gtgtgctcatatctattttctgttg

SEQ ID NO: 518297 - DNA, 25 bp, Rattus norvegicus
gtgtgctcatatgtattttctgttg

SEQ ID NO: 518298 - DNA, 25 bp, Rattus norvegicus
gtgtgctcatccctaagcgcgggaa

SEQ ID NO: 518299 - DNA, 25 bp, Rattus norvegicus
gtgtgctcatccgtaagcgcgggaa

SEQ ID NO: 518300 - DNA, 25 bp, Rattus norvegicus
gtgtgctcatgtacagtgctttgcc

SEQ ID NO: 518301 - DNA, 25 bp, Rattus norvegicus
gtgtgctcatgtccactgtggtgta

SEQ ID NO: 518302 - DNA, 25 bp, Rattus norvegicus
gtgtgctcatgtgcactgtggtgta

SEQ ID NO: 518303 - DNA, 25 bp, Rattus norvegicus
gtgtgctcatgttcagtgctttgcc

SEQ ID NO: 518304 - DNA, 25 bp, Rattus norvegicus
gtgtgctccagcaaatgtccatttg

SEQ ID NO: 518305 - DNA, 25 bp, Rattus norvegicus
gtgtgctccagctaatgtccatttg

SEQ ID NO: 518306 - DNA, 25 bp, Rattus norvegicus
gtgtgctccaggagccctcggtcac

SEQ ID NO: 518307 - DNA, 25 bp, Rattus norvegicus
gtgtgctccaggtgccctcggtcac

SEQ ID NO: 518308 - DNA, 25 bp, Rattus norvegicus
gtgtgctcccaccattttatatata

SEQ ID NO: 518309 - DNA, 25 bp, Rattus norvegicus
gtgtgctcccacgattttatatata

SEQ ID NO: 518310 - DNA, 25 bp, Rattus norvegicus
gtgtgctccctgcatgcaaagtgca

SEQ ID NO: 518311 - DNA, 25 bp, Rattus norvegicus
gtgtgctccctggatgcaaagtgca

SEQ ID NO: 518312 - DNA, 25 bp, Rattus norvegicus
gtgtgctccgtgagttgtgaaagtt

SEQ ID NO: 518313 - DNA, 25 bp, Rattus norvegicus
gtgtgctccgtgtgttgtgaaagtt

SEQ ID NO: 518314 - DNA, 25 bp, Rattus norvegicus
gtgtgctcctaactagacagtccag

SEQ ID NO: 518315 - DNA, 25 bp, Rattus norvegicus
gtgtgctcctaagtagacagtccag

SEQ ID NO: 518316 - DNA, 25 bp, Rattus norvegicus
gtgtgctcctgccaacacatgagga

SEQ ID NO: 518317 - DNA, 25 bp, Rattus norvegicus
gtgtgctcctgcgaacacatgagga

SEQ ID NO: 518318 - DNA, 25 bp, Rattus norvegicus
gtgtgctcctgtctttagggcttca

SEQ ID NO: 518319 - DNA, 25 bp, Rattus norvegicus
gtgtgctcctgtgtttagggcttca

SEQ ID NO: 518320 - DNA, 25 bp, Rattus norvegicus
gtgtgctccttgcatgacatgaatg

SEQ ID NO: 518321 - DNA, 25 bp, Rattus norvegicus
gtgtgctccttggatgacatgaatg

SEQ ID NO: 518322 - DNA, 25 bp, Rattus norvegicus
gtgtgctcgacgaagaatcgacgct

SEQ ID NO: 518323 - DNA, 25 bp, Rattus norvegicus
gtgtgctcgacgtagaatcgacgct

SEQ ID NO: 518324 - DNA, 25 bp, Rattus norvegicus
gtgtgctcgttgctctttgcaaaat

SEQ ID NO: 518325 - DNA, 25 bp, Rattus norvegicus
gtgtgctcgttggtctttgcaaaat

SEQ ID NO: 518326 - DNA, 25 bp, Rattus norvegicus
gtgtgctctctcaccagtgaagagg

SEQ ID NO: 518327 - DNA, 25 bp, Rattus norvegicus
gtgtgctctctctccagtgaagagg

SEQ ID NO: 518328 - DNA, 25 bp, Rattus norvegicus
gtgtgctctcttacagcagggagaa

SEQ ID NO: 518329 - DNA, 25 bp, Rattus norvegicus
gtgtgctctctttcagcagggagaa

SEQ ID NO: 518330 - DNA, 25 bp, Rattus norvegicus
gtgtgctctgccaaggccatggaga

SEQ ID NO: 518331 - DNA, 25 bp, Rattus norvegicus
gtgtgctctgcctaggccatggaga

SEQ ID NO: 518332 - DNA, 25 bp, Rattus norvegicus
gtgtgctctgtacaactgcacgcaa

SEQ ID NO: 518333 - DNA, 25 bp, Rattus norvegicus
gtgtgctctgtagaactgcacgcaa

SEQ ID NO: 518334 - DNA, 25 bp, Rattus norvegicus
gtgtgctcttcaattttatccctta

SEQ ID NO: 518335 - DNA, 25 bp, Rattus norvegicus
gtgtgctcttcaccgcatacaaaca

SEQ ID NO: 518336 - DNA, 25 bp, Rattus norvegicus
gtgtgctcttcagcgcatacaaaca

SEQ ID NO: 518337 - DNA, 25 bp, Rattus norvegicus
gtgtgctcttcatttttatccctta

SEQ ID NO: 518338 - DNA, 25 bp, Rattus norvegicus
gtgtgctcttctctagctttggaaa

SEQ ID NO: 518339 - DNA, 25 bp, Rattus norvegicus
gtgtgctcttctgtagctttggaaa

SEQ ID NO: 518340 - DNA, 25 bp, Rattus norvegicus
gtgtgctgaataattgccgtcctga

SEQ ID NO: 518341 - DNA, 25 bp, Rattus norvegicus
gtgtgctgaatatttgccgtcctga

SEQ ID NO: 518342 - DNA, 25 bp, Rattus norvegicus
gtgtgctgaccacgcttgccaggaa

SEQ ID NO: 518343 - DNA, 25 bp, Rattus norvegicus
gtgtgctgaccaggcttgccaggaa

SEQ ID NO: 518344 - DNA, 25 bp, Rattus norvegicus
gtgtgctgaccccaaatatccattc

SEQ ID NO: 518345 - DNA, 25 bp, Rattus norvegicus
gtgtgctgacccgaaatatccattc

SEQ ID NO: 518346 - DNA, 25 bp, Rattus norvegicus
gtgtgctgacgacaggatgttcctc

SEQ ID NO: 518347 - DNA, 25 bp, Rattus norvegicus
gtgtgctgacgagaggatgttcctc

SEQ ID NO: 518348 - DNA, 25 bp, Rattus norvegicus
gtgtgctgactcctagttgccttga

SEQ ID NO: 518349 - DNA, 25 bp, Rattus norvegicus
gtgtgctgactcgtagttgccttga

SEQ ID NO: 518350 - DNA, 25 bp, Rattus norvegicus
gtgtgctgactgcatcatggcattt

SEQ ID NO: 518351 - DNA, 25 bp, Rattus norvegicus
gtgtgctgactggatcatggcattt

SEQ ID NO: 518352 - DNA, 25 bp, Rattus norvegicus
gtgtgctgagccagcagttctcaac

SEQ ID NO: 518353 - DNA, 25 bp, Rattus norvegicus
gtgtgctgagcctgcagttctcaac

SEQ ID NO: 518354 - DNA, 25 bp, Rattus norvegicus
gtgtgctgagcgacacttactaaat

SEQ ID NO: 518355 - DNA, 25 bp, Rattus norvegicus
gtgtgctgagcgtcacttactaaat

SEQ ID NO: 518356 - DNA, 25 bp, Rattus norvegicus
gtgtgctgagtgatatcttccacca

SEQ ID NO: 518357 - DNA, 25 bp, Rattus norvegicus
gtgtgctgagtgttatcttccacca

SEQ ID NO: 518358 - DNA, 25 bp, Rattus norvegicus
gtgtgctgattgcagaaccttgtca

SEQ ID NO: 518359 - DNA, 25 bp, Rattus norvegicus
gtgtgctgattggagaaccttgtca

SEQ ID NO: 518360 - DNA, 25 bp, Rattus norvegicus
gtgtgctgcaacaccctattttgtt

SEQ ID NO: 518361 - DNA, 25 bp, Rattus norvegicus
gtgtgctgcaactccctattttgtt

SEQ ID NO: 518362 - DNA, 25 bp, Rattus norvegicus
gtgtgctgccacaaactcttttgag

SEQ ID NO: 518363 - DNA, 25 bp, Rattus norvegicus
gtgtgctgccactaactcttttgag

SEQ ID NO: 518364 - DNA, 25 bp, Rattus norvegicus
gtgtgctgcctgaacagattctcta

SEQ ID NO: 518365 - DNA, 25 bp, Rattus norvegicus
gtgtgctgcctgacggaacgtagcc

SEQ ID NO: 518366 - DNA, 25 bp, Rattus norvegicus
gtgtgctgcctgtacagattctcta

SEQ ID NO: 518367 - DNA, 25 bp, Rattus norvegicus
gtgtgctgcctgtcggaacgtagcc

SEQ ID NO: 518368 - DNA, 25 bp, Rattus norvegicus
gtgtgctgccttcatatatgtctat

SEQ ID NO: 518369 - DNA, 25 bp, Rattus norvegicus
gtgtgctgccttgatatatgtctat

SEQ ID NO: 518370 - DNA, 25 bp, Rattus norvegicus
gtgtgctgcgggaaacttgcaatgc

SEQ ID NO: 518371 - DNA, 25 bp, Rattus norvegicus
gtgtgctgcgggtaacttgcaatgc

SEQ ID NO: 518372 - DNA, 25 bp, Rattus norvegicus
gtgtgctgctccataaaccactgct

SEQ ID NO: 518373 - DNA, 25 bp, Rattus norvegicus
gtgtgctgctccttaaaccactgct

SEQ ID NO: 518374 - DNA, 25 bp, Rattus norvegicus
gtgtgctgctgcatggtctaggcaa

SEQ ID NO: 518375 - DNA, 25 bp, Rattus norvegicus
gtgtgctgctgcttggtctaggcaa

SEQ ID NO: 518376 - DNA, 25 bp, Rattus norvegicus
gtgtgctggttactttagctcaact

SEQ ID NO: 518377 - DNA, 25 bp, Rattus norvegicus
gtgtgctggttagtttagctcaact

SEQ ID NO: 518378 - DNA, 25 bp, Rattus norvegicus
gtgtgctgtacaaagtggtcactgc

SEQ ID NO: 518379 - DNA, 25 bp, Rattus norvegicus
gtgtgctgtacacgcatgaggacca

SEQ ID NO: 518380 - DNA, 25 bp, Rattus norvegicus
gtgtgctgtacaggcatgaggacca

SEQ ID NO: 518381 - DNA, 25 bp, Rattus norvegicus
gtgtgctgtacatagtggtcactgc

SEQ ID NO: 518382 - DNA, 25 bp, Rattus norvegicus
gtgtgctgtactaagaggccatgtc

SEQ ID NO: 518383 - DNA, 25 bp, Rattus norvegicus
gtgtgctgtacttagaggccatgtc

SEQ ID NO: 518384 - DNA, 25 bp, Rattus norvegicus
gtgtgctgtcttaacatacatacac

SEQ ID NO: 518385 - DNA, 25 bp, Rattus norvegicus
gtgtgctgtctttacatacatacac

SEQ ID NO: 518386 - DNA, 25 bp, Rattus norvegicus
gtgtgctgtgcaacattttgctaca

SEQ ID NO: 518387 - DNA, 25 bp, Rattus norvegicus
gtgtgctgtgcatcattttgctaca

SEQ ID NO: 518388 - DNA, 25 bp, Rattus norvegicus
gtgtgctgtggcatgccagtccccg

SEQ ID NO: 518389 - DNA, 25 bp, Rattus norvegicus
gtgtgctgtggcttgccagtccccg

SEQ ID NO: 518390 - DNA, 25 bp, Rattus norvegicus
gtgtgctgtgttactaattgaagta

SEQ ID NO: 518391 - DNA, 25 bp, Rattus norvegicus
gtgtgctgtgttattgtagatcctc

SEQ ID NO: 518392 - DNA, 25 bp, Rattus norvegicus
gtgtgctgtgtttctaattgaagta

SEQ ID NO: 518393 - DNA, 25 bp, Rattus norvegicus
gtgtgctgtgtttttgtagatcctc

SEQ ID NO: 518394 - DNA, 25 bp, Rattus norvegicus
gtgtgctgttaaactccgtaggctc

SEQ ID NO: 518395 - DNA, 25 bp, Rattus norvegicus
gtgtgctgttaatctccgtaggctc

SEQ ID NO: 518396 - DNA, 25 bp, Rattus norvegicus
gtgtgctgttcacggtctgctcctt

SEQ ID NO: 518397 - DNA, 25 bp, Rattus norvegicus
gtgtgctgttcagggtctgctcctt

SEQ ID NO: 518398 - DNA, 25 bp, Rattus norvegicus
gtgtgctgttggaagtttcattcgc

SEQ ID NO: 518399 - DNA, 25 bp, Rattus norvegicus
gtgtgctgttggatctttcaagatt

SEQ ID NO: 518400 - DNA, 25 bp, Rattus norvegicus
gtgtgctgttggtagtttcattcgc

SEQ ID NO: 518401 - DNA, 25 bp, Rattus norvegicus
gtgtgctgttggttctttcaagatt

SEQ ID NO: 518402 - DNA, 25 bp, Rattus norvegicus
gtgtgcttagctcatctggatatac

SEQ ID NO: 518403 - DNA, 25 bp, Rattus norvegicus
gtgtgcttagctgatctggatatac

SEQ ID NO: 518404 - DNA, 25 bp, Rattus norvegicus
gtgtgcttcatgagtatcaggccct

SEQ ID NO: 518405 - DNA, 25 bp, Rattus norvegicus
gtgtgcttcatgtgtatcaggccct

SEQ ID NO: 518406 - DNA, 25 bp, Rattus norvegicus
gtgtgcttccctcactgactaatac

SEQ ID NO: 518407 - DNA, 25 bp, Rattus norvegicus
gtgtgcttccctgactgactaatac

SEQ ID NO: 518408 - DNA, 25 bp, Rattus norvegicus
gtgtgcttcgttataaagacagctt

SEQ ID NO: 518409 - DNA, 25 bp, Rattus norvegicus
gtgtgcttcgttttaaagacagctt

SEQ ID NO: 518410 - DNA, 25 bp, Rattus norvegicus
gtgtgcttggcacctgtcaaatact

SEQ ID NO: 518411 - DNA, 25 bp, Rattus norvegicus
gtgtgcttggcagctgtcaaatact

SEQ ID NO: 518412 - DNA, 25 bp, Rattus norvegicus
gtgtgctttatactagtttctctac

SEQ ID NO: 518413 - DNA, 25 bp, Rattus norvegicus
gtgtgctttatagtagtttctctac

SEQ ID NO: 518414 - DNA, 25 bp, Rattus norvegicus
gtgtgctttcaactgttctgaggga

SEQ ID NO: 518415 - DNA, 25 bp, Rattus norvegicus
gtgtgctttcaagtgttctgaggga

SEQ ID NO: 518416 - DNA, 25 bp, Rattus norvegicus
gtgtgctttcacattatggactgtc

SEQ ID NO: 518417 - DNA, 25 bp, Rattus norvegicus
gtgtgctttcactttatggactgtc

SEQ ID NO: 518418 - DNA, 25 bp, Rattus norvegicus
gtgtgctttcccatgataatgctag

SEQ ID NO: 518419 - DNA, 25 bp, Rattus norvegicus
gtgtgctttcccttgataatgctag

SEQ ID NO: 518420 - DNA, 25 bp, Rattus norvegicus
gtgtgctttctacacaaaacctcaa

SEQ ID NO: 518421 - DNA, 25 bp, Rattus norvegicus
gtgtgctttctagacaaaacctcaa

SEQ ID NO: 518422 - DNA, 25 bp, Rattus norvegicus
gtgtgctttctgagtcagcctcaga

SEQ ID NO: 518423 - DNA, 25 bp, Rattus norvegicus
gtgtgctttctgtgtcagcctcaga

SEQ ID NO: 518424 - DNA, 25 bp, Rattus norvegicus
gtgtgctttcttactcttgattaaa

SEQ ID NO: 518425 - DNA, 25 bp, Rattus norvegicus
gtgtgctttctttctcttgattaaa

SEQ ID NO: 518426 - DNA, 25 bp, Rattus norvegicus
gtgtgctttgataccatctggaatg

SEQ ID NO: 518427 - DNA, 25 bp, Rattus norvegicus
gtgtgctttgattccatctggaatg

SEQ ID NO: 518428 - DNA, 25 bp, Rattus norvegicus
gtgtgctttgcaatcccagtaaatt

SEQ ID NO: 518429 - DNA, 25 bp, Rattus norvegicus
gtgtgctttgcattcccagtaaatt

SEQ ID NO: 518430 - DNA, 25 bp, Rattus norvegicus
gtgtgctttgccatagttttggcca

SEQ ID NO: 518431 - DNA, 25 bp, Rattus norvegicus
gtgtgctttgccttagttttggcca

SEQ ID NO: 518432 - DNA, 25 bp, Rattus norvegicus
gtgtgctttgggacagaaaccgagc

SEQ ID NO: 518433 - DNA, 25 bp, Rattus norvegicus
gtgtgctttgggtcagaaaccgagc

SEQ ID NO: 518434 - DNA, 25 bp, Rattus norvegicus
gtgtgctttgtaagcccctcctgaa

SEQ ID NO: 518435 - DNA, 25 bp, Rattus norvegicus
gtgtgctttgtatgcccctcctgaa

SEQ ID NO: 518436 - DNA, 25 bp, Rattus norvegicus
gtgtgcttttacacatggtggcagc

SEQ ID NO: 518437 - DNA, 25 bp, Rattus norvegicus
gtgtgcttttactcatggtggcagc

SEQ ID NO: 518438 - DNA, 25 bp, Rattus norvegicus
gtgtgcttttagattgtctttcaaa

SEQ ID NO: 518439 - DNA, 25 bp, Rattus norvegicus
gtgtgcttttagtttgtctttcaaa

SEQ ID NO: 518440 - DNA, 25 bp, Rattus norvegicus
gtgtgcttttctaaaatgcttgtgt

SEQ ID NO: 518441 - DNA, 25 bp, Rattus norvegicus
gtgtgcttttcttaaatgcttgtgt

SEQ ID NO: 518442 - DNA, 25 bp, Rattus norvegicus
gtgtgcttttgcagagaacttctct

SEQ ID NO: 518443 - DNA, 25 bp, Rattus norvegicus
gtgtgcttttgctgagaacttctct

SEQ ID NO: 518444 - DNA, 25 bp, Rattus norvegicus
gtgtggaaaagcaaatgccatttga

SEQ ID NO: 518445 - DNA, 25 bp, Rattus norvegicus
gtgtggaaaagctaatgccatttga

SEQ ID NO: 518446 - DNA, 25 bp, Rattus norvegicus
gtgtggaaaataacccttcccttct

SEQ ID NO: 518447 - DNA, 25 bp, Rattus norvegicus
gtgtggaaaatatcccttcccttct

SEQ ID NO: 518448 - DNA, 25 bp, Rattus norvegicus
gtgtggaaactgctcagcctaccat

SEQ ID NO: 518449 - DNA, 25 bp, Rattus norvegicus
gtgtggaaactggtcagcctaccat

SEQ ID NO: 518450 - DNA, 25 bp, Rattus norvegicus
gtgtggaaacttactcttgtcccat

SEQ ID NO: 518451 - DNA, 25 bp, Rattus norvegicus
gtgtggaaactttctcttgtcccat

SEQ ID NO: 518452 - DNA, 25 bp, Rattus norvegicus
gtgtggaaagacctcactgatgtgt

SEQ ID NO: 518453 - DNA, 25 bp, Rattus norvegicus
gtgtggaaagacgtcactgatgtgt

SEQ ID NO: 518454 - DNA, 25 bp, Rattus norvegicus
gtgtggaacaccacgagaacctaaa

SEQ ID NO: 518455 - DNA, 25 bp, Rattus norvegicus
gtgtggaacacctcgagaacctaaa

SEQ ID NO: 518456 - DNA, 25 bp, Rattus norvegicus
gtgtggaacctgagaaccgcagccc

SEQ ID NO: 518457 - DNA, 25 bp, Rattus norvegicus
gtgtggaacctgtgaaccgcagccc

SEQ ID NO: 518458 - DNA, 25 bp, Rattus norvegicus
gtgtggaagaacattcagacgcaat

SEQ ID NO: 518459 - DNA, 25 bp, Rattus norvegicus
gtgtggaagaactttcagacgcaat

SEQ ID NO: 518460 - DNA, 25 bp, Rattus norvegicus
gtgtggaagcctacggaatccgtgt

SEQ ID NO: 518461 - DNA, 25 bp, Rattus norvegicus
gtgtggaagccttcggaatccgtgt

SEQ ID NO: 518462 - DNA, 25 bp, Rattus norvegicus
gtgtggaaggccctttttgatatca

SEQ ID NO: 518463 - DNA, 25 bp, Rattus norvegicus
gtgtggaaggccgtttttgatatca

SEQ ID NO: 518464 - DNA, 25 bp, Rattus norvegicus
gtgtggaatgtcctcagtggcaaac

SEQ ID NO: 518465 - DNA, 25 bp, Rattus norvegicus
gtgtggaatgtcgtcagtggcaaac

SEQ ID NO: 518466 - DNA, 25 bp, Rattus norvegicus
gtgtggacaaagaggcactatttgc

SEQ ID NO: 518467 - DNA, 25 bp, Rattus norvegicus
gtgtggacaaagtggcactatttgc

SEQ ID NO: 518468 - DNA, 25 bp, Rattus norvegicus
gtgtggacaacgacttcttgtgatt

SEQ ID NO: 518469 - DNA, 25 bp, Rattus norvegicus
gtgtggacaacgtcttcttgtgatt

SEQ ID NO: 518470 - DNA, 25 bp, Rattus norvegicus
gtgtggacacaacatgtctgatttt

SEQ ID NO: 518471 - DNA, 25 bp, Rattus norvegicus
gtgtggacacaagatgtctgatttt

SEQ ID NO: 518472 - DNA, 25 bp, Rattus norvegicus
gtgtggacacacagctggagctgct

SEQ ID NO: 518473 - DNA, 25 bp, Rattus norvegicus
gtgtggacacactgctggagctgct

SEQ ID NO: 518474 - DNA, 25 bp, Rattus norvegicus
gtgtggacaccaaccgttgtgtgga

SEQ ID NO: 518475 - DNA, 25 bp, Rattus norvegicus
gtgtggacaccatccgttgtgtgga

SEQ ID NO: 518476 - DNA, 25 bp, Rattus norvegicus
gtgtggacacggcactgacgcaaca

SEQ ID NO: 518477 - DNA, 25 bp, Rattus norvegicus
gtgtggacacgggactgacgcaaca

SEQ ID NO: 518478 - DNA, 25 bp, Rattus norvegicus
gtgtggacatttagactcttgcagt

SEQ ID NO: 518479 - DNA, 25 bp, Rattus norvegicus
gtgtggacattttgactcttgcagt

SEQ ID NO: 518480 - DNA, 25 bp, Rattus norvegicus
gtgtggaccacgacgagccccagtg

SEQ ID NO: 518481 - DNA, 25 bp, Rattus norvegicus
gtgtggaccacgtcgagccccagtg

SEQ ID NO: 518482 - DNA, 25 bp, Rattus norvegicus
gtgtggaccataagaaaccttcaat

SEQ ID NO: 518483 - DNA, 25 bp, Rattus norvegicus
gtgtggaccatatgaaaccttcaat

SEQ ID NO: 518484 - DNA, 25 bp, Rattus norvegicus
gtgtggacctagaatgttcgaccta

SEQ ID NO: 518485 - DNA, 25 bp, Rattus norvegicus
gtgtggacctagtatgttcgaccta

SEQ ID NO: 518486 - DNA, 25 bp, Rattus norvegicus
gtgtggacctcactttgcacagcag

SEQ ID NO: 518487 - DNA, 25 bp, Rattus norvegicus
gtgtggacctcagtttgcacagcag

SEQ ID NO: 518488 - DNA, 25 bp, Rattus norvegicus
gtgtggacctggagcttggaacata

SEQ ID NO: 518489 - DNA, 25 bp, Rattus norvegicus
gtgtggacctggtgcttggaacata

SEQ ID NO: 518490 - DNA, 25 bp, Rattus norvegicus
gtgtggacgccaccatgagacaaga

SEQ ID NO: 518491 - DNA, 25 bp, Rattus norvegicus
gtgtggacgccagcatgagacaaga

SEQ ID NO: 518492 - DNA, 25 bp, Rattus norvegicus
gtgtggactacaacatttcccatct

SEQ ID NO: 518493 - DNA, 25 bp, Rattus norvegicus
gtgtggactacatcatttcccatct

SEQ ID NO: 518494 - DNA, 25 bp, Rattus norvegicus
gtgtggactatcatcagtgcctcgc

SEQ ID NO: 518495 - DNA, 25 bp, Rattus norvegicus
gtgtggactatcttcagtgcctcgc

SEQ ID NO: 518496 - DNA, 25 bp, Rattus norvegicus
gtgtggactgaactgctgatatcct

SEQ ID NO: 518497 - DNA, 25 bp, Rattus norvegicus
gtgtggactgaagtgctgatatcct

SEQ ID NO: 518498 - DNA, 25 bp, Rattus norvegicus
gtgtggagaaagaattcctgcctta

SEQ ID NO: 518499 - DNA, 25 bp, Rattus norvegicus
gtgtggagaaagtattcctgcctta

SEQ ID NO: 518500 - DNA, 25 bp, Rattus norvegicus
gtgtggagccaactacagttttcct

SEQ ID NO: 518501 - DNA, 25 bp, Rattus norvegicus
gtgtggagccaagtacagttttcct

SEQ ID NO: 518502 - DNA, 25 bp, Rattus norvegicus
gtgtggaggaataccagtctctgac

SEQ ID NO: 518503 - DNA, 25 bp, Rattus norvegicus
gtgtggaggaattccagtctctgac

SEQ ID NO: 518504 - DNA, 25 bp, Rattus norvegicus
gtgtggaggactactctgtgagcca

SEQ ID NO: 518505 - DNA, 25 bp, Rattus norvegicus
gtgtggaggacttctctgtgagcca

SEQ ID NO: 518506 - DNA, 25 bp, Rattus norvegicus
gtgtggaggattactcatcactcca

SEQ ID NO: 518507 - DNA, 25 bp, Rattus norvegicus
gtgtggaggatttctcatcactcca

SEQ ID NO: 518508 - DNA, 25 bp, Rattus norvegicus
gtgtggaggctgcataaccacccat

SEQ ID NO: 518509 - DNA, 25 bp, Rattus norvegicus
gtgtggaggctggataaccacccat

SEQ ID NO: 518510 - DNA, 25 bp, Rattus norvegicus
gtgtggaggtctatagtctactttc

SEQ ID NO: 518511 - DNA, 25 bp, Rattus norvegicus
gtgtggaggtctttagtctactttc

SEQ ID NO: 518512 - DNA, 25 bp, Rattus norvegicus
gtgtggaggtgcacgtctctcatcc

SEQ ID NO: 518513 - DNA, 25 bp, Rattus norvegicus
gtgtggaggtgctcgtctctcatcc

SEQ ID NO: 518514 - DNA, 25 bp, Rattus norvegicus
gtgtggagtataagtgctcaggcaa

SEQ ID NO: 518515 - DNA, 25 bp, Rattus norvegicus
gtgtggagtatatgtgctcaggcaa

SEQ ID NO: 518516 - DNA, 25 bp, Rattus norvegicus
gtgtggatacagcacattgtttttc

SEQ ID NO: 518517 - DNA, 25 bp, Rattus norvegicus
gtgtggatacaggacattgtttttc

SEQ ID NO: 518518 - DNA, 25 bp, Rattus norvegicus
gtgtggatatcgatctatggcagac

SEQ ID NO: 518519 - DNA, 25 bp, Rattus norvegicus
gtgtggatatcgttctatggcagac

SEQ ID NO: 518520 - DNA, 25 bp, Rattus norvegicus
gtgtggatcagtctggcccttgaac

SEQ ID NO: 518521 - DNA, 25 bp, Rattus norvegicus
gtgtggatcagtgtggcccttgaac

SEQ ID NO: 518522 - DNA, 25 bp, Rattus norvegicus
gtgtggatccacaggactcccaaca

SEQ ID NO: 518523 - DNA, 25 bp, Rattus norvegicus
gtgtggatccactggactcccaaca

SEQ ID NO: 518524 - DNA, 25 bp, Rattus norvegicus
gtgtggatccctaccatggtgtgtg

SEQ ID NO: 518525 - DNA, 25 bp, Rattus norvegicus
gtgtggatcccttccatggtgtgtg

SEQ ID NO: 518526 - DNA, 25 bp, Rattus norvegicus
gtgtggatccgaagggccagccttt

SEQ ID NO: 518527 - DNA, 25 bp, Rattus norvegicus
gtgtggatccgatgggccagccttt

SEQ ID NO: 518528 - DNA, 25 bp, Rattus norvegicus
gtgtggatcgggagcacccttcatg

SEQ ID NO: 518529 - DNA, 25 bp, Rattus norvegicus
gtgtggatcgggtgcacccttcatg

SEQ ID NO: 518530 - DNA, 25 bp, Rattus norvegicus
gtgtggatctccacatgtggacatg

SEQ ID NO: 518531 - DNA, 25 bp, Rattus norvegicus
gtgtggatctcctcatgtggacatg

SEQ ID NO: 518532 - DNA, 25 bp, Rattus norvegicus
gtgtggatgaccacatgcacctcat

SEQ ID NO: 518533 - DNA, 25 bp, Rattus norvegicus
gtgtggatgacctcatgcacctcat

SEQ ID NO: 518534 - DNA, 25 bp, Rattus norvegicus
gtgtggatgccccacttgcagaaga

SEQ ID NO: 518535 - DNA, 25 bp, Rattus norvegicus
gtgtggatgcccgacttgcagaaga

SEQ ID NO: 518536 - DNA, 25 bp, Rattus norvegicus
gtgtggatgtatctgaccctggctc

SEQ ID NO: 518537 - DNA, 25 bp, Rattus norvegicus
gtgtggatgtatgtgaccctggctc

SEQ ID NO: 518538 - DNA, 25 bp, Rattus norvegicus
gtgtggattaatcccgacgtccttc

SEQ ID NO: 518539 - DNA, 25 bp, Rattus norvegicus
gtgtggattaatgccgacgtccttc

SEQ ID NO: 518540 - DNA, 25 bp, Rattus norvegicus
gtgtggattatcactctggaccacg

SEQ ID NO: 518541 - DNA, 25 bp, Rattus norvegicus
gtgtggattatctctctggaccacg

SEQ ID NO: 518542 - DNA, 25 bp, Rattus norvegicus
gtgtggattctgacctggactgaca

SEQ ID NO: 518543 - DNA, 25 bp, Rattus norvegicus
gtgtggattctgtcctggactgaca

SEQ ID NO: 518544 - DNA, 25 bp, Rattus norvegicus
gtgtggattcttcgaagcttacccc

SEQ ID NO: 518545 - DNA, 25 bp, Rattus norvegicus
gtgtggattcttcttctttgtaaaa

SEQ ID NO: 518546 - DNA, 25 bp, Rattus norvegicus
gtgtggattcttggaagcttacccc

SEQ ID NO: 518547 - DNA, 25 bp, Rattus norvegicus
gtgtggattcttgttctttgtaaaa

SEQ ID NO: 518548 - DNA, 25 bp, Rattus norvegicus
gtgtggattgaactcttcctgccct

SEQ ID NO: 518549 - DNA, 25 bp, Rattus norvegicus
gtgtggattgaagtcttcctgccct

SEQ ID NO: 518550 - DNA, 25 bp, Rattus norvegicus
gtgtggatttaaccctgtcttctat

SEQ ID NO: 518551 - DNA, 25 bp, Rattus norvegicus
gtgtggatttaagcctgtcttctat

SEQ ID NO: 518552 - DNA, 25 bp, Rattus norvegicus
gtgtggatttccagtaactctttta

SEQ ID NO: 518553 - DNA, 25 bp, Rattus norvegicus
gtgtggatttcctgtaactctttta

SEQ ID NO: 518554 - DNA, 25 bp, Rattus norvegicus
gtgtggcaacaccagtctgagctgc

SEQ ID NO: 518555 - DNA, 25 bp, Rattus norvegicus
gtgtggcaacacgagtctgagctgc

SEQ ID NO: 518556 - DNA, 25 bp, Rattus norvegicus
gtgtggcaacctctaaactgttaaa

SEQ ID NO: 518557 - DNA, 25 bp, Rattus norvegicus
gtgtggcaacctgtaaactgttaaa

SEQ ID NO: 518558 - DNA, 25 bp, Rattus norvegicus
gtgtggcacatgctttgatctctag

SEQ ID NO: 518559 - DNA, 25 bp, Rattus norvegicus
gtgtggcacatggtttgatctctag

SEQ ID NO: 518560 - DNA, 25 bp, Rattus norvegicus
gtgtggcactatcccgagaagacaa

SEQ ID NO: 518561 - DNA, 25 bp, Rattus norvegicus
gtgtggcactatgccgagaagacaa

SEQ ID NO: 518562 - DNA, 25 bp, Rattus norvegicus
gtgtggcagcgcaaacctttgaggc

SEQ ID NO: 518563 - DNA, 25 bp, Rattus norvegicus
gtgtggcagcgctaacctttgaggc

SEQ ID NO: 518564 - DNA, 25 bp, Rattus norvegicus
gtgtggcagtacacctgttatccca

SEQ ID NO: 518565 - DNA, 25 bp, Rattus norvegicus
gtgtggcagtactcctgttatccca

SEQ ID NO: 518566 - DNA, 25 bp, Rattus norvegicus
gtgtggcagtcacatgacggctttt

SEQ ID NO: 518567 - DNA, 25 bp, Rattus norvegicus
gtgtggcagtcagatgacggctttt

SEQ ID NO: 518568 - DNA, 25 bp, Rattus norvegicus
gtgtggcatattcgaacctgtattt

SEQ ID NO: 518569 - DNA, 25 bp, Rattus norvegicus
gtgtggcatattggaacctgtattt

SEQ ID NO: 518570 - DNA, 25 bp, Rattus norvegicus
gtgtggcatccaatttacagggtca

SEQ ID NO: 518571 - DNA, 25 bp, Rattus norvegicus
gtgtggcatccattttacagggtca

SEQ ID NO: 518572 - DNA, 25 bp, Rattus norvegicus
gtgtggcatcgcacgccttcaattc

SEQ ID NO: 518573 - DNA, 25 bp, Rattus norvegicus
gtgtggcatcgctcgccttcaattc

SEQ ID NO: 518574 - DNA, 25 bp, Rattus norvegicus
gtgtggcatttgcaccagtgtctaa

SEQ ID NO: 518575 - DNA, 25 bp, Rattus norvegicus
gtgtggcatttggaccagtgtctaa

SEQ ID NO: 518576 - DNA, 25 bp, Rattus norvegicus
gtgtggccacacagattggactcag

SEQ ID NO: 518577 - DNA, 25 bp, Rattus norvegicus
gtgtggccacacatacgaagaggaa

SEQ ID NO: 518578 - DNA, 25 bp, Rattus norvegicus
gtgtggccacactgattggactcag

SEQ ID NO: 518579 - DNA, 25 bp, Rattus norvegicus
gtgtggccacacttacgaagaggaa

SEQ ID NO: 518580 - DNA, 25 bp, Rattus norvegicus
gtgtggccacagctaaattacttct

SEQ ID NO: 518581 - DNA, 25 bp, Rattus norvegicus
gtgtggccacaggtaaattacttct

SEQ ID NO: 518582 - DNA, 25 bp, Rattus norvegicus
gtgtggccacatatctaaactacgt

SEQ ID NO: 518583 - DNA, 25 bp, Rattus norvegicus
gtgtggccacatttctaaactacgt

SEQ ID NO: 518584 - DNA, 25 bp, Rattus norvegicus
gtgtggccaccaacgctgtgcaccg

SEQ ID NO: 518585 - DNA, 25 bp, Rattus norvegicus
gtgtggccaccatcgctgtgcaccg

SEQ ID NO: 518586 - DNA, 25 bp, Rattus norvegicus
gtgtggccacccagggtacaaacta

SEQ ID NO: 518587 - DNA, 25 bp, Rattus norvegicus
gtgtggccaccctgggtacaaacta

SEQ ID NO: 518588 - DNA, 25 bp, Rattus norvegicus
gtgtggccacgaactgacatatgaa

SEQ ID NO: 518589 - DNA, 25 bp, Rattus norvegicus
gtgtggccacgatctgacatatgaa

SEQ ID NO: 518590 - DNA, 25 bp, Rattus norvegicus
gtgtggccagcaaccgagtcatcaa

SEQ ID NO: 518591 - DNA, 25 bp, Rattus norvegicus
gtgtggccagcatccgagtcatcaa

SEQ ID NO: 518592 - DNA, 25 bp, Rattus norvegicus
gtgtggccagttcactgattactgt

SEQ ID NO: 518593 - DNA, 25 bp, Rattus norvegicus
gtgtggccagttgactgattactgt

SEQ ID NO: 518594 - DNA, 25 bp, Rattus norvegicus
gtgtggcccactcccagagcaatag

SEQ ID NO: 518595 - DNA, 25 bp, Rattus norvegicus
gtgtggcccactgccagagcaatag

SEQ ID NO: 518596 - DNA, 25 bp, Rattus norvegicus
gtgtggcccatgacatttgtctaat

SEQ ID NO: 518597 - DNA, 25 bp, Rattus norvegicus
gtgtggcccatgtcatttgtctaat

SEQ ID NO: 518598 - DNA, 25 bp, Rattus norvegicus
gtgtggcccctgatcattgtaaaaa

SEQ ID NO: 518599 - DNA, 25 bp, Rattus norvegicus
gtgtggcccctgttcattgtaaaaa

SEQ ID NO: 518600 - DNA, 25 bp, Rattus norvegicus
gtgtggccgcctacatgaagtcgga

SEQ ID NO: 518601 - DNA, 25 bp, Rattus norvegicus
gtgtggccgccttcatgaagtcgga

SEQ ID NO: 518602 - DNA, 25 bp, Rattus norvegicus
gtgtggccgctgcaacaagacctca

SEQ ID NO: 518603 - DNA, 25 bp, Rattus norvegicus
gtgtggccgctgcacttagatcatg

SEQ ID NO: 518604 - DNA, 25 bp, Rattus norvegicus
gtgtggccgctggaacaagacctca

SEQ ID NO: 518605 - DNA, 25 bp, Rattus norvegicus
gtgtggccgctggacttagatcatg

SEQ ID NO: 518606 - DNA, 25 bp, Rattus norvegicus
gtgtggccgtgtagaactctagagt

SEQ ID NO: 518607 - DNA, 25 bp, Rattus norvegicus
gtgtggccgtgttgaactctagagt

SEQ ID NO: 518608 - DNA, 25 bp, Rattus norvegicus
gtgtggcctctacatttggtcatga

SEQ ID NO: 518609 - DNA, 25 bp, Rattus norvegicus
gtgtggcctctagatttggtcatga

SEQ ID NO: 518610 - DNA, 25 bp, Rattus norvegicus
gtgtggcctcttctttgggaagcca

SEQ ID NO: 518611 - DNA, 25 bp, Rattus norvegicus
gtgtggcctcttgtttgggaagcca

SEQ ID NO: 518612 - DNA, 25 bp, Rattus norvegicus
gtgtggcctggcagactatgctgac

SEQ ID NO: 518613 - DNA, 25 bp, Rattus norvegicus
gtgtggcctggctgactatgctgac

SEQ ID NO: 518614 - DNA, 25 bp, Rattus norvegicus
gtgtggcctgtcatcacaagtactg

SEQ ID NO: 518615 - DNA, 25 bp, Rattus norvegicus
gtgtggcctgtcttcacaagtactg

SEQ ID NO: 518616 - DNA, 25 bp, Rattus norvegicus
gtgtggccttagacttagattgtag

SEQ ID NO: 518617 - DNA, 25 bp, Rattus norvegicus
gtgtggccttagattgtttattgac

SEQ ID NO: 518618 - DNA, 25 bp, Rattus norvegicus
gtgtggccttagtcttagattgtag

SEQ ID NO: 518619 - DNA, 25 bp, Rattus norvegicus
gtgtggccttagtttgtttattgac

SEQ ID NO: 518620 - DNA, 25 bp, Rattus norvegicus
gtgtggcgacacagcgagtaaactc

SEQ ID NO: 518621 - DNA, 25 bp, Rattus norvegicus
gtgtggcgacactgcgagtaaactc

SEQ ID NO: 518622 - DNA, 25 bp, Rattus norvegicus
gtgtggctaatgctgcgtgctcaat

SEQ ID NO: 518623 - DNA, 25 bp, Rattus norvegicus
gtgtggctaatggtgcgtgctcaat

SEQ ID NO: 518624 - DNA, 25 bp, Rattus norvegicus
gtgtggctactgctctcgaactctc

SEQ ID NO: 518625 - DNA, 25 bp, Rattus norvegicus
gtgtggctactggtctcgaactctc

SEQ ID NO: 518626 - DNA, 25 bp, Rattus norvegicus
gtgtggctatatactatttttcttt

SEQ ID NO: 518627 - DNA, 25 bp, Rattus norvegicus
gtgtggctatattctatttttcttt

SEQ ID NO: 518628 - DNA, 25 bp, Rattus norvegicus
gtgtggctcagcacttttgcaggtc

SEQ ID NO: 518629 - DNA, 25 bp, Rattus norvegicus
gtgtggctcagctcttttgcaggtc

SEQ ID NO: 518630 - DNA, 25 bp, Rattus norvegicus
gtgtggctcaggagtcttgcccatg

SEQ ID NO: 518631 - DNA, 25 bp, Rattus norvegicus
gtgtggctcaggtgtcttgcccatg

SEQ ID NO: 518632 - DNA, 25 bp, Rattus norvegicus
gtgtggctcctaccactagccaatc

SEQ ID NO: 518633 - DNA, 25 bp, Rattus norvegicus
gtgtggctcctagcactagccaatc

SEQ ID NO: 518634 - DNA, 25 bp, Rattus norvegicus
gtgtggctctcacggctgtgatcaa

SEQ ID NO: 518635 - DNA, 25 bp, Rattus norvegicus
gtgtggctctcagggctgtgatcaa

SEQ ID NO: 518636 - DNA, 25 bp, Rattus norvegicus
gtgtggctgactctgactattacat

SEQ ID NO: 518637 - DNA, 25 bp, Rattus norvegicus
gtgtggctgactgtgactattacat

SEQ ID NO: 518638 - DNA, 25 bp, Rattus norvegicus
gtgtggctgccgaatttcttatgat

SEQ ID NO: 518639 - DNA, 25 bp, Rattus norvegicus
gtgtggctgccgtatttcttatgat

SEQ ID NO: 518640 - DNA, 25 bp, Rattus norvegicus
gtgtggctgcttacatctctgacta

SEQ ID NO: 518641 - DNA, 25 bp, Rattus norvegicus
gtgtggctgcttcctggtatccttt

SEQ ID NO: 518642 - DNA, 25 bp, Rattus norvegicus
gtgtggctgcttgctggtatccttt

SEQ ID NO: 518643 - DNA, 25 bp, Rattus norvegicus
gtgtggctgctttcatctctgacta

SEQ ID NO: 518644 - DNA, 25 bp, Rattus norvegicus
gtgtggctgttgacattctgcatcc

SEQ ID NO: 518645 - DNA, 25 bp, Rattus norvegicus
gtgtggctgttgtcattctgcatcc

SEQ ID NO: 518646 - DNA, 25 bp, Rattus norvegicus
gtgtggcttatcaagtgtactgacc

SEQ ID NO: 518647 - DNA, 25 bp, Rattus norvegicus
gtgtggcttatctagtgtactgacc

SEQ ID NO: 518648 - DNA, 25 bp, Rattus norvegicus
gtgtggcttcaacgatctctgcata

SEQ ID NO: 518649 - DNA, 25 bp, Rattus norvegicus
gtgtggcttcaaggatctctgcata

SEQ ID NO: 518650 - DNA, 25 bp, Rattus norvegicus
gtgtggcttcacatttcagtacctc

SEQ ID NO: 518651 - DNA, 25 bp, Rattus norvegicus
gtgtggcttcacttttcagtacctc

SEQ ID NO: 518652 - DNA, 25 bp, Rattus norvegicus
gtgtggcttcataggcatgtgtgta

SEQ ID NO: 518653 - DNA, 25 bp, Rattus norvegicus
gtgtggcttcattggcatgtgtgta

SEQ ID NO: 518654 - DNA, 25 bp, Rattus norvegicus
gtgtggcttctcattaccaatggat

SEQ ID NO: 518655 - DNA, 25 bp, Rattus norvegicus
gtgtggcttctctttaccaatggat

SEQ ID NO: 518656 - DNA, 25 bp, Rattus norvegicus
gtgtggcttgtccattagttttctt

SEQ ID NO: 518657 - DNA, 25 bp, Rattus norvegicus
gtgtggcttgtcgattagttttctt

SEQ ID NO: 518658 - DNA, 25 bp, Rattus norvegicus
gtgtggcttgtgaatcctatcaacc

SEQ ID NO: 518659 - DNA, 25 bp, Rattus norvegicus
gtgtggcttgtgtatcctatcaacc

SEQ ID NO: 518660 - DNA, 25 bp, Rattus norvegicus
gtgtgggaaacacaggtgcctctcc

SEQ ID NO: 518661 - DNA, 25 bp, Rattus norvegicus
gtgtgggaaacagaggtgcctctcc

SEQ ID NO: 518662 - DNA, 25 bp, Rattus norvegicus
gtgtgggacactagggctctatcca

SEQ ID NO: 518663 - DNA, 25 bp, Rattus norvegicus
gtgtgggacacttgggctctatcca

SEQ ID NO: 518664 - DNA, 25 bp, Rattus norvegicus
gtgtgggatatcatccaacctgcta

SEQ ID NO: 518665 - DNA, 25 bp, Rattus norvegicus
gtgtgggatatcttccaacctgcta

SEQ ID NO: 518666 - DNA, 25 bp, Rattus norvegicus
gtgtgggattcaacatctacaggga

SEQ ID NO: 518667 - DNA, 25 bp, Rattus norvegicus
gtgtgggattcatcatctacaggga

SEQ ID NO: 518668 - DNA, 25 bp, Rattus norvegicus
gtgtgggcaattctttctgcctata

SEQ ID NO: 518669 - DNA, 25 bp, Rattus norvegicus
gtgtgggcaattgtttctgcctata

SEQ ID NO: 518670 - DNA, 25 bp, Rattus norvegicus
gtgtgggcaccactcagagcagaca

SEQ ID NO: 518671 - DNA, 25 bp, Rattus norvegicus
gtgtgggcaccagtcagagcagaca

SEQ ID NO: 518672 - DNA, 25 bp, Rattus norvegicus
gtgtgggcatctagggcagctaccc

SEQ ID NO: 518673 - DNA, 25 bp, Rattus norvegicus
gtgtgggcatcttgggcagctaccc

SEQ ID NO: 518674 - DNA, 25 bp, Rattus norvegicus
gtgtgggcatgtctgaacttgtcct

SEQ ID NO: 518675 - DNA, 25 bp, Rattus norvegicus
gtgtgggcatgtgtgaacttgtcct

SEQ ID NO: 518676 - DNA, 25 bp, Rattus norvegicus
gtgtgggccaccatggtatatgttg

SEQ ID NO: 518677 - DNA, 25 bp, Rattus norvegicus
gtgtgggccaccttggtatatgttg

SEQ ID NO: 518678 - DNA, 25 bp, Rattus norvegicus
gtgtgggccaggatgtcttcccagt

SEQ ID NO: 518679 - DNA, 25 bp, Rattus norvegicus
gtgtgggccaggttgtcttcccagt

SEQ ID NO: 518680 - DNA, 25 bp, Rattus norvegicus
gtgtgggcccaaagttgactcgttg

SEQ ID NO: 518681 - DNA, 25 bp, Rattus norvegicus
gtgtgggcccaatgttgactcgttg

SEQ ID NO: 518682 - DNA, 25 bp, Rattus norvegicus
gtgtgggccccactgataagtgaat

SEQ ID NO: 518683 - DNA, 25 bp, Rattus norvegicus
gtgtgggccccagtgataagtgaat

SEQ ID NO: 518684 - DNA, 25 bp, Rattus norvegicus
gtgtgggccctgaaaacctgatgta

SEQ ID NO: 518685 - DNA, 25 bp, Rattus norvegicus
gtgtgggccctgtaaacctgatgta

SEQ ID NO: 518686 - DNA, 25 bp, Rattus norvegicus
gtgtgggcctcaactctggcagaga

SEQ ID NO: 518687 - DNA, 25 bp, Rattus norvegicus
gtgtgggcctcatctctggcagaga

SEQ ID NO: 518688 - DNA, 25 bp, Rattus norvegicus
gtgtgggcgtacatgtgtgtataaa

SEQ ID NO: 518689 - DNA, 25 bp, Rattus norvegicus
gtgtgggcgtacttgtgtgtataaa

SEQ ID NO: 518690 - DNA, 25 bp, Rattus norvegicus
gtgtgggctcctatcattttatgaa

SEQ ID NO: 518691 - DNA, 25 bp, Rattus norvegicus
gtgtgggctcctttcattttatgaa

SEQ ID NO: 518692 - DNA, 25 bp, Rattus norvegicus
gtgtgggctcttattatttctggca

SEQ ID NO: 518693 - DNA, 25 bp, Rattus norvegicus
gtgtgggctctttttatttctggca

SEQ ID NO: 518694 - DNA, 25 bp, Rattus norvegicus
gtgtgggctttgaatttattgcagt

SEQ ID NO: 518695 - DNA, 25 bp, Rattus norvegicus
gtgtgggctttgtatttattgcagt

SEQ ID NO: 518696 - DNA, 25 bp, Rattus norvegicus
gtgtgggtattcagagactcaccaa

SEQ ID NO: 518697 - DNA, 25 bp, Rattus norvegicus
gtgtgggtattctgagactcaccaa

SEQ ID NO: 518698 - DNA, 25 bp, Rattus norvegicus
gtgtgggtcacactgaattgtctgt

SEQ ID NO: 518699 - DNA, 25 bp, Rattus norvegicus
gtgtgggtcacagtgaattgtctgt

SEQ ID NO: 518700 - DNA, 25 bp, Rattus norvegicus
gtgtgggtctatatgtctactggcc

SEQ ID NO: 518701 - DNA, 25 bp, Rattus norvegicus
gtgtgggtctatttgtctactggcc

SEQ ID NO: 518702 - DNA, 25 bp, Rattus norvegicus
gtgtgggtctcacctcagccatatc

SEQ ID NO: 518703 - DNA, 25 bp, Rattus norvegicus
gtgtgggtctcagctcagccatatc

SEQ ID NO: 518704 - DNA, 25 bp, Rattus norvegicus
gtgtgggtggccagtttctcaacca

SEQ ID NO: 518705 - DNA, 25 bp, Rattus norvegicus
gtgtgggtggcctgtttctcaacca

SEQ ID NO: 518706 - DNA, 25 bp, Rattus norvegicus
gtgtgggtgtttctatgcaccatgt

SEQ ID NO: 518707 - DNA, 25 bp, Rattus norvegicus
gtgtgggtgtttgtatgcaccatgt

SEQ ID NO: 518708 - DNA, 25 bp, Rattus norvegicus
gtgtgggtttgcagcctgttccctg

SEQ ID NO: 518709 - DNA, 25 bp, Rattus norvegicus
gtgtgggtttgctgcctgttccctg

SEQ ID NO: 518710 - DNA, 25 bp, Rattus norvegicus
gtgtggtaagggaccccgtcattct

SEQ ID NO: 518711 - DNA, 25 bp, Rattus norvegicus
gtgtggtaagggtccccgtcattct

SEQ ID NO: 518712 - DNA, 25 bp, Rattus norvegicus
gtgtggtacaggcacttaacccgca

SEQ ID NO: 518713 - DNA, 25 bp, Rattus norvegicus
gtgtggtacagggacttaacccgca

SEQ ID NO: 518714 - DNA, 25 bp, Rattus norvegicus
gtgtggtaccaacgccttcgacata

SEQ ID NO: 518715 - DNA, 25 bp, Rattus norvegicus
gtgtggtaccaaggccttcgacata

SEQ ID NO: 518716 - DNA, 25 bp, Rattus norvegicus
gtgtggtacttgattttcttctgtc

SEQ ID NO: 518717 - DNA, 25 bp, Rattus norvegicus
gtgtggtacttgtttttcttctgtc

SEQ ID NO: 518718 - DNA, 25 bp, Rattus norvegicus
gtgtggtatattatatgcatgcata

SEQ ID NO: 518719 - DNA, 25 bp, Rattus norvegicus
gtgtggtatattttatgcatgcata

SEQ ID NO: 518720 - DNA, 25 bp, Rattus norvegicus
gtgtggtatgtgaccctttttacaa

SEQ ID NO: 518721 - DNA, 25 bp, Rattus norvegicus
gtgtggtatgtgtccctttttacaa

SEQ ID NO: 518722 - DNA, 25 bp, Rattus norvegicus
gtgtggtattgtaactgcttcagct

SEQ ID NO: 518723 - DNA, 25 bp, Rattus norvegicus
gtgtggtattgttactgcttcagct

SEQ ID NO: 518724 - DNA, 25 bp, Rattus norvegicus
gtgtggtatttgatacattaagaac

SEQ ID NO: 518725 - DNA, 25 bp, Rattus norvegicus
gtgtggtatttgttacattaagaac

SEQ ID NO: 518726 - DNA, 25 bp, Rattus norvegicus
gtgtggtcaccaaccagagtgccaa

SEQ ID NO: 518727 - DNA, 25 bp, Rattus norvegicus
gtgtggtcaccaagccccagcagga

SEQ ID NO: 518728 - DNA, 25 bp, Rattus norvegicus
gtgtggtcaccatccagagtgccaa

SEQ ID NO: 518729 - DNA, 25 bp, Rattus norvegicus
gtgtggtcaccatgccccagcagga

SEQ ID NO: 518730 - DNA, 25 bp, Rattus norvegicus
gtgtggtcacccagcattgataaac

SEQ ID NO: 518731 - DNA, 25 bp, Rattus norvegicus
gtgtggtcaccctgcattgataaac

SEQ ID NO: 518732 - DNA, 25 bp, Rattus norvegicus
gtgtggtcacttaatattcgtcctg

SEQ ID NO: 518733 - DNA, 25 bp, Rattus norvegicus
gtgtggtcactttatattcgtcctg

SEQ ID NO: 518734 - DNA, 25 bp, Rattus norvegicus
gtgtggtcagagctgcatacctcac

SEQ ID NO: 518735 - DNA, 25 bp, Rattus norvegicus
gtgtggtcagaggtgcatacctcac

SEQ ID NO: 518736 - DNA, 25 bp, Rattus norvegicus
gtgtggtcagatcagcatcctcgct

SEQ ID NO: 518737 - DNA, 25 bp, Rattus norvegicus
gtgtggtcagatgagcatcctcgct

SEQ ID NO: 518738 - DNA, 25 bp, Rattus norvegicus
gtgtggtcatatagtgtcctgggac

SEQ ID NO: 518739 - DNA, 25 bp, Rattus norvegicus
gtgtggtcatattgtgtcctgggac

SEQ ID NO: 518740 - DNA, 25 bp, Rattus norvegicus
gtgtggtcattgatctagacgaaac

SEQ ID NO: 518741 - DNA, 25 bp, Rattus norvegicus
gtgtggtcattgttctagacgaaac

SEQ ID NO: 518742 - DNA, 25 bp, Rattus norvegicus
gtgtggtccacaaagccgacgataa

SEQ ID NO: 518743 - DNA, 25 bp, Rattus norvegicus
gtgtggtccacatagccgacgataa

SEQ ID NO: 518744 - DNA, 25 bp, Rattus norvegicus
gtgtggtcccagatttaatgtacaa

SEQ ID NO: 518745 - DNA, 25 bp, Rattus norvegicus
gtgtggtcccagttttaatgtacaa

SEQ ID NO: 518746 - DNA, 25 bp, Rattus norvegicus
gtgtggtcctaccagaactgtccat

SEQ ID NO: 518747 - DNA, 25 bp, Rattus norvegicus
gtgtggtcctaccatttctagcata

SEQ ID NO: 518748 - DNA, 25 bp, Rattus norvegicus
gtgtggtcctacgagaactgtccat

SEQ ID NO: 518749 - DNA, 25 bp, Rattus norvegicus
gtgtggtcctacgatttctagcata

SEQ ID NO: 518750 - DNA, 25 bp, Rattus norvegicus
gtgtggtccttactttctacctata

SEQ ID NO: 518751 - DNA, 25 bp, Rattus norvegicus
gtgtggtccttagtttctacctata

SEQ ID NO: 518752 - DNA, 25 bp, Rattus norvegicus
gtgtggtcgctaatgaggttcctca

SEQ ID NO: 518753 - DNA, 25 bp, Rattus norvegicus
gtgtggtcgctattgaggttcctca

SEQ ID NO: 518754 - DNA, 25 bp, Rattus norvegicus
gtgtggtcggtcagcctgtttgctc

SEQ ID NO: 518755 - DNA, 25 bp, Rattus norvegicus
gtgtggtcggtctgcctgtttgctc

SEQ ID NO: 518756 - DNA, 25 bp, Rattus norvegicus
gtgtggtctcagcagagtgcaccaa

SEQ ID NO: 518757 - DNA, 25 bp, Rattus norvegicus
gtgtggtctcaggagagtgcaccaa

SEQ ID NO: 518758 - DNA, 25 bp, Rattus norvegicus
gtgtggtctctccagaatgagtctg

SEQ ID NO: 518759 - DNA, 25 bp, Rattus norvegicus
gtgtggtctctcgagaatgagtctg

SEQ ID NO: 518760 - DNA, 25 bp, Rattus norvegicus
gtgtggtctgatccttttgttattt

SEQ ID NO: 518761 - DNA, 25 bp, Rattus norvegicus
gtgtggtctgatgcttttgttattt

SEQ ID NO: 518762 - DNA, 25 bp, Rattus norvegicus
gtgtggtctgcaccaggatttatga

SEQ ID NO: 518763 - DNA, 25 bp, Rattus norvegicus
gtgtggtctgcagcaggatttatga

SEQ ID NO: 518764 - DNA, 25 bp, Rattus norvegicus
gtgtggtctgccagcttcagaaata

SEQ ID NO: 518765 - DNA, 25 bp, Rattus norvegicus
gtgtggtctgcctgcttcagaaata

SEQ ID NO: 518766 - DNA, 25 bp, Rattus norvegicus
gtgtggtctggtacctgagatctga

SEQ ID NO: 518767 - DNA, 25 bp, Rattus norvegicus
gtgtggtctggtactttgatgtttc

SEQ ID NO: 518768 - DNA, 25 bp, Rattus norvegicus
gtgtggtctggttcctgagatctga

SEQ ID NO: 518769 - DNA, 25 bp, Rattus norvegicus
gtgtggtctggttctttgatgtttc

SEQ ID NO: 518770 - DNA, 25 bp, Rattus norvegicus
gtgtggtcttcacccctggatcctt

SEQ ID NO: 518771 - DNA, 25 bp, Rattus norvegicus
gtgtggtcttcagccctggatcctt

SEQ ID NO: 518772 - DNA, 25 bp, Rattus norvegicus
gtgtggtcttctcgatttccagcac

SEQ ID NO: 518773 - DNA, 25 bp, Rattus norvegicus
gtgtggtcttctggatttccagcac

SEQ ID NO: 518774 - DNA, 25 bp, Rattus norvegicus
gtgtggtgacccatggctgacatcc

SEQ ID NO: 518775 - DNA, 25 bp, Rattus norvegicus
gtgtggtgacccttggctgacatcc

SEQ ID NO: 518776 - DNA, 25 bp, Rattus norvegicus
gtgtggtgagatcatgccccttgaa

SEQ ID NO: 518777 - DNA, 25 bp, Rattus norvegicus
gtgtggtgagatgatgccccttgaa

SEQ ID NO: 518778 - DNA, 25 bp, Rattus norvegicus
gtgtggtgatacatgcccttactcc

SEQ ID NO: 518779 - DNA, 25 bp, Rattus norvegicus
gtgtggtgatacttgcccttactcc

SEQ ID NO: 518780 - DNA, 25 bp, Rattus norvegicus
gtgtggtgcaagatcccagcatcca

SEQ ID NO: 518781 - DNA, 25 bp, Rattus norvegicus
gtgtggtgcaagttcccagcatcca

SEQ ID NO: 518782 - DNA, 25 bp, Rattus norvegicus
gtgtggtgctatatgcccttaatcc

SEQ ID NO: 518783 - DNA, 25 bp, Rattus norvegicus
gtgtggtgctatttgcccttaatcc

SEQ ID NO: 518784 - DNA, 25 bp, Rattus norvegicus
gtgtggtgctctctctacacaagat

SEQ ID NO: 518785 - DNA, 25 bp, Rattus norvegicus
gtgtggtgctctgtctacacaagat

SEQ ID NO: 518786 - DNA, 25 bp, Rattus norvegicus
gtgtggtgcttcacacctggaattc

SEQ ID NO: 518787 - DNA, 25 bp, Rattus norvegicus
gtgtggtgcttctcacctggaattc

SEQ ID NO: 518788 - DNA, 25 bp, Rattus norvegicus
gtgtggtgctttaaaagccacccct

SEQ ID NO: 518789 - DNA, 25 bp, Rattus norvegicus
gtgtggtgcttttaaagccacccct

SEQ ID NO: 518790 - DNA, 25 bp, Rattus norvegicus
gtgtggtggagtacttagcttctaa

SEQ ID NO: 518791 - DNA, 25 bp, Rattus norvegicus
gtgtggtggagttcttagcttctaa

SEQ ID NO: 518792 - DNA, 25 bp, Rattus norvegicus
gtgtggtggattcgcacatgacttt

SEQ ID NO: 518793 - DNA, 25 bp, Rattus norvegicus
gtgtggtggattggcacatgacttt

SEQ ID NO: 518794 - DNA, 25 bp, Rattus norvegicus
gtgtggtgggcaaagcttctcatca

SEQ ID NO: 518795 - DNA, 25 bp, Rattus norvegicus
gtgtggtgggcatagcttctcatca

SEQ ID NO: 518796 - DNA, 25 bp, Rattus norvegicus
gtgtggtggtgacaactgtattccc

SEQ ID NO: 518797 - DNA, 25 bp, Rattus norvegicus
gtgtggtggtgagaactgtattccc

SEQ ID NO: 518798 - DNA, 25 bp, Rattus norvegicus
gtgtggtgtataccgcaggattcta

SEQ ID NO: 518799 - DNA, 25 bp, Rattus norvegicus
gtgtggtgtatagcgcaggattcta

SEQ ID NO: 518800 - DNA, 25 bp, Rattus norvegicus
gtgtggtgtccccagaattccatac

SEQ ID NO: 518801 - DNA, 25 bp, Rattus norvegicus
gtgtggtgtcccgagaattccatac

SEQ ID NO: 518802 - DNA, 25 bp, Rattus norvegicus
gtgtggttagcaatcatgtgcccca

SEQ ID NO: 518803 - DNA, 25 bp, Rattus norvegicus
gtgtggttagcattcatgtgcccca

SEQ ID NO: 518804 - DNA, 25 bp, Rattus norvegicus
gtgtggttagcccatgaactcatga

SEQ ID NO: 518805 - DNA, 25 bp, Rattus norvegicus
gtgtggttagccgatgaactcatga

SEQ ID NO: 518806 - DNA, 25 bp, Rattus norvegicus
gtgtggttccacctgtgtgtatttc

SEQ ID NO: 518807 - DNA, 25 bp, Rattus norvegicus
gtgtggttccacgtgtgtgtatttc

SEQ ID NO: 518808 - DNA, 25 bp, Rattus norvegicus
gtgtggttccccaggcagcatagag

SEQ ID NO: 518809 - DNA, 25 bp, Rattus norvegicus
gtgtggttcccctggcagcatagag

SEQ ID NO: 518810 - DNA, 25 bp, Rattus norvegicus
gtgtggttccgcagtcagatgatga

SEQ ID NO: 518811 - DNA, 25 bp, Rattus norvegicus
gtgtggttccgctgtcagatgatga

SEQ ID NO: 518812 - DNA, 25 bp, Rattus norvegicus
gtgtggttctggaactcatgagctt

SEQ ID NO: 518813 - DNA, 25 bp, Rattus norvegicus
gtgtggttctggaatctcatgacga

SEQ ID NO: 518814 - DNA, 25 bp, Rattus norvegicus
gtgtggttctggtactcatgagctt

SEQ ID NO: 518815 - DNA, 25 bp, Rattus norvegicus
gtgtggttctggtatctcatgacga

SEQ ID NO: 518816 - DNA, 25 bp, Rattus norvegicus
gtgtggttggttattattatctgga

SEQ ID NO: 518817 - DNA, 25 bp, Rattus norvegicus
gtgtggttggtttttattatctgga

SEQ ID NO: 518818 - DNA, 25 bp, Rattus norvegicus
gtgtgtaaactcatgtgctccaatc

SEQ ID NO: 518819 - DNA, 25 bp, Rattus norvegicus
gtgtgtaaactcttgtgctccaatc

SEQ ID NO: 518820 - DNA, 25 bp, Rattus norvegicus
gtgtgtaaagtcactagatatggaa

SEQ ID NO: 518821 - DNA, 25 bp, Rattus norvegicus
gtgtgtaaagtctctagatatggaa

SEQ ID NO: 518822 - DNA, 25 bp, Rattus norvegicus
gtgtgtaaagtgaggcccacctgca

SEQ ID NO: 518823 - DNA, 25 bp, Rattus norvegicus
gtgtgtaaagtgtggcccacctgca

SEQ ID NO: 518824 - DNA, 25 bp, Rattus norvegicus
gtgtgtaacaggctcataccccctc

SEQ ID NO: 518825 - DNA, 25 bp, Rattus norvegicus
gtgtgtaacagggtcataccccctc

SEQ ID NO: 518826 - DNA, 25 bp, Rattus norvegicus
gtgtgtaacatactcttgtacattt

SEQ ID NO: 518827 - DNA, 25 bp, Rattus norvegicus
gtgtgtaacatagtcttgtacattt

SEQ ID NO: 518828 - DNA, 25 bp, Rattus norvegicus
gtgtgtaacttcctcagacgcagaa

SEQ ID NO: 518829 - DNA, 25 bp, Rattus norvegicus
gtgtgtaacttcgtcagacgcagaa

SEQ ID NO: 518830 - DNA, 25 bp, Rattus norvegicus
gtgtgtaagacccacctcagtgcct

SEQ ID NO: 518831 - DNA, 25 bp, Rattus norvegicus
gtgtgtaagaccgacctcagtgcct

SEQ ID NO: 518832 - DNA, 25 bp, Rattus norvegicus
gtgtgtaagcatcctaagcccctag

SEQ ID NO: 518833 - DNA, 25 bp, Rattus norvegicus
gtgtgtaagcatgctaagcccctag

SEQ ID NO: 518834 - DNA, 25 bp, Rattus norvegicus
gtgtgtaagctcacagccctggaat

SEQ ID NO: 518835 - DNA, 25 bp, Rattus norvegicus
gtgtgtaagctctcagccctggaat

SEQ ID NO: 518836 - DNA, 25 bp, Rattus norvegicus
gtgtgtaatagcaccgatccgcatg

SEQ ID NO: 518837 - DNA, 25 bp, Rattus norvegicus
gtgtgtaatagctccgatccgcatg

SEQ ID NO: 518838 - DNA, 25 bp, Rattus norvegicus
gtgtgtaatcttcttcaacaatctg

SEQ ID NO: 518839 - DNA, 25 bp, Rattus norvegicus
gtgtgtaatcttgttcaacaatctg

SEQ ID NO: 518840 - DNA, 25 bp, Rattus norvegicus
gtgtgtaatggactcaactttctca

SEQ ID NO: 518841 - DNA, 25 bp, Rattus norvegicus
gtgtgtaatggagtcaactttctca

SEQ ID NO: 518842 - DNA, 25 bp, Rattus norvegicus
gtgtgtaatgtgacgcaaagtgtgc

SEQ ID NO: 518843 - DNA, 25 bp, Rattus norvegicus
gtgtgtaatgtgtcgcaaagtgtgc

SEQ ID NO: 518844 - DNA, 25 bp, Rattus norvegicus
gtgtgtaatgttcctctagacctag

SEQ ID NO: 518845 - DNA, 25 bp, Rattus norvegicus
gtgtgtaatgttctgttttcctttc

SEQ ID NO: 518846 - DNA, 25 bp, Rattus norvegicus
gtgtgtaatgttgctctagacctag

SEQ ID NO: 518847 - DNA, 25 bp, Rattus norvegicus
gtgtgtaatgttgtgttttcctttc

SEQ ID NO: 518848 - DNA, 25 bp, Rattus norvegicus
gtgtgtaattatactcttcgaaaac

SEQ ID NO: 518849 - DNA, 25 bp, Rattus norvegicus
gtgtgtaattatactgactgtggtc

SEQ ID NO: 518850 - DNA, 25 bp, Rattus norvegicus
gtgtgtaattattctcttcgaaaac

SEQ ID NO: 518851 - DNA, 25 bp, Rattus norvegicus
gtgtgtaattattctgactgtggtc

SEQ ID NO: 518852 - DNA, 25 bp, Rattus norvegicus
gtgtgtaatttactccagttggtat

SEQ ID NO: 518853 - DNA, 25 bp, Rattus norvegicus
gtgtgtaatttagtccagttggtat

SEQ ID NO: 518854 - DNA, 25 bp, Rattus norvegicus
gtgtgtacaattctcctattctcaa

SEQ ID NO: 518855 - DNA, 25 bp, Rattus norvegicus
gtgtgtacaattgtcctattctcaa

SEQ ID NO: 518856 - DNA, 25 bp, Rattus norvegicus
gtgtgtacacacatctcttgaacta

SEQ ID NO: 518857 - DNA, 25 bp, Rattus norvegicus
gtgtgtacacacttctcttgaacta

SEQ ID NO: 518858 - DNA, 25 bp, Rattus norvegicus
gtgtgtacacccatgcacaggcgaa

SEQ ID NO: 518859 - DNA, 25 bp, Rattus norvegicus
gtgtgtacacccttgcacaggcgaa

SEQ ID NO: 518860 - DNA, 25 bp, Rattus norvegicus
gtgtgtacaccgctgattaatgctt

SEQ ID NO: 518861 - DNA, 25 bp, Rattus norvegicus
gtgtgtacaccggtgattaatgctt

SEQ ID NO: 518862 - DNA, 25 bp, Rattus norvegicus
gtgtgtacacgactttaaaatgtca

SEQ ID NO: 518863 - DNA, 25 bp, Rattus norvegicus
gtgtgtacacgagtttaaaatgtca

SEQ ID NO: 518864 - DNA, 25 bp, Rattus norvegicus
gtgtgtacacttagcattcgtgagt

SEQ ID NO: 518865 - DNA, 25 bp, Rattus norvegicus
gtgtgtacactttgcattcgtgagt

SEQ ID NO: 518866 - DNA, 25 bp, Rattus norvegicus
gtgtgtaccaccactgttaaaatcc

SEQ ID NO: 518867 - DNA, 25 bp, Rattus norvegicus
gtgtgtaccacctctgttaaaatcc

SEQ ID NO: 518868 - DNA, 25 bp, Rattus norvegicus
gtgtgtaccatcctcttgtaaatta

SEQ ID NO: 518869 - DNA, 25 bp, Rattus norvegicus
gtgtgtaccatcgtcttgtaaatta

SEQ ID NO: 518870 - DNA, 25 bp, Rattus norvegicus
gtgtgtaccattaacattggtcctg

SEQ ID NO: 518871 - DNA, 25 bp, Rattus norvegicus
gtgtgtaccatttacattggtcctg

SEQ ID NO: 518872 - DNA, 25 bp, Rattus norvegicus
gtgtgtaccccacggcttgtacaaa

SEQ ID NO: 518873 - DNA, 25 bp, Rattus norvegicus
gtgtgtaccccagggcttgtacaaa

SEQ ID NO: 518874 - DNA, 25 bp, Rattus norvegicus
gtgtgtaccgagaccgaattgccca

SEQ ID NO: 518875 - DNA, 25 bp, Rattus norvegicus
gtgtgtaccgagtccgaattgccca

SEQ ID NO: 518876 - DNA, 25 bp, Rattus norvegicus
gtgtgtaccgtcactgataacaggg

SEQ ID NO: 518877 - DNA, 25 bp, Rattus norvegicus
gtgtgtaccgtcatgctcgtatcac

SEQ ID NO: 518878 - DNA, 25 bp, Rattus norvegicus
gtgtgtaccgtctctgataacaggg

SEQ ID NO: 518879 - DNA, 25 bp, Rattus norvegicus
gtgtgtaccgtcttgctcgtatcac

SEQ ID NO: 518880 - DNA, 25 bp, Rattus norvegicus
gtgtgtactctgatttgatattgtc

SEQ ID NO: 518881 - DNA, 25 bp, Rattus norvegicus
gtgtgtactctgttttgatattgtc

SEQ ID NO: 518882 - DNA, 25 bp, Rattus norvegicus
gtgtgtactgtactgtgcagacatg

SEQ ID NO: 518883 - DNA, 25 bp, Rattus norvegicus
gtgtgtactgtagtgtgcagacatg

SEQ ID NO: 518884 - DNA, 25 bp, Rattus norvegicus
gtgtgtagacacactgacagtttcg

SEQ ID NO: 518885 - DNA, 25 bp, Rattus norvegicus
gtgtgtagacactctgacagtttcg

SEQ ID NO: 518886 - DNA, 25 bp, Rattus norvegicus
gtgtgtagataccatgccggcccca

SEQ ID NO: 518887 - DNA, 25 bp, Rattus norvegicus
gtgtgtagatacgatgccggcccca

SEQ ID NO: 518888 - DNA, 25 bp, Rattus norvegicus
gtgtgtagcaagacatcaccaacat

SEQ ID NO: 518889 - DNA, 25 bp, Rattus norvegicus
gtgtgtagcaagtcatcaccaacat

SEQ ID NO: 518890 - DNA, 25 bp, Rattus norvegicus
gtgtgtagcagaagtggccaccctg

SEQ ID NO: 518891 - DNA, 25 bp, Rattus norvegicus
gtgtgtagcagatgtggccaccctg

SEQ ID NO: 518892 - DNA, 25 bp, Rattus norvegicus
gtgtgtagcatccaggactggctca

SEQ ID NO: 518893 - DNA, 25 bp, Rattus norvegicus
gtgtgtagcatcgaggactggctca

SEQ ID NO: 518894 - DNA, 25 bp, Rattus norvegicus
gtgtgtagccataggtgagctctga

SEQ ID NO: 518895 - DNA, 25 bp, Rattus norvegicus
gtgtgtagccattggtgagctctga

SEQ ID NO: 518896 - DNA, 25 bp, Rattus norvegicus
gtgtgtagcctacggtacctttata

SEQ ID NO: 518897 - DNA, 25 bp, Rattus norvegicus
gtgtgtagcctagggtacctttata

SEQ ID NO: 518898 - DNA, 25 bp, Rattus norvegicus
gtgtgtagctaaaaattcttccttt

SEQ ID NO: 518899 - DNA, 25 bp, Rattus norvegicus
gtgtgtagctaataattcttccttt

SEQ ID NO: 518900 - DNA, 25 bp, Rattus norvegicus
gtgtgtagctacaattcttgacatt

SEQ ID NO: 518901 - DNA, 25 bp, Rattus norvegicus
gtgtgtagctactattcttgacatt

SEQ ID NO: 518902 - DNA, 25 bp, Rattus norvegicus
gtgtgtagtattatcccagtcagct

SEQ ID NO: 518903 - DNA, 25 bp, Rattus norvegicus
gtgtgtagtattttcccagtcagct

SEQ ID NO: 518904 - DNA, 25 bp, Rattus norvegicus
gtgtgtagtcaaccaggatcacttg

SEQ ID NO: 518905 - DNA, 25 bp, Rattus norvegicus
gtgtgtagtcaagcaggatcacttg

SEQ ID NO: 518906 - DNA, 25 bp, Rattus norvegicus
gtgtgtagtgtgaatcatatctgat

SEQ ID NO: 518907 - DNA, 25 bp, Rattus norvegicus
gtgtgtagtgtgtatcatatctgat

SEQ ID NO: 518908 - DNA, 25 bp, Rattus norvegicus
gtgtgtagttcacttactgcattaa

SEQ ID NO: 518909 - DNA, 25 bp, Rattus norvegicus
gtgtgtagttcagttactgcattaa

SEQ ID NO: 518910 - DNA, 25 bp, Rattus norvegicus
gtgtgtataactccacttccgggag

SEQ ID NO: 518911 - DNA, 25 bp, Rattus norvegicus
gtgtgtataactctggagcattttc

SEQ ID NO: 518912 - DNA, 25 bp, Rattus norvegicus
gtgtgtataactgcacttccgggag

SEQ ID NO: 518913 - DNA, 25 bp, Rattus norvegicus
gtgtgtataactgtggagcattttc

SEQ ID NO: 518914 - DNA, 25 bp, Rattus norvegicus
gtgtgtatacacacctgatagtcaa

SEQ ID NO: 518915 - DNA, 25 bp, Rattus norvegicus
gtgtgtatacactcctgatagtcaa

SEQ ID NO: 518916 - DNA, 25 bp, Rattus norvegicus
gtgtgtatactgaatccttccagaa

SEQ ID NO: 518917 - DNA, 25 bp, Rattus norvegicus
gtgtgtatactgtatccttccagaa

SEQ ID NO: 518918 - DNA, 25 bp, Rattus norvegicus
gtgtgtatagccagcatgtctgcct

SEQ ID NO: 518919 - DNA, 25 bp, Rattus norvegicus
gtgtgtatagcctgcatgtctgcct

SEQ ID NO: 518920 - DNA, 25 bp, Rattus norvegicus
gtgtgtatagtaaatgcctcatcac

SEQ ID NO: 518921 - DNA, 25 bp, Rattus norvegicus
gtgtgtatagtatatgcctcatcac

SEQ ID NO: 518922 - DNA, 25 bp, Rattus norvegicus
gtgtgtatatacatctccaatctgt

SEQ ID NO: 518923 - DNA, 25 bp, Rattus norvegicus
gtgtgtatataccttgactgttctt

SEQ ID NO: 518924 - DNA, 25 bp, Rattus norvegicus
gtgtgtatatacgttgactgttctt

SEQ ID NO: 518925 - DNA, 25 bp, Rattus norvegicus
gtgtgtatatacttctccaatctgt

SEQ ID NO: 518926 - DNA, 25 bp, Rattus norvegicus
gtgtgtatatccaggggcccttggc

SEQ ID NO: 518927 - DNA, 25 bp, Rattus norvegicus
gtgtgtatatcctggggcccttggc

SEQ ID NO: 518928 - DNA, 25 bp, Rattus norvegicus
gtgtgtatattaactggctcatgaa

SEQ ID NO: 518929 - DNA, 25 bp, Rattus norvegicus
gtgtgtatattatctggctcatgaa

SEQ ID NO: 518930 - DNA, 25 bp, Rattus norvegicus
gtgtgtatcacaaggagctagtcag

SEQ ID NO: 518931 - DNA, 25 bp, Rattus norvegicus
gtgtgtatcacatggagctagtcag

SEQ ID NO: 518932 - DNA, 25 bp, Rattus norvegicus
gtgtgtatcatacccctgagtgctg

SEQ ID NO: 518933 - DNA, 25 bp, Rattus norvegicus
gtgtgtatcatagccctgagtgctg

SEQ ID NO: 518934 - DNA, 25 bp, Rattus norvegicus
gtgtgtatcatccaaagggcagcag

SEQ ID NO: 518935 - DNA, 25 bp, Rattus norvegicus
gtgtgtatcatcgaaagggcagcag

SEQ ID NO: 518936 - DNA, 25 bp, Rattus norvegicus
gtgtgtatccagacacggctcaaag

SEQ ID NO: 518937 - DNA, 25 bp, Rattus norvegicus
gtgtgtatccagtcacggctcaaag

SEQ ID NO: 518938 - DNA, 25 bp, Rattus norvegicus
gtgtgtatccatatatacgccagat

SEQ ID NO: 518939 - DNA, 25 bp, Rattus norvegicus
gtgtgtatccatttatacgccagat

SEQ ID NO: 518940 - DNA, 25 bp, Rattus norvegicus
gtgtgtatcccgcaggtttccaaag

SEQ ID NO: 518941 - DNA, 25 bp, Rattus norvegicus
gtgtgtatcccggaggtttccaaag

SEQ ID NO: 518942 - DNA, 25 bp, Rattus norvegicus
gtgtgtatcctaacgtgtcctgagt

SEQ ID NO: 518943 - DNA, 25 bp, Rattus norvegicus
gtgtgtatcctatcgtgtcctgagt

SEQ ID NO: 518944 - DNA, 25 bp, Rattus norvegicus
gtgtgtatctacacatgacggcagt

SEQ ID NO: 518945 - DNA, 25 bp, Rattus norvegicus
gtgtgtatctactcatgacggcagt

SEQ ID NO: 518946 - DNA, 25 bp, Rattus norvegicus
gtgtgtatctgtaagtaaccccagg

SEQ ID NO: 518947 - DNA, 25 bp, Rattus norvegicus
gtgtgtatctgtatgttttgtgcat

SEQ ID NO: 518948 - DNA, 25 bp, Rattus norvegicus
gtgtgtatctgttagtaaccccagg

SEQ ID NO: 518949 - DNA, 25 bp, Rattus norvegicus
gtgtgtatctgtttgttttgtgcat

SEQ ID NO: 518950 - DNA, 25 bp, Rattus norvegicus
gtgtgtatcttcaagctacaaaata

SEQ ID NO: 518951 - DNA, 25 bp, Rattus norvegicus
gtgtgtatcttctagctacaaaata

SEQ ID NO: 518952 - DNA, 25 bp, Rattus norvegicus
gtgtgtatgagtcttagcagtctga

SEQ ID NO: 518953 - DNA, 25 bp, Rattus norvegicus
gtgtgtatgagtgttagcagtctga

SEQ ID NO: 518954 - DNA, 25 bp, Rattus norvegicus
gtgtgtatgcagaatgcctttcttt

SEQ ID NO: 518955 - DNA, 25 bp, Rattus norvegicus
gtgtgtatgcagtatgcctttcttt

SEQ ID NO: 518956 - DNA, 25 bp, Rattus norvegicus
gtgtgtatgcctctgcatgcatgca

SEQ ID NO: 518957 - DNA, 25 bp, Rattus norvegicus
gtgtgtatgcctgtgcatgcatgca

SEQ ID NO: 518958 - DNA, 25 bp, Rattus norvegicus
gtgtgtatgctaacaggcccactgt

SEQ ID NO: 518959 - DNA, 25 bp, Rattus norvegicus
gtgtgtatgctatcaggcccactgt

SEQ ID NO: 518960 - DNA, 25 bp, Rattus norvegicus
gtgtgtatgggcctgcctgcataca

SEQ ID NO: 518961 - DNA, 25 bp, Rattus norvegicus
gtgtgtatgggcgtgcctgcataca

SEQ ID NO: 518962 - DNA, 25 bp, Rattus norvegicus
gtgtgtatgttcagtgtttgtaagt

SEQ ID NO: 518963 - DNA, 25 bp, Rattus norvegicus
gtgtgtatgttctgtgtttgtaagt

SEQ ID NO: 518964 - DNA, 25 bp, Rattus norvegicus
gtgtgtattaagacagttctttctg

SEQ ID NO: 518965 - DNA, 25 bp, Rattus norvegicus
gtgtgtattaagtcagttctttctg

SEQ ID NO: 518966 - DNA, 25 bp, Rattus norvegicus
gtgtgtattataactggcctcgtta

SEQ ID NO: 518967 - DNA, 25 bp, Rattus norvegicus
gtgtgtattatatctggcctcgtta

SEQ ID NO: 518968 - DNA, 25 bp, Rattus norvegicus
gtgtgtattcctaggttttgcattt

SEQ ID NO: 518969 - DNA, 25 bp, Rattus norvegicus
gtgtgtattccttggttttgcattt

SEQ ID NO: 518970 - DNA, 25 bp, Rattus norvegicus
gtgtgtatttgtctccaggtaactt

SEQ ID NO: 518971 - DNA, 25 bp, Rattus norvegicus
gtgtgtatttgtgtccaggtaactt

SEQ ID NO: 518972 - DNA, 25 bp, Rattus norvegicus
gtgtgtatttttctacttcgctgag

SEQ ID NO: 518973 - DNA, 25 bp, Rattus norvegicus
gtgtgtatttttgtacttcgctgag

SEQ ID NO: 518974 - DNA, 25 bp, Rattus norvegicus
gtgtgtcaacacatttgctcatcta

SEQ ID NO: 518975 - DNA, 25 bp, Rattus norvegicus
gtgtgtcaacacttttgctcatcta

SEQ ID NO: 518976 - DNA, 25 bp, Rattus norvegicus
gtgtgtcaagcaacatctgttctgt

SEQ ID NO: 518977 - DNA, 25 bp, Rattus norvegicus
gtgtgtcaagcatcatctgttctgt

SEQ ID NO: 518978 - DNA, 25 bp, Rattus norvegicus
gtgtgtcacaagctatcatggcccc

SEQ ID NO: 518979 - DNA, 25 bp, Rattus norvegicus
gtgtgtcacaaggtatcatggcccc

SEQ ID NO: 518980 - DNA, 25 bp, Rattus norvegicus
gtgtgtcacacacatagtgttaaat

SEQ ID NO: 518981 - DNA, 25 bp, Rattus norvegicus
gtgtgtcacacagatagtgttaaat

SEQ ID NO: 518982 - DNA, 25 bp, Rattus norvegicus
gtgtgtcacaccaacagttccagca

SEQ ID NO: 518983 - DNA, 25 bp, Rattus norvegicus
gtgtgtcacacctacagttccagca

SEQ ID NO: 518984 - DNA, 25 bp, Rattus norvegicus
gtgtgtcacagcagtagccctagag

SEQ ID NO: 518985 - DNA, 25 bp, Rattus norvegicus
gtgtgtcacagctgtagccctagag

SEQ ID NO: 518986 - DNA, 25 bp, Rattus norvegicus
gtgtgtcacatgactgtcaaccctg

SEQ ID NO: 518987 - DNA, 25 bp, Rattus norvegicus
gtgtgtcacatgtctgtcaaccctg

SEQ ID NO: 518988 - DNA, 25 bp, Rattus norvegicus
gtgtgtcaccataccctggcagaat

SEQ ID NO: 518989 - DNA, 25 bp, Rattus norvegicus
gtgtgtcaccatacttgaaaacatt

SEQ ID NO: 518990 - DNA, 25 bp, Rattus norvegicus
gtgtgtcaccattccctggcagaat

SEQ ID NO: 518991 - DNA, 25 bp, Rattus norvegicus
gtgtgtcaccattcttgaaaacatt

SEQ ID NO: 518992 - DNA, 25 bp, Rattus norvegicus
gtgtgtcaccttcctacttaactaa

SEQ ID NO: 518993 - DNA, 25 bp, Rattus norvegicus
gtgtgtcaccttgctacttaactaa

SEQ ID NO: 518994 - DNA, 25 bp, Rattus norvegicus
gtgtgtcactgaactcaacataggt

SEQ ID NO: 518995 - DNA, 25 bp, Rattus norvegicus
gtgtgtcactgatctcaacataggt

SEQ ID NO: 518996 - DNA, 25 bp, Rattus norvegicus
gtgtgtcagagaatgcagaccactc

SEQ ID NO: 518997 - DNA, 25 bp, Rattus norvegicus
gtgtgtcagagattgcagaccactc

SEQ ID NO: 518998 - DNA, 25 bp, Rattus norvegicus
gtgtgtcagcatataatcctgccag

SEQ ID NO: 518999 - DNA, 25 bp, Rattus norvegicus
gtgtgtcagcatttaatcctgccag

SEQ ID NO: 519000 - DNA, 25 bp, Rattus norvegicus
gtgtgtcagttaattgtactacttg

SEQ ID NO: 519001 - DNA, 25 bp, Rattus norvegicus
gtgtgtcagttatttgtactacttg

SEQ ID NO: 519002 - DNA, 25 bp, Rattus norvegicus
gtgtgtcagtttccactcagcttaa

SEQ ID NO: 519003 - DNA, 25 bp, Rattus norvegicus
gtgtgtcagtttgcactcagcttaa

SEQ ID NO: 519004 - DNA, 25 bp, Rattus norvegicus
gtgtgtcataaaatctccagctcta

SEQ ID NO: 519005 - DNA, 25 bp, Rattus norvegicus
gtgtgtcataaattctccagctcta

SEQ ID NO: 519006 - DNA, 25 bp, Rattus norvegicus
gtgtgtcatattcaaagccttatta

SEQ ID NO: 519007 - DNA, 25 bp, Rattus norvegicus
gtgtgtcatattccccaggatgcta

SEQ ID NO: 519008 - DNA, 25 bp, Rattus norvegicus
gtgtgtcatattgaaagccttatta

SEQ ID NO: 519009 - DNA, 25 bp, Rattus norvegicus
gtgtgtcatattgcccaggatgcta

SEQ ID NO: 519010 - DNA, 25 bp, Rattus norvegicus
gtgtgtcatcacaggcggcagtgct

SEQ ID NO: 519011 - DNA, 25 bp, Rattus norvegicus
gtgtgtcatcactggcggcagtgct

SEQ ID NO: 519012 - DNA, 25 bp, Rattus norvegicus
gtgtgtcatcccatggccagtgatg

SEQ ID NO: 519013 - DNA, 25 bp, Rattus norvegicus
gtgtgtcatcccttggccagtgatg

SEQ ID NO: 519014 - DNA, 25 bp, Rattus norvegicus
gtgtgtcatctgcttaattctactg

SEQ ID NO: 519015 - DNA, 25 bp, Rattus norvegicus
gtgtgtcatctggttaattctactg

SEQ ID NO: 519016 - DNA, 25 bp, Rattus norvegicus
gtgtgtcatgacatctttggttgtt

SEQ ID NO: 519017 - DNA, 25 bp, Rattus norvegicus
gtgtgtcatgacttctttggttgtt

SEQ ID NO: 519018 - DNA, 25 bp, Rattus norvegicus
gtgtgtcatgggatgtcgttacaga

SEQ ID NO: 519019 - DNA, 25 bp, Rattus norvegicus
gtgtgtcatgggttgtcgttacaga

SEQ ID NO: 519020 - DNA, 25 bp, Rattus norvegicus
gtgtgtcattttagctataattggc

SEQ ID NO: 519021 - DNA, 25 bp, Rattus norvegicus
gtgtgtcatttttgctataattggc

SEQ ID NO: 519022 - DNA, 25 bp, Rattus norvegicus
gtgtgtccaagcctcaggtgattat

SEQ ID NO: 519023 - DNA, 25 bp, Rattus norvegicus
gtgtgtccaagcgtcaggtgattat

SEQ ID NO: 519024 - DNA, 25 bp, Rattus norvegicus
gtgtgtccacaaaattcccttgcat

SEQ ID NO: 519025 - DNA, 25 bp, Rattus norvegicus
gtgtgtccacaatattcccttgcat

SEQ ID NO: 519026 - DNA, 25 bp, Rattus norvegicus
gtgtgtccacgaacaaagaaattct

SEQ ID NO: 519027 - DNA, 25 bp, Rattus norvegicus
gtgtgtccacgatcaaagaaattct

SEQ ID NO: 519028 - DNA, 25 bp, Rattus norvegicus
gtgtgtccagctctctaacatggca

SEQ ID NO: 519029 - DNA, 25 bp, Rattus norvegicus
gtgtgtccagctgtctaacatggca

SEQ ID NO: 519030 - DNA, 25 bp, Rattus norvegicus
gtgtgtccatatatatttgcctcct

SEQ ID NO: 519031 - DNA, 25 bp, Rattus norvegicus
gtgtgtccatatttatttgcctcct

SEQ ID NO: 519032 - DNA, 25 bp, Rattus norvegicus
gtgtgtccatgaataaagccaatct

SEQ ID NO: 519033 - DNA, 25 bp, Rattus norvegicus
gtgtgtccatgattaaagccaatct

SEQ ID NO: 519034 - DNA, 25 bp, Rattus norvegicus
gtgtgtccatgcagttgcgatactc

SEQ ID NO: 519035 - DNA, 25 bp, Rattus norvegicus
gtgtgtccatgctgttgcgatactc

SEQ ID NO: 519036 - DNA, 25 bp, Rattus norvegicus
gtgtgtcccaggatctggaaccact

SEQ ID NO: 519037 - DNA, 25 bp, Rattus norvegicus
gtgtgtcccaggttctggaaccact

SEQ ID NO: 519038 - DNA, 25 bp, Rattus norvegicus
gtgtgtcccgagcagagactccatt

SEQ ID NO: 519039 - DNA, 25 bp, Rattus norvegicus
gtgtgtcccgaggagagactccatt

SEQ ID NO: 519040 - DNA, 25 bp, Rattus norvegicus
gtgtgtccctgactagctttgctgc

SEQ ID NO: 519041 - DNA, 25 bp, Rattus norvegicus
gtgtgtccctgagtagctttgctgc

SEQ ID NO: 519042 - DNA, 25 bp, Rattus norvegicus
gtgtgtcctatacctcttaatgcat

SEQ ID NO: 519043 - DNA, 25 bp, Rattus norvegicus
gtgtgtcctatactaaattgtttgc

SEQ ID NO: 519044 - DNA, 25 bp, Rattus norvegicus
gtgtgtcctatagctcttaatgcat

SEQ ID NO: 519045 - DNA, 25 bp, Rattus norvegicus
gtgtgtcctatagtaaattgtttgc

SEQ ID NO: 519046 - DNA, 25 bp, Rattus norvegicus
gtgtgtcctcacaacgtttttgatc

SEQ ID NO: 519047 - DNA, 25 bp, Rattus norvegicus
gtgtgtcctcactacgtttttgatc

SEQ ID NO: 519048 - DNA, 25 bp, Rattus norvegicus
gtgtgtcctcatctaacactggtat

SEQ ID NO: 519049 - DNA, 25 bp, Rattus norvegicus
gtgtgtcctcatgtaacactggtat

SEQ ID NO: 519050 - DNA, 25 bp, Rattus norvegicus
gtgtgtcctctgagtaccttgacca

SEQ ID NO: 519051 - DNA, 25 bp, Rattus norvegicus
gtgtgtcctctgtgtaccttgacca

SEQ ID NO: 519052 - DNA, 25 bp, Rattus norvegicus
gtgtgtcctgacaactctggtggtc

SEQ ID NO: 519053 - DNA, 25 bp, Rattus norvegicus
gtgtgtcctgactactctggtggtc

SEQ ID NO: 519054 - DNA, 25 bp, Rattus norvegicus
gtgtgtccttatcatgtagtcatct

SEQ ID NO: 519055 - DNA, 25 bp, Rattus norvegicus
gtgtgtccttatgatgtagtcatct

SEQ ID NO: 519056 - DNA, 25 bp, Rattus norvegicus
gtgtgtcctttcaccaacagaagtg

SEQ ID NO: 519057 - DNA, 25 bp, Rattus norvegicus
gtgtgtcctttctccaacagaagtg

SEQ ID NO: 519058 - DNA, 25 bp, Rattus norvegicus
gtgtgtcgacatactcctgaagtta

SEQ ID NO: 519059 - DNA, 25 bp, Rattus norvegicus
gtgtgtcgacattctcctgaagtta

SEQ ID NO: 519060 - DNA, 25 bp, Rattus norvegicus
gtgtgtcgcagcacacaactgctta

SEQ ID NO: 519061 - DNA, 25 bp, Rattus norvegicus
gtgtgtcgcagctcacaactgctta

SEQ ID NO: 519062 - DNA, 25 bp, Rattus norvegicus
gtgtgtcgctaacatttatatttcc

SEQ ID NO: 519063 - DNA, 25 bp, Rattus norvegicus
gtgtgtcgctaagatttatatttcc

SEQ ID NO: 519064 - DNA, 25 bp, Rattus norvegicus
gtgtgtcgcttactcagagaactca

SEQ ID NO: 519065 - DNA, 25 bp, Rattus norvegicus
gtgtgtcgcttagtcagagaactca

SEQ ID NO: 519066 - DNA, 25 bp, Rattus norvegicus
gtgtgtcggaccagccagccagaaa

SEQ ID NO: 519067 - DNA, 25 bp, Rattus norvegicus
gtgtgtcggacctgccagccagaaa

SEQ ID NO: 519068 - DNA, 25 bp, Rattus norvegicus
gtgtgtcggtttaactcgggatagc

SEQ ID NO: 519069 - DNA, 25 bp, Rattus norvegicus
gtgtgtcggttttactcgggatagc

SEQ ID NO: 519070 - DNA, 25 bp, Rattus norvegicus
gtgtgtcgtacaatgactgtactca

SEQ ID NO: 519071 - DNA, 25 bp, Rattus norvegicus
gtgtgtcgtacattgactgtactca

SEQ ID NO: 519072 - DNA, 25 bp, Rattus norvegicus
gtgtgtctaaacctgcataaaccca

SEQ ID NO: 519073 - DNA, 25 bp, Rattus norvegicus
gtgtgtctaaacgtgcataaaccca

SEQ ID NO: 519074 - DNA, 25 bp, Rattus norvegicus
gtgtgtctaacaaaatggagcctta

SEQ ID NO: 519075 - DNA, 25 bp, Rattus norvegicus
gtgtgtctaacataatggagcctta

SEQ ID NO: 519076 - DNA, 25 bp, Rattus norvegicus
gtgtgtctaatgctgcaactgcgaa

SEQ ID NO: 519077 - DNA, 25 bp, Rattus norvegicus
gtgtgtctaatggtgcaactgcgaa

SEQ ID NO: 519078 - DNA, 25 bp, Rattus norvegicus
gtgtgtctacacatacatccaggag

SEQ ID NO: 519079 - DNA, 25 bp, Rattus norvegicus
gtgtgtctacacttacatccaggag

SEQ ID NO: 519080 - DNA, 25 bp, Rattus norvegicus
gtgtgtctacgtagaacacttcaat

SEQ ID NO: 519081 - DNA, 25 bp, Rattus norvegicus
gtgtgtctacgttgaacacttcaat

SEQ ID NO: 519082 - DNA, 25 bp, Rattus norvegicus
gtgtgtctatgtactggctattatt

SEQ ID NO: 519083 - DNA, 25 bp, Rattus norvegicus
gtgtgtctatgttctggctattatt

SEQ ID NO: 519084 - DNA, 25 bp, Rattus norvegicus
gtgtgtctcacaactttttcctttc

SEQ ID NO: 519085 - DNA, 25 bp, Rattus norvegicus
gtgtgtctcacatctttttcctttc

SEQ ID NO: 519086 - DNA, 25 bp, Rattus norvegicus
gtgtgtctcaggaacgccattgtga

SEQ ID NO: 519087 - DNA, 25 bp, Rattus norvegicus
gtgtgtctcaggtacgccattgtga

SEQ ID NO: 519088 - DNA, 25 bp, Rattus norvegicus
gtgtgtctccaaagcagaatttcaa

SEQ ID NO: 519089 - DNA, 25 bp, Rattus norvegicus
gtgtgtctccaatgcagaatttcaa

SEQ ID NO: 519090 - DNA, 25 bp, Rattus norvegicus
gtgtgtctccagaacatgtgctggc

SEQ ID NO: 519091 - DNA, 25 bp, Rattus norvegicus
gtgtgtctccagtacatgtgctggc

SEQ ID NO: 519092 - DNA, 25 bp, Rattus norvegicus
gtgtgtctccatagggcttttatta

SEQ ID NO: 519093 - DNA, 25 bp, Rattus norvegicus
gtgtgtctccatatacatgaagttc

SEQ ID NO: 519094 - DNA, 25 bp, Rattus norvegicus
gtgtgtctccattgggcttttatta

SEQ ID NO: 519095 - DNA, 25 bp, Rattus norvegicus
gtgtgtctccatttacatgaagttc

SEQ ID NO: 519096 - DNA, 25 bp, Rattus norvegicus
gtgtgtctccccaatggagtgttaa

SEQ ID NO: 519097 - DNA, 25 bp, Rattus norvegicus
gtgtgtctcccctatggagtgttaa

SEQ ID NO: 519098 - DNA, 25 bp, Rattus norvegicus
gtgtgtctccgcagttcagaaaggc

SEQ ID NO: 519099 - DNA, 25 bp, Rattus norvegicus
gtgtgtctccgctgttcagaaaggc

SEQ ID NO: 519100 - DNA, 25 bp, Rattus norvegicus
gtgtgtctctacacgttgtcaggga

SEQ ID NO: 519101 - DNA, 25 bp, Rattus norvegicus
gtgtgtctctactcgttgtcaggga

SEQ ID NO: 519102 - DNA, 25 bp, Rattus norvegicus
gtgtgtctcttcactggcatctgat

SEQ ID NO: 519103 - DNA, 25 bp, Rattus norvegicus
gtgtgtctcttctctggcatctgat

SEQ ID NO: 519104 - DNA, 25 bp, Rattus norvegicus
gtgtgtctgaatcaagacccgtatc

SEQ ID NO: 519105 - DNA, 25 bp, Rattus norvegicus
gtgtgtctgaatgaagacccgtatc

SEQ ID NO: 519106 - DNA, 25 bp, Rattus norvegicus
gtgtgtctgaccatgaatctcattg

SEQ ID NO: 519107 - DNA, 25 bp, Rattus norvegicus
gtgtgtctgaccttgaatctcattg

SEQ ID NO: 519108 - DNA, 25 bp, Rattus norvegicus
gtgtgtctgactatccttttatata

SEQ ID NO: 519109 - DNA, 25 bp, Rattus norvegicus
gtgtgtctgactttccttttatata

SEQ ID NO: 519110 - DNA, 25 bp, Rattus norvegicus
gtgtgtctgcacattcagggttagg

SEQ ID NO: 519111 - DNA, 25 bp, Rattus norvegicus
gtgtgtctgcactttcagggttagg

SEQ ID NO: 519112 - DNA, 25 bp, Rattus norvegicus
gtgtgtctgcataaccacttaaaat

SEQ ID NO: 519113 - DNA, 25 bp, Rattus norvegicus
gtgtgtctgcattaccacttaaaat

SEQ ID NO: 519114 - DNA, 25 bp, Rattus norvegicus
gtgtgtctgcttaccatgtacatgc

SEQ ID NO: 519115 - DNA, 25 bp, Rattus norvegicus
gtgtgtctgcttcttcttactgaac

SEQ ID NO: 519116 - DNA, 25 bp, Rattus norvegicus
gtgtgtctgcttgttcttactgaac

SEQ ID NO: 519117 - DNA, 25 bp, Rattus norvegicus
gtgtgtctgctttccatgtacatgc

SEQ ID NO: 519118 - DNA, 25 bp, Rattus norvegicus
gtgtgtctggccatcgcaagcccca

SEQ ID NO: 519119 - DNA, 25 bp, Rattus norvegicus
gtgtgtctggccttcgcaagcccca

SEQ ID NO: 519120 - DNA, 25 bp, Rattus norvegicus
gtgtgtctgtatccaattttctctt

SEQ ID NO: 519121 - DNA, 25 bp, Rattus norvegicus
gtgtgtctgtatctgacatcatgaa

SEQ ID NO: 519122 - DNA, 25 bp, Rattus norvegicus
gtgtgtctgtatgcaattttctctt

SEQ ID NO: 519123 - DNA, 25 bp, Rattus norvegicus
gtgtgtctgtatgtgacatcatgaa

SEQ ID NO: 519124 - DNA, 25 bp, Rattus norvegicus
gtgtgtctgtcaatagtgctgtatt

SEQ ID NO: 519125 - DNA, 25 bp, Rattus norvegicus
gtgtgtctgtcattagtgctgtatt

SEQ ID NO: 519126 - DNA, 25 bp, Rattus norvegicus
gtgtgtctgtgcaccacgccttgtg

SEQ ID NO: 519127 - DNA, 25 bp, Rattus norvegicus
gtgtgtctgtgctccacgccttgtg

SEQ ID NO: 519128 - DNA, 25 bp, Rattus norvegicus
gtgtgtcttaagacatacatgcacc

SEQ ID NO: 519129 - DNA, 25 bp, Rattus norvegicus
gtgtgtcttaagtcatacatgcacc

SEQ ID NO: 519130 - DNA, 25 bp, Rattus norvegicus
gtgtgtcttacgacttagtagaatt

SEQ ID NO: 519131 - DNA, 25 bp, Rattus norvegicus
gtgtgtcttacgtcttagtagaatt

SEQ ID NO: 519132 - DNA, 25 bp, Rattus norvegicus
gtgtgtcttatgaaactccaccagc

SEQ ID NO: 519133 - DNA, 25 bp, Rattus norvegicus
gtgtgtcttatgtaactccaccagc

SEQ ID NO: 519134 - DNA, 25 bp, Rattus norvegicus
gtgtgtcttcctattgatatttatg

SEQ ID NO: 519135 - DNA, 25 bp, Rattus norvegicus
gtgtgtcttccttttgatatttatg

SEQ ID NO: 519136 - DNA, 25 bp, Rattus norvegicus
gtgtgtcttgaaccacttccctgaa

SEQ ID NO: 519137 - DNA, 25 bp, Rattus norvegicus
gtgtgtcttgaagcacttccctgaa

SEQ ID NO: 519138 - DNA, 25 bp, Rattus norvegicus
gtgtgtcttgtcaggatactttcta

SEQ ID NO: 519139 - DNA, 25 bp, Rattus norvegicus
gtgtgtcttgtctggatactttcta

SEQ ID NO: 519140 - DNA, 25 bp, Rattus norvegicus
gtgtgtctttaaattgtccctatca

SEQ ID NO: 519141 - DNA, 25 bp, Rattus norvegicus
gtgtgtctttaatttgtccctatca

SEQ ID NO: 519142 - DNA, 25 bp, Rattus norvegicus
gtgtgtctttttctcactcactctt

SEQ ID NO: 519143 - DNA, 25 bp, Rattus norvegicus
gtgtgtctttttgtcactcactctt

SEQ ID NO: 519144 - DNA, 25 bp, Rattus norvegicus
gtgtgtgaacacattcaaaatccag

SEQ ID NO: 519145 - DNA, 25 bp, Rattus norvegicus
gtgtgtgaacactttcaaaatccag

SEQ ID NO: 519146 - DNA, 25 bp, Rattus norvegicus
gtgtgtgaaccactatgtgtcccct

SEQ ID NO: 519147 - DNA, 25 bp, Rattus norvegicus
gtgtgtgaaccagtatgtgtcccct

SEQ ID NO: 519148 - DNA, 25 bp, Rattus norvegicus
gtgtgtgaagatcatcattcccaga

SEQ ID NO: 519149 - DNA, 25 bp, Rattus norvegicus
gtgtgtgaagatgatcattcccaga

SEQ ID NO: 519150 - DNA, 25 bp, Rattus norvegicus
gtgtgtgaagttactccactaagca

SEQ ID NO: 519151 - DNA, 25 bp, Rattus norvegicus
gtgtgtgaagttagccatttctact

SEQ ID NO: 519152 - DNA, 25 bp, Rattus norvegicus
gtgtgtgaagtttctccactaagca

SEQ ID NO: 519153 - DNA, 25 bp, Rattus norvegicus
gtgtgtgaagtttgccatttctact

SEQ ID NO: 519154 - DNA, 25 bp, Rattus norvegicus
gtgtgtgaatcccatacctagaagt

SEQ ID NO: 519155 - DNA, 25 bp, Rattus norvegicus
gtgtgtgaatccgatacctagaagt

SEQ ID NO: 519156 - DNA, 25 bp, Rattus norvegicus
gtgtgtgaatgtaccctcttggctg

SEQ ID NO: 519157 - DNA, 25 bp, Rattus norvegicus
gtgtgtgaatgttccctcttggctg

SEQ ID NO: 519158 - DNA, 25 bp, Rattus norvegicus
gtgtgtgaattcaaggcgtaagcca

SEQ ID NO: 519159 - DNA, 25 bp, Rattus norvegicus
gtgtgtgaattctaggcgtaagcca

SEQ ID NO: 519160 - DNA, 25 bp, Rattus norvegicus
gtgtgtgacaacagaactccaataa

SEQ ID NO: 519161 - DNA, 25 bp, Rattus norvegicus
gtgtgtgacaactgaactccaataa

SEQ ID NO: 519162 - DNA, 25 bp, Rattus norvegicus
gtgtgtgacaagcagcccaccgcca

SEQ ID NO: 519163 - DNA, 25 bp, Rattus norvegicus
gtgtgtgacaaggagcccaccgcca

SEQ ID NO: 519164 - DNA, 25 bp, Rattus norvegicus
gtgtgtgacacaagcctacagtatt

SEQ ID NO: 519165 - DNA, 25 bp, Rattus norvegicus
gtgtgtgacacactgttgaccaact

SEQ ID NO: 519166 - DNA, 25 bp, Rattus norvegicus
gtgtgtgacacagtgttgaccaact

SEQ ID NO: 519167 - DNA, 25 bp, Rattus norvegicus
gtgtgtgacacatgcctacagtatt

SEQ ID NO: 519168 - DNA, 25 bp, Rattus norvegicus
gtgtgtgacactacatctggctcag

SEQ ID NO: 519169 - DNA, 25 bp, Rattus norvegicus
gtgtgtgacacttcatctggctcag

SEQ ID NO: 519170 - DNA, 25 bp, Rattus norvegicus
gtgtgtgacagcatacctctatgtc

SEQ ID NO: 519171 - DNA, 25 bp, Rattus norvegicus
gtgtgtgacagcttacctctatgtc

SEQ ID NO: 519172 - DNA, 25 bp, Rattus norvegicus
gtgtgtgacaggacaccctaccgga

SEQ ID NO: 519173 - DNA, 25 bp, Rattus norvegicus
gtgtgtgacaggtcaccctaccgga

SEQ ID NO: 519174 - DNA, 25 bp, Rattus norvegicus
gtgtgtgacattagccttaaaacgt

SEQ ID NO: 519175 - DNA, 25 bp, Rattus norvegicus
gtgtgtgacatttgccttaaaacgt

SEQ ID NO: 519176 - DNA, 25 bp, Rattus norvegicus
gtgtgtgacctaacatcctgtgact

SEQ ID NO: 519177 - DNA, 25 bp, Rattus norvegicus
gtgtgtgacctatcatcctgtgact

SEQ ID NO: 519178 - DNA, 25 bp, Rattus norvegicus
gtgtgtgacgcactctttcttctct

SEQ ID NO: 519179 - DNA, 25 bp, Rattus norvegicus
gtgtgtgacgcagtctttcttctct

SEQ ID NO: 519180 - DNA, 25 bp, Rattus norvegicus
gtgtgtgactcaaagcatgctgctc

SEQ ID NO: 519181 - DNA, 25 bp, Rattus norvegicus
gtgtgtgactcaagcacttctaacc

SEQ ID NO: 519182 - DNA, 25 bp, Rattus norvegicus
gtgtgtgactcatagcatgctgctc

SEQ ID NO: 519183 - DNA, 25 bp, Rattus norvegicus
gtgtgtgactcatgcacttctaacc

SEQ ID NO: 519184 - DNA, 25 bp, Rattus norvegicus
gtgtgtgactgtctccaccttgagc

SEQ ID NO: 519185 - DNA, 25 bp, Rattus norvegicus
gtgtgtgactgtgtccaccttgagc

SEQ ID NO: 519186 - DNA, 25 bp, Rattus norvegicus
gtgtgtgacttaatactttgggatt

SEQ ID NO: 519187 - DNA, 25 bp, Rattus norvegicus
gtgtgtgacttattactttgggatt

SEQ ID NO: 519188 - DNA, 25 bp, Rattus norvegicus
gtgtgtgagacacaagcagtaccat

SEQ ID NO: 519189 - DNA, 25 bp, Rattus norvegicus
gtgtgtgagacagaagcagtaccat

SEQ ID NO: 519190 - DNA, 25 bp, Rattus norvegicus
gtgtgtgagagcaaagcctccacca

SEQ ID NO: 519191 - DNA, 25 bp, Rattus norvegicus
gtgtgtgagagcactgcatgtttaa

SEQ ID NO: 519192 - DNA, 25 bp, Rattus norvegicus
gtgtgtgagagctaagcctccacca

SEQ ID NO: 519193 - DNA, 25 bp, Rattus norvegicus
gtgtgtgagagctctgcatgtttaa

SEQ ID NO: 519194 - DNA, 25 bp, Rattus norvegicus
gtgtgtgagagtcctctatcccttt

SEQ ID NO: 519195 - DNA, 25 bp, Rattus norvegicus
gtgtgtgagagtgctctatcccttt

SEQ ID NO: 519196 - DNA, 25 bp, Rattus norvegicus
gtgtgtgagattcgcctctatgagc

SEQ ID NO: 519197 - DNA, 25 bp, Rattus norvegicus
gtgtgtgagattggcctctatgagc

SEQ ID NO: 519198 - DNA, 25 bp, Rattus norvegicus
gtgtgtgagcatcttccactagttt

SEQ ID NO: 519199 - DNA, 25 bp, Rattus norvegicus
gtgtgtgagcatgttccactagttt

SEQ ID NO: 519200 - DNA, 25 bp, Rattus norvegicus
gtgtgtgagcccaatcgaagtcctt

SEQ ID NO: 519201 - DNA, 25 bp, Rattus norvegicus
gtgtgtgagccctatcgaagtcctt

SEQ ID NO: 519202 - DNA, 25 bp, Rattus norvegicus
gtgtgtgagcgcctgagtgacctgt

SEQ ID NO: 519203 - DNA, 25 bp, Rattus norvegicus
gtgtgtgagcgcgtgagtgacctgt

SEQ ID NO: 519204 - DNA, 25 bp, Rattus norvegicus
gtgtgtgagtggcttacccttcccc

SEQ ID NO: 519205 - DNA, 25 bp, Rattus norvegicus
gtgtgtgagtgggttacccttcccc

SEQ ID NO: 519206 - DNA, 25 bp, Rattus norvegicus
gtgtgtgatattagaactctttcat

SEQ ID NO: 519207 - DNA, 25 bp, Rattus norvegicus
gtgtgtgatatttgaactctttcat

SEQ ID NO: 519208 - DNA, 25 bp, Rattus norvegicus
gtgtgtgattgtcatagccctgaga

SEQ ID NO: 519209 - DNA, 25 bp, Rattus norvegicus
gtgtgtgattgtgatagccctgaga

SEQ ID NO: 519210 - DNA, 25 bp, Rattus norvegicus
gtgtgtgcaaaccatgttattacca

SEQ ID NO: 519211 - DNA, 25 bp, Rattus norvegicus
gtgtgtgcaaacgatgttattacca

SEQ ID NO: 519212 - DNA, 25 bp, Rattus norvegicus
gtgtgtgcacaaccatattgctctt

SEQ ID NO: 519213 - DNA, 25 bp, Rattus norvegicus
gtgtgtgcacaagcatattgctctt

SEQ ID NO: 519214 - DNA, 25 bp, Rattus norvegicus
gtgtgtgcacacagcttcaaggaaa

SEQ ID NO: 519215 - DNA, 25 bp, Rattus norvegicus
gtgtgtgcacactgcttcaaggaaa

SEQ ID NO: 519216 - DNA, 25 bp, Rattus norvegicus
gtgtgtgcacatagatttgagggta

SEQ ID NO: 519217 - DNA, 25 bp, Rattus norvegicus
gtgtgtgcacattgatttgagggta

SEQ ID NO: 519218 - DNA, 25 bp, Rattus norvegicus
gtgtgtgcaccactgctgcacagga

SEQ ID NO: 519219 - DNA, 25 bp, Rattus norvegicus
gtgtgtgcaccagtgctgcacagga

SEQ ID NO: 519220 - DNA, 25 bp, Rattus norvegicus
gtgtgtgcacttatatcctttaaag

SEQ ID NO: 519221 - DNA, 25 bp, Rattus norvegicus
gtgtgtgcacttttatcctttaaag

SEQ ID NO: 519222 - DNA, 25 bp, Rattus norvegicus
gtgtgtgcagtactatctcggtttt

SEQ ID NO: 519223 - DNA, 25 bp, Rattus norvegicus
gtgtgtgcagtagtatctcggtttt

SEQ ID NO: 519224 - DNA, 25 bp, Rattus norvegicus
gtgtgtgcagttcactgtccagcca

SEQ ID NO: 519225 - DNA, 25 bp, Rattus norvegicus
gtgtgtgcagttgactgtccagcca

SEQ ID NO: 519226 - DNA, 25 bp, Rattus norvegicus
gtgtgtgcatatacaccgagttaat

SEQ ID NO: 519227 - DNA, 25 bp, Rattus norvegicus
gtgtgtgcatatcttttttattatt

SEQ ID NO: 519228 - DNA, 25 bp, Rattus norvegicus
gtgtgtgcatatgttttttattatt

SEQ ID NO: 519229 - DNA, 25 bp, Rattus norvegicus
gtgtgtgcatattcaccgagttaat

SEQ ID NO: 519230 - DNA, 25 bp, Rattus norvegicus
gtgtgtgcatcacaatcctttcttt

SEQ ID NO: 519231 - DNA, 25 bp, Rattus norvegicus
gtgtgtgcatcagaatcctttcttt

SEQ ID NO: 519232 - DNA, 25 bp, Rattus norvegicus
gtgtgtgcatctcctattgaaatac

SEQ ID NO: 519233 - DNA, 25 bp, Rattus norvegicus
gtgtgtgcatctgctattgaaatac

SEQ ID NO: 519234 - DNA, 25 bp, Rattus norvegicus
gtgtgtgccaagatcttgttgccaa

SEQ ID NO: 519235 - DNA, 25 bp, Rattus norvegicus
gtgtgtgccaagttcttgttgccaa

SEQ ID NO: 519236 - DNA, 25 bp, Rattus norvegicus
gtgtgtgcccgtacagcagtgactt

SEQ ID NO: 519237 - DNA, 25 bp, Rattus norvegicus
gtgtgtgcccgttcagcagtgactt

SEQ ID NO: 519238 - DNA, 25 bp, Rattus norvegicus
gtgtgtgccctcacctaggaggtca

SEQ ID NO: 519239 - DNA, 25 bp, Rattus norvegicus
gtgtgtgccctctcctaggaggtca

SEQ ID NO: 519240 - DNA, 25 bp, Rattus norvegicus
gtgtgtgccgtacacgcactatgaa

SEQ ID NO: 519241 - DNA, 25 bp, Rattus norvegicus
gtgtgtgccgtagacgcactatgaa

SEQ ID NO: 519242 - DNA, 25 bp, Rattus norvegicus
gtgtgtgcctatcgtgcgatgcaat

SEQ ID NO: 519243 - DNA, 25 bp, Rattus norvegicus
gtgtgtgcctatggtgcgatgcaat

SEQ ID NO: 519244 - DNA, 25 bp, Rattus norvegicus
gtgtgtgcggttaagagccctctat

SEQ ID NO: 519245 - DNA, 25 bp, Rattus norvegicus
gtgtgtgcggtttagagccctctat

SEQ ID NO: 519246 - DNA, 25 bp, Rattus norvegicus
gtgtgtgcgtgaaacatatcttcat

SEQ ID NO: 519247 - DNA, 25 bp, Rattus norvegicus
gtgtgtgcgtgatacatatcttcat

SEQ ID NO: 519248 - DNA, 25 bp, Rattus norvegicus
gtgtgtgctactcaactgagccaga

SEQ ID NO: 519249 - DNA, 25 bp, Rattus norvegicus
gtgtgtgctactgaactgagccaga

SEQ ID NO: 519250 - DNA, 25 bp, Rattus norvegicus
gtgtgtgctcagatggtcacgaagt

SEQ ID NO: 519251 - DNA, 25 bp, Rattus norvegicus
gtgtgtgctcagttggtcacgaagt

SEQ ID NO: 519252 - DNA, 25 bp, Rattus norvegicus
gtgtgtgctccacactgacacttaa

SEQ ID NO: 519253 - DNA, 25 bp, Rattus norvegicus
gtgtgtgctccagactgacacttaa

SEQ ID NO: 519254 - DNA, 25 bp, Rattus norvegicus
gtgtgtgctcggaacattatgatct

SEQ ID NO: 519255 - DNA, 25 bp, Rattus norvegicus
gtgtgtgctcggtacattatgatct

SEQ ID NO: 519256 - DNA, 25 bp, Rattus norvegicus
gtgtgtgctctacaactctgaatgc

SEQ ID NO: 519257 - DNA, 25 bp, Rattus norvegicus
gtgtgtgctctagaactctgaatgc

SEQ ID NO: 519258 - DNA, 25 bp, Rattus norvegicus
gtgtgtgctgcaagagaagacccca

SEQ ID NO: 519259 - DNA, 25 bp, Rattus norvegicus
gtgtgtgctgcatgagaagacccca

SEQ ID NO: 519260 - DNA, 25 bp, Rattus norvegicus
gtgtgtgctgctaatcctgtaaagg

SEQ ID NO: 519261 - DNA, 25 bp, Rattus norvegicus
gtgtgtgctgctccaatgctcagcc

SEQ ID NO: 519262 - DNA, 25 bp, Rattus norvegicus
gtgtgtgctgctgcaatgctcagcc

SEQ ID NO: 519263 - DNA, 25 bp, Rattus norvegicus
gtgtgtgctgcttatcctgtaaagg

SEQ ID NO: 519264 - DNA, 25 bp, Rattus norvegicus
gtgtgtgctgtcaagatccttgcat

SEQ ID NO: 519265 - DNA, 25 bp, Rattus norvegicus
gtgtgtgctgtccttgcctactata

SEQ ID NO: 519266 - DNA, 25 bp, Rattus norvegicus
gtgtgtgctgtcgttgcctactata

SEQ ID NO: 519267 - DNA, 25 bp, Rattus norvegicus
gtgtgtgctgtctagatccttgcat

SEQ ID NO: 519268 - DNA, 25 bp, Rattus norvegicus
gtgtgtgctgttatcctcaggaaga

SEQ ID NO: 519269 - DNA, 25 bp, Rattus norvegicus
gtgtgtgctgttttcctcaggaaga

SEQ ID NO: 519270 - DNA, 25 bp, Rattus norvegicus
gtgtgtgctttgaagaccaccatcg

SEQ ID NO: 519271 - DNA, 25 bp, Rattus norvegicus
gtgtgtgctttgtagaccaccatcg

SEQ ID NO: 519272 - DNA, 25 bp, Rattus norvegicus
gtgtgtggactgagttactcctccc

SEQ ID NO: 519273 - DNA, 25 bp, Rattus norvegicus
gtgtgtggactgtgttactcctccc

SEQ ID NO: 519274 - DNA, 25 bp, Rattus norvegicus
gtgtgtggagctaatagtctgtact

SEQ ID NO: 519275 - DNA, 25 bp, Rattus norvegicus
gtgtgtggagcttatagtctgtact

SEQ ID NO: 519276 - DNA, 25 bp, Rattus norvegicus
gtgtgtggagtcactgcagacttca

SEQ ID NO: 519277 - DNA, 25 bp, Rattus norvegicus
gtgtgtggagtctctgcagacttca

SEQ ID NO: 519278 - DNA, 25 bp, Rattus norvegicus
gtgtgtggatatcacaccccgtttc

SEQ ID NO: 519279 - DNA, 25 bp, Rattus norvegicus
gtgtgtggatatgacaccccgtttc

SEQ ID NO: 519280 - DNA, 25 bp, Rattus norvegicus
gtgtgtggatttctgtggttttaac

SEQ ID NO: 519281 - DNA, 25 bp, Rattus norvegicus
gtgtgtggatttgtgtggttttaac

SEQ ID NO: 519282 - DNA, 25 bp, Rattus norvegicus
gtgtgtggcatgacttcaaggtcag

SEQ ID NO: 519283 - DNA, 25 bp, Rattus norvegicus
gtgtgtggcatgtcttcaaggtcag

SEQ ID NO: 519284 - DNA, 25 bp, Rattus norvegicus
gtgtgtggccacactggcaagcatg

SEQ ID NO: 519285 - DNA, 25 bp, Rattus norvegicus
gtgtgtggccactctggcaagcatg

SEQ ID NO: 519286 - DNA, 25 bp, Rattus norvegicus
gtgtgtggccatcttatgaataaat

SEQ ID NO: 519287 - DNA, 25 bp, Rattus norvegicus
gtgtgtggccatgttatgaataaat

SEQ ID NO: 519288 - DNA, 25 bp, Rattus norvegicus
gtgtgtggccccaggtgtcaaaaat

SEQ ID NO: 519289 - DNA, 25 bp, Rattus norvegicus
gtgtgtggcccctggtgtcaaaaat

SEQ ID NO: 519290 - DNA, 25 bp, Rattus norvegicus
gtgtgtggccttccaacttttgaaa

SEQ ID NO: 519291 - DNA, 25 bp, Rattus norvegicus
gtgtgtggccttgcaacttttgaaa

SEQ ID NO: 519292 - DNA, 25 bp, Rattus norvegicus
gtgtgtggcgctctttatttatcag

SEQ ID NO: 519293 - DNA, 25 bp, Rattus norvegicus
gtgtgtggcgctgtttatttatcag

SEQ ID NO: 519294 - DNA, 25 bp, Rattus norvegicus
gtgtgtggctgcatagggccattac

SEQ ID NO: 519295 - DNA, 25 bp, Rattus norvegicus
gtgtgtggctgcttagggccattac

SEQ ID NO: 519296 - DNA, 25 bp, Rattus norvegicus
gtgtgtggcttaccattgaccttca

SEQ ID NO: 519297 - DNA, 25 bp, Rattus norvegicus
gtgtgtggcttagcattgaccttca

SEQ ID NO: 519298 - DNA, 25 bp, Rattus norvegicus
gtgtgtgggattatgccgaaccaag

SEQ ID NO: 519299 - DNA, 25 bp, Rattus norvegicus
gtgtgtgggattttgccgaaccaag

SEQ ID NO: 519300 - DNA, 25 bp, Rattus norvegicus
gtgtgtggtaagagtctgtgatcct

SEQ ID NO: 519301 - DNA, 25 bp, Rattus norvegicus
gtgtgtggtaagtgtctgtgatcct

SEQ ID NO: 519302 - DNA, 25 bp, Rattus norvegicus
gtgtgtggtcttcccttcaaaacat

SEQ ID NO: 519303 - DNA, 25 bp, Rattus norvegicus
gtgtgtggtcttgccttcaaaacat

SEQ ID NO: 519304 - DNA, 25 bp, Rattus norvegicus
gtgtgtggttgtagtttcttcccag

SEQ ID NO: 519305 - DNA, 25 bp, Rattus norvegicus
gtgtgtggttgttgtttcttcccag

SEQ ID NO: 519306 - DNA, 25 bp, Rattus norvegicus
gtgtgtgtaacgactcactggacca

SEQ ID NO: 519307 - DNA, 25 bp, Rattus norvegicus
gtgtgtgtaacgtctcactggacca

SEQ ID NO: 519308 - DNA, 25 bp, Rattus norvegicus
gtgtgtgtacacagtaacgtgctat

SEQ ID NO: 519309 - DNA, 25 bp, Rattus norvegicus
gtgtgtgtacactgtaacgtgctat

SEQ ID NO: 519310 - DNA, 25 bp, Rattus norvegicus
gtgtgtgtacatattgccgtgtggt

SEQ ID NO: 519311 - DNA, 25 bp, Rattus norvegicus
gtgtgtgtacattttgccgtgtggt

SEQ ID NO: 519312 - DNA, 25 bp, Rattus norvegicus
gtgtgtgtacgcaaattgttgctag

SEQ ID NO: 519313 - DNA, 25 bp, Rattus norvegicus
gtgtgtgtacgctaattgttgctag

SEQ ID NO: 519314 - DNA, 25 bp, Rattus norvegicus
gtgtgtgtagccattccagtgtacg

SEQ ID NO: 519315 - DNA, 25 bp, Rattus norvegicus
gtgtgtgtagcctttccagtgtacg

SEQ ID NO: 519316 - DNA, 25 bp, Rattus norvegicus
gtgtgtgtagctccacacagccttt

SEQ ID NO: 519317 - DNA, 25 bp, Rattus norvegicus
gtgtgtgtagctgcacacagccttt

SEQ ID NO: 519318 - DNA, 25 bp, Rattus norvegicus
gtgtgtgtagtaattacccaacaaa

SEQ ID NO: 519319 - DNA, 25 bp, Rattus norvegicus
gtgtgtgtagtatttacccaacaaa

SEQ ID NO: 519320 - DNA, 25 bp, Rattus norvegicus
gtgtgtgtagtcagttgtccttttt

SEQ ID NO: 519321 - DNA, 25 bp, Rattus norvegicus
gtgtgtgtagtctgttgtccttttt

SEQ ID NO: 519322 - DNA, 25 bp, Rattus norvegicus
gtgtgtgtatagatgacgcctgtct

SEQ ID NO: 519323 - DNA, 25 bp, Rattus norvegicus
gtgtgtgtatagttgacgcctgtct

SEQ ID NO: 519324 - DNA, 25 bp, Rattus norvegicus
gtgtgtgtatgaacgtgtgcctgca

SEQ ID NO: 519325 - DNA, 25 bp, Rattus norvegicus
gtgtgtgtatgatcgtgtgcctgca

SEQ ID NO: 519326 - DNA, 25 bp, Rattus norvegicus
gtgtgtgtcaaaaacttatcaaggc

SEQ ID NO: 519327 - DNA, 25 bp, Rattus norvegicus
gtgtgtgtcaaatacttatcaaggc

SEQ ID NO: 519328 - DNA, 25 bp, Rattus norvegicus
gtgtgtgtcaagacatctgtatttt

SEQ ID NO: 519329 - DNA, 25 bp, Rattus norvegicus
gtgtgtgtcaagtcatctgtatttt

SEQ ID NO: 519330 - DNA, 25 bp, Rattus norvegicus
gtgtgtgtcacaaagtatcttttac

SEQ ID NO: 519331 - DNA, 25 bp, Rattus norvegicus
gtgtgtgtcacatagtatcttttac

SEQ ID NO: 519332 - DNA, 25 bp, Rattus norvegicus
gtgtgtgtcactatgctgtcaatca

SEQ ID NO: 519333 - DNA, 25 bp, Rattus norvegicus
gtgtgtgtcactatgttattttttc

SEQ ID NO: 519334 - DNA, 25 bp, Rattus norvegicus
gtgtgtgtcactttgctgtcaatca

SEQ ID NO: 519335 - DNA, 25 bp, Rattus norvegicus
gtgtgtgtcactttgttattttttc

SEQ ID NO: 519336 - DNA, 25 bp, Rattus norvegicus
gtgtgtgtcatacttcttttgggag

SEQ ID NO: 519337 - DNA, 25 bp, Rattus norvegicus
gtgtgtgtcatagttcttttgggag

SEQ ID NO: 519338 - DNA, 25 bp, Rattus norvegicus
gtgtgtgtcatcattaccagcttgg

SEQ ID NO: 519339 - DNA, 25 bp, Rattus norvegicus
gtgtgtgtcatctttaccagcttgg

SEQ ID NO: 519340 - DNA, 25 bp, Rattus norvegicus
gtgtgtgtcattcagcatttaagtg

SEQ ID NO: 519341 - DNA, 25 bp, Rattus norvegicus
gtgtgtgtcattgagcatttaagtg

SEQ ID NO: 519342 - DNA, 25 bp, Rattus norvegicus
gtgtgtgtcctgatgcaacatggcc

SEQ ID NO: 519343 - DNA, 25 bp, Rattus norvegicus
gtgtgtgtcctgttgcaacatggcc

SEQ ID NO: 519344 - DNA, 25 bp, Rattus norvegicus
gtgtgtgtccttaacacgctttggc

SEQ ID NO: 519345 - DNA, 25 bp, Rattus norvegicus
gtgtgtgtccttagtgcaaatccca

SEQ ID NO: 519346 - DNA, 25 bp, Rattus norvegicus
gtgtgtgtcctttacacgctttggc

SEQ ID NO: 519347 - DNA, 25 bp, Rattus norvegicus
gtgtgtgtcctttgtgcaaatccca

SEQ ID NO: 519348 - DNA, 25 bp, Rattus norvegicus
gtgtgtgtctgcaagcgtgccacac

SEQ ID NO: 519349 - DNA, 25 bp, Rattus norvegicus
gtgtgtgtctgcagaattggctgac

SEQ ID NO: 519350 - DNA, 25 bp, Rattus norvegicus
gtgtgtgtctgcatgggccacgtat

SEQ ID NO: 519351 - DNA, 25 bp, Rattus norvegicus
gtgtgtgtctgctagcgtgccacac

SEQ ID NO: 519352 - DNA, 25 bp, Rattus norvegicus
gtgtgtgtctgctgaattggctgac

SEQ ID NO: 519353 - DNA, 25 bp, Rattus norvegicus
gtgtgtgtctgcttgggccacgtat

SEQ ID NO: 519354 - DNA, 25 bp, Rattus norvegicus
gtgtgtgtctgtcagtcttttaccc

SEQ ID NO: 519355 - DNA, 25 bp, Rattus norvegicus
gtgtgtgtctgtgagtcttttaccc

SEQ ID NO: 519356 - DNA, 25 bp, Rattus norvegicus
gtgtgtgtcttgattactttcaatg

SEQ ID NO: 519357 - DNA, 25 bp, Rattus norvegicus
gtgtgtgtcttgctcagatcatctg

SEQ ID NO: 519358 - DNA, 25 bp, Rattus norvegicus
gtgtgtgtcttggtcagatcatctg

SEQ ID NO: 519359 - DNA, 25 bp, Rattus norvegicus
gtgtgtgtcttgtttactttcaatg

SEQ ID NO: 519360 - DNA, 25 bp, Rattus norvegicus
gtgtgtgtctttatactcctagaga

SEQ ID NO: 519361 - DNA, 25 bp, Rattus norvegicus
gtgtgtgtctttttactcctagaga

SEQ ID NO: 519362 - DNA, 25 bp, Rattus norvegicus
gtgtgtgtgaccacagaatgctgct

SEQ ID NO: 519363 - DNA, 25 bp, Rattus norvegicus
gtgtgtgtgacctcagaatgctgct

SEQ ID NO: 519364 - DNA, 25 bp, Rattus norvegicus
gtgtgtgtgccgatatttcacctgc

SEQ ID NO: 519365 - DNA, 25 bp, Rattus norvegicus
gtgtgtgtgccgttatttcacctgc

SEQ ID NO: 519366 - DNA, 25 bp, Rattus norvegicus
gtgtgtgtgcttagccttcaagaaa

SEQ ID NO: 519367 - DNA, 25 bp, Rattus norvegicus
gtgtgtgtgctttgccttcaagaaa

SEQ ID NO: 519368 - DNA, 25 bp, Rattus norvegicus
gtgtgtgttaaacgcccacctaagt

SEQ ID NO: 519369 - DNA, 25 bp, Rattus norvegicus
gtgtgtgttaaaggcccacctaagt

SEQ ID NO: 519370 - DNA, 25 bp, Rattus norvegicus
gtgtgtgttaagacagttcattttg

SEQ ID NO: 519371 - DNA, 25 bp, Rattus norvegicus
gtgtgtgttaagtcagttcattttg

SEQ ID NO: 519372 - DNA, 25 bp, Rattus norvegicus
gtgtgtgttaatagtacctgtgcat

SEQ ID NO: 519373 - DNA, 25 bp, Rattus norvegicus
gtgtgtgttaattgtacctgtgcat

SEQ ID NO: 519374 - DNA, 25 bp, Rattus norvegicus
gtgtgtgttatacttttcctctccc

SEQ ID NO: 519375 - DNA, 25 bp, Rattus norvegicus
gtgtgtgttatagttttcctctccc

SEQ ID NO: 519376 - DNA, 25 bp, Rattus norvegicus
gtgtgtgttccaattctgcacagcc

SEQ ID NO: 519377 - DNA, 25 bp, Rattus norvegicus
gtgtgtgttccatttctgcacagcc

SEQ ID NO: 519378 - DNA, 25 bp, Rattus norvegicus
gtgtgtgttctaagagcttgtcata

SEQ ID NO: 519379 - DNA, 25 bp, Rattus norvegicus
gtgtgtgttctactctaaataggat

SEQ ID NO: 519380 - DNA, 25 bp, Rattus norvegicus
gtgtgtgttctagtctaaataggat

SEQ ID NO: 519381 - DNA, 25 bp, Rattus norvegicus
gtgtgtgttctatgagcttgtcata

SEQ ID NO: 519382 - DNA, 25 bp, Rattus norvegicus
gtgtgtgttgctaatcctgaaaaat

SEQ ID NO: 519383 - DNA, 25 bp, Rattus norvegicus
gtgtgtgttgcttatcctgaaaaat

SEQ ID NO: 519384 - DNA, 25 bp, Rattus norvegicus
gtgtgtgtttacagaaccagcagtc

SEQ ID NO: 519385 - DNA, 25 bp, Rattus norvegicus
gtgtgtgtttactgaaccagcagtc

SEQ ID NO: 519386 - DNA, 25 bp, Rattus norvegicus
gtgtgtgtttgaccactggcagatc

SEQ ID NO: 519387 - DNA, 25 bp, Rattus norvegicus
gtgtgtgtttgagcactggcagatc

SEQ ID NO: 519388 - DNA, 25 bp, Rattus norvegicus
gtgtgtgtttgtcatcctggtatga

SEQ ID NO: 519389 - DNA, 25 bp, Rattus norvegicus
gtgtgtgtttgtgatcctggtatga

SEQ ID NO: 519390 - DNA, 25 bp, Rattus norvegicus
gtgtgtgttttaatcatcttttgga

SEQ ID NO: 519391 - DNA, 25 bp, Rattus norvegicus
gtgtgtgttttacccactgttgtta

SEQ ID NO: 519392 - DNA, 25 bp, Rattus norvegicus
gtgtgtgttttagccactgttgtta

SEQ ID NO: 519393 - DNA, 25 bp, Rattus norvegicus
gtgtgtgttttattcatcttttgga

SEQ ID NO: 519394 - DNA, 25 bp, Rattus norvegicus
gtgtgtgttttgacagagagccctg

SEQ ID NO: 519395 - DNA, 25 bp, Rattus norvegicus
gtgtgtgttttgtcagagagccctg

SEQ ID NO: 519396 - DNA, 25 bp, Rattus norvegicus
gtgtgtgtttttacatgctgcagtc

SEQ ID NO: 519397 - DNA, 25 bp, Rattus norvegicus
gtgtgtgttttttcatgctgcagtc

SEQ ID NO: 519398 - DNA, 25 bp, Rattus norvegicus
gtgtgttaacaaccagtcccaattt

SEQ ID NO: 519399 - DNA, 25 bp, Rattus norvegicus
gtgtgttaacaagcagtcccaattt

SEQ ID NO: 519400 - DNA, 25 bp, Rattus norvegicus
gtgtgttaaccaatgccttaccagt

SEQ ID NO: 519401 - DNA, 25 bp, Rattus norvegicus
gtgtgttaaccattgccttaccagt

SEQ ID NO: 519402 - DNA, 25 bp, Rattus norvegicus
gtgtgttaagttcaaacctccggca

SEQ ID NO: 519403 - DNA, 25 bp, Rattus norvegicus
gtgtgttaagttgaaacctccggca

SEQ ID NO: 519404 - DNA, 25 bp, Rattus norvegicus
gtgtgttacattaccagcttgtctt

SEQ ID NO: 519405 - DNA, 25 bp, Rattus norvegicus
gtgtgttacattatgtcactgctga

SEQ ID NO: 519406 - DNA, 25 bp, Rattus norvegicus
gtgtgttacatttccagcttgtctt

SEQ ID NO: 519407 - DNA, 25 bp, Rattus norvegicus
gtgtgttacattttgtcactgctga

SEQ ID NO: 519408 - DNA, 25 bp, Rattus norvegicus
gtgtgttacctcactcttgatggta

SEQ ID NO: 519409 - DNA, 25 bp, Rattus norvegicus
gtgtgttacctctctcttgatggta

SEQ ID NO: 519410 - DNA, 25 bp, Rattus norvegicus
gtgtgttacggacaattaactgtta

SEQ ID NO: 519411 - DNA, 25 bp, Rattus norvegicus
gtgtgttacggagaattaactgtta

SEQ ID NO: 519412 - DNA, 25 bp, Rattus norvegicus
gtgtgttactacagagtcaaatctt

SEQ ID NO: 519413 - DNA, 25 bp, Rattus norvegicus
gtgtgttactactgagtcaaatctt

SEQ ID NO: 519414 - DNA, 25 bp, Rattus norvegicus
gtgtgttagcgaaggatacaggaca

SEQ ID NO: 519415 - DNA, 25 bp, Rattus norvegicus
gtgtgttagcgatggatacaggaca

SEQ ID NO: 519416 - DNA, 25 bp, Rattus norvegicus
gtgtgttagttgacaatgttctcaa

SEQ ID NO: 519417 - DNA, 25 bp, Rattus norvegicus
gtgtgttagttgtcaatgttctcaa

SEQ ID NO: 519418 - DNA, 25 bp, Rattus norvegicus
gtgtgttatactcattcagcatctg

SEQ ID NO: 519419 - DNA, 25 bp, Rattus norvegicus
gtgtgttatactgattcagcatctg

SEQ ID NO: 519420 - DNA, 25 bp, Rattus norvegicus
gtgtgttatcaccagcagacactgc

SEQ ID NO: 519421 - DNA, 25 bp, Rattus norvegicus
gtgtgttatcacgagcagacactgc

SEQ ID NO: 519422 - DNA, 25 bp, Rattus norvegicus
gtgtgttatctgaaagccttctctc

SEQ ID NO: 519423 - DNA, 25 bp, Rattus norvegicus
gtgtgttatctgtaagccttctctc

SEQ ID NO: 519424 - DNA, 25 bp, Rattus norvegicus
gtgtgttatgttcccatgtatgcag

SEQ ID NO: 519425 - DNA, 25 bp, Rattus norvegicus
gtgtgttatgttgccatgtatgcag

SEQ ID NO: 519426 - DNA, 25 bp, Rattus norvegicus
gtgtgttcaaacatatcgatgtcaa

SEQ ID NO: 519427 - DNA, 25 bp, Rattus norvegicus
gtgtgttcaaacttatcgatgtcaa

SEQ ID NO: 519428 - DNA, 25 bp, Rattus norvegicus
gtgtgttcacctaggatatgttcta

SEQ ID NO: 519429 - DNA, 25 bp, Rattus norvegicus
gtgtgttcaccttggatatgttcta

SEQ ID NO: 519430 - DNA, 25 bp, Rattus norvegicus
gtgtgttcacgtattttacaggagt

SEQ ID NO: 519431 - DNA, 25 bp, Rattus norvegicus
gtgtgttcacgttttttacaggagt

SEQ ID NO: 519432 - DNA, 25 bp, Rattus norvegicus
gtgtgttcacttacactctgtaaat

SEQ ID NO: 519433 - DNA, 25 bp, Rattus norvegicus
gtgtgttcacttcatctgcttgaaa

SEQ ID NO: 519434 - DNA, 25 bp, Rattus norvegicus
gtgtgttcacttgatctgcttgaaa

SEQ ID NO: 519435 - DNA, 25 bp, Rattus norvegicus
gtgtgttcactttcactctgtaaat

SEQ ID NO: 519436 - DNA, 25 bp, Rattus norvegicus
gtgtgttcagctcattttgctatct

SEQ ID NO: 519437 - DNA, 25 bp, Rattus norvegicus
gtgtgttcagctgattttgctatct

SEQ ID NO: 519438 - DNA, 25 bp, Rattus norvegicus
gtgtgttcatacctttcttttctgg

SEQ ID NO: 519439 - DNA, 25 bp, Rattus norvegicus
gtgtgttcatacgtttcttttctgg

SEQ ID NO: 519440 - DNA, 25 bp, Rattus norvegicus
gtgtgttcattcatcagcctagagc

SEQ ID NO: 519441 - DNA, 25 bp, Rattus norvegicus
gtgtgttcattcttcagcctagagc

SEQ ID NO: 519442 - DNA, 25 bp, Rattus norvegicus
gtgtgttccacacaaacagctgtgt

SEQ ID NO: 519443 - DNA, 25 bp, Rattus norvegicus
gtgtgttccacagaaacagctgtgt

SEQ ID NO: 519444 - DNA, 25 bp, Rattus norvegicus
gtgtgttccagactgacgcacatca

SEQ ID NO: 519445 - DNA, 25 bp, Rattus norvegicus
gtgtgttccagagtgacgcacatca

SEQ ID NO: 519446 - DNA, 25 bp, Rattus norvegicus
gtgtgttcccagcaaaagcagcggc

SEQ ID NO: 519447 - DNA, 25 bp, Rattus norvegicus
gtgtgttcccaggaaaagcagcggc

SEQ ID NO: 519448 - DNA, 25 bp, Rattus norvegicus
gtgtgttccccactggagaccagga

SEQ ID NO: 519449 - DNA, 25 bp, Rattus norvegicus
gtgtgttccccagtggagaccagga

SEQ ID NO: 519450 - DNA, 25 bp, Rattus norvegicus
gtgtgttccctgactatgatgtact

SEQ ID NO: 519451 - DNA, 25 bp, Rattus norvegicus
gtgtgttccctgtctatgatgtact

SEQ ID NO: 519452 - DNA, 25 bp, Rattus norvegicus
gtgtgttcccttcacagctcatagt

SEQ ID NO: 519453 - DNA, 25 bp, Rattus norvegicus
gtgtgttcccttgacagctcatagt

SEQ ID NO: 519454 - DNA, 25 bp, Rattus norvegicus
gtgtgttcctacaggtgatctacat

SEQ ID NO: 519455 - DNA, 25 bp, Rattus norvegicus
gtgtgttcctaccacccagagggaa

SEQ ID NO: 519456 - DNA, 25 bp, Rattus norvegicus
gtgtgttcctacgacccagagggaa

SEQ ID NO: 519457 - DNA, 25 bp, Rattus norvegicus
gtgtgttcctactggtgatctacat

SEQ ID NO: 519458 - DNA, 25 bp, Rattus norvegicus
gtgtgttcctctagcagtattttaa

SEQ ID NO: 519459 - DNA, 25 bp, Rattus norvegicus
gtgtgttcctcttgcagtattttaa

SEQ ID NO: 519460 - DNA, 25 bp, Rattus norvegicus
gtgtgttcgaagagatcgtgcccat

SEQ ID NO: 519461 - DNA, 25 bp, Rattus norvegicus
gtgtgttcgaagtgatcgtgcccat

SEQ ID NO: 519462 - DNA, 25 bp, Rattus norvegicus
gtgtgttcgcagcaagaccaatgat

SEQ ID NO: 519463 - DNA, 25 bp, Rattus norvegicus
gtgtgttcgcaggaagaccaatgat

SEQ ID NO: 519464 - DNA, 25 bp, Rattus norvegicus
gtgtgttcgttcctttagctgaaga

SEQ ID NO: 519465 - DNA, 25 bp, Rattus norvegicus
gtgtgttcgttcgtttagctgaaga

SEQ ID NO: 519466 - DNA, 25 bp, Rattus norvegicus
gtgtgttctacaaactgctgtctag

SEQ ID NO: 519467 - DNA, 25 bp, Rattus norvegicus
gtgtgttctacatactgctgtctag

SEQ ID NO: 519468 - DNA, 25 bp, Rattus norvegicus
gtgtgttctatacagccttgtgctt

SEQ ID NO: 519469 - DNA, 25 bp, Rattus norvegicus
gtgtgttctatagagccttgtgctt

SEQ ID NO: 519470 - DNA, 25 bp, Rattus norvegicus
gtgtgttctcagctgcagccataac

SEQ ID NO: 519471 - DNA, 25 bp, Rattus norvegicus
gtgtgttctcaggtgcagccataac

SEQ ID NO: 519472 - DNA, 25 bp, Rattus norvegicus
gtgtgttctgacaatatgataaaat

SEQ ID NO: 519473 - DNA, 25 bp, Rattus norvegicus
gtgtgttctgactatatgataaaat

SEQ ID NO: 519474 - DNA, 25 bp, Rattus norvegicus
gtgtgttctgagacctcttgtattc

SEQ ID NO: 519475 - DNA, 25 bp, Rattus norvegicus
gtgtgttctgagtcctcttgtattc

SEQ ID NO: 519476 - DNA, 25 bp, Rattus norvegicus
gtgtgttctgatatacaaacttctt

SEQ ID NO: 519477 - DNA, 25 bp, Rattus norvegicus
gtgtgttctgatttacaaacttctt

SEQ ID NO: 519478 - DNA, 25 bp, Rattus norvegicus
gtgtgttctgcaagacttgctcttg

SEQ ID NO: 519479 - DNA, 25 bp, Rattus norvegicus
gtgtgttctgcaccgaacttgtcca

SEQ ID NO: 519480 - DNA, 25 bp, Rattus norvegicus
gtgtgttctgcagcgaacttgtcca

SEQ ID NO: 519481 - DNA, 25 bp, Rattus norvegicus
gtgtgttctgcatgacttgctcttg

SEQ ID NO: 519482 - DNA, 25 bp, Rattus norvegicus
gtgtgttctggaaaagtggcgacat

SEQ ID NO: 519483 - DNA, 25 bp, Rattus norvegicus
gtgtgttctggataagtggcgacat

SEQ ID NO: 519484 - DNA, 25 bp, Rattus norvegicus
gtgtgttcttacatcccttgtggga

SEQ ID NO: 519485 - DNA, 25 bp, Rattus norvegicus
gtgtgttcttacttcccttgtggga

SEQ ID NO: 519486 - DNA, 25 bp, Rattus norvegicus
gtgtgttcttccactacactaaatg

SEQ ID NO: 519487 - DNA, 25 bp, Rattus norvegicus
gtgtgttcttcctctacactaaatg

SEQ ID NO: 519488 - DNA, 25 bp, Rattus norvegicus
gtgtgttctttcatcataatcgttc

SEQ ID NO: 519489 - DNA, 25 bp, Rattus norvegicus
gtgtgttctttcttcataatcgttc

SEQ ID NO: 519490 - DNA, 25 bp, Rattus norvegicus
gtgtgttctttgataacccagacat

SEQ ID NO: 519491 - DNA, 25 bp, Rattus norvegicus
gtgtgttctttgttaacccagacat

SEQ ID NO: 519492 - DNA, 25 bp, Rattus norvegicus
gtgtgttgaagtccactctctgggt

SEQ ID NO: 519493 - DNA, 25 bp, Rattus norvegicus
gtgtgttgaagtgcactctctgggt

SEQ ID NO: 519494 - DNA, 25 bp, Rattus norvegicus
gtgtgttgaatcagccactttggga

SEQ ID NO: 519495 - DNA, 25 bp, Rattus norvegicus
gtgtgttgaatctgccactttggga

SEQ ID NO: 519496 - DNA, 25 bp, Rattus norvegicus
gtgtgttgatgcaatcttcgctagc

SEQ ID NO: 519497 - DNA, 25 bp, Rattus norvegicus
gtgtgttgatgctatcttcgctagc

SEQ ID NO: 519498 - DNA, 25 bp, Rattus norvegicus
gtgtgttgattgaaccgaaggctca

SEQ ID NO: 519499 - DNA, 25 bp, Rattus norvegicus
gtgtgttgattgatgttgctgagtt

SEQ ID NO: 519500 - DNA, 25 bp, Rattus norvegicus
gtgtgttgattgcagccactgctag

SEQ ID NO: 519501 - DNA, 25 bp, Rattus norvegicus
gtgtgttgattggagccactgctag

SEQ ID NO: 519502 - DNA, 25 bp, Rattus norvegicus
gtgtgttgattgtaccgaaggctca

SEQ ID NO: 519503 - DNA, 25 bp, Rattus norvegicus
gtgtgttgattgttgttgctgagtt

SEQ ID NO: 519504 - DNA, 25 bp, Rattus norvegicus
gtgtgttgccacacctagcaaattg

SEQ ID NO: 519505 - DNA, 25 bp, Rattus norvegicus
gtgtgttgccactcctagcaaattg

SEQ ID NO: 519506 - DNA, 25 bp, Rattus norvegicus
gtgtgttgcccaaacatgtgtgtga

SEQ ID NO: 519507 - DNA, 25 bp, Rattus norvegicus
gtgtgttgcccatacatgtgtgtga

SEQ ID NO: 519508 - DNA, 25 bp, Rattus norvegicus
gtgtgttggcaaacatctgcaggac

SEQ ID NO: 519509 - DNA, 25 bp, Rattus norvegicus
gtgtgttggcaatcatctgcaggac

SEQ ID NO: 519510 - DNA, 25 bp, Rattus norvegicus
gtgtgttggtctatgacagtagcta

SEQ ID NO: 519511 - DNA, 25 bp, Rattus norvegicus
gtgtgttggtctttgacagtagcta

SEQ ID NO: 519512 - DNA, 25 bp, Rattus norvegicus
gtgtgttgtagcacatttgtttcaa

SEQ ID NO: 519513 - DNA, 25 bp, Rattus norvegicus
gtgtgttgtagctcatttgtttcaa

SEQ ID NO: 519514 - DNA, 25 bp, Rattus norvegicus
gtgtgttgtgcactgctgccccata

SEQ ID NO: 519515 - DNA, 25 bp, Rattus norvegicus
gtgtgttgtgcagtgctgccccata

SEQ ID NO: 519516 - DNA, 25 bp, Rattus norvegicus
gtgtgttgtgttacccacaatcact

SEQ ID NO: 519517 - DNA, 25 bp, Rattus norvegicus
gtgtgttgtgtttcccacaatcact

SEQ ID NO: 519518 - DNA, 25 bp, Rattus norvegicus
gtgtgtttaactagcttatcttgta

SEQ ID NO: 519519 - DNA, 25 bp, Rattus norvegicus
gtgtgtttaacttgcttatcttgta

SEQ ID NO: 519520 - DNA, 25 bp, Rattus norvegicus
gtgtgtttaatcacagtgttctact

SEQ ID NO: 519521 - DNA, 25 bp, Rattus norvegicus
gtgtgtttaatctcagtgttctact

SEQ ID NO: 519522 - DNA, 25 bp, Rattus norvegicus
gtgtgtttacacctatcttttaatt

SEQ ID NO: 519523 - DNA, 25 bp, Rattus norvegicus
gtgtgtttacacgtatcttttaatt

SEQ ID NO: 519524 - DNA, 25 bp, Rattus norvegicus
gtgtgtttacatctctttgcaaagt

SEQ ID NO: 519525 - DNA, 25 bp, Rattus norvegicus
gtgtgtttacatgtctttgcaaagt

SEQ ID NO: 519526 - DNA, 25 bp, Rattus norvegicus
gtgtgtttaccccactagactgtga

SEQ ID NO: 519527 - DNA, 25 bp, Rattus norvegicus
gtgtgtttacccgactagactgtga

SEQ ID NO: 519528 - DNA, 25 bp, Rattus norvegicus
gtgtgtttagtaacttgaggtttca

SEQ ID NO: 519529 - DNA, 25 bp, Rattus norvegicus
gtgtgtttagtatcttgaggtttca

SEQ ID NO: 519530 - DNA, 25 bp, Rattus norvegicus
gtgtgtttatgactgacaagaaata

SEQ ID NO: 519531 - DNA, 25 bp, Rattus norvegicus
gtgtgtttatgagtgacaagaaata

SEQ ID NO: 519532 - DNA, 25 bp, Rattus norvegicus
gtgtgtttatgtagaccagtcctag

SEQ ID NO: 519533 - DNA, 25 bp, Rattus norvegicus
gtgtgtttatgtatacctctacagg

SEQ ID NO: 519534 - DNA, 25 bp, Rattus norvegicus
gtgtgtttatgttgaccagtcctag

SEQ ID NO: 519535 - DNA, 25 bp, Rattus norvegicus
gtgtgtttatgtttacctctacagg

SEQ ID NO: 519536 - DNA, 25 bp, Rattus norvegicus
gtgtgtttcactctatgactgacaa

SEQ ID NO: 519537 - DNA, 25 bp, Rattus norvegicus
gtgtgtttcactgtatgactgacaa

SEQ ID NO: 519538 - DNA, 25 bp, Rattus norvegicus
gtgtgtttcagcacgttgagttaaa

SEQ ID NO: 519539 - DNA, 25 bp, Rattus norvegicus
gtgtgtttcagctcgttgagttaaa

SEQ ID NO: 519540 - DNA, 25 bp, Rattus norvegicus
gtgtgtttcctcatcaaccgggagc

SEQ ID NO: 519541 - DNA, 25 bp, Rattus norvegicus
gtgtgtttcctcttcaaccgggagc

SEQ ID NO: 519542 - DNA, 25 bp, Rattus norvegicus
gtgtgtttcggtccctttccacttc

SEQ ID NO: 519543 - DNA, 25 bp, Rattus norvegicus
gtgtgtttcggtgcctttccacttc

SEQ ID NO: 519544 - DNA, 25 bp, Rattus norvegicus
gtgtgtttctaaactctctgtctag

SEQ ID NO: 519545 - DNA, 25 bp, Rattus norvegicus
gtgtgtttctaatctctctgtctag

SEQ ID NO: 519546 - DNA, 25 bp, Rattus norvegicus
gtgtgtttctacatttacatgatcc

SEQ ID NO: 519547 - DNA, 25 bp, Rattus norvegicus
gtgtgtttctacttttacatgatcc

SEQ ID NO: 519548 - DNA, 25 bp, Rattus norvegicus
gtgtgtttctagaccaatcaatcaa

SEQ ID NO: 519549 - DNA, 25 bp, Rattus norvegicus
gtgtgtttctagtccaatcaatcaa

SEQ ID NO: 519550 - DNA, 25 bp, Rattus norvegicus
gtgtgtttctgactacgtttgtttg

SEQ ID NO: 519551 - DNA, 25 bp, Rattus norvegicus
gtgtgtttctgagtacgtttgtttg

SEQ ID NO: 519552 - DNA, 25 bp, Rattus norvegicus
gtgtgtttgaccattatctgcccct

SEQ ID NO: 519553 - DNA, 25 bp, Rattus norvegicus
gtgtgtttgacctttatctgcccct

SEQ ID NO: 519554 - DNA, 25 bp, Rattus norvegicus
gtgtgtttgcttctgttcaactcag

SEQ ID NO: 519555 - DNA, 25 bp, Rattus norvegicus
gtgtgtttgcttcttgacactctga

SEQ ID NO: 519556 - DNA, 25 bp, Rattus norvegicus
gtgtgtttgcttgtgttcaactcag

SEQ ID NO: 519557 - DNA, 25 bp, Rattus norvegicus
gtgtgtttgcttgttgacactctga

SEQ ID NO: 519558 - DNA, 25 bp, Rattus norvegicus
gtgtgtttgtcaaagcacccagtgt

SEQ ID NO: 519559 - DNA, 25 bp, Rattus norvegicus
gtgtgtttgtcatagcacccagtgt

SEQ ID NO: 519560 - DNA, 25 bp, Rattus norvegicus
gtgtgtttgtgaagatcttgcagaa

SEQ ID NO: 519561 - DNA, 25 bp, Rattus norvegicus
gtgtgtttgtgatgatcttgcagaa

SEQ ID NO: 519562 - DNA, 25 bp, Rattus norvegicus
gtgtgttttacacaaaacaacgaat

SEQ ID NO: 519563 - DNA, 25 bp, Rattus norvegicus
gtgtgttttacagaaaacaacgaat

SEQ ID NO: 519564 - DNA, 25 bp, Rattus norvegicus
gtgtgttttcatactattggttgta

SEQ ID NO: 519565 - DNA, 25 bp, Rattus norvegicus
gtgtgttttcattctattggttgta

SEQ ID NO: 519566 - DNA, 25 bp, Rattus norvegicus
gtgtgttttctcagttcctttgagg

SEQ ID NO: 519567 - DNA, 25 bp, Rattus norvegicus
gtgtgttttctctgttcctttgagg

SEQ ID NO: 519568 - DNA, 25 bp, Rattus norvegicus
gtgtgttttgagactgcacttctgt

SEQ ID NO: 519569 - DNA, 25 bp, Rattus norvegicus
gtgtgttttgagtctgcacttctgt

SEQ ID NO: 519570 - DNA, 25 bp, Rattus norvegicus
gtgtgttttggtcgactgtttgtca

SEQ ID NO: 519571 - DNA, 25 bp, Rattus norvegicus
gtgtgttttggtggactgtttgtca

SEQ ID NO: 519572 - DNA, 25 bp, Rattus norvegicus
gtgtgttttgttatacaataccttg

SEQ ID NO: 519573 - DNA, 25 bp, Rattus norvegicus
gtgtgttttgttttacaataccttg

SEQ ID NO: 519574 - DNA, 25 bp, Rattus norvegicus
gtgtgtttttgtaaccagtcttgtg

SEQ ID NO: 519575 - DNA, 25 bp, Rattus norvegicus
gtgtgtttttgttaccagtcttgtg

SEQ ID NO: 519576 - DNA, 25 bp, Rattus norvegicus
gtgttaaaagtcactcctgttagct

SEQ ID NO: 519577 - DNA, 25 bp, Rattus norvegicus
gtgttaaaagtctctcctgttagct

SEQ ID NO: 519578 - DNA, 25 bp, Rattus norvegicus
gtgttaaaatacaccattctcttcg

SEQ ID NO: 519579 - DNA, 25 bp, Rattus norvegicus
gtgttaaaatactccattctcttcg

SEQ ID NO: 519580 - DNA, 25 bp, Rattus norvegicus
gtgttaaaatttcatgtcggcctaa

SEQ ID NO: 519581 - DNA, 25 bp, Rattus norvegicus
gtgttaaaatttgatgtcggcctaa

SEQ ID NO: 519582 - DNA, 25 bp, Rattus norvegicus
gtgttaaaggctaagcacacctgat

SEQ ID NO: 519583 - DNA, 25 bp, Rattus norvegicus
gtgttaaaggcttagcacacctgat

SEQ ID NO: 519584 - DNA, 25 bp, Rattus norvegicus
gtgttaaaggtcacacccgggattg

SEQ ID NO: 519585 - DNA, 25 bp, Rattus norvegicus
gtgttaaaggtcacctgtcctcact

SEQ ID NO: 519586 - DNA, 25 bp, Rattus norvegicus
gtgttaaaggtctcacccgggattg

SEQ ID NO: 519587 - DNA, 25 bp, Rattus norvegicus
gtgttaaaggtctcctgtcctcact

SEQ ID NO: 519588 - DNA, 25 bp, Rattus norvegicus
gtgttaaattctacattggctcctg

SEQ ID NO: 519589 - DNA, 25 bp, Rattus norvegicus
gtgttaaattcttcattggctcctg

SEQ ID NO: 519590 - DNA, 25 bp, Rattus norvegicus
gtgttaacaaccatgtggcccacag

SEQ ID NO: 519591 - DNA, 25 bp, Rattus norvegicus
gtgttaacaaccttgtggcccacag

SEQ ID NO: 519592 - DNA, 25 bp, Rattus norvegicus
gtgttaacacatagctcacactggg

SEQ ID NO: 519593 - DNA, 25 bp, Rattus norvegicus
gtgttaacacattgctcacactggg

SEQ ID NO: 519594 - DNA, 25 bp, Rattus norvegicus
gtgttaacactcaccaaagaaactg

SEQ ID NO: 519595 - DNA, 25 bp, Rattus norvegicus
gtgttaacactctccaaagaaactg

SEQ ID NO: 519596 - DNA, 25 bp, Rattus norvegicus
gtgttaactattaattacctgggtg

SEQ ID NO: 519597 - DNA, 25 bp, Rattus norvegicus
gtgttaactatttattacctgggtg

SEQ ID NO: 519598 - DNA, 25 bp, Rattus norvegicus
gtgttaactcatcacttaggcaaga

SEQ ID NO: 519599 - DNA, 25 bp, Rattus norvegicus
gtgttaactcatcctttgtacatcc

SEQ ID NO: 519600 - DNA, 25 bp, Rattus norvegicus
gtgttaactcatgacttaggcaaga

SEQ ID NO: 519601 - DNA, 25 bp, Rattus norvegicus
gtgttaactcatgctttgtacatcc

SEQ ID NO: 519602 - DNA, 25 bp, Rattus norvegicus
gtgttaactgagagcaccactccag

SEQ ID NO: 519603 - DNA, 25 bp, Rattus norvegicus
gtgttaactgagtgcaccactccag

SEQ ID NO: 519604 - DNA, 25 bp, Rattus norvegicus
gtgttaacttcccaatccagtcctt

SEQ ID NO: 519605 - DNA, 25 bp, Rattus norvegicus
gtgttaacttccgaatccagtcctt

SEQ ID NO: 519606 - DNA, 25 bp, Rattus norvegicus
gtgttaagacacctcagaatttagt

SEQ ID NO: 519607 - DNA, 25 bp, Rattus norvegicus
gtgttaagacacgtcagaatttagt

SEQ ID NO: 519608 - DNA, 25 bp, Rattus norvegicus
gtgttaagcctaaccagctgtcaga

SEQ ID NO: 519609 - DNA, 25 bp, Rattus norvegicus
gtgttaagcctatccagctgtcaga

SEQ ID NO: 519610 - DNA, 25 bp, Rattus norvegicus
gtgttaaggccacttttcccagaag

SEQ ID NO: 519611 - DNA, 25 bp, Rattus norvegicus
gtgttaaggccagttttcccagaag

SEQ ID NO: 519612 - DNA, 25 bp, Rattus norvegicus
gtgttaaggcctatttagcaagcat

SEQ ID NO: 519613 - DNA, 25 bp, Rattus norvegicus
gtgttaaggcctttttagcaagcat

SEQ ID NO: 519614 - DNA, 25 bp, Rattus norvegicus
gtgttaagtagcatcccacaagctg

SEQ ID NO: 519615 - DNA, 25 bp, Rattus norvegicus
gtgttaagtagcttcccacaagctg

SEQ ID NO: 519616 - DNA, 25 bp, Rattus norvegicus
gtgttaataagcatcccatctgtct

SEQ ID NO: 519617 - DNA, 25 bp, Rattus norvegicus
gtgttaataagcttcccatctgtct

SEQ ID NO: 519618 - DNA, 25 bp, Rattus norvegicus
gtgttaatacaaacttgtcttctaa

SEQ ID NO: 519619 - DNA, 25 bp, Rattus norvegicus
gtgttaatacaatcttgtcttctaa

SEQ ID NO: 519620 - DNA, 25 bp, Rattus norvegicus
gtgttaataggtcagtgtcccctgc

SEQ ID NO: 519621 - DNA, 25 bp, Rattus norvegicus
gtgttaataggtgagtgtcccctgc

SEQ ID NO: 519622 - DNA, 25 bp, Rattus norvegicus
gtgttaatagtcatgtgctacccag

SEQ ID NO: 519623 - DNA, 25 bp, Rattus norvegicus
gtgttaatagtcttgtgctacccag

SEQ ID NO: 519624 - DNA, 25 bp, Rattus norvegicus
gtgttaatcacacgagactcttgta

SEQ ID NO: 519625 - DNA, 25 bp, Rattus norvegicus
gtgttaatcacaggagactcttgta

SEQ ID NO: 519626 - DNA, 25 bp, Rattus norvegicus
gtgttaatcatgacagttcttgaat

SEQ ID NO: 519627 - DNA, 25 bp, Rattus norvegicus
gtgttaatcatgtcagttcttgaat

SEQ ID NO: 519628 - DNA, 25 bp, Rattus norvegicus
gtgttaatcttgattacctcgctag

SEQ ID NO: 519629 - DNA, 25 bp, Rattus norvegicus
gtgttaatcttgtttacctcgctag

SEQ ID NO: 519630 - DNA, 25 bp, Rattus norvegicus
gtgttaatgcacattccacagttag

SEQ ID NO: 519631 - DNA, 25 bp, Rattus norvegicus
gtgttaatgcacatttccccacttt

SEQ ID NO: 519632 - DNA, 25 bp, Rattus norvegicus
gtgttaatgcactttccacagttag

SEQ ID NO: 519633 - DNA, 25 bp, Rattus norvegicus
gtgttaatgcacttttccccacttt

SEQ ID NO: 519634 - DNA, 25 bp, Rattus norvegicus
gtgttaatgccaactgtagtatcag

SEQ ID NO: 519635 - DNA, 25 bp, Rattus norvegicus
gtgttaatgccatctgtagtatcag

SEQ ID NO: 519636 - DNA, 25 bp, Rattus norvegicus
gtgttaatgctgagctggcaaagat

SEQ ID NO: 519637 - DNA, 25 bp, Rattus norvegicus
gtgttaatgctgtgctggcaaagat

SEQ ID NO: 519638 - DNA, 25 bp, Rattus norvegicus
gtgttaatggccaagcatgatggga

SEQ ID NO: 519639 - DNA, 25 bp, Rattus norvegicus
gtgttaatggcctagcatgatggga

SEQ ID NO: 519640 - DNA, 25 bp, Rattus norvegicus
gtgttaatttgaacttggatggaat

SEQ ID NO: 519641 - DNA, 25 bp, Rattus norvegicus
gtgttaatttgatcttggatggaat

SEQ ID NO: 519642 - DNA, 25 bp, Rattus norvegicus
gtgttacaactgcaaaaccactttt

SEQ ID NO: 519643 - DNA, 25 bp, Rattus norvegicus
gtgttacaactggaaaaccactttt

SEQ ID NO: 519644 - DNA, 25 bp, Rattus norvegicus
gtgttacaagaacccagctgagctg

SEQ ID NO: 519645 - DNA, 25 bp, Rattus norvegicus
gtgttacaagaagccagctgagctg

SEQ ID NO: 519646 - DNA, 25 bp, Rattus norvegicus
gtgttacaattgatctgtcttgaga

SEQ ID NO: 519647 - DNA, 25 bp, Rattus norvegicus
gtgttacaattgttctgtcttgaga

SEQ ID NO: 519648 - DNA, 25 bp, Rattus norvegicus
gtgttacacacaattctctatgtat

SEQ ID NO: 519649 - DNA, 25 bp, Rattus norvegicus
gtgttacacacatttctctatgtat

SEQ ID NO: 519650 - DNA, 25 bp, Rattus norvegicus
gtgttacacatcagcattgactttg

SEQ ID NO: 519651 - DNA, 25 bp, Rattus norvegicus
gtgttacacatctgcattgactttg

SEQ ID NO: 519652 - DNA, 25 bp, Rattus norvegicus
gtgttacagcacagggaactttaat

SEQ ID NO: 519653 - DNA, 25 bp, Rattus norvegicus
gtgttacagcactgggaactttaat

SEQ ID NO: 519654 - DNA, 25 bp, Rattus norvegicus
gtgttacatctaatcctcagcagaa

SEQ ID NO: 519655 - DNA, 25 bp, Rattus norvegicus
gtgttacatctattcctcagcagaa

SEQ ID NO: 519656 - DNA, 25 bp, Rattus norvegicus
gtgttacattcactacttctttgtt

SEQ ID NO: 519657 - DNA, 25 bp, Rattus norvegicus
gtgttacattcagtacttctttgtt

SEQ ID NO: 519658 - DNA, 25 bp, Rattus norvegicus
gtgttaccaggtcctccagctagga

SEQ ID NO: 519659 - DNA, 25 bp, Rattus norvegicus
gtgttaccaggtgctccagctagga

SEQ ID NO: 519660 - DNA, 25 bp, Rattus norvegicus
gtgttacccacacaacagagtgact

SEQ ID NO: 519661 - DNA, 25 bp, Rattus norvegicus
gtgttacccacagaacagagtgact

SEQ ID NO: 519662 - DNA, 25 bp, Rattus norvegicus
gtgttacccatcacctcctgggttc

SEQ ID NO: 519663 - DNA, 25 bp, Rattus norvegicus
gtgttacccatctcctcctgggttc

SEQ ID NO: 519664 - DNA, 25 bp, Rattus norvegicus
gtgttacctgctctaagaagctggc

SEQ ID NO: 519665 - DNA, 25 bp, Rattus norvegicus
gtgttacctgctgtaagaagctggc

SEQ ID NO: 519666 - DNA, 25 bp, Rattus norvegicus
gtgttaccttcaagtctgacaactg

SEQ ID NO: 519667 - DNA, 25 bp, Rattus norvegicus
gtgttaccttcatgtctgacaactg

SEQ ID NO: 519668 - DNA, 25 bp, Rattus norvegicus
gtgttaccttctatcctgcttacta

SEQ ID NO: 519669 - DNA, 25 bp, Rattus norvegicus
gtgttaccttctttcctgcttacta

SEQ ID NO: 519670 - DNA, 25 bp, Rattus norvegicus
gtgttactacagaagcaagagccta

SEQ ID NO: 519671 - DNA, 25 bp, Rattus norvegicus
gtgttactacagtagcaagagccta

SEQ ID NO: 519672 - DNA, 25 bp, Rattus norvegicus
gtgttactatggattctgtcacaaa

SEQ ID NO: 519673 - DNA, 25 bp, Rattus norvegicus
gtgttactatggtttctgtcacaaa

SEQ ID NO: 519674 - DNA, 25 bp, Rattus norvegicus
gtgttactcactactgttctcatga

SEQ ID NO: 519675 - DNA, 25 bp, Rattus norvegicus
gtgttactcacttctgttctcatga

SEQ ID NO: 519676 - DNA, 25 bp, Rattus norvegicus
gtgttactctgtcagtagtgcccag

SEQ ID NO: 519677 - DNA, 25 bp, Rattus norvegicus
gtgttactctgtgagtagtgcccag

SEQ ID NO: 519678 - DNA, 25 bp, Rattus norvegicus
gtgttactgaacaacccagttttga

SEQ ID NO: 519679 - DNA, 25 bp, Rattus norvegicus
gtgttactgaactacccagttttga

SEQ ID NO: 519680 - DNA, 25 bp, Rattus norvegicus
gtgttactgcatatcaccaactaaa

SEQ ID NO: 519681 - DNA, 25 bp, Rattus norvegicus
gtgttactgcatttcaccaactaaa

SEQ ID NO: 519682 - DNA, 25 bp, Rattus norvegicus
gtgttactgccgctgtgctttggtc

SEQ ID NO: 519683 - DNA, 25 bp, Rattus norvegicus
gtgttactgccggtgtgctttggtc

SEQ ID NO: 519684 - DNA, 25 bp, Rattus norvegicus
gtgttactgctgaatctgagatgtt

SEQ ID NO: 519685 - DNA, 25 bp, Rattus norvegicus
gtgttactgctgtatctgagatgtt

SEQ ID NO: 519686 - DNA, 25 bp, Rattus norvegicus
gtgttactggtaaccaacctgcttt

SEQ ID NO: 519687 - DNA, 25 bp, Rattus norvegicus
gtgttactggtatccaacctgcttt

SEQ ID NO: 519688 - DNA, 25 bp, Rattus norvegicus
gtgttactgtctagtcagcacactg

SEQ ID NO: 519689 - DNA, 25 bp, Rattus norvegicus
gtgttactgtcttgtcagcacactg

SEQ ID NO: 519690 - DNA, 25 bp, Rattus norvegicus
gtgttacttcatccagagtgttact

SEQ ID NO: 519691 - DNA, 25 bp, Rattus norvegicus
gtgttacttcatgcagagtgttact

SEQ ID NO: 519692 - DNA, 25 bp, Rattus norvegicus
gtgttacttcctaagcttaccaaat

SEQ ID NO: 519693 - DNA, 25 bp, Rattus norvegicus
gtgttacttccttagcttaccaaat

SEQ ID NO: 519694 - DNA, 25 bp, Rattus norvegicus
gtgttacttctcagtttgtgactag

SEQ ID NO: 519695 - DNA, 25 bp, Rattus norvegicus
gtgttacttctctgtttgtgactag

SEQ ID NO: 519696 - DNA, 25 bp, Rattus norvegicus
gtgttacttgttcgactgcaccact

SEQ ID NO: 519697 - DNA, 25 bp, Rattus norvegicus
gtgttacttgttggactgcaccact

SEQ ID NO: 519698 - DNA, 25 bp, Rattus norvegicus
gtgttactttctacatcattttgga

SEQ ID NO: 519699 - DNA, 25 bp, Rattus norvegicus
gtgttactttcttcatcattttgga

SEQ ID NO: 519700 - DNA, 25 bp, Rattus norvegicus
gtgttagaaactacatagctctgct

SEQ ID NO: 519701 - DNA, 25 bp, Rattus norvegicus
gtgttagaaacttcatagctctgct

SEQ ID NO: 519702 - DNA, 25 bp, Rattus norvegicus
gtgttagaattacctgctctcttgc

SEQ ID NO: 519703 - DNA, 25 bp, Rattus norvegicus
gtgttagaattagctgctctcttgc

SEQ ID NO: 519704 - DNA, 25 bp, Rattus norvegicus
gtgttagaattcactcgtctgccaa

SEQ ID NO: 519705 - DNA, 25 bp, Rattus norvegicus
gtgttagaattctctcgtctgccaa

SEQ ID NO: 519706 - DNA, 25 bp, Rattus norvegicus
gtgttagacccaaaggtcctgaggt

SEQ ID NO: 519707 - DNA, 25 bp, Rattus norvegicus
gtgttagacccataggtcctgaggt

SEQ ID NO: 519708 - DNA, 25 bp, Rattus norvegicus
gtgttagaccgtcttagccctgagt

SEQ ID NO: 519709 - DNA, 25 bp, Rattus norvegicus
gtgttagaccgtgttagccctgagt

SEQ ID NO: 519710 - DNA, 25 bp, Rattus norvegicus
gtgttagaggtcaccgcagcagtcc

SEQ ID NO: 519711 - DNA, 25 bp, Rattus norvegicus
gtgttagaggtctccgcagcagtcc

SEQ ID NO: 519712 - DNA, 25 bp, Rattus norvegicus
gtgttagatcccagtagttcttttc

SEQ ID NO: 519713 - DNA, 25 bp, Rattus norvegicus
gtgttagatccctgtagttcttttc

SEQ ID NO: 519714 - DNA, 25 bp, Rattus norvegicus
gtgttagatgccctctttgttctct

SEQ ID NO: 519715 - DNA, 25 bp, Rattus norvegicus
gtgttagatgccgtctttgttctct

SEQ ID NO: 519716 - DNA, 25 bp, Rattus norvegicus
gtgttagattttccattccagggat

SEQ ID NO: 519717 - DNA, 25 bp, Rattus norvegicus
gtgttagattttgcattccagggat

SEQ ID NO: 519718 - DNA, 25 bp, Rattus norvegicus
gtgttagcacatactgatagccatc

SEQ ID NO: 519719 - DNA, 25 bp, Rattus norvegicus
gtgttagcacattctgatagccatc

SEQ ID NO: 519720 - DNA, 25 bp, Rattus norvegicus
gtgttagcagccaccggtatgagga

SEQ ID NO: 519721 - DNA, 25 bp, Rattus norvegicus
gtgttagcagcctccggtatgagga

SEQ ID NO: 519722 - DNA, 25 bp, Rattus norvegicus
gtgttagcatgccatcagtctcctt

SEQ ID NO: 519723 - DNA, 25 bp, Rattus norvegicus
gtgttagcatgcgatcagtctcctt

SEQ ID NO: 519724 - DNA, 25 bp, Rattus norvegicus
gtgttagcgcacaatcaaactgtaa

SEQ ID NO: 519725 - DNA, 25 bp, Rattus norvegicus
gtgttagcgcactatcaaactgtaa

SEQ ID NO: 519726 - DNA, 25 bp, Rattus norvegicus
gtgttagctgtgaatttaccctgta

SEQ ID NO: 519727 - DNA, 25 bp, Rattus norvegicus
gtgttagctgtgtatttaccctgta

SEQ ID NO: 519728 - DNA, 25 bp, Rattus norvegicus
gtgttagctttcagcagttacctgc

SEQ ID NO: 519729 - DNA, 25 bp, Rattus norvegicus
gtgttagctttctgcagttacctgc

SEQ ID NO: 519730 - DNA, 25 bp, Rattus norvegicus
gtgttaggcattctatccaacccat

SEQ ID NO: 519731 - DNA, 25 bp, Rattus norvegicus
gtgttaggcattgtatccaacccat

SEQ ID NO: 519732 - DNA, 25 bp, Rattus norvegicus
gtgttagtcctgactgttcacacag

SEQ ID NO: 519733 - DNA, 25 bp, Rattus norvegicus
gtgttagtcctgtctgttcacacag

SEQ ID NO: 519734 - DNA, 25 bp, Rattus norvegicus
gtgttagtctagcatcacttttgat

SEQ ID NO: 519735 - DNA, 25 bp, Rattus norvegicus
gtgttagtctaggatcacttttgat

SEQ ID NO: 519736 - DNA, 25 bp, Rattus norvegicus
gtgttagtgaacactcactgctccc

SEQ ID NO: 519737 - DNA, 25 bp, Rattus norvegicus
gtgttagtgaactctcactgctccc

SEQ ID NO: 519738 - DNA, 25 bp, Rattus norvegicus
gtgttagtgagtatggttccttcct

SEQ ID NO: 519739 - DNA, 25 bp, Rattus norvegicus
gtgttagtgagtttggttccttcct

SEQ ID NO: 519740 - DNA, 25 bp, Rattus norvegicus
gtgttagtgccacggcctcttacat

SEQ ID NO: 519741 - DNA, 25 bp, Rattus norvegicus
gtgttagtgccagggcctcttacat

SEQ ID NO: 519742 - DNA, 25 bp, Rattus norvegicus
gtgttataacctatattccctgtgt

SEQ ID NO: 519743 - DNA, 25 bp, Rattus norvegicus
gtgttataacctttattccctgtgt

SEQ ID NO: 519744 - DNA, 25 bp, Rattus norvegicus
gtgttatacttcactggagaagcta

SEQ ID NO: 519745 - DNA, 25 bp, Rattus norvegicus
gtgttatacttctctggagaagcta

SEQ ID NO: 519746 - DNA, 25 bp, Rattus norvegicus
gtgttatagccccacagtcactcga

SEQ ID NO: 519747 - DNA, 25 bp, Rattus norvegicus
gtgttatagcccgacagtcactcga

SEQ ID NO: 519748 - DNA, 25 bp, Rattus norvegicus
gtgttatagtgtaaatccttgtgca

SEQ ID NO: 519749 - DNA, 25 bp, Rattus norvegicus
gtgttatagtgttaatccttgtgca

SEQ ID NO: 519750 - DNA, 25 bp, Rattus norvegicus
gtgttatcaatgcttccagtgccac

SEQ ID NO: 519751 - DNA, 25 bp, Rattus norvegicus
gtgttatcaatggttccagtgccac

SEQ ID NO: 519752 - DNA, 25 bp, Rattus norvegicus
gtgttatcactgaataccttgagga

SEQ ID NO: 519753 - DNA, 25 bp, Rattus norvegicus
gtgttatcactgtataccttgagga

SEQ ID NO: 519754 - DNA, 25 bp, Rattus norvegicus
gtgttatcatccctgagggctgata

SEQ ID NO: 519755 - DNA, 25 bp, Rattus norvegicus
gtgttatcatccgtgagggctgata

SEQ ID NO: 519756 - DNA, 25 bp, Rattus norvegicus
gtgttatctcttaccagtcgagcat

SEQ ID NO: 519757 - DNA, 25 bp, Rattus norvegicus
gtgttatctctttccagtcgagcat

SEQ ID NO: 519758 - DNA, 25 bp, Rattus norvegicus
gtgttatctgagactgacctctcca

SEQ ID NO: 519759 - DNA, 25 bp, Rattus norvegicus
gtgttatctgagtctgacctctcca

SEQ ID NO: 519760 - DNA, 25 bp, Rattus norvegicus
gtgttatgactgatcttcactatca

SEQ ID NO: 519761 - DNA, 25 bp, Rattus norvegicus
gtgttatgactgttcttcactatca

SEQ ID NO: 519762 - DNA, 25 bp, Rattus norvegicus
gtgttatgaggacgccctttacttc

SEQ ID NO: 519763 - DNA, 25 bp, Rattus norvegicus
gtgttatgaggaggccctttacttc

SEQ ID NO: 519764 - DNA, 25 bp, Rattus norvegicus
gtgttatggccacacccagtttcat

SEQ ID NO: 519765 - DNA, 25 bp, Rattus norvegicus
gtgttatggccagacccagtttcat

SEQ ID NO: 519766 - DNA, 25 bp, Rattus norvegicus
gtgttatgtatacctcagctcagag

SEQ ID NO: 519767 - DNA, 25 bp, Rattus norvegicus
gtgttatgtatagctcagctcagag

SEQ ID NO: 519768 - DNA, 25 bp, Rattus norvegicus
gtgttatgtattctggtttttttgt

SEQ ID NO: 519769 - DNA, 25 bp, Rattus norvegicus
gtgttatgtattgtggtttttttgt

SEQ ID NO: 519770 - DNA, 25 bp, Rattus norvegicus
gtgttattcttgagacagccttgga

SEQ ID NO: 519771 - DNA, 25 bp, Rattus norvegicus
gtgttattcttgtgacagccttgga

SEQ ID NO: 519772 - DNA, 25 bp, Rattus norvegicus
gtgttattgttaactgtgctggttt

SEQ ID NO: 519773 - DNA, 25 bp, Rattus norvegicus
gtgttattgttatctgtgctggttt

SEQ ID NO: 519774 - DNA, 25 bp, Rattus norvegicus
gtgttatttactatagctgcttaaa

SEQ ID NO: 519775 - DNA, 25 bp, Rattus norvegicus
gtgttatttactttagctgcttaaa

SEQ ID NO: 519776 - DNA, 25 bp, Rattus norvegicus
gtgttatttgcgcacgtcacttcca

SEQ ID NO: 519777 - DNA, 25 bp, Rattus norvegicus
gtgttatttgcggacgtcacttcca

SEQ ID NO: 519778 - DNA, 25 bp, Rattus norvegicus
gtgttcaaaaatctcctggacttct

SEQ ID NO: 519779 - DNA, 25 bp, Rattus norvegicus
gtgttcaaaaatgtcctggacttct

SEQ ID NO: 519780 - DNA, 25 bp, Rattus norvegicus
gtgttcaaactgaccatttctgtag

SEQ ID NO: 519781 - DNA, 25 bp, Rattus norvegicus
gtgttcaaactgtccatttctgtag

SEQ ID NO: 519782 - DNA, 25 bp, Rattus norvegicus
gtgttcaacgggagcctcagtagat

SEQ ID NO: 519783 - DNA, 25 bp, Rattus norvegicus
gtgttcaacgggtgcctcagtagat

SEQ ID NO: 519784 - DNA, 25 bp, Rattus norvegicus
gtgttcaactctcctaataaacttc

SEQ ID NO: 519785 - DNA, 25 bp, Rattus norvegicus
gtgttcaactctgctaataaacttc

SEQ ID NO: 519786 - DNA, 25 bp, Rattus norvegicus
gtgttcaagcccagatgcctgctcc

SEQ ID NO: 519787 - DNA, 25 bp, Rattus norvegicus
gtgttcaagccctgatgcctgctcc

SEQ ID NO: 519788 - DNA, 25 bp, Rattus norvegicus
gtgttcaagttcagctttgctgttt

SEQ ID NO: 519789 - DNA, 25 bp, Rattus norvegicus
gtgttcaagttctgctttgctgttt

SEQ ID NO: 519790 - DNA, 25 bp, Rattus norvegicus
gtgttcaatacacgatcatctcgag

SEQ ID NO: 519791 - DNA, 25 bp, Rattus norvegicus
gtgttcaatacaggatcatctcgag

SEQ ID NO: 519792 - DNA, 25 bp, Rattus norvegicus
gtgttcaatccacactcagtagtat

SEQ ID NO: 519793 - DNA, 25 bp, Rattus norvegicus
gtgttcaatccagactcagtagtat

SEQ ID NO: 519794 - DNA, 25 bp, Rattus norvegicus
gtgttcaatcccattttagagcgtg

SEQ ID NO: 519795 - DNA, 25 bp, Rattus norvegicus
gtgttcaatccctttttagagcgtg

SEQ ID NO: 519796 - DNA, 25 bp, Rattus norvegicus
gtgttcaatgccagtgctcaattca

SEQ ID NO: 519797 - DNA, 25 bp, Rattus norvegicus
gtgttcaatgcctgtgctcaattca

SEQ ID NO: 519798 - DNA, 25 bp, Rattus norvegicus
gtgttcaattttaacatcctctgat

SEQ ID NO: 519799 - DNA, 25 bp, Rattus norvegicus
gtgttcaatttttacatcctctgat

SEQ ID NO: 519800 - DNA, 25 bp, Rattus norvegicus
gtgttcacaacgacagcaatcaagt

SEQ ID NO: 519801 - DNA, 25 bp, Rattus norvegicus
gtgttcacaacgtcagcaatcaagt

SEQ ID NO: 519802 - DNA, 25 bp, Rattus norvegicus
gtgttcacacgcacaaaccgtggta

SEQ ID NO: 519803 - DNA, 25 bp, Rattus norvegicus
gtgttcacacgcagattcctgatca

SEQ ID NO: 519804 - DNA, 25 bp, Rattus norvegicus
gtgttcacacgctcaaaccgtggta

SEQ ID NO: 519805 - DNA, 25 bp, Rattus norvegicus
gtgttcacacgctgattcctgatca

SEQ ID NO: 519806 - DNA, 25 bp, Rattus norvegicus
gtgttcacagacctgctgttgctgg

SEQ ID NO: 519807 - DNA, 25 bp, Rattus norvegicus
gtgttcacagacgtgctgttgctgg

SEQ ID NO: 519808 - DNA, 25 bp, Rattus norvegicus
gtgttcacaggtactgcgttacaac

SEQ ID NO: 519809 - DNA, 25 bp, Rattus norvegicus
gtgttcacaggttctgcgttacaac

SEQ ID NO: 519810 - DNA, 25 bp, Rattus norvegicus
gtgttcacatctcagttactgtaca

SEQ ID NO: 519811 - DNA, 25 bp, Rattus norvegicus
gtgttcacatctctcttgatgccta

SEQ ID NO: 519812 - DNA, 25 bp, Rattus norvegicus
gtgttcacatctgagttactgtaca

SEQ ID NO: 519813 - DNA, 25 bp, Rattus norvegicus
gtgttcacatctgtcttgatgccta

SEQ ID NO: 519814 - DNA, 25 bp, Rattus norvegicus
gtgttcacatgccagcaggcacagt

SEQ ID NO: 519815 - DNA, 25 bp, Rattus norvegicus
gtgttcacatgcgagcaggcacagt

SEQ ID NO: 519816 - DNA, 25 bp, Rattus norvegicus
gtgttcacatgtcttacctggttga

SEQ ID NO: 519817 - DNA, 25 bp, Rattus norvegicus
gtgttcacatgtgttacctggttga

SEQ ID NO: 519818 - DNA, 25 bp, Rattus norvegicus
gtgttcaccaataacgtagccgact

SEQ ID NO: 519819 - DNA, 25 bp, Rattus norvegicus
gtgttcaccaattacgtagccgact

SEQ ID NO: 519820 - DNA, 25 bp, Rattus norvegicus
gtgttcaccatcagtcttggttata

SEQ ID NO: 519821 - DNA, 25 bp, Rattus norvegicus
gtgttcaccatctgtcttggttata

SEQ ID NO: 519822 - DNA, 25 bp, Rattus norvegicus
gtgttcacctcaccgtagtccagag

SEQ ID NO: 519823 - DNA, 25 bp, Rattus norvegicus
gtgttcacctcagcgtagtccagag

SEQ ID NO: 519824 - DNA, 25 bp, Rattus norvegicus
gtgttcaccttgagtttttgcttga

SEQ ID NO: 519825 - DNA, 25 bp, Rattus norvegicus
gtgttcaccttgtgtttttgcttga

SEQ ID NO: 519826 - DNA, 25 bp, Rattus norvegicus
gtgttcacctttcccactgtataaa

SEQ ID NO: 519827 - DNA, 25 bp, Rattus norvegicus
gtgttcacctttctcttaaaataat

SEQ ID NO: 519828 - DNA, 25 bp, Rattus norvegicus
gtgttcacctttgccactgtataaa

SEQ ID NO: 519829 - DNA, 25 bp, Rattus norvegicus
gtgttcacctttgtcttaaaataat

SEQ ID NO: 519830 - DNA, 25 bp, Rattus norvegicus
gtgttcactcatatattccttttgg

SEQ ID NO: 519831 - DNA, 25 bp, Rattus norvegicus
gtgttcactcatttattccttttgg

SEQ ID NO: 519832 - DNA, 25 bp, Rattus norvegicus
gtgttcactcttatgagggcattat

SEQ ID NO: 519833 - DNA, 25 bp, Rattus norvegicus
gtgttcactcttttgagggcattat

SEQ ID NO: 519834 - DNA, 25 bp, Rattus norvegicus
gtgttcactgtaatcatttcatggc

SEQ ID NO: 519835 - DNA, 25 bp, Rattus norvegicus
gtgttcactgtattcatttcatggc

SEQ ID NO: 519836 - DNA, 25 bp, Rattus norvegicus
gtgttcacttagagcactgccaaaa

SEQ ID NO: 519837 - DNA, 25 bp, Rattus norvegicus
gtgttcacttagtgcactgccaaaa

SEQ ID NO: 519838 - DNA, 25 bp, Rattus norvegicus
gtgttcactttcagatttgttgggt

SEQ ID NO: 519839 - DNA, 25 bp, Rattus norvegicus
gtgttcactttctgatttgttgggt

SEQ ID NO: 519840 - DNA, 25 bp, Rattus norvegicus
gtgttcagaacaacaagcttgtagc

SEQ ID NO: 519841 - DNA, 25 bp, Rattus norvegicus
gtgttcagaacaccacgtgggacta

SEQ ID NO: 519842 - DNA, 25 bp, Rattus norvegicus
gtgttcagaacagcacgtgggacta

SEQ ID NO: 519843 - DNA, 25 bp, Rattus norvegicus
gtgttcagaacatcaagcttgtagc

SEQ ID NO: 519844 - DNA, 25 bp, Rattus norvegicus
gtgttcagacgtcggctattccatg

SEQ ID NO: 519845 - DNA, 25 bp, Rattus norvegicus
gtgttcagacgtgggctattccatg

SEQ ID NO: 519846 - DNA, 25 bp, Rattus norvegicus
gtgttcagcaaactgcgcttctgca

SEQ ID NO: 519847 - DNA, 25 bp, Rattus norvegicus
gtgttcagcaaagtgcgcttctgca

SEQ ID NO: 519848 - DNA, 25 bp, Rattus norvegicus
gtgttcagcacacttccttccgagt

SEQ ID NO: 519849 - DNA, 25 bp, Rattus norvegicus
gtgttcagcacacttgccattgtgg

SEQ ID NO: 519850 - DNA, 25 bp, Rattus norvegicus
gtgttcagcacagttccttccgagt

SEQ ID NO: 519851 - DNA, 25 bp, Rattus norvegicus
gtgttcagcacagttgccattgtgg

SEQ ID NO: 519852 - DNA, 25 bp, Rattus norvegicus
gtgttcaggatgaagcagcctccta

SEQ ID NO: 519853 - DNA, 25 bp, Rattus norvegicus
gtgttcaggatgtagcagcctccta

SEQ ID NO: 519854 - DNA, 25 bp, Rattus norvegicus
gtgttcagggagacaatggtcttca

SEQ ID NO: 519855 - DNA, 25 bp, Rattus norvegicus
gtgttcagggagtcaatggtcttca

SEQ ID NO: 519856 - DNA, 25 bp, Rattus norvegicus
gtgttcagggctactctgtgttcca

SEQ ID NO: 519857 - DNA, 25 bp, Rattus norvegicus
gtgttcagggcttctctgtgttcca

SEQ ID NO: 519858 - DNA, 25 bp, Rattus norvegicus
gtgttcagtcagaagcaaacccact

SEQ ID NO: 519859 - DNA, 25 bp, Rattus norvegicus
gtgttcagtcagtagcaaacccact

SEQ ID NO: 519860 - DNA, 25 bp, Rattus norvegicus
gtgttcagtcccaaaccttaaatca

SEQ ID NO: 519861 - DNA, 25 bp, Rattus norvegicus
gtgttcagtccctaaccttaaatca

SEQ ID NO: 519862 - DNA, 25 bp, Rattus norvegicus
gtgttcatatgcaaaccaacttttg

SEQ ID NO: 519863 - DNA, 25 bp, Rattus norvegicus
gtgttcatatgctaaccaacttttg

SEQ ID NO: 519864 - DNA, 25 bp, Rattus norvegicus
gtgttcatatggatgtgtcttccct

SEQ ID NO: 519865 - DNA, 25 bp, Rattus norvegicus
gtgttcatatggttgtgtcttccct

SEQ ID NO: 519866 - DNA, 25 bp, Rattus norvegicus
gtgttcatatgtctttcctcttcca

SEQ ID NO: 519867 - DNA, 25 bp, Rattus norvegicus
gtgttcatatgtgtttcctcttcca

SEQ ID NO: 519868 - DNA, 25 bp, Rattus norvegicus
gtgttcatcaagctgcagactctca

SEQ ID NO: 519869 - DNA, 25 bp, Rattus norvegicus
gtgttcatcaaggtgcagactctca

SEQ ID NO: 519870 - DNA, 25 bp, Rattus norvegicus
gtgttcatcagtacaactattcaag

SEQ ID NO: 519871 - DNA, 25 bp, Rattus norvegicus
gtgttcatcagtctggaacccataa

SEQ ID NO: 519872 - DNA, 25 bp, Rattus norvegicus
gtgttcatcagtgtggaacccataa

SEQ ID NO: 519873 - DNA, 25 bp, Rattus norvegicus
gtgttcatcagttcaactattcaag

SEQ ID NO: 519874 - DNA, 25 bp, Rattus norvegicus
gtgttcatccagattctacattgct

SEQ ID NO: 519875 - DNA, 25 bp, Rattus norvegicus
gtgttcatccagtttctacattgct

SEQ ID NO: 519876 - DNA, 25 bp, Rattus norvegicus
gtgttcatctacatcatcgtgtctc

SEQ ID NO: 519877 - DNA, 25 bp, Rattus norvegicus
gtgttcatctacttcatcgtgtctc

SEQ ID NO: 519878 - DNA, 25 bp, Rattus norvegicus
gtgttcatctggattatgtcacatg

SEQ ID NO: 519879 - DNA, 25 bp, Rattus norvegicus
gtgttcatctggtttatgtcacatg

SEQ ID NO: 519880 - DNA, 25 bp, Rattus norvegicus
gtgttcatcttcattattttgcatg

SEQ ID NO: 519881 - DNA, 25 bp, Rattus norvegicus
gtgttcatcttctttattttgcatg

SEQ ID NO: 519882 - DNA, 25 bp, Rattus norvegicus
gtgttcatcttgactgttctcccca

SEQ ID NO: 519883 - DNA, 25 bp, Rattus norvegicus
gtgttcatcttgtctgttctcccca

SEQ ID NO: 519884 - DNA, 25 bp, Rattus norvegicus
gtgttcatgaagaaacccttggtta

SEQ ID NO: 519885 - DNA, 25 bp, Rattus norvegicus
gtgttcatgaagtaacccttggtta

SEQ ID NO: 519886 - DNA, 25 bp, Rattus norvegicus
gtgttcatgattcacatgcgccgtg

SEQ ID NO: 519887 - DNA, 25 bp, Rattus norvegicus
gtgttcatgattgacatgcgccgtg

SEQ ID NO: 519888 - DNA, 25 bp, Rattus norvegicus
gtgttcatgcttattgtacccatct

SEQ ID NO: 519889 - DNA, 25 bp, Rattus norvegicus
gtgttcatgctttttgtacccatct

SEQ ID NO: 519890 - DNA, 25 bp, Rattus norvegicus
gtgttcatggaaaggactctgttag

SEQ ID NO: 519891 - DNA, 25 bp, Rattus norvegicus
gtgttcatggaatggactctgttag

SEQ ID NO: 519892 - DNA, 25 bp, Rattus norvegicus
gtgttcatgtcactcttcaaagtgc

SEQ ID NO: 519893 - DNA, 25 bp, Rattus norvegicus
gtgttcatgtcagtcttcaaagtgc

SEQ ID NO: 519894 - DNA, 25 bp, Rattus norvegicus
gtgttcatgtgtactcagcacccaa

SEQ ID NO: 519895 - DNA, 25 bp, Rattus norvegicus
gtgttcatgtgttctcagcacccaa

SEQ ID NO: 519896 - DNA, 25 bp, Rattus norvegicus
gtgttcattcttatattgtccattg

SEQ ID NO: 519897 - DNA, 25 bp, Rattus norvegicus
gtgttcattcttttattgtccattg

SEQ ID NO: 519898 - DNA, 25 bp, Rattus norvegicus
gtgttcatttctatctgttcttgac

SEQ ID NO: 519899 - DNA, 25 bp, Rattus norvegicus
gtgttcatttctttctgttcttgac

SEQ ID NO: 519900 - DNA, 25 bp, Rattus norvegicus
gtgttcatttttaacccagtcttag

SEQ ID NO: 519901 - DNA, 25 bp, Rattus norvegicus
gtgttcattttttacccagtcttag

SEQ ID NO: 519902 - DNA, 25 bp, Rattus norvegicus
gtgttccaaacacggactacccgca

SEQ ID NO: 519903 - DNA, 25 bp, Rattus norvegicus
gtgttccaaacagggactacccgca

SEQ ID NO: 519904 - DNA, 25 bp, Rattus norvegicus
gtgttccaaagtcatcgttcggttc

SEQ ID NO: 519905 - DNA, 25 bp, Rattus norvegicus
gtgttccaaagtgatcgttcggttc

SEQ ID NO: 519906 - DNA, 25 bp, Rattus norvegicus
gtgttccaatcactagcctcacagt

SEQ ID NO: 519907 - DNA, 25 bp, Rattus norvegicus
gtgttccaatcagtagcctcacagt

SEQ ID NO: 519908 - DNA, 25 bp, Rattus norvegicus
gtgttccacacaaacagctgtgtta

SEQ ID NO: 519909 - DNA, 25 bp, Rattus norvegicus
gtgttccacacatacagctgtgtta

SEQ ID NO: 519910 - DNA, 25 bp, Rattus norvegicus
gtgttccacagaaggccattagaat

SEQ ID NO: 519911 - DNA, 25 bp, Rattus norvegicus
gtgttccacagatggccattagaat

SEQ ID NO: 519912 - DNA, 25 bp, Rattus norvegicus
gtgttccacagtaggccgttggcca

SEQ ID NO: 519913 - DNA, 25 bp, Rattus norvegicus
gtgttccacagttggccgttggcca

SEQ ID NO: 519914 - DNA, 25 bp, Rattus norvegicus
gtgttccacatcatatttactctcc

SEQ ID NO: 519915 - DNA, 25 bp, Rattus norvegicus
gtgttccacatcttatttactctcc

SEQ ID NO: 519916 - DNA, 25 bp, Rattus norvegicus
gtgttccacggcactactatgcaaa

SEQ ID NO: 519917 - DNA, 25 bp, Rattus norvegicus
gtgttccacggctctactatgcaaa

SEQ ID NO: 519918 - DNA, 25 bp, Rattus norvegicus
gtgttccactttaagctcataggtt

SEQ ID NO: 519919 - DNA, 25 bp, Rattus norvegicus
gtgttccacttttagctcataggtt

SEQ ID NO: 519920 - DNA, 25 bp, Rattus norvegicus
gtgttccagatactcagtgggaaat

SEQ ID NO: 519921 - DNA, 25 bp, Rattus norvegicus
gtgttccagatagtcagtgggaaat

SEQ ID NO: 519922 - DNA, 25 bp, Rattus norvegicus
gtgttccagcctagtggtcacaaat

SEQ ID NO: 519923 - DNA, 25 bp, Rattus norvegicus
gtgttccagccttgtggtcacaaat

SEQ ID NO: 519924 - DNA, 25 bp, Rattus norvegicus
gtgttccaggttctttattgacttc

SEQ ID NO: 519925 - DNA, 25 bp, Rattus norvegicus
gtgttccaggttgtttattgacttc

SEQ ID NO: 519926 - DNA, 25 bp, Rattus norvegicus
gtgttccataagaccttgtctcaaa

SEQ ID NO: 519927 - DNA, 25 bp, Rattus norvegicus
gtgttccataagtccttgtctcaaa

SEQ ID NO: 519928 - DNA, 25 bp, Rattus norvegicus
gtgttccatagtaggtggcttccca

SEQ ID NO: 519929 - DNA, 25 bp, Rattus norvegicus
gtgttccatagttggtggcttccca

SEQ ID NO: 519930 - DNA, 25 bp, Rattus norvegicus
gtgttccatctgcacttacaatagg

SEQ ID NO: 519931 - DNA, 25 bp, Rattus norvegicus
gtgttccatctggacttacaatagg

SEQ ID NO: 519932 - DNA, 25 bp, Rattus norvegicus
gtgttccattcaaggctgagcatct

SEQ ID NO: 519933 - DNA, 25 bp, Rattus norvegicus
gtgttccattcatggctgagcatct

SEQ ID NO: 519934 - DNA, 25 bp, Rattus norvegicus
gtgttccattgcatgtggttcctaa

SEQ ID NO: 519935 - DNA, 25 bp, Rattus norvegicus
gtgttccattgcttgtggttcctaa

SEQ ID NO: 519936 - DNA, 25 bp, Rattus norvegicus
gtgttcccaactaccttggtgagta

SEQ ID NO: 519937 - DNA, 25 bp, Rattus norvegicus
gtgttcccaacttccttggtgagta

SEQ ID NO: 519938 - DNA, 25 bp, Rattus norvegicus
gtgttcccaatcatgccagggagtc

SEQ ID NO: 519939 - DNA, 25 bp, Rattus norvegicus
gtgttcccaatcttgccagggagtc

SEQ ID NO: 519940 - DNA, 25 bp, Rattus norvegicus
gtgttcccacccagtaaagttacag

SEQ ID NO: 519941 - DNA, 25 bp, Rattus norvegicus
gtgttcccaccctgtaaagttacag

SEQ ID NO: 519942 - DNA, 25 bp, Rattus norvegicus
gtgttcccacctcaaaatggtgttt

SEQ ID NO: 519943 - DNA, 25 bp, Rattus norvegicus
gtgttcccacctgaaaatggtgttt

SEQ ID NO: 519944 - DNA, 25 bp, Rattus norvegicus
gtgttcccagctatcctgaatgcag

SEQ ID NO: 519945 - DNA, 25 bp, Rattus norvegicus
gtgttcccagctttcctgaatgcag

SEQ ID NO: 519946 - DNA, 25 bp, Rattus norvegicus
gtgttcccaggtcagacgtctggat

SEQ ID NO: 519947 - DNA, 25 bp, Rattus norvegicus
gtgttcccaggtgagacgtctggat

SEQ ID NO: 519948 - DNA, 25 bp, Rattus norvegicus
gtgttccccatccagaacatctaca

SEQ ID NO: 519949 - DNA, 25 bp, Rattus norvegicus
gtgttccccatcgagaacatctaca

SEQ ID NO: 519950 - DNA, 25 bp, Rattus norvegicus
gtgttccccgtaccggtaggcaatg

SEQ ID NO: 519951 - DNA, 25 bp, Rattus norvegicus
gtgttccccgtagcggtaggcaatg

SEQ ID NO: 519952 - DNA, 25 bp, Rattus norvegicus
gtgttccccttcctgtttatgaaca

SEQ ID NO: 519953 - DNA, 25 bp, Rattus norvegicus
gtgttccccttcgtgtttatgaaca

SEQ ID NO: 519954 - DNA, 25 bp, Rattus norvegicus
gtgttcccgataactatgtactgtg

SEQ ID NO: 519955 - DNA, 25 bp, Rattus norvegicus
gtgttcccgatatctatgtactgtg

SEQ ID NO: 519956 - DNA, 25 bp, Rattus norvegicus
gtgttcccgtgaaggaactcctcgg

SEQ ID NO: 519957 - DNA, 25 bp, Rattus norvegicus
gtgttcccgtgatggaactcctcgg

SEQ ID NO: 519958 - DNA, 25 bp, Rattus norvegicus
gtgttcccgtgcaatttctagtgaa

SEQ ID NO: 519959 - DNA, 25 bp, Rattus norvegicus
gtgttcccgtgctatttctagtgaa

SEQ ID NO: 519960 - DNA, 25 bp, Rattus norvegicus
gtgttcccttcactgtgaccagatt

SEQ ID NO: 519961 - DNA, 25 bp, Rattus norvegicus
gtgttcccttcagtgtgaccagatt

SEQ ID NO: 519962 - DNA, 25 bp, Rattus norvegicus
gtgttccgaggacaactggcttcta

SEQ ID NO: 519963 - DNA, 25 bp, Rattus norvegicus
gtgttccgaggagaactggcttcta

SEQ ID NO: 519964 - DNA, 25 bp, Rattus norvegicus
gtgttccgtgtactctgagctagct

SEQ ID NO: 519965 - DNA, 25 bp, Rattus norvegicus
gtgttccgtgtagtctgagctagct

SEQ ID NO: 519966 - DNA, 25 bp, Rattus norvegicus
gtgttcctaaccctacctgacctga

SEQ ID NO: 519967 - DNA, 25 bp, Rattus norvegicus
gtgttcctaaccgtacctgacctga

SEQ ID NO: 519968 - DNA, 25 bp, Rattus norvegicus
gtgttcctaacgaactatgtgtaag

SEQ ID NO: 519969 - DNA, 25 bp, Rattus norvegicus
gtgttcctaacgtactatgtgtaag

SEQ ID NO: 519970 - DNA, 25 bp, Rattus norvegicus
gtgttcctacagagagggccagcta

SEQ ID NO: 519971 - DNA, 25 bp, Rattus norvegicus
gtgttcctacagtgagggccagcta

SEQ ID NO: 519972 - DNA, 25 bp, Rattus norvegicus
gtgttcctatttatcataatcctgg

SEQ ID NO: 519973 - DNA, 25 bp, Rattus norvegicus
gtgttcctatttttcataatcctgg

SEQ ID NO: 519974 - DNA, 25 bp, Rattus norvegicus
gtgttcctcaccaggccaagcagac

SEQ ID NO: 519975 - DNA, 25 bp, Rattus norvegicus
gtgttcctcaccatatgaatgtcaa

SEQ ID NO: 519976 - DNA, 25 bp, Rattus norvegicus
gtgttcctcacctggccaagcagac

SEQ ID NO: 519977 - DNA, 25 bp, Rattus norvegicus
gtgttcctcaccttatgaatgtcaa

SEQ ID NO: 519978 - DNA, 25 bp, Rattus norvegicus
gtgttcctcccaaccctgggagtag

SEQ ID NO: 519979 - DNA, 25 bp, Rattus norvegicus
gtgttcctcccatccctgggagtag

SEQ ID NO: 519980 - DNA, 25 bp, Rattus norvegicus
gtgttcctctaaattgtgtctctct

SEQ ID NO: 519981 - DNA, 25 bp, Rattus norvegicus
gtgttcctctaatttgtgtctctct

SEQ ID NO: 519982 - DNA, 25 bp, Rattus norvegicus
gtgttcctctcacaaggctcggcct

SEQ ID NO: 519983 - DNA, 25 bp, Rattus norvegicus
gtgttcctctcagaaggctcggcct

SEQ ID NO: 519984 - DNA, 25 bp, Rattus norvegicus
gtgttcctctctcttttggttaaga

SEQ ID NO: 519985 - DNA, 25 bp, Rattus norvegicus
gtgttcctctctgttttggttaaga

SEQ ID NO: 519986 - DNA, 25 bp, Rattus norvegicus
gtgttcctctttcagtctagttttg

SEQ ID NO: 519987 - DNA, 25 bp, Rattus norvegicus
gtgttcctctttgagtctagttttg

SEQ ID NO: 519988 - DNA, 25 bp, Rattus norvegicus
gtgttcctgaccacgctgtgcatgg

SEQ ID NO: 519989 - DNA, 25 bp, Rattus norvegicus
gtgttcctgacctcgctgtgcatgg

SEQ ID NO: 519990 - DNA, 25 bp, Rattus norvegicus
gtgttcctgcagagggccgagtccc

SEQ ID NO: 519991 - DNA, 25 bp, Rattus norvegicus
gtgttcctgcagtgggccgagtccc

SEQ ID NO: 519992 - DNA, 25 bp, Rattus norvegicus
gtgttcctgcccacatacatacatg

SEQ ID NO: 519993 - DNA, 25 bp, Rattus norvegicus
gtgttcctgccctcatacatacatg

SEQ ID NO: 519994 - DNA, 25 bp, Rattus norvegicus
gtgttccttcacatgcaagtgttga

SEQ ID NO: 519995 - DNA, 25 bp, Rattus norvegicus
gtgttccttcacttgcaagtgttga

SEQ ID NO: 519996 - DNA, 25 bp, Rattus norvegicus
gtgttccttctaacgattgcactat

SEQ ID NO: 519997 - DNA, 25 bp, Rattus norvegicus
gtgttccttctatcgattgcactat

SEQ ID NO: 519998 - DNA, 25 bp, Rattus norvegicus
gtgttccttcttatgtgttgtgtat

SEQ ID NO: 519999 - DNA, 25 bp, Rattus norvegicus
gtgttccttcttcactatgtttgac

SEQ ID NO: 520000 - DNA, 25 bp, Rattus norvegicus
gtgttccttcttcccaatcaagtgg

SEQ ID NO: 520001 - DNA, 25 bp, Rattus norvegicus
gtgttccttcttgactatgtttgac

SEQ ID NO: 520002 - DNA, 25 bp, Rattus norvegicus
gtgttccttcttgccaatcaagtgg

SEQ ID NO: 520003 - DNA, 25 bp, Rattus norvegicus
gtgttccttcttttgtgttgtgtat

SEQ ID NO: 520004 - DNA, 25 bp, Rattus norvegicus
gtgttccttgttcccaagagcaaga

SEQ ID NO: 520005 - DNA, 25 bp, Rattus norvegicus
gtgttccttgttgccaagagcaaga

SEQ ID NO: 520006 - DNA, 25 bp, Rattus norvegicus
gtgttcctttgtagaagacagggtt

SEQ ID NO: 520007 - DNA, 25 bp, Rattus norvegicus
gtgttcctttgttgaagacagggtt

SEQ ID NO: 520008 - DNA, 25 bp, Rattus norvegicus
gtgttcctttttccagttggtcata

SEQ ID NO: 520009 - DNA, 25 bp, Rattus norvegicus
gtgttcctttttgcagttggtcata

SEQ ID NO: 520010 - DNA, 25 bp, Rattus norvegicus
gtgttcgagcaaagaacccgtctga

SEQ ID NO: 520011 - DNA, 25 bp, Rattus norvegicus
gtgttcgagcaatgaacccgtctga

SEQ ID NO: 520012 - DNA, 25 bp, Rattus norvegicus
gtgttcgagcttatgcagatgccat

SEQ ID NO: 520013 - DNA, 25 bp, Rattus norvegicus
gtgttcgagcttttgcagatgccat

SEQ ID NO: 520014 - DNA, 25 bp, Rattus norvegicus
gtgttcgatcgacagaggttgcaat

SEQ ID NO: 520015 - DNA, 25 bp, Rattus norvegicus
gtgttcgatcgagagaggttgcaat

SEQ ID NO: 520016 - DNA, 25 bp, Rattus norvegicus
gtgttcgatgggaagcctcagcaca

SEQ ID NO: 520017 - DNA, 25 bp, Rattus norvegicus
gtgttcgatgggtagcctcagcaca

SEQ ID NO: 520018 - DNA, 25 bp, Rattus norvegicus
gtgttcgctacaagctccagatata

SEQ ID NO: 520019 - DNA, 25 bp, Rattus norvegicus
gtgttcgctacatgctccagatata

SEQ ID NO: 520020 - DNA, 25 bp, Rattus norvegicus
gtgttcgctctcagggatttgttac

SEQ ID NO: 520021 - DNA, 25 bp, Rattus norvegicus
gtgttcgctctctgggatttgttac

SEQ ID NO: 520022 - DNA, 25 bp, Rattus norvegicus
gtgttcgctggtatttgattggttt

SEQ ID NO: 520023 - DNA, 25 bp, Rattus norvegicus
gtgttcgctggtttttgattggttt

SEQ ID NO: 520024 - DNA, 25 bp, Rattus norvegicus
gtgttcggccctcctgtagatgatc

SEQ ID NO: 520025 - DNA, 25 bp, Rattus norvegicus
gtgttcggccctgctgtagatgatc

SEQ ID NO: 520026 - DNA, 25 bp, Rattus norvegicus
gtgttcggctcaactgtagtgtata

SEQ ID NO: 520027 - DNA, 25 bp, Rattus norvegicus
gtgttcggctcatctgtagtgtata

SEQ ID NO: 520028 - DNA, 25 bp, Rattus norvegicus
gtgttcgtaagcatgtctggtttat

SEQ ID NO: 520029 - DNA, 25 bp, Rattus norvegicus
gtgttcgtaagcttgtctggtttat

SEQ ID NO: 520030 - DNA, 25 bp, Rattus norvegicus
gtgttcgtactcaactgggcagagc

SEQ ID NO: 520031 - DNA, 25 bp, Rattus norvegicus
gtgttcgtactctactgggcagagc

SEQ ID NO: 520032 - DNA, 25 bp, Rattus norvegicus
gtgttcgtattcaacttccaagggt

SEQ ID NO: 520033 - DNA, 25 bp, Rattus norvegicus
gtgttcgtattctacttccaagggt

SEQ ID NO: 520034 - DNA, 25 bp, Rattus norvegicus
gtgttcgtcagcctgatgctgtaca

SEQ ID NO: 520035 - DNA, 25 bp, Rattus norvegicus
gtgttcgtcagcgtgatgctgtaca

SEQ ID NO: 520036 - DNA, 25 bp, Rattus norvegicus
gtgttcgtgatactgctcttaatta

SEQ ID NO: 520037 - DNA, 25 bp, Rattus norvegicus
gtgttcgtgatagtgctcttaatta

SEQ ID NO: 520038 - DNA, 25 bp, Rattus norvegicus
gtgttcgtgtggaatctagaccctt

SEQ ID NO: 520039 - DNA, 25 bp, Rattus norvegicus
gtgttcgtgtggtatctagaccctt

SEQ ID NO: 520040 - DNA, 25 bp, Rattus norvegicus
gtgttcgttccacagctgtttgaaa

SEQ ID NO: 520041 - DNA, 25 bp, Rattus norvegicus
gtgttcgttccagagctgtttgaaa

SEQ ID NO: 520042 - DNA, 25 bp, Rattus norvegicus
gtgttcgttttacattcttctgtca

SEQ ID NO: 520043 - DNA, 25 bp, Rattus norvegicus
gtgttcgttttagattcttctgtca

SEQ ID NO: 520044 - DNA, 25 bp, Rattus norvegicus
gtgttctaacttctgacaggcagat

SEQ ID NO: 520045 - DNA, 25 bp, Rattus norvegicus
gtgttctaacttgtgacaggcagat

SEQ ID NO: 520046 - DNA, 25 bp, Rattus norvegicus
gtgttctaaggccatgtttcctcaa

SEQ ID NO: 520047 - DNA, 25 bp, Rattus norvegicus
gtgttctaaggcgatgtttcctcaa

SEQ ID NO: 520048 - DNA, 25 bp, Rattus norvegicus
gtgttctaatgcagactccacaggt

SEQ ID NO: 520049 - DNA, 25 bp, Rattus norvegicus
gtgttctaatgctgactccacaggt

SEQ ID NO: 520050 - DNA, 25 bp, Rattus norvegicus
gtgttctaatggagtggcccagcta

SEQ ID NO: 520051 - DNA, 25 bp, Rattus norvegicus
gtgttctaatggtgtggcccagcta

SEQ ID NO: 520052 - DNA, 25 bp, Rattus norvegicus
gtgttctaattcaaactgtaaacca

SEQ ID NO: 520053 - DNA, 25 bp, Rattus norvegicus
gtgttctaattcactgatgttacta

SEQ ID NO: 520054 - DNA, 25 bp, Rattus norvegicus
gtgttctaattctaactgtaaacca

SEQ ID NO: 520055 - DNA, 25 bp, Rattus norvegicus
gtgttctaattctctgatgttacta

SEQ ID NO: 520056 - DNA, 25 bp, Rattus norvegicus
gtgttctacaagacagcctaaagct

SEQ ID NO: 520057 - DNA, 25 bp, Rattus norvegicus
gtgttctacaagtcagcctaaagct

SEQ ID NO: 520058 - DNA, 25 bp, Rattus norvegicus
gtgttctacacacgatcaggtctca

SEQ ID NO: 520059 - DNA, 25 bp, Rattus norvegicus
gtgttctacacaggatcaggtctca

SEQ ID NO: 520060 - DNA, 25 bp, Rattus norvegicus
gtgttctacagacacttgcagtctt

SEQ ID NO: 520061 - DNA, 25 bp, Rattus norvegicus
gtgttctacagagacttgcagtctt

SEQ ID NO: 520062 - DNA, 25 bp, Rattus norvegicus
gtgttctactctatatccacagtga

SEQ ID NO: 520063 - DNA, 25 bp, Rattus norvegicus
gtgttctactctcaaccaggcattc

SEQ ID NO: 520064 - DNA, 25 bp, Rattus norvegicus
gtgttctactctcttctatgtggga

SEQ ID NO: 520065 - DNA, 25 bp, Rattus norvegicus
gtgttctactctgaaccaggcattc

SEQ ID NO: 520066 - DNA, 25 bp, Rattus norvegicus
gtgttctactctgttctatgtggga

SEQ ID NO: 520067 - DNA, 25 bp, Rattus norvegicus
gtgttctactctttatccacagtga

SEQ ID NO: 520068 - DNA, 25 bp, Rattus norvegicus
gtgttctactgcaggctagattcta

SEQ ID NO: 520069 - DNA, 25 bp, Rattus norvegicus
gtgttctactgctggctagattcta

SEQ ID NO: 520070 - DNA, 25 bp, Rattus norvegicus
gtgttctactttaggtgactgcagt

SEQ ID NO: 520071 - DNA, 25 bp, Rattus norvegicus
gtgttctacttttggtgactgcagt

SEQ ID NO: 520072 - DNA, 25 bp, Rattus norvegicus
gtgttctagaaacccatcattgctg

SEQ ID NO: 520073 - DNA, 25 bp, Rattus norvegicus
gtgttctagaaagccatcattgctg

SEQ ID NO: 520074 - DNA, 25 bp, Rattus norvegicus
gtgttctagctgattgcatcaaagg

SEQ ID NO: 520075 - DNA, 25 bp, Rattus norvegicus
gtgttctagctgtttgcatcaaagg

SEQ ID NO: 520076 - DNA, 25 bp, Rattus norvegicus
gtgttctatctactgatgcctggaa

SEQ ID NO: 520077 - DNA, 25 bp, Rattus norvegicus
gtgttctatctagtgatgcctggaa

SEQ ID NO: 520078 - DNA, 25 bp, Rattus norvegicus
gtgttctatgacagagcaacctcct

SEQ ID NO: 520079 - DNA, 25 bp, Rattus norvegicus
gtgttctatgactgagcaacctcct

SEQ ID NO: 520080 - DNA, 25 bp, Rattus norvegicus
gtgttctatttaacttacttgctaa

SEQ ID NO: 520081 - DNA, 25 bp, Rattus norvegicus
gtgttctatttatcttacttgctaa

SEQ ID NO: 520082 - DNA, 25 bp, Rattus norvegicus
gtgttctattttacctttagccctg

SEQ ID NO: 520083 - DNA, 25 bp, Rattus norvegicus
gtgttctatttttcctttagccctg

SEQ ID NO: 520084 - DNA, 25 bp, Rattus norvegicus
gtgttctcaatgaagttcatcttgt

SEQ ID NO: 520085 - DNA, 25 bp, Rattus norvegicus
gtgttctcaatgtagttcatcttgt

SEQ ID NO: 520086 - DNA, 25 bp, Rattus norvegicus
gtgttctcatatacagctctacatt

SEQ ID NO: 520087 - DNA, 25 bp, Rattus norvegicus
gtgttctcatattcagctctacatt

SEQ ID NO: 520088 - DNA, 25 bp, Rattus norvegicus
gtgttctcatttatcatagcttctg

SEQ ID NO: 520089 - DNA, 25 bp, Rattus norvegicus
gtgttctcatttttcatagcttctg

SEQ ID NO: 520090 - DNA, 25 bp, Rattus norvegicus
gtgttctccagaagactatgtccct

SEQ ID NO: 520091 - DNA, 25 bp, Rattus norvegicus
gtgttctccagatgactatgtccct

SEQ ID NO: 520092 - DNA, 25 bp, Rattus norvegicus
gtgttctccagcacaagtacattag

SEQ ID NO: 520093 - DNA, 25 bp, Rattus norvegicus
gtgttctccagctcaagtacattag

SEQ ID NO: 520094 - DNA, 25 bp, Rattus norvegicus
gtgttctccccactcttgagagggt

SEQ ID NO: 520095 - DNA, 25 bp, Rattus norvegicus
gtgttctccccagtcttgagagggt

SEQ ID NO: 520096 - DNA, 25 bp, Rattus norvegicus
gtgttctccgcaaggaatatgcagt

SEQ ID NO: 520097 - DNA, 25 bp, Rattus norvegicus
gtgttctccgcatggaatatgcagt

SEQ ID NO: 520098 - DNA, 25 bp, Rattus norvegicus
gtgttctccgcgatgttggtctgtt

SEQ ID NO: 520099 - DNA, 25 bp, Rattus norvegicus
gtgttctccgcgttgttggtctgtt

SEQ ID NO: 520100 - DNA, 25 bp, Rattus norvegicus
gtgttctcctccattctatagaata

SEQ ID NO: 520101 - DNA, 25 bp, Rattus norvegicus
gtgttctcctcctttctatagaata

SEQ ID NO: 520102 - DNA, 25 bp, Rattus norvegicus
gtgttctcctgcaggaagtgacgga

SEQ ID NO: 520103 - DNA, 25 bp, Rattus norvegicus
gtgttctcctgctggaagtgacgga

SEQ ID NO: 520104 - DNA, 25 bp, Rattus norvegicus
gtgttctcggtgaccagcaagcagt

SEQ ID NO: 520105 - DNA, 25 bp, Rattus norvegicus
gtgttctcggtgtccagcaagcagt

SEQ ID NO: 520106 - DNA, 25 bp, Rattus norvegicus
gtgttctcgtggctatttatgtgac

SEQ ID NO: 520107 - DNA, 25 bp, Rattus norvegicus
gtgttctcgtgggtatttatgtgac

SEQ ID NO: 520108 - DNA, 25 bp, Rattus norvegicus
gtgttctcgtgtctgtgctcttaga

SEQ ID NO: 520109 - DNA, 25 bp, Rattus norvegicus
gtgttctcgtgtgtgtgctcttaga

SEQ ID NO: 520110 - DNA, 25 bp, Rattus norvegicus
gtgttctctacacaaactacccgtg

SEQ ID NO: 520111 - DNA, 25 bp, Rattus norvegicus
gtgttctctacagaaactacccgtg

SEQ ID NO: 520112 - DNA, 25 bp, Rattus norvegicus
gtgttctctagcactttgagttgac

SEQ ID NO: 520113 - DNA, 25 bp, Rattus norvegicus
gtgttctctagctctttgagttgac

SEQ ID NO: 520114 - DNA, 25 bp, Rattus norvegicus
gtgttctctcacagtgcaggctctg

SEQ ID NO: 520115 - DNA, 25 bp, Rattus norvegicus
gtgttctctcactgtgcaggctctg

SEQ ID NO: 520116 - DNA, 25 bp, Rattus norvegicus
gtgttctctcataaaaccctattgg

SEQ ID NO: 520117 - DNA, 25 bp, Rattus norvegicus
gtgttctctcattaaaccctattgg

SEQ ID NO: 520118 - DNA, 25 bp, Rattus norvegicus
gtgttctctctcatactagcaatga

SEQ ID NO: 520119 - DNA, 25 bp, Rattus norvegicus
gtgttctctctcttactagcaatga

SEQ ID NO: 520120 - DNA, 25 bp, Rattus norvegicus
gtgttctctgaaacatacagccctg

SEQ ID NO: 520121 - DNA, 25 bp, Rattus norvegicus
gtgttctctgaatcatacagccctg

SEQ ID NO: 520122 - DNA, 25 bp, Rattus norvegicus
gtgttctctgacctcagtcactaaa

SEQ ID NO: 520123 - DNA, 25 bp, Rattus norvegicus
gtgttctctgacgtcagtcactaaa

SEQ ID NO: 520124 - DNA, 25 bp, Rattus norvegicus
gtgttctctgccctattctagttca

SEQ ID NO: 520125 - DNA, 25 bp, Rattus norvegicus
gtgttctctgccgtattctagttca

SEQ ID NO: 520126 - DNA, 25 bp, Rattus norvegicus
gtgttctctggtaagttaagccatt

SEQ ID NO: 520127 - DNA, 25 bp, Rattus norvegicus
gtgttctctggttagttaagccatt

SEQ ID NO: 520128 - DNA, 25 bp, Rattus norvegicus
gtgttctctgtgatcatgcagctga

SEQ ID NO: 520129 - DNA, 25 bp, Rattus norvegicus
gtgttctctgtgttcatgcagctga

SEQ ID NO: 520130 - DNA, 25 bp, Rattus norvegicus
gtgttctctgttcttgtatggtcaa

SEQ ID NO: 520131 - DNA, 25 bp, Rattus norvegicus
gtgttctctgttgttgtatggtcaa

SEQ ID NO: 520132 - DNA, 25 bp, Rattus norvegicus
gtgttctcttttcagctctgtagat

SEQ ID NO: 520133 - DNA, 25 bp, Rattus norvegicus
gtgttctcttttgagctctgtagat

SEQ ID NO: 520134 - DNA, 25 bp, Rattus norvegicus
gtgttctgacacaagcacccaagaa

SEQ ID NO: 520135 - DNA, 25 bp, Rattus norvegicus
gtgttctgacactagcacccaagaa

SEQ ID NO: 520136 - DNA, 25 bp, Rattus norvegicus
gtgttctgactaaagctgccgactt

SEQ ID NO: 520137 - DNA, 25 bp, Rattus norvegicus
gtgttctgactatagctgccgactt

SEQ ID NO: 520138 - DNA, 25 bp, Rattus norvegicus
gtgttctgagtgagcaccagcgaag

SEQ ID NO: 520139 - DNA, 25 bp, Rattus norvegicus
gtgttctgagtgtgcaccagcgaag

SEQ ID NO: 520140 - DNA, 25 bp, Rattus norvegicus
gtgttctgcacccaagtatattgat

SEQ ID NO: 520141 - DNA, 25 bp, Rattus norvegicus
gtgttctgcaccgaagtatattgat

SEQ ID NO: 520142 - DNA, 25 bp, Rattus norvegicus
gtgttctgcatactttttgcttcag

SEQ ID NO: 520143 - DNA, 25 bp, Rattus norvegicus
gtgttctgcatagtttttgcttcag

SEQ ID NO: 520144 - DNA, 25 bp, Rattus norvegicus
gtgttctgcctcactaatcgaagga

SEQ ID NO: 520145 - DNA, 25 bp, Rattus norvegicus
gtgttctgcctctctaatcgaagga

SEQ ID NO: 520146 - DNA, 25 bp, Rattus norvegicus
gtgttctgcctgacacaatgaagtc

SEQ ID NO: 520147 - DNA, 25 bp, Rattus norvegicus
gtgttctgcctgtcacaatgaagtc

SEQ ID NO: 520148 - DNA, 25 bp, Rattus norvegicus
gtgttctgctttcagtgtaggcctc

SEQ ID NO: 520149 - DNA, 25 bp, Rattus norvegicus
gtgttctgctttgagtgtaggcctc

SEQ ID NO: 520150 - DNA, 25 bp, Rattus norvegicus
gtgttctggaagctcatggctctaa

SEQ ID NO: 520151 - DNA, 25 bp, Rattus norvegicus
gtgttctggaaggtcatggctctaa

SEQ ID NO: 520152 - DNA, 25 bp, Rattus norvegicus
gtgttctggcatataggcccatagt

SEQ ID NO: 520153 - DNA, 25 bp, Rattus norvegicus
gtgttctggcatttaggcccatagt

SEQ ID NO: 520154 - DNA, 25 bp, Rattus norvegicus
gtgttctggcccaattcgtgtaaat

SEQ ID NO: 520155 - DNA, 25 bp, Rattus norvegicus
gtgttctggccctattcgtgtaaat

SEQ ID NO: 520156 - DNA, 25 bp, Rattus norvegicus
gtgttctgggagagacccgcaccaa

SEQ ID NO: 520157 - DNA, 25 bp, Rattus norvegicus
gtgttctgggagtgacccgcaccaa

SEQ ID NO: 520158 - DNA, 25 bp, Rattus norvegicus
gtgttctggtgtccctgagcgttaa

SEQ ID NO: 520159 - DNA, 25 bp, Rattus norvegicus
gtgttctggtgtgcctgagcgttaa

SEQ ID NO: 520160 - DNA, 25 bp, Rattus norvegicus
gtgttctgtaacctggaccactaaa

SEQ ID NO: 520161 - DNA, 25 bp, Rattus norvegicus
gtgttctgtaacgtggaccactaaa

SEQ ID NO: 520162 - DNA, 25 bp, Rattus norvegicus
gtgttctgtgaacccctcattgaaa

SEQ ID NO: 520163 - DNA, 25 bp, Rattus norvegicus
gtgttctgtgaagccctcattgaaa

SEQ ID NO: 520164 - DNA, 25 bp, Rattus norvegicus
gtgttctgtgagctgtaacctagat

SEQ ID NO: 520165 - DNA, 25 bp, Rattus norvegicus
gtgttctgtgaggtgtaacctagat

SEQ ID NO: 520166 - DNA, 25 bp, Rattus norvegicus
gtgttctgtgttatcctctgtaaac

SEQ ID NO: 520167 - DNA, 25 bp, Rattus norvegicus
gtgttctgtgttttcctctgtaaac

SEQ ID NO: 520168 - DNA, 25 bp, Rattus norvegicus
gtgttctgtttcatactcatacttg

SEQ ID NO: 520169 - DNA, 25 bp, Rattus norvegicus
gtgttctgtttcttactcatacttg

SEQ ID NO: 520170 - DNA, 25 bp, Rattus norvegicus
gtgttcttacacctggactagtttc

SEQ ID NO: 520171 - DNA, 25 bp, Rattus norvegicus
gtgttcttacacgtggactagtttc

SEQ ID NO: 520172 - DNA, 25 bp, Rattus norvegicus
gtgttcttatttatcaagcgtcggg

SEQ ID NO: 520173 - DNA, 25 bp, Rattus norvegicus
gtgttcttatttttcaagcgtcggg

SEQ ID NO: 520174 - DNA, 25 bp, Rattus norvegicus
gtgttcttcaccacaaagcatcgct

SEQ ID NO: 520175 - DNA, 25 bp, Rattus norvegicus
gtgttcttcacctcaaagcatcgct

SEQ ID NO: 520176 - DNA, 25 bp, Rattus norvegicus
gtgttcttccctaccagtggaattg

SEQ ID NO: 520177 - DNA, 25 bp, Rattus norvegicus
gtgttcttcccttccagtggaattg

SEQ ID NO: 520178 - DNA, 25 bp, Rattus norvegicus
gtgttcttctttaagaggccctttg

SEQ ID NO: 520179 - DNA, 25 bp, Rattus norvegicus
gtgttcttcttttagaggccctttg

SEQ ID NO: 520180 - DNA, 25 bp, Rattus norvegicus
gtgttcttgagccacaataactcat

SEQ ID NO: 520181 - DNA, 25 bp, Rattus norvegicus
gtgttcttgagcgacaataactcat

SEQ ID NO: 520182 - DNA, 25 bp, Rattus norvegicus
gtgttcttgattaagcttctcgtga

SEQ ID NO: 520183 - DNA, 25 bp, Rattus norvegicus
gtgttcttgatttagcttctcgtga

SEQ ID NO: 520184 - DNA, 25 bp, Rattus norvegicus
gtgttcttgctcaataaaccgtgtt

SEQ ID NO: 520185 - DNA, 25 bp, Rattus norvegicus
gtgttcttgctctataaaccgtgtt

SEQ ID NO: 520186 - DNA, 25 bp, Rattus norvegicus
gtgttcttgctgaagcattcaccat

SEQ ID NO: 520187 - DNA, 25 bp, Rattus norvegicus
gtgttcttgctgtagcattcaccat

SEQ ID NO: 520188 - DNA, 25 bp, Rattus norvegicus
gtgttcttggatatagtttgcaatt

SEQ ID NO: 520189 - DNA, 25 bp, Rattus norvegicus
gtgttcttggatttagtttgcaatt

SEQ ID NO: 520190 - DNA, 25 bp, Rattus norvegicus
gtgttctttaccaagtcaaccagat

SEQ ID NO: 520191 - DNA, 25 bp, Rattus norvegicus
gtgttctttacctagtcaaccagat

SEQ ID NO: 520192 - DNA, 25 bp, Rattus norvegicus
gtgttctttactcctgagctatctg

SEQ ID NO: 520193 - DNA, 25 bp, Rattus norvegicus
gtgttctttactgctgagctatctg

SEQ ID NO: 520194 - DNA, 25 bp, Rattus norvegicus
gtgttctttcctacgacggtgaata

SEQ ID NO: 520195 - DNA, 25 bp, Rattus norvegicus
gtgttctttccttcgacggtgaata

SEQ ID NO: 520196 - DNA, 25 bp, Rattus norvegicus
gtgttctttctacccatctacagta

SEQ ID NO: 520197 - DNA, 25 bp, Rattus norvegicus
gtgttctttctagccatctacagta

SEQ ID NO: 520198 - DNA, 25 bp, Rattus norvegicus
gtgttctttgctaccttaaacctat

SEQ ID NO: 520199 - DNA, 25 bp, Rattus norvegicus
gtgttctttgcttccttaaacctat

SEQ ID NO: 520200 - DNA, 25 bp, Rattus norvegicus
gtgttctttgtaacatcttccttcc

SEQ ID NO: 520201 - DNA, 25 bp, Rattus norvegicus
gtgttctttgtatcatcttccttcc

SEQ ID NO: 520202 - DNA, 25 bp, Rattus norvegicus
gtgttcttttctcatggagttgatt

SEQ ID NO: 520203 - DNA, 25 bp, Rattus norvegicus
gtgttcttttctgatggagttgatt

SEQ ID NO: 520204 - DNA, 25 bp, Rattus norvegicus
gtgttctttttccataatctctcag

SEQ ID NO: 520205 - DNA, 25 bp, Rattus norvegicus
gtgttctttttcgataatctctcag

SEQ ID NO: 520206 - DNA, 25 bp, Rattus norvegicus
gtgttgaaacttaagtccagccctc

SEQ ID NO: 520207 - DNA, 25 bp, Rattus norvegicus
gtgttgaaactttagtccagccctc

SEQ ID NO: 520208 - DNA, 25 bp, Rattus norvegicus
gtgttgaactctcacaatctccttc

SEQ ID NO: 520209 - DNA, 25 bp, Rattus norvegicus
gtgttgaactctgacaatctccttc

SEQ ID NO: 520210 - DNA, 25 bp, Rattus norvegicus
gtgttgaagacaagccttgccacat

SEQ ID NO: 520211 - DNA, 25 bp, Rattus norvegicus
gtgttgaagacatgccttgccacat

SEQ ID NO: 520212 - DNA, 25 bp, Rattus norvegicus
gtgttgaagagacagccctgcaccg

SEQ ID NO: 520213 - DNA, 25 bp, Rattus norvegicus
gtgttgaagagagagccctgcaccg

SEQ ID NO: 520214 - DNA, 25 bp, Rattus norvegicus
gtgttgaagccactgtgacagcaca

SEQ ID NO: 520215 - DNA, 25 bp, Rattus norvegicus
gtgttgaagccagtgtgacagcaca

SEQ ID NO: 520216 - DNA, 25 bp, Rattus norvegicus
gtgttgaattaacctgaccattact

SEQ ID NO: 520217 - DNA, 25 bp, Rattus norvegicus
gtgttgaattaagctgaccattact

SEQ ID NO: 520218 - DNA, 25 bp, Rattus norvegicus
gtgttgaccaagagctgcaactcag

SEQ ID NO: 520219 - DNA, 25 bp, Rattus norvegicus
gtgttgaccaagtgctgcaactcag

SEQ ID NO: 520220 - DNA, 25 bp, Rattus norvegicus
gtgttgacctaaactgtatgccata

SEQ ID NO: 520221 - DNA, 25 bp, Rattus norvegicus
gtgttgacctaatctgtatgccata

SEQ ID NO: 520222 - DNA, 25 bp, Rattus norvegicus
gtgttgacctctcacaagtcctgaa

SEQ ID NO: 520223 - DNA, 25 bp, Rattus norvegicus
gtgttgacctctgacaagtcctgaa

SEQ ID NO: 520224 - DNA, 25 bp, Rattus norvegicus
gtgttgacgcacatccgttaaaaag

SEQ ID NO: 520225 - DNA, 25 bp, Rattus norvegicus
gtgttgacgcacttccgttaaaaag

SEQ ID NO: 520226 - DNA, 25 bp, Rattus norvegicus
gtgttgactctacacctgatgtctc

SEQ ID NO: 520227 - DNA, 25 bp, Rattus norvegicus
gtgttgactctagacctgatgtctc

SEQ ID NO: 520228 - DNA, 25 bp, Rattus norvegicus
gtgttgactctgatgcccatggagt

SEQ ID NO: 520229 - DNA, 25 bp, Rattus norvegicus
gtgttgactctgatgtatgacccgt

SEQ ID NO: 520230 - DNA, 25 bp, Rattus norvegicus
gtgttgactctgttgcccatggagt

SEQ ID NO: 520231 - DNA, 25 bp, Rattus norvegicus
gtgttgactctgttgtatgacccgt

SEQ ID NO: 520232 - DNA, 25 bp, Rattus norvegicus
gtgttgacttctactctggacttca

SEQ ID NO: 520233 - DNA, 25 bp, Rattus norvegicus
gtgttgacttcttctctggacttca

SEQ ID NO: 520234 - DNA, 25 bp, Rattus norvegicus
gtgttgacttggcagtctatctcag

SEQ ID NO: 520235 - DNA, 25 bp, Rattus norvegicus
gtgttgacttgggagtctatctcag

SEQ ID NO: 520236 - DNA, 25 bp, Rattus norvegicus
gtgttgagaagtagcttgctcctct

SEQ ID NO: 520237 - DNA, 25 bp, Rattus norvegicus
gtgttgagaagttgcttgctcctct

SEQ ID NO: 520238 - DNA, 25 bp, Rattus norvegicus
gtgttgagatcgcacttcagcaagt

SEQ ID NO: 520239 - DNA, 25 bp, Rattus norvegicus
gtgttgagatcggacttcagcaagt

SEQ ID NO: 520240 - DNA, 25 bp, Rattus norvegicus
gtgttgagctgtagacacacacagt

SEQ ID NO: 520241 - DNA, 25 bp, Rattus norvegicus
gtgttgagctgttgacacacacagt

SEQ ID NO: 520242 - DNA, 25 bp, Rattus norvegicus
gtgttgaggtatactgttccttcct

SEQ ID NO: 520243 - DNA, 25 bp, Rattus norvegicus
gtgttgaggtattctgttccttcct

SEQ ID NO: 520244 - DNA, 25 bp, Rattus norvegicus
gtgttgagttcactgccctatatac

SEQ ID NO: 520245 - DNA, 25 bp, Rattus norvegicus
gtgttgagttcagtgccctatatac

SEQ ID NO: 520246 - DNA, 25 bp, Rattus norvegicus
gtgttgagtttgatattctgttgtc

SEQ ID NO: 520247 - DNA, 25 bp, Rattus norvegicus
gtgttgagtttgcccacagggaaat

SEQ ID NO: 520248 - DNA, 25 bp, Rattus norvegicus
gtgttgagtttggccacagggaaat

SEQ ID NO: 520249 - DNA, 25 bp, Rattus norvegicus
gtgttgagtttgttattctgttgtc

SEQ ID NO: 520250 - DNA, 25 bp, Rattus norvegicus
gtgttgatcaagaactcccttcttc

SEQ ID NO: 520251 - DNA, 25 bp, Rattus norvegicus
gtgttgatcaagtactcccttcttc

SEQ ID NO: 520252 - DNA, 25 bp, Rattus norvegicus
gtgttgatgcccagcagctgttagg

SEQ ID NO: 520253 - DNA, 25 bp, Rattus norvegicus
gtgttgatgccctgcagctgttagg

SEQ ID NO: 520254 - DNA, 25 bp, Rattus norvegicus
gtgttgattcctcctcacaaaagat

SEQ ID NO: 520255 - DNA, 25 bp, Rattus norvegicus
gtgttgattcctgctcacaaaagat

SEQ ID NO: 520256 - DNA, 25 bp, Rattus norvegicus
gtgttgatttctaagtccatgtaat

SEQ ID NO: 520257 - DNA, 25 bp, Rattus norvegicus
gtgttgatttcttagtccatgtaat

SEQ ID NO: 520258 - DNA, 25 bp, Rattus norvegicus
gtgttgcaactgaccccagggaaat

SEQ ID NO: 520259 - DNA, 25 bp, Rattus norvegicus
gtgttgcaactgtccccagggaaat

SEQ ID NO: 520260 - DNA, 25 bp, Rattus norvegicus
gtgttgcaaggcagccgacaaggat

SEQ ID NO: 520261 - DNA, 25 bp, Rattus norvegicus
gtgttgcaaggctgccgacaaggat

SEQ ID NO: 520262 - DNA, 25 bp, Rattus norvegicus
gtgttgcaccttccataatgggttc

SEQ ID NO: 520263 - DNA, 25 bp, Rattus norvegicus
gtgttgcaccttgcataatgggttc

SEQ ID NO: 520264 - DNA, 25 bp, Rattus norvegicus
gtgttgcacgcaccaagcatcttga

SEQ ID NO: 520265 - DNA, 25 bp, Rattus norvegicus
gtgttgcacgcagcaagcatcttga

SEQ ID NO: 520266 - DNA, 25 bp, Rattus norvegicus
gtgttgcagtctcttgtcaccagcc

SEQ ID NO: 520267 - DNA, 25 bp, Rattus norvegicus
gtgttgcagtctgttgtcaccagcc

SEQ ID NO: 520268 - DNA, 25 bp, Rattus norvegicus
gtgttgcatcggcagcttccttgga

SEQ ID NO: 520269 - DNA, 25 bp, Rattus norvegicus
gtgttgcatcgggagcttccttgga

SEQ ID NO: 520270 - DNA, 25 bp, Rattus norvegicus
gtgttgcatgccattcagtagtaca

SEQ ID NO: 520271 - DNA, 25 bp, Rattus norvegicus
gtgttgcatgcctttcagtagtaca

SEQ ID NO: 520272 - DNA, 25 bp, Rattus norvegicus
gtgttgcatttgaggaggttcttat

SEQ ID NO: 520273 - DNA, 25 bp, Rattus norvegicus
gtgttgcatttgtggaggttcttat

SEQ ID NO: 520274 - DNA, 25 bp, Rattus norvegicus
gtgttgcattttatcttgctgccca

SEQ ID NO: 520275 - DNA, 25 bp, Rattus norvegicus
gtgttgcattttccagtttgctcag

SEQ ID NO: 520276 - DNA, 25 bp, Rattus norvegicus
gtgttgcattttgcagtttgctcag

SEQ ID NO: 520277 - DNA, 25 bp, Rattus norvegicus
gtgttgcattttttcttgctgccca

SEQ ID NO: 520278 - DNA, 25 bp, Rattus norvegicus
gtgttgccaaagagccagttgttta

SEQ ID NO: 520279 - DNA, 25 bp, Rattus norvegicus
gtgttgccaaagtgccagttgttta

SEQ ID NO: 520280 - DNA, 25 bp, Rattus norvegicus
gtgttgccaatcaagtctgacttca

SEQ ID NO: 520281 - DNA, 25 bp, Rattus norvegicus
gtgttgccaatctagtctgacttca

SEQ ID NO: 520282 - DNA, 25 bp, Rattus norvegicus
gtgttgccagccacttaatgagcta

SEQ ID NO: 520283 - DNA, 25 bp, Rattus norvegicus
gtgttgccagcctcttaatgagcta

SEQ ID NO: 520284 - DNA, 25 bp, Rattus norvegicus
gtgttgccatgactgctgtcagcca

SEQ ID NO: 520285 - DNA, 25 bp, Rattus norvegicus
gtgttgccatgagtgctgtcagcca

SEQ ID NO: 520286 - DNA, 25 bp, Rattus norvegicus
gtgttgccgtgaccatgaccgtgac

SEQ ID NO: 520287 - DNA, 25 bp, Rattus norvegicus
gtgttgccgtgagcatgaccgtgac

SEQ ID NO: 520288 - DNA, 25 bp, Rattus norvegicus
gtgttgcctacaaagtgactgctca

SEQ ID NO: 520289 - DNA, 25 bp, Rattus norvegicus
gtgttgcctacatagtgactgctca

SEQ ID NO: 520290 - DNA, 25 bp, Rattus norvegicus
gtgttgcctaccacattcagccttg

SEQ ID NO: 520291 - DNA, 25 bp, Rattus norvegicus
gtgttgcctacctcattcagccttg

SEQ ID NO: 520292 - DNA, 25 bp, Rattus norvegicus
gtgttgcctagtatgactttgtgaa

SEQ ID NO: 520293 - DNA, 25 bp, Rattus norvegicus
gtgttgcctagtcttacacatgact

SEQ ID NO: 520294 - DNA, 25 bp, Rattus norvegicus
gtgttgcctagtgttacacatgact

SEQ ID NO: 520295 - DNA, 25 bp, Rattus norvegicus
gtgttgcctagtttgactttgtgaa

SEQ ID NO: 520296 - DNA, 25 bp, Rattus norvegicus
gtgttgcctgcaaagacttttgttt

SEQ ID NO: 520297 - DNA, 25 bp, Rattus norvegicus
gtgttgcctgcaagccaatattctc

SEQ ID NO: 520298 - DNA, 25 bp, Rattus norvegicus
gtgttgcctgcatagacttttgttt

SEQ ID NO: 520299 - DNA, 25 bp, Rattus norvegicus
gtgttgcctgcatgccaatattctc

SEQ ID NO: 520300 - DNA, 25 bp, Rattus norvegicus
gtgttgcctgctcaatgtgcatatc

SEQ ID NO: 520301 - DNA, 25 bp, Rattus norvegicus
gtgttgcctgctgaatgtgcatatc

SEQ ID NO: 520302 - DNA, 25 bp, Rattus norvegicus
gtgttgcgagtaccatcatttctgt

SEQ ID NO: 520303 - DNA, 25 bp, Rattus norvegicus
gtgttgcgagtagcatcatttctgt

SEQ ID NO: 520304 - DNA, 25 bp, Rattus norvegicus
gtgttgcgatggatcacttgggcct

SEQ ID NO: 520305 - DNA, 25 bp, Rattus norvegicus
gtgttgcgatggttcacttgggcct

SEQ ID NO: 520306 - DNA, 25 bp, Rattus norvegicus
gtgttgctaagaaacaatcctcagt

SEQ ID NO: 520307 - DNA, 25 bp, Rattus norvegicus
gtgttgctaagatacaatcctcagt

SEQ ID NO: 520308 - DNA, 25 bp, Rattus norvegicus
gtgttgctatcacttctattgcagc

SEQ ID NO: 520309 - DNA, 25 bp, Rattus norvegicus
gtgttgctatcagttctattgcagc

SEQ ID NO: 520310 - DNA, 25 bp, Rattus norvegicus
gtgttgctcaatctgctggtggaca

SEQ ID NO: 520311 - DNA, 25 bp, Rattus norvegicus
gtgttgctcaatgtgctggtggaca

SEQ ID NO: 520312 - DNA, 25 bp, Rattus norvegicus
gtgttgctcacacagatgttctaaa

SEQ ID NO: 520313 - DNA, 25 bp, Rattus norvegicus
gtgttgctcacagagatgttctaaa

SEQ ID NO: 520314 - DNA, 25 bp, Rattus norvegicus
gtgttgctcattagtgagccttcat

SEQ ID NO: 520315 - DNA, 25 bp, Rattus norvegicus
gtgttgctcatttgtgagccttcat

SEQ ID NO: 520316 - DNA, 25 bp, Rattus norvegicus
gtgttgctcctacactgaggattag

SEQ ID NO: 520317 - DNA, 25 bp, Rattus norvegicus
gtgttgctcctagactgaggattag

SEQ ID NO: 520318 - DNA, 25 bp, Rattus norvegicus
gtgttgctctgtaatctggactcaa

SEQ ID NO: 520319 - DNA, 25 bp, Rattus norvegicus
gtgttgctctgttatctggactcaa

SEQ ID NO: 520320 - DNA, 25 bp, Rattus norvegicus
gtgttgctcttactcatgcctaaca

SEQ ID NO: 520321 - DNA, 25 bp, Rattus norvegicus
gtgttgctcttagtcatgcctaaca

SEQ ID NO: 520322 - DNA, 25 bp, Rattus norvegicus
gtgttgctgagacctccgacaccat

SEQ ID NO: 520323 - DNA, 25 bp, Rattus norvegicus
gtgttgctgagagctccgacaccat

SEQ ID NO: 520324 - DNA, 25 bp, Rattus norvegicus
gtgttgctggttatcattggtgttt

SEQ ID NO: 520325 - DNA, 25 bp, Rattus norvegicus
gtgttgctggttttcattggtgttt

SEQ ID NO: 520326 - DNA, 25 bp, Rattus norvegicus
gtgttgcttctaaaggtgcacatca

SEQ ID NO: 520327 - DNA, 25 bp, Rattus norvegicus
gtgttgcttctataggtgcacatca

SEQ ID NO: 520328 - DNA, 25 bp, Rattus norvegicus
gtgttggaattaccggagtgcccct

SEQ ID NO: 520329 - DNA, 25 bp, Rattus norvegicus
gtgttggaattagcggagtgcccct

SEQ ID NO: 520330 - DNA, 25 bp, Rattus norvegicus
gtgttggacacaagtgatcacctcc

SEQ ID NO: 520331 - DNA, 25 bp, Rattus norvegicus
gtgttggacacatgtgatcacctcc

SEQ ID NO: 520332 - DNA, 25 bp, Rattus norvegicus
gtgttggacccacaacccatagtta

SEQ ID NO: 520333 - DNA, 25 bp, Rattus norvegicus
gtgttggacccagaacccatagtta

SEQ ID NO: 520334 - DNA, 25 bp, Rattus norvegicus
gtgttggaccgacacagtatcgata

SEQ ID NO: 520335 - DNA, 25 bp, Rattus norvegicus
gtgttggaccgagacagtatcgata

SEQ ID NO: 520336 - DNA, 25 bp, Rattus norvegicus
gtgttggaggtacatcatctcacca

SEQ ID NO: 520337 - DNA, 25 bp, Rattus norvegicus
gtgttggaggtagatcatctcacca

SEQ ID NO: 520338 - DNA, 25 bp, Rattus norvegicus
gtgttggatcatcacactccacttt

SEQ ID NO: 520339 - DNA, 25 bp, Rattus norvegicus
gtgttggatcatgacactccacttt

SEQ ID NO: 520340 - DNA, 25 bp, Rattus norvegicus
gtgttggcagtaccatctcgtcatg

SEQ ID NO: 520341 - DNA, 25 bp, Rattus norvegicus
gtgttggcagtagcatctcgtcatg

SEQ ID NO: 520342 - DNA, 25 bp, Rattus norvegicus
gtgttggcatgaactgagccagcca

SEQ ID NO: 520343 - DNA, 25 bp, Rattus norvegicus
gtgttggcatgatctgagccagcca

SEQ ID NO: 520344 - DNA, 25 bp, Rattus norvegicus
gtgttggccaaaaggcgctatgcct

SEQ ID NO: 520345 - DNA, 25 bp, Rattus norvegicus
gtgttggccaaatggcgctatgcct

SEQ ID NO: 520346 - DNA, 25 bp, Rattus norvegicus
gtgttggccacaccacggctcatga

SEQ ID NO: 520347 - DNA, 25 bp, Rattus norvegicus
gtgttggccacagcacggctcatga

SEQ ID NO: 520348 - DNA, 25 bp, Rattus norvegicus
gtgttggccaggacctctggtacag

SEQ ID NO: 520349 - DNA, 25 bp, Rattus norvegicus
gtgttggccaggtcctctggtacag

SEQ ID NO: 520350 - DNA, 25 bp, Rattus norvegicus
gtgttggcggtgaagatcctgactc

SEQ ID NO: 520351 - DNA, 25 bp, Rattus norvegicus
gtgttggcggtgtagatcctgactc

SEQ ID NO: 520352 - DNA, 25 bp, Rattus norvegicus
gtgttggctttgaacattctggcat

SEQ ID NO: 520353 - DNA, 25 bp, Rattus norvegicus
gtgttggctttgtacattctggcat

SEQ ID NO: 520354 - DNA, 25 bp, Rattus norvegicus
gtgttgggaactccatccagggcct

SEQ ID NO: 520355 - DNA, 25 bp, Rattus norvegicus
gtgttgggaactgcatccagggcct

SEQ ID NO: 520356 - DNA, 25 bp, Rattus norvegicus
gtgttgggagtcataccctgtgtat

SEQ ID NO: 520357 - DNA, 25 bp, Rattus norvegicus
gtgttgggagtcttaccctgtgtat

SEQ ID NO: 520358 - DNA, 25 bp, Rattus norvegicus
gtgttgggcccaagatggcacactt

SEQ ID NO: 520359 - DNA, 25 bp, Rattus norvegicus
gtgttgggcccatgatggcacactt

SEQ ID NO: 520360 - DNA, 25 bp, Rattus norvegicus
gtgttggtatgtctaaacgttttct

SEQ ID NO: 520361 - DNA, 25 bp, Rattus norvegicus
gtgttggtatgtgtaaacgttttct

SEQ ID NO: 520362 - DNA, 25 bp, Rattus norvegicus
gtgttggtcacacaactcctgaagc

SEQ ID NO: 520363 - DNA, 25 bp, Rattus norvegicus
gtgttggtcacagaactcctgaagc

SEQ ID NO: 520364 - DNA, 25 bp, Rattus norvegicus
gtgttggtcactaggcagttcagaa

SEQ ID NO: 520365 - DNA, 25 bp, Rattus norvegicus
gtgttggtcacttggcagttcagaa

SEQ ID NO: 520366 - DNA, 25 bp, Rattus norvegicus
gtgttggtcatactgcatgccttta

SEQ ID NO: 520367 - DNA, 25 bp, Rattus norvegicus
gtgttggtcatagtgcatgccttta

SEQ ID NO: 520368 - DNA, 25 bp, Rattus norvegicus
gtgttggtcccaaacttgtctgctc

SEQ ID NO: 520369 - DNA, 25 bp, Rattus norvegicus
gtgttggtcccatacttgtctgctc

SEQ ID NO: 520370 - DNA, 25 bp, Rattus norvegicus
gtgttggtctttctaacgtagctat

SEQ ID NO: 520371 - DNA, 25 bp, Rattus norvegicus
gtgttggtctttgtaacgtagctat

SEQ ID NO: 520372 - DNA, 25 bp, Rattus norvegicus
gtgttggtgaaccttgctctctgca

SEQ ID NO: 520373 - DNA, 25 bp, Rattus norvegicus
gtgttggtgaacgttgctctctgca

SEQ ID NO: 520374 - DNA, 25 bp, Rattus norvegicus
gtgttggtgttgctcgaggcggcgc

SEQ ID NO: 520375 - DNA, 25 bp, Rattus norvegicus
gtgttggtgttggtcgaggcggcgc

SEQ ID NO: 520376 - DNA, 25 bp, Rattus norvegicus
gtgttgtaacatactgtcacagcgt

SEQ ID NO: 520377 - DNA, 25 bp, Rattus norvegicus
gtgttgtaacattctgtcacagcgt

SEQ ID NO: 520378 - DNA, 25 bp, Rattus norvegicus
gtgttgtaagcactcgccaagctgg

SEQ ID NO: 520379 - DNA, 25 bp, Rattus norvegicus
gtgttgtaagcagtcgccaagctgg

SEQ ID NO: 520380 - DNA, 25 bp, Rattus norvegicus
gtgttgtacaccagggcagctcctt

SEQ ID NO: 520381 - DNA, 25 bp, Rattus norvegicus
gtgttgtacacctgggcagctcctt

SEQ ID NO: 520382 - DNA, 25 bp, Rattus norvegicus
gtgttgtacatgagacctttttgaa

SEQ ID NO: 520383 - DNA, 25 bp, Rattus norvegicus
gtgttgtacatgctctgattctttt

SEQ ID NO: 520384 - DNA, 25 bp, Rattus norvegicus
gtgttgtacatggtctgattctttt

SEQ ID NO: 520385 - DNA, 25 bp, Rattus norvegicus
gtgttgtacatgtgacctttttgaa

SEQ ID NO: 520386 - DNA, 25 bp, Rattus norvegicus
gtgttgtactacagagctaggccca

SEQ ID NO: 520387 - DNA, 25 bp, Rattus norvegicus
gtgttgtactactgagctaggccca

SEQ ID NO: 520388 - DNA, 25 bp, Rattus norvegicus
gtgttgtagctacctgtatctcaga

SEQ ID NO: 520389 - DNA, 25 bp, Rattus norvegicus
gtgttgtagctagctgtatctcaga

SEQ ID NO: 520390 - DNA, 25 bp, Rattus norvegicus
gtgttgtagctcatttgtttcaaga

SEQ ID NO: 520391 - DNA, 25 bp, Rattus norvegicus
gtgttgtagctcttttgtttcaaga

SEQ ID NO: 520392 - DNA, 25 bp, Rattus norvegicus
gtgttgtaggaacagatcccacctt

SEQ ID NO: 520393 - DNA, 25 bp, Rattus norvegicus
gtgttgtaggaagagatcccacctt

SEQ ID NO: 520394 - DNA, 25 bp, Rattus norvegicus
gtgttgtatatcacattttggaaag

SEQ ID NO: 520395 - DNA, 25 bp, Rattus norvegicus
gtgttgtatatctcattttggaaag

SEQ ID NO: 520396 - DNA, 25 bp, Rattus norvegicus
gtgttgtatctaagtgttgcctttt

SEQ ID NO: 520397 - DNA, 25 bp, Rattus norvegicus
gtgttgtatctatgtgttgcctttt

SEQ ID NO: 520398 - DNA, 25 bp, Rattus norvegicus
gtgttgtattacctgtttgtcttta

SEQ ID NO: 520399 - DNA, 25 bp, Rattus norvegicus
gtgttgtattacgtgtttgtcttta

SEQ ID NO: 520400 - DNA, 25 bp, Rattus norvegicus
gtgttgtcaagcaaaccaatgtatc

SEQ ID NO: 520401 - DNA, 25 bp, Rattus norvegicus
gtgttgtcaagctaaccaatgtatc

SEQ ID NO: 520402 - DNA, 25 bp, Rattus norvegicus
gtgttgtcagtgaagcctgcagccc

SEQ ID NO: 520403 - DNA, 25 bp, Rattus norvegicus
gtgttgtcagtgtagcctgcagccc

SEQ ID NO: 520404 - DNA, 25 bp, Rattus norvegicus
gtgttgtcatagagtttgcagtgct

SEQ ID NO: 520405 - DNA, 25 bp, Rattus norvegicus
gtgttgtcatagtgtttgcagtgct

SEQ ID NO: 520406 - DNA, 25 bp, Rattus norvegicus
gtgttgtcatcaattaactcttgtt

SEQ ID NO: 520407 - DNA, 25 bp, Rattus norvegicus
gtgttgtcatcatttaactcttgtt

SEQ ID NO: 520408 - DNA, 25 bp, Rattus norvegicus
gtgttgtcatttacctgcaaactga

SEQ ID NO: 520409 - DNA, 25 bp, Rattus norvegicus
gtgttgtcattttcctgcaaactga

SEQ ID NO: 520410 - DNA, 25 bp, Rattus norvegicus
gtgttgtccactcaatgacgcttca

SEQ ID NO: 520411 - DNA, 25 bp, Rattus norvegicus
gtgttgtccactgaatgacgcttca

SEQ ID NO: 520412 - DNA, 25 bp, Rattus norvegicus
gtgttgtcccacaaagttacatttg

SEQ ID NO: 520413 - DNA, 25 bp, Rattus norvegicus
gtgttgtcccactaagttacatttg

SEQ ID NO: 520414 - DNA, 25 bp, Rattus norvegicus
gtgttgtccctgcatctagagctgg

SEQ ID NO: 520415 - DNA, 25 bp, Rattus norvegicus
gtgttgtccctggatctagagctgg

SEQ ID NO: 520416 - DNA, 25 bp, Rattus norvegicus
gtgttgtccttaatcgttttcagag

SEQ ID NO: 520417 - DNA, 25 bp, Rattus norvegicus
gtgttgtccttattcgttttcagag

SEQ ID NO: 520418 - DNA, 25 bp, Rattus norvegicus
gtgttgtctcctcagcaattcgcaa

SEQ ID NO: 520419 - DNA, 25 bp, Rattus norvegicus
gtgttgtctcctgagcaattcgcaa

SEQ ID NO: 520420 - DNA, 25 bp, Rattus norvegicus
gtgttgtctcttacagttctatcta

SEQ ID NO: 520421 - DNA, 25 bp, Rattus norvegicus
gtgttgtctctttcagttctatcta

SEQ ID NO: 520422 - DNA, 25 bp, Rattus norvegicus
gtgttgtctgacatcagcctacttc

SEQ ID NO: 520423 - DNA, 25 bp, Rattus norvegicus
gtgttgtctgacttcagcctacttc

SEQ ID NO: 520424 - DNA, 25 bp, Rattus norvegicus
gtgttgtctgagctcaggacccaaa

SEQ ID NO: 520425 - DNA, 25 bp, Rattus norvegicus
gtgttgtctgaggtcaggacccaaa

SEQ ID NO: 520426 - DNA, 25 bp, Rattus norvegicus
gtgttgtgaaatactatagccttct

SEQ ID NO: 520427 - DNA, 25 bp, Rattus norvegicus
gtgttgtgaaattctatagccttct

SEQ ID NO: 520428 - DNA, 25 bp, Rattus norvegicus
gtgttgtgaatacctgtgcagtgcc

SEQ ID NO: 520429 - DNA, 25 bp, Rattus norvegicus
gtgttgtgaatagctgtgcagtgcc

SEQ ID NO: 520430 - DNA, 25 bp, Rattus norvegicus
gtgttgtgacttcagtccctggaaa

SEQ ID NO: 520431 - DNA, 25 bp, Rattus norvegicus
gtgttgtgacttgagtccctggaaa

SEQ ID NO: 520432 - DNA, 25 bp, Rattus norvegicus
gtgttgtgagttagttttcccagac

SEQ ID NO: 520433 - DNA, 25 bp, Rattus norvegicus
gtgttgtgagtttgttttcccagac

SEQ ID NO: 520434 - DNA, 25 bp, Rattus norvegicus
gtgttgtgctgaaagaccttctaaa

SEQ ID NO: 520435 - DNA, 25 bp, Rattus norvegicus
gtgttgtgctgatagaccttctaaa

SEQ ID NO: 520436 - DNA, 25 bp, Rattus norvegicus
gtgttgtgctgtcttgaacttcttt

SEQ ID NO: 520437 - DNA, 25 bp, Rattus norvegicus
gtgttgtgctgtgttgaacttcttt

SEQ ID NO: 520438 - DNA, 25 bp, Rattus norvegicus
gtgttgtggcaaaagcctagtcaga

SEQ ID NO: 520439 - DNA, 25 bp, Rattus norvegicus
gtgttgtggcaatagcctagtcaga

SEQ ID NO: 520440 - DNA, 25 bp, Rattus norvegicus
gtgttgtgtcacctaggaatctgta

SEQ ID NO: 520441 - DNA, 25 bp, Rattus norvegicus
gtgttgtgtcacgtaggaatctgta

SEQ ID NO: 520442 - DNA, 25 bp, Rattus norvegicus
gtgttgtgtggactctactttatta

SEQ ID NO: 520443 - DNA, 25 bp, Rattus norvegicus
gtgttgtgtggagtctactttatta

SEQ ID NO: 520444 - DNA, 25 bp, Rattus norvegicus
gtgttgtgtgtaacctgtacagcaa

SEQ ID NO: 520445 - DNA, 25 bp, Rattus norvegicus
gtgttgtgtgtatcctgtacagcaa

SEQ ID NO: 520446 - DNA, 25 bp, Rattus norvegicus
gtgttgtgtgttattgttaccagtc

SEQ ID NO: 520447 - DNA, 25 bp, Rattus norvegicus
gtgttgtgtgtttttgttaccagtc

SEQ ID NO: 520448 - DNA, 25 bp, Rattus norvegicus
gtgttgttacccattggccttctct

SEQ ID NO: 520449 - DNA, 25 bp, Rattus norvegicus
gtgttgttaccctttggccttctct

SEQ ID NO: 520450 - DNA, 25 bp, Rattus norvegicus
gtgttgttaggcaactcactccatc

SEQ ID NO: 520451 - DNA, 25 bp, Rattus norvegicus
gtgttgttaggctactcactccatc

SEQ ID NO: 520452 - DNA, 25 bp, Rattus norvegicus
gtgttgttcttgagttggttcccat

SEQ ID NO: 520453 - DNA, 25 bp, Rattus norvegicus
gtgttgttcttgtgttggttcccat

SEQ ID NO: 520454 - DNA, 25 bp, Rattus norvegicus
gtgttgttgaagcacagcctgtcaa

SEQ ID NO: 520455 - DNA, 25 bp, Rattus norvegicus
gtgttgttgaaggacagcctgtcaa

SEQ ID NO: 520456 - DNA, 25 bp, Rattus norvegicus
gtgttgtttaacatgcccacatttc

SEQ ID NO: 520457 - DNA, 25 bp, Rattus norvegicus
gtgttgtttaacttgcccacatttc

SEQ ID NO: 520458 - DNA, 25 bp, Rattus norvegicus
gtgttgtttctaattcatctccaaa

SEQ ID NO: 520459 - DNA, 25 bp, Rattus norvegicus
gtgttgtttctatttcatctccaaa

SEQ ID NO: 520460 - DNA, 25 bp, Rattus norvegicus
gtgttgtttgtaactggacctgtat

SEQ ID NO: 520461 - DNA, 25 bp, Rattus norvegicus
gtgttgtttgtatctggacctgtat

SEQ ID NO: 520462 - DNA, 25 bp, Rattus norvegicus
gtgttgtttgtgaccgttcttagcc

SEQ ID NO: 520463 - DNA, 25 bp, Rattus norvegicus
gtgttgtttgtgtccgttcttagcc

SEQ ID NO: 520464 - DNA, 25 bp, Rattus norvegicus
gtgttgttttatactgtggccacaa

SEQ ID NO: 520465 - DNA, 25 bp, Rattus norvegicus
gtgttgttttattctgtggccacaa

SEQ ID NO: 520466 - DNA, 25 bp, Rattus norvegicus
gtgttgttttctcacagttacttaa

SEQ ID NO: 520467 - DNA, 25 bp, Rattus norvegicus
gtgttgttttctgacagttacttaa

SEQ ID NO: 520468 - DNA, 25 bp, Rattus norvegicus
gtgtttaaaacacccctagggactg

SEQ ID NO: 520469 - DNA, 25 bp, Rattus norvegicus
gtgtttaaaacagccctagggactg

SEQ ID NO: 520470 - DNA, 25 bp, Rattus norvegicus
gtgtttaaaactaggcattgacaat

SEQ ID NO: 520471 - DNA, 25 bp, Rattus norvegicus
gtgtttaaaacttggcattgacaat

SEQ ID NO: 520472 - DNA, 25 bp, Rattus norvegicus
gtgtttaaccatacatcactgtgat

SEQ ID NO: 520473 - DNA, 25 bp, Rattus norvegicus
gtgtttaaccattcatcactgtgat

SEQ ID NO: 520474 - DNA, 25 bp, Rattus norvegicus
gtgtttaagacgctccacaggtgat

SEQ ID NO: 520475 - DNA, 25 bp, Rattus norvegicus
gtgtttaagacggtccacaggtgat

SEQ ID NO: 520476 - DNA, 25 bp, Rattus norvegicus
gtgtttaagtcccagacaacctgct

SEQ ID NO: 520477 - DNA, 25 bp, Rattus norvegicus
gtgtttaagtccgagacaacctgct

SEQ ID NO: 520478 - DNA, 25 bp, Rattus norvegicus
gtgtttaatactcctcacgtcttcc

SEQ ID NO: 520479 - DNA, 25 bp, Rattus norvegicus
gtgtttaatactcttcctaccagct

SEQ ID NO: 520480 - DNA, 25 bp, Rattus norvegicus
gtgtttaatactgctcacgtcttcc

SEQ ID NO: 520481 - DNA, 25 bp, Rattus norvegicus
gtgtttaatactgttcctaccagct

SEQ ID NO: 520482 - DNA, 25 bp, Rattus norvegicus
gtgtttaatatcctgctctaaccag

SEQ ID NO: 520483 - DNA, 25 bp, Rattus norvegicus
gtgtttaatatcgtgctctaaccag

SEQ ID NO: 520484 - DNA, 25 bp, Rattus norvegicus
gtgtttaatccactccttttcaatt

SEQ ID NO: 520485 - DNA, 25 bp, Rattus norvegicus
gtgtttaatccagtccttttcaatt

SEQ ID NO: 520486 - DNA, 25 bp, Rattus norvegicus
gtgtttaattaacctctgctccact

SEQ ID NO: 520487 - DNA, 25 bp, Rattus norvegicus
gtgtttaattaagctctgctccact

SEQ ID NO: 520488 - DNA, 25 bp, Rattus norvegicus
gtgtttacacttatactccgagtca

SEQ ID NO: 520489 - DNA, 25 bp, Rattus norvegicus
gtgtttacacttttactccgagtca

SEQ ID NO: 520490 - DNA, 25 bp, Rattus norvegicus
gtgtttacaggactaaccccagtga

SEQ ID NO: 520491 - DNA, 25 bp, Rattus norvegicus
gtgtttacaggagtaaccccagtga

SEQ ID NO: 520492 - DNA, 25 bp, Rattus norvegicus
gtgtttacatgtatccctggttaaa

SEQ ID NO: 520493 - DNA, 25 bp, Rattus norvegicus
gtgtttacatgtttccctggttaaa

SEQ ID NO: 520494 - DNA, 25 bp, Rattus norvegicus
gtgtttaccaaaagcttgccttgct

SEQ ID NO: 520495 - DNA, 25 bp, Rattus norvegicus
gtgtttaccaaatgcttgccttgct

SEQ ID NO: 520496 - DNA, 25 bp, Rattus norvegicus
gtgtttaccaatattagggatcata

SEQ ID NO: 520497 - DNA, 25 bp, Rattus norvegicus
gtgtttaccaattttagggatcata

SEQ ID NO: 520498 - DNA, 25 bp, Rattus norvegicus
gtgtttaccagacaggcttcgtccc

SEQ ID NO: 520499 - DNA, 25 bp, Rattus norvegicus
gtgtttaccagagaggcttcgtccc

SEQ ID NO: 520500 - DNA, 25 bp, Rattus norvegicus
gtgtttaccctgagtgttgctctct

SEQ ID NO: 520501 - DNA, 25 bp, Rattus norvegicus
gtgtttaccctgtgtgttgctctct

SEQ ID NO: 520502 - DNA, 25 bp, Rattus norvegicus
gtgtttacctgtacacaagccattg

SEQ ID NO: 520503 - DNA, 25 bp, Rattus norvegicus
gtgtttacctgttcacaagccattg

SEQ ID NO: 520504 - DNA, 25 bp, Rattus norvegicus
gtgtttacttcaatgcagatgcctt

SEQ ID NO: 520505 - DNA, 25 bp, Rattus norvegicus
gtgtttacttcattgcagatgcctt

SEQ ID NO: 520506 - DNA, 25 bp, Rattus norvegicus
gtgtttacttccagcagtgaattga

SEQ ID NO: 520507 - DNA, 25 bp, Rattus norvegicus
gtgtttacttcctgcagtgaattga

SEQ ID NO: 520508 - DNA, 25 bp, Rattus norvegicus
gtgtttagactgctcccaagcacta

SEQ ID NO: 520509 - DNA, 25 bp, Rattus norvegicus
gtgtttagactggtcccaagcacta

SEQ ID NO: 520510 - DNA, 25 bp, Rattus norvegicus
gtgtttagagtgcatcacccagtct

SEQ ID NO: 520511 - DNA, 25 bp, Rattus norvegicus
gtgtttagagtggatcacccagtct

SEQ ID NO: 520512 - DNA, 25 bp, Rattus norvegicus
gtgtttagatgtccccaactaccgg

SEQ ID NO: 520513 - DNA, 25 bp, Rattus norvegicus
gtgtttagatgtgcccaactaccgg

SEQ ID NO: 520514 - DNA, 25 bp, Rattus norvegicus
gtgtttagcaagatgatgtaaccac

SEQ ID NO: 520515 - DNA, 25 bp, Rattus norvegicus
gtgtttagcaagttgatgtaaccac

SEQ ID NO: 520516 - DNA, 25 bp, Rattus norvegicus
gtgtttagccgtccgtaaagcatta

SEQ ID NO: 520517 - DNA, 25 bp, Rattus norvegicus
gtgtttagccgtgcgtaaagcatta

SEQ ID NO: 520518 - DNA, 25 bp, Rattus norvegicus
gtgtttagctatccatctccagttt

SEQ ID NO: 520519 - DNA, 25 bp, Rattus norvegicus
gtgtttagctatgcatctccagttt

SEQ ID NO: 520520 - DNA, 25 bp, Rattus norvegicus
gtgtttaggaatagaaactccccag

SEQ ID NO: 520521 - DNA, 25 bp, Rattus norvegicus
gtgtttaggaattgaaactccccag

SEQ ID NO: 520522 - DNA, 25 bp, Rattus norvegicus
gtgtttagtatcaaaagagcccgag

SEQ ID NO: 520523 - DNA, 25 bp, Rattus norvegicus
gtgtttagtatctaaagagcccgag

SEQ ID NO: 520524 - DNA, 25 bp, Rattus norvegicus
gtgtttagtatgatcagccactgaa

SEQ ID NO: 520525 - DNA, 25 bp, Rattus norvegicus
gtgtttagtatgttcagccactgaa

SEQ ID NO: 520526 - DNA, 25 bp, Rattus norvegicus
gtgtttagtcctcatgagtatacca

SEQ ID NO: 520527 - DNA, 25 bp, Rattus norvegicus
gtgtttagtcctgatgagtatacca

SEQ ID NO: 520528 - DNA, 25 bp, Rattus norvegicus
gtgtttagtcttcagccttattgga

SEQ ID NO: 520529 - DNA, 25 bp, Rattus norvegicus
gtgtttagtcttgagccttattgga

SEQ ID NO: 520530 - DNA, 25 bp, Rattus norvegicus
gtgtttataatgacctttctccctg

SEQ ID NO: 520531 - DNA, 25 bp, Rattus norvegicus
gtgtttataatgtcctttctccctg

SEQ ID NO: 520532 - DNA, 25 bp, Rattus norvegicus
gtgtttatatcacttacagtggttt

SEQ ID NO: 520533 - DNA, 25 bp, Rattus norvegicus
gtgtttatatcagttacagtggttt

SEQ ID NO: 520534 - DNA, 25 bp, Rattus norvegicus
gtgtttatcagccttgaaccccagg

SEQ ID NO: 520535 - DNA, 25 bp, Rattus norvegicus
gtgtttatcagcgttgaaccccagg

SEQ ID NO: 520536 - DNA, 25 bp, Rattus norvegicus
gtgtttatggaaataccacaggtcc

SEQ ID NO: 520537 - DNA, 25 bp, Rattus norvegicus
gtgtttatggaattaccacaggtcc

SEQ ID NO: 520538 - DNA, 25 bp, Rattus norvegicus
gtgtttatggagaccttgccagcta

SEQ ID NO: 520539 - DNA, 25 bp, Rattus norvegicus
gtgtttatggagtccttgccagcta

SEQ ID NO: 520540 - DNA, 25 bp, Rattus norvegicus
gtgtttattacactgtcactgatac

SEQ ID NO: 520541 - DNA, 25 bp, Rattus norvegicus
gtgtttattacagtgtcactgatac

SEQ ID NO: 520542 - DNA, 25 bp, Rattus norvegicus
gtgtttattataagccaagggcatt

SEQ ID NO: 520543 - DNA, 25 bp, Rattus norvegicus
gtgtttattatatgccaagggcatt

SEQ ID NO: 520544 - DNA, 25 bp, Rattus norvegicus
gtgtttattatcagggagtcctctt

SEQ ID NO: 520545 - DNA, 25 bp, Rattus norvegicus
gtgtttattatctgggagtcctctt

SEQ ID NO: 520546 - DNA, 25 bp, Rattus norvegicus
gtgtttatttgcacatctgcttcca

SEQ ID NO: 520547 - DNA, 25 bp, Rattus norvegicus
gtgtttatttgctcatctgcttcca

SEQ ID NO: 520548 - DNA, 25 bp, Rattus norvegicus
gtgtttcaaaagaacatcttctcct

SEQ ID NO: 520549 - DNA, 25 bp, Rattus norvegicus
gtgtttcaaaagtacatcttctcct

SEQ ID NO: 520550 - DNA, 25 bp, Rattus norvegicus
gtgtttcaaactcccaccaaaggtg

SEQ ID NO: 520551 - DNA, 25 bp, Rattus norvegicus
gtgtttcaaactgccaccaaaggtg

SEQ ID NO: 520552 - DNA, 25 bp, Rattus norvegicus
gtgtttcaagatagcgtttctctgt

SEQ ID NO: 520553 - DNA, 25 bp, Rattus norvegicus
gtgtttcaagattgcgtttctctgt

SEQ ID NO: 520554 - DNA, 25 bp, Rattus norvegicus
gtgtttcacaggaaccactcatgta

SEQ ID NO: 520555 - DNA, 25 bp, Rattus norvegicus
gtgtttcacaggtaccactcatgta

SEQ ID NO: 520556 - DNA, 25 bp, Rattus norvegicus
gtgtttcacatcaaccttctaagac

SEQ ID NO: 520557 - DNA, 25 bp, Rattus norvegicus
gtgtttcacatctaccttctaagac

SEQ ID NO: 520558 - DNA, 25 bp, Rattus norvegicus
gtgtttcacattaggagcataagga

SEQ ID NO: 520559 - DNA, 25 bp, Rattus norvegicus
gtgtttcacatttggagcataagga

SEQ ID NO: 520560 - DNA, 25 bp, Rattus norvegicus
gtgtttcacccgaatgtatttccga

SEQ ID NO: 520561 - DNA, 25 bp, Rattus norvegicus
gtgtttcacccgtatgtatttccga

SEQ ID NO: 520562 - DNA, 25 bp, Rattus norvegicus
gtgtttcactggcttctgttgatct

SEQ ID NO: 520563 - DNA, 25 bp, Rattus norvegicus
gtgtttcactgggttctgttgatct

SEQ ID NO: 520564 - DNA, 25 bp, Rattus norvegicus
gtgtttcaggtgagtgatcttgcat

SEQ ID NO: 520565 - DNA, 25 bp, Rattus norvegicus
gtgtttcaggtgtgtgatcttgcat

SEQ ID NO: 520566 - DNA, 25 bp, Rattus norvegicus
gtgtttcatacacataggctactga

SEQ ID NO: 520567 - DNA, 25 bp, Rattus norvegicus
gtgtttcatacagataggctactga

SEQ ID NO: 520568 - DNA, 25 bp, Rattus norvegicus
gtgtttcatataccgctaaagccga

SEQ ID NO: 520569 - DNA, 25 bp, Rattus norvegicus
gtgtttcatatagcgctaaagccga

SEQ ID NO: 520570 - DNA, 25 bp, Rattus norvegicus
gtgtttcatcaaaaataaccctgag

SEQ ID NO: 520571 - DNA, 25 bp, Rattus norvegicus
gtgtttcatcaataataaccctgag

SEQ ID NO: 520572 - DNA, 25 bp, Rattus norvegicus
gtgtttcatggcagtagcgcggctc

SEQ ID NO: 520573 - DNA, 25 bp, Rattus norvegicus
gtgtttcatggctgtagcgcggctc

SEQ ID NO: 520574 - DNA, 25 bp, Rattus norvegicus
gtgtttcattatcttgctgaggcca

SEQ ID NO: 520575 - DNA, 25 bp, Rattus norvegicus
gtgtttcattatgttgctgaggcca

SEQ ID NO: 520576 - DNA, 25 bp, Rattus norvegicus
gtgtttcattggaccagtggttcct

SEQ ID NO: 520577 - DNA, 25 bp, Rattus norvegicus
gtgtttcattggtccagtggttcct

SEQ ID NO: 520578 - DNA, 25 bp, Rattus norvegicus
gtgtttcattgtatcctacagagta

SEQ ID NO: 520579 - DNA, 25 bp, Rattus norvegicus
gtgtttcattgtttcctacagagta

SEQ ID NO: 520580 - DNA, 25 bp, Rattus norvegicus
gtgtttccaagaacgaccaggtcag

SEQ ID NO: 520581 - DNA, 25 bp, Rattus norvegicus
gtgtttccaagatcgaccaggtcag

SEQ ID NO: 520582 - DNA, 25 bp, Rattus norvegicus
gtgtttccacctcgaggagctatgt

SEQ ID NO: 520583 - DNA, 25 bp, Rattus norvegicus
gtgtttccacctggaggagctatgt

SEQ ID NO: 520584 - DNA, 25 bp, Rattus norvegicus
gtgtttccagcaaacagacggctct

SEQ ID NO: 520585 - DNA, 25 bp, Rattus norvegicus
gtgtttccagcatacagacggctct

SEQ ID NO: 520586 - DNA, 25 bp, Rattus norvegicus
gtgtttccagggagacaccccgaag

SEQ ID NO: 520587 - DNA, 25 bp, Rattus norvegicus
gtgtttccagggtgacaccccgaag

SEQ ID NO: 520588 - DNA, 25 bp, Rattus norvegicus
gtgtttccagttcatgtctctcaaa

SEQ ID NO: 520589 - DNA, 25 bp, Rattus norvegicus
gtgtttccagttgatgtctctcaaa

SEQ ID NO: 520590 - DNA, 25 bp, Rattus norvegicus
gtgtttccatccagcattgaagcca

SEQ ID NO: 520591 - DNA, 25 bp, Rattus norvegicus
gtgtttccatcctgcattgaagcca

SEQ ID NO: 520592 - DNA, 25 bp, Rattus norvegicus
gtgtttcccaagatggagctgcctc

SEQ ID NO: 520593 - DNA, 25 bp, Rattus norvegicus
gtgtttcccaagttggagctgcctc

SEQ ID NO: 520594 - DNA, 25 bp, Rattus norvegicus
gtgtttccccagagctcaatgagaa

SEQ ID NO: 520595 - DNA, 25 bp, Rattus norvegicus
gtgtttccccagtgctcaatgagaa

SEQ ID NO: 520596 - DNA, 25 bp, Rattus norvegicus
gtgtttccctctcacatttgacaag

SEQ ID NO: 520597 - DNA, 25 bp, Rattus norvegicus
gtgtttccctctgacatttgacaag

SEQ ID NO: 520598 - DNA, 25 bp, Rattus norvegicus
gtgtttcccttcattcctgtatctt

SEQ ID NO: 520599 - DNA, 25 bp, Rattus norvegicus
gtgtttcccttctttcctgtatctt

SEQ ID NO: 520600 - DNA, 25 bp, Rattus norvegicus
gtgtttccggttatgtgactgtgcc

SEQ ID NO: 520601 - DNA, 25 bp, Rattus norvegicus
gtgtttccggttttgtgactgtgcc

SEQ ID NO: 520602 - DNA, 25 bp, Rattus norvegicus
gtgtttccgtggcttctcacaatgc

SEQ ID NO: 520603 - DNA, 25 bp, Rattus norvegicus
gtgtttccgtgggttctcacaatgc

SEQ ID NO: 520604 - DNA, 25 bp, Rattus norvegicus
gtgtttcctacaatctgagcatatt

SEQ ID NO: 520605 - DNA, 25 bp, Rattus norvegicus
gtgtttcctacattctgagcatatt

SEQ ID NO: 520606 - DNA, 25 bp, Rattus norvegicus
gtgtttcctcatcaatggttctaaa

SEQ ID NO: 520607 - DNA, 25 bp, Rattus norvegicus
gtgtttcctcatgaatggttctaaa

SEQ ID NO: 520608 - DNA, 25 bp, Rattus norvegicus
gtgtttcctcttaaactgtctgcag

SEQ ID NO: 520609 - DNA, 25 bp, Rattus norvegicus
gtgtttcctcttatatccagttcct

SEQ ID NO: 520610 - DNA, 25 bp, Rattus norvegicus
gtgtttcctctttaactgtctgcag

SEQ ID NO: 520611 - DNA, 25 bp, Rattus norvegicus
gtgtttcctcttttatccagttcct

SEQ ID NO: 520612 - DNA, 25 bp, Rattus norvegicus
gtgtttcctgtccttcacataaacg

SEQ ID NO: 520613 - DNA, 25 bp, Rattus norvegicus
gtgtttcctgtcgttcacataaacg

SEQ ID NO: 520614 - DNA, 25 bp, Rattus norvegicus
gtgtttccttaaactcaaatccatc

SEQ ID NO: 520615 - DNA, 25 bp, Rattus norvegicus
gtgtttccttaatctcaaatccatc

SEQ ID NO: 520616 - DNA, 25 bp, Rattus norvegicus
gtgtttccttagatactgctaccaa

SEQ ID NO: 520617 - DNA, 25 bp, Rattus norvegicus
gtgtttccttagttactgctaccaa

SEQ ID NO: 520618 - DNA, 25 bp, Rattus norvegicus
gtgtttccttgccttgtggatatga

SEQ ID NO: 520619 - DNA, 25 bp, Rattus norvegicus
gtgtttccttgcgttgtggatatga

SEQ ID NO: 520620 - DNA, 25 bp, Rattus norvegicus
gtgtttcgagaccttgacttgggaa

SEQ ID NO: 520621 - DNA, 25 bp, Rattus norvegicus
gtgtttcgagacgttgacttgggaa

SEQ ID NO: 520622 - DNA, 25 bp, Rattus norvegicus
gtgtttcgcagtagaacagagttcc

SEQ ID NO: 520623 - DNA, 25 bp, Rattus norvegicus
gtgtttcgcagttgaacagagttcc

SEQ ID NO: 520624 - DNA, 25 bp, Rattus norvegicus
gtgtttcgtgacagtgtgtgttatc

SEQ ID NO: 520625 - DNA, 25 bp, Rattus norvegicus
gtgtttcgtgactgtgtgtgttatc

SEQ ID NO: 520626 - DNA, 25 bp, Rattus norvegicus
gtgtttcgtgcaaagtactgcccgg

SEQ ID NO: 520627 - DNA, 25 bp, Rattus norvegicus
gtgtttcgtgcatagtactgcccgg

SEQ ID NO: 520628 - DNA, 25 bp, Rattus norvegicus
gtgtttcgttgtattctttgcctag

SEQ ID NO: 520629 - DNA, 25 bp, Rattus norvegicus
gtgtttcgttgttttctttgcctag

SEQ ID NO: 520630 - DNA, 25 bp, Rattus norvegicus
gtgtttctaaagatgcgtcttgtgg

SEQ ID NO: 520631 - DNA, 25 bp, Rattus norvegicus
gtgtttctaaagttgcgtcttgtgg

SEQ ID NO: 520632 - DNA, 25 bp, Rattus norvegicus
gtgtttctaagcattccatatttgt

SEQ ID NO: 520633 - DNA, 25 bp, Rattus norvegicus
gtgtttctaagctttccatatttgt

SEQ ID NO: 520634 - DNA, 25 bp, Rattus norvegicus
gtgtttctacataaaggtcttcatt

SEQ ID NO: 520635 - DNA, 25 bp, Rattus norvegicus
gtgtttctacattaaggtcttcatt

SEQ ID NO: 520636 - DNA, 25 bp, Rattus norvegicus
gtgtttctaccaatatccagtctac

SEQ ID NO: 520637 - DNA, 25 bp, Rattus norvegicus
gtgtttctaccattatccagtctac

SEQ ID NO: 520638 - DNA, 25 bp, Rattus norvegicus
gtgtttctatacatttattgggcaa

SEQ ID NO: 520639 - DNA, 25 bp, Rattus norvegicus
gtgtttctatacttttattgggcaa

SEQ ID NO: 520640 - DNA, 25 bp, Rattus norvegicus
gtgtttctatcactgttgccctcct

SEQ ID NO: 520641 - DNA, 25 bp, Rattus norvegicus
gtgtttctatcagtgttgccctcct

SEQ ID NO: 520642 - DNA, 25 bp, Rattus norvegicus
gtgtttctatggaactggtcttctt

SEQ ID NO: 520643 - DNA, 25 bp, Rattus norvegicus
gtgtttctatggtactggtcttctt

SEQ ID NO: 520644 - DNA, 25 bp, Rattus norvegicus
gtgtttctcaaactgtctctaggga

SEQ ID NO: 520645 - DNA, 25 bp, Rattus norvegicus
gtgtttctcaaagtgtctctaggga

SEQ ID NO: 520646 - DNA, 25 bp, Rattus norvegicus
gtgtttctcagaatcactgattgta

SEQ ID NO: 520647 - DNA, 25 bp, Rattus norvegicus
gtgtttctcagattcactgattgta

SEQ ID NO: 520648 - DNA, 25 bp, Rattus norvegicus
gtgtttctcctgcacagagtattgc

SEQ ID NO: 520649 - DNA, 25 bp, Rattus norvegicus
gtgtttctcctggacagagtattgc

SEQ ID NO: 520650 - DNA, 25 bp, Rattus norvegicus
gtgtttctctgtcgaagactctagt

SEQ ID NO: 520651 - DNA, 25 bp, Rattus norvegicus
gtgtttctctgtggaagactctagt

SEQ ID NO: 520652 - DNA, 25 bp, Rattus norvegicus
gtgtttctcttgaagtctctgtgga

SEQ ID NO: 520653 - DNA, 25 bp, Rattus norvegicus
gtgtttctcttgtagtctctgtgga

SEQ ID NO: 520654 - DNA, 25 bp, Rattus norvegicus
gtgtttctgataacacatagtaact

SEQ ID NO: 520655 - DNA, 25 bp, Rattus norvegicus
gtgtttctgatatcacatagtaact

SEQ ID NO: 520656 - DNA, 25 bp, Rattus norvegicus
gtgtttctggagaggttcacatcga

SEQ ID NO: 520657 - DNA, 25 bp, Rattus norvegicus
gtgtttctggagtggttcacatcga

SEQ ID NO: 520658 - DNA, 25 bp, Rattus norvegicus
gtgtttctgtaccttgactgctgac

SEQ ID NO: 520659 - DNA, 25 bp, Rattus norvegicus
gtgtttctgtacgttgactgctgac

SEQ ID NO: 520660 - DNA, 25 bp, Rattus norvegicus
gtgtttctgtgtccaccacagtcat

SEQ ID NO: 520661 - DNA, 25 bp, Rattus norvegicus
gtgtttctgtgtgcaccacagtcat

SEQ ID NO: 520662 - DNA, 25 bp, Rattus norvegicus
gtgtttcttaaacatcatgcaccat

SEQ ID NO: 520663 - DNA, 25 bp, Rattus norvegicus
gtgtttcttaaagatcatgcaccat

SEQ ID NO: 520664 - DNA, 25 bp, Rattus norvegicus
gtgtttcttataatatgtctctctt

SEQ ID NO: 520665 - DNA, 25 bp, Rattus norvegicus
gtgtttcttatattatgtctctctt

SEQ ID NO: 520666 - DNA, 25 bp, Rattus norvegicus
gtgtttcttatcaggctacataggc

SEQ ID NO: 520667 - DNA, 25 bp, Rattus norvegicus
gtgtttcttatcctgtatcctttat

SEQ ID NO: 520668 - DNA, 25 bp, Rattus norvegicus
gtgtttcttatcgtgtatcctttat

SEQ ID NO: 520669 - DNA, 25 bp, Rattus norvegicus
gtgtttcttatctggctacataggc

SEQ ID NO: 520670 - DNA, 25 bp, Rattus norvegicus
gtgtttcttcatcagcaacttcaac

SEQ ID NO: 520671 - DNA, 25 bp, Rattus norvegicus
gtgtttcttcatgagcaacttcaac

SEQ ID NO: 520672 - DNA, 25 bp, Rattus norvegicus
gtgtttcttcccaagacagaagcta

SEQ ID NO: 520673 - DNA, 25 bp, Rattus norvegicus
gtgtttcttccctagacagaagcta

SEQ ID NO: 520674 - DNA, 25 bp, Rattus norvegicus
gtgtttcttcctcggaggagccttg

SEQ ID NO: 520675 - DNA, 25 bp, Rattus norvegicus
gtgtttcttcctgggaggagccttg

SEQ ID NO: 520676 - DNA, 25 bp, Rattus norvegicus
gtgtttcttctcattgaaccttgaa

SEQ ID NO: 520677 - DNA, 25 bp, Rattus norvegicus
gtgtttcttctctttgaaccttgaa

SEQ ID NO: 520678 - DNA, 25 bp, Rattus norvegicus
gtgtttcttctgacattaaaaggca

SEQ ID NO: 520679 - DNA, 25 bp, Rattus norvegicus
gtgtttcttctgtcattaaaaggca

SEQ ID NO: 520680 - DNA, 25 bp, Rattus norvegicus
gtgtttcttgaaatgagcctgagtg

SEQ ID NO: 520681 - DNA, 25 bp, Rattus norvegicus
gtgtttcttgaattgagcctgagtg

SEQ ID NO: 520682 - DNA, 25 bp, Rattus norvegicus
gtgtttctttttagcattatgtcag

SEQ ID NO: 520683 - DNA, 25 bp, Rattus norvegicus
gtgtttcttttttgcattatgtcag

SEQ ID NO: 520684 - DNA, 25 bp, Rattus norvegicus
gtgtttgacactattgttctctgaa

SEQ ID NO: 520685 - DNA, 25 bp, Rattus norvegicus
gtgtttgacacttttgttctctgaa

SEQ ID NO: 520686 - DNA, 25 bp, Rattus norvegicus
gtgtttgaccacacactgggttcaa

SEQ ID NO: 520687 - DNA, 25 bp, Rattus norvegicus
gtgtttgaccactcactgggttcaa

SEQ ID NO: 520688 - DNA, 25 bp, Rattus norvegicus
gtgtttgactatattccagcttgta

SEQ ID NO: 520689 - DNA, 25 bp, Rattus norvegicus
gtgtttgactattttccagcttgta

SEQ ID NO: 520690 - DNA, 25 bp, Rattus norvegicus
gtgtttgagcctcctcgttcccttg

SEQ ID NO: 520691 - DNA, 25 bp, Rattus norvegicus
gtgtttgagcctgctcgttcccttg

SEQ ID NO: 520692 - DNA, 25 bp, Rattus norvegicus
gtgtttgagcgtatcgagctgccgc

SEQ ID NO: 520693 - DNA, 25 bp, Rattus norvegicus
gtgtttgagcgtttcgagctgccgc

SEQ ID NO: 520694 - DNA, 25 bp, Rattus norvegicus
gtgtttgagtttctttgcagtcccc

SEQ ID NO: 520695 - DNA, 25 bp, Rattus norvegicus
gtgtttgagtttgtttgcagtcccc

SEQ ID NO: 520696 - DNA, 25 bp, Rattus norvegicus
gtgtttgataagacgttggcagaat

SEQ ID NO: 520697 - DNA, 25 bp, Rattus norvegicus
gtgtttgataagtcgttggcagaat

SEQ ID NO: 520698 - DNA, 25 bp, Rattus norvegicus
gtgtttgatcaccttctgcttggaa

SEQ ID NO: 520699 - DNA, 25 bp, Rattus norvegicus
gtgtttgatcacgttctgcttggaa

SEQ ID NO: 520700 - DNA, 25 bp, Rattus norvegicus
gtgtttgatccaaaaaatttccagt

SEQ ID NO: 520701 - DNA, 25 bp, Rattus norvegicus
gtgtttgatccataaaatttccagt

SEQ ID NO: 520702 - DNA, 25 bp, Rattus norvegicus
gtgtttgatttacgtttgttcctga

SEQ ID NO: 520703 - DNA, 25 bp, Rattus norvegicus
gtgtttgatttaggtttgttcctga

SEQ ID NO: 520704 - DNA, 25 bp, Rattus norvegicus
gtgtttgcacacatttccagaacgt

SEQ ID NO: 520705 - DNA, 25 bp, Rattus norvegicus
gtgtttgcacacttttccagaacgt

SEQ ID NO: 520706 - DNA, 25 bp, Rattus norvegicus
gtgtttgcaccaaatgctgtctctt

SEQ ID NO: 520707 - DNA, 25 bp, Rattus norvegicus
gtgtttgcaccatatgctgtctctt

SEQ ID NO: 520708 - DNA, 25 bp, Rattus norvegicus
gtgtttgcacctaacttcctgtgag

SEQ ID NO: 520709 - DNA, 25 bp, Rattus norvegicus
gtgtttgcaccttacttcctgtgag

SEQ ID NO: 520710 - DNA, 25 bp, Rattus norvegicus
gtgtttgcagaacctagcagtccta

SEQ ID NO: 520711 - DNA, 25 bp, Rattus norvegicus
gtgtttgcagaagctagcagtccta

SEQ ID NO: 520712 - DNA, 25 bp, Rattus norvegicus
gtgtttgcagtcatagtgttcctac

SEQ ID NO: 520713 - DNA, 25 bp, Rattus norvegicus
gtgtttgcagtcttagtgttcctac

SEQ ID NO: 520714 - DNA, 25 bp, Rattus norvegicus
gtgtttgcatggaaaggcgctcttt

SEQ ID NO: 520715 - DNA, 25 bp, Rattus norvegicus
gtgtttgcatggattccagctctgc

SEQ ID NO: 520716 - DNA, 25 bp, Rattus norvegicus
gtgtttgcatggtaaggcgctcttt

SEQ ID NO: 520717 - DNA, 25 bp, Rattus norvegicus
gtgtttgcatggtttccagctctgc

SEQ ID NO: 520718 - DNA, 25 bp, Rattus norvegicus
gtgtttgcatgtcgccattaccgtc

SEQ ID NO: 520719 - DNA, 25 bp, Rattus norvegicus
gtgtttgcatgtggccattaccgtc

SEQ ID NO: 520720 - DNA, 25 bp, Rattus norvegicus
gtgtttgcatttcggtttccgaatt

SEQ ID NO: 520721 - DNA, 25 bp, Rattus norvegicus
gtgtttgcatttgggtttccgaatt

SEQ ID NO: 520722 - DNA, 25 bp, Rattus norvegicus
gtgtttgccaagatcgacatcaacg

SEQ ID NO: 520723 - DNA, 25 bp, Rattus norvegicus
gtgtttgccaagttcgacatcaacg

SEQ ID NO: 520724 - DNA, 25 bp, Rattus norvegicus
gtgtttgcccaacatttggaaccag

SEQ ID NO: 520725 - DNA, 25 bp, Rattus norvegicus
gtgtttgcccaagatttggaaccag

SEQ ID NO: 520726 - DNA, 25 bp, Rattus norvegicus
gtgtttgccccacagatagcatttt

SEQ ID NO: 520727 - DNA, 25 bp, Rattus norvegicus
gtgtttgccccagagatagcatttt

SEQ ID NO: 520728 - DNA, 25 bp, Rattus norvegicus
gtgtttgcgagtatatatattttct

SEQ ID NO: 520729 - DNA, 25 bp, Rattus norvegicus
gtgtttgcgagtcccctgctttaaa

SEQ ID NO: 520730 - DNA, 25 bp, Rattus norvegicus
gtgtttgcgagtgccctgctttaaa

SEQ ID NO: 520731 - DNA, 25 bp, Rattus norvegicus
gtgtttgcgagtttatatattttct

SEQ ID NO: 520732 - DNA, 25 bp, Rattus norvegicus
gtgtttgctcacatggtagactaaa

SEQ ID NO: 520733 - DNA, 25 bp, Rattus norvegicus
gtgtttgctcacttggtagactaaa

SEQ ID NO: 520734 - DNA, 25 bp, Rattus norvegicus
gtgtttgctcatatgctttttctga

SEQ ID NO: 520735 - DNA, 25 bp, Rattus norvegicus
gtgtttgctcatattcatgctgtga

SEQ ID NO: 520736 - DNA, 25 bp, Rattus norvegicus
gtgtttgctcatttgctttttctga

SEQ ID NO: 520737 - DNA, 25 bp, Rattus norvegicus
gtgtttgctcattttcatgctgtga

SEQ ID NO: 520738 - DNA, 25 bp, Rattus norvegicus
gtgtttgctgccctaagattggaca

SEQ ID NO: 520739 - DNA, 25 bp, Rattus norvegicus
gtgtttgctgccgtaagattggaca

SEQ ID NO: 520740 - DNA, 25 bp, Rattus norvegicus
gtgtttgctgtgaaactgaatcccc

SEQ ID NO: 520741 - DNA, 25 bp, Rattus norvegicus
gtgtttgctgtgtaactgaatcccc

SEQ ID NO: 520742 - DNA, 25 bp, Rattus norvegicus
gtgtttggaactaccctgctaagct

SEQ ID NO: 520743 - DNA, 25 bp, Rattus norvegicus
gtgtttggaacttccctgctaagct

SEQ ID NO: 520744 - DNA, 25 bp, Rattus norvegicus
gtgtttggaaggaccacacccatgt

SEQ ID NO: 520745 - DNA, 25 bp, Rattus norvegicus
gtgtttggaaggtccacacccatgt

SEQ ID NO: 520746 - DNA, 25 bp, Rattus norvegicus
gtgtttggaagtcattcttcgctct

SEQ ID NO: 520747 - DNA, 25 bp, Rattus norvegicus
gtgtttggaagtgattcttcgctct

SEQ ID NO: 520748 - DNA, 25 bp, Rattus norvegicus
gtgtttggatgtcaattcctgtctc

SEQ ID NO: 520749 - DNA, 25 bp, Rattus norvegicus
gtgtttggatgtgaattcctgtctc

SEQ ID NO: 520750 - DNA, 25 bp, Rattus norvegicus
gtgtttggcaaaaaactctgtcaag

SEQ ID NO: 520751 - DNA, 25 bp, Rattus norvegicus
gtgtttggcaaataactctgtcaag

SEQ ID NO: 520752 - DNA, 25 bp, Rattus norvegicus
gtgtttggccctatagacagtgaaa

SEQ ID NO: 520753 - DNA, 25 bp, Rattus norvegicus
gtgtttggccctttagacagtgaaa

SEQ ID NO: 520754 - DNA, 25 bp, Rattus norvegicus
gtgtttggcctgagtaccacatgtg

SEQ ID NO: 520755 - DNA, 25 bp, Rattus norvegicus
gtgtttggcctgtgtaccacatgtg

SEQ ID NO: 520756 - DNA, 25 bp, Rattus norvegicus
gtgtttggccttctgagaactggtc

SEQ ID NO: 520757 - DNA, 25 bp, Rattus norvegicus
gtgtttggccttgtgagaactggtc

SEQ ID NO: 520758 - DNA, 25 bp, Rattus norvegicus
gtgtttgggaacatcctctcaggac

SEQ ID NO: 520759 - DNA, 25 bp, Rattus norvegicus
gtgtttgggaacttcctctcaggac

SEQ ID NO: 520760 - DNA, 25 bp, Rattus norvegicus
gtgtttgggatcagtgttctcattt

SEQ ID NO: 520761 - DNA, 25 bp, Rattus norvegicus
gtgtttgggatctgtgttctcattt

SEQ ID NO: 520762 - DNA, 25 bp, Rattus norvegicus
gtgtttgggcccaccctgatgagac

SEQ ID NO: 520763 - DNA, 25 bp, Rattus norvegicus
gtgtttgggccctccctgatgagac

SEQ ID NO: 520764 - DNA, 25 bp, Rattus norvegicus
gtgtttggtacccacatacaaaaca

SEQ ID NO: 520765 - DNA, 25 bp, Rattus norvegicus
gtgtttggtaccgacatacaaaaca

SEQ ID NO: 520766 - DNA, 25 bp, Rattus norvegicus
gtgtttgtaaatactctggcttcct

SEQ ID NO: 520767 - DNA, 25 bp, Rattus norvegicus
gtgtttgtaaatcgagaccctctta

SEQ ID NO: 520768 - DNA, 25 bp, Rattus norvegicus
gtgtttgtaaatggagaccctctta

SEQ ID NO: 520769 - DNA, 25 bp, Rattus norvegicus
gtgtttgtaaattctctggcttcct

SEQ ID NO: 520770 - DNA, 25 bp, Rattus norvegicus
gtgtttgtaaccctataggaggaat

SEQ ID NO: 520771 - DNA, 25 bp, Rattus norvegicus
gtgtttgtaaccgtataggaggaat

SEQ ID NO: 520772 - DNA, 25 bp, Rattus norvegicus
gtgtttgtactcacatggtggctag

SEQ ID NO: 520773 - DNA, 25 bp, Rattus norvegicus
gtgtttgtactctcatggtggctag

SEQ ID NO: 520774 - DNA, 25 bp, Rattus norvegicus
gtgtttgtacttagaaccagttgac

SEQ ID NO: 520775 - DNA, 25 bp, Rattus norvegicus
gtgtttgtactttgaaccagttgac

SEQ ID NO: 520776 - DNA, 25 bp, Rattus norvegicus
gtgtttgtatgtatgcgcctacaca

SEQ ID NO: 520777 - DNA, 25 bp, Rattus norvegicus
gtgtttgtatgtttgcgcctacaca

SEQ ID NO: 520778 - DNA, 25 bp, Rattus norvegicus
gtgtttgtcacaatccagggctagc

SEQ ID NO: 520779 - DNA, 25 bp, Rattus norvegicus
gtgtttgtcacattccagggctagc

SEQ ID NO: 520780 - DNA, 25 bp, Rattus norvegicus
gtgtttgtcatgaccgtcttgatca

SEQ ID NO: 520781 - DNA, 25 bp, Rattus norvegicus
gtgtttgtcatgtccgtcttgatca

SEQ ID NO: 520782 - DNA, 25 bp, Rattus norvegicus
gtgtttgtctacctgtttagcattc

SEQ ID NO: 520783 - DNA, 25 bp, Rattus norvegicus
gtgtttgtctacgtgtttagcattc

SEQ ID NO: 520784 - DNA, 25 bp, Rattus norvegicus
gtgtttgtctataccgtcagcaata

SEQ ID NO: 520785 - DNA, 25 bp, Rattus norvegicus
gtgtttgtctattccgtcagcaata

SEQ ID NO: 520786 - DNA, 25 bp, Rattus norvegicus
gtgtttgtctgtaggagacctcaga

SEQ ID NO: 520787 - DNA, 25 bp, Rattus norvegicus
gtgtttgtctgttggagacctcaga

SEQ ID NO: 520788 - DNA, 25 bp, Rattus norvegicus
gtgtttgtgaatagagctgtgagct

SEQ ID NO: 520789 - DNA, 25 bp, Rattus norvegicus
gtgtttgtgaattgagctgtgagct

SEQ ID NO: 520790 - DNA, 25 bp, Rattus norvegicus
gtgtttgtgaccatagctatggata

SEQ ID NO: 520791 - DNA, 25 bp, Rattus norvegicus
gtgtttgtgaccttagctatggata

SEQ ID NO: 520792 - DNA, 25 bp, Rattus norvegicus
gtgtttgtgctcagaaatcaccata

SEQ ID NO: 520793 - DNA, 25 bp, Rattus norvegicus
gtgtttgtgctctgaaatcaccata

SEQ ID NO: 520794 - DNA, 25 bp, Rattus norvegicus
gtgtttgtggacaatgacgaaagga

SEQ ID NO: 520795 - DNA, 25 bp, Rattus norvegicus
gtgtttgtggactatgacgaaagga

SEQ ID NO: 520796 - DNA, 25 bp, Rattus norvegicus
gtgtttgtgtgcatttgctctggca

SEQ ID NO: 520797 - DNA, 25 bp, Rattus norvegicus
gtgtttgtgtgcttttgctctggca

SEQ ID NO: 520798 - DNA, 25 bp, Rattus norvegicus
gtgtttgtgtgtcaccattttgctt

SEQ ID NO: 520799 - DNA, 25 bp, Rattus norvegicus
gtgtttgtgtgtgaccattttgctt

SEQ ID NO: 520800 - DNA, 25 bp, Rattus norvegicus
gtgtttgtgttgacgctttttataa

SEQ ID NO: 520801 - DNA, 25 bp, Rattus norvegicus
gtgtttgtgttgtcgctttttataa

SEQ ID NO: 520802 - DNA, 25 bp, Rattus norvegicus
gtgtttgttactattcggtattgca

SEQ ID NO: 520803 - DNA, 25 bp, Rattus norvegicus
gtgtttgttacttttcggtattgca

SEQ ID NO: 520804 - DNA, 25 bp, Rattus norvegicus
gtgtttgttctaactctatctgcag

SEQ ID NO: 520805 - DNA, 25 bp, Rattus norvegicus
gtgtttgttctatctctatctgcag

SEQ ID NO: 520806 - DNA, 25 bp, Rattus norvegicus
gtgtttgtttcgagagacttggtaa

SEQ ID NO: 520807 - DNA, 25 bp, Rattus norvegicus
gtgtttgtttcgtgagacttggtaa

SEQ ID NO: 520808 - DNA, 25 bp, Rattus norvegicus
gtgttttaaatgagccctgaaatgt

SEQ ID NO: 520809 - DNA, 25 bp, Rattus norvegicus
gtgttttaaatgtgccctgaaatgt

SEQ ID NO: 520810 - DNA, 25 bp, Rattus norvegicus
gtgttttaaggcaatccctgtccca

SEQ ID NO: 520811 - DNA, 25 bp, Rattus norvegicus
gtgttttaaggctatccctgtccca

SEQ ID NO: 520812 - DNA, 25 bp, Rattus norvegicus
gtgttttaatgtaccctgttcatgg

SEQ ID NO: 520813 - DNA, 25 bp, Rattus norvegicus
gtgttttaatgttccctgttcatgg

SEQ ID NO: 520814 - DNA, 25 bp, Rattus norvegicus
gtgttttacaccctgagattccatg

SEQ ID NO: 520815 - DNA, 25 bp, Rattus norvegicus
gtgttttacaccgtgagattccatg

SEQ ID NO: 520816 - DNA, 25 bp, Rattus norvegicus
gtgttttaccaccaattgcctttgt

SEQ ID NO: 520817 - DNA, 25 bp, Rattus norvegicus
gtgttttaccacgaattgcctttgt

SEQ ID NO: 520818 - DNA, 25 bp, Rattus norvegicus
gtgttttactctcccacatccgaaa

SEQ ID NO: 520819 - DNA, 25 bp, Rattus norvegicus
gtgttttactctgccacatccgaaa

SEQ ID NO: 520820 - DNA, 25 bp, Rattus norvegicus
gtgttttactgtagatttcctttct

SEQ ID NO: 520821 - DNA, 25 bp, Rattus norvegicus
gtgttttactgttgatttcctttct

SEQ ID NO: 520822 - DNA, 25 bp, Rattus norvegicus
gtgttttagccactaaatttcgctg

SEQ ID NO: 520823 - DNA, 25 bp, Rattus norvegicus
gtgttttagccagtaaatttcgctg

SEQ ID NO: 520824 - DNA, 25 bp, Rattus norvegicus
gtgttttaggtgattgcctcttctc

SEQ ID NO: 520825 - DNA, 25 bp, Rattus norvegicus
gtgttttaggtgtttgcctcttctc

SEQ ID NO: 520826 - DNA, 25 bp, Rattus norvegicus
gtgttttagtcacatcccttaagca

SEQ ID NO: 520827 - DNA, 25 bp, Rattus norvegicus
gtgttttagtcagatcccttaagca

SEQ ID NO: 520828 - DNA, 25 bp, Rattus norvegicus
gtgttttagtctcaatctgaggcaa

SEQ ID NO: 520829 - DNA, 25 bp, Rattus norvegicus
gtgttttagtctgaatctgaggcaa

SEQ ID NO: 520830 - DNA, 25 bp, Rattus norvegicus
gtgttttattatcttgtccaggacc

SEQ ID NO: 520831 - DNA, 25 bp, Rattus norvegicus
gtgttttattatgttgtccaggacc

SEQ ID NO: 520832 - DNA, 25 bp, Rattus norvegicus
gtgttttattccatttgagttgctt

SEQ ID NO: 520833 - DNA, 25 bp, Rattus norvegicus
gtgttttattccttttgagttgctt

SEQ ID NO: 520834 - DNA, 25 bp, Rattus norvegicus
gtgttttcaaatcctttggtgcaat

SEQ ID NO: 520835 - DNA, 25 bp, Rattus norvegicus
gtgttttcaaatgctttggtgcaat

SEQ ID NO: 520836 - DNA, 25 bp, Rattus norvegicus
gtgttttcacaaactgcgaagtgca

SEQ ID NO: 520837 - DNA, 25 bp, Rattus norvegicus
gtgttttcacaatctgcgaagtgca

SEQ ID NO: 520838 - DNA, 25 bp, Rattus norvegicus
gtgttttcaccaatcaaagtgctgt

SEQ ID NO: 520839 - DNA, 25 bp, Rattus norvegicus
gtgttttcaccattcaaagtgctgt

SEQ ID NO: 520840 - DNA, 25 bp, Rattus norvegicus
gtgttttcagcaagtccttgtcctt

SEQ ID NO: 520841 - DNA, 25 bp, Rattus norvegicus
gtgttttcagcatgtccttgtcctt

SEQ ID NO: 520842 - DNA, 25 bp, Rattus norvegicus
gtgttttcattgatgcacctttgag

SEQ ID NO: 520843 - DNA, 25 bp, Rattus norvegicus
gtgttttcattgcaagttgtccctg

SEQ ID NO: 520844 - DNA, 25 bp, Rattus norvegicus
gtgttttcattggaagttgtccctg

SEQ ID NO: 520845 - DNA, 25 bp, Rattus norvegicus
gtgttttcattgttgcacctttgag

SEQ ID NO: 520846 - DNA, 25 bp, Rattus norvegicus
gtgttttccacactaacacaacgga

SEQ ID NO: 520847 - DNA, 25 bp, Rattus norvegicus
gtgttttccacagtaacacaacgga

SEQ ID NO: 520848 - DNA, 25 bp, Rattus norvegicus
gtgttttccatgagctaagtctaat

SEQ ID NO: 520849 - DNA, 25 bp, Rattus norvegicus
gtgttttccatgtgctaagtctaat

SEQ ID NO: 520850 - DNA, 25 bp, Rattus norvegicus
gtgttttcccacaagagcaggcttt

SEQ ID NO: 520851 - DNA, 25 bp, Rattus norvegicus
gtgttttcccactagagcaggcttt

SEQ ID NO: 520852 - DNA, 25 bp, Rattus norvegicus
gtgttttcccctcggaactttgctg

SEQ ID NO: 520853 - DNA, 25 bp, Rattus norvegicus
gtgttttcccctgggaactttgctg

SEQ ID NO: 520854 - DNA, 25 bp, Rattus norvegicus
gtgttttcctctacctagtaaagag

SEQ ID NO: 520855 - DNA, 25 bp, Rattus norvegicus
gtgttttcctcttcctagtaaagag

SEQ ID NO: 520856 - DNA, 25 bp, Rattus norvegicus
gtgttttcgaaactcaaatctctaa

SEQ ID NO: 520857 - DNA, 25 bp, Rattus norvegicus
gtgttttcgaaagtcaaatctctaa

SEQ ID NO: 520858 - DNA, 25 bp, Rattus norvegicus
gtgttttctccacttggcttagaac

SEQ ID NO: 520859 - DNA, 25 bp, Rattus norvegicus
gtgttttctccagttggcttagaac

SEQ ID NO: 520860 - DNA, 25 bp, Rattus norvegicus
gtgttttctcttcttgttttgttcg

SEQ ID NO: 520861 - DNA, 25 bp, Rattus norvegicus
gtgttttctcttgttgttttgttcg

SEQ ID NO: 520862 - DNA, 25 bp, Rattus norvegicus
gtgttttctgctcgaagcagcacac

SEQ ID NO: 520863 - DNA, 25 bp, Rattus norvegicus
gtgttttctgctggaagcagcacac

SEQ ID NO: 520864 - DNA, 25 bp, Rattus norvegicus
gtgttttcttacctgccttcatgag

SEQ ID NO: 520865 - DNA, 25 bp, Rattus norvegicus
gtgttttcttacgtgccttcatgag

SEQ ID NO: 520866 - DNA, 25 bp, Rattus norvegicus
gtgttttctttaccttctgttgagt

SEQ ID NO: 520867 - DNA, 25 bp, Rattus norvegicus
gtgttttctttagcttctgttgagt

SEQ ID NO: 520868 - DNA, 25 bp, Rattus norvegicus
gtgttttctttcatggctttgccaa

SEQ ID NO: 520869 - DNA, 25 bp, Rattus norvegicus
gtgttttctttcttggctttgccaa

SEQ ID NO: 520870 - DNA, 25 bp, Rattus norvegicus
gtgttttcttttatgtgaggatgtt

SEQ ID NO: 520871 - DNA, 25 bp, Rattus norvegicus
gtgttttcttttttgtgaggatgtt

SEQ ID NO: 520872 - DNA, 25 bp, Rattus norvegicus
gtgttttgaacaatacggccccttg

SEQ ID NO: 520873 - DNA, 25 bp, Rattus norvegicus
gtgttttgaacattacggccccttg

SEQ ID NO: 520874 - DNA, 25 bp, Rattus norvegicus
gtgttttgactgctaataaatgttt

SEQ ID NO: 520875 - DNA, 25 bp, Rattus norvegicus
gtgttttgactggtaataaatgttt

SEQ ID NO: 520876 - DNA, 25 bp, Rattus norvegicus
gtgttttgctacatgtgcctatcta

SEQ ID NO: 520877 - DNA, 25 bp, Rattus norvegicus
gtgttttgctacttgtgcctatcta

SEQ ID NO: 520878 - DNA, 25 bp, Rattus norvegicus
gtgttttgctatcctttttactgta

SEQ ID NO: 520879 - DNA, 25 bp, Rattus norvegicus
gtgttttgctatgctttttactgta

SEQ ID NO: 520880 - DNA, 25 bp, Rattus norvegicus
gtgttttgctgacaaccagccttct

SEQ ID NO: 520881 - DNA, 25 bp, Rattus norvegicus
gtgttttgctgagaaccagccttct

SEQ ID NO: 520882 - DNA, 25 bp, Rattus norvegicus
gtgttttgtcaacggctaaatagca

SEQ ID NO: 520883 - DNA, 25 bp, Rattus norvegicus
gtgttttgtcaagggctaaatagca

SEQ ID NO: 520884 - DNA, 25 bp, Rattus norvegicus
gtgttttgtgttctaggttggccca

SEQ ID NO: 520885 - DNA, 25 bp, Rattus norvegicus
gtgttttgtgttgtaggttggccca

SEQ ID NO: 520886 - DNA, 25 bp, Rattus norvegicus
gtgtttttaaaaccctgtttctatg

SEQ ID NO: 520887 - DNA, 25 bp, Rattus norvegicus
gtgtttttaaaagcctgtttctatg

SEQ ID NO: 520888 - DNA, 25 bp, Rattus norvegicus
gtgtttttaaagctcactctgcacc

SEQ ID NO: 520889 - DNA, 25 bp, Rattus norvegicus
gtgtttttaaaggtcactctgcacc

SEQ ID NO: 520890 - DNA, 25 bp, Rattus norvegicus
gtgtttttaactcactgcacatcct

SEQ ID NO: 520891 - DNA, 25 bp, Rattus norvegicus
gtgtttttaactgactgcacatcct

SEQ ID NO: 520892 - DNA, 25 bp, Rattus norvegicus
gtgtttttacaacctgcataaccag

SEQ ID NO: 520893 - DNA, 25 bp, Rattus norvegicus
gtgtttttacaagctgcataaccag

SEQ ID NO: 520894 - DNA, 25 bp, Rattus norvegicus
gtgtttttattcctcgaacttcgct

SEQ ID NO: 520895 - DNA, 25 bp, Rattus norvegicus
gtgtttttattcgtcgaacttcgct

SEQ ID NO: 520896 - DNA, 25 bp, Rattus norvegicus
gtgtttttcaaacataccatgttcc

SEQ ID NO: 520897 - DNA, 25 bp, Rattus norvegicus
gtgtttttcaaagataccatgttcc

SEQ ID NO: 520898 - DNA, 25 bp, Rattus norvegicus
gtgtttttcaacatgggcacatcag

SEQ ID NO: 520899 - DNA, 25 bp, Rattus norvegicus
gtgtttttcaacttgggcacatcag

SEQ ID NO: 520900 - DNA, 25 bp, Rattus norvegicus
gtgtttttcaatagcctgtggtggg

SEQ ID NO: 520901 - DNA, 25 bp, Rattus norvegicus
gtgtttttcaattgcctgtggtggg

SEQ ID NO: 520902 - DNA, 25 bp, Rattus norvegicus
gtgtttttcacacctggcctaagga

SEQ ID NO: 520903 - DNA, 25 bp, Rattus norvegicus
gtgtttttcacagctggcctaagga

SEQ ID NO: 520904 - DNA, 25 bp, Rattus norvegicus
gtgtttttcctgcattgtatctttt

SEQ ID NO: 520905 - DNA, 25 bp, Rattus norvegicus
gtgtttttcctggattgtatctttt

SEQ ID NO: 520906 - DNA, 25 bp, Rattus norvegicus
gtgtttttgaatattcactcggaag

SEQ ID NO: 520907 - DNA, 25 bp, Rattus norvegicus
gtgtttttgaattttcactcggaag

SEQ ID NO: 520908 - DNA, 25 bp, Rattus norvegicus
gtgtttttgacacttcagttgggaa

SEQ ID NO: 520909 - DNA, 25 bp, Rattus norvegicus
gtgtttttgacagttcagttgggaa

SEQ ID NO: 520910 - DNA, 25 bp, Rattus norvegicus
gtgtttttggacagaatttacttga

SEQ ID NO: 520911 - DNA, 25 bp, Rattus norvegicus
gtgtttttggactgaatttacttga

SEQ ID NO: 520912 - DNA, 25 bp, Rattus norvegicus
gtgttttttagcctggagttaatca

SEQ ID NO: 520913 - DNA, 25 bp, Rattus norvegicus
gtgttttttagcgtggagttaatca

SEQ ID NO: 520914 - DNA, 25 bp, Rattus norvegicus
gtgttttttatcatgtgaccaagcg

SEQ ID NO: 520915 - DNA, 25 bp, Rattus norvegicus
gtgttttttatcttgtgaccaagcg

SEQ ID NO: 520916 - DNA, 25 bp, Rattus norvegicus
gtgttttttcttaccttgtagtctg

SEQ ID NO: 520917 - DNA, 25 bp, Rattus norvegicus
gtgttttttctttccttgtagtctg

SEQ ID NO: 520918 - DNA, 25 bp, Rattus norvegicus
gtgttttttgaccttccacaagcag

SEQ ID NO: 520919 - DNA, 25 bp, Rattus norvegicus
gtgttttttgacgttccacaagcag

SEQ ID NO: 520920 - DNA, 25 bp, Rattus norvegicus
gtgttttttggcaaccaatggcaga

SEQ ID NO: 520921 - DNA, 25 bp, Rattus norvegicus
gtgttttttggctaccaatggcaga

SEQ ID NO: 520922 - DNA, 25 bp, Rattus norvegicus
gtgttttttggtagtgcagcctgct

SEQ ID NO: 520923 - DNA, 25 bp, Rattus norvegicus
gtgttttttggttgtgcagcctgct

SEQ ID NO: 520924 - DNA, 25 bp, Rattus norvegicus
gttaaaaatcacatcgcacatcctc

SEQ ID NO: 520925 - DNA, 25 bp, Rattus norvegicus
gttaaaaatcacttcgcacatcctc

SEQ ID NO: 520926 - DNA, 25 bp, Rattus norvegicus
gttaaaacactgatcgggctggaga

SEQ ID NO: 520927 - DNA, 25 bp, Rattus norvegicus
gttaaaacactgttcgggctggaga

SEQ ID NO: 520928 - DNA, 25 bp, Rattus norvegicus
gttaaaaccagacccactgggtgcg

SEQ ID NO: 520929 - DNA, 25 bp, Rattus norvegicus
gttaaaaccagagccactgggtgcg

SEQ ID NO: 520930 - DNA, 25 bp, Rattus norvegicus
gttaaaacgacacggcactctcttc

SEQ ID NO: 520931 - DNA, 25 bp, Rattus norvegicus
gttaaaacgacagggcactctcttc

SEQ ID NO: 520932 - DNA, 25 bp, Rattus norvegicus
gttaaaactacaccagtccaaggag

SEQ ID NO: 520933 - DNA, 25 bp, Rattus norvegicus
gttaaaactacagcagtccaaggag

SEQ ID NO: 520934 - DNA, 25 bp, Rattus norvegicus
gttaaaactatgaaactctggtcag

SEQ ID NO: 520935 - DNA, 25 bp, Rattus norvegicus
gttaaaactatgtaactctggtcag

SEQ ID NO: 520936 - DNA, 25 bp, Rattus norvegicus
gttaaaactcttaccttacctgcat

SEQ ID NO: 520937 - DNA, 25 bp, Rattus norvegicus
gttaaaactctttccttacctgcat

SEQ ID NO: 520938 - DNA, 25 bp, Rattus norvegicus
gttaaaactgaccagccagttcagt

SEQ ID NO: 520939 - DNA, 25 bp, Rattus norvegicus
gttaaaactgacgagccagttcagt

SEQ ID NO: 520940 - DNA, 25 bp, Rattus norvegicus
gttaaaataagtatgcccatgtcca

SEQ ID NO: 520941 - DNA, 25 bp, Rattus norvegicus
gttaaaataagtttgcccatgtcca

SEQ ID NO: 520942 - DNA, 25 bp, Rattus norvegicus
gttaaaatcaccactgctcattcag

SEQ ID NO: 520943 - DNA, 25 bp, Rattus norvegicus
gttaaaatcacctctgctcattcag

SEQ ID NO: 520944 - DNA, 25 bp, Rattus norvegicus
gttaaacaaaccacgcaaagcaaat

SEQ ID NO: 520945 - DNA, 25 bp, Rattus norvegicus
gttaaacaaacctcgcaaagcaaat

SEQ ID NO: 520946 - DNA, 25 bp, Rattus norvegicus
gttaaacacactcggaatcgactcc

SEQ ID NO: 520947 - DNA, 25 bp, Rattus norvegicus
gttaaacacactgggaatcgactcc

SEQ ID NO: 520948 - DNA, 25 bp, Rattus norvegicus
gttaaacacttactagattatcaat

SEQ ID NO: 520949 - DNA, 25 bp, Rattus norvegicus
gttaaacacttagtagattatcaat

SEQ ID NO: 520950 - DNA, 25 bp, Rattus norvegicus
gttaaacagatacatcctcatggct

SEQ ID NO: 520951 - DNA, 25 bp, Rattus norvegicus
gttaaacagatagatcctcatggct

SEQ ID NO: 520952 - DNA, 25 bp, Rattus norvegicus
gttaaacagtatacactcccaccat

SEQ ID NO: 520953 - DNA, 25 bp, Rattus norvegicus
gttaaacagtattcactcccaccat

SEQ ID NO: 520954 - DNA, 25 bp, Rattus norvegicus
gttaaaccagctattgagacttact

SEQ ID NO: 520955 - DNA, 25 bp, Rattus norvegicus
gttaaaccagcttttgagacttact

SEQ ID NO: 520956 - DNA, 25 bp, Rattus norvegicus
gttaaaccagtcagtacctatattg

SEQ ID NO: 520957 - DNA, 25 bp, Rattus norvegicus
gttaaaccagtctgtacctatattg

SEQ ID NO: 520958 - DNA, 25 bp, Rattus norvegicus
gttaaacccggtagcatgtgcgctg

SEQ ID NO: 520959 - DNA, 25 bp, Rattus norvegicus
gttaaacccggttgcatgtgcgctg

SEQ ID NO: 520960 - DNA, 25 bp, Rattus norvegicus
gttaaacctaatatggcctcagcaa

SEQ ID NO: 520961 - DNA, 25 bp, Rattus norvegicus
gttaaacctaatttggcctcagcaa

SEQ ID NO: 520962 - DNA, 25 bp, Rattus norvegicus
gttaaacctcagatggtgctgttga

SEQ ID NO: 520963 - DNA, 25 bp, Rattus norvegicus
gttaaacctcagttggtgctgttga

SEQ ID NO: 520964 - DNA, 25 bp, Rattus norvegicus
gttaaacctctcctgtcattcctag

SEQ ID NO: 520965 - DNA, 25 bp, Rattus norvegicus
gttaaacctctcgtgtcattcctag

SEQ ID NO: 520966 - DNA, 25 bp, Rattus norvegicus
gttaaacggcttaaccatgcagagc

SEQ ID NO: 520967 - DNA, 25 bp, Rattus norvegicus
gttaaacggctttaccatgcagagc

SEQ ID NO: 520968 - DNA, 25 bp, Rattus norvegicus
gttaaacggtatagtcccatggctt

SEQ ID NO: 520969 - DNA, 25 bp, Rattus norvegicus
gttaaacggtattgtcccatggctt

SEQ ID NO: 520970 - DNA, 25 bp, Rattus norvegicus
gttaaacgtcaaaacactgtacatg

SEQ ID NO: 520971 - DNA, 25 bp, Rattus norvegicus
gttaaacgtcaatacactgtacatg

SEQ ID NO: 520972 - DNA, 25 bp, Rattus norvegicus
gttaaactatcaccttacattcatg

SEQ ID NO: 520973 - DNA, 25 bp, Rattus norvegicus
gttaaactatcagcttacattcatg

SEQ ID NO: 520974 - DNA, 25 bp, Rattus norvegicus
gttaaactcagtccccttcagggta

SEQ ID NO: 520975 - DNA, 25 bp, Rattus norvegicus
gttaaactcagtgcccttcagggta

SEQ ID NO: 520976 - DNA, 25 bp, Rattus norvegicus
gttaaactccacaactaagtcacta

SEQ ID NO: 520977 - DNA, 25 bp, Rattus norvegicus
gttaaactccactactaagtcacta

SEQ ID NO: 520978 - DNA, 25 bp, Rattus norvegicus
gttaaactccatcagggcgaaacat

SEQ ID NO: 520979 - DNA, 25 bp, Rattus norvegicus
gttaaactccatgagggcgaaacat

SEQ ID NO: 520980 - DNA, 25 bp, Rattus norvegicus
gttaaactcttgactgcatcttcac

SEQ ID NO: 520981 - DNA, 25 bp, Rattus norvegicus
gttaaactcttgtctgcatcttcac

SEQ ID NO: 520982 - DNA, 25 bp, Rattus norvegicus
gttaaactgccaaacaatctgctaa

SEQ ID NO: 520983 - DNA, 25 bp, Rattus norvegicus
gttaaactgccatacaatctgctaa

SEQ ID NO: 520984 - DNA, 25 bp, Rattus norvegicus
gttaaacttagacagctgccaagct

SEQ ID NO: 520985 - DNA, 25 bp, Rattus norvegicus
gttaaacttagagagctgccaagct

SEQ ID NO: 520986 - DNA, 25 bp, Rattus norvegicus
gttaaacttctaatttcatccttca

SEQ ID NO: 520987 - DNA, 25 bp, Rattus norvegicus
gttaaacttctattttcatccttca

SEQ ID NO: 520988 - DNA, 25 bp, Rattus norvegicus
gttaaacttgctcctcagatattag

SEQ ID NO: 520989 - DNA, 25 bp, Rattus norvegicus
gttaaacttgctgctcagatattag

SEQ ID NO: 520990 - DNA, 25 bp, Rattus norvegicus
gttaaagacctcagtagctgcttaa

SEQ ID NO: 520991 - DNA, 25 bp, Rattus norvegicus
gttaaagacctctgtagctgcttaa

SEQ ID NO: 520992 - DNA, 25 bp, Rattus norvegicus
gttaaagactggattgccccacgag

SEQ ID NO: 520993 - DNA, 25 bp, Rattus norvegicus
gttaaagactggtttgccccacgag

SEQ ID NO: 520994 - DNA, 25 bp, Rattus norvegicus
gttaaagagtatcaccgggcagcac

SEQ ID NO: 520995 - DNA, 25 bp, Rattus norvegicus
gttaaagagtatgaccgggcagcac

SEQ ID NO: 520996 - DNA, 25 bp, Rattus norvegicus
gttaaagatgtgcacctcctaccca

SEQ ID NO: 520997 - DNA, 25 bp, Rattus norvegicus
gttaaagatgtggacctcctaccca

SEQ ID NO: 520998 - DNA, 25 bp, Rattus norvegicus
gttaaagattaaaggccgacggttg

SEQ ID NO: 520999 - DNA, 25 bp, Rattus norvegicus
gttaaagattaatggccgacggttg

SEQ ID NO: 521000 - DNA, 25 bp, Rattus norvegicus
gttaaagattctattcagccttctg

SEQ ID NO: 521001 - DNA, 25 bp, Rattus norvegicus
gttaaagattcttttcagccttctg

SEQ ID NO: 521002 - DNA, 25 bp, Rattus norvegicus
gttaaagcagcactcagtcaaattc

SEQ ID NO: 521003 - DNA, 25 bp, Rattus norvegicus
gttaaagcagcagtcagtcaaattc

SEQ ID NO: 521004 - DNA, 25 bp, Rattus norvegicus
gttaaagccgtaccagacagctctt

SEQ ID NO: 521005 - DNA, 25 bp, Rattus norvegicus
gttaaagccgtagcagacagctctt

SEQ ID NO: 521006 - DNA, 25 bp, Rattus norvegicus
gttaaagctcttagcatgcccagag

SEQ ID NO: 521007 - DNA, 25 bp, Rattus norvegicus
gttaaagctctttgcatgcccagag

SEQ ID NO: 521008 - DNA, 25 bp, Rattus norvegicus
gttaaaggaaaacgagccacagctt

SEQ ID NO: 521009 - DNA, 25 bp, Rattus norvegicus
gttaaaggaaaaggagccacagctt

SEQ ID NO: 521010 - DNA, 25 bp, Rattus norvegicus
gttaaaggagatcactcctccctag

SEQ ID NO: 521011 - DNA, 25 bp, Rattus norvegicus
gttaaaggagatgactcctccctag

SEQ ID NO: 521012 - DNA, 25 bp, Rattus norvegicus
gttaaaggtgacaggcgggcactac

SEQ ID NO: 521013 - DNA, 25 bp, Rattus norvegicus
gttaaaggtgactggcgggcactac

SEQ ID NO: 521014 - DNA, 25 bp, Rattus norvegicus
gttaaagtctctcctgtcagtattc

SEQ ID NO: 521015 - DNA, 25 bp, Rattus norvegicus
gttaaagtctctgctgtcagtattc

SEQ ID NO: 521016 - DNA, 25 bp, Rattus norvegicus
gttaaagtgcgtctagcgagctcat

SEQ ID NO: 521017 - DNA, 25 bp, Rattus norvegicus
gttaaagtgcgtgtagcgagctcat

SEQ ID NO: 521018 - DNA, 25 bp, Rattus norvegicus
gttaaagttcgcctgtcttggacta

SEQ ID NO: 521019 - DNA, 25 bp, Rattus norvegicus
gttaaagttcgcgtgtcttggacta

SEQ ID NO: 521020 - DNA, 25 bp, Rattus norvegicus
gttaaagttcttactcctggcacgt

SEQ ID NO: 521021 - DNA, 25 bp, Rattus norvegicus
gttaaagttctttctcctggcacgt

SEQ ID NO: 521022 - DNA, 25 bp, Rattus norvegicus
gttaaataattcagagctaatggga

SEQ ID NO: 521023 - DNA, 25 bp, Rattus norvegicus
gttaaataattctgagctaatggga

SEQ ID NO: 521024 - DNA, 25 bp, Rattus norvegicus
gttaaataccggatttcatgcaaat

SEQ ID NO: 521025 - DNA, 25 bp, Rattus norvegicus
gttaaataccggttttcatgcaaat

SEQ ID NO: 521026 - DNA, 25 bp, Rattus norvegicus
gttaaatactggatcactgtgttgt

SEQ ID NO: 521027 - DNA, 25 bp, Rattus norvegicus
gttaaatactggttcactgtgttgt

SEQ ID NO: 521028 - DNA, 25 bp, Rattus norvegicus
gttaaatatatacctggcaccttag

SEQ ID NO: 521029 - DNA, 25 bp, Rattus norvegicus
gttaaatatatagctggcaccttag

SEQ ID NO: 521030 - DNA, 25 bp, Rattus norvegicus
gttaaatatcttcaatgggtcccga

SEQ ID NO: 521031 - DNA, 25 bp, Rattus norvegicus
gttaaatatcttgaatgggtcccga

SEQ ID NO: 521032 - DNA, 25 bp, Rattus norvegicus
gttaaatatggtcccaagcatacat

SEQ ID NO: 521033 - DNA, 25 bp, Rattus norvegicus
gttaaatatggtgccaagcatacat

SEQ ID NO: 521034 - DNA, 25 bp, Rattus norvegicus
gttaaatattgtcttatggagtcat

SEQ ID NO: 521035 - DNA, 25 bp, Rattus norvegicus
gttaaatattgtgttatggagtcat

SEQ ID NO: 521036 - DNA, 25 bp, Rattus norvegicus
gttaaatcacttaatactgtttcag

SEQ ID NO: 521037 - DNA, 25 bp, Rattus norvegicus
gttaaatcactttatactgtttcag

SEQ ID NO: 521038 - DNA, 25 bp, Rattus norvegicus
gttaaatcagtgaagtccaggatca

SEQ ID NO: 521039 - DNA, 25 bp, Rattus norvegicus
gttaaatcagtgtagtccaggatca

SEQ ID NO: 521040 - DNA, 25 bp, Rattus norvegicus
gttaaatcatcacggcgattgcatg

SEQ ID NO: 521041 - DNA, 25 bp, Rattus norvegicus
gttaaatcatcagggcgattgcatg

SEQ ID NO: 521042 - DNA, 25 bp, Rattus norvegicus
gttaaatcatttccaagtgaccatg

SEQ ID NO: 521043 - DNA, 25 bp, Rattus norvegicus
gttaaatcatttgcaagtgaccatg

SEQ ID NO: 521044 - DNA, 25 bp, Rattus norvegicus
gttaaatctaggaacccacatggtg

SEQ ID NO: 521045 - DNA, 25 bp, Rattus norvegicus
gttaaatctaggtacccacatggtg

SEQ ID NO: 521046 - DNA, 25 bp, Rattus norvegicus
gttaaatctcagctaacagatgttt

SEQ ID NO: 521047 - DNA, 25 bp, Rattus norvegicus
gttaaatctcaggtaacagatgttt

SEQ ID NO: 521048 - DNA, 25 bp, Rattus norvegicus
gttaaatctttaccagcagtgctgt

SEQ ID NO: 521049 - DNA, 25 bp, Rattus norvegicus
gttaaatctttagcagcagtgctgt

SEQ ID NO: 521050 - DNA, 25 bp, Rattus norvegicus
gttaaatgatggattgctgcatgct

SEQ ID NO: 521051 - DNA, 25 bp, Rattus norvegicus
gttaaatgatggtttgctgcatgct

SEQ ID NO: 521052 - DNA, 25 bp, Rattus norvegicus
gttaaatgcaccattcgaatctttt

SEQ ID NO: 521053 - DNA, 25 bp, Rattus norvegicus
gttaaatgcacctttcgaatctttt

SEQ ID NO: 521054 - DNA, 25 bp, Rattus norvegicus
gttaaatgctgtcttccgagtacca

SEQ ID NO: 521055 - DNA, 25 bp, Rattus norvegicus
gttaaatgctgtgttccgagtacca

SEQ ID NO: 521056 - DNA, 25 bp, Rattus norvegicus
gttaaatggaacctccgtctctatg

SEQ ID NO: 521057 - DNA, 25 bp, Rattus norvegicus
gttaaatggaacgtccgtctctatg

SEQ ID NO: 521058 - DNA, 25 bp, Rattus norvegicus
gttaaatggacacctaatgccctct

SEQ ID NO: 521059 - DNA, 25 bp, Rattus norvegicus
gttaaatggacagctaatgccctct

SEQ ID NO: 521060 - DNA, 25 bp, Rattus norvegicus
gttaaatgtataactggtacccaca

SEQ ID NO: 521061 - DNA, 25 bp, Rattus norvegicus
gttaaatgtatatctggtacccaca

SEQ ID NO: 521062 - DNA, 25 bp, Rattus norvegicus
gttaaatgtcatcttcagctccgca

SEQ ID NO: 521063 - DNA, 25 bp, Rattus norvegicus
gttaaatgtcatgttcagctccgca

SEQ ID NO: 521064 - DNA, 25 bp, Rattus norvegicus
gttaaatgtgatctgcgctctggcc

SEQ ID NO: 521065 - DNA, 25 bp, Rattus norvegicus
gttaaatgtgatgtgcgctctggcc

SEQ ID NO: 521066 - DNA, 25 bp, Rattus norvegicus
gttaaatgtgctcgccacgtggcta

SEQ ID NO: 521067 - DNA, 25 bp, Rattus norvegicus
gttaaatgtgctggccacgtggcta

SEQ ID NO: 521068 - DNA, 25 bp, Rattus norvegicus
gttaaatgttagctctccggtgcca

SEQ ID NO: 521069 - DNA, 25 bp, Rattus norvegicus
gttaaatgttaggtctccggtgcca

SEQ ID NO: 521070 - DNA, 25 bp, Rattus norvegicus
gttaaatgttgcacatctcaaggga

SEQ ID NO: 521071 - DNA, 25 bp, Rattus norvegicus
gttaaatgttgctcatctcaaggga

SEQ ID NO: 521072 - DNA, 25 bp, Rattus norvegicus
gttaaattacccatcacacatagcg

SEQ ID NO: 521073 - DNA, 25 bp, Rattus norvegicus
gttaaattacccttcacacatagcg

SEQ ID NO: 521074 - DNA, 25 bp, Rattus norvegicus
gttaaattccagcaacaagccattc

SEQ ID NO: 521075 - DNA, 25 bp, Rattus norvegicus
gttaaattccaggaacaagccattc

SEQ ID NO: 521076 - DNA, 25 bp, Rattus norvegicus
gttaaattctaaccctctttgctgc

SEQ ID NO: 521077 - DNA, 25 bp, Rattus norvegicus
gttaaattctaagcctctttgctgc

SEQ ID NO: 521078 - DNA, 25 bp, Rattus norvegicus
gttaaattgtatactaccagggtgg

SEQ ID NO: 521079 - DNA, 25 bp, Rattus norvegicus
gttaaattgtattctaccagggtgg

SEQ ID NO: 521080 - DNA, 25 bp, Rattus norvegicus
gttaaattgtttccagtgctccata

SEQ ID NO: 521081 - DNA, 25 bp, Rattus norvegicus
gttaaattgtttgcagtgctccata

SEQ ID NO: 521082 - DNA, 25 bp, Rattus norvegicus
gttaaatttcttcttaagacagaat

SEQ ID NO: 521083 - DNA, 25 bp, Rattus norvegicus
gttaaatttcttgttaagacagaat

SEQ ID NO: 521084 - DNA, 25 bp, Rattus norvegicus
gttaacaaatttcaatgcccttggc

SEQ ID NO: 521085 - DNA, 25 bp, Rattus norvegicus
gttaacaaatttgaatgcccttggc

SEQ ID NO: 521086 - DNA, 25 bp, Rattus norvegicus
gttaacaacagcagcctagagccta

SEQ ID NO: 521087 - DNA, 25 bp, Rattus norvegicus
gttaacaacagctgcctagagccta

SEQ ID NO: 521088 - DNA, 25 bp, Rattus norvegicus
gttaacaactacagacatactgctt

SEQ ID NO: 521089 - DNA, 25 bp, Rattus norvegicus
gttaacaactactgacatactgctt

SEQ ID NO: 521090 - DNA, 25 bp, Rattus norvegicus
gttaacaactatagctgtgtaccat

SEQ ID NO: 521091 - DNA, 25 bp, Rattus norvegicus
gttaacaactattgctgtgtaccat

SEQ ID NO: 521092 - DNA, 25 bp, Rattus norvegicus
gttaacaagcgaagagcactttcat

SEQ ID NO: 521093 - DNA, 25 bp, Rattus norvegicus
gttaacaagcgatgagcactttcat

SEQ ID NO: 521094 - DNA, 25 bp, Rattus norvegicus
gttaacaagtttcattgcactttga

SEQ ID NO: 521095 - DNA, 25 bp, Rattus norvegicus
gttaacaagtttgattgcactttga

SEQ ID NO: 521096 - DNA, 25 bp, Rattus norvegicus
gttaacacactacccgcactgtaaa

SEQ ID NO: 521097 - DNA, 25 bp, Rattus norvegicus
gttaacacactagccgcactgtaaa

SEQ ID NO: 521098 - DNA, 25 bp, Rattus norvegicus
gttaacacatgtccaatttacaaag

SEQ ID NO: 521099 - DNA, 25 bp, Rattus norvegicus
gttaacacatgtgcaatttacaaag

SEQ ID NO: 521100 - DNA, 25 bp, Rattus norvegicus
gttaacacctctccatacatttgaa

SEQ ID NO: 521101 - DNA, 25 bp, Rattus norvegicus
gttaacacctctgcatacatttgaa

SEQ ID NO: 521102 - DNA, 25 bp, Rattus norvegicus
gttaacacctgtagcatttaccgtc

SEQ ID NO: 521103 - DNA, 25 bp, Rattus norvegicus
gttaacacctgttgcatttaccgtc

SEQ ID NO: 521104 - DNA, 25 bp, Rattus norvegicus
gttaacacgcagcttcttgatttct

SEQ ID NO: 521105 - DNA, 25 bp, Rattus norvegicus
gttaacacgcaggttcttgatttct

SEQ ID NO: 521106 - DNA, 25 bp, Rattus norvegicus
gttaacacttagaacctagtcggtg

SEQ ID NO: 521107 - DNA, 25 bp, Rattus norvegicus
gttaacacttagtacctagtcggtg

SEQ ID NO: 521108 - DNA, 25 bp, Rattus norvegicus
gttaacacttgtcacactgcagagt

SEQ ID NO: 521109 - DNA, 25 bp, Rattus norvegicus
gttaacacttgtgacactgcagagt

SEQ ID NO: 521110 - DNA, 25 bp, Rattus norvegicus
gttaacagaactcaggtccacagta

SEQ ID NO: 521111 - DNA, 25 bp, Rattus norvegicus
gttaacagaactgaggtccacagta

SEQ ID NO: 521112 - DNA, 25 bp, Rattus norvegicus
gttaacagctataggcttccttcac

SEQ ID NO: 521113 - DNA, 25 bp, Rattus norvegicus
gttaacagctattggcttccttcac

SEQ ID NO: 521114 - DNA, 25 bp, Rattus norvegicus
gttaacagctctacgcacatggtgt

SEQ ID NO: 521115 - DNA, 25 bp, Rattus norvegicus
gttaacagctcttcgcacatggtgt

SEQ ID NO: 521116 - DNA, 25 bp, Rattus norvegicus
gttaacagcttcaaaccaccagagg

SEQ ID NO: 521117 - DNA, 25 bp, Rattus norvegicus
gttaacagcttctaaccaccagagg

SEQ ID NO: 521118 - DNA, 25 bp, Rattus norvegicus
gttaacagggaacacaccaccacaa

SEQ ID NO: 521119 - DNA, 25 bp, Rattus norvegicus
gttaacagggaagacaccaccacaa

SEQ ID NO: 521120 - DNA, 25 bp, Rattus norvegicus
gttaacataatccagcctcttcaga

SEQ ID NO: 521121 - DNA, 25 bp, Rattus norvegicus
gttaacataatcgagcctcttcaga

SEQ ID NO: 521122 - DNA, 25 bp, Rattus norvegicus
gttaacataatgctctctccgggtg

SEQ ID NO: 521123 - DNA, 25 bp, Rattus norvegicus
gttaacataatggtctctccgggtg

SEQ ID NO: 521124 - DNA, 25 bp, Rattus norvegicus
gttaacatcctgaccgttgtattat

SEQ ID NO: 521125 - DNA, 25 bp, Rattus norvegicus
gttaacatcctgtccgttgtattat

SEQ ID NO: 521126 - DNA, 25 bp, Rattus norvegicus
gttaacatctagatggtccaccagg

SEQ ID NO: 521127 - DNA, 25 bp, Rattus norvegicus
gttaacatctagttggtccaccagg

SEQ ID NO: 521128 - DNA, 25 bp, Rattus norvegicus
gttaacatgagaacgttgctgcaga

SEQ ID NO: 521129 - DNA, 25 bp, Rattus norvegicus
gttaacatgagatcgttgctgcaga

SEQ ID NO: 521130 - DNA, 25 bp, Rattus norvegicus
gttaacatgtccactagcgatgctc

SEQ ID NO: 521131 - DNA, 25 bp, Rattus norvegicus
gttaacatgtcctctagcgatgctc

SEQ ID NO: 521132 - DNA, 25 bp, Rattus norvegicus
gttaacattcatacaggacactaaa

SEQ ID NO: 521133 - DNA, 25 bp, Rattus norvegicus
gttaacattcattcaggacactaaa

SEQ ID NO: 521134 - DNA, 25 bp, Rattus norvegicus
gttaacattccaaaaggtcactcag

SEQ ID NO: 521135 - DNA, 25 bp, Rattus norvegicus
gttaacattccataaggtcactcag

SEQ ID NO: 521136 - DNA, 25 bp, Rattus norvegicus
gttaacattgaccaagaactgcatg

SEQ ID NO: 521137 - DNA, 25 bp, Rattus norvegicus
gttaacattgacgaagaactgcatg

SEQ ID NO: 521138 - DNA, 25 bp, Rattus norvegicus
gttaacattgttctgccttatccta

SEQ ID NO: 521139 - DNA, 25 bp, Rattus norvegicus
gttaacattgttgtgccttatccta

SEQ ID NO: 521140 - DNA, 25 bp, Rattus norvegicus
gttaaccaacttcaatctaggctaa

SEQ ID NO: 521141 - DNA, 25 bp, Rattus norvegicus
gttaaccaacttgaatctaggctaa

SEQ ID NO: 521142 - DNA, 25 bp, Rattus norvegicus
gttaaccacaggacacaggttcagt

SEQ ID NO: 521143 - DNA, 25 bp, Rattus norvegicus
gttaaccacaggtcacaggttcagt

SEQ ID NO: 521144 - DNA, 25 bp, Rattus norvegicus
gttaaccacgtgaagtgcctcatct

SEQ ID NO: 521145 - DNA, 25 bp, Rattus norvegicus
gttaaccacgtgtagtgcctcatct

SEQ ID NO: 521146 - DNA, 25 bp, Rattus norvegicus
gttaaccaggacactgaaactcagg

SEQ ID NO: 521147 - DNA, 25 bp, Rattus norvegicus
gttaaccaggaccacattccaacag

SEQ ID NO: 521148 - DNA, 25 bp, Rattus norvegicus
gttaaccaggacgacattccaacag

SEQ ID NO: 521149 - DNA, 25 bp, Rattus norvegicus
gttaaccaggactctgaaactcagg

SEQ ID NO: 521150 - DNA, 25 bp, Rattus norvegicus
gttaaccatcctacaaaggtcctga

SEQ ID NO: 521151 - DNA, 25 bp, Rattus norvegicus
gttaaccatccttcaaaggtcctga

SEQ ID NO: 521152 - DNA, 25 bp, Rattus norvegicus
gttaaccatcttaccttgatacgct

SEQ ID NO: 521153 - DNA, 25 bp, Rattus norvegicus
gttaaccatctttccttgatacgct

SEQ ID NO: 521154 - DNA, 25 bp, Rattus norvegicus
gttaacccaagtcttcatatgtcca

SEQ ID NO: 521155 - DNA, 25 bp, Rattus norvegicus
gttaacccaagtgttcatatgtcca

SEQ ID NO: 521156 - DNA, 25 bp, Rattus norvegicus
gttaacccaataattcattttcata

SEQ ID NO: 521157 - DNA, 25 bp, Rattus norvegicus
gttaacccaatatttcattttcata

SEQ ID NO: 521158 - DNA, 25 bp, Rattus norvegicus
gttaaccctggaaggacactgtcac

SEQ ID NO: 521159 - DNA, 25 bp, Rattus norvegicus
gttaaccctggatggacactgtcac

SEQ ID NO: 521160 - DNA, 25 bp, Rattus norvegicus
gttaaccctttcattagctgtgcgt

SEQ ID NO: 521161 - DNA, 25 bp, Rattus norvegicus
gttaaccctttctttagctgtgcgt

SEQ ID NO: 521162 - DNA, 25 bp, Rattus norvegicus
gttaacccttttcgagtcacgtgtg

SEQ ID NO: 521163 - DNA, 25 bp, Rattus norvegicus
gttaacccttttggagtcacgtgtg

SEQ ID NO: 521164 - DNA, 25 bp, Rattus norvegicus
gttaaccggatgattggtcctgcca

SEQ ID NO: 521165 - DNA, 25 bp, Rattus norvegicus
gttaaccggatgtttggtcctgcca

SEQ ID NO: 521166 - DNA, 25 bp, Rattus norvegicus
gttaaccggcttaatgctgccatta

SEQ ID NO: 521167 - DNA, 25 bp, Rattus norvegicus
gttaaccggctttatgctgccatta

SEQ ID NO: 521168 - DNA, 25 bp, Rattus norvegicus
gttaacctcacacttttgttgcttg

SEQ ID NO: 521169 - DNA, 25 bp, Rattus norvegicus
gttaacctcacagttttgttgcttg

SEQ ID NO: 521170 - DNA, 25 bp, Rattus norvegicus
gttaacctctgcatccaaagacaag

SEQ ID NO: 521171 - DNA, 25 bp, Rattus norvegicus
gttaacctctgcttccaaagacaag

SEQ ID NO: 521172 - DNA, 25 bp, Rattus norvegicus
gttaacctcttgattgctgttctta

SEQ ID NO: 521173 - DNA, 25 bp, Rattus norvegicus
gttaacctcttgtttgctgttctta

SEQ ID NO: 521174 - DNA, 25 bp, Rattus norvegicus
gttaacctgactcacacaagaccaa

SEQ ID NO: 521175 - DNA, 25 bp, Rattus norvegicus
gttaacctgactgacacaagaccaa

SEQ ID NO: 521176 - DNA, 25 bp, Rattus norvegicus
gttaacctgcatcctgtaaatgtat

SEQ ID NO: 521177 - DNA, 25 bp, Rattus norvegicus
gttaacctgcatgctgtaaatgtat

SEQ ID NO: 521178 - DNA, 25 bp, Rattus norvegicus
gttaacctgctaattatatcccaat

SEQ ID NO: 521179 - DNA, 25 bp, Rattus norvegicus
gttaacctgctatttatatcccaat

SEQ ID NO: 521180 - DNA, 25 bp, Rattus norvegicus
gttaacctggctaagcttctctcat

SEQ ID NO: 521181 - DNA, 25 bp, Rattus norvegicus
gttaacctggcttagcttctctcat

SEQ ID NO: 521182 - DNA, 25 bp, Rattus norvegicus
gttaacctgtgacataactttgatg

SEQ ID NO: 521183 - DNA, 25 bp, Rattus norvegicus
gttaacctgtgagataactttgatg

SEQ ID NO: 521184 - DNA, 25 bp, Rattus norvegicus
gttaaccttgctaaatggcccgaga

SEQ ID NO: 521185 - DNA, 25 bp, Rattus norvegicus
gttaaccttgcttaatggcccgaga

SEQ ID NO: 521186 - DNA, 25 bp, Rattus norvegicus
gttaacgacataccttcagactctg

SEQ ID NO: 521187 - DNA, 25 bp, Rattus norvegicus
gttaacgacatagcttcagactctg

SEQ ID NO: 521188 - DNA, 25 bp, Rattus norvegicus
gttaacgatggtagggagctgccat

SEQ ID NO: 521189 - DNA, 25 bp, Rattus norvegicus
gttaacgatggttgggagctgccat

SEQ ID NO: 521190 - DNA, 25 bp, Rattus norvegicus
gttaacgcctggaagtgtccgtgac

SEQ ID NO: 521191 - DNA, 25 bp, Rattus norvegicus
gttaacgcctggtagtgtccgtgac

SEQ ID NO: 521192 - DNA, 25 bp, Rattus norvegicus
gttaacgctcacacttaaatctgta

SEQ ID NO: 521193 - DNA, 25 bp, Rattus norvegicus
gttaacgctcactcttaaatctgta

SEQ ID NO: 521194 - DNA, 25 bp, Rattus norvegicus
gttaacgctttaaggaccctggcag

SEQ ID NO: 521195 - DNA, 25 bp, Rattus norvegicus
gttaacgctttatggaccctggcag

SEQ ID NO: 521196 - DNA, 25 bp, Rattus norvegicus
gttaacggctgcagcctctggcatg

SEQ ID NO: 521197 - DNA, 25 bp, Rattus norvegicus
gttaacggctgctgcctctggcatg

SEQ ID NO: 521198 - DNA, 25 bp, Rattus norvegicus
gttaacgtcacaactaatagagcat

SEQ ID NO: 521199 - DNA, 25 bp, Rattus norvegicus
gttaacgtcacatctaatagagcat

SEQ ID NO: 521200 - DNA, 25 bp, Rattus norvegicus
gttaacgtcctgctggccaagtaat

SEQ ID NO: 521201 - DNA, 25 bp, Rattus norvegicus
gttaacgtcctggtggccaagtaat

SEQ ID NO: 521202 - DNA, 25 bp, Rattus norvegicus
gttaacgtctgactctgtccaaatg

SEQ ID NO: 521203 - DNA, 25 bp, Rattus norvegicus
gttaacgtctgagtctgtccaaatg

SEQ ID NO: 521204 - DNA, 25 bp, Rattus norvegicus
gttaacgtctttacatacctgcata

SEQ ID NO: 521205 - DNA, 25 bp, Rattus norvegicus
gttaacgtcttttcatacctgcata

SEQ ID NO: 521206 - DNA, 25 bp, Rattus norvegicus
gttaacgtgaacctggccattactc

SEQ ID NO: 521207 - DNA, 25 bp, Rattus norvegicus
gttaacgtgaacgtggccattactc

SEQ ID NO: 521208 - DNA, 25 bp, Rattus norvegicus
gttaacgtggttccatggactcaca

SEQ ID NO: 521209 - DNA, 25 bp, Rattus norvegicus
gttaacgtggttgcatggactcaca

SEQ ID NO: 521210 - DNA, 25 bp, Rattus norvegicus
gttaacgttgttactccctgtgaca

SEQ ID NO: 521211 - DNA, 25 bp, Rattus norvegicus
gttaacgttgttaggctgtctgtgc

SEQ ID NO: 521212 - DNA, 25 bp, Rattus norvegicus
gttaacgttgtttctccctgtgaca

SEQ ID NO: 521213 - DNA, 25 bp, Rattus norvegicus
gttaacgttgtttggctgtctgtgc

SEQ ID NO: 521214 - DNA, 25 bp, Rattus norvegicus
gttaacgttttccaacatgagtcta

SEQ ID NO: 521215 - DNA, 25 bp, Rattus norvegicus
gttaacgttttcgaacatgagtcta

SEQ ID NO: 521216 - DNA, 25 bp, Rattus norvegicus
gttaacgttttgctacagtgtatca

SEQ ID NO: 521217 - DNA, 25 bp, Rattus norvegicus
gttaacgttttggtacagtgtatca

SEQ ID NO: 521218 - DNA, 25 bp, Rattus norvegicus
gttaactaatttatgccaggaccat

SEQ ID NO: 521219 - DNA, 25 bp, Rattus norvegicus
gttaactaatttttgccaggaccat

SEQ ID NO: 521220 - DNA, 25 bp, Rattus norvegicus
gttaactacaacacaatactggcac

SEQ ID NO: 521221 - DNA, 25 bp, Rattus norvegicus
gttaactacaactcaatactggcac

SEQ ID NO: 521222 - DNA, 25 bp, Rattus norvegicus
gttaactactaacctacctttccag

SEQ ID NO: 521223 - DNA, 25 bp, Rattus norvegicus
gttaactactaagctacctttccag

SEQ ID NO: 521224 - DNA, 25 bp, Rattus norvegicus
gttaactatgccaggagttggctat

SEQ ID NO: 521225 - DNA, 25 bp, Rattus norvegicus
gttaactatgcctggagttggctat

SEQ ID NO: 521226 - DNA, 25 bp, Rattus norvegicus
gttaactatgtgcagacgtctgcta

SEQ ID NO: 521227 - DNA, 25 bp, Rattus norvegicus
gttaactatgtggagacgtctgcta

SEQ ID NO: 521228 - DNA, 25 bp, Rattus norvegicus
gttaactatgttcttttcttgggat

SEQ ID NO: 521229 - DNA, 25 bp, Rattus norvegicus
gttaactatgttgttttcttgggat

SEQ ID NO: 521230 - DNA, 25 bp, Rattus norvegicus
gttaactcagctctggataccgtcc

SEQ ID NO: 521231 - DNA, 25 bp, Rattus norvegicus
gttaactcagctgtggataccgtcc

SEQ ID NO: 521232 - DNA, 25 bp, Rattus norvegicus
gttaactccatgctgcagaaagctg

SEQ ID NO: 521233 - DNA, 25 bp, Rattus norvegicus
gttaactccatggtgcagaaagctg

SEQ ID NO: 521234 - DNA, 25 bp, Rattus norvegicus
gttaactcccagcacatgcagtcat

SEQ ID NO: 521235 - DNA, 25 bp, Rattus norvegicus
gttaactcccaggacatgcagtcat

SEQ ID NO: 521236 - DNA, 25 bp, Rattus norvegicus
gttaactcccatctgaatgtcagat

SEQ ID NO: 521237 - DNA, 25 bp, Rattus norvegicus
gttaactcccatgtgaatgtcagat

SEQ ID NO: 521238 - DNA, 25 bp, Rattus norvegicus
gttaactccctgagacagggatgaa

SEQ ID NO: 521239 - DNA, 25 bp, Rattus norvegicus
gttaactccctgtgacagggatgaa

SEQ ID NO: 521240 - DNA, 25 bp, Rattus norvegicus
gttaactccttaagacgggcatcaa

SEQ ID NO: 521241 - DNA, 25 bp, Rattus norvegicus
gttaactccttatgacgggcatcaa

SEQ ID NO: 521242 - DNA, 25 bp, Rattus norvegicus
gttaactctctcatcagctactaaa

SEQ ID NO: 521243 - DNA, 25 bp, Rattus norvegicus
gttaactctctcttcagctactaaa

SEQ ID NO: 521244 - DNA, 25 bp, Rattus norvegicus
gttaactctgagaagtcgtcctctt

SEQ ID NO: 521245 - DNA, 25 bp, Rattus norvegicus
gttaactctgagtagtcgtcctctt

SEQ ID NO: 521246 - DNA, 25 bp, Rattus norvegicus
gttaactgatgacaacctgaggtcc

SEQ ID NO: 521247 - DNA, 25 bp, Rattus norvegicus
gttaactgatgagaacctgaggtcc

SEQ ID NO: 521248 - DNA, 25 bp, Rattus norvegicus
gttaactgccaaaggaattgtctgt

SEQ ID NO: 521249 - DNA, 25 bp, Rattus norvegicus
gttaactgccaatggaattgtctgt

SEQ ID NO: 521250 - DNA, 25 bp, Rattus norvegicus
gttaactgctgcacgctatttaaat

SEQ ID NO: 521251 - DNA, 25 bp, Rattus norvegicus
gttaactgctgctcgctatttaaat

SEQ ID NO: 521252 - DNA, 25 bp, Rattus norvegicus
gttaactgtttgactcatgttgact

SEQ ID NO: 521253 - DNA, 25 bp, Rattus norvegicus
gttaactgtttgtctcatgttgact

SEQ ID NO: 521254 - DNA, 25 bp, Rattus norvegicus
gttaacttacttcgtatatcaggat

SEQ ID NO: 521255 - DNA, 25 bp, Rattus norvegicus
gttaacttacttggtatatcaggat

SEQ ID NO: 521256 - DNA, 25 bp, Rattus norvegicus
gttaacttattgctgggactccttg

SEQ ID NO: 521257 - DNA, 25 bp, Rattus norvegicus
gttaacttattggtgggactccttg

SEQ ID NO: 521258 - DNA, 25 bp, Rattus norvegicus
gttaacttccaactttgacgaggca

SEQ ID NO: 521259 - DNA, 25 bp, Rattus norvegicus
gttaacttccaagtttgacgaggca

SEQ ID NO: 521260 - DNA, 25 bp, Rattus norvegicus
gttaacttctccctgcttggaaata

SEQ ID NO: 521261 - DNA, 25 bp, Rattus norvegicus
gttaacttctccgtgcttggaaata

SEQ ID NO: 521262 - DNA, 25 bp, Rattus norvegicus
gttaactttgcaacttcagactcct

SEQ ID NO: 521263 - DNA, 25 bp, Rattus norvegicus
gttaactttgcatcttcagactcct

SEQ ID NO: 521264 - DNA, 25 bp, Rattus norvegicus
gttaacttttacaataaggctcatt

SEQ ID NO: 521265 - DNA, 25 bp, Rattus norvegicus
gttaacttttactataaggctcatt

SEQ ID NO: 521266 - DNA, 25 bp, Rattus norvegicus
gttaagaaaatgactcatgactggg

SEQ ID NO: 521267 - DNA, 25 bp, Rattus norvegicus
gttaagaaaatgtctcatgactggg

SEQ ID NO: 521268 - DNA, 25 bp, Rattus norvegicus
gttaagaacaacagttcttccagag

SEQ ID NO: 521269 - DNA, 25 bp, Rattus norvegicus
gttaagaacaactgttcttccagag

SEQ ID NO: 521270 - DNA, 25 bp, Rattus norvegicus
gttaagaagcttctacctgacagga

SEQ ID NO: 521271 - DNA, 25 bp, Rattus norvegicus
gttaagaagcttgtacctgacagga

SEQ ID NO: 521272 - DNA, 25 bp, Rattus norvegicus
gttaagaagggaccacacccatgga

SEQ ID NO: 521273 - DNA, 25 bp, Rattus norvegicus
gttaagaagggagcacacccatgga

SEQ ID NO: 521274 - DNA, 25 bp, Rattus norvegicus
gttaagacccagaagtatcatgatt

SEQ ID NO: 521275 - DNA, 25 bp, Rattus norvegicus
gttaagacccagtagtatcatgatt

SEQ ID NO: 521276 - DNA, 25 bp, Rattus norvegicus
gttaagacttgtaccagtgcgacat

SEQ ID NO: 521277 - DNA, 25 bp, Rattus norvegicus
gttaagacttgttccagtgcgacat

SEQ ID NO: 521278 - DNA, 25 bp, Rattus norvegicus
gttaagagagctagccgctcttgca

SEQ ID NO: 521279 - DNA, 25 bp, Rattus norvegicus
gttaagagagcttgccgctcttgca

SEQ ID NO: 521280 - DNA, 25 bp, Rattus norvegicus
gttaagagcaatcgctggctgttct

SEQ ID NO: 521281 - DNA, 25 bp, Rattus norvegicus
gttaagagcaatggctggctgttct

SEQ ID NO: 521282 - DNA, 25 bp, Rattus norvegicus
gttaagagccaacgcctctcaaggg

SEQ ID NO: 521283 - DNA, 25 bp, Rattus norvegicus
gttaagagccaaggcctctcaaggg

SEQ ID NO: 521284 - DNA, 25 bp, Rattus norvegicus
gttaagagcccacttttacacatct

SEQ ID NO: 521285 - DNA, 25 bp, Rattus norvegicus
gttaagagcccagttttacacatct

SEQ ID NO: 521286 - DNA, 25 bp, Rattus norvegicus
gttaagagccctcgcccttgagtct

SEQ ID NO: 521287 - DNA, 25 bp, Rattus norvegicus
gttaagagccctggcccttgagtct

SEQ ID NO: 521288 - DNA, 25 bp, Rattus norvegicus
gttaagagcctgaaaccatggaaac

SEQ ID NO: 521289 - DNA, 25 bp, Rattus norvegicus
gttaagagcctgtaaccatggaaac

SEQ ID NO: 521290 - DNA, 25 bp, Rattus norvegicus
gttaagagccttcagtccatgtgtg

SEQ ID NO: 521291 - DNA, 25 bp, Rattus norvegicus
gttaagagccttgagtccatgtgtg

SEQ ID NO: 521292 - DNA, 25 bp, Rattus norvegicus
gttaagaggcgaccagaaccttcct

SEQ ID NO: 521293 - DNA, 25 bp, Rattus norvegicus
gttaagaggcgagcagaaccttcct

SEQ ID NO: 521294 - DNA, 25 bp, Rattus norvegicus
gttaagaggctgaggcaaatggatc

SEQ ID NO: 521295 - DNA, 25 bp, Rattus norvegicus
gttaagaggctgtggcaaatggatc

SEQ ID NO: 521296 - DNA, 25 bp, Rattus norvegicus
gttaagatcccaattactatttgaa

SEQ ID NO: 521297 - DNA, 25 bp, Rattus norvegicus
gttaagatcccatttactatttgaa

SEQ ID NO: 521298 - DNA, 25 bp, Rattus norvegicus
gttaagatgggcaatcctcgcctgc

SEQ ID NO: 521299 - DNA, 25 bp, Rattus norvegicus
gttaagatgggctatcctcgcctgc

SEQ ID NO: 521300 - DNA, 25 bp, Rattus norvegicus
gttaagattgctcacttctcttcca

SEQ ID NO: 521301 - DNA, 25 bp, Rattus norvegicus
gttaagattgctgacttctcttcca

SEQ ID NO: 521302 - DNA, 25 bp, Rattus norvegicus
gttaagatttccctatgcatgtaca

SEQ ID NO: 521303 - DNA, 25 bp, Rattus norvegicus
gttaagatttccgtatgcatgtaca

SEQ ID NO: 521304 - DNA, 25 bp, Rattus norvegicus
gttaagcacctgagtgacttccagt

SEQ ID NO: 521305 - DNA, 25 bp, Rattus norvegicus
gttaagcacctgtgtgacttccagt

SEQ ID NO: 521306 - DNA, 25 bp, Rattus norvegicus
gttaagcaccttatcaagttattaa

SEQ ID NO: 521307 - DNA, 25 bp, Rattus norvegicus
gttaagcaccttttcaagttattaa

SEQ ID NO: 521308 - DNA, 25 bp, Rattus norvegicus
gttaagcacggtctccaaggactgc

SEQ ID NO: 521309 - DNA, 25 bp, Rattus norvegicus
gttaagcacggtgtccaaggactgc

SEQ ID NO: 521310 - DNA, 25 bp, Rattus norvegicus
gttaagcacttaaatgacatccaat

SEQ ID NO: 521311 - DNA, 25 bp, Rattus norvegicus
gttaagcacttatatgacatccaat

SEQ ID NO: 521312 - DNA, 25 bp, Rattus norvegicus
gttaagcagcccagataccgaaaag

SEQ ID NO: 521313 - DNA, 25 bp, Rattus norvegicus
gttaagcagccctgataccgaaaag

SEQ ID NO: 521314 - DNA, 25 bp, Rattus norvegicus
gttaagcaggtcaacctttgtccag

SEQ ID NO: 521315 - DNA, 25 bp, Rattus norvegicus
gttaagcaggtctacctttgtccag

SEQ ID NO: 521316 - DNA, 25 bp, Rattus norvegicus
gttaagccacacatatattgcgggt

SEQ ID NO: 521317 - DNA, 25 bp, Rattus norvegicus
gttaagccacacttatattgcgggt

SEQ ID NO: 521318 - DNA, 25 bp, Rattus norvegicus
gttaagccagctcatggtctccaat

SEQ ID NO: 521319 - DNA, 25 bp, Rattus norvegicus
gttaagccagctctgctcagtgggc

SEQ ID NO: 521320 - DNA, 25 bp, Rattus norvegicus
gttaagccagctgatggtctccaat

SEQ ID NO: 521321 - DNA, 25 bp, Rattus norvegicus
gttaagccagctgtgctcagtgggc

SEQ ID NO: 521322 - DNA, 25 bp, Rattus norvegicus
gttaagccatgaaaagcagccctgt

SEQ ID NO: 521323 - DNA, 25 bp, Rattus norvegicus
gttaagccatgataagcagccctgt

SEQ ID NO: 521324 - DNA, 25 bp, Rattus norvegicus
gttaagcccactctaccagaagtta

SEQ ID NO: 521325 - DNA, 25 bp, Rattus norvegicus
gttaagcccactgtaccagaagtta

SEQ ID NO: 521326 - DNA, 25 bp, Rattus norvegicus
gttaagcctctaacaggtcgctaga

SEQ ID NO: 521327 - DNA, 25 bp, Rattus norvegicus
gttaagcctctatcaggtcgctaga

SEQ ID NO: 521328 - DNA, 25 bp, Rattus norvegicus
gttaagcctttcagacctgttgtgt

SEQ ID NO: 521329 - DNA, 25 bp, Rattus norvegicus
gttaagcctttctgacctgttgtgt

SEQ ID NO: 521330 - DNA, 25 bp, Rattus norvegicus
gttaagctactcagagctccaggaa

SEQ ID NO: 521331 - DNA, 25 bp, Rattus norvegicus
gttaagctactctgagctccaggaa

SEQ ID NO: 521332 - DNA, 25 bp, Rattus norvegicus
gttaagctatttagatcactctgga

SEQ ID NO: 521333 - DNA, 25 bp, Rattus norvegicus
gttaagctattttgatcactctgga

SEQ ID NO: 521334 - DNA, 25 bp, Rattus norvegicus
gttaagctcatacagctgcgaacca

SEQ ID NO: 521335 - DNA, 25 bp, Rattus norvegicus
gttaagctcatagagctgcgaacca

SEQ ID NO: 521336 - DNA, 25 bp, Rattus norvegicus
gttaagctgccgagcaacagggctt

SEQ ID NO: 521337 - DNA, 25 bp, Rattus norvegicus
gttaagctgccgtgcaacagggctt

SEQ ID NO: 521338 - DNA, 25 bp, Rattus norvegicus
gttaagctgcctcaagtgtggtctg

SEQ ID NO: 521339 - DNA, 25 bp, Rattus norvegicus
gttaagctgcctgaagtgtggtctg

SEQ ID NO: 521340 - DNA, 25 bp, Rattus norvegicus
gttaagctggtcacatgtatagatt

SEQ ID NO: 521341 - DNA, 25 bp, Rattus norvegicus
gttaagctggtctcatgtatagatt

SEQ ID NO: 521342 - DNA, 25 bp, Rattus norvegicus
gttaagctgtagcagtgggctcact

SEQ ID NO: 521343 - DNA, 25 bp, Rattus norvegicus
gttaagctgtaggagtgggctcact

SEQ ID NO: 521344 - DNA, 25 bp, Rattus norvegicus
gttaagcttgatcccggctgtctca

SEQ ID NO: 521345 - DNA, 25 bp, Rattus norvegicus
gttaagcttgatctatccacatctg

SEQ ID NO: 521346 - DNA, 25 bp, Rattus norvegicus
gttaagcttgatgccggctgtctca

SEQ ID NO: 521347 - DNA, 25 bp, Rattus norvegicus
gttaagcttgatgtatccacatctg

SEQ ID NO: 521348 - DNA, 25 bp, Rattus norvegicus
gttaagcttgtcaggtctacattcc

SEQ ID NO: 521349 - DNA, 25 bp, Rattus norvegicus
gttaagcttgtctggtctacattcc

SEQ ID NO: 521350 - DNA, 25 bp, Rattus norvegicus
gttaaggacaccagctcatggtagt

SEQ ID NO: 521351 - DNA, 25 bp, Rattus norvegicus
gttaaggacacctgctcatggtagt

SEQ ID NO: 521352 - DNA, 25 bp, Rattus norvegicus
gttaaggcccaaatctagagctggc

SEQ ID NO: 521353 - DNA, 25 bp, Rattus norvegicus
gttaaggcccaattctagagctggc

SEQ ID NO: 521354 - DNA, 25 bp, Rattus norvegicus
gttaaggcgccactctttacaacac

SEQ ID NO: 521355 - DNA, 25 bp, Rattus norvegicus
gttaaggcgccagtctttacaacac

SEQ ID NO: 521356 - DNA, 25 bp, Rattus norvegicus
gttaaggctgatacagcttttcaaa

SEQ ID NO: 521357 - DNA, 25 bp, Rattus norvegicus
gttaaggctgattcagcttttcaaa

SEQ ID NO: 521358 - DNA, 25 bp, Rattus norvegicus
gttaaggctgcaccagccgcagcca

SEQ ID NO: 521359 - DNA, 25 bp, Rattus norvegicus
gttaaggctgcagcagccgcagcca

SEQ ID NO: 521360 - DNA, 25 bp, Rattus norvegicus
gttaagggacccacagcatgattta

SEQ ID NO: 521361 - DNA, 25 bp, Rattus norvegicus
gttaagggaccctcagcatgattta

SEQ ID NO: 521362 - DNA, 25 bp, Rattus norvegicus
gttaagggagctccactgtggttta

SEQ ID NO: 521363 - DNA, 25 bp, Rattus norvegicus
gttaagggagctgcactgtggttta

SEQ ID NO: 521364 - DNA, 25 bp, Rattus norvegicus
gttaagggagtcctcgctgatgctc

SEQ ID NO: 521365 - DNA, 25 bp, Rattus norvegicus
gttaagggagtcgtcgctgatgctc

SEQ ID NO: 521366 - DNA, 25 bp, Rattus norvegicus
gttaagggcattaaagcctcctgaa

SEQ ID NO: 521367 - DNA, 25 bp, Rattus norvegicus
gttaagggcatttaagcctcctgaa

SEQ ID NO: 521368 - DNA, 25 bp, Rattus norvegicus
gttaagggcgcgacctgttcagttc

SEQ ID NO: 521369 - DNA, 25 bp, Rattus norvegicus
gttaagggcgcgtcctgttcagttc

SEQ ID NO: 521370 - DNA, 25 bp, Rattus norvegicus
gttaaggtaatccacttggtgaaca

SEQ ID NO: 521371 - DNA, 25 bp, Rattus norvegicus
gttaaggtaatcgacttggtgaaca

SEQ ID NO: 521372 - DNA, 25 bp, Rattus norvegicus
gttaaggtctatacacacactatgg

SEQ ID NO: 521373 - DNA, 25 bp, Rattus norvegicus
gttaaggtctattcacacactatgg

SEQ ID NO: 521374 - DNA, 25 bp, Rattus norvegicus
gttaagtacacaaggagcggtcagt

SEQ ID NO: 521375 - DNA, 25 bp, Rattus norvegicus
gttaagtacacatggagcggtcagt

SEQ ID NO: 521376 - DNA, 25 bp, Rattus norvegicus
gttaagtatatgctttgggctagtt

SEQ ID NO: 521377 - DNA, 25 bp, Rattus norvegicus
gttaagtatatggtttgggctagtt

SEQ ID NO: 521378 - DNA, 25 bp, Rattus norvegicus
gttaagtatcctagactgatggcac

SEQ ID NO: 521379 - DNA, 25 bp, Rattus norvegicus
gttaagtatccttgactgatggcac

SEQ ID NO: 521380 - DNA, 25 bp, Rattus norvegicus
gttaagtcctaacgcagactgcgca

SEQ ID NO: 521381 - DNA, 25 bp, Rattus norvegicus
gttaagtcctaaggcagactgcgca

SEQ ID NO: 521382 - DNA, 25 bp, Rattus norvegicus
gttaagtctactctttgccatctga

SEQ ID NO: 521383 - DNA, 25 bp, Rattus norvegicus
gttaagtctactgtttgccatctga

SEQ ID NO: 521384 - DNA, 25 bp, Rattus norvegicus
gttaagtctgggaaccaaccaacag

SEQ ID NO: 521385 - DNA, 25 bp, Rattus norvegicus
gttaagtctgggtaccaaccaacag

SEQ ID NO: 521386 - DNA, 25 bp, Rattus norvegicus
gttaagtgcactcttaatgccatgt

SEQ ID NO: 521387 - DNA, 25 bp, Rattus norvegicus
gttaagtgcactgttaatgccatgt

SEQ ID NO: 521388 - DNA, 25 bp, Rattus norvegicus
gttaagtgcctgaattcctttcatt

SEQ ID NO: 521389 - DNA, 25 bp, Rattus norvegicus
gttaagtgcctgtattcctttcatt

SEQ ID NO: 521390 - DNA, 25 bp, Rattus norvegicus
gttaagtgctcaatagaggcccttt

SEQ ID NO: 521391 - DNA, 25 bp, Rattus norvegicus
gttaagtgctcattagaggcccttt

SEQ ID NO: 521392 - DNA, 25 bp, Rattus norvegicus
gttaagtggattccttttgccttgg

SEQ ID NO: 521393 - DNA, 25 bp, Rattus norvegicus
gttaagtggattgcttttgccttgg

SEQ ID NO: 521394 - DNA, 25 bp, Rattus norvegicus
gttaagtgtacgaactcccgcagac

SEQ ID NO: 521395 - DNA, 25 bp, Rattus norvegicus
gttaagtgtacgtactcccgcagac

SEQ ID NO: 521396 - DNA, 25 bp, Rattus norvegicus
gttaagttccagcacaactgtgttg

SEQ ID NO: 521397 - DNA, 25 bp, Rattus norvegicus
gttaagttccaggacaactgtgttg

SEQ ID NO: 521398 - DNA, 25 bp, Rattus norvegicus
gttaagttctaacagggctccagga

SEQ ID NO: 521399 - DNA, 25 bp, Rattus norvegicus
gttaagttctaagagggctccagga

SEQ ID NO: 521400 - DNA, 25 bp, Rattus norvegicus
gttaagttctccaggatggccgcaa

SEQ ID NO: 521401 - DNA, 25 bp, Rattus norvegicus
gttaagttctcctggatggccgcaa

SEQ ID NO: 521402 - DNA, 25 bp, Rattus norvegicus
gttaagttctgtctggtttggttca

SEQ ID NO: 521403 - DNA, 25 bp, Rattus norvegicus
gttaagttctgtgtggtttggttca

SEQ ID NO: 521404 - DNA, 25 bp, Rattus norvegicus
gttaagttgtatcacacctgtgtgc

SEQ ID NO: 521405 - DNA, 25 bp, Rattus norvegicus
gttaagttgtatgacacctgtgtgc

SEQ ID NO: 521406 - DNA, 25 bp, Rattus norvegicus
gttaagtttgccctatgaattttgt

SEQ ID NO: 521407 - DNA, 25 bp, Rattus norvegicus
gttaagtttgccgtatgaattttgt

SEQ ID NO: 521408 - DNA, 25 bp, Rattus norvegicus
gttaagtttttcatctgtgcatcaa

SEQ ID NO: 521409 - DNA, 25 bp, Rattus norvegicus
gttaagtttttcttctgtgcatcaa

SEQ ID NO: 521410 - DNA, 25 bp, Rattus norvegicus
gttaataaagctacctcttgctgtt

SEQ ID NO: 521411 - DNA, 25 bp, Rattus norvegicus
gttaataaagcttcctcttgctgtt

SEQ ID NO: 521412 - DNA, 25 bp, Rattus norvegicus
gttaataacgttagtatccatgtga

SEQ ID NO: 521413 - DNA, 25 bp, Rattus norvegicus
gttaataacgtttgtatccatgtga

SEQ ID NO: 521414 - DNA, 25 bp, Rattus norvegicus
gttaataactgtattccagcaagaa

SEQ ID NO: 521415 - DNA, 25 bp, Rattus norvegicus
gttaataactgttttccagcaagaa

SEQ ID NO: 521416 - DNA, 25 bp, Rattus norvegicus
gttaatactcctaacacttcttggg

SEQ ID NO: 521417 - DNA, 25 bp, Rattus norvegicus
gttaatactccttacacttcttggg

SEQ ID NO: 521418 - DNA, 25 bp, Rattus norvegicus
gttaatagaagccacacccatcatg

SEQ ID NO: 521419 - DNA, 25 bp, Rattus norvegicus
gttaatagaagcgacacccatcatg

SEQ ID NO: 521420 - DNA, 25 bp, Rattus norvegicus
gttaatagcacaaatgccactttga

SEQ ID NO: 521421 - DNA, 25 bp, Rattus norvegicus
gttaatagcacatatgccactttga

SEQ ID NO: 521422 - DNA, 25 bp, Rattus norvegicus
gttaatagcctgcatcaaaccttta

SEQ ID NO: 521423 - DNA, 25 bp, Rattus norvegicus
gttaatagcctggatcaaaccttta

SEQ ID NO: 521424 - DNA, 25 bp, Rattus norvegicus
gttaatagctagatgtggactctta

SEQ ID NO: 521425 - DNA, 25 bp, Rattus norvegicus
gttaatagctagttgtggactctta

SEQ ID NO: 521426 - DNA, 25 bp, Rattus norvegicus
gttaatatatccaggtgctcaccaa

SEQ ID NO: 521427 - DNA, 25 bp, Rattus norvegicus
gttaatatatcctggtgctcaccaa

SEQ ID NO: 521428 - DNA, 25 bp, Rattus norvegicus
gttaatatgcatccccaagggtttt

SEQ ID NO: 521429 - DNA, 25 bp, Rattus norvegicus
gttaatatgcatgcccaagggtttt

SEQ ID NO: 521430 - DNA, 25 bp, Rattus norvegicus
gttaatattcaccttcctgttttga

SEQ ID NO: 521431 - DNA, 25 bp, Rattus norvegicus
gttaatattcacgttcctgttttga

SEQ ID NO: 521432 - DNA, 25 bp, Rattus norvegicus
gttaatatttttcactacctttgca

SEQ ID NO: 521433 - DNA, 25 bp, Rattus norvegicus
gttaatatttttgactacctttgca

SEQ ID NO: 521434 - DNA, 25 bp, Rattus norvegicus
gttaatcaactgcaagtgtttcctt

SEQ ID NO: 521435 - DNA, 25 bp, Rattus norvegicus
gttaatcaactggaagtgtttcctt

SEQ ID NO: 521436 - DNA, 25 bp, Rattus norvegicus
gttaatcacccaaagtgagcccttg

SEQ ID NO: 521437 - DNA, 25 bp, Rattus norvegicus
gttaatcacccatagtgagcccttg

SEQ ID NO: 521438 - DNA, 25 bp, Rattus norvegicus
gttaatcactctcctgagatctgac

SEQ ID NO: 521439 - DNA, 25 bp, Rattus norvegicus
gttaatcactctgctgagatctgac

SEQ ID NO: 521440 - DNA, 25 bp, Rattus norvegicus
gttaatcagcttcgtgatgcccatg

SEQ ID NO: 521441 - DNA, 25 bp, Rattus norvegicus
gttaatcagcttggtgatgcccatg

SEQ ID NO: 521442 - DNA, 25 bp, Rattus norvegicus
gttaatccagtcactctaggtccaa

SEQ ID NO: 521443 - DNA, 25 bp, Rattus norvegicus
gttaatccagtctctctaggtccaa

SEQ ID NO: 521444 - DNA, 25 bp, Rattus norvegicus
gttaatccagtgcatctcttactaa

SEQ ID NO: 521445 - DNA, 25 bp, Rattus norvegicus
gttaatccagtggatctcttactaa

SEQ ID NO: 521446 - DNA, 25 bp, Rattus norvegicus
gttaatccatataggcagaacgaaa

SEQ ID NO: 521447 - DNA, 25 bp, Rattus norvegicus
gttaatccatattggcagaacgaaa

SEQ ID NO: 521448 - DNA, 25 bp, Rattus norvegicus
gttaatcccaagcaactgcccaagt

SEQ ID NO: 521449 - DNA, 25 bp, Rattus norvegicus
gttaatcccaaggaactgcccaagt

SEQ ID NO: 521450 - DNA, 25 bp, Rattus norvegicus
gttaatccttataggagttgtgcca

SEQ ID NO: 521451 - DNA, 25 bp, Rattus norvegicus
gttaatccttattggagttgtgcca

SEQ ID NO: 521452 - DNA, 25 bp, Rattus norvegicus
gttaatcgattaccatcatggaggc

SEQ ID NO: 521453 - DNA, 25 bp, Rattus norvegicus
gttaatcgattagcatcatggaggc

SEQ ID NO: 521454 - DNA, 25 bp, Rattus norvegicus
gttaatcgatttactctactctggt

SEQ ID NO: 521455 - DNA, 25 bp, Rattus norvegicus
gttaatcgattttctctactctggt

SEQ ID NO: 521456 - DNA, 25 bp, Rattus norvegicus
gttaatctctgccactagagcagga

SEQ ID NO: 521457 - DNA, 25 bp, Rattus norvegicus
gttaatctctgcgactagagcagga

SEQ ID NO: 521458 - DNA, 25 bp, Rattus norvegicus
gttaatctcttgagttactcgtccc

SEQ ID NO: 521459 - DNA, 25 bp, Rattus norvegicus
gttaatctcttgtgttactcgtccc

SEQ ID NO: 521460 - DNA, 25 bp, Rattus norvegicus
gttaatctgtatctcctgtttgcca

SEQ ID NO: 521461 - DNA, 25 bp, Rattus norvegicus
gttaatctgtatgtcctgtttgcca

SEQ ID NO: 521462 - DNA, 25 bp, Rattus norvegicus
gttaatctgtgtctggtactttcaa

SEQ ID NO: 521463 - DNA, 25 bp, Rattus norvegicus
gttaatctgtgtgtggtactttcaa

SEQ ID NO: 521464 - DNA, 25 bp, Rattus norvegicus
gttaatcttattagccatccttgaa

SEQ ID NO: 521465 - DNA, 25 bp, Rattus norvegicus
gttaatcttatttgccatccttgaa

SEQ ID NO: 521466 - DNA, 25 bp, Rattus norvegicus
gttaatcttgttacttgccatgtcc

SEQ ID NO: 521467 - DNA, 25 bp, Rattus norvegicus
gttaatcttgtttcttgccatgtcc

SEQ ID NO: 521468 - DNA, 25 bp, Rattus norvegicus
gttaatgaacacatctggctccaag

SEQ ID NO: 521469 - DNA, 25 bp, Rattus norvegicus
gttaatgaacacttctggctccaag

SEQ ID NO: 521470 - DNA, 25 bp, Rattus norvegicus
gttaatgaccccacagaaaatgtcc

SEQ ID NO: 521471 - DNA, 25 bp, Rattus norvegicus
gttaatgacccctcagaaaatgtcc

SEQ ID NO: 521472 - DNA, 25 bp, Rattus norvegicus
gttaatgactttaccaaatgcctag

SEQ ID NO: 521473 - DNA, 25 bp, Rattus norvegicus
gttaatgactttaccacggctgaca

SEQ ID NO: 521474 - DNA, 25 bp, Rattus norvegicus
gttaatgacttttccaaatgcctag

SEQ ID NO: 521475 - DNA, 25 bp, Rattus norvegicus
gttaatgacttttccacggctgaca

SEQ ID NO: 521476 - DNA, 25 bp, Rattus norvegicus
gttaatgagcggatatctccatggt

SEQ ID NO: 521477 - DNA, 25 bp, Rattus norvegicus
gttaatgagcggttatctccatggt

SEQ ID NO: 521478 - DNA, 25 bp, Rattus norvegicus
gttaatgaggccaacttttccaaca

SEQ ID NO: 521479 - DNA, 25 bp, Rattus norvegicus
gttaatgaggcctacttttccaaca

SEQ ID NO: 521480 - DNA, 25 bp, Rattus norvegicus
gttaatgatgtcaccaccaaggcat

SEQ ID NO: 521481 - DNA, 25 bp, Rattus norvegicus
gttaatgatgtctccaccaaggcat

SEQ ID NO: 521482 - DNA, 25 bp, Rattus norvegicus
gttaatgcactcactctatgttaca

SEQ ID NO: 521483 - DNA, 25 bp, Rattus norvegicus
gttaatgcactcattcaccttggca

SEQ ID NO: 521484 - DNA, 25 bp, Rattus norvegicus
gttaatgcactctctctatgttaca

SEQ ID NO: 521485 - DNA, 25 bp, Rattus norvegicus
gttaatgcactctttcaccttggca

SEQ ID NO: 521486 - DNA, 25 bp, Rattus norvegicus
gttaatgcacttcttttcctagctc

SEQ ID NO: 521487 - DNA, 25 bp, Rattus norvegicus
gttaatgcacttgttttcctagctc

SEQ ID NO: 521488 - DNA, 25 bp, Rattus norvegicus
gttaatgctgagacaccacacggat

SEQ ID NO: 521489 - DNA, 25 bp, Rattus norvegicus
gttaatgctgagtcaccacacggat

SEQ ID NO: 521490 - DNA, 25 bp, Rattus norvegicus
gttaatggacatatcatgctgctga

SEQ ID NO: 521491 - DNA, 25 bp, Rattus norvegicus
gttaatggacatttcatgctgctga

SEQ ID NO: 521492 - DNA, 25 bp, Rattus norvegicus
gttaatggagccattcactggacct

SEQ ID NO: 521493 - DNA, 25 bp, Rattus norvegicus
gttaatggagcctttcactggacct

SEQ ID NO: 521494 - DNA, 25 bp, Rattus norvegicus
gttaatggcagcattcacaggccta

SEQ ID NO: 521495 - DNA, 25 bp, Rattus norvegicus
gttaatggcagctttcacaggccta

SEQ ID NO: 521496 - DNA, 25 bp, Rattus norvegicus
gttaatggcatgaaccatcacacct

SEQ ID NO: 521497 - DNA, 25 bp, Rattus norvegicus
gttaatggcatgtaccatcacacct

SEQ ID NO: 521498 - DNA, 25 bp, Rattus norvegicus
gttaatggccagattggttcaccca

SEQ ID NO: 521499 - DNA, 25 bp, Rattus norvegicus
gttaatggccagtttggttcaccca

SEQ ID NO: 521500 - DNA, 25 bp, Rattus norvegicus
gttaatgggcaaacattctcctggg

SEQ ID NO: 521501 - DNA, 25 bp, Rattus norvegicus
gttaatgggcaatcattctcctggg

SEQ ID NO: 521502 - DNA, 25 bp, Rattus norvegicus
gttaatgtaatcatcactccggagt

SEQ ID NO: 521503 - DNA, 25 bp, Rattus norvegicus
gttaatgtaatcttcactccggagt

SEQ ID NO: 521504 - DNA, 25 bp, Rattus norvegicus
gttaatgtagtgatgcctgcctgta

SEQ ID NO: 521505 - DNA, 25 bp, Rattus norvegicus
gttaatgtagtgttgcctgcctgta

SEQ ID NO: 521506 - DNA, 25 bp, Rattus norvegicus
gttaatgtcttccttaggttctgaa

SEQ ID NO: 521507 - DNA, 25 bp, Rattus norvegicus
gttaatgtcttcgttaggttctgaa

SEQ ID NO: 521508 - DNA, 25 bp, Rattus norvegicus
gttaatgtgcagagacatggctgat

SEQ ID NO: 521509 - DNA, 25 bp, Rattus norvegicus
gttaatgtgcagtgacatggctgat

SEQ ID NO: 521510 - DNA, 25 bp, Rattus norvegicus
gttaatgtgtgtacctttcagactg

SEQ ID NO: 521511 - DNA, 25 bp, Rattus norvegicus
gttaatgtgtgttcctttcagactg

SEQ ID NO: 521512 - DNA, 25 bp, Rattus norvegicus
gttaatgttccaaggtctgtacttt

SEQ ID NO: 521513 - DNA, 25 bp, Rattus norvegicus
gttaatgttccatggtctgtacttt

SEQ ID NO: 521514 - DNA, 25 bp, Rattus norvegicus
gttaatgttcggcactgttccagaa

SEQ ID NO: 521515 - DNA, 25 bp, Rattus norvegicus
gttaatgttcgggactgttccagaa

SEQ ID NO: 521516 - DNA, 25 bp, Rattus norvegicus
gttaatgttgcaattactgcagcag

SEQ ID NO: 521517 - DNA, 25 bp, Rattus norvegicus
gttaatgttgcatttactgcagcag

SEQ ID NO: 521518 - DNA, 25 bp, Rattus norvegicus
gttaattacctcatcattaccacgt

SEQ ID NO: 521519 - DNA, 25 bp, Rattus norvegicus
gttaattacctcttcattaccacgt

SEQ ID NO: 521520 - DNA, 25 bp, Rattus norvegicus
gttaattagcccaaataccacgagc

SEQ ID NO: 521521 - DNA, 25 bp, Rattus norvegicus
gttaattagccctaataccacgagc

SEQ ID NO: 521522 - DNA, 25 bp, Rattus norvegicus
gttaattatcagaaccctcctggat

SEQ ID NO: 521523 - DNA, 25 bp, Rattus norvegicus
gttaattatcagtaccctcctggat

SEQ ID NO: 521524 - DNA, 25 bp, Rattus norvegicus
gttaattcacagacagctggagcaa

SEQ ID NO: 521525 - DNA, 25 bp, Rattus norvegicus
gttaattcacagtcagctggagcaa

SEQ ID NO: 521526 - DNA, 25 bp, Rattus norvegicus
gttaattcccagctcacacgtggtg

SEQ ID NO: 521527 - DNA, 25 bp, Rattus norvegicus
gttaattcccaggtcacacgtggtg

SEQ ID NO: 521528 - DNA, 25 bp, Rattus norvegicus
gttaattccctaaatgtactatgtt

SEQ ID NO: 521529 - DNA, 25 bp, Rattus norvegicus
gttaattccctatatgtactatgtt

SEQ ID NO: 521530 - DNA, 25 bp, Rattus norvegicus
gttaattcctgcatcgtttcaatgg

SEQ ID NO: 521531 - DNA, 25 bp, Rattus norvegicus
gttaattcctgcttcgtttcaatgg

SEQ ID NO: 521532 - DNA, 25 bp, Rattus norvegicus
gttaattctgtgatcgtttgcatca

SEQ ID NO: 521533 - DNA, 25 bp, Rattus norvegicus
gttaattctgtgttcgtttgcatca

SEQ ID NO: 521534 - DNA, 25 bp, Rattus norvegicus
gttaattgagagatccgcaggatac

SEQ ID NO: 521535 - DNA, 25 bp, Rattus norvegicus
gttaattgagagttccgcaggatac

SEQ ID NO: 521536 - DNA, 25 bp, Rattus norvegicus
gttaattgcacacactgatttccca

SEQ ID NO: 521537 - DNA, 25 bp, Rattus norvegicus
gttaattgcacagactgatttccca

SEQ ID NO: 521538 - DNA, 25 bp, Rattus norvegicus
gttaattgcagcaccgtggctgaca

SEQ ID NO: 521539 - DNA, 25 bp, Rattus norvegicus
gttaattgcagctccgtggctgaca

SEQ ID NO: 521540 - DNA, 25 bp, Rattus norvegicus
gttaattgcctcatactgtcaaaaa

SEQ ID NO: 521541 - DNA, 25 bp, Rattus norvegicus
gttaattgcctcttactgtcaaaaa

SEQ ID NO: 521542 - DNA, 25 bp, Rattus norvegicus
gttaattgcgtcactctaaaccgtt

SEQ ID NO: 521543 - DNA, 25 bp, Rattus norvegicus
gttaattgcgtctctctaaaccgtt

SEQ ID NO: 521544 - DNA, 25 bp, Rattus norvegicus
gttaattggcaaattttgccccaag

SEQ ID NO: 521545 - DNA, 25 bp, Rattus norvegicus
gttaattggcaatttttgccccaag

SEQ ID NO: 521546 - DNA, 25 bp, Rattus norvegicus
gttaattgtccgacattggtccggg

SEQ ID NO: 521547 - DNA, 25 bp, Rattus norvegicus
gttaattgtccgtcattggtccggg

SEQ ID NO: 521548 - DNA, 25 bp, Rattus norvegicus
gttaattgttttacttgccctggat

SEQ ID NO: 521549 - DNA, 25 bp, Rattus norvegicus
gttaattgtttttcttgccctggat

SEQ ID NO: 521550 - DNA, 25 bp, Rattus norvegicus
gttaatttaatgattgcactcgggt

SEQ ID NO: 521551 - DNA, 25 bp, Rattus norvegicus
gttaatttaatgtttgcactcgggt

SEQ ID NO: 521552 - DNA, 25 bp, Rattus norvegicus
gttaatttccatcccgtgaagtttt

SEQ ID NO: 521553 - DNA, 25 bp, Rattus norvegicus
gttaatttccatgccgtgaagtttt

SEQ ID NO: 521554 - DNA, 25 bp, Rattus norvegicus
gttaatttcctgaacatattgtatc

SEQ ID NO: 521555 - DNA, 25 bp, Rattus norvegicus
gttaatttcctgtacatattgtatc

SEQ ID NO: 521556 - DNA, 25 bp, Rattus norvegicus
gttaatttcttcaacctaattcagg

SEQ ID NO: 521557 - DNA, 25 bp, Rattus norvegicus
gttaatttcttctacctaattcagg

SEQ ID NO: 521558 - DNA, 25 bp, Rattus norvegicus
gttaatttctttatagcatgtgctc

SEQ ID NO: 521559 - DNA, 25 bp, Rattus norvegicus
gttaatttctttttagcatgtgctc

SEQ ID NO: 521560 - DNA, 25 bp, Rattus norvegicus
gttaatttgctccttgatcacttga

SEQ ID NO: 521561 - DNA, 25 bp, Rattus norvegicus
gttaatttgctcgttgatcacttga

SEQ ID NO: 521562 - DNA, 25 bp, Rattus norvegicus
gttaatttggctctaatggcattta

SEQ ID NO: 521563 - DNA, 25 bp, Rattus norvegicus
gttaatttggctgtaatggcattta

SEQ ID NO: 521564 - DNA, 25 bp, Rattus norvegicus
gttaattttgaaacaacctcaggct

SEQ ID NO: 521565 - DNA, 25 bp, Rattus norvegicus
gttaattttgaatcaacctcaggct

SEQ ID NO: 521566 - DNA, 25 bp, Rattus norvegicus
gttacaaaatgaaggctttcgggat

SEQ ID NO: 521567 - DNA, 25 bp, Rattus norvegicus
gttacaaaatgatggctttcgggat

SEQ ID NO: 521568 - DNA, 25 bp, Rattus norvegicus
gttacaaaatgcattgccccgggtt

SEQ ID NO: 521569 - DNA, 25 bp, Rattus norvegicus
gttacaaaatgctttgccccgggtt

SEQ ID NO: 521570 - DNA, 25 bp, Rattus norvegicus
gttacaaaatgtactcacggccctc

SEQ ID NO: 521571 - DNA, 25 bp, Rattus norvegicus
gttacaaaatgttctcacggccctc

SEQ ID NO: 521572 - DNA, 25 bp, Rattus norvegicus
gttacaaacaatatcgctgagcagt

SEQ ID NO: 521573 - DNA, 25 bp, Rattus norvegicus
gttacaaacaatttcgctgagcagt

SEQ ID NO: 521574 - DNA, 25 bp, Rattus norvegicus
gttacaaacaggaaatacaaattat

SEQ ID NO: 521575 - DNA, 25 bp, Rattus norvegicus
gttacaaacaggtaatacaaattat

SEQ ID NO: 521576 - DNA, 25 bp, Rattus norvegicus
gttacaaacccactgaggccttcat

SEQ ID NO: 521577 - DNA, 25 bp, Rattus norvegicus
gttacaaacccagtgaggccttcat

SEQ ID NO: 521578 - DNA, 25 bp, Rattus norvegicus
gttacaaactcgacactaaacaaga

SEQ ID NO: 521579 - DNA, 25 bp, Rattus norvegicus
gttacaaactcgtcactaaacaaga

SEQ ID NO: 521580 - DNA, 25 bp, Rattus norvegicus
gttacaaacttgagcggtcccataa

SEQ ID NO: 521581 - DNA, 25 bp, Rattus norvegicus
gttacaaacttgtgcggtcccataa

SEQ ID NO: 521582 - DNA, 25 bp, Rattus norvegicus
gttacaaagccgactacagccatac

SEQ ID NO: 521583 - DNA, 25 bp, Rattus norvegicus
gttacaaagccgtctacagccatac

SEQ ID NO: 521584 - DNA, 25 bp, Rattus norvegicus
gttacaaattcactttgtggcacaa

SEQ ID NO: 521585 - DNA, 25 bp, Rattus norvegicus
gttacaaattcagtttgtggcacaa

SEQ ID NO: 521586 - DNA, 25 bp, Rattus norvegicus
gttacaacaaaaaactatgatgcgg

SEQ ID NO: 521587 - DNA, 25 bp, Rattus norvegicus
gttacaacaaaatactatgatgcgg

SEQ ID NO: 521588 - DNA, 25 bp, Rattus norvegicus
gttacaaccatcatcgcctagaaga

SEQ ID NO: 521589 - DNA, 25 bp, Rattus norvegicus
gttacaaccatcttcgcctagaaga

SEQ ID NO: 521590 - DNA, 25 bp, Rattus norvegicus
gttacaactttccatatgttccctg

SEQ ID NO: 521591 - DNA, 25 bp, Rattus norvegicus
gttacaactttcgatatgttccctg

SEQ ID NO: 521592 - DNA, 25 bp, Rattus norvegicus
gttacaagaggacacaagcgttcat

SEQ ID NO: 521593 - DNA, 25 bp, Rattus norvegicus
gttacaagaggagacaagcgttcat

SEQ ID NO: 521594 - DNA, 25 bp, Rattus norvegicus
gttacaagaggtagtcggccacctg

SEQ ID NO: 521595 - DNA, 25 bp, Rattus norvegicus
gttacaagaggttgtcggccacctg

SEQ ID NO: 521596 - DNA, 25 bp, Rattus norvegicus
gttacaagcagtagtggctcccaca

SEQ ID NO: 521597 - DNA, 25 bp, Rattus norvegicus
gttacaagcagttgtggctcccaca

SEQ ID NO: 521598 - DNA, 25 bp, Rattus norvegicus
gttacaagctctcaacctgtgatga

SEQ ID NO: 521599 - DNA, 25 bp, Rattus norvegicus
gttacaagctctgaacctgtgatga

SEQ ID NO: 521600 - DNA, 25 bp, Rattus norvegicus
gttacaatacagctgcactcaggga

SEQ ID NO: 521601 - DNA, 25 bp, Rattus norvegicus
gttacaatacaggtgcactcaggga

SEQ ID NO: 521602 - DNA, 25 bp, Rattus norvegicus
gttacaatatggacagtagggtggt

SEQ ID NO: 521603 - DNA, 25 bp, Rattus norvegicus
gttacaatatggtcagtagggtggt

SEQ ID NO: 521604 - DNA, 25 bp, Rattus norvegicus
gttacaatccgacagtcctacagac

SEQ ID NO: 521605 - DNA, 25 bp, Rattus norvegicus
gttacaatccgagagtcctacagac

SEQ ID NO: 521606 - DNA, 25 bp, Rattus norvegicus
gttacaatctgcatctaaggtatat

SEQ ID NO: 521607 - DNA, 25 bp, Rattus norvegicus
gttacaatctgcttctaaggtatat

SEQ ID NO: 521608 - DNA, 25 bp, Rattus norvegicus
gttacaatgtttatgacccacccaa

SEQ ID NO: 521609 - DNA, 25 bp, Rattus norvegicus
gttacaatgtttttgacccacccaa

SEQ ID NO: 521610 - DNA, 25 bp, Rattus norvegicus
gttacaatttcaccccttaagtctc

SEQ ID NO: 521611 - DNA, 25 bp, Rattus norvegicus
gttacaatttcagcccttaagtctc

SEQ ID NO: 521612 - DNA, 25 bp, Rattus norvegicus
gttacacaacagctttcacttgaag

SEQ ID NO: 521613 - DNA, 25 bp, Rattus norvegicus
gttacacaacaggtttcacttgaag

SEQ ID NO: 521614 - DNA, 25 bp, Rattus norvegicus
gttacacaagggatggctactctat

SEQ ID NO: 521615 - DNA, 25 bp, Rattus norvegicus
gttacacaagggttggctactctat

SEQ ID NO: 521616 - DNA, 25 bp, Rattus norvegicus
gttacacaagtacatgggccacatt

SEQ ID NO: 521617 - DNA, 25 bp, Rattus norvegicus
gttacacaagtagatgggccacatt

SEQ ID NO: 521618 - DNA, 25 bp, Rattus norvegicus
gttacacaccagaacacatcaaagt

SEQ ID NO: 521619 - DNA, 25 bp, Rattus norvegicus
gttacacaccagtacacatcaaagt

SEQ ID NO: 521620 - DNA, 25 bp, Rattus norvegicus
gttacacaggtaatgctgggccaac

SEQ ID NO: 521621 - DNA, 25 bp, Rattus norvegicus
gttacacaggtattgctgggccaac

SEQ ID NO: 521622 - DNA, 25 bp, Rattus norvegicus
gttacacagtgccttctaggctaca

SEQ ID NO: 521623 - DNA, 25 bp, Rattus norvegicus
gttacacagtgcgttctaggctaca

SEQ ID NO: 521624 - DNA, 25 bp, Rattus norvegicus
gttacaccaagcacagtcagttctg

SEQ ID NO: 521625 - DNA, 25 bp, Rattus norvegicus
gttacaccaagctcagtcagttctg

SEQ ID NO: 521626 - DNA, 25 bp, Rattus norvegicus
gttacaccacctaacagcatcatgg

SEQ ID NO: 521627 - DNA, 25 bp, Rattus norvegicus
gttacaccaccttacagcatcatgg

SEQ ID NO: 521628 - DNA, 25 bp, Rattus norvegicus
gttacaccttctcctgtctgcgggt

SEQ ID NO: 521629 - DNA, 25 bp, Rattus norvegicus
gttacaccttctgctgtctgcgggt

SEQ ID NO: 521630 - DNA, 25 bp, Rattus norvegicus
gttacacggcacagaggactggatt

SEQ ID NO: 521631 - DNA, 25 bp, Rattus norvegicus
gttacacggcactgaggactggatt

SEQ ID NO: 521632 - DNA, 25 bp, Rattus norvegicus
gttacacggcgtagtggtgtcccga

SEQ ID NO: 521633 - DNA, 25 bp, Rattus norvegicus
gttacacggcgttgtggtgtcccga

SEQ ID NO: 521634 - DNA, 25 bp, Rattus norvegicus
gttacacggcttagccatacaagct

SEQ ID NO: 521635 - DNA, 25 bp, Rattus norvegicus
gttacacggctttgccatacaagct

SEQ ID NO: 521636 - DNA, 25 bp, Rattus norvegicus
gttacactaaatcggagagtctcag

SEQ ID NO: 521637 - DNA, 25 bp, Rattus norvegicus
gttacactaaatgggagagtctcag

SEQ ID NO: 521638 - DNA, 25 bp, Rattus norvegicus
gttacactcgctcaagtacagcagt

SEQ ID NO: 521639 - DNA, 25 bp, Rattus norvegicus
gttacactcgctgaagtacagcagt

SEQ ID NO: 521640 - DNA, 25 bp, Rattus norvegicus
gttacactctcacccatcaaatcag

SEQ ID NO: 521641 - DNA, 25 bp, Rattus norvegicus
gttacactctcagccatcaaatcag

SEQ ID NO: 521642 - DNA, 25 bp, Rattus norvegicus
gttacactgaagcaggcactgtctg

SEQ ID NO: 521643 - DNA, 25 bp, Rattus norvegicus
gttacactgaaggaggcactgtctg

SEQ ID NO: 521644 - DNA, 25 bp, Rattus norvegicus
gttacactgagcatcaaccatccaa

SEQ ID NO: 521645 - DNA, 25 bp, Rattus norvegicus
gttacactgagcttcaaccatccaa

SEQ ID NO: 521646 - DNA, 25 bp, Rattus norvegicus
gttacactgtgtatctgagaccttt

SEQ ID NO: 521647 - DNA, 25 bp, Rattus norvegicus
gttacactgtgtttctgagaccttt

SEQ ID NO: 521648 - DNA, 25 bp, Rattus norvegicus
gttacacttaaacggctttgcacct

SEQ ID NO: 521649 - DNA, 25 bp, Rattus norvegicus
gttacacttaaagggctttgcacct

SEQ ID NO: 521650 - DNA, 25 bp, Rattus norvegicus
gttacacttaaccattattcccagc

SEQ ID NO: 521651 - DNA, 25 bp, Rattus norvegicus
gttacacttaacgattattcccagc

SEQ ID NO: 521652 - DNA, 25 bp, Rattus norvegicus
gttacacttagaccctgcacgggtc

SEQ ID NO: 521653 - DNA, 25 bp, Rattus norvegicus
gttacacttagagcctgcacgggtc

SEQ ID NO: 521654 - DNA, 25 bp, Rattus norvegicus
gttacagaactcacagccagtgggc

SEQ ID NO: 521655 - DNA, 25 bp, Rattus norvegicus
gttacagaactctcagccagtgggc

SEQ ID NO: 521656 - DNA, 25 bp, Rattus norvegicus
gttacagaatgacaacctctttcaa

SEQ ID NO: 521657 - DNA, 25 bp, Rattus norvegicus
gttacagaatgagaacctctttcaa

SEQ ID NO: 521658 - DNA, 25 bp, Rattus norvegicus
gttacagaatgtccgttaaacaatg

SEQ ID NO: 521659 - DNA, 25 bp, Rattus norvegicus
gttacagaatgtgcgttaaacaatg

SEQ ID NO: 521660 - DNA, 25 bp, Rattus norvegicus
gttacagacaataactacccatgtt

SEQ ID NO: 521661 - DNA, 25 bp, Rattus norvegicus
gttacagacaattactacccatgtt

SEQ ID NO: 521662 - DNA, 25 bp, Rattus norvegicus
gttacagacataccctatgccactg

SEQ ID NO: 521663 - DNA, 25 bp, Rattus norvegicus
gttacagacatagcctatgccactg

SEQ ID NO: 521664 - DNA, 25 bp, Rattus norvegicus
gttacagacatcatgctcaaccaca

SEQ ID NO: 521665 - DNA, 25 bp, Rattus norvegicus
gttacagacatcttgctcaaccaca

SEQ ID NO: 521666 - DNA, 25 bp, Rattus norvegicus
gttacagacgcacagtcaagatctt

SEQ ID NO: 521667 - DNA, 25 bp, Rattus norvegicus
gttacagacgcagagtcaagatctt

SEQ ID NO: 521668 - DNA, 25 bp, Rattus norvegicus
gttacagagagcctgcaaaaccctt

SEQ ID NO: 521669 - DNA, 25 bp, Rattus norvegicus
gttacagagagcgtgcaaaaccctt

SEQ ID NO: 521670 - DNA, 25 bp, Rattus norvegicus
gttacagagatactattgctcctca

SEQ ID NO: 521671 - DNA, 25 bp, Rattus norvegicus
gttacagagatagtattgctcctca

SEQ ID NO: 521672 - DNA, 25 bp, Rattus norvegicus
gttacagatctccagcaggctgtga

SEQ ID NO: 521673 - DNA, 25 bp, Rattus norvegicus
gttacagatctcgagcaggctgtga

SEQ ID NO: 521674 - DNA, 25 bp, Rattus norvegicus
gttacagatgaacccaatgtccaat

SEQ ID NO: 521675 - DNA, 25 bp, Rattus norvegicus
gttacagatgaagccaatgtccaat

SEQ ID NO: 521676 - DNA, 25 bp, Rattus norvegicus
gttacagatggtagttagacaccgt

SEQ ID NO: 521677 - DNA, 25 bp, Rattus norvegicus
gttacagatggttgttagacaccgt

SEQ ID NO: 521678 - DNA, 25 bp, Rattus norvegicus
gttacagattttctactcggagcag

SEQ ID NO: 521679 - DNA, 25 bp, Rattus norvegicus
gttacagattttgtactcggagcag

SEQ ID NO: 521680 - DNA, 25 bp, Rattus norvegicus
gttacagcagagattccagcacttt

SEQ ID NO: 521681 - DNA, 25 bp, Rattus norvegicus
gttacagcagagtttccagcacttt

SEQ ID NO: 521682 - DNA, 25 bp, Rattus norvegicus
gttacagcagcacttagagacatac

SEQ ID NO: 521683 - DNA, 25 bp, Rattus norvegicus
gttacagcagcagttagagacatac

SEQ ID NO: 521684 - DNA, 25 bp, Rattus norvegicus
gttacagcatctcatagaggccctg

SEQ ID NO: 521685 - DNA, 25 bp, Rattus norvegicus
gttacagcatctgatagaggccctg

SEQ ID NO: 521686 - DNA, 25 bp, Rattus norvegicus
gttacagcatttcgttttgccgtct

SEQ ID NO: 521687 - DNA, 25 bp, Rattus norvegicus
gttacagcatttggttttgccgtct

SEQ ID NO: 521688 - DNA, 25 bp, Rattus norvegicus
gttacagcccgtccagctgctctga

SEQ ID NO: 521689 - DNA, 25 bp, Rattus norvegicus
gttacagcccgtgcagctgctctga

SEQ ID NO: 521690 - DNA, 25 bp, Rattus norvegicus
gttacagccgttattggcaaccaat

SEQ ID NO: 521691 - DNA, 25 bp, Rattus norvegicus
gttacagccgtttttggcaaccaat

SEQ ID NO: 521692 - DNA, 25 bp, Rattus norvegicus
gttacagcgctgacgtgcctgaagg

SEQ ID NO: 521693 - DNA, 25 bp, Rattus norvegicus
gttacagcgctgtcgtgcctgaagg

SEQ ID NO: 521694 - DNA, 25 bp, Rattus norvegicus
gttacagcttaaatcagactgcagt

SEQ ID NO: 521695 - DNA, 25 bp, Rattus norvegicus
gttacagcttaattcagactgcagt

SEQ ID NO: 521696 - DNA, 25 bp, Rattus norvegicus
gttacaggatagcacaggacaggct

SEQ ID NO: 521697 - DNA, 25 bp, Rattus norvegicus
gttacaggataggacaggacaggct

SEQ ID NO: 521698 - DNA, 25 bp, Rattus norvegicus
gttacaggcaacctcagtggctgct

SEQ ID NO: 521699 - DNA, 25 bp, Rattus norvegicus
gttacaggcaacgtcagtggctgct

SEQ ID NO: 521700 - DNA, 25 bp, Rattus norvegicus
gttacaggccacatcatgctaacga

SEQ ID NO: 521701 - DNA, 25 bp, Rattus norvegicus
gttacaggccacttcatgctaacga

SEQ ID NO: 521702 - DNA, 25 bp, Rattus norvegicus
gttacaggctctctgtaaacagtgt

SEQ ID NO: 521703 - DNA, 25 bp, Rattus norvegicus
gttacaggctctgtgtaaacagtgt

SEQ ID NO: 521704 - DNA, 25 bp, Rattus norvegicus
gttacaggctgacgcccaggaacaa

SEQ ID NO: 521705 - DNA, 25 bp, Rattus norvegicus
gttacaggctgaggcccaggaacaa

SEQ ID NO: 521706 - DNA, 25 bp, Rattus norvegicus
gttacaggtgtgcactgccatacct

SEQ ID NO: 521707 - DNA, 25 bp, Rattus norvegicus
gttacaggtgtggactgccatacct

SEQ ID NO: 521708 - DNA, 25 bp, Rattus norvegicus
gttacaggtgttagtgagctccctt

SEQ ID NO: 521709 - DNA, 25 bp, Rattus norvegicus
gttacaggtgtttgtgagctccctt

SEQ ID NO: 521710 - DNA, 25 bp, Rattus norvegicus
gttacaggttcactacttccaaagg

SEQ ID NO: 521711 - DNA, 25 bp, Rattus norvegicus
gttacaggttcagtacttccaaagg

SEQ ID NO: 521712 - DNA, 25 bp, Rattus norvegicus
gttacagtagccatattcacctttt

SEQ ID NO: 521713 - DNA, 25 bp, Rattus norvegicus
gttacagtagccttattcacctttt

SEQ ID NO: 521714 - DNA, 25 bp, Rattus norvegicus
gttacagtcatgagcattttgccaa

SEQ ID NO: 521715 - DNA, 25 bp, Rattus norvegicus
gttacagtcatgtgcattttgccaa

SEQ ID NO: 521716 - DNA, 25 bp, Rattus norvegicus
gttacagtcttcatacacttattaa

SEQ ID NO: 521717 - DNA, 25 bp, Rattus norvegicus
gttacagtcttcttacacttattaa

SEQ ID NO: 521718 - DNA, 25 bp, Rattus norvegicus
gttacagtgttgagaggctaccagt

SEQ ID NO: 521719 - DNA, 25 bp, Rattus norvegicus
gttacagtgttgtgaggctaccagt

SEQ ID NO: 521720 - DNA, 25 bp, Rattus norvegicus
gttacagttcccatttgtggcctga

SEQ ID NO: 521721 - DNA, 25 bp, Rattus norvegicus
gttacagttcccttttgtggcctga

SEQ ID NO: 521722 - DNA, 25 bp, Rattus norvegicus
gttacagtttcacccattgctgaag

SEQ ID NO: 521723 - DNA, 25 bp, Rattus norvegicus
gttacagtttcagccattgctgaag

SEQ ID NO: 521724 - DNA, 25 bp, Rattus norvegicus
gttacagttttcaaagcatcaggct

SEQ ID NO: 521725 - DNA, 25 bp, Rattus norvegicus
gttacagttttcatacggatacact

SEQ ID NO: 521726 - DNA, 25 bp, Rattus norvegicus
gttacagttttctaagcatcaggct

SEQ ID NO: 521727 - DNA, 25 bp, Rattus norvegicus
gttacagttttcttacggatacact

SEQ ID NO: 521728 - DNA, 25 bp, Rattus norvegicus
gttacataatctccaacgcacatga

SEQ ID NO: 521729 - DNA, 25 bp, Rattus norvegicus
gttacataatctgcaacgcacatga

SEQ ID NO: 521730 - DNA, 25 bp, Rattus norvegicus
gttacatacatcaccagctataatt

SEQ ID NO: 521731 - DNA, 25 bp, Rattus norvegicus
gttacatacatctccagctataatt

SEQ ID NO: 521732 - DNA, 25 bp, Rattus norvegicus
gttacataccgtcaccacagcgagt

SEQ ID NO: 521733 - DNA, 25 bp, Rattus norvegicus
gttacataccgtgaccacagcgagt

SEQ ID NO: 521734 - DNA, 25 bp, Rattus norvegicus
gttacatagataagcgtagcgttct

SEQ ID NO: 521735 - DNA, 25 bp, Rattus norvegicus
gttacatagatatgcgtagcgttct

SEQ ID NO: 521736 - DNA, 25 bp, Rattus norvegicus
gttacataggacacttgctggacaa

SEQ ID NO: 521737 - DNA, 25 bp, Rattus norvegicus
gttacataggactcttgctggacaa

SEQ ID NO: 521738 - DNA, 25 bp, Rattus norvegicus
gttacataggagattctggtggaaa

SEQ ID NO: 521739 - DNA, 25 bp, Rattus norvegicus
gttacataggagtttctggtggaaa

SEQ ID NO: 521740 - DNA, 25 bp, Rattus norvegicus
gttacatatctgacctgagcattag

SEQ ID NO: 521741 - DNA, 25 bp, Rattus norvegicus
gttacatatctgtcctgagcattag

SEQ ID NO: 521742 - DNA, 25 bp, Rattus norvegicus
gttacatcaaagacaccacctaagg

SEQ ID NO: 521743 - DNA, 25 bp, Rattus norvegicus
gttacatcaaagtcaccacctaagg

SEQ ID NO: 521744 - DNA, 25 bp, Rattus norvegicus
gttacatcaactatgcagacacagt

SEQ ID NO: 521745 - DNA, 25 bp, Rattus norvegicus
gttacatcaactttgcagacacagt

SEQ ID NO: 521746 - DNA, 25 bp, Rattus norvegicus
gttacatcatttcagctgtctgaca

SEQ ID NO: 521747 - DNA, 25 bp, Rattus norvegicus
gttacatcatttgagctgtctgaca

SEQ ID NO: 521748 - DNA, 25 bp, Rattus norvegicus
gttacatccatcctgtgctacgtgt

SEQ ID NO: 521749 - DNA, 25 bp, Rattus norvegicus
gttacatccatcgtgtgctacgtgt

SEQ ID NO: 521750 - DNA, 25 bp, Rattus norvegicus
gttacatcctttagtgggttccact

SEQ ID NO: 521751 - DNA, 25 bp, Rattus norvegicus
gttacatccttttgtgggttccact

SEQ ID NO: 521752 - DNA, 25 bp, Rattus norvegicus
gttacatctagcaccacaaggtctt

SEQ ID NO: 521753 - DNA, 25 bp, Rattus norvegicus
gttacatctagctccacaaggtctt

SEQ ID NO: 521754 - DNA, 25 bp, Rattus norvegicus
gttacatctagtattccaagtactg

SEQ ID NO: 521755 - DNA, 25 bp, Rattus norvegicus
gttacatctagttttccaagtactg

SEQ ID NO: 521756 - DNA, 25 bp, Rattus norvegicus
gttacatctgacctaaaaagctatt

SEQ ID NO: 521757 - DNA, 25 bp, Rattus norvegicus
gttacatctgacgtaaaaagctatt

SEQ ID NO: 521758 - DNA, 25 bp, Rattus norvegicus
gttacatctgcgatggtgctagtta

SEQ ID NO: 521759 - DNA, 25 bp, Rattus norvegicus
gttacatctgcgttggtgctagtta

SEQ ID NO: 521760 - DNA, 25 bp, Rattus norvegicus
gttacatcttcaaacgcctcaagtt

SEQ ID NO: 521761 - DNA, 25 bp, Rattus norvegicus
gttacatcttcacggacctgagaga

SEQ ID NO: 521762 - DNA, 25 bp, Rattus norvegicus
gttacatcttcagggacctgagaga

SEQ ID NO: 521763 - DNA, 25 bp, Rattus norvegicus
gttacatcttcatacgcctcaagtt

SEQ ID NO: 521764 - DNA, 25 bp, Rattus norvegicus
gttacatgaatgcacctgccagcga

SEQ ID NO: 521765 - DNA, 25 bp, Rattus norvegicus
gttacatgaatggacctgccagcga

SEQ ID NO: 521766 - DNA, 25 bp, Rattus norvegicus
gttacatgacacatggactttcgag

SEQ ID NO: 521767 - DNA, 25 bp, Rattus norvegicus
gttacatgacacttggactttcgag

SEQ ID NO: 521768 - DNA, 25 bp, Rattus norvegicus
gttacatgacataatacctaaaaac

SEQ ID NO: 521769 - DNA, 25 bp, Rattus norvegicus
gttacatgacattatacctaaaaac

SEQ ID NO: 521770 - DNA, 25 bp, Rattus norvegicus
gttacatgccctcaacctatgtgaa

SEQ ID NO: 521771 - DNA, 25 bp, Rattus norvegicus
gttacatgccctgaacctatgtgaa

SEQ ID NO: 521772 - DNA, 25 bp, Rattus norvegicus
gttacatggcaacttcggcaggcta

SEQ ID NO: 521773 - DNA, 25 bp, Rattus norvegicus
gttacatggcaagttcggcaggcta

SEQ ID NO: 521774 - DNA, 25 bp, Rattus norvegicus
gttacatgtatgacttgcccttacc

SEQ ID NO: 521775 - DNA, 25 bp, Rattus norvegicus
gttacatgtatgtcttgcccttacc

SEQ ID NO: 521776 - DNA, 25 bp, Rattus norvegicus
gttacatgtttgcacctttctagtt

SEQ ID NO: 521777 - DNA, 25 bp, Rattus norvegicus
gttacatgtttggacctttctagtt

SEQ ID NO: 521778 - DNA, 25 bp, Rattus norvegicus
gttacattctgtatctcactgactt

SEQ ID NO: 521779 - DNA, 25 bp, Rattus norvegicus
gttacattctgtttctcactgactt

SEQ ID NO: 521780 - DNA, 25 bp, Rattus norvegicus
gttacattgtatcagggcccacatc

SEQ ID NO: 521781 - DNA, 25 bp, Rattus norvegicus
gttacattgtatgagggcccacatc

SEQ ID NO: 521782 - DNA, 25 bp, Rattus norvegicus
gttacatttattcctcagaaccctg

SEQ ID NO: 521783 - DNA, 25 bp, Rattus norvegicus
gttacatttattgctcagaaccctg

SEQ ID NO: 521784 - DNA, 25 bp, Rattus norvegicus
gttacatttccacacacctgcatca

SEQ ID NO: 521785 - DNA, 25 bp, Rattus norvegicus
gttacatttccagacacctgcatca

SEQ ID NO: 521786 - DNA, 25 bp, Rattus norvegicus
gttacatttgctctcagtacccata

SEQ ID NO: 521787 - DNA, 25 bp, Rattus norvegicus
gttacatttgctgtcagtacccata

SEQ ID NO: 521788 - DNA, 25 bp, Rattus norvegicus
gttacattttcaataggccccgtca

SEQ ID NO: 521789 - DNA, 25 bp, Rattus norvegicus
gttacattttcattaggccccgtca

SEQ ID NO: 521790 - DNA, 25 bp, Rattus norvegicus
gttacattttgtattgcagtttgca

SEQ ID NO: 521791 - DNA, 25 bp, Rattus norvegicus
gttacattttgttttgcagtttgca

SEQ ID NO: 521792 - DNA, 25 bp, Rattus norvegicus
gttaccaaaagacgcctgatcactc

SEQ ID NO: 521793 - DNA, 25 bp, Rattus norvegicus
gttaccaaaagaggcctgatcactc

SEQ ID NO: 521794 - DNA, 25 bp, Rattus norvegicus
gttaccaacattcattttgctgcta

SEQ ID NO: 521795 - DNA, 25 bp, Rattus norvegicus
gttaccaacattgattttgctgcta

SEQ ID NO: 521796 - DNA, 25 bp, Rattus norvegicus
gttaccaagatcaaagcaaagctga

SEQ ID NO: 521797 - DNA, 25 bp, Rattus norvegicus
gttaccaagatctaagcaaagctga

SEQ ID NO: 521798 - DNA, 25 bp, Rattus norvegicus
gttaccaaggctaccttatggctgg

SEQ ID NO: 521799 - DNA, 25 bp, Rattus norvegicus
gttaccaaggcttccttatggctgg

SEQ ID NO: 521800 - DNA, 25 bp, Rattus norvegicus
gttaccaagtctaatgaatgcttta

SEQ ID NO: 521801 - DNA, 25 bp, Rattus norvegicus
gttaccaagtcttatgaatgcttta

SEQ ID NO: 521802 - DNA, 25 bp, Rattus norvegicus
gttaccaatggtctatgcctgtctc

SEQ ID NO: 521803 - DNA, 25 bp, Rattus norvegicus
gttaccaatggtgtatgcctgtctc

SEQ ID NO: 521804 - DNA, 25 bp, Rattus norvegicus
gttaccaattccaacgtctgtgcaa

SEQ ID NO: 521805 - DNA, 25 bp, Rattus norvegicus
gttaccaattcctacgtctgtgcaa

SEQ ID NO: 521806 - DNA, 25 bp, Rattus norvegicus
gttaccacagcaaccatggctacat

SEQ ID NO: 521807 - DNA, 25 bp, Rattus norvegicus
gttaccacagcatccatggctacat

SEQ ID NO: 521808 - DNA, 25 bp, Rattus norvegicus
gttaccacatttcttggcctgggat

SEQ ID NO: 521809 - DNA, 25 bp, Rattus norvegicus
gttaccacatttgttggcctgggat

SEQ ID NO: 521810 - DNA, 25 bp, Rattus norvegicus
gttaccaccaccctacagagctgaa

SEQ ID NO: 521811 - DNA, 25 bp, Rattus norvegicus
gttaccaccaccgtacagagctgaa

SEQ ID NO: 521812 - DNA, 25 bp, Rattus norvegicus
gttaccacccagagtttccaggaga

SEQ ID NO: 521813 - DNA, 25 bp, Rattus norvegicus
gttaccacccagtgtttccaggaga

SEQ ID NO: 521814 - DNA, 25 bp, Rattus norvegicus
gttaccaccctcaggagacgctgaa

SEQ ID NO: 521815 - DNA, 25 bp, Rattus norvegicus
gttaccaccctctggagacgctgaa

SEQ ID NO: 521816 - DNA, 25 bp, Rattus norvegicus
gttaccactacacacctggttgtgt

SEQ ID NO: 521817 - DNA, 25 bp, Rattus norvegicus
gttaccactacagacctggttgtgt

SEQ ID NO: 521818 - DNA, 25 bp, Rattus norvegicus
gttaccactactaaacccatgatga

SEQ ID NO: 521819 - DNA, 25 bp, Rattus norvegicus
gttaccactacttaacccatgatga

SEQ ID NO: 521820 - DNA, 25 bp, Rattus norvegicus
gttaccactcaaaaaagttgccctg

SEQ ID NO: 521821 - DNA, 25 bp, Rattus norvegicus
gttaccactcaataaagttgccctg

SEQ ID NO: 521822 - DNA, 25 bp, Rattus norvegicus
gttaccactctgcttggagaccaaa

SEQ ID NO: 521823 - DNA, 25 bp, Rattus norvegicus
gttaccactctggttggagaccaaa

SEQ ID NO: 521824 - DNA, 25 bp, Rattus norvegicus
gttaccactgaaccttaccatatgt

SEQ ID NO: 521825 - DNA, 25 bp, Rattus norvegicus
gttaccactgaagcttaccatatgt

SEQ ID NO: 521826 - DNA, 25 bp, Rattus norvegicus
gttaccacttacataggcccagata

SEQ ID NO: 521827 - DNA, 25 bp, Rattus norvegicus
gttaccacttacttaggcccagata

SEQ ID NO: 521828 - DNA, 25 bp, Rattus norvegicus
gttaccagaccaaactgtctcttta

SEQ ID NO: 521829 - DNA, 25 bp, Rattus norvegicus
gttaccagaccatactgtctcttta

SEQ ID NO: 521830 - DNA, 25 bp, Rattus norvegicus
gttaccagacttccatttcaaatta

SEQ ID NO: 521831 - DNA, 25 bp, Rattus norvegicus
gttaccagacttgcatttcaaatta

SEQ ID NO: 521832 - DNA, 25 bp, Rattus norvegicus
gttaccagcagaagccaggtttcat

SEQ ID NO: 521833 - DNA, 25 bp, Rattus norvegicus
gttaccagcagatgccaggtttcat

SEQ ID NO: 521834 - DNA, 25 bp, Rattus norvegicus
gttaccagcatgagcagtggtgcgt

SEQ ID NO: 521835 - DNA, 25 bp, Rattus norvegicus
gttaccagcatgatgtcctcaaaat

SEQ ID NO: 521836 - DNA, 25 bp, Rattus norvegicus
gttaccagcatgtgcagtggtgcgt

SEQ ID NO: 521837 - DNA, 25 bp, Rattus norvegicus
gttaccagcatgttgtcctcaaaat

SEQ ID NO: 521838 - DNA, 25 bp, Rattus norvegicus
gttaccagccgcctataaccaggga

SEQ ID NO: 521839 - DNA, 25 bp, Rattus norvegicus
gttaccagccgcgtataaccaggga

SEQ ID NO: 521840 - DNA, 25 bp, Rattus norvegicus
gttaccaggaaactgattcttcttt

SEQ ID NO: 521841 - DNA, 25 bp, Rattus norvegicus
gttaccaggaaagtgattcttcttt

SEQ ID NO: 521842 - DNA, 25 bp, Rattus norvegicus
gttaccaggtggcatagcatgtcta

SEQ ID NO: 521843 - DNA, 25 bp, Rattus norvegicus
gttaccaggtgggatagcatgtcta

SEQ ID NO: 521844 - DNA, 25 bp, Rattus norvegicus
gttaccaggtgtcactaaagcatat

SEQ ID NO: 521845 - DNA, 25 bp, Rattus norvegicus
gttaccaggtgtgactaaagcatat

SEQ ID NO: 521846 - DNA, 25 bp, Rattus norvegicus
gttaccaggttgctaggagtccact

SEQ ID NO: 521847 - DNA, 25 bp, Rattus norvegicus
gttaccaggttggtaggagtccact

SEQ ID NO: 521848 - DNA, 25 bp, Rattus norvegicus
gttaccagtgcaatgcttggctcag

SEQ ID NO: 521849 - DNA, 25 bp, Rattus norvegicus
gttaccagtgcattgcttggctcag

SEQ ID NO: 521850 - DNA, 25 bp, Rattus norvegicus
gttaccagtgccactgagacggtgg

SEQ ID NO: 521851 - DNA, 25 bp, Rattus norvegicus
gttaccagtgcctctgagacggtgg

SEQ ID NO: 521852 - DNA, 25 bp, Rattus norvegicus
gttaccagtggcactgtcatgactc

SEQ ID NO: 521853 - DNA, 25 bp, Rattus norvegicus
gttaccagtggctctgtcatgactc

SEQ ID NO: 521854 - DNA, 25 bp, Rattus norvegicus
gttaccagtttcatattatccagca

SEQ ID NO: 521855 - DNA, 25 bp, Rattus norvegicus
gttaccagtttcttattatccagca

SEQ ID NO: 521856 - DNA, 25 bp, Rattus norvegicus
gttaccatagctcttggtggcacct

SEQ ID NO: 521857 - DNA, 25 bp, Rattus norvegicus
gttaccatagctgttggtggcacct

SEQ ID NO: 521858 - DNA, 25 bp, Rattus norvegicus
gttaccatctcgaagcacgaagcct

SEQ ID NO: 521859 - DNA, 25 bp, Rattus norvegicus
gttaccatctcgtagcacgaagcct

SEQ ID NO: 521860 - DNA, 25 bp, Rattus norvegicus
gttaccatgaccaccagatacatat

SEQ ID NO: 521861 - DNA, 25 bp, Rattus norvegicus
gttaccatgacctccagatacatat

SEQ ID NO: 521862 - DNA, 25 bp, Rattus norvegicus
gttaccatgctgacctttttggatt

SEQ ID NO: 521863 - DNA, 25 bp, Rattus norvegicus
gttaccatgctgtcctttttggatt

SEQ ID NO: 521864 - DNA, 25 bp, Rattus norvegicus
gttaccatgcttatctgcttattct

SEQ ID NO: 521865 - DNA, 25 bp, Rattus norvegicus
gttaccatgcttttctgcttattct

SEQ ID NO: 521866 - DNA, 25 bp, Rattus norvegicus
gttaccatgtacagtttcttgacca

SEQ ID NO: 521867 - DNA, 25 bp, Rattus norvegicus
gttaccatgtactgtttcttgacca

SEQ ID NO: 521868 - DNA, 25 bp, Rattus norvegicus
gttaccatgtagatttctgttctgt

SEQ ID NO: 521869 - DNA, 25 bp, Rattus norvegicus
gttaccatgtagttttctgttctgt

SEQ ID NO: 521870 - DNA, 25 bp, Rattus norvegicus
gttaccattcagacatcccgggaga

SEQ ID NO: 521871 - DNA, 25 bp, Rattus norvegicus
gttaccattcagtcatcccgggaga

SEQ ID NO: 521872 - DNA, 25 bp, Rattus norvegicus
gttaccattcctctaactcgatgga

SEQ ID NO: 521873 - DNA, 25 bp, Rattus norvegicus
gttaccattcctgtaactcgatgga

SEQ ID NO: 521874 - DNA, 25 bp, Rattus norvegicus
gttaccattctactggtctactcaa

SEQ ID NO: 521875 - DNA, 25 bp, Rattus norvegicus
gttaccattctagtggtctactcaa

SEQ ID NO: 521876 - DNA, 25 bp, Rattus norvegicus
gttaccattgcaatctagctttctt

SEQ ID NO: 521877 - DNA, 25 bp, Rattus norvegicus
gttaccattgcattctagctttctt

SEQ ID NO: 521878 - DNA, 25 bp, Rattus norvegicus
gttacccaacctagggcatatcctt

SEQ ID NO: 521879 - DNA, 25 bp, Rattus norvegicus
gttacccaaccttgggcatatcctt

SEQ ID NO: 521880 - DNA, 25 bp, Rattus norvegicus
gttacccaagtccacacatcaaagt

SEQ ID NO: 521881 - DNA, 25 bp, Rattus norvegicus
gttacccaagtcgacacatcaaagt

SEQ ID NO: 521882 - DNA, 25 bp, Rattus norvegicus
gttacccaatatctctgtttcaaat

SEQ ID NO: 521883 - DNA, 25 bp, Rattus norvegicus
gttacccaatatgtctgtttcaaat

SEQ ID NO: 521884 - DNA, 25 bp, Rattus norvegicus
gttacccaatggaaatgtctatttt

SEQ ID NO: 521885 - DNA, 25 bp, Rattus norvegicus
gttacccaatggtaatgtctatttt

SEQ ID NO: 521886 - DNA, 25 bp, Rattus norvegicus
gttacccacatgaggccagaagcca

SEQ ID NO: 521887 - DNA, 25 bp, Rattus norvegicus
gttacccacatgtggccagaagcca

SEQ ID NO: 521888 - DNA, 25 bp, Rattus norvegicus
gttacccacgctccagaaggcctgg

SEQ ID NO: 521889 - DNA, 25 bp, Rattus norvegicus
gttacccacgctgcagaaggcctgg

SEQ ID NO: 521890 - DNA, 25 bp, Rattus norvegicus
gttacccactacagagattgttccg

SEQ ID NO: 521891 - DNA, 25 bp, Rattus norvegicus
gttacccactactgagattgttccg

SEQ ID NO: 521892 - DNA, 25 bp, Rattus norvegicus
gttacccagacaagataccacatcc

SEQ ID NO: 521893 - DNA, 25 bp, Rattus norvegicus
gttacccagacatgataccacatcc

SEQ ID NO: 521894 - DNA, 25 bp, Rattus norvegicus
gttacccagatacccataaaagtgt

SEQ ID NO: 521895 - DNA, 25 bp, Rattus norvegicus
gttacccagatagccataaaagtgt

SEQ ID NO: 521896 - DNA, 25 bp, Rattus norvegicus
gttacccagatgagcgcagtagccc

SEQ ID NO: 521897 - DNA, 25 bp, Rattus norvegicus
gttacccagatgtgcgcagtagccc

SEQ ID NO: 521898 - DNA, 25 bp, Rattus norvegicus
gttacccaggccaagagcacagtga

SEQ ID NO: 521899 - DNA, 25 bp, Rattus norvegicus
gttacccaggcctagagcacagtga

SEQ ID NO: 521900 - DNA, 25 bp, Rattus norvegicus
gttacccagtcaaacccttggagag

SEQ ID NO: 521901 - DNA, 25 bp, Rattus norvegicus
gttacccagtcatacccttggagag

SEQ ID NO: 521902 - DNA, 25 bp, Rattus norvegicus
gttacccatgagacagaaatccgtt

SEQ ID NO: 521903 - DNA, 25 bp, Rattus norvegicus
gttacccatgagtcagaaatccgtt

SEQ ID NO: 521904 - DNA, 25 bp, Rattus norvegicus
gttacccatgatagtgacaccctgt

SEQ ID NO: 521905 - DNA, 25 bp, Rattus norvegicus
gttacccatgattgtgacaccctgt

SEQ ID NO: 521906 - DNA, 25 bp, Rattus norvegicus
gttaccccatttcagctctgtttaa

SEQ ID NO: 521907 - DNA, 25 bp, Rattus norvegicus
gttaccccatttgagctctgtttaa

SEQ ID NO: 521908 - DNA, 25 bp, Rattus norvegicus
gttacccctcttaggactcttccag

SEQ ID NO: 521909 - DNA, 25 bp, Rattus norvegicus
gttacccctctttggactcttccag

SEQ ID NO: 521910 - DNA, 25 bp, Rattus norvegicus
gttacccctttcctcattaattgat

SEQ ID NO: 521911 - DNA, 25 bp, Rattus norvegicus
gttacccctttcgtcattaattgat

SEQ ID NO: 521912 - DNA, 25 bp, Rattus norvegicus
gttacccgttttatgttgactcttg

SEQ ID NO: 521913 - DNA, 25 bp, Rattus norvegicus
gttacccgttttttgttgactcttg

SEQ ID NO: 521914 - DNA, 25 bp, Rattus norvegicus
gttaccctaactctgccagaataag

SEQ ID NO: 521915 - DNA, 25 bp, Rattus norvegicus
gttaccctaactgtgccagaataag

SEQ ID NO: 521916 - DNA, 25 bp, Rattus norvegicus
gttaccctacagactgactcatgtt

SEQ ID NO: 521917 - DNA, 25 bp, Rattus norvegicus
gttaccctacagtctgactcatgtt

SEQ ID NO: 521918 - DNA, 25 bp, Rattus norvegicus
gttaccctcctcatcaatgtggtga

SEQ ID NO: 521919 - DNA, 25 bp, Rattus norvegicus
gttaccctcctcttcaatgtggtga

SEQ ID NO: 521920 - DNA, 25 bp, Rattus norvegicus
gttaccctgaacatggtcatccttt

SEQ ID NO: 521921 - DNA, 25 bp, Rattus norvegicus
gttaccctgaacttggtcatccttt

SEQ ID NO: 521922 - DNA, 25 bp, Rattus norvegicus
gttaccctgacaaccatcaaaatgt

SEQ ID NO: 521923 - DNA, 25 bp, Rattus norvegicus
gttaccctgacatccatcaaaatgt

SEQ ID NO: 521924 - DNA, 25 bp, Rattus norvegicus
gttaccctgctaccctgaataatgt

SEQ ID NO: 521925 - DNA, 25 bp, Rattus norvegicus
gttaccctgctagcctgaataatgt

SEQ ID NO: 521926 - DNA, 25 bp, Rattus norvegicus
gttaccctggatctgtctcaacctg

SEQ ID NO: 521927 - DNA, 25 bp, Rattus norvegicus
gttaccctggatgtgtctcaacctg

SEQ ID NO: 521928 - DNA, 25 bp, Rattus norvegicus
gttacccttgtaaatcctgcaaatg

SEQ ID NO: 521929 - DNA, 25 bp, Rattus norvegicus
gttacccttgtatatcctgcaaatg

SEQ ID NO: 521930 - DNA, 25 bp, Rattus norvegicus
gttaccctttggaggatcttttgat

SEQ ID NO: 521931 - DNA, 25 bp, Rattus norvegicus
gttaccctttggtggatcttttgat

SEQ ID NO: 521932 - DNA, 25 bp, Rattus norvegicus
gttaccgactctagactctttgcag

SEQ ID NO: 521933 - DNA, 25 bp, Rattus norvegicus
gttaccgactcttgactctttgcag

SEQ ID NO: 521934 - DNA, 25 bp, Rattus norvegicus
gttaccgaggttatcagtacgtgct

SEQ ID NO: 521935 - DNA, 25 bp, Rattus norvegicus
gttaccgaggttttcagtacgtgct

SEQ ID NO: 521936 - DNA, 25 bp, Rattus norvegicus
gttaccggagacaggcattcaggaa

SEQ ID NO: 521937 - DNA, 25 bp, Rattus norvegicus
gttaccggagactggcattcaggaa

SEQ ID NO: 521938 - DNA, 25 bp, Rattus norvegicus
gttaccggtcagctgagtcagccac

SEQ ID NO: 521939 - DNA, 25 bp, Rattus norvegicus
gttaccggtcaggtgagtcagccac

SEQ ID NO: 521940 - DNA, 25 bp, Rattus norvegicus
gttaccgtcttacaactgaacatgt

SEQ ID NO: 521941 - DNA, 25 bp, Rattus norvegicus
gttaccgtcttagaactgaacatgt

SEQ ID NO: 521942 - DNA, 25 bp, Rattus norvegicus
gttaccgtggttaagcagagcaagc

SEQ ID NO: 521943 - DNA, 25 bp, Rattus norvegicus
gttaccgtggtttagcagagcaagc

SEQ ID NO: 521944 - DNA, 25 bp, Rattus norvegicus
gttaccgtgtgaatggagcttgcta

SEQ ID NO: 521945 - DNA, 25 bp, Rattus norvegicus
gttaccgtgtgattggagcttgcta

SEQ ID NO: 521946 - DNA, 25 bp, Rattus norvegicus
gttaccgttacaagcactctgatga

SEQ ID NO: 521947 - DNA, 25 bp, Rattus norvegicus
gttaccgttacatgcactctgatga

SEQ ID NO: 521948 - DNA, 25 bp, Rattus norvegicus
gttacctaacaaaccagtttcctga

SEQ ID NO: 521949 - DNA, 25 bp, Rattus norvegicus
gttacctaacaatccagtttcctga

SEQ ID NO: 521950 - DNA, 25 bp, Rattus norvegicus
gttacctaagaactggctatcatat

SEQ ID NO: 521951 - DNA, 25 bp, Rattus norvegicus
gttacctaagaagtggctatcatat

SEQ ID NO: 521952 - DNA, 25 bp, Rattus norvegicus
gttacctaccttcagagctaactgg

SEQ ID NO: 521953 - DNA, 25 bp, Rattus norvegicus
gttacctaccttgagagctaactgg

SEQ ID NO: 521954 - DNA, 25 bp, Rattus norvegicus
gttacctacttacatagcggatatc

SEQ ID NO: 521955 - DNA, 25 bp, Rattus norvegicus
gttacctacttagatagcggatatc

SEQ ID NO: 521956 - DNA, 25 bp, Rattus norvegicus
gttacctagctgagttttgttattg

SEQ ID NO: 521957 - DNA, 25 bp, Rattus norvegicus
gttacctagctgtgttttgttattg

SEQ ID NO: 521958 - DNA, 25 bp, Rattus norvegicus
gttacctcacacaggtttctgaagg

SEQ ID NO: 521959 - DNA, 25 bp, Rattus norvegicus
gttacctcacactggtttctgaagg

SEQ ID NO: 521960 - DNA, 25 bp, Rattus norvegicus
gttacctcagaaagcccaagacaga

SEQ ID NO: 521961 - DNA, 25 bp, Rattus norvegicus
gttacctcagaatgcccaagacaga

SEQ ID NO: 521962 - DNA, 25 bp, Rattus norvegicus
gttacctcaggaacatgtcactgca

SEQ ID NO: 521963 - DNA, 25 bp, Rattus norvegicus
gttacctcaggatcatgtcactgca

SEQ ID NO: 521964 - DNA, 25 bp, Rattus norvegicus
gttacctcataccaggtctgcatat

SEQ ID NO: 521965 - DNA, 25 bp, Rattus norvegicus
gttacctcatacgaggtctgcatat

SEQ ID NO: 521966 - DNA, 25 bp, Rattus norvegicus
gttacctcatgaagtagcgttgtac

SEQ ID NO: 521967 - DNA, 25 bp, Rattus norvegicus
gttacctcatgatgtagcgttgtac

SEQ ID NO: 521968 - DNA, 25 bp, Rattus norvegicus
gttacctcatgtccgtgcccgctgg

SEQ ID NO: 521969 - DNA, 25 bp, Rattus norvegicus
gttacctcatgtgcgtgcccgctgg

SEQ ID NO: 521970 - DNA, 25 bp, Rattus norvegicus
gttacctccacacgcactgcaggaa

SEQ ID NO: 521971 - DNA, 25 bp, Rattus norvegicus
gttacctccacaggcactgcaggaa

SEQ ID NO: 521972 - DNA, 25 bp, Rattus norvegicus
gttacctctataagtatgtctctgc

SEQ ID NO: 521973 - DNA, 25 bp, Rattus norvegicus
gttacctctatatgtatgtctctgc

SEQ ID NO: 521974 - DNA, 25 bp, Rattus norvegicus
gttacctctattcgccctacagatt

SEQ ID NO: 521975 - DNA, 25 bp, Rattus norvegicus
gttacctctattggccctacagatt

SEQ ID NO: 521976 - DNA, 25 bp, Rattus norvegicus
gttacctctgccagtctagtttatg

SEQ ID NO: 521977 - DNA, 25 bp, Rattus norvegicus
gttacctctgcctgtctagtttatg

SEQ ID NO: 521978 - DNA, 25 bp, Rattus norvegicus
gttacctctgctactggaggctgag

SEQ ID NO: 521979 - DNA, 25 bp, Rattus norvegicus
gttacctctgcttctggaggctgag

SEQ ID NO: 521980 - DNA, 25 bp, Rattus norvegicus
gttacctgaatcaatctcccatatg

SEQ ID NO: 521981 - DNA, 25 bp, Rattus norvegicus
gttacctgaatctatctcccatatg

SEQ ID NO: 521982 - DNA, 25 bp, Rattus norvegicus
gttacctgaattagaccctcatgac

SEQ ID NO: 521983 - DNA, 25 bp, Rattus norvegicus
gttacctgaatttgaccctcatgac

SEQ ID NO: 521984 - DNA, 25 bp, Rattus norvegicus
gttacctgacatactcctacaagtt

SEQ ID NO: 521985 - DNA, 25 bp, Rattus norvegicus
gttacctgacattctcctacaagtt

SEQ ID NO: 521986 - DNA, 25 bp, Rattus norvegicus
gttacctgagaacgaagtcacaact

SEQ ID NO: 521987 - DNA, 25 bp, Rattus norvegicus
gttacctgagaaggaagtcacaact

SEQ ID NO: 521988 - DNA, 25 bp, Rattus norvegicus
gttacctgaggtatcttggctcatt

SEQ ID NO: 521989 - DNA, 25 bp, Rattus norvegicus
gttacctgaggtcttgcttattcac

SEQ ID NO: 521990 - DNA, 25 bp, Rattus norvegicus
gttacctgaggtgttgcttattcac

SEQ ID NO: 521991 - DNA, 25 bp, Rattus norvegicus
gttacctgaggtttcttggctcatt

SEQ ID NO: 521992 - DNA, 25 bp, Rattus norvegicus
gttacctgatacacaaaggctatga

SEQ ID NO: 521993 - DNA, 25 bp, Rattus norvegicus
gttacctgatactcaaaggctatga

SEQ ID NO: 521994 - DNA, 25 bp, Rattus norvegicus
gttacctgatcacgcgacagccggg

SEQ ID NO: 521995 - DNA, 25 bp, Rattus norvegicus
gttacctgatcaggcgacagccggg

SEQ ID NO: 521996 - DNA, 25 bp, Rattus norvegicus
gttacctgcaaaccacaggtgtgta

SEQ ID NO: 521997 - DNA, 25 bp, Rattus norvegicus
gttacctgcaaagcacaggtgtgta

SEQ ID NO: 521998 - DNA, 25 bp, Rattus norvegicus
gttacctgcagtattaagtcagtgt

SEQ ID NO: 521999 - DNA, 25 bp, Rattus norvegicus
gttacctgcagttttaagtcagtgt

SEQ ID NO: 522000 - DNA, 25 bp, Rattus norvegicus
gttacctgcctgagccaggactaaa

SEQ ID NO: 522001 - DNA, 25 bp, Rattus norvegicus
gttacctgcctgtgccaggactaaa

SEQ ID NO: 522002 - DNA, 25 bp, Rattus norvegicus
gttacctgctgtaaaacattgcttg

SEQ ID NO: 522003 - DNA, 25 bp, Rattus norvegicus
gttacctgctgttaaacattgcttg

SEQ ID NO: 522004 - DNA, 25 bp, Rattus norvegicus
gttacctgcttgaaaacactgctgt

SEQ ID NO: 522005 - DNA, 25 bp, Rattus norvegicus
gttacctgcttgtaaacactgctgt

SEQ ID NO: 522006 - DNA, 25 bp, Rattus norvegicus
gttacctggacacagaactttatca

SEQ ID NO: 522007 - DNA, 25 bp, Rattus norvegicus
gttacctggacagagaactttatca

SEQ ID NO: 522008 - DNA, 25 bp, Rattus norvegicus
gttacctggagcctccatacaccat

SEQ ID NO: 522009 - DNA, 25 bp, Rattus norvegicus
gttacctggagcgtccatacaccat

SEQ ID NO: 522010 - DNA, 25 bp, Rattus norvegicus
gttacctggcacaagtattctcctg

SEQ ID NO: 522011 - DNA, 25 bp, Rattus norvegicus
gttacctggcactagtattctcctg

SEQ ID NO: 522012 - DNA, 25 bp, Rattus norvegicus
gttacctgggagaacgacaaactca

SEQ ID NO: 522013 - DNA, 25 bp, Rattus norvegicus
gttacctgggagtacgacaaactca

SEQ ID NO: 522014 - DNA, 25 bp, Rattus norvegicus
gttacctgtgtcatgagctctggca

SEQ ID NO: 522015 - DNA, 25 bp, Rattus norvegicus
gttacctgtgtcttgagctctggca

SEQ ID NO: 522016 - DNA, 25 bp, Rattus norvegicus
gttacctgttgaatgacagagcctt

SEQ ID NO: 522017 - DNA, 25 bp, Rattus norvegicus
gttacctgttgacttctagatgtct

SEQ ID NO: 522018 - DNA, 25 bp, Rattus norvegicus
gttacctgttgagttctagatgtct

SEQ ID NO: 522019 - DNA, 25 bp, Rattus norvegicus
gttacctgttgattgacagagcctt

SEQ ID NO: 522020 - DNA, 25 bp, Rattus norvegicus
gttacctgttgcagttgtgtttaca

SEQ ID NO: 522021 - DNA, 25 bp, Rattus norvegicus
gttacctgttgctgttgtgtttaca

SEQ ID NO: 522022 - DNA, 25 bp, Rattus norvegicus
gttacctgtttcagtagagctcttt

SEQ ID NO: 522023 - DNA, 25 bp, Rattus norvegicus
gttacctgtttctgtagagctcttt

SEQ ID NO: 522024 - DNA, 25 bp, Rattus norvegicus
gttaccttatgtctatttaatcatg

SEQ ID NO: 522025 - DNA, 25 bp, Rattus norvegicus
gttaccttatgtgtatttaatcatg

SEQ ID NO: 522026 - DNA, 25 bp, Rattus norvegicus
gttaccttatttcgcaattcttgga

SEQ ID NO: 522027 - DNA, 25 bp, Rattus norvegicus
gttaccttatttggcaattcttgga

SEQ ID NO: 522028 - DNA, 25 bp, Rattus norvegicus
gttaccttcagcattcaaataccca

SEQ ID NO: 522029 - DNA, 25 bp, Rattus norvegicus
gttaccttcagctttcaaataccca

SEQ ID NO: 522030 - DNA, 25 bp, Rattus norvegicus
gttaccttcattcttaccaccaaat

SEQ ID NO: 522031 - DNA, 25 bp, Rattus norvegicus
gttaccttcattgttaccaccaaat

SEQ ID NO: 522032 - DNA, 25 bp, Rattus norvegicus
gttaccttcccaaggagcaggccag

SEQ ID NO: 522033 - DNA, 25 bp, Rattus norvegicus
gttaccttcccatggagcaggccag

SEQ ID NO: 522034 - DNA, 25 bp, Rattus norvegicus
gttaccttcgagcaaccagtggcca

SEQ ID NO: 522035 - DNA, 25 bp, Rattus norvegicus
gttaccttcgaggaaccagtggcca

SEQ ID NO: 522036 - DNA, 25 bp, Rattus norvegicus
gttaccttcgtacattcctgggagt

SEQ ID NO: 522037 - DNA, 25 bp, Rattus norvegicus
gttaccttcgtagattcctgggagt

SEQ ID NO: 522038 - DNA, 25 bp, Rattus norvegicus
gttaccttctatctactttccgatt

SEQ ID NO: 522039 - DNA, 25 bp, Rattus norvegicus
gttaccttctatgtactttccgatt

SEQ ID NO: 522040 - DNA, 25 bp, Rattus norvegicus
gttaccttgactcaacccattgagt

SEQ ID NO: 522041 - DNA, 25 bp, Rattus norvegicus
gttaccttgactgaacccattgagt

SEQ ID NO: 522042 - DNA, 25 bp, Rattus norvegicus
gttaccttgctaagaccttgcatct

SEQ ID NO: 522043 - DNA, 25 bp, Rattus norvegicus
gttaccttgctatgaccttgcatct

SEQ ID NO: 522044 - DNA, 25 bp, Rattus norvegicus
gttaccttggaccagatgagcttca

SEQ ID NO: 522045 - DNA, 25 bp, Rattus norvegicus
gttaccttggacgagatgagcttca

SEQ ID NO: 522046 - DNA, 25 bp, Rattus norvegicus
gttaccttgtatctatcccagattt

SEQ ID NO: 522047 - DNA, 25 bp, Rattus norvegicus
gttaccttgtatgtatcccagattt

SEQ ID NO: 522048 - DNA, 25 bp, Rattus norvegicus
gttacctttcagcaaatcgacctca

SEQ ID NO: 522049 - DNA, 25 bp, Rattus norvegicus
gttacctttcaggaaatcgacctca

SEQ ID NO: 522050 - DNA, 25 bp, Rattus norvegicus
gttacctttcatattctcaaacaat

SEQ ID NO: 522051 - DNA, 25 bp, Rattus norvegicus
gttacctttcattttctcaaacaat

SEQ ID NO: 522052 - DNA, 25 bp, Rattus norvegicus
gttacctttccgaggcaagccaaag

SEQ ID NO: 522053 - DNA, 25 bp, Rattus norvegicus
gttacctttccgtggcaagccaaag

SEQ ID NO: 522054 - DNA, 25 bp, Rattus norvegicus
gttaccttttgtacccatggaagag

SEQ ID NO: 522055 - DNA, 25 bp, Rattus norvegicus
gttaccttttgttcccatggaagag

SEQ ID NO: 522056 - DNA, 25 bp, Rattus norvegicus
gttacgagcatcattggcacttgag

SEQ ID NO: 522057 - DNA, 25 bp, Rattus norvegicus
gttacgagcatctttggcacttgag

SEQ ID NO: 522058 - DNA, 25 bp, Rattus norvegicus
gttacgcaaaaacctcagtcagtta

SEQ ID NO: 522059 - DNA, 25 bp, Rattus norvegicus
gttacgcaaaaagctcagtcagtta

SEQ ID NO: 522060 - DNA, 25 bp, Rattus norvegicus
gttacgcaaatcactttgcccgttc

SEQ ID NO: 522061 - DNA, 25 bp, Rattus norvegicus
gttacgcaaatctctttgcccgttc

SEQ ID NO: 522062 - DNA, 25 bp, Rattus norvegicus
gttacggcactgaaagatggactct

SEQ ID NO: 522063 - DNA, 25 bp, Rattus norvegicus
gttacggcactgtaagatggactct

SEQ ID NO: 522064 - DNA, 25 bp, Rattus norvegicus
gttacggccacaatctatactattg

SEQ ID NO: 522065 - DNA, 25 bp, Rattus norvegicus
gttacggccacattctatactattg

SEQ ID NO: 522066 - DNA, 25 bp, Rattus norvegicus
gttacggctctgcattcaatcgaag

SEQ ID NO: 522067 - DNA, 25 bp, Rattus norvegicus
gttacggctctggattcaatcgaag

SEQ ID NO: 522068 - DNA, 25 bp, Rattus norvegicus
gttacgggaaagcacagccttacag

SEQ ID NO: 522069 - DNA, 25 bp, Rattus norvegicus
gttacgggaaaggacagccttacag

SEQ ID NO: 522070 - DNA, 25 bp, Rattus norvegicus
gttacgggaagacacctgtgcactg

SEQ ID NO: 522071 - DNA, 25 bp, Rattus norvegicus
gttacgggaagagacctgtgcactg

SEQ ID NO: 522072 - DNA, 25 bp, Rattus norvegicus
gttacgggaagtacctgctgacgtc

SEQ ID NO: 522073 - DNA, 25 bp, Rattus norvegicus
gttacgggaagttcctgctgacgtc

SEQ ID NO: 522074 - DNA, 25 bp, Rattus norvegicus
gttacgggcagtaacattcatcaag

SEQ ID NO: 522075 - DNA, 25 bp, Rattus norvegicus
gttacgggcagttacattcatcaag

SEQ ID NO: 522076 - DNA, 25 bp, Rattus norvegicus
gttacgggcgaaaggcacactttca

SEQ ID NO: 522077 - DNA, 25 bp, Rattus norvegicus
gttacgggcgaatggcacactttca

SEQ ID NO: 522078 - DNA, 25 bp, Rattus norvegicus
gttacggttatcatgatctgtctct

SEQ ID NO: 522079 - DNA, 25 bp, Rattus norvegicus
gttacggttatcttgatctgtctct

SEQ ID NO: 522080 - DNA, 25 bp, Rattus norvegicus
gttacggttcagatttgcttgtctc

SEQ ID NO: 522081 - DNA, 25 bp, Rattus norvegicus
gttacggttcagttttgcttgtctc

SEQ ID NO: 522082 - DNA, 25 bp, Rattus norvegicus
gttacggttctcatttactgatgga

SEQ ID NO: 522083 - DNA, 25 bp, Rattus norvegicus
gttacggttctcttttactgatgga

SEQ ID NO: 522084 - DNA, 25 bp, Rattus norvegicus
gttacgtcatcgctgatgtgcctag

SEQ ID NO: 522085 - DNA, 25 bp, Rattus norvegicus
gttacgtcatcggtgatgtgcctag

SEQ ID NO: 522086 - DNA, 25 bp, Rattus norvegicus
gttacgtcgcagcaagagccttctg

SEQ ID NO: 522087 - DNA, 25 bp, Rattus norvegicus
gttacgtcgcaggaagagccttctg

SEQ ID NO: 522088 - DNA, 25 bp, Rattus norvegicus
gttacgtcttctaagtctcactagt

SEQ ID NO: 522089 - DNA, 25 bp, Rattus norvegicus
gttacgtcttcttagtctcactagt

SEQ ID NO: 522090 - DNA, 25 bp, Rattus norvegicus
gttacgtgtctaagtgtgtgcctgt

SEQ ID NO: 522091 - DNA, 25 bp, Rattus norvegicus
gttacgtgtctatgtgtgtgcctgt

SEQ ID NO: 522092 - DNA, 25 bp, Rattus norvegicus
gttacgtgtctgaagatcatcatta

SEQ ID NO: 522093 - DNA, 25 bp, Rattus norvegicus
gttacgtgtctgtagatcatcatta

SEQ ID NO: 522094 - DNA, 25 bp, Rattus norvegicus
gttacgtttctcacagactctgtcc

SEQ ID NO: 522095 - DNA, 25 bp, Rattus norvegicus
gttacgtttctctcagactctgtcc

SEQ ID NO: 522096 - DNA, 25 bp, Rattus norvegicus
gttacgttttaaactatgctccaga

SEQ ID NO: 522097 - DNA, 25 bp, Rattus norvegicus
gttacgttttaatctatgctccaga

SEQ ID NO: 522098 - DNA, 25 bp, Rattus norvegicus
gttactaacttgcagctgcagggtc

SEQ ID NO: 522099 - DNA, 25 bp, Rattus norvegicus
gttactaacttggagctgcagggtc

SEQ ID NO: 522100 - DNA, 25 bp, Rattus norvegicus
gttactaagagcagggcttccttaa

SEQ ID NO: 522101 - DNA, 25 bp, Rattus norvegicus
gttactaagagctgggcttccttaa

SEQ ID NO: 522102 - DNA, 25 bp, Rattus norvegicus
gttactaagcaaagtgtcccgcttt

SEQ ID NO: 522103 - DNA, 25 bp, Rattus norvegicus
gttactaagcaatgtgtcccgcttt

SEQ ID NO: 522104 - DNA, 25 bp, Rattus norvegicus
gttactaagcatacctcatatccta

SEQ ID NO: 522105 - DNA, 25 bp, Rattus norvegicus
gttactaagcattcctcatatccta

SEQ ID NO: 522106 - DNA, 25 bp, Rattus norvegicus
gttactaagtatctccacagcaggt

SEQ ID NO: 522107 - DNA, 25 bp, Rattus norvegicus
gttactaagtatgtccacagcaggt

SEQ ID NO: 522108 - DNA, 25 bp, Rattus norvegicus
gttactacatgtcggtggcttctta

SEQ ID NO: 522109 - DNA, 25 bp, Rattus norvegicus
gttactacatgtgggtggcttctta

SEQ ID NO: 522110 - DNA, 25 bp, Rattus norvegicus
gttactaccaggcacaccatcatgt

SEQ ID NO: 522111 - DNA, 25 bp, Rattus norvegicus
gttactaccagggacaccatcatgt

SEQ ID NO: 522112 - DNA, 25 bp, Rattus norvegicus
gttactaccagtcactacgaaggtt

SEQ ID NO: 522113 - DNA, 25 bp, Rattus norvegicus
gttactaccagtgactacgaaggtt

SEQ ID NO: 522114 - DNA, 25 bp, Rattus norvegicus
gttactaccatcagctgaggcggca

SEQ ID NO: 522115 - DNA, 25 bp, Rattus norvegicus
gttactaccatctgctgaggcggca

SEQ ID NO: 522116 - DNA, 25 bp, Rattus norvegicus
gttactaccctaatcttgctcaagt

SEQ ID NO: 522117 - DNA, 25 bp, Rattus norvegicus
gttactaccctattcttgctcaagt

SEQ ID NO: 522118 - DNA, 25 bp, Rattus norvegicus
gttactaccgacactgcaatgacag

SEQ ID NO: 522119 - DNA, 25 bp, Rattus norvegicus
gttactaccgactctgcaatgacag

SEQ ID NO: 522120 - DNA, 25 bp, Rattus norvegicus
gttactacgctgcttaagggcttat

SEQ ID NO: 522121 - DNA, 25 bp, Rattus norvegicus
gttactacgctggttaagggcttat

SEQ ID NO: 522122 - DNA, 25 bp, Rattus norvegicus
gttactactgtacgttttcctcagt

SEQ ID NO: 522123 - DNA, 25 bp, Rattus norvegicus
gttactactgtaggttttcctcagt

SEQ ID NO: 522124 - DNA, 25 bp, Rattus norvegicus
gttactacttagactcacatactga

SEQ ID NO: 522125 - DNA, 25 bp, Rattus norvegicus
gttactacttagtctcacatactga

SEQ ID NO: 522126 - DNA, 25 bp, Rattus norvegicus
gttactagactgataccttttgtgt

SEQ ID NO: 522127 - DNA, 25 bp, Rattus norvegicus
gttactagactgttaccttttgtgt

SEQ ID NO: 522128 - DNA, 25 bp, Rattus norvegicus
gttactaggcagctgtttgcacaaa

SEQ ID NO: 522129 - DNA, 25 bp, Rattus norvegicus
gttactaggcaggtgtttgcacaaa

SEQ ID NO: 522130 - DNA, 25 bp, Rattus norvegicus
gttactagtggcatcagaaaatcat

SEQ ID NO: 522131 - DNA, 25 bp, Rattus norvegicus
gttactagtggcttcagaaaatcat

SEQ ID NO: 522132 - DNA, 25 bp, Rattus norvegicus
gttactagttgtagccattatggtc

SEQ ID NO: 522133 - DNA, 25 bp, Rattus norvegicus
gttactagttgttgccattatggtc

SEQ ID NO: 522134 - DNA, 25 bp, Rattus norvegicus
gttactagtttgctgaatgtccttt

SEQ ID NO: 522135 - DNA, 25 bp, Rattus norvegicus
gttactagtttggtgaatgtccttt

SEQ ID NO: 522136 - DNA, 25 bp, Rattus norvegicus
gttactatagagctgttatctgtta

SEQ ID NO: 522137 - DNA, 25 bp, Rattus norvegicus
gttactatagaggtgttatctgtta

SEQ ID NO: 522138 - DNA, 25 bp, Rattus norvegicus
gttactatagatctttaccactttc

SEQ ID NO: 522139 - DNA, 25 bp, Rattus norvegicus
gttactatagatgtttaccactttc

SEQ ID NO: 522140 - DNA, 25 bp, Rattus norvegicus
gttactatatacagaggccattttg

SEQ ID NO: 522141 - DNA, 25 bp, Rattus norvegicus
gttactatatactgaggccattttg

SEQ ID NO: 522142 - DNA, 25 bp, Rattus norvegicus
gttactatcatcctctgtgagctac

SEQ ID NO: 522143 - DNA, 25 bp, Rattus norvegicus
gttactatcatcgtctgtgagctac

SEQ ID NO: 522144 - DNA, 25 bp, Rattus norvegicus
gttactatccctatactatttgctt

SEQ ID NO: 522145 - DNA, 25 bp, Rattus norvegicus
gttactatccctttactatttgctt

SEQ ID NO: 522146 - DNA, 25 bp, Rattus norvegicus
gttactattatcctactatacctga

SEQ ID NO: 522147 - DNA, 25 bp, Rattus norvegicus
gttactattatcgtactatacctga

SEQ ID NO: 522148 - DNA, 25 bp, Rattus norvegicus
gttactcaaaataccaagctcactt

SEQ ID NO: 522149 - DNA, 25 bp, Rattus norvegicus
gttactcaaaattccaagctcactt

SEQ ID NO: 522150 - DNA, 25 bp, Rattus norvegicus
gttactcaaagcagattctgccagt

SEQ ID NO: 522151 - DNA, 25 bp, Rattus norvegicus
gttactcaaagctgattctgccagt

SEQ ID NO: 522152 - DNA, 25 bp, Rattus norvegicus
gttactcaatttaagcaggctgcca

SEQ ID NO: 522153 - DNA, 25 bp, Rattus norvegicus
gttactcaattttagcaggctgcca

SEQ ID NO: 522154 - DNA, 25 bp, Rattus norvegicus
gttactcacaatatacgcagctctg

SEQ ID NO: 522155 - DNA, 25 bp, Rattus norvegicus
gttactcacaatttacgcagctctg

SEQ ID NO: 522156 - DNA, 25 bp, Rattus norvegicus
gttactcaccagaatagatccaagt

SEQ ID NO: 522157 - DNA, 25 bp, Rattus norvegicus
gttactcaccagtatagatccaagt

SEQ ID NO: 522158 - DNA, 25 bp, Rattus norvegicus
gttactcagagtcgtatccctgcta

SEQ ID NO: 522159 - DNA, 25 bp, Rattus norvegicus
gttactcagagtggtatccctgcta

SEQ ID NO: 522160 - DNA, 25 bp, Rattus norvegicus
gttactcagatgctactgtactgtt

SEQ ID NO: 522161 - DNA, 25 bp, Rattus norvegicus
gttactcagatggtactgtactgtt

SEQ ID NO: 522162 - DNA, 25 bp, Rattus norvegicus
gttactcagcacatgttcaagtcta

SEQ ID NO: 522163 - DNA, 25 bp, Rattus norvegicus
gttactcagcacttgttcaagtcta

SEQ ID NO: 522164 - DNA, 25 bp, Rattus norvegicus
gttactcagggcagcacacgctgca

SEQ ID NO: 522165 - DNA, 25 bp, Rattus norvegicus
gttactcagggctgcacacgctgca

SEQ ID NO: 522166 - DNA, 25 bp, Rattus norvegicus
gttactcagtccacataactactct

SEQ ID NO: 522167 - DNA, 25 bp, Rattus norvegicus
gttactcagtcctcataactactct

SEQ ID NO: 522168 - DNA, 25 bp, Rattus norvegicus
gttactcagtgtcaacagttcccct

SEQ ID NO: 522169 - DNA, 25 bp, Rattus norvegicus
gttactcagtgtgaacagttcccct

SEQ ID NO: 522170 - DNA, 25 bp, Rattus norvegicus
gttactcagtttatcctcactggat

SEQ ID NO: 522171 - DNA, 25 bp, Rattus norvegicus
gttactcagtttttcctcactggat

SEQ ID NO: 522172 - DNA, 25 bp, Rattus norvegicus
gttactcataatcttgaacatctct

SEQ ID NO: 522173 - DNA, 25 bp, Rattus norvegicus
gttactcataatgttgaacatctct

SEQ ID NO: 522174 - DNA, 25 bp, Rattus norvegicus
gttactcatctgcaaaattgggcca

SEQ ID NO: 522175 - DNA, 25 bp, Rattus norvegicus
gttactcatctggaaaattgggcca

SEQ ID NO: 522176 - DNA, 25 bp, Rattus norvegicus
gttactcatgagattacacatgcat

SEQ ID NO: 522177 - DNA, 25 bp, Rattus norvegicus
gttactcatgagtttacacatgcat

SEQ ID NO: 522178 - DNA, 25 bp, Rattus norvegicus
gttactcattagagctgtgctcaga

SEQ ID NO: 522179 - DNA, 25 bp, Rattus norvegicus
gttactcattagtgctgtgctcaga

SEQ ID NO: 522180 - DNA, 25 bp, Rattus norvegicus
gttactcatttgaaagctgttcagt

SEQ ID NO: 522181 - DNA, 25 bp, Rattus norvegicus
gttactcatttgtaagctgttcagt

SEQ ID NO: 522182 - DNA, 25 bp, Rattus norvegicus
gttactccaattatctctgctactt

SEQ ID NO: 522183 - DNA, 25 bp, Rattus norvegicus
gttactccaattttctctgctactt

SEQ ID NO: 522184 - DNA, 25 bp, Rattus norvegicus
gttactccactcaggaagttgcatt

SEQ ID NO: 522185 - DNA, 25 bp, Rattus norvegicus
gttactccactctggaagttgcatt

SEQ ID NO: 522186 - DNA, 25 bp, Rattus norvegicus
gttactccagagactcagaccttgt

SEQ ID NO: 522187 - DNA, 25 bp, Rattus norvegicus
gttactccagagtctcagaccttgt

SEQ ID NO: 522188 - DNA, 25 bp, Rattus norvegicus
gttactccagtaaccttgtggcaat

SEQ ID NO: 522189 - DNA, 25 bp, Rattus norvegicus
gttactccagtatccttgtggcaat

SEQ ID NO: 522190 - DNA, 25 bp, Rattus norvegicus
gttactccagtcagaagaacctaga

SEQ ID NO: 522191 - DNA, 25 bp, Rattus norvegicus
gttactccagtctgaagaacctaga

SEQ ID NO: 522192 - DNA, 25 bp, Rattus norvegicus
gttactcccaatatataccacatat

SEQ ID NO: 522193 - DNA, 25 bp, Rattus norvegicus
gttactcccaatttataccacatat

SEQ ID NO: 522194 - DNA, 25 bp, Rattus norvegicus
gttactccgatccaactatcggcta

SEQ ID NO: 522195 - DNA, 25 bp, Rattus norvegicus
gttactccgatcgaactatcggcta

SEQ ID NO: 522196 - DNA, 25 bp, Rattus norvegicus
gttactccgtgtcagctgactggca

SEQ ID NO: 522197 - DNA, 25 bp, Rattus norvegicus
gttactccgtgtgagctgactggca

SEQ ID NO: 522198 - DNA, 25 bp, Rattus norvegicus
gttactccgtttatgatacattcct

SEQ ID NO: 522199 - DNA, 25 bp, Rattus norvegicus
gttactccgtttttgatacattcct

SEQ ID NO: 522200 - DNA, 25 bp, Rattus norvegicus
gttactcctaaaaacagtggcccag

SEQ ID NO: 522201 - DNA, 25 bp, Rattus norvegicus
gttactcctaaatacagtggcccag

SEQ ID NO: 522202 - DNA, 25 bp, Rattus norvegicus
gttactcctcagaaatactgcactg

SEQ ID NO: 522203 - DNA, 25 bp, Rattus norvegicus
gttactcctcagtaatactgcactg

SEQ ID NO: 522204 - DNA, 25 bp, Rattus norvegicus
gttactcctgctaaaaccatgtttt

SEQ ID NO: 522205 - DNA, 25 bp, Rattus norvegicus
gttactcctgcttaaaccatgtttt

SEQ ID NO: 522206 - DNA, 25 bp, Rattus norvegicus
gttactccttatccacttgtactct

SEQ ID NO: 522207 - DNA, 25 bp, Rattus norvegicus
gttactccttatgcacttgtactct

SEQ ID NO: 522208 - DNA, 25 bp, Rattus norvegicus
gttactcgcagccaatccggagtga

SEQ ID NO: 522209 - DNA, 25 bp, Rattus norvegicus
gttactcgcagcgaatccggagtga

SEQ ID NO: 522210 - DNA, 25 bp, Rattus norvegicus
gttactctagaaccaaccaacaatt

SEQ ID NO: 522211 - DNA, 25 bp, Rattus norvegicus
gttactctagaagcaaccaacaatt

SEQ ID NO: 522212 - DNA, 25 bp, Rattus norvegicus
gttactctagacagttcagttttga

SEQ ID NO: 522213 - DNA, 25 bp, Rattus norvegicus
gttactctagactgttcagttttga

SEQ ID NO: 522214 - DNA, 25 bp, Rattus norvegicus
gttactctagcacgaggcatgccca

SEQ ID NO: 522215 - DNA, 25 bp, Rattus norvegicus
gttactctagcaggaggcatgccca

SEQ ID NO: 522216 - DNA, 25 bp, Rattus norvegicus
gttactctcgaaaatctcctttgaa

SEQ ID NO: 522217 - DNA, 25 bp, Rattus norvegicus
gttactctcgaatatctcctttgaa

SEQ ID NO: 522218 - DNA, 25 bp, Rattus norvegicus
gttactctctcacgtaaagcgtcat

SEQ ID NO: 522219 - DNA, 25 bp, Rattus norvegicus
gttactctctcaggtaaagcgtcat

SEQ ID NO: 522220 - DNA, 25 bp, Rattus norvegicus
gttactctctgaagtgcaactgatg

SEQ ID NO: 522221 - DNA, 25 bp, Rattus norvegicus
gttactctctgatgtgcaactgatg

SEQ ID NO: 522222 - DNA, 25 bp, Rattus norvegicus
gttactctcttaagcaagtgacgaa

SEQ ID NO: 522223 - DNA, 25 bp, Rattus norvegicus
gttactctcttatgcaagtgacgaa

SEQ ID NO: 522224 - DNA, 25 bp, Rattus norvegicus
gttactctcttcaagtgtttgctta

SEQ ID NO: 522225 - DNA, 25 bp, Rattus norvegicus
gttactctcttctagtgtttgctta

SEQ ID NO: 522226 - DNA, 25 bp, Rattus norvegicus
gttactctgaagattgttcctttcg

SEQ ID NO: 522227 - DNA, 25 bp, Rattus norvegicus
gttactctgaagtttgttcctttcg

SEQ ID NO: 522228 - DNA, 25 bp, Rattus norvegicus
gttactctgactacagctgatctca

SEQ ID NO: 522229 - DNA, 25 bp, Rattus norvegicus
gttactctgacttcagctgatctca

SEQ ID NO: 522230 - DNA, 25 bp, Rattus norvegicus
gttactctgagacgctttcaagcac

SEQ ID NO: 522231 - DNA, 25 bp, Rattus norvegicus
gttactctgagaggctttcaagcac

SEQ ID NO: 522232 - DNA, 25 bp, Rattus norvegicus
gttactctgatcatgactccaatcg

SEQ ID NO: 522233 - DNA, 25 bp, Rattus norvegicus
gttactctgatcttgactccaatcg

SEQ ID NO: 522234 - DNA, 25 bp, Rattus norvegicus
gttactctggatccgagctcggtac

SEQ ID NO: 522235 - DNA, 25 bp, Rattus norvegicus
gttactctggatgcgagctcggtac

SEQ ID NO: 522236 - DNA, 25 bp, Rattus norvegicus
gttactctggcaatggagccaggca

SEQ ID NO: 522237 - DNA, 25 bp, Rattus norvegicus
gttactctggcattggagccaggca

SEQ ID NO: 522238 - DNA, 25 bp, Rattus norvegicus
gttactctgtccacacagcaaggat

SEQ ID NO: 522239 - DNA, 25 bp, Rattus norvegicus
gttactctgtcctcacagcaaggat

SEQ ID NO: 522240 - DNA, 25 bp, Rattus norvegicus
gttactctgtctagaatttctctgt

SEQ ID NO: 522241 - DNA, 25 bp, Rattus norvegicus
gttactctgtcttgaatttctctgt

SEQ ID NO: 522242 - DNA, 25 bp, Rattus norvegicus
gttactctgtggatcatcttatctg

SEQ ID NO: 522243 - DNA, 25 bp, Rattus norvegicus
gttactctgtggttcatcttatctg

SEQ ID NO: 522244 - DNA, 25 bp, Rattus norvegicus
gttactctgttgcacttatctttat

SEQ ID NO: 522245 - DNA, 25 bp, Rattus norvegicus
gttactctgttggacttatctttat

SEQ ID NO: 522246 - DNA, 25 bp, Rattus norvegicus
gttactcttattacttgggcctggg

SEQ ID NO: 522247 - DNA, 25 bp, Rattus norvegicus
gttactcttatttcttgggcctggg

SEQ ID NO: 522248 - DNA, 25 bp, Rattus norvegicus
gttactcttcgaacttgttaggaaa

SEQ ID NO: 522249 - DNA, 25 bp, Rattus norvegicus
gttactcttcgatcttgttaggaaa

SEQ ID NO: 522250 - DNA, 25 bp, Rattus norvegicus
gttactcttgtaaccagctctggta

SEQ ID NO: 522251 - DNA, 25 bp, Rattus norvegicus
gttactcttgtatccagctctggta

SEQ ID NO: 522252 - DNA, 25 bp, Rattus norvegicus
gttactctttaacatttcctgtgta

SEQ ID NO: 522253 - DNA, 25 bp, Rattus norvegicus
gttactctttaagatttcctgtgta

SEQ ID NO: 522254 - DNA, 25 bp, Rattus norvegicus
gttactgaactcatagaactggcat

SEQ ID NO: 522255 - DNA, 25 bp, Rattus norvegicus
gttactgaactcttagaactggcat

SEQ ID NO: 522256 - DNA, 25 bp, Rattus norvegicus
gttactgaagttagccttctgcctc

SEQ ID NO: 522257 - DNA, 25 bp, Rattus norvegicus
gttactgaagtttgccttctgcctc

SEQ ID NO: 522258 - DNA, 25 bp, Rattus norvegicus
gttactgacaagagctcttacctgc

SEQ ID NO: 522259 - DNA, 25 bp, Rattus norvegicus
gttactgacaagtgctcttacctgc

SEQ ID NO: 522260 - DNA, 25 bp, Rattus norvegicus
gttactgacaatcgagctcttatct

SEQ ID NO: 522261 - DNA, 25 bp, Rattus norvegicus
gttactgacaatggagctcttatct

SEQ ID NO: 522262 - DNA, 25 bp, Rattus norvegicus
gttactgacactcctctagtttgct

SEQ ID NO: 522263 - DNA, 25 bp, Rattus norvegicus
gttactgacactgctctagtttgct

SEQ ID NO: 522264 - DNA, 25 bp, Rattus norvegicus
gttactgacagcacaaattccattg

SEQ ID NO: 522265 - DNA, 25 bp, Rattus norvegicus
gttactgacagctcaaattccattg

SEQ ID NO: 522266 - DNA, 25 bp, Rattus norvegicus
gttactgacggtctggacatctgta

SEQ ID NO: 522267 - DNA, 25 bp, Rattus norvegicus
gttactgacggtgtggacatctgta

SEQ ID NO: 522268 - DNA, 25 bp, Rattus norvegicus
gttactgacttgagacctatggttg

SEQ ID NO: 522269 - DNA, 25 bp, Rattus norvegicus
gttactgacttgtgacctatggttg

SEQ ID NO: 522270 - DNA, 25 bp, Rattus norvegicus
gttactgaggaacggttcagtccca

SEQ ID NO: 522271 - DNA, 25 bp, Rattus norvegicus
gttactgaggaagggttcagtccca

SEQ ID NO: 522272 - DNA, 25 bp, Rattus norvegicus
gttactgatttcatgtatcccagga

SEQ ID NO: 522273 - DNA, 25 bp, Rattus norvegicus
gttactgatttcttgtatcccagga

SEQ ID NO: 522274 - DNA, 25 bp, Rattus norvegicus
gttactgcaactcctttgagtctaa

SEQ ID NO: 522275 - DNA, 25 bp, Rattus norvegicus
gttactgcaactgctttgagtctaa

SEQ ID NO: 522276 - DNA, 25 bp, Rattus norvegicus
gttactgcaataattgtgctcatca

SEQ ID NO: 522277 - DNA, 25 bp, Rattus norvegicus
gttactgcaatatttgtgctcatca

SEQ ID NO: 522278 - DNA, 25 bp, Rattus norvegicus
gttactgcacacaagctggatttat

SEQ ID NO: 522279 - DNA, 25 bp, Rattus norvegicus
gttactgcacaccttcacagacagt

SEQ ID NO: 522280 - DNA, 25 bp, Rattus norvegicus
gttactgcacacgttcacagacagt

SEQ ID NO: 522281 - DNA, 25 bp, Rattus norvegicus
gttactgcacactagctggatttat

SEQ ID NO: 522282 - DNA, 25 bp, Rattus norvegicus
gttactgcaccgatcacgcttagga

SEQ ID NO: 522283 - DNA, 25 bp, Rattus norvegicus
gttactgcaccgttcacgcttagga

SEQ ID NO: 522284 - DNA, 25 bp, Rattus norvegicus
gttactgcagacacagttgtcactg

SEQ ID NO: 522285 - DNA, 25 bp, Rattus norvegicus
gttactgcagactcagttgtcactg

SEQ ID NO: 522286 - DNA, 25 bp, Rattus norvegicus
gttactgcaggaaacttgaggccac

SEQ ID NO: 522287 - DNA, 25 bp, Rattus norvegicus
gttactgcaggatacttgaggccac

SEQ ID NO: 522288 - DNA, 25 bp, Rattus norvegicus
gttactgcagttcagctcagtgcat

SEQ ID NO: 522289 - DNA, 25 bp, Rattus norvegicus
gttactgcagttgagctcagtgcat

SEQ ID NO: 522290 - DNA, 25 bp, Rattus norvegicus
gttactgcatgcagctggcccagat

SEQ ID NO: 522291 - DNA, 25 bp, Rattus norvegicus
gttactgcatgctgctggcccagat

SEQ ID NO: 522292 - DNA, 25 bp, Rattus norvegicus
gttactgccaagctgagttcaatct

SEQ ID NO: 522293 - DNA, 25 bp, Rattus norvegicus
gttactgccaaggtgagttcaatct

SEQ ID NO: 522294 - DNA, 25 bp, Rattus norvegicus
gttactgccacccagagcaatatct

SEQ ID NO: 522295 - DNA, 25 bp, Rattus norvegicus
gttactgccaccgagagcaatatct

SEQ ID NO: 522296 - DNA, 25 bp, Rattus norvegicus
gttactgccagaccagactcctgag

SEQ ID NO: 522297 - DNA, 25 bp, Rattus norvegicus
gttactgccagagcagactcctgag

SEQ ID NO: 522298 - DNA, 25 bp, Rattus norvegicus
gttactgcctatcctttttacctta

SEQ ID NO: 522299 - DNA, 25 bp, Rattus norvegicus
gttactgcctatgctttttacctta

SEQ ID NO: 522300 - DNA, 25 bp, Rattus norvegicus
gttactgcctttagacttgacctgt

SEQ ID NO: 522301 - DNA, 25 bp, Rattus norvegicus
gttactgccttttgacttgacctgt

SEQ ID NO: 522302 - DNA, 25 bp, Rattus norvegicus
gttactgcggcactgggaccagaat

SEQ ID NO: 522303 - DNA, 25 bp, Rattus norvegicus
gttactgcggcagtgggaccagaat

SEQ ID NO: 522304 - DNA, 25 bp, Rattus norvegicus
gttactgctacaatgttgcctttgg

SEQ ID NO: 522305 - DNA, 25 bp, Rattus norvegicus
gttactgctacattgttgcctttgg

SEQ ID NO: 522306 - DNA, 25 bp, Rattus norvegicus
gttactgcttagaggaacggcctgc

SEQ ID NO: 522307 - DNA, 25 bp, Rattus norvegicus
gttactgcttagtggaacggcctgc

SEQ ID NO: 522308 - DNA, 25 bp, Rattus norvegicus
gttactggacatcaagactcggctg

SEQ ID NO: 522309 - DNA, 25 bp, Rattus norvegicus
gttactggacatgaagactcggctg

SEQ ID NO: 522310 - DNA, 25 bp, Rattus norvegicus
gttactggactcaaggaccctggat

SEQ ID NO: 522311 - DNA, 25 bp, Rattus norvegicus
gttactggactctaggaccctggat

SEQ ID NO: 522312 - DNA, 25 bp, Rattus norvegicus
gttactggatgtaaaggcccggctt

SEQ ID NO: 522313 - DNA, 25 bp, Rattus norvegicus
gttactggatgttaaggcccggctt

SEQ ID NO: 522314 - DNA, 25 bp, Rattus norvegicus
gttactggcagccttctttccgaag

SEQ ID NO: 522315 - DNA, 25 bp, Rattus norvegicus
gttactggcagcgttctttccgaag

SEQ ID NO: 522316 - DNA, 25 bp, Rattus norvegicus
gttactgggaagctgtacacactca

SEQ ID NO: 522317 - DNA, 25 bp, Rattus norvegicus
gttactgggaaggtgtacacactca

SEQ ID NO: 522318 - DNA, 25 bp, Rattus norvegicus
gttactggtttccttactatggatt

SEQ ID NO: 522319 - DNA, 25 bp, Rattus norvegicus
gttactggtttcctttgacaataca

SEQ ID NO: 522320 - DNA, 25 bp, Rattus norvegicus
gttactggtttcgttactatggatt

SEQ ID NO: 522321 - DNA, 25 bp, Rattus norvegicus
gttactggtttcgtttgacaataca

SEQ ID NO: 522322 - DNA, 25 bp, Rattus norvegicus
gttactgtaacaatgctgatctcga

SEQ ID NO: 522323 - DNA, 25 bp, Rattus norvegicus
gttactgtaacattgctgatctcga

SEQ ID NO: 522324 - DNA, 25 bp, Rattus norvegicus
gttactgtagaaatgacactgctta

SEQ ID NO: 522325 - DNA, 25 bp, Rattus norvegicus
gttactgtagaattgacactgctta

SEQ ID NO: 522326 - DNA, 25 bp, Rattus norvegicus
gttactgtagtacacgtccctgagg

SEQ ID NO: 522327 - DNA, 25 bp, Rattus norvegicus
gttactgtagtagacgtccctgagg

SEQ ID NO: 522328 - DNA, 25 bp, Rattus norvegicus
gttactgtagtgacctcagggccag

SEQ ID NO: 522329 - DNA, 25 bp, Rattus norvegicus
gttactgtagtgaggtgctttttct

SEQ ID NO: 522330 - DNA, 25 bp, Rattus norvegicus
gttactgtagtgctgttaccgacca

SEQ ID NO: 522331 - DNA, 25 bp, Rattus norvegicus
gttactgtagtggtgttaccgacca

SEQ ID NO: 522332 - DNA, 25 bp, Rattus norvegicus
gttactgtagtgtcctcagggccag

SEQ ID NO: 522333 - DNA, 25 bp, Rattus norvegicus
gttactgtagtgtggtgctttttct

SEQ ID NO: 522334 - DNA, 25 bp, Rattus norvegicus
gttactgtcaacaaaattccatgga

SEQ ID NO: 522335 - DNA, 25 bp, Rattus norvegicus
gttactgtcaacctgtacgtcatag

SEQ ID NO: 522336 - DNA, 25 bp, Rattus norvegicus
gttactgtcaacgtgtacgtcatag

SEQ ID NO: 522337 - DNA, 25 bp, Rattus norvegicus
gttactgtcaactaaattccatgga

SEQ ID NO: 522338 - DNA, 25 bp, Rattus norvegicus
gttactgtcgtcatcattgctctta

SEQ ID NO: 522339 - DNA, 25 bp, Rattus norvegicus
gttactgtcgtcttcattgctctta

SEQ ID NO: 522340 - DNA, 25 bp, Rattus norvegicus
gttactgtcttgagtaaggatgcat

SEQ ID NO: 522341 - DNA, 25 bp, Rattus norvegicus
gttactgtcttgtgtaaggatgcat

SEQ ID NO: 522342 - DNA, 25 bp, Rattus norvegicus
gttactgtggaccacagaccgctct

SEQ ID NO: 522343 - DNA, 25 bp, Rattus norvegicus
gttactgtggacgacagaccgctct

SEQ ID NO: 522344 - DNA, 25 bp, Rattus norvegicus
gttactgtgtaaagaaactttttct

SEQ ID NO: 522345 - DNA, 25 bp, Rattus norvegicus
gttactgtgtaatgaaactttttct

SEQ ID NO: 522346 - DNA, 25 bp, Rattus norvegicus
gttactgtgtacctgactcatgcta

SEQ ID NO: 522347 - DNA, 25 bp, Rattus norvegicus
gttactgtgtacgtgactcatgcta

SEQ ID NO: 522348 - DNA, 25 bp, Rattus norvegicus
gttactgtgtgaattgttccccaag

SEQ ID NO: 522349 - DNA, 25 bp, Rattus norvegicus
gttactgtgtgatttgttccccaag

SEQ ID NO: 522350 - DNA, 25 bp, Rattus norvegicus
gttactgttagtagtttacaagcca

SEQ ID NO: 522351 - DNA, 25 bp, Rattus norvegicus
gttactgttagttgtttacaagcca

SEQ ID NO: 522352 - DNA, 25 bp, Rattus norvegicus
gttactgttataaccagcctatact

SEQ ID NO: 522353 - DNA, 25 bp, Rattus norvegicus
gttactgttatatccagcctatact

SEQ ID NO: 522354 - DNA, 25 bp, Rattus norvegicus
gttactgttcagaggttggctttaa

SEQ ID NO: 522355 - DNA, 25 bp, Rattus norvegicus
gttactgttcagtggttggctttaa

SEQ ID NO: 522356 - DNA, 25 bp, Rattus norvegicus
gttactgttgctctgctttcatttt

SEQ ID NO: 522357 - DNA, 25 bp, Rattus norvegicus
gttactgttgctgtgctttcatttt

SEQ ID NO: 522358 - DNA, 25 bp, Rattus norvegicus
gttactgttgggagaggacactgca

SEQ ID NO: 522359 - DNA, 25 bp, Rattus norvegicus
gttactgttgggtgaggacactgca

SEQ ID NO: 522360 - DNA, 25 bp, Rattus norvegicus
gttactgttggtcgctggaagactt

SEQ ID NO: 522361 - DNA, 25 bp, Rattus norvegicus
gttactgttggtggctggaagactt

SEQ ID NO: 522362 - DNA, 25 bp, Rattus norvegicus
gttactgttgtgaacttcctggaaa

SEQ ID NO: 522363 - DNA, 25 bp, Rattus norvegicus
gttactgttgtgtacttcctggaaa

SEQ ID NO: 522364 - DNA, 25 bp, Rattus norvegicus
gttactgttgttctgtgttgtttgg

SEQ ID NO: 522365 - DNA, 25 bp, Rattus norvegicus
gttactgttgttgtgtgttgtttgg

SEQ ID NO: 522366 - DNA, 25 bp, Rattus norvegicus
gttacttaacatctcagttacccta

SEQ ID NO: 522367 - DNA, 25 bp, Rattus norvegicus
gttacttaacatgtcagttacccta

SEQ ID NO: 522368 - DNA, 25 bp, Rattus norvegicus
gttacttaaccaaactgttggcaag

SEQ ID NO: 522369 - DNA, 25 bp, Rattus norvegicus
gttacttaaccatactgttggcaag

SEQ ID NO: 522370 - DNA, 25 bp, Rattus norvegicus
gttacttaacctcagtggctgcctt

SEQ ID NO: 522371 - DNA, 25 bp, Rattus norvegicus
gttacttaacctgagtggctgcctt

SEQ ID NO: 522372 - DNA, 25 bp, Rattus norvegicus
gttacttaagacacactgcctagca

SEQ ID NO: 522373 - DNA, 25 bp, Rattus norvegicus
gttacttaagactcactgcctagca

SEQ ID NO: 522374 - DNA, 25 bp, Rattus norvegicus
gttacttaatatcctctggcacaga

SEQ ID NO: 522375 - DNA, 25 bp, Rattus norvegicus
gttacttaatatgctctggcacaga

SEQ ID NO: 522376 - DNA, 25 bp, Rattus norvegicus
gttacttactaccattgctgtgaca

SEQ ID NO: 522377 - DNA, 25 bp, Rattus norvegicus
gttacttactacgattgctgtgaca

SEQ ID NO: 522378 - DNA, 25 bp, Rattus norvegicus
gttacttagaaaaaggccagcctta

SEQ ID NO: 522379 - DNA, 25 bp, Rattus norvegicus
gttacttagaaataggccagcctta

SEQ ID NO: 522380 - DNA, 25 bp, Rattus norvegicus
gttacttagtacagactcaacaggg

SEQ ID NO: 522381 - DNA, 25 bp, Rattus norvegicus
gttacttagtactgactcaacaggg

SEQ ID NO: 522382 - DNA, 25 bp, Rattus norvegicus
gttacttataccacactgcttcttg

SEQ ID NO: 522383 - DNA, 25 bp, Rattus norvegicus
gttacttatacctcactgcttcttg

SEQ ID NO: 522384 - DNA, 25 bp, Rattus norvegicus
gttacttatcatcagacttatcccc

SEQ ID NO: 522385 - DNA, 25 bp, Rattus norvegicus
gttacttatcatgagacttatcccc

SEQ ID NO: 522386 - DNA, 25 bp, Rattus norvegicus
gttacttatgcgagtagacatttta

SEQ ID NO: 522387 - DNA, 25 bp, Rattus norvegicus
gttacttatgcgtgtagacatttta

SEQ ID NO: 522388 - DNA, 25 bp, Rattus norvegicus
gttacttcaggccactgggcgacat

SEQ ID NO: 522389 - DNA, 25 bp, Rattus norvegicus
gttacttcaggcgactgggcgacat

SEQ ID NO: 522390 - DNA, 25 bp, Rattus norvegicus
gttacttcatttagcccggctaaag

SEQ ID NO: 522391 - DNA, 25 bp, Rattus norvegicus
gttacttcattttgcccggctaaag

SEQ ID NO: 522392 - DNA, 25 bp, Rattus norvegicus
gttacttccaaaaggttagaggcat

SEQ ID NO: 522393 - DNA, 25 bp, Rattus norvegicus
gttacttccaaatggttagaggcat

SEQ ID NO: 522394 - DNA, 25 bp, Rattus norvegicus
gttacttccactcttttacaactga

SEQ ID NO: 522395 - DNA, 25 bp, Rattus norvegicus
gttacttccactgttttacaactga

SEQ ID NO: 522396 - DNA, 25 bp, Rattus norvegicus
gttacttccattcttgctactgctg

SEQ ID NO: 522397 - DNA, 25 bp, Rattus norvegicus
gttacttccattgttgctactgctg

SEQ ID NO: 522398 - DNA, 25 bp, Rattus norvegicus
gttacttcccagagtttgaaaagat

SEQ ID NO: 522399 - DNA, 25 bp, Rattus norvegicus
gttacttcccagtgtttgaaaagat

SEQ ID NO: 522400 - DNA, 25 bp, Rattus norvegicus
gttacttccccacccaaatggatga

SEQ ID NO: 522401 - DNA, 25 bp, Rattus norvegicus
gttacttccccagccaaatggatga

SEQ ID NO: 522402 - DNA, 25 bp, Rattus norvegicus
gttacttcgctaagtagtgtacagg

SEQ ID NO: 522403 - DNA, 25 bp, Rattus norvegicus
gttacttcgctatgtagtgtacagg

SEQ ID NO: 522404 - DNA, 25 bp, Rattus norvegicus
gttacttctccaactcaactaaggt

SEQ ID NO: 522405 - DNA, 25 bp, Rattus norvegicus
gttacttctccatctcaactaaggt

SEQ ID NO: 522406 - DNA, 25 bp, Rattus norvegicus
gttacttctgcacttccatgaggga

SEQ ID NO: 522407 - DNA, 25 bp, Rattus norvegicus
gttacttctgcagttccatgaggga

SEQ ID NO: 522408 - DNA, 25 bp, Rattus norvegicus
gttacttctgtaattcttgcctaaa

SEQ ID NO: 522409 - DNA, 25 bp, Rattus norvegicus
gttacttctgtatttcttgcctaaa

SEQ ID NO: 522410 - DNA, 25 bp, Rattus norvegicus
gttacttctgttactttttctgtat

SEQ ID NO: 522411 - DNA, 25 bp, Rattus norvegicus
gttacttctgtttctttttctgtat

SEQ ID NO: 522412 - DNA, 25 bp, Rattus norvegicus
gttacttcttcgaggttctgggcat

SEQ ID NO: 522413 - DNA, 25 bp, Rattus norvegicus
gttacttcttcgtggttctgggcat

SEQ ID NO: 522414 - DNA, 25 bp, Rattus norvegicus
gttacttcttctctcataccattga

SEQ ID NO: 522415 - DNA, 25 bp, Rattus norvegicus
gttacttcttctgtcataccattga

SEQ ID NO: 522416 - DNA, 25 bp, Rattus norvegicus
gttacttctttcattatcatctcct

SEQ ID NO: 522417 - DNA, 25 bp, Rattus norvegicus
gttacttctttctttatcatctcct

SEQ ID NO: 522418 - DNA, 25 bp, Rattus norvegicus
gttacttgaaagactatctccttct

SEQ ID NO: 522419 - DNA, 25 bp, Rattus norvegicus
gttacttgaaagtctatctccttct

SEQ ID NO: 522420 - DNA, 25 bp, Rattus norvegicus
gttacttgaatcagtcccaaccaca

SEQ ID NO: 522421 - DNA, 25 bp, Rattus norvegicus
gttacttgaatctgtcccaaccaca

SEQ ID NO: 522422 - DNA, 25 bp, Rattus norvegicus
gttacttgactgatttctatcatgg

SEQ ID NO: 522423 - DNA, 25 bp, Rattus norvegicus
gttacttgactgttttctatcatgg

SEQ ID NO: 522424 - DNA, 25 bp, Rattus norvegicus
gttacttgcaatccttaagccttgt

SEQ ID NO: 522425 - DNA, 25 bp, Rattus norvegicus
gttacttgcaatgcttaagccttgt

SEQ ID NO: 522426 - DNA, 25 bp, Rattus norvegicus
gttacttgccaaaatgaccgcttct

SEQ ID NO: 522427 - DNA, 25 bp, Rattus norvegicus
gttacttgccaaacattctaagctg

SEQ ID NO: 522428 - DNA, 25 bp, Rattus norvegicus
gttacttgccaatatgaccgcttct

SEQ ID NO: 522429 - DNA, 25 bp, Rattus norvegicus
gttacttgccaatcattctaagctg

SEQ ID NO: 522430 - DNA, 25 bp, Rattus norvegicus
gttacttggaatatgccctccaggc

SEQ ID NO: 522431 - DNA, 25 bp, Rattus norvegicus
gttacttggaatttgccctccaggc

SEQ ID NO: 522432 - DNA, 25 bp, Rattus norvegicus
gttacttggacaatggtcacttata

SEQ ID NO: 522433 - DNA, 25 bp, Rattus norvegicus
gttacttggacattggtcacttata

SEQ ID NO: 522434 - DNA, 25 bp, Rattus norvegicus
gttacttgtagcacagcctggtgat

SEQ ID NO: 522435 - DNA, 25 bp, Rattus norvegicus
gttacttgtagctcagcctggtgat

SEQ ID NO: 522436 - DNA, 25 bp, Rattus norvegicus
gttacttgtgatatccataaacaac

SEQ ID NO: 522437 - DNA, 25 bp, Rattus norvegicus
gttacttgtgatttccataaacaac

SEQ ID NO: 522438 - DNA, 25 bp, Rattus norvegicus
gttacttgtgctagtgagtcaccta

SEQ ID NO: 522439 - DNA, 25 bp, Rattus norvegicus
gttacttgtgcttgtgagtcaccta

SEQ ID NO: 522440 - DNA, 25 bp, Rattus norvegicus
gttacttgttttcactcatgtgcca

SEQ ID NO: 522441 - DNA, 25 bp, Rattus norvegicus
gttacttgttttgactcatgtgcca

SEQ ID NO: 522442 - DNA, 25 bp, Rattus norvegicus
gttactttacctctgttgacttcca

SEQ ID NO: 522443 - DNA, 25 bp, Rattus norvegicus
gttactttacctgtgttgacttcca

SEQ ID NO: 522444 - DNA, 25 bp, Rattus norvegicus
gttactttataactatgtctgctaa

SEQ ID NO: 522445 - DNA, 25 bp, Rattus norvegicus
gttactttataagtatgtctgctaa

SEQ ID NO: 522446 - DNA, 25 bp, Rattus norvegicus
gttactttcacgatatcttgtttcc

SEQ ID NO: 522447 - DNA, 25 bp, Rattus norvegicus
gttactttcacgttatcttgtttcc

SEQ ID NO: 522448 - DNA, 25 bp, Rattus norvegicus
gttactttccatacattttgcaaac

SEQ ID NO: 522449 - DNA, 25 bp, Rattus norvegicus
gttactttccattcattttgcaaac

SEQ ID NO: 522450 - DNA, 25 bp, Rattus norvegicus
gttactttctaaatcagctcttgct

SEQ ID NO: 522451 - DNA, 25 bp, Rattus norvegicus
gttactttctaattcagctcttgct

SEQ ID NO: 522452 - DNA, 25 bp, Rattus norvegicus
gttactttcttcatctatttgtata

SEQ ID NO: 522453 - DNA, 25 bp, Rattus norvegicus
gttactttcttcttctatttgtata

SEQ ID NO: 522454 - DNA, 25 bp, Rattus norvegicus
gttactttgaagagtttacaactgc

SEQ ID NO: 522455 - DNA, 25 bp, Rattus norvegicus
gttactttgaagtgtttacaactgc

SEQ ID NO: 522456 - DNA, 25 bp, Rattus norvegicus
gttactttgaccattccaaggatgt

SEQ ID NO: 522457 - DNA, 25 bp, Rattus norvegicus
gttactttgacctttccaaggatgt

SEQ ID NO: 522458 - DNA, 25 bp, Rattus norvegicus
gttactttgttaaatcccattggct

SEQ ID NO: 522459 - DNA, 25 bp, Rattus norvegicus
gttactttgttatatcccattggct

SEQ ID NO: 522460 - DNA, 25 bp, Rattus norvegicus
gttacttttcaaccttgtacttaag

SEQ ID NO: 522461 - DNA, 25 bp, Rattus norvegicus
gttacttttcaagcttgtacttaag

SEQ ID NO: 522462 - DNA, 25 bp, Rattus norvegicus
gttacttttctgctcttttcatgcc

SEQ ID NO: 522463 - DNA, 25 bp, Rattus norvegicus
gttacttttctggtcttttcatgcc

SEQ ID NO: 522464 - DNA, 25 bp, Rattus norvegicus
gttagaaaatccagctctctgtgct

SEQ ID NO: 522465 - DNA, 25 bp, Rattus norvegicus
gttagaaaatcctgctctctgtgct

SEQ ID NO: 522466 - DNA, 25 bp, Rattus norvegicus
gttagaaacattaactggctgtctg

SEQ ID NO: 522467 - DNA, 25 bp, Rattus norvegicus
gttagaaacatttactggctgtctg

SEQ ID NO: 522468 - DNA, 25 bp, Rattus norvegicus
gttagaaagatcacggtggctcctt

SEQ ID NO: 522469 - DNA, 25 bp, Rattus norvegicus
gttagaaagatctcggtggctcctt

SEQ ID NO: 522470 - DNA, 25 bp, Rattus norvegicus
gttagaaaggccacggacctccaag

SEQ ID NO: 522471 - DNA, 25 bp, Rattus norvegicus
gttagaaaggcctcggacctccaag

SEQ ID NO: 522472 - DNA, 25 bp, Rattus norvegicus
gttagaaatctaagcacacgaggtt

SEQ ID NO: 522473 - DNA, 25 bp, Rattus norvegicus
gttagaaatctatgcacacgaggtt

SEQ ID NO: 522474 - DNA, 25 bp, Rattus norvegicus
gttagaacagcccagcaaacaatct

SEQ ID NO: 522475 - DNA, 25 bp, Rattus norvegicus
gttagaacagccgagcaaacaatct

SEQ ID NO: 522476 - DNA, 25 bp, Rattus norvegicus
gttagaacagcgaatgcccatgcct

SEQ ID NO: 522477 - DNA, 25 bp, Rattus norvegicus
gttagaacagcgtatgcccatgcct

SEQ ID NO: 522478 - DNA, 25 bp, Rattus norvegicus
gttagaacatacagcagccttgcct

SEQ ID NO: 522479 - DNA, 25 bp, Rattus norvegicus
gttagaacatactgcagccttgcct

SEQ ID NO: 522480 - DNA, 25 bp, Rattus norvegicus
gttagaacatgacttctttggctct

SEQ ID NO: 522481 - DNA, 25 bp, Rattus norvegicus
gttagaacatgagttctttggctct

SEQ ID NO: 522482 - DNA, 25 bp, Rattus norvegicus
gttagaacgttcaagactccatcca

SEQ ID NO: 522483 - DNA, 25 bp, Rattus norvegicus
gttagaacgttctagactccatcca

SEQ ID NO: 522484 - DNA, 25 bp, Rattus norvegicus
gttagaactctgcaacccgtatggt

SEQ ID NO: 522485 - DNA, 25 bp, Rattus norvegicus
gttagaactctggaacccgtatggt

SEQ ID NO: 522486 - DNA, 25 bp, Rattus norvegicus
gttagaacttctctaccaactttga

SEQ ID NO: 522487 - DNA, 25 bp, Rattus norvegicus
gttagaacttctgtaccaactttga

SEQ ID NO: 522488 - DNA, 25 bp, Rattus norvegicus
gttagaagaactattccgcgatgct

SEQ ID NO: 522489 - DNA, 25 bp, Rattus norvegicus
gttagaagaacttttccgcgatgct

SEQ ID NO: 522490 - DNA, 25 bp, Rattus norvegicus
gttagaagatgtaggccctttcctg

SEQ ID NO: 522491 - DNA, 25 bp, Rattus norvegicus
gttagaagatgttggccctttcctg

SEQ ID NO: 522492 - DNA, 25 bp, Rattus norvegicus
gttagaagcaatcctgctctttcag

SEQ ID NO: 522493 - DNA, 25 bp, Rattus norvegicus
gttagaagcaatgctgctctttcag

SEQ ID NO: 522494 - DNA, 25 bp, Rattus norvegicus
gttagaagtcgaacctgacactgac

SEQ ID NO: 522495 - DNA, 25 bp, Rattus norvegicus
gttagaagtcgatcctgacactgac

SEQ ID NO: 522496 - DNA, 25 bp, Rattus norvegicus
gttagaatcattcgcgactgacgct

SEQ ID NO: 522497 - DNA, 25 bp, Rattus norvegicus
gttagaatcattggcgactgacgct

SEQ ID NO: 522498 - DNA, 25 bp, Rattus norvegicus
gttagaatcttgattgtaggttgaa

SEQ ID NO: 522499 - DNA, 25 bp, Rattus norvegicus
gttagaatcttgtttgtaggttgaa

SEQ ID NO: 522500 - DNA, 25 bp, Rattus norvegicus
gttagacaaaagctcgtttccctgc

SEQ ID NO: 522501 - DNA, 25 bp, Rattus norvegicus
gttagacaaaaggtcgtttccctgc

SEQ ID NO: 522502 - DNA, 25 bp, Rattus norvegicus
gttagacacagacaagccttaaagt

SEQ ID NO: 522503 - DNA, 25 bp, Rattus norvegicus
gttagacacagagaagccttaaagt

SEQ ID NO: 522504 - DNA, 25 bp, Rattus norvegicus
gttagacacttcaccgtgagatatt

SEQ ID NO: 522505 - DNA, 25 bp, Rattus norvegicus
gttagacacttctccgtgagatatt

SEQ ID NO: 522506 - DNA, 25 bp, Rattus norvegicus
gttagacacttgcactcagggccta

SEQ ID NO: 522507 - DNA, 25 bp, Rattus norvegicus
gttagacacttggactcagggccta

SEQ ID NO: 522508 - DNA, 25 bp, Rattus norvegicus
gttagacatcgtctctatgactgat

SEQ ID NO: 522509 - DNA, 25 bp, Rattus norvegicus
gttagacatcgtgtctatgactgat

SEQ ID NO: 522510 - DNA, 25 bp, Rattus norvegicus
gttagacatggcagtgcaggccctc

SEQ ID NO: 522511 - DNA, 25 bp, Rattus norvegicus
gttagacatggctgtgcaggccctc

SEQ ID NO: 522512 - DNA, 25 bp, Rattus norvegicus
gttagacattgcaagcactgcgagg

SEQ ID NO: 522513 - DNA, 25 bp, Rattus norvegicus
gttagacattgcataatcccctttt

SEQ ID NO: 522514 - DNA, 25 bp, Rattus norvegicus
gttagacattgctagcactgcgagg

SEQ ID NO: 522515 - DNA, 25 bp, Rattus norvegicus
gttagacattgcttaatcccctttt

SEQ ID NO: 522516 - DNA, 25 bp, Rattus norvegicus
gttagaccaaggcacagttttgttt

SEQ ID NO: 522517 - DNA, 25 bp, Rattus norvegicus
gttagaccaagggacagttttgttt

SEQ ID NO: 522518 - DNA, 25 bp, Rattus norvegicus
gttagaccataaagtagcagctgat

SEQ ID NO: 522519 - DNA, 25 bp, Rattus norvegicus
gttagaccataatgtagcagctgat

SEQ ID NO: 522520 - DNA, 25 bp, Rattus norvegicus
gttagacccaggacctctactgagg

SEQ ID NO: 522521 - DNA, 25 bp, Rattus norvegicus
gttagacccaggtcctctactgagg

SEQ ID NO: 522522 - DNA, 25 bp, Rattus norvegicus
gttagacctaggcagatgacttgac

SEQ ID NO: 522523 - DNA, 25 bp, Rattus norvegicus
gttagacctagggagatgacttgac

SEQ ID NO: 522524 - DNA, 25 bp, Rattus norvegicus
gttagacctgccagaggcctgagca

SEQ ID NO: 522525 - DNA, 25 bp, Rattus norvegicus
gttagacctgcctgaggcctgagca

SEQ ID NO: 522526 - DNA, 25 bp, Rattus norvegicus
gttagacgaacccaccaacatgctg

SEQ ID NO: 522527 - DNA, 25 bp, Rattus norvegicus
gttagacgaaccgaccaacatgctg

SEQ ID NO: 522528 - DNA, 25 bp, Rattus norvegicus
gttagactacttcctgtcgataagg

SEQ ID NO: 522529 - DNA, 25 bp, Rattus norvegicus
gttagactacttgctgtcgataagg

SEQ ID NO: 522530 - DNA, 25 bp, Rattus norvegicus
gttagactcagacgaccctgaccca

SEQ ID NO: 522531 - DNA, 25 bp, Rattus norvegicus
gttagactcagaggaccctgaccca

SEQ ID NO: 522532 - DNA, 25 bp, Rattus norvegicus
gttagactgtggagaatgcctgtga

SEQ ID NO: 522533 - DNA, 25 bp, Rattus norvegicus
gttagactgtggtgaatgcctgtga

SEQ ID NO: 522534 - DNA, 25 bp, Rattus norvegicus
gttagacttctacattaatttcata

SEQ ID NO: 522535 - DNA, 25 bp, Rattus norvegicus
gttagacttctagattaatttcata

SEQ ID NO: 522536 - DNA, 25 bp, Rattus norvegicus
gttagacttcttcttttcattcaaa

SEQ ID NO: 522537 - DNA, 25 bp, Rattus norvegicus
gttagacttcttgttttcattcaaa

SEQ ID NO: 522538 - DNA, 25 bp, Rattus norvegicus
gttagacttgaacccaacgtgcaat

SEQ ID NO: 522539 - DNA, 25 bp, Rattus norvegicus
gttagacttgaagccaacgtgcaat

SEQ ID NO: 522540 - DNA, 25 bp, Rattus norvegicus
gttagacttgctccagtgggtcatt

SEQ ID NO: 522541 - DNA, 25 bp, Rattus norvegicus
gttagacttgctgcagtgggtcatt

SEQ ID NO: 522542 - DNA, 25 bp, Rattus norvegicus
gttagagacaccatctgctctggac

SEQ ID NO: 522543 - DNA, 25 bp, Rattus norvegicus
gttagagacaccttctgctctggac

SEQ ID NO: 522544 - DNA, 25 bp, Rattus norvegicus
gttagagaggttccggctcatttgc

SEQ ID NO: 522545 - DNA, 25 bp, Rattus norvegicus
gttagagaggttgcggctcatttgc

SEQ ID NO: 522546 - DNA, 25 bp, Rattus norvegicus
gttagagcaactatacggacaccaa

SEQ ID NO: 522547 - DNA, 25 bp, Rattus norvegicus
gttagagcaactttacggacaccaa

SEQ ID NO: 522548 - DNA, 25 bp, Rattus norvegicus
gttagagcaatcagagctggactgt

SEQ ID NO: 522549 - DNA, 25 bp, Rattus norvegicus
gttagagcaatctgagctggactgt

SEQ ID NO: 522550 - DNA, 25 bp, Rattus norvegicus
gttagagccctactactgcataaac

SEQ ID NO: 522551 - DNA, 25 bp, Rattus norvegicus
gttagagccctagtactgcataaac

SEQ ID NO: 522552 - DNA, 25 bp, Rattus norvegicus
gttagagcctgaattggcaccatgg

SEQ ID NO: 522553 - DNA, 25 bp, Rattus norvegicus
gttagagcctgatttggcaccatgg

SEQ ID NO: 522554 - DNA, 25 bp, Rattus norvegicus
gttagagctacacgcggttgcgaac

SEQ ID NO: 522555 - DNA, 25 bp, Rattus norvegicus
gttagagctacaggcggttgcgaac

SEQ ID NO: 522556 - DNA, 25 bp, Rattus norvegicus
gttagagctatccatgctgccgtcc

SEQ ID NO: 522557 - DNA, 25 bp, Rattus norvegicus
gttagagctatcgatgctgccgtcc

SEQ ID NO: 522558 - DNA, 25 bp, Rattus norvegicus
gttagagctcctaagaagccctgac

SEQ ID NO: 522559 - DNA, 25 bp, Rattus norvegicus
gttagagctccttagaagccctgac

SEQ ID NO: 522560 - DNA, 25 bp, Rattus norvegicus
gttagagcttacacattagcaagtt

SEQ ID NO: 522561 - DNA, 25 bp, Rattus norvegicus
gttagagcttactcattagcaagtt

SEQ ID NO: 522562 - DNA, 25 bp, Rattus norvegicus
gttagaggaaatacactccctccta

SEQ ID NO: 522563 - DNA, 25 bp, Rattus norvegicus
gttagaggaaattcactccctccta

SEQ ID NO: 522564 - DNA, 25 bp, Rattus norvegicus
gttagaggacatctgttttcacaat

SEQ ID NO: 522565 - DNA, 25 bp, Rattus norvegicus
gttagaggacatgtgttttcacaat

SEQ ID NO: 522566 - DNA, 25 bp, Rattus norvegicus
gttagaggagcccaccggacctgac

SEQ ID NO: 522567 - DNA, 25 bp, Rattus norvegicus
gttagaggagcccagttgttaccat

SEQ ID NO: 522568 - DNA, 25 bp, Rattus norvegicus
gttagaggagccgaccggacctgac

SEQ ID NO: 522569 - DNA, 25 bp, Rattus norvegicus
gttagaggagccgagttgttaccat

SEQ ID NO: 522570 - DNA, 25 bp, Rattus norvegicus
gttagaggatgtcacccgtgcgcta

SEQ ID NO: 522571 - DNA, 25 bp, Rattus norvegicus
gttagaggatgtgacccgtgcgcta

SEQ ID NO: 522572 - DNA, 25 bp, Rattus norvegicus
gttagaggtcttaatgccagcctgt

SEQ ID NO: 522573 - DNA, 25 bp, Rattus norvegicus
gttagaggtctttatgccagcctgt

SEQ ID NO: 522574 - DNA, 25 bp, Rattus norvegicus
gttagagtccgaatgaccccgcggg

SEQ ID NO: 522575 - DNA, 25 bp, Rattus norvegicus
gttagagtccgattgaccccgcggg

SEQ ID NO: 522576 - DNA, 25 bp, Rattus norvegicus
gttagagtctgcctagccgtggccc

SEQ ID NO: 522577 - DNA, 25 bp, Rattus norvegicus
gttagagtctgcgtagccgtggccc

SEQ ID NO: 522578 - DNA, 25 bp, Rattus norvegicus
gttagagtgcccacaggtagtctgt

SEQ ID NO: 522579 - DNA, 25 bp, Rattus norvegicus
gttagagtgccctcaggtagtctgt

SEQ ID NO: 522580 - DNA, 25 bp, Rattus norvegicus
gttagagttctcacgctatgacctt

SEQ ID NO: 522581 - DNA, 25 bp, Rattus norvegicus
gttagagttctctcgctatgacctt

SEQ ID NO: 522582 - DNA, 25 bp, Rattus norvegicus
gttagataccacaccaaggtccggg

SEQ ID NO: 522583 - DNA, 25 bp, Rattus norvegicus
gttagataccactccaaggtccggg

SEQ ID NO: 522584 - DNA, 25 bp, Rattus norvegicus
gttagatacctcaatgcttacactg

SEQ ID NO: 522585 - DNA, 25 bp, Rattus norvegicus
gttagatacctctatgcttacactg

SEQ ID NO: 522586 - DNA, 25 bp, Rattus norvegicus
gttagatagtatatgggagccttga

SEQ ID NO: 522587 - DNA, 25 bp, Rattus norvegicus
gttagatagtatttgggagccttga

SEQ ID NO: 522588 - DNA, 25 bp, Rattus norvegicus
gttagatatcctaccacactttgtt

SEQ ID NO: 522589 - DNA, 25 bp, Rattus norvegicus
gttagatatccttccacactttgtt

SEQ ID NO: 522590 - DNA, 25 bp, Rattus norvegicus
gttagatcaccactgttagccatgt

SEQ ID NO: 522591 - DNA, 25 bp, Rattus norvegicus
gttagatcaccagtgttagccatgt

SEQ ID NO: 522592 - DNA, 25 bp, Rattus norvegicus
gttagatccccgaatccaggtaaag

SEQ ID NO: 522593 - DNA, 25 bp, Rattus norvegicus
gttagatccccgtatccaggtaaag

SEQ ID NO: 522594 - DNA, 25 bp, Rattus norvegicus
gttagatcctacactgtgtattgac

SEQ ID NO: 522595 - DNA, 25 bp, Rattus norvegicus
gttagatcctactctgtgtattgac

SEQ ID NO: 522596 - DNA, 25 bp, Rattus norvegicus
gttagatcctggcaattgccaccaa

SEQ ID NO: 522597 - DNA, 25 bp, Rattus norvegicus
gttagatcctgggaattgccaccaa

SEQ ID NO: 522598 - DNA, 25 bp, Rattus norvegicus
gttagatctaatctcttgggcacga

SEQ ID NO: 522599 - DNA, 25 bp, Rattus norvegicus
gttagatctaatgtcttgggcacga

SEQ ID NO: 522600 - DNA, 25 bp, Rattus norvegicus
gttagatctttactctgacacaaca

SEQ ID NO: 522601 - DNA, 25 bp, Rattus norvegicus
gttagatctttagtctgacacaaca

SEQ ID NO: 522602 - DNA, 25 bp, Rattus norvegicus
gttagatggtgtattctgtctcccc

SEQ ID NO: 522603 - DNA, 25 bp, Rattus norvegicus
gttagatggtgttttctgtctcccc

SEQ ID NO: 522604 - DNA, 25 bp, Rattus norvegicus
gttagattatcaagctttgtttact

SEQ ID NO: 522605 - DNA, 25 bp, Rattus norvegicus
gttagattatcatgctttgtttact

SEQ ID NO: 522606 - DNA, 25 bp, Rattus norvegicus
gttagattgaccaaccagggcccag

SEQ ID NO: 522607 - DNA, 25 bp, Rattus norvegicus
gttagattgacctaccagggcccag

SEQ ID NO: 522608 - DNA, 25 bp, Rattus norvegicus
gttagatttcttctgtcctgacatt

SEQ ID NO: 522609 - DNA, 25 bp, Rattus norvegicus
gttagatttcttgtgtcctgacatt

SEQ ID NO: 522610 - DNA, 25 bp, Rattus norvegicus
gttagatttgcccagtaagtgccct

SEQ ID NO: 522611 - DNA, 25 bp, Rattus norvegicus
gttagatttgccgagtaagtgccct

SEQ ID NO: 522612 - DNA, 25 bp, Rattus norvegicus
gttagatttggaatctccagctcct

SEQ ID NO: 522613 - DNA, 25 bp, Rattus norvegicus
gttagatttggattctccagctcct

SEQ ID NO: 522614 - DNA, 25 bp, Rattus norvegicus
gttagcaaaacccagcaagcctgct

SEQ ID NO: 522615 - DNA, 25 bp, Rattus norvegicus
gttagcaaaaccgagcaagcctgct

SEQ ID NO: 522616 - DNA, 25 bp, Rattus norvegicus
gttagcaaagttacgcggagccgcg

SEQ ID NO: 522617 - DNA, 25 bp, Rattus norvegicus
gttagcaaagtttcgcggagccgcg

SEQ ID NO: 522618 - DNA, 25 bp, Rattus norvegicus
gttagcaagtagatgagtatctctc

SEQ ID NO: 522619 - DNA, 25 bp, Rattus norvegicus
gttagcaagtagttgagtatctctc

SEQ ID NO: 522620 - DNA, 25 bp, Rattus norvegicus
gttagcaatgtcagcttcgtttcca

SEQ ID NO: 522621 - DNA, 25 bp, Rattus norvegicus
gttagcaatgtctgcttcgtttcca

SEQ ID NO: 522622 - DNA, 25 bp, Rattus norvegicus
gttagcaatttcatttgtgccattt

SEQ ID NO: 522623 - DNA, 25 bp, Rattus norvegicus
gttagcaatttcttttgtgccattt

SEQ ID NO: 522624 - DNA, 25 bp, Rattus norvegicus
gttagcacactacttcattcattta

SEQ ID NO: 522625 - DNA, 25 bp, Rattus norvegicus
gttagcacactagttcattcattta

SEQ ID NO: 522626 - DNA, 25 bp, Rattus norvegicus
gttagcacagtacattttcatgact

SEQ ID NO: 522627 - DNA, 25 bp, Rattus norvegicus
gttagcacagtagattttcatgact

SEQ ID NO: 522628 - DNA, 25 bp, Rattus norvegicus
gttagcaccaaacctgtgttcagtg

SEQ ID NO: 522629 - DNA, 25 bp, Rattus norvegicus
gttagcaccaaagctgtgttcagtg

SEQ ID NO: 522630 - DNA, 25 bp, Rattus norvegicus
gttagcaccgcgaccattgaaataa

SEQ ID NO: 522631 - DNA, 25 bp, Rattus norvegicus
gttagcaccgcgtccattgaaataa

SEQ ID NO: 522632 - DNA, 25 bp, Rattus norvegicus
gttagcacgggcaataaccgacagt

SEQ ID NO: 522633 - DNA, 25 bp, Rattus norvegicus
gttagcacgggctataaccgacagt

SEQ ID NO: 522634 - DNA, 25 bp, Rattus norvegicus
gttagcactaacacaccgtgatcct

SEQ ID NO: 522635 - DNA, 25 bp, Rattus norvegicus
gttagcactaactcaccgtgatcct

SEQ ID NO: 522636 - DNA, 25 bp, Rattus norvegicus
gttagcactatactccttttccagt

SEQ ID NO: 522637 - DNA, 25 bp, Rattus norvegicus
gttagcactatagtccttttccagt

SEQ ID NO: 522638 - DNA, 25 bp, Rattus norvegicus
gttagcactgcaaaagcccaaagcc

SEQ ID NO: 522639 - DNA, 25 bp, Rattus norvegicus
gttagcactgcactggcatccagat

SEQ ID NO: 522640 - DNA, 25 bp, Rattus norvegicus
gttagcactgcagtggcatccagat

SEQ ID NO: 522641 - DNA, 25 bp, Rattus norvegicus
gttagcactgcataagcccaaagcc

SEQ ID NO: 522642 - DNA, 25 bp, Rattus norvegicus
gttagcactgggaccaggcctgaaa

SEQ ID NO: 522643 - DNA, 25 bp, Rattus norvegicus
gttagcactgggtccaggcctgaaa

SEQ ID NO: 522644 - DNA, 25 bp, Rattus norvegicus
gttagcacttcaaaacacagatcct

SEQ ID NO: 522645 - DNA, 25 bp, Rattus norvegicus
gttagcacttcataacacagatcct

SEQ ID NO: 522646 - DNA, 25 bp, Rattus norvegicus
gttagcagaattaatctattgcatg

SEQ ID NO: 522647 - DNA, 25 bp, Rattus norvegicus
gttagcagaatttatctattgcatg

SEQ ID NO: 522648 - DNA, 25 bp, Rattus norvegicus
gttagcagagtgactagggccatct

SEQ ID NO: 522649 - DNA, 25 bp, Rattus norvegicus
gttagcagagtgtctagggccatct

SEQ ID NO: 522650 - DNA, 25 bp, Rattus norvegicus
gttagcagcgatatcctcagggaca

SEQ ID NO: 522651 - DNA, 25 bp, Rattus norvegicus
gttagcagcgatttcctcagggaca

SEQ ID NO: 522652 - DNA, 25 bp, Rattus norvegicus
gttagcagctgacaatgatgcggct

SEQ ID NO: 522653 - DNA, 25 bp, Rattus norvegicus
gttagcagctgagaatgatgcggct

SEQ ID NO: 522654 - DNA, 25 bp, Rattus norvegicus
gttagcagggctatcacagcagatt

SEQ ID NO: 522655 - DNA, 25 bp, Rattus norvegicus
gttagcagggctttcacagcagatt

SEQ ID NO: 522656 - DNA, 25 bp, Rattus norvegicus
gttagcagtacacatccagcacagg

SEQ ID NO: 522657 - DNA, 25 bp, Rattus norvegicus
gttagcagtacagatccagcacagg

SEQ ID NO: 522658 - DNA, 25 bp, Rattus norvegicus
gttagcagtaccaagcaggcttcca

SEQ ID NO: 522659 - DNA, 25 bp, Rattus norvegicus
gttagcagtacctagcaggcttcca

SEQ ID NO: 522660 - DNA, 25 bp, Rattus norvegicus
gttagcagtattcagccttgtgttc

SEQ ID NO: 522661 - DNA, 25 bp, Rattus norvegicus
gttagcagtattgagccttgtgttc

SEQ ID NO: 522662 - DNA, 25 bp, Rattus norvegicus
gttagcagtcgtccattaacactgt

SEQ ID NO: 522663 - DNA, 25 bp, Rattus norvegicus
gttagcagtcgtgcattaacactgt

SEQ ID NO: 522664 - DNA, 25 bp, Rattus norvegicus
gttagcatatagacattctcccatt

SEQ ID NO: 522665 - DNA, 25 bp, Rattus norvegicus
gttagcatatagtcattctcccatt

SEQ ID NO: 522666 - DNA, 25 bp, Rattus norvegicus
gttagcatctgaaaccggtagaggt

SEQ ID NO: 522667 - DNA, 25 bp, Rattus norvegicus
gttagcatctgataccggtagaggt

SEQ ID NO: 522668 - DNA, 25 bp, Rattus norvegicus
gttagcattatgactctgtgtgtga

SEQ ID NO: 522669 - DNA, 25 bp, Rattus norvegicus
gttagcattatgtctctgtgtgtga

SEQ ID NO: 522670 - DNA, 25 bp, Rattus norvegicus
gttagcattcacatcctgggtatta

SEQ ID NO: 522671 - DNA, 25 bp, Rattus norvegicus
gttagcattcacttcctgggtatta

SEQ ID NO: 522672 - DNA, 25 bp, Rattus norvegicus
gttagcattcatcacagtacggtgt

SEQ ID NO: 522673 - DNA, 25 bp, Rattus norvegicus
gttagcattcatgacagtacggtgt

SEQ ID NO: 522674 - DNA, 25 bp, Rattus norvegicus
gttagcattgctattgagtgtacaa

SEQ ID NO: 522675 - DNA, 25 bp, Rattus norvegicus
gttagcattgcttttgagtgtacaa

SEQ ID NO: 522676 - DNA, 25 bp, Rattus norvegicus
gttagcatttccatgggtcacacat

SEQ ID NO: 522677 - DNA, 25 bp, Rattus norvegicus
gttagcatttccttgggtcacacat

SEQ ID NO: 522678 - DNA, 25 bp, Rattus norvegicus
gttagcatttctcatagggagcatt

SEQ ID NO: 522679 - DNA, 25 bp, Rattus norvegicus
gttagcatttctgatagggagcatt

SEQ ID NO: 522680 - DNA, 25 bp, Rattus norvegicus
gttagcattttaaagagacccctca

SEQ ID NO: 522681 - DNA, 25 bp, Rattus norvegicus
gttagcattttatagagacccctca

SEQ ID NO: 522682 - DNA, 25 bp, Rattus norvegicus
gttagcattttcagcattcctgtga

SEQ ID NO: 522683 - DNA, 25 bp, Rattus norvegicus
gttagcattttctgcattcctgtga

SEQ ID NO: 522684 - DNA, 25 bp, Rattus norvegicus
gttagccaacagacagagcaaggaa

SEQ ID NO: 522685 - DNA, 25 bp, Rattus norvegicus
gttagccaacagtcagagcaaggaa

SEQ ID NO: 522686 - DNA, 25 bp, Rattus norvegicus
gttagccacctaacatgcatgttct

SEQ ID NO: 522687 - DNA, 25 bp, Rattus norvegicus
gttagccacctatcatgcatgttct

SEQ ID NO: 522688 - DNA, 25 bp, Rattus norvegicus
gttagccagcttcacagtacaccct

SEQ ID NO: 522689 - DNA, 25 bp, Rattus norvegicus
gttagccagcttgacagtacaccct

SEQ ID NO: 522690 - DNA, 25 bp, Rattus norvegicus
gttagccaggtgcagaagccagaaa

SEQ ID NO: 522691 - DNA, 25 bp, Rattus norvegicus
gttagccaggtggagaagccagaaa

SEQ ID NO: 522692 - DNA, 25 bp, Rattus norvegicus
gttagccagtaaccgctccttggga

SEQ ID NO: 522693 - DNA, 25 bp, Rattus norvegicus
gttagccagtaagcgctccttggga

SEQ ID NO: 522694 - DNA, 25 bp, Rattus norvegicus
gttagccagtgacaacatccccagc

SEQ ID NO: 522695 - DNA, 25 bp, Rattus norvegicus
gttagccagtgagaacatccccagc

SEQ ID NO: 522696 - DNA, 25 bp, Rattus norvegicus
gttagccatctgatatttttacttt

SEQ ID NO: 522697 - DNA, 25 bp, Rattus norvegicus
gttagccatctgttatttttacttt

SEQ ID NO: 522698 - DNA, 25 bp, Rattus norvegicus
gttagccatggcaccagtgaacatc

SEQ ID NO: 522699 - DNA, 25 bp, Rattus norvegicus
gttagccatggctccagtgaacatc

SEQ ID NO: 522700 - DNA, 25 bp, Rattus norvegicus
gttagcccaagaaacctctgaagtg

SEQ ID NO: 522701 - DNA, 25 bp, Rattus norvegicus
gttagcccaagatacctctgaagtg

SEQ ID NO: 522702 - DNA, 25 bp, Rattus norvegicus
gttagcccagtaagcggatgtgacg

SEQ ID NO: 522703 - DNA, 25 bp, Rattus norvegicus
gttagcccagtaattctgaagcgtg

SEQ ID NO: 522704 - DNA, 25 bp, Rattus norvegicus
gttagcccagtatgcggatgtgacg

SEQ ID NO: 522705 - DNA, 25 bp, Rattus norvegicus
gttagcccagtatttctgaagcgtg

SEQ ID NO: 522706 - DNA, 25 bp, Rattus norvegicus
gttagcccctttacagaatatcttt

SEQ ID NO: 522707 - DNA, 25 bp, Rattus norvegicus
gttagccccttttcagaatatcttt

SEQ ID NO: 522708 - DNA, 25 bp, Rattus norvegicus
gttagccctcagagtcttatttctc

SEQ ID NO: 522709 - DNA, 25 bp, Rattus norvegicus
gttagccctcagtgtcttatttctc

SEQ ID NO: 522710 - DNA, 25 bp, Rattus norvegicus
gttagccctctgcttagtgtgacta

SEQ ID NO: 522711 - DNA, 25 bp, Rattus norvegicus
gttagccctctggttagtgtgacta

SEQ ID NO: 522712 - DNA, 25 bp, Rattus norvegicus
gttagcctaaatacctagttggtca

SEQ ID NO: 522713 - DNA, 25 bp, Rattus norvegicus
gttagcctaaattcctagttggtca

SEQ ID NO: 522714 - DNA, 25 bp, Rattus norvegicus
gttagcctagctacctttttgagat

SEQ ID NO: 522715 - DNA, 25 bp, Rattus norvegicus
gttagcctagcttcctttttgagat

SEQ ID NO: 522716 - DNA, 25 bp, Rattus norvegicus
gttagcctcctgaccttgaaggtac

SEQ ID NO: 522717 - DNA, 25 bp, Rattus norvegicus
gttagcctcctgtccttgaaggtac

SEQ ID NO: 522718 - DNA, 25 bp, Rattus norvegicus
gttagcctcggtactaataggtatg

SEQ ID NO: 522719 - DNA, 25 bp, Rattus norvegicus
gttagcctcggttctaataggtatg

SEQ ID NO: 522720 - DNA, 25 bp, Rattus norvegicus
gttagcctgaggagccagcagagct

SEQ ID NO: 522721 - DNA, 25 bp, Rattus norvegicus
gttagcctgaggtgccagcagagct

SEQ ID NO: 522722 - DNA, 25 bp, Rattus norvegicus
gttagcctgcagacatcacatgact

SEQ ID NO: 522723 - DNA, 25 bp, Rattus norvegicus
gttagcctgcagtcatcacatgact

SEQ ID NO: 522724 - DNA, 25 bp, Rattus norvegicus
gttagcctgcttacataaatctccc

SEQ ID NO: 522725 - DNA, 25 bp, Rattus norvegicus
gttagcctgctttcataaatctccc

SEQ ID NO: 522726 - DNA, 25 bp, Rattus norvegicus
gttagcctgtgacaatttgcacttt

SEQ ID NO: 522727 - DNA, 25 bp, Rattus norvegicus
gttagcctgtgagaatttgcacttt

SEQ ID NO: 522728 - DNA, 25 bp, Rattus norvegicus
gttagccttaggatcacagtgcata

SEQ ID NO: 522729 - DNA, 25 bp, Rattus norvegicus
gttagccttaggttcacagtgcata

SEQ ID NO: 522730 - DNA, 25 bp, Rattus norvegicus
gttagccttgaaaccacgtacacac

SEQ ID NO: 522731 - DNA, 25 bp, Rattus norvegicus
gttagccttgaatccacgtacacac

SEQ ID NO: 522732 - DNA, 25 bp, Rattus norvegicus
gttagccttgctattaagctgaaaa

SEQ ID NO: 522733 - DNA, 25 bp, Rattus norvegicus
gttagccttgcttttaagctgaaaa

SEQ ID NO: 522734 - DNA, 25 bp, Rattus norvegicus
gttagcgcggtaaaccaatcccgag

SEQ ID NO: 522735 - DNA, 25 bp, Rattus norvegicus
gttagcgcggtataccaatcccgag

SEQ ID NO: 522736 - DNA, 25 bp, Rattus norvegicus
gttagcgctgcaatttcaaaggtca

SEQ ID NO: 522737 - DNA, 25 bp, Rattus norvegicus
gttagcgctgcattttcaaaggtca

SEQ ID NO: 522738 - DNA, 25 bp, Rattus norvegicus
gttagcgcttttaatctgcagtctt

SEQ ID NO: 522739 - DNA, 25 bp, Rattus norvegicus
gttagcgctttttatctgcagtctt

SEQ ID NO: 522740 - DNA, 25 bp, Rattus norvegicus
gttagcggaggccaccccatgtgat

SEQ ID NO: 522741 - DNA, 25 bp, Rattus norvegicus
gttagcggaggcgaccccatgtgat

SEQ ID NO: 522742 - DNA, 25 bp, Rattus norvegicus
gttagcggatcaagtaccagctgat

SEQ ID NO: 522743 - DNA, 25 bp, Rattus norvegicus
gttagcggatcatgtaccagctgat

SEQ ID NO: 522744 - DNA, 25 bp, Rattus norvegicus
gttagcggtaacagtgctgcagcag

SEQ ID NO: 522745 - DNA, 25 bp, Rattus norvegicus
gttagcggtaactgtgctgcagcag

SEQ ID NO: 522746 - DNA, 25 bp, Rattus norvegicus
gttagcgtgtacagttttcagccag

SEQ ID NO: 522747 - DNA, 25 bp, Rattus norvegicus
gttagcgtgtactgttttcagccag

SEQ ID NO: 522748 - DNA, 25 bp, Rattus norvegicus
gttagcgttcctatctggagcaatc

SEQ ID NO: 522749 - DNA, 25 bp, Rattus norvegicus
gttagcgttcctttctggagcaatc

SEQ ID NO: 522750 - DNA, 25 bp, Rattus norvegicus
gttagctaagctcacacatttgtaa

SEQ ID NO: 522751 - DNA, 25 bp, Rattus norvegicus
gttagctaagctgacacatttgtaa

SEQ ID NO: 522752 - DNA, 25 bp, Rattus norvegicus
gttagctacttaaggcatgctgccc

SEQ ID NO: 522753 - DNA, 25 bp, Rattus norvegicus
gttagctacttatggcatgctgccc

SEQ ID NO: 522754 - DNA, 25 bp, Rattus norvegicus
gttagctagcttcatcaagataccc

SEQ ID NO: 522755 - DNA, 25 bp, Rattus norvegicus
gttagctagcttgatcaagataccc

SEQ ID NO: 522756 - DNA, 25 bp, Rattus norvegicus
gttagctaggtaagatagctcacat

SEQ ID NO: 522757 - DNA, 25 bp, Rattus norvegicus
gttagctaggtatgatagctcacat

SEQ ID NO: 522758 - DNA, 25 bp, Rattus norvegicus
gttagctaggttagtctctctttga

SEQ ID NO: 522759 - DNA, 25 bp, Rattus norvegicus
gttagctaggtttgtctctctttga

SEQ ID NO: 522760 - DNA, 25 bp, Rattus norvegicus
gttagctatgacagccctactatga

SEQ ID NO: 522761 - DNA, 25 bp, Rattus norvegicus
gttagctatgactgccctactatga

SEQ ID NO: 522762 - DNA, 25 bp, Rattus norvegicus
gttagctattaaaggcatgcctttt

SEQ ID NO: 522763 - DNA, 25 bp, Rattus norvegicus
gttagctattaatggcatgcctttt

SEQ ID NO: 522764 - DNA, 25 bp, Rattus norvegicus
gttagctattccagtgagacccaga

SEQ ID NO: 522765 - DNA, 25 bp, Rattus norvegicus
gttagctattcctgtgagacccaga

SEQ ID NO: 522766 - DNA, 25 bp, Rattus norvegicus
gttagctcagctactggatggcaaa

SEQ ID NO: 522767 - DNA, 25 bp, Rattus norvegicus
gttagctcagcttctggatggcaaa

SEQ ID NO: 522768 - DNA, 25 bp, Rattus norvegicus
gttagctccaaacaacagactacag

SEQ ID NO: 522769 - DNA, 25 bp, Rattus norvegicus
gttagctccaaagaacagactacag

SEQ ID NO: 522770 - DNA, 25 bp, Rattus norvegicus
gttagctccattctgttgttttgtt

SEQ ID NO: 522771 - DNA, 25 bp, Rattus norvegicus
gttagctccattgtgttgttttgtt

SEQ ID NO: 522772 - DNA, 25 bp, Rattus norvegicus
gttagctcttaacattctccatata

SEQ ID NO: 522773 - DNA, 25 bp, Rattus norvegicus
gttagctcttaagattctccatata

SEQ ID NO: 522774 - DNA, 25 bp, Rattus norvegicus
gttagctcttcaatttctcaatgat

SEQ ID NO: 522775 - DNA, 25 bp, Rattus norvegicus
gttagctcttcattttctcaatgat

SEQ ID NO: 522776 - DNA, 25 bp, Rattus norvegicus
gttagctgagttacttgttctctga

SEQ ID NO: 522777 - DNA, 25 bp, Rattus norvegicus
gttagctgagtttcttgttctctga

SEQ ID NO: 522778 - DNA, 25 bp, Rattus norvegicus
gttagctgccaaacttcaagctgtc

SEQ ID NO: 522779 - DNA, 25 bp, Rattus norvegicus
gttagctgccaatcttcaagctgtc

SEQ ID NO: 522780 - DNA, 25 bp, Rattus norvegicus
gttagctgcctaactgtcatcaaga

SEQ ID NO: 522781 - DNA, 25 bp, Rattus norvegicus
gttagctgcctatctgtcatcaaga

SEQ ID NO: 522782 - DNA, 25 bp, Rattus norvegicus
gttagctgctctcgccgtcagaaga

SEQ ID NO: 522783 - DNA, 25 bp, Rattus norvegicus
gttagctgctctggccgtcagaaga

SEQ ID NO: 522784 - DNA, 25 bp, Rattus norvegicus
gttagctggctgagagtaaacctct

SEQ ID NO: 522785 - DNA, 25 bp, Rattus norvegicus
gttagctggctgtgagtaaacctct

SEQ ID NO: 522786 - DNA, 25 bp, Rattus norvegicus
gttagcttactcataatgtctggtg

SEQ ID NO: 522787 - DNA, 25 bp, Rattus norvegicus
gttagcttactcttaatgtctggtg

SEQ ID NO: 522788 - DNA, 25 bp, Rattus norvegicus
gttagcttagggaggatttatcaga

SEQ ID NO: 522789 - DNA, 25 bp, Rattus norvegicus
gttagcttagggtggatttatcaga

SEQ ID NO: 522790 - DNA, 25 bp, Rattus norvegicus
gttagcttcagcactcttgaaacct

SEQ ID NO: 522791 - DNA, 25 bp, Rattus norvegicus
gttagcttcagctctcttgaaacct

SEQ ID NO: 522792 - DNA, 25 bp, Rattus norvegicus
gttagcttctaaccactgtctatag

SEQ ID NO: 522793 - DNA, 25 bp, Rattus norvegicus
gttagcttctaagcactgtctatag

SEQ ID NO: 522794 - DNA, 25 bp, Rattus norvegicus
gttagcttctacaggagaaatttct

SEQ ID NO: 522795 - DNA, 25 bp, Rattus norvegicus
gttagcttctactggagaaatttct

SEQ ID NO: 522796 - DNA, 25 bp, Rattus norvegicus
gttagcttgacaatttagtccttta

SEQ ID NO: 522797 - DNA, 25 bp, Rattus norvegicus
gttagcttgacattttagtccttta

SEQ ID NO: 522798 - DNA, 25 bp, Rattus norvegicus
gttagcttgagccagtttttgcagg

SEQ ID NO: 522799 - DNA, 25 bp, Rattus norvegicus
gttagcttgagcgagtttttgcagg

SEQ ID NO: 522800 - DNA, 25 bp, Rattus norvegicus
gttagcttgctcattttgcacgatc

SEQ ID NO: 522801 - DNA, 25 bp, Rattus norvegicus
gttagcttgctctttttgcacgatc

SEQ ID NO: 522802 - DNA, 25 bp, Rattus norvegicus
gttagcttggctcgctcgttgctcg

SEQ ID NO: 522803 - DNA, 25 bp, Rattus norvegicus
gttagcttggctggctcgttgctcg

SEQ ID NO: 522804 - DNA, 25 bp, Rattus norvegicus
gttagcttgtagattcatgttccat

SEQ ID NO: 522805 - DNA, 25 bp, Rattus norvegicus
gttagcttgtagtttcatgttccat

SEQ ID NO: 522806 - DNA, 25 bp, Rattus norvegicus
gttagctttaaaaacgtgctatgat

SEQ ID NO: 522807 - DNA, 25 bp, Rattus norvegicus
gttagctttaaatacgtgctatgat

SEQ ID NO: 522808 - DNA, 25 bp, Rattus norvegicus
gttagctttctaattccacacagat

SEQ ID NO: 522809 - DNA, 25 bp, Rattus norvegicus
gttagctttctatttccacacagat

SEQ ID NO: 522810 - DNA, 25 bp, Rattus norvegicus
gttagctttttaatcaatgtctgat

SEQ ID NO: 522811 - DNA, 25 bp, Rattus norvegicus
gttagctttttattcaatgtctgat

SEQ ID NO: 522812 - DNA, 25 bp, Rattus norvegicus
gttagctttttcactagaggaccac

SEQ ID NO: 522813 - DNA, 25 bp, Rattus norvegicus
gttagctttttctctagaggaccac

SEQ ID NO: 522814 - DNA, 25 bp, Rattus norvegicus
gttaggaaaacaaccgcattctctt

SEQ ID NO: 522815 - DNA, 25 bp, Rattus norvegicus
gttaggaaaacatccgcattctctt

SEQ ID NO: 522816 - DNA, 25 bp, Rattus norvegicus
gttaggaaacgcagcaagccgttaa

SEQ ID NO: 522817 - DNA, 25 bp, Rattus norvegicus
gttaggaaacgctgcaagccgttaa

SEQ ID NO: 522818 - DNA, 25 bp, Rattus norvegicus
gttaggaacaacactgcatccctct

SEQ ID NO: 522819 - DNA, 25 bp, Rattus norvegicus
gttaggaacaacatctacaactctt

SEQ ID NO: 522820 - DNA, 25 bp, Rattus norvegicus
gttaggaacaactctgcatccctct

SEQ ID NO: 522821 - DNA, 25 bp, Rattus norvegicus
gttaggaacaacttctacaactctt

SEQ ID NO: 522822 - DNA, 25 bp, Rattus norvegicus
gttaggaactcaattctggccctat

SEQ ID NO: 522823 - DNA, 25 bp, Rattus norvegicus
gttaggaactcatttctggccctat

SEQ ID NO: 522824 - DNA, 25 bp, Rattus norvegicus
gttaggacataaccatcttctgatg

SEQ ID NO: 522825 - DNA, 25 bp, Rattus norvegicus
gttaggacataagcatcttctgatg

SEQ ID NO: 522826 - DNA, 25 bp, Rattus norvegicus
gttaggacctccacaccatttttag

SEQ ID NO: 522827 - DNA, 25 bp, Rattus norvegicus
gttaggacctcctcaccatttttag

SEQ ID NO: 522828 - DNA, 25 bp, Rattus norvegicus
gttaggacttcaaattggcatgtgg

SEQ ID NO: 522829 - DNA, 25 bp, Rattus norvegicus
gttaggacttcatattggcatgtgg

SEQ ID NO: 522830 - DNA, 25 bp, Rattus norvegicus
gttaggagcagacttttctacttga

SEQ ID NO: 522831 - DNA, 25 bp, Rattus norvegicus
gttaggagcagagttttctacttga

SEQ ID NO: 522832 - DNA, 25 bp, Rattus norvegicus
gttaggagcatcagcattctcttta

SEQ ID NO: 522833 - DNA, 25 bp, Rattus norvegicus
gttaggagcatctgcattctcttta

SEQ ID NO: 522834 - DNA, 25 bp, Rattus norvegicus
gttaggagccaccatccagctgtga

SEQ ID NO: 522835 - DNA, 25 bp, Rattus norvegicus
gttaggagccacgatccagctgtga

SEQ ID NO: 522836 - DNA, 25 bp, Rattus norvegicus
gttaggaggaccagagcctgtctca

SEQ ID NO: 522837 - DNA, 25 bp, Rattus norvegicus
gttaggaggacctgagcctgtctca

SEQ ID NO: 522838 - DNA, 25 bp, Rattus norvegicus
gttaggagggaaccagattaccatg

SEQ ID NO: 522839 - DNA, 25 bp, Rattus norvegicus
gttaggagggaagcagattaccatg

SEQ ID NO: 522840 - DNA, 25 bp, Rattus norvegicus
gttaggagtgtgcactgctcttgta

SEQ ID NO: 522841 - DNA, 25 bp, Rattus norvegicus
gttaggagtgtggactgctcttgta

SEQ ID NO: 522842 - DNA, 25 bp, Rattus norvegicus
gttaggatgaaactcttgaacccga

SEQ ID NO: 522843 - DNA, 25 bp, Rattus norvegicus
gttaggatgaaagtcttgaacccga

SEQ ID NO: 522844 - DNA, 25 bp, Rattus norvegicus
gttaggatgaacaaagggctgccat

SEQ ID NO: 522845 - DNA, 25 bp, Rattus norvegicus
gttaggatgaactaagggctgccat

SEQ ID NO: 522846 - DNA, 25 bp, Rattus norvegicus
gttaggatgacaccacaggccacta

SEQ ID NO: 522847 - DNA, 25 bp, Rattus norvegicus
gttaggatgacagcacaggccacta

SEQ ID NO: 522848 - DNA, 25 bp, Rattus norvegicus
gttaggatgatcagctccagggcat

SEQ ID NO: 522849 - DNA, 25 bp, Rattus norvegicus
gttaggatgatctgctccagggcat

SEQ ID NO: 522850 - DNA, 25 bp, Rattus norvegicus
gttaggatgtgtctgcagcccacgc

SEQ ID NO: 522851 - DNA, 25 bp, Rattus norvegicus
gttaggatgtgtgtgcagcccacgc

SEQ ID NO: 522852 - DNA, 25 bp, Rattus norvegicus
gttaggatttcacggtccagaccat

SEQ ID NO: 522853 - DNA, 25 bp, Rattus norvegicus
gttaggatttcagggtccagaccat

SEQ ID NO: 522854 - DNA, 25 bp, Rattus norvegicus
gttaggatttgaaaccatttggcca

SEQ ID NO: 522855 - DNA, 25 bp, Rattus norvegicus
gttaggatttgataccatttggcca

SEQ ID NO: 522856 - DNA, 25 bp, Rattus norvegicus
gttaggcaaggcaagtcccctgtca

SEQ ID NO: 522857 - DNA, 25 bp, Rattus norvegicus
gttaggcaaggctagtcccctgtca

SEQ ID NO: 522858 - DNA, 25 bp, Rattus norvegicus
gttaggcacacacaaggaacatttc

SEQ ID NO: 522859 - DNA, 25 bp, Rattus norvegicus
gttaggcacacagaaggaacatttc

SEQ ID NO: 522860 - DNA, 25 bp, Rattus norvegicus
gttaggcagcagacatacgcggtaa

SEQ ID NO: 522861 - DNA, 25 bp, Rattus norvegicus
gttaggcagcagtcatacgcggtaa

SEQ ID NO: 522862 - DNA, 25 bp, Rattus norvegicus
gttaggcagcatatcttttaccatt

SEQ ID NO: 522863 - DNA, 25 bp, Rattus norvegicus
gttaggcagcatttcttttaccatt

SEQ ID NO: 522864 - DNA, 25 bp, Rattus norvegicus
gttaggcaggtcagtctggactcca

SEQ ID NO: 522865 - DNA, 25 bp, Rattus norvegicus
gttaggcaggtctgtctggactcca

SEQ ID NO: 522866 - DNA, 25 bp, Rattus norvegicus
gttaggcatcttctgttcgttagga

SEQ ID NO: 522867 - DNA, 25 bp, Rattus norvegicus
gttaggcatcttgtgttcgttagga

SEQ ID NO: 522868 - DNA, 25 bp, Rattus norvegicus
gttaggcatgtacctgagctattca

SEQ ID NO: 522869 - DNA, 25 bp, Rattus norvegicus
gttaggcatgtagctgagctattca

SEQ ID NO: 522870 - DNA, 25 bp, Rattus norvegicus
gttaggcattttctcagtgatcgat

SEQ ID NO: 522871 - DNA, 25 bp, Rattus norvegicus
gttaggcattttgtcagtgatcgat

SEQ ID NO: 522872 - DNA, 25 bp, Rattus norvegicus
gttaggccagtcacatctccagctt

SEQ ID NO: 522873 - DNA, 25 bp, Rattus norvegicus
gttaggccagtctcatctccagctt

SEQ ID NO: 522874 - DNA, 25 bp, Rattus norvegicus
gttaggccccagcaaaatctaatgc

SEQ ID NO: 522875 - DNA, 25 bp, Rattus norvegicus
gttaggccccaggaaaatctaatgc

SEQ ID NO: 522876 - DNA, 25 bp, Rattus norvegicus
gttaggcctaagagggaccccagca

SEQ ID NO: 522877 - DNA, 25 bp, Rattus norvegicus
gttaggcctaagtgggaccccagca

SEQ ID NO: 522878 - DNA, 25 bp, Rattus norvegicus
gttaggccttgaactaggcctgcag

SEQ ID NO: 522879 - DNA, 25 bp, Rattus norvegicus
gttaggccttgatctaggcctgcag

SEQ ID NO: 522880 - DNA, 25 bp, Rattus norvegicus
gttaggcctttgcttacagtggatt

SEQ ID NO: 522881 - DNA, 25 bp, Rattus norvegicus
gttaggcctttggttacagtggatt

SEQ ID NO: 522882 - DNA, 25 bp, Rattus norvegicus
gttaggcgccccagtgacacaggtt

SEQ ID NO: 522883 - DNA, 25 bp, Rattus norvegicus
gttaggcgcccctgtgacacaggtt

SEQ ID NO: 522884 - DNA, 25 bp, Rattus norvegicus
gttagggaaacacacttccccacat

SEQ ID NO: 522885 - DNA, 25 bp, Rattus norvegicus
gttagggaaacagacttccccacat

SEQ ID NO: 522886 - DNA, 25 bp, Rattus norvegicus
gttagggaaagcagatctgatcaat

SEQ ID NO: 522887 - DNA, 25 bp, Rattus norvegicus
gttagggaaagctgatctgatcaat

SEQ ID NO: 522888 - DNA, 25 bp, Rattus norvegicus
gttagggacatgactcaccatgccc

SEQ ID NO: 522889 - DNA, 25 bp, Rattus norvegicus
gttagggacatgtctcaccatgccc

SEQ ID NO: 522890 - DNA, 25 bp, Rattus norvegicus
gttagggatgagatgcgttcacttc

SEQ ID NO: 522891 - DNA, 25 bp, Rattus norvegicus
gttagggatgagttgcgttcacttc

SEQ ID NO: 522892 - DNA, 25 bp, Rattus norvegicus
gttagggtccacagagtacacaact

SEQ ID NO: 522893 - DNA, 25 bp, Rattus norvegicus
gttagggtccactgagtacacaact

SEQ ID NO: 522894 - DNA, 25 bp, Rattus norvegicus
gttaggtaactcaccactggctgcc

SEQ ID NO: 522895 - DNA, 25 bp, Rattus norvegicus
gttaggtaactctccactggctgcc

SEQ ID NO: 522896 - DNA, 25 bp, Rattus norvegicus
gttaggtaagtacagaactttcaat

SEQ ID NO: 522897 - DNA, 25 bp, Rattus norvegicus
gttaggtaagtagagaactttcaat

SEQ ID NO: 522898 - DNA, 25 bp, Rattus norvegicus
gttaggtagtgtcgtgccctgtcca

SEQ ID NO: 522899 - DNA, 25 bp, Rattus norvegicus
gttaggtagtgtggtgccctgtcca

SEQ ID NO: 522900 - DNA, 25 bp, Rattus norvegicus
gttaggtcatctatcctttatgccc

SEQ ID NO: 522901 - DNA, 25 bp, Rattus norvegicus
gttaggtcatctttcctttatgccc

SEQ ID NO: 522902 - DNA, 25 bp, Rattus norvegicus
gttaggtctacaccacaattcttca

SEQ ID NO: 522903 - DNA, 25 bp, Rattus norvegicus
gttaggtctacagcacaattcttca

SEQ ID NO: 522904 - DNA, 25 bp, Rattus norvegicus
gttaggtgatgcatttccattgtac

SEQ ID NO: 522905 - DNA, 25 bp, Rattus norvegicus
gttaggtgatgcttttccattgtac

SEQ ID NO: 522906 - DNA, 25 bp, Rattus norvegicus
gttaggtgccacagactgtatcaac

SEQ ID NO: 522907 - DNA, 25 bp, Rattus norvegicus
gttaggtgccactgactgtatcaac

SEQ ID NO: 522908 - DNA, 25 bp, Rattus norvegicus
gttaggtgcctcatgaatatactga

SEQ ID NO: 522909 - DNA, 25 bp, Rattus norvegicus
gttaggtgcctcttgaatatactga

SEQ ID NO: 522910 - DNA, 25 bp, Rattus norvegicus
gttaggtgtagcagtgtgccacatg

SEQ ID NO: 522911 - DNA, 25 bp, Rattus norvegicus
gttaggtgtagctgtgtgccacatg

SEQ ID NO: 522912 - DNA, 25 bp, Rattus norvegicus
gttaggttcatcatctctgactgag

SEQ ID NO: 522913 - DNA, 25 bp, Rattus norvegicus
gttaggttcatcttctctgactgag

SEQ ID NO: 522914 - DNA, 25 bp, Rattus norvegicus
gttaggttcgccatgacatggctga

SEQ ID NO: 522915 - DNA, 25 bp, Rattus norvegicus
gttaggttcgccttgacatggctga

SEQ ID NO: 522916 - DNA, 25 bp, Rattus norvegicus
gttaggttctagagttctgtcttgt

SEQ ID NO: 522917 - DNA, 25 bp, Rattus norvegicus
gttaggttctagtgttctgtcttgt

SEQ ID NO: 522918 - DNA, 25 bp, Rattus norvegicus
gttaggtttcctcatgtaagcacag

SEQ ID NO: 522919 - DNA, 25 bp, Rattus norvegicus
gttaggtttcctgatgtaagcacag

SEQ ID NO: 522920 - DNA, 25 bp, Rattus norvegicus
gttaggtttgtcctcacagtggtga

SEQ ID NO: 522921 - DNA, 25 bp, Rattus norvegicus
gttaggtttgtcgtcacagtggtga

SEQ ID NO: 522922 - DNA, 25 bp, Rattus norvegicus
gttagtaagcatacactgtcacttg

SEQ ID NO: 522923 - DNA, 25 bp, Rattus norvegicus
gttagtaagcattcactgtcacttg

SEQ ID NO: 522924 - DNA, 25 bp, Rattus norvegicus
gttagtacaagtaacagagaaagag

SEQ ID NO: 522925 - DNA, 25 bp, Rattus norvegicus
gttagtacaagttacagagaaagag

SEQ ID NO: 522926 - DNA, 25 bp, Rattus norvegicus
gttagtacacacatccttacgagtg

SEQ ID NO: 522927 - DNA, 25 bp, Rattus norvegicus
gttagtacacacttccttacgagtg

SEQ ID NO: 522928 - DNA, 25 bp, Rattus norvegicus
gttagtactcaaatgcttggcgttc

SEQ ID NO: 522929 - DNA, 25 bp, Rattus norvegicus
gttagtactcaattgcttggcgttc

SEQ ID NO: 522930 - DNA, 25 bp, Rattus norvegicus
gttagtactgtcattggcttttgca

SEQ ID NO: 522931 - DNA, 25 bp, Rattus norvegicus
gttagtactgtctttggcttttgca

SEQ ID NO: 522932 - DNA, 25 bp, Rattus norvegicus
gttagtagcagtaatccatgggtag

SEQ ID NO: 522933 - DNA, 25 bp, Rattus norvegicus
gttagtagcagttatccatgggtag

SEQ ID NO: 522934 - DNA, 25 bp, Rattus norvegicus
gttagtataatcattgatgcccagt

SEQ ID NO: 522935 - DNA, 25 bp, Rattus norvegicus
gttagtataatctttgatgcccagt

SEQ ID NO: 522936 - DNA, 25 bp, Rattus norvegicus
gttagtatgtatatgacactgtggt

SEQ ID NO: 522937 - DNA, 25 bp, Rattus norvegicus
gttagtatgtatttgacactgtggt

SEQ ID NO: 522938 - DNA, 25 bp, Rattus norvegicus
gttagtatttatatcagcacctgtt

SEQ ID NO: 522939 - DNA, 25 bp, Rattus norvegicus
gttagtatttatttcagcacctgtt

SEQ ID NO: 522940 - DNA, 25 bp, Rattus norvegicus
gttagtcaccaacttgacttcttca

SEQ ID NO: 522941 - DNA, 25 bp, Rattus norvegicus
gttagtcaccaagttgacttcttca

SEQ ID NO: 522942 - DNA, 25 bp, Rattus norvegicus
gttagtcagagaaggctcctgcctt

SEQ ID NO: 522943 - DNA, 25 bp, Rattus norvegicus
gttagtcagagatggctcctgcctt

SEQ ID NO: 522944 - DNA, 25 bp, Rattus norvegicus
gttagtcatcttacaatcactgtaa

SEQ ID NO: 522945 - DNA, 25 bp, Rattus norvegicus
gttagtcatctttcaatcactgtaa

SEQ ID NO: 522946 - DNA, 25 bp, Rattus norvegicus
gttagtccaaaccaactcctcaaag

SEQ ID NO: 522947 - DNA, 25 bp, Rattus norvegicus
gttagtccaaacgaactcctcaaag

SEQ ID NO: 522948 - DNA, 25 bp, Rattus norvegicus
gttagtccacctctatttaaaatgt

SEQ ID NO: 522949 - DNA, 25 bp, Rattus norvegicus
gttagtccacctgtatttaaaatgt

SEQ ID NO: 522950 - DNA, 25 bp, Rattus norvegicus
gttagtccagttattgtcgcttatt

SEQ ID NO: 522951 - DNA, 25 bp, Rattus norvegicus
gttagtccagtttttgtcgcttatt

SEQ ID NO: 522952 - DNA, 25 bp, Rattus norvegicus
gttagtcccactcttaggaggcgaa

SEQ ID NO: 522953 - DNA, 25 bp, Rattus norvegicus
gttagtcccactgttaggaggcgaa

SEQ ID NO: 522954 - DNA, 25 bp, Rattus norvegicus
gttagtcccagcacacaagaagcag

SEQ ID NO: 522955 - DNA, 25 bp, Rattus norvegicus
gttagtcccagctcacaagaagcag

SEQ ID NO: 522956 - DNA, 25 bp, Rattus norvegicus
gttagtccccatctgattacagtga

SEQ ID NO: 522957 - DNA, 25 bp, Rattus norvegicus
gttagtccccatgtgattacagtga

SEQ ID NO: 522958 - DNA, 25 bp, Rattus norvegicus
gttagtccctaacttcttcattgat

SEQ ID NO: 522959 - DNA, 25 bp, Rattus norvegicus
gttagtccctaagttcttcattgat

SEQ ID NO: 522960 - DNA, 25 bp, Rattus norvegicus
gttagtcctactatgtattttctgc

SEQ ID NO: 522961 - DNA, 25 bp, Rattus norvegicus
gttagtcctactttgtattttctgc

SEQ ID NO: 522962 - DNA, 25 bp, Rattus norvegicus
gttagtcctcaccacaagctatgga

SEQ ID NO: 522963 - DNA, 25 bp, Rattus norvegicus
gttagtcctcacgacaagctatgga

SEQ ID NO: 522964 - DNA, 25 bp, Rattus norvegicus
gttagtccttagcagtccaacacta

SEQ ID NO: 522965 - DNA, 25 bp, Rattus norvegicus
gttagtccttaggagtccaacacta

SEQ ID NO: 522966 - DNA, 25 bp, Rattus norvegicus
gttagtcgattaccacttctgacaa

SEQ ID NO: 522967 - DNA, 25 bp, Rattus norvegicus
gttagtcgattagcacttctgacaa

SEQ ID NO: 522968 - DNA, 25 bp, Rattus norvegicus
gttagtctctagataacttcaccgc

SEQ ID NO: 522969 - DNA, 25 bp, Rattus norvegicus
gttagtctctagttaacttcaccgc

SEQ ID NO: 522970 - DNA, 25 bp, Rattus norvegicus
gttagtctgtaacgatactcaaaaa

SEQ ID NO: 522971 - DNA, 25 bp, Rattus norvegicus
gttagtctgtaaggatactcaaaaa

SEQ ID NO: 522972 - DNA, 25 bp, Rattus norvegicus
gttagtctgtctctcccttttcata

SEQ ID NO: 522973 - DNA, 25 bp, Rattus norvegicus
gttagtctgtctgtcccttttcata

SEQ ID NO: 522974 - DNA, 25 bp, Rattus norvegicus
gttagtcttaacagtgctctcactg

SEQ ID NO: 522975 - DNA, 25 bp, Rattus norvegicus
gttagtcttaactgtgctctcactg

SEQ ID NO: 522976 - DNA, 25 bp, Rattus norvegicus
gttagtcttattctgctatgccgtc

SEQ ID NO: 522977 - DNA, 25 bp, Rattus norvegicus
gttagtcttattgtgctatgccgtc

SEQ ID NO: 522978 - DNA, 25 bp, Rattus norvegicus
gttagtgaactgacctgcaagcatg

SEQ ID NO: 522979 - DNA, 25 bp, Rattus norvegicus
gttagtgaactgtcctgcaagcatg

SEQ ID NO: 522980 - DNA, 25 bp, Rattus norvegicus
gttagtgacagccatgtcctcttga

SEQ ID NO: 522981 - DNA, 25 bp, Rattus norvegicus
gttagtgacagcgatgtcctcttga

SEQ ID NO: 522982 - DNA, 25 bp, Rattus norvegicus
gttagtgaggccatggaccccgcca

SEQ ID NO: 522983 - DNA, 25 bp, Rattus norvegicus
gttagtgaggccttggaccccgcca

SEQ ID NO: 522984 - DNA, 25 bp, Rattus norvegicus
gttagtgatccaaagctgtcaagtg

SEQ ID NO: 522985 - DNA, 25 bp, Rattus norvegicus
gttagtgatccatagctgtcaagtg

SEQ ID NO: 522986 - DNA, 25 bp, Rattus norvegicus
gttagtgcagctagtggccaagacg

SEQ ID NO: 522987 - DNA, 25 bp, Rattus norvegicus
gttagtgcagcttgtggccaagacg

SEQ ID NO: 522988 - DNA, 25 bp, Rattus norvegicus
gttagtgcaggccagcaggacctcc

SEQ ID NO: 522989 - DNA, 25 bp, Rattus norvegicus
gttagtgcaggcgagcaggacctcc

SEQ ID NO: 522990 - DNA, 25 bp, Rattus norvegicus
gttagtgccactcgcgactgcacca

SEQ ID NO: 522991 - DNA, 25 bp, Rattus norvegicus
gttagtgccactggcgactgcacca

SEQ ID NO: 522992 - DNA, 25 bp, Rattus norvegicus
gttagtgccgaaccaatgctttctt

SEQ ID NO: 522993 - DNA, 25 bp, Rattus norvegicus
gttagtgccgaagcaatgctttctt

SEQ ID NO: 522994 - DNA, 25 bp, Rattus norvegicus
gttagtgcctgccatccacaagatg

SEQ ID NO: 522995 - DNA, 25 bp, Rattus norvegicus
gttagtgcctgcgatccacaagatg

SEQ ID NO: 522996 - DNA, 25 bp, Rattus norvegicus
gttagtgcgcagatctattcaacct

SEQ ID NO: 522997 - DNA, 25 bp, Rattus norvegicus
gttagtgcgcagttctattcaacct

SEQ ID NO: 522998 - DNA, 25 bp, Rattus norvegicus
gttagtgctattcagattggccatt

SEQ ID NO: 522999 - DNA, 25 bp, Rattus norvegicus
gttagtgctattgagattggccatt

SEQ ID NO: 523000 - DNA, 25 bp, Rattus norvegicus
gttagtgctcacagaatgccgttcg

SEQ ID NO: 523001 - DNA, 25 bp, Rattus norvegicus
gttagtgctcactgaatgccgttcg

SEQ ID NO: 523002 - DNA, 25 bp, Rattus norvegicus
gttagtgctcatagtgtaggtcctg

SEQ ID NO: 523003 - DNA, 25 bp, Rattus norvegicus
gttagtgctcattgtgtaggtcctg

SEQ ID NO: 523004 - DNA, 25 bp, Rattus norvegicus
gttagtgctgtgcatgctcagtaac

SEQ ID NO: 523005 - DNA, 25 bp, Rattus norvegicus
gttagtgctgtggatgctcagtaac

SEQ ID NO: 523006 - DNA, 25 bp, Rattus norvegicus
gttagtggaatcaccagaccatcaa

SEQ ID NO: 523007 - DNA, 25 bp, Rattus norvegicus
gttagtggaatctccagaccatcaa

SEQ ID NO: 523008 - DNA, 25 bp, Rattus norvegicus
gttagtggattcagcctttgacagg

SEQ ID NO: 523009 - DNA, 25 bp, Rattus norvegicus
gttagtggattctgcctttgacagg

SEQ ID NO: 523010 - DNA, 25 bp, Rattus norvegicus
gttagtggccctcaagctgacattc

SEQ ID NO: 523011 - DNA, 25 bp, Rattus norvegicus
gttagtggccctgaagctgacattc

SEQ ID NO: 523012 - DNA, 25 bp, Rattus norvegicus
gttagtggctaaccagtcaggtgca

SEQ ID NO: 523013 - DNA, 25 bp, Rattus norvegicus
gttagtggctaagcagtcaggtgca

SEQ ID NO: 523014 - DNA, 25 bp, Rattus norvegicus
gttagtgggtatacggacaattcaa

SEQ ID NO: 523015 - DNA, 25 bp, Rattus norvegicus
gttagtgggtattcggacaattcaa

SEQ ID NO: 523016 - DNA, 25 bp, Rattus norvegicus
gttagtgtccctagactccaaagga

SEQ ID NO: 523017 - DNA, 25 bp, Rattus norvegicus
gttagtgtcccttgactccaaagga

SEQ ID NO: 523018 - DNA, 25 bp, Rattus norvegicus
gttagtgtgacaccgtacctcatgt

SEQ ID NO: 523019 - DNA, 25 bp, Rattus norvegicus
gttagtgtgacagcgtacctcatgt

SEQ ID NO: 523020 - DNA, 25 bp, Rattus norvegicus
gttagtgtgattaaccacctgccac

SEQ ID NO: 523021 - DNA, 25 bp, Rattus norvegicus
gttagtgtgatttaccacctgccac

SEQ ID NO: 523022 - DNA, 25 bp, Rattus norvegicus
gttagtgttcataccctatggtgat

SEQ ID NO: 523023 - DNA, 25 bp, Rattus norvegicus
gttagtgttcattccctatggtgat

SEQ ID NO: 523024 - DNA, 25 bp, Rattus norvegicus
gttagtgtttccatgtacacctatc

SEQ ID NO: 523025 - DNA, 25 bp, Rattus norvegicus
gttagtgtttccttgtacacctatc

SEQ ID NO: 523026 - DNA, 25 bp, Rattus norvegicus
gttagtgtttctactaggctagctt

SEQ ID NO: 523027 - DNA, 25 bp, Rattus norvegicus
gttagtgtttcttctaggctagctt

SEQ ID NO: 523028 - DNA, 25 bp, Rattus norvegicus
gttagttaccataacaccttgtctg

SEQ ID NO: 523029 - DNA, 25 bp, Rattus norvegicus
gttagttaccattacaccttgtctg

SEQ ID NO: 523030 - DNA, 25 bp, Rattus norvegicus
gttagttagcatctttgtcttatct

SEQ ID NO: 523031 - DNA, 25 bp, Rattus norvegicus
gttagttagcatgtttgtcttatct

SEQ ID NO: 523032 - DNA, 25 bp, Rattus norvegicus
gttagttagtgtcggttctggcctc

SEQ ID NO: 523033 - DNA, 25 bp, Rattus norvegicus
gttagttagtgtgggttctggcctc

SEQ ID NO: 523034 - DNA, 25 bp, Rattus norvegicus
gttagttcagtaccttatctcactt

SEQ ID NO: 523035 - DNA, 25 bp, Rattus norvegicus
gttagttcagtagcttatctcactt

SEQ ID NO: 523036 - DNA, 25 bp, Rattus norvegicus
gttagttcccctaaataatggacag

SEQ ID NO: 523037 - DNA, 25 bp, Rattus norvegicus
gttagttccccttaataatggacag

SEQ ID NO: 523038 - DNA, 25 bp, Rattus norvegicus
gttagttccgttatggagctggcta

SEQ ID NO: 523039 - DNA, 25 bp, Rattus norvegicus
gttagttccgttttggagctggcta

SEQ ID NO: 523040 - DNA, 25 bp, Rattus norvegicus
gttagttcctaccagagaagtgctg

SEQ ID NO: 523041 - DNA, 25 bp, Rattus norvegicus
gttagttcctacgagagaagtgctg

SEQ ID NO: 523042 - DNA, 25 bp, Rattus norvegicus
gttagttcctgaacgtctacagacc

SEQ ID NO: 523043 - DNA, 25 bp, Rattus norvegicus
gttagttcctgatcgtctacagacc

SEQ ID NO: 523044 - DNA, 25 bp, Rattus norvegicus
gttagttctaatcatagccagactt

SEQ ID NO: 523045 - DNA, 25 bp, Rattus norvegicus
gttagttctaatgatagccagactt

SEQ ID NO: 523046 - DNA, 25 bp, Rattus norvegicus
gttagttctagcattatttacttca

SEQ ID NO: 523047 - DNA, 25 bp, Rattus norvegicus
gttagttctagctttatttacttca

SEQ ID NO: 523048 - DNA, 25 bp, Rattus norvegicus
gttagttctgtacttactcccaggt

SEQ ID NO: 523049 - DNA, 25 bp, Rattus norvegicus
gttagttctgtagttactcccaggt

SEQ ID NO: 523050 - DNA, 25 bp, Rattus norvegicus
gttagttcttgactcaccttttgta

SEQ ID NO: 523051 - DNA, 25 bp, Rattus norvegicus
gttagttcttgagtcaccttttgta

SEQ ID NO: 523052 - DNA, 25 bp, Rattus norvegicus
gttagttgctcaatgtacatctgta

SEQ ID NO: 523053 - DNA, 25 bp, Rattus norvegicus
gttagttgctcattgtacatctgta

SEQ ID NO: 523054 - DNA, 25 bp, Rattus norvegicus
gttagttggcgtatttctcagagac

SEQ ID NO: 523055 - DNA, 25 bp, Rattus norvegicus
gttagttggcgtttttctcagagac

SEQ ID NO: 523056 - DNA, 25 bp, Rattus norvegicus
gttagttggttcatcacaaggctct

SEQ ID NO: 523057 - DNA, 25 bp, Rattus norvegicus
gttagttggttcttcacaaggctct

SEQ ID NO: 523058 - DNA, 25 bp, Rattus norvegicus
gttagttgtatgctcagttcttctg

SEQ ID NO: 523059 - DNA, 25 bp, Rattus norvegicus
gttagttgtatggtcagttcttctg

SEQ ID NO: 523060 - DNA, 25 bp, Rattus norvegicus
gttagttgtgtcaccaatatcaggt

SEQ ID NO: 523061 - DNA, 25 bp, Rattus norvegicus
gttagttgtgtctccaatatcaggt

SEQ ID NO: 523062 - DNA, 25 bp, Rattus norvegicus
gttagtttattaccttagcctcctg

SEQ ID NO: 523063 - DNA, 25 bp, Rattus norvegicus
gttagtttattagcttagcctcctg

SEQ ID NO: 523064 - DNA, 25 bp, Rattus norvegicus
gttagtttcaacaacacctggctac

SEQ ID NO: 523065 - DNA, 25 bp, Rattus norvegicus
gttagtttcaactacacctggctac

SEQ ID NO: 523066 - DNA, 25 bp, Rattus norvegicus
gttagtttcatgacatgctgggaac

SEQ ID NO: 523067 - DNA, 25 bp, Rattus norvegicus
gttagtttcatgtcatgctgggaac

SEQ ID NO: 523068 - DNA, 25 bp, Rattus norvegicus
gttagtttctacagtggttcctata

SEQ ID NO: 523069 - DNA, 25 bp, Rattus norvegicus
gttagtttctactgtggttcctata

SEQ ID NO: 523070 - DNA, 25 bp, Rattus norvegicus
gttagtttgaatcttctgtgtgcat

SEQ ID NO: 523071 - DNA, 25 bp, Rattus norvegicus
gttagtttgaatgttctgtgtgcat

SEQ ID NO: 523072 - DNA, 25 bp, Rattus norvegicus
gttataaaccaaaatctcccacttg

SEQ ID NO: 523073 - DNA, 25 bp, Rattus norvegicus
gttataaaccaatatctcccacttg

SEQ ID NO: 523074 - DNA, 25 bp, Rattus norvegicus
gttataaaccaccatacctgacttt

SEQ ID NO: 523075 - DNA, 25 bp, Rattus norvegicus
gttataaaccacgatacctgacttt

SEQ ID NO: 523076 - DNA, 25 bp, Rattus norvegicus
gttataaattaaaaaagccttgaca

SEQ ID NO: 523077 - DNA, 25 bp, Rattus norvegicus
gttataaattaataaagccttgaca

SEQ ID NO: 523078 - DNA, 25 bp, Rattus norvegicus
gttataacagctcaagtggcttggt

SEQ ID NO: 523079 - DNA, 25 bp, Rattus norvegicus
gttataacagctgaagtggcttggt

SEQ ID NO: 523080 - DNA, 25 bp, Rattus norvegicus
gttataacagtgatcagccctgagt

SEQ ID NO: 523081 - DNA, 25 bp, Rattus norvegicus
gttataacagtgttcagccctgagt

SEQ ID NO: 523082 - DNA, 25 bp, Rattus norvegicus
gttataacgcttctgtctttgcata

SEQ ID NO: 523083 - DNA, 25 bp, Rattus norvegicus
gttataacgcttgtgtctttgcata

SEQ ID NO: 523084 - DNA, 25 bp, Rattus norvegicus
gttataagactcctttccatttctg

SEQ ID NO: 523085 - DNA, 25 bp, Rattus norvegicus
gttataagactcgtttccatttctg

SEQ ID NO: 523086 - DNA, 25 bp, Rattus norvegicus
gttataagactgagtagccggccta

SEQ ID NO: 523087 - DNA, 25 bp, Rattus norvegicus
gttataagactgtgtagccggccta

SEQ ID NO: 523088 - DNA, 25 bp, Rattus norvegicus
gttataagcaacatcctattgtcaa

SEQ ID NO: 523089 - DNA, 25 bp, Rattus norvegicus
gttataagcaacttcctattgtcaa

SEQ ID NO: 523090 - DNA, 25 bp, Rattus norvegicus
gttataatcaacacacatcctgcct

SEQ ID NO: 523091 - DNA, 25 bp, Rattus norvegicus
gttataatcaactcacatcctgcct

SEQ ID NO: 523092 - DNA, 25 bp, Rattus norvegicus
gttataatgcccagaacctgtccag

SEQ ID NO: 523093 - DNA, 25 bp, Rattus norvegicus
gttataatgccctgaacctgtccag

SEQ ID NO: 523094 - DNA, 25 bp, Rattus norvegicus
gttatacacgtcaccgggactggca

SEQ ID NO: 523095 - DNA, 25 bp, Rattus norvegicus
gttatacacgtctccgggactggca

SEQ ID NO: 523096 - DNA, 25 bp, Rattus norvegicus
gttatacactcacatagcctcggaa

SEQ ID NO: 523097 - DNA, 25 bp, Rattus norvegicus
gttatacactcagatagcctcggaa

SEQ ID NO: 523098 - DNA, 25 bp, Rattus norvegicus
gttatacagcctagattgcctcagg

SEQ ID NO: 523099 - DNA, 25 bp, Rattus norvegicus
gttatacagccttgattgcctcagg

SEQ ID NO: 523100 - DNA, 25 bp, Rattus norvegicus
gttatacatctgcactcagtctccc

SEQ ID NO: 523101 - DNA, 25 bp, Rattus norvegicus
gttatacatctggactcagtctccc

SEQ ID NO: 523102 - DNA, 25 bp, Rattus norvegicus
gttataccacacagactctgcctgg

SEQ ID NO: 523103 - DNA, 25 bp, Rattus norvegicus
gttataccacactgactctgcctgg

SEQ ID NO: 523104 - DNA, 25 bp, Rattus norvegicus
gttatactaagcaatggcgtccttg

SEQ ID NO: 523105 - DNA, 25 bp, Rattus norvegicus
gttatactaagctatggcgtccttg

SEQ ID NO: 523106 - DNA, 25 bp, Rattus norvegicus
gttatactctgtatactacgtcata

SEQ ID NO: 523107 - DNA, 25 bp, Rattus norvegicus
gttatactctgtttactacgtcata

SEQ ID NO: 523108 - DNA, 25 bp, Rattus norvegicus
gttatactgaacagtccattcggtt

SEQ ID NO: 523109 - DNA, 25 bp, Rattus norvegicus
gttatactgaactgtccattcggtt

SEQ ID NO: 523110 - DNA, 25 bp, Rattus norvegicus
gttatacttggacagccggtacacc

SEQ ID NO: 523111 - DNA, 25 bp, Rattus norvegicus
gttatacttggagagccggtacacc

SEQ ID NO: 523112 - DNA, 25 bp, Rattus norvegicus
gttatagacacccacttcagacatt

SEQ ID NO: 523113 - DNA, 25 bp, Rattus norvegicus
gttatagacaccgacttcagacatt

SEQ ID NO: 523114 - DNA, 25 bp, Rattus norvegicus
gttatagatttacctgtatttgtca

SEQ ID NO: 523115 - DNA, 25 bp, Rattus norvegicus
gttatagatttagctgtatttgtca

SEQ ID NO: 523116 - DNA, 25 bp, Rattus norvegicus
gttatagcctatccatactgttgag

SEQ ID NO: 523117 - DNA, 25 bp, Rattus norvegicus
gttatagcctatgcatactgttgag

SEQ ID NO: 523118 - DNA, 25 bp, Rattus norvegicus
gttatagctcagaaccatgcggtga

SEQ ID NO: 523119 - DNA, 25 bp, Rattus norvegicus
gttatagctcagtaccatgcggtga

SEQ ID NO: 523120 - DNA, 25 bp, Rattus norvegicus
gttatagctggcatttctacacaga

SEQ ID NO: 523121 - DNA, 25 bp, Rattus norvegicus
gttatagctggcttttctacacaga

SEQ ID NO: 523122 - DNA, 25 bp, Rattus norvegicus
gttatagcttgtaactcagtttctt

SEQ ID NO: 523123 - DNA, 25 bp, Rattus norvegicus
gttatagcttgttactcagtttctt

SEQ ID NO: 523124 - DNA, 25 bp, Rattus norvegicus
gttatagggccaaagaaaatgcacc

SEQ ID NO: 523125 - DNA, 25 bp, Rattus norvegicus
gttatagggccatagaaaatgcacc

SEQ ID NO: 523126 - DNA, 25 bp, Rattus norvegicus
gttatagtgagccagcctgtgcaaa

SEQ ID NO: 523127 - DNA, 25 bp, Rattus norvegicus
gttatagtgagcgagcctgtgcaaa

SEQ ID NO: 523128 - DNA, 25 bp, Rattus norvegicus
gttatagttaggcagagtctcacaa

SEQ ID NO: 523129 - DNA, 25 bp, Rattus norvegicus
gttatagttagggagagtctcacaa

SEQ ID NO: 523130 - DNA, 25 bp, Rattus norvegicus
gttatatacctactttgagatcaat

SEQ ID NO: 523131 - DNA, 25 bp, Rattus norvegicus
gttatatacctagtttgagatcaat

SEQ ID NO: 523132 - DNA, 25 bp, Rattus norvegicus
gttatatacttcaaacgtatgcggt

SEQ ID NO: 523133 - DNA, 25 bp, Rattus norvegicus
gttatatacttctaacgtatgcggt

SEQ ID NO: 523134 - DNA, 25 bp, Rattus norvegicus
gttatataggccagcctcctgaggc

SEQ ID NO: 523135 - DNA, 25 bp, Rattus norvegicus
gttatataggcctgcctcctgaggc

SEQ ID NO: 523136 - DNA, 25 bp, Rattus norvegicus
gttatatatagaacaccgcagatgg

SEQ ID NO: 523137 - DNA, 25 bp, Rattus norvegicus
gttatatatagatcaccgcagatgg

SEQ ID NO: 523138 - DNA, 25 bp, Rattus norvegicus
gttatatcaaagaccgactcaaatt

SEQ ID NO: 523139 - DNA, 25 bp, Rattus norvegicus
gttatatcaaagtccgactcaaatt

SEQ ID NO: 523140 - DNA, 25 bp, Rattus norvegicus
gttatatcactccttagctagccag

SEQ ID NO: 523141 - DNA, 25 bp, Rattus norvegicus
gttatatcactcgttagctagccag

SEQ ID NO: 523142 - DNA, 25 bp, Rattus norvegicus
gttatatcatctatatggtgccaga

SEQ ID NO: 523143 - DNA, 25 bp, Rattus norvegicus
gttatatcatctttatggtgccaga

SEQ ID NO: 523144 - DNA, 25 bp, Rattus norvegicus
gttatatcattcattttacttcatt

SEQ ID NO: 523145 - DNA, 25 bp, Rattus norvegicus
gttatatcattctttttacttcatt

SEQ ID NO: 523146 - DNA, 25 bp, Rattus norvegicus
gttatatgaccacggaacacccaat

SEQ ID NO: 523147 - DNA, 25 bp, Rattus norvegicus
gttatatgaccagggaacacccaat

SEQ ID NO: 523148 - DNA, 25 bp, Rattus norvegicus
gttatatgcacccacacacttgtga

SEQ ID NO: 523149 - DNA, 25 bp, Rattus norvegicus
gttatatgcaccgacacacttgtga

SEQ ID NO: 523150 - DNA, 25 bp, Rattus norvegicus
gttatatgctccaacagtgtccgaa

SEQ ID NO: 523151 - DNA, 25 bp, Rattus norvegicus
gttatatgctcctacagtgtccgaa

SEQ ID NO: 523152 - DNA, 25 bp, Rattus norvegicus
gttatattcagtaatctcttccaga

SEQ ID NO: 523153 - DNA, 25 bp, Rattus norvegicus
gttatattcagttatctcttccaga

SEQ ID NO: 523154 - DNA, 25 bp, Rattus norvegicus
gttatattctctcaaactctacctt

SEQ ID NO: 523155 - DNA, 25 bp, Rattus norvegicus
gttatattctctgaaactctacctt

SEQ ID NO: 523156 - DNA, 25 bp, Rattus norvegicus
gttatatttgaactagtcctggccc

SEQ ID NO: 523157 - DNA, 25 bp, Rattus norvegicus
gttatatttgaagtagtcctggccc

SEQ ID NO: 523158 - DNA, 25 bp, Rattus norvegicus
gttatatttgcaatctagccagagt

SEQ ID NO: 523159 - DNA, 25 bp, Rattus norvegicus
gttatatttgcattctagccagagt

SEQ ID NO: 523160 - DNA, 25 bp, Rattus norvegicus
gttatattttcccatctgtactctt

SEQ ID NO: 523161 - DNA, 25 bp, Rattus norvegicus
gttatattttccgatctgtactctt

SEQ ID NO: 523162 - DNA, 25 bp, Rattus norvegicus
gttatcaaaaataccatcattcata

SEQ ID NO: 523163 - DNA, 25 bp, Rattus norvegicus
gttatcaaaaattccatcattcata

SEQ ID NO: 523164 - DNA, 25 bp, Rattus norvegicus
gttatcaacaatagggtcaccatcc

SEQ ID NO: 523165 - DNA, 25 bp, Rattus norvegicus
gttatcaacaattgggtcaccatcc

SEQ ID NO: 523166 - DNA, 25 bp, Rattus norvegicus
gttatcaaccacagttgcgtgttgg

SEQ ID NO: 523167 - DNA, 25 bp, Rattus norvegicus
gttatcaaccactgttgcgtgttgg

SEQ ID NO: 523168 - DNA, 25 bp, Rattus norvegicus
gttatcaagtatacagcatcctgga

SEQ ID NO: 523169 - DNA, 25 bp, Rattus norvegicus
gttatcaagtattcagcatcctgga

SEQ ID NO: 523170 - DNA, 25 bp, Rattus norvegicus
gttatcaagtttcaggactcctttg

SEQ ID NO: 523171 - DNA, 25 bp, Rattus norvegicus
gttatcaagtttctatgtcacagca

SEQ ID NO: 523172 - DNA, 25 bp, Rattus norvegicus
gttatcaagtttgaggactcctttg

SEQ ID NO: 523173 - DNA, 25 bp, Rattus norvegicus
gttatcaagtttgtatgtcacagca

SEQ ID NO: 523174 - DNA, 25 bp, Rattus norvegicus
gttatcaatgctctcaatgtcacat

SEQ ID NO: 523175 - DNA, 25 bp, Rattus norvegicus
gttatcaatgctgtcaatgtcacat

SEQ ID NO: 523176 - DNA, 25 bp, Rattus norvegicus
gttatcaattaaaaccacgcctctt

SEQ ID NO: 523177 - DNA, 25 bp, Rattus norvegicus
gttatcaattaataccacgcctctt

SEQ ID NO: 523178 - DNA, 25 bp, Rattus norvegicus
gttatcacagaacgaagcctgcaga

SEQ ID NO: 523179 - DNA, 25 bp, Rattus norvegicus
gttatcacagaaggaagcctgcaga

SEQ ID NO: 523180 - DNA, 25 bp, Rattus norvegicus
gttatcacatttcggctgctcatac

SEQ ID NO: 523181 - DNA, 25 bp, Rattus norvegicus
gttatcacatttgggctgctcatac

SEQ ID NO: 523182 - DNA, 25 bp, Rattus norvegicus
gttatcacccaacatgccgtactca

SEQ ID NO: 523183 - DNA, 25 bp, Rattus norvegicus
gttatcacccaagatgccgtactca

SEQ ID NO: 523184 - DNA, 25 bp, Rattus norvegicus
gttatcaccctcatcagaaaccagt

SEQ ID NO: 523185 - DNA, 25 bp, Rattus norvegicus
gttatcaccctcttcagaaaccagt

SEQ ID NO: 523186 - DNA, 25 bp, Rattus norvegicus
gttatcacggcaacgcaggcgactc

SEQ ID NO: 523187 - DNA, 25 bp, Rattus norvegicus
gttatcacggcatcgcaggcgactc

SEQ ID NO: 523188 - DNA, 25 bp, Rattus norvegicus
gttatcactagaccattgtcacact

SEQ ID NO: 523189 - DNA, 25 bp, Rattus norvegicus
gttatcactagagcattgtcacact

SEQ ID NO: 523190 - DNA, 25 bp, Rattus norvegicus
gttatcactagtaaggtcctgtcat

SEQ ID NO: 523191 - DNA, 25 bp, Rattus norvegicus
gttatcactagttaggtcctgtcat

SEQ ID NO: 523192 - DNA, 25 bp, Rattus norvegicus
gttatcactgacaacacaccaagtt

SEQ ID NO: 523193 - DNA, 25 bp, Rattus norvegicus
gttatcactgactacacaccaagtt

SEQ ID NO: 523194 - DNA, 25 bp, Rattus norvegicus
gttatcactttgatccattcaggtc

SEQ ID NO: 523195 - DNA, 25 bp, Rattus norvegicus
gttatcactttgttccattcaggtc

SEQ ID NO: 523196 - DNA, 25 bp, Rattus norvegicus
gttatcacttttccttgctatctag

SEQ ID NO: 523197 - DNA, 25 bp, Rattus norvegicus
gttatcacttttgcttgctatctag

SEQ ID NO: 523198 - DNA, 25 bp, Rattus norvegicus
gttatcagatcccatgagccagtct

SEQ ID NO: 523199 - DNA, 25 bp, Rattus norvegicus
gttatcagatccgatgagccagtct

SEQ ID NO: 523200 - DNA, 25 bp, Rattus norvegicus
gttatcagatgccttgctattcaga

SEQ ID NO: 523201 - DNA, 25 bp, Rattus norvegicus
gttatcagatgcgttgctattcaga

SEQ ID NO: 523202 - DNA, 25 bp, Rattus norvegicus
gttatcagctgcacaacctgttttc

SEQ ID NO: 523203 - DNA, 25 bp, Rattus norvegicus
gttatcagctgctcaacctgttttc

SEQ ID NO: 523204 - DNA, 25 bp, Rattus norvegicus
gttatcagtccactacaaacacgct

SEQ ID NO: 523205 - DNA, 25 bp, Rattus norvegicus
gttatcagtccagtacaaacacgct

SEQ ID NO: 523206 - DNA, 25 bp, Rattus norvegicus
gttatcagtcctctgtatcagttga

SEQ ID NO: 523207 - DNA, 25 bp, Rattus norvegicus
gttatcagtcctgtgtatcagttga

SEQ ID NO: 523208 - DNA, 25 bp, Rattus norvegicus
gttatcagttgtacagggctatcct

SEQ ID NO: 523209 - DNA, 25 bp, Rattus norvegicus
gttatcagttgttcagggctatcct

SEQ ID NO: 523210 - DNA, 25 bp, Rattus norvegicus
gttatcagtttcatgagggctcctt

SEQ ID NO: 523211 - DNA, 25 bp, Rattus norvegicus
gttatcagtttcttgagggctcctt

SEQ ID NO: 523212 - DNA, 25 bp, Rattus norvegicus
gttatcatattcacatttggagccc

SEQ ID NO: 523213 - DNA, 25 bp, Rattus norvegicus
gttatcatattctcatttggagccc

SEQ ID NO: 523214 - DNA, 25 bp, Rattus norvegicus
gttatcatcgcaagtcgaggcagtg

SEQ ID NO: 523215 - DNA, 25 bp, Rattus norvegicus
gttatcatcgcatgtcgaggcagtg

SEQ ID NO: 523216 - DNA, 25 bp, Rattus norvegicus
gttatcatggccacaaaccgaatag

SEQ ID NO: 523217 - DNA, 25 bp, Rattus norvegicus
gttatcatggcctcaaaccgaatag

SEQ ID NO: 523218 - DNA, 25 bp, Rattus norvegicus
gttatcattaatactagctcggtct

SEQ ID NO: 523219 - DNA, 25 bp, Rattus norvegicus
gttatcattaattctagctcggtct

SEQ ID NO: 523220 - DNA, 25 bp, Rattus norvegicus
gttatcattattcaggcatgccgtg

SEQ ID NO: 523221 - DNA, 25 bp, Rattus norvegicus
gttatcattattgaggcatgccgtg

SEQ ID NO: 523222 - DNA, 25 bp, Rattus norvegicus
gttatccaaaacctgggcggccagc

SEQ ID NO: 523223 - DNA, 25 bp, Rattus norvegicus
gttatccaaaacgtgggcggccagc

SEQ ID NO: 523224 - DNA, 25 bp, Rattus norvegicus
gttatccaaggccaaactgcttttc

SEQ ID NO: 523225 - DNA, 25 bp, Rattus norvegicus
gttatccaaggcgaaactgcttttc

SEQ ID NO: 523226 - DNA, 25 bp, Rattus norvegicus
gttatccacctcatgagttactgtg

SEQ ID NO: 523227 - DNA, 25 bp, Rattus norvegicus
gttatccacctcttgagttactgtg

SEQ ID NO: 523228 - DNA, 25 bp, Rattus norvegicus
gttatccagttaagctcaccagtag

SEQ ID NO: 523229 - DNA, 25 bp, Rattus norvegicus
gttatccagttatgctcaccagtag

SEQ ID NO: 523230 - DNA, 25 bp, Rattus norvegicus
gttatccattataatgcctcttctc

SEQ ID NO: 523231 - DNA, 25 bp, Rattus norvegicus
gttatccattattatgcctcttctc

SEQ ID NO: 523232 - DNA, 25 bp, Rattus norvegicus
gttatcccactcacctttaataaat

SEQ ID NO: 523233 - DNA, 25 bp, Rattus norvegicus
gttatcccactctcctttaataaat

SEQ ID NO: 523234 - DNA, 25 bp, Rattus norvegicus
gttatcccatttaggtgttgttcta

SEQ ID NO: 523235 - DNA, 25 bp, Rattus norvegicus
gttatcccattttggtgttgttcta

SEQ ID NO: 523236 - DNA, 25 bp, Rattus norvegicus
gttatccccacaatcactgggagaa

SEQ ID NO: 523237 - DNA, 25 bp, Rattus norvegicus
gttatccccacattcactgggagaa

SEQ ID NO: 523238 - DNA, 25 bp, Rattus norvegicus
gttatccctcctatcaaaatttatg

SEQ ID NO: 523239 - DNA, 25 bp, Rattus norvegicus
gttatccctcctttcaaaatttatg

SEQ ID NO: 523240 - DNA, 25 bp, Rattus norvegicus
gttatccctgccaaacttcaagtaa

SEQ ID NO: 523241 - DNA, 25 bp, Rattus norvegicus
gttatccctgcctaacttcaagtaa

SEQ ID NO: 523242 - DNA, 25 bp, Rattus norvegicus
gttatccgagacatcagatttccaa

SEQ ID NO: 523243 - DNA, 25 bp, Rattus norvegicus
gttatccgagacttcagatttccaa

SEQ ID NO: 523244 - DNA, 25 bp, Rattus norvegicus
gttatccgtaacatggcaactctgg

SEQ ID NO: 523245 - DNA, 25 bp, Rattus norvegicus
gttatccgtaacttggcaactctgg

SEQ ID NO: 523246 - DNA, 25 bp, Rattus norvegicus
gttatcctagaaacatccaaccctg

SEQ ID NO: 523247 - DNA, 25 bp, Rattus norvegicus
gttatcctagaatcatccaaccctg

SEQ ID NO: 523248 - DNA, 25 bp, Rattus norvegicus
gttatcctcaaaaaagccaccgcct

SEQ ID NO: 523249 - DNA, 25 bp, Rattus norvegicus
gttatcctcaaataagccaccgcct

SEQ ID NO: 523250 - DNA, 25 bp, Rattus norvegicus
gttatcctcatcatctgttctatta

SEQ ID NO: 523251 - DNA, 25 bp, Rattus norvegicus
gttatcctcatcttctgttctatta

SEQ ID NO: 523252 - DNA, 25 bp, Rattus norvegicus
gttatcctccatccaagacttggag

SEQ ID NO: 523253 - DNA, 25 bp, Rattus norvegicus
gttatcctccatgcaagacttggag

SEQ ID NO: 523254 - DNA, 25 bp, Rattus norvegicus
gttatcctctagacctggagctgag

SEQ ID NO: 523255 - DNA, 25 bp, Rattus norvegicus
gttatcctctagtcctggagctgag

SEQ ID NO: 523256 - DNA, 25 bp, Rattus norvegicus
gttatcctgacacttaaggcatcag

SEQ ID NO: 523257 - DNA, 25 bp, Rattus norvegicus
gttatcctgacagttaaggcatcag

SEQ ID NO: 523258 - DNA, 25 bp, Rattus norvegicus
gttatcctgggaaacctcggaacag

SEQ ID NO: 523259 - DNA, 25 bp, Rattus norvegicus
gttatcctgggatacctcggaacag

SEQ ID NO: 523260 - DNA, 25 bp, Rattus norvegicus
gttatccttgaacattcattttgca

SEQ ID NO: 523261 - DNA, 25 bp, Rattus norvegicus
gttatccttgaagattcattttgca

SEQ ID NO: 523262 - DNA, 25 bp, Rattus norvegicus
gttatcctttagcaggctgcacacc

SEQ ID NO: 523263 - DNA, 25 bp, Rattus norvegicus
gttatcctttaggaggctgcacacc

SEQ ID NO: 523264 - DNA, 25 bp, Rattus norvegicus
gttatccttttgctacattctatgt

SEQ ID NO: 523265 - DNA, 25 bp, Rattus norvegicus
gttatccttttggtacattctatgt

SEQ ID NO: 523266 - DNA, 25 bp, Rattus norvegicus
gttatcgaataaaaacgacttcaga

SEQ ID NO: 523267 - DNA, 25 bp, Rattus norvegicus
gttatcgaataataacgacttcaga

SEQ ID NO: 523268 - DNA, 25 bp, Rattus norvegicus
gttatcgacacacgctagaagacaa

SEQ ID NO: 523269 - DNA, 25 bp, Rattus norvegicus
gttatcgacacaggctagaagacaa

SEQ ID NO: 523270 - DNA, 25 bp, Rattus norvegicus
gttatcgattatccaggcaaaattc

SEQ ID NO: 523271 - DNA, 25 bp, Rattus norvegicus
gttatcgattatgcaggcaaaattc

SEQ ID NO: 523272 - DNA, 25 bp, Rattus norvegicus
gttatcgccgctcgccaacgaatgt

SEQ ID NO: 523273 - DNA, 25 bp, Rattus norvegicus
gttatcgccgctggccaacgaatgt

SEQ ID NO: 523274 - DNA, 25 bp, Rattus norvegicus
gttatcgccttactcgacacatgaa

SEQ ID NO: 523275 - DNA, 25 bp, Rattus norvegicus
gttatcgccttagtcgacacatgaa

SEQ ID NO: 523276 - DNA, 25 bp, Rattus norvegicus
gttatcgtaggacctatccgacccc

SEQ ID NO: 523277 - DNA, 25 bp, Rattus norvegicus
gttatcgtaggagctatccgacccc

SEQ ID NO: 523278 - DNA, 25 bp, Rattus norvegicus
gttatcgtcaacaatcagtgctcta

SEQ ID NO: 523279 - DNA, 25 bp, Rattus norvegicus
gttatcgtcaactatcagtgctcta

SEQ ID NO: 523280 - DNA, 25 bp, Rattus norvegicus
gttatctacaaaccccattctcatt

SEQ ID NO: 523281 - DNA, 25 bp, Rattus norvegicus
gttatctacaaactgaccgatccct

SEQ ID NO: 523282 - DNA, 25 bp, Rattus norvegicus
gttatctacaaagcccattctcatt

SEQ ID NO: 523283 - DNA, 25 bp, Rattus norvegicus
gttatctacaaagtgaccgatccct

SEQ ID NO: 523284 - DNA, 25 bp, Rattus norvegicus
gttatctacaccattttcaaccacg

SEQ ID NO: 523285 - DNA, 25 bp, Rattus norvegicus
gttatctacacctttttcaaccacg

SEQ ID NO: 523286 - DNA, 25 bp, Rattus norvegicus
gttatctacctgaaacccattgtga

SEQ ID NO: 523287 - DNA, 25 bp, Rattus norvegicus
gttatctacctgtaacccattgtga

SEQ ID NO: 523288 - DNA, 25 bp, Rattus norvegicus
gttatctagataagcagttgaactt

SEQ ID NO: 523289 - DNA, 25 bp, Rattus norvegicus
gttatctagatatgcagttgaactt

SEQ ID NO: 523290 - DNA, 25 bp, Rattus norvegicus
gttatctagcctccctgagaggcaa

SEQ ID NO: 523291 - DNA, 25 bp, Rattus norvegicus
gttatctagcctgcctgagaggcaa

SEQ ID NO: 523292 - DNA, 25 bp, Rattus norvegicus
gttatctatccaccaatgtcacctc

SEQ ID NO: 523293 - DNA, 25 bp, Rattus norvegicus
gttatctatccagcaatgtcacctc

SEQ ID NO: 523294 - DNA, 25 bp, Rattus norvegicus
gttatctcacttcctcggagtctga

SEQ ID NO: 523295 - DNA, 25 bp, Rattus norvegicus
gttatctcacttgctcggagtctga

SEQ ID NO: 523296 - DNA, 25 bp, Rattus norvegicus
gttatctcagagaagcccatttcat

SEQ ID NO: 523297 - DNA, 25 bp, Rattus norvegicus
gttatctcagagtagcccatttcat

SEQ ID NO: 523298 - DNA, 25 bp, Rattus norvegicus
gttatctcagctcgcaacaatagtt

SEQ ID NO: 523299 - DNA, 25 bp, Rattus norvegicus
gttatctcagctggcaacaatagtt

SEQ ID NO: 523300 - DNA, 25 bp, Rattus norvegicus
gttatctcatttctacctaagtcct

SEQ ID NO: 523301 - DNA, 25 bp, Rattus norvegicus
gttatctcatttgtacctaagtcct

SEQ ID NO: 523302 - DNA, 25 bp, Rattus norvegicus
gttatctcgcctccgggctggaaga

SEQ ID NO: 523303 - DNA, 25 bp, Rattus norvegicus
gttatctcgcctgcgggctggaaga

SEQ ID NO: 523304 - DNA, 25 bp, Rattus norvegicus
gttatctctaaacgcactccggtga

SEQ ID NO: 523305 - DNA, 25 bp, Rattus norvegicus
gttatctctaaaggcactccggtga

SEQ ID NO: 523306 - DNA, 25 bp, Rattus norvegicus
gttatctctagtattatatcacatt

SEQ ID NO: 523307 - DNA, 25 bp, Rattus norvegicus
gttatctctagttttatatcacatt

SEQ ID NO: 523308 - DNA, 25 bp, Rattus norvegicus
gttatctctatcatgtgtatccttt

SEQ ID NO: 523309 - DNA, 25 bp, Rattus norvegicus
gttatctctatcttgtgtatccttt

SEQ ID NO: 523310 - DNA, 25 bp, Rattus norvegicus
gttatctctgctaaagtcttcattg

SEQ ID NO: 523311 - DNA, 25 bp, Rattus norvegicus
gttatctctgcttaagtcttcattg

SEQ ID NO: 523312 - DNA, 25 bp, Rattus norvegicus
gttatctctttcatgcttggtgttt

SEQ ID NO: 523313 - DNA, 25 bp, Rattus norvegicus
gttatctctttcttgcttggtgttt

SEQ ID NO: 523314 - DNA, 25 bp, Rattus norvegicus
gttatctgacttaagcactttacaa

SEQ ID NO: 523315 - DNA, 25 bp, Rattus norvegicus
gttatctgactttagcactttacaa

SEQ ID NO: 523316 - DNA, 25 bp, Rattus norvegicus
gttatctgagggagccgagagccac

SEQ ID NO: 523317 - DNA, 25 bp, Rattus norvegicus
gttatctgagggtgccgagagccac

SEQ ID NO: 523318 - DNA, 25 bp, Rattus norvegicus
gttatctgcatcaagaaagacatca

SEQ ID NO: 523319 - DNA, 25 bp, Rattus norvegicus
gttatctgcatctagaaagacatca

SEQ ID NO: 523320 - DNA, 25 bp, Rattus norvegicus
gttatctgcgtgaccattgctggcg

SEQ ID NO: 523321 - DNA, 25 bp, Rattus norvegicus
gttatctgcgtgtccattgctggcg

SEQ ID NO: 523322 - DNA, 25 bp, Rattus norvegicus
gttatctggaacagtcatgctgcct

SEQ ID NO: 523323 - DNA, 25 bp, Rattus norvegicus
gttatctggaactgtcatgctgcct

SEQ ID NO: 523324 - DNA, 25 bp, Rattus norvegicus
gttatctgggtaaagtggcacttgc

SEQ ID NO: 523325 - DNA, 25 bp, Rattus norvegicus
gttatctgggtatagtggcacttgc

SEQ ID NO: 523326 - DNA, 25 bp, Rattus norvegicus
gttatctgtcctcaattatagcact

SEQ ID NO: 523327 - DNA, 25 bp, Rattus norvegicus
gttatctgtcctgaattatagcact

SEQ ID NO: 523328 - DNA, 25 bp, Rattus norvegicus
gttatctgtggcattgtcttctacg

SEQ ID NO: 523329 - DNA, 25 bp, Rattus norvegicus
gttatctgtggctttgtcttctacg

SEQ ID NO: 523330 - DNA, 25 bp, Rattus norvegicus
gttatcttaactccgtgtttatcta

SEQ ID NO: 523331 - DNA, 25 bp, Rattus norvegicus
gttatcttaactgcgtgtttatcta

SEQ ID NO: 523332 - DNA, 25 bp, Rattus norvegicus
gttatcttacttcagcactccaaaa

SEQ ID NO: 523333 - DNA, 25 bp, Rattus norvegicus
gttatcttacttgagcactccaaaa

SEQ ID NO: 523334 - DNA, 25 bp, Rattus norvegicus
gttatcttcagaatggagccaccac

SEQ ID NO: 523335 - DNA, 25 bp, Rattus norvegicus
gttatcttcagattggagccaccac

SEQ ID NO: 523336 - DNA, 25 bp, Rattus norvegicus
gttatcttcagcatctttaatgcgt

SEQ ID NO: 523337 - DNA, 25 bp, Rattus norvegicus
gttatcttcagcttctttaatgcgt

SEQ ID NO: 523338 - DNA, 25 bp, Rattus norvegicus
gttatcttctgtctgttacctagca

SEQ ID NO: 523339 - DNA, 25 bp, Rattus norvegicus
gttatcttctgtgtgttacctagca

SEQ ID NO: 523340 - DNA, 25 bp, Rattus norvegicus
gttatcttcttcattgttagtcagg

SEQ ID NO: 523341 - DNA, 25 bp, Rattus norvegicus
gttatcttcttctttgttagtcagg

SEQ ID NO: 523342 - DNA, 25 bp, Rattus norvegicus
gttatcttgactacgtagtgttcac

SEQ ID NO: 523343 - DNA, 25 bp, Rattus norvegicus
gttatcttgacttcgtagtgttcac

SEQ ID NO: 523344 - DNA, 25 bp, Rattus norvegicus
gttatcttgccaactcttttccttc

SEQ ID NO: 523345 - DNA, 25 bp, Rattus norvegicus
gttatcttgccatctcttttccttc

SEQ ID NO: 523346 - DNA, 25 bp, Rattus norvegicus
gttatcttgtaaacgagcctctcca

SEQ ID NO: 523347 - DNA, 25 bp, Rattus norvegicus
gttatcttgtaatcgagcctctcca

SEQ ID NO: 523348 - DNA, 25 bp, Rattus norvegicus
gttatcttgtttatcttggacttca

SEQ ID NO: 523349 - DNA, 25 bp, Rattus norvegicus
gttatcttgtttttcttggacttca

SEQ ID NO: 523350 - DNA, 25 bp, Rattus norvegicus
gttatctttacgattgaactgactc

SEQ ID NO: 523351 - DNA, 25 bp, Rattus norvegicus
gttatctttacgtttgaactgactc

SEQ ID NO: 523352 - DNA, 25 bp, Rattus norvegicus
gttatctttgagagattggtctcct

SEQ ID NO: 523353 - DNA, 25 bp, Rattus norvegicus
gttatctttgagtgattggtctcct

SEQ ID NO: 523354 - DNA, 25 bp, Rattus norvegicus
gttatcttttctcctttctgacaca

SEQ ID NO: 523355 - DNA, 25 bp, Rattus norvegicus
gttatcttttctgctttctgacaca

SEQ ID NO: 523356 - DNA, 25 bp, Rattus norvegicus
gttatgaaacgcagatccggtcagc

SEQ ID NO: 523357 - DNA, 25 bp, Rattus norvegicus
gttatgaaacgctgatccggtcagc

SEQ ID NO: 523358 - DNA, 25 bp, Rattus norvegicus
gttatgaacactatacacagtcaat

SEQ ID NO: 523359 - DNA, 25 bp, Rattus norvegicus
gttatgaacactttacacagtcaat

SEQ ID NO: 523360 - DNA, 25 bp, Rattus norvegicus
gttatgaacatcagagtctctctta

SEQ ID NO: 523361 - DNA, 25 bp, Rattus norvegicus
gttatgaacatctgagtctctctta

SEQ ID NO: 523362 - DNA, 25 bp, Rattus norvegicus
gttatgaatcctatatctgtttgta

SEQ ID NO: 523363 - DNA, 25 bp, Rattus norvegicus
gttatgaatcctttatctgtttgta

SEQ ID NO: 523364 - DNA, 25 bp, Rattus norvegicus
gttatgaatgggagctactcgagac

SEQ ID NO: 523365 - DNA, 25 bp, Rattus norvegicus
gttatgaatgggtgctactcgagac

SEQ ID NO: 523366 - DNA, 25 bp, Rattus norvegicus
gttatgacaagcatcccaaatattt

SEQ ID NO: 523367 - DNA, 25 bp, Rattus norvegicus
gttatgacaagcttcccaaatattt

SEQ ID NO: 523368 - DNA, 25 bp, Rattus norvegicus
gttatgaccaagcagagtaaactac

SEQ ID NO: 523369 - DNA, 25 bp, Rattus norvegicus
gttatgaccaaggagagtaaactac

SEQ ID NO: 523370 - DNA, 25 bp, Rattus norvegicus
gttatgacccatcagaggccttaag

SEQ ID NO: 523371 - DNA, 25 bp, Rattus norvegicus
gttatgacccatgagaggccttaag

SEQ ID NO: 523372 - DNA, 25 bp, Rattus norvegicus
gttatgaccgggaccatgtggtgct

SEQ ID NO: 523373 - DNA, 25 bp, Rattus norvegicus
gttatgaccgggtccatgtggtgct

SEQ ID NO: 523374 - DNA, 25 bp, Rattus norvegicus
gttatgactaacagctctttggctc

SEQ ID NO: 523375 - DNA, 25 bp, Rattus norvegicus
gttatgactaactgctctttggctc

SEQ ID NO: 523376 - DNA, 25 bp, Rattus norvegicus
gttatgacttaacgcccagcttcct

SEQ ID NO: 523377 - DNA, 25 bp, Rattus norvegicus
gttatgacttaaggcccagcttcct

SEQ ID NO: 523378 - DNA, 25 bp, Rattus norvegicus
gttatgagagctccccagatggaca

SEQ ID NO: 523379 - DNA, 25 bp, Rattus norvegicus
gttatgagagctgcccagatggaca

SEQ ID NO: 523380 - DNA, 25 bp, Rattus norvegicus
gttatgagcggaacggacccttggc

SEQ ID NO: 523381 - DNA, 25 bp, Rattus norvegicus
gttatgagcggatcggacccttggc

SEQ ID NO: 523382 - DNA, 25 bp, Rattus norvegicus
gttatgaggtcccagaccttcgcac

SEQ ID NO: 523383 - DNA, 25 bp, Rattus norvegicus
gttatgaggtccgagaccttcgcac

SEQ ID NO: 523384 - DNA, 25 bp, Rattus norvegicus
gttatgatgctactttaacccctag

SEQ ID NO: 523385 - DNA, 25 bp, Rattus norvegicus
gttatgatgctagtttaacccctag

SEQ ID NO: 523386 - DNA, 25 bp, Rattus norvegicus
gttatgatttgaaaagctcccctgt

SEQ ID NO: 523387 - DNA, 25 bp, Rattus norvegicus
gttatgatttgataagctcccctgt

SEQ ID NO: 523388 - DNA, 25 bp, Rattus norvegicus
gttatgcacagtctgtgtctgcctg

SEQ ID NO: 523389 - DNA, 25 bp, Rattus norvegicus
gttatgcacagtgtgtgtctgcctg

SEQ ID NO: 523390 - DNA, 25 bp, Rattus norvegicus
gttatgcaccgaccgaattttcgac

SEQ ID NO: 523391 - DNA, 25 bp, Rattus norvegicus
gttatgcaccgagcgaattttcgac

SEQ ID NO: 523392 - DNA, 25 bp, Rattus norvegicus
gttatgcacttaacaaggtatacag

SEQ ID NO: 523393 - DNA, 25 bp, Rattus norvegicus
gttatgcacttatcaaggtatacag

SEQ ID NO: 523394 - DNA, 25 bp, Rattus norvegicus
gttatgccaaaacagtcgcgggtca

SEQ ID NO: 523395 - DNA, 25 bp, Rattus norvegicus
gttatgccaaaagagtcgcgggtca

SEQ ID NO: 523396 - DNA, 25 bp, Rattus norvegicus
gttatgccacagaaatggagctcta

SEQ ID NO: 523397 - DNA, 25 bp, Rattus norvegicus
gttatgccacagtaatggagctcta

SEQ ID NO: 523398 - DNA, 25 bp, Rattus norvegicus
gttatgcccataattagtgtactct

SEQ ID NO: 523399 - DNA, 25 bp, Rattus norvegicus
gttatgcccatatttagtgtactct

SEQ ID NO: 523400 - DNA, 25 bp, Rattus norvegicus
gttatgcctgaaacgccacaggtga

SEQ ID NO: 523401 - DNA, 25 bp, Rattus norvegicus
gttatgcctgaatcgccacaggtga

SEQ ID NO: 523402 - DNA, 25 bp, Rattus norvegicus
gttatgccttccaggattgcttcaa

SEQ ID NO: 523403 - DNA, 25 bp, Rattus norvegicus
gttatgccttcctggattgcttcaa

SEQ ID NO: 523404 - DNA, 25 bp, Rattus norvegicus
gttatgctaataatccaccttgaaa

SEQ ID NO: 523405 - DNA, 25 bp, Rattus norvegicus
gttatgctaatattccaccttgaaa

SEQ ID NO: 523406 - DNA, 25 bp, Rattus norvegicus
gttatgctacggaataaagcacccc

SEQ ID NO: 523407 - DNA, 25 bp, Rattus norvegicus
gttatgctacggtataaagcacccc

SEQ ID NO: 523408 - DNA, 25 bp, Rattus norvegicus
gttatgctgctaattctctacatgc

SEQ ID NO: 523409 - DNA, 25 bp, Rattus norvegicus
gttatgctgctatttctctacatgc

SEQ ID NO: 523410 - DNA, 25 bp, Rattus norvegicus
gttatgctggacataacagatattt

SEQ ID NO: 523411 - DNA, 25 bp, Rattus norvegicus
gttatgctggacttaacagatattt

SEQ ID NO: 523412 - DNA, 25 bp, Rattus norvegicus
gttatggaaactacccttctcacat

SEQ ID NO: 523413 - DNA, 25 bp, Rattus norvegicus
gttatggaaacttcccttctcacat

SEQ ID NO: 523414 - DNA, 25 bp, Rattus norvegicus
gttatggacgccacatctctgagct

SEQ ID NO: 523415 - DNA, 25 bp, Rattus norvegicus
gttatggacgcctcatctctgagct

SEQ ID NO: 523416 - DNA, 25 bp, Rattus norvegicus
gttatggacttactacgagagcttt

SEQ ID NO: 523417 - DNA, 25 bp, Rattus norvegicus
gttatggacttagtacgagagcttt

SEQ ID NO: 523418 - DNA, 25 bp, Rattus norvegicus
gttatggataacactcaatcttgga

SEQ ID NO: 523419 - DNA, 25 bp, Rattus norvegicus
gttatggataactctcaatcttgga

SEQ ID NO: 523420 - DNA, 25 bp, Rattus norvegicus
gttatggatatcagctctcaatcaa

SEQ ID NO: 523421 - DNA, 25 bp, Rattus norvegicus
gttatggatatctgctctcaatcaa

SEQ ID NO: 523422 - DNA, 25 bp, Rattus norvegicus
gttatggcagaaaccacctgagaga

SEQ ID NO: 523423 - DNA, 25 bp, Rattus norvegicus
gttatggcagaatccacctgagaga

SEQ ID NO: 523424 - DNA, 25 bp, Rattus norvegicus
gttatggccctcacatttaaaccag

SEQ ID NO: 523425 - DNA, 25 bp, Rattus norvegicus
gttatggccctctcatttaaaccag

SEQ ID NO: 523426 - DNA, 25 bp, Rattus norvegicus
gttatggcctaaacaatcccatggg

SEQ ID NO: 523427 - DNA, 25 bp, Rattus norvegicus
gttatggcctaatcaatcccatggg

SEQ ID NO: 523428 - DNA, 25 bp, Rattus norvegicus
gttatggcttctcattaactgcccc

SEQ ID NO: 523429 - DNA, 25 bp, Rattus norvegicus
gttatggcttctgattaactgcccc

SEQ ID NO: 523430 - DNA, 25 bp, Rattus norvegicus
gttatggcttttaccagaccagaaa

SEQ ID NO: 523431 - DNA, 25 bp, Rattus norvegicus
gttatggctttttccagaccagaaa

SEQ ID NO: 523432 - DNA, 25 bp, Rattus norvegicus
gttatgggagctcttacctttttct

SEQ ID NO: 523433 - DNA, 25 bp, Rattus norvegicus
gttatgggagctgttacctttttct

SEQ ID NO: 523434 - DNA, 25 bp, Rattus norvegicus
gttatgggatctaacagacctctag

SEQ ID NO: 523435 - DNA, 25 bp, Rattus norvegicus
gttatgggatcttacagacctctag

SEQ ID NO: 523436 - DNA, 25 bp, Rattus norvegicus
gttatgggcccaagacttacattaa

SEQ ID NO: 523437 - DNA, 25 bp, Rattus norvegicus
gttatgggcccatgacttacattaa

SEQ ID NO: 523438 - DNA, 25 bp, Rattus norvegicus
gttatgggcctgcaagtcttctgac

SEQ ID NO: 523439 - DNA, 25 bp, Rattus norvegicus
gttatgggcctggaagtcttctgac

SEQ ID NO: 523440 - DNA, 25 bp, Rattus norvegicus
gttatggtcactcacacttccattg

SEQ ID NO: 523441 - DNA, 25 bp, Rattus norvegicus
gttatggtcactgacacttccattg

SEQ ID NO: 523442 - DNA, 25 bp, Rattus norvegicus
gttatggtctacattccatcctgat

SEQ ID NO: 523443 - DNA, 25 bp, Rattus norvegicus
gttatggtctactttccatcctgat

SEQ ID NO: 523444 - DNA, 25 bp, Rattus norvegicus
gttatggtgcatacttggctcagcc

SEQ ID NO: 523445 - DNA, 25 bp, Rattus norvegicus
gttatggtgcattcttggctcagcc

SEQ ID NO: 523446 - DNA, 25 bp, Rattus norvegicus
gttatggttatgaccttgctgctac

SEQ ID NO: 523447 - DNA, 25 bp, Rattus norvegicus
gttatggttatgtccttgctgctac

SEQ ID NO: 523448 - DNA, 25 bp, Rattus norvegicus
gttatgtaagcaactggactcccgc

SEQ ID NO: 523449 - DNA, 25 bp, Rattus norvegicus
gttatgtaagcactagggctctcac

SEQ ID NO: 523450 - DNA, 25 bp, Rattus norvegicus
gttatgtaagcagtagggctctcac

SEQ ID NO: 523451 - DNA, 25 bp, Rattus norvegicus
gttatgtaagcatctggactcccgc

SEQ ID NO: 523452 - DNA, 25 bp, Rattus norvegicus
gttatgtaagccacggtgcactcta

SEQ ID NO: 523453 - DNA, 25 bp, Rattus norvegicus
gttatgtaagcctcggtgcactcta

SEQ ID NO: 523454 - DNA, 25 bp, Rattus norvegicus
gttatgtagacgaggatgactttga

SEQ ID NO: 523455 - DNA, 25 bp, Rattus norvegicus
gttatgtagacgtggatgactttga

SEQ ID NO: 523456 - DNA, 25 bp, Rattus norvegicus
gttatgtagcatatttctctgttgc

SEQ ID NO: 523457 - DNA, 25 bp, Rattus norvegicus
gttatgtagcatttttctctgttgc

SEQ ID NO: 523458 - DNA, 25 bp, Rattus norvegicus
gttatgtagtcaacaagccccgtat

SEQ ID NO: 523459 - DNA, 25 bp, Rattus norvegicus
gttatgtagtcatcaagccccgtat

SEQ ID NO: 523460 - DNA, 25 bp, Rattus norvegicus
gttatgtatctaatcaccacagcac

SEQ ID NO: 523461 - DNA, 25 bp, Rattus norvegicus
gttatgtatctattcaccacagcac

SEQ ID NO: 523462 - DNA, 25 bp, Rattus norvegicus
gttatgtatgttactgcatgtgtca

SEQ ID NO: 523463 - DNA, 25 bp, Rattus norvegicus
gttatgtatgtttctgcatgtgtca

SEQ ID NO: 523464 - DNA, 25 bp, Rattus norvegicus
gttatgtatttgatatgcttcctat

SEQ ID NO: 523465 - DNA, 25 bp, Rattus norvegicus
gttatgtatttgttatgcttcctat

SEQ ID NO: 523466 - DNA, 25 bp, Rattus norvegicus
gttatgtcaccccagctaggaagac

SEQ ID NO: 523467 - DNA, 25 bp, Rattus norvegicus
gttatgtcacccgagctaggaagac

SEQ ID NO: 523468 - DNA, 25 bp, Rattus norvegicus
gttatgtcagtactgcagcctggaa

SEQ ID NO: 523469 - DNA, 25 bp, Rattus norvegicus
gttatgtcagtagtgcagcctggaa

SEQ ID NO: 523470 - DNA, 25 bp, Rattus norvegicus
gttatgtccacacccactgtttaaa

SEQ ID NO: 523471 - DNA, 25 bp, Rattus norvegicus
gttatgtccacagccactgtttaaa

SEQ ID NO: 523472 - DNA, 25 bp, Rattus norvegicus
gttatgtcccagacctttctgagac

SEQ ID NO: 523473 - DNA, 25 bp, Rattus norvegicus
gttatgtcccagtcctttctgagac

SEQ ID NO: 523474 - DNA, 25 bp, Rattus norvegicus
gttatgtctacaaacctgttccttt

SEQ ID NO: 523475 - DNA, 25 bp, Rattus norvegicus
gttatgtctacatacctgttccttt

SEQ ID NO: 523476 - DNA, 25 bp, Rattus norvegicus
gttatgtctcctaagtgacacccat

SEQ ID NO: 523477 - DNA, 25 bp, Rattus norvegicus
gttatgtctccttagtgacacccat

SEQ ID NO: 523478 - DNA, 25 bp, Rattus norvegicus
gttatgtctgttcattgcatcctga

SEQ ID NO: 523479 - DNA, 25 bp, Rattus norvegicus
gttatgtctgttgattgcatcctga

SEQ ID NO: 523480 - DNA, 25 bp, Rattus norvegicus
gttatgtgacaaacgggcaccggga

SEQ ID NO: 523481 - DNA, 25 bp, Rattus norvegicus
gttatgtgacaatcgggcaccggga

SEQ ID NO: 523482 - DNA, 25 bp, Rattus norvegicus
gttatgtgactaagcccctctggga

SEQ ID NO: 523483 - DNA, 25 bp, Rattus norvegicus
gttatgtgactatgcccctctggga

SEQ ID NO: 523484 - DNA, 25 bp, Rattus norvegicus
gttatgtgcaaaccagtatccagtt

SEQ ID NO: 523485 - DNA, 25 bp, Rattus norvegicus
gttatgtgcaaagcagtatccagtt

SEQ ID NO: 523486 - DNA, 25 bp, Rattus norvegicus
gttatgtgcaagcttctttttcctt

SEQ ID NO: 523487 - DNA, 25 bp, Rattus norvegicus
gttatgtgcaaggttctttttcctt

SEQ ID NO: 523488 - DNA, 25 bp, Rattus norvegicus
gttatgtgtcccctagagaacaact

SEQ ID NO: 523489 - DNA, 25 bp, Rattus norvegicus
gttatgtgtcccgtagagaacaact

SEQ ID NO: 523490 - DNA, 25 bp, Rattus norvegicus
gttatgttacagctgccgggtgaac

SEQ ID NO: 523491 - DNA, 25 bp, Rattus norvegicus
gttatgttacaggtgccgggtgaac

SEQ ID NO: 523492 - DNA, 25 bp, Rattus norvegicus
gttatgttagggaaacctcccatag

SEQ ID NO: 523493 - DNA, 25 bp, Rattus norvegicus
gttatgttagggtaacctcccatag

SEQ ID NO: 523494 - DNA, 25 bp, Rattus norvegicus
gttatgttcctacgttctgaccaaa

SEQ ID NO: 523495 - DNA, 25 bp, Rattus norvegicus
gttatgttcctaggttctgaccaaa

SEQ ID NO: 523496 - DNA, 25 bp, Rattus norvegicus
gttatgttccttacacgaaaaccag

SEQ ID NO: 523497 - DNA, 25 bp, Rattus norvegicus
gttatgttcctttcacgaaaaccag

SEQ ID NO: 523498 - DNA, 25 bp, Rattus norvegicus
gttatgttgattcttcatttttgcc

SEQ ID NO: 523499 - DNA, 25 bp, Rattus norvegicus
gttatgttgattgttcatttttgcc

SEQ ID NO: 523500 - DNA, 25 bp, Rattus norvegicus
gttatgtttctaaggcacaggcctc

SEQ ID NO: 523501 - DNA, 25 bp, Rattus norvegicus
gttatgtttctatggcacaggcctc

SEQ ID NO: 523502 - DNA, 25 bp, Rattus norvegicus
gttatgtttctcctggtgcagtacc

SEQ ID NO: 523503 - DNA, 25 bp, Rattus norvegicus
gttatgtttctcgtggtgcagtacc

SEQ ID NO: 523504 - DNA, 25 bp, Rattus norvegicus
gttattaacacccagtcaggtggct

SEQ ID NO: 523505 - DNA, 25 bp, Rattus norvegicus
gttattaacaccgagtcaggtggct

SEQ ID NO: 523506 - DNA, 25 bp, Rattus norvegicus
gttattaagtgaaagggatgccctg

SEQ ID NO: 523507 - DNA, 25 bp, Rattus norvegicus
gttattaagtgatagggatgccctg

SEQ ID NO: 523508 - DNA, 25 bp, Rattus norvegicus
gttattaagtgtagctccagtcatt

SEQ ID NO: 523509 - DNA, 25 bp, Rattus norvegicus
gttattaagtgttgctccagtcatt

SEQ ID NO: 523510 - DNA, 25 bp, Rattus norvegicus
gttattacagacattctagtttctc

SEQ ID NO: 523511 - DNA, 25 bp, Rattus norvegicus
gttattacagactttctagtttctc

SEQ ID NO: 523512 - DNA, 25 bp, Rattus norvegicus
gttattacatgcatttgatccacat

SEQ ID NO: 523513 - DNA, 25 bp, Rattus norvegicus
gttattacatgcttttgatccacat

SEQ ID NO: 523514 - DNA, 25 bp, Rattus norvegicus
gttattacctttatctttctagttg

SEQ ID NO: 523515 - DNA, 25 bp, Rattus norvegicus
gttattacctttttctttctagttg

SEQ ID NO: 523516 - DNA, 25 bp, Rattus norvegicus
gttattactcacagaagggccacat

SEQ ID NO: 523517 - DNA, 25 bp, Rattus norvegicus
gttattactcactgaagggccacat

SEQ ID NO: 523518 - DNA, 25 bp, Rattus norvegicus
gttattactctgacatactgtggga

SEQ ID NO: 523519 - DNA, 25 bp, Rattus norvegicus
gttattactctgtcatactgtggga

SEQ ID NO: 523520 - DNA, 25 bp, Rattus norvegicus
gttattacttgcaagagatccccag

SEQ ID NO: 523521 - DNA, 25 bp, Rattus norvegicus
gttattacttgctagagatccccag

SEQ ID NO: 523522 - DNA, 25 bp, Rattus norvegicus
gttattaggctcatcaagccatctt

SEQ ID NO: 523523 - DNA, 25 bp, Rattus norvegicus
gttattaggctcttcaagccatctt

SEQ ID NO: 523524 - DNA, 25 bp, Rattus norvegicus
gttattagttccaccatcatttggg

SEQ ID NO: 523525 - DNA, 25 bp, Rattus norvegicus
gttattagttcctccatcatttggg

SEQ ID NO: 523526 - DNA, 25 bp, Rattus norvegicus
gttattataatcactgcctcttgca

SEQ ID NO: 523527 - DNA, 25 bp, Rattus norvegicus
gttattataatctctgcctcttgca

SEQ ID NO: 523528 - DNA, 25 bp, Rattus norvegicus
gttattattcccattaccctttgtg

SEQ ID NO: 523529 - DNA, 25 bp, Rattus norvegicus
gttattattccctttaccctttgtg

SEQ ID NO: 523530 - DNA, 25 bp, Rattus norvegicus
gttattattctcattcctttgggct

SEQ ID NO: 523531 - DNA, 25 bp, Rattus norvegicus
gttattattctctttcctttgggct

SEQ ID NO: 523532 - DNA, 25 bp, Rattus norvegicus
gttattccaagcacttcttaggctc

SEQ ID NO: 523533 - DNA, 25 bp, Rattus norvegicus
gttattccaagctcttcttaggctc

SEQ ID NO: 523534 - DNA, 25 bp, Rattus norvegicus
gttattccattcctgctcattgtta

SEQ ID NO: 523535 - DNA, 25 bp, Rattus norvegicus
gttattccattcgtgctcattgtta

SEQ ID NO: 523536 - DNA, 25 bp, Rattus norvegicus
gttattccccggcaacacaagagag

SEQ ID NO: 523537 - DNA, 25 bp, Rattus norvegicus
gttattccccgggaacacaagagag

SEQ ID NO: 523538 - DNA, 25 bp, Rattus norvegicus
gttattcctgagagctggctgcaga

SEQ ID NO: 523539 - DNA, 25 bp, Rattus norvegicus
gttattcctgagtgctggctgcaga

SEQ ID NO: 523540 - DNA, 25 bp, Rattus norvegicus
gttattcctgtgctgatactcattg

SEQ ID NO: 523541 - DNA, 25 bp, Rattus norvegicus
gttattcctgtggtgatactcattg

SEQ ID NO: 523542 - DNA, 25 bp, Rattus norvegicus
gttattcgaaccattattactagtg

SEQ ID NO: 523543 - DNA, 25 bp, Rattus norvegicus
gttattcgaacctttattactagtg

SEQ ID NO: 523544 - DNA, 25 bp, Rattus norvegicus
gttattctatcacgacataccgaac

SEQ ID NO: 523545 - DNA, 25 bp, Rattus norvegicus
gttattctatcaggacataccgaac

SEQ ID NO: 523546 - DNA, 25 bp, Rattus norvegicus
gttattctattcaatcccaccaagc

SEQ ID NO: 523547 - DNA, 25 bp, Rattus norvegicus
gttattctattctatcccaccaagc

SEQ ID NO: 523548 - DNA, 25 bp, Rattus norvegicus
gttattctcagaaccttccaaaggc

SEQ ID NO: 523549 - DNA, 25 bp, Rattus norvegicus
gttattctcagatccttccaaaggc

SEQ ID NO: 523550 - DNA, 25 bp, Rattus norvegicus
gttattctcgcccataagcagttac

SEQ ID NO: 523551 - DNA, 25 bp, Rattus norvegicus
gttattctcgccgataagcagttac

SEQ ID NO: 523552 - DNA, 25 bp, Rattus norvegicus
gttattctctgaagcctgaagcctg

SEQ ID NO: 523553 - DNA, 25 bp, Rattus norvegicus
gttattctctgatgcctgaagcctg

SEQ ID NO: 523554 - DNA, 25 bp, Rattus norvegicus
gttattctcttacagaaaccattgt

SEQ ID NO: 523555 - DNA, 25 bp, Rattus norvegicus
gttattctcttagagaaaccattgt

SEQ ID NO: 523556 - DNA, 25 bp, Rattus norvegicus
gttattctgaagatccatccatgtg

SEQ ID NO: 523557 - DNA, 25 bp, Rattus norvegicus
gttattctgaagttccatccatgtg

SEQ ID NO: 523558 - DNA, 25 bp, Rattus norvegicus
gttattctggcgctaactccatgaa

SEQ ID NO: 523559 - DNA, 25 bp, Rattus norvegicus
gttattctggcggtaactccatgaa

SEQ ID NO: 523560 - DNA, 25 bp, Rattus norvegicus
gttattcttggcattgttaaacaca

SEQ ID NO: 523561 - DNA, 25 bp, Rattus norvegicus
gttattcttggctttgttaaacaca

SEQ ID NO: 523562 - DNA, 25 bp, Rattus norvegicus
gttattcttttaagaggtgcactca

SEQ ID NO: 523563 - DNA, 25 bp, Rattus norvegicus
gttattcttttatgaggtgcactca

SEQ ID NO: 523564 - DNA, 25 bp, Rattus norvegicus
gttattgataaacgctccaaactga

SEQ ID NO: 523565 - DNA, 25 bp, Rattus norvegicus
gttattgataaaggctccaaactga

SEQ ID NO: 523566 - DNA, 25 bp, Rattus norvegicus
gttattgatccgaatgaactctaaa

SEQ ID NO: 523567 - DNA, 25 bp, Rattus norvegicus
gttattgatccgtatgaactctaaa

SEQ ID NO: 523568 - DNA, 25 bp, Rattus norvegicus
gttattgcacatagtacttcctagt

SEQ ID NO: 523569 - DNA, 25 bp, Rattus norvegicus
gttattgcacattgtacttcctagt

SEQ ID NO: 523570 - DNA, 25 bp, Rattus norvegicus
gttattgcacttacatcttttggag

SEQ ID NO: 523571 - DNA, 25 bp, Rattus norvegicus
gttattgcactttcatcttttggag

SEQ ID NO: 523572 - DNA, 25 bp, Rattus norvegicus
gttattgcattgaggctgtgacttc

SEQ ID NO: 523573 - DNA, 25 bp, Rattus norvegicus
gttattgcattgtggctgtgacttc

SEQ ID NO: 523574 - DNA, 25 bp, Rattus norvegicus
gttattgctgagacttacctcgcta

SEQ ID NO: 523575 - DNA, 25 bp, Rattus norvegicus
gttattgctgagtcttacctcgcta

SEQ ID NO: 523576 - DNA, 25 bp, Rattus norvegicus
gttattggatggcgttccgtcctat

SEQ ID NO: 523577 - DNA, 25 bp, Rattus norvegicus
gttattggatggggttccgtcctat

SEQ ID NO: 523578 - DNA, 25 bp, Rattus norvegicus
gttattggcaaactcataaaccggg

SEQ ID NO: 523579 - DNA, 25 bp, Rattus norvegicus
gttattggcaaagtcataaaccggg

SEQ ID NO: 523580 - DNA, 25 bp, Rattus norvegicus
gttattggcctgataaacgctgctg

SEQ ID NO: 523581 - DNA, 25 bp, Rattus norvegicus
gttattggcctgttaaacgctgctg

SEQ ID NO: 523582 - DNA, 25 bp, Rattus norvegicus
gttattggtggacaggcttgcctat

SEQ ID NO: 523583 - DNA, 25 bp, Rattus norvegicus
gttattggtggagaggcttgcctat

SEQ ID NO: 523584 - DNA, 25 bp, Rattus norvegicus
gttattgtcacaccaagcttgtact

SEQ ID NO: 523585 - DNA, 25 bp, Rattus norvegicus
gttattgtcacagcaagcttgtact

SEQ ID NO: 523586 - DNA, 25 bp, Rattus norvegicus
gttattgtcactaatgcagctgtat

SEQ ID NO: 523587 - DNA, 25 bp, Rattus norvegicus
gttattgtcacttatgcagctgtat

SEQ ID NO: 523588 - DNA, 25 bp, Rattus norvegicus
gttattgtctaccttaaatgccttt

SEQ ID NO: 523589 - DNA, 25 bp, Rattus norvegicus
gttattgtctacgttaaatgccttt

SEQ ID NO: 523590 - DNA, 25 bp, Rattus norvegicus
gttattgtctttaggaggtctgctc

SEQ ID NO: 523591 - DNA, 25 bp, Rattus norvegicus
gttattgtcttttggaggtctgctc

SEQ ID NO: 523592 - DNA, 25 bp, Rattus norvegicus
gttattgttactacatcactgtcaa

SEQ ID NO: 523593 - DNA, 25 bp, Rattus norvegicus
gttattgttacttcatcactgtcaa

SEQ ID NO: 523594 - DNA, 25 bp, Rattus norvegicus
gttattgttcataatcttactggag

SEQ ID NO: 523595 - DNA, 25 bp, Rattus norvegicus
gttattgttcattatcttactggag

SEQ ID NO: 523596 - DNA, 25 bp, Rattus norvegicus
gttattgttgtcattcttattgcta

SEQ ID NO: 523597 - DNA, 25 bp, Rattus norvegicus
gttattgttgtctttcttattgcta

SEQ ID NO: 523598 - DNA, 25 bp, Rattus norvegicus
gttatttacactaatcagctcttgc

SEQ ID NO: 523599 - DNA, 25 bp, Rattus norvegicus
gttatttacacttatcagctcttgc

SEQ ID NO: 523600 - DNA, 25 bp, Rattus norvegicus
gttatttatcaaagcagccaacttt

SEQ ID NO: 523601 - DNA, 25 bp, Rattus norvegicus
gttatttatcaatgcagccaacttt

SEQ ID NO: 523602 - DNA, 25 bp, Rattus norvegicus
gttatttatggcaacattactcagg

SEQ ID NO: 523603 - DNA, 25 bp, Rattus norvegicus
gttatttatggctacattactcagg

SEQ ID NO: 523604 - DNA, 25 bp, Rattus norvegicus
gttatttattcactttgcccacaga

SEQ ID NO: 523605 - DNA, 25 bp, Rattus norvegicus
gttatttattcagtttgcccacaga

SEQ ID NO: 523606 - DNA, 25 bp, Rattus norvegicus
gttatttattgtaatcctggtctcc

SEQ ID NO: 523607 - DNA, 25 bp, Rattus norvegicus
gttatttattgttatcctggtctcc

SEQ ID NO: 523608 - DNA, 25 bp, Rattus norvegicus
gttatttatttccatccgaggctct

SEQ ID NO: 523609 - DNA, 25 bp, Rattus norvegicus
gttatttatttcgatccgaggctct

SEQ ID NO: 523610 - DNA, 25 bp, Rattus norvegicus
gttatttcacatagtacctgacatt

SEQ ID NO: 523611 - DNA, 25 bp, Rattus norvegicus
gttatttcacattgtacctgacatt

SEQ ID NO: 523612 - DNA, 25 bp, Rattus norvegicus
gttatttcacttaatttgctagctt

SEQ ID NO: 523613 - DNA, 25 bp, Rattus norvegicus
gttatttcactttatttgctagctt

SEQ ID NO: 523614 - DNA, 25 bp, Rattus norvegicus
gttatttcagcacatctactcggat

SEQ ID NO: 523615 - DNA, 25 bp, Rattus norvegicus
gttatttcagcagatctactcggat

SEQ ID NO: 523616 - DNA, 25 bp, Rattus norvegicus
gttatttcgaagagcctacccaggt

SEQ ID NO: 523617 - DNA, 25 bp, Rattus norvegicus
gttatttcgaagtgcctacccaggt

SEQ ID NO: 523618 - DNA, 25 bp, Rattus norvegicus
gttatttctccactagaacgtcact

SEQ ID NO: 523619 - DNA, 25 bp, Rattus norvegicus
gttatttctccagtagaacgtcact

SEQ ID NO: 523620 - DNA, 25 bp, Rattus norvegicus
gttatttctctcctcatcatttttt

SEQ ID NO: 523621 - DNA, 25 bp, Rattus norvegicus
gttatttctctcgtcatcatttttt

SEQ ID NO: 523622 - DNA, 25 bp, Rattus norvegicus
gttatttctcttctgcacagggaaa

SEQ ID NO: 523623 - DNA, 25 bp, Rattus norvegicus
gttatttctcttgtgcacagggaaa

SEQ ID NO: 523624 - DNA, 25 bp, Rattus norvegicus
gttatttgattgaccagctctccta

SEQ ID NO: 523625 - DNA, 25 bp, Rattus norvegicus
gttatttgattgtccagctctccta

SEQ ID NO: 523626 - DNA, 25 bp, Rattus norvegicus
gttatttgcatgaaatggcactatt

SEQ ID NO: 523627 - DNA, 25 bp, Rattus norvegicus
gttatttgcatgtaatggcactatt

SEQ ID NO: 523628 - DNA, 25 bp, Rattus norvegicus
gttatttgtacaccttcactttgaa

SEQ ID NO: 523629 - DNA, 25 bp, Rattus norvegicus
gttatttgtacagcttcactttgaa

SEQ ID NO: 523630 - DNA, 25 bp, Rattus norvegicus
gttattttatcccacctattggaga

SEQ ID NO: 523631 - DNA, 25 bp, Rattus norvegicus
gttattttatccgacctattggaga

SEQ ID NO: 523632 - DNA, 25 bp, Rattus norvegicus
gttattttcagcaggccttctatct

SEQ ID NO: 523633 - DNA, 25 bp, Rattus norvegicus
gttattttcagctggccttctatct

SEQ ID NO: 523634 - DNA, 25 bp, Rattus norvegicus
gttattttcattctgttccttccct

SEQ ID NO: 523635 - DNA, 25 bp, Rattus norvegicus
gttattttcattgtgttccttccct

SEQ ID NO: 523636 - DNA, 25 bp, Rattus norvegicus
gttattttctacctggagacttggg

SEQ ID NO: 523637 - DNA, 25 bp, Rattus norvegicus
gttattttctacgtggagacttggg

SEQ ID NO: 523638 - DNA, 25 bp, Rattus norvegicus
gttattttctttcttgcattgacat

SEQ ID NO: 523639 - DNA, 25 bp, Rattus norvegicus
gttattttctttgttgcattgacat

SEQ ID NO: 523640 - DNA, 25 bp, Rattus norvegicus
gttattttgagtattttgccttggt

SEQ ID NO: 523641 - DNA, 25 bp, Rattus norvegicus
gttattttgagttttttgccttggt

SEQ ID NO: 523642 - DNA, 25 bp, Rattus norvegicus
gttattttgcacattcttatgtata

SEQ ID NO: 523643 - DNA, 25 bp, Rattus norvegicus
gttattttgcactttcttatgtata

SEQ ID NO: 523644 - DNA, 25 bp, Rattus norvegicus
gttattttgggtctgtagctctgtc

SEQ ID NO: 523645 - DNA, 25 bp, Rattus norvegicus
gttattttgggtgtgtagctctgtc

SEQ ID NO: 523646 - DNA, 25 bp, Rattus norvegicus
gttattttgtctctctattcacacc

SEQ ID NO: 523647 - DNA, 25 bp, Rattus norvegicus
gttattttgtctgtctattcacacc

SEQ ID NO: 523648 - DNA, 25 bp, Rattus norvegicus
gttatttttagacaagtccgctcta

SEQ ID NO: 523649 - DNA, 25 bp, Rattus norvegicus
gttatttttagagaagtccgctcta

SEQ ID NO: 523650 - DNA, 25 bp, Rattus norvegicus
gttatttttcctatatctcacagta

SEQ ID NO: 523651 - DNA, 25 bp, Rattus norvegicus
gttatttttcctttatctcacagta

SEQ ID NO: 523652 - DNA, 25 bp, Rattus norvegicus
gttcaaacaaacattccttcgctct

SEQ ID NO: 523653 - DNA, 25 bp, Rattus norvegicus
gttcaaacaaactttccttcgctct

SEQ ID NO: 523654 - DNA, 25 bp, Rattus norvegicus
gttcaaacagcgctgcattaattca

SEQ ID NO: 523655 - DNA, 25 bp, Rattus norvegicus
gttcaaacagcggtgcattaattca

SEQ ID NO: 523656 - DNA, 25 bp, Rattus norvegicus
gttcaaaccggtagttgctgcacaa

SEQ ID NO: 523657 - DNA, 25 bp, Rattus norvegicus
gttcaaaccggttgttgctgcacaa

SEQ ID NO: 523658 - DNA, 25 bp, Rattus norvegicus
gttcaaacggttactgacgaagtca

SEQ ID NO: 523659 - DNA, 25 bp, Rattus norvegicus
gttcaaacggtttctgacgaagtca

SEQ ID NO: 523660 - DNA, 25 bp, Rattus norvegicus
gttcaaactacacaccagagcctac

SEQ ID NO: 523661 - DNA, 25 bp, Rattus norvegicus
gttcaaactacagaccagagcctac

SEQ ID NO: 523662 - DNA, 25 bp, Rattus norvegicus
gttcaaagccatctcaattccatag

SEQ ID NO: 523663 - DNA, 25 bp, Rattus norvegicus
gttcaaagccatgtcaattccatag

SEQ ID NO: 523664 - DNA, 25 bp, Rattus norvegicus
gttcaaaggcacaaaatgtaaaact

SEQ ID NO: 523665 - DNA, 25 bp, Rattus norvegicus
gttcaaaggcactaaatgtaaaact

SEQ ID NO: 523666 - DNA, 25 bp, Rattus norvegicus
gttcaaaggcagacagggtacacac

SEQ ID NO: 523667 - DNA, 25 bp, Rattus norvegicus
gttcaaaggcagtcagggtacacac

SEQ ID NO: 523668 - DNA, 25 bp, Rattus norvegicus
gttcaaaggtttccactatcaccac

SEQ ID NO: 523669 - DNA, 25 bp, Rattus norvegicus
gttcaaaggtttgcactatcaccac

SEQ ID NO: 523670 - DNA, 25 bp, Rattus norvegicus
gttcaaagttcgctctcttggaaga

SEQ ID NO: 523671 - DNA, 25 bp, Rattus norvegicus
gttcaaagttcggtctcttggaaga

SEQ ID NO: 523672 - DNA, 25 bp, Rattus norvegicus
gttcaaataaggctctgcacttgca

SEQ ID NO: 523673 - DNA, 25 bp, Rattus norvegicus
gttcaaataagggtctgcacttgca

SEQ ID NO: 523674 - DNA, 25 bp, Rattus norvegicus
gttcaaatacgtcaccatcttttta

SEQ ID NO: 523675 - DNA, 25 bp, Rattus norvegicus
gttcaaatacgtgaccatcttttta

SEQ ID NO: 523676 - DNA, 25 bp, Rattus norvegicus
gttcaaatactgagtcatcatcccc

SEQ ID NO: 523677 - DNA, 25 bp, Rattus norvegicus
gttcaaatactgtgtcatcatcccc

SEQ ID NO: 523678 - DNA, 25 bp, Rattus norvegicus
gttcaaatcccacaatgcataaggt

SEQ ID NO: 523679 - DNA, 25 bp, Rattus norvegicus
gttcaaatcccagaatgcataaggt

SEQ ID NO: 523680 - DNA, 25 bp, Rattus norvegicus
gttcaaatgctgatatcatggactt

SEQ ID NO: 523681 - DNA, 25 bp, Rattus norvegicus
gttcaaatgctgttatcatggactt

SEQ ID NO: 523682 - DNA, 25 bp, Rattus norvegicus
gttcaacacagaactcttgagcttt

SEQ ID NO: 523683 - DNA, 25 bp, Rattus norvegicus
gttcaacacagatctcttgagcttt

SEQ ID NO: 523684 - DNA, 25 bp, Rattus norvegicus
gttcaacactaaaaatgggtcgctt

SEQ ID NO: 523685 - DNA, 25 bp, Rattus norvegicus
gttcaacactaataatgggtcgctt

SEQ ID NO: 523686 - DNA, 25 bp, Rattus norvegicus
gttcaacagcagcaggtagcccatc

SEQ ID NO: 523687 - DNA, 25 bp, Rattus norvegicus
gttcaacagcaggaggtagcccatc

SEQ ID NO: 523688 - DNA, 25 bp, Rattus norvegicus
gttcaacatagtatgtccccaacct

SEQ ID NO: 523689 - DNA, 25 bp, Rattus norvegicus
gttcaacatagtttgtccccaacct

SEQ ID NO: 523690 - DNA, 25 bp, Rattus norvegicus
gttcaacatcctcttcgttacaagt

SEQ ID NO: 523691 - DNA, 25 bp, Rattus norvegicus
gttcaacatcctgttcgttacaagt

SEQ ID NO: 523692 - DNA, 25 bp, Rattus norvegicus
gttcaaccagcaaaacccactaggg

SEQ ID NO: 523693 - DNA, 25 bp, Rattus norvegicus
gttcaaccagcataacccactaggg

SEQ ID NO: 523694 - DNA, 25 bp, Rattus norvegicus
gttcaaccctcacgatgcagaacag

SEQ ID NO: 523695 - DNA, 25 bp, Rattus norvegicus
gttcaaccctcaggatgcagaacag

SEQ ID NO: 523696 - DNA, 25 bp, Rattus norvegicus
gttcaaccgacgatcgtgtgacctg

SEQ ID NO: 523697 - DNA, 25 bp, Rattus norvegicus
gttcaaccgacgttcgtgtgacctg

SEQ ID NO: 523698 - DNA, 25 bp, Rattus norvegicus
gttcaacctggcaacatcctagata

SEQ ID NO: 523699 - DNA, 25 bp, Rattus norvegicus
gttcaacctggctacatcctagata

SEQ ID NO: 523700 - DNA, 25 bp, Rattus norvegicus
gttcaacctgtgagcttcgaaggat

SEQ ID NO: 523701 - DNA, 25 bp, Rattus norvegicus
gttcaacctgtgtgcttcgaaggat

SEQ ID NO: 523702 - DNA, 25 bp, Rattus norvegicus
gttcaacgccatagctggtaactgg

SEQ ID NO: 523703 - DNA, 25 bp, Rattus norvegicus
gttcaacgccattgctggtaactgg

SEQ ID NO: 523704 - DNA, 25 bp, Rattus norvegicus
gttcaacgggatatccactcggaag

SEQ ID NO: 523705 - DNA, 25 bp, Rattus norvegicus
gttcaacgggatttccactcggaag

SEQ ID NO: 523706 - DNA, 25 bp, Rattus norvegicus
gttcaacgtcctctatgaccgacaa

SEQ ID NO: 523707 - DNA, 25 bp, Rattus norvegicus
gttcaacgtcctgtatgaccgacaa

SEQ ID NO: 523708 - DNA, 25 bp, Rattus norvegicus
gttcaactaaccagttcagctaccc

SEQ ID NO: 523709 - DNA, 25 bp, Rattus norvegicus
gttcaactaacctgttcagctaccc

SEQ ID NO: 523710 - DNA, 25 bp, Rattus norvegicus
gttcaactaagactctgactttcca

SEQ ID NO: 523711 - DNA, 25 bp, Rattus norvegicus
gttcaactaagagtctgactttcca

SEQ ID NO: 523712 - DNA, 25 bp, Rattus norvegicus
gttcaactacttccaggtgccagat

SEQ ID NO: 523713 - DNA, 25 bp, Rattus norvegicus
gttcaactacttgcaggtgccagat

SEQ ID NO: 523714 - DNA, 25 bp, Rattus norvegicus
gttcaactagaaacagactgacaca

SEQ ID NO: 523715 - DNA, 25 bp, Rattus norvegicus
gttcaactagaatcagactgacaca

SEQ ID NO: 523716 - DNA, 25 bp, Rattus norvegicus
gttcaactcagacaacctggaggga

SEQ ID NO: 523717 - DNA, 25 bp, Rattus norvegicus
gttcaactcagactttgcacataat

SEQ ID NO: 523718 - DNA, 25 bp, Rattus norvegicus
gttcaactcagagaacctggaggga

SEQ ID NO: 523719 - DNA, 25 bp, Rattus norvegicus
gttcaactcagagtttgcacataat

SEQ ID NO: 523720 - DNA, 25 bp, Rattus norvegicus
gttcaactctggcaagtgacctcag

SEQ ID NO: 523721 - DNA, 25 bp, Rattus norvegicus
gttcaactctgggaagtgacctcag

SEQ ID NO: 523722 - DNA, 25 bp, Rattus norvegicus
gttcaactgaagaagcacaggcgtg

SEQ ID NO: 523723 - DNA, 25 bp, Rattus norvegicus
gttcaactgaagtagcacaggcgtg

SEQ ID NO: 523724 - DNA, 25 bp, Rattus norvegicus
gttcaacttaataaccactgcggtg

SEQ ID NO: 523725 - DNA, 25 bp, Rattus norvegicus
gttcaacttaattaccactgcggtg

SEQ ID NO: 523726 - DNA, 25 bp, Rattus norvegicus
gttcaacttcatccttgcagcggac

SEQ ID NO: 523727 - DNA, 25 bp, Rattus norvegicus
gttcaacttcatgcttgcagcggac

SEQ ID NO: 523728 - DNA, 25 bp, Rattus norvegicus
gttcaacttcttaaggtggcttcca

SEQ ID NO: 523729 - DNA, 25 bp, Rattus norvegicus
gttcaacttctttaggtggcttcca

SEQ ID NO: 523730 - DNA, 25 bp, Rattus norvegicus
gttcaacttttgaggaccaaggact

SEQ ID NO: 523731 - DNA, 25 bp, Rattus norvegicus
gttcaacttttgtggaccaaggact

SEQ ID NO: 523732 - DNA, 25 bp, Rattus norvegicus
gttcaagaacacctatggctaactg

SEQ ID NO: 523733 - DNA, 25 bp, Rattus norvegicus
gttcaagaacacgtatggctaactg

SEQ ID NO: 523734 - DNA, 25 bp, Rattus norvegicus
gttcaagaattcaatgaccccatga

SEQ ID NO: 523735 - DNA, 25 bp, Rattus norvegicus
gttcaagaattctatgaccccatga

SEQ ID NO: 523736 - DNA, 25 bp, Rattus norvegicus
gttcaagaccggaagggcagcttta

SEQ ID NO: 523737 - DNA, 25 bp, Rattus norvegicus
gttcaagaccggtagggcagcttta

SEQ ID NO: 523738 - DNA, 25 bp, Rattus norvegicus
gttcaagactctaccctgtagggag

SEQ ID NO: 523739 - DNA, 25 bp, Rattus norvegicus
gttcaagactcttccctgtagggag

SEQ ID NO: 523740 - DNA, 25 bp, Rattus norvegicus
gttcaagatcccatttaaattcctt

SEQ ID NO: 523741 - DNA, 25 bp, Rattus norvegicus
gttcaagatcccttttaaattcctt

SEQ ID NO: 523742 - DNA, 25 bp, Rattus norvegicus
gttcaagcaaacagctcgctttctc

SEQ ID NO: 523743 - DNA, 25 bp, Rattus norvegicus
gttcaagcaaactgctcgctttctc

SEQ ID NO: 523744 - DNA, 25 bp, Rattus norvegicus
gttcaagcccagagtaccaggtagg

SEQ ID NO: 523745 - DNA, 25 bp, Rattus norvegicus
gttcaagcccagtgtaccaggtagg

SEQ ID NO: 523746 - DNA, 25 bp, Rattus norvegicus
gttcaagccgtgcagcaccaagagg

SEQ ID NO: 523747 - DNA, 25 bp, Rattus norvegicus
gttcaagccgtggagcaccaagagg

SEQ ID NO: 523748 - DNA, 25 bp, Rattus norvegicus
gttcaagcctgtcccctggtcaagt

SEQ ID NO: 523749 - DNA, 25 bp, Rattus norvegicus
gttcaagcctgtgccctggtcaagt

SEQ ID NO: 523750 - DNA, 25 bp, Rattus norvegicus
gttcaagccttcagaaacaccaagt

SEQ ID NO: 523751 - DNA, 25 bp, Rattus norvegicus
gttcaagccttctgaaacaccaagt

SEQ ID NO: 523752 - DNA, 25 bp, Rattus norvegicus
gttcaagcgccacctaaatgacgat

SEQ ID NO: 523753 - DNA, 25 bp, Rattus norvegicus
gttcaagcgccagctaaatgacgat

SEQ ID NO: 523754 - DNA, 25 bp, Rattus norvegicus
gttcaagctctgcaacttgcaggaa

SEQ ID NO: 523755 - DNA, 25 bp, Rattus norvegicus
gttcaagctctggaacttgcaggaa

SEQ ID NO: 523756 - DNA, 25 bp, Rattus norvegicus
gttcaagcttttcgatactgcaggc

SEQ ID NO: 523757 - DNA, 25 bp, Rattus norvegicus
gttcaagcttttggatactgcaggc

SEQ ID NO: 523758 - DNA, 25 bp, Rattus norvegicus
gttcaaggacaaactagactgcagt

SEQ ID NO: 523759 - DNA, 25 bp, Rattus norvegicus
gttcaaggacaatctagactgcagt

SEQ ID NO: 523760 - DNA, 25 bp, Rattus norvegicus
gttcaaggccacattcagatacgta

SEQ ID NO: 523761 - DNA, 25 bp, Rattus norvegicus
gttcaaggccactttcagatacgta

SEQ ID NO: 523762 - DNA, 25 bp, Rattus norvegicus
gttcaaggccagactcggcaacaga

SEQ ID NO: 523763 - DNA, 25 bp, Rattus norvegicus
gttcaaggccagactttctacttta

SEQ ID NO: 523764 - DNA, 25 bp, Rattus norvegicus
gttcaaggccagtctcggcaacaga

SEQ ID NO: 523765 - DNA, 25 bp, Rattus norvegicus
gttcaaggccagtctttctacttta

SEQ ID NO: 523766 - DNA, 25 bp, Rattus norvegicus
gttcaaggccatctgactacctagt

SEQ ID NO: 523767 - DNA, 25 bp, Rattus norvegicus
gttcaaggccatgtgactacctagt

SEQ ID NO: 523768 - DNA, 25 bp, Rattus norvegicus
gttcaaggcccaaggtttttgactg

SEQ ID NO: 523769 - DNA, 25 bp, Rattus norvegicus
gttcaaggcccatggtttttgactg

SEQ ID NO: 523770 - DNA, 25 bp, Rattus norvegicus
gttcaaggcctacataggatatcca

SEQ ID NO: 523771 - DNA, 25 bp, Rattus norvegicus
gttcaaggcctagataggatatcca

SEQ ID NO: 523772 - DNA, 25 bp, Rattus norvegicus
gttcaaggccttagtcgctattggg

SEQ ID NO: 523773 - DNA, 25 bp, Rattus norvegicus
gttcaaggcctttgtcgctattggg

SEQ ID NO: 523774 - DNA, 25 bp, Rattus norvegicus
gttcaaggctgtatctatgacctgc

SEQ ID NO: 523775 - DNA, 25 bp, Rattus norvegicus
gttcaaggctgtttctatgacctgc

SEQ ID NO: 523776 - DNA, 25 bp, Rattus norvegicus
gttcaagggagcatttaggcacatc

SEQ ID NO: 523777 - DNA, 25 bp, Rattus norvegicus
gttcaagggagcttttaggcacatc

SEQ ID NO: 523778 - DNA, 25 bp, Rattus norvegicus
gttcaaggtcagactagtccacgta

SEQ ID NO: 523779 - DNA, 25 bp, Rattus norvegicus
gttcaaggtcagtctagtccacgta

SEQ ID NO: 523780 - DNA, 25 bp, Rattus norvegicus
gttcaaggtgaaatgactctcagca

SEQ ID NO: 523781 - DNA, 25 bp, Rattus norvegicus
gttcaaggtgaattgactctcagca

SEQ ID NO: 523782 - DNA, 25 bp, Rattus norvegicus
gttcaaggtgttaccaggctttcct

SEQ ID NO: 523783 - DNA, 25 bp, Rattus norvegicus
gttcaaggtgtttccaggctttcct

SEQ ID NO: 523784 - DNA, 25 bp, Rattus norvegicus
gttcaagtattcagagcgcccaatc

SEQ ID NO: 523785 - DNA, 25 bp, Rattus norvegicus
gttcaagtattctgagcgcccaatc

SEQ ID NO: 523786 - DNA, 25 bp, Rattus norvegicus
gttcaagtcaccagccaggagtact

SEQ ID NO: 523787 - DNA, 25 bp, Rattus norvegicus
gttcaagtcacctgccaggagtact

SEQ ID NO: 523788 - DNA, 25 bp, Rattus norvegicus
gttcaagtcctgctgagactcacat

SEQ ID NO: 523789 - DNA, 25 bp, Rattus norvegicus
gttcaagtcctggtgagactcacat

SEQ ID NO: 523790 - DNA, 25 bp, Rattus norvegicus
gttcaagtctcgcacgcacgttggc

SEQ ID NO: 523791 - DNA, 25 bp, Rattus norvegicus
gttcaagtctcggacgcacgttggc

SEQ ID NO: 523792 - DNA, 25 bp, Rattus norvegicus
gttcaagtgcttaagtcatccattt

SEQ ID NO: 523793 - DNA, 25 bp, Rattus norvegicus
gttcaagtgctttagtcatccattt

SEQ ID NO: 523794 - DNA, 25 bp, Rattus norvegicus
gttcaagtgtcaattgtgcctcaaa

SEQ ID NO: 523795 - DNA, 25 bp, Rattus norvegicus
gttcaagtgtcatttgtgcctcaaa

SEQ ID NO: 523796 - DNA, 25 bp, Rattus norvegicus
gttcaagtgtgcactgtacagtgtt

SEQ ID NO: 523797 - DNA, 25 bp, Rattus norvegicus
gttcaagtgtgcattgaagaaccac

SEQ ID NO: 523798 - DNA, 25 bp, Rattus norvegicus
gttcaagtgtgctctgtacagtgtt

SEQ ID NO: 523799 - DNA, 25 bp, Rattus norvegicus
gttcaagtgtgctttgaagaaccac

SEQ ID NO: 523800 - DNA, 25 bp, Rattus norvegicus
gttcaagtgtgtctttccaacccct

SEQ ID NO: 523801 - DNA, 25 bp, Rattus norvegicus
gttcaagtgtgtgtttccaacccct

SEQ ID NO: 523802 - DNA, 25 bp, Rattus norvegicus
gttcaagttattcttagcacctagt

SEQ ID NO: 523803 - DNA, 25 bp, Rattus norvegicus
gttcaagttattgttagcacctagt

SEQ ID NO: 523804 - DNA, 25 bp, Rattus norvegicus
gttcaagttcatcttcatctcctgg

SEQ ID NO: 523805 - DNA, 25 bp, Rattus norvegicus
gttcaagttcatgttcatctcctgg

SEQ ID NO: 523806 - DNA, 25 bp, Rattus norvegicus
gttcaagttcccaacctgtaatagt

SEQ ID NO: 523807 - DNA, 25 bp, Rattus norvegicus
gttcaagttccctacctgtaatagt

SEQ ID NO: 523808 - DNA, 25 bp, Rattus norvegicus
gttcaagtttctatcatctccaaaa

SEQ ID NO: 523809 - DNA, 25 bp, Rattus norvegicus
gttcaagtttctttcatctccaaaa

SEQ ID NO: 523810 - DNA, 25 bp, Rattus norvegicus
gttcaataaagaactatgtggcatt

SEQ ID NO: 523811 - DNA, 25 bp, Rattus norvegicus
gttcaataaagatctatgtggcatt

SEQ ID NO: 523812 - DNA, 25 bp, Rattus norvegicus
gttcaataccgtctctcaaattggg

SEQ ID NO: 523813 - DNA, 25 bp, Rattus norvegicus
gttcaataccgtgtctcaaattggg

SEQ ID NO: 523814 - DNA, 25 bp, Rattus norvegicus
gttcaatagaccatattttggacgt

SEQ ID NO: 523815 - DNA, 25 bp, Rattus norvegicus
gttcaatagaccttattttggacgt

SEQ ID NO: 523816 - DNA, 25 bp, Rattus norvegicus
gttcaatccaagcaccctaatggca

SEQ ID NO: 523817 - DNA, 25 bp, Rattus norvegicus
gttcaatccaaggaccctaatggca

SEQ ID NO: 523818 - DNA, 25 bp, Rattus norvegicus
gttcaatccttgaaaagtcccagag

SEQ ID NO: 523819 - DNA, 25 bp, Rattus norvegicus
gttcaatccttgtaaagtcccagag

SEQ ID NO: 523820 - DNA, 25 bp, Rattus norvegicus
gttcaatcgactcaggacaacctcg

SEQ ID NO: 523821 - DNA, 25 bp, Rattus norvegicus
gttcaatcgactgaggacaacctcg

SEQ ID NO: 523822 - DNA, 25 bp, Rattus norvegicus
gttcaatctgcaatcagacctctga

SEQ ID NO: 523823 - DNA, 25 bp, Rattus norvegicus
gttcaatctgcattcagacctctga

SEQ ID NO: 523824 - DNA, 25 bp, Rattus norvegicus
gttcaatgagacaccagactcttcc

SEQ ID NO: 523825 - DNA, 25 bp, Rattus norvegicus
gttcaatgagactccagactcttcc

SEQ ID NO: 523826 - DNA, 25 bp, Rattus norvegicus
gttcaatgccaaaatcctggaaatg

SEQ ID NO: 523827 - DNA, 25 bp, Rattus norvegicus
gttcaatgccaatatcctggaaatg

SEQ ID NO: 523828 - DNA, 25 bp, Rattus norvegicus
gttcaatggattcaccggagctgca

SEQ ID NO: 523829 - DNA, 25 bp, Rattus norvegicus
gttcaatggattgaccggagctgca

SEQ ID NO: 523830 - DNA, 25 bp, Rattus norvegicus
gttcaatggctaaagctgttcttag

SEQ ID NO: 523831 - DNA, 25 bp, Rattus norvegicus
gttcaatggctatagctgttcttag

SEQ ID NO: 523832 - DNA, 25 bp, Rattus norvegicus
gttcaatgtctgactcatttcactt

SEQ ID NO: 523833 - DNA, 25 bp, Rattus norvegicus
gttcaatgtctgtctcatttcactt

SEQ ID NO: 523834 - DNA, 25 bp, Rattus norvegicus
gttcaatgtgagagctactccagag

SEQ ID NO: 523835 - DNA, 25 bp, Rattus norvegicus
gttcaatgtgagtgctactccagag

SEQ ID NO: 523836 - DNA, 25 bp, Rattus norvegicus
gttcaattcctaataactacatgtg

SEQ ID NO: 523837 - DNA, 25 bp, Rattus norvegicus
gttcaattcctattaactacatgtg

SEQ ID NO: 523838 - DNA, 25 bp, Rattus norvegicus
gttcaattgccacgaaccaaatggt

SEQ ID NO: 523839 - DNA, 25 bp, Rattus norvegicus
gttcaattgccaggaaccaaatggt

SEQ ID NO: 523840 - DNA, 25 bp, Rattus norvegicus
gttcaatttacaatctcagtcagtg

SEQ ID NO: 523841 - DNA, 25 bp, Rattus norvegicus
gttcaatttacattctcagtcagtg

SEQ ID NO: 523842 - DNA, 25 bp, Rattus norvegicus
gttcaatttccactaccatcatcac

SEQ ID NO: 523843 - DNA, 25 bp, Rattus norvegicus
gttcaatttccagtaccatcatcac

SEQ ID NO: 523844 - DNA, 25 bp, Rattus norvegicus
gttcaatttgggaattagctctttt

SEQ ID NO: 523845 - DNA, 25 bp, Rattus norvegicus
gttcaatttgggtattagctctttt

SEQ ID NO: 523846 - DNA, 25 bp, Rattus norvegicus
gttcaattttccagcaagtcaatcc

SEQ ID NO: 523847 - DNA, 25 bp, Rattus norvegicus
gttcaattttcctgcaagtcaatcc

SEQ ID NO: 523848 - DNA, 25 bp, Rattus norvegicus
gttcacaaaatacgccttaacatat

SEQ ID NO: 523849 - DNA, 25 bp, Rattus norvegicus
gttcacaaaataggccttaacatat

SEQ ID NO: 523850 - DNA, 25 bp, Rattus norvegicus
gttcacaaccatagctacagctgga

SEQ ID NO: 523851 - DNA, 25 bp, Rattus norvegicus
gttcacaaccattgctacagctgga

SEQ ID NO: 523852 - DNA, 25 bp, Rattus norvegicus
gttcacaagaataacacccacacgc

SEQ ID NO: 523853 - DNA, 25 bp, Rattus norvegicus
gttcacaagaattacacccacacgc

SEQ ID NO: 523854 - DNA, 25 bp, Rattus norvegicus
gttcacaagcaaactgggcgccatg

SEQ ID NO: 523855 - DNA, 25 bp, Rattus norvegicus
gttcacaagcaatctgggcgccatg

SEQ ID NO: 523856 - DNA, 25 bp, Rattus norvegicus
gttcacaagccacaacctgcagttg

SEQ ID NO: 523857 - DNA, 25 bp, Rattus norvegicus
gttcacaagccagaacctgcagttg

SEQ ID NO: 523858 - DNA, 25 bp, Rattus norvegicus
gttcacaagctcaattgtagaccat

SEQ ID NO: 523859 - DNA, 25 bp, Rattus norvegicus
gttcacaagctctattgtagaccat

SEQ ID NO: 523860 - DNA, 25 bp, Rattus norvegicus
gttcacaagttacaccacagtagat

SEQ ID NO: 523861 - DNA, 25 bp, Rattus norvegicus
gttcacaagttagaccacagtagat

SEQ ID NO: 523862 - DNA, 25 bp, Rattus norvegicus
gttcacaataaaccttcccgtatcc

SEQ ID NO: 523863 - DNA, 25 bp, Rattus norvegicus
gttcacaataaagcttcccgtatcc

SEQ ID NO: 523864 - DNA, 25 bp, Rattus norvegicus
gttcacaatgtaaagtcctatgggc

SEQ ID NO: 523865 - DNA, 25 bp, Rattus norvegicus
gttcacaatgtatagtcctatgggc

SEQ ID NO: 523866 - DNA, 25 bp, Rattus norvegicus
gttcacaattctattatactgctgg

SEQ ID NO: 523867 - DNA, 25 bp, Rattus norvegicus
gttcacaattcttttatactgctgg

SEQ ID NO: 523868 - DNA, 25 bp, Rattus norvegicus
gttcacaatttcatgtcagccatca

SEQ ID NO: 523869 - DNA, 25 bp, Rattus norvegicus
gttcacaatttcttgtcagccatca

SEQ ID NO: 523870 - DNA, 25 bp, Rattus norvegicus
gttcacacaattaaacccactgttt

SEQ ID NO: 523871 - DNA, 25 bp, Rattus norvegicus
gttcacacaatttaacccactgttt

SEQ ID NO: 523872 - DNA, 25 bp, Rattus norvegicus
gttcacacacggctttgccatgaga

SEQ ID NO: 523873 - DNA, 25 bp, Rattus norvegicus
gttcacacacgggtttgccatgaga

SEQ ID NO: 523874 - DNA, 25 bp, Rattus norvegicus
gttcacacagaacctggtcttgctt

SEQ ID NO: 523875 - DNA, 25 bp, Rattus norvegicus
gttcacacagaagctggtcttgctt

SEQ ID NO: 523876 - DNA, 25 bp, Rattus norvegicus
gttcacacagcgctactgatgttct

SEQ ID NO: 523877 - DNA, 25 bp, Rattus norvegicus
gttcacacagcggtactgatgttct

SEQ ID NO: 523878 - DNA, 25 bp, Rattus norvegicus
gttcacacccatcctttgtgagcta

SEQ ID NO: 523879 - DNA, 25 bp, Rattus norvegicus
gttcacacccatgctttgtgagcta

SEQ ID NO: 523880 - DNA, 25 bp, Rattus norvegicus
gttcacaccttgctgagatttgcca

SEQ ID NO: 523881 - DNA, 25 bp, Rattus norvegicus
gttcacaccttggtgagatttgcca

SEQ ID NO: 523882 - DNA, 25 bp, Rattus norvegicus
gttcacacgaacatttctatggcct

SEQ ID NO: 523883 - DNA, 25 bp, Rattus norvegicus
gttcacacgaacttttctatggcct

SEQ ID NO: 523884 - DNA, 25 bp, Rattus norvegicus
gttcacactaccaggctgacagtga

SEQ ID NO: 523885 - DNA, 25 bp, Rattus norvegicus
gttcacactacctggctgacagtga

SEQ ID NO: 523886 - DNA, 25 bp, Rattus norvegicus
gttcacactccgaggaaatgccaga

SEQ ID NO: 523887 - DNA, 25 bp, Rattus norvegicus
gttcacactccgtggaaatgccaga

SEQ ID NO: 523888 - DNA, 25 bp, Rattus norvegicus
gttcacactcttaccttgcaaggta

SEQ ID NO: 523889 - DNA, 25 bp, Rattus norvegicus
gttcacactctttccttgcaaggta

SEQ ID NO: 523890 - DNA, 25 bp, Rattus norvegicus
gttcacactgtgatggccaagacac

SEQ ID NO: 523891 - DNA, 25 bp, Rattus norvegicus
gttcacactgtgttggccaagacac

SEQ ID NO: 523892 - DNA, 25 bp, Rattus norvegicus
gttcacacttctataactagcctgc

SEQ ID NO: 523893 - DNA, 25 bp, Rattus norvegicus
gttcacacttctttaactagcctgc

SEQ ID NO: 523894 - DNA, 25 bp, Rattus norvegicus
gttcacagacacatgagaccagtta

SEQ ID NO: 523895 - DNA, 25 bp, Rattus norvegicus
gttcacagacacttgagaccagtta

SEQ ID NO: 523896 - DNA, 25 bp, Rattus norvegicus
gttcacagactaaacttcggttcaa

SEQ ID NO: 523897 - DNA, 25 bp, Rattus norvegicus
gttcacagactatacttcggttcaa

SEQ ID NO: 523898 - DNA, 25 bp, Rattus norvegicus
gttcacagactgcttcctgccaggg

SEQ ID NO: 523899 - DNA, 25 bp, Rattus norvegicus
gttcacagactggttcctgccaggg

SEQ ID NO: 523900 - DNA, 25 bp, Rattus norvegicus
gttcacagcaaactccatagcatgt

SEQ ID NO: 523901 - DNA, 25 bp, Rattus norvegicus
gttcacagcaaagtccatagcatgt

SEQ ID NO: 523902 - DNA, 25 bp, Rattus norvegicus
gttcacagcaataggcccggcaagc

SEQ ID NO: 523903 - DNA, 25 bp, Rattus norvegicus
gttcacagcaattggcccggcaagc

SEQ ID NO: 523904 - DNA, 25 bp, Rattus norvegicus
gttcacagcccacgataaggtacct

SEQ ID NO: 523905 - DNA, 25 bp, Rattus norvegicus
gttcacagcccaggataaggtacct

SEQ ID NO: 523906 - DNA, 25 bp, Rattus norvegicus
gttcacagctcacacgagaattcct

SEQ ID NO: 523907 - DNA, 25 bp, Rattus norvegicus
gttcacagctcacatgatcaccatc

SEQ ID NO: 523908 - DNA, 25 bp, Rattus norvegicus
gttcacagctcagacgagaattcct

SEQ ID NO: 523909 - DNA, 25 bp, Rattus norvegicus
gttcacagctcagatgatcaccatc

SEQ ID NO: 523910 - DNA, 25 bp, Rattus norvegicus
gttcacaggccacaagtacccaact

SEQ ID NO: 523911 - DNA, 25 bp, Rattus norvegicus
gttcacaggccagaagtacccaact

SEQ ID NO: 523912 - DNA, 25 bp, Rattus norvegicus
gttcacaggttcacagatccattgt

SEQ ID NO: 523913 - DNA, 25 bp, Rattus norvegicus
gttcacaggttctcagatccattgt

SEQ ID NO: 523914 - DNA, 25 bp, Rattus norvegicus
gttcacaggtttactcaccacagga

SEQ ID NO: 523915 - DNA, 25 bp, Rattus norvegicus
gttcacaggttttctcaccacagga

SEQ ID NO: 523916 - DNA, 25 bp, Rattus norvegicus
gttcacagtaagcacacacaataga

SEQ ID NO: 523917 - DNA, 25 bp, Rattus norvegicus
gttcacagtaaggacacacaataga

SEQ ID NO: 523918 - DNA, 25 bp, Rattus norvegicus
gttcacagtaatcaccaggctcagt

SEQ ID NO: 523919 - DNA, 25 bp, Rattus norvegicus
gttcacagtaatgaccaggctcagt

SEQ ID NO: 523920 - DNA, 25 bp, Rattus norvegicus
gttcacagtagtagagcccaggcct

SEQ ID NO: 523921 - DNA, 25 bp, Rattus norvegicus
gttcacagtagttgagcccaggcct

SEQ ID NO: 523922 - DNA, 25 bp, Rattus norvegicus
gttcacagtcacctttaatccagtt

SEQ ID NO: 523923 - DNA, 25 bp, Rattus norvegicus
gttcacagtcacgtttaatccagtt

SEQ ID NO: 523924 - DNA, 25 bp, Rattus norvegicus
gttcacagtgaaaaaagggccccta

SEQ ID NO: 523925 - DNA, 25 bp, Rattus norvegicus
gttcacagtgaataaagggccccta

SEQ ID NO: 523926 - DNA, 25 bp, Rattus norvegicus
gttcacagttctcggactttcctag

SEQ ID NO: 523927 - DNA, 25 bp, Rattus norvegicus
gttcacagttctcgttctccagatg

SEQ ID NO: 523928 - DNA, 25 bp, Rattus norvegicus
gttcacagttctgggactttcctag

SEQ ID NO: 523929 - DNA, 25 bp, Rattus norvegicus
gttcacagttctggttctccagatg

SEQ ID NO: 523930 - DNA, 25 bp, Rattus norvegicus
gttcacatatatacatcttccagtc

SEQ ID NO: 523931 - DNA, 25 bp, Rattus norvegicus
gttcacatatattcatcttccagtc

SEQ ID NO: 523932 - DNA, 25 bp, Rattus norvegicus
gttcacatcagacttcacacgggtc

SEQ ID NO: 523933 - DNA, 25 bp, Rattus norvegicus
gttcacatcagagttcacacgggtc

SEQ ID NO: 523934 - DNA, 25 bp, Rattus norvegicus
gttcacatcctgaaagacaccggca

SEQ ID NO: 523935 - DNA, 25 bp, Rattus norvegicus
gttcacatcctgtaagacaccggca

SEQ ID NO: 523936 - DNA, 25 bp, Rattus norvegicus
gttcacatcgagcactcttctaaag

SEQ ID NO: 523937 - DNA, 25 bp, Rattus norvegicus
gttcacatcgaggactcttctaaag

SEQ ID NO: 523938 - DNA, 25 bp, Rattus norvegicus
gttcacatcggtctttattggtaaa

SEQ ID NO: 523939 - DNA, 25 bp, Rattus norvegicus
gttcacatcggtgtttattggtaaa

SEQ ID NO: 523940 - DNA, 25 bp, Rattus norvegicus
gttcacatctctatttggtttactg

SEQ ID NO: 523941 - DNA, 25 bp, Rattus norvegicus
gttcacatctctttttggtttactg

SEQ ID NO: 523942 - DNA, 25 bp, Rattus norvegicus
gttcacatgaacatggtgccactgt

SEQ ID NO: 523943 - DNA, 25 bp, Rattus norvegicus
gttcacatgaacttggtgccactgt

SEQ ID NO: 523944 - DNA, 25 bp, Rattus norvegicus
gttcacatgctgctcttcacaagag

SEQ ID NO: 523945 - DNA, 25 bp, Rattus norvegicus
gttcacatgctggtcttcacaagag

SEQ ID NO: 523946 - DNA, 25 bp, Rattus norvegicus
gttcacatggctctgatgttcaggt

SEQ ID NO: 523947 - DNA, 25 bp, Rattus norvegicus
gttcacatggctgtgatgttcaggt

SEQ ID NO: 523948 - DNA, 25 bp, Rattus norvegicus
gttcacatgtatacactcacacaga

SEQ ID NO: 523949 - DNA, 25 bp, Rattus norvegicus
gttcacatgtattcactcacacaga

SEQ ID NO: 523950 - DNA, 25 bp, Rattus norvegicus
gttcacatgttcacacactttttca

SEQ ID NO: 523951 - DNA, 25 bp, Rattus norvegicus
gttcacatgttctcacactttttca

SEQ ID NO: 523952 - DNA, 25 bp, Rattus norvegicus
gttcacattactactgtctgttcac

SEQ ID NO: 523953 - DNA, 25 bp, Rattus norvegicus
gttcacattacttctgtctgttcac

SEQ ID NO: 523954 - DNA, 25 bp, Rattus norvegicus
gttcacattctcacatggtagaggc

SEQ ID NO: 523955 - DNA, 25 bp, Rattus norvegicus
gttcacattctctcatggtagaggc

SEQ ID NO: 523956 - DNA, 25 bp, Rattus norvegicus
gttcacattgaacgcctgaagaata

SEQ ID NO: 523957 - DNA, 25 bp, Rattus norvegicus
gttcacattgaaggcctgaagaata

SEQ ID NO: 523958 - DNA, 25 bp, Rattus norvegicus
gttcacattgggacctttctcagag

SEQ ID NO: 523959 - DNA, 25 bp, Rattus norvegicus
gttcacattgggtcctttctcagag

SEQ ID NO: 523960 - DNA, 25 bp, Rattus norvegicus
gttcaccaaaagctgtggacgctca

SEQ ID NO: 523961 - DNA, 25 bp, Rattus norvegicus
gttcaccaaaaggtgtggacgctca

SEQ ID NO: 523962 - DNA, 25 bp, Rattus norvegicus
gttcaccaaacacctagtgttctag

SEQ ID NO: 523963 - DNA, 25 bp, Rattus norvegicus
gttcaccaaacagctagtgttctag

SEQ ID NO: 523964 - DNA, 25 bp, Rattus norvegicus
gttcaccaaagccatgagcattttt

SEQ ID NO: 523965 - DNA, 25 bp, Rattus norvegicus
gttcaccaaagcgatgagcattttt

SEQ ID NO: 523966 - DNA, 25 bp, Rattus norvegicus
gttcaccaactgatctttcaagact

SEQ ID NO: 523967 - DNA, 25 bp, Rattus norvegicus
gttcaccaactgttctttcaagact

SEQ ID NO: 523968 - DNA, 25 bp, Rattus norvegicus
gttcaccaagtcaccttatcaggaa

SEQ ID NO: 523969 - DNA, 25 bp, Rattus norvegicus
gttcaccaagtctccttatcaggaa

SEQ ID NO: 523970 - DNA, 25 bp, Rattus norvegicus
gttcaccacatactaggtttgacta

SEQ ID NO: 523971 - DNA, 25 bp, Rattus norvegicus
gttcaccacatagtaggtttgacta

SEQ ID NO: 523972 - DNA, 25 bp, Rattus norvegicus
gttcaccactaaatcatctttcggg

SEQ ID NO: 523973 - DNA, 25 bp, Rattus norvegicus
gttcaccactaattcatctttcggg

SEQ ID NO: 523974 - DNA, 25 bp, Rattus norvegicus
gttcaccagagcaaacttgccaaag

SEQ ID NO: 523975 - DNA, 25 bp, Rattus norvegicus
gttcaccagagctaacttgccaaag

SEQ ID NO: 523976 - DNA, 25 bp, Rattus norvegicus
gttcaccagcttatctttagactaa

SEQ ID NO: 523977 - DNA, 25 bp, Rattus norvegicus
gttcaccagcttttctttagactaa

SEQ ID NO: 523978 - DNA, 25 bp, Rattus norvegicus
gttcaccatcttattgcattcattt

SEQ ID NO: 523979 - DNA, 25 bp, Rattus norvegicus
gttcaccatctttttgcattcattt

SEQ ID NO: 523980 - DNA, 25 bp, Rattus norvegicus
gttcaccatgatctggtcctgagga

SEQ ID NO: 523981 - DNA, 25 bp, Rattus norvegicus
gttcaccatgatgtggtcctgagga

SEQ ID NO: 523982 - DNA, 25 bp, Rattus norvegicus
gttcaccattcaccctgtgttaaaa

SEQ ID NO: 523983 - DNA, 25 bp, Rattus norvegicus
gttcaccattcagcctgtgttaaaa

SEQ ID NO: 523984 - DNA, 25 bp, Rattus norvegicus
gttcacccatctaactatgttggta

SEQ ID NO: 523985 - DNA, 25 bp, Rattus norvegicus
gttcacccatcttactatgttggta

SEQ ID NO: 523986 - DNA, 25 bp, Rattus norvegicus
gttcaccccagcaggatgatactta

SEQ ID NO: 523987 - DNA, 25 bp, Rattus norvegicus
gttcaccccagctggatgatactta

SEQ ID NO: 523988 - DNA, 25 bp, Rattus norvegicus
gttcaccccatacattcacatatat

SEQ ID NO: 523989 - DNA, 25 bp, Rattus norvegicus
gttcaccccatagattcacatatat

SEQ ID NO: 523990 - DNA, 25 bp, Rattus norvegicus
gttcacccccaacattacacattaa

SEQ ID NO: 523991 - DNA, 25 bp, Rattus norvegicus
gttcacccccaagattacacattaa

SEQ ID NO: 523992 - DNA, 25 bp, Rattus norvegicus
gttcacccttgaaaacggagccagg

SEQ ID NO: 523993 - DNA, 25 bp, Rattus norvegicus
gttcacccttgataacggagccagg

SEQ ID NO: 523994 - DNA, 25 bp, Rattus norvegicus
gttcaccgcggtctacaaagtgtgc

SEQ ID NO: 523995 - DNA, 25 bp, Rattus norvegicus
gttcaccgcggtgtacaaagtgtgc

SEQ ID NO: 523996 - DNA, 25 bp, Rattus norvegicus
gttcaccgtgaccaacaccgagtgc

SEQ ID NO: 523997 - DNA, 25 bp, Rattus norvegicus
gttcaccgtgacgaacaccgagtgc

SEQ ID NO: 523998 - DNA, 25 bp, Rattus norvegicus
gttcacctactactaaagcttccaa

SEQ ID NO: 523999 - DNA, 25 bp, Rattus norvegicus
gttcacctactagtaaagcttccaa

SEQ ID NO: 524000 - DNA, 25 bp, Rattus norvegicus
gttcacctcgaacaaagtctagctc

SEQ ID NO: 524001 - DNA, 25 bp, Rattus norvegicus
gttcacctcgaagaaagtctagctc

SEQ ID NO: 524002 - DNA, 25 bp, Rattus norvegicus
gttcacctctggcataaagctttgt

SEQ ID NO: 524003 - DNA, 25 bp, Rattus norvegicus
gttcacctctgggataaagctttgt

SEQ ID NO: 524004 - DNA, 25 bp, Rattus norvegicus
gttcacctgaggcatcgctgctaag

SEQ ID NO: 524005 - DNA, 25 bp, Rattus norvegicus
gttcacctgagggatcgctgctaag

SEQ ID NO: 524006 - DNA, 25 bp, Rattus norvegicus
gttcaccttaaaatcagtacatcag

SEQ ID NO: 524007 - DNA, 25 bp, Rattus norvegicus
gttcaccttaaattcagtacatcag

SEQ ID NO: 524008 - DNA, 25 bp, Rattus norvegicus
gttcaccttactatatggcacagca

SEQ ID NO: 524009 - DNA, 25 bp, Rattus norvegicus
gttcaccttactttatggcacagca

SEQ ID NO: 524010 - DNA, 25 bp, Rattus norvegicus
gttcaccttcatctgacacatgggc

SEQ ID NO: 524011 - DNA, 25 bp, Rattus norvegicus
gttcaccttcatgtgacacatgggc

SEQ ID NO: 524012 - DNA, 25 bp, Rattus norvegicus
gttcacctttctattcatttttgtt

SEQ ID NO: 524013 - DNA, 25 bp, Rattus norvegicus
gttcacctttcttttcatttttgtt

SEQ ID NO: 524014 - DNA, 25 bp, Rattus norvegicus
gttcaccttttcagtgcagggtcag

SEQ ID NO: 524015 - DNA, 25 bp, Rattus norvegicus
gttcaccttttctgtgcagggtcag

SEQ ID NO: 524016 - DNA, 25 bp, Rattus norvegicus
gttcacgactgtcttcagggaccag

SEQ ID NO: 524017 - DNA, 25 bp, Rattus norvegicus
gttcacgactgtgttcagggaccag

SEQ ID NO: 524018 - DNA, 25 bp, Rattus norvegicus
gttcacgagacacacagctgctgca

SEQ ID NO: 524019 - DNA, 25 bp, Rattus norvegicus
gttcacgagacagacagctgctgca

SEQ ID NO: 524020 - DNA, 25 bp, Rattus norvegicus
gttcacgcacacactactttgatat

SEQ ID NO: 524021 - DNA, 25 bp, Rattus norvegicus
gttcacgcacactctactttgatat

SEQ ID NO: 524022 - DNA, 25 bp, Rattus norvegicus
gttcacgcattactgactccatgat

SEQ ID NO: 524023 - DNA, 25 bp, Rattus norvegicus
gttcacgcattagtgactccatgat

SEQ ID NO: 524024 - DNA, 25 bp, Rattus norvegicus
gttcacgccatcaggaaatgctggt

SEQ ID NO: 524025 - DNA, 25 bp, Rattus norvegicus
gttcacgccatctggaaatgctggt

SEQ ID NO: 524026 - DNA, 25 bp, Rattus norvegicus
gttcacgccatgattttcaagtcag

SEQ ID NO: 524027 - DNA, 25 bp, Rattus norvegicus
gttcacgccatgtttttcaagtcag

SEQ ID NO: 524028 - DNA, 25 bp, Rattus norvegicus
gttcacggaggtagagggtttcata

SEQ ID NO: 524029 - DNA, 25 bp, Rattus norvegicus
gttcacggaggttgagggtttcata

SEQ ID NO: 524030 - DNA, 25 bp, Rattus norvegicus
gttcacggtaagatgctcacagtat

SEQ ID NO: 524031 - DNA, 25 bp, Rattus norvegicus
gttcacggtaagttgctcacagtat

SEQ ID NO: 524032 - DNA, 25 bp, Rattus norvegicus
gttcacggtcaacctttgattcctt

SEQ ID NO: 524033 - DNA, 25 bp, Rattus norvegicus
gttcacggtcaagctttgattcctt

SEQ ID NO: 524034 - DNA, 25 bp, Rattus norvegicus
gttcacgtaatgaaggagcagccat

SEQ ID NO: 524035 - DNA, 25 bp, Rattus norvegicus
gttcacgtaatgacgcacagaggga

SEQ ID NO: 524036 - DNA, 25 bp, Rattus norvegicus
gttcacgtaatgtaggagcagccat

SEQ ID NO: 524037 - DNA, 25 bp, Rattus norvegicus
gttcacgtaatgtcgcacagaggga

SEQ ID NO: 524038 - DNA, 25 bp, Rattus norvegicus
gttcacgtatagctgtatccttaga

SEQ ID NO: 524039 - DNA, 25 bp, Rattus norvegicus
gttcacgtataggtgtatccttaga

SEQ ID NO: 524040 - DNA, 25 bp, Rattus norvegicus
gttcacgtggcgaaggtgcgcatca

SEQ ID NO: 524041 - DNA, 25 bp, Rattus norvegicus
gttcacgtggcgtaggtgcgcatca

SEQ ID NO: 524042 - DNA, 25 bp, Rattus norvegicus
gttcacgtgtgtacatatgatctgg

SEQ ID NO: 524043 - DNA, 25 bp, Rattus norvegicus
gttcacgtgtgttcatatgatctgg

SEQ ID NO: 524044 - DNA, 25 bp, Rattus norvegicus
gttcacgtttagatttgtaggcaca

SEQ ID NO: 524045 - DNA, 25 bp, Rattus norvegicus
gttcacgtttagttttgtaggcaca

SEQ ID NO: 524046 - DNA, 25 bp, Rattus norvegicus
gttcactaagtgaagaggccactgt

SEQ ID NO: 524047 - DNA, 25 bp, Rattus norvegicus
gttcactaagtgtagaggccactgt

SEQ ID NO: 524048 - DNA, 25 bp, Rattus norvegicus
gttcactactacacagggactggca

SEQ ID NO: 524049 - DNA, 25 bp, Rattus norvegicus
gttcactactactcagggactggca

SEQ ID NO: 524050 - DNA, 25 bp, Rattus norvegicus
gttcactactgtataggtgtcttag

SEQ ID NO: 524051 - DNA, 25 bp, Rattus norvegicus
gttcactactgtttaggtgtcttag

SEQ ID NO: 524052 - DNA, 25 bp, Rattus norvegicus
gttcactattacacagacacctggg

SEQ ID NO: 524053 - DNA, 25 bp, Rattus norvegicus
gttcactattactcagacacctggg

SEQ ID NO: 524054 - DNA, 25 bp, Rattus norvegicus
gttcactcatttcggctttgccatc

SEQ ID NO: 524055 - DNA, 25 bp, Rattus norvegicus
gttcactcatttgggctttgccatc

SEQ ID NO: 524056 - DNA, 25 bp, Rattus norvegicus
gttcactccatcaggacctggaata

SEQ ID NO: 524057 - DNA, 25 bp, Rattus norvegicus
gttcactccatctggacctggaata

SEQ ID NO: 524058 - DNA, 25 bp, Rattus norvegicus
gttcactcgtatatgcattcttgta

SEQ ID NO: 524059 - DNA, 25 bp, Rattus norvegicus
gttcactcgtatttgcattcttgta

SEQ ID NO: 524060 - DNA, 25 bp, Rattus norvegicus
gttcactctacccatttgtatgttt

SEQ ID NO: 524061 - DNA, 25 bp, Rattus norvegicus
gttcactctaccgatttgtatgttt

SEQ ID NO: 524062 - DNA, 25 bp, Rattus norvegicus
gttcactctcacagttaggttttgc

SEQ ID NO: 524063 - DNA, 25 bp, Rattus norvegicus
gttcactctcactgttaggttttgc

SEQ ID NO: 524064 - DNA, 25 bp, Rattus norvegicus
gttcactctctgcttagtacttgtt

SEQ ID NO: 524065 - DNA, 25 bp, Rattus norvegicus
gttcactctctggttagtacttgtt

SEQ ID NO: 524066 - DNA, 25 bp, Rattus norvegicus
gttcactctcttcgctttgagcagc

SEQ ID NO: 524067 - DNA, 25 bp, Rattus norvegicus
gttcactctcttggctttgagcagc

SEQ ID NO: 524068 - DNA, 25 bp, Rattus norvegicus
gttcactctgacatactgtagggta

SEQ ID NO: 524069 - DNA, 25 bp, Rattus norvegicus
gttcactctgacatcgagatttgat

SEQ ID NO: 524070 - DNA, 25 bp, Rattus norvegicus
gttcactctgacttactgtagggta

SEQ ID NO: 524071 - DNA, 25 bp, Rattus norvegicus
gttcactctgacttcgagatttgat

SEQ ID NO: 524072 - DNA, 25 bp, Rattus norvegicus
gttcactctgtaccagtttttcctg

SEQ ID NO: 524073 - DNA, 25 bp, Rattus norvegicus
gttcactctgtagcagtttttcctg

SEQ ID NO: 524074 - DNA, 25 bp, Rattus norvegicus
gttcactctttaatacatgtcctgt

SEQ ID NO: 524075 - DNA, 25 bp, Rattus norvegicus
gttcactctttattacatgtcctgt

SEQ ID NO: 524076 - DNA, 25 bp, Rattus norvegicus
gttcactgaacccaaacgcagccag

SEQ ID NO: 524077 - DNA, 25 bp, Rattus norvegicus
gttcactgaaccgaaacgcagccag

SEQ ID NO: 524078 - DNA, 25 bp, Rattus norvegicus
gttcactgagctatgatgtactgca

SEQ ID NO: 524079 - DNA, 25 bp, Rattus norvegicus
gttcactgagctttgatgtactgca

SEQ ID NO: 524080 - DNA, 25 bp, Rattus norvegicus
gttcactgatcaactttcttacctg

SEQ ID NO: 524081 - DNA, 25 bp, Rattus norvegicus
gttcactgatcatctttcttacctg

SEQ ID NO: 524082 - DNA, 25 bp, Rattus norvegicus
gttcactgcagtcattaacccgcct

SEQ ID NO: 524083 - DNA, 25 bp, Rattus norvegicus
gttcactgcagtgattaacccgcct

SEQ ID NO: 524084 - DNA, 25 bp, Rattus norvegicus
gttcactgccaactttgttgcgtat

SEQ ID NO: 524085 - DNA, 25 bp, Rattus norvegicus
gttcactgccaagtttgttgcgtat

SEQ ID NO: 524086 - DNA, 25 bp, Rattus norvegicus
gttcactgtcataaacatgtatgcc

SEQ ID NO: 524087 - DNA, 25 bp, Rattus norvegicus
gttcactgtcattaacatgtatgcc

SEQ ID NO: 524088 - DNA, 25 bp, Rattus norvegicus
gttcactgtcccagatagctggtgt

SEQ ID NO: 524089 - DNA, 25 bp, Rattus norvegicus
gttcactgtccctgatagctggtgt

SEQ ID NO: 524090 - DNA, 25 bp, Rattus norvegicus
gttcactgtcggcatcatacaagca

SEQ ID NO: 524091 - DNA, 25 bp, Rattus norvegicus
gttcactgtcgggatcatacaagca

SEQ ID NO: 524092 - DNA, 25 bp, Rattus norvegicus
gttcactgtgtgaagtccctacgag

SEQ ID NO: 524093 - DNA, 25 bp, Rattus norvegicus
gttcactgtgtgtagtccctacgag

SEQ ID NO: 524094 - DNA, 25 bp, Rattus norvegicus
gttcacttaaaaactgttcatggct

SEQ ID NO: 524095 - DNA, 25 bp, Rattus norvegicus
gttcacttaaaatctgttcatggct

SEQ ID NO: 524096 - DNA, 25 bp, Rattus norvegicus
gttcacttaactcttctaacgctgt

SEQ ID NO: 524097 - DNA, 25 bp, Rattus norvegicus
gttcacttaactgttctaacgctgt

SEQ ID NO: 524098 - DNA, 25 bp, Rattus norvegicus
gttcacttacacaggacagcacttg

SEQ ID NO: 524099 - DNA, 25 bp, Rattus norvegicus
gttcacttacactggacagcacttg

SEQ ID NO: 524100 - DNA, 25 bp, Rattus norvegicus
gttcacttagtgcattacctggtgg

SEQ ID NO: 524101 - DNA, 25 bp, Rattus norvegicus
gttcacttagtggattacctggtgg

SEQ ID NO: 524102 - DNA, 25 bp, Rattus norvegicus
gttcacttattgaactctttggcaa

SEQ ID NO: 524103 - DNA, 25 bp, Rattus norvegicus
gttcacttattgtactctttggcaa

SEQ ID NO: 524104 - DNA, 25 bp, Rattus norvegicus
gttcacttcagaatttgagccagca

SEQ ID NO: 524105 - DNA, 25 bp, Rattus norvegicus
gttcacttcagattttgagccagca

SEQ ID NO: 524106 - DNA, 25 bp, Rattus norvegicus
gttcacttcatcagcaagagtcagg

SEQ ID NO: 524107 - DNA, 25 bp, Rattus norvegicus
gttcacttcatctgcaagagtcagg

SEQ ID NO: 524108 - DNA, 25 bp, Rattus norvegicus
gttcacttcccaacagggttactga

SEQ ID NO: 524109 - DNA, 25 bp, Rattus norvegicus
gttcacttcccatcagggttactga

SEQ ID NO: 524110 - DNA, 25 bp, Rattus norvegicus
gttcacttccttcaaattccgttgt

SEQ ID NO: 524111 - DNA, 25 bp, Rattus norvegicus
gttcacttccttgaaattccgttgt

SEQ ID NO: 524112 - DNA, 25 bp, Rattus norvegicus
gttcacttctataattctctttctc

SEQ ID NO: 524113 - DNA, 25 bp, Rattus norvegicus
gttcacttctattattctctttctc

SEQ ID NO: 524114 - DNA, 25 bp, Rattus norvegicus
gttcacttctgtatacaaaagcttg

SEQ ID NO: 524115 - DNA, 25 bp, Rattus norvegicus
gttcacttctgtttacaaaagcttg

SEQ ID NO: 524116 - DNA, 25 bp, Rattus norvegicus
gttcacttgaagcacggttcatttt

SEQ ID NO: 524117 - DNA, 25 bp, Rattus norvegicus
gttcacttgaaggacggttcatttt

SEQ ID NO: 524118 - DNA, 25 bp, Rattus norvegicus
gttcacttgagtacacttcctagaa

SEQ ID NO: 524119 - DNA, 25 bp, Rattus norvegicus
gttcacttgagttcacttcctagaa

SEQ ID NO: 524120 - DNA, 25 bp, Rattus norvegicus
gttcacttgcttcgcgatagcactg

SEQ ID NO: 524121 - DNA, 25 bp, Rattus norvegicus
gttcacttgcttggcgatagcactg

SEQ ID NO: 524122 - DNA, 25 bp, Rattus norvegicus
gttcacttgtagatttgcacacttc

SEQ ID NO: 524123 - DNA, 25 bp, Rattus norvegicus
gttcacttgtagttttgcacacttc

SEQ ID NO: 524124 - DNA, 25 bp, Rattus norvegicus
gttcactttccaaagctacttgttt

SEQ ID NO: 524125 - DNA, 25 bp, Rattus norvegicus
gttcactttccatagctacttgttt

SEQ ID NO: 524126 - DNA, 25 bp, Rattus norvegicus
gttcactttcccagagactcagttc

SEQ ID NO: 524127 - DNA, 25 bp, Rattus norvegicus
gttcactttccctgagactcagttc

SEQ ID NO: 524128 - DNA, 25 bp, Rattus norvegicus
gttcactttcttctttgtaaatggg

SEQ ID NO: 524129 - DNA, 25 bp, Rattus norvegicus
gttcactttcttgtttgtaaatggg

SEQ ID NO: 524130 - DNA, 25 bp, Rattus norvegicus
gttcagaaaacacgtatctcctttt

SEQ ID NO: 524131 - DNA, 25 bp, Rattus norvegicus
gttcagaaaacaggtatctcctttt

SEQ ID NO: 524132 - DNA, 25 bp, Rattus norvegicus
gttcagaaaagcatgaccaggtcat

SEQ ID NO: 524133 - DNA, 25 bp, Rattus norvegicus
gttcagaaaagcttgaccaggtcat

SEQ ID NO: 524134 - DNA, 25 bp, Rattus norvegicus
gttcagaaaatcaatgactctcggg

SEQ ID NO: 524135 - DNA, 25 bp, Rattus norvegicus
gttcagaaaatctatgactctcggg

SEQ ID NO: 524136 - DNA, 25 bp, Rattus norvegicus
gttcagaaaccccagtagcatcaat

SEQ ID NO: 524137 - DNA, 25 bp, Rattus norvegicus
gttcagaaacccgagtagcatcaat

SEQ ID NO: 524138 - DNA, 25 bp, Rattus norvegicus
gttcagaaatacattgtggtctctc

SEQ ID NO: 524139 - DNA, 25 bp, Rattus norvegicus
gttcagaaatactttgtggtctctc

SEQ ID NO: 524140 - DNA, 25 bp, Rattus norvegicus
gttcagaacagaaccagtatttagc

SEQ ID NO: 524141 - DNA, 25 bp, Rattus norvegicus
gttcagaacagatccagtatttagc

SEQ ID NO: 524142 - DNA, 25 bp, Rattus norvegicus
gttcagaacctgcacatccgtaaaa

SEQ ID NO: 524143 - DNA, 25 bp, Rattus norvegicus
gttcagaacctggacatccgtaaaa

SEQ ID NO: 524144 - DNA, 25 bp, Rattus norvegicus
gttcagaagaacagcctccttttgc

SEQ ID NO: 524145 - DNA, 25 bp, Rattus norvegicus
gttcagaagaactgcctccttttgc

SEQ ID NO: 524146 - DNA, 25 bp, Rattus norvegicus
gttcagaatagcaatggtatgtaag

SEQ ID NO: 524147 - DNA, 25 bp, Rattus norvegicus
gttcagaatagctatggtatgtaag

SEQ ID NO: 524148 - DNA, 25 bp, Rattus norvegicus
gttcagaatctcctatttgctttgt

SEQ ID NO: 524149 - DNA, 25 bp, Rattus norvegicus
gttcagaatctcgtatttgctttgt

SEQ ID NO: 524150 - DNA, 25 bp, Rattus norvegicus
gttcagacaactcagcttccaaagg

SEQ ID NO: 524151 - DNA, 25 bp, Rattus norvegicus
gttcagacaactgagcttccaaagg

SEQ ID NO: 524152 - DNA, 25 bp, Rattus norvegicus
gttcagacagcaatggcccagatgt

SEQ ID NO: 524153 - DNA, 25 bp, Rattus norvegicus
gttcagacagcattggcccagatgt

SEQ ID NO: 524154 - DNA, 25 bp, Rattus norvegicus
gttcagacagttaccaatatgcaca

SEQ ID NO: 524155 - DNA, 25 bp, Rattus norvegicus
gttcagacagtttccaatatgcaca

SEQ ID NO: 524156 - DNA, 25 bp, Rattus norvegicus
gttcagaccaacagaaagccggcag

SEQ ID NO: 524157 - DNA, 25 bp, Rattus norvegicus
gttcagaccaactgaaagccggcag

SEQ ID NO: 524158 - DNA, 25 bp, Rattus norvegicus
gttcagacctagcagtgaaacagaa

SEQ ID NO: 524159 - DNA, 25 bp, Rattus norvegicus
gttcagacctaggagtgaaacagaa

SEQ ID NO: 524160 - DNA, 25 bp, Rattus norvegicus
gttcagacctgtacgtaagtttagt

SEQ ID NO: 524161 - DNA, 25 bp, Rattus norvegicus
gttcagacctgttcgtaagtttagt

SEQ ID NO: 524162 - DNA, 25 bp, Rattus norvegicus
gttcagactcctatcccaaatgatt

SEQ ID NO: 524163 - DNA, 25 bp, Rattus norvegicus
gttcagactcctttcccaaatgatt

SEQ ID NO: 524164 - DNA, 25 bp, Rattus norvegicus
gttcagactcgcaggtgtcactgta

SEQ ID NO: 524165 - DNA, 25 bp, Rattus norvegicus
gttcagactcgctggtgtcactgta

SEQ ID NO: 524166 - DNA, 25 bp, Rattus norvegicus
gttcagactcttaggacaactcacc

SEQ ID NO: 524167 - DNA, 25 bp, Rattus norvegicus
gttcagactctttggacaactcacc

SEQ ID NO: 524168 - DNA, 25 bp, Rattus norvegicus
gttcagacttcaacgcaagtatcga

SEQ ID NO: 524169 - DNA, 25 bp, Rattus norvegicus
gttcagacttcatcgcaagtatcga

SEQ ID NO: 524170 - DNA, 25 bp, Rattus norvegicus
gttcagacttctcacctaaaattag

SEQ ID NO: 524171 - DNA, 25 bp, Rattus norvegicus
gttcagacttctgacctaaaattag

SEQ ID NO: 524172 - DNA, 25 bp, Rattus norvegicus
gttcagagacacatacttcagcggg

SEQ ID NO: 524173 - DNA, 25 bp, Rattus norvegicus
gttcagagacacttacttcagcggg

SEQ ID NO: 524174 - DNA, 25 bp, Rattus norvegicus
gttcagagactgatttcctttcctc

SEQ ID NO: 524175 - DNA, 25 bp, Rattus norvegicus
gttcagagactgttttcctttcctc

SEQ ID NO: 524176 - DNA, 25 bp, Rattus norvegicus
gttcagagagggaagggcatcactt

SEQ ID NO: 524177 - DNA, 25 bp, Rattus norvegicus
gttcagagagggtagggcatcactt

SEQ ID NO: 524178 - DNA, 25 bp, Rattus norvegicus
gttcagagcggccatcaggacacga

SEQ ID NO: 524179 - DNA, 25 bp, Rattus norvegicus
gttcagagcggcgatcaggacacga

SEQ ID NO: 524180 - DNA, 25 bp, Rattus norvegicus
gttcagaggacgcagagcacctttg

SEQ ID NO: 524181 - DNA, 25 bp, Rattus norvegicus
gttcagaggacggagagcacctttg

SEQ ID NO: 524182 - DNA, 25 bp, Rattus norvegicus
gttcagaggcttcgtgtgtgtttct

SEQ ID NO: 524183 - DNA, 25 bp, Rattus norvegicus
gttcagaggcttggtgtgtgtttct

SEQ ID NO: 524184 - DNA, 25 bp, Rattus norvegicus
gttcagaggtacctgcattcttagt

SEQ ID NO: 524185 - DNA, 25 bp, Rattus norvegicus
gttcagaggtacgtgcattcttagt

SEQ ID NO: 524186 - DNA, 25 bp, Rattus norvegicus
gttcagaggtatcccaccaggagcc

SEQ ID NO: 524187 - DNA, 25 bp, Rattus norvegicus
gttcagaggtatgccaccaggagcc

SEQ ID NO: 524188 - DNA, 25 bp, Rattus norvegicus
gttcagaggtgacagcccacatgtt

SEQ ID NO: 524189 - DNA, 25 bp, Rattus norvegicus
gttcagaggtgagagcccacatgtt

SEQ ID NO: 524190 - DNA, 25 bp, Rattus norvegicus
gttcagagtcacaggatcagctcga

SEQ ID NO: 524191 - DNA, 25 bp, Rattus norvegicus
gttcagagtcactggatcagctcga

SEQ ID NO: 524192 - DNA, 25 bp, Rattus norvegicus
gttcagagtctgaagccctgcaata

SEQ ID NO: 524193 - DNA, 25 bp, Rattus norvegicus
gttcagagtctgtagccctgcaata

SEQ ID NO: 524194 - DNA, 25 bp, Rattus norvegicus
gttcagagttggaatgtggcacgca

SEQ ID NO: 524195 - DNA, 25 bp, Rattus norvegicus
gttcagagttggtatgtggcacgca

SEQ ID NO: 524196 - DNA, 25 bp, Rattus norvegicus
gttcagatcatcctgggtcacatgg

SEQ ID NO: 524197 - DNA, 25 bp, Rattus norvegicus
gttcagatcatcgtgggtcacatgg

SEQ ID NO: 524198 - DNA, 25 bp, Rattus norvegicus
gttcagatcattaacttcacattac

SEQ ID NO: 524199 - DNA, 25 bp, Rattus norvegicus
gttcagatcatttacttcacattac

SEQ ID NO: 524200 - DNA, 25 bp, Rattus norvegicus
gttcagatcgtgcacattttacttt

SEQ ID NO: 524201 - DNA, 25 bp, Rattus norvegicus
gttcagatcgtggacattttacttt

SEQ ID NO: 524202 - DNA, 25 bp, Rattus norvegicus
gttcagatctctcgcttgtgggtat

SEQ ID NO: 524203 - DNA, 25 bp, Rattus norvegicus
gttcagatctctggcttgtgggtat

SEQ ID NO: 524204 - DNA, 25 bp, Rattus norvegicus
gttcagatgaccagcagactttcta

SEQ ID NO: 524205 - DNA, 25 bp, Rattus norvegicus
gttcagatgacctgcagactttcta

SEQ ID NO: 524206 - DNA, 25 bp, Rattus norvegicus
gttcagatgccaagccattgtcaaa

SEQ ID NO: 524207 - DNA, 25 bp, Rattus norvegicus
gttcagatgccatgccattgtcaaa

SEQ ID NO: 524208 - DNA, 25 bp, Rattus norvegicus
gttcagatgctgaggtctagtgaca

SEQ ID NO: 524209 - DNA, 25 bp, Rattus norvegicus
gttcagatgctgtggtctagtgaca

SEQ ID NO: 524210 - DNA, 25 bp, Rattus norvegicus
gttcagatttgtcttttccttcgat

SEQ ID NO: 524211 - DNA, 25 bp, Rattus norvegicus
gttcagatttgtgttttccttcgat

SEQ ID NO: 524212 - DNA, 25 bp, Rattus norvegicus
gttcagcaatttagaggcccaagtt

SEQ ID NO: 524213 - DNA, 25 bp, Rattus norvegicus
gttcagcaattttgaggcccaagtt

SEQ ID NO: 524214 - DNA, 25 bp, Rattus norvegicus
gttcagcagtgcatgttggtcaggt

SEQ ID NO: 524215 - DNA, 25 bp, Rattus norvegicus
gttcagcagtgcttgttggtcaggt

SEQ ID NO: 524216 - DNA, 25 bp, Rattus norvegicus
gttcagcatcccagacaagcagtat

SEQ ID NO: 524217 - DNA, 25 bp, Rattus norvegicus
gttcagcatccctgacaagcagtat

SEQ ID NO: 524218 - DNA, 25 bp, Rattus norvegicus
gttcagcatggtctcctcattcata

SEQ ID NO: 524219 - DNA, 25 bp, Rattus norvegicus
gttcagcatggtgtcctcattcata

SEQ ID NO: 524220 - DNA, 25 bp, Rattus norvegicus
gttcagcattaaacctcagtttgag

SEQ ID NO: 524221 - DNA, 25 bp, Rattus norvegicus
gttcagcattaatcctcagtttgag

SEQ ID NO: 524222 - DNA, 25 bp, Rattus norvegicus
gttcagcattgccaagactctgtct

SEQ ID NO: 524223 - DNA, 25 bp, Rattus norvegicus
gttcagcattgcgaagactctgtct

SEQ ID NO: 524224 - DNA, 25 bp, Rattus norvegicus
gttcagccaaaaaattccagctcct

SEQ ID NO: 524225 - DNA, 25 bp, Rattus norvegicus
gttcagccaaaatattccagctcct

SEQ ID NO: 524226 - DNA, 25 bp, Rattus norvegicus
gttcagccaactagtgcattttatt

SEQ ID NO: 524227 - DNA, 25 bp, Rattus norvegicus
gttcagccaacttgtgcattttatt

SEQ ID NO: 524228 - DNA, 25 bp, Rattus norvegicus
gttcagccaataagtgtgccagcag

SEQ ID NO: 524229 - DNA, 25 bp, Rattus norvegicus
gttcagccaatatgtgtgccagcag

SEQ ID NO: 524230 - DNA, 25 bp, Rattus norvegicus
gttcagccagccattgaaggtctta

SEQ ID NO: 524231 - DNA, 25 bp, Rattus norvegicus
gttcagccagcctttgaaggtctta

SEQ ID NO: 524232 - DNA, 25 bp, Rattus norvegicus
gttcagccatggacagtgttacagg

SEQ ID NO: 524233 - DNA, 25 bp, Rattus norvegicus
gttcagccatggtcagtgttacagg

SEQ ID NO: 524234 - DNA, 25 bp, Rattus norvegicus
gttcagcctagcacgggtgaaacgg

SEQ ID NO: 524235 - DNA, 25 bp, Rattus norvegicus
gttcagcctagctcgggtgaaacgg

SEQ ID NO: 524236 - DNA, 25 bp, Rattus norvegicus
gttcagcgccaacccaaaatgttct

SEQ ID NO: 524237 - DNA, 25 bp, Rattus norvegicus
gttcagcgccaagccaaaatgttct

SEQ ID NO: 524238 - DNA, 25 bp, Rattus norvegicus
gttcagcggctcaatcagatttaac

SEQ ID NO: 524239 - DNA, 25 bp, Rattus norvegicus
gttcagcggctctatcagatttaac

SEQ ID NO: 524240 - DNA, 25 bp, Rattus norvegicus
gttcagctatttacgtttcgccaat

SEQ ID NO: 524241 - DNA, 25 bp, Rattus norvegicus
gttcagctattttcgtttcgccaat

SEQ ID NO: 524242 - DNA, 25 bp, Rattus norvegicus
gttcagctccttaccatttggtatt

SEQ ID NO: 524243 - DNA, 25 bp, Rattus norvegicus
gttcagctcctttccatttggtatt

SEQ ID NO: 524244 - DNA, 25 bp, Rattus norvegicus
gttcagctctgaagtaaaccgcatt

SEQ ID NO: 524245 - DNA, 25 bp, Rattus norvegicus
gttcagctctgatgtaaaccgcatt

SEQ ID NO: 524246 - DNA, 25 bp, Rattus norvegicus
gttcagctcttcacagggagtagaa

SEQ ID NO: 524247 - DNA, 25 bp, Rattus norvegicus
gttcagctcttctcagggagtagaa

SEQ ID NO: 524248 - DNA, 25 bp, Rattus norvegicus
gttcagctcttgattcccaggatag

SEQ ID NO: 524249 - DNA, 25 bp, Rattus norvegicus
gttcagctcttgtttcccaggatag

SEQ ID NO: 524250 - DNA, 25 bp, Rattus norvegicus
gttcagcttgcgaaaggtcttgtca

SEQ ID NO: 524251 - DNA, 25 bp, Rattus norvegicus
gttcagcttgcgtaaggtcttgtca

SEQ ID NO: 524252 - DNA, 25 bp, Rattus norvegicus
gttcagcttgggagcagccatgaaa

SEQ ID NO: 524253 - DNA, 25 bp, Rattus norvegicus
gttcagcttgggtgcagccatgaaa

SEQ ID NO: 524254 - DNA, 25 bp, Rattus norvegicus
gttcagctttctaccattgttgttt

SEQ ID NO: 524255 - DNA, 25 bp, Rattus norvegicus
gttcagctttctcggaaggcaggca

SEQ ID NO: 524256 - DNA, 25 bp, Rattus norvegicus
gttcagctttctgggaaggcaggca

SEQ ID NO: 524257 - DNA, 25 bp, Rattus norvegicus
gttcagctttcttccattgttgttt

SEQ ID NO: 524258 - DNA, 25 bp, Rattus norvegicus
gttcaggaactacctaatacccaag

SEQ ID NO: 524259 - DNA, 25 bp, Rattus norvegicus
gttcaggaactagctaatacccaag

SEQ ID NO: 524260 - DNA, 25 bp, Rattus norvegicus
gttcaggacttcagtgttttggtaa

SEQ ID NO: 524261 - DNA, 25 bp, Rattus norvegicus
gttcaggacttctgtgttttggtaa

SEQ ID NO: 524262 - DNA, 25 bp, Rattus norvegicus
gttcaggatctgagggactctccct

SEQ ID NO: 524263 - DNA, 25 bp, Rattus norvegicus
gttcaggatctgtgggactctccct

SEQ ID NO: 524264 - DNA, 25 bp, Rattus norvegicus
gttcaggatgaacacactgccccac

SEQ ID NO: 524265 - DNA, 25 bp, Rattus norvegicus
gttcaggatgaagacactgccccac

SEQ ID NO: 524266 - DNA, 25 bp, Rattus norvegicus
gttcaggatgccaagtctgtgccaa

SEQ ID NO: 524267 - DNA, 25 bp, Rattus norvegicus
gttcaggatgcctagtctgtgccaa

SEQ ID NO: 524268 - DNA, 25 bp, Rattus norvegicus
gttcaggatttcattacataaccct

SEQ ID NO: 524269 - DNA, 25 bp, Rattus norvegicus
gttcaggatttctttacataaccct

SEQ ID NO: 524270 - DNA, 25 bp, Rattus norvegicus
gttcaggcaaagacttagtcgcagg

SEQ ID NO: 524271 - DNA, 25 bp, Rattus norvegicus
gttcaggcaaagtcttagtcgcagg

SEQ ID NO: 524272 - DNA, 25 bp, Rattus norvegicus
gttcaggcaagcaccgaagttgcga

SEQ ID NO: 524273 - DNA, 25 bp, Rattus norvegicus
gttcaggcaagctccgaagttgcga

SEQ ID NO: 524274 - DNA, 25 bp, Rattus norvegicus
gttcaggcatcaatcctctggtgta

SEQ ID NO: 524275 - DNA, 25 bp, Rattus norvegicus
gttcaggcatcattcctctggtgta

SEQ ID NO: 524276 - DNA, 25 bp, Rattus norvegicus
gttcaggccgaccacgaagacgaaa

SEQ ID NO: 524277 - DNA, 25 bp, Rattus norvegicus
gttcaggccgacgacgaagacgaaa

SEQ ID NO: 524278 - DNA, 25 bp, Rattus norvegicus
gttcaggctgtcaaggcacactcca

SEQ ID NO: 524279 - DNA, 25 bp, Rattus norvegicus
gttcaggctgtctaggcacactcca

SEQ ID NO: 524280 - DNA, 25 bp, Rattus norvegicus
gttcaggctttaataaacagctatt

SEQ ID NO: 524281 - DNA, 25 bp, Rattus norvegicus
gttcaggctttattaaacagctatt

SEQ ID NO: 524282 - DNA, 25 bp, Rattus norvegicus
gttcagggagatatagccgctttct

SEQ ID NO: 524283 - DNA, 25 bp, Rattus norvegicus
gttcagggagatttagccgctttct

SEQ ID NO: 524284 - DNA, 25 bp, Rattus norvegicus
gttcagggatgactcagctgtccca

SEQ ID NO: 524285 - DNA, 25 bp, Rattus norvegicus
gttcagggatgagtcagctgtccca

SEQ ID NO: 524286 - DNA, 25 bp, Rattus norvegicus
gttcagggatggcacgcccacccag

SEQ ID NO: 524287 - DNA, 25 bp, Rattus norvegicus
gttcagggatgggacgcccacccag

SEQ ID NO: 524288 - DNA, 25 bp, Rattus norvegicus
gttcagggcgaacacagatcacact

SEQ ID NO: 524289 - DNA, 25 bp, Rattus norvegicus
gttcagggcgaagacagatcacact

SEQ ID NO: 524290 - DNA, 25 bp, Rattus norvegicus
gttcagggtcaacagactatcctat

SEQ ID NO: 524291 - DNA, 25 bp, Rattus norvegicus
gttcagggtcaagagactatcctat

SEQ ID NO: 524292 - DNA, 25 bp, Rattus norvegicus
gttcagggttctagctgcacttgca

SEQ ID NO: 524293 - DNA, 25 bp, Rattus norvegicus
gttcagggttcttgctgcacttgca

SEQ ID NO: 524294 - DNA, 25 bp, Rattus norvegicus
gttcaggtaattccagagcacagca

SEQ ID NO: 524295 - DNA, 25 bp, Rattus norvegicus
gttcaggtaattgcagagcacagca

SEQ ID NO: 524296 - DNA, 25 bp, Rattus norvegicus
gttcaggtcacacgctggtgccagc

SEQ ID NO: 524297 - DNA, 25 bp, Rattus norvegicus
gttcaggtcacaggctggtgccagc

SEQ ID NO: 524298 - DNA, 25 bp, Rattus norvegicus
gttcaggtgacaaccccagacgttt

SEQ ID NO: 524299 - DNA, 25 bp, Rattus norvegicus
gttcaggtgacatccccagacgttt

SEQ ID NO: 524300 - DNA, 25 bp, Rattus norvegicus
gttcaggtgacgattctaagtcctt

SEQ ID NO: 524301 - DNA, 25 bp, Rattus norvegicus
gttcaggtgacgtttctaagtcctt

SEQ ID NO: 524302 - DNA, 25 bp, Rattus norvegicus
gttcaggtggaccataaccagttct

SEQ ID NO: 524303 - DNA, 25 bp, Rattus norvegicus
gttcaggtggacgataaccagttct

SEQ ID NO: 524304 - DNA, 25 bp, Rattus norvegicus
gttcaggttgagcacatcaaggcat

SEQ ID NO: 524305 - DNA, 25 bp, Rattus norvegicus
gttcaggttgaggacatcaaggcat

SEQ ID NO: 524306 - DNA, 25 bp, Rattus norvegicus
gttcaggtttctagtgttgagagtt

SEQ ID NO: 524307 - DNA, 25 bp, Rattus norvegicus
gttcaggtttcttgtgttgagagtt

SEQ ID NO: 524308 - DNA, 25 bp, Rattus norvegicus
gttcagtaaccacaggcaagtcagt

SEQ ID NO: 524309 - DNA, 25 bp, Rattus norvegicus
gttcagtaaccagaggcaagtcagt

SEQ ID NO: 524310 - DNA, 25 bp, Rattus norvegicus
gttcagtaccaacagttctgccaga

SEQ ID NO: 524311 - DNA, 25 bp, Rattus norvegicus
gttcagtaccaagagttctgccaga

SEQ ID NO: 524312 - DNA, 25 bp, Rattus norvegicus
gttcagtagactactgtttacagta

SEQ ID NO: 524313 - DNA, 25 bp, Rattus norvegicus
gttcagtagacttctgtttacagta

SEQ ID NO: 524314 - DNA, 25 bp, Rattus norvegicus
gttcagtagccaacaaccagcaata

SEQ ID NO: 524315 - DNA, 25 bp, Rattus norvegicus
gttcagtagccatcaaccagcaata

SEQ ID NO: 524316 - DNA, 25 bp, Rattus norvegicus
gttcagtatactatgtgtaccacgt

SEQ ID NO: 524317 - DNA, 25 bp, Rattus norvegicus
gttcagtatactttgtgtaccacgt

SEQ ID NO: 524318 - DNA, 25 bp, Rattus norvegicus
gttcagtatctgaggttcatttaaa

SEQ ID NO: 524319 - DNA, 25 bp, Rattus norvegicus
gttcagtatctgtggttcatttaaa

SEQ ID NO: 524320 - DNA, 25 bp, Rattus norvegicus
gttcagtatgaaccacctcaggagg

SEQ ID NO: 524321 - DNA, 25 bp, Rattus norvegicus
gttcagtatgaagcacctcaggagg

SEQ ID NO: 524322 - DNA, 25 bp, Rattus norvegicus
gttcagtcactcaattcacaatgca

SEQ ID NO: 524323 - DNA, 25 bp, Rattus norvegicus
gttcagtcactctattcacaatgca

SEQ ID NO: 524324 - DNA, 25 bp, Rattus norvegicus
gttcagtcagaccagtaagcccttc

SEQ ID NO: 524325 - DNA, 25 bp, Rattus norvegicus
gttcagtcagacgagtaagcccttc

SEQ ID NO: 524326 - DNA, 25 bp, Rattus norvegicus
gttcagtcagcacagttgatttcct

SEQ ID NO: 524327 - DNA, 25 bp, Rattus norvegicus
gttcagtcagcagagttgatttcct

SEQ ID NO: 524328 - DNA, 25 bp, Rattus norvegicus
gttcagtcatagctctgcaggacag

SEQ ID NO: 524329 - DNA, 25 bp, Rattus norvegicus
gttcagtcataggtctgcaggacag

SEQ ID NO: 524330 - DNA, 25 bp, Rattus norvegicus
gttcagtccacacaggctggatctc

SEQ ID NO: 524331 - DNA, 25 bp, Rattus norvegicus
gttcagtccacagaggctggatctc

SEQ ID NO: 524332 - DNA, 25 bp, Rattus norvegicus
gttcagtccagtctgagatcagcct

SEQ ID NO: 524333 - DNA, 25 bp, Rattus norvegicus
gttcagtccagtgtgagatcagcct

SEQ ID NO: 524334 - DNA, 25 bp, Rattus norvegicus
gttcagtccccacgattgacatggt

SEQ ID NO: 524335 - DNA, 25 bp, Rattus norvegicus
gttcagtccccaggattgacatggt

SEQ ID NO: 524336 - DNA, 25 bp, Rattus norvegicus
gttcagtccctaaacacgcatatat

SEQ ID NO: 524337 - DNA, 25 bp, Rattus norvegicus
gttcagtccctatacacgcatatat

SEQ ID NO: 524338 - DNA, 25 bp, Rattus norvegicus
gttcagtccctcaaacaggcagtta

SEQ ID NO: 524339 - DNA, 25 bp, Rattus norvegicus
gttcagtccctctaacaggcagtta

SEQ ID NO: 524340 - DNA, 25 bp, Rattus norvegicus
gttcagtcccttccagccacagggt

SEQ ID NO: 524341 - DNA, 25 bp, Rattus norvegicus
gttcagtcccttcgcaatggagctg

SEQ ID NO: 524342 - DNA, 25 bp, Rattus norvegicus
gttcagtcccttgcagccacagggt

SEQ ID NO: 524343 - DNA, 25 bp, Rattus norvegicus
gttcagtcccttggcaatggagctg

SEQ ID NO: 524344 - DNA, 25 bp, Rattus norvegicus
gttcagtcctagcaggcccatctta

SEQ ID NO: 524345 - DNA, 25 bp, Rattus norvegicus
gttcagtcctaggaggcccatctta

SEQ ID NO: 524346 - DNA, 25 bp, Rattus norvegicus
gttcagtcctcaactccaagttaaa

SEQ ID NO: 524347 - DNA, 25 bp, Rattus norvegicus
gttcagtcctcatctccaagttaaa

SEQ ID NO: 524348 - DNA, 25 bp, Rattus norvegicus
gttcagtgaaaacctcttgtctcaa

SEQ ID NO: 524349 - DNA, 25 bp, Rattus norvegicus
gttcagtgaaaagctcttgtctcaa

SEQ ID NO: 524350 - DNA, 25 bp, Rattus norvegicus
gttcagtgaaggactttggaccagt

SEQ ID NO: 524351 - DNA, 25 bp, Rattus norvegicus
gttcagtgaaggtctttggaccagt

SEQ ID NO: 524352 - DNA, 25 bp, Rattus norvegicus
gttcagtgcctgagctcattgagct

SEQ ID NO: 524353 - DNA, 25 bp, Rattus norvegicus
gttcagtgcctgtgctcattgagct

SEQ ID NO: 524354 - DNA, 25 bp, Rattus norvegicus
gttcagtggcagcaatttccctgtc

SEQ ID NO: 524355 - DNA, 25 bp, Rattus norvegicus
gttcagtggcaggaatttccctgtc

SEQ ID NO: 524356 - DNA, 25 bp, Rattus norvegicus
gttcagtggccgacaggccagaact

SEQ ID NO: 524357 - DNA, 25 bp, Rattus norvegicus
gttcagtggccgtcaggccagaact

SEQ ID NO: 524358 - DNA, 25 bp, Rattus norvegicus
gttcagtggtccaagcacagagact

SEQ ID NO: 524359 - DNA, 25 bp, Rattus norvegicus
gttcagtggtcctagcacagagact

SEQ ID NO: 524360 - DNA, 25 bp, Rattus norvegicus
gttcagtggtgaagcatcctctatt

SEQ ID NO: 524361 - DNA, 25 bp, Rattus norvegicus
gttcagtggtgatgcatcctctatt

SEQ ID NO: 524362 - DNA, 25 bp, Rattus norvegicus
gttcagtggtgcaacgagctgctaa

SEQ ID NO: 524363 - DNA, 25 bp, Rattus norvegicus
gttcagtggtgctacgagctgctaa

SEQ ID NO: 524364 - DNA, 25 bp, Rattus norvegicus
gttcagtggtttacagtatgttcat

SEQ ID NO: 524365 - DNA, 25 bp, Rattus norvegicus
gttcagtggttttcagtatgttcat

SEQ ID NO: 524366 - DNA, 25 bp, Rattus norvegicus
gttcagtgtatacacaactcacagt

SEQ ID NO: 524367 - DNA, 25 bp, Rattus norvegicus
gttcagtgtatagacaactcacagt

SEQ ID NO: 524368 - DNA, 25 bp, Rattus norvegicus
gttcagtgtcacagtcacccagagg

SEQ ID NO: 524369 - DNA, 25 bp, Rattus norvegicus
gttcagtgtcactgtcacccagagg

SEQ ID NO: 524370 - DNA, 25 bp, Rattus norvegicus
gttcagtgtcccctttgacccttga

SEQ ID NO: 524371 - DNA, 25 bp, Rattus norvegicus
gttcagtgtcccgtttgacccttga

SEQ ID NO: 524372 - DNA, 25 bp, Rattus norvegicus
gttcagtgttctctttcacaaaatt

SEQ ID NO: 524373 - DNA, 25 bp, Rattus norvegicus
gttcagtgttctgtttcacaaaatt

SEQ ID NO: 524374 - DNA, 25 bp, Rattus norvegicus
gttcagttactcagactttctcaga

SEQ ID NO: 524375 - DNA, 25 bp, Rattus norvegicus
gttcagttactcatcaggttctgga

SEQ ID NO: 524376 - DNA, 25 bp, Rattus norvegicus
gttcagttactctgactttctcaga

SEQ ID NO: 524377 - DNA, 25 bp, Rattus norvegicus
gttcagttactcttcaggttctgga

SEQ ID NO: 524378 - DNA, 25 bp, Rattus norvegicus
gttcagttcacaccatctacagagg

SEQ ID NO: 524379 - DNA, 25 bp, Rattus norvegicus
gttcagttcacagcatctacagagg

SEQ ID NO: 524380 - DNA, 25 bp, Rattus norvegicus
gttcagttccaacaaagcgcgcctt

SEQ ID NO: 524381 - DNA, 25 bp, Rattus norvegicus
gttcagttccaagaaagcgcgcctt

SEQ ID NO: 524382 - DNA, 25 bp, Rattus norvegicus
gttcagttgactcggagcccactgc

SEQ ID NO: 524383 - DNA, 25 bp, Rattus norvegicus
gttcagttgactgggagcccactgc

SEQ ID NO: 524384 - DNA, 25 bp, Rattus norvegicus
gttcagttggctagacaccgtcacg

SEQ ID NO: 524385 - DNA, 25 bp, Rattus norvegicus
gttcagttggcttgacaccgtcacg

SEQ ID NO: 524386 - DNA, 25 bp, Rattus norvegicus
gttcagttggtgcagttcttgctta

SEQ ID NO: 524387 - DNA, 25 bp, Rattus norvegicus
gttcagttggtggagttcttgctta

SEQ ID NO: 524388 - DNA, 25 bp, Rattus norvegicus
gttcagttgtagaggaatcccgcta

SEQ ID NO: 524389 - DNA, 25 bp, Rattus norvegicus
gttcagttgtagtggaatcccgcta

SEQ ID NO: 524390 - DNA, 25 bp, Rattus norvegicus
gttcagttgttcattccaaccgtct

SEQ ID NO: 524391 - DNA, 25 bp, Rattus norvegicus
gttcagttgttctttccaaccgtct

SEQ ID NO: 524392 - DNA, 25 bp, Rattus norvegicus
gttcagtttagacattcctggatgc

SEQ ID NO: 524393 - DNA, 25 bp, Rattus norvegicus
gttcagtttagagattcctggatgc

SEQ ID NO: 524394 - DNA, 25 bp, Rattus norvegicus
gttcagtttcacatgctaaattaat

SEQ ID NO: 524395 - DNA, 25 bp, Rattus norvegicus
gttcagtttcacttgctaaattaat

SEQ ID NO: 524396 - DNA, 25 bp, Rattus norvegicus
gttcagtttggcatctctgtatcta

SEQ ID NO: 524397 - DNA, 25 bp, Rattus norvegicus
gttcagtttggcttctctgtatcta

SEQ ID NO: 524398 - DNA, 25 bp, Rattus norvegicus
gttcagttttatagtgcttgtcgtg

SEQ ID NO: 524399 - DNA, 25 bp, Rattus norvegicus
gttcagttttattgtgcttgtcgtg

SEQ ID NO: 524400 - DNA, 25 bp, Rattus norvegicus
gttcagttttgacggctcgcagcca

SEQ ID NO: 524401 - DNA, 25 bp, Rattus norvegicus
gttcagttttgagggctcgcagcca

SEQ ID NO: 524402 - DNA, 25 bp, Rattus norvegicus
gttcagttttgcctgtgtggcagca

SEQ ID NO: 524403 - DNA, 25 bp, Rattus norvegicus
gttcagttttgcgtgtgtggcagca

SEQ ID NO: 524404 - DNA, 25 bp, Rattus norvegicus
gttcataagtatataatcggcacaa

SEQ ID NO: 524405 - DNA, 25 bp, Rattus norvegicus
gttcataagtatttaatcggcacaa

SEQ ID NO: 524406 - DNA, 25 bp, Rattus norvegicus
gttcataatgccaggagcagccttt

SEQ ID NO: 524407 - DNA, 25 bp, Rattus norvegicus
gttcataatgcctggagcagccttt

SEQ ID NO: 524408 - DNA, 25 bp, Rattus norvegicus
gttcatacactcagaaattcttcct

SEQ ID NO: 524409 - DNA, 25 bp, Rattus norvegicus
gttcatacactctgaaattcttcct

SEQ ID NO: 524410 - DNA, 25 bp, Rattus norvegicus
gttcatacactgacctgggagccaa

SEQ ID NO: 524411 - DNA, 25 bp, Rattus norvegicus
gttcatacactgtcctgggagccaa

SEQ ID NO: 524412 - DNA, 25 bp, Rattus norvegicus
gttcatacatgtcaatctacctcgt

SEQ ID NO: 524413 - DNA, 25 bp, Rattus norvegicus
gttcatacatgtgaatctacctcgt

SEQ ID NO: 524414 - DNA, 25 bp, Rattus norvegicus
gttcataccagtaacggaccaataa

SEQ ID NO: 524415 - DNA, 25 bp, Rattus norvegicus
gttcataccagttacggaccaataa

SEQ ID NO: 524416 - DNA, 25 bp, Rattus norvegicus
gttcatacccttatgccatagaatt

SEQ ID NO: 524417 - DNA, 25 bp, Rattus norvegicus
gttcatacccttttgccatagaatt

SEQ ID NO: 524418 - DNA, 25 bp, Rattus norvegicus
gttcatactgagagcccatctgtga

SEQ ID NO: 524419 - DNA, 25 bp, Rattus norvegicus
gttcatactgagtgcccatctgtga

SEQ ID NO: 524420 - DNA, 25 bp, Rattus norvegicus
gttcatactgatcctcaaaccggaa

SEQ ID NO: 524421 - DNA, 25 bp, Rattus norvegicus
gttcatactgatgctcaaaccggaa

SEQ ID NO: 524422 - DNA, 25 bp, Rattus norvegicus
gttcatactggacagtaacatacca

SEQ ID NO: 524423 - DNA, 25 bp, Rattus norvegicus
gttcatactggagagtaacatacca

SEQ ID NO: 524424 - DNA, 25 bp, Rattus norvegicus
gttcatacttgtagctatgccgtcc

SEQ ID NO: 524425 - DNA, 25 bp, Rattus norvegicus
gttcatacttgttgctatgccgtcc

SEQ ID NO: 524426 - DNA, 25 bp, Rattus norvegicus
gttcatactttgcaacgctcgttca

SEQ ID NO: 524427 - DNA, 25 bp, Rattus norvegicus
gttcatactttggaacgctcgttca

SEQ ID NO: 524428 - DNA, 25 bp, Rattus norvegicus
gttcatagaaaaaagagccccagga

SEQ ID NO: 524429 - DNA, 25 bp, Rattus norvegicus
gttcatagaaaatagagccccagga

SEQ ID NO: 524430 - DNA, 25 bp, Rattus norvegicus
gttcatagaactccgggctcgaggc

SEQ ID NO: 524431 - DNA, 25 bp, Rattus norvegicus
gttcatagaactgcgggctcgaggc

SEQ ID NO: 524432 - DNA, 25 bp, Rattus norvegicus
gttcatagacccaaaatctcacaag

SEQ ID NO: 524433 - DNA, 25 bp, Rattus norvegicus
gttcatagaccctaaatctcacaag

SEQ ID NO: 524434 - DNA, 25 bp, Rattus norvegicus
gttcatagagctcctttctgaggtc

SEQ ID NO: 524435 - DNA, 25 bp, Rattus norvegicus
gttcatagagctgctttctgaggtc

SEQ ID NO: 524436 - DNA, 25 bp, Rattus norvegicus
gttcatagcagtctgtgaattccaa

SEQ ID NO: 524437 - DNA, 25 bp, Rattus norvegicus
gttcatagcagtgtgtgaattccaa

SEQ ID NO: 524438 - DNA, 25 bp, Rattus norvegicus
gttcatagctgtccctacttcatgg

SEQ ID NO: 524439 - DNA, 25 bp, Rattus norvegicus
gttcatagctgtgcctacttcatgg

SEQ ID NO: 524440 - DNA, 25 bp, Rattus norvegicus
gttcatagcttaaacctgggtacct

SEQ ID NO: 524441 - DNA, 25 bp, Rattus norvegicus
gttcatagcttactcatttctaccc

SEQ ID NO: 524442 - DNA, 25 bp, Rattus norvegicus
gttcatagcttagtcatttctaccc

SEQ ID NO: 524443 - DNA, 25 bp, Rattus norvegicus
gttcatagcttatacctgggtacct

SEQ ID NO: 524444 - DNA, 25 bp, Rattus norvegicus
gttcataggactaaaggactctatt

SEQ ID NO: 524445 - DNA, 25 bp, Rattus norvegicus
gttcataggacttaaggactctatt

SEQ ID NO: 524446 - DNA, 25 bp, Rattus norvegicus
gttcataggcgtatagcagctcaaa

SEQ ID NO: 524447 - DNA, 25 bp, Rattus norvegicus
gttcataggcgtttagcagctcaaa

SEQ ID NO: 524448 - DNA, 25 bp, Rattus norvegicus
gttcatagggcaaatggctgacgga

SEQ ID NO: 524449 - DNA, 25 bp, Rattus norvegicus
gttcatagggcatatggctgacgga

SEQ ID NO: 524450 - DNA, 25 bp, Rattus norvegicus
gttcataggtcaaggtcactcacat

SEQ ID NO: 524451 - DNA, 25 bp, Rattus norvegicus
gttcataggtcatggtcactcacat

SEQ ID NO: 524452 - DNA, 25 bp, Rattus norvegicus
gttcatagtccaatgcttggctccg

SEQ ID NO: 524453 - DNA, 25 bp, Rattus norvegicus
gttcatagtccattgcttggctccg

SEQ ID NO: 524454 - DNA, 25 bp, Rattus norvegicus
gttcatagtcctctttgtgagatac

SEQ ID NO: 524455 - DNA, 25 bp, Rattus norvegicus
gttcatagtcctgtttgtgagatac

SEQ ID NO: 524456 - DNA, 25 bp, Rattus norvegicus
gttcatataatgacatgatccagga

SEQ ID NO: 524457 - DNA, 25 bp, Rattus norvegicus
gttcatataatgtcatgatccagga

SEQ ID NO: 524458 - DNA, 25 bp, Rattus norvegicus
gttcatatactcaaaaaggaccctg

SEQ ID NO: 524459 - DNA, 25 bp, Rattus norvegicus
gttcatatactctaaaaggaccctg

SEQ ID NO: 524460 - DNA, 25 bp, Rattus norvegicus
gttcatatcagcactttgcaggttg

SEQ ID NO: 524461 - DNA, 25 bp, Rattus norvegicus
gttcatatcagctctttgcaggttg

SEQ ID NO: 524462 - DNA, 25 bp, Rattus norvegicus
gttcatatcataaagttccatccat

SEQ ID NO: 524463 - DNA, 25 bp, Rattus norvegicus
gttcatatcatacaccagcagcgtt

SEQ ID NO: 524464 - DNA, 25 bp, Rattus norvegicus
gttcatatcatagaccagcagcgtt

SEQ ID NO: 524465 - DNA, 25 bp, Rattus norvegicus
gttcatatcatatagttccatccat

SEQ ID NO: 524466 - DNA, 25 bp, Rattus norvegicus
gttcatatccctctgtatgcatatt

SEQ ID NO: 524467 - DNA, 25 bp, Rattus norvegicus
gttcatatccctgtgtatgcatatt

SEQ ID NO: 524468 - DNA, 25 bp, Rattus norvegicus
gttcatatcttcatacttttctgtg

SEQ ID NO: 524469 - DNA, 25 bp, Rattus norvegicus
gttcatatcttcttacttttctgtg

SEQ ID NO: 524470 - DNA, 25 bp, Rattus norvegicus
gttcatatgatgaaggctctcgctg

SEQ ID NO: 524471 - DNA, 25 bp, Rattus norvegicus
gttcatatgatgtaggctctcgctg

SEQ ID NO: 524472 - DNA, 25 bp, Rattus norvegicus
gttcatatgttcaaccctgtcagtg

SEQ ID NO: 524473 - DNA, 25 bp, Rattus norvegicus
gttcatatgttctaccctgtcagtg

SEQ ID NO: 524474 - DNA, 25 bp, Rattus norvegicus
gttcatattccacgtgtagctagca

SEQ ID NO: 524475 - DNA, 25 bp, Rattus norvegicus
gttcatattccaggtgtagctagca

SEQ ID NO: 524476 - DNA, 25 bp, Rattus norvegicus
gttcatcaacagctcttaggtttca

SEQ ID NO: 524477 - DNA, 25 bp, Rattus norvegicus
gttcatcaacaggtcttaggtttca

SEQ ID NO: 524478 - DNA, 25 bp, Rattus norvegicus
gttcatcaagccaatctcagagtcc

SEQ ID NO: 524479 - DNA, 25 bp, Rattus norvegicus
gttcatcaagcctatctcagagtcc

SEQ ID NO: 524480 - DNA, 25 bp, Rattus norvegicus
gttcatcaagttagtcctgatccca

SEQ ID NO: 524481 - DNA, 25 bp, Rattus norvegicus
gttcatcaagtttgtcctgatccca

SEQ ID NO: 524482 - DNA, 25 bp, Rattus norvegicus
gttcatcaccgcaccggacctggag

SEQ ID NO: 524483 - DNA, 25 bp, Rattus norvegicus
gttcatcaccgctccggacctggag

SEQ ID NO: 524484 - DNA, 25 bp, Rattus norvegicus
gttcatcactgaagtctgtaggatt

SEQ ID NO: 524485 - DNA, 25 bp, Rattus norvegicus
gttcatcactgatgtctgtaggatt

SEQ ID NO: 524486 - DNA, 25 bp, Rattus norvegicus
gttcatcaggcacctaactcaaact

SEQ ID NO: 524487 - DNA, 25 bp, Rattus norvegicus
gttcatcaggcagctaactcaaact

SEQ ID NO: 524488 - DNA, 25 bp, Rattus norvegicus
gttcatcagggcagtacaatcccaa

SEQ ID NO: 524489 - DNA, 25 bp, Rattus norvegicus
gttcatcagggctgtacaatcccaa

SEQ ID NO: 524490 - DNA, 25 bp, Rattus norvegicus
gttcatcaggttcctgctgagaatg

SEQ ID NO: 524491 - DNA, 25 bp, Rattus norvegicus
gttcatcaggttgctgctgagaatg

SEQ ID NO: 524492 - DNA, 25 bp, Rattus norvegicus
gttcatcatgggacgcagatccttc

SEQ ID NO: 524493 - DNA, 25 bp, Rattus norvegicus
gttcatcatgggtcgcagatccttc

SEQ ID NO: 524494 - DNA, 25 bp, Rattus norvegicus
gttcatcattcacttattcctttaa

SEQ ID NO: 524495 - DNA, 25 bp, Rattus norvegicus
gttcatcattcagttattcctttaa

SEQ ID NO: 524496 - DNA, 25 bp, Rattus norvegicus
gttcatcattgtagtcccaagcagt

SEQ ID NO: 524497 - DNA, 25 bp, Rattus norvegicus
gttcatcattgtcttatttttctat

SEQ ID NO: 524498 - DNA, 25 bp, Rattus norvegicus
gttcatcattgtgttatttttctat

SEQ ID NO: 524499 - DNA, 25 bp, Rattus norvegicus
gttcatcattgttgtcccaagcagt

SEQ ID NO: 524500 - DNA, 25 bp, Rattus norvegicus
gttcatccacttcagcatacttcat

SEQ ID NO: 524501 - DNA, 25 bp, Rattus norvegicus
gttcatccacttgagcatacttcat

SEQ ID NO: 524502 - DNA, 25 bp, Rattus norvegicus
gttcatccagttctttcttcagaga

SEQ ID NO: 524503 - DNA, 25 bp, Rattus norvegicus
gttcatccagttgtttcttcagaga

SEQ ID NO: 524504 - DNA, 25 bp, Rattus norvegicus
gttcatcccaagaacctgttttctt

SEQ ID NO: 524505 - DNA, 25 bp, Rattus norvegicus
gttcatcccaagtacctgttttctt

SEQ ID NO: 524506 - DNA, 25 bp, Rattus norvegicus
gttcatcccagactctaggactgtc

SEQ ID NO: 524507 - DNA, 25 bp, Rattus norvegicus
gttcatcccagagtctaggactgtc

SEQ ID NO: 524508 - DNA, 25 bp, Rattus norvegicus
gttcatcccagcaaatgtggttctg

SEQ ID NO: 524509 - DNA, 25 bp, Rattus norvegicus
gttcatcccagctaatgtggttctg

SEQ ID NO: 524510 - DNA, 25 bp, Rattus norvegicus
gttcatccccagaaccgtagcctgg

SEQ ID NO: 524511 - DNA, 25 bp, Rattus norvegicus
gttcatccccagtaccgtagcctgg

SEQ ID NO: 524512 - DNA, 25 bp, Rattus norvegicus
gttcatccctgacgcgtggactaga

SEQ ID NO: 524513 - DNA, 25 bp, Rattus norvegicus
gttcatccctgaggcgtggactaga

SEQ ID NO: 524514 - DNA, 25 bp, Rattus norvegicus
gttcatccctgcctcagtaaatgaa

SEQ ID NO: 524515 - DNA, 25 bp, Rattus norvegicus
gttcatccctgcgtcagtaaatgaa

SEQ ID NO: 524516 - DNA, 25 bp, Rattus norvegicus
gttcatcccttaatcagcatgaaag

SEQ ID NO: 524517 - DNA, 25 bp, Rattus norvegicus
gttcatcccttattcagcatgaaag

SEQ ID NO: 524518 - DNA, 25 bp, Rattus norvegicus
gttcatcccttgctaagcacagagt

SEQ ID NO: 524519 - DNA, 25 bp, Rattus norvegicus
gttcatcccttggtaagcacagagt

SEQ ID NO: 524520 - DNA, 25 bp, Rattus norvegicus
gttcatcctaacaaaatccacgctg

SEQ ID NO: 524521 - DNA, 25 bp, Rattus norvegicus
gttcatcctaactaaatccacgctg

SEQ ID NO: 524522 - DNA, 25 bp, Rattus norvegicus
gttcatcctagcctgtctcctgtgg

SEQ ID NO: 524523 - DNA, 25 bp, Rattus norvegicus
gttcatcctagcgtgtctcctgtgg

SEQ ID NO: 524524 - DNA, 25 bp, Rattus norvegicus
gttcatcctcgtcattgtccttaaa

SEQ ID NO: 524525 - DNA, 25 bp, Rattus norvegicus
gttcatcctcgtgattgtccttaaa

SEQ ID NO: 524526 - DNA, 25 bp, Rattus norvegicus
gttcatcctgagaccgttttcaaag

SEQ ID NO: 524527 - DNA, 25 bp, Rattus norvegicus
gttcatcctgagtccgttttcaaag

SEQ ID NO: 524528 - DNA, 25 bp, Rattus norvegicus
gttcatcctgcgagagatctgtgga

SEQ ID NO: 524529 - DNA, 25 bp, Rattus norvegicus
gttcatcctgcgtgagatctgtgga

SEQ ID NO: 524530 - DNA, 25 bp, Rattus norvegicus
gttcatcctgttatgatccagcaca

SEQ ID NO: 524531 - DNA, 25 bp, Rattus norvegicus
gttcatcctgttttgatccagcaca

SEQ ID NO: 524532 - DNA, 25 bp, Rattus norvegicus
gttcatccttataactgctttgtca

SEQ ID NO: 524533 - DNA, 25 bp, Rattus norvegicus
gttcatccttattactgctttgtca

SEQ ID NO: 524534 - DNA, 25 bp, Rattus norvegicus
gttcatcgaagacactctactcaaa

SEQ ID NO: 524535 - DNA, 25 bp, Rattus norvegicus
gttcatcgaagagactctactcaaa

SEQ ID NO: 524536 - DNA, 25 bp, Rattus norvegicus
gttcatcgaattacacctgaggagg

SEQ ID NO: 524537 - DNA, 25 bp, Rattus norvegicus
gttcatcgaatttcacctgaggagg

SEQ ID NO: 524538 - DNA, 25 bp, Rattus norvegicus
gttcatcgacgacgccaagagactg

SEQ ID NO: 524539 - DNA, 25 bp, Rattus norvegicus
gttcatcgacgacgcgaagcgcctg

SEQ ID NO: 524540 - DNA, 25 bp, Rattus norvegicus
gttcatcgacgaggccaagagactg

SEQ ID NO: 524541 - DNA, 25 bp, Rattus norvegicus
gttcatcgacgaggcgaagcgcctg

SEQ ID NO: 524542 - DNA, 25 bp, Rattus norvegicus
gttcatcgaggcctccagcagagag

SEQ ID NO: 524543 - DNA, 25 bp, Rattus norvegicus
gttcatcgaggcgtccagcagagag

SEQ ID NO: 524544 - DNA, 25 bp, Rattus norvegicus
gttcatcgtgaaattttgcatctta

SEQ ID NO: 524545 - DNA, 25 bp, Rattus norvegicus
gttcatcgtgaatttttgcatctta

SEQ ID NO: 524546 - DNA, 25 bp, Rattus norvegicus
gttcatcgtgtaagcagactctgat

SEQ ID NO: 524547 - DNA, 25 bp, Rattus norvegicus
gttcatcgtgtatgcagactctgat

SEQ ID NO: 524548 - DNA, 25 bp, Rattus norvegicus
gttcatcgttacacggtggcaagga

SEQ ID NO: 524549 - DNA, 25 bp, Rattus norvegicus
gttcatcgttactcggtggcaagga

SEQ ID NO: 524550 - DNA, 25 bp, Rattus norvegicus
gttcatctaaatcttgtgttctgta

SEQ ID NO: 524551 - DNA, 25 bp, Rattus norvegicus
gttcatctaaatgttgtgttctgta

SEQ ID NO: 524552 - DNA, 25 bp, Rattus norvegicus
gttcatctacctattaggtttctga

SEQ ID NO: 524553 - DNA, 25 bp, Rattus norvegicus
gttcatctaccttttaggtttctga

SEQ ID NO: 524554 - DNA, 25 bp, Rattus norvegicus
gttcatctacttcacttgaatgtca

SEQ ID NO: 524555 - DNA, 25 bp, Rattus norvegicus
gttcatctacttgacttgaatgtca

SEQ ID NO: 524556 - DNA, 25 bp, Rattus norvegicus
gttcatctcacactttttcttctga

SEQ ID NO: 524557 - DNA, 25 bp, Rattus norvegicus
gttcatctcacagtttttcttctga

SEQ ID NO: 524558 - DNA, 25 bp, Rattus norvegicus
gttcatctcaccaagttccggaaag

SEQ ID NO: 524559 - DNA, 25 bp, Rattus norvegicus
gttcatctcacctagttccggaaag

SEQ ID NO: 524560 - DNA, 25 bp, Rattus norvegicus
gttcatctcattacatgtgacagga

SEQ ID NO: 524561 - DNA, 25 bp, Rattus norvegicus
gttcatctcatttcatgtgacagga

SEQ ID NO: 524562 - DNA, 25 bp, Rattus norvegicus
gttcatctctgtatatgtctctcca

SEQ ID NO: 524563 - DNA, 25 bp, Rattus norvegicus
gttcatctctgtttatgtctctcca

SEQ ID NO: 524564 - DNA, 25 bp, Rattus norvegicus
gttcatctgacaaaattctttacta

SEQ ID NO: 524565 - DNA, 25 bp, Rattus norvegicus
gttcatctgacataattctttacta

SEQ ID NO: 524566 - DNA, 25 bp, Rattus norvegicus
gttcatctgctactgtggaatccga

SEQ ID NO: 524567 - DNA, 25 bp, Rattus norvegicus
gttcatctgctagtgtggaatccga

SEQ ID NO: 524568 - DNA, 25 bp, Rattus norvegicus
gttcatctgtctacctcttaactga

SEQ ID NO: 524569 - DNA, 25 bp, Rattus norvegicus
gttcatctgtcttcctcttaactga

SEQ ID NO: 524570 - DNA, 25 bp, Rattus norvegicus
gttcatcttaaaacgactggagcag

SEQ ID NO: 524571 - DNA, 25 bp, Rattus norvegicus
gttcatcttaaatcgactggagcag

SEQ ID NO: 524572 - DNA, 25 bp, Rattus norvegicus
gttcatcttcatatgttttggaata

SEQ ID NO: 524573 - DNA, 25 bp, Rattus norvegicus
gttcatcttcatttgttttggaata

SEQ ID NO: 524574 - DNA, 25 bp, Rattus norvegicus
gttcatcttccaccatgcgtctaga

SEQ ID NO: 524575 - DNA, 25 bp, Rattus norvegicus
gttcatcttccagcatgcgtctaga

SEQ ID NO: 524576 - DNA, 25 bp, Rattus norvegicus
gttcatcttctcagactgagtctag

SEQ ID NO: 524577 - DNA, 25 bp, Rattus norvegicus
gttcatcttctctgactgagtctag

SEQ ID NO: 524578 - DNA, 25 bp, Rattus norvegicus
gttcatcttcttcgttcattttgta

SEQ ID NO: 524579 - DNA, 25 bp, Rattus norvegicus
gttcatcttcttggttcattttgta

SEQ ID NO: 524580 - DNA, 25 bp, Rattus norvegicus
gttcatcttgagatacagcttaggg

SEQ ID NO: 524581 - DNA, 25 bp, Rattus norvegicus
gttcatcttgagcacaggcgttagt

SEQ ID NO: 524582 - DNA, 25 bp, Rattus norvegicus
gttcatcttgaggacaggcgttagt

SEQ ID NO: 524583 - DNA, 25 bp, Rattus norvegicus
gttcatcttgagttacagcttaggg

SEQ ID NO: 524584 - DNA, 25 bp, Rattus norvegicus
gttcatctttcaagcgtaagcagca

SEQ ID NO: 524585 - DNA, 25 bp, Rattus norvegicus
gttcatctttcatgcgtaagcagca

SEQ ID NO: 524586 - DNA, 25 bp, Rattus norvegicus
gttcatgacaaaccgtctgcttcag

SEQ ID NO: 524587 - DNA, 25 bp, Rattus norvegicus
gttcatgacaaagcgtctgcttcag

SEQ ID NO: 524588 - DNA, 25 bp, Rattus norvegicus
gttcatgacatcctattttcttctg

SEQ ID NO: 524589 - DNA, 25 bp, Rattus norvegicus
gttcatgacatcgtattttcttctg

SEQ ID NO: 524590 - DNA, 25 bp, Rattus norvegicus
gttcatgactaacatagcagcgttt

SEQ ID NO: 524591 - DNA, 25 bp, Rattus norvegicus
gttcatgactaagatagcagcgttt

SEQ ID NO: 524592 - DNA, 25 bp, Rattus norvegicus
gttcatgagagtaatatttttcaac

SEQ ID NO: 524593 - DNA, 25 bp, Rattus norvegicus
gttcatgagagttatatttttcaac

SEQ ID NO: 524594 - DNA, 25 bp, Rattus norvegicus
gttcatgagttaccaacaccgactt

SEQ ID NO: 524595 - DNA, 25 bp, Rattus norvegicus
gttcatgagttagcaacaccgactt

SEQ ID NO: 524596 - DNA, 25 bp, Rattus norvegicus
gttcatgatatcagtacctaccaat

SEQ ID NO: 524597 - DNA, 25 bp, Rattus norvegicus
gttcatgatatctgtacctaccaat

SEQ ID NO: 524598 - DNA, 25 bp, Rattus norvegicus
gttcatgatctcatttcgactaaat

SEQ ID NO: 524599 - DNA, 25 bp, Rattus norvegicus
gttcatgatctcttttcgactaaat

SEQ ID NO: 524600 - DNA, 25 bp, Rattus norvegicus
gttcatgccatcctgaagatacgca

SEQ ID NO: 524601 - DNA, 25 bp, Rattus norvegicus
gttcatgccatcgtgaagatacgca

SEQ ID NO: 524602 - DNA, 25 bp, Rattus norvegicus
gttcatgcctgcctggacgactgaa

SEQ ID NO: 524603 - DNA, 25 bp, Rattus norvegicus
gttcatgcctgcgtggacgactgaa

SEQ ID NO: 524604 - DNA, 25 bp, Rattus norvegicus
gttcatgcgcaaaccaaacgtacct

SEQ ID NO: 524605 - DNA, 25 bp, Rattus norvegicus
gttcatgcgcaatccaaacgtacct

SEQ ID NO: 524606 - DNA, 25 bp, Rattus norvegicus
gttcatgctcttaagtgctcagtca

SEQ ID NO: 524607 - DNA, 25 bp, Rattus norvegicus
gttcatgctctttagtgctcagtca

SEQ ID NO: 524608 - DNA, 25 bp, Rattus norvegicus
gttcatgctgcaagaggacctccgt

SEQ ID NO: 524609 - DNA, 25 bp, Rattus norvegicus
gttcatgctgcatgaggacctccgt

SEQ ID NO: 524610 - DNA, 25 bp, Rattus norvegicus
gttcatgcttacagtttgtttccta

SEQ ID NO: 524611 - DNA, 25 bp, Rattus norvegicus
gttcatgcttactgtttgtttccta

SEQ ID NO: 524612 - DNA, 25 bp, Rattus norvegicus
gttcatgcttttcttgtcagtaaac

SEQ ID NO: 524613 - DNA, 25 bp, Rattus norvegicus
gttcatgcttttgttgtcagtaaac

SEQ ID NO: 524614 - DNA, 25 bp, Rattus norvegicus
gttcatggaaacaggccgaggtcgc

SEQ ID NO: 524615 - DNA, 25 bp, Rattus norvegicus
gttcatggaaactggccgaggtcgc

SEQ ID NO: 524616 - DNA, 25 bp, Rattus norvegicus
gttcatggccagagttgctgtaaga

SEQ ID NO: 524617 - DNA, 25 bp, Rattus norvegicus
gttcatggccagtgttgctgtaaga

SEQ ID NO: 524618 - DNA, 25 bp, Rattus norvegicus
gttcatggtaatcttgggccaccga

SEQ ID NO: 524619 - DNA, 25 bp, Rattus norvegicus
gttcatggtaatgttgggccaccga

SEQ ID NO: 524620 - DNA, 25 bp, Rattus norvegicus
gttcatggttacattgccagagcaa

SEQ ID NO: 524621 - DNA, 25 bp, Rattus norvegicus
gttcatggttactttgccagagcaa

SEQ ID NO: 524622 - DNA, 25 bp, Rattus norvegicus
gttcatggttatactacatttctag

SEQ ID NO: 524623 - DNA, 25 bp, Rattus norvegicus
gttcatggttattctacatttctag

SEQ ID NO: 524624 - DNA, 25 bp, Rattus norvegicus
gttcatgtaagcattgattctcccc

SEQ ID NO: 524625 - DNA, 25 bp, Rattus norvegicus
gttcatgtaagctttgattctcccc

SEQ ID NO: 524626 - DNA, 25 bp, Rattus norvegicus
gttcatgtaccgattctttgtaaag

SEQ ID NO: 524627 - DNA, 25 bp, Rattus norvegicus
gttcatgtaccgtttctttgtaaag

SEQ ID NO: 524628 - DNA, 25 bp, Rattus norvegicus
gttcatgtacttcatagccttgtat

SEQ ID NO: 524629 - DNA, 25 bp, Rattus norvegicus
gttcatgtacttgatagccttgtat

SEQ ID NO: 524630 - DNA, 25 bp, Rattus norvegicus
gttcatgtagccatgttgggaatat

SEQ ID NO: 524631 - DNA, 25 bp, Rattus norvegicus
gttcatgtagccctggtgggaatct

SEQ ID NO: 524632 - DNA, 25 bp, Rattus norvegicus
gttcatgtagccgtggtgggaatct

SEQ ID NO: 524633 - DNA, 25 bp, Rattus norvegicus
gttcatgtagccttgttgggaatat

SEQ ID NO: 524634 - DNA, 25 bp, Rattus norvegicus
gttcatgtattccttgctgttgtaa

SEQ ID NO: 524635 - DNA, 25 bp, Rattus norvegicus
gttcatgtattcgttgctgttgtaa

SEQ ID NO: 524636 - DNA, 25 bp, Rattus norvegicus
gttcatgtccataagctcttctagg

SEQ ID NO: 524637 - DNA, 25 bp, Rattus norvegicus
gttcatgtccattagctcttctagg

SEQ ID NO: 524638 - DNA, 25 bp, Rattus norvegicus
gttcatgtgaacagctaacgggttt

SEQ ID NO: 524639 - DNA, 25 bp, Rattus norvegicus
gttcatgtgaactgctaacgggttt

SEQ ID NO: 524640 - DNA, 25 bp, Rattus norvegicus
gttcatgtgactcatcaccatattg

SEQ ID NO: 524641 - DNA, 25 bp, Rattus norvegicus
gttcatgtgactgatcaccatattg

SEQ ID NO: 524642 - DNA, 25 bp, Rattus norvegicus
gttcatgtgcacatacttacaggtt

SEQ ID NO: 524643 - DNA, 25 bp, Rattus norvegicus
gttcatgtgcacttacttacaggtt

SEQ ID NO: 524644 - DNA, 25 bp, Rattus norvegicus
gttcatgtggctaagcaaggttttc

SEQ ID NO: 524645 - DNA, 25 bp, Rattus norvegicus
gttcatgtggcttagcaaggttttc

SEQ ID NO: 524646 - DNA, 25 bp, Rattus norvegicus
gttcatgttactagtgctctgggcc

SEQ ID NO: 524647 - DNA, 25 bp, Rattus norvegicus
gttcatgttacttgtgctctgggcc

SEQ ID NO: 524648 - DNA, 25 bp, Rattus norvegicus
gttcatgttccaatcaatagtcttg

SEQ ID NO: 524649 - DNA, 25 bp, Rattus norvegicus
gttcatgttccattcaatagtcttg

SEQ ID NO: 524650 - DNA, 25 bp, Rattus norvegicus
gttcatgttcttactggaaacaggc

SEQ ID NO: 524651 - DNA, 25 bp, Rattus norvegicus
gttcatgttctttctggaaacaggc

SEQ ID NO: 524652 - DNA, 25 bp, Rattus norvegicus
gttcatgttgaacatttcagcactc

SEQ ID NO: 524653 - DNA, 25 bp, Rattus norvegicus
gttcatgttgaagatttcagcactc

SEQ ID NO: 524654 - DNA, 25 bp, Rattus norvegicus
gttcatgttttacctttttctgcat

SEQ ID NO: 524655 - DNA, 25 bp, Rattus norvegicus
gttcatgttttagctttttctgcat

SEQ ID NO: 524656 - DNA, 25 bp, Rattus norvegicus
gttcattaacctccatcagtatctg

SEQ ID NO: 524657 - DNA, 25 bp, Rattus norvegicus
gttcattaacctgcatcagtatctg

SEQ ID NO: 524658 - DNA, 25 bp, Rattus norvegicus
gttcattaagacagttcgactaggt

SEQ ID NO: 524659 - DNA, 25 bp, Rattus norvegicus
gttcattaagactgttcgactaggt

SEQ ID NO: 524660 - DNA, 25 bp, Rattus norvegicus
gttcattacctccattttcactgaa

SEQ ID NO: 524661 - DNA, 25 bp, Rattus norvegicus
gttcattacctcgattttcactgaa

SEQ ID NO: 524662 - DNA, 25 bp, Rattus norvegicus
gttcattactcaccctcttttaagg

SEQ ID NO: 524663 - DNA, 25 bp, Rattus norvegicus
gttcattactcagcctcttttaagg

SEQ ID NO: 524664 - DNA, 25 bp, Rattus norvegicus
gttcattactgtactcaagctctgt

SEQ ID NO: 524665 - DNA, 25 bp, Rattus norvegicus
gttcattactgttctcaagctctgt

SEQ ID NO: 524666 - DNA, 25 bp, Rattus norvegicus
gttcattatagacacgtccagctca

SEQ ID NO: 524667 - DNA, 25 bp, Rattus norvegicus
gttcattatagagacgtccagctca

SEQ ID NO: 524668 - DNA, 25 bp, Rattus norvegicus
gttcattatataagttcatctctgc

SEQ ID NO: 524669 - DNA, 25 bp, Rattus norvegicus
gttcattatatatgttcatctctgc

SEQ ID NO: 524670 - DNA, 25 bp, Rattus norvegicus
gttcattatcagagactgtgtgcta

SEQ ID NO: 524671 - DNA, 25 bp, Rattus norvegicus
gttcattatcagtgactgtgtgcta

SEQ ID NO: 524672 - DNA, 25 bp, Rattus norvegicus
gttcattcaattcctctcctaaaaa

SEQ ID NO: 524673 - DNA, 25 bp, Rattus norvegicus
gttcattcaattgctctcctaaaaa

SEQ ID NO: 524674 - DNA, 25 bp, Rattus norvegicus
gttcattcacacaccagcagcgtgt

SEQ ID NO: 524675 - DNA, 25 bp, Rattus norvegicus
gttcattcacactccagcagcgtgt

SEQ ID NO: 524676 - DNA, 25 bp, Rattus norvegicus
gttcattcagctcgagagctgtgca

SEQ ID NO: 524677 - DNA, 25 bp, Rattus norvegicus
gttcattcagctggagagctgtgca

SEQ ID NO: 524678 - DNA, 25 bp, Rattus norvegicus
gttcattcatctccgtgaatcctcg

SEQ ID NO: 524679 - DNA, 25 bp, Rattus norvegicus
gttcattcatctgcgtgaatcctcg

SEQ ID NO: 524680 - DNA, 25 bp, Rattus norvegicus
gttcattccagtcagatgcagcttt

SEQ ID NO: 524681 - DNA, 25 bp, Rattus norvegicus
gttcattccagtgagatgcagcttt

SEQ ID NO: 524682 - DNA, 25 bp, Rattus norvegicus
gttcattcccaacagtctatgttga

SEQ ID NO: 524683 - DNA, 25 bp, Rattus norvegicus
gttcattcccaagagtctatgttga

SEQ ID NO: 524684 - DNA, 25 bp, Rattus norvegicus
gttcattccgtgcataacactcgta

SEQ ID NO: 524685 - DNA, 25 bp, Rattus norvegicus
gttcattccgtggataacactcgta

SEQ ID NO: 524686 - DNA, 25 bp, Rattus norvegicus
gttcattcctaccaagtgactgttg

SEQ ID NO: 524687 - DNA, 25 bp, Rattus norvegicus
gttcattcctacgaagtgactgttg

SEQ ID NO: 524688 - DNA, 25 bp, Rattus norvegicus
gttcattcctgcattatggttccat

SEQ ID NO: 524689 - DNA, 25 bp, Rattus norvegicus
gttcattcctgctttatggttccat

SEQ ID NO: 524690 - DNA, 25 bp, Rattus norvegicus
gttcattccttcatgggcgtataca

SEQ ID NO: 524691 - DNA, 25 bp, Rattus norvegicus
gttcattccttcttgggcgtataca

SEQ ID NO: 524692 - DNA, 25 bp, Rattus norvegicus
gttcattcggacctcagagagcact

SEQ ID NO: 524693 - DNA, 25 bp, Rattus norvegicus
gttcattcggacgtcagagagcact

SEQ ID NO: 524694 - DNA, 25 bp, Rattus norvegicus
gttcattcgggacttctacagtgtg

SEQ ID NO: 524695 - DNA, 25 bp, Rattus norvegicus
gttcattcgggagttctacagtgtg

SEQ ID NO: 524696 - DNA, 25 bp, Rattus norvegicus
gttcattctcagatgtgtggttcac

SEQ ID NO: 524697 - DNA, 25 bp, Rattus norvegicus
gttcattctcagttgtgtggttcac

SEQ ID NO: 524698 - DNA, 25 bp, Rattus norvegicus
gttcattctgataattgcccacacg

SEQ ID NO: 524699 - DNA, 25 bp, Rattus norvegicus
gttcattctgattattgcccacacg

SEQ ID NO: 524700 - DNA, 25 bp, Rattus norvegicus
gttcattgaacaacagcacgccaag

SEQ ID NO: 524701 - DNA, 25 bp, Rattus norvegicus
gttcattgaacatcagcacgccaag

SEQ ID NO: 524702 - DNA, 25 bp, Rattus norvegicus
gttcattgaactaatctgtctgtct

SEQ ID NO: 524703 - DNA, 25 bp, Rattus norvegicus
gttcattgaacttatctgtctgtct

SEQ ID NO: 524704 - DNA, 25 bp, Rattus norvegicus
gttcattgacacaccatcctatagt

SEQ ID NO: 524705 - DNA, 25 bp, Rattus norvegicus
gttcattgacactccatcctatagt

SEQ ID NO: 524706 - DNA, 25 bp, Rattus norvegicus
gttcattgaggcaggccagtacaac

SEQ ID NO: 524707 - DNA, 25 bp, Rattus norvegicus
gttcattgaggctggccagtacaac

SEQ ID NO: 524708 - DNA, 25 bp, Rattus norvegicus
gttcattgcctgatcggctttgaga

SEQ ID NO: 524709 - DNA, 25 bp, Rattus norvegicus
gttcattgcctgttcggctttgaga

SEQ ID NO: 524710 - DNA, 25 bp, Rattus norvegicus
gttcattggagtacacccttgagct

SEQ ID NO: 524711 - DNA, 25 bp, Rattus norvegicus
gttcattggagttcacccttgagct

SEQ ID NO: 524712 - DNA, 25 bp, Rattus norvegicus
gttcattggctaaggatgggttcgc

SEQ ID NO: 524713 - DNA, 25 bp, Rattus norvegicus
gttcattggctatggatgggttcgc

SEQ ID NO: 524714 - DNA, 25 bp, Rattus norvegicus
gttcattgtgtcaacagattgttaa

SEQ ID NO: 524715 - DNA, 25 bp, Rattus norvegicus
gttcattgtgtctacagattgttaa

SEQ ID NO: 524716 - DNA, 25 bp, Rattus norvegicus
gttcattgttctagagtgatatcct

SEQ ID NO: 524717 - DNA, 25 bp, Rattus norvegicus
gttcattgttcttgagtgatatcct

SEQ ID NO: 524718 - DNA, 25 bp, Rattus norvegicus
gttcatttactaaacatcttactgt

SEQ ID NO: 524719 - DNA, 25 bp, Rattus norvegicus
gttcatttactatacatcttactgt

SEQ ID NO: 524720 - DNA, 25 bp, Rattus norvegicus
gttcatttacttaccacctgataca

SEQ ID NO: 524721 - DNA, 25 bp, Rattus norvegicus
gttcatttactttccacctgataca

SEQ ID NO: 524722 - DNA, 25 bp, Rattus norvegicus
gttcatttcctgacaactgattgct

SEQ ID NO: 524723 - DNA, 25 bp, Rattus norvegicus
gttcatttcctgtcaactgattgct

SEQ ID NO: 524724 - DNA, 25 bp, Rattus norvegicus
gttcatttctctccccttgcaggag

SEQ ID NO: 524725 - DNA, 25 bp, Rattus norvegicus
gttcatttctctgcccttgcaggag

SEQ ID NO: 524726 - DNA, 25 bp, Rattus norvegicus
gttcatttgaaactttggatgctga

SEQ ID NO: 524727 - DNA, 25 bp, Rattus norvegicus
gttcatttgaaagtttggatgctga

SEQ ID NO: 524728 - DNA, 25 bp, Rattus norvegicus
gttcatttgaacacatactaatttt

SEQ ID NO: 524729 - DNA, 25 bp, Rattus norvegicus
gttcatttgaactcatactaatttt

SEQ ID NO: 524730 - DNA, 25 bp, Rattus norvegicus
gttcatttgaggctatccatctttg

SEQ ID NO: 524731 - DNA, 25 bp, Rattus norvegicus
gttcatttgagggtatccatctttg

SEQ ID NO: 524732 - DNA, 25 bp, Rattus norvegicus
gttcatttgcctatcgtttaaccag

SEQ ID NO: 524733 - DNA, 25 bp, Rattus norvegicus
gttcatttgcctttcgtttaaccag

SEQ ID NO: 524734 - DNA, 25 bp, Rattus norvegicus
gttcattttagtacattctagcctt

SEQ ID NO: 524735 - DNA, 25 bp, Rattus norvegicus
gttcattttagttcattctagcctt

SEQ ID NO: 524736 - DNA, 25 bp, Rattus norvegicus
gttcattttcacagaggattcctct

SEQ ID NO: 524737 - DNA, 25 bp, Rattus norvegicus
gttcattttcaccatggttggcttg

SEQ ID NO: 524738 - DNA, 25 bp, Rattus norvegicus
gttcattttcacgatggttggcttg

SEQ ID NO: 524739 - DNA, 25 bp, Rattus norvegicus
gttcattttcactgaggattcctct

SEQ ID NO: 524740 - DNA, 25 bp, Rattus norvegicus
gttccaaagcagattctactctcgg

SEQ ID NO: 524741 - DNA, 25 bp, Rattus norvegicus
gttccaaagcagtttctactctcgg

SEQ ID NO: 524742 - DNA, 25 bp, Rattus norvegicus
gttccaaagccgatacttcgagtca

SEQ ID NO: 524743 - DNA, 25 bp, Rattus norvegicus
gttccaaagccgttacttcgagtca

SEQ ID NO: 524744 - DNA, 25 bp, Rattus norvegicus
gttccaaaggatccagtgcttgctt

SEQ ID NO: 524745 - DNA, 25 bp, Rattus norvegicus
gttccaaaggatgcagtgcttgctt

SEQ ID NO: 524746 - DNA, 25 bp, Rattus norvegicus
gttccaaagttaatttctctaatag

SEQ ID NO: 524747 - DNA, 25 bp, Rattus norvegicus
gttccaaagttattttctctaatag

SEQ ID NO: 524748 - DNA, 25 bp, Rattus norvegicus
gttccaaatgcgaatgtgccggtca

SEQ ID NO: 524749 - DNA, 25 bp, Rattus norvegicus
gttccaaatgcgtatgtgccggtca

SEQ ID NO: 524750 - DNA, 25 bp, Rattus norvegicus
gttccaaattcactttcataaaagg

SEQ ID NO: 524751 - DNA, 25 bp, Rattus norvegicus
gttccaaattcagtttcataaaagg

SEQ ID NO: 524752 - DNA, 25 bp, Rattus norvegicus
gttccaacaagcagagcaaacttct

SEQ ID NO: 524753 - DNA, 25 bp, Rattus norvegicus
gttccaacaagctgagcaaacttct

SEQ ID NO: 524754 - DNA, 25 bp, Rattus norvegicus
gttccaacacgcatagaaggccctc

SEQ ID NO: 524755 - DNA, 25 bp, Rattus norvegicus
gttccaacacgcttagaaggccctc

SEQ ID NO: 524756 - DNA, 25 bp, Rattus norvegicus
gttccaacagctacctttgcaggaa

SEQ ID NO: 524757 - DNA, 25 bp, Rattus norvegicus
gttccaacagcttcctttgcaggaa

SEQ ID NO: 524758 - DNA, 25 bp, Rattus norvegicus
gttccaaccacactcaggattctga

SEQ ID NO: 524759 - DNA, 25 bp, Rattus norvegicus
gttccaaccacagtcaggattctga

SEQ ID NO: 524760 - DNA, 25 bp, Rattus norvegicus
gttccaaccttgactattcttactt

SEQ ID NO: 524761 - DNA, 25 bp, Rattus norvegicus
gttccaaccttgtctattcttactt

SEQ ID NO: 524762 - DNA, 25 bp, Rattus norvegicus
gttccaagagggaactcctccattg

SEQ ID NO: 524763 - DNA, 25 bp, Rattus norvegicus
gttccaagagggtactcctccattg

SEQ ID NO: 524764 - DNA, 25 bp, Rattus norvegicus
gttccaagagttacctacgcaataa

SEQ ID NO: 524765 - DNA, 25 bp, Rattus norvegicus
gttccaagagtttcctacgcaataa

SEQ ID NO: 524766 - DNA, 25 bp, Rattus norvegicus
gttccaagctcccatatgttgttag

SEQ ID NO: 524767 - DNA, 25 bp, Rattus norvegicus
gttccaagctccgatatgttgttag

SEQ ID NO: 524768 - DNA, 25 bp, Rattus norvegicus
gttccaaggaagagtttgctattca

SEQ ID NO: 524769 - DNA, 25 bp, Rattus norvegicus
gttccaaggaagtgtttgctattca

SEQ ID NO: 524770 - DNA, 25 bp, Rattus norvegicus
gttccaaggagactcatgctctttt

SEQ ID NO: 524771 - DNA, 25 bp, Rattus norvegicus
gttccaaggagagtcatgctctttt

SEQ ID NO: 524772 - DNA, 25 bp, Rattus norvegicus
gttccaagggagattctgcttcaaa

SEQ ID NO: 524773 - DNA, 25 bp, Rattus norvegicus
gttccaagggagtttctgcttcaaa

SEQ ID NO: 524774 - DNA, 25 bp, Rattus norvegicus
gttccaagggatacgcttagcactc

SEQ ID NO: 524775 - DNA, 25 bp, Rattus norvegicus
gttccaagggattcgcttagcactc

SEQ ID NO: 524776 - DNA, 25 bp, Rattus norvegicus
gttccaagtaacaaagggcgggcag

SEQ ID NO: 524777 - DNA, 25 bp, Rattus norvegicus
gttccaagtaactaagggcgggcag

SEQ ID NO: 524778 - DNA, 25 bp, Rattus norvegicus
gttccaagtattcacatgacagctc

SEQ ID NO: 524779 - DNA, 25 bp, Rattus norvegicus
gttccaagtattgacatgacagctc

SEQ ID NO: 524780 - DNA, 25 bp, Rattus norvegicus
gttccaagtcagaacctacgtgtgt

SEQ ID NO: 524781 - DNA, 25 bp, Rattus norvegicus
gttccaagtcagtacctacgtgtgt

SEQ ID NO: 524782 - DNA, 25 bp, Rattus norvegicus
gttccaagtcttatactggtacaag

SEQ ID NO: 524783 - DNA, 25 bp, Rattus norvegicus
gttccaagtcttctatattgtagct

SEQ ID NO: 524784 - DNA, 25 bp, Rattus norvegicus
gttccaagtcttgtatattgtagct

SEQ ID NO: 524785 - DNA, 25 bp, Rattus norvegicus
gttccaagtcttttactggtacaag

SEQ ID NO: 524786 - DNA, 25 bp, Rattus norvegicus
gttccaagttggagtagccaccttt

SEQ ID NO: 524787 - DNA, 25 bp, Rattus norvegicus
gttccaagttggtgtagccaccttt

SEQ ID NO: 524788 - DNA, 25 bp, Rattus norvegicus
gttccaataccgatggcatcctttg

SEQ ID NO: 524789 - DNA, 25 bp, Rattus norvegicus
gttccaataccgttggcatcctttg

SEQ ID NO: 524790 - DNA, 25 bp, Rattus norvegicus
gttccaatattcatcacactcataa

SEQ ID NO: 524791 - DNA, 25 bp, Rattus norvegicus
gttccaatattcttcacactcataa

SEQ ID NO: 524792 - DNA, 25 bp, Rattus norvegicus
gttccaatcttgcaggtcatccatt

SEQ ID NO: 524793 - DNA, 25 bp, Rattus norvegicus
gttccaatcttggaggtcatccatt

SEQ ID NO: 524794 - DNA, 25 bp, Rattus norvegicus
gttccaatgaggagtccaacgggcc

SEQ ID NO: 524795 - DNA, 25 bp, Rattus norvegicus
gttccaatgaggtgtccaacgggcc

SEQ ID NO: 524796 - DNA, 25 bp, Rattus norvegicus
gttccaatgtagactgtagctcctt

SEQ ID NO: 524797 - DNA, 25 bp, Rattus norvegicus
gttccaatgtagtctgtagctcctt

SEQ ID NO: 524798 - DNA, 25 bp, Rattus norvegicus
gttccaatgtctatatagtagctag

SEQ ID NO: 524799 - DNA, 25 bp, Rattus norvegicus
gttccaatgtctttatagtagctag

SEQ ID NO: 524800 - DNA, 25 bp, Rattus norvegicus
gttccaattgtcaagccttgtctgt

SEQ ID NO: 524801 - DNA, 25 bp, Rattus norvegicus
gttccaattgtctagccttgtctgt

SEQ ID NO: 524802 - DNA, 25 bp, Rattus norvegicus
gttccacaatttactgtccttgagg

SEQ ID NO: 524803 - DNA, 25 bp, Rattus norvegicus
gttccacaattttctgtccttgagg

SEQ ID NO: 524804 - DNA, 25 bp, Rattus norvegicus
gttccacacagtagttggcgcccaa

SEQ ID NO: 524805 - DNA, 25 bp, Rattus norvegicus
gttccacacagttgttggcgcccaa

SEQ ID NO: 524806 - DNA, 25 bp, Rattus norvegicus
gttccacacccacatactaattatg

SEQ ID NO: 524807 - DNA, 25 bp, Rattus norvegicus
gttccacacccagatactaattatg

SEQ ID NO: 524808 - DNA, 25 bp, Rattus norvegicus
gttccacactcaaaacaaggccatg

SEQ ID NO: 524809 - DNA, 25 bp, Rattus norvegicus
gttccacactcataacaaggccatg

SEQ ID NO: 524810 - DNA, 25 bp, Rattus norvegicus
gttccacactgtcccattgttcaat

SEQ ID NO: 524811 - DNA, 25 bp, Rattus norvegicus
gttccacactgtgccattgttcaat

SEQ ID NO: 524812 - DNA, 25 bp, Rattus norvegicus
gttccacagaaactgcacttagcca

SEQ ID NO: 524813 - DNA, 25 bp, Rattus norvegicus
gttccacagaaagtgcacttagcca

SEQ ID NO: 524814 - DNA, 25 bp, Rattus norvegicus
gttccacagcttctccagtatagta

SEQ ID NO: 524815 - DNA, 25 bp, Rattus norvegicus
gttccacagcttgtccagtatagta

SEQ ID NO: 524816 - DNA, 25 bp, Rattus norvegicus
gttccacagtgaccctttctagata

SEQ ID NO: 524817 - DNA, 25 bp, Rattus norvegicus
gttccacagtgagcctttctagata

SEQ ID NO: 524818 - DNA, 25 bp, Rattus norvegicus
gttccacataccagctatgaaagag

SEQ ID NO: 524819 - DNA, 25 bp, Rattus norvegicus
gttccacatacctgctatgaaagag

SEQ ID NO: 524820 - DNA, 25 bp, Rattus norvegicus
gttccaccagcaaccatgagtggtt

SEQ ID NO: 524821 - DNA, 25 bp, Rattus norvegicus
gttccaccagcatccatgagtggtt

SEQ ID NO: 524822 - DNA, 25 bp, Rattus norvegicus
gttccaccagtcacaaaccagatga

SEQ ID NO: 524823 - DNA, 25 bp, Rattus norvegicus
gttccaccagtctcaaaccagatga

SEQ ID NO: 524824 - DNA, 25 bp, Rattus norvegicus
gttccaccattcagagagcatgtct

SEQ ID NO: 524825 - DNA, 25 bp, Rattus norvegicus
gttccaccattctgagagcatgtct

SEQ ID NO: 524826 - DNA, 25 bp, Rattus norvegicus
gttccacccaagatgacttccatat

SEQ ID NO: 524827 - DNA, 25 bp, Rattus norvegicus
gttccacccaagttgacttccatat

SEQ ID NO: 524828 - DNA, 25 bp, Rattus norvegicus
gttccacccaccacagatagaaatt

SEQ ID NO: 524829 - DNA, 25 bp, Rattus norvegicus
gttccacccacctcagatagaaatt

SEQ ID NO: 524830 - DNA, 25 bp, Rattus norvegicus
gttccacccactcggatggactgaa

SEQ ID NO: 524831 - DNA, 25 bp, Rattus norvegicus
gttccacccactgggatggactgaa

SEQ ID NO: 524832 - DNA, 25 bp, Rattus norvegicus
gttccaccctcaccatgacaaatat

SEQ ID NO: 524833 - DNA, 25 bp, Rattus norvegicus
gttccaccctcactgcttaaacaaa

SEQ ID NO: 524834 - DNA, 25 bp, Rattus norvegicus
gttccaccctcagcatgacaaatat

SEQ ID NO: 524835 - DNA, 25 bp, Rattus norvegicus
gttccaccctcagtgcttaaacaaa

SEQ ID NO: 524836 - DNA, 25 bp, Rattus norvegicus
gttccaccctgtatgaagaccatga

SEQ ID NO: 524837 - DNA, 25 bp, Rattus norvegicus
gttccaccctgtttgaagaccatga

SEQ ID NO: 524838 - DNA, 25 bp, Rattus norvegicus
gttccacctgcaccgagagatttta

SEQ ID NO: 524839 - DNA, 25 bp, Rattus norvegicus
gttccacctgcagcgagagatttta

SEQ ID NO: 524840 - DNA, 25 bp, Rattus norvegicus
gttccacctggcctagctttaggac

SEQ ID NO: 524841 - DNA, 25 bp, Rattus norvegicus
gttccacctggcgtagctttaggac

SEQ ID NO: 524842 - DNA, 25 bp, Rattus norvegicus
gttccacctgtcatttgcagtttca

SEQ ID NO: 524843 - DNA, 25 bp, Rattus norvegicus
gttccacctgtcttttgcagtttca

SEQ ID NO: 524844 - DNA, 25 bp, Rattus norvegicus
gttccacgaagacaagtcccactag

SEQ ID NO: 524845 - DNA, 25 bp, Rattus norvegicus
gttccacgaagagaagtcccactag

SEQ ID NO: 524846 - DNA, 25 bp, Rattus norvegicus
gttccacgtcaaaggcaactctgag

SEQ ID NO: 524847 - DNA, 25 bp, Rattus norvegicus
gttccacgtcaatggcaactctgag

SEQ ID NO: 524848 - DNA, 25 bp, Rattus norvegicus
gttccacgtgggatttttctgatat

SEQ ID NO: 524849 - DNA, 25 bp, Rattus norvegicus
gttccacgtgggttttttctgatat

SEQ ID NO: 524850 - DNA, 25 bp, Rattus norvegicus
gttccacgtgtaaccttcaagaaat

SEQ ID NO: 524851 - DNA, 25 bp, Rattus norvegicus
gttccacgtgtatccttcaagaaat

SEQ ID NO: 524852 - DNA, 25 bp, Rattus norvegicus
gttccactactgcaacttttagatg

SEQ ID NO: 524853 - DNA, 25 bp, Rattus norvegicus
gttccactactggaacttttagatg

SEQ ID NO: 524854 - DNA, 25 bp, Rattus norvegicus
gttccactacttactgcctcttttg

SEQ ID NO: 524855 - DNA, 25 bp, Rattus norvegicus
gttccactactttctgcctcttttg

SEQ ID NO: 524856 - DNA, 25 bp, Rattus norvegicus
gttccactctcaaagcagcaggctg

SEQ ID NO: 524857 - DNA, 25 bp, Rattus norvegicus
gttccactctcatagcagcaggctg

SEQ ID NO: 524858 - DNA, 25 bp, Rattus norvegicus
gttccactgatactgactcactttg

SEQ ID NO: 524859 - DNA, 25 bp, Rattus norvegicus
gttccactgatagtgactcactttg

SEQ ID NO: 524860 - DNA, 25 bp, Rattus norvegicus
gttccactgctcctattatcttaat

SEQ ID NO: 524861 - DNA, 25 bp, Rattus norvegicus
gttccactgctcgtattatcttaat

SEQ ID NO: 524862 - DNA, 25 bp, Rattus norvegicus
gttccactggaaatgattgcaaaaa

SEQ ID NO: 524863 - DNA, 25 bp, Rattus norvegicus
gttccactggaattgattgcaaaaa

SEQ ID NO: 524864 - DNA, 25 bp, Rattus norvegicus
gttccactggttccatactgcggga

SEQ ID NO: 524865 - DNA, 25 bp, Rattus norvegicus
gttccactggttgcatactgcggga

SEQ ID NO: 524866 - DNA, 25 bp, Rattus norvegicus
gttccactgtctaaactcatggttg

SEQ ID NO: 524867 - DNA, 25 bp, Rattus norvegicus
gttccactgtcttaactcatggttg

SEQ ID NO: 524868 - DNA, 25 bp, Rattus norvegicus
gttccactgtgtcaactaattcacc

SEQ ID NO: 524869 - DNA, 25 bp, Rattus norvegicus
gttccactgtgtgaactaattcacc

SEQ ID NO: 524870 - DNA, 25 bp, Rattus norvegicus
gttccacttcagaagatcgtgagca

SEQ ID NO: 524871 - DNA, 25 bp, Rattus norvegicus
gttccacttcagtagatcgtgagca

SEQ ID NO: 524872 - DNA, 25 bp, Rattus norvegicus
gttccacttggaacaaaatttagat

SEQ ID NO: 524873 - DNA, 25 bp, Rattus norvegicus
gttccacttggatcaaaatttagat

SEQ ID NO: 524874 - DNA, 25 bp, Rattus norvegicus
gttccactttcaccactgttagatt

SEQ ID NO: 524875 - DNA, 25 bp, Rattus norvegicus
gttccactttcagcactgttagatt

SEQ ID NO: 524876 - DNA, 25 bp, Rattus norvegicus
gttccactttgacaaatactgcttt

SEQ ID NO: 524877 - DNA, 25 bp, Rattus norvegicus
gttccactttgagaaatactgcttt

SEQ ID NO: 524878 - DNA, 25 bp, Rattus norvegicus
gttccactttggagtcttttatgcc

SEQ ID NO: 524879 - DNA, 25 bp, Rattus norvegicus
gttccactttggtgtcttttatgcc

SEQ ID NO: 524880 - DNA, 25 bp, Rattus norvegicus
gttccagaaagaaccgcacccgtag

SEQ ID NO: 524881 - DNA, 25 bp, Rattus norvegicus
gttccagaaagatccgcacccgtag

SEQ ID NO: 524882 - DNA, 25 bp, Rattus norvegicus
gttccagaaattcaaatgctctatt

SEQ ID NO: 524883 - DNA, 25 bp, Rattus norvegicus
gttccagaaattgaaatgctctatt

SEQ ID NO: 524884 - DNA, 25 bp, Rattus norvegicus
gttccagaacatccagagttacgta

SEQ ID NO: 524885 - DNA, 25 bp, Rattus norvegicus
gttccagaacatgcagagttacgta

SEQ ID NO: 524886 - DNA, 25 bp, Rattus norvegicus
gttccagaaccgacgggccaaggag

SEQ ID NO: 524887 - DNA, 25 bp, Rattus norvegicus
gttccagaaccgtcgggccaaggag

SEQ ID NO: 524888 - DNA, 25 bp, Rattus norvegicus
gttccagaactgagagctcagccta

SEQ ID NO: 524889 - DNA, 25 bp, Rattus norvegicus
gttccagaactgtgagctcagccta

SEQ ID NO: 524890 - DNA, 25 bp, Rattus norvegicus
gttccagaatttctggtcccggact

SEQ ID NO: 524891 - DNA, 25 bp, Rattus norvegicus
gttccagaatttgtggtcccggact

SEQ ID NO: 524892 - DNA, 25 bp, Rattus norvegicus
gttccagacatacatagaagaccct

SEQ ID NO: 524893 - DNA, 25 bp, Rattus norvegicus
gttccagacatagatagaagaccct

SEQ ID NO: 524894 - DNA, 25 bp, Rattus norvegicus
gttccagacctccacactcaagaag

SEQ ID NO: 524895 - DNA, 25 bp, Rattus norvegicus
gttccagacctcgacactcaagaag

SEQ ID NO: 524896 - DNA, 25 bp, Rattus norvegicus
gttccagacctgcttatagatgcca

SEQ ID NO: 524897 - DNA, 25 bp, Rattus norvegicus
gttccagacctggttatagatgcca

SEQ ID NO: 524898 - DNA, 25 bp, Rattus norvegicus
gttccagacggaagcggacttctac

SEQ ID NO: 524899 - DNA, 25 bp, Rattus norvegicus
gttccagacggatgcggacttctac

SEQ ID NO: 524900 - DNA, 25 bp, Rattus norvegicus
gttccagacggccttcgtgttcact

SEQ ID NO: 524901 - DNA, 25 bp, Rattus norvegicus
gttccagacggcgttcgtgttcact

SEQ ID NO: 524902 - DNA, 25 bp, Rattus norvegicus
gttccagactctcctcatgctagct

SEQ ID NO: 524903 - DNA, 25 bp, Rattus norvegicus
gttccagactctgctcatgctagct

SEQ ID NO: 524904 - DNA, 25 bp, Rattus norvegicus
gttccagagaacattccagatcccg

SEQ ID NO: 524905 - DNA, 25 bp, Rattus norvegicus
gttccagagaactttccagatcccg

SEQ ID NO: 524906 - DNA, 25 bp, Rattus norvegicus
gttccagataatctagacatcactc

SEQ ID NO: 524907 - DNA, 25 bp, Rattus norvegicus
gttccagataatgtagacatcactc

SEQ ID NO: 524908 - DNA, 25 bp, Rattus norvegicus
gttccagatgctactgaccaagctt

SEQ ID NO: 524909 - DNA, 25 bp, Rattus norvegicus
gttccagatgcttctgaccaagctt

SEQ ID NO: 524910 - DNA, 25 bp, Rattus norvegicus
gttccagatgttctcaacaacggtg

SEQ ID NO: 524911 - DNA, 25 bp, Rattus norvegicus
gttccagatgttgtcaacaacggtg

SEQ ID NO: 524912 - DNA, 25 bp, Rattus norvegicus
gttccagcagataaagcgcgagcct

SEQ ID NO: 524913 - DNA, 25 bp, Rattus norvegicus
gttccagcagattaagcgcgagcct

SEQ ID NO: 524914 - DNA, 25 bp, Rattus norvegicus
gttccagcagtccttcgaagacgat

SEQ ID NO: 524915 - DNA, 25 bp, Rattus norvegicus
gttccagcagtcgttcgaagacgat

SEQ ID NO: 524916 - DNA, 25 bp, Rattus norvegicus
gttccagcatggactatatcacgat

SEQ ID NO: 524917 - DNA, 25 bp, Rattus norvegicus
gttccagcatggtctatatcacgat

SEQ ID NO: 524918 - DNA, 25 bp, Rattus norvegicus
gttccagccatcacatcggtgaaat

SEQ ID NO: 524919 - DNA, 25 bp, Rattus norvegicus
gttccagccatctcatcggtgaaat

SEQ ID NO: 524920 - DNA, 25 bp, Rattus norvegicus
gttccagcctgcacacactagaggg

SEQ ID NO: 524921 - DNA, 25 bp, Rattus norvegicus
gttccagcctgctcacactagaggg

SEQ ID NO: 524922 - DNA, 25 bp, Rattus norvegicus
gttccagccttgaagccagcaaggg

SEQ ID NO: 524923 - DNA, 25 bp, Rattus norvegicus
gttccagccttgtagccagcaaggg

SEQ ID NO: 524924 - DNA, 25 bp, Rattus norvegicus
gttccagcgattacgaccgagttcg

SEQ ID NO: 524925 - DNA, 25 bp, Rattus norvegicus
gttccagcgatttcgaccgagttcg

SEQ ID NO: 524926 - DNA, 25 bp, Rattus norvegicus
gttccagcgggacgccctagagaat

SEQ ID NO: 524927 - DNA, 25 bp, Rattus norvegicus
gttccagcgggaggccctagagaat

SEQ ID NO: 524928 - DNA, 25 bp, Rattus norvegicus
gttccagcggtaccaactgatcatg

SEQ ID NO: 524929 - DNA, 25 bp, Rattus norvegicus
gttccagcggtagcaactgatcatg

SEQ ID NO: 524930 - DNA, 25 bp, Rattus norvegicus
gttccagcgttaattttgatccaaa

SEQ ID NO: 524931 - DNA, 25 bp, Rattus norvegicus
gttccagcgttatttttgatccaaa

SEQ ID NO: 524932 - DNA, 25 bp, Rattus norvegicus
gttccagcgtttctagtccatctta

SEQ ID NO: 524933 - DNA, 25 bp, Rattus norvegicus
gttccagcgtttgtagtccatctta

SEQ ID NO: 524934 - DNA, 25 bp, Rattus norvegicus
gttccagctcccaactagagagagt

SEQ ID NO: 524935 - DNA, 25 bp, Rattus norvegicus
gttccagctccctactagagagagt

SEQ ID NO: 524936 - DNA, 25 bp, Rattus norvegicus
gttccagctcctcattcctgaaaga

SEQ ID NO: 524937 - DNA, 25 bp, Rattus norvegicus
gttccagctcctgattcctgaaaga

SEQ ID NO: 524938 - DNA, 25 bp, Rattus norvegicus
gttccagctctacttgggtttttct

SEQ ID NO: 524939 - DNA, 25 bp, Rattus norvegicus
gttccagctctagttgggtttttct

SEQ ID NO: 524940 - DNA, 25 bp, Rattus norvegicus
gttccagctctcaaacacagaggtc

SEQ ID NO: 524941 - DNA, 25 bp, Rattus norvegicus
gttccagctctctaacacagaggtc

SEQ ID NO: 524942 - DNA, 25 bp, Rattus norvegicus
gttccagctcttcatcgatttcatt

SEQ ID NO: 524943 - DNA, 25 bp, Rattus norvegicus
gttccagctcttgatcgatttcatt

SEQ ID NO: 524944 - DNA, 25 bp, Rattus norvegicus
gttccagctgtcctcaaacttagac

SEQ ID NO: 524945 - DNA, 25 bp, Rattus norvegicus
gttccagctgtcgtcaaacttagac

SEQ ID NO: 524946 - DNA, 25 bp, Rattus norvegicus
gttccagcttaaaactgttgtccag

SEQ ID NO: 524947 - DNA, 25 bp, Rattus norvegicus
gttccagcttaatactgttgtccag

SEQ ID NO: 524948 - DNA, 25 bp, Rattus norvegicus
gttccagcttgtaacgctacttaaa

SEQ ID NO: 524949 - DNA, 25 bp, Rattus norvegicus
gttccagcttgttacgctacttaaa

SEQ ID NO: 524950 - DNA, 25 bp, Rattus norvegicus
gttccaggacaaccaatgttctata

SEQ ID NO: 524951 - DNA, 25 bp, Rattus norvegicus
gttccaggacaagcaatgttctata

SEQ ID NO: 524952 - DNA, 25 bp, Rattus norvegicus
gttccaggacagagtcagtggctta

SEQ ID NO: 524953 - DNA, 25 bp, Rattus norvegicus
gttccaggacagatctgccaagcgt

SEQ ID NO: 524954 - DNA, 25 bp, Rattus norvegicus
gttccaggacagatgaaggtacaca

SEQ ID NO: 524955 - DNA, 25 bp, Rattus norvegicus
gttccaggacagtgtcagtggctta

SEQ ID NO: 524956 - DNA, 25 bp, Rattus norvegicus
gttccaggacagttctgccaagcgt

SEQ ID NO: 524957 - DNA, 25 bp, Rattus norvegicus
gttccaggacagttgaaggtacaca

SEQ ID NO: 524958 - DNA, 25 bp, Rattus norvegicus
gttccaggagatattaagactctct

SEQ ID NO: 524959 - DNA, 25 bp, Rattus norvegicus
gttccaggagattttaagactctct

SEQ ID NO: 524960 - DNA, 25 bp, Rattus norvegicus
gttccaggaggcagcatttgccaat

SEQ ID NO: 524961 - DNA, 25 bp, Rattus norvegicus
gttccaggaggctgcatttgccaat

SEQ ID NO: 524962 - DNA, 25 bp, Rattus norvegicus
gttccaggatatctgacaccatctt

SEQ ID NO: 524963 - DNA, 25 bp, Rattus norvegicus
gttccaggatatgtgacaccatctt

SEQ ID NO: 524964 - DNA, 25 bp, Rattus norvegicus
gttccaggcatcctcaggctagctg

SEQ ID NO: 524965 - DNA, 25 bp, Rattus norvegicus
gttccaggcatcgtcaggctagctg

SEQ ID NO: 524966 - DNA, 25 bp, Rattus norvegicus
gttccaggccagacgaggctatgtt

SEQ ID NO: 524967 - DNA, 25 bp, Rattus norvegicus
gttccaggccagacgggactatgta

SEQ ID NO: 524968 - DNA, 25 bp, Rattus norvegicus
gttccaggccagtcgaggctatgtt

SEQ ID NO: 524969 - DNA, 25 bp, Rattus norvegicus
gttccaggccagtcgggactatgta

SEQ ID NO: 524970 - DNA, 25 bp, Rattus norvegicus
gttccaggccataaatgcagcactt

SEQ ID NO: 524971 - DNA, 25 bp, Rattus norvegicus
gttccaggccattaatgcagcactt

SEQ ID NO: 524972 - DNA, 25 bp, Rattus norvegicus
gttccaggcccacgcaacagggatg

SEQ ID NO: 524973 - DNA, 25 bp, Rattus norvegicus
gttccaggcccaggcaacagggatg

SEQ ID NO: 524974 - DNA, 25 bp, Rattus norvegicus
gttccaggcgtgcaagcagaactcg

SEQ ID NO: 524975 - DNA, 25 bp, Rattus norvegicus
gttccaggcgtggaagcagaactcg

SEQ ID NO: 524976 - DNA, 25 bp, Rattus norvegicus
gttccaggctagctagagctgtttc

SEQ ID NO: 524977 - DNA, 25 bp, Rattus norvegicus
gttccaggctaggtagagctgtttc

SEQ ID NO: 524978 - DNA, 25 bp, Rattus norvegicus
gttccaggctgactgaacgcccatg

SEQ ID NO: 524979 - DNA, 25 bp, Rattus norvegicus
gttccaggctgagtgaacgcccatg

SEQ ID NO: 524980 - DNA, 25 bp, Rattus norvegicus
gttccagggatgcatgtacccgcgt

SEQ ID NO: 524981 - DNA, 25 bp, Rattus norvegicus
gttccagggatggatgtacccgcgt

SEQ ID NO: 524982 - DNA, 25 bp, Rattus norvegicus
gttccagggcacctacgagagcaga

SEQ ID NO: 524983 - DNA, 25 bp, Rattus norvegicus
gttccagggcacgtacgagagcaga

SEQ ID NO: 524984 - DNA, 25 bp, Rattus norvegicus
gttccagggccgctgtcttgaagaa

SEQ ID NO: 524985 - DNA, 25 bp, Rattus norvegicus
gttccagggccggtgtcttgaagaa

SEQ ID NO: 524986 - DNA, 25 bp, Rattus norvegicus
gttccagggtcacatccactaggac

SEQ ID NO: 524987 - DNA, 25 bp, Rattus norvegicus
gttccagggtcagatccactaggac

SEQ ID NO: 524988 - DNA, 25 bp, Rattus norvegicus
gttccagggtgtctctgtctaagaa

SEQ ID NO: 524989 - DNA, 25 bp, Rattus norvegicus
gttccagggtgtgtctgtctaagaa

SEQ ID NO: 524990 - DNA, 25 bp, Rattus norvegicus
gttccagggttcataacctctctag

SEQ ID NO: 524991 - DNA, 25 bp, Rattus norvegicus
gttccagggttcttaacctctctag

SEQ ID NO: 524992 - DNA, 25 bp, Rattus norvegicus
gttccaggtagccattgacgacacg

SEQ ID NO: 524993 - DNA, 25 bp, Rattus norvegicus
gttccaggtagcgattgacgacacg

SEQ ID NO: 524994 - DNA, 25 bp, Rattus norvegicus
gttccagtactgctctgctgtgaaa

SEQ ID NO: 524995 - DNA, 25 bp, Rattus norvegicus
gttccagtactggtctgctgtgaaa

SEQ ID NO: 524996 - DNA, 25 bp, Rattus norvegicus
gttccagtagacagcaccgttggtt

SEQ ID NO: 524997 - DNA, 25 bp, Rattus norvegicus
gttccagtagactgcaccgttggtt

SEQ ID NO: 524998 - DNA, 25 bp, Rattus norvegicus
gttccagtaggtaggctacttgtca

SEQ ID NO: 524999 - DNA, 25 bp, Rattus norvegicus
gttccagtaggttggctacttgtca

SEQ ID NO: 525000 - DNA, 25 bp, Rattus norvegicus
gttccagtatgtcgtccatggtgct

SEQ ID NO: 525001 - DNA, 25 bp, Rattus norvegicus
gttccagtatgtggtccatggtgct

SEQ ID NO: 525002 - DNA, 25 bp, Rattus norvegicus
gttccagtcaacatgtacttactgc

SEQ ID NO: 525003 - DNA, 25 bp, Rattus norvegicus
gttccagtcaacttgtacttactgc

SEQ ID NO: 525004 - DNA, 25 bp, Rattus norvegicus
gttccagtcatgcttgaccttagca

SEQ ID NO: 525005 - DNA, 25 bp, Rattus norvegicus
gttccagtcatggttgaccttagca

SEQ ID NO: 525006 - DNA, 25 bp, Rattus norvegicus
gttccagtcattcagtcagtatcgc

SEQ ID NO: 525007 - DNA, 25 bp, Rattus norvegicus
gttccagtcattgagtcagtatcgc

SEQ ID NO: 525008 - DNA, 25 bp, Rattus norvegicus
gttccagtcggaagtcaatcatgca

SEQ ID NO: 525009 - DNA, 25 bp, Rattus norvegicus
gttccagtcggatgtcaatcatgca

SEQ ID NO: 525010 - DNA, 25 bp, Rattus norvegicus
gttccagtgaagaaatctgtacgag

SEQ ID NO: 525011 - DNA, 25 bp, Rattus norvegicus
gttccagtgaagtaatctgtacgag

SEQ ID NO: 525012 - DNA, 25 bp, Rattus norvegicus
gttccagtggacagttccaagcgca

SEQ ID NO: 525013 - DNA, 25 bp, Rattus norvegicus
gttccagtggactgttccaagcgca

SEQ ID NO: 525014 - DNA, 25 bp, Rattus norvegicus
gttccagtgtatagatggtactcta

SEQ ID NO: 525015 - DNA, 25 bp, Rattus norvegicus
gttccagtgtattgatggtactcta

SEQ ID NO: 525016 - DNA, 25 bp, Rattus norvegicus
gttccagttctacttccagcagaag

SEQ ID NO: 525017 - DNA, 25 bp, Rattus norvegicus
gttccagttctagttccagcagaag

SEQ ID NO: 525018 - DNA, 25 bp, Rattus norvegicus
gttccagttgcccacaagtgactag

SEQ ID NO: 525019 - DNA, 25 bp, Rattus norvegicus
gttccagttgccgacaagtgactag

SEQ ID NO: 525020 - DNA, 25 bp, Rattus norvegicus
gttccagtttcaagtgcctgaacta

SEQ ID NO: 525021 - DNA, 25 bp, Rattus norvegicus
gttccagtttcatgtgcctgaacta

SEQ ID NO: 525022 - DNA, 25 bp, Rattus norvegicus
gttccagttttcatgtgcttagcag

SEQ ID NO: 525023 - DNA, 25 bp, Rattus norvegicus
gttccagttttcttgtgcttagcag

SEQ ID NO: 525024 - DNA, 25 bp, Rattus norvegicus
gttccataactgacaccatgagtaa

SEQ ID NO: 525025 - DNA, 25 bp, Rattus norvegicus
gttccataactgtcaccatgagtaa

SEQ ID NO: 525026 - DNA, 25 bp, Rattus norvegicus
gttccataattaaactcctagttta

SEQ ID NO: 525027 - DNA, 25 bp, Rattus norvegicus
gttccataattatactcctagttta

SEQ ID NO: 525028 - DNA, 25 bp, Rattus norvegicus
gttccataccatagacaccagcagg

SEQ ID NO: 525029 - DNA, 25 bp, Rattus norvegicus
gttccataccattgacaccagcagg

SEQ ID NO: 525030 - DNA, 25 bp, Rattus norvegicus
gttccatactttaagcaccagactc

SEQ ID NO: 525031 - DNA, 25 bp, Rattus norvegicus
gttccatacttttagcaccagactc

SEQ ID NO: 525032 - DNA, 25 bp, Rattus norvegicus
gttccatagaatcctccaaattccc

SEQ ID NO: 525033 - DNA, 25 bp, Rattus norvegicus
gttccatagaatgctccaaattccc

SEQ ID NO: 525034 - DNA, 25 bp, Rattus norvegicus
gttccatagccacttgagccaaatg

SEQ ID NO: 525035 - DNA, 25 bp, Rattus norvegicus
gttccatagccagttgagccaaatg

SEQ ID NO: 525036 - DNA, 25 bp, Rattus norvegicus
gttccatatgccaccgaagttcaaa

SEQ ID NO: 525037 - DNA, 25 bp, Rattus norvegicus
gttccatatgcctccgaagttcaaa

SEQ ID NO: 525038 - DNA, 25 bp, Rattus norvegicus
gttccatatggaatcacctgcctaa

SEQ ID NO: 525039 - DNA, 25 bp, Rattus norvegicus
gttccatatggaatctgctctttta

SEQ ID NO: 525040 - DNA, 25 bp, Rattus norvegicus
gttccatatggattcacctgcctaa

SEQ ID NO: 525041 - DNA, 25 bp, Rattus norvegicus
gttccatatggattctgctctttta

SEQ ID NO: 525042 - DNA, 25 bp, Rattus norvegicus
gttccatcaaagctttatcagttca

SEQ ID NO: 525043 - DNA, 25 bp, Rattus norvegicus
gttccatcaaaggtttatcagttca

SEQ ID NO: 525044 - DNA, 25 bp, Rattus norvegicus
gttccatcagacagtggatcctgaa

SEQ ID NO: 525045 - DNA, 25 bp, Rattus norvegicus
gttccatcagactgtggatcctgaa

SEQ ID NO: 525046 - DNA, 25 bp, Rattus norvegicus
gttccatcagccctaccgggcgatg

SEQ ID NO: 525047 - DNA, 25 bp, Rattus norvegicus
gttccatcagccgtaccgggcgatg

SEQ ID NO: 525048 - DNA, 25 bp, Rattus norvegicus
gttccatccacaaaaggcccttaga

SEQ ID NO: 525049 - DNA, 25 bp, Rattus norvegicus
gttccatccacataaggcccttaga

SEQ ID NO: 525050 - DNA, 25 bp, Rattus norvegicus
gttccatccataatacccacaaggt

SEQ ID NO: 525051 - DNA, 25 bp, Rattus norvegicus
gttccatccatattacccacaaggt

SEQ ID NO: 525052 - DNA, 25 bp, Rattus norvegicus
gttccatccctacaaaccatgtaaa

SEQ ID NO: 525053 - DNA, 25 bp, Rattus norvegicus
gttccatccctagaaaccatgtaaa

SEQ ID NO: 525054 - DNA, 25 bp, Rattus norvegicus
gttccatccctgaaatgcaacatga

SEQ ID NO: 525055 - DNA, 25 bp, Rattus norvegicus
gttccatccctgtaatgcaacatga

SEQ ID NO: 525056 - DNA, 25 bp, Rattus norvegicus
gttccatctacccaaagctgaaatt

SEQ ID NO: 525057 - DNA, 25 bp, Rattus norvegicus
gttccatctaccgaaagctgaaatt

SEQ ID NO: 525058 - DNA, 25 bp, Rattus norvegicus
gttccatctataattactgccttgc

SEQ ID NO: 525059 - DNA, 25 bp, Rattus norvegicus
gttccatctatatttactgccttgc

SEQ ID NO: 525060 - DNA, 25 bp, Rattus norvegicus
gttccatcttctcaggccagcaaag

SEQ ID NO: 525061 - DNA, 25 bp, Rattus norvegicus
gttccatcttctgaggccagcaaag

SEQ ID NO: 525062 - DNA, 25 bp, Rattus norvegicus
gttccatgggaaattgagggcagct

SEQ ID NO: 525063 - DNA, 25 bp, Rattus norvegicus
gttccatgggaatttgagggcagct

SEQ ID NO: 525064 - DNA, 25 bp, Rattus norvegicus
gttccatgggctagtacgtgttcct

SEQ ID NO: 525065 - DNA, 25 bp, Rattus norvegicus
gttccatgggcttgtacgtgttcct

SEQ ID NO: 525066 - DNA, 25 bp, Rattus norvegicus
gttccatgtcctctaagctctagat

SEQ ID NO: 525067 - DNA, 25 bp, Rattus norvegicus
gttccatgtcctgtaagctctagat

SEQ ID NO: 525068 - DNA, 25 bp, Rattus norvegicus
gttccatgtctaaagttggccctag

SEQ ID NO: 525069 - DNA, 25 bp, Rattus norvegicus
gttccatgtctatagttggccctag

SEQ ID NO: 525070 - DNA, 25 bp, Rattus norvegicus
gttccattccgtatggctctaaggg

SEQ ID NO: 525071 - DNA, 25 bp, Rattus norvegicus
gttccattccgtttggctctaaggg

SEQ ID NO: 525072 - DNA, 25 bp, Rattus norvegicus
gttccattcctcagtccgaacagtt

SEQ ID NO: 525073 - DNA, 25 bp, Rattus norvegicus
gttccattcctctgtccgaacagtt

SEQ ID NO: 525074 - DNA, 25 bp, Rattus norvegicus
gttccattctgcctgtggctttcta

SEQ ID NO: 525075 - DNA, 25 bp, Rattus norvegicus
gttccattctgcgtgtggctttcta

SEQ ID NO: 525076 - DNA, 25 bp, Rattus norvegicus
gttccattcttgaaatgcacatgat

SEQ ID NO: 525077 - DNA, 25 bp, Rattus norvegicus
gttccattcttgtaatgcacatgat

SEQ ID NO: 525078 - DNA, 25 bp, Rattus norvegicus
gttccattgacaaggccatgcagct

SEQ ID NO: 525079 - DNA, 25 bp, Rattus norvegicus
gttccattgacaccgagagcgtttt

SEQ ID NO: 525080 - DNA, 25 bp, Rattus norvegicus
gttccattgacagcgagagcgtttt

SEQ ID NO: 525081 - DNA, 25 bp, Rattus norvegicus
gttccattgacatggccatgcagct

SEQ ID NO: 525082 - DNA, 25 bp, Rattus norvegicus
gttccattgcatcagaccttttagt

SEQ ID NO: 525083 - DNA, 25 bp, Rattus norvegicus
gttccattgcatgagaccttttagt

SEQ ID NO: 525084 - DNA, 25 bp, Rattus norvegicus
gttccattgcctcttggtcattcag

SEQ ID NO: 525085 - DNA, 25 bp, Rattus norvegicus
gttccattgcctgttggtcattcag

SEQ ID NO: 525086 - DNA, 25 bp, Rattus norvegicus
gttccattgcgtatgcagtactgat

SEQ ID NO: 525087 - DNA, 25 bp, Rattus norvegicus
gttccattgcgtttgcagtactgat

SEQ ID NO: 525088 - DNA, 25 bp, Rattus norvegicus
gttccattggagatcggcacccggg

SEQ ID NO: 525089 - DNA, 25 bp, Rattus norvegicus
gttccattggagttcggcacccggg

SEQ ID NO: 525090 - DNA, 25 bp, Rattus norvegicus
gttccattgtcaccagtcacattgt

SEQ ID NO: 525091 - DNA, 25 bp, Rattus norvegicus
gttccattgtcagcagtcacattgt

SEQ ID NO: 525092 - DNA, 25 bp, Rattus norvegicus
gttccatttacaccttttcttactt

SEQ ID NO: 525093 - DNA, 25 bp, Rattus norvegicus
gttccatttacagcttttcttactt

SEQ ID NO: 525094 - DNA, 25 bp, Rattus norvegicus
gttccatttccacatccacatttat

SEQ ID NO: 525095 - DNA, 25 bp, Rattus norvegicus
gttccatttccagatccacatttat

SEQ ID NO: 525096 - DNA, 25 bp, Rattus norvegicus
gttccatttgaacaatatacaaggc

SEQ ID NO: 525097 - DNA, 25 bp, Rattus norvegicus
gttccatttgaagaatatacaaggc

SEQ ID NO: 525098 - DNA, 25 bp, Rattus norvegicus
gttccattttgtaagttcatttact

SEQ ID NO: 525099 - DNA, 25 bp, Rattus norvegicus
gttccattttgtaatcaactagcta

SEQ ID NO: 525100 - DNA, 25 bp, Rattus norvegicus
gttccattttgttagttcatttact

SEQ ID NO: 525101 - DNA, 25 bp, Rattus norvegicus
gttccattttgttatcaactagcta

SEQ ID NO: 525102 - DNA, 25 bp, Rattus norvegicus
gttcccaaaagcaggcagtaccctt

SEQ ID NO: 525103 - DNA, 25 bp, Rattus norvegicus
gttcccaaaagctggcagtaccctt

SEQ ID NO: 525104 - DNA, 25 bp, Rattus norvegicus
gttcccaaagcaacacttgttcgga

SEQ ID NO: 525105 - DNA, 25 bp, Rattus norvegicus
gttcccaaagcatcacttgttcgga

SEQ ID NO: 525106 - DNA, 25 bp, Rattus norvegicus
gttcccaactttagttcaattgaca

SEQ ID NO: 525107 - DNA, 25 bp, Rattus norvegicus
gttcccaacttttgttcaattgaca

SEQ ID NO: 525108 - DNA, 25 bp, Rattus norvegicus
gttcccaagagacatcacagtgcca

SEQ ID NO: 525109 - DNA, 25 bp, Rattus norvegicus
gttcccaagagagatcacagtgcca

SEQ ID NO: 525110 - DNA, 25 bp, Rattus norvegicus
gttcccaaggtgacgtttggcaaca

SEQ ID NO: 525111 - DNA, 25 bp, Rattus norvegicus
gttcccaaggtgtcgtttggcaaca

SEQ ID NO: 525112 - DNA, 25 bp, Rattus norvegicus
gttcccaaggttaacacggcatcaa

SEQ ID NO: 525113 - DNA, 25 bp, Rattus norvegicus
gttcccaaggtttacacggcatcaa

SEQ ID NO: 525114 - DNA, 25 bp, Rattus norvegicus
gttcccacaatcaagaaacgtccct

SEQ ID NO: 525115 - DNA, 25 bp, Rattus norvegicus
gttcccacaatctagaaacgtccct

SEQ ID NO: 525116 - DNA, 25 bp, Rattus norvegicus
gttcccacacagcacagagccagtg

SEQ ID NO: 525117 - DNA, 25 bp, Rattus norvegicus
gttcccacacaggacagagccagtg

SEQ ID NO: 525118 - DNA, 25 bp, Rattus norvegicus
gttcccacagagatgactgtctctt

SEQ ID NO: 525119 - DNA, 25 bp, Rattus norvegicus
gttcccacagagttgactgtctctt

SEQ ID NO: 525120 - DNA, 25 bp, Rattus norvegicus
gttcccaccgtgaaatttttgacat

SEQ ID NO: 525121 - DNA, 25 bp, Rattus norvegicus
gttcccaccgtgtaatttttgacat

SEQ ID NO: 525122 - DNA, 25 bp, Rattus norvegicus
gttcccacctctccaaagcaagaaa

SEQ ID NO: 525123 - DNA, 25 bp, Rattus norvegicus
gttcccacctctgcaaagcaagaaa

SEQ ID NO: 525124 - DNA, 25 bp, Rattus norvegicus
gttcccaccttaccaggcatgagag

SEQ ID NO: 525125 - DNA, 25 bp, Rattus norvegicus
gttcccaccttagcaggcatgagag

SEQ ID NO: 525126 - DNA, 25 bp, Rattus norvegicus
gttcccacggtgaaatgatctccca

SEQ ID NO: 525127 - DNA, 25 bp, Rattus norvegicus
gttcccacggtgtaatgatctccca

SEQ ID NO: 525128 - DNA, 25 bp, Rattus norvegicus
gttcccactgcaaggagatccgcaa

SEQ ID NO: 525129 - DNA, 25 bp, Rattus norvegicus
gttcccactgcatggagatccgcaa

SEQ ID NO: 525130 - DNA, 25 bp, Rattus norvegicus
gttcccactgggaaacttcatattt

SEQ ID NO: 525131 - DNA, 25 bp, Rattus norvegicus
gttcccactgggtaacttcatattt

SEQ ID NO: 525132 - DNA, 25 bp, Rattus norvegicus
gttcccagaaaaaggctgattgcta

SEQ ID NO: 525133 - DNA, 25 bp, Rattus norvegicus
gttcccagaaaatggctgattgcta

SEQ ID NO: 525134 - DNA, 25 bp, Rattus norvegicus
gttcccagaagtatggagcctccag

SEQ ID NO: 525135 - DNA, 25 bp, Rattus norvegicus
gttcccagaagtttggagcctccag

SEQ ID NO: 525136 - DNA, 25 bp, Rattus norvegicus
gttcccagaataattgatcacgaga

SEQ ID NO: 525137 - DNA, 25 bp, Rattus norvegicus
gttcccagaatatttgatcacgaga

SEQ ID NO: 525138 - DNA, 25 bp, Rattus norvegicus
gttcccagacacaacagcaagtggt

SEQ ID NO: 525139 - DNA, 25 bp, Rattus norvegicus
gttcccagacactacagcaagtggt

SEQ ID NO: 525140 - DNA, 25 bp, Rattus norvegicus
gttcccagacgacatccatggagtc

SEQ ID NO: 525141 - DNA, 25 bp, Rattus norvegicus
gttcccagacgagatccatggagtc

SEQ ID NO: 525142 - DNA, 25 bp, Rattus norvegicus
gttcccagagccatttcagagtagt

SEQ ID NO: 525143 - DNA, 25 bp, Rattus norvegicus
gttcccagagccttttcagagtagt

SEQ ID NO: 525144 - DNA, 25 bp, Rattus norvegicus
gttcccagagtccaccaaggtaagg

SEQ ID NO: 525145 - DNA, 25 bp, Rattus norvegicus
gttcccagagtcgaccaaggtaagg

SEQ ID NO: 525146 - DNA, 25 bp, Rattus norvegicus
gttcccagcactaagctaaggctta

SEQ ID NO: 525147 - DNA, 25 bp, Rattus norvegicus
gttcccagcacttagctaaggctta

SEQ ID NO: 525148 - DNA, 25 bp, Rattus norvegicus
gttcccagcagacgtgtgccaacaa

SEQ ID NO: 525149 - DNA, 25 bp, Rattus norvegicus
gttcccagcagaggtgtgccaacaa

SEQ ID NO: 525150 - DNA, 25 bp, Rattus norvegicus
gttcccagcctcctgaatgagatta

SEQ ID NO: 525151 - DNA, 25 bp, Rattus norvegicus
gttcccagcctcgtgaatgagatta

SEQ ID NO: 525152 - DNA, 25 bp, Rattus norvegicus
gttcccagccttcctgaatggatta

SEQ ID NO: 525153 - DNA, 25 bp, Rattus norvegicus
gttcccagccttgctgaatggatta

SEQ ID NO: 525154 - DNA, 25 bp, Rattus norvegicus
gttcccagcgagcatccttatttga

SEQ ID NO: 525155 - DNA, 25 bp, Rattus norvegicus
gttcccagcgaggatccttatttga

SEQ ID NO: 525156 - DNA, 25 bp, Rattus norvegicus
gttcccagcttccacggctgcggta

SEQ ID NO: 525157 - DNA, 25 bp, Rattus norvegicus
gttcccagcttcgacggctgcggta

SEQ ID NO: 525158 - DNA, 25 bp, Rattus norvegicus
gttcccaggactcatttttctattc

SEQ ID NO: 525159 - DNA, 25 bp, Rattus norvegicus
gttcccaggactgatttttctattc

SEQ ID NO: 525160 - DNA, 25 bp, Rattus norvegicus
gttcccaggaggaaggtacactctt

SEQ ID NO: 525161 - DNA, 25 bp, Rattus norvegicus
gttcccaggaggtaggtacactctt

SEQ ID NO: 525162 - DNA, 25 bp, Rattus norvegicus
gttcccagggatcttgatgcagtca

SEQ ID NO: 525163 - DNA, 25 bp, Rattus norvegicus
gttcccagggatgttgatgcagtca

SEQ ID NO: 525164 - DNA, 25 bp, Rattus norvegicus
gttcccagggcaatgattttagtct

SEQ ID NO: 525165 - DNA, 25 bp, Rattus norvegicus
gttcccagggcattgattttagtct

SEQ ID NO: 525166 - DNA, 25 bp, Rattus norvegicus
gttcccagtctcactactatgaaga

SEQ ID NO: 525167 - DNA, 25 bp, Rattus norvegicus
gttcccagtctctctactatgaaga

SEQ ID NO: 525168 - DNA, 25 bp, Rattus norvegicus
gttcccagttgtccatttttagcat

SEQ ID NO: 525169 - DNA, 25 bp, Rattus norvegicus
gttcccagttgtgcatttttagcat

SEQ ID NO: 525170 - DNA, 25 bp, Rattus norvegicus
gttcccataatcatatgcctgtcca

SEQ ID NO: 525171 - DNA, 25 bp, Rattus norvegicus
gttcccataatcttatgcctgtcca

SEQ ID NO: 525172 - DNA, 25 bp, Rattus norvegicus
gttcccataggtctacagagttctg

SEQ ID NO: 525173 - DNA, 25 bp, Rattus norvegicus
gttcccataggtgtacagagttctg

SEQ ID NO: 525174 - DNA, 25 bp, Rattus norvegicus
gttcccatcaatcgcaggaagcaca

SEQ ID NO: 525175 - DNA, 25 bp, Rattus norvegicus
gttcccatcaatggcaggaagcaca

SEQ ID NO: 525176 - DNA, 25 bp, Rattus norvegicus
gttcccatcctgaggctatctagaa

SEQ ID NO: 525177 - DNA, 25 bp, Rattus norvegicus
gttcccatcctgtggctatctagaa

SEQ ID NO: 525178 - DNA, 25 bp, Rattus norvegicus
gttcccatctgtaacactttctagt

SEQ ID NO: 525179 - DNA, 25 bp, Rattus norvegicus
gttcccatctgttacactttctagt

SEQ ID NO: 525180 - DNA, 25 bp, Rattus norvegicus
gttcccatcttgattctagaagagg

SEQ ID NO: 525181 - DNA, 25 bp, Rattus norvegicus
gttcccatcttgtttctagaagagg

SEQ ID NO: 525182 - DNA, 25 bp, Rattus norvegicus
gttcccatctttatgtagtcatctc

SEQ ID NO: 525183 - DNA, 25 bp, Rattus norvegicus
gttcccatctttttgtagtcatctc

SEQ ID NO: 525184 - DNA, 25 bp, Rattus norvegicus
gttcccatggtgataacactaactg

SEQ ID NO: 525185 - DNA, 25 bp, Rattus norvegicus
gttcccatggtgttaacactaactg

SEQ ID NO: 525186 - DNA, 25 bp, Rattus norvegicus
gttcccatgtcacaagagcccttga

SEQ ID NO: 525187 - DNA, 25 bp, Rattus norvegicus
gttcccatgtcagaagagcccttga

SEQ ID NO: 525188 - DNA, 25 bp, Rattus norvegicus
gttcccatgttactagtgcttgcca

SEQ ID NO: 525189 - DNA, 25 bp, Rattus norvegicus
gttcccatgttagtagtgcttgcca

SEQ ID NO: 525190 - DNA, 25 bp, Rattus norvegicus
gttcccattagacctacatcttatt

SEQ ID NO: 525191 - DNA, 25 bp, Rattus norvegicus
gttcccattagagctacatcttatt

SEQ ID NO: 525192 - DNA, 25 bp, Rattus norvegicus
gttcccattcgtagccgaatttgta

SEQ ID NO: 525193 - DNA, 25 bp, Rattus norvegicus
gttcccattcgttgccgaatttgta

SEQ ID NO: 525194 - DNA, 25 bp, Rattus norvegicus
gttcccattctacgggtcaatatga

SEQ ID NO: 525195 - DNA, 25 bp, Rattus norvegicus
gttcccattctaggggtcaatatga

SEQ ID NO: 525196 - DNA, 25 bp, Rattus norvegicus
gttcccattgccatgagtggcatca

SEQ ID NO: 525197 - DNA, 25 bp, Rattus norvegicus
gttcccattgccttgagtggcatca

SEQ ID NO: 525198 - DNA, 25 bp, Rattus norvegicus
gttcccattgctacatgtttcagta

SEQ ID NO: 525199 - DNA, 25 bp, Rattus norvegicus
gttcccattgcttcatgtttcagta

SEQ ID NO: 525200 - DNA, 25 bp, Rattus norvegicus
gttcccatttcacatagcagagtgt

SEQ ID NO: 525201 - DNA, 25 bp, Rattus norvegicus
gttcccatttcagatagcagagtgt

SEQ ID NO: 525202 - DNA, 25 bp, Rattus norvegicus
gttcccatttggaggttgtttctct

SEQ ID NO: 525203 - DNA, 25 bp, Rattus norvegicus
gttcccatttggtggttgtttctct

SEQ ID NO: 525204 - DNA, 25 bp, Rattus norvegicus
gttcccattttaaacaattcagttt

SEQ ID NO: 525205 - DNA, 25 bp, Rattus norvegicus
gttcccattttatacaattcagttt

SEQ ID NO: 525206 - DNA, 25 bp, Rattus norvegicus
gttccccacggaatggtcaagcata

SEQ ID NO: 525207 - DNA, 25 bp, Rattus norvegicus
gttccccacggattggtcaagcata

SEQ ID NO: 525208 - DNA, 25 bp, Rattus norvegicus
gttccccaggaaataacatgcccaa

SEQ ID NO: 525209 - DNA, 25 bp, Rattus norvegicus
gttccccaggaattaacatgcccaa

SEQ ID NO: 525210 - DNA, 25 bp, Rattus norvegicus
gttccccagggtcgtcaagctgtca

SEQ ID NO: 525211 - DNA, 25 bp, Rattus norvegicus
gttccccagggtggtcaagctgtca

SEQ ID NO: 525212 - DNA, 25 bp, Rattus norvegicus
gttccccagtctagtgagagcattt

SEQ ID NO: 525213 - DNA, 25 bp, Rattus norvegicus
gttccccagtcttgtgagagcattt

SEQ ID NO: 525214 - DNA, 25 bp, Rattus norvegicus
gttccccatattattacagctctac

SEQ ID NO: 525215 - DNA, 25 bp, Rattus norvegicus
gttccccatatttttacagctctac

SEQ ID NO: 525216 - DNA, 25 bp, Rattus norvegicus
gttccccatggactttgagttcagt

SEQ ID NO: 525217 - DNA, 25 bp, Rattus norvegicus
gttccccatggagtttgagttcagt

SEQ ID NO: 525218 - DNA, 25 bp, Rattus norvegicus
gttccccatggtaatgaaccccaga

SEQ ID NO: 525219 - DNA, 25 bp, Rattus norvegicus
gttccccatggttatgaaccccaga

SEQ ID NO: 525220 - DNA, 25 bp, Rattus norvegicus
gttccccgaatgctggcactgtgga

SEQ ID NO: 525221 - DNA, 25 bp, Rattus norvegicus
gttccccgaatggtggcactgtgga

SEQ ID NO: 525222 - DNA, 25 bp, Rattus norvegicus
gttccccgacacaggataccaaaga

SEQ ID NO: 525223 - DNA, 25 bp, Rattus norvegicus
gttccccgacactggataccaaaga

SEQ ID NO: 525224 - DNA, 25 bp, Rattus norvegicus
gttccccgaggtatgagttcttgta

SEQ ID NO: 525225 - DNA, 25 bp, Rattus norvegicus
gttccccgaggtttgagttcttgta

SEQ ID NO: 525226 - DNA, 25 bp, Rattus norvegicus
gttccccgatgtagtctgtgacttg

SEQ ID NO: 525227 - DNA, 25 bp, Rattus norvegicus
gttccccgatgttgtctgtgacttg

SEQ ID NO: 525228 - DNA, 25 bp, Rattus norvegicus
gttccccgtatgatgttgacatcac

SEQ ID NO: 525229 - DNA, 25 bp, Rattus norvegicus
gttccccgtatgttgttgacatcac

SEQ ID NO: 525230 - DNA, 25 bp, Rattus norvegicus
gttccccgtggaccttgcaagcaag

SEQ ID NO: 525231 - DNA, 25 bp, Rattus norvegicus
gttccccgtggagcttgcaagcaag

SEQ ID NO: 525232 - DNA, 25 bp, Rattus norvegicus
gttccccgtgtgacatcagcatagt

SEQ ID NO: 525233 - DNA, 25 bp, Rattus norvegicus
gttccccgtgtgtcatcagcatagt

SEQ ID NO: 525234 - DNA, 25 bp, Rattus norvegicus
gttcccctaaccattagaagcacat

SEQ ID NO: 525235 - DNA, 25 bp, Rattus norvegicus
gttcccctaacctttagaagcacat

SEQ ID NO: 525236 - DNA, 25 bp, Rattus norvegicus
gttcccctaataaagtcctgcagtg

SEQ ID NO: 525237 - DNA, 25 bp, Rattus norvegicus
gttcccctaatatagtcctgcagtg

SEQ ID NO: 525238 - DNA, 25 bp, Rattus norvegicus
gttcccctcccgaagcatggtgggc

SEQ ID NO: 525239 - DNA, 25 bp, Rattus norvegicus
gttcccctcccgtagcatggtgggc

SEQ ID NO: 525240 - DNA, 25 bp, Rattus norvegicus
gttcccctgaagaaatgtcctttat

SEQ ID NO: 525241 - DNA, 25 bp, Rattus norvegicus
gttcccctgaagtaatgtcctttat

SEQ ID NO: 525242 - DNA, 25 bp, Rattus norvegicus
gttccccttagcagccttgggtgta

SEQ ID NO: 525243 - DNA, 25 bp, Rattus norvegicus
gttccccttagctgccttgggtgta

SEQ ID NO: 525244 - DNA, 25 bp, Rattus norvegicus
gttccccttatgctgtctttagaga

SEQ ID NO: 525245 - DNA, 25 bp, Rattus norvegicus
gttccccttatggtgtctttagaga

SEQ ID NO: 525246 - DNA, 25 bp, Rattus norvegicus
gttccccttcttagatacattttca

SEQ ID NO: 525247 - DNA, 25 bp, Rattus norvegicus
gttccccttctttgatacattttca

SEQ ID NO: 525248 - DNA, 25 bp, Rattus norvegicus
gttcccgacaggactcagactttga

SEQ ID NO: 525249 - DNA, 25 bp, Rattus norvegicus
gttcccgacaggtctcagactttga

SEQ ID NO: 525250 - DNA, 25 bp, Rattus norvegicus
gttcccgacataaacatggtggcta

SEQ ID NO: 525251 - DNA, 25 bp, Rattus norvegicus
gttcccgacatatacatggtggcta

SEQ ID NO: 525252 - DNA, 25 bp, Rattus norvegicus
gttcccgacggtcacaaacttgaag

SEQ ID NO: 525253 - DNA, 25 bp, Rattus norvegicus
gttcccgacggtgacaaacttgaag

SEQ ID NO: 525254 - DNA, 25 bp, Rattus norvegicus
gttcccgagaaccagtggctcaggt

SEQ ID NO: 525255 - DNA, 25 bp, Rattus norvegicus
gttcccgagaacgagtggctcaggt

SEQ ID NO: 525256 - DNA, 25 bp, Rattus norvegicus
gttcccgatgtcaatcagagtctga

SEQ ID NO: 525257 - DNA, 25 bp, Rattus norvegicus
gttcccgatgtctatcagagtctga

SEQ ID NO: 525258 - DNA, 25 bp, Rattus norvegicus
gttcccgcagtaccgccagtgagct

SEQ ID NO: 525259 - DNA, 25 bp, Rattus norvegicus
gttcccgcagtagcgccagtgagct

SEQ ID NO: 525260 - DNA, 25 bp, Rattus norvegicus
gttcccgggcctcgacaaagtcgag

SEQ ID NO: 525261 - DNA, 25 bp, Rattus norvegicus
gttcccgggcctggacaaagtcgag

SEQ ID NO: 525262 - DNA, 25 bp, Rattus norvegicus
gttcccgtgggaacagagacaataa

SEQ ID NO: 525263 - DNA, 25 bp, Rattus norvegicus
gttcccgtgggatcagagacaataa

SEQ ID NO: 525264 - DNA, 25 bp, Rattus norvegicus
gttcccgtgtgtcttagtttagtga

SEQ ID NO: 525265 - DNA, 25 bp, Rattus norvegicus
gttcccgtgtgtgttagtttagtga

SEQ ID NO: 525266 - DNA, 25 bp, Rattus norvegicus
gttcccgttctactttacataggct

SEQ ID NO: 525267 - DNA, 25 bp, Rattus norvegicus
gttcccgttctagtttacataggct

SEQ ID NO: 525268 - DNA, 25 bp, Rattus norvegicus
gttcccgtttgacttcattattgcc

SEQ ID NO: 525269 - DNA, 25 bp, Rattus norvegicus
gttcccgtttgagttcattattgcc

SEQ ID NO: 525270 - DNA, 25 bp, Rattus norvegicus
gttcccgttttcattaacatgctca

SEQ ID NO: 525271 - DNA, 25 bp, Rattus norvegicus
gttcccgttttctttaacatgctca

SEQ ID NO: 525272 - DNA, 25 bp, Rattus norvegicus
gttccctacaggaattttcagccat

SEQ ID NO: 525273 - DNA, 25 bp, Rattus norvegicus
gttccctacaggtattttcagccat

SEQ ID NO: 525274 - DNA, 25 bp, Rattus norvegicus
gttccctacagtatctgttctgtga

SEQ ID NO: 525275 - DNA, 25 bp, Rattus norvegicus
gttccctacagtttctgttctgtga

SEQ ID NO: 525276 - DNA, 25 bp, Rattus norvegicus
gttccctactaaagtttttatccag

SEQ ID NO: 525277 - DNA, 25 bp, Rattus norvegicus
gttccctactaatgtttttatccag

SEQ ID NO: 525278 - DNA, 25 bp, Rattus norvegicus
gttccctactgtccaaaggagcttt

SEQ ID NO: 525279 - DNA, 25 bp, Rattus norvegicus
gttccctactgtgcaaaggagcttt

SEQ ID NO: 525280 - DNA, 25 bp, Rattus norvegicus
gttccctagggactctggtatagta

SEQ ID NO: 525281 - DNA, 25 bp, Rattus norvegicus
gttccctagggagtctggtatagta

SEQ ID NO: 525282 - DNA, 25 bp, Rattus norvegicus
gttccctataacattcacctaagat

SEQ ID NO: 525283 - DNA, 25 bp, Rattus norvegicus
gttccctataactttcacctaagat

SEQ ID NO: 525284 - DNA, 25 bp, Rattus norvegicus
gttccctcaaacaaggtgtctgatc

SEQ ID NO: 525285 - DNA, 25 bp, Rattus norvegicus
gttccctcaaactaggtgtctgatc

SEQ ID NO: 525286 - DNA, 25 bp, Rattus norvegicus
gttccctcactgcataccttaataa

SEQ ID NO: 525287 - DNA, 25 bp, Rattus norvegicus
gttccctcactggataccttaataa

SEQ ID NO: 525288 - DNA, 25 bp, Rattus norvegicus
gttccctccgatcaggactggtgga

SEQ ID NO: 525289 - DNA, 25 bp, Rattus norvegicus
gttccctccgatgaggactggtgga

SEQ ID NO: 525290 - DNA, 25 bp, Rattus norvegicus
gttccctctcatagtattaggccca

SEQ ID NO: 525291 - DNA, 25 bp, Rattus norvegicus
gttccctctcattgtattaggccca

SEQ ID NO: 525292 - DNA, 25 bp, Rattus norvegicus
gttccctctgaaatttagtctctgt

SEQ ID NO: 525293 - DNA, 25 bp, Rattus norvegicus
gttccctctgaattttagtctctgt

SEQ ID NO: 525294 - DNA, 25 bp, Rattus norvegicus
gttccctcttctcagatgaccatat

SEQ ID NO: 525295 - DNA, 25 bp, Rattus norvegicus
gttccctcttctgagatgaccatat

SEQ ID NO: 525296 - DNA, 25 bp, Rattus norvegicus
gttccctctttcaacgaagtcttat

SEQ ID NO: 525297 - DNA, 25 bp, Rattus norvegicus
gttccctctttctacgaagtcttat

SEQ ID NO: 525298 - DNA, 25 bp, Rattus norvegicus
gttccctgaaaactggcagatccag

SEQ ID NO: 525299 - DNA, 25 bp, Rattus norvegicus
gttccctgaaaagtggcagatccag

SEQ ID NO: 525300 - DNA, 25 bp, Rattus norvegicus
gttccctgacgacattttgttgcat

SEQ ID NO: 525301 - DNA, 25 bp, Rattus norvegicus
gttccctgacgagattttgttgcat

SEQ ID NO: 525302 - DNA, 25 bp, Rattus norvegicus
gttccctgagccagaatgactgcca

SEQ ID NO: 525303 - DNA, 25 bp, Rattus norvegicus
gttccctgagcctgaatgactgcca

SEQ ID NO: 525304 - DNA, 25 bp, Rattus norvegicus
gttccctgcccacggagagtgatga

SEQ ID NO: 525305 - DNA, 25 bp, Rattus norvegicus
gttccctgcccagggagagtgatga

SEQ ID NO: 525306 - DNA, 25 bp, Rattus norvegicus
gttccctggaaactacttctgtttg

SEQ ID NO: 525307 - DNA, 25 bp, Rattus norvegicus
gttccctggaaagtacttctgtttg

SEQ ID NO: 525308 - DNA, 25 bp, Rattus norvegicus
gttccctggaacatacctgtgtgag

SEQ ID NO: 525309 - DNA, 25 bp, Rattus norvegicus
gttccctggaacttacctgtgtgag

SEQ ID NO: 525310 - DNA, 25 bp, Rattus norvegicus
gttccctgggaacaactgggtctca

SEQ ID NO: 525311 - DNA, 25 bp, Rattus norvegicus
gttccctgggaagaactgggtctca

SEQ ID NO: 525312 - DNA, 25 bp, Rattus norvegicus
gttccctgggtgacactgaactaag

SEQ ID NO: 525313 - DNA, 25 bp, Rattus norvegicus
gttccctgggtgtcactgaactaag

SEQ ID NO: 525314 - DNA, 25 bp, Rattus norvegicus
gttccctggtttacataagctacgt

SEQ ID NO: 525315 - DNA, 25 bp, Rattus norvegicus
gttccctggttttcataagctacgt

SEQ ID NO: 525316 - DNA, 25 bp, Rattus norvegicus
gttccctgtctaaatgccttttgaa

SEQ ID NO: 525317 - DNA, 25 bp, Rattus norvegicus
gttccctgtctatatgccttttgaa

SEQ ID NO: 525318 - DNA, 25 bp, Rattus norvegicus
gttccctgtgtacattttaagcaaa

SEQ ID NO: 525319 - DNA, 25 bp, Rattus norvegicus
gttccctgtgtagattttaagcaaa

SEQ ID NO: 525320 - DNA, 25 bp, Rattus norvegicus
gttccctgtgttagtccagaagcag

SEQ ID NO: 525321 - DNA, 25 bp, Rattus norvegicus
gttccctgtgtttgtccagaagcag

SEQ ID NO: 525322 - DNA, 25 bp, Rattus norvegicus
gttccctgttctctttatgcggaaa

SEQ ID NO: 525323 - DNA, 25 bp, Rattus norvegicus
gttccctgttctgtttatgcggaaa

SEQ ID NO: 525324 - DNA, 25 bp, Rattus norvegicus
gttcccttcaacaccaatggtttgt

SEQ ID NO: 525325 - DNA, 25 bp, Rattus norvegicus
gttcccttcaacatcttcattgttt

SEQ ID NO: 525326 - DNA, 25 bp, Rattus norvegicus
gttcccttcaactccaatggtttgt

SEQ ID NO: 525327 - DNA, 25 bp, Rattus norvegicus
gttcccttcaacttcttcattgttt

SEQ ID NO: 525328 - DNA, 25 bp, Rattus norvegicus
gttcccttcaggaccaccaataatt

SEQ ID NO: 525329 - DNA, 25 bp, Rattus norvegicus
gttcccttcaggtccaccaataatt

SEQ ID NO: 525330 - DNA, 25 bp, Rattus norvegicus
gttcccttcagtcaggcttgtatga

SEQ ID NO: 525331 - DNA, 25 bp, Rattus norvegicus
gttcccttcagtccacacaactgaa

SEQ ID NO: 525332 - DNA, 25 bp, Rattus norvegicus
gttcccttcagtgaggcttgtatga

SEQ ID NO: 525333 - DNA, 25 bp, Rattus norvegicus
gttcccttcagtgcacacaactgaa

SEQ ID NO: 525334 - DNA, 25 bp, Rattus norvegicus
gttcccttccaaaaatccttacatt

SEQ ID NO: 525335 - DNA, 25 bp, Rattus norvegicus
gttcccttccaataatccttacatt

SEQ ID NO: 525336 - DNA, 25 bp, Rattus norvegicus
gttcccttcgcactcaaggtaggaa

SEQ ID NO: 525337 - DNA, 25 bp, Rattus norvegicus
gttcccttcgcagtcaaggtaggaa

SEQ ID NO: 525338 - DNA, 25 bp, Rattus norvegicus
gttcccttgcaaacttcttctactg

SEQ ID NO: 525339 - DNA, 25 bp, Rattus norvegicus
gttcccttgcaatcttcttctactg

SEQ ID NO: 525340 - DNA, 25 bp, Rattus norvegicus
gttcccttgggcatcagtttatgat

SEQ ID NO: 525341 - DNA, 25 bp, Rattus norvegicus
gttcccttgggcttcagtttatgat

SEQ ID NO: 525342 - DNA, 25 bp, Rattus norvegicus
gttccctttcgtaatagctgcttga

SEQ ID NO: 525343 - DNA, 25 bp, Rattus norvegicus
gttccctttcgttatagctgcttga

SEQ ID NO: 525344 - DNA, 25 bp, Rattus norvegicus
gttcccttttatacacacagtttct

SEQ ID NO: 525345 - DNA, 25 bp, Rattus norvegicus
gttcccttttattcacacagtttct

SEQ ID NO: 525346 - DNA, 25 bp, Rattus norvegicus
gttcccttttgacttgagactgaaa

SEQ ID NO: 525347 - DNA, 25 bp, Rattus norvegicus
gttcccttttgagttgagactgaaa

SEQ ID NO: 525348 - DNA, 25 bp, Rattus norvegicus
gttccgaaggccacagctgtcactg

SEQ ID NO: 525349 - DNA, 25 bp, Rattus norvegicus
gttccgaaggcctcagctgtcactg

SEQ ID NO: 525350 - DNA, 25 bp, Rattus norvegicus
gttccgacacttctgaaactccgag

SEQ ID NO: 525351 - DNA, 25 bp, Rattus norvegicus
gttccgacacttgtgaaactccgag

SEQ ID NO: 525352 - DNA, 25 bp, Rattus norvegicus
gttccgacctgtataatttgatgtt

SEQ ID NO: 525353 - DNA, 25 bp, Rattus norvegicus
gttccgacctgtttaatttgatgtt

SEQ ID NO: 525354 - DNA, 25 bp, Rattus norvegicus
gttccgagaattctgtggaccttcc

SEQ ID NO: 525355 - DNA, 25 bp, Rattus norvegicus
gttccgagaattgtgtggaccttcc

SEQ ID NO: 525356 - DNA, 25 bp, Rattus norvegicus
gttccgaggaggatcttactcactc

SEQ ID NO: 525357 - DNA, 25 bp, Rattus norvegicus
gttccgaggaggttcttactcactc

SEQ ID NO: 525358 - DNA, 25 bp, Rattus norvegicus
gttccgagtgccaaaaactgtcttg

SEQ ID NO: 525359 - DNA, 25 bp, Rattus norvegicus
gttccgagtgcctaaaactgtcttg

SEQ ID NO: 525360 - DNA, 25 bp, Rattus norvegicus
gttccgatcaacactgtattagcct

SEQ ID NO: 525361 - DNA, 25 bp, Rattus norvegicus
gttccgatcaactctgtattagcct

SEQ ID NO: 525362 - DNA, 25 bp, Rattus norvegicus
gttccgatcctactgcgggccgaga

SEQ ID NO: 525363 - DNA, 25 bp, Rattus norvegicus
gttccgatcctagtgcgggccgaga

SEQ ID NO: 525364 - DNA, 25 bp, Rattus norvegicus
gttccgatgaagagaaacgcgccat

SEQ ID NO: 525365 - DNA, 25 bp, Rattus norvegicus
gttccgatgaagtgaaacgcgccat

SEQ ID NO: 525366 - DNA, 25 bp, Rattus norvegicus
gttccgcacttgactcatttaatgt

SEQ ID NO: 525367 - DNA, 25 bp, Rattus norvegicus
gttccgcacttgtctcatttaatgt

SEQ ID NO: 525368 - DNA, 25 bp, Rattus norvegicus
gttccgcaggagctagttcttggca

SEQ ID NO: 525369 - DNA, 25 bp, Rattus norvegicus
gttccgcaggaggtagttcttggca

SEQ ID NO: 525370 - DNA, 25 bp, Rattus norvegicus
gttccgcatgaaatacatatgtact

SEQ ID NO: 525371 - DNA, 25 bp, Rattus norvegicus
gttccgcatgaattacatatgtact

SEQ ID NO: 525372 - DNA, 25 bp, Rattus norvegicus
gttccgcatggaagactttgatgtg

SEQ ID NO: 525373 - DNA, 25 bp, Rattus norvegicus
gttccgcatggatgactttgatgtg

SEQ ID NO: 525374 - DNA, 25 bp, Rattus norvegicus
gttccgccggagagtaactgttcaa

SEQ ID NO: 525375 - DNA, 25 bp, Rattus norvegicus
gttccgccggagtgtaactgttcaa

SEQ ID NO: 525376 - DNA, 25 bp, Rattus norvegicus
gttccgcctataaaaaagctggtgc

SEQ ID NO: 525377 - DNA, 25 bp, Rattus norvegicus
gttccgcctatataaaagctggtgc

SEQ ID NO: 525378 - DNA, 25 bp, Rattus norvegicus
gttccgcggagcatgcagagcagaa

SEQ ID NO: 525379 - DNA, 25 bp, Rattus norvegicus
gttccgcggagcttgcagagcagaa

SEQ ID NO: 525380 - DNA, 25 bp, Rattus norvegicus
gttccgcgttacacctgaaagacgt

SEQ ID NO: 525381 - DNA, 25 bp, Rattus norvegicus
gttccgcgttactcctgaaagacgt

SEQ ID NO: 525382 - DNA, 25 bp, Rattus norvegicus
gttccgctaaacatggctaattcag

SEQ ID NO: 525383 - DNA, 25 bp, Rattus norvegicus
gttccgctaaacttggctaattcag

SEQ ID NO: 525384 - DNA, 25 bp, Rattus norvegicus
gttccgctgctcaccatatgtgaag

SEQ ID NO: 525385 - DNA, 25 bp, Rattus norvegicus
gttccgctgctctccatatgtgaag

SEQ ID NO: 525386 - DNA, 25 bp, Rattus norvegicus
gttccggaaactcgtgactgccatc

SEQ ID NO: 525387 - DNA, 25 bp, Rattus norvegicus
gttccggaaactggtgactgccatc

SEQ ID NO: 525388 - DNA, 25 bp, Rattus norvegicus
gttccggacacccagggttatgtag

SEQ ID NO: 525389 - DNA, 25 bp, Rattus norvegicus
gttccggacaccgagggttatgtag

SEQ ID NO: 525390 - DNA, 25 bp, Rattus norvegicus
gttccggagaatactggcggtacca

SEQ ID NO: 525391 - DNA, 25 bp, Rattus norvegicus
gttccggagaattctggcggtacca

SEQ ID NO: 525392 - DNA, 25 bp, Rattus norvegicus
gttccggatagcaaggtcgtgaaga

SEQ ID NO: 525393 - DNA, 25 bp, Rattus norvegicus
gttccggatagctaggtcgtgaaga

SEQ ID NO: 525394 - DNA, 25 bp, Rattus norvegicus
gttccggatgggactcagagctgaa

SEQ ID NO: 525395 - DNA, 25 bp, Rattus norvegicus
gttccggatgggtctcagagctgaa

SEQ ID NO: 525396 - DNA, 25 bp, Rattus norvegicus
gttccggccagcattcttttaagat

SEQ ID NO: 525397 - DNA, 25 bp, Rattus norvegicus
gttccggccagctttcttttaagat

SEQ ID NO: 525398 - DNA, 25 bp, Rattus norvegicus
gttccggcgccaaagagtagcatca

SEQ ID NO: 525399 - DNA, 25 bp, Rattus norvegicus
gttccggcgccatagagtagcatca

SEQ ID NO: 525400 - DNA, 25 bp, Rattus norvegicus
gttccggctcttcgtaggcgatgcc

SEQ ID NO: 525401 - DNA, 25 bp, Rattus norvegicus
gttccggctcttggtaggcgatgcc

SEQ ID NO: 525402 - DNA, 25 bp, Rattus norvegicus
gttccggcttttcaagcgggacacg

SEQ ID NO: 525403 - DNA, 25 bp, Rattus norvegicus
gttccggcttttgaagcgggacacg

SEQ ID NO: 525404 - DNA, 25 bp, Rattus norvegicus
gttccgggaaacaccatgagcctct

SEQ ID NO: 525405 - DNA, 25 bp, Rattus norvegicus
gttccgggaaactccatgagcctct

SEQ ID NO: 525406 - DNA, 25 bp, Rattus norvegicus
gttccgggaccacagggtaatcatt

SEQ ID NO: 525407 - DNA, 25 bp, Rattus norvegicus
gttccgggaccagagggtaatcatt

SEQ ID NO: 525408 - DNA, 25 bp, Rattus norvegicus
gttccgggagagcatccgcgctcac

SEQ ID NO: 525409 - DNA, 25 bp, Rattus norvegicus
gttccgggagaggatccgcgctcac

SEQ ID NO: 525410 - DNA, 25 bp, Rattus norvegicus
gttccggtgcctcgatggatcgaaa

SEQ ID NO: 525411 - DNA, 25 bp, Rattus norvegicus
gttccggtgcctggatggatcgaaa

SEQ ID NO: 525412 - DNA, 25 bp, Rattus norvegicus
gttccgtatgttagcttttgctgtt

SEQ ID NO: 525413 - DNA, 25 bp, Rattus norvegicus
gttccgtatgtttgcttttgctgtt

SEQ ID NO: 525414 - DNA, 25 bp, Rattus norvegicus
gttccgtcatctagaacaacgcaga

SEQ ID NO: 525415 - DNA, 25 bp, Rattus norvegicus
gttccgtcatcttgaacaacgcaga

SEQ ID NO: 525416 - DNA, 25 bp, Rattus norvegicus
gttccgtcttggattccatggctta

SEQ ID NO: 525417 - DNA, 25 bp, Rattus norvegicus
gttccgtcttggtttccatggctta

SEQ ID NO: 525418 - DNA, 25 bp, Rattus norvegicus
gttccgtgagaccacaacatcttta

SEQ ID NO: 525419 - DNA, 25 bp, Rattus norvegicus
gttccgtgagacgacaacatcttta

SEQ ID NO: 525420 - DNA, 25 bp, Rattus norvegicus
gttccgtgcaccaatttatattttt

SEQ ID NO: 525421 - DNA, 25 bp, Rattus norvegicus
gttccgtgcacctatttatattttt

SEQ ID NO: 525422 - DNA, 25 bp, Rattus norvegicus
gttccgtgccacatgactgtaagac

SEQ ID NO: 525423 - DNA, 25 bp, Rattus norvegicus
gttccgtgccacttgactgtaagac

SEQ ID NO: 525424 - DNA, 25 bp, Rattus norvegicus
gttccgttagctcctgtactcagga

SEQ ID NO: 525425 - DNA, 25 bp, Rattus norvegicus
gttccgttagctgctgtactcagga

SEQ ID NO: 525426 - DNA, 25 bp, Rattus norvegicus
gttccgttccaactgtgatgttcgt

SEQ ID NO: 525427 - DNA, 25 bp, Rattus norvegicus
gttccgttccaagtgtgatgttcgt

SEQ ID NO: 525428 - DNA, 25 bp, Rattus norvegicus
gttccgttgagactcttcggcggca

SEQ ID NO: 525429 - DNA, 25 bp, Rattus norvegicus
gttccgttgagagtcttcggcggca

SEQ ID NO: 525430 - DNA, 25 bp, Rattus norvegicus
gttccgtttcatattgtactacatg

SEQ ID NO: 525431 - DNA, 25 bp, Rattus norvegicus
gttccgtttcattttgtactacatg

SEQ ID NO: 525432 - DNA, 25 bp, Rattus norvegicus
gttcctaaaactatggcttcctacg

SEQ ID NO: 525433 - DNA, 25 bp, Rattus norvegicus
gttcctaaaactttggcttcctacg

SEQ ID NO: 525434 - DNA, 25 bp, Rattus norvegicus
gttcctaaacccctgtgctggagat

SEQ ID NO: 525435 - DNA, 25 bp, Rattus norvegicus
gttcctaaacccgtgtgctggagat

SEQ ID NO: 525436 - DNA, 25 bp, Rattus norvegicus
gttcctaaacgacctaagagtcaga

SEQ ID NO: 525437 - DNA, 25 bp, Rattus norvegicus
gttcctaaacgagctaagagtcaga

SEQ ID NO: 525438 - DNA, 25 bp, Rattus norvegicus
gttcctaaagaaacttcagcagtgc

SEQ ID NO: 525439 - DNA, 25 bp, Rattus norvegicus
gttcctaaagaatcttcagcagtgc

SEQ ID NO: 525440 - DNA, 25 bp, Rattus norvegicus
gttcctaaatgcaggagtacaggca

SEQ ID NO: 525441 - DNA, 25 bp, Rattus norvegicus
gttcctaaatgctggagtacaggca

SEQ ID NO: 525442 - DNA, 25 bp, Rattus norvegicus
gttcctaaccaaagccatcatcagg

SEQ ID NO: 525443 - DNA, 25 bp, Rattus norvegicus
gttcctaaccaatgccatcatcagg

SEQ ID NO: 525444 - DNA, 25 bp, Rattus norvegicus
gttcctaactgcagtctaatactca

SEQ ID NO: 525445 - DNA, 25 bp, Rattus norvegicus
gttcctaactgctgtctaatactca

SEQ ID NO: 525446 - DNA, 25 bp, Rattus norvegicus
gttcctaagaacctgtctcctgagg

SEQ ID NO: 525447 - DNA, 25 bp, Rattus norvegicus
gttcctaagaacgtgtctcctgagg

SEQ ID NO: 525448 - DNA, 25 bp, Rattus norvegicus
gttcctaagcaccacaacactgatc

SEQ ID NO: 525449 - DNA, 25 bp, Rattus norvegicus
gttcctaagcacgacaacactgatc

SEQ ID NO: 525450 - DNA, 25 bp, Rattus norvegicus
gttcctaagtcgattcaattcaatg

SEQ ID NO: 525451 - DNA, 25 bp, Rattus norvegicus
gttcctaagtcgtttcaattcaatg

SEQ ID NO: 525452 - DNA, 25 bp, Rattus norvegicus
gttcctaagtgcctccattacaaaa

SEQ ID NO: 525453 - DNA, 25 bp, Rattus norvegicus
gttcctaagtgcgtccattacaaaa

SEQ ID NO: 525454 - DNA, 25 bp, Rattus norvegicus
gttcctaagtgtcagagaatccttc

SEQ ID NO: 525455 - DNA, 25 bp, Rattus norvegicus
gttcctaagtgtgagagaatccttc

SEQ ID NO: 525456 - DNA, 25 bp, Rattus norvegicus
gttcctaatcccatattgagacttt

SEQ ID NO: 525457 - DNA, 25 bp, Rattus norvegicus
gttcctaatcccttattgagacttt

SEQ ID NO: 525458 - DNA, 25 bp, Rattus norvegicus
gttcctaatgcaccttcttggcctg

SEQ ID NO: 525459 - DNA, 25 bp, Rattus norvegicus
gttcctaatgcagcttcttggcctg

SEQ ID NO: 525460 - DNA, 25 bp, Rattus norvegicus
gttcctacaacaaacagcttccatg

SEQ ID NO: 525461 - DNA, 25 bp, Rattus norvegicus
gttcctacaacatacagcttccatg

SEQ ID NO: 525462 - DNA, 25 bp, Rattus norvegicus
gttcctacatagaggcatgccatct

SEQ ID NO: 525463 - DNA, 25 bp, Rattus norvegicus
gttcctacatagtggcatgccatct

SEQ ID NO: 525464 - DNA, 25 bp, Rattus norvegicus
gttcctacctggagaatctacacgt

SEQ ID NO: 525465 - DNA, 25 bp, Rattus norvegicus
gttcctacctggtgaatctacacgt

SEQ ID NO: 525466 - DNA, 25 bp, Rattus norvegicus
gttcctactgtgaaggcacctttga

SEQ ID NO: 525467 - DNA, 25 bp, Rattus norvegicus
gttcctactgtgtaggcacctttga

SEQ ID NO: 525468 - DNA, 25 bp, Rattus norvegicus
gttcctagaatgcagctgaagacct

SEQ ID NO: 525469 - DNA, 25 bp, Rattus norvegicus
gttcctagaatggagctgaagacct

SEQ ID NO: 525470 - DNA, 25 bp, Rattus norvegicus
gttcctagactccttcaatctgaaa

SEQ ID NO: 525471 - DNA, 25 bp, Rattus norvegicus
gttcctagactcgttcaatctgaaa

SEQ ID NO: 525472 - DNA, 25 bp, Rattus norvegicus
gttcctagccctagtttgcactaaa

SEQ ID NO: 525473 - DNA, 25 bp, Rattus norvegicus
gttcctagcccttgtttgcactaaa

SEQ ID NO: 525474 - DNA, 25 bp, Rattus norvegicus
gttcctagcttcactgctggcaggg

SEQ ID NO: 525475 - DNA, 25 bp, Rattus norvegicus
gttcctagcttctctgctggcaggg

SEQ ID NO: 525476 - DNA, 25 bp, Rattus norvegicus
gttcctaggtaaactctgggatgtg

SEQ ID NO: 525477 - DNA, 25 bp, Rattus norvegicus
gttcctaggtaatctctgggatgtg

SEQ ID NO: 525478 - DNA, 25 bp, Rattus norvegicus
gttcctaggtgactaacagaattgg

SEQ ID NO: 525479 - DNA, 25 bp, Rattus norvegicus
gttcctaggtgagtaacagaattgg

SEQ ID NO: 525480 - DNA, 25 bp, Rattus norvegicus
gttcctatcctacctgaacagcaca

SEQ ID NO: 525481 - DNA, 25 bp, Rattus norvegicus
gttcctatcctagctgaacagcaca

SEQ ID NO: 525482 - DNA, 25 bp, Rattus norvegicus
gttcctatgatcaggctgtgtgact

SEQ ID NO: 525483 - DNA, 25 bp, Rattus norvegicus
gttcctatgatctggctgtgtgact

SEQ ID NO: 525484 - DNA, 25 bp, Rattus norvegicus
gttcctatgctaagcaggctctctg

SEQ ID NO: 525485 - DNA, 25 bp, Rattus norvegicus
gttcctatgctactgtggctgtgag

SEQ ID NO: 525486 - DNA, 25 bp, Rattus norvegicus
gttcctatgctagtgtggctgtgag

SEQ ID NO: 525487 - DNA, 25 bp, Rattus norvegicus
gttcctatgctatgcaggctctctg

SEQ ID NO: 525488 - DNA, 25 bp, Rattus norvegicus
gttcctatgctgagacacttccgtg

SEQ ID NO: 525489 - DNA, 25 bp, Rattus norvegicus
gttcctatgctgtgacacttccgtg

SEQ ID NO: 525490 - DNA, 25 bp, Rattus norvegicus
gttcctatggaaacactgtgtattg

SEQ ID NO: 525491 - DNA, 25 bp, Rattus norvegicus
gttcctatggaatcactgtgtattg

SEQ ID NO: 525492 - DNA, 25 bp, Rattus norvegicus
gttcctattacgagagctcttttgc

SEQ ID NO: 525493 - DNA, 25 bp, Rattus norvegicus
gttcctattacgtgagctcttttgc

SEQ ID NO: 525494 - DNA, 25 bp, Rattus norvegicus
gttcctatttctatgctgtcagctg

SEQ ID NO: 525495 - DNA, 25 bp, Rattus norvegicus
gttcctatttctttgctgtcagctg

SEQ ID NO: 525496 - DNA, 25 bp, Rattus norvegicus
gttcctatttttctatgttctactc

SEQ ID NO: 525497 - DNA, 25 bp, Rattus norvegicus
gttcctatttttgtatgttctactc

SEQ ID NO: 525498 - DNA, 25 bp, Rattus norvegicus
gttcctcaaagaaagaaggccacgc

SEQ ID NO: 525499 - DNA, 25 bp, Rattus norvegicus
gttcctcaaagatagaaggccacgc

SEQ ID NO: 525500 - DNA, 25 bp, Rattus norvegicus
gttcctcaacatattcagtggtatc

SEQ ID NO: 525501 - DNA, 25 bp, Rattus norvegicus
gttcctcaacattttcagtggtatc

SEQ ID NO: 525502 - DNA, 25 bp, Rattus norvegicus
gttcctcaacccacaacagtgctga

SEQ ID NO: 525503 - DNA, 25 bp, Rattus norvegicus
gttcctcaaccctcaacagtgctga

SEQ ID NO: 525504 - DNA, 25 bp, Rattus norvegicus
gttcctcaactcaagtgcctaaaag

SEQ ID NO: 525505 - DNA, 25 bp, Rattus norvegicus
gttcctcaactctagtgcctaaaag

SEQ ID NO: 525506 - DNA, 25 bp, Rattus norvegicus
gttcctcacctcagatatagagtct

SEQ ID NO: 525507 - DNA, 25 bp, Rattus norvegicus
gttcctcacctctgatatagagtct

SEQ ID NO: 525508 - DNA, 25 bp, Rattus norvegicus
gttcctcacttcctctagggagaaa

SEQ ID NO: 525509 - DNA, 25 bp, Rattus norvegicus
gttcctcacttcgtctagggagaaa

SEQ ID NO: 525510 - DNA, 25 bp, Rattus norvegicus
gttcctcagaagaaagtcccttatg

SEQ ID NO: 525511 - DNA, 25 bp, Rattus norvegicus
gttcctcagaagtaagtcccttatg

SEQ ID NO: 525512 - DNA, 25 bp, Rattus norvegicus
gttcctcagcaacaacgtagtgtca

SEQ ID NO: 525513 - DNA, 25 bp, Rattus norvegicus
gttcctcagcaagaacgtagtgtca

SEQ ID NO: 525514 - DNA, 25 bp, Rattus norvegicus
gttcctcagccacagtgatgcatga

SEQ ID NO: 525515 - DNA, 25 bp, Rattus norvegicus
gttcctcagccagagtgatgcatga

SEQ ID NO: 525516 - DNA, 25 bp, Rattus norvegicus
gttcctcagctgaaatctttccaga

SEQ ID NO: 525517 - DNA, 25 bp, Rattus norvegicus
gttcctcagctgtaatctttccaga

SEQ ID NO: 525518 - DNA, 25 bp, Rattus norvegicus
gttcctcagtagacatgtaacttaa

SEQ ID NO: 525519 - DNA, 25 bp, Rattus norvegicus
gttcctcagtagtcatgtaacttaa

SEQ ID NO: 525520 - DNA, 25 bp, Rattus norvegicus
gttcctcatatcatcctagtgttgt

SEQ ID NO: 525521 - DNA, 25 bp, Rattus norvegicus
gttcctcatatcttcctagtgttgt

SEQ ID NO: 525522 - DNA, 25 bp, Rattus norvegicus
gttcctcatattaattccagtctgg

SEQ ID NO: 525523 - DNA, 25 bp, Rattus norvegicus
gttcctcatatttattccagtctgg

SEQ ID NO: 525524 - DNA, 25 bp, Rattus norvegicus
gttcctcatccacatgtggctattg

SEQ ID NO: 525525 - DNA, 25 bp, Rattus norvegicus
gttcctcatccagatgtggctattg

SEQ ID NO: 525526 - DNA, 25 bp, Rattus norvegicus
gttcctcatgccatggtgaccttaa

SEQ ID NO: 525527 - DNA, 25 bp, Rattus norvegicus
gttcctcatgccttggtgaccttaa

SEQ ID NO: 525528 - DNA, 25 bp, Rattus norvegicus
gttcctcatggaccactggctgtgg

SEQ ID NO: 525529 - DNA, 25 bp, Rattus norvegicus
gttcctcatggagcactggctgtgg

SEQ ID NO: 525530 - DNA, 25 bp, Rattus norvegicus
gttcctcatgttctcacatcctcag

SEQ ID NO: 525531 - DNA, 25 bp, Rattus norvegicus
gttcctcatgttgtcacatcctcag

SEQ ID NO: 525532 - DNA, 25 bp, Rattus norvegicus
gttcctcatttgactttctcgtttg

SEQ ID NO: 525533 - DNA, 25 bp, Rattus norvegicus
gttcctcatttgtctttctcgtttg

SEQ ID NO: 525534 - DNA, 25 bp, Rattus norvegicus
gttcctccaaataagcattagactg

SEQ ID NO: 525535 - DNA, 25 bp, Rattus norvegicus
gttcctccaaattagcattagactg

SEQ ID NO: 525536 - DNA, 25 bp, Rattus norvegicus
gttcctccaagtcaaacggctgttt

SEQ ID NO: 525537 - DNA, 25 bp, Rattus norvegicus
gttcctccaagtgaaacggctgttt

SEQ ID NO: 525538 - DNA, 25 bp, Rattus norvegicus
gttcctccaataacccttgtatgat

SEQ ID NO: 525539 - DNA, 25 bp, Rattus norvegicus
gttcctccaatatcccttgtatgat

SEQ ID NO: 525540 - DNA, 25 bp, Rattus norvegicus
gttcctccacatacactatggacag

SEQ ID NO: 525541 - DNA, 25 bp, Rattus norvegicus
gttcctccacattcactatggacag

SEQ ID NO: 525542 - DNA, 25 bp, Rattus norvegicus
gttcctccacccaaagtcagataaa

SEQ ID NO: 525543 - DNA, 25 bp, Rattus norvegicus
gttcctccaccctaagtcagataaa

SEQ ID NO: 525544 - DNA, 25 bp, Rattus norvegicus
gttcctccacttattaatattactg

SEQ ID NO: 525545 - DNA, 25 bp, Rattus norvegicus
gttcctccactttttaatattactg

SEQ ID NO: 525546 - DNA, 25 bp, Rattus norvegicus
gttcctccagtgaactcagacatga

SEQ ID NO: 525547 - DNA, 25 bp, Rattus norvegicus
gttcctccagtgtactcagacatga

SEQ ID NO: 525548 - DNA, 25 bp, Rattus norvegicus
gttcctccatttctgctaatttgtt

SEQ ID NO: 525549 - DNA, 25 bp, Rattus norvegicus
gttcctccatttgtgctaatttgtt

SEQ ID NO: 525550 - DNA, 25 bp, Rattus norvegicus
gttcctcccaagactctagggaaat

SEQ ID NO: 525551 - DNA, 25 bp, Rattus norvegicus
gttcctcccaagtctctagggaaat

SEQ ID NO: 525552 - DNA, 25 bp, Rattus norvegicus
gttcctccccgaagagcggtgtggc

SEQ ID NO: 525553 - DNA, 25 bp, Rattus norvegicus
gttcctccccgatgagcggtgtggc

SEQ ID NO: 525554 - DNA, 25 bp, Rattus norvegicus
gttcctcccctcaaattctgggatt

SEQ ID NO: 525555 - DNA, 25 bp, Rattus norvegicus
gttcctcccctctaattctgggatt

SEQ ID NO: 525556 - DNA, 25 bp, Rattus norvegicus
gttcctcccttcaatacagtaacag

SEQ ID NO: 525557 - DNA, 25 bp, Rattus norvegicus
gttcctcccttctatacagtaacag

SEQ ID NO: 525558 - DNA, 25 bp, Rattus norvegicus
gttcctcccttgacaacagtggaaa

SEQ ID NO: 525559 - DNA, 25 bp, Rattus norvegicus
gttcctcccttgtcaacagtggaaa

SEQ ID NO: 525560 - DNA, 25 bp, Rattus norvegicus
gttcctccgggacatgcctgaaaag

SEQ ID NO: 525561 - DNA, 25 bp, Rattus norvegicus
gttcctccgggagatgcctgaaaag

SEQ ID NO: 525562 - DNA, 25 bp, Rattus norvegicus
gttcctccgtggcttgagagtcatg

SEQ ID NO: 525563 - DNA, 25 bp, Rattus norvegicus
gttcctccgtgggttgagagtcatg

SEQ ID NO: 525564 - DNA, 25 bp, Rattus norvegicus
gttcctcctacaaccaatagtgtgt

SEQ ID NO: 525565 - DNA, 25 bp, Rattus norvegicus
gttcctcctacatccaatagtgtgt

SEQ ID NO: 525566 - DNA, 25 bp, Rattus norvegicus
gttcctcctccgaaagcagagctga

SEQ ID NO: 525567 - DNA, 25 bp, Rattus norvegicus
gttcctcctccgtaagcagagctga

SEQ ID NO: 525568 - DNA, 25 bp, Rattus norvegicus
gttcctccttggagacgatattagc

SEQ ID NO: 525569 - DNA, 25 bp, Rattus norvegicus
gttcctccttggtgacgatattagc

SEQ ID NO: 525570 - DNA, 25 bp, Rattus norvegicus
gttcctccttgtctttctaatcttt

SEQ ID NO: 525571 - DNA, 25 bp, Rattus norvegicus
gttcctccttgtgtttctaatcttt

SEQ ID NO: 525572 - DNA, 25 bp, Rattus norvegicus
gttcctccttttcgtatttctcaag

SEQ ID NO: 525573 - DNA, 25 bp, Rattus norvegicus
gttcctccttttggtatttctcaag

SEQ ID NO: 525574 - DNA, 25 bp, Rattus norvegicus
gttcctcgaattccagctgaagcta

SEQ ID NO: 525575 - DNA, 25 bp, Rattus norvegicus
gttcctcgaattgcagctgaagcta

SEQ ID NO: 525576 - DNA, 25 bp, Rattus norvegicus
gttcctctagttccagctttgagaa

SEQ ID NO: 525577 - DNA, 25 bp, Rattus norvegicus
gttcctctagttgcagctttgagaa

SEQ ID NO: 525578 - DNA, 25 bp, Rattus norvegicus
gttcctctatagagagcctctaaga

SEQ ID NO: 525579 - DNA, 25 bp, Rattus norvegicus
gttcctctatagtgagcctctaaga

SEQ ID NO: 525580 - DNA, 25 bp, Rattus norvegicus
gttcctctatttccttgcctaaagg

SEQ ID NO: 525581 - DNA, 25 bp, Rattus norvegicus
gttcctctatttgcttgcctaaagg

SEQ ID NO: 525582 - DNA, 25 bp, Rattus norvegicus
gttcctctcaacagtgatacgtcag

SEQ ID NO: 525583 - DNA, 25 bp, Rattus norvegicus
gttcctctcaactgtgatacgtcag

SEQ ID NO: 525584 - DNA, 25 bp, Rattus norvegicus
gttcctctcagaagtgatcttgttc

SEQ ID NO: 525585 - DNA, 25 bp, Rattus norvegicus
gttcctctcagatgtgatcttgttc

SEQ ID NO: 525586 - DNA, 25 bp, Rattus norvegicus
gttcctctcaggaatctgtaacttt

SEQ ID NO: 525587 - DNA, 25 bp, Rattus norvegicus
gttcctctcaggataacttccgtgg

SEQ ID NO: 525588 - DNA, 25 bp, Rattus norvegicus
gttcctctcaggtatctgtaacttt

SEQ ID NO: 525589 - DNA, 25 bp, Rattus norvegicus
gttcctctcaggttaacttccgtgg

SEQ ID NO: 525590 - DNA, 25 bp, Rattus norvegicus
gttcctctccaacaaacatttctat

SEQ ID NO: 525591 - DNA, 25 bp, Rattus norvegicus
gttcctctccaagaaacatttctat

SEQ ID NO: 525592 - DNA, 25 bp, Rattus norvegicus
gttcctctgaagcaaattctcggtg

SEQ ID NO: 525593 - DNA, 25 bp, Rattus norvegicus
gttcctctgaaggaaattctcggtg

SEQ ID NO: 525594 - DNA, 25 bp, Rattus norvegicus
gttcctctgactctcaactaaagtt

SEQ ID NO: 525595 - DNA, 25 bp, Rattus norvegicus
gttcctctgactgtcaactaaagtt

SEQ ID NO: 525596 - DNA, 25 bp, Rattus norvegicus
gttcctctgagtcgtattagtaatt

SEQ ID NO: 525597 - DNA, 25 bp, Rattus norvegicus
gttcctctgagtggtattagtaatt

SEQ ID NO: 525598 - DNA, 25 bp, Rattus norvegicus
gttcctctgcacatttgattttgat

SEQ ID NO: 525599 - DNA, 25 bp, Rattus norvegicus
gttcctctgcacttttgattttgat

SEQ ID NO: 525600 - DNA, 25 bp, Rattus norvegicus
gttcctctgccaacgttcatatgga

SEQ ID NO: 525601 - DNA, 25 bp, Rattus norvegicus
gttcctctgccatcgttcatatgga

SEQ ID NO: 525602 - DNA, 25 bp, Rattus norvegicus
gttcctctggaacgtgtccgtcatc

SEQ ID NO: 525603 - DNA, 25 bp, Rattus norvegicus
gttcctctggaaggtgtccgtcatc

SEQ ID NO: 525604 - DNA, 25 bp, Rattus norvegicus
gttcctctggagaggagattcccaa

SEQ ID NO: 525605 - DNA, 25 bp, Rattus norvegicus
gttcctctggagtggagattcccaa

SEQ ID NO: 525606 - DNA, 25 bp, Rattus norvegicus
gttcctcttattagtggcacttgta

SEQ ID NO: 525607 - DNA, 25 bp, Rattus norvegicus
gttcctcttatttgtggcacttgta

SEQ ID NO: 525608 - DNA, 25 bp, Rattus norvegicus
gttcctcttgccagcaaaaatgcca

SEQ ID NO: 525609 - DNA, 25 bp, Rattus norvegicus
gttcctcttgcctgcaaaaatgcca

SEQ ID NO: 525610 - DNA, 25 bp, Rattus norvegicus
gttcctcttgctataatctcgtcaa

SEQ ID NO: 525611 - DNA, 25 bp, Rattus norvegicus
gttcctcttgctttaatctcgtcaa

SEQ ID NO: 525612 - DNA, 25 bp, Rattus norvegicus
gttcctctttgacatctccttggtg

SEQ ID NO: 525613 - DNA, 25 bp, Rattus norvegicus
gttcctctttgagatctccttggtg

SEQ ID NO: 525614 - DNA, 25 bp, Rattus norvegicus
gttcctctttggatgagcgtttggg

SEQ ID NO: 525615 - DNA, 25 bp, Rattus norvegicus
gttcctctttggttgagcgtttggg

SEQ ID NO: 525616 - DNA, 25 bp, Rattus norvegicus
gttcctgaaaacatgactggtgtat

SEQ ID NO: 525617 - DNA, 25 bp, Rattus norvegicus
gttcctgaaaacttgactggtgtat

SEQ ID NO: 525618 - DNA, 25 bp, Rattus norvegicus
gttcctgaaagtattatcttcattt

SEQ ID NO: 525619 - DNA, 25 bp, Rattus norvegicus
gttcctgaaagttttatcttcattt

SEQ ID NO: 525620 - DNA, 25 bp, Rattus norvegicus
gttcctgaactgagtagtcttcaaa

SEQ ID NO: 525621 - DNA, 25 bp, Rattus norvegicus
gttcctgaactgtgtagtcttcaaa

SEQ ID NO: 525622 - DNA, 25 bp, Rattus norvegicus
gttcctgaacttctccatgcatggt

SEQ ID NO: 525623 - DNA, 25 bp, Rattus norvegicus
gttcctgaacttgtccatgcatggt

SEQ ID NO: 525624 - DNA, 25 bp, Rattus norvegicus
gttcctgaagcaacctgactgggca

SEQ ID NO: 525625 - DNA, 25 bp, Rattus norvegicus
gttcctgaagcatcctgactgggca

SEQ ID NO: 525626 - DNA, 25 bp, Rattus norvegicus
gttcctgaagccactgcagggcaga

SEQ ID NO: 525627 - DNA, 25 bp, Rattus norvegicus
gttcctgaagcctctgcagggcaga

SEQ ID NO: 525628 - DNA, 25 bp, Rattus norvegicus
gttcctgaagctatcttgctcatgt

SEQ ID NO: 525629 - DNA, 25 bp, Rattus norvegicus
gttcctgaagctttcttgctcatgt

SEQ ID NO: 525630 - DNA, 25 bp, Rattus norvegicus
gttcctgaagtcatcctctcaaaag

SEQ ID NO: 525631 - DNA, 25 bp, Rattus norvegicus
gttcctgaagtcttcctctcaaaag

SEQ ID NO: 525632 - DNA, 25 bp, Rattus norvegicus
gttcctgaagttctcgggccatgta

SEQ ID NO: 525633 - DNA, 25 bp, Rattus norvegicus
gttcctgaagttgtcgggccatgta

SEQ ID NO: 525634 - DNA, 25 bp, Rattus norvegicus
gttcctgaatgtacagtgttgcacg

SEQ ID NO: 525635 - DNA, 25 bp, Rattus norvegicus
gttcctgaatgttcagtgttgcacg

SEQ ID NO: 525636 - DNA, 25 bp, Rattus norvegicus
gttcctgacactctcattaacctga

SEQ ID NO: 525637 - DNA, 25 bp, Rattus norvegicus
gttcctgacactgtcattaacctga

SEQ ID NO: 525638 - DNA, 25 bp, Rattus norvegicus
gttcctgacttccagacactgttct

SEQ ID NO: 525639 - DNA, 25 bp, Rattus norvegicus
gttcctgacttcgagacactgttct

SEQ ID NO: 525640 - DNA, 25 bp, Rattus norvegicus
gttcctgagaccagctacatgtatg

SEQ ID NO: 525641 - DNA, 25 bp, Rattus norvegicus
gttcctgagacctgctacatgtatg

SEQ ID NO: 525642 - DNA, 25 bp, Rattus norvegicus
gttcctgagatcctgaggttgcctt

SEQ ID NO: 525643 - DNA, 25 bp, Rattus norvegicus
gttcctgagatcgtgaggttgcctt

SEQ ID NO: 525644 - DNA, 25 bp, Rattus norvegicus
gttcctgagcaaacactttaccaac

SEQ ID NO: 525645 - DNA, 25 bp, Rattus norvegicus
gttcctgagcaatcactttaccaac

SEQ ID NO: 525646 - DNA, 25 bp, Rattus norvegicus
gttcctgagcccagaaaaaccaaca

SEQ ID NO: 525647 - DNA, 25 bp, Rattus norvegicus
gttcctgagccctgaaaaaccaaca

SEQ ID NO: 525648 - DNA, 25 bp, Rattus norvegicus
gttcctgagcctccaagtgtgagca

SEQ ID NO: 525649 - DNA, 25 bp, Rattus norvegicus
gttcctgagcctgcaagtgtgagca

SEQ ID NO: 525650 - DNA, 25 bp, Rattus norvegicus
gttcctgaggaaatttcagctccgc

SEQ ID NO: 525651 - DNA, 25 bp, Rattus norvegicus
gttcctgaggaattttcagctccgc

SEQ ID NO: 525652 - DNA, 25 bp, Rattus norvegicus
gttcctgaggcgacacgcagtggta

SEQ ID NO: 525653 - DNA, 25 bp, Rattus norvegicus
gttcctgaggcgtcacgcagtggta

SEQ ID NO: 525654 - DNA, 25 bp, Rattus norvegicus
gttcctgagtaactgcaaccctgag

SEQ ID NO: 525655 - DNA, 25 bp, Rattus norvegicus
gttcctgagtaagtgcaaccctgag

SEQ ID NO: 525656 - DNA, 25 bp, Rattus norvegicus
gttcctgagtgaacccagtctttca

SEQ ID NO: 525657 - DNA, 25 bp, Rattus norvegicus
gttcctgagtgatcccagtctttca

SEQ ID NO: 525658 - DNA, 25 bp, Rattus norvegicus
gttcctgatgcccatgtcaataagg

SEQ ID NO: 525659 - DNA, 25 bp, Rattus norvegicus
gttcctgatgccgatgtcaataagg

SEQ ID NO: 525660 - DNA, 25 bp, Rattus norvegicus
gttcctgatgtcaacgaggcctgta

SEQ ID NO: 525661 - DNA, 25 bp, Rattus norvegicus
gttcctgatgtctacgaggcctgta

SEQ ID NO: 525662 - DNA, 25 bp, Rattus norvegicus
gttcctgcaactaagaaaccttccg

SEQ ID NO: 525663 - DNA, 25 bp, Rattus norvegicus
gttcctgcaactccctgactggtta

SEQ ID NO: 525664 - DNA, 25 bp, Rattus norvegicus
gttcctgcaactgcctgactggtta

SEQ ID NO: 525665 - DNA, 25 bp, Rattus norvegicus
gttcctgcaacttagaaaccttccg

SEQ ID NO: 525666 - DNA, 25 bp, Rattus norvegicus
gttcctgcacccaagttctctctgt

SEQ ID NO: 525667 - DNA, 25 bp, Rattus norvegicus
gttcctgcaccctagttctctctgt

SEQ ID NO: 525668 - DNA, 25 bp, Rattus norvegicus
gttcctgcaggaagataaagaccca

SEQ ID NO: 525669 - DNA, 25 bp, Rattus norvegicus
gttcctgcaggatgataaagaccca

SEQ ID NO: 525670 - DNA, 25 bp, Rattus norvegicus
gttcctgcagttacaattgctggac

SEQ ID NO: 525671 - DNA, 25 bp, Rattus norvegicus
gttcctgcagtttcaattgctggac

SEQ ID NO: 525672 - DNA, 25 bp, Rattus norvegicus
gttcctgcattaactttccatgttc

SEQ ID NO: 525673 - DNA, 25 bp, Rattus norvegicus
gttcctgcattatctttccatgttc

SEQ ID NO: 525674 - DNA, 25 bp, Rattus norvegicus
gttcctgcattcagagaagtgagtc

SEQ ID NO: 525675 - DNA, 25 bp, Rattus norvegicus
gttcctgcattctgagaagtgagtc

SEQ ID NO: 525676 - DNA, 25 bp, Rattus norvegicus
gttcctgcctgcacttgactcggac

SEQ ID NO: 525677 - DNA, 25 bp, Rattus norvegicus
gttcctgcctgctcttgactcggac

SEQ ID NO: 525678 - DNA, 25 bp, Rattus norvegicus
gttcctgccttgacctaatgcaata

SEQ ID NO: 525679 - DNA, 25 bp, Rattus norvegicus
gttcctgccttgtcctaatgcaata

SEQ ID NO: 525680 - DNA, 25 bp, Rattus norvegicus
gttcctgcctttccacatgagcaag

SEQ ID NO: 525681 - DNA, 25 bp, Rattus norvegicus
gttcctgcctttgcacatgagcaag

SEQ ID NO: 525682 - DNA, 25 bp, Rattus norvegicus
gttcctgcgaagagtgtccgcctcg

SEQ ID NO: 525683 - DNA, 25 bp, Rattus norvegicus
gttcctgcgaagtgtgtccgcctcg

SEQ ID NO: 525684 - DNA, 25 bp, Rattus norvegicus
gttcctgcggataaaaactgtgtat

SEQ ID NO: 525685 - DNA, 25 bp, Rattus norvegicus
gttcctgcggattaaaactgtgtat

SEQ ID NO: 525686 - DNA, 25 bp, Rattus norvegicus
gttcctgctaggaccctgcagagga

SEQ ID NO: 525687 - DNA, 25 bp, Rattus norvegicus
gttcctgctaggtccctgcagagga

SEQ ID NO: 525688 - DNA, 25 bp, Rattus norvegicus
gttcctgctcagagtaatatgtttt

SEQ ID NO: 525689 - DNA, 25 bp, Rattus norvegicus
gttcctgctcagtgtaatatgtttt

SEQ ID NO: 525690 - DNA, 25 bp, Rattus norvegicus
gttcctgctccactactatctgaga

SEQ ID NO: 525691 - DNA, 25 bp, Rattus norvegicus
gttcctgctccagtactatctgaga

SEQ ID NO: 525692 - DNA, 25 bp, Rattus norvegicus
gttcctgctgtactccaaatacaag

SEQ ID NO: 525693 - DNA, 25 bp, Rattus norvegicus
gttcctgctgtagtccaaatacaag

SEQ ID NO: 525694 - DNA, 25 bp, Rattus norvegicus
gttcctgctgttatttatccccgaa

SEQ ID NO: 525695 - DNA, 25 bp, Rattus norvegicus
gttcctgctgttttttatccccgaa

SEQ ID NO: 525696 - DNA, 25 bp, Rattus norvegicus
gttcctgcttctactgtgaatactg

SEQ ID NO: 525697 - DNA, 25 bp, Rattus norvegicus
gttcctgcttcttctgtgaatactg

SEQ ID NO: 525698 - DNA, 25 bp, Rattus norvegicus
gttcctggacagactacatatattc

SEQ ID NO: 525699 - DNA, 25 bp, Rattus norvegicus
gttcctggacagtctacatatattc

SEQ ID NO: 525700 - DNA, 25 bp, Rattus norvegicus
gttcctggactcagggctacagaga

SEQ ID NO: 525701 - DNA, 25 bp, Rattus norvegicus
gttcctggactctgggctacagaga

SEQ ID NO: 525702 - DNA, 25 bp, Rattus norvegicus
gttcctggactgagccaatctgtga

SEQ ID NO: 525703 - DNA, 25 bp, Rattus norvegicus
gttcctggactgtgccaatctgtga

SEQ ID NO: 525704 - DNA, 25 bp, Rattus norvegicus
gttcctggagtgcaactctcctttc

SEQ ID NO: 525705 - DNA, 25 bp, Rattus norvegicus
gttcctggagtggaactctcctttc

SEQ ID NO: 525706 - DNA, 25 bp, Rattus norvegicus
gttcctggatataaagccacctact

SEQ ID NO: 525707 - DNA, 25 bp, Rattus norvegicus
gttcctggatattaagccacctact

SEQ ID NO: 525708 - DNA, 25 bp, Rattus norvegicus
gttcctggattcaggaactgcaact

SEQ ID NO: 525709 - DNA, 25 bp, Rattus norvegicus
gttcctggattctggaactgcaact

SEQ ID NO: 525710 - DNA, 25 bp, Rattus norvegicus
gttcctggcaacactcaagaatctt

SEQ ID NO: 525711 - DNA, 25 bp, Rattus norvegicus
gttcctggcaactctcaagaatctt

SEQ ID NO: 525712 - DNA, 25 bp, Rattus norvegicus
gttcctggccagaggattgtatgtg

SEQ ID NO: 525713 - DNA, 25 bp, Rattus norvegicus
gttcctggccagtggattgtatgtg

SEQ ID NO: 525714 - DNA, 25 bp, Rattus norvegicus
gttcctggccgaactggacaacata

SEQ ID NO: 525715 - DNA, 25 bp, Rattus norvegicus
gttcctggccgatctggacaacata

SEQ ID NO: 525716 - DNA, 25 bp, Rattus norvegicus
gttcctgggaagctctaatttgcat

SEQ ID NO: 525717 - DNA, 25 bp, Rattus norvegicus
gttcctgggaaggtctaatttgcat

SEQ ID NO: 525718 - DNA, 25 bp, Rattus norvegicus
gttcctgggagacactagcggctta

SEQ ID NO: 525719 - DNA, 25 bp, Rattus norvegicus
gttcctgggagagactagcggctta

SEQ ID NO: 525720 - DNA, 25 bp, Rattus norvegicus
gttcctgggcacaaggacttaattt

SEQ ID NO: 525721 - DNA, 25 bp, Rattus norvegicus
gttcctgggcactaggacttaattt

SEQ ID NO: 525722 - DNA, 25 bp, Rattus norvegicus
gttcctgggcgtaacccaagttctg

SEQ ID NO: 525723 - DNA, 25 bp, Rattus norvegicus
gttcctgggcgttacccaagttctg

SEQ ID NO: 525724 - DNA, 25 bp, Rattus norvegicus
gttcctggttccatctcctgctgtt

SEQ ID NO: 525725 - DNA, 25 bp, Rattus norvegicus
gttcctggttccttctcctgctgtt

SEQ ID NO: 525726 - DNA, 25 bp, Rattus norvegicus
gttcctggttttctacggaccatgc

SEQ ID NO: 525727 - DNA, 25 bp, Rattus norvegicus
gttcctggttttgtacggaccatgc

SEQ ID NO: 525728 - DNA, 25 bp, Rattus norvegicus
gttcctgtacagctctttagtgaat

SEQ ID NO: 525729 - DNA, 25 bp, Rattus norvegicus
gttcctgtacaggtctttagtgaat

SEQ ID NO: 525730 - DNA, 25 bp, Rattus norvegicus
gttcctgtactcattttattccaaa

SEQ ID NO: 525731 - DNA, 25 bp, Rattus norvegicus
gttcctgtactctttttattccaaa

SEQ ID NO: 525732 - DNA, 25 bp, Rattus norvegicus
gttcctgtagcaccttaaactttca

SEQ ID NO: 525733 - DNA, 25 bp, Rattus norvegicus
gttcctgtagcagcttaaactttca

SEQ ID NO: 525734 - DNA, 25 bp, Rattus norvegicus
gttcctgtcacaaaggtcccaatac

SEQ ID NO: 525735 - DNA, 25 bp, Rattus norvegicus
gttcctgtcacataggtcccaatac

SEQ ID NO: 525736 - DNA, 25 bp, Rattus norvegicus
gttcctgtcagccactattttatga

SEQ ID NO: 525737 - DNA, 25 bp, Rattus norvegicus
gttcctgtcagcgactattttatga

SEQ ID NO: 525738 - DNA, 25 bp, Rattus norvegicus
gttcctgtcagtatcattgtttaaa

SEQ ID NO: 525739 - DNA, 25 bp, Rattus norvegicus
gttcctgtcagtttcattgtttaaa

SEQ ID NO: 525740 - DNA, 25 bp, Rattus norvegicus
gttcctgtcatcaacactatgtgtg

SEQ ID NO: 525741 - DNA, 25 bp, Rattus norvegicus
gttcctgtcatctacactatgtgtg

SEQ ID NO: 525742 - DNA, 25 bp, Rattus norvegicus
gttcctgtgaaaagttgatctctgt

SEQ ID NO: 525743 - DNA, 25 bp, Rattus norvegicus
gttcctgtgaaatgttgatctctgt

SEQ ID NO: 525744 - DNA, 25 bp, Rattus norvegicus
gttcctgtgaccatgtgtgctggca

SEQ ID NO: 525745 - DNA, 25 bp, Rattus norvegicus
gttcctgtgaccttgtgtgctggca

SEQ ID NO: 525746 - DNA, 25 bp, Rattus norvegicus
gttcctgtgcacagctttaaactcc

SEQ ID NO: 525747 - DNA, 25 bp, Rattus norvegicus
gttcctgtgcactgctttaaactcc

SEQ ID NO: 525748 - DNA, 25 bp, Rattus norvegicus
gttcctgtgccaagactgcctgaat

SEQ ID NO: 525749 - DNA, 25 bp, Rattus norvegicus
gttcctgtgccatgactgcctgaat

SEQ ID NO: 525750 - DNA, 25 bp, Rattus norvegicus
gttcctgtgcccagtttccaaaatt

SEQ ID NO: 525751 - DNA, 25 bp, Rattus norvegicus
gttcctgtgccctgtttccaaaatt

SEQ ID NO: 525752 - DNA, 25 bp, Rattus norvegicus
gttcctgtggctatgcactttgtaa

SEQ ID NO: 525753 - DNA, 25 bp, Rattus norvegicus
gttcctgtggctttgcactttgtaa

SEQ ID NO: 525754 - DNA, 25 bp, Rattus norvegicus
gttcctgtgtatactcactgggatt

SEQ ID NO: 525755 - DNA, 25 bp, Rattus norvegicus
gttcctgtgtatcctcgtttgtaca

SEQ ID NO: 525756 - DNA, 25 bp, Rattus norvegicus
gttcctgtgtatgctcgtttgtaca

SEQ ID NO: 525757 - DNA, 25 bp, Rattus norvegicus
gttcctgtgtattctcactgggatt

SEQ ID NO: 525758 - DNA, 25 bp, Rattus norvegicus
gttcctgtgtccagtgcctgaaaag

SEQ ID NO: 525759 - DNA, 25 bp, Rattus norvegicus
gttcctgtgtcctgtgcctgaaaag

SEQ ID NO: 525760 - DNA, 25 bp, Rattus norvegicus
gttcctgtgtggatgggatacgcat

SEQ ID NO: 525761 - DNA, 25 bp, Rattus norvegicus
gttcctgtgtggttgggatacgcat

SEQ ID NO: 525762 - DNA, 25 bp, Rattus norvegicus
gttcctgtgttcctgcttatgaaga

SEQ ID NO: 525763 - DNA, 25 bp, Rattus norvegicus
gttcctgtgttcgtgcttatgaaga

SEQ ID NO: 525764 - DNA, 25 bp, Rattus norvegicus
gttcctgttcacatcagcatggatt

SEQ ID NO: 525765 - DNA, 25 bp, Rattus norvegicus
gttcctgttcaccttatctattgtt

SEQ ID NO: 525766 - DNA, 25 bp, Rattus norvegicus
gttcctgttcacgttatctattgtt

SEQ ID NO: 525767 - DNA, 25 bp, Rattus norvegicus
gttcctgttcacttcagcatggatt

SEQ ID NO: 525768 - DNA, 25 bp, Rattus norvegicus
gttcctgttcagcaagggcaccaag

SEQ ID NO: 525769 - DNA, 25 bp, Rattus norvegicus
gttcctgttcaggaagggcaccaag

SEQ ID NO: 525770 - DNA, 25 bp, Rattus norvegicus
gttcctgttgtgctcttgtaaaaga

SEQ ID NO: 525771 - DNA, 25 bp, Rattus norvegicus
gttcctgttgtggtcttgtaaaaga

SEQ ID NO: 525772 - DNA, 25 bp, Rattus norvegicus
gttcctgtttaaacagtcaggccat

SEQ ID NO: 525773 - DNA, 25 bp, Rattus norvegicus
gttcctgtttaacgacagcctcttt

SEQ ID NO: 525774 - DNA, 25 bp, Rattus norvegicus
gttcctgtttaaggacagcctcttt

SEQ ID NO: 525775 - DNA, 25 bp, Rattus norvegicus
gttcctgtttaatcagtcaggccat

SEQ ID NO: 525776 - DNA, 25 bp, Rattus norvegicus
gttcctgtttatacatcttaccaaa

SEQ ID NO: 525777 - DNA, 25 bp, Rattus norvegicus
gttcctgtttattcatcttaccaaa

SEQ ID NO: 525778 - DNA, 25 bp, Rattus norvegicus
gttcctgttttgagacatctgcatt

SEQ ID NO: 525779 - DNA, 25 bp, Rattus norvegicus
gttcctgttttgtgacatctgcatt

SEQ ID NO: 525780 - DNA, 25 bp, Rattus norvegicus
gttccttaaaaacatgagcactata

SEQ ID NO: 525781 - DNA, 25 bp, Rattus norvegicus
gttccttaaaaagatgagcactata

SEQ ID NO: 525782 - DNA, 25 bp, Rattus norvegicus
gttccttaaaggctgacacttctga

SEQ ID NO: 525783 - DNA, 25 bp, Rattus norvegicus
gttccttaaagggtgacacttctga

SEQ ID NO: 525784 - DNA, 25 bp, Rattus norvegicus
gttccttaagctacattgacctggg

SEQ ID NO: 525785 - DNA, 25 bp, Rattus norvegicus
gttccttaagcttcattgacctggg

SEQ ID NO: 525786 - DNA, 25 bp, Rattus norvegicus
gttccttaatctccattgtcttagt

SEQ ID NO: 525787 - DNA, 25 bp, Rattus norvegicus
gttccttaatctgcattgtcttagt

SEQ ID NO: 525788 - DNA, 25 bp, Rattus norvegicus
gttccttacaacagtcccttgaaag

SEQ ID NO: 525789 - DNA, 25 bp, Rattus norvegicus
gttccttacaactgtcccttgaaag

SEQ ID NO: 525790 - DNA, 25 bp, Rattus norvegicus
gttccttacactaccaacgatatgg

SEQ ID NO: 525791 - DNA, 25 bp, Rattus norvegicus
gttccttacacttccaacgatatgg

SEQ ID NO: 525792 - DNA, 25 bp, Rattus norvegicus
gttccttacgagaatcgcctgcaac

SEQ ID NO: 525793 - DNA, 25 bp, Rattus norvegicus
gttccttacgagtatcgcctgcaac

SEQ ID NO: 525794 - DNA, 25 bp, Rattus norvegicus
gttccttacgttaacagccctggag

SEQ ID NO: 525795 - DNA, 25 bp, Rattus norvegicus
gttccttacgtttacagccctggag

SEQ ID NO: 525796 - DNA, 25 bp, Rattus norvegicus
gttccttagagaattttggccctgt

SEQ ID NO: 525797 - DNA, 25 bp, Rattus norvegicus
gttccttagagatttttggccctgt

SEQ ID NO: 525798 - DNA, 25 bp, Rattus norvegicus
gttccttagcatatagttaaacatg

SEQ ID NO: 525799 - DNA, 25 bp, Rattus norvegicus
gttccttagcatttagttaaacatg

SEQ ID NO: 525800 - DNA, 25 bp, Rattus norvegicus
gttccttagctaacctagggacctg

SEQ ID NO: 525801 - DNA, 25 bp, Rattus norvegicus
gttccttagctatcctagggacctg

SEQ ID NO: 525802 - DNA, 25 bp, Rattus norvegicus
gttccttaggatattacctctgcag

SEQ ID NO: 525803 - DNA, 25 bp, Rattus norvegicus
gttccttaggattttacctctgcag

SEQ ID NO: 525804 - DNA, 25 bp, Rattus norvegicus
gttccttagggcaagtttgatcttt

SEQ ID NO: 525805 - DNA, 25 bp, Rattus norvegicus
gttccttagggcaatgactgtcttt

SEQ ID NO: 525806 - DNA, 25 bp, Rattus norvegicus
gttccttagggctagtttgatcttt

SEQ ID NO: 525807 - DNA, 25 bp, Rattus norvegicus
gttccttagggctatgactgtcttt

SEQ ID NO: 525808 - DNA, 25 bp, Rattus norvegicus
gttccttatattctcagcctctgaa

SEQ ID NO: 525809 - DNA, 25 bp, Rattus norvegicus
gttccttatattgtcagcctctgaa

SEQ ID NO: 525810 - DNA, 25 bp, Rattus norvegicus
gttccttatggaataaacctctttg

SEQ ID NO: 525811 - DNA, 25 bp, Rattus norvegicus
gttccttatggattaaacctctttg

SEQ ID NO: 525812 - DNA, 25 bp, Rattus norvegicus
gttccttcagctccggccaggcgga

SEQ ID NO: 525813 - DNA, 25 bp, Rattus norvegicus
gttccttcagctgcggccaggcgga

SEQ ID NO: 525814 - DNA, 25 bp, Rattus norvegicus
gttccttcaggaccgtcatcagaca

SEQ ID NO: 525815 - DNA, 25 bp, Rattus norvegicus
gttccttcaggacggctcaggcaaa

SEQ ID NO: 525816 - DNA, 25 bp, Rattus norvegicus
gttccttcaggagcgtcatcagaca

SEQ ID NO: 525817 - DNA, 25 bp, Rattus norvegicus
gttccttcaggagggctcaggcaaa

SEQ ID NO: 525818 - DNA, 25 bp, Rattus norvegicus
gttccttccaagattcaaaagcagg

SEQ ID NO: 525819 - DNA, 25 bp, Rattus norvegicus
gttccttccaagtttcaaaagcagg

SEQ ID NO: 525820 - DNA, 25 bp, Rattus norvegicus
gttccttccatacacgcatgccttg

SEQ ID NO: 525821 - DNA, 25 bp, Rattus norvegicus
gttccttccatagacgcatgccttg

SEQ ID NO: 525822 - DNA, 25 bp, Rattus norvegicus
gttccttccgtgaagcgtagtcata

SEQ ID NO: 525823 - DNA, 25 bp, Rattus norvegicus
gttccttccgtgtagcgtagtcata

SEQ ID NO: 525824 - DNA, 25 bp, Rattus norvegicus
gttccttcctcacagcaaaaacatg

SEQ ID NO: 525825 - DNA, 25 bp, Rattus norvegicus
gttccttcctcagagcaaaaacatg

SEQ ID NO: 525826 - DNA, 25 bp, Rattus norvegicus
gttccttcctgtagactttgaatag

SEQ ID NO: 525827 - DNA, 25 bp, Rattus norvegicus
gttccttcctgttgactttgaatag

SEQ ID NO: 525828 - DNA, 25 bp, Rattus norvegicus
gttccttccttcaatactgcatgag

SEQ ID NO: 525829 - DNA, 25 bp, Rattus norvegicus
gttccttccttctatactgcatgag

SEQ ID NO: 525830 - DNA, 25 bp, Rattus norvegicus
gttccttcctttagtctctgagctg

SEQ ID NO: 525831 - DNA, 25 bp, Rattus norvegicus
gttccttcctttctgtgtgtacatt

SEQ ID NO: 525832 - DNA, 25 bp, Rattus norvegicus
gttccttcctttgtgtgtgtacatt

SEQ ID NO: 525833 - DNA, 25 bp, Rattus norvegicus
gttccttccttttgtctctgagctg

SEQ ID NO: 525834 - DNA, 25 bp, Rattus norvegicus
gttccttcgaataaactatgacatg

SEQ ID NO: 525835 - DNA, 25 bp, Rattus norvegicus
gttccttcgaattaactatgacatg

SEQ ID NO: 525836 - DNA, 25 bp, Rattus norvegicus
gttccttctactcacaaccagttgt

SEQ ID NO: 525837 - DNA, 25 bp, Rattus norvegicus
gttccttctactgacaaccagttgt

SEQ ID NO: 525838 - DNA, 25 bp, Rattus norvegicus
gttccttctatcactcagagttcag

SEQ ID NO: 525839 - DNA, 25 bp, Rattus norvegicus
gttccttctatctctcagagttcag

SEQ ID NO: 525840 - DNA, 25 bp, Rattus norvegicus
gttccttctcaaccccagtgatata

SEQ ID NO: 525841 - DNA, 25 bp, Rattus norvegicus
gttccttctcaagcccagtgatata

SEQ ID NO: 525842 - DNA, 25 bp, Rattus norvegicus
gttccttcttggaaccggtcactca

SEQ ID NO: 525843 - DNA, 25 bp, Rattus norvegicus
gttccttcttggcttctgtccatga

SEQ ID NO: 525844 - DNA, 25 bp, Rattus norvegicus
gttccttcttgggttctgtccatga

SEQ ID NO: 525845 - DNA, 25 bp, Rattus norvegicus
gttccttcttggtaccggtcactca

SEQ ID NO: 525846 - DNA, 25 bp, Rattus norvegicus
gttccttgacaaatttgtccacatg

SEQ ID NO: 525847 - DNA, 25 bp, Rattus norvegicus
gttccttgacaattttgtccacatg

SEQ ID NO: 525848 - DNA, 25 bp, Rattus norvegicus
gttccttgacgaaggcgagcttgac

SEQ ID NO: 525849 - DNA, 25 bp, Rattus norvegicus
gttccttgacgatggcgagcttgac

SEQ ID NO: 525850 - DNA, 25 bp, Rattus norvegicus
gttccttgaggtatgcttttttgca

SEQ ID NO: 525851 - DNA, 25 bp, Rattus norvegicus
gttccttgaggtttgcttttttgca

SEQ ID NO: 525852 - DNA, 25 bp, Rattus norvegicus
gttccttgatctatgtgcttgggag

SEQ ID NO: 525853 - DNA, 25 bp, Rattus norvegicus
gttccttgatctttgtgcttgggag

SEQ ID NO: 525854 - DNA, 25 bp, Rattus norvegicus
gttccttgccctcttaccaatgaaa

SEQ ID NO: 525855 - DNA, 25 bp, Rattus norvegicus
gttccttgccctgttaccaatgaaa

SEQ ID NO: 525856 - DNA, 25 bp, Rattus norvegicus
gttccttgcgggagttctcgagtac

SEQ ID NO: 525857 - DNA, 25 bp, Rattus norvegicus
gttccttgcgggtgttctcgagtac

SEQ ID NO: 525858 - DNA, 25 bp, Rattus norvegicus
gttccttggactagagtcagtcact

SEQ ID NO: 525859 - DNA, 25 bp, Rattus norvegicus
gttccttggacttgagtcagtcact

SEQ ID NO: 525860 - DNA, 25 bp, Rattus norvegicus
gttccttggcaccagggacgtgata

SEQ ID NO: 525861 - DNA, 25 bp, Rattus norvegicus
gttccttggcacgagggacgtgata

SEQ ID NO: 525862 - DNA, 25 bp, Rattus norvegicus
gttccttgggaacttgaccagagct

SEQ ID NO: 525863 - DNA, 25 bp, Rattus norvegicus
gttccttgggaagttgaccagagct

SEQ ID NO: 525864 - DNA, 25 bp, Rattus norvegicus
gttccttgtcctattgttcaaactg

SEQ ID NO: 525865 - DNA, 25 bp, Rattus norvegicus
gttccttgtccttttgttcaaactg

SEQ ID NO: 525866 - DNA, 25 bp, Rattus norvegicus
gttccttgtgtcacagcattcgaga

SEQ ID NO: 525867 - DNA, 25 bp, Rattus norvegicus
gttccttgtgtctcagcattcgaga

SEQ ID NO: 525868 - DNA, 25 bp, Rattus norvegicus
gttccttgtttgctttacactgtca

SEQ ID NO: 525869 - DNA, 25 bp, Rattus norvegicus
gttccttgtttggtttacactgtca

SEQ ID NO: 525870 - DNA, 25 bp, Rattus norvegicus
gttccttgttttccaacattgtatg

SEQ ID NO: 525871 - DNA, 25 bp, Rattus norvegicus
gttccttgttttgcaacattgtatg

SEQ ID NO: 525872 - DNA, 25 bp, Rattus norvegicus
gttcctttaatcatctgtctgggta

SEQ ID NO: 525873 - DNA, 25 bp, Rattus norvegicus
gttcctttaatcttctgtctgggta

SEQ ID NO: 525874 - DNA, 25 bp, Rattus norvegicus
gttcctttacacagctgagtacagc

SEQ ID NO: 525875 - DNA, 25 bp, Rattus norvegicus
gttcctttacactgctgagtacagc

SEQ ID NO: 525876 - DNA, 25 bp, Rattus norvegicus
gttcctttaccacagatttcgttgc

SEQ ID NO: 525877 - DNA, 25 bp, Rattus norvegicus
gttcctttaccagagatttcgttgc

SEQ ID NO: 525878 - DNA, 25 bp, Rattus norvegicus
gttcctttacctatctaggctcagg

SEQ ID NO: 525879 - DNA, 25 bp, Rattus norvegicus
gttcctttacctttctaggctcagg

SEQ ID NO: 525880 - DNA, 25 bp, Rattus norvegicus
gttcctttagatatctctgtgcata

SEQ ID NO: 525881 - DNA, 25 bp, Rattus norvegicus
gttcctttagatttctctgtgcata

SEQ ID NO: 525882 - DNA, 25 bp, Rattus norvegicus
gttcctttcaacctttgtacacatc

SEQ ID NO: 525883 - DNA, 25 bp, Rattus norvegicus
gttcctttcaacgtttgtacacatc

SEQ ID NO: 525884 - DNA, 25 bp, Rattus norvegicus
gttcctttccacacggtagtgcgga

SEQ ID NO: 525885 - DNA, 25 bp, Rattus norvegicus
gttcctttccactcggtagtgcgga

SEQ ID NO: 525886 - DNA, 25 bp, Rattus norvegicus
gttcctttcccaccatcattattag

SEQ ID NO: 525887 - DNA, 25 bp, Rattus norvegicus
gttcctttcccagcatcattattag

SEQ ID NO: 525888 - DNA, 25 bp, Rattus norvegicus
gttcctttctctctttcatgttggg

SEQ ID NO: 525889 - DNA, 25 bp, Rattus norvegicus
gttcctttctctgtttcatgttggg

SEQ ID NO: 525890 - DNA, 25 bp, Rattus norvegicus
gttcctttctgaagtgagttcattt

SEQ ID NO: 525891 - DNA, 25 bp, Rattus norvegicus
gttcctttctgatgtgagttcattt

SEQ ID NO: 525892 - DNA, 25 bp, Rattus norvegicus
gttcctttctgccaatgtcataatg

SEQ ID NO: 525893 - DNA, 25 bp, Rattus norvegicus
gttcctttctgcgaatgtcataatg

SEQ ID NO: 525894 - DNA, 25 bp, Rattus norvegicus
gttcctttctggcaagcagcaggta

SEQ ID NO: 525895 - DNA, 25 bp, Rattus norvegicus
gttcctttctgggaagcagcaggta

SEQ ID NO: 525896 - DNA, 25 bp, Rattus norvegicus
gttcctttctgtatactttcatgcc

SEQ ID NO: 525897 - DNA, 25 bp, Rattus norvegicus
gttcctttctgtcgtattttgtcct

SEQ ID NO: 525898 - DNA, 25 bp, Rattus norvegicus
gttcctttctgtggtattttgtcct

SEQ ID NO: 525899 - DNA, 25 bp, Rattus norvegicus
gttcctttctgtttactttcatgcc

SEQ ID NO: 525900 - DNA, 25 bp, Rattus norvegicus
gttcctttgaacagcgtcttacaca

SEQ ID NO: 525901 - DNA, 25 bp, Rattus norvegicus
gttcctttgaactgcgtcttacaca

SEQ ID NO: 525902 - DNA, 25 bp, Rattus norvegicus
gttcctttgacgcagcagttgctgt

SEQ ID NO: 525903 - DNA, 25 bp, Rattus norvegicus
gttcctttgacggagcagttgctgt

SEQ ID NO: 525904 - DNA, 25 bp, Rattus norvegicus
gttcctttgcccaaaattcttgcac

SEQ ID NO: 525905 - DNA, 25 bp, Rattus norvegicus
gttcctttgccctaaattcttgcac

SEQ ID NO: 525906 - DNA, 25 bp, Rattus norvegicus
gttcctttgcctctaagtctgtggg

SEQ ID NO: 525907 - DNA, 25 bp, Rattus norvegicus
gttcctttgcctgtaagtctgtggg

SEQ ID NO: 525908 - DNA, 25 bp, Rattus norvegicus
gttcctttggatacttccttggaca

SEQ ID NO: 525909 - DNA, 25 bp, Rattus norvegicus
gttcctttggattcttccttggaca

SEQ ID NO: 525910 - DNA, 25 bp, Rattus norvegicus
gttcctttgggcaagagccctaagg

SEQ ID NO: 525911 - DNA, 25 bp, Rattus norvegicus
gttcctttgggctagagccctaagg

SEQ ID NO: 525912 - DNA, 25 bp, Rattus norvegicus
gttcctttgtgtcttttttgcagac

SEQ ID NO: 525913 - DNA, 25 bp, Rattus norvegicus
gttcctttgtgtgttttttgcagac

SEQ ID NO: 525914 - DNA, 25 bp, Rattus norvegicus
gttccttttataccatgtgagccaa

SEQ ID NO: 525915 - DNA, 25 bp, Rattus norvegicus
gttccttttatagcatgtgagccaa

SEQ ID NO: 525916 - DNA, 25 bp, Rattus norvegicus
gttccttttccacggtgacttgtat

SEQ ID NO: 525917 - DNA, 25 bp, Rattus norvegicus
gttccttttccagggtgacttgtat

SEQ ID NO: 525918 - DNA, 25 bp, Rattus norvegicus
gttccttttcccataattgctttgc

SEQ ID NO: 525919 - DNA, 25 bp, Rattus norvegicus
gttccttttcccttaattgctttgc

SEQ ID NO: 525920 - DNA, 25 bp, Rattus norvegicus
gttccttttcctacaattcagttgg

SEQ ID NO: 525921 - DNA, 25 bp, Rattus norvegicus
gttccttttccttcaattcagttgg

SEQ ID NO: 525922 - DNA, 25 bp, Rattus norvegicus
gttccttttctccatcattttttag

SEQ ID NO: 525923 - DNA, 25 bp, Rattus norvegicus
gttccttttctcgatcattttttag

SEQ ID NO: 525924 - DNA, 25 bp, Rattus norvegicus
gttccttttgtaagacaggcgcttg

SEQ ID NO: 525925 - DNA, 25 bp, Rattus norvegicus
gttccttttgtatgacaggcgcttg

SEQ ID NO: 525926 - DNA, 25 bp, Rattus norvegicus
gttcctttttatcactatttctgtt

SEQ ID NO: 525927 - DNA, 25 bp, Rattus norvegicus
gttcctttttatgactatttctgtt

SEQ ID NO: 525928 - DNA, 25 bp, Rattus norvegicus
gttcctttttgaccggtgggcagca

SEQ ID NO: 525929 - DNA, 25 bp, Rattus norvegicus
gttcctttttgagcggtgggcagca

SEQ ID NO: 525930 - DNA, 25 bp, Rattus norvegicus
gttcgaaaactcatcatccgcagac

SEQ ID NO: 525931 - DNA, 25 bp, Rattus norvegicus
gttcgaaaactcttcatccgcagac

SEQ ID NO: 525932 - DNA, 25 bp, Rattus norvegicus
gttcgaaacacaagtgctctacata

SEQ ID NO: 525933 - DNA, 25 bp, Rattus norvegicus
gttcgaaacacatgtgctctacata

SEQ ID NO: 525934 - DNA, 25 bp, Rattus norvegicus
gttcgaaataccctcttgcaatgta

SEQ ID NO: 525935 - DNA, 25 bp, Rattus norvegicus
gttcgaaataccgtcttgcaatgta

SEQ ID NO: 525936 - DNA, 25 bp, Rattus norvegicus
gttcgaacacttcagtggactccta

SEQ ID NO: 525937 - DNA, 25 bp, Rattus norvegicus
gttcgaacacttgagtggactccta

SEQ ID NO: 525938 - DNA, 25 bp, Rattus norvegicus
gttcgaaccagtaagtgctcaataa

SEQ ID NO: 525939 - DNA, 25 bp, Rattus norvegicus
gttcgaaccagttagtgctcaataa

SEQ ID NO: 525940 - DNA, 25 bp, Rattus norvegicus
gttcgaacctcacatatgggtggtt

SEQ ID NO: 525941 - DNA, 25 bp, Rattus norvegicus
gttcgaacctcagatatgggtggtt

SEQ ID NO: 525942 - DNA, 25 bp, Rattus norvegicus
gttcgaactgtacaataagaccctg

SEQ ID NO: 525943 - DNA, 25 bp, Rattus norvegicus
gttcgaactgtagaataagaccctg

SEQ ID NO: 525944 - DNA, 25 bp, Rattus norvegicus
gttcgaactgttatttcatagaata

SEQ ID NO: 525945 - DNA, 25 bp, Rattus norvegicus
gttcgaactgttttttcatagaata

SEQ ID NO: 525946 - DNA, 25 bp, Rattus norvegicus
gttcgaagaatgatagtaagcccta

SEQ ID NO: 525947 - DNA, 25 bp, Rattus norvegicus
gttcgaagaatgttagtaagcccta

SEQ ID NO: 525948 - DNA, 25 bp, Rattus norvegicus
gttcgaagaggaccttcagcgtctc

SEQ ID NO: 525949 - DNA, 25 bp, Rattus norvegicus
gttcgaagaggagcttcagcgtctc

SEQ ID NO: 525950 - DNA, 25 bp, Rattus norvegicus
gttcgaatactaaagaagcattgtg

SEQ ID NO: 525951 - DNA, 25 bp, Rattus norvegicus
gttcgaatactatagaagcattgtg

SEQ ID NO: 525952 - DNA, 25 bp, Rattus norvegicus
gttcgaatccccaggctctcgggaa

SEQ ID NO: 525953 - DNA, 25 bp, Rattus norvegicus
gttcgaatcccctggctctcgggaa

SEQ ID NO: 525954 - DNA, 25 bp, Rattus norvegicus
gttcgaatcttgagacggctatgtc

SEQ ID NO: 525955 - DNA, 25 bp, Rattus norvegicus
gttcgaatcttgtgacggctatgtc

SEQ ID NO: 525956 - DNA, 25 bp, Rattus norvegicus
gttcgacatgctatattggagactc

SEQ ID NO: 525957 - DNA, 25 bp, Rattus norvegicus
gttcgacatgctttattggagactc

SEQ ID NO: 525958 - DNA, 25 bp, Rattus norvegicus
gttcgaccgggcactgaccactgag

SEQ ID NO: 525959 - DNA, 25 bp, Rattus norvegicus
gttcgaccgggctctgaccactgag

SEQ ID NO: 525960 - DNA, 25 bp, Rattus norvegicus
gttcgacctaggactagcttccaat

SEQ ID NO: 525961 - DNA, 25 bp, Rattus norvegicus
gttcgacctaggtctagcttccaat

SEQ ID NO: 525962 - DNA, 25 bp, Rattus norvegicus
gttcgacctcaaccgctgctgggaa

SEQ ID NO: 525963 - DNA, 25 bp, Rattus norvegicus
gttcgacctcaagcgctgctgggaa

SEQ ID NO: 525964 - DNA, 25 bp, Rattus norvegicus
gttcgacctcatctatgccaaacgg

SEQ ID NO: 525965 - DNA, 25 bp, Rattus norvegicus
gttcgacctcatgtatgccaaacgg

SEQ ID NO: 525966 - DNA, 25 bp, Rattus norvegicus
gttcgacttgaacccagagctggct

SEQ ID NO: 525967 - DNA, 25 bp, Rattus norvegicus
gttcgacttgaagccagagctggct

SEQ ID NO: 525968 - DNA, 25 bp, Rattus norvegicus
gttcgagaaagtcaccccagtgacc

SEQ ID NO: 525969 - DNA, 25 bp, Rattus norvegicus
gttcgagaaagtgaccccagtgacc

SEQ ID NO: 525970 - DNA, 25 bp, Rattus norvegicus
gttcgagacagtctgttccaccgct

SEQ ID NO: 525971 - DNA, 25 bp, Rattus norvegicus
gttcgagacagtgtgttccaccgct

SEQ ID NO: 525972 - DNA, 25 bp, Rattus norvegicus
gttcgagaccatcgtgagccacaat

SEQ ID NO: 525973 - DNA, 25 bp, Rattus norvegicus
gttcgagaccatggtgagccacaat

SEQ ID NO: 525974 - DNA, 25 bp, Rattus norvegicus
gttcgagcacctctatcatgcaggg

SEQ ID NO: 525975 - DNA, 25 bp, Rattus norvegicus
gttcgagcacctgtatcatgcaggg

SEQ ID NO: 525976 - DNA, 25 bp, Rattus norvegicus
gttcgagcacgcatggccgagccga

SEQ ID NO: 525977 - DNA, 25 bp, Rattus norvegicus
gttcgagcacgcttggccgagccga

SEQ ID NO: 525978 - DNA, 25 bp, Rattus norvegicus
gttcgaggctgacctgcacctgcca

SEQ ID NO: 525979 - DNA, 25 bp, Rattus norvegicus
gttcgaggctgagctgcacctgcca

SEQ ID NO: 525980 - DNA, 25 bp, Rattus norvegicus
gttcgaggtccgagatggtgctcta

SEQ ID NO: 525981 - DNA, 25 bp, Rattus norvegicus
gttcgaggtccgtgatggtgctcta

SEQ ID NO: 525982 - DNA, 25 bp, Rattus norvegicus
gttcgaggttgcctctccctgtgag

SEQ ID NO: 525983 - DNA, 25 bp, Rattus norvegicus
gttcgaggttgcgtctccctgtgag

SEQ ID NO: 525984 - DNA, 25 bp, Rattus norvegicus
gttcgagtcactcgtctgtgtaaca

SEQ ID NO: 525985 - DNA, 25 bp, Rattus norvegicus
gttcgagtcactcgtgctgatgtcc

SEQ ID NO: 525986 - DNA, 25 bp, Rattus norvegicus
gttcgagtcactggtctgtgtaaca

SEQ ID NO: 525987 - DNA, 25 bp, Rattus norvegicus
gttcgagtcactggtgctgatgtcc

SEQ ID NO: 525988 - DNA, 25 bp, Rattus norvegicus
gttcgagtcattcgtcctaggatct

SEQ ID NO: 525989 - DNA, 25 bp, Rattus norvegicus
gttcgagtcattggtcctaggatct

SEQ ID NO: 525990 - DNA, 25 bp, Rattus norvegicus
gttcgagtccttccttgatgatgag

SEQ ID NO: 525991 - DNA, 25 bp, Rattus norvegicus
gttcgagtccttgcttgatgatgag

SEQ ID NO: 525992 - DNA, 25 bp, Rattus norvegicus
gttcgataggcgcttttgcttgcga

SEQ ID NO: 525993 - DNA, 25 bp, Rattus norvegicus
gttcgataggcggttttgcttgcga

SEQ ID NO: 525994 - DNA, 25 bp, Rattus norvegicus
gttcgatatcgactgcagccagggt

SEQ ID NO: 525995 - DNA, 25 bp, Rattus norvegicus
gttcgatatcgagtgcagccagggt

SEQ ID NO: 525996 - DNA, 25 bp, Rattus norvegicus
gttcgatcagtccttcttcggtata

SEQ ID NO: 525997 - DNA, 25 bp, Rattus norvegicus
gttcgatcagtcgttcttcggtata

SEQ ID NO: 525998 - DNA, 25 bp, Rattus norvegicus
gttcgatcctccatatagatgctgt

SEQ ID NO: 525999 - DNA, 25 bp, Rattus norvegicus
gttcgatcctccttatagatgctgt

SEQ ID NO: 526000 - DNA, 25 bp, Rattus norvegicus
gttcgatctctgagcctgacaacaa

SEQ ID NO: 526001 - DNA, 25 bp, Rattus norvegicus
gttcgatctctgtgcctgacaacaa

SEQ ID NO: 526002 - DNA, 25 bp, Rattus norvegicus
gttcgatgaaatctctgcaccgtaa

SEQ ID NO: 526003 - DNA, 25 bp, Rattus norvegicus
gttcgatgaaatgtctgcaccgtaa

SEQ ID NO: 526004 - DNA, 25 bp, Rattus norvegicus
gttcgatgttccacatgatccatat

SEQ ID NO: 526005 - DNA, 25 bp, Rattus norvegicus
gttcgatgttcctcatgatccatat

SEQ ID NO: 526006 - DNA, 25 bp, Rattus norvegicus
gttcgattaagtcctcagagccaag

SEQ ID NO: 526007 - DNA, 25 bp, Rattus norvegicus
gttcgattaagtgctcagagccaag

SEQ ID NO: 526008 - DNA, 25 bp, Rattus norvegicus
gttcgatttacacctggttacccac

SEQ ID NO: 526009 - DNA, 25 bp, Rattus norvegicus
gttcgatttacagctggttacccac

SEQ ID NO: 526010 - DNA, 25 bp, Rattus norvegicus
gttcgattttctcaaaactattttg

SEQ ID NO: 526011 - DNA, 25 bp, Rattus norvegicus
gttcgattttctgaaaactattttg

SEQ ID NO: 526012 - DNA, 25 bp, Rattus norvegicus
gttcgcaactgtcggtaactctagt

SEQ ID NO: 526013 - DNA, 25 bp, Rattus norvegicus
gttcgcaactgtgggtaactctagt

SEQ ID NO: 526014 - DNA, 25 bp, Rattus norvegicus
gttcgcaagttgactaacccatcag

SEQ ID NO: 526015 - DNA, 25 bp, Rattus norvegicus
gttcgcaagttgtctaacccatcag

SEQ ID NO: 526016 - DNA, 25 bp, Rattus norvegicus
gttcgcacaaatctaggcttagcta

SEQ ID NO: 526017 - DNA, 25 bp, Rattus norvegicus
gttcgcacaaatgtaggcttagcta

SEQ ID NO: 526018 - DNA, 25 bp, Rattus norvegicus
gttcgcacaggaagcacaggttctc

SEQ ID NO: 526019 - DNA, 25 bp, Rattus norvegicus
gttcgcacaggatgcacaggttctc

SEQ ID NO: 526020 - DNA, 25 bp, Rattus norvegicus
gttcgcaccatcagaattccttgag

SEQ ID NO: 526021 - DNA, 25 bp, Rattus norvegicus
gttcgcaccatctgaattccttgag

SEQ ID NO: 526022 - DNA, 25 bp, Rattus norvegicus
gttcgcagcagacagtggagcccca

SEQ ID NO: 526023 - DNA, 25 bp, Rattus norvegicus
gttcgcagcagagagtggagcccca

SEQ ID NO: 526024 - DNA, 25 bp, Rattus norvegicus
gttcgcagttacaggctttggaagc

SEQ ID NO: 526025 - DNA, 25 bp, Rattus norvegicus
gttcgcagttactggctttggaagc

SEQ ID NO: 526026 - DNA, 25 bp, Rattus norvegicus
gttcgcatacagatgctcttggagc

SEQ ID NO: 526027 - DNA, 25 bp, Rattus norvegicus
gttcgcatacagttgctcttggagc

SEQ ID NO: 526028 - DNA, 25 bp, Rattus norvegicus
gttcgcatatgtcttcctgtttgat

SEQ ID NO: 526029 - DNA, 25 bp, Rattus norvegicus
gttcgcatatgtgttcctgtttgat

SEQ ID NO: 526030 - DNA, 25 bp, Rattus norvegicus
gttcgcatcctcaggtgagtgctaa

SEQ ID NO: 526031 - DNA, 25 bp, Rattus norvegicus
gttcgcatcctctggtgagtgctaa

SEQ ID NO: 526032 - DNA, 25 bp, Rattus norvegicus
gttcgcatggccatgaaaacggatt

SEQ ID NO: 526033 - DNA, 25 bp, Rattus norvegicus
gttcgcatggccttgaaaacggatt

SEQ ID NO: 526034 - DNA, 25 bp, Rattus norvegicus
gttcgcattctccttaccaatatta

SEQ ID NO: 526035 - DNA, 25 bp, Rattus norvegicus
gttcgcattctcgttaccaatatta

SEQ ID NO: 526036 - DNA, 25 bp, Rattus norvegicus
gttcgcattgttaatccagacggtg

SEQ ID NO: 526037 - DNA, 25 bp, Rattus norvegicus
gttcgcattgtttatccagacggtg

SEQ ID NO: 526038 - DNA, 25 bp, Rattus norvegicus
gttcgccaagggaataacatgtgac

SEQ ID NO: 526039 - DNA, 25 bp, Rattus norvegicus
gttcgccaagggtataacatgtgac

SEQ ID NO: 526040 - DNA, 25 bp, Rattus norvegicus
gttcgccaatagacgcagagattag

SEQ ID NO: 526041 - DNA, 25 bp, Rattus norvegicus
gttcgccaatagtcgcagagattag

SEQ ID NO: 526042 - DNA, 25 bp, Rattus norvegicus
gttcgccaggcaacttggtgtccag

SEQ ID NO: 526043 - DNA, 25 bp, Rattus norvegicus
gttcgccaggcatcttggtgtccag

SEQ ID NO: 526044 - DNA, 25 bp, Rattus norvegicus
gttcgcctatttatactttgtctcg

SEQ ID NO: 526045 - DNA, 25 bp, Rattus norvegicus
gttcgcctatttttactttgtctcg

SEQ ID NO: 526046 - DNA, 25 bp, Rattus norvegicus
gttcgcctgctgaatcatcagttga

SEQ ID NO: 526047 - DNA, 25 bp, Rattus norvegicus
gttcgcctgctgtatcatcagttga

SEQ ID NO: 526048 - DNA, 25 bp, Rattus norvegicus
gttcgcgaccctaaacgagcaatag

SEQ ID NO: 526049 - DNA, 25 bp, Rattus norvegicus
gttcgcgacccttaacgagcaatag

SEQ ID NO: 526050 - DNA, 25 bp, Rattus norvegicus
gttcgcgcacggcttccatgagctg

SEQ ID NO: 526051 - DNA, 25 bp, Rattus norvegicus
gttcgcgcacgggttccatgagctg

SEQ ID NO: 526052 - DNA, 25 bp, Rattus norvegicus
gttcgcgctaaacctacacttcggt

SEQ ID NO: 526053 - DNA, 25 bp, Rattus norvegicus
gttcgcgctaaagctacacttcggt

SEQ ID NO: 526054 - DNA, 25 bp, Rattus norvegicus
gttcgcgtcggaattgtattctctc

SEQ ID NO: 526055 - DNA, 25 bp, Rattus norvegicus
gttcgcgtcggatttgtattctctc

SEQ ID NO: 526056 - DNA, 25 bp, Rattus norvegicus
gttcgcgtgtctaggactaatcagt

SEQ ID NO: 526057 - DNA, 25 bp, Rattus norvegicus
gttcgcgtgtcttggactaatcagt

SEQ ID NO: 526058 - DNA, 25 bp, Rattus norvegicus
gttcgctactggagtgcaagctcaa

SEQ ID NO: 526059 - DNA, 25 bp, Rattus norvegicus
gttcgctactggtgtgcaagctcaa

SEQ ID NO: 526060 - DNA, 25 bp, Rattus norvegicus
gttcgctcctgcagaggaacaagtc

SEQ ID NO: 526061 - DNA, 25 bp, Rattus norvegicus
gttcgctcctgctgaggaacaagtc

SEQ ID NO: 526062 - DNA, 25 bp, Rattus norvegicus
gttcgctggagacccctggaagtac

SEQ ID NO: 526063 - DNA, 25 bp, Rattus norvegicus
gttcgctggagagccctggaagtac

SEQ ID NO: 526064 - DNA, 25 bp, Rattus norvegicus
gttcgctgggttacttggcacatag

SEQ ID NO: 526065 - DNA, 25 bp, Rattus norvegicus
gttcgctgggtttcttggcacatag

SEQ ID NO: 526066 - DNA, 25 bp, Rattus norvegicus
gttcgctggtgacactgctggttac

SEQ ID NO: 526067 - DNA, 25 bp, Rattus norvegicus
gttcgctggtgagactgctggttac

SEQ ID NO: 526068 - DNA, 25 bp, Rattus norvegicus
gttcgcttcaagaggaagttcgcag

SEQ ID NO: 526069 - DNA, 25 bp, Rattus norvegicus
gttcgcttcaagtggaagttcgcag

SEQ ID NO: 526070 - DNA, 25 bp, Rattus norvegicus
gttcgcttgcagagagtacttttat

SEQ ID NO: 526071 - DNA, 25 bp, Rattus norvegicus
gttcgcttgcagtgagtacttttat

SEQ ID NO: 526072 - DNA, 25 bp, Rattus norvegicus
gttcgctttactaccctcaaagagg

SEQ ID NO: 526073 - DNA, 25 bp, Rattus norvegicus
gttcgctttacttccctcaaagagg

SEQ ID NO: 526074 - DNA, 25 bp, Rattus norvegicus
gttcgctttgcaaaggtgtctgcta

SEQ ID NO: 526075 - DNA, 25 bp, Rattus norvegicus
gttcgctttgcataggtgtctgcta

SEQ ID NO: 526076 - DNA, 25 bp, Rattus norvegicus
gttcgctttttcaacaatcatgtgg

SEQ ID NO: 526077 - DNA, 25 bp, Rattus norvegicus
gttcgctttttctacaatcatgtgg

SEQ ID NO: 526078 - DNA, 25 bp, Rattus norvegicus
gttcggaaacatacagccatatact

SEQ ID NO: 526079 - DNA, 25 bp, Rattus norvegicus
gttcggaaacattcagccatatact

SEQ ID NO: 526080 - DNA, 25 bp, Rattus norvegicus
gttcggaaccagattcacgttgctt

SEQ ID NO: 526081 - DNA, 25 bp, Rattus norvegicus
gttcggaaccagtttcacgttgctt

SEQ ID NO: 526082 - DNA, 25 bp, Rattus norvegicus
gttcggaagtttcctgacagggtat

SEQ ID NO: 526083 - DNA, 25 bp, Rattus norvegicus
gttcggaagtttgctgacagggtat

SEQ ID NO: 526084 - DNA, 25 bp, Rattus norvegicus
gttcggacactaacctttcaataca

SEQ ID NO: 526085 - DNA, 25 bp, Rattus norvegicus
gttcggacactatcctttcaataca

SEQ ID NO: 526086 - DNA, 25 bp, Rattus norvegicus
gttcggagaaaacacccatggcttg

SEQ ID NO: 526087 - DNA, 25 bp, Rattus norvegicus
gttcggagaaaagacccatggcttg

SEQ ID NO: 526088 - DNA, 25 bp, Rattus norvegicus
gttcggatacaacctgtgcatcttc

SEQ ID NO: 526089 - DNA, 25 bp, Rattus norvegicus
gttcggatacaagctgtgcatcttc

SEQ ID NO: 526090 - DNA, 25 bp, Rattus norvegicus
gttcggatgttacatttcccgttat

SEQ ID NO: 526091 - DNA, 25 bp, Rattus norvegicus
gttcggatgttagatttcccgttat

SEQ ID NO: 526092 - DNA, 25 bp, Rattus norvegicus
gttcggattctaccactaagctgca

SEQ ID NO: 526093 - DNA, 25 bp, Rattus norvegicus
gttcggattctagcactaagctgca

SEQ ID NO: 526094 - DNA, 25 bp, Rattus norvegicus
gttcggattcttagtaaatgtcctg

SEQ ID NO: 526095 - DNA, 25 bp, Rattus norvegicus
gttcggattctttgtaaatgtcctg

SEQ ID NO: 526096 - DNA, 25 bp, Rattus norvegicus
gttcggcaaagaatacagactcagg

SEQ ID NO: 526097 - DNA, 25 bp, Rattus norvegicus
gttcggcaaagattacagactcagg

SEQ ID NO: 526098 - DNA, 25 bp, Rattus norvegicus
gttcggcattttaattgactggctt

SEQ ID NO: 526099 - DNA, 25 bp, Rattus norvegicus
gttcggcatttttattgactggctt

SEQ ID NO: 526100 - DNA, 25 bp, Rattus norvegicus
gttcggcctaccagggatgttcaga

SEQ ID NO: 526101 - DNA, 25 bp, Rattus norvegicus
gttcggcctacctgggatgttcaga

SEQ ID NO: 526102 - DNA, 25 bp, Rattus norvegicus
gttcggcctctccataggacagaat

SEQ ID NO: 526103 - DNA, 25 bp, Rattus norvegicus
gttcggcctctcgataggacagaat

SEQ ID NO: 526104 - DNA, 25 bp, Rattus norvegicus
gttcggccttttctgtaattgatgc

SEQ ID NO: 526105 - DNA, 25 bp, Rattus norvegicus
gttcggccttttgtgtaattgatgc

SEQ ID NO: 526106 - DNA, 25 bp, Rattus norvegicus
gttcgggaccataacatcttttctg

SEQ ID NO: 526107 - DNA, 25 bp, Rattus norvegicus
gttcgggaccattacatcttttctg

SEQ ID NO: 526108 - DNA, 25 bp, Rattus norvegicus
gttcgggagcttatgacacttatat

SEQ ID NO: 526109 - DNA, 25 bp, Rattus norvegicus
gttcgggagcttttgacacttatat

SEQ ID NO: 526110 - DNA, 25 bp, Rattus norvegicus
gttcgggcccttactatggatagca

SEQ ID NO: 526111 - DNA, 25 bp, Rattus norvegicus
gttcgggccctttctatggatagca

SEQ ID NO: 526112 - DNA, 25 bp, Rattus norvegicus
gttcgggtgcgcaggatcttgactc

SEQ ID NO: 526113 - DNA, 25 bp, Rattus norvegicus
gttcgggtgcgctggatcttgactc

SEQ ID NO: 526114 - DNA, 25 bp, Rattus norvegicus
gttcgggtgtgtcagtattttcaaa

SEQ ID NO: 526115 - DNA, 25 bp, Rattus norvegicus
gttcgggtgtgtgagtattttcaaa

SEQ ID NO: 526116 - DNA, 25 bp, Rattus norvegicus
gttcggtattttatgccatccatga

SEQ ID NO: 526117 - DNA, 25 bp, Rattus norvegicus
gttcggtattttttgccatccatga

SEQ ID NO: 526118 - DNA, 25 bp, Rattus norvegicus
gttcggtctaggcatctcttttcag

SEQ ID NO: 526119 - DNA, 25 bp, Rattus norvegicus
gttcggtctagggatctcttttcag

SEQ ID NO: 526120 - DNA, 25 bp, Rattus norvegicus
gttcggtctgcaatcaagtcctagg

SEQ ID NO: 526121 - DNA, 25 bp, Rattus norvegicus
gttcggtctgcattcaagtcctagg

SEQ ID NO: 526122 - DNA, 25 bp, Rattus norvegicus
gttcggtctggcattagatcagtat

SEQ ID NO: 526123 - DNA, 25 bp, Rattus norvegicus
gttcggtctggctttagatcagtat

SEQ ID NO: 526124 - DNA, 25 bp, Rattus norvegicus
gttcggtgaataccagcagcctcaa

SEQ ID NO: 526125 - DNA, 25 bp, Rattus norvegicus
gttcggtgaatagcagcagcctcaa

SEQ ID NO: 526126 - DNA, 25 bp, Rattus norvegicus
gttcggtgaccgcaatggcctcagc

SEQ ID NO: 526127 - DNA, 25 bp, Rattus norvegicus
gttcggtgaccggaatggcctcagc

SEQ ID NO: 526128 - DNA, 25 bp, Rattus norvegicus
gttcggtgctcacttctcatgtttg

SEQ ID NO: 526129 - DNA, 25 bp, Rattus norvegicus
gttcggtgctcagttctcatgtttg

SEQ ID NO: 526130 - DNA, 25 bp, Rattus norvegicus
gttcggtgttccataatgctgtaac

SEQ ID NO: 526131 - DNA, 25 bp, Rattus norvegicus
gttcggtgttccttaatgctgtaac

SEQ ID NO: 526132 - DNA, 25 bp, Rattus norvegicus
gttcggtttcatcttctgcattttt

SEQ ID NO: 526133 - DNA, 25 bp, Rattus norvegicus
gttcggtttcatgttctgcattttt

SEQ ID NO: 526134 - DNA, 25 bp, Rattus norvegicus
gttcgtaacaggatccttcatcgag

SEQ ID NO: 526135 - DNA, 25 bp, Rattus norvegicus
gttcgtaacaggttccttcatcgag

SEQ ID NO: 526136 - DNA, 25 bp, Rattus norvegicus
gttcgtaagcccctgttgagtgaaa

SEQ ID NO: 526137 - DNA, 25 bp, Rattus norvegicus
gttcgtaagcccgtgttgagtgaaa

SEQ ID NO: 526138 - DNA, 25 bp, Rattus norvegicus
gttcgtaatgggatcctgtattctt

SEQ ID NO: 526139 - DNA, 25 bp, Rattus norvegicus
gttcgtaatgggttcctgtattctt

SEQ ID NO: 526140 - DNA, 25 bp, Rattus norvegicus
gttcgtagaagaatctgtttcacag

SEQ ID NO: 526141 - DNA, 25 bp, Rattus norvegicus
gttcgtagaagattctgtttcacag

SEQ ID NO: 526142 - DNA, 25 bp, Rattus norvegicus
gttcgtagacgcatcatttctgtgg

SEQ ID NO: 526143 - DNA, 25 bp, Rattus norvegicus
gttcgtagacgcttcatttctgtgg

SEQ ID NO: 526144 - DNA, 25 bp, Rattus norvegicus
gttcgtagagagatttacagtccat

SEQ ID NO: 526145 - DNA, 25 bp, Rattus norvegicus
gttcgtagagagttttacagtccat

SEQ ID NO: 526146 - DNA, 25 bp, Rattus norvegicus
gttcgtagctttaccatctttggaa

SEQ ID NO: 526147 - DNA, 25 bp, Rattus norvegicus
gttcgtagcttttccatctttggaa

SEQ ID NO: 526148 - DNA, 25 bp, Rattus norvegicus
gttcgtatactgctgaggtgctctc

SEQ ID NO: 526149 - DNA, 25 bp, Rattus norvegicus
gttcgtatactggtgaggtgctctc

SEQ ID NO: 526150 - DNA, 25 bp, Rattus norvegicus
gttcgtatcttgaacttttctatta

SEQ ID NO: 526151 - DNA, 25 bp, Rattus norvegicus
gttcgtatcttgtacttttctatta

SEQ ID NO: 526152 - DNA, 25 bp, Rattus norvegicus
gttcgtatgctaacttgcccatatt

SEQ ID NO: 526153 - DNA, 25 bp, Rattus norvegicus
gttcgtatgctatcttgcccatatt

SEQ ID NO: 526154 - DNA, 25 bp, Rattus norvegicus
gttcgtcacttcaggcacagcacgt

SEQ ID NO: 526155 - DNA, 25 bp, Rattus norvegicus
gttcgtcacttctggcacagcacgt

SEQ ID NO: 526156 - DNA, 25 bp, Rattus norvegicus
gttcgtccacaccttaatcagttgt

SEQ ID NO: 526157 - DNA, 25 bp, Rattus norvegicus
gttcgtccacacgttaatcagttgt

SEQ ID NO: 526158 - DNA, 25 bp, Rattus norvegicus
gttcgtcctactcaggcaagggcta

SEQ ID NO: 526159 - DNA, 25 bp, Rattus norvegicus
gttcgtcctactgaggcaagggcta

SEQ ID NO: 526160 - DNA, 25 bp, Rattus norvegicus
gttcgtcgtttgctttgtatcttgt

SEQ ID NO: 526161 - DNA, 25 bp, Rattus norvegicus
gttcgtcgtttggtttgtatcttgt

SEQ ID NO: 526162 - DNA, 25 bp, Rattus norvegicus
gttcgtctacctaatcttgtgggtc

SEQ ID NO: 526163 - DNA, 25 bp, Rattus norvegicus
gttcgtctaccttatcttgtgggtc

SEQ ID NO: 526164 - DNA, 25 bp, Rattus norvegicus
gttcgtcttggtattcagcagggtt

SEQ ID NO: 526165 - DNA, 25 bp, Rattus norvegicus
gttcgtcttggttttcagcagggtt

SEQ ID NO: 526166 - DNA, 25 bp, Rattus norvegicus
gttcgtgaacatatctcctctggaa

SEQ ID NO: 526167 - DNA, 25 bp, Rattus norvegicus
gttcgtgaacatttctcctctggaa

SEQ ID NO: 526168 - DNA, 25 bp, Rattus norvegicus
gttcgtgatttcatcctttgattct

SEQ ID NO: 526169 - DNA, 25 bp, Rattus norvegicus
gttcgtgatttcttcctttgattct

SEQ ID NO: 526170 - DNA, 25 bp, Rattus norvegicus
gttcgtgcaaggaaaccgtgaggct

SEQ ID NO: 526171 - DNA, 25 bp, Rattus norvegicus
gttcgtgcaaggtaaccgtgaggct

SEQ ID NO: 526172 - DNA, 25 bp, Rattus norvegicus
gttcgtgccacgctaaagaatcctg

SEQ ID NO: 526173 - DNA, 25 bp, Rattus norvegicus
gttcgtgccacggtaaagaatcctg

SEQ ID NO: 526174 - DNA, 25 bp, Rattus norvegicus
gttcgtgcgcgtccttcctgaccgt

SEQ ID NO: 526175 - DNA, 25 bp, Rattus norvegicus
gttcgtgcgcgtgcttcctgaccgt

SEQ ID NO: 526176 - DNA, 25 bp, Rattus norvegicus
gttcgtgctgggattgaggatcaat

SEQ ID NO: 526177 - DNA, 25 bp, Rattus norvegicus
gttcgtgctgggtttgaggatcaat

SEQ ID NO: 526178 - DNA, 25 bp, Rattus norvegicus
gttcgtggaaccaacatgtttgatt

SEQ ID NO: 526179 - DNA, 25 bp, Rattus norvegicus
gttcgtggaacctacatgtttgatt

SEQ ID NO: 526180 - DNA, 25 bp, Rattus norvegicus
gttcgtggcataacttggctacata

SEQ ID NO: 526181 - DNA, 25 bp, Rattus norvegicus
gttcgtggcatatcttggctacata

SEQ ID NO: 526182 - DNA, 25 bp, Rattus norvegicus
gttcgtgtcatgatttactcatatc

SEQ ID NO: 526183 - DNA, 25 bp, Rattus norvegicus
gttcgtgtcatgttttactcatatc

SEQ ID NO: 526184 - DNA, 25 bp, Rattus norvegicus
gttcgtgtgcagcagttgtaaccca

SEQ ID NO: 526185 - DNA, 25 bp, Rattus norvegicus
gttcgtgtgcaggagttgtaaccca

SEQ ID NO: 526186 - DNA, 25 bp, Rattus norvegicus
gttcgtgtgccccaagaccggccag

SEQ ID NO: 526187 - DNA, 25 bp, Rattus norvegicus
gttcgtgtgcccgaagaccggccag

SEQ ID NO: 526188 - DNA, 25 bp, Rattus norvegicus
gttcgtgttataaacagcctatgtt

SEQ ID NO: 526189 - DNA, 25 bp, Rattus norvegicus
gttcgtgttatatacagcctatgtt

SEQ ID NO: 526190 - DNA, 25 bp, Rattus norvegicus
gttcgttagcctacttgtggtaatt

SEQ ID NO: 526191 - DNA, 25 bp, Rattus norvegicus
gttcgttagccttcttgtggtaatt

SEQ ID NO: 526192 - DNA, 25 bp, Rattus norvegicus
gttcgttattggaggagccacctat

SEQ ID NO: 526193 - DNA, 25 bp, Rattus norvegicus
gttcgttattggtggagccacctat

SEQ ID NO: 526194 - DNA, 25 bp, Rattus norvegicus
gttcgttcaagaacctgatggctac

SEQ ID NO: 526195 - DNA, 25 bp, Rattus norvegicus
gttcgttcaagatcctgatggctac

SEQ ID NO: 526196 - DNA, 25 bp, Rattus norvegicus
gttcgttcccaaagggcctgcggag

SEQ ID NO: 526197 - DNA, 25 bp, Rattus norvegicus
gttcgttcccaatgggcctgcggag

SEQ ID NO: 526198 - DNA, 25 bp, Rattus norvegicus
gttcgttctcccatttgagtaagca

SEQ ID NO: 526199 - DNA, 25 bp, Rattus norvegicus
gttcgttctcccttttgagtaagca

SEQ ID NO: 526200 - DNA, 25 bp, Rattus norvegicus
gttcgttgacttatttgcctgttat

SEQ ID NO: 526201 - DNA, 25 bp, Rattus norvegicus
gttcgttgacttttttgcctgttat

SEQ ID NO: 526202 - DNA, 25 bp, Rattus norvegicus
gttcgttgcacaatccaggattcag

SEQ ID NO: 526203 - DNA, 25 bp, Rattus norvegicus
gttcgttgcacattccaggattcag

SEQ ID NO: 526204 - DNA, 25 bp, Rattus norvegicus
gttcgttgcgagagcaatctcacta

SEQ ID NO: 526205 - DNA, 25 bp, Rattus norvegicus
gttcgttgcgagtgcaatctcacta

SEQ ID NO: 526206 - DNA, 25 bp, Rattus norvegicus
gttcgttggcttatatttcaacaag

SEQ ID NO: 526207 - DNA, 25 bp, Rattus norvegicus
gttcgttggcttttatttcaacaag

SEQ ID NO: 526208 - DNA, 25 bp, Rattus norvegicus
gttcgttttataatgactttgggct

SEQ ID NO: 526209 - DNA, 25 bp, Rattus norvegicus
gttcgttttatattgactttgggct

SEQ ID NO: 526210 - DNA, 25 bp, Rattus norvegicus
gttcgttttcctctatatgtgtctg

SEQ ID NO: 526211 - DNA, 25 bp, Rattus norvegicus
gttcgttttcctgtatatgtgtctg

SEQ ID NO: 526212 - DNA, 25 bp, Rattus norvegicus
gttcgttttgaaatcgtgtgctgtg

SEQ ID NO: 526213 - DNA, 25 bp, Rattus norvegicus
gttcgttttgaattcgtgtgctgtg

SEQ ID NO: 526214 - DNA, 25 bp, Rattus norvegicus
gttcgttttgctcttaaattatctg

SEQ ID NO: 526215 - DNA, 25 bp, Rattus norvegicus
gttcgttttgctgttaaattatctg

SEQ ID NO: 526216 - DNA, 25 bp, Rattus norvegicus
gttcgttttttcactcattgtttga

SEQ ID NO: 526217 - DNA, 25 bp, Rattus norvegicus
gttcgttttttctctcattgtttga

SEQ ID NO: 526218 - DNA, 25 bp, Rattus norvegicus
gttctaaaaaccctctgtgcaatcc

SEQ ID NO: 526219 - DNA, 25 bp, Rattus norvegicus
gttctaaaaaccgtctgtgcaatcc

SEQ ID NO: 526220 - DNA, 25 bp, Rattus norvegicus
gttctaaagctaaccgttgtgtcat

SEQ ID NO: 526221 - DNA, 25 bp, Rattus norvegicus
gttctaaagctatccgttgtgtcat

SEQ ID NO: 526222 - DNA, 25 bp, Rattus norvegicus
gttctaaatgtgattgcagctcaat

SEQ ID NO: 526223 - DNA, 25 bp, Rattus norvegicus
gttctaaatgtgtttgcagctcaat

SEQ ID NO: 526224 - DNA, 25 bp, Rattus norvegicus
gttctaaccacacagacattctcag

SEQ ID NO: 526225 - DNA, 25 bp, Rattus norvegicus
gttctaaccacagagacattctcag

SEQ ID NO: 526226 - DNA, 25 bp, Rattus norvegicus
gttctaaccggccagagctatatag

SEQ ID NO: 526227 - DNA, 25 bp, Rattus norvegicus
gttctaaccggcgagagctatatag

SEQ ID NO: 526228 - DNA, 25 bp, Rattus norvegicus
gttctaacgttactctgaaacccag

SEQ ID NO: 526229 - DNA, 25 bp, Rattus norvegicus
gttctaacgttagtctgaaacccag

SEQ ID NO: 526230 - DNA, 25 bp, Rattus norvegicus
gttctaactcccatagttgcttcaa

SEQ ID NO: 526231 - DNA, 25 bp, Rattus norvegicus
gttctaactcccttagttgcttcaa

SEQ ID NO: 526232 - DNA, 25 bp, Rattus norvegicus
gttctaactgctaagtgtgatggtc

SEQ ID NO: 526233 - DNA, 25 bp, Rattus norvegicus
gttctaactgcttagtgtgatggtc

SEQ ID NO: 526234 - DNA, 25 bp, Rattus norvegicus
gttctaactttccacacctgatatt

SEQ ID NO: 526235 - DNA, 25 bp, Rattus norvegicus
gttctaactttcgacacctgatatt

SEQ ID NO: 526236 - DNA, 25 bp, Rattus norvegicus
gttctaagacccaccaagctatgag

SEQ ID NO: 526237 - DNA, 25 bp, Rattus norvegicus
gttctaagaccctccaagctatgag

SEQ ID NO: 526238 - DNA, 25 bp, Rattus norvegicus
gttctaagacggagtgcgacgcgca

SEQ ID NO: 526239 - DNA, 25 bp, Rattus norvegicus
gttctaagacggtgtgcgacgcgca

SEQ ID NO: 526240 - DNA, 25 bp, Rattus norvegicus
gttctaagagccattatgaccctga

SEQ ID NO: 526241 - DNA, 25 bp, Rattus norvegicus
gttctaagagcctttatgaccctga

SEQ ID NO: 526242 - DNA, 25 bp, Rattus norvegicus
gttctaagatgtcaaggagctttct

SEQ ID NO: 526243 - DNA, 25 bp, Rattus norvegicus
gttctaagatgtgaaggagctttct

SEQ ID NO: 526244 - DNA, 25 bp, Rattus norvegicus
gttctaagcacgaggctgagtacca

SEQ ID NO: 526245 - DNA, 25 bp, Rattus norvegicus
gttctaagcacgtggctgagtacca

SEQ ID NO: 526246 - DNA, 25 bp, Rattus norvegicus
gttctaagtccaatggtcctgctca

SEQ ID NO: 526247 - DNA, 25 bp, Rattus norvegicus
gttctaagtccattggtcctgctca

SEQ ID NO: 526248 - DNA, 25 bp, Rattus norvegicus
gttctaagtcctcggttctctggaa

SEQ ID NO: 526249 - DNA, 25 bp, Rattus norvegicus
gttctaagtcctgggttctctggaa

SEQ ID NO: 526250 - DNA, 25 bp, Rattus norvegicus
gttctaataaacacgcagcagccat

SEQ ID NO: 526251 - DNA, 25 bp, Rattus norvegicus
gttctaataaactcgcagcagccat

SEQ ID NO: 526252 - DNA, 25 bp, Rattus norvegicus
gttctaatatctattgcggtactct

SEQ ID NO: 526253 - DNA, 25 bp, Rattus norvegicus
gttctaatatcttttgcggtactct

SEQ ID NO: 526254 - DNA, 25 bp, Rattus norvegicus
gttctaatcaatcaggtctctctcc

SEQ ID NO: 526255 - DNA, 25 bp, Rattus norvegicus
gttctaatcaatgaggtctctctcc

SEQ ID NO: 526256 - DNA, 25 bp, Rattus norvegicus
gttctaatcgttctaatgttgcagt

SEQ ID NO: 526257 - DNA, 25 bp, Rattus norvegicus
gttctaatcgttgtaatgttgcagt

SEQ ID NO: 526258 - DNA, 25 bp, Rattus norvegicus
gttctaatcttacccacagtgctgg

SEQ ID NO: 526259 - DNA, 25 bp, Rattus norvegicus
gttctaatcttagccacagtgctgg

SEQ ID NO: 526260 - DNA, 25 bp, Rattus norvegicus
gttctaattctcaacggacagtcga

SEQ ID NO: 526261 - DNA, 25 bp, Rattus norvegicus
gttctaattctctacggacagtcga

SEQ ID NO: 526262 - DNA, 25 bp, Rattus norvegicus
gttctacaaataaactgctgtgggt

SEQ ID NO: 526263 - DNA, 25 bp, Rattus norvegicus
gttctacaaatatactgctgtgggt

SEQ ID NO: 526264 - DNA, 25 bp, Rattus norvegicus
gttctacaccataactcagttctta

SEQ ID NO: 526265 - DNA, 25 bp, Rattus norvegicus
gttctacaccattactcagttctta

SEQ ID NO: 526266 - DNA, 25 bp, Rattus norvegicus
gttctacagaacatgtcacgtcttt

SEQ ID NO: 526267 - DNA, 25 bp, Rattus norvegicus
gttctacagaacttgtcacgtcttt

SEQ ID NO: 526268 - DNA, 25 bp, Rattus norvegicus
gttctacagcatcgccaagtggaag

SEQ ID NO: 526269 - DNA, 25 bp, Rattus norvegicus
gttctacagcatcgctgcccagatc

SEQ ID NO: 526270 - DNA, 25 bp, Rattus norvegicus
gttctacagcatggccaagtggaag

SEQ ID NO: 526271 - DNA, 25 bp, Rattus norvegicus
gttctacagcatggctgcccagatc

SEQ ID NO: 526272 - DNA, 25 bp, Rattus norvegicus
gttctacaggttctgctctgagctc

SEQ ID NO: 526273 - DNA, 25 bp, Rattus norvegicus
gttctacaggttgtgctctgagctc

SEQ ID NO: 526274 - DNA, 25 bp, Rattus norvegicus
gttctacatcccagcaagacaaatg

SEQ ID NO: 526275 - DNA, 25 bp, Rattus norvegicus
gttctacatccctgcaagacaaatg

SEQ ID NO: 526276 - DNA, 25 bp, Rattus norvegicus
gttctacatgaacagtgcgggcctg

SEQ ID NO: 526277 - DNA, 25 bp, Rattus norvegicus
gttctacatgaagagtgcgggcctg

SEQ ID NO: 526278 - DNA, 25 bp, Rattus norvegicus
gttctaccacataaggagctgagtc

SEQ ID NO: 526279 - DNA, 25 bp, Rattus norvegicus
gttctaccacattaggagctgagtc

SEQ ID NO: 526280 - DNA, 25 bp, Rattus norvegicus
gttctaccatgcctagcgttgtttt

SEQ ID NO: 526281 - DNA, 25 bp, Rattus norvegicus
gttctaccatgcgtagcgttgtttt

SEQ ID NO: 526282 - DNA, 25 bp, Rattus norvegicus
gttctaccatgtcagctgtggctgc

SEQ ID NO: 526283 - DNA, 25 bp, Rattus norvegicus
gttctaccatgtgagctgtggctgc

SEQ ID NO: 526284 - DNA, 25 bp, Rattus norvegicus
gttctaccatttatctgtgtttcag

SEQ ID NO: 526285 - DNA, 25 bp, Rattus norvegicus
gttctaccatttttctgtgtttcag

SEQ ID NO: 526286 - DNA, 25 bp, Rattus norvegicus
gttctacccaatacctgagttcata

SEQ ID NO: 526287 - DNA, 25 bp, Rattus norvegicus
gttctacccaattcctgagttcata

SEQ ID NO: 526288 - DNA, 25 bp, Rattus norvegicus
gttctaccctttacagtgcaaaata

SEQ ID NO: 526289 - DNA, 25 bp, Rattus norvegicus
gttctacccttttcagtgcaaaata

SEQ ID NO: 526290 - DNA, 25 bp, Rattus norvegicus
gttctacctcagctgttcatgatag

SEQ ID NO: 526291 - DNA, 25 bp, Rattus norvegicus
gttctacctcaggtgttcatgatag

SEQ ID NO: 526292 - DNA, 25 bp, Rattus norvegicus
gttctacctggaatcttgggtggca

SEQ ID NO: 526293 - DNA, 25 bp, Rattus norvegicus
gttctacctggaattaaactgcata

SEQ ID NO: 526294 - DNA, 25 bp, Rattus norvegicus
gttctacctggattcttgggtggca

SEQ ID NO: 526295 - DNA, 25 bp, Rattus norvegicus
gttctacctggatttaaactgcata

SEQ ID NO: 526296 - DNA, 25 bp, Rattus norvegicus
gttctacctttcaaccatatgtgat

SEQ ID NO: 526297 - DNA, 25 bp, Rattus norvegicus
gttctacctttctaccatatgtgat

SEQ ID NO: 526298 - DNA, 25 bp, Rattus norvegicus
gttctacgcaggctgtctcgggact

SEQ ID NO: 526299 - DNA, 25 bp, Rattus norvegicus
gttctacgcagggtgtctcgggact

SEQ ID NO: 526300 - DNA, 25 bp, Rattus norvegicus
gttctacggaggacatgattctgat

SEQ ID NO: 526301 - DNA, 25 bp, Rattus norvegicus
gttctacggaggtcatgattctgat

SEQ ID NO: 526302 - DNA, 25 bp, Rattus norvegicus
gttctactaacaaccttcataaagc

SEQ ID NO: 526303 - DNA, 25 bp, Rattus norvegicus
gttctactaacatccttcataaagc

SEQ ID NO: 526304 - DNA, 25 bp, Rattus norvegicus
gttctactacggatatcgtttaact

SEQ ID NO: 526305 - DNA, 25 bp, Rattus norvegicus
gttctactacggttatcgtttaact

SEQ ID NO: 526306 - DNA, 25 bp, Rattus norvegicus
gttctactctatcgttatcttgcac

SEQ ID NO: 526307 - DNA, 25 bp, Rattus norvegicus
gttctactctatggttatcttgcac

SEQ ID NO: 526308 - DNA, 25 bp, Rattus norvegicus
gttctactgaatccttacttgtcgg

SEQ ID NO: 526309 - DNA, 25 bp, Rattus norvegicus
gttctactgaatgcttacttgtcgg

SEQ ID NO: 526310 - DNA, 25 bp, Rattus norvegicus
gttctactgagtagggcttcctcaa

SEQ ID NO: 526311 - DNA, 25 bp, Rattus norvegicus
gttctactgagttgggcttcctcaa

SEQ ID NO: 526312 - DNA, 25 bp, Rattus norvegicus
gttctactgtggaccatgatccttc

SEQ ID NO: 526313 - DNA, 25 bp, Rattus norvegicus
gttctactgtggtccatgatccttc

SEQ ID NO: 526314 - DNA, 25 bp, Rattus norvegicus
gttctacttaagagcatccttttga

SEQ ID NO: 526315 - DNA, 25 bp, Rattus norvegicus
gttctacttaagtgcatccttttga

SEQ ID NO: 526316 - DNA, 25 bp, Rattus norvegicus
gttctagaaacaaactgcctgcatt

SEQ ID NO: 526317 - DNA, 25 bp, Rattus norvegicus
gttctagaaacatactgcctgcatt

SEQ ID NO: 526318 - DNA, 25 bp, Rattus norvegicus
gttctagaaggaactcagctgcctc

SEQ ID NO: 526319 - DNA, 25 bp, Rattus norvegicus
gttctagaaggatctcagctgcctc

SEQ ID NO: 526320 - DNA, 25 bp, Rattus norvegicus
gttctagactggctagcactacata

SEQ ID NO: 526321 - DNA, 25 bp, Rattus norvegicus
gttctagactgggtagcactacata

SEQ ID NO: 526322 - DNA, 25 bp, Rattus norvegicus
gttctagagagtacttatccctgaa

SEQ ID NO: 526323 - DNA, 25 bp, Rattus norvegicus
gttctagagagttcttatccctgaa

SEQ ID NO: 526324 - DNA, 25 bp, Rattus norvegicus
gttctagagcccactgtttaaggga

SEQ ID NO: 526325 - DNA, 25 bp, Rattus norvegicus
gttctagagccctctgtttaaggga

SEQ ID NO: 526326 - DNA, 25 bp, Rattus norvegicus
gttctagatgggagggaccaacctt

SEQ ID NO: 526327 - DNA, 25 bp, Rattus norvegicus
gttctagatgggtgggaccaacctt

SEQ ID NO: 526328 - DNA, 25 bp, Rattus norvegicus
gttctagattccagttttgtccaat

SEQ ID NO: 526329 - DNA, 25 bp, Rattus norvegicus
gttctagattcctgttttgtccaat

SEQ ID NO: 526330 - DNA, 25 bp, Rattus norvegicus
gttctagcacagctcacactgagag

SEQ ID NO: 526331 - DNA, 25 bp, Rattus norvegicus
gttctagcacaggtcacactgagag

SEQ ID NO: 526332 - DNA, 25 bp, Rattus norvegicus
gttctagcacctatgagcatttact

SEQ ID NO: 526333 - DNA, 25 bp, Rattus norvegicus
gttctagcacctttgagcatttact

SEQ ID NO: 526334 - DNA, 25 bp, Rattus norvegicus
gttctagcacttaggagatgacagt

SEQ ID NO: 526335 - DNA, 25 bp, Rattus norvegicus
gttctagcactttggagatgacagt

SEQ ID NO: 526336 - DNA, 25 bp, Rattus norvegicus
gttctagcagccatgtaagcagcag

SEQ ID NO: 526337 - DNA, 25 bp, Rattus norvegicus
gttctagcagccttgtaagcagcag

SEQ ID NO: 526338 - DNA, 25 bp, Rattus norvegicus
gttctagcagtgaggactcttccag

SEQ ID NO: 526339 - DNA, 25 bp, Rattus norvegicus
gttctagcagtgtggactcttccag

SEQ ID NO: 526340 - DNA, 25 bp, Rattus norvegicus
gttctagcatgaatggatgcctgat

SEQ ID NO: 526341 - DNA, 25 bp, Rattus norvegicus
gttctagcatgattggatgcctgat

SEQ ID NO: 526342 - DNA, 25 bp, Rattus norvegicus
gttctagccagtaagctcccaaggt

SEQ ID NO: 526343 - DNA, 25 bp, Rattus norvegicus
gttctagccagttagctcccaaggt

SEQ ID NO: 526344 - DNA, 25 bp, Rattus norvegicus
gttctagccatgcaattacatctct

SEQ ID NO: 526345 - DNA, 25 bp, Rattus norvegicus
gttctagccatggaattacatctct

SEQ ID NO: 526346 - DNA, 25 bp, Rattus norvegicus
gttctaggaacgagcgtaaactcta

SEQ ID NO: 526347 - DNA, 25 bp, Rattus norvegicus
gttctaggaacgtgcgtaaactcta

SEQ ID NO: 526348 - DNA, 25 bp, Rattus norvegicus
gttctaggccccactgtatagagat

SEQ ID NO: 526349 - DNA, 25 bp, Rattus norvegicus
gttctaggcccctctgtatagagat

SEQ ID NO: 526350 - DNA, 25 bp, Rattus norvegicus
gttctaggctccagttgacacctga

SEQ ID NO: 526351 - DNA, 25 bp, Rattus norvegicus
gttctaggctcctgttgacacctga

SEQ ID NO: 526352 - DNA, 25 bp, Rattus norvegicus
gttctagggcagctcacttgaagtt

SEQ ID NO: 526353 - DNA, 25 bp, Rattus norvegicus
gttctagggcaggtcacttgaagtt

SEQ ID NO: 526354 - DNA, 25 bp, Rattus norvegicus
gttctaggtcggagagatgctcagt

SEQ ID NO: 526355 - DNA, 25 bp, Rattus norvegicus
gttctaggtcggtgagatgctcagt

SEQ ID NO: 526356 - DNA, 25 bp, Rattus norvegicus
gttctagtacacactattttgggaa

SEQ ID NO: 526357 - DNA, 25 bp, Rattus norvegicus
gttctagtacactctattttgggaa

SEQ ID NO: 526358 - DNA, 25 bp, Rattus norvegicus
gttctagtcagcattgcttgtcaca

SEQ ID NO: 526359 - DNA, 25 bp, Rattus norvegicus
gttctagtcagctttgcttgtcaca

SEQ ID NO: 526360 - DNA, 25 bp, Rattus norvegicus
gttctagtctaaccttacgagtgga

SEQ ID NO: 526361 - DNA, 25 bp, Rattus norvegicus
gttctagtctaagcttacgagtgga

SEQ ID NO: 526362 - DNA, 25 bp, Rattus norvegicus
gttctagtgatcaggtagtcccggt

SEQ ID NO: 526363 - DNA, 25 bp, Rattus norvegicus
gttctagtgatctggtagtcccggt

SEQ ID NO: 526364 - DNA, 25 bp, Rattus norvegicus
gttctagtggctattacatcaattc

SEQ ID NO: 526365 - DNA, 25 bp, Rattus norvegicus
gttctagtggcttttacatcaattc

SEQ ID NO: 526366 - DNA, 25 bp, Rattus norvegicus
gttctagtgtgtccagaggtccgtt

SEQ ID NO: 526367 - DNA, 25 bp, Rattus norvegicus
gttctagtgtgtgcagaggtccgtt

SEQ ID NO: 526368 - DNA, 25 bp, Rattus norvegicus
gttctagtttcaattttgtggctgg

SEQ ID NO: 526369 - DNA, 25 bp, Rattus norvegicus
gttctagtttcatttttgtggctgg

SEQ ID NO: 526370 - DNA, 25 bp, Rattus norvegicus
gttctatacaatagagtgcctctct

SEQ ID NO: 526371 - DNA, 25 bp, Rattus norvegicus
gttctatacaattgagtgcctctct

SEQ ID NO: 526372 - DNA, 25 bp, Rattus norvegicus
gttctatacagacttcgaccggcat

SEQ ID NO: 526373 - DNA, 25 bp, Rattus norvegicus
gttctatacagagttcgaccggcat

SEQ ID NO: 526374 - DNA, 25 bp, Rattus norvegicus
gttctatacaggctgcttggttggt

SEQ ID NO: 526375 - DNA, 25 bp, Rattus norvegicus
gttctatacagggtgcttggttggt

SEQ ID NO: 526376 - DNA, 25 bp, Rattus norvegicus
gttctataccacagtgatccccatg

SEQ ID NO: 526377 - DNA, 25 bp, Rattus norvegicus
gttctataccactgtgatccccatg

SEQ ID NO: 526378 - DNA, 25 bp, Rattus norvegicus
gttctatactaacgccctgtctcag

SEQ ID NO: 526379 - DNA, 25 bp, Rattus norvegicus
gttctatactaaggccctgtctcag

SEQ ID NO: 526380 - DNA, 25 bp, Rattus norvegicus
gttctataggacatcatttactttt

SEQ ID NO: 526381 - DNA, 25 bp, Rattus norvegicus
gttctataggacttcatttactttt

SEQ ID NO: 526382 - DNA, 25 bp, Rattus norvegicus
gttctatagttcatatacacgacgg

SEQ ID NO: 526383 - DNA, 25 bp, Rattus norvegicus
gttctatagttcttatacacgacgg

SEQ ID NO: 526384 - DNA, 25 bp, Rattus norvegicus
gttctatatgccacttgtgtttgga

SEQ ID NO: 526385 - DNA, 25 bp, Rattus norvegicus
gttctatatgcctcttgtgtttgga

SEQ ID NO: 526386 - DNA, 25 bp, Rattus norvegicus
gttctatctgtacttcattgttctc

SEQ ID NO: 526387 - DNA, 25 bp, Rattus norvegicus
gttctatctgtagttcattgttctc

SEQ ID NO: 526388 - DNA, 25 bp, Rattus norvegicus
gttctatgacatcctggccacaagg

SEQ ID NO: 526389 - DNA, 25 bp, Rattus norvegicus
gttctatgacatgctggccacaagg

SEQ ID NO: 526390 - DNA, 25 bp, Rattus norvegicus
gttctatgatgtcattccgggagct

SEQ ID NO: 526391 - DNA, 25 bp, Rattus norvegicus
gttctatgatgtgattccgggagct

SEQ ID NO: 526392 - DNA, 25 bp, Rattus norvegicus
gttctatgccatctggtgaacccaa

SEQ ID NO: 526393 - DNA, 25 bp, Rattus norvegicus
gttctatgccatgtggtgaacccaa

SEQ ID NO: 526394 - DNA, 25 bp, Rattus norvegicus
gttctatgctcactgctgtgtcttc

SEQ ID NO: 526395 - DNA, 25 bp, Rattus norvegicus
gttctatgctcagtgctgtgtcttc

SEQ ID NO: 526396 - DNA, 25 bp, Rattus norvegicus
gttctatggactatgacaccctctt

SEQ ID NO: 526397 - DNA, 25 bp, Rattus norvegicus
gttctatggactttgacaccctctt

SEQ ID NO: 526398 - DNA, 25 bp, Rattus norvegicus
gttctatggcctctgggtagatgtt

SEQ ID NO: 526399 - DNA, 25 bp, Rattus norvegicus
gttctatggcctgtgggtagatgtt

SEQ ID NO: 526400 - DNA, 25 bp, Rattus norvegicus
gttctatgtaaaacccaatgtcagg

SEQ ID NO: 526401 - DNA, 25 bp, Rattus norvegicus
gttctatgtaaatcccaatgtcagg

SEQ ID NO: 526402 - DNA, 25 bp, Rattus norvegicus
gttctatgtataaaactgcatttct

SEQ ID NO: 526403 - DNA, 25 bp, Rattus norvegicus
gttctatgtatataactgcatttct

SEQ ID NO: 526404 - DNA, 25 bp, Rattus norvegicus
gttctatgttttcccagttttccac

SEQ ID NO: 526405 - DNA, 25 bp, Rattus norvegicus
gttctatgttttgccagttttccac

SEQ ID NO: 526406 - DNA, 25 bp, Rattus norvegicus
gttctattcacaagcttaaagaagt

SEQ ID NO: 526407 - DNA, 25 bp, Rattus norvegicus
gttctattcacatgcttaaagaagt

SEQ ID NO: 526408 - DNA, 25 bp, Rattus norvegicus
gttctattcatcagcaaagagccat

SEQ ID NO: 526409 - DNA, 25 bp, Rattus norvegicus
gttctattcatctgcaaagagccat

SEQ ID NO: 526410 - DNA, 25 bp, Rattus norvegicus
gttctattccctacttggcaggctt

SEQ ID NO: 526411 - DNA, 25 bp, Rattus norvegicus
gttctattcccttcttggcaggctt

SEQ ID NO: 526412 - DNA, 25 bp, Rattus norvegicus
gttctattctgaccgcacacacaca

SEQ ID NO: 526413 - DNA, 25 bp, Rattus norvegicus
gttctattctgagcgcacacacaca

SEQ ID NO: 526414 - DNA, 25 bp, Rattus norvegicus
gttctattgtaaacgctttgcctgt

SEQ ID NO: 526415 - DNA, 25 bp, Rattus norvegicus
gttctattgtaatcgctttgcctgt

SEQ ID NO: 526416 - DNA, 25 bp, Rattus norvegicus
gttctatttcagactttatatccag

SEQ ID NO: 526417 - DNA, 25 bp, Rattus norvegicus
gttctatttcagtctttatatccag

SEQ ID NO: 526418 - DNA, 25 bp, Rattus norvegicus
gttctattttaccatggtgctccca

SEQ ID NO: 526419 - DNA, 25 bp, Rattus norvegicus
gttctattttacgatggtgctccca

SEQ ID NO: 526420 - DNA, 25 bp, Rattus norvegicus
gttctattttgtcgcagtgacaata

SEQ ID NO: 526421 - DNA, 25 bp, Rattus norvegicus
gttctattttgtggcagtgacaata

SEQ ID NO: 526422 - DNA, 25 bp, Rattus norvegicus
gttctcaaaaacaacaatgggattt

SEQ ID NO: 526423 - DNA, 25 bp, Rattus norvegicus
gttctcaaaaactacaatgggattt

SEQ ID NO: 526424 - DNA, 25 bp, Rattus norvegicus
gttctcaaaatgctgctagcagtca

SEQ ID NO: 526425 - DNA, 25 bp, Rattus norvegicus
gttctcaaaatggtgctagcagtca

SEQ ID NO: 526426 - DNA, 25 bp, Rattus norvegicus
gttctcaaacccaggtatcagtgat

SEQ ID NO: 526427 - DNA, 25 bp, Rattus norvegicus
gttctcaaaccctggtatcagtgat

SEQ ID NO: 526428 - DNA, 25 bp, Rattus norvegicus
gttctcaaacctaggagcgtcttta

SEQ ID NO: 526429 - DNA, 25 bp, Rattus norvegicus
gttctcaaaccttggagcgtcttta

SEQ ID NO: 526430 - DNA, 25 bp, Rattus norvegicus
gttctcaaagacatgcagcccagtt

SEQ ID NO: 526431 - DNA, 25 bp, Rattus norvegicus
gttctcaaagacttgcagcccagtt

SEQ ID NO: 526432 - DNA, 25 bp, Rattus norvegicus
gttctcaaaggacttggactcttct

SEQ ID NO: 526433 - DNA, 25 bp, Rattus norvegicus
gttctcaaaggagttggactcttct

SEQ ID NO: 526434 - DNA, 25 bp, Rattus norvegicus
gttctcaaattccagtgtgcccata

SEQ ID NO: 526435 - DNA, 25 bp, Rattus norvegicus
gttctcaaattcgagtgtgcccata

SEQ ID NO: 526436 - DNA, 25 bp, Rattus norvegicus
gttctcaactgcagggagcaaggga

SEQ ID NO: 526437 - DNA, 25 bp, Rattus norvegicus
gttctcaactgctgggagcaaggga

SEQ ID NO: 526438 - DNA, 25 bp, Rattus norvegicus
gttctcaactttccaattggcctgc

SEQ ID NO: 526439 - DNA, 25 bp, Rattus norvegicus
gttctcaactttgcaattggcctgc

SEQ ID NO: 526440 - DNA, 25 bp, Rattus norvegicus
gttctcaaggagctccctatgtcta

SEQ ID NO: 526441 - DNA, 25 bp, Rattus norvegicus
gttctcaaggaggtccctatgtcta

SEQ ID NO: 526442 - DNA, 25 bp, Rattus norvegicus
gttctcaagtgcattttgttctgta

SEQ ID NO: 526443 - DNA, 25 bp, Rattus norvegicus
gttctcaagtgctttttgttctgta

SEQ ID NO: 526444 - DNA, 25 bp, Rattus norvegicus
gttctcacacataagtacacaccca

SEQ ID NO: 526445 - DNA, 25 bp, Rattus norvegicus
gttctcacacattagtacacaccca

SEQ ID NO: 526446 - DNA, 25 bp, Rattus norvegicus
gttctcacactcacttggtaatggg

SEQ ID NO: 526447 - DNA, 25 bp, Rattus norvegicus
gttctcacactctcttggtaatggg

SEQ ID NO: 526448 - DNA, 25 bp, Rattus norvegicus
gttctcacagcaagtttatcacaca

SEQ ID NO: 526449 - DNA, 25 bp, Rattus norvegicus
gttctcacagcacccactttgaggg

SEQ ID NO: 526450 - DNA, 25 bp, Rattus norvegicus
gttctcacagcagccactttgaggg

SEQ ID NO: 526451 - DNA, 25 bp, Rattus norvegicus
gttctcacagcatgtttatcacaca

SEQ ID NO: 526452 - DNA, 25 bp, Rattus norvegicus
gttctcacatagatgttgctcacca

SEQ ID NO: 526453 - DNA, 25 bp, Rattus norvegicus
gttctcacatagttgttgctcacca

SEQ ID NO: 526454 - DNA, 25 bp, Rattus norvegicus
gttctcacattgacgtgcaggccgg

SEQ ID NO: 526455 - DNA, 25 bp, Rattus norvegicus
gttctcacattgtcgtgcaggccgg

SEQ ID NO: 526456 - DNA, 25 bp, Rattus norvegicus
gttctcaccaccaactcctggaggg

SEQ ID NO: 526457 - DNA, 25 bp, Rattus norvegicus
gttctcaccacctactcctggaggg

SEQ ID NO: 526458 - DNA, 25 bp, Rattus norvegicus
gttctcacggcccactgagggcgac

SEQ ID NO: 526459 - DNA, 25 bp, Rattus norvegicus
gttctcacggccgactgagggcgac

SEQ ID NO: 526460 - DNA, 25 bp, Rattus norvegicus
gttctcactcaaaacttcagctcta

SEQ ID NO: 526461 - DNA, 25 bp, Rattus norvegicus
gttctcactcaatacttcagctcta

SEQ ID NO: 526462 - DNA, 25 bp, Rattus norvegicus
gttctcactccgatgctggagtaca

SEQ ID NO: 526463 - DNA, 25 bp, Rattus norvegicus
gttctcactccgttgctggagtaca

SEQ ID NO: 526464 - DNA, 25 bp, Rattus norvegicus
gttctcactgacagactatggtgcc

SEQ ID NO: 526465 - DNA, 25 bp, Rattus norvegicus
gttctcactgactgactatggtgcc

SEQ ID NO: 526466 - DNA, 25 bp, Rattus norvegicus
gttctcactgtgctcagatacaaaa

SEQ ID NO: 526467 - DNA, 25 bp, Rattus norvegicus
gttctcactgtggtcagatacaaaa

SEQ ID NO: 526468 - DNA, 25 bp, Rattus norvegicus
gttctcactgttcaggtactcctaa

SEQ ID NO: 526469 - DNA, 25 bp, Rattus norvegicus
gttctcactgttgaggtactcctaa

SEQ ID NO: 526470 - DNA, 25 bp, Rattus norvegicus
gttctcactttaagccgtgcaatat

SEQ ID NO: 526471 - DNA, 25 bp, Rattus norvegicus
gttctcactttatgccgtgcaatat

SEQ ID NO: 526472 - DNA, 25 bp, Rattus norvegicus
gttctcagaaacatagctgcctcgg

SEQ ID NO: 526473 - DNA, 25 bp, Rattus norvegicus
gttctcagaaacttagctgcctcgg

SEQ ID NO: 526474 - DNA, 25 bp, Rattus norvegicus
gttctcagagcacgagactccccga

SEQ ID NO: 526475 - DNA, 25 bp, Rattus norvegicus
gttctcagagcacttcagcatccac

SEQ ID NO: 526476 - DNA, 25 bp, Rattus norvegicus
gttctcagagcaggagactccccga

SEQ ID NO: 526477 - DNA, 25 bp, Rattus norvegicus
gttctcagagcagttcagcatccac

SEQ ID NO: 526478 - DNA, 25 bp, Rattus norvegicus
gttctcagaggcatcagacacatct

SEQ ID NO: 526479 - DNA, 25 bp, Rattus norvegicus
gttctcagaggcttcagacacatct

SEQ ID NO: 526480 - DNA, 25 bp, Rattus norvegicus
gttctcagataccactggatacttt

SEQ ID NO: 526481 - DNA, 25 bp, Rattus norvegicus
gttctcagatacgactggatacttt

SEQ ID NO: 526482 - DNA, 25 bp, Rattus norvegicus
gttctcagcagccagatagtgcttc

SEQ ID NO: 526483 - DNA, 25 bp, Rattus norvegicus
gttctcagcagcgagatagtgcttc

SEQ ID NO: 526484 - DNA, 25 bp, Rattus norvegicus
gttctcagctcccttgtgttcaaca

SEQ ID NO: 526485 - DNA, 25 bp, Rattus norvegicus
gttctcagctccgttgtgttcaaca

SEQ ID NO: 526486 - DNA, 25 bp, Rattus norvegicus
gttctcaggacacgacctggatgcg

SEQ ID NO: 526487 - DNA, 25 bp, Rattus norvegicus
gttctcaggacaggacctggatgcg

SEQ ID NO: 526488 - DNA, 25 bp, Rattus norvegicus
gttctcaggctgaccacactgggaa

SEQ ID NO: 526489 - DNA, 25 bp, Rattus norvegicus
gttctcaggctgtccacactgggaa

SEQ ID NO: 526490 - DNA, 25 bp, Rattus norvegicus
gttctcagggaaacagtctggctcc

SEQ ID NO: 526491 - DNA, 25 bp, Rattus norvegicus
gttctcagggaatcagtctggctcc

SEQ ID NO: 526492 - DNA, 25 bp, Rattus norvegicus
gttctcagtcttaatttcactctcg

SEQ ID NO: 526493 - DNA, 25 bp, Rattus norvegicus
gttctcagtctttatttcactctcg

SEQ ID NO: 526494 - DNA, 25 bp, Rattus norvegicus
gttctcagtggaagtcatttgtgat

SEQ ID NO: 526495 - DNA, 25 bp, Rattus norvegicus
gttctcagtggatgtcatttgtgat

SEQ ID NO: 526496 - DNA, 25 bp, Rattus norvegicus
gttctcataaagaggcggctccctt

SEQ ID NO: 526497 - DNA, 25 bp, Rattus norvegicus
gttctcataaagtggcggctccctt

SEQ ID NO: 526498 - DNA, 25 bp, Rattus norvegicus
gttctcatagccagtttttcaagtg

SEQ ID NO: 526499 - DNA, 25 bp, Rattus norvegicus
gttctcatagcctgtttttcaagtg

SEQ ID NO: 526500 - DNA, 25 bp, Rattus norvegicus
gttctcatccacagacttggtgcag

SEQ ID NO: 526501 - DNA, 25 bp, Rattus norvegicus
gttctcatccacatgccatctaaga

SEQ ID NO: 526502 - DNA, 25 bp, Rattus norvegicus
gttctcatccactgacttggtgcag

SEQ ID NO: 526503 - DNA, 25 bp, Rattus norvegicus
gttctcatccacttgccatctaaga

SEQ ID NO: 526504 - DNA, 25 bp, Rattus norvegicus
gttctcatctgtaacacacgtgttt

SEQ ID NO: 526505 - DNA, 25 bp, Rattus norvegicus
gttctcatctgttacacacgtgttt

SEQ ID NO: 526506 - DNA, 25 bp, Rattus norvegicus
gttctcatgaaacctgtctcgggac

SEQ ID NO: 526507 - DNA, 25 bp, Rattus norvegicus
gttctcatgaaagctgtctcgggac

SEQ ID NO: 526508 - DNA, 25 bp, Rattus norvegicus
gttctcatgaagatcacacttgagt

SEQ ID NO: 526509 - DNA, 25 bp, Rattus norvegicus
gttctcatgaagttcacacttgagt

SEQ ID NO: 526510 - DNA, 25 bp, Rattus norvegicus
gttctcatgcacaatgcactcagac

SEQ ID NO: 526511 - DNA, 25 bp, Rattus norvegicus
gttctcatgcactatgcactcagac

SEQ ID NO: 526512 - DNA, 25 bp, Rattus norvegicus
gttctcatgcatacgtaagcctgga

SEQ ID NO: 526513 - DNA, 25 bp, Rattus norvegicus
gttctcatgcattcgtaagcctgga

SEQ ID NO: 526514 - DNA, 25 bp, Rattus norvegicus
gttctcatggtgctcaaacctgctc

SEQ ID NO: 526515 - DNA, 25 bp, Rattus norvegicus
gttctcatggtggtcaaacctgctc

SEQ ID NO: 526516 - DNA, 25 bp, Rattus norvegicus
gttctcatgtttcatgccttggtga

SEQ ID NO: 526517 - DNA, 25 bp, Rattus norvegicus
gttctcatgtttgatgccttggtga

SEQ ID NO: 526518 - DNA, 25 bp, Rattus norvegicus
gttctcattctgctgtgtcttctga

SEQ ID NO: 526519 - DNA, 25 bp, Rattus norvegicus
gttctcattctggtgtgtcttctga

SEQ ID NO: 526520 - DNA, 25 bp, Rattus norvegicus
gttctcattgttctgactgtatcag

SEQ ID NO: 526521 - DNA, 25 bp, Rattus norvegicus
gttctcattgttgtgactgtatcag

SEQ ID NO: 526522 - DNA, 25 bp, Rattus norvegicus
gttctccaaccacattttgagccag

SEQ ID NO: 526523 - DNA, 25 bp, Rattus norvegicus
gttctccaaccagattttgagccag

SEQ ID NO: 526524 - DNA, 25 bp, Rattus norvegicus
gttctccacaccctagatgtaacat

SEQ ID NO: 526525 - DNA, 25 bp, Rattus norvegicus
gttctccacaccgtagatgtaacat

SEQ ID NO: 526526 - DNA, 25 bp, Rattus norvegicus
gttctccaccataaaacatgtttcc

SEQ ID NO: 526527 - DNA, 25 bp, Rattus norvegicus
gttctccaccattaaacatgtttcc

SEQ ID NO: 526528 - DNA, 25 bp, Rattus norvegicus
gttctccactcacacatcaagacag

SEQ ID NO: 526529 - DNA, 25 bp, Rattus norvegicus
gttctccactcagacatcaagacag

SEQ ID NO: 526530 - DNA, 25 bp, Rattus norvegicus
gttctccacttcagagtagtcgagt

SEQ ID NO: 526531 - DNA, 25 bp, Rattus norvegicus
gttctccacttctgagtagtcgagt

SEQ ID NO: 526532 - DNA, 25 bp, Rattus norvegicus
gttctccagaatatgggtgatgcaa

SEQ ID NO: 526533 - DNA, 25 bp, Rattus norvegicus
gttctccagaatttgggtgatgcaa

SEQ ID NO: 526534 - DNA, 25 bp, Rattus norvegicus
gttctccagggacaacaaccatcag

SEQ ID NO: 526535 - DNA, 25 bp, Rattus norvegicus
gttctccagggaccgctcattgaga

SEQ ID NO: 526536 - DNA, 25 bp, Rattus norvegicus
gttctccagggagaacaaccatcag

SEQ ID NO: 526537 - DNA, 25 bp, Rattus norvegicus
gttctccagggagcgctcattgaga

SEQ ID NO: 526538 - DNA, 25 bp, Rattus norvegicus
gttctccagtctcgtcagggcatgt

SEQ ID NO: 526539 - DNA, 25 bp, Rattus norvegicus
gttctccagtctggtcagggcatgt

SEQ ID NO: 526540 - DNA, 25 bp, Rattus norvegicus
gttctccagtggatacaatgggcta

SEQ ID NO: 526541 - DNA, 25 bp, Rattus norvegicus
gttctccagtggttacaatgggcta

SEQ ID NO: 526542 - DNA, 25 bp, Rattus norvegicus
gttctccatcgaattctcatttctg

SEQ ID NO: 526543 - DNA, 25 bp, Rattus norvegicus
gttctccatcgatttctcatttctg

SEQ ID NO: 526544 - DNA, 25 bp, Rattus norvegicus
gttctccatgatagtcagatctgca

SEQ ID NO: 526545 - DNA, 25 bp, Rattus norvegicus
gttctccatgattgtcagatctgca

SEQ ID NO: 526546 - DNA, 25 bp, Rattus norvegicus
gttctccatggcagctgccggaggt

SEQ ID NO: 526547 - DNA, 25 bp, Rattus norvegicus
gttctccatggctgctgccggaggt

SEQ ID NO: 526548 - DNA, 25 bp, Rattus norvegicus
gttctccattataatctcagtctta

SEQ ID NO: 526549 - DNA, 25 bp, Rattus norvegicus
gttctccattattatctcagtctta

SEQ ID NO: 526550 - DNA, 25 bp, Rattus norvegicus
gttctccattgtcattcgtttgact

SEQ ID NO: 526551 - DNA, 25 bp, Rattus norvegicus
gttctccattgtgattcgtttgact

SEQ ID NO: 526552 - DNA, 25 bp, Rattus norvegicus
gttctcccaacacctgaaaacggta

SEQ ID NO: 526553 - DNA, 25 bp, Rattus norvegicus
gttctcccaacagctgaaaacggta

SEQ ID NO: 526554 - DNA, 25 bp, Rattus norvegicus
gttctcccagaacgttttgctggtt

SEQ ID NO: 526555 - DNA, 25 bp, Rattus norvegicus
gttctcccagaaggttttgctggtt

SEQ ID NO: 526556 - DNA, 25 bp, Rattus norvegicus
gttctcccagctcactggatgacaa

SEQ ID NO: 526557 - DNA, 25 bp, Rattus norvegicus
gttctcccagctgactggatgacaa

SEQ ID NO: 526558 - DNA, 25 bp, Rattus norvegicus
gttctccccgtaattgtggcaagtg

SEQ ID NO: 526559 - DNA, 25 bp, Rattus norvegicus
gttctccccgtatttgtggcaagtg

SEQ ID NO: 526560 - DNA, 25 bp, Rattus norvegicus
gttctcccctgaatcacattttaat

SEQ ID NO: 526561 - DNA, 25 bp, Rattus norvegicus
gttctcccctgattcacattttaat

SEQ ID NO: 526562 - DNA, 25 bp, Rattus norvegicus
gttctcccgagacaatctttctcac

SEQ ID NO: 526563 - DNA, 25 bp, Rattus norvegicus
gttctcccgagagaatctttctcac

SEQ ID NO: 526564 - DNA, 25 bp, Rattus norvegicus
gttctccctgtaacaatatttcttg

SEQ ID NO: 526565 - DNA, 25 bp, Rattus norvegicus
gttctccctgtatcaatatttcttg

SEQ ID NO: 526566 - DNA, 25 bp, Rattus norvegicus
gttctccctttaccaacctgagtaa

SEQ ID NO: 526567 - DNA, 25 bp, Rattus norvegicus
gttctccctttagcaacctgagtaa

SEQ ID NO: 526568 - DNA, 25 bp, Rattus norvegicus
gttctccgaaacatggtggatccca

SEQ ID NO: 526569 - DNA, 25 bp, Rattus norvegicus
gttctccgaaacttggtggatccca

SEQ ID NO: 526570 - DNA, 25 bp, Rattus norvegicus
gttctccgattcagtgatacttctt

SEQ ID NO: 526571 - DNA, 25 bp, Rattus norvegicus
gttctccgattctgtgatacttctt

SEQ ID NO: 526572 - DNA, 25 bp, Rattus norvegicus
gttctccgtcagctgtacagttttt

SEQ ID NO: 526573 - DNA, 25 bp, Rattus norvegicus
gttctccgtcaggtgtacagttttt

SEQ ID NO: 526574 - DNA, 25 bp, Rattus norvegicus
gttctccgttggattgtacttgtat

SEQ ID NO: 526575 - DNA, 25 bp, Rattus norvegicus
gttctccgttggtttgtacttgtat

SEQ ID NO: 526576 - DNA, 25 bp, Rattus norvegicus
gttctcctactgagacttgtgattt

SEQ ID NO: 526577 - DNA, 25 bp, Rattus norvegicus
gttctcctactgtgacttgtgattt

SEQ ID NO: 526578 - DNA, 25 bp, Rattus norvegicus
gttctcctattactgtctgtcataa

SEQ ID NO: 526579 - DNA, 25 bp, Rattus norvegicus
gttctcctattagtgtctgtcataa

SEQ ID NO: 526580 - DNA, 25 bp, Rattus norvegicus
gttctcctattcatgaatacagctg

SEQ ID NO: 526581 - DNA, 25 bp, Rattus norvegicus
gttctcctattcttgaatacagctg

SEQ ID NO: 526582 - DNA, 25 bp, Rattus norvegicus
gttctcctcatccttgtgattttca

SEQ ID NO: 526583 - DNA, 25 bp, Rattus norvegicus
gttctcctcatcgttgtgattttca

SEQ ID NO: 526584 - DNA, 25 bp, Rattus norvegicus
gttctcctctgtatctgttttagaa

SEQ ID NO: 526585 - DNA, 25 bp, Rattus norvegicus
gttctcctctgtttctgttttagaa

SEQ ID NO: 526586 - DNA, 25 bp, Rattus norvegicus
gttctcctctttcttttatcttgtt

SEQ ID NO: 526587 - DNA, 25 bp, Rattus norvegicus
gttctcctctttgttttatcttgtt

SEQ ID NO: 526588 - DNA, 25 bp, Rattus norvegicus
gttctcctgaccagtggtgttgcag

SEQ ID NO: 526589 - DNA, 25 bp, Rattus norvegicus
gttctcctgacctgtggtgttgcag

SEQ ID NO: 526590 - DNA, 25 bp, Rattus norvegicus
gttctcctgcaaatagttcactttc

SEQ ID NO: 526591 - DNA, 25 bp, Rattus norvegicus
gttctcctgcaattagttcactttc

SEQ ID NO: 526592 - DNA, 25 bp, Rattus norvegicus
gttctcctgctaattgtatgacatc

SEQ ID NO: 526593 - DNA, 25 bp, Rattus norvegicus
gttctcctgctatttgtatgacatc

SEQ ID NO: 526594 - DNA, 25 bp, Rattus norvegicus
gttctccttaacctttgtatgcttt

SEQ ID NO: 526595 - DNA, 25 bp, Rattus norvegicus
gttctccttaacgtttgtatgcttt

SEQ ID NO: 526596 - DNA, 25 bp, Rattus norvegicus
gttctccttcagacttcaatgaggc

SEQ ID NO: 526597 - DNA, 25 bp, Rattus norvegicus
gttctccttcagtcttcaatgaggc

SEQ ID NO: 526598 - DNA, 25 bp, Rattus norvegicus
gttctccttccacagtgggttctaa

SEQ ID NO: 526599 - DNA, 25 bp, Rattus norvegicus
gttctccttccagagtgggttctaa

SEQ ID NO: 526600 - DNA, 25 bp, Rattus norvegicus
gttctccttgagagtttccaggcct

SEQ ID NO: 526601 - DNA, 25 bp, Rattus norvegicus
gttctccttgagtgtttccaggcct

SEQ ID NO: 526602 - DNA, 25 bp, Rattus norvegicus
gttctccttggtaaccctctgtata

SEQ ID NO: 526603 - DNA, 25 bp, Rattus norvegicus
gttctccttggttaccctctgtata

SEQ ID NO: 526604 - DNA, 25 bp, Rattus norvegicus
gttctccttttgaagtatcccactg

SEQ ID NO: 526605 - DNA, 25 bp, Rattus norvegicus
gttctccttttgtagtatcccactg

SEQ ID NO: 526606 - DNA, 25 bp, Rattus norvegicus
gttctcgaacttacctatttgtcct

SEQ ID NO: 526607 - DNA, 25 bp, Rattus norvegicus
gttctcgaactttcctatttgtcct

SEQ ID NO: 526608 - DNA, 25 bp, Rattus norvegicus
gttctcgattttaggagcccagctt

SEQ ID NO: 526609 - DNA, 25 bp, Rattus norvegicus
gttctcgatttttggagcccagctt

SEQ ID NO: 526610 - DNA, 25 bp, Rattus norvegicus
gttctcgccgagaaggtagcctcac

SEQ ID NO: 526611 - DNA, 25 bp, Rattus norvegicus
gttctcgccgagtaggtagcctcac

SEQ ID NO: 526612 - DNA, 25 bp, Rattus norvegicus
gttctcgccggacagacagaggtat

SEQ ID NO: 526613 - DNA, 25 bp, Rattus norvegicus
gttctcgccggagagacagaggtat

SEQ ID NO: 526614 - DNA, 25 bp, Rattus norvegicus
gttctcgctggaagaggcgtaccca

SEQ ID NO: 526615 - DNA, 25 bp, Rattus norvegicus
gttctcgctggatgaggcgtaccca

SEQ ID NO: 526616 - DNA, 25 bp, Rattus norvegicus
gttctcggagaaccattcgaccctg

SEQ ID NO: 526617 - DNA, 25 bp, Rattus norvegicus
gttctcggagaagcattcgaccctg

SEQ ID NO: 526618 - DNA, 25 bp, Rattus norvegicus
gttctcgtctcacagtgtctaatgc

SEQ ID NO: 526619 - DNA, 25 bp, Rattus norvegicus
gttctcgtctcagagtgtctaatgc

SEQ ID NO: 526620 - DNA, 25 bp, Rattus norvegicus
gttctcgtgtgtctttaattggccc

SEQ ID NO: 526621 - DNA, 25 bp, Rattus norvegicus
gttctcgtgtgtgtttaattggccc

SEQ ID NO: 526622 - DNA, 25 bp, Rattus norvegicus
gttctcgttaaacaccagagtgcat

SEQ ID NO: 526623 - DNA, 25 bp, Rattus norvegicus
gttctcgttaaagaccagagtgcat

SEQ ID NO: 526624 - DNA, 25 bp, Rattus norvegicus
gttctcgttctgaagcgtttgtaaa

SEQ ID NO: 526625 - DNA, 25 bp, Rattus norvegicus
gttctcgttctgtagcgtttgtaaa

SEQ ID NO: 526626 - DNA, 25 bp, Rattus norvegicus
gttctctaacataatgggctgtcat

SEQ ID NO: 526627 - DNA, 25 bp, Rattus norvegicus
gttctctaacattatgggctgtcat

SEQ ID NO: 526628 - DNA, 25 bp, Rattus norvegicus
gttctctaagttaataagggcccag

SEQ ID NO: 526629 - DNA, 25 bp, Rattus norvegicus
gttctctaagtttataagggcccag

SEQ ID NO: 526630 - DNA, 25 bp, Rattus norvegicus
gttctctaatctacatcctaatcac

SEQ ID NO: 526631 - DNA, 25 bp, Rattus norvegicus
gttctctaatcttcatcctaatcac

SEQ ID NO: 526632 - DNA, 25 bp, Rattus norvegicus
gttctctaatgaaactaacacgatg

SEQ ID NO: 526633 - DNA, 25 bp, Rattus norvegicus
gttctctaatgatactaacacgatg

SEQ ID NO: 526634 - DNA, 25 bp, Rattus norvegicus
gttctctacaacacttatgccgcct

SEQ ID NO: 526635 - DNA, 25 bp, Rattus norvegicus
gttctctacaactcttatgccgcct

SEQ ID NO: 526636 - DNA, 25 bp, Rattus norvegicus
gttctctacacccattttagacttg

SEQ ID NO: 526637 - DNA, 25 bp, Rattus norvegicus
gttctctacaccgattttagacttg

SEQ ID NO: 526638 - DNA, 25 bp, Rattus norvegicus
gttctctacgctccctagacattat

SEQ ID NO: 526639 - DNA, 25 bp, Rattus norvegicus
gttctctacgctgcctagacattat

SEQ ID NO: 526640 - DNA, 25 bp, Rattus norvegicus
gttctctactgaacttccctgaagt

SEQ ID NO: 526641 - DNA, 25 bp, Rattus norvegicus
gttctctactgatcttccctgaagt

SEQ ID NO: 526642 - DNA, 25 bp, Rattus norvegicus
gttctctactgcctaactggtgtga

SEQ ID NO: 526643 - DNA, 25 bp, Rattus norvegicus
gttctctactgcgtaactggtgtga

SEQ ID NO: 526644 - DNA, 25 bp, Rattus norvegicus
gttctctagaacaatttatggcaga

SEQ ID NO: 526645 - DNA, 25 bp, Rattus norvegicus
gttctctagaactatttatggcaga

SEQ ID NO: 526646 - DNA, 25 bp, Rattus norvegicus
gttctctagagaaaaacacgctttt

SEQ ID NO: 526647 - DNA, 25 bp, Rattus norvegicus
gttctctagagataaacacgctttt

SEQ ID NO: 526648 - DNA, 25 bp, Rattus norvegicus
gttctctaggctctttcaggtatac

SEQ ID NO: 526649 - DNA, 25 bp, Rattus norvegicus
gttctctaggctgtttcaggtatac

SEQ ID NO: 526650 - DNA, 25 bp, Rattus norvegicus
gttctctatgtgactgtggcactga

SEQ ID NO: 526651 - DNA, 25 bp, Rattus norvegicus
gttctctatgtgtctgtggcactga

SEQ ID NO: 526652 - DNA, 25 bp, Rattus norvegicus
gttctctattcacagctaatgggtt

SEQ ID NO: 526653 - DNA, 25 bp, Rattus norvegicus
gttctctattcagagctaatgggtt

SEQ ID NO: 526654 - DNA, 25 bp, Rattus norvegicus
gttctctcaaatcacctaagctaga

SEQ ID NO: 526655 - DNA, 25 bp, Rattus norvegicus
gttctctcaaatgacctaagctaga

SEQ ID NO: 526656 - DNA, 25 bp, Rattus norvegicus
gttctctcaacaaacattgccttgt

SEQ ID NO: 526657 - DNA, 25 bp, Rattus norvegicus
gttctctcaacatacattgccttgt

SEQ ID NO: 526658 - DNA, 25 bp, Rattus norvegicus
gttctctcaccacgtggttttgttc

SEQ ID NO: 526659 - DNA, 25 bp, Rattus norvegicus
gttctctcaccaggtggttttgttc

SEQ ID NO: 526660 - DNA, 25 bp, Rattus norvegicus
gttctctcacctccagggcgatagg

SEQ ID NO: 526661 - DNA, 25 bp, Rattus norvegicus
gttctctcacctctaagtgatggcc

SEQ ID NO: 526662 - DNA, 25 bp, Rattus norvegicus
gttctctcacctgcagggcgatagg

SEQ ID NO: 526663 - DNA, 25 bp, Rattus norvegicus
gttctctcacctgtaagtgatggcc

SEQ ID NO: 526664 - DNA, 25 bp, Rattus norvegicus
gttctctcagttaattatgccatct

SEQ ID NO: 526665 - DNA, 25 bp, Rattus norvegicus
gttctctcagtttattatgccatct

SEQ ID NO: 526666 - DNA, 25 bp, Rattus norvegicus
gttctctccaagaaaccagtgatct

SEQ ID NO: 526667 - DNA, 25 bp, Rattus norvegicus
gttctctccaagtaaccagtgatct

SEQ ID NO: 526668 - DNA, 25 bp, Rattus norvegicus
gttctctccactattgtgtcaataa

SEQ ID NO: 526669 - DNA, 25 bp, Rattus norvegicus
gttctctccacttttgtgtcaataa

SEQ ID NO: 526670 - DNA, 25 bp, Rattus norvegicus
gttctctccatcagactctgagtgt

SEQ ID NO: 526671 - DNA, 25 bp, Rattus norvegicus
gttctctccatctgactctgagtgt

SEQ ID NO: 526672 - DNA, 25 bp, Rattus norvegicus
gttctctccctactcttggaaaaca

SEQ ID NO: 526673 - DNA, 25 bp, Rattus norvegicus
gttctctccctagtcttggaaaaca

SEQ ID NO: 526674 - DNA, 25 bp, Rattus norvegicus
gttctctcccttaagttctagcaaa

SEQ ID NO: 526675 - DNA, 25 bp, Rattus norvegicus
gttctctccctttagttctagcaaa

SEQ ID NO: 526676 - DNA, 25 bp, Rattus norvegicus
gttctctcctaccatgtagatcctg

SEQ ID NO: 526677 - DNA, 25 bp, Rattus norvegicus
gttctctcctacgatgtagatcctg

SEQ ID NO: 526678 - DNA, 25 bp, Rattus norvegicus
gttctctcgcttaagtggcctgaaa

SEQ ID NO: 526679 - DNA, 25 bp, Rattus norvegicus
gttctctcgctttagtggcctgaaa

SEQ ID NO: 526680 - DNA, 25 bp, Rattus norvegicus
gttctctctcatattttagggaggg

SEQ ID NO: 526681 - DNA, 25 bp, Rattus norvegicus
gttctctctcatcgaattctgttga

SEQ ID NO: 526682 - DNA, 25 bp, Rattus norvegicus
gttctctctcatggaattctgttga

SEQ ID NO: 526683 - DNA, 25 bp, Rattus norvegicus
gttctctctcattttttagggaggg

SEQ ID NO: 526684 - DNA, 25 bp, Rattus norvegicus
gttctctctccaagaaggtcctgag

SEQ ID NO: 526685 - DNA, 25 bp, Rattus norvegicus
gttctctctccatgaaggtcctgag

SEQ ID NO: 526686 - DNA, 25 bp, Rattus norvegicus
gttctctctgaactggacttaccag

SEQ ID NO: 526687 - DNA, 25 bp, Rattus norvegicus
gttctctctgaagtggacttaccag

SEQ ID NO: 526688 - DNA, 25 bp, Rattus norvegicus
gttctctctgcactggatctggaaa

SEQ ID NO: 526689 - DNA, 25 bp, Rattus norvegicus
gttctctctgcagtggatctggaaa

SEQ ID NO: 526690 - DNA, 25 bp, Rattus norvegicus
gttctctctgtaatcacctgacgtt

SEQ ID NO: 526691 - DNA, 25 bp, Rattus norvegicus
gttctctctgtattcacctgacgtt

SEQ ID NO: 526692 - DNA, 25 bp, Rattus norvegicus
gttctctgacagctacatattgcaa

SEQ ID NO: 526693 - DNA, 25 bp, Rattus norvegicus
gttctctgacaggtacatattgcaa

SEQ ID NO: 526694 - DNA, 25 bp, Rattus norvegicus
gttctctgaccaacttggaactacc

SEQ ID NO: 526695 - DNA, 25 bp, Rattus norvegicus
gttctctgaccatcttggaactacc

SEQ ID NO: 526696 - DNA, 25 bp, Rattus norvegicus
gttctctgactgagcaagtctctta

SEQ ID NO: 526697 - DNA, 25 bp, Rattus norvegicus
gttctctgactgtgcaagtctctta

SEQ ID NO: 526698 - DNA, 25 bp, Rattus norvegicus
gttctctgagtaactgtgggcacaa

SEQ ID NO: 526699 - DNA, 25 bp, Rattus norvegicus
gttctctgagtatctgtgggcacaa

SEQ ID NO: 526700 - DNA, 25 bp, Rattus norvegicus
gttctctgcattcttgtagttctgt

SEQ ID NO: 526701 - DNA, 25 bp, Rattus norvegicus
gttctctgcattgttgtagttctgt

SEQ ID NO: 526702 - DNA, 25 bp, Rattus norvegicus
gttctctgctaaccactgttgatgc

SEQ ID NO: 526703 - DNA, 25 bp, Rattus norvegicus
gttctctgctaagcactgttgatgc

SEQ ID NO: 526704 - DNA, 25 bp, Rattus norvegicus
gttctctgctgacttactgctgagc

SEQ ID NO: 526705 - DNA, 25 bp, Rattus norvegicus
gttctctgctgagttactgctgagc

SEQ ID NO: 526706 - DNA, 25 bp, Rattus norvegicus
gttctctgcttaattagaggccttt

SEQ ID NO: 526707 - DNA, 25 bp, Rattus norvegicus
gttctctgcttatttagaggccttt

SEQ ID NO: 526708 - DNA, 25 bp, Rattus norvegicus
gttctctggaaacacctattaagtt

SEQ ID NO: 526709 - DNA, 25 bp, Rattus norvegicus
gttctctggaaagacctattaagtt

SEQ ID NO: 526710 - DNA, 25 bp, Rattus norvegicus
gttctctggagaccaccaaggttgg

SEQ ID NO: 526711 - DNA, 25 bp, Rattus norvegicus
gttctctggagagcaccaaggttgg

SEQ ID NO: 526712 - DNA, 25 bp, Rattus norvegicus
gttctctggcgcatgtaacaactcg

SEQ ID NO: 526713 - DNA, 25 bp, Rattus norvegicus
gttctctggcgcttgtaacaactcg

SEQ ID NO: 526714 - DNA, 25 bp, Rattus norvegicus
gttctctgggagaaggctttccaca

SEQ ID NO: 526715 - DNA, 25 bp, Rattus norvegicus
gttctctgggagtaggctttccaca

SEQ ID NO: 526716 - DNA, 25 bp, Rattus norvegicus
gttctctggttaagtgatctgggac

SEQ ID NO: 526717 - DNA, 25 bp, Rattus norvegicus
gttctctggttatgtgatctgggac

SEQ ID NO: 526718 - DNA, 25 bp, Rattus norvegicus
gttctctggtttacatacttccagt

SEQ ID NO: 526719 - DNA, 25 bp, Rattus norvegicus
gttctctggttttcatacttccagt

SEQ ID NO: 526720 - DNA, 25 bp, Rattus norvegicus
gttctctgtagaattctgaagtgca

SEQ ID NO: 526721 - DNA, 25 bp, Rattus norvegicus
gttctctgtagatttctgaagtgca

SEQ ID NO: 526722 - DNA, 25 bp, Rattus norvegicus
gttctctgtagcatcctgctggaaa

SEQ ID NO: 526723 - DNA, 25 bp, Rattus norvegicus
gttctctgtagcttcctgctggaaa

SEQ ID NO: 526724 - DNA, 25 bp, Rattus norvegicus
gttctctgtcacaaagcgtgcagca

SEQ ID NO: 526725 - DNA, 25 bp, Rattus norvegicus
gttctctgtcactaagcgtgcagca

SEQ ID NO: 526726 - DNA, 25 bp, Rattus norvegicus
gttctctgtggtattgagtcttcca

SEQ ID NO: 526727 - DNA, 25 bp, Rattus norvegicus
gttctctgtggttttgagtcttcca

SEQ ID NO: 526728 - DNA, 25 bp, Rattus norvegicus
gttctctgtgttcgaacgcagtctg

SEQ ID NO: 526729 - DNA, 25 bp, Rattus norvegicus
gttctctgtgttggaacgcagtctg

SEQ ID NO: 526730 - DNA, 25 bp, Rattus norvegicus
gttctctgttaaatcaagccgtgct

SEQ ID NO: 526731 - DNA, 25 bp, Rattus norvegicus
gttctctgttaattcaagccgtgct

SEQ ID NO: 526732 - DNA, 25 bp, Rattus norvegicus
gttctctgttccagggtacaagggt

SEQ ID NO: 526733 - DNA, 25 bp, Rattus norvegicus
gttctctgttcctgggtacaagggt

SEQ ID NO: 526734 - DNA, 25 bp, Rattus norvegicus
gttctcttaagtattgctggctgta

SEQ ID NO: 526735 - DNA, 25 bp, Rattus norvegicus
gttctcttaagttttgctggctgta

SEQ ID NO: 526736 - DNA, 25 bp, Rattus norvegicus
gttctcttactgaactccaggttaa

SEQ ID NO: 526737 - DNA, 25 bp, Rattus norvegicus
gttctcttactgactactgattggt

SEQ ID NO: 526738 - DNA, 25 bp, Rattus norvegicus
gttctcttactgtactccaggttaa

SEQ ID NO: 526739 - DNA, 25 bp, Rattus norvegicus
gttctcttactgtctactgattggt

SEQ ID NO: 526740 - DNA, 25 bp, Rattus norvegicus
gttctcttacttcccttaaaactgg

SEQ ID NO: 526741 - DNA, 25 bp, Rattus norvegicus
gttctcttacttgccttaaaactgg

SEQ ID NO: 526742 - DNA, 25 bp, Rattus norvegicus
gttctcttagtcctcatattcacaa

SEQ ID NO: 526743 - DNA, 25 bp, Rattus norvegicus
gttctcttagtcgtcatattcacaa

SEQ ID NO: 526744 - DNA, 25 bp, Rattus norvegicus
gttctcttcataactgccttgacgt

SEQ ID NO: 526745 - DNA, 25 bp, Rattus norvegicus
gttctcttcatatctgccttgacgt

SEQ ID NO: 526746 - DNA, 25 bp, Rattus norvegicus
gttctcttccttcttgtattaacag

SEQ ID NO: 526747 - DNA, 25 bp, Rattus norvegicus
gttctcttccttgttgtattaacag

SEQ ID NO: 526748 - DNA, 25 bp, Rattus norvegicus
gttctcttctatcttttctctttta

SEQ ID NO: 526749 - DNA, 25 bp, Rattus norvegicus
gttctcttctatgttttctctttta

SEQ ID NO: 526750 - DNA, 25 bp, Rattus norvegicus
gttctcttcttaatggatcaccaaa

SEQ ID NO: 526751 - DNA, 25 bp, Rattus norvegicus
gttctcttcttattggatcaccaaa

SEQ ID NO: 526752 - DNA, 25 bp, Rattus norvegicus
gttctcttgaaaattttggcccagt

SEQ ID NO: 526753 - DNA, 25 bp, Rattus norvegicus
gttctcttgaaatttttggcccagt

SEQ ID NO: 526754 - DNA, 25 bp, Rattus norvegicus
gttctcttgtatactcaaggatcca

SEQ ID NO: 526755 - DNA, 25 bp, Rattus norvegicus
gttctcttgtattctcaaggatcca

SEQ ID NO: 526756 - DNA, 25 bp, Rattus norvegicus
gttctctttcaaaagctttcccaga

SEQ ID NO: 526757 - DNA, 25 bp, Rattus norvegicus
gttctctttcaatagctttcccaga

SEQ ID NO: 526758 - DNA, 25 bp, Rattus norvegicus
gttctctttccaaagggcggctgcc

SEQ ID NO: 526759 - DNA, 25 bp, Rattus norvegicus
gttctctttccatagggcggctgcc

SEQ ID NO: 526760 - DNA, 25 bp, Rattus norvegicus
gttctctttctgacattccaaacca

SEQ ID NO: 526761 - DNA, 25 bp, Rattus norvegicus
gttctctttctgtcattccaaacca

SEQ ID NO: 526762 - DNA, 25 bp, Rattus norvegicus
gttctctttggcatgactcagacta

SEQ ID NO: 526763 - DNA, 25 bp, Rattus norvegicus
gttctctttggcttgactcagacta

SEQ ID NO: 526764 - DNA, 25 bp, Rattus norvegicus
gttctcttttctacatgttatactg

SEQ ID NO: 526765 - DNA, 25 bp, Rattus norvegicus
gttctcttttcttcatgttatactg

SEQ ID NO: 526766 - DNA, 25 bp, Rattus norvegicus
gttctcttttgactacatttctcca

SEQ ID NO: 526767 - DNA, 25 bp, Rattus norvegicus
gttctcttttgactcctttcaaaga

SEQ ID NO: 526768 - DNA, 25 bp, Rattus norvegicus
gttctcttttgagtacatttctcca

SEQ ID NO: 526769 - DNA, 25 bp, Rattus norvegicus
gttctcttttgagtcctttcaaaga

SEQ ID NO: 526770 - DNA, 25 bp, Rattus norvegicus
gttctgaaaagcacctgttctgccc

SEQ ID NO: 526771 - DNA, 25 bp, Rattus norvegicus
gttctgaaaagctcctgttctgccc

SEQ ID NO: 526772 - DNA, 25 bp, Rattus norvegicus
gttctgaaatggcagtgtccactta

SEQ ID NO: 526773 - DNA, 25 bp, Rattus norvegicus
gttctgaaatgggagtgtccactta

SEQ ID NO: 526774 - DNA, 25 bp, Rattus norvegicus
gttctgaagaacagtatctgagggt

SEQ ID NO: 526775 - DNA, 25 bp, Rattus norvegicus
gttctgaagaactgtatctgagggt

SEQ ID NO: 526776 - DNA, 25 bp, Rattus norvegicus
gttctgaagatgaaccttggcctca

SEQ ID NO: 526777 - DNA, 25 bp, Rattus norvegicus
gttctgaagatgcatccctctggca

SEQ ID NO: 526778 - DNA, 25 bp, Rattus norvegicus
gttctgaagatggatccctctggca

SEQ ID NO: 526779 - DNA, 25 bp, Rattus norvegicus
gttctgaagatgtaccttggcctca

SEQ ID NO: 526780 - DNA, 25 bp, Rattus norvegicus
gttctgaagcgaaacagttgtcact

SEQ ID NO: 526781 - DNA, 25 bp, Rattus norvegicus
gttctgaagcgatacagttgtcact

SEQ ID NO: 526782 - DNA, 25 bp, Rattus norvegicus
gttctgaagtccctagtcatcgtca

SEQ ID NO: 526783 - DNA, 25 bp, Rattus norvegicus
gttctgaagtccgtagtcatcgtca

SEQ ID NO: 526784 - DNA, 25 bp, Rattus norvegicus
gttctgaatcaaagcagtcctcccc

SEQ ID NO: 526785 - DNA, 25 bp, Rattus norvegicus
gttctgaatcaatgcagtcctcccc

SEQ ID NO: 526786 - DNA, 25 bp, Rattus norvegicus
gttctgaatgaactatgccccttcc

SEQ ID NO: 526787 - DNA, 25 bp, Rattus norvegicus
gttctgaatgaagtatgccccttcc

SEQ ID NO: 526788 - DNA, 25 bp, Rattus norvegicus
gttctgaatgcaaccggttctgaat

SEQ ID NO: 526789 - DNA, 25 bp, Rattus norvegicus
gttctgaatgcatccggttctgaat

SEQ ID NO: 526790 - DNA, 25 bp, Rattus norvegicus
gttctgaatgccaaagacttgagtg

SEQ ID NO: 526791 - DNA, 25 bp, Rattus norvegicus
gttctgaatgcctaagacttgagtg

SEQ ID NO: 526792 - DNA, 25 bp, Rattus norvegicus
gttctgaattaaatggtcctgacct

SEQ ID NO: 526793 - DNA, 25 bp, Rattus norvegicus
gttctgaattaattggtcctgacct

SEQ ID NO: 526794 - DNA, 25 bp, Rattus norvegicus
gttctgacagacatattctgccata

SEQ ID NO: 526795 - DNA, 25 bp, Rattus norvegicus
gttctgacagacttattctgccata

SEQ ID NO: 526796 - DNA, 25 bp, Rattus norvegicus
gttctgacaggaactttgggtccat

SEQ ID NO: 526797 - DNA, 25 bp, Rattus norvegicus
gttctgacaggatctttgggtccat

SEQ ID NO: 526798 - DNA, 25 bp, Rattus norvegicus
gttctgacatagagttcctcactga

SEQ ID NO: 526799 - DNA, 25 bp, Rattus norvegicus
gttctgacatagtgttcctcactga

SEQ ID NO: 526800 - DNA, 25 bp, Rattus norvegicus
gttctgacattaacagttttccatg

SEQ ID NO: 526801 - DNA, 25 bp, Rattus norvegicus
gttctgacattatcagttttccatg

SEQ ID NO: 526802 - DNA, 25 bp, Rattus norvegicus
gttctgacatttacacactatgaag

SEQ ID NO: 526803 - DNA, 25 bp, Rattus norvegicus
gttctgacattttcacactatgaag

SEQ ID NO: 526804 - DNA, 25 bp, Rattus norvegicus
gttctgaccaaacttgttctgtatc

SEQ ID NO: 526805 - DNA, 25 bp, Rattus norvegicus
gttctgaccaaagttgttctgtatc

SEQ ID NO: 526806 - DNA, 25 bp, Rattus norvegicus
gttctgaccaatcagcacggctgac

SEQ ID NO: 526807 - DNA, 25 bp, Rattus norvegicus
gttctgaccaatgagcacggctgac

SEQ ID NO: 526808 - DNA, 25 bp, Rattus norvegicus
gttctgaccttcatggatgctctga

SEQ ID NO: 526809 - DNA, 25 bp, Rattus norvegicus
gttctgaccttcttggatgctctga

SEQ ID NO: 526810 - DNA, 25 bp, Rattus norvegicus
gttctgactaataccaattgcttgc

SEQ ID NO: 526811 - DNA, 25 bp, Rattus norvegicus
gttctgactaattccaattgcttgc

SEQ ID NO: 526812 - DNA, 25 bp, Rattus norvegicus
gttctgactagtctctagcattctg

SEQ ID NO: 526813 - DNA, 25 bp, Rattus norvegicus
gttctgactagtgtctagcattctg

SEQ ID NO: 526814 - DNA, 25 bp, Rattus norvegicus
gttctgactggcatggtggagtgaa

SEQ ID NO: 526815 - DNA, 25 bp, Rattus norvegicus
gttctgactggcttggtggagtgaa

SEQ ID NO: 526816 - DNA, 25 bp, Rattus norvegicus
gttctgacttctatatttggttctg

SEQ ID NO: 526817 - DNA, 25 bp, Rattus norvegicus
gttctgacttctcagccctaaaatt

SEQ ID NO: 526818 - DNA, 25 bp, Rattus norvegicus
gttctgacttctgagccctaaaatt

SEQ ID NO: 526819 - DNA, 25 bp, Rattus norvegicus
gttctgacttctttatttggttctg

SEQ ID NO: 526820 - DNA, 25 bp, Rattus norvegicus
gttctgagaacacgacagtctatac

SEQ ID NO: 526821 - DNA, 25 bp, Rattus norvegicus
gttctgagaacaggacagtctatac

SEQ ID NO: 526822 - DNA, 25 bp, Rattus norvegicus
gttctgagaaccagcaccgagtgga

SEQ ID NO: 526823 - DNA, 25 bp, Rattus norvegicus
gttctgagaacctgcaccgagtgga

SEQ ID NO: 526824 - DNA, 25 bp, Rattus norvegicus
gttctgagaccaagcatgacctaag

SEQ ID NO: 526825 - DNA, 25 bp, Rattus norvegicus
gttctgagaccacgcaatgctttga

SEQ ID NO: 526826 - DNA, 25 bp, Rattus norvegicus
gttctgagaccaggcaatgctttga

SEQ ID NO: 526827 - DNA, 25 bp, Rattus norvegicus
gttctgagaccatgcatgacctaag

SEQ ID NO: 526828 - DNA, 25 bp, Rattus norvegicus
gttctgagatgcctgggttttgcca

SEQ ID NO: 526829 - DNA, 25 bp, Rattus norvegicus
gttctgagatgcgtgggttttgcca

SEQ ID NO: 526830 - DNA, 25 bp, Rattus norvegicus
gttctgagcactagaaagcgtacaa

SEQ ID NO: 526831 - DNA, 25 bp, Rattus norvegicus
gttctgagcacttgaaagcgtacaa

SEQ ID NO: 526832 - DNA, 25 bp, Rattus norvegicus
gttctgagcagcaaccttgtggtat

SEQ ID NO: 526833 - DNA, 25 bp, Rattus norvegicus
gttctgagcagctaccttgtggtat

SEQ ID NO: 526834 - DNA, 25 bp, Rattus norvegicus
gttctgagcctgcagtttggattct

SEQ ID NO: 526835 - DNA, 25 bp, Rattus norvegicus
gttctgagcctggagtttggattct

SEQ ID NO: 526836 - DNA, 25 bp, Rattus norvegicus
gttctgagctgtcagattccactgt

SEQ ID NO: 526837 - DNA, 25 bp, Rattus norvegicus
gttctgagctgtgagattccactgt

SEQ ID NO: 526838 - DNA, 25 bp, Rattus norvegicus
gttctgaggagcatctaccatgtac

SEQ ID NO: 526839 - DNA, 25 bp, Rattus norvegicus
gttctgaggagcttctaccatgtac

SEQ ID NO: 526840 - DNA, 25 bp, Rattus norvegicus
gttctgaggctgatgattctagttc

SEQ ID NO: 526841 - DNA, 25 bp, Rattus norvegicus
gttctgaggctgttgattctagttc

SEQ ID NO: 526842 - DNA, 25 bp, Rattus norvegicus
gttctgagggcccaggtcccacaag

SEQ ID NO: 526843 - DNA, 25 bp, Rattus norvegicus
gttctgagggccgaggtcccacaag

SEQ ID NO: 526844 - DNA, 25 bp, Rattus norvegicus
gttctgagtcatccttgtgccaaag

SEQ ID NO: 526845 - DNA, 25 bp, Rattus norvegicus
gttctgagtcatgcttgtgccaaag

SEQ ID NO: 526846 - DNA, 25 bp, Rattus norvegicus
gttctgagtctgaattccttgtcaa

SEQ ID NO: 526847 - DNA, 25 bp, Rattus norvegicus
gttctgagtctgaggtcatcagtca

SEQ ID NO: 526848 - DNA, 25 bp, Rattus norvegicus
gttctgagtctgtattccttgtcaa

SEQ ID NO: 526849 - DNA, 25 bp, Rattus norvegicus
gttctgagtctgtggtcatcagtca

SEQ ID NO: 526850 - DNA, 25 bp, Rattus norvegicus
gttctgagtgatcttccctggtgac

SEQ ID NO: 526851 - DNA, 25 bp, Rattus norvegicus
gttctgagtgatgttccctggtgac

SEQ ID NO: 526852 - DNA, 25 bp, Rattus norvegicus
gttctgagtgttactgtctgtccca

SEQ ID NO: 526853 - DNA, 25 bp, Rattus norvegicus
gttctgagtgttctcgtgagcttta

SEQ ID NO: 526854 - DNA, 25 bp, Rattus norvegicus
gttctgagtgttgtcgtgagcttta

SEQ ID NO: 526855 - DNA, 25 bp, Rattus norvegicus
gttctgagtgtttctgtctgtccca

SEQ ID NO: 526856 - DNA, 25 bp, Rattus norvegicus
gttctgatcaatatggcggacactg

SEQ ID NO: 526857 - DNA, 25 bp, Rattus norvegicus
gttctgatcaatttggcggacactg

SEQ ID NO: 526858 - DNA, 25 bp, Rattus norvegicus
gttctgatcagaagcttctgctgca

SEQ ID NO: 526859 - DNA, 25 bp, Rattus norvegicus
gttctgatcagatgcttctgctgca

SEQ ID NO: 526860 - DNA, 25 bp, Rattus norvegicus
gttctgatcattaggtgctaccgga

SEQ ID NO: 526861 - DNA, 25 bp, Rattus norvegicus
gttctgatcatttggtgctaccgga

SEQ ID NO: 526862 - DNA, 25 bp, Rattus norvegicus
gttctgatctggatgctgccactca

SEQ ID NO: 526863 - DNA, 25 bp, Rattus norvegicus
gttctgatctggttgctgccactca

SEQ ID NO: 526864 - DNA, 25 bp, Rattus norvegicus
gttctgatctgtagggtgtggcttc

SEQ ID NO: 526865 - DNA, 25 bp, Rattus norvegicus
gttctgatctgttgggtgtggcttc

SEQ ID NO: 526866 - DNA, 25 bp, Rattus norvegicus
gttctgatcttaagtcctggacgtc

SEQ ID NO: 526867 - DNA, 25 bp, Rattus norvegicus
gttctgatcttatgtcctggacgtc

SEQ ID NO: 526868 - DNA, 25 bp, Rattus norvegicus
gttctgatgcaaaacacttggcttc

SEQ ID NO: 526869 - DNA, 25 bp, Rattus norvegicus
gttctgatgcaatacacttggcttc

SEQ ID NO: 526870 - DNA, 25 bp, Rattus norvegicus
gttctgatggagacattctgttgtt

SEQ ID NO: 526871 - DNA, 25 bp, Rattus norvegicus
gttctgatggagtcattctgttgtt

SEQ ID NO: 526872 - DNA, 25 bp, Rattus norvegicus
gttctgattacaaatgtgatgccac

SEQ ID NO: 526873 - DNA, 25 bp, Rattus norvegicus
gttctgattacatatgtgatgccac

SEQ ID NO: 526874 - DNA, 25 bp, Rattus norvegicus
gttctgattctcagattctcatcta

SEQ ID NO: 526875 - DNA, 25 bp, Rattus norvegicus
gttctgattctctgattctcatcta

SEQ ID NO: 526876 - DNA, 25 bp, Rattus norvegicus
gttctgcaagttaggtgatccgtgt

SEQ ID NO: 526877 - DNA, 25 bp, Rattus norvegicus
gttctgcaagttcctgtttgcttag

SEQ ID NO: 526878 - DNA, 25 bp, Rattus norvegicus
gttctgcaagttgctgtttgcttag

SEQ ID NO: 526879 - DNA, 25 bp, Rattus norvegicus
gttctgcaagtttggtgatccgtgt

SEQ ID NO: 526880 - DNA, 25 bp, Rattus norvegicus
gttctgcacacgcttttatcaggga

SEQ ID NO: 526881 - DNA, 25 bp, Rattus norvegicus
gttctgcacacggttttatcaggga

SEQ ID NO: 526882 - DNA, 25 bp, Rattus norvegicus
gttctgcagagtaaccagggaccag

SEQ ID NO: 526883 - DNA, 25 bp, Rattus norvegicus
gttctgcagagttaccagggaccag

SEQ ID NO: 526884 - DNA, 25 bp, Rattus norvegicus
gttctgcagtcgctgcttaggtatg

SEQ ID NO: 526885 - DNA, 25 bp, Rattus norvegicus
gttctgcagtcggtgcttaggtatg

SEQ ID NO: 526886 - DNA, 25 bp, Rattus norvegicus
gttctgcatgtaaatacttgtacta

SEQ ID NO: 526887 - DNA, 25 bp, Rattus norvegicus
gttctgcatgtatatacttgtacta

SEQ ID NO: 526888 - DNA, 25 bp, Rattus norvegicus
gttctgccaaataatcgctgactct

SEQ ID NO: 526889 - DNA, 25 bp, Rattus norvegicus
gttctgccaaattatcgctgactct

SEQ ID NO: 526890 - DNA, 25 bp, Rattus norvegicus
gttctgccaacaacaatgaccggag

SEQ ID NO: 526891 - DNA, 25 bp, Rattus norvegicus
gttctgccaacatcaatgaccggag

SEQ ID NO: 526892 - DNA, 25 bp, Rattus norvegicus
gttctgccagcacgagaataactat

SEQ ID NO: 526893 - DNA, 25 bp, Rattus norvegicus
gttctgccagcaggagaataactat

SEQ ID NO: 526894 - DNA, 25 bp, Rattus norvegicus
gttctgccagctactaattgaaagt

SEQ ID NO: 526895 - DNA, 25 bp, Rattus norvegicus
gttctgccagcttctaattgaaagt

SEQ ID NO: 526896 - DNA, 25 bp, Rattus norvegicus
gttctgcccctgagaaagcgttcat

SEQ ID NO: 526897 - DNA, 25 bp, Rattus norvegicus
gttctgcccctgtgaaagcgttcat

SEQ ID NO: 526898 - DNA, 25 bp, Rattus norvegicus
gttctgccctgtctgtacttggaaa

SEQ ID NO: 526899 - DNA, 25 bp, Rattus norvegicus
gttctgccctgtgtgtacttggaaa

SEQ ID NO: 526900 - DNA, 25 bp, Rattus norvegicus
gttctgcctacaaggctgtattcag

SEQ ID NO: 526901 - DNA, 25 bp, Rattus norvegicus
gttctgcctacatggctgtattcag

SEQ ID NO: 526902 - DNA, 25 bp, Rattus norvegicus
gttctgcctatcctgttggtataaa

SEQ ID NO: 526903 - DNA, 25 bp, Rattus norvegicus
gttctgcctatcgtgttggtataaa

SEQ ID NO: 526904 - DNA, 25 bp, Rattus norvegicus
gttctgcctccactggaagcagaca

SEQ ID NO: 526905 - DNA, 25 bp, Rattus norvegicus
gttctgcctccagtggaagcagaca

SEQ ID NO: 526906 - DNA, 25 bp, Rattus norvegicus
gttctgccttcaccaagacaaccaa

SEQ ID NO: 526907 - DNA, 25 bp, Rattus norvegicus
gttctgccttcagcaagacaaccaa

SEQ ID NO: 526908 - DNA, 25 bp, Rattus norvegicus
gttctgccttctcagcaaatgttaa

SEQ ID NO: 526909 - DNA, 25 bp, Rattus norvegicus
gttctgccttctgagcaaatgttaa

SEQ ID NO: 526910 - DNA, 25 bp, Rattus norvegicus
gttctgctacagagagatccaaaca

SEQ ID NO: 526911 - DNA, 25 bp, Rattus norvegicus
gttctgctacagtgagatccaaaca

SEQ ID NO: 526912 - DNA, 25 bp, Rattus norvegicus
gttctgctagcaatgtaggcggctt

SEQ ID NO: 526913 - DNA, 25 bp, Rattus norvegicus
gttctgctagcattgtaggcggctt

SEQ ID NO: 526914 - DNA, 25 bp, Rattus norvegicus
gttctgctaggcatgtcagtgttaa

SEQ ID NO: 526915 - DNA, 25 bp, Rattus norvegicus
gttctgctaggcttgtcagtgttaa

SEQ ID NO: 526916 - DNA, 25 bp, Rattus norvegicus
gttctgctcaaccttagggtgaatg

SEQ ID NO: 526917 - DNA, 25 bp, Rattus norvegicus
gttctgctcaacgttagggtgaatg

SEQ ID NO: 526918 - DNA, 25 bp, Rattus norvegicus
gttctgctgccccacatgggtgaac

SEQ ID NO: 526919 - DNA, 25 bp, Rattus norvegicus
gttctgctgcccgacatgggtgaac

SEQ ID NO: 526920 - DNA, 25 bp, Rattus norvegicus
gttctgctgctactatgggcacaat

SEQ ID NO: 526921 - DNA, 25 bp, Rattus norvegicus
gttctgctgctagtatgggcacaat

SEQ ID NO: 526922 - DNA, 25 bp, Rattus norvegicus
gttctgctgctcatcaatattgtat

SEQ ID NO: 526923 - DNA, 25 bp, Rattus norvegicus
gttctgctgctcttcaatattgtat

SEQ ID NO: 526924 - DNA, 25 bp, Rattus norvegicus
gttctgcttagtatttccacaatgt

SEQ ID NO: 526925 - DNA, 25 bp, Rattus norvegicus
gttctgcttagtttttccacaatgt

SEQ ID NO: 526926 - DNA, 25 bp, Rattus norvegicus
gttctgcttcagctaggccgaggcc

SEQ ID NO: 526927 - DNA, 25 bp, Rattus norvegicus
gttctgcttcaggtaggccgaggcc

SEQ ID NO: 526928 - DNA, 25 bp, Rattus norvegicus
gttctgcttctcacaagcacaggag

SEQ ID NO: 526929 - DNA, 25 bp, Rattus norvegicus
gttctgcttctctcaagcacaggag

SEQ ID NO: 526930 - DNA, 25 bp, Rattus norvegicus
gttctgcttttgctaagtaccgtgt

SEQ ID NO: 526931 - DNA, 25 bp, Rattus norvegicus
gttctgcttttggtaagtaccgtgt

SEQ ID NO: 526932 - DNA, 25 bp, Rattus norvegicus
gttctggaacctactaccgtatgga

SEQ ID NO: 526933 - DNA, 25 bp, Rattus norvegicus
gttctggaaccttctaccgtatgga

SEQ ID NO: 526934 - DNA, 25 bp, Rattus norvegicus
gttctggaacttactactgcttgga

SEQ ID NO: 526935 - DNA, 25 bp, Rattus norvegicus
gttctggaactttctactgcttgga

SEQ ID NO: 526936 - DNA, 25 bp, Rattus norvegicus
gttctggaagccctcaagtgaagta

SEQ ID NO: 526937 - DNA, 25 bp, Rattus norvegicus
gttctggaagccgtcaagtgaagta

SEQ ID NO: 526938 - DNA, 25 bp, Rattus norvegicus
gttctggaatgtctctgcggtacaa

SEQ ID NO: 526939 - DNA, 25 bp, Rattus norvegicus
gttctggaatgtgtctgcggtacaa

SEQ ID NO: 526940 - DNA, 25 bp, Rattus norvegicus
gttctggacagtctccattgggaga

SEQ ID NO: 526941 - DNA, 25 bp, Rattus norvegicus
gttctggacagtgtccattgggaga

SEQ ID NO: 526942 - DNA, 25 bp, Rattus norvegicus
gttctggaccgaagacatagcctat

SEQ ID NO: 526943 - DNA, 25 bp, Rattus norvegicus
gttctggaccgactagaggcatgta

SEQ ID NO: 526944 - DNA, 25 bp, Rattus norvegicus
gttctggaccgagtagaggcatgta

SEQ ID NO: 526945 - DNA, 25 bp, Rattus norvegicus
gttctggaccgatgacatagcctat

SEQ ID NO: 526946 - DNA, 25 bp, Rattus norvegicus
gttctggacttacggccttgtttgc

SEQ ID NO: 526947 - DNA, 25 bp, Rattus norvegicus
gttctggacttagggccttgtttgc

SEQ ID NO: 526948 - DNA, 25 bp, Rattus norvegicus
gttctggagaccaaagtctgtcctt

SEQ ID NO: 526949 - DNA, 25 bp, Rattus norvegicus
gttctggagaccattctgggagtct

SEQ ID NO: 526950 - DNA, 25 bp, Rattus norvegicus
gttctggagacctaagtctgtcctt

SEQ ID NO: 526951 - DNA, 25 bp, Rattus norvegicus
gttctggagacctttctgggagtct

SEQ ID NO: 526952 - DNA, 25 bp, Rattus norvegicus
gttctggagccaagtatcatcgaca

SEQ ID NO: 526953 - DNA, 25 bp, Rattus norvegicus
gttctggagccatgtatcatcgaca

SEQ ID NO: 526954 - DNA, 25 bp, Rattus norvegicus
gttctggaggctcgagtcaccatta

SEQ ID NO: 526955 - DNA, 25 bp, Rattus norvegicus
gttctggaggctggagtcaccatta

SEQ ID NO: 526956 - DNA, 25 bp, Rattus norvegicus
gttctggatttcagttatgtgcttg

SEQ ID NO: 526957 - DNA, 25 bp, Rattus norvegicus
gttctggatttctgttatgtgcttg

SEQ ID NO: 526958 - DNA, 25 bp, Rattus norvegicus
gttctggcaatgactaacccatatt

SEQ ID NO: 526959 - DNA, 25 bp, Rattus norvegicus
gttctggcaatgtctaacccatatt

SEQ ID NO: 526960 - DNA, 25 bp, Rattus norvegicus
gttctggcacaacaagacctccctt

SEQ ID NO: 526961 - DNA, 25 bp, Rattus norvegicus
gttctggcacaagaagacctccctt

SEQ ID NO: 526962 - DNA, 25 bp, Rattus norvegicus
gttctggcacctagggcactgtgta

SEQ ID NO: 526963 - DNA, 25 bp, Rattus norvegicus
gttctggcaccttgggcactgtgta

SEQ ID NO: 526964 - DNA, 25 bp, Rattus norvegicus
gttctggccctgattagtctgtgag

SEQ ID NO: 526965 - DNA, 25 bp, Rattus norvegicus
gttctggccctgtttagtctgtgag

SEQ ID NO: 526966 - DNA, 25 bp, Rattus norvegicus
gttctggctactcatgcagcacaag

SEQ ID NO: 526967 - DNA, 25 bp, Rattus norvegicus
gttctggctactgatgcagcacaag

SEQ ID NO: 526968 - DNA, 25 bp, Rattus norvegicus
gttctggctaggatgagtcttcttt

SEQ ID NO: 526969 - DNA, 25 bp, Rattus norvegicus
gttctggctaggctgtcccggttac

SEQ ID NO: 526970 - DNA, 25 bp, Rattus norvegicus
gttctggctagggtgtcccggttac

SEQ ID NO: 526971 - DNA, 25 bp, Rattus norvegicus
gttctggctaggttgagtcttcttt

SEQ ID NO: 526972 - DNA, 25 bp, Rattus norvegicus
gttctggctcctctctttagagcaa

SEQ ID NO: 526973 - DNA, 25 bp, Rattus norvegicus
gttctggctcctgtctttagagcaa

SEQ ID NO: 526974 - DNA, 25 bp, Rattus norvegicus
gttctggcttaccttgctacacaag

SEQ ID NO: 526975 - DNA, 25 bp, Rattus norvegicus
gttctggcttacgttgctacacaag

SEQ ID NO: 526976 - DNA, 25 bp, Rattus norvegicus
gttctggcttagagggtttgcaaaa

SEQ ID NO: 526977 - DNA, 25 bp, Rattus norvegicus
gttctggcttagtgggtttgcaaaa

SEQ ID NO: 526978 - DNA, 25 bp, Rattus norvegicus
gttctggcttgaattgtttgtggga

SEQ ID NO: 526979 - DNA, 25 bp, Rattus norvegicus
gttctggcttgatttgtttgtggga

SEQ ID NO: 526980 - DNA, 25 bp, Rattus norvegicus
gttctgggaacaacaatcactatca

SEQ ID NO: 526981 - DNA, 25 bp, Rattus norvegicus
gttctgggaacatcaatcactatca

SEQ ID NO: 526982 - DNA, 25 bp, Rattus norvegicus
gttctgggaactcagcaatgctgtg

SEQ ID NO: 526983 - DNA, 25 bp, Rattus norvegicus
gttctgggaactgagcaatgctgtg

SEQ ID NO: 526984 - DNA, 25 bp, Rattus norvegicus
gttctgggaagcaatccgctctgga

SEQ ID NO: 526985 - DNA, 25 bp, Rattus norvegicus
gttctgggaagctatccgctctgga

SEQ ID NO: 526986 - DNA, 25 bp, Rattus norvegicus
gttctgggaatcaagtggcagcctt

SEQ ID NO: 526987 - DNA, 25 bp, Rattus norvegicus
gttctgggaatctagtggcagcctt

SEQ ID NO: 526988 - DNA, 25 bp, Rattus norvegicus
gttctgggagacacactacaacaat

SEQ ID NO: 526989 - DNA, 25 bp, Rattus norvegicus
gttctgggagactcactacaacaat

SEQ ID NO: 526990 - DNA, 25 bp, Rattus norvegicus
gttctgggatctcaagggcattcga

SEQ ID NO: 526991 - DNA, 25 bp, Rattus norvegicus
gttctgggatctgaagggcattcga

SEQ ID NO: 526992 - DNA, 25 bp, Rattus norvegicus
gttctgggccaaccgtttaaatgtg

SEQ ID NO: 526993 - DNA, 25 bp, Rattus norvegicus
gttctgggccaagcgtttaaatgtg

SEQ ID NO: 526994 - DNA, 25 bp, Rattus norvegicus
gttctgggctagatttagctgcttt

SEQ ID NO: 526995 - DNA, 25 bp, Rattus norvegicus
gttctgggctagttttagctgcttt

SEQ ID NO: 526996 - DNA, 25 bp, Rattus norvegicus
gttctgggctatactgaaatcacct

SEQ ID NO: 526997 - DNA, 25 bp, Rattus norvegicus
gttctgggctatatttggtctttct

SEQ ID NO: 526998 - DNA, 25 bp, Rattus norvegicus
gttctgggctattctgaaatcacct

SEQ ID NO: 526999 - DNA, 25 bp, Rattus norvegicus
gttctgggctatttttggtctttct

SEQ ID NO: 527000 - DNA, 25 bp, Rattus norvegicus
gttctgggtccactgaattattcac

SEQ ID NO: 527001 - DNA, 25 bp, Rattus norvegicus
gttctgggtccagtgaattattcac

SEQ ID NO: 527002 - DNA, 25 bp, Rattus norvegicus
gttctgggtcggatcgccgctgctc

SEQ ID NO: 527003 - DNA, 25 bp, Rattus norvegicus
gttctgggtcggttcgccgctgctc

SEQ ID NO: 527004 - DNA, 25 bp, Rattus norvegicus
gttctgggttacattctggtgcaca

SEQ ID NO: 527005 - DNA, 25 bp, Rattus norvegicus
gttctgggttactttctggtgcaca

SEQ ID NO: 527006 - DNA, 25 bp, Rattus norvegicus
gttctgggttcaaaagcacacttgt

SEQ ID NO: 527007 - DNA, 25 bp, Rattus norvegicus
gttctgggttcacatggctgagcta

SEQ ID NO: 527008 - DNA, 25 bp, Rattus norvegicus
gttctgggttcagatggctgagcta

SEQ ID NO: 527009 - DNA, 25 bp, Rattus norvegicus
gttctgggttcataagcacacttgt

SEQ ID NO: 527010 - DNA, 25 bp, Rattus norvegicus
gttctggtacacagggagccatgga

SEQ ID NO: 527011 - DNA, 25 bp, Rattus norvegicus
gttctggtacactgggagccatgga

SEQ ID NO: 527012 - DNA, 25 bp, Rattus norvegicus
gttctggtacggattttggagacat

SEQ ID NO: 527013 - DNA, 25 bp, Rattus norvegicus
gttctggtacggtttttggagacat

SEQ ID NO: 527014 - DNA, 25 bp, Rattus norvegicus
gttctggtaggcattacatgtctct

SEQ ID NO: 527015 - DNA, 25 bp, Rattus norvegicus
gttctggtaggctttacatgtctct

SEQ ID NO: 527016 - DNA, 25 bp, Rattus norvegicus
gttctggtgaacaggcaacctgtac

SEQ ID NO: 527017 - DNA, 25 bp, Rattus norvegicus
gttctggtgaactggcaacctgtac

SEQ ID NO: 527018 - DNA, 25 bp, Rattus norvegicus
gttctggtgactcaactcaggtact

SEQ ID NO: 527019 - DNA, 25 bp, Rattus norvegicus
gttctggtgactgaactcaggtact

SEQ ID NO: 527020 - DNA, 25 bp, Rattus norvegicus
gttctggtgagcagccggaccaata

SEQ ID NO: 527021 - DNA, 25 bp, Rattus norvegicus
gttctggtgagctgccggaccaata

SEQ ID NO: 527022 - DNA, 25 bp, Rattus norvegicus
gttctggtgctacctgagttggaca

SEQ ID NO: 527023 - DNA, 25 bp, Rattus norvegicus
gttctggtgctagctgagttggaca

SEQ ID NO: 527024 - DNA, 25 bp, Rattus norvegicus
gttctggttcgtctggtcgctgcca

SEQ ID NO: 527025 - DNA, 25 bp, Rattus norvegicus
gttctggttcgtgtggtcgctgcca

SEQ ID NO: 527026 - DNA, 25 bp, Rattus norvegicus
gttctggttctgagctgaaacctgt

SEQ ID NO: 527027 - DNA, 25 bp, Rattus norvegicus
gttctggttctgtgctgaaacctgt

SEQ ID NO: 527028 - DNA, 25 bp, Rattus norvegicus
gttctggttggtatgatatgccttt

SEQ ID NO: 527029 - DNA, 25 bp, Rattus norvegicus
gttctggttggtttgatatgccttt

SEQ ID NO: 527030 - DNA, 25 bp, Rattus norvegicus
gttctggttttaacatccaccttct

SEQ ID NO: 527031 - DNA, 25 bp, Rattus norvegicus
gttctggttttatcatccaccttct

SEQ ID NO: 527032 - DNA, 25 bp, Rattus norvegicus
gttctggttttcactttgtacatac

SEQ ID NO: 527033 - DNA, 25 bp, Rattus norvegicus
gttctggttttctctttgtacatac

SEQ ID NO: 527034 - DNA, 25 bp, Rattus norvegicus
gttctggttttgatctatcatcttg

SEQ ID NO: 527035 - DNA, 25 bp, Rattus norvegicus
gttctggttttgttctatcatcttg

SEQ ID NO: 527036 - DNA, 25 bp, Rattus norvegicus
gttctgtaaacacgttgcacaagct

SEQ ID NO: 527037 - DNA, 25 bp, Rattus norvegicus
gttctgtaaacaggttgcacaagct

SEQ ID NO: 527038 - DNA, 25 bp, Rattus norvegicus
gttctgtaaagccactgggactgta

SEQ ID NO: 527039 - DNA, 25 bp, Rattus norvegicus
gttctgtaaagcgactgggactgta

SEQ ID NO: 527040 - DNA, 25 bp, Rattus norvegicus
gttctgtaattcatgggctgtggcc

SEQ ID NO: 527041 - DNA, 25 bp, Rattus norvegicus
gttctgtaattcttgggctgtggcc

SEQ ID NO: 527042 - DNA, 25 bp, Rattus norvegicus
gttctgtaatttcgagttttgggct

SEQ ID NO: 527043 - DNA, 25 bp, Rattus norvegicus
gttctgtaatttggagttttgggct

SEQ ID NO: 527044 - DNA, 25 bp, Rattus norvegicus
gttctgtacagcatcaggtctcgta

SEQ ID NO: 527045 - DNA, 25 bp, Rattus norvegicus
gttctgtacagcttcaggtctcgta

SEQ ID NO: 527046 - DNA, 25 bp, Rattus norvegicus
gttctgtaccataatccctaacatg

SEQ ID NO: 527047 - DNA, 25 bp, Rattus norvegicus
gttctgtaccattatccctaacatg

SEQ ID NO: 527048 - DNA, 25 bp, Rattus norvegicus
gttctgtacgagataccagccacga

SEQ ID NO: 527049 - DNA, 25 bp, Rattus norvegicus
gttctgtacgagttaccagccacga

SEQ ID NO: 527050 - DNA, 25 bp, Rattus norvegicus
gttctgtaggtaacagccaccttag

SEQ ID NO: 527051 - DNA, 25 bp, Rattus norvegicus
gttctgtaggtatcagccaccttag

SEQ ID NO: 527052 - DNA, 25 bp, Rattus norvegicus
gttctgtagtttcggtggttattgc

SEQ ID NO: 527053 - DNA, 25 bp, Rattus norvegicus
gttctgtagtttgggtggttattgc

SEQ ID NO: 527054 - DNA, 25 bp, Rattus norvegicus
gttctgtataaaatgtcccactgag

SEQ ID NO: 527055 - DNA, 25 bp, Rattus norvegicus
gttctgtataaattgtcccactgag

SEQ ID NO: 527056 - DNA, 25 bp, Rattus norvegicus
gttctgtatattattgctccttggt

SEQ ID NO: 527057 - DNA, 25 bp, Rattus norvegicus
gttctgtatatttttgctccttggt

SEQ ID NO: 527058 - DNA, 25 bp, Rattus norvegicus
gttctgtatcaaatctagtcttgga

SEQ ID NO: 527059 - DNA, 25 bp, Rattus norvegicus
gttctgtatcaattctagtcttgga

SEQ ID NO: 527060 - DNA, 25 bp, Rattus norvegicus
gttctgtatccactagtcttgggaa

SEQ ID NO: 527061 - DNA, 25 bp, Rattus norvegicus
gttctgtatccagtagtcttgggaa

SEQ ID NO: 527062 - DNA, 25 bp, Rattus norvegicus
gttctgtatggcctgttcttgtata

SEQ ID NO: 527063 - DNA, 25 bp, Rattus norvegicus
gttctgtatggcgtgttcttgtata

SEQ ID NO: 527064 - DNA, 25 bp, Rattus norvegicus
gttctgtatttgagatctctgcctt

SEQ ID NO: 527065 - DNA, 25 bp, Rattus norvegicus
gttctgtatttgtgatctctgcctt

SEQ ID NO: 527066 - DNA, 25 bp, Rattus norvegicus
gttctgtcaaccaaatagcctctac

SEQ ID NO: 527067 - DNA, 25 bp, Rattus norvegicus
gttctgtcaacctaatagcctctac

SEQ ID NO: 527068 - DNA, 25 bp, Rattus norvegicus
gttctgtcacatccaggttagccta

SEQ ID NO: 527069 - DNA, 25 bp, Rattus norvegicus
gttctgtcacatgcaggttagccta

SEQ ID NO: 527070 - DNA, 25 bp, Rattus norvegicus
gttctgtcagtaagcatgaggaccc

SEQ ID NO: 527071 - DNA, 25 bp, Rattus norvegicus
gttctgtcagtatgcatgaggaccc

SEQ ID NO: 527072 - DNA, 25 bp, Rattus norvegicus
gttctgtcagtcagctaggtctgca

SEQ ID NO: 527073 - DNA, 25 bp, Rattus norvegicus
gttctgtcagtctgctaggtctgca

SEQ ID NO: 527074 - DNA, 25 bp, Rattus norvegicus
gttctgtcatggattaaatactgta

SEQ ID NO: 527075 - DNA, 25 bp, Rattus norvegicus
gttctgtcatggtttaaatactgta

SEQ ID NO: 527076 - DNA, 25 bp, Rattus norvegicus
gttctgtcatttactgcatttgcca

SEQ ID NO: 527077 - DNA, 25 bp, Rattus norvegicus
gttctgtcattttctgcatttgcca

SEQ ID NO: 527078 - DNA, 25 bp, Rattus norvegicus
gttctgtcccttagtatattctcta

SEQ ID NO: 527079 - DNA, 25 bp, Rattus norvegicus
gttctgtccctttgtatattctcta

SEQ ID NO: 527080 - DNA, 25 bp, Rattus norvegicus
gttctgtcgcgtatgtgaaactttt

SEQ ID NO: 527081 - DNA, 25 bp, Rattus norvegicus
gttctgtcgcgtttgtgaaactttt

SEQ ID NO: 527082 - DNA, 25 bp, Rattus norvegicus
gttctgtctatactcttcattgctt

SEQ ID NO: 527083 - DNA, 25 bp, Rattus norvegicus
gttctgtctatagtcttcattgctt

SEQ ID NO: 527084 - DNA, 25 bp, Rattus norvegicus
gttctgtctcggcttcctggaaggt

SEQ ID NO: 527085 - DNA, 25 bp, Rattus norvegicus
gttctgtctcgggttcctggaaggt

SEQ ID NO: 527086 - DNA, 25 bp, Rattus norvegicus
gttctgtctctacatttgactactt

SEQ ID NO: 527087 - DNA, 25 bp, Rattus norvegicus
gttctgtctctagatttgactactt

SEQ ID NO: 527088 - DNA, 25 bp, Rattus norvegicus
gttctgtctgtaccctctgatttgg

SEQ ID NO: 527089 - DNA, 25 bp, Rattus norvegicus
gttctgtctgtagcctctgatttgg

SEQ ID NO: 527090 - DNA, 25 bp, Rattus norvegicus
gttctgtgaacaccactaccactgt

SEQ ID NO: 527091 - DNA, 25 bp, Rattus norvegicus
gttctgtgaacacggatgagccctc

SEQ ID NO: 527092 - DNA, 25 bp, Rattus norvegicus
gttctgtgaacagcactaccactgt

SEQ ID NO: 527093 - DNA, 25 bp, Rattus norvegicus
gttctgtgaacagggatgagccctc

SEQ ID NO: 527094 - DNA, 25 bp, Rattus norvegicus
gttctgtgaatcagccattgttaaa

SEQ ID NO: 527095 - DNA, 25 bp, Rattus norvegicus
gttctgtgaatctgccattgttaaa

SEQ ID NO: 527096 - DNA, 25 bp, Rattus norvegicus
gttctgtgaattctgactcagcagt

SEQ ID NO: 527097 - DNA, 25 bp, Rattus norvegicus
gttctgtgaattgtgactcagcagt

SEQ ID NO: 527098 - DNA, 25 bp, Rattus norvegicus
gttctgtgacctaattccggacaac

SEQ ID NO: 527099 - DNA, 25 bp, Rattus norvegicus
gttctgtgaccttattccggacaac

SEQ ID NO: 527100 - DNA, 25 bp, Rattus norvegicus
gttctgtgagaactacgagctggat

SEQ ID NO: 527101 - DNA, 25 bp, Rattus norvegicus
gttctgtgagaagtacgagctggat

SEQ ID NO: 527102 - DNA, 25 bp, Rattus norvegicus
gttctgtgagaccaccattggctgc

SEQ ID NO: 527103 - DNA, 25 bp, Rattus norvegicus
gttctgtgagacgaccattggctgc

SEQ ID NO: 527104 - DNA, 25 bp, Rattus norvegicus
gttctgtgagcgctttctccagtag

SEQ ID NO: 527105 - DNA, 25 bp, Rattus norvegicus
gttctgtgagcggtttctccagtag

SEQ ID NO: 527106 - DNA, 25 bp, Rattus norvegicus
gttctgtgcaccatgtgggaatcac

SEQ ID NO: 527107 - DNA, 25 bp, Rattus norvegicus
gttctgtgcaccttgtgggaatcac

SEQ ID NO: 527108 - DNA, 25 bp, Rattus norvegicus
gttctgtggacaagacttccttctg

SEQ ID NO: 527109 - DNA, 25 bp, Rattus norvegicus
gttctgtggacatgacttccttctg

SEQ ID NO: 527110 - DNA, 25 bp, Rattus norvegicus
gttctgtggactattttgatttctt

SEQ ID NO: 527111 - DNA, 25 bp, Rattus norvegicus
gttctgtggacttttttgatttctt

SEQ ID NO: 527112 - DNA, 25 bp, Rattus norvegicus
gttctgtggagcagaaacccaccct

SEQ ID NO: 527113 - DNA, 25 bp, Rattus norvegicus
gttctgtggagctgaaacccaccct

SEQ ID NO: 527114 - DNA, 25 bp, Rattus norvegicus
gttctgtggctcataggtgcattct

SEQ ID NO: 527115 - DNA, 25 bp, Rattus norvegicus
gttctgtggctcttaggtgcattct

SEQ ID NO: 527116 - DNA, 25 bp, Rattus norvegicus
gttctgtggctgattccaatccaaa

SEQ ID NO: 527117 - DNA, 25 bp, Rattus norvegicus
gttctgtggctgtttccaatccaaa

SEQ ID NO: 527118 - DNA, 25 bp, Rattus norvegicus
gttctgtgggctcggacatctgcat

SEQ ID NO: 527119 - DNA, 25 bp, Rattus norvegicus
gttctgtgggctgggacatctgcat

SEQ ID NO: 527120 - DNA, 25 bp, Rattus norvegicus
gttctgtggtctactaatactttta

SEQ ID NO: 527121 - DNA, 25 bp, Rattus norvegicus
gttctgtggtcttctaatactttta

SEQ ID NO: 527122 - DNA, 25 bp, Rattus norvegicus
gttctgtgtcttcttgttttggatt

SEQ ID NO: 527123 - DNA, 25 bp, Rattus norvegicus
gttctgtgtcttgttgttttggatt

SEQ ID NO: 527124 - DNA, 25 bp, Rattus norvegicus
gttctgtgtgtgacttaaccccaca

SEQ ID NO: 527125 - DNA, 25 bp, Rattus norvegicus
gttctgtgtgtgagatctgagctct

SEQ ID NO: 527126 - DNA, 25 bp, Rattus norvegicus
gttctgtgtgtgtcttaaccccaca

SEQ ID NO: 527127 - DNA, 25 bp, Rattus norvegicus
gttctgtgtgtgtgatctgagctct

SEQ ID NO: 527128 - DNA, 25 bp, Rattus norvegicus
gttctgtgttcactgctgacatcta

SEQ ID NO: 527129 - DNA, 25 bp, Rattus norvegicus
gttctgtgttcagtgctgacatcta

SEQ ID NO: 527130 - DNA, 25 bp, Rattus norvegicus
gttctgttaactcaataccactctg

SEQ ID NO: 527131 - DNA, 25 bp, Rattus norvegicus
gttctgttaactgaataccactctg

SEQ ID NO: 527132 - DNA, 25 bp, Rattus norvegicus
gttctgttaattcttctgtatgctt

SEQ ID NO: 527133 - DNA, 25 bp, Rattus norvegicus
gttctgttaattgttctgtatgctt

SEQ ID NO: 527134 - DNA, 25 bp, Rattus norvegicus
gttctgttactccaattgtagccaa

SEQ ID NO: 527135 - DNA, 25 bp, Rattus norvegicus
gttctgttactcgaattgtagccaa

SEQ ID NO: 527136 - DNA, 25 bp, Rattus norvegicus
gttctgttagagctgaggtccgcca

SEQ ID NO: 527137 - DNA, 25 bp, Rattus norvegicus
gttctgttagaggtgaggtccgcca

SEQ ID NO: 527138 - DNA, 25 bp, Rattus norvegicus
gttctgttatctcagcactaaggtt

SEQ ID NO: 527139 - DNA, 25 bp, Rattus norvegicus
gttctgttatctgagcactaaggtt

SEQ ID NO: 527140 - DNA, 25 bp, Rattus norvegicus
gttctgttatttactcagcaggtaa

SEQ ID NO: 527141 - DNA, 25 bp, Rattus norvegicus
gttctgttattttctcagcaggtaa

SEQ ID NO: 527142 - DNA, 25 bp, Rattus norvegicus
gttctgttcagacctgcagcagcag

SEQ ID NO: 527143 - DNA, 25 bp, Rattus norvegicus
gttctgttcagagctgcagcagcag

SEQ ID NO: 527144 - DNA, 25 bp, Rattus norvegicus
gttctgttcctcagagtctctggga

SEQ ID NO: 527145 - DNA, 25 bp, Rattus norvegicus
gttctgttcctctgagtctctggga

SEQ ID NO: 527146 - DNA, 25 bp, Rattus norvegicus
gttctgttccttcgtttcatgggtg

SEQ ID NO: 527147 - DNA, 25 bp, Rattus norvegicus
gttctgttccttggtttcatgggtg

SEQ ID NO: 527148 - DNA, 25 bp, Rattus norvegicus
gttctgttctgtcatgtgccacaaa

SEQ ID NO: 527149 - DNA, 25 bp, Rattus norvegicus
gttctgttctgtgatgtgccacaaa

SEQ ID NO: 527150 - DNA, 25 bp, Rattus norvegicus
gttctgttgtgcagtaacaataaaa

SEQ ID NO: 527151 - DNA, 25 bp, Rattus norvegicus
gttctgttgtgctgtaacaataaaa

SEQ ID NO: 527152 - DNA, 25 bp, Rattus norvegicus
gttctgtttatcatctcatgggtga

SEQ ID NO: 527153 - DNA, 25 bp, Rattus norvegicus
gttctgtttatcttctcatgggtga

SEQ ID NO: 527154 - DNA, 25 bp, Rattus norvegicus
gttctgtttccaacaaagctagcgt

SEQ ID NO: 527155 - DNA, 25 bp, Rattus norvegicus
gttctgtttccatcaaagctagcgt

SEQ ID NO: 527156 - DNA, 25 bp, Rattus norvegicus
gttctgtttcgtattgttgccatca

SEQ ID NO: 527157 - DNA, 25 bp, Rattus norvegicus
gttctgtttcgttttgttgccatca

SEQ ID NO: 527158 - DNA, 25 bp, Rattus norvegicus
gttctgtttctacaccaactataaa

SEQ ID NO: 527159 - DNA, 25 bp, Rattus norvegicus
gttctgtttctagaccaactataaa

SEQ ID NO: 527160 - DNA, 25 bp, Rattus norvegicus
gttctgtttgaaccttgtttgtcaa

SEQ ID NO: 527161 - DNA, 25 bp, Rattus norvegicus
gttctgtttgaagcttgtttgtcaa

SEQ ID NO: 527162 - DNA, 25 bp, Rattus norvegicus
gttctgtttgtcaaaaagtactata

SEQ ID NO: 527163 - DNA, 25 bp, Rattus norvegicus
gttctgtttgtctaaaagtactata

SEQ ID NO: 527164 - DNA, 25 bp, Rattus norvegicus
gttctgttttcaactgtttcccata

SEQ ID NO: 527165 - DNA, 25 bp, Rattus norvegicus
gttctgttttcatctgtttcccata

SEQ ID NO: 527166 - DNA, 25 bp, Rattus norvegicus
gttctgttttgtagtcaagagcatt

SEQ ID NO: 527167 - DNA, 25 bp, Rattus norvegicus
gttctgttttgttgtcaagagcatt

SEQ ID NO: 527168 - DNA, 25 bp, Rattus norvegicus
gttcttaaaaatccttctgtctcct

SEQ ID NO: 527169 - DNA, 25 bp, Rattus norvegicus
gttcttaaaaatgcttctgtctcct

SEQ ID NO: 527170 - DNA, 25 bp, Rattus norvegicus
gttcttaaatgcaccaggctctatt

SEQ ID NO: 527171 - DNA, 25 bp, Rattus norvegicus
gttcttaaatgctccaggctctatt

SEQ ID NO: 527172 - DNA, 25 bp, Rattus norvegicus
gttcttaacattcaaggaagctctg

SEQ ID NO: 527173 - DNA, 25 bp, Rattus norvegicus
gttcttaacattgaaggaagctctg

SEQ ID NO: 527174 - DNA, 25 bp, Rattus norvegicus
gttcttaaccttcctcaggatcagc

SEQ ID NO: 527175 - DNA, 25 bp, Rattus norvegicus
gttcttaaccttgctcaggatcagc

SEQ ID NO: 527176 - DNA, 25 bp, Rattus norvegicus
gttcttaacgttctgctgacttcaa

SEQ ID NO: 527177 - DNA, 25 bp, Rattus norvegicus
gttcttaacgttgtgctgacttcaa

SEQ ID NO: 527178 - DNA, 25 bp, Rattus norvegicus
gttcttaagccaagcatagtgatgc

SEQ ID NO: 527179 - DNA, 25 bp, Rattus norvegicus
gttcttaagccatgcatagtgatgc

SEQ ID NO: 527180 - DNA, 25 bp, Rattus norvegicus
gttcttaatgaaccttctggctcta

SEQ ID NO: 527181 - DNA, 25 bp, Rattus norvegicus
gttcttaatgaagcttctggctcta

SEQ ID NO: 527182 - DNA, 25 bp, Rattus norvegicus
gttcttaatgtaacaaataccacac

SEQ ID NO: 527183 - DNA, 25 bp, Rattus norvegicus
gttcttaatgtatcaaataccacac

SEQ ID NO: 527184 - DNA, 25 bp, Rattus norvegicus
gttcttaattccagaatcctccacc

SEQ ID NO: 527185 - DNA, 25 bp, Rattus norvegicus
gttcttaattcctgaatcctccacc

SEQ ID NO: 527186 - DNA, 25 bp, Rattus norvegicus
gttcttaattctcttttcgtactat

SEQ ID NO: 527187 - DNA, 25 bp, Rattus norvegicus
gttcttaattctgttttcgtactat

SEQ ID NO: 527188 - DNA, 25 bp, Rattus norvegicus
gttcttaatttccatgggcgcgtca

SEQ ID NO: 527189 - DNA, 25 bp, Rattus norvegicus
gttcttaatttcgatgggcgcgtca

SEQ ID NO: 527190 - DNA, 25 bp, Rattus norvegicus
gttcttacaaacagcgggtgtcttc

SEQ ID NO: 527191 - DNA, 25 bp, Rattus norvegicus
gttcttacaaactgcgggtgtcttc

SEQ ID NO: 527192 - DNA, 25 bp, Rattus norvegicus
gttcttacacctcagatctgtacag

SEQ ID NO: 527193 - DNA, 25 bp, Rattus norvegicus
gttcttacacctgagatctgtacag

SEQ ID NO: 527194 - DNA, 25 bp, Rattus norvegicus
gttcttacagaacctcatagtttga

SEQ ID NO: 527195 - DNA, 25 bp, Rattus norvegicus
gttcttacagaagctcatagtttga

SEQ ID NO: 527196 - DNA, 25 bp, Rattus norvegicus
gttcttacatgcatccttttcctgt

SEQ ID NO: 527197 - DNA, 25 bp, Rattus norvegicus
gttcttacatgcttccttttcctgt

SEQ ID NO: 527198 - DNA, 25 bp, Rattus norvegicus
gttcttacccttaccggctcagaag

SEQ ID NO: 527199 - DNA, 25 bp, Rattus norvegicus
gttcttaccctttccggctcagaag

SEQ ID NO: 527200 - DNA, 25 bp, Rattus norvegicus
gttcttacgaatacacagcagctat

SEQ ID NO: 527201 - DNA, 25 bp, Rattus norvegicus
gttcttacgaattcacagcagctat

SEQ ID NO: 527202 - DNA, 25 bp, Rattus norvegicus
gttcttactatcagggattctccat

SEQ ID NO: 527203 - DNA, 25 bp, Rattus norvegicus
gttcttactatctgggattctccat

SEQ ID NO: 527204 - DNA, 25 bp, Rattus norvegicus
gttcttactgatattgttccatggt

SEQ ID NO: 527205 - DNA, 25 bp, Rattus norvegicus
gttcttactgattttgttccatggt

SEQ ID NO: 527206 - DNA, 25 bp, Rattus norvegicus
gttcttactgcaatttcttctttat

SEQ ID NO: 527207 - DNA, 25 bp, Rattus norvegicus
gttcttactgcacccaaagcgtaga

SEQ ID NO: 527208 - DNA, 25 bp, Rattus norvegicus
gttcttactgcagccaaagcgtaga

SEQ ID NO: 527209 - DNA, 25 bp, Rattus norvegicus
gttcttactgcattttcttctttat

SEQ ID NO: 527210 - DNA, 25 bp, Rattus norvegicus
gttcttactgtgctctggtcaggaa

SEQ ID NO: 527211 - DNA, 25 bp, Rattus norvegicus
gttcttactgtggtctggtcaggaa

SEQ ID NO: 527212 - DNA, 25 bp, Rattus norvegicus
gttcttagagctatgcagcttctcg

SEQ ID NO: 527213 - DNA, 25 bp, Rattus norvegicus
gttcttagagctttgcagcttctcg

SEQ ID NO: 527214 - DNA, 25 bp, Rattus norvegicus
gttcttagcagtagccaatcagagg

SEQ ID NO: 527215 - DNA, 25 bp, Rattus norvegicus
gttcttagcagttgccaatcagagg

SEQ ID NO: 527216 - DNA, 25 bp, Rattus norvegicus
gttcttagccccaatgtcctaagtt

SEQ ID NO: 527217 - DNA, 25 bp, Rattus norvegicus
gttcttagcccctatgtcctaagtt

SEQ ID NO: 527218 - DNA, 25 bp, Rattus norvegicus
gttcttagccttactgtggtttctc

SEQ ID NO: 527219 - DNA, 25 bp, Rattus norvegicus
gttcttagcctttctgtggtttctc

SEQ ID NO: 527220 - DNA, 25 bp, Rattus norvegicus
gttcttaggaaacccacagtagctg

SEQ ID NO: 527221 - DNA, 25 bp, Rattus norvegicus
gttcttaggaaagccacagtagctg

SEQ ID NO: 527222 - DNA, 25 bp, Rattus norvegicus
gttcttagtcctactcttgtacaaa

SEQ ID NO: 527223 - DNA, 25 bp, Rattus norvegicus
gttcttagtccttctcttgtacaaa

SEQ ID NO: 527224 - DNA, 25 bp, Rattus norvegicus
gttcttagtgtccaagtgccaagtg

SEQ ID NO: 527225 - DNA, 25 bp, Rattus norvegicus
gttcttagtgtcgaagtgccaagtg

SEQ ID NO: 527226 - DNA, 25 bp, Rattus norvegicus
gttcttagtttcctagtcaatggca

SEQ ID NO: 527227 - DNA, 25 bp, Rattus norvegicus
gttcttagtttcgtagtcaatggca

SEQ ID NO: 527228 - DNA, 25 bp, Rattus norvegicus
gttcttatcaacctgtatcctggat

SEQ ID NO: 527229 - DNA, 25 bp, Rattus norvegicus
gttcttatcaacgtgtatcctggat

SEQ ID NO: 527230 - DNA, 25 bp, Rattus norvegicus
gttcttatcaatatacctgcaatgt

SEQ ID NO: 527231 - DNA, 25 bp, Rattus norvegicus
gttcttatcaatttacctgcaatgt

SEQ ID NO: 527232 - DNA, 25 bp, Rattus norvegicus
gttcttatgtagatcaggttgtcct

SEQ ID NO: 527233 - DNA, 25 bp, Rattus norvegicus
gttcttatgtagttcaggttgtcct

SEQ ID NO: 527234 - DNA, 25 bp, Rattus norvegicus
gttcttattcctaaccattgtcttg

SEQ ID NO: 527235 - DNA, 25 bp, Rattus norvegicus
gttcttattccttaccattgtcttg

SEQ ID NO: 527236 - DNA, 25 bp, Rattus norvegicus
gttcttattggcaaagctcctcaac

SEQ ID NO: 527237 - DNA, 25 bp, Rattus norvegicus
gttcttattggctaagctcctcaac

SEQ ID NO: 527238 - DNA, 25 bp, Rattus norvegicus
gttcttatttatctcacagtgccct

SEQ ID NO: 527239 - DNA, 25 bp, Rattus norvegicus
gttcttatttatgtcacagtgccct

SEQ ID NO: 527240 - DNA, 25 bp, Rattus norvegicus
gttcttatttccatgtggcatctaa

SEQ ID NO: 527241 - DNA, 25 bp, Rattus norvegicus
gttcttatttccttgtggcatctaa

SEQ ID NO: 527242 - DNA, 25 bp, Rattus norvegicus
gttcttatttttctgctaatagcca

SEQ ID NO: 527243 - DNA, 25 bp, Rattus norvegicus
gttcttatttttgtgctaatagcca

SEQ ID NO: 527244 - DNA, 25 bp, Rattus norvegicus
gttcttcaaaacacagcacagtcga

SEQ ID NO: 527245 - DNA, 25 bp, Rattus norvegicus
gttcttcaaaactcagcacagtcga

SEQ ID NO: 527246 - DNA, 25 bp, Rattus norvegicus
gttcttcaactaaagcaaatactgg

SEQ ID NO: 527247 - DNA, 25 bp, Rattus norvegicus
gttcttcaactatagcaaatactgg

SEQ ID NO: 527248 - DNA, 25 bp, Rattus norvegicus
gttcttcaagatacctgttcaaagc

SEQ ID NO: 527249 - DNA, 25 bp, Rattus norvegicus
gttcttcaagattcctgttcaaagc

SEQ ID NO: 527250 - DNA, 25 bp, Rattus norvegicus
gttcttcacaaaaagtcctctgact

SEQ ID NO: 527251 - DNA, 25 bp, Rattus norvegicus
gttcttcacaaatagtcctctgact

SEQ ID NO: 527252 - DNA, 25 bp, Rattus norvegicus
gttcttcacataaaggcagggtccc

SEQ ID NO: 527253 - DNA, 25 bp, Rattus norvegicus
gttcttcacatataggcagggtccc

SEQ ID NO: 527254 - DNA, 25 bp, Rattus norvegicus
gttcttcacctgcatgataagtctg

SEQ ID NO: 527255 - DNA, 25 bp, Rattus norvegicus
gttcttcacctggatgataagtctg

SEQ ID NO: 527256 - DNA, 25 bp, Rattus norvegicus
gttcttcacgccaatagtgcagtct

SEQ ID NO: 527257 - DNA, 25 bp, Rattus norvegicus
gttcttcacgcctatagtgcagtct

SEQ ID NO: 527258 - DNA, 25 bp, Rattus norvegicus
gttcttcactttatgctacacacag

SEQ ID NO: 527259 - DNA, 25 bp, Rattus norvegicus
gttcttcactttttgctacacacag

SEQ ID NO: 527260 - DNA, 25 bp, Rattus norvegicus
gttcttcagacacttcacgttgcgc

SEQ ID NO: 527261 - DNA, 25 bp, Rattus norvegicus
gttcttcagacagttcacgttgcgc

SEQ ID NO: 527262 - DNA, 25 bp, Rattus norvegicus
gttcttcagaggatatatacttcat

SEQ ID NO: 527263 - DNA, 25 bp, Rattus norvegicus
gttcttcagaggttatatacttcat

SEQ ID NO: 527264 - DNA, 25 bp, Rattus norvegicus
gttcttcaggagagtacaccgatca

SEQ ID NO: 527265 - DNA, 25 bp, Rattus norvegicus
gttcttcaggagtgtacaccgatca

SEQ ID NO: 527266 - DNA, 25 bp, Rattus norvegicus
gttcttcaggcgcttctagaggata

SEQ ID NO: 527267 - DNA, 25 bp, Rattus norvegicus
gttcttcaggcggttctagaggata

SEQ ID NO: 527268 - DNA, 25 bp, Rattus norvegicus
gttcttcagtgtctggatgctccag

SEQ ID NO: 527269 - DNA, 25 bp, Rattus norvegicus
gttcttcagtgtgtggatgctccag

SEQ ID NO: 527270 - DNA, 25 bp, Rattus norvegicus
gttcttcagttgacagagagcctta

SEQ ID NO: 527271 - DNA, 25 bp, Rattus norvegicus
gttcttcagttgtcagagagcctta

SEQ ID NO: 527272 - DNA, 25 bp, Rattus norvegicus
gttcttcatcagctcggattttttc

SEQ ID NO: 527273 - DNA, 25 bp, Rattus norvegicus
gttcttcatcaggtcggattttttc

SEQ ID NO: 527274 - DNA, 25 bp, Rattus norvegicus
gttcttcatctccattttcagctgt

SEQ ID NO: 527275 - DNA, 25 bp, Rattus norvegicus
gttcttcatctcgattttcagctgt

SEQ ID NO: 527276 - DNA, 25 bp, Rattus norvegicus
gttcttcatgatagtatccctagca

SEQ ID NO: 527277 - DNA, 25 bp, Rattus norvegicus
gttcttcatgattgtatccctagca

SEQ ID NO: 527278 - DNA, 25 bp, Rattus norvegicus
gttcttcatttacacttctcaggga

SEQ ID NO: 527279 - DNA, 25 bp, Rattus norvegicus
gttcttcatttagacttctcaggga

SEQ ID NO: 527280 - DNA, 25 bp, Rattus norvegicus
gttcttcattttcagtgtcgtcatt

SEQ ID NO: 527281 - DNA, 25 bp, Rattus norvegicus
gttcttcattttgagtgtcgtcatt

SEQ ID NO: 527282 - DNA, 25 bp, Rattus norvegicus
gttcttccacaacgaaaacgactgg

SEQ ID NO: 527283 - DNA, 25 bp, Rattus norvegicus
gttcttccacaaggaaaacgactgg

SEQ ID NO: 527284 - DNA, 25 bp, Rattus norvegicus
gttcttccacagctgtttacggtag

SEQ ID NO: 527285 - DNA, 25 bp, Rattus norvegicus
gttcttccacaggtgtttacggtag

SEQ ID NO: 527286 - DNA, 25 bp, Rattus norvegicus
gttcttccacgtacaggacctagaa

SEQ ID NO: 527287 - DNA, 25 bp, Rattus norvegicus
gttcttccacgttcaggacctagaa

SEQ ID NO: 527288 - DNA, 25 bp, Rattus norvegicus
gttcttccagacagacatgtcttaa

SEQ ID NO: 527289 - DNA, 25 bp, Rattus norvegicus
gttcttccagactgacatgtcttaa

SEQ ID NO: 527290 - DNA, 25 bp, Rattus norvegicus
gttcttccagagagcagcaacactt

SEQ ID NO: 527291 - DNA, 25 bp, Rattus norvegicus
gttcttccagagtgcagcaacactt

SEQ ID NO: 527292 - DNA, 25 bp, Rattus norvegicus
gttcttcccagcatctaactattat

SEQ ID NO: 527293 - DNA, 25 bp, Rattus norvegicus
gttcttcccagcttctaactattat

SEQ ID NO: 527294 - DNA, 25 bp, Rattus norvegicus
gttcttccgggtcacgacagcttgt

SEQ ID NO: 527295 - DNA, 25 bp, Rattus norvegicus
gttcttccgggtgacgacagcttgt

SEQ ID NO: 527296 - DNA, 25 bp, Rattus norvegicus
gttcttccgtgcaacatgggctgga

SEQ ID NO: 527297 - DNA, 25 bp, Rattus norvegicus
gttcttccgtgctacatgggctgga

SEQ ID NO: 527298 - DNA, 25 bp, Rattus norvegicus
gttcttccgttactttgtcaattca

SEQ ID NO: 527299 - DNA, 25 bp, Rattus norvegicus
gttcttccgttagtttgtcaattca

SEQ ID NO: 527300 - DNA, 25 bp, Rattus norvegicus
gttcttcctagacctgagtttttta

SEQ ID NO: 527301 - DNA, 25 bp, Rattus norvegicus
gttcttcctagagctgagtttttta

SEQ ID NO: 527302 - DNA, 25 bp, Rattus norvegicus
gttcttcctagtcatgcccattggg

SEQ ID NO: 527303 - DNA, 25 bp, Rattus norvegicus
gttcttcctagtgatgcccattggg

SEQ ID NO: 527304 - DNA, 25 bp, Rattus norvegicus
gttcttcctcaactagaagccaagt

SEQ ID NO: 527305 - DNA, 25 bp, Rattus norvegicus
gttcttcctcaagtagaagccaagt

SEQ ID NO: 527306 - DNA, 25 bp, Rattus norvegicus
gttcttcctcacactagtgaacttt

SEQ ID NO: 527307 - DNA, 25 bp, Rattus norvegicus
gttcttcctcactctagtgaacttt

SEQ ID NO: 527308 - DNA, 25 bp, Rattus norvegicus
gttcttcctgccatgctgggaaata

SEQ ID NO: 527309 - DNA, 25 bp, Rattus norvegicus
gttcttcctgccttgctgggaaata

SEQ ID NO: 527310 - DNA, 25 bp, Rattus norvegicus
gttcttcctggacctgggcattcag

SEQ ID NO: 527311 - DNA, 25 bp, Rattus norvegicus
gttcttcctggagctgggcattcag

SEQ ID NO: 527312 - DNA, 25 bp, Rattus norvegicus
gttcttcctggtctgctaaggcagt

SEQ ID NO: 527313 - DNA, 25 bp, Rattus norvegicus
gttcttcctggtgtgctaaggcagt

SEQ ID NO: 527314 - DNA, 25 bp, Rattus norvegicus
gttcttccttttagtcatgttctca

SEQ ID NO: 527315 - DNA, 25 bp, Rattus norvegicus
gttcttcctttttgtcatgttctca

SEQ ID NO: 527316 - DNA, 25 bp, Rattus norvegicus
gttcttcgcaagagtacagttttca

SEQ ID NO: 527317 - DNA, 25 bp, Rattus norvegicus
gttcttcgcaagtgtacagttttca

SEQ ID NO: 527318 - DNA, 25 bp, Rattus norvegicus
gttcttcgcagccttcagggacaag

SEQ ID NO: 527319 - DNA, 25 bp, Rattus norvegicus
gttcttcgcagcgttcagggacaag

SEQ ID NO: 527320 - DNA, 25 bp, Rattus norvegicus
gttcttcggtgaccattccacagaa

SEQ ID NO: 527321 - DNA, 25 bp, Rattus norvegicus
gttcttcggtgagcattccacagaa

SEQ ID NO: 527322 - DNA, 25 bp, Rattus norvegicus
gttcttctaagtctttactttctca

SEQ ID NO: 527323 - DNA, 25 bp, Rattus norvegicus
gttcttctaagtgtttactttctca

SEQ ID NO: 527324 - DNA, 25 bp, Rattus norvegicus
gttcttctaggtagtattgccacac

SEQ ID NO: 527325 - DNA, 25 bp, Rattus norvegicus
gttcttctaggttgtattgccacac

SEQ ID NO: 527326 - DNA, 25 bp, Rattus norvegicus
gttcttctatctaaatcatccggtt

SEQ ID NO: 527327 - DNA, 25 bp, Rattus norvegicus
gttcttctatcttaatcatccggtt

SEQ ID NO: 527328 - DNA, 25 bp, Rattus norvegicus
gttcttctcactatatccctttgaa

SEQ ID NO: 527329 - DNA, 25 bp, Rattus norvegicus
gttcttctcactttatccctttgaa

SEQ ID NO: 527330 - DNA, 25 bp, Rattus norvegicus
gttcttctccctccaatttttaatt

SEQ ID NO: 527331 - DNA, 25 bp, Rattus norvegicus
gttcttctccctgcaatttttaatt

SEQ ID NO: 527332 - DNA, 25 bp, Rattus norvegicus
gttcttctcctaatgttccttagtg

SEQ ID NO: 527333 - DNA, 25 bp, Rattus norvegicus
gttcttctcctattgttccttagtg

SEQ ID NO: 527334 - DNA, 25 bp, Rattus norvegicus
gttcttctccttctggatgatttcg

SEQ ID NO: 527335 - DNA, 25 bp, Rattus norvegicus
gttcttctccttgtggatgatttcg

SEQ ID NO: 527336 - DNA, 25 bp, Rattus norvegicus
gttcttctctccatatatctcaaca

SEQ ID NO: 527337 - DNA, 25 bp, Rattus norvegicus
gttcttctctccttatatctcaaca

SEQ ID NO: 527338 - DNA, 25 bp, Rattus norvegicus
gttcttctgaaacctgttttgctca

SEQ ID NO: 527339 - DNA, 25 bp, Rattus norvegicus
gttcttctgaaagctgttttgctca

SEQ ID NO: 527340 - DNA, 25 bp, Rattus norvegicus
gttcttctgaagctcctgtgttcaa

SEQ ID NO: 527341 - DNA, 25 bp, Rattus norvegicus
gttcttctgaaggtcctgtgttcaa

SEQ ID NO: 527342 - DNA, 25 bp, Rattus norvegicus
gttcttctgaccctggtttcagccg

SEQ ID NO: 527343 - DNA, 25 bp, Rattus norvegicus
gttcttctgaccgtggtttcagccg

SEQ ID NO: 527344 - DNA, 25 bp, Rattus norvegicus
gttcttctgagaagggctgccctcg

SEQ ID NO: 527345 - DNA, 25 bp, Rattus norvegicus
gttcttctgagatgggctgccctcg

SEQ ID NO: 527346 - DNA, 25 bp, Rattus norvegicus
gttcttctgctacatccatacaagg

SEQ ID NO: 527347 - DNA, 25 bp, Rattus norvegicus
gttcttctgctagatccatacaagg

SEQ ID NO: 527348 - DNA, 25 bp, Rattus norvegicus
gttcttctgtggctcttttaagtta

SEQ ID NO: 527349 - DNA, 25 bp, Rattus norvegicus
gttcttctgtgggtcttttaagtta

SEQ ID NO: 527350 - DNA, 25 bp, Rattus norvegicus
gttcttctgtgtccttaattgtttc

SEQ ID NO: 527351 - DNA, 25 bp, Rattus norvegicus
gttcttctgtgtgcttaattgtttc

SEQ ID NO: 527352 - DNA, 25 bp, Rattus norvegicus
gttcttctgtttcctgatgtctgac

SEQ ID NO: 527353 - DNA, 25 bp, Rattus norvegicus
gttcttctgtttgctgatgtctgac

SEQ ID NO: 527354 - DNA, 25 bp, Rattus norvegicus
gttcttcttcaaaagcggatccctg

SEQ ID NO: 527355 - DNA, 25 bp, Rattus norvegicus
gttcttcttcaatagcggatccctg

SEQ ID NO: 527356 - DNA, 25 bp, Rattus norvegicus
gttcttcttcataaaccctggacta

SEQ ID NO: 527357 - DNA, 25 bp, Rattus norvegicus
gttcttcttcattaaccctggacta

SEQ ID NO: 527358 - DNA, 25 bp, Rattus norvegicus
gttcttcttccccaggatcagttca

SEQ ID NO: 527359 - DNA, 25 bp, Rattus norvegicus
gttcttcttcccgaggatcagttca

SEQ ID NO: 527360 - DNA, 25 bp, Rattus norvegicus
gttcttctttgaccttctggtgaga

SEQ ID NO: 527361 - DNA, 25 bp, Rattus norvegicus
gttcttctttgagcttctggtgaga

SEQ ID NO: 527362 - DNA, 25 bp, Rattus norvegicus
gttcttcttttcaactgagcctaaa

SEQ ID NO: 527363 - DNA, 25 bp, Rattus norvegicus
gttcttcttttctactgagcctaaa

SEQ ID NO: 527364 - DNA, 25 bp, Rattus norvegicus
gttcttgaaactctgtcgtatgatc

SEQ ID NO: 527365 - DNA, 25 bp, Rattus norvegicus
gttcttgaaactgtgtcgtatgatc

SEQ ID NO: 527366 - DNA, 25 bp, Rattus norvegicus
gttcttgaagtcaaactctgtgcta

SEQ ID NO: 527367 - DNA, 25 bp, Rattus norvegicus
gttcttgaagtctaactctgtgcta

SEQ ID NO: 527368 - DNA, 25 bp, Rattus norvegicus
gttcttgaattaatttctgacctgg

SEQ ID NO: 527369 - DNA, 25 bp, Rattus norvegicus
gttcttgaattattttctgacctgg

SEQ ID NO: 527370 - DNA, 25 bp, Rattus norvegicus
gttcttgacttgagtgttcctttta

SEQ ID NO: 527371 - DNA, 25 bp, Rattus norvegicus
gttcttgacttgtgtgttcctttta

SEQ ID NO: 527372 - DNA, 25 bp, Rattus norvegicus
gttcttgactttaaaggctactcga

SEQ ID NO: 527373 - DNA, 25 bp, Rattus norvegicus
gttcttgacttttaaggctactcga

SEQ ID NO: 527374 - DNA, 25 bp, Rattus norvegicus
gttcttgatccaaattctactttcc

SEQ ID NO: 527375 - DNA, 25 bp, Rattus norvegicus
gttcttgatccatattctactttcc

SEQ ID NO: 527376 - DNA, 25 bp, Rattus norvegicus
gttcttgatgtacaggtcccgcatg

SEQ ID NO: 527377 - DNA, 25 bp, Rattus norvegicus
gttcttgatgtagaggtcccgcatg

SEQ ID NO: 527378 - DNA, 25 bp, Rattus norvegicus
gttcttgcaattccttcagcccaag

SEQ ID NO: 527379 - DNA, 25 bp, Rattus norvegicus
gttcttgcaattgcttcagcccaag

SEQ ID NO: 527380 - DNA, 25 bp, Rattus norvegicus
gttcttgcacaacgactcggctgac

SEQ ID NO: 527381 - DNA, 25 bp, Rattus norvegicus
gttcttgcacaaggactcggctgac

SEQ ID NO: 527382 - DNA, 25 bp, Rattus norvegicus
gttcttgcacatattgaagtttcct

SEQ ID NO: 527383 - DNA, 25 bp, Rattus norvegicus
gttcttgcacattttgaagtttcct

SEQ ID NO: 527384 - DNA, 25 bp, Rattus norvegicus
gttcttgcacgcagtttcttagaga

SEQ ID NO: 527385 - DNA, 25 bp, Rattus norvegicus
gttcttgcacgctgtttcttagaga

SEQ ID NO: 527386 - DNA, 25 bp, Rattus norvegicus
gttcttgcattactctttgtgcgca

SEQ ID NO: 527387 - DNA, 25 bp, Rattus norvegicus
gttcttgcattagtctttgtgcgca

SEQ ID NO: 527388 - DNA, 25 bp, Rattus norvegicus
gttcttgccaacactgtctacacag

SEQ ID NO: 527389 - DNA, 25 bp, Rattus norvegicus
gttcttgccaactctgtctacacag

SEQ ID NO: 527390 - DNA, 25 bp, Rattus norvegicus
gttcttgccgagacagcgcaggtag

SEQ ID NO: 527391 - DNA, 25 bp, Rattus norvegicus
gttcttgccgagtcagcgcaggtag

SEQ ID NO: 527392 - DNA, 25 bp, Rattus norvegicus
gttcttgcctataacaacctctctg

SEQ ID NO: 527393 - DNA, 25 bp, Rattus norvegicus
gttcttgcctattacaacctctctg

SEQ ID NO: 527394 - DNA, 25 bp, Rattus norvegicus
gttcttgcctgcagatcgaccagat

SEQ ID NO: 527395 - DNA, 25 bp, Rattus norvegicus
gttcttgcctgctgatcgaccagat

SEQ ID NO: 527396 - DNA, 25 bp, Rattus norvegicus
gttcttgcgcgtctatcgcaggagt

SEQ ID NO: 527397 - DNA, 25 bp, Rattus norvegicus
gttcttgcgcgtgtatcgcaggagt

SEQ ID NO: 527398 - DNA, 25 bp, Rattus norvegicus
gttcttgctctgagaccagatagcc

SEQ ID NO: 527399 - DNA, 25 bp, Rattus norvegicus
gttcttgctctgtgaccagatagcc

SEQ ID NO: 527400 - DNA, 25 bp, Rattus norvegicus
gttcttgctgcactcatggttgcat

SEQ ID NO: 527401 - DNA, 25 bp, Rattus norvegicus
gttcttgctgcagtcatggttgcat

SEQ ID NO: 527402 - DNA, 25 bp, Rattus norvegicus
gttcttgctgctcgtgctgtcttgg

SEQ ID NO: 527403 - DNA, 25 bp, Rattus norvegicus
gttcttgctgctggtgctgtcttgg

SEQ ID NO: 527404 - DNA, 25 bp, Rattus norvegicus
gttcttgcttaaaactcaccaggcc

SEQ ID NO: 527405 - DNA, 25 bp, Rattus norvegicus
gttcttgcttaatactcaccaggcc

SEQ ID NO: 527406 - DNA, 25 bp, Rattus norvegicus
gttcttggaaagactgagtggtaca

SEQ ID NO: 527407 - DNA, 25 bp, Rattus norvegicus
gttcttggaaagtctgagtggtaca

SEQ ID NO: 527408 - DNA, 25 bp, Rattus norvegicus
gttcttgggccaaaacacattgttt

SEQ ID NO: 527409 - DNA, 25 bp, Rattus norvegicus
gttcttgggccataacacattgttt

SEQ ID NO: 527410 - DNA, 25 bp, Rattus norvegicus
gttcttgggcccacagtcaccttct

SEQ ID NO: 527411 - DNA, 25 bp, Rattus norvegicus
gttcttgggccctcagtcaccttct

SEQ ID NO: 527412 - DNA, 25 bp, Rattus norvegicus
gttcttgggtcaaccggcgtacaga

SEQ ID NO: 527413 - DNA, 25 bp, Rattus norvegicus
gttcttgggtcatccggcgtacaga

SEQ ID NO: 527414 - DNA, 25 bp, Rattus norvegicus
gttcttgggtgaactgtaataaatt

SEQ ID NO: 527415 - DNA, 25 bp, Rattus norvegicus
gttcttgggtgatctgtaataaatt

SEQ ID NO: 527416 - DNA, 25 bp, Rattus norvegicus
gttcttggttctctcaaagagccat

SEQ ID NO: 527417 - DNA, 25 bp, Rattus norvegicus
gttcttggttctgtcaaagagccat

SEQ ID NO: 527418 - DNA, 25 bp, Rattus norvegicus
gttcttgtaaagcttcatattcagc

SEQ ID NO: 527419 - DNA, 25 bp, Rattus norvegicus
gttcttgtaaaggttcatattcagc

SEQ ID NO: 527420 - DNA, 25 bp, Rattus norvegicus
gttcttgtaagtatgtcccagcact

SEQ ID NO: 527421 - DNA, 25 bp, Rattus norvegicus
gttcttgtaagtttgtcccagcact

SEQ ID NO: 527422 - DNA, 25 bp, Rattus norvegicus
gttcttgtaattatccgcgcttttg

SEQ ID NO: 527423 - DNA, 25 bp, Rattus norvegicus
gttcttgtaattttccgcgcttttg

SEQ ID NO: 527424 - DNA, 25 bp, Rattus norvegicus
gttcttgtagaaacgacggtctcat

SEQ ID NO: 527425 - DNA, 25 bp, Rattus norvegicus
gttcttgtagaatcgacggtctcat

SEQ ID NO: 527426 - DNA, 25 bp, Rattus norvegicus
gttcttgtcagaatccatcttgtta

SEQ ID NO: 527427 - DNA, 25 bp, Rattus norvegicus
gttcttgtcagattccatcttgtta

SEQ ID NO: 527428 - DNA, 25 bp, Rattus norvegicus
gttcttgtccccagcaaacaggagt

SEQ ID NO: 527429 - DNA, 25 bp, Rattus norvegicus
gttcttgtcccctgcaaacaggagt

SEQ ID NO: 527430 - DNA, 25 bp, Rattus norvegicus
gttcttgtcctaacttccttcaata

SEQ ID NO: 527431 - DNA, 25 bp, Rattus norvegicus
gttcttgtcctatcttccttcaata

SEQ ID NO: 527432 - DNA, 25 bp, Rattus norvegicus
gttcttgtctggaactcggccgcag

SEQ ID NO: 527433 - DNA, 25 bp, Rattus norvegicus
gttcttgtctggtactcggccgcag

SEQ ID NO: 527434 - DNA, 25 bp, Rattus norvegicus
gttcttgtgtttatgcttttgtgtg

SEQ ID NO: 527435 - DNA, 25 bp, Rattus norvegicus
gttcttgtgtttttgcttttgtgtg

SEQ ID NO: 527436 - DNA, 25 bp, Rattus norvegicus
gttcttgttcccagtttaaatggtg

SEQ ID NO: 527437 - DNA, 25 bp, Rattus norvegicus
gttcttgttccctgtttaaatggtg

SEQ ID NO: 527438 - DNA, 25 bp, Rattus norvegicus
gttcttgttctgctatgcaatcatt

SEQ ID NO: 527439 - DNA, 25 bp, Rattus norvegicus
gttcttgttctggtatgcaatcatt

SEQ ID NO: 527440 - DNA, 25 bp, Rattus norvegicus
gttcttgttggcattctaccaccag

SEQ ID NO: 527441 - DNA, 25 bp, Rattus norvegicus
gttcttgttggctttctaccaccag

SEQ ID NO: 527442 - DNA, 25 bp, Rattus norvegicus
gttcttgttgtcaccaaatgctgta

SEQ ID NO: 527443 - DNA, 25 bp, Rattus norvegicus
gttcttgttgtcctaatgttctaat

SEQ ID NO: 527444 - DNA, 25 bp, Rattus norvegicus
gttcttgttgtcgtaatgttctaat

SEQ ID NO: 527445 - DNA, 25 bp, Rattus norvegicus
gttcttgttgtctccaaatgctgta

SEQ ID NO: 527446 - DNA, 25 bp, Rattus norvegicus
gttcttgttttcctctagtcatgga

SEQ ID NO: 527447 - DNA, 25 bp, Rattus norvegicus
gttcttgttttcgtctagtcatgga

SEQ ID NO: 527448 - DNA, 25 bp, Rattus norvegicus
gttctttaaagcatacctggcacca

SEQ ID NO: 527449 - DNA, 25 bp, Rattus norvegicus
gttctttaaagcttacctggcacca

SEQ ID NO: 527450 - DNA, 25 bp, Rattus norvegicus
gttctttaaattctattgctctcag

SEQ ID NO: 527451 - DNA, 25 bp, Rattus norvegicus
gttctttaaattgtattgctctcag

SEQ ID NO: 527452 - DNA, 25 bp, Rattus norvegicus
gttctttaacagactgtggaagtca

SEQ ID NO: 527453 - DNA, 25 bp, Rattus norvegicus
gttctttaacagtctgtggaagtca

SEQ ID NO: 527454 - DNA, 25 bp, Rattus norvegicus
gttctttaccctaagtggcaaacat

SEQ ID NO: 527455 - DNA, 25 bp, Rattus norvegicus
gttctttaccctcgccatggatttt

SEQ ID NO: 527456 - DNA, 25 bp, Rattus norvegicus
gttctttaccctggccatggatttt

SEQ ID NO: 527457 - DNA, 25 bp, Rattus norvegicus
gttctttacccttagtggcaaacat

SEQ ID NO: 527458 - DNA, 25 bp, Rattus norvegicus
gttctttacgccatcctggatgaaa

SEQ ID NO: 527459 - DNA, 25 bp, Rattus norvegicus
gttctttacgccttcctggatgaaa

SEQ ID NO: 527460 - DNA, 25 bp, Rattus norvegicus
gttctttactgtaactattcattta

SEQ ID NO: 527461 - DNA, 25 bp, Rattus norvegicus
gttctttactgttactattcattta

SEQ ID NO: 527462 - DNA, 25 bp, Rattus norvegicus
gttctttacttgctacatgtggccg

SEQ ID NO: 527463 - DNA, 25 bp, Rattus norvegicus
gttctttacttggtacatgtggccg

SEQ ID NO: 527464 - DNA, 25 bp, Rattus norvegicus
gttctttagaagatctggccatttg

SEQ ID NO: 527465 - DNA, 25 bp, Rattus norvegicus
gttctttagaagttctggccatttg

SEQ ID NO: 527466 - DNA, 25 bp, Rattus norvegicus
gttctttagcttacaactcgcagga

SEQ ID NO: 527467 - DNA, 25 bp, Rattus norvegicus
gttctttagctttcaactcgcagga

SEQ ID NO: 527468 - DNA, 25 bp, Rattus norvegicus
gttctttagtcacgtggttccccat

SEQ ID NO: 527469 - DNA, 25 bp, Rattus norvegicus
gttctttagtcaggtggttccccat

SEQ ID NO: 527470 - DNA, 25 bp, Rattus norvegicus
gttctttagtctctcatgggttcac

SEQ ID NO: 527471 - DNA, 25 bp, Rattus norvegicus
gttctttagtctgtcatgggttcac

SEQ ID NO: 527472 - DNA, 25 bp, Rattus norvegicus
gttctttatcataccccattttgag

SEQ ID NO: 527473 - DNA, 25 bp, Rattus norvegicus
gttctttatcattccccattttgag

SEQ ID NO: 527474 - DNA, 25 bp, Rattus norvegicus
gttctttatctgaagatgtgcctac

SEQ ID NO: 527475 - DNA, 25 bp, Rattus norvegicus
gttctttatctgtagatgtgcctac

SEQ ID NO: 527476 - DNA, 25 bp, Rattus norvegicus
gttctttatgtaactgtcaacccca

SEQ ID NO: 527477 - DNA, 25 bp, Rattus norvegicus
gttctttatgtatctgtcaacccca

SEQ ID NO: 527478 - DNA, 25 bp, Rattus norvegicus
gttctttcacatatagcggacacga

SEQ ID NO: 527479 - DNA, 25 bp, Rattus norvegicus
gttctttcacatttagcggacacga

SEQ ID NO: 527480 - DNA, 25 bp, Rattus norvegicus
gttctttcagagataatagcctatt

SEQ ID NO: 527481 - DNA, 25 bp, Rattus norvegicus
gttctttcagagttaatagcctatt

SEQ ID NO: 527482 - DNA, 25 bp, Rattus norvegicus
gttctttcaggcacggcagttgaga

SEQ ID NO: 527483 - DNA, 25 bp, Rattus norvegicus
gttctttcaggctcggcagttgaga

SEQ ID NO: 527484 - DNA, 25 bp, Rattus norvegicus
gttctttccattatcttagtgtact

SEQ ID NO: 527485 - DNA, 25 bp, Rattus norvegicus
gttctttccattttcttagtgtact

SEQ ID NO: 527486 - DNA, 25 bp, Rattus norvegicus
gttctttcctcaacctataatactg

SEQ ID NO: 527487 - DNA, 25 bp, Rattus norvegicus
gttctttcctcatcctataatactg

SEQ ID NO: 527488 - DNA, 25 bp, Rattus norvegicus
gttctttctgaacatctttgggcag

SEQ ID NO: 527489 - DNA, 25 bp, Rattus norvegicus
gttctttctgaagatctttgggcag

SEQ ID NO: 527490 - DNA, 25 bp, Rattus norvegicus
gttctttctgagcagctatttcgta

SEQ ID NO: 527491 - DNA, 25 bp, Rattus norvegicus
gttctttctgaggagctatttcgta

SEQ ID NO: 527492 - DNA, 25 bp, Rattus norvegicus
gttctttctggcctaatgtattaca

SEQ ID NO: 527493 - DNA, 25 bp, Rattus norvegicus
gttctttctggcgtaatgtattaca

SEQ ID NO: 527494 - DNA, 25 bp, Rattus norvegicus
gttctttcttgcacacattgcactt

SEQ ID NO: 527495 - DNA, 25 bp, Rattus norvegicus
gttctttcttgctcacattgcactt

SEQ ID NO: 527496 - DNA, 25 bp, Rattus norvegicus
gttctttcttgtacttcaccatcat

SEQ ID NO: 527497 - DNA, 25 bp, Rattus norvegicus
gttctttcttgttcttcaccatcat

SEQ ID NO: 527498 - DNA, 25 bp, Rattus norvegicus
gttctttgagaactacccagtattg

SEQ ID NO: 527499 - DNA, 25 bp, Rattus norvegicus
gttctttgagaagtacccagtattg

SEQ ID NO: 527500 - DNA, 25 bp, Rattus norvegicus
gttctttgcactagacttacctttt

SEQ ID NO: 527501 - DNA, 25 bp, Rattus norvegicus
gttctttgcacttgacttacctttt

SEQ ID NO: 527502 - DNA, 25 bp, Rattus norvegicus
gttctttgcataaaggtgtggtcca

SEQ ID NO: 527503 - DNA, 25 bp, Rattus norvegicus
gttctttgcatataggtgtggtcca

SEQ ID NO: 527504 - DNA, 25 bp, Rattus norvegicus
gttctttgcatgagggttccttaaa

SEQ ID NO: 527505 - DNA, 25 bp, Rattus norvegicus
gttctttgcatgtgggttccttaaa

SEQ ID NO: 527506 - DNA, 25 bp, Rattus norvegicus
gttctttgccagatacgttttaatt

SEQ ID NO: 527507 - DNA, 25 bp, Rattus norvegicus
gttctttgccagttacgttttaatt

SEQ ID NO: 527508 - DNA, 25 bp, Rattus norvegicus
gttctttgccgaaatccaagctcat

SEQ ID NO: 527509 - DNA, 25 bp, Rattus norvegicus
gttctttgccgatatccaagctcat

SEQ ID NO: 527510 - DNA, 25 bp, Rattus norvegicus
gttctttggaacagctgtttgcttg

SEQ ID NO: 527511 - DNA, 25 bp, Rattus norvegicus
gttctttggaactgctgtttgcttg

SEQ ID NO: 527512 - DNA, 25 bp, Rattus norvegicus
gttctttggccaacacaggtgtagt

SEQ ID NO: 527513 - DNA, 25 bp, Rattus norvegicus
gttctttggccatcacaggtgtagt

SEQ ID NO: 527514 - DNA, 25 bp, Rattus norvegicus
gttctttggcccatcttacaagaat

SEQ ID NO: 527515 - DNA, 25 bp, Rattus norvegicus
gttctttggcccttcttacaagaat

SEQ ID NO: 527516 - DNA, 25 bp, Rattus norvegicus
gttctttgggcccttgggagctggc

SEQ ID NO: 527517 - DNA, 25 bp, Rattus norvegicus
gttctttgggccgttgggagctggc

SEQ ID NO: 527518 - DNA, 25 bp, Rattus norvegicus
gttctttgtcctctatgatttctgc

SEQ ID NO: 527519 - DNA, 25 bp, Rattus norvegicus
gttctttgtcctgtatgatttctgc

SEQ ID NO: 527520 - DNA, 25 bp, Rattus norvegicus
gttctttgttttatctatcctgggt

SEQ ID NO: 527521 - DNA, 25 bp, Rattus norvegicus
gttctttgttttttctatcctgggt

SEQ ID NO: 527522 - DNA, 25 bp, Rattus norvegicus
gttcttttaagtcctgtatcagcat

SEQ ID NO: 527523 - DNA, 25 bp, Rattus norvegicus
gttcttttaagtgctgtatcagcat

SEQ ID NO: 527524 - DNA, 25 bp, Rattus norvegicus
gttcttttactgatcctgctctggg

SEQ ID NO: 527525 - DNA, 25 bp, Rattus norvegicus
gttcttttactgttcctgctctggg

SEQ ID NO: 527526 - DNA, 25 bp, Rattus norvegicus
gttcttttatcaaggcatcctgcca

SEQ ID NO: 527527 - DNA, 25 bp, Rattus norvegicus
gttcttttatcatggcatcctgcca

SEQ ID NO: 527528 - DNA, 25 bp, Rattus norvegicus
gttcttttatccatttgttcactgc

SEQ ID NO: 527529 - DNA, 25 bp, Rattus norvegicus
gttcttttatccttttgttcactgc

SEQ ID NO: 527530 - DNA, 25 bp, Rattus norvegicus
gttcttttcaggagaaagtcttcca

SEQ ID NO: 527531 - DNA, 25 bp, Rattus norvegicus
gttcttttcaggtgaaagtcttcca

SEQ ID NO: 527532 - DNA, 25 bp, Rattus norvegicus
gttcttttcctacgagtatatccaa

SEQ ID NO: 527533 - DNA, 25 bp, Rattus norvegicus
gttcttttcctaggagtatatccaa

SEQ ID NO: 527534 - DNA, 25 bp, Rattus norvegicus
gttcttttcctcctggtagcagatg

SEQ ID NO: 527535 - DNA, 25 bp, Rattus norvegicus
gttcttttcctcgtggtagcagatg

SEQ ID NO: 527536 - DNA, 25 bp, Rattus norvegicus
gttcttttcctgagataacctcgtt

SEQ ID NO: 527537 - DNA, 25 bp, Rattus norvegicus
gttcttttcctgtgataacctcgtt

SEQ ID NO: 527538 - DNA, 25 bp, Rattus norvegicus
gttcttttctaacaattactccaag

SEQ ID NO: 527539 - DNA, 25 bp, Rattus norvegicus
gttcttttctaagaattactccaag

SEQ ID NO: 527540 - DNA, 25 bp, Rattus norvegicus
gttcttttctatatcatggccaggc

SEQ ID NO: 527541 - DNA, 25 bp, Rattus norvegicus
gttcttttctatttcatggccaggc

SEQ ID NO: 527542 - DNA, 25 bp, Rattus norvegicus
gttcttttctttagacttctttgtg

SEQ ID NO: 527543 - DNA, 25 bp, Rattus norvegicus
gttcttttcttttgacttctttgtg

SEQ ID NO: 527544 - DNA, 25 bp, Rattus norvegicus
gttcttttgcctaaactctggttgt

SEQ ID NO: 527545 - DNA, 25 bp, Rattus norvegicus
gttcttttgccttaactctggttgt

SEQ ID NO: 527546 - DNA, 25 bp, Rattus norvegicus
gttcttttggaacttccaggccagc

SEQ ID NO: 527547 - DNA, 25 bp, Rattus norvegicus
gttcttttggaagttccaggccagc

SEQ ID NO: 527548 - DNA, 25 bp, Rattus norvegicus
gttcttttggctcatccagttcttt

SEQ ID NO: 527549 - DNA, 25 bp, Rattus norvegicus
gttcttttggctgatccagttcttt

SEQ ID NO: 527550 - DNA, 25 bp, Rattus norvegicus
gttcttttgtctatactcttgttca

SEQ ID NO: 527551 - DNA, 25 bp, Rattus norvegicus
gttcttttgtctttactcttgttca

SEQ ID NO: 527552 - DNA, 25 bp, Rattus norvegicus
gttctttttaagatggtgtctcatt

SEQ ID NO: 527553 - DNA, 25 bp, Rattus norvegicus
gttctttttaagttggtgtctcatt

SEQ ID NO: 527554 - DNA, 25 bp, Rattus norvegicus
gttctttttagcatcagcggccaag

SEQ ID NO: 527555 - DNA, 25 bp, Rattus norvegicus
gttctttttagcttcagcggccaag

SEQ ID NO: 527556 - DNA, 25 bp, Rattus norvegicus
gttctttttcagacaatccacaaat

SEQ ID NO: 527557 - DNA, 25 bp, Rattus norvegicus
gttctttttcagtcaatccacaaat

SEQ ID NO: 527558 - DNA, 25 bp, Rattus norvegicus
gttctttttcatcctatggcttctc

SEQ ID NO: 527559 - DNA, 25 bp, Rattus norvegicus
gttctttttcatgctatggcttctc

SEQ ID NO: 527560 - DNA, 25 bp, Rattus norvegicus
gttctttttcccaggtttcagctat

SEQ ID NO: 527561 - DNA, 25 bp, Rattus norvegicus
gttctttttcccatcctttatgcat

SEQ ID NO: 527562 - DNA, 25 bp, Rattus norvegicus
gttctttttccctggtttcagctat

SEQ ID NO: 527563 - DNA, 25 bp, Rattus norvegicus
gttctttttcccttcctttatgcat

SEQ ID NO: 527564 - DNA, 25 bp, Rattus norvegicus
gttctttttctgcatggtcctggac

SEQ ID NO: 527565 - DNA, 25 bp, Rattus norvegicus
gttctttttctggatggtcctggac

SEQ ID NO: 527566 - DNA, 25 bp, Rattus norvegicus
gttctttttggccacagtcaaatgg

SEQ ID NO: 527567 - DNA, 25 bp, Rattus norvegicus
gttctttttggcgacagtcaaatgg

SEQ ID NO: 527568 - DNA, 25 bp, Rattus norvegicus
gttctttttgttacacagggtctgg

SEQ ID NO: 527569 - DNA, 25 bp, Rattus norvegicus
gttctttttgtttcacagggtctgg

SEQ ID NO: 527570 - DNA, 25 bp, Rattus norvegicus
gttgaaaatgtcactggcagctttg

SEQ ID NO: 527571 - DNA, 25 bp, Rattus norvegicus
gttgaaaatgtctctggcagctttg

SEQ ID NO: 527572 - DNA, 25 bp, Rattus norvegicus
gttgaaacacatatgacacctgcca

SEQ ID NO: 527573 - DNA, 25 bp, Rattus norvegicus
gttgaaacacatttgacacctgcca

SEQ ID NO: 527574 - DNA, 25 bp, Rattus norvegicus
gttgaaacactaaggatcgcagctc

SEQ ID NO: 527575 - DNA, 25 bp, Rattus norvegicus
gttgaaacactatggatcgcagctc

SEQ ID NO: 527576 - DNA, 25 bp, Rattus norvegicus
gttgaaacatgccaggatgcccctt

SEQ ID NO: 527577 - DNA, 25 bp, Rattus norvegicus
gttgaaacatgcgaggatgcccctt

SEQ ID NO: 527578 - DNA, 25 bp, Rattus norvegicus
gttgaaacccaccacatcagctgtg

SEQ ID NO: 527579 - DNA, 25 bp, Rattus norvegicus
gttgaaacccacgacatcagctgtg

SEQ ID NO: 527580 - DNA, 25 bp, Rattus norvegicus
gttgaaaccttacagcaaagtgatc

SEQ ID NO: 527581 - DNA, 25 bp, Rattus norvegicus
gttgaaaccttagagcaaagtgatc

SEQ ID NO: 527582 - DNA, 25 bp, Rattus norvegicus
gttgaaactctaagaataccacagg

SEQ ID NO: 527583 - DNA, 25 bp, Rattus norvegicus
gttgaaactctatgaataccacagg

SEQ ID NO: 527584 - DNA, 25 bp, Rattus norvegicus
gttgaaagatgtcactgacctccac

SEQ ID NO: 527585 - DNA, 25 bp, Rattus norvegicus
gttgaaagatgtgactgacctccac

SEQ ID NO: 527586 - DNA, 25 bp, Rattus norvegicus
gttgaaagttcaaggaccttattga

SEQ ID NO: 527587 - DNA, 25 bp, Rattus norvegicus
gttgaaagttcatggaccttattga

SEQ ID NO: 527588 - DNA, 25 bp, Rattus norvegicus
gttgaaataacacctctcctacatg

SEQ ID NO: 527589 - DNA, 25 bp, Rattus norvegicus
gttgaaataacagctctcctacatg

SEQ ID NO: 527590 - DNA, 25 bp, Rattus norvegicus
gttgaaataagccacctcattaggg

SEQ ID NO: 527591 - DNA, 25 bp, Rattus norvegicus
gttgaaataagcgacctcattaggg

SEQ ID NO: 527592 - DNA, 25 bp, Rattus norvegicus
gttgaaatgtcgactcccactctgt

SEQ ID NO: 527593 - DNA, 25 bp, Rattus norvegicus
gttgaaatgtcgtctcccactctgt

SEQ ID NO: 527594 - DNA, 25 bp, Rattus norvegicus
gttgaaattactacatgcatatgaa

SEQ ID NO: 527595 - DNA, 25 bp, Rattus norvegicus
gttgaaattacttcatgcatatgaa

SEQ ID NO: 527596 - DNA, 25 bp, Rattus norvegicus
gttgaacaagatccacgtgtcacgt

SEQ ID NO: 527597 - DNA, 25 bp, Rattus norvegicus
gttgaacaagatgcacgtgtcacgt

SEQ ID NO: 527598 - DNA, 25 bp, Rattus norvegicus
gttgaacaagctaggaatcctgagt

SEQ ID NO: 527599 - DNA, 25 bp, Rattus norvegicus
gttgaacaagcttggaatcctgagt

SEQ ID NO: 527600 - DNA, 25 bp, Rattus norvegicus
gttgaacactccatcattacttgct

SEQ ID NO: 527601 - DNA, 25 bp, Rattus norvegicus
gttgaacactccttcattacttgct

SEQ ID NO: 527602 - DNA, 25 bp, Rattus norvegicus
gttgaacatagcagtcacctaggat

SEQ ID NO: 527603 - DNA, 25 bp, Rattus norvegicus
gttgaacatagctgtcacctaggat

SEQ ID NO: 527604 - DNA, 25 bp, Rattus norvegicus
gttgaacatcacagcagtacttcgt

SEQ ID NO: 527605 - DNA, 25 bp, Rattus norvegicus
gttgaacatcactgcagtacttcgt

SEQ ID NO: 527606 - DNA, 25 bp, Rattus norvegicus
gttgaacatctcctggtgtgaccaa

SEQ ID NO: 527607 - DNA, 25 bp, Rattus norvegicus
gttgaacatctcgtggtgtgaccaa

SEQ ID NO: 527608 - DNA, 25 bp, Rattus norvegicus
gttgaacatttccaatctccatgag

SEQ ID NO: 527609 - DNA, 25 bp, Rattus norvegicus
gttgaacatttcgaatctccatgag

SEQ ID NO: 527610 - DNA, 25 bp, Rattus norvegicus
gttgaaccaggacctcaggattcca

SEQ ID NO: 527611 - DNA, 25 bp, Rattus norvegicus
gttgaaccaggagctcaggattcca

SEQ ID NO: 527612 - DNA, 25 bp, Rattus norvegicus
gttgaaccagttagaatgcttttta

SEQ ID NO: 527613 - DNA, 25 bp, Rattus norvegicus
gttgaaccagtttgaatgcttttta

SEQ ID NO: 527614 - DNA, 25 bp, Rattus norvegicus
gttgaaccattactcagactgtgtt

SEQ ID NO: 527615 - DNA, 25 bp, Rattus norvegicus
gttgaaccattagtcagactgtgtt

SEQ ID NO: 527616 - DNA, 25 bp, Rattus norvegicus
gttgaaccatttcttttcccattag

SEQ ID NO: 527617 - DNA, 25 bp, Rattus norvegicus
gttgaaccatttgttttcccattag

SEQ ID NO: 527618 - DNA, 25 bp, Rattus norvegicus
gttgaacccatgcagatgagacctg

SEQ ID NO: 527619 - DNA, 25 bp, Rattus norvegicus
gttgaacccatggagatgagacctg

SEQ ID NO: 527620 - DNA, 25 bp, Rattus norvegicus
gttgaaccccaaccaggtcgagtat

SEQ ID NO: 527621 - DNA, 25 bp, Rattus norvegicus
gttgaaccccaagcaggtcgagtat

SEQ ID NO: 527622 - DNA, 25 bp, Rattus norvegicus
gttgaaccccagcagaagtaggtgc

SEQ ID NO: 527623 - DNA, 25 bp, Rattus norvegicus
gttgaaccccaggagaagtaggtgc

SEQ ID NO: 527624 - DNA, 25 bp, Rattus norvegicus
gttgaacctatactacatcgctcac

SEQ ID NO: 527625 - DNA, 25 bp, Rattus norvegicus
gttgaacctatagtacatcgctcac

SEQ ID NO: 527626 - DNA, 25 bp, Rattus norvegicus
gttgaaccttagcattgtcattctg

SEQ ID NO: 527627 - DNA, 25 bp, Rattus norvegicus
gttgaaccttaggattgtcattctg

SEQ ID NO: 527628 - DNA, 25 bp, Rattus norvegicus
gttgaaccttgaatttcccatttgt

SEQ ID NO: 527629 - DNA, 25 bp, Rattus norvegicus
gttgaaccttgattttcccatttgt

SEQ ID NO: 527630 - DNA, 25 bp, Rattus norvegicus
gttgaacgctttcaagccctatcaa

SEQ ID NO: 527631 - DNA, 25 bp, Rattus norvegicus
gttgaacgctttgaagccctatcaa

SEQ ID NO: 527632 - DNA, 25 bp, Rattus norvegicus
gttgaactagaaacttctttgaggc

SEQ ID NO: 527633 - DNA, 25 bp, Rattus norvegicus
gttgaactagaatcttctttgaggc

SEQ ID NO: 527634 - DNA, 25 bp, Rattus norvegicus
gttgaactcaaacccaagtctccga

SEQ ID NO: 527635 - DNA, 25 bp, Rattus norvegicus
gttgaactcaaagccaagtctccga

SEQ ID NO: 527636 - DNA, 25 bp, Rattus norvegicus
gttgaactcgggaccatgggctggg

SEQ ID NO: 527637 - DNA, 25 bp, Rattus norvegicus
gttgaactcgggtccatgggctggg

SEQ ID NO: 527638 - DNA, 25 bp, Rattus norvegicus
gttgaactctggagcttccctctgc

SEQ ID NO: 527639 - DNA, 25 bp, Rattus norvegicus
gttgaactctggtgcttccctctgc

SEQ ID NO: 527640 - DNA, 25 bp, Rattus norvegicus
gttgaactcttacgtacattccaaa

SEQ ID NO: 527641 - DNA, 25 bp, Rattus norvegicus
gttgaactcttaggtacattccaaa

SEQ ID NO: 527642 - DNA, 25 bp, Rattus norvegicus
gttgaactggaaaattctctgaggc

SEQ ID NO: 527643 - DNA, 25 bp, Rattus norvegicus
gttgaactggaatattctctgaggc

SEQ ID NO: 527644 - DNA, 25 bp, Rattus norvegicus
gttgaacttggcagaatacccgtgc

SEQ ID NO: 527645 - DNA, 25 bp, Rattus norvegicus
gttgaacttggctgaatacccgtgc

SEQ ID NO: 527646 - DNA, 25 bp, Rattus norvegicus
gttgaacttgtacatatctgccaga

SEQ ID NO: 527647 - DNA, 25 bp, Rattus norvegicus
gttgaacttgtagatatctgccaga

SEQ ID NO: 527648 - DNA, 25 bp, Rattus norvegicus
gttgaacttttcaagctgtttctaa

SEQ ID NO: 527649 - DNA, 25 bp, Rattus norvegicus
gttgaacttttctagctgtttctaa

SEQ ID NO: 527650 - DNA, 25 bp, Rattus norvegicus
gttgaagaagagacctctgctcccc

SEQ ID NO: 527651 - DNA, 25 bp, Rattus norvegicus
gttgaagaagagtcctctgctcccc

SEQ ID NO: 527652 - DNA, 25 bp, Rattus norvegicus
gttgaagaagccaagcgtctcctac

SEQ ID NO: 527653 - DNA, 25 bp, Rattus norvegicus
gttgaagaagcctagcgtctcctac

SEQ ID NO: 527654 - DNA, 25 bp, Rattus norvegicus
gttgaagaatctagccagtccttat

SEQ ID NO: 527655 - DNA, 25 bp, Rattus norvegicus
gttgaagaatcttgccagtccttat

SEQ ID NO: 527656 - DNA, 25 bp, Rattus norvegicus
gttgaagacacacagctgtccctcc

SEQ ID NO: 527657 - DNA, 25 bp, Rattus norvegicus
gttgaagacacagagctgtccctcc

SEQ ID NO: 527658 - DNA, 25 bp, Rattus norvegicus
gttgaagagactatcccaggaccag

SEQ ID NO: 527659 - DNA, 25 bp, Rattus norvegicus
gttgaagagactttcccaggaccag

SEQ ID NO: 527660 - DNA, 25 bp, Rattus norvegicus
gttgaagatctaaacacgcctggct

SEQ ID NO: 527661 - DNA, 25 bp, Rattus norvegicus
gttgaagatctatacacgcctggct

SEQ ID NO: 527662 - DNA, 25 bp, Rattus norvegicus
gttgaagattccatggctgctagtc

SEQ ID NO: 527663 - DNA, 25 bp, Rattus norvegicus
gttgaagattccttggctgctagtc

SEQ ID NO: 527664 - DNA, 25 bp, Rattus norvegicus
gttgaagatttgagcttgcctccga

SEQ ID NO: 527665 - DNA, 25 bp, Rattus norvegicus
gttgaagatttgtgcttgcctccga

SEQ ID NO: 527666 - DNA, 25 bp, Rattus norvegicus
gttgaagcaagacagtcaggagttc

SEQ ID NO: 527667 - DNA, 25 bp, Rattus norvegicus
gttgaagcaagagagtcaggagttc

SEQ ID NO: 527668 - DNA, 25 bp, Rattus norvegicus
gttgaagcctctcatggaccaccaa

SEQ ID NO: 527669 - DNA, 25 bp, Rattus norvegicus
gttgaagcctctgatggaccaccaa

SEQ ID NO: 527670 - DNA, 25 bp, Rattus norvegicus
gttgaagctgatacattgcacaata

SEQ ID NO: 527671 - DNA, 25 bp, Rattus norvegicus
gttgaagctgattcattgcacaata

SEQ ID NO: 527672 - DNA, 25 bp, Rattus norvegicus
gttgaaggcacaacttcggcagaaa

SEQ ID NO: 527673 - DNA, 25 bp, Rattus norvegicus
gttgaaggcacatcttcggcagaaa

SEQ ID NO: 527674 - DNA, 25 bp, Rattus norvegicus
gttgaaggcctcatcagtctgagag

SEQ ID NO: 527675 - DNA, 25 bp, Rattus norvegicus
gttgaaggcctcttcagtctgagag

SEQ ID NO: 527676 - DNA, 25 bp, Rattus norvegicus
gttgaagggttaccagcatggcttt

SEQ ID NO: 527677 - DNA, 25 bp, Rattus norvegicus
gttgaagggttagcagcatggcttt

SEQ ID NO: 527678 - DNA, 25 bp, Rattus norvegicus
gttgaagtgcttctcccagatgagg

SEQ ID NO: 527679 - DNA, 25 bp, Rattus norvegicus
gttgaagtgcttgtcccagatgagg

SEQ ID NO: 527680 - DNA, 25 bp, Rattus norvegicus
gttgaagtgggcagcttgtcctctg

SEQ ID NO: 527681 - DNA, 25 bp, Rattus norvegicus
gttgaagtgggctgcttgtcctctg

SEQ ID NO: 527682 - DNA, 25 bp, Rattus norvegicus
gttgaagttggcacattgctctttc

SEQ ID NO: 527683 - DNA, 25 bp, Rattus norvegicus
gttgaagttggctcattgctctttc

SEQ ID NO: 527684 - DNA, 25 bp, Rattus norvegicus
gttgaagtttacaaccctcattcag

SEQ ID NO: 527685 - DNA, 25 bp, Rattus norvegicus
gttgaagtttactaccctcattcag

SEQ ID NO: 527686 - DNA, 25 bp, Rattus norvegicus
gttgaataacgtcaggaatcccatt

SEQ ID NO: 527687 - DNA, 25 bp, Rattus norvegicus
gttgaataacgtgaggaatcccatt

SEQ ID NO: 527688 - DNA, 25 bp, Rattus norvegicus
gttgaataggatcctctgggccctc

SEQ ID NO: 527689 - DNA, 25 bp, Rattus norvegicus
gttgaataggatgctctgggccctc

SEQ ID NO: 527690 - DNA, 25 bp, Rattus norvegicus
gttgaatattaacactgccagcctt

SEQ ID NO: 527691 - DNA, 25 bp, Rattus norvegicus
gttgaatattaagactgccagcctt

SEQ ID NO: 527692 - DNA, 25 bp, Rattus norvegicus
gttgaatctagcattcgtacctata

SEQ ID NO: 527693 - DNA, 25 bp, Rattus norvegicus
gttgaatctagctttcgtacctata

SEQ ID NO: 527694 - DNA, 25 bp, Rattus norvegicus
gttgaatctgtacacacccgttaat

SEQ ID NO: 527695 - DNA, 25 bp, Rattus norvegicus
gttgaatctgtagacacccgttaat

SEQ ID NO: 527696 - DNA, 25 bp, Rattus norvegicus
gttgaatgggcactgaggcctcttc

SEQ ID NO: 527697 - DNA, 25 bp, Rattus norvegicus
gttgaatgggcagtgaggcctcttc

SEQ ID NO: 527698 - DNA, 25 bp, Rattus norvegicus
gttgaatgtcatatttccagtataa

SEQ ID NO: 527699 - DNA, 25 bp, Rattus norvegicus
gttgaatgtcatttttccagtataa

SEQ ID NO: 527700 - DNA, 25 bp, Rattus norvegicus
gttgaattactgaaccttctgcttt

SEQ ID NO: 527701 - DNA, 25 bp, Rattus norvegicus
gttgaattactgtaccttctgcttt

SEQ ID NO: 527702 - DNA, 25 bp, Rattus norvegicus
gttgaattattgactgtgcaaactg

SEQ ID NO: 527703 - DNA, 25 bp, Rattus norvegicus
gttgaattattgtctgtgcaaactg

SEQ ID NO: 527704 - DNA, 25 bp, Rattus norvegicus
gttgaattctaaacaccctcaattt

SEQ ID NO: 527705 - DNA, 25 bp, Rattus norvegicus
gttgaattctaatcaccctcaattt

SEQ ID NO: 527706 - DNA, 25 bp, Rattus norvegicus
gttgaattcttgcacttctcaggaa

SEQ ID NO: 527707 - DNA, 25 bp, Rattus norvegicus
gttgaattcttggacttctcaggaa

SEQ ID NO: 527708 - DNA, 25 bp, Rattus norvegicus
gttgaatttcttactcatggtaacc

SEQ ID NO: 527709 - DNA, 25 bp, Rattus norvegicus
gttgaatttctttctcatggtaacc

SEQ ID NO: 527710 - DNA, 25 bp, Rattus norvegicus
gttgaatttgctatcagcaaggtaa

SEQ ID NO: 527711 - DNA, 25 bp, Rattus norvegicus
gttgaatttgctttcagcaaggtaa

SEQ ID NO: 527712 - DNA, 25 bp, Rattus norvegicus
gttgaattttgcattggaagccaca

SEQ ID NO: 527713 - DNA, 25 bp, Rattus norvegicus
gttgaattttgctttggaagccaca

SEQ ID NO: 527714 - DNA, 25 bp, Rattus norvegicus
gttgacaaaagaaacccgcctgtgt

SEQ ID NO: 527715 - DNA, 25 bp, Rattus norvegicus
gttgacaaaagatacccgcctgtgt

SEQ ID NO: 527716 - DNA, 25 bp, Rattus norvegicus
gttgacaaacacatactagatccat

SEQ ID NO: 527717 - DNA, 25 bp, Rattus norvegicus
gttgacaaacacttactagatccat

SEQ ID NO: 527718 - DNA, 25 bp, Rattus norvegicus
gttgacaacatgagcacttccgaag

SEQ ID NO: 527719 - DNA, 25 bp, Rattus norvegicus
gttgacaacatgtgcacttccgaag

SEQ ID NO: 527720 - DNA, 25 bp, Rattus norvegicus
gttgacaacttactagcacttcagt

SEQ ID NO: 527721 - DNA, 25 bp, Rattus norvegicus
gttgacaacttagtagcacttcagt

SEQ ID NO: 527722 - DNA, 25 bp, Rattus norvegicus
gttgacaatgttaccaaccctgaaa

SEQ ID NO: 527723 - DNA, 25 bp, Rattus norvegicus
gttgacaatgtttccaaccctgaaa

SEQ ID NO: 527724 - DNA, 25 bp, Rattus norvegicus
gttgacacattgcttgacctgattt

SEQ ID NO: 527725 - DNA, 25 bp, Rattus norvegicus
gttgacacattggttgacctgattt

SEQ ID NO: 527726 - DNA, 25 bp, Rattus norvegicus
gttgacactccaatgctagagcagt

SEQ ID NO: 527727 - DNA, 25 bp, Rattus norvegicus
gttgacactccattgctagagcagt

SEQ ID NO: 527728 - DNA, 25 bp, Rattus norvegicus
gttgacactgtacctcatactggaa

SEQ ID NO: 527729 - DNA, 25 bp, Rattus norvegicus
gttgacactgtagctcatactggaa

SEQ ID NO: 527730 - DNA, 25 bp, Rattus norvegicus
gttgacactgttaactcactgatta

SEQ ID NO: 527731 - DNA, 25 bp, Rattus norvegicus
gttgacactgtttactcactgatta

SEQ ID NO: 527732 - DNA, 25 bp, Rattus norvegicus
gttgacagacaactacttgggaaga

SEQ ID NO: 527733 - DNA, 25 bp, Rattus norvegicus
gttgacagacaagtacttgggaaga

SEQ ID NO: 527734 - DNA, 25 bp, Rattus norvegicus
gttgacagacatatgccttttgggt

SEQ ID NO: 527735 - DNA, 25 bp, Rattus norvegicus
gttgacagacatcttctccattgtg

SEQ ID NO: 527736 - DNA, 25 bp, Rattus norvegicus
gttgacagacatgttctccattgtg

SEQ ID NO: 527737 - DNA, 25 bp, Rattus norvegicus
gttgacagacatttgccttttgggt

SEQ ID NO: 527738 - DNA, 25 bp, Rattus norvegicus
gttgacagcctgctgaagcatgccc

SEQ ID NO: 527739 - DNA, 25 bp, Rattus norvegicus
gttgacagcctggtgaagcatgccc

SEQ ID NO: 527740 - DNA, 25 bp, Rattus norvegicus
gttgacaggagcatccagctgacct

SEQ ID NO: 527741 - DNA, 25 bp, Rattus norvegicus
gttgacaggagcttccagctgacct

SEQ ID NO: 527742 - DNA, 25 bp, Rattus norvegicus
gttgacagtcgcaaagtttccacat

SEQ ID NO: 527743 - DNA, 25 bp, Rattus norvegicus
gttgacagtcgctaagtttccacat

SEQ ID NO: 527744 - DNA, 25 bp, Rattus norvegicus
gttgacagttccaaaaagcgtaact

SEQ ID NO: 527745 - DNA, 25 bp, Rattus norvegicus
gttgacagttcctaaaagcgtaact

SEQ ID NO: 527746 - DNA, 25 bp, Rattus norvegicus
gttgacagttgtcaccgagaccgaa

SEQ ID NO: 527747 - DNA, 25 bp, Rattus norvegicus
gttgacagttgtgaccgagaccgaa

SEQ ID NO: 527748 - DNA, 25 bp, Rattus norvegicus
gttgacatcattccggatgctgcgt

SEQ ID NO: 527749 - DNA, 25 bp, Rattus norvegicus
gttgacatcattgcggatgctgcgt

SEQ ID NO: 527750 - DNA, 25 bp, Rattus norvegicus
gttgacatggacagtgccactcacg

SEQ ID NO: 527751 - DNA, 25 bp, Rattus norvegicus
gttgacatggactgtgccactcacg

SEQ ID NO: 527752 - DNA, 25 bp, Rattus norvegicus
gttgacatgggaagctgctcttggc

SEQ ID NO: 527753 - DNA, 25 bp, Rattus norvegicus
gttgacatgggatgctgctcttggc

SEQ ID NO: 527754 - DNA, 25 bp, Rattus norvegicus
gttgacatgtttcctaccatcagac

SEQ ID NO: 527755 - DNA, 25 bp, Rattus norvegicus
gttgacatgtttgctaccatcagac

SEQ ID NO: 527756 - DNA, 25 bp, Rattus norvegicus
gttgacattaacattccatacttgt

SEQ ID NO: 527757 - DNA, 25 bp, Rattus norvegicus
gttgacattaactttccatacttgt

SEQ ID NO: 527758 - DNA, 25 bp, Rattus norvegicus
gttgacattcagaatcttattgaga

SEQ ID NO: 527759 - DNA, 25 bp, Rattus norvegicus
gttgacattcagtatcttattgaga

SEQ ID NO: 527760 - DNA, 25 bp, Rattus norvegicus
gttgacattgtcatgaaccatcact

SEQ ID NO: 527761 - DNA, 25 bp, Rattus norvegicus
gttgacattgtcttgaaccatcact

SEQ ID NO: 527762 - DNA, 25 bp, Rattus norvegicus
gttgacatttagattcttcagcttc

SEQ ID NO: 527763 - DNA, 25 bp, Rattus norvegicus
gttgacatttagtttcttcagcttc

SEQ ID NO: 527764 - DNA, 25 bp, Rattus norvegicus
gttgacatttccaccataatctaga

SEQ ID NO: 527765 - DNA, 25 bp, Rattus norvegicus
gttgacatttcctccataatctaga

SEQ ID NO: 527766 - DNA, 25 bp, Rattus norvegicus
gttgacatttctattctcctatgca

SEQ ID NO: 527767 - DNA, 25 bp, Rattus norvegicus
gttgacatttcttttctcctatgca

SEQ ID NO: 527768 - DNA, 25 bp, Rattus norvegicus
gttgaccaacatagagacagacatt

SEQ ID NO: 527769 - DNA, 25 bp, Rattus norvegicus
gttgaccaacattgagacagacatt

SEQ ID NO: 527770 - DNA, 25 bp, Rattus norvegicus
gttgaccaactaaccatgctaggca

SEQ ID NO: 527771 - DNA, 25 bp, Rattus norvegicus
gttgaccaactatccatgctaggca

SEQ ID NO: 527772 - DNA, 25 bp, Rattus norvegicus
gttgaccaccaaacatttcctgaag

SEQ ID NO: 527773 - DNA, 25 bp, Rattus norvegicus
gttgaccaccaatcatttcctgaag

SEQ ID NO: 527774 - DNA, 25 bp, Rattus norvegicus
gttgaccacgagctgtgatctccat

SEQ ID NO: 527775 - DNA, 25 bp, Rattus norvegicus
gttgaccacgaggtgtgatctccat

SEQ ID NO: 527776 - DNA, 25 bp, Rattus norvegicus
gttgaccaggaaatagtgcctcaca

SEQ ID NO: 527777 - DNA, 25 bp, Rattus norvegicus
gttgaccaggaattagtgcctcaca

SEQ ID NO: 527778 - DNA, 25 bp, Rattus norvegicus
gttgaccatcgtcgactgaggctca

SEQ ID NO: 527779 - DNA, 25 bp, Rattus norvegicus
gttgaccatcgtggactgaggctca

SEQ ID NO: 527780 - DNA, 25 bp, Rattus norvegicus
gttgaccattgtcagtttcgcactg

SEQ ID NO: 527781 - DNA, 25 bp, Rattus norvegicus
gttgaccattgtgagtttcgcactg

SEQ ID NO: 527782 - DNA, 25 bp, Rattus norvegicus
gttgacccaactagacagcagattt

SEQ ID NO: 527783 - DNA, 25 bp, Rattus norvegicus
gttgacccaacttgacagcagattt

SEQ ID NO: 527784 - DNA, 25 bp, Rattus norvegicus
gttgacccacacagtcatccataaa

SEQ ID NO: 527785 - DNA, 25 bp, Rattus norvegicus
gttgacccacactgtcatccataaa

SEQ ID NO: 527786 - DNA, 25 bp, Rattus norvegicus
gttgacccatagagtggaaccgggc

SEQ ID NO: 527787 - DNA, 25 bp, Rattus norvegicus
gttgacccatagtgtggaaccgggc

SEQ ID NO: 527788 - DNA, 25 bp, Rattus norvegicus
gttgaccccaaacatacctctgagg

SEQ ID NO: 527789 - DNA, 25 bp, Rattus norvegicus
gttgaccccaaagatacctctgagg

SEQ ID NO: 527790 - DNA, 25 bp, Rattus norvegicus
gttgaccccaacactgaacttgcaa

SEQ ID NO: 527791 - DNA, 25 bp, Rattus norvegicus
gttgaccccaactctgaacttgcaa

SEQ ID NO: 527792 - DNA, 25 bp, Rattus norvegicus
gttgaccccatgatagacctggata

SEQ ID NO: 527793 - DNA, 25 bp, Rattus norvegicus
gttgaccccatgttagacctggata

SEQ ID NO: 527794 - DNA, 25 bp, Rattus norvegicus
gttgaccctactaattgggaggcca

SEQ ID NO: 527795 - DNA, 25 bp, Rattus norvegicus
gttgaccctacttattgggaggcca

SEQ ID NO: 527796 - DNA, 25 bp, Rattus norvegicus
gttgaccctattaagctgtgttttg

SEQ ID NO: 527797 - DNA, 25 bp, Rattus norvegicus
gttgaccctatttagctgtgttttg

SEQ ID NO: 527798 - DNA, 25 bp, Rattus norvegicus
gttgaccctggtaacgacacattaa

SEQ ID NO: 527799 - DNA, 25 bp, Rattus norvegicus
gttgaccctggttacgacacattaa

SEQ ID NO: 527800 - DNA, 25 bp, Rattus norvegicus
gttgaccgactcactgtatagattt

SEQ ID NO: 527801 - DNA, 25 bp, Rattus norvegicus
gttgaccgactctctgtatagattt

SEQ ID NO: 527802 - DNA, 25 bp, Rattus norvegicus
gttgaccggtgcattctgtacatac

SEQ ID NO: 527803 - DNA, 25 bp, Rattus norvegicus
gttgaccggtgctttctgtacatac

SEQ ID NO: 527804 - DNA, 25 bp, Rattus norvegicus
gttgacctacctacttattaatgtg

SEQ ID NO: 527805 - DNA, 25 bp, Rattus norvegicus
gttgacctaccttcttattaatgtg

SEQ ID NO: 527806 - DNA, 25 bp, Rattus norvegicus
gttgacctagcacacaggctccaga

SEQ ID NO: 527807 - DNA, 25 bp, Rattus norvegicus
gttgacctagcagacaggctccaga

SEQ ID NO: 527808 - DNA, 25 bp, Rattus norvegicus
gttgacctagctcgctgtatttttt

SEQ ID NO: 527809 - DNA, 25 bp, Rattus norvegicus
gttgacctagctggctgtatttttt

SEQ ID NO: 527810 - DNA, 25 bp, Rattus norvegicus
gttgacctagtgaatatcctgagat

SEQ ID NO: 527811 - DNA, 25 bp, Rattus norvegicus
gttgacctagtgtatatcctgagat

SEQ ID NO: 527812 - DNA, 25 bp, Rattus norvegicus
gttgacctcaaaatcctgattctcc

SEQ ID NO: 527813 - DNA, 25 bp, Rattus norvegicus
gttgacctcaaattcctgattctcc

SEQ ID NO: 527814 - DNA, 25 bp, Rattus norvegicus
gttgacctcagaatttccagctgct

SEQ ID NO: 527815 - DNA, 25 bp, Rattus norvegicus
gttgacctcagattttccagctgct

SEQ ID NO: 527816 - DNA, 25 bp, Rattus norvegicus
gttgacctgcgcagtccacgcaggg

SEQ ID NO: 527817 - DNA, 25 bp, Rattus norvegicus
gttgacctgcgctgtccacgcaggg

SEQ ID NO: 527818 - DNA, 25 bp, Rattus norvegicus
gttgaccttcataatggtgccttat

SEQ ID NO: 527819 - DNA, 25 bp, Rattus norvegicus
gttgaccttcatcggtttacagcct

SEQ ID NO: 527820 - DNA, 25 bp, Rattus norvegicus
gttgaccttcatgggtttacagcct

SEQ ID NO: 527821 - DNA, 25 bp, Rattus norvegicus
gttgaccttcattatggtgccttat

SEQ ID NO: 527822 - DNA, 25 bp, Rattus norvegicus
gttgaccttgtgactaacaagcatc

SEQ ID NO: 527823 - DNA, 25 bp, Rattus norvegicus
gttgaccttgtgtctaacaagcatc

SEQ ID NO: 527824 - DNA, 25 bp, Rattus norvegicus
gttgaccttttgagccttgacagta

SEQ ID NO: 527825 - DNA, 25 bp, Rattus norvegicus
gttgaccttttgtgccttgacagta

SEQ ID NO: 527826 - DNA, 25 bp, Rattus norvegicus
gttgacgaaaacatgtggctctcca

SEQ ID NO: 527827 - DNA, 25 bp, Rattus norvegicus
gttgacgaaaacttgtggctctcca

SEQ ID NO: 527828 - DNA, 25 bp, Rattus norvegicus
gttgacgaacttcttgaagcggtcc

SEQ ID NO: 527829 - DNA, 25 bp, Rattus norvegicus
gttgacgaacttgttgaagcggtcc

SEQ ID NO: 527830 - DNA, 25 bp, Rattus norvegicus
gttgacgatctaattgtattcttat

SEQ ID NO: 527831 - DNA, 25 bp, Rattus norvegicus
gttgacgatctatttgtattcttat

SEQ ID NO: 527832 - DNA, 25 bp, Rattus norvegicus
gttgacgctcatatgctatgaggac

SEQ ID NO: 527833 - DNA, 25 bp, Rattus norvegicus
gttgacgctcatttgctatgaggac

SEQ ID NO: 527834 - DNA, 25 bp, Rattus norvegicus
gttgacggtaatcttgctcttgttt

SEQ ID NO: 527835 - DNA, 25 bp, Rattus norvegicus
gttgacggtaatgttgctcttgttt

SEQ ID NO: 527836 - DNA, 25 bp, Rattus norvegicus
gttgacgtatttagttctgtatttt

SEQ ID NO: 527837 - DNA, 25 bp, Rattus norvegicus
gttgacgtattttgttctgtatttt

SEQ ID NO: 527838 - DNA, 25 bp, Rattus norvegicus
gttgacgtcactctccaatagggac

SEQ ID NO: 527839 - DNA, 25 bp, Rattus norvegicus
gttgacgtcactgtccaatagggac

SEQ ID NO: 527840 - DNA, 25 bp, Rattus norvegicus
gttgacgtcgtgaagcatttaagca

SEQ ID NO: 527841 - DNA, 25 bp, Rattus norvegicus
gttgacgtcgtgtagcatttaagca

SEQ ID NO: 527842 - DNA, 25 bp, Rattus norvegicus
gttgacgtgattaaacttgctttta

SEQ ID NO: 527843 - DNA, 25 bp, Rattus norvegicus
gttgacgtgatttaacttgctttta

SEQ ID NO: 527844 - DNA, 25 bp, Rattus norvegicus
gttgacgttcatcaggcgccttggc

SEQ ID NO: 527845 - DNA, 25 bp, Rattus norvegicus
gttgacgttcatgaggcgccttggc

SEQ ID NO: 527846 - DNA, 25 bp, Rattus norvegicus
gttgactacgcaaatcaatttcatt

SEQ ID NO: 527847 - DNA, 25 bp, Rattus norvegicus
gttgactacgcatatcaatttcatt

SEQ ID NO: 527848 - DNA, 25 bp, Rattus norvegicus
gttgactattccaggaaccacaagt

SEQ ID NO: 527849 - DNA, 25 bp, Rattus norvegicus
gttgactattcctggaaccacaagt

SEQ ID NO: 527850 - DNA, 25 bp, Rattus norvegicus
gttgactcaaagattgcacccaatg

SEQ ID NO: 527851 - DNA, 25 bp, Rattus norvegicus
gttgactcaaagtttgcacccaatg

SEQ ID NO: 527852 - DNA, 25 bp, Rattus norvegicus
gttgactcagcaatcttaactctca

SEQ ID NO: 527853 - DNA, 25 bp, Rattus norvegicus
gttgactcagcattcttaactctca

SEQ ID NO: 527854 - DNA, 25 bp, Rattus norvegicus
gttgactccgcgcagctagcaagaa

SEQ ID NO: 527855 - DNA, 25 bp, Rattus norvegicus
gttgactccgcggagctagcaagaa

SEQ ID NO: 527856 - DNA, 25 bp, Rattus norvegicus
gttgactccgtgatttgtaaatgaa

SEQ ID NO: 527857 - DNA, 25 bp, Rattus norvegicus
gttgactccgtgttttgtaaatgaa

SEQ ID NO: 527858 - DNA, 25 bp, Rattus norvegicus
gttgactcctgaacatcttcactta

SEQ ID NO: 527859 - DNA, 25 bp, Rattus norvegicus
gttgactcctgatcatcttcactta

SEQ ID NO: 527860 - DNA, 25 bp, Rattus norvegicus
gttgactctgatacatcgactttgt

SEQ ID NO: 527861 - DNA, 25 bp, Rattus norvegicus
gttgactctgattcatcgactttgt

SEQ ID NO: 527862 - DNA, 25 bp, Rattus norvegicus
gttgactctgcaaacttggcttatg

SEQ ID NO: 527863 - DNA, 25 bp, Rattus norvegicus
gttgactctgcatacttggcttatg

SEQ ID NO: 527864 - DNA, 25 bp, Rattus norvegicus
gttgactctgccatttgagcactgt

SEQ ID NO: 527865 - DNA, 25 bp, Rattus norvegicus
gttgactctgccttttgagcactgt

SEQ ID NO: 527866 - DNA, 25 bp, Rattus norvegicus
gttgactctttcaatagttcttttt

SEQ ID NO: 527867 - DNA, 25 bp, Rattus norvegicus
gttgactctttctatagttcttttt

SEQ ID NO: 527868 - DNA, 25 bp, Rattus norvegicus
gttgactgaattcctaacttggtgt

SEQ ID NO: 527869 - DNA, 25 bp, Rattus norvegicus
gttgactgaattgctaacttggtgt

SEQ ID NO: 527870 - DNA, 25 bp, Rattus norvegicus
gttgactgacgacgaggacgctcca

SEQ ID NO: 527871 - DNA, 25 bp, Rattus norvegicus
gttgactgacgaggaggacgctcca

SEQ ID NO: 527872 - DNA, 25 bp, Rattus norvegicus
gttgactgacgtacttaggactaca

SEQ ID NO: 527873 - DNA, 25 bp, Rattus norvegicus
gttgactgacgttcttaggactaca

SEQ ID NO: 527874 - DNA, 25 bp, Rattus norvegicus
gttgactgactgatgctctgtggat

SEQ ID NO: 527875 - DNA, 25 bp, Rattus norvegicus
gttgactgactgttgctctgtggat

SEQ ID NO: 527876 - DNA, 25 bp, Rattus norvegicus
gttgactgagttacaaagggcacat

SEQ ID NO: 527877 - DNA, 25 bp, Rattus norvegicus
gttgactgagtttcaaagggcacat

SEQ ID NO: 527878 - DNA, 25 bp, Rattus norvegicus
gttgactgatttatatgcccaatga

SEQ ID NO: 527879 - DNA, 25 bp, Rattus norvegicus
gttgactgatttttatgcccaatga

SEQ ID NO: 527880 - DNA, 25 bp, Rattus norvegicus
gttgactgccaaacactatgtcatt

SEQ ID NO: 527881 - DNA, 25 bp, Rattus norvegicus
gttgactgccaatcactatgtcatt

SEQ ID NO: 527882 - DNA, 25 bp, Rattus norvegicus
gttgactgcctccatccagaaggag

SEQ ID NO: 527883 - DNA, 25 bp, Rattus norvegicus
gttgactgcctcgatccagaaggag

SEQ ID NO: 527884 - DNA, 25 bp, Rattus norvegicus
gttgactggcgtccaggtgcttaca

SEQ ID NO: 527885 - DNA, 25 bp, Rattus norvegicus
gttgactggcgtgcaggtgcttaca

SEQ ID NO: 527886 - DNA, 25 bp, Rattus norvegicus
gttgactgtaaaatctcccaagaca

SEQ ID NO: 527887 - DNA, 25 bp, Rattus norvegicus
gttgactgtaaattctcccaagaca

SEQ ID NO: 527888 - DNA, 25 bp, Rattus norvegicus
gttgacttaattcgtgcatcctata

SEQ ID NO: 527889 - DNA, 25 bp, Rattus norvegicus
gttgacttaattggtgcatcctata

SEQ ID NO: 527890 - DNA, 25 bp, Rattus norvegicus
gttgacttcattattcccatggtat

SEQ ID NO: 527891 - DNA, 25 bp, Rattus norvegicus
gttgacttcatttttcccatggtat

SEQ ID NO: 527892 - DNA, 25 bp, Rattus norvegicus
gttgacttccaaagttcctctggta

SEQ ID NO: 527893 - DNA, 25 bp, Rattus norvegicus
gttgacttccaatgttcctctggta

SEQ ID NO: 527894 - DNA, 25 bp, Rattus norvegicus
gttgacttccacatagctgtagctt

SEQ ID NO: 527895 - DNA, 25 bp, Rattus norvegicus
gttgacttccacttagctgtagctt

SEQ ID NO: 527896 - DNA, 25 bp, Rattus norvegicus
gttgacttctacacctgctccagga

SEQ ID NO: 527897 - DNA, 25 bp, Rattus norvegicus
gttgacttctactcctgctccagga

SEQ ID NO: 527898 - DNA, 25 bp, Rattus norvegicus
gttgacttctttcttactggtgcat

SEQ ID NO: 527899 - DNA, 25 bp, Rattus norvegicus
gttgacttctttgttactggtgcat

SEQ ID NO: 527900 - DNA, 25 bp, Rattus norvegicus
gttgacttgaacagctttcttctgc

SEQ ID NO: 527901 - DNA, 25 bp, Rattus norvegicus
gttgacttgaactgctttcttctgc

SEQ ID NO: 527902 - DNA, 25 bp, Rattus norvegicus
gttgacttgaatctgcctaaaggta

SEQ ID NO: 527903 - DNA, 25 bp, Rattus norvegicus
gttgacttgaatgtgcctaaaggta

SEQ ID NO: 527904 - DNA, 25 bp, Rattus norvegicus
gttgacttgttgattacatccacag

SEQ ID NO: 527905 - DNA, 25 bp, Rattus norvegicus
gttgacttgttgtttacatccacag

SEQ ID NO: 527906 - DNA, 25 bp, Rattus norvegicus
gttgactttcgtactcccaataaat

SEQ ID NO: 527907 - DNA, 25 bp, Rattus norvegicus
gttgactttcgttctcccaataaat

SEQ ID NO: 527908 - DNA, 25 bp, Rattus norvegicus
gttgactttctacgtcttcgtatga

SEQ ID NO: 527909 - DNA, 25 bp, Rattus norvegicus
gttgactttctaggtcttcgtatga

SEQ ID NO: 527910 - DNA, 25 bp, Rattus norvegicus
gttgactttctgaaattcccattga

SEQ ID NO: 527911 - DNA, 25 bp, Rattus norvegicus
gttgactttctgtaattcccattga

SEQ ID NO: 527912 - DNA, 25 bp, Rattus norvegicus
gttgactttgagacggaggctaccc

SEQ ID NO: 527913 - DNA, 25 bp, Rattus norvegicus
gttgactttgagtcggaggctaccc

SEQ ID NO: 527914 - DNA, 25 bp, Rattus norvegicus
gttgacttttgactatcattcttca

SEQ ID NO: 527915 - DNA, 25 bp, Rattus norvegicus
gttgacttttgagtatcattcttca

SEQ ID NO: 527916 - DNA, 25 bp, Rattus norvegicus
gttgagaaaaataccctgcatgtca

SEQ ID NO: 527917 - DNA, 25 bp, Rattus norvegicus
gttgagaaaaattccctgcatgtca

SEQ ID NO: 527918 - DNA, 25 bp, Rattus norvegicus
gttgagaaaatgactctaccagagt

SEQ ID NO: 527919 - DNA, 25 bp, Rattus norvegicus
gttgagaaaatgtctctaccagagt

SEQ ID NO: 527920 - DNA, 25 bp, Rattus norvegicus
gttgagaaaggcagacacacttagt

SEQ ID NO: 527921 - DNA, 25 bp, Rattus norvegicus
gttgagaaaggctgacacacttagt

SEQ ID NO: 527922 - DNA, 25 bp, Rattus norvegicus
gttgagaaatttcatgtaacttaca

SEQ ID NO: 527923 - DNA, 25 bp, Rattus norvegicus
gttgagaaatttgatgtaacttaca

SEQ ID NO: 527924 - DNA, 25 bp, Rattus norvegicus
gttgagaacatcatgcacacattca

SEQ ID NO: 527925 - DNA, 25 bp, Rattus norvegicus
gttgagaacatcttgcacacattca

SEQ ID NO: 527926 - DNA, 25 bp, Rattus norvegicus
gttgagaaccccaggtgcaagtgca

SEQ ID NO: 527927 - DNA, 25 bp, Rattus norvegicus
gttgagaacccctggtgcaagtgca

SEQ ID NO: 527928 - DNA, 25 bp, Rattus norvegicus
gttgagaagggcctgaacctcccag

SEQ ID NO: 527929 - DNA, 25 bp, Rattus norvegicus
gttgagaagggcgtgaacctcccag

SEQ ID NO: 527930 - DNA, 25 bp, Rattus norvegicus
gttgagaagtccagtttttatacct

SEQ ID NO: 527931 - DNA, 25 bp, Rattus norvegicus
gttgagaagtcctgtttttatacct

SEQ ID NO: 527932 - DNA, 25 bp, Rattus norvegicus
gttgagaagtgtaggtcattcccat

SEQ ID NO: 527933 - DNA, 25 bp, Rattus norvegicus
gttgagaagtgttggtcattcccat

SEQ ID NO: 527934 - DNA, 25 bp, Rattus norvegicus
gttgagaagtttccctgactcttat

SEQ ID NO: 527935 - DNA, 25 bp, Rattus norvegicus
gttgagaagtttgcctgactcttat

SEQ ID NO: 527936 - DNA, 25 bp, Rattus norvegicus
gttgagaattagatcccacatcata

SEQ ID NO: 527937 - DNA, 25 bp, Rattus norvegicus
gttgagaattagttcccacatcata

SEQ ID NO: 527938 - DNA, 25 bp, Rattus norvegicus
gttgagaccaacaaaggctgcttaa

SEQ ID NO: 527939 - DNA, 25 bp, Rattus norvegicus
gttgagaccaactaaggctgcttaa

SEQ ID NO: 527940 - DNA, 25 bp, Rattus norvegicus
gttgagaccagacatcatctactgt

SEQ ID NO: 527941 - DNA, 25 bp, Rattus norvegicus
gttgagaccagagatcatctactgt

SEQ ID NO: 527942 - DNA, 25 bp, Rattus norvegicus
gttgagacggcaacggcagaccagc

SEQ ID NO: 527943 - DNA, 25 bp, Rattus norvegicus
gttgagacggcatcggcagaccagc

SEQ ID NO: 527944 - DNA, 25 bp, Rattus norvegicus
gttgagacgtttacccataaatcct

SEQ ID NO: 527945 - DNA, 25 bp, Rattus norvegicus
gttgagacgttttcccataaatcct

SEQ ID NO: 527946 - DNA, 25 bp, Rattus norvegicus
gttgagagagtcacagagccacctc

SEQ ID NO: 527947 - DNA, 25 bp, Rattus norvegicus
gttgagagagtctcagagccacctc

SEQ ID NO: 527948 - DNA, 25 bp, Rattus norvegicus
gttgagagcgtgctccagctcctcg

SEQ ID NO: 527949 - DNA, 25 bp, Rattus norvegicus
gttgagagcgtggtccagctcctcg

SEQ ID NO: 527950 - DNA, 25 bp, Rattus norvegicus
gttgagaggcaacttccttttccag

SEQ ID NO: 527951 - DNA, 25 bp, Rattus norvegicus
gttgagaggcaagttccttttccag

SEQ ID NO: 527952 - DNA, 25 bp, Rattus norvegicus
gttgagagtcctaagtggtcaccag

SEQ ID NO: 527953 - DNA, 25 bp, Rattus norvegicus
gttgagagtccttagtggtcaccag

SEQ ID NO: 527954 - DNA, 25 bp, Rattus norvegicus
gttgagagtgtgacattgttgaaat

SEQ ID NO: 527955 - DNA, 25 bp, Rattus norvegicus
gttgagagtgtgtcattgttgaaat

SEQ ID NO: 527956 - DNA, 25 bp, Rattus norvegicus
gttgagagttccaacaccgtatggg

SEQ ID NO: 527957 - DNA, 25 bp, Rattus norvegicus
gttgagagttcctacaccgtatggg

SEQ ID NO: 527958 - DNA, 25 bp, Rattus norvegicus
gttgagatagtacaggagagcattt

SEQ ID NO: 527959 - DNA, 25 bp, Rattus norvegicus
gttgagatagtagaggagagcattt

SEQ ID NO: 527960 - DNA, 25 bp, Rattus norvegicus
gttgagatcctaagtcacacttcgg

SEQ ID NO: 527961 - DNA, 25 bp, Rattus norvegicus
gttgagatcctatgtcacacttcgg

SEQ ID NO: 527962 - DNA, 25 bp, Rattus norvegicus
gttgagatccttacttgtaaatgaa

SEQ ID NO: 527963 - DNA, 25 bp, Rattus norvegicus
gttgagatcctttcttgtaaatgaa

SEQ ID NO: 527964 - DNA, 25 bp, Rattus norvegicus
gttgagatctcactcgtgtcactcc

SEQ ID NO: 527965 - DNA, 25 bp, Rattus norvegicus
gttgagatctcagtcgtgtcactcc

SEQ ID NO: 527966 - DNA, 25 bp, Rattus norvegicus
gttgagatctccaatgtttgtattt

SEQ ID NO: 527967 - DNA, 25 bp, Rattus norvegicus
gttgagatctcctatgtttgtattt

SEQ ID NO: 527968 - DNA, 25 bp, Rattus norvegicus
gttgagatgtctcaccactgtatat

SEQ ID NO: 527969 - DNA, 25 bp, Rattus norvegicus
gttgagatgtctgaccactgtatat

SEQ ID NO: 527970 - DNA, 25 bp, Rattus norvegicus
gttgagatgttcacttttcatcctt

SEQ ID NO: 527971 - DNA, 25 bp, Rattus norvegicus
gttgagatgttctcttttcatcctt

SEQ ID NO: 527972 - DNA, 25 bp, Rattus norvegicus
gttgagattctcaaatcccctttgt

SEQ ID NO: 527973 - DNA, 25 bp, Rattus norvegicus
gttgagattctctaatcccctttgt

SEQ ID NO: 527974 - DNA, 25 bp, Rattus norvegicus
gttgagattttacccattccttcag

SEQ ID NO: 527975 - DNA, 25 bp, Rattus norvegicus
gttgagattttagccattccttcag

SEQ ID NO: 527976 - DNA, 25 bp, Rattus norvegicus
gttgagcaagctatgtggagtccca

SEQ ID NO: 527977 - DNA, 25 bp, Rattus norvegicus
gttgagcaagctttgtggagtccca

SEQ ID NO: 527978 - DNA, 25 bp, Rattus norvegicus
gttgagcaatacaccattgtataga

SEQ ID NO: 527979 - DNA, 25 bp, Rattus norvegicus
gttgagcaatactccattgtataga

SEQ ID NO: 527980 - DNA, 25 bp, Rattus norvegicus
gttgagcaccaaaggccggtggttt

SEQ ID NO: 527981 - DNA, 25 bp, Rattus norvegicus
gttgagcaccaatggccggtggttt

SEQ ID NO: 527982 - DNA, 25 bp, Rattus norvegicus
gttgagcagccaagttcttcagtaa

SEQ ID NO: 527983 - DNA, 25 bp, Rattus norvegicus
gttgagcagccatgttcttcagtaa

SEQ ID NO: 527984 - DNA, 25 bp, Rattus norvegicus
gttgagcaggtaccacaatctacta

SEQ ID NO: 527985 - DNA, 25 bp, Rattus norvegicus
gttgagcaggtagcacaatctacta

SEQ ID NO: 527986 - DNA, 25 bp, Rattus norvegicus
gttgagcatttgctactcttgcaga

SEQ ID NO: 527987 - DNA, 25 bp, Rattus norvegicus
gttgagcatttggtactcttgcaga

SEQ ID NO: 527988 - DNA, 25 bp, Rattus norvegicus
gttgagccagatcccactgcgcgtt

SEQ ID NO: 527989 - DNA, 25 bp, Rattus norvegicus
gttgagccagatgccactgcgcgtt

SEQ ID NO: 527990 - DNA, 25 bp, Rattus norvegicus
gttgagcccaacatagaaaacatcc

SEQ ID NO: 527991 - DNA, 25 bp, Rattus norvegicus
gttgagcccaacttagaaaacatcc

SEQ ID NO: 527992 - DNA, 25 bp, Rattus norvegicus
gttgagccggacagtgtttccttct

SEQ ID NO: 527993 - DNA, 25 bp, Rattus norvegicus
gttgagccggactgtgtttccttct

SEQ ID NO: 527994 - DNA, 25 bp, Rattus norvegicus
gttgagcctctcagaaaaagctgtc

SEQ ID NO: 527995 - DNA, 25 bp, Rattus norvegicus
gttgagcctctctgaaaaagctgtc

SEQ ID NO: 527996 - DNA, 25 bp, Rattus norvegicus
gttgagccttttcacttaattgatg

SEQ ID NO: 527997 - DNA, 25 bp, Rattus norvegicus
gttgagccttttgacttaattgatg

SEQ ID NO: 527998 - DNA, 25 bp, Rattus norvegicus
gttgagcgccatctgtgggcaactc

SEQ ID NO: 527999 - DNA, 25 bp, Rattus norvegicus
gttgagcgccatgtgtgggcaactc

SEQ ID NO: 528000 - DNA, 25 bp, Rattus norvegicus
gttgagcgtgtacaccttcacccgc

SEQ ID NO: 528001 - DNA, 25 bp, Rattus norvegicus
gttgagcgtgtagaccttcacccgc

SEQ ID NO: 528002 - DNA, 25 bp, Rattus norvegicus
gttgagctaaacaagcctggagact

SEQ ID NO: 528003 - DNA, 25 bp, Rattus norvegicus
gttgagctaaactagcctggagact

SEQ ID NO: 528004 - DNA, 25 bp, Rattus norvegicus
gttgagctacatacttcattgcttt

SEQ ID NO: 528005 - DNA, 25 bp, Rattus norvegicus
gttgagctacattcttcattgcttt

SEQ ID NO: 528006 - DNA, 25 bp, Rattus norvegicus
gttgagctcattccaaatgctctct

SEQ ID NO: 528007 - DNA, 25 bp, Rattus norvegicus
gttgagctcattgcaaatgctctct

SEQ ID NO: 528008 - DNA, 25 bp, Rattus norvegicus
gttgagctccatcagtttctgcagc

SEQ ID NO: 528009 - DNA, 25 bp, Rattus norvegicus
gttgagctccatgagtttctgcagc

SEQ ID NO: 528010 - DNA, 25 bp, Rattus norvegicus
gttgagctccggagatgatctgcta

SEQ ID NO: 528011 - DNA, 25 bp, Rattus norvegicus
gttgagctccggtgatgatctgcta

SEQ ID NO: 528012 - DNA, 25 bp, Rattus norvegicus
gttgagctcggtagtctgctttcag

SEQ ID NO: 528013 - DNA, 25 bp, Rattus norvegicus
gttgagctcggttgtctgctttcag

SEQ ID NO: 528014 - DNA, 25 bp, Rattus norvegicus
gttgagctcgtgcagggccttccat

SEQ ID NO: 528015 - DNA, 25 bp, Rattus norvegicus
gttgagctcgtggagggccttccat

SEQ ID NO: 528016 - DNA, 25 bp, Rattus norvegicus
gttgagctctgaactgtcattcaca

SEQ ID NO: 528017 - DNA, 25 bp, Rattus norvegicus
gttgagctctgatctgtcattcaca

SEQ ID NO: 528018 - DNA, 25 bp, Rattus norvegicus
gttgagctgcctctttttaaatgta

SEQ ID NO: 528019 - DNA, 25 bp, Rattus norvegicus
gttgagctgcctgtttttaaatgta

SEQ ID NO: 528020 - DNA, 25 bp, Rattus norvegicus
gttgagctgtttcgccaccagggat

SEQ ID NO: 528021 - DNA, 25 bp, Rattus norvegicus
gttgagctgtttggccaccagggat

SEQ ID NO: 528022 - DNA, 25 bp, Rattus norvegicus
gttgagctttcaacattttggtggc

SEQ ID NO: 528023 - DNA, 25 bp, Rattus norvegicus
gttgagctttcatcattttggtggc

SEQ ID NO: 528024 - DNA, 25 bp, Rattus norvegicus
gttgagctttgacatgttccattcg

SEQ ID NO: 528025 - DNA, 25 bp, Rattus norvegicus
gttgagctttgagatgttccattcg

SEQ ID NO: 528026 - DNA, 25 bp, Rattus norvegicus
gttgagcttttgatatgaggcccag

SEQ ID NO: 528027 - DNA, 25 bp, Rattus norvegicus
gttgagcttttgttatgaggcccag

SEQ ID NO: 528028 - DNA, 25 bp, Rattus norvegicus
gttgaggaaaagctcacctgcttct

SEQ ID NO: 528029 - DNA, 25 bp, Rattus norvegicus
gttgaggaaaaggtcacctgcttct

SEQ ID NO: 528030 - DNA, 25 bp, Rattus norvegicus
gttgaggaacatccagacagttttc

SEQ ID NO: 528031 - DNA, 25 bp, Rattus norvegicus
gttgaggaacatgcagacagttttc

SEQ ID NO: 528032 - DNA, 25 bp, Rattus norvegicus
gttgaggactgtctcatgtctgcat

SEQ ID NO: 528033 - DNA, 25 bp, Rattus norvegicus
gttgaggactgtgtcatgtctgcat

SEQ ID NO: 528034 - DNA, 25 bp, Rattus norvegicus
gttgaggaggatctccagccaacag

SEQ ID NO: 528035 - DNA, 25 bp, Rattus norvegicus
gttgaggaggatgtccagccaacag

SEQ ID NO: 528036 - DNA, 25 bp, Rattus norvegicus
gttgaggatcagacttggctaggta

SEQ ID NO: 528037 - DNA, 25 bp, Rattus norvegicus
gttgaggatcagtcttggctaggta

SEQ ID NO: 528038 - DNA, 25 bp, Rattus norvegicus
gttgaggattcaatgacctccctca

SEQ ID NO: 528039 - DNA, 25 bp, Rattus norvegicus
gttgaggattcattgacctccctca

SEQ ID NO: 528040 - DNA, 25 bp, Rattus norvegicus
gttgaggcagccagaagcacaccag

SEQ ID NO: 528041 - DNA, 25 bp, Rattus norvegicus
gttgaggcagcctgaagcacaccag

SEQ ID NO: 528042 - DNA, 25 bp, Rattus norvegicus
gttgaggccaatatgagttacacag

SEQ ID NO: 528043 - DNA, 25 bp, Rattus norvegicus
gttgaggccaatttgagttacacag

SEQ ID NO: 528044 - DNA, 25 bp, Rattus norvegicus
gttgaggcccctattacacaatctg

SEQ ID NO: 528045 - DNA, 25 bp, Rattus norvegicus
gttgaggccccttttacacaatctg

SEQ ID NO: 528046 - DNA, 25 bp, Rattus norvegicus
gttgaggctataattgaagacatta

SEQ ID NO: 528047 - DNA, 25 bp, Rattus norvegicus
gttgaggctatatttgaagacatta

SEQ ID NO: 528048 - DNA, 25 bp, Rattus norvegicus
gttgaggctctccagaaggtgaaca

SEQ ID NO: 528049 - DNA, 25 bp, Rattus norvegicus
gttgaggctctcgagaaggtgaaca

SEQ ID NO: 528050 - DNA, 25 bp, Rattus norvegicus
gttgaggctcttcagaattctcctg

SEQ ID NO: 528051 - DNA, 25 bp, Rattus norvegicus
gttgaggctcttgagaattctcctg

SEQ ID NO: 528052 - DNA, 25 bp, Rattus norvegicus
gttgaggctgtgatgcacactgccc

SEQ ID NO: 528053 - DNA, 25 bp, Rattus norvegicus
gttgaggctgtgttgcacactgccc

SEQ ID NO: 528054 - DNA, 25 bp, Rattus norvegicus
gttgaggctttaatgccgcttacct

SEQ ID NO: 528055 - DNA, 25 bp, Rattus norvegicus
gttgaggctttattgccgcttacct

SEQ ID NO: 528056 - DNA, 25 bp, Rattus norvegicus
gttgagggactgagtatcctaccac

SEQ ID NO: 528057 - DNA, 25 bp, Rattus norvegicus
gttgagggactgtgtatcctaccac

SEQ ID NO: 528058 - DNA, 25 bp, Rattus norvegicus
gttgagggctttcggtacatctacc

SEQ ID NO: 528059 - DNA, 25 bp, Rattus norvegicus
gttgagggctttgggtacatctacc

SEQ ID NO: 528060 - DNA, 25 bp, Rattus norvegicus
gttgagggtgctattctatactttc

SEQ ID NO: 528061 - DNA, 25 bp, Rattus norvegicus
gttgagggtgcttttctatactttc

SEQ ID NO: 528062 - DNA, 25 bp, Rattus norvegicus
gttgagggttgcatggctgtatcca

SEQ ID NO: 528063 - DNA, 25 bp, Rattus norvegicus
gttgagggttgcttggctgtatcca

SEQ ID NO: 528064 - DNA, 25 bp, Rattus norvegicus
gttgaggtaatgactttgtactaac

SEQ ID NO: 528065 - DNA, 25 bp, Rattus norvegicus
gttgaggtaatgtctttgtactaac

SEQ ID NO: 528066 - DNA, 25 bp, Rattus norvegicus
gttgaggtccctcactggtgacaga

SEQ ID NO: 528067 - DNA, 25 bp, Rattus norvegicus
gttgaggtccctgactggtgacaga

SEQ ID NO: 528068 - DNA, 25 bp, Rattus norvegicus
gttgaggtctccctgcatgacagtc

SEQ ID NO: 528069 - DNA, 25 bp, Rattus norvegicus
gttgaggtctccgtgcatgacagtc

SEQ ID NO: 528070 - DNA, 25 bp, Rattus norvegicus
gttgaggtttacatctttccagtgt

SEQ ID NO: 528071 - DNA, 25 bp, Rattus norvegicus
gttgaggtttacttctttccagtgt

SEQ ID NO: 528072 - DNA, 25 bp, Rattus norvegicus
gttgaggtttccctctgtccctctg

SEQ ID NO: 528073 - DNA, 25 bp, Rattus norvegicus
gttgaggtttccgtctgtccctctg

SEQ ID NO: 528074 - DNA, 25 bp, Rattus norvegicus
gttgaggtttgtatggaccctgtat

SEQ ID NO: 528075 - DNA, 25 bp, Rattus norvegicus
gttgaggtttgtttggaccctgtat

SEQ ID NO: 528076 - DNA, 25 bp, Rattus norvegicus
gttgagtaaaagctgcccctttctt

SEQ ID NO: 528077 - DNA, 25 bp, Rattus norvegicus
gttgagtaaaaggtgcccctttctt

SEQ ID NO: 528078 - DNA, 25 bp, Rattus norvegicus
gttgagtaattgattcacgagctga

SEQ ID NO: 528079 - DNA, 25 bp, Rattus norvegicus
gttgagtaattgtttcacgagctga

SEQ ID NO: 528080 - DNA, 25 bp, Rattus norvegicus
gttgagtattttctatgctattctg

SEQ ID NO: 528081 - DNA, 25 bp, Rattus norvegicus
gttgagtattttgtatgctattctg

SEQ ID NO: 528082 - DNA, 25 bp, Rattus norvegicus
gttgagtcatacactcttccagatg

SEQ ID NO: 528083 - DNA, 25 bp, Rattus norvegicus
gttgagtcatactctcttccagatg

SEQ ID NO: 528084 - DNA, 25 bp, Rattus norvegicus
gttgagtcccaacccataaaagttg

SEQ ID NO: 528085 - DNA, 25 bp, Rattus norvegicus
gttgagtcccaagccataaaagttg

SEQ ID NO: 528086 - DNA, 25 bp, Rattus norvegicus
gttgagtcccagaggatgtgtgtct

SEQ ID NO: 528087 - DNA, 25 bp, Rattus norvegicus
gttgagtcccagtggatgtgtgtct

SEQ ID NO: 528088 - DNA, 25 bp, Rattus norvegicus
gttgagtccctcaagatatttcccc

SEQ ID NO: 528089 - DNA, 25 bp, Rattus norvegicus
gttgagtccctctagatatttcccc

SEQ ID NO: 528090 - DNA, 25 bp, Rattus norvegicus
gttgagtccctgcagtcccatcaga

SEQ ID NO: 528091 - DNA, 25 bp, Rattus norvegicus
gttgagtccctggagtcccatcaga

SEQ ID NO: 528092 - DNA, 25 bp, Rattus norvegicus
gttgagtctgacaccaggccacgtg

SEQ ID NO: 528093 - DNA, 25 bp, Rattus norvegicus
gttgagtctgactccaggccacgtg

SEQ ID NO: 528094 - DNA, 25 bp, Rattus norvegicus
gttgagtgaaaacctgtcctctaag

SEQ ID NO: 528095 - DNA, 25 bp, Rattus norvegicus
gttgagtgaaaagctgtcctctaag

SEQ ID NO: 528096 - DNA, 25 bp, Rattus norvegicus
gttgagtgcacacgtgtgactgccc

SEQ ID NO: 528097 - DNA, 25 bp, Rattus norvegicus
gttgagtgcacaggtgtgactgccc

SEQ ID NO: 528098 - DNA, 25 bp, Rattus norvegicus
gttgagtgccacagagttggttcca

SEQ ID NO: 528099 - DNA, 25 bp, Rattus norvegicus
gttgagtgccactgagttggttcca

SEQ ID NO: 528100 - DNA, 25 bp, Rattus norvegicus
gttgagtgctaacggctgccatgta

SEQ ID NO: 528101 - DNA, 25 bp, Rattus norvegicus
gttgagtgctaagggctgccatgta

SEQ ID NO: 528102 - DNA, 25 bp, Rattus norvegicus
gttgagtgggtgaggcatactttcc

SEQ ID NO: 528103 - DNA, 25 bp, Rattus norvegicus
gttgagtgggtgtggcatactttcc

SEQ ID NO: 528104 - DNA, 25 bp, Rattus norvegicus
gttgagttaccgcaacaactatgta

SEQ ID NO: 528105 - DNA, 25 bp, Rattus norvegicus
gttgagttaccggaacaactatgta

SEQ ID NO: 528106 - DNA, 25 bp, Rattus norvegicus
gttgagttccatctgctacggctga

SEQ ID NO: 528107 - DNA, 25 bp, Rattus norvegicus
gttgagttccatgtgctacggctga

SEQ ID NO: 528108 - DNA, 25 bp, Rattus norvegicus
gttgagttgatcatatcccagtttg

SEQ ID NO: 528109 - DNA, 25 bp, Rattus norvegicus
gttgagttgatcttatcccagtttg

SEQ ID NO: 528110 - DNA, 25 bp, Rattus norvegicus
gttgagttgccacttcttgtgatac

SEQ ID NO: 528111 - DNA, 25 bp, Rattus norvegicus
gttgagttgccagttcttgtgatac

SEQ ID NO: 528112 - DNA, 25 bp, Rattus norvegicus
gttgagttgggcatggtagcactta

SEQ ID NO: 528113 - DNA, 25 bp, Rattus norvegicus
gttgagttgggcttggtagcactta

SEQ ID NO: 528114 - DNA, 25 bp, Rattus norvegicus
gttgagtttgagacttatggcattc

SEQ ID NO: 528115 - DNA, 25 bp, Rattus norvegicus
gttgagtttgagtcttatggcattc

SEQ ID NO: 528116 - DNA, 25 bp, Rattus norvegicus
gttgataacatgcacgaggctgctg

SEQ ID NO: 528117 - DNA, 25 bp, Rattus norvegicus
gttgataacatggacgaggctgctg

SEQ ID NO: 528118 - DNA, 25 bp, Rattus norvegicus
gttgataacccaccaattgcttgaa

SEQ ID NO: 528119 - DNA, 25 bp, Rattus norvegicus
gttgataacccagcaattgcttgaa

SEQ ID NO: 528120 - DNA, 25 bp, Rattus norvegicus
gttgataactagcacgacccatgcc

SEQ ID NO: 528121 - DNA, 25 bp, Rattus norvegicus
gttgataactaggacgacccatgcc

SEQ ID NO: 528122 - DNA, 25 bp, Rattus norvegicus
gttgataccaacatacaggcatgtt

SEQ ID NO: 528123 - DNA, 25 bp, Rattus norvegicus
gttgataccaacttacaggcatgtt

SEQ ID NO: 528124 - DNA, 25 bp, Rattus norvegicus
gttgatacctgaaaatcttccctcc

SEQ ID NO: 528125 - DNA, 25 bp, Rattus norvegicus
gttgatacctgataatcttccctcc

SEQ ID NO: 528126 - DNA, 25 bp, Rattus norvegicus
gttgatactgatatccaatgtgcaa

SEQ ID NO: 528127 - DNA, 25 bp, Rattus norvegicus
gttgatactgatttccaatgtgcaa

SEQ ID NO: 528128 - DNA, 25 bp, Rattus norvegicus
gttgatagctatctcacttttgcaa

SEQ ID NO: 528129 - DNA, 25 bp, Rattus norvegicus
gttgatagctatgtcacttttgcaa

SEQ ID NO: 528130 - DNA, 25 bp, Rattus norvegicus
gttgatagctttccacacgtggtaa

SEQ ID NO: 528131 - DNA, 25 bp, Rattus norvegicus
gttgatagctttgcacacgtggtaa

SEQ ID NO: 528132 - DNA, 25 bp, Rattus norvegicus
gttgatagggttacagccctccgat

SEQ ID NO: 528133 - DNA, 25 bp, Rattus norvegicus
gttgatagggtttcagccctccgat

SEQ ID NO: 528134 - DNA, 25 bp, Rattus norvegicus
gttgatatcaacatagttcccaaaa

SEQ ID NO: 528135 - DNA, 25 bp, Rattus norvegicus
gttgatatcaacttagttcccaaaa

SEQ ID NO: 528136 - DNA, 25 bp, Rattus norvegicus
gttgatatgattcactggtgcccag

SEQ ID NO: 528137 - DNA, 25 bp, Rattus norvegicus
gttgatatgattgactggtgcccag

SEQ ID NO: 528138 - DNA, 25 bp, Rattus norvegicus
gttgatattactccttttttcgtat

SEQ ID NO: 528139 - DNA, 25 bp, Rattus norvegicus
gttgatattactgcttttttcgtat

SEQ ID NO: 528140 - DNA, 25 bp, Rattus norvegicus
gttgatatttcacttattcccaaga

SEQ ID NO: 528141 - DNA, 25 bp, Rattus norvegicus
gttgatatttcagttattcccaaga

SEQ ID NO: 528142 - DNA, 25 bp, Rattus norvegicus
gttgatattttcagacattttgctt

SEQ ID NO: 528143 - DNA, 25 bp, Rattus norvegicus
gttgatattttctgacattttgctt

SEQ ID NO: 528144 - DNA, 25 bp, Rattus norvegicus
gttgatcaacagacattacctggag

SEQ ID NO: 528145 - DNA, 25 bp, Rattus norvegicus
gttgatcaacagtcattacctggag

SEQ ID NO: 528146 - DNA, 25 bp, Rattus norvegicus
gttgatcacttaactcttgtatgtg

SEQ ID NO: 528147 - DNA, 25 bp, Rattus norvegicus
gttgatcacttatctcttgtatgtg

SEQ ID NO: 528148 - DNA, 25 bp, Rattus norvegicus
gttgatcatttcagagtccacgctc

SEQ ID NO: 528149 - DNA, 25 bp, Rattus norvegicus
gttgatcatttctgagtccacgctc

SEQ ID NO: 528150 - DNA, 25 bp, Rattus norvegicus
gttgatcatttgaccactctgaaga

SEQ ID NO: 528151 - DNA, 25 bp, Rattus norvegicus
gttgatcatttgtccactctgaaga

SEQ ID NO: 528152 - DNA, 25 bp, Rattus norvegicus
gttgatccaacacccacactttaat

SEQ ID NO: 528153 - DNA, 25 bp, Rattus norvegicus
gttgatccaacagccacactttaat

SEQ ID NO: 528154 - DNA, 25 bp, Rattus norvegicus
gttgatccacaaagtcacccaaaag

SEQ ID NO: 528155 - DNA, 25 bp, Rattus norvegicus
gttgatccacaatgtcacccaaaag

SEQ ID NO: 528156 - DNA, 25 bp, Rattus norvegicus
gttgatccatacaacccagcaagtt

SEQ ID NO: 528157 - DNA, 25 bp, Rattus norvegicus
gttgatccatacatcatctaacaaa

SEQ ID NO: 528158 - DNA, 25 bp, Rattus norvegicus
gttgatccatacatcctgtctgaga

SEQ ID NO: 528159 - DNA, 25 bp, Rattus norvegicus
gttgatccatactacccagcaagtt

SEQ ID NO: 528160 - DNA, 25 bp, Rattus norvegicus
gttgatccatacttcatctaacaaa

SEQ ID NO: 528161 - DNA, 25 bp, Rattus norvegicus
gttgatccatacttcctgtctgaga

SEQ ID NO: 528162 - DNA, 25 bp, Rattus norvegicus
gttgatccctgtagtgcatgtgcac

SEQ ID NO: 528163 - DNA, 25 bp, Rattus norvegicus
gttgatccctgttgtgcatgtgcac

SEQ ID NO: 528164 - DNA, 25 bp, Rattus norvegicus
gttgatccggttagcaatcctgatt

SEQ ID NO: 528165 - DNA, 25 bp, Rattus norvegicus
gttgatccggtttgcaatcctgatt

SEQ ID NO: 528166 - DNA, 25 bp, Rattus norvegicus
gttgatcctaagacacgcttactta

SEQ ID NO: 528167 - DNA, 25 bp, Rattus norvegicus
gttgatcctaagtcacgcttactta

SEQ ID NO: 528168 - DNA, 25 bp, Rattus norvegicus
gttgatcgctagataaatgtccccg

SEQ ID NO: 528169 - DNA, 25 bp, Rattus norvegicus
gttgatcgctagttaaatgtccccg

SEQ ID NO: 528170 - DNA, 25 bp, Rattus norvegicus
gttgatcgtctaaactctttcagta

SEQ ID NO: 528171 - DNA, 25 bp, Rattus norvegicus
gttgatcgtctatactctttcagta

SEQ ID NO: 528172 - DNA, 25 bp, Rattus norvegicus
gttgatcgtgtcagacgtgtgccaa

SEQ ID NO: 528173 - DNA, 25 bp, Rattus norvegicus
gttgatcgtgtctgacgtgtgccaa

SEQ ID NO: 528174 - DNA, 25 bp, Rattus norvegicus
gttgatctaaacaatgctgcacctg

SEQ ID NO: 528175 - DNA, 25 bp, Rattus norvegicus
gttgatctaaactatgctgcacctg

SEQ ID NO: 528176 - DNA, 25 bp, Rattus norvegicus
gttgatctaacaattccagttcgag

SEQ ID NO: 528177 - DNA, 25 bp, Rattus norvegicus
gttgatctaacatttccagttcgag

SEQ ID NO: 528178 - DNA, 25 bp, Rattus norvegicus
gttgatctatgcctgttctgccaaa

SEQ ID NO: 528179 - DNA, 25 bp, Rattus norvegicus
gttgatctatgcgtgttctgccaaa

SEQ ID NO: 528180 - DNA, 25 bp, Rattus norvegicus
gttgatctccacatagtccttggtg

SEQ ID NO: 528181 - DNA, 25 bp, Rattus norvegicus
gttgatctccacatggtgggagcaa

SEQ ID NO: 528182 - DNA, 25 bp, Rattus norvegicus
gttgatctccacttagtccttggtg

SEQ ID NO: 528183 - DNA, 25 bp, Rattus norvegicus
gttgatctccacttggtgggagcaa

SEQ ID NO: 528184 - DNA, 25 bp, Rattus norvegicus
gttgatctccttcttttcatcaaaa

SEQ ID NO: 528185 - DNA, 25 bp, Rattus norvegicus
gttgatctccttgttttcatcaaaa

SEQ ID NO: 528186 - DNA, 25 bp, Rattus norvegicus
gttgatctctatctggatgtcctca

SEQ ID NO: 528187 - DNA, 25 bp, Rattus norvegicus
gttgatctctatgtggatgtcctca

SEQ ID NO: 528188 - DNA, 25 bp, Rattus norvegicus
gttgatctcttcagccctgagaagt

SEQ ID NO: 528189 - DNA, 25 bp, Rattus norvegicus
gttgatctcttctgccctgagaagt

SEQ ID NO: 528190 - DNA, 25 bp, Rattus norvegicus
gttgatctgtatacatagtgtccat

SEQ ID NO: 528191 - DNA, 25 bp, Rattus norvegicus
gttgatctgtattcatagtgtccat

SEQ ID NO: 528192 - DNA, 25 bp, Rattus norvegicus
gttgatctgtcaagcgtctactaaa

SEQ ID NO: 528193 - DNA, 25 bp, Rattus norvegicus
gttgatctgtcatgcgtctactaaa

SEQ ID NO: 528194 - DNA, 25 bp, Rattus norvegicus
gttgatctgtcgctactgtttgata

SEQ ID NO: 528195 - DNA, 25 bp, Rattus norvegicus
gttgatctgtcggtactgtttgata

SEQ ID NO: 528196 - DNA, 25 bp, Rattus norvegicus
gttgatcttccactgcaaattttga

SEQ ID NO: 528197 - DNA, 25 bp, Rattus norvegicus
gttgatcttccagtgcaaattttga

SEQ ID NO: 528198 - DNA, 25 bp, Rattus norvegicus
gttgatcttctgaatgttctgtaca

SEQ ID NO: 528199 - DNA, 25 bp, Rattus norvegicus
gttgatcttctgtatgttctgtaca

SEQ ID NO: 528200 - DNA, 25 bp, Rattus norvegicus
gttgatgaaacgcacgacacccaga

SEQ ID NO: 528201 - DNA, 25 bp, Rattus norvegicus
gttgatgaaacggacgacacccaga

SEQ ID NO: 528202 - DNA, 25 bp, Rattus norvegicus
gttgatgaacttacttgagagctgg

SEQ ID NO: 528203 - DNA, 25 bp, Rattus norvegicus
gttgatgaactttcttgagagctgg

SEQ ID NO: 528204 - DNA, 25 bp, Rattus norvegicus
gttgatgacaaccagcccagatcat

SEQ ID NO: 528205 - DNA, 25 bp, Rattus norvegicus
gttgatgacaacgagcccagatcat

SEQ ID NO: 528206 - DNA, 25 bp, Rattus norvegicus
gttgatgacattcctcaggacgtaa

SEQ ID NO: 528207 - DNA, 25 bp, Rattus norvegicus
gttgatgacattgctcaggacgtaa

SEQ ID NO: 528208 - DNA, 25 bp, Rattus norvegicus
gttgatgactgccagctactcttaa

SEQ ID NO: 528209 - DNA, 25 bp, Rattus norvegicus
gttgatgactgcgagctactcttaa

SEQ ID NO: 528210 - DNA, 25 bp, Rattus norvegicus
gttgatgagcatctagcctggttct

SEQ ID NO: 528211 - DNA, 25 bp, Rattus norvegicus
gttgatgagcatgtagcctggttct

SEQ ID NO: 528212 - DNA, 25 bp, Rattus norvegicus
gttgatgataagctgttcactggcc

SEQ ID NO: 528213 - DNA, 25 bp, Rattus norvegicus
gttgatgataaggtgttcactggcc

SEQ ID NO: 528214 - DNA, 25 bp, Rattus norvegicus
gttgatgcactacccatatggacct

SEQ ID NO: 528215 - DNA, 25 bp, Rattus norvegicus
gttgatgcactagccatatggacct

SEQ ID NO: 528216 - DNA, 25 bp, Rattus norvegicus
gttgatgcagcaccgactttatcct

SEQ ID NO: 528217 - DNA, 25 bp, Rattus norvegicus
gttgatgcagcagcgactttatcct

SEQ ID NO: 528218 - DNA, 25 bp, Rattus norvegicus
gttgatgcatatacgtgactctcac

SEQ ID NO: 528219 - DNA, 25 bp, Rattus norvegicus
gttgatgcatattcgtgactctcac

SEQ ID NO: 528220 - DNA, 25 bp, Rattus norvegicus
gttgatgcattcaggtgcgtaccac

SEQ ID NO: 528221 - DNA, 25 bp, Rattus norvegicus
gttgatgcattctggtgcgtaccac

SEQ ID NO: 528222 - DNA, 25 bp, Rattus norvegicus
gttgatgcccgcaatgaagctgcat

SEQ ID NO: 528223 - DNA, 25 bp, Rattus norvegicus
gttgatgcccgctatgaagctgcat

SEQ ID NO: 528224 - DNA, 25 bp, Rattus norvegicus
gttgatgcctggatgcccaaggaac

SEQ ID NO: 528225 - DNA, 25 bp, Rattus norvegicus
gttgatgcctggctaggaacctact

SEQ ID NO: 528226 - DNA, 25 bp, Rattus norvegicus
gttgatgcctgggtaggaacctact

SEQ ID NO: 528227 - DNA, 25 bp, Rattus norvegicus
gttgatgcctggttgcccaaggaac

SEQ ID NO: 528228 - DNA, 25 bp, Rattus norvegicus
gttgatgccttactttctaatgtgt

SEQ ID NO: 528229 - DNA, 25 bp, Rattus norvegicus
gttgatgccttagtttctaatgtgt

SEQ ID NO: 528230 - DNA, 25 bp, Rattus norvegicus
gttgatgctaaaccactgctcccag

SEQ ID NO: 528231 - DNA, 25 bp, Rattus norvegicus
gttgatgctaaagcactgctcccag

SEQ ID NO: 528232 - DNA, 25 bp, Rattus norvegicus
gttgatgctttgctcaatgaaccta

SEQ ID NO: 528233 - DNA, 25 bp, Rattus norvegicus
gttgatgctttggtcaatgaaccta

SEQ ID NO: 528234 - DNA, 25 bp, Rattus norvegicus
gttgatgggactcattggcttacct

SEQ ID NO: 528235 - DNA, 25 bp, Rattus norvegicus
gttgatgggactgattggcttacct

SEQ ID NO: 528236 - DNA, 25 bp, Rattus norvegicus
gttgatgtacgaaatctcttctcag

SEQ ID NO: 528237 - DNA, 25 bp, Rattus norvegicus
gttgatgtacgatatctcttctcag

SEQ ID NO: 528238 - DNA, 25 bp, Rattus norvegicus
gttgatgtcaagctgatacgtgatt

SEQ ID NO: 528239 - DNA, 25 bp, Rattus norvegicus
gttgatgtcaaggtgatacgtgatt

SEQ ID NO: 528240 - DNA, 25 bp, Rattus norvegicus
gttgatgtcatcagctttatcctgc

SEQ ID NO: 528241 - DNA, 25 bp, Rattus norvegicus
gttgatgtcatctgctttatcctgc

SEQ ID NO: 528242 - DNA, 25 bp, Rattus norvegicus
gttgatgtctctaagcatctctggt

SEQ ID NO: 528243 - DNA, 25 bp, Rattus norvegicus
gttgatgtctcttagcatctctggt

SEQ ID NO: 528244 - DNA, 25 bp, Rattus norvegicus
gttgatgtgattcctggttcttcca

SEQ ID NO: 528245 - DNA, 25 bp, Rattus norvegicus
gttgatgtgattgctggttcttcca

SEQ ID NO: 528246 - DNA, 25 bp, Rattus norvegicus
gttgatgttcttatctgatgtggac

SEQ ID NO: 528247 - DNA, 25 bp, Rattus norvegicus
gttgatgttcttttctgatgtggac

SEQ ID NO: 528248 - DNA, 25 bp, Rattus norvegicus
gttgatgtttgtcaagccagttact

SEQ ID NO: 528249 - DNA, 25 bp, Rattus norvegicus
gttgatgtttgtgaagccagttact

SEQ ID NO: 528250 - DNA, 25 bp, Rattus norvegicus
gttgattaatctagctgtctcccac

SEQ ID NO: 528251 - DNA, 25 bp, Rattus norvegicus
gttgattaatcttgctgtctcccac

SEQ ID NO: 528252 - DNA, 25 bp, Rattus norvegicus
gttgattaccaaactaccagtgcct

SEQ ID NO: 528253 - DNA, 25 bp, Rattus norvegicus
gttgattaccaatctaccagtgcct

SEQ ID NO: 528254 - DNA, 25 bp, Rattus norvegicus
gttgattagactcagctctcagcat

SEQ ID NO: 528255 - DNA, 25 bp, Rattus norvegicus
gttgattagactgagctctcagcat

SEQ ID NO: 528256 - DNA, 25 bp, Rattus norvegicus
gttgattagcttatacctgaggtac

SEQ ID NO: 528257 - DNA, 25 bp, Rattus norvegicus
gttgattagcttttacctgaggtac

SEQ ID NO: 528258 - DNA, 25 bp, Rattus norvegicus
gttgattcaaacagaccctgacgtc

SEQ ID NO: 528259 - DNA, 25 bp, Rattus norvegicus
gttgattcaaactgaccctgacgtc

SEQ ID NO: 528260 - DNA, 25 bp, Rattus norvegicus
gttgattcaagaaccttttggccac

SEQ ID NO: 528261 - DNA, 25 bp, Rattus norvegicus
gttgattcaagatccttttggccac

SEQ ID NO: 528262 - DNA, 25 bp, Rattus norvegicus
gttgattcatcaacggaaggagctc

SEQ ID NO: 528263 - DNA, 25 bp, Rattus norvegicus
gttgattcatcatcggaaggagctc

SEQ ID NO: 528264 - DNA, 25 bp, Rattus norvegicus
gttgattcatttaacgtgaccgacg

SEQ ID NO: 528265 - DNA, 25 bp, Rattus norvegicus
gttgattcattttacgtgaccgacg

SEQ ID NO: 528266 - DNA, 25 bp, Rattus norvegicus
gttgattccaccaactgcacaggaa

SEQ ID NO: 528267 - DNA, 25 bp, Rattus norvegicus
gttgattccacctactgcacaggaa

SEQ ID NO: 528268 - DNA, 25 bp, Rattus norvegicus
gttgattccatcaattctgtgcctg

SEQ ID NO: 528269 - DNA, 25 bp, Rattus norvegicus
gttgattccatctattctgtgcctg

SEQ ID NO: 528270 - DNA, 25 bp, Rattus norvegicus
gttgattccgcacggtcttggagca

SEQ ID NO: 528271 - DNA, 25 bp, Rattus norvegicus
gttgattccgcagggtcttggagca

SEQ ID NO: 528272 - DNA, 25 bp, Rattus norvegicus
gttgattcctgacaccttggactgt

SEQ ID NO: 528273 - DNA, 25 bp, Rattus norvegicus
gttgattcctgagaccttggactgt

SEQ ID NO: 528274 - DNA, 25 bp, Rattus norvegicus
gttgattccttcatgcttgcaaact

SEQ ID NO: 528275 - DNA, 25 bp, Rattus norvegicus
gttgattccttcttgcttgcaaact

SEQ ID NO: 528276 - DNA, 25 bp, Rattus norvegicus
gttgattctgttaaatgaccaatac

SEQ ID NO: 528277 - DNA, 25 bp, Rattus norvegicus
gttgattctgtttaatgaccaatac

SEQ ID NO: 528278 - DNA, 25 bp, Rattus norvegicus
gttgattcttttaacctgagtctca

SEQ ID NO: 528279 - DNA, 25 bp, Rattus norvegicus
gttgattctttttacctgagtctca

SEQ ID NO: 528280 - DNA, 25 bp, Rattus norvegicus
gttgattgaacacagatctcccatc

SEQ ID NO: 528281 - DNA, 25 bp, Rattus norvegicus
gttgattgaacagagatctcccatc

SEQ ID NO: 528282 - DNA, 25 bp, Rattus norvegicus
gttgattgagatctccctgcagatg

SEQ ID NO: 528283 - DNA, 25 bp, Rattus norvegicus
gttgattgagatgtccctgcagatg

SEQ ID NO: 528284 - DNA, 25 bp, Rattus norvegicus
gttgattgtaaaaaggccgcatcct

SEQ ID NO: 528285 - DNA, 25 bp, Rattus norvegicus
gttgattgtaaataggccgcatcct

SEQ ID NO: 528286 - DNA, 25 bp, Rattus norvegicus
gttgattgtgtgactgaccaggatt

SEQ ID NO: 528287 - DNA, 25 bp, Rattus norvegicus
gttgattgtgtgtctgaccaggatt

SEQ ID NO: 528288 - DNA, 25 bp, Rattus norvegicus
gttgattgttgcctcactgtgtaga

SEQ ID NO: 528289 - DNA, 25 bp, Rattus norvegicus
gttgattgttgcgtcactgtgtaga

SEQ ID NO: 528290 - DNA, 25 bp, Rattus norvegicus
gttgattgttttcttctggcttacc

SEQ ID NO: 528291 - DNA, 25 bp, Rattus norvegicus
gttgattgttttgttctggcttacc

SEQ ID NO: 528292 - DNA, 25 bp, Rattus norvegicus
gttgatttagctaacctttcagtag

SEQ ID NO: 528293 - DNA, 25 bp, Rattus norvegicus
gttgatttagcttacctttcagtag

SEQ ID NO: 528294 - DNA, 25 bp, Rattus norvegicus
gttgatttatataccttccacagct

SEQ ID NO: 528295 - DNA, 25 bp, Rattus norvegicus
gttgatttatattccttccacagct

SEQ ID NO: 528296 - DNA, 25 bp, Rattus norvegicus
gttgatttcaatcatacccttttca

SEQ ID NO: 528297 - DNA, 25 bp, Rattus norvegicus
gttgatttcaatgatacccttttca

SEQ ID NO: 528298 - DNA, 25 bp, Rattus norvegicus
gttgatttccgtaagtggctgcatt

SEQ ID NO: 528299 - DNA, 25 bp, Rattus norvegicus
gttgatttccgttagtggctgcatt

SEQ ID NO: 528300 - DNA, 25 bp, Rattus norvegicus
gttgatttcgagcttactttttata

SEQ ID NO: 528301 - DNA, 25 bp, Rattus norvegicus
gttgatttcgaggttactttttata

SEQ ID NO: 528302 - DNA, 25 bp, Rattus norvegicus
gttgatttctaacccacatgttatg

SEQ ID NO: 528303 - DNA, 25 bp, Rattus norvegicus
gttgatttctaagccacatgttatg

SEQ ID NO: 528304 - DNA, 25 bp, Rattus norvegicus
gttgatttctatacagtggcacgct

SEQ ID NO: 528305 - DNA, 25 bp, Rattus norvegicus
gttgatttctattcagtggcacgct

SEQ ID NO: 528306 - DNA, 25 bp, Rattus norvegicus
gttgattttcctcccagggaataca

SEQ ID NO: 528307 - DNA, 25 bp, Rattus norvegicus
gttgattttcctgccagggaataca

SEQ ID NO: 528308 - DNA, 25 bp, Rattus norvegicus
gttgattttgagcaacaaactgctt

SEQ ID NO: 528309 - DNA, 25 bp, Rattus norvegicus
gttgattttgaggaacaaactgctt

SEQ ID NO: 528310 - DNA, 25 bp, Rattus norvegicus
gttgcaaaactgctgtcttgtccct

SEQ ID NO: 528311 - DNA, 25 bp, Rattus norvegicus
gttgcaaaactggtgtcttgtccct

SEQ ID NO: 528312 - DNA, 25 bp, Rattus norvegicus
gttgcaaaaggcatacgccttcgct

SEQ ID NO: 528313 - DNA, 25 bp, Rattus norvegicus
gttgcaaaaggcttacgccttcgct

SEQ ID NO: 528314 - DNA, 25 bp, Rattus norvegicus
gttgcaaactaacgagttacaccat

SEQ ID NO: 528315 - DNA, 25 bp, Rattus norvegicus
gttgcaaactaaggagttacaccat

SEQ ID NO: 528316 - DNA, 25 bp, Rattus norvegicus
gttgcaaactggagtcatattcctt

SEQ ID NO: 528317 - DNA, 25 bp, Rattus norvegicus
gttgcaaactggtgtcatattcctt

SEQ ID NO: 528318 - DNA, 25 bp, Rattus norvegicus
gttgcaaatcagaaccgggtccatg

SEQ ID NO: 528319 - DNA, 25 bp, Rattus norvegicus
gttgcaaatcagcacttcaggcaca

SEQ ID NO: 528320 - DNA, 25 bp, Rattus norvegicus
gttgcaaatcaggacttcaggcaca

SEQ ID NO: 528321 - DNA, 25 bp, Rattus norvegicus
gttgcaaatcagtaccgggtccatg

SEQ ID NO: 528322 - DNA, 25 bp, Rattus norvegicus
gttgcaaatgagactccatccgctc

SEQ ID NO: 528323 - DNA, 25 bp, Rattus norvegicus
gttgcaaatgagtctccatccgctc

SEQ ID NO: 528324 - DNA, 25 bp, Rattus norvegicus
gttgcaaatgctatttaagagacat

SEQ ID NO: 528325 - DNA, 25 bp, Rattus norvegicus
gttgcaaatgctttttaagagacat

SEQ ID NO: 528326 - DNA, 25 bp, Rattus norvegicus
gttgcaacaatacttcaggcctggt

SEQ ID NO: 528327 - DNA, 25 bp, Rattus norvegicus
gttgcaacaatagttcaggcctggt

SEQ ID NO: 528328 - DNA, 25 bp, Rattus norvegicus
gttgcaacacacatacttgatgatt

SEQ ID NO: 528329 - DNA, 25 bp, Rattus norvegicus
gttgcaacacacttacttgatgatt

SEQ ID NO: 528330 - DNA, 25 bp, Rattus norvegicus
gttgcaacagccatcttcttgggag

SEQ ID NO: 528331 - DNA, 25 bp, Rattus norvegicus
gttgcaacagccttcttcttgggag

SEQ ID NO: 528332 - DNA, 25 bp, Rattus norvegicus
gttgcaacaggacctcagaccttag

SEQ ID NO: 528333 - DNA, 25 bp, Rattus norvegicus
gttgcaacaggagctcagaccttag

SEQ ID NO: 528334 - DNA, 25 bp, Rattus norvegicus
gttgcaaccaccaggaactccaatt

SEQ ID NO: 528335 - DNA, 25 bp, Rattus norvegicus
gttgcaaccacctggaactccaatt

SEQ ID NO: 528336 - DNA, 25 bp, Rattus norvegicus
gttgcaaccagcaatctttgtactc

SEQ ID NO: 528337 - DNA, 25 bp, Rattus norvegicus
gttgcaaccagctatctttgtactc

SEQ ID NO: 528338 - DNA, 25 bp, Rattus norvegicus
gttgcaaccatcagctgtcaagtca

SEQ ID NO: 528339 - DNA, 25 bp, Rattus norvegicus
gttgcaaccatctgctgtcaagtca

SEQ ID NO: 528340 - DNA, 25 bp, Rattus norvegicus
gttgcaacgaaaactctaatctgag

SEQ ID NO: 528341 - DNA, 25 bp, Rattus norvegicus
gttgcaacgaaatctctaatctgag

SEQ ID NO: 528342 - DNA, 25 bp, Rattus norvegicus
gttgcaactatacaactcactattg

SEQ ID NO: 528343 - DNA, 25 bp, Rattus norvegicus
gttgcaactatagaactcactattg

SEQ ID NO: 528344 - DNA, 25 bp, Rattus norvegicus
gttgcaagacttaacccatcacata

SEQ ID NO: 528345 - DNA, 25 bp, Rattus norvegicus
gttgcaagactttacccatcacata

SEQ ID NO: 528346 - DNA, 25 bp, Rattus norvegicus
gttgcaagtgcgcatgaccggtctt

SEQ ID NO: 528347 - DNA, 25 bp, Rattus norvegicus
gttgcaagtgcggatgaccggtctt

SEQ ID NO: 528348 - DNA, 25 bp, Rattus norvegicus
gttgcaatactaacttacgaccttg

SEQ ID NO: 528349 - DNA, 25 bp, Rattus norvegicus
gttgcaatactatcttacgaccttg

SEQ ID NO: 528350 - DNA, 25 bp, Rattus norvegicus
gttgcaatatagctcaagtctttat

SEQ ID NO: 528351 - DNA, 25 bp, Rattus norvegicus
gttgcaatataggtcaagtctttat

SEQ ID NO: 528352 - DNA, 25 bp, Rattus norvegicus
gttgcaatgctgcacattaaaccag

SEQ ID NO: 528353 - DNA, 25 bp, Rattus norvegicus
gttgcaatgctggacattaaaccag

SEQ ID NO: 528354 - DNA, 25 bp, Rattus norvegicus
gttgcaatgggcaataagccgcttt

SEQ ID NO: 528355 - DNA, 25 bp, Rattus norvegicus
gttgcaatgggctataagccgcttt

SEQ ID NO: 528356 - DNA, 25 bp, Rattus norvegicus
gttgcaatggtcaccaagatgcgcc

SEQ ID NO: 528357 - DNA, 25 bp, Rattus norvegicus
gttgcaatggtctccaagatgcgcc

SEQ ID NO: 528358 - DNA, 25 bp, Rattus norvegicus
gttgcaattgatctaaagccagtct

SEQ ID NO: 528359 - DNA, 25 bp, Rattus norvegicus
gttgcaattgatgtaaagccagtct

SEQ ID NO: 528360 - DNA, 25 bp, Rattus norvegicus
gttgcacaaagaccacacttagttc

SEQ ID NO: 528361 - DNA, 25 bp, Rattus norvegicus
gttgcacaaagagcacacttagttc

SEQ ID NO: 528362 - DNA, 25 bp, Rattus norvegicus
gttgcacaaagcatcctcaagttcc

SEQ ID NO: 528363 - DNA, 25 bp, Rattus norvegicus
gttgcacaaagcttcctcaagttcc

SEQ ID NO: 528364 - DNA, 25 bp, Rattus norvegicus
gttgcacaagcaccagcgggccctg

SEQ ID NO: 528365 - DNA, 25 bp, Rattus norvegicus
gttgcacaagcagcagcgggccctg

SEQ ID NO: 528366 - DNA, 25 bp, Rattus norvegicus
gttgcacaatgtagatggcctctta

SEQ ID NO: 528367 - DNA, 25 bp, Rattus norvegicus
gttgcacaatgttgatggcctctta

SEQ ID NO: 528368 - DNA, 25 bp, Rattus norvegicus
gttgcacaccccaacagagtgtagc

SEQ ID NO: 528369 - DNA, 25 bp, Rattus norvegicus
gttgcacacccctacagagtgtagc

SEQ ID NO: 528370 - DNA, 25 bp, Rattus norvegicus
gttgcacacgtcagcgtaatggtga

SEQ ID NO: 528371 - DNA, 25 bp, Rattus norvegicus
gttgcacacgtctgcgtaatggtga

SEQ ID NO: 528372 - DNA, 25 bp, Rattus norvegicus
gttgcacagaaaaagtttggacatt

SEQ ID NO: 528373 - DNA, 25 bp, Rattus norvegicus
gttgcacagaaatagtttggacatt

SEQ ID NO: 528374 - DNA, 25 bp, Rattus norvegicus
gttgcacatactaacttgacgttga

SEQ ID NO: 528375 - DNA, 25 bp, Rattus norvegicus
gttgcacatactcctcatggctcga

SEQ ID NO: 528376 - DNA, 25 bp, Rattus norvegicus
gttgcacatactgctcatggctcga

SEQ ID NO: 528377 - DNA, 25 bp, Rattus norvegicus
gttgcacatacttacttgacgttga

SEQ ID NO: 528378 - DNA, 25 bp, Rattus norvegicus
gttgcacatgaaaccttacagacag

SEQ ID NO: 528379 - DNA, 25 bp, Rattus norvegicus
gttgcacatgaatccttacagacag

SEQ ID NO: 528380 - DNA, 25 bp, Rattus norvegicus
gttgcaccaagacatgttgatcgaa

SEQ ID NO: 528381 - DNA, 25 bp, Rattus norvegicus
gttgcaccaagagatgttgatcgaa

SEQ ID NO: 528382 - DNA, 25 bp, Rattus norvegicus
gttgcaccccacaattttcgtcttc

SEQ ID NO: 528383 - DNA, 25 bp, Rattus norvegicus
gttgcaccccactattttcgtcttc

SEQ ID NO: 528384 - DNA, 25 bp, Rattus norvegicus
gttgcaccccagctctgttacttaa

SEQ ID NO: 528385 - DNA, 25 bp, Rattus norvegicus
gttgcaccccaggtctgttacttaa

SEQ ID NO: 528386 - DNA, 25 bp, Rattus norvegicus
gttgcacccggaatcaaaccttcaa

SEQ ID NO: 528387 - DNA, 25 bp, Rattus norvegicus
gttgcacccggattcaaaccttcaa

SEQ ID NO: 528388 - DNA, 25 bp, Rattus norvegicus
gttgcaccgggaccgagccatgata

SEQ ID NO: 528389 - DNA, 25 bp, Rattus norvegicus
gttgcaccgggagcgagccatgata

SEQ ID NO: 528390 - DNA, 25 bp, Rattus norvegicus
gttgcacctatgatggtgtttttgt

SEQ ID NO: 528391 - DNA, 25 bp, Rattus norvegicus
gttgcacctatgttggtgtttttgt

SEQ ID NO: 528392 - DNA, 25 bp, Rattus norvegicus
gttgcacctcacagaataccatgtt

SEQ ID NO: 528393 - DNA, 25 bp, Rattus norvegicus
gttgcacctcactgaataccatgtt

SEQ ID NO: 528394 - DNA, 25 bp, Rattus norvegicus
gttgcacctcagaattaaccgtgtg

SEQ ID NO: 528395 - DNA, 25 bp, Rattus norvegicus
gttgcacctcagtattaaccgtgtg

SEQ ID NO: 528396 - DNA, 25 bp, Rattus norvegicus
gttgcacctcccaaaagtttgggct

SEQ ID NO: 528397 - DNA, 25 bp, Rattus norvegicus
gttgcacctccctaaagtttgggct

SEQ ID NO: 528398 - DNA, 25 bp, Rattus norvegicus
gttgcacctttcctttcatatgtat

SEQ ID NO: 528399 - DNA, 25 bp, Rattus norvegicus
gttgcacctttcgtttcatatgtat

SEQ ID NO: 528400 - DNA, 25 bp, Rattus norvegicus
gttgcacgcaatcttaacggttttg

SEQ ID NO: 528401 - DNA, 25 bp, Rattus norvegicus
gttgcacgcaatgttaacggttttg

SEQ ID NO: 528402 - DNA, 25 bp, Rattus norvegicus
gttgcacgtggaatctaatatgtca

SEQ ID NO: 528403 - DNA, 25 bp, Rattus norvegicus
gttgcacgtggattctaatatgtca

SEQ ID NO: 528404 - DNA, 25 bp, Rattus norvegicus
gttgcactaagtcaaggcccattct

SEQ ID NO: 528405 - DNA, 25 bp, Rattus norvegicus
gttgcactaagtgaaggcccattct

SEQ ID NO: 528406 - DNA, 25 bp, Rattus norvegicus
gttgcactgacacaatttttgttca

SEQ ID NO: 528407 - DNA, 25 bp, Rattus norvegicus
gttgcactgacagaatttttgttca

SEQ ID NO: 528408 - DNA, 25 bp, Rattus norvegicus
gttgcactggatagttttgacttca

SEQ ID NO: 528409 - DNA, 25 bp, Rattus norvegicus
gttgcactggattgttttgacttca

SEQ ID NO: 528410 - DNA, 25 bp, Rattus norvegicus
gttgcactggccacacaatttaagt

SEQ ID NO: 528411 - DNA, 25 bp, Rattus norvegicus
gttgcactggcctcacaatttaagt

SEQ ID NO: 528412 - DNA, 25 bp, Rattus norvegicus
gttgcactgggtcgagttccagaac

SEQ ID NO: 528413 - DNA, 25 bp, Rattus norvegicus
gttgcactgggtggagttccagaac

SEQ ID NO: 528414 - DNA, 25 bp, Rattus norvegicus
gttgcacttcttaatccagactgta

SEQ ID NO: 528415 - DNA, 25 bp, Rattus norvegicus
gttgcacttctttatccagactgta

SEQ ID NO: 528416 - DNA, 25 bp, Rattus norvegicus
gttgcactttagacagctgtaccag

SEQ ID NO: 528417 - DNA, 25 bp, Rattus norvegicus
gttgcactttagtcagctgtaccag

SEQ ID NO: 528418 - DNA, 25 bp, Rattus norvegicus
gttgcagaagctcgctcgaccatcg

SEQ ID NO: 528419 - DNA, 25 bp, Rattus norvegicus
gttgcagaagctggctcgaccatcg

SEQ ID NO: 528420 - DNA, 25 bp, Rattus norvegicus
gttgcagacggtccgagtacactta

SEQ ID NO: 528421 - DNA, 25 bp, Rattus norvegicus
gttgcagacggtgcgagtacactta

SEQ ID NO: 528422 - DNA, 25 bp, Rattus norvegicus
gttgcagagcacacaccttgtatgg

SEQ ID NO: 528423 - DNA, 25 bp, Rattus norvegicus
gttgcagagcactcaccttgtatgg

SEQ ID NO: 528424 - DNA, 25 bp, Rattus norvegicus
gttgcagattgcacagctctatcca

SEQ ID NO: 528425 - DNA, 25 bp, Rattus norvegicus
gttgcagattgctcagctctatcca

SEQ ID NO: 528426 - DNA, 25 bp, Rattus norvegicus
gttgcagcacccatgtgaagcagtt

SEQ ID NO: 528427 - DNA, 25 bp, Rattus norvegicus
gttgcagcacccttgtgaagcagtt

SEQ ID NO: 528428 - DNA, 25 bp, Rattus norvegicus
gttgcagcagatcccattgtacagc

SEQ ID NO: 528429 - DNA, 25 bp, Rattus norvegicus
gttgcagcagatgccattgtacagc

SEQ ID NO: 528430 - DNA, 25 bp, Rattus norvegicus
gttgcagcagtacaaccctggatgt

SEQ ID NO: 528431 - DNA, 25 bp, Rattus norvegicus
gttgcagcagtagaaccctggatgt

SEQ ID NO: 528432 - DNA, 25 bp, Rattus norvegicus
gttgcagccctccagatccaagaga

SEQ ID NO: 528433 - DNA, 25 bp, Rattus norvegicus
gttgcagccctcgagatccaagaga

SEQ ID NO: 528434 - DNA, 25 bp, Rattus norvegicus
gttgcagcgcaactgtatatactgt

SEQ ID NO: 528435 - DNA, 25 bp, Rattus norvegicus
gttgcagcgcaagtgtatatactgt

SEQ ID NO: 528436 - DNA, 25 bp, Rattus norvegicus
gttgcagctacacatacctcggata

SEQ ID NO: 528437 - DNA, 25 bp, Rattus norvegicus
gttgcagctacagatacctcggata

SEQ ID NO: 528438 - DNA, 25 bp, Rattus norvegicus
gttgcagctagacttcggcaggtaa

SEQ ID NO: 528439 - DNA, 25 bp, Rattus norvegicus
gttgcagctagagttcggcaggtaa

SEQ ID NO: 528440 - DNA, 25 bp, Rattus norvegicus
gttgcagctcatctctgcggtcact

SEQ ID NO: 528441 - DNA, 25 bp, Rattus norvegicus
gttgcagctcatgtctgcggtcact

SEQ ID NO: 528442 - DNA, 25 bp, Rattus norvegicus
gttgcagctgaaaggtgacacctct

SEQ ID NO: 528443 - DNA, 25 bp, Rattus norvegicus
gttgcagctgaatggtgacacctct

SEQ ID NO: 528444 - DNA, 25 bp, Rattus norvegicus
gttgcagctggcatggtggaccatc

SEQ ID NO: 528445 - DNA, 25 bp, Rattus norvegicus
gttgcagctggcattgggcttatgc

SEQ ID NO: 528446 - DNA, 25 bp, Rattus norvegicus
gttgcagctggcttggtggaccatc

SEQ ID NO: 528447 - DNA, 25 bp, Rattus norvegicus
gttgcagctggctttgggcttatgc

SEQ ID NO: 528448 - DNA, 25 bp, Rattus norvegicus
gttgcaggacatcgccaggtttaca

SEQ ID NO: 528449 - DNA, 25 bp, Rattus norvegicus
gttgcaggacatggccaggtttaca

SEQ ID NO: 528450 - DNA, 25 bp, Rattus norvegicus
gttgcaggattgatctctgttgctg

SEQ ID NO: 528451 - DNA, 25 bp, Rattus norvegicus
gttgcaggattgttctctgttgctg

SEQ ID NO: 528452 - DNA, 25 bp, Rattus norvegicus
gttgcaggccgaaagctatgacttt

SEQ ID NO: 528453 - DNA, 25 bp, Rattus norvegicus
gttgcaggccgatagctatgacttt

SEQ ID NO: 528454 - DNA, 25 bp, Rattus norvegicus
gttgcaggcgaacttgattttgctt

SEQ ID NO: 528455 - DNA, 25 bp, Rattus norvegicus
gttgcaggcgaagttgattttgctt

SEQ ID NO: 528456 - DNA, 25 bp, Rattus norvegicus
gttgcaggttcgatttgcgacacaa

SEQ ID NO: 528457 - DNA, 25 bp, Rattus norvegicus
gttgcaggttcgttttgcgacacaa

SEQ ID NO: 528458 - DNA, 25 bp, Rattus norvegicus
gttgcagtaatgcaaacttcatgag

SEQ ID NO: 528459 - DNA, 25 bp, Rattus norvegicus
gttgcagtaatggaaacttcatgag

SEQ ID NO: 528460 - DNA, 25 bp, Rattus norvegicus
gttgcagtatatccgcttagcccag

SEQ ID NO: 528461 - DNA, 25 bp, Rattus norvegicus
gttgcagtatatgcgcttagcccag

SEQ ID NO: 528462 - DNA, 25 bp, Rattus norvegicus
gttgcagtcggcagtcagagactat

SEQ ID NO: 528463 - DNA, 25 bp, Rattus norvegicus
gttgcagtcggctgtcagagactat

SEQ ID NO: 528464 - DNA, 25 bp, Rattus norvegicus
gttgcagtctgaagtgggtacctct

SEQ ID NO: 528465 - DNA, 25 bp, Rattus norvegicus
gttgcagtctgatgtgggtacctct

SEQ ID NO: 528466 - DNA, 25 bp, Rattus norvegicus
gttgcagtctgcaaagctctgtgca

SEQ ID NO: 528467 - DNA, 25 bp, Rattus norvegicus
gttgcagtctgctaagctctgtgca

SEQ ID NO: 528468 - DNA, 25 bp, Rattus norvegicus
gttgcagtgaaacaatgccttcagt

SEQ ID NO: 528469 - DNA, 25 bp, Rattus norvegicus
gttgcagtgaaagaatgccttcagt

SEQ ID NO: 528470 - DNA, 25 bp, Rattus norvegicus
gttgcagtgcagctctcaatccaaa

SEQ ID NO: 528471 - DNA, 25 bp, Rattus norvegicus
gttgcagtgcaggtctcaatccaaa

SEQ ID NO: 528472 - DNA, 25 bp, Rattus norvegicus
gttgcagtgggaaaccttcatcaca

SEQ ID NO: 528473 - DNA, 25 bp, Rattus norvegicus
gttgcagtgggataccttcatcaca

SEQ ID NO: 528474 - DNA, 25 bp, Rattus norvegicus
gttgcagttcatccactggtaccaa

SEQ ID NO: 528475 - DNA, 25 bp, Rattus norvegicus
gttgcagttcatgcactggtaccaa

SEQ ID NO: 528476 - DNA, 25 bp, Rattus norvegicus
gttgcagttgatccttcatttaaca

SEQ ID NO: 528477 - DNA, 25 bp, Rattus norvegicus
gttgcagttgatgcttcatttaaca

SEQ ID NO: 528478 - DNA, 25 bp, Rattus norvegicus
gttgcagttgccattgattagagct

SEQ ID NO: 528479 - DNA, 25 bp, Rattus norvegicus
gttgcagttgcctttgattagagct

SEQ ID NO: 528480 - DNA, 25 bp, Rattus norvegicus
gttgcagttgctagaatttcagggc

SEQ ID NO: 528481 - DNA, 25 bp, Rattus norvegicus
gttgcagttgcttgaatttcagggc

SEQ ID NO: 528482 - DNA, 25 bp, Rattus norvegicus
gttgcagtttttacaggcctgtgcc

SEQ ID NO: 528483 - DNA, 25 bp, Rattus norvegicus
gttgcagttttttcaggcctgtgcc

SEQ ID NO: 528484 - DNA, 25 bp, Rattus norvegicus
gttgcatagagtatgcttcctagag

SEQ ID NO: 528485 - DNA, 25 bp, Rattus norvegicus
gttgcatagagtttgcttcctagag

SEQ ID NO: 528486 - DNA, 25 bp, Rattus norvegicus
gttgcatatcagaccataccataaa

SEQ ID NO: 528487 - DNA, 25 bp, Rattus norvegicus
gttgcatatcagtccataccataaa

SEQ ID NO: 528488 - DNA, 25 bp, Rattus norvegicus
gttgcatatctgatgctctgagagc

SEQ ID NO: 528489 - DNA, 25 bp, Rattus norvegicus
gttgcatatctgttgctctgagagc

SEQ ID NO: 528490 - DNA, 25 bp, Rattus norvegicus
gttgcatattgcattatcttggcca

SEQ ID NO: 528491 - DNA, 25 bp, Rattus norvegicus
gttgcatattgctttatcttggcca

SEQ ID NO: 528492 - DNA, 25 bp, Rattus norvegicus
gttgcatcccctaagctgagttgat

SEQ ID NO: 528493 - DNA, 25 bp, Rattus norvegicus
gttgcatccccttagctgagttgat

SEQ ID NO: 528494 - DNA, 25 bp, Rattus norvegicus
gttgcatccggtataatcctaaaca

SEQ ID NO: 528495 - DNA, 25 bp, Rattus norvegicus
gttgcatccggtttaatcctaaaca

SEQ ID NO: 528496 - DNA, 25 bp, Rattus norvegicus
gttgcatccgtgaccagctttccag

SEQ ID NO: 528497 - DNA, 25 bp, Rattus norvegicus
gttgcatccgtgtccagctttccag

SEQ ID NO: 528498 - DNA, 25 bp, Rattus norvegicus
gttgcatcctccatgctgtactgaa

SEQ ID NO: 528499 - DNA, 25 bp, Rattus norvegicus
gttgcatcctccttgctgtactgaa

SEQ ID NO: 528500 - DNA, 25 bp, Rattus norvegicus
gttgcatcctggactcacaaagcag

SEQ ID NO: 528501 - DNA, 25 bp, Rattus norvegicus
gttgcatcctggtctcacaaagcag

SEQ ID NO: 528502 - DNA, 25 bp, Rattus norvegicus
gttgcatcgattctggcctctgggt

SEQ ID NO: 528503 - DNA, 25 bp, Rattus norvegicus
gttgcatcgattgtggcctctgggt

SEQ ID NO: 528504 - DNA, 25 bp, Rattus norvegicus
gttgcatctctacagatctcagggt

SEQ ID NO: 528505 - DNA, 25 bp, Rattus norvegicus
gttgcatctctagagatctcagggt

SEQ ID NO: 528506 - DNA, 25 bp, Rattus norvegicus
gttgcatctctgagcacaacagtgg

SEQ ID NO: 528507 - DNA, 25 bp, Rattus norvegicus
gttgcatctctgaggagttcagaat

SEQ ID NO: 528508 - DNA, 25 bp, Rattus norvegicus
gttgcatctctgtgcacaacagtgg

SEQ ID NO: 528509 - DNA, 25 bp, Rattus norvegicus
gttgcatctctgtggagttcagaat

SEQ ID NO: 528510 - DNA, 25 bp, Rattus norvegicus
gttgcatctgttatcccttagttac

SEQ ID NO: 528511 - DNA, 25 bp, Rattus norvegicus
gttgcatctgttttcccttagttac

SEQ ID NO: 528512 - DNA, 25 bp, Rattus norvegicus
gttgcatgatatatgtgcacactta

SEQ ID NO: 528513 - DNA, 25 bp, Rattus norvegicus
gttgcatgatatttgtgcacactta

SEQ ID NO: 528514 - DNA, 25 bp, Rattus norvegicus
gttgcatgatgcaagaccacctcaa

SEQ ID NO: 528515 - DNA, 25 bp, Rattus norvegicus
gttgcatgatgctagaccacctcaa

SEQ ID NO: 528516 - DNA, 25 bp, Rattus norvegicus
gttgcatgccctcatctttaacata

SEQ ID NO: 528517 - DNA, 25 bp, Rattus norvegicus
gttgcatgccctgatctttaacata

SEQ ID NO: 528518 - DNA, 25 bp, Rattus norvegicus
gttgcatggcacagaaataagtcat

SEQ ID NO: 528519 - DNA, 25 bp, Rattus norvegicus
gttgcatggcactgaaataagtcat

SEQ ID NO: 528520 - DNA, 25 bp, Rattus norvegicus
gttgcatgggtacgagcaccgcact
